United States Patent 11,369,692 (MATERIALS AND METHODS FOR TREATMENT OF DUCHENNE MUSCULAR DYSTROPHY) - sequence listing, part 28

SEQ ID NO: 923295 - DNA, 22 bp, Artificial Sequence
  chemically synthesized
agtattcatagaaaccacaatt

SEQ ID NO: 923296 - DNA, 22 bp, Artificial Sequence
  chemically synthesized
gtattcatagaaaccacaattc

SEQ ID NO: 923297 - DNA, 22 bp, Artificial Sequence
  chemically synthesized
atagaaaccacaattctcttat

SEQ ID NO: 923298 - DNA, 22 bp, Artificial Sequence
  chemically synthesized
atgaaatagaaatgaaaagata

SEQ ID NO: 923299 - DNA, 22 bp, Artificial Sequence
  chemically synthesized
tcttatcttttcatttctattt

SEQ ID NO: 923300 - DNA, 22 bp, Artificial Sequence
  chemically synthesized
ttatcttttcatttctatttca

SEQ ID NO: 923301 - DNA, 22 bp, Artificial Sequence
  chemically synthesized
atcttttcatttctatttcatt

SEQ ID NO: 923302 - DNA, 22 bp, Artificial Sequence
  chemically synthesized
tcttttcatttctatttcatta

SEQ ID NO: 923303 - DNA, 22 bp, Artificial Sequence
  chemically synthesized
aatatcatgaaaactaatgaaa

SEQ ID NO: 923304 - DNA, 22 bp, Artificial Sequence
  chemically synthesized
ttcatttctatttcattagttt

SEQ ID NO: 923305 - DNA, 22 bp, Artificial Sequence
  chemically synthesized
tcatttctatttcattagtttt

SEQ ID NO: 923306 - DNA, 22 bp, Artificial Sequence
  chemically synthesized
catttctatttcattagttttc

SEQ ID NO: 923307 - DNA, 22 bp, Artificial Sequence
  chemically synthesized
attaaatatcatgaaaactaat

SEQ ID NO: 923308 - DNA, 22 bp, Artificial Sequence
  chemically synthesized
atttctatttcattagttttca

SEQ ID NO: 923309 - DNA, 22 bp, Artificial Sequence
  chemically synthesized
aattaaatatcatgaaaactaa

SEQ ID NO: 923310 - DNA, 22 bp, Artificial Sequence
  chemically synthesized
tttaattaaatatcatgaaaac

SEQ ID NO: 923311 - DNA, 22 bp, Artificial Sequence
  chemically synthesized
ctatttcattagttttcatgat

SEQ ID NO: 923312 - DNA, 22 bp, Artificial Sequence
  chemically synthesized
tatttcattagttttcatgata

SEQ ID NO: 923313 - DNA, 22 bp, Artificial Sequence
  chemically synthesized
tttcattagttttcatgatatt

SEQ ID NO: 923314 - DNA, 22 bp, Artificial Sequence
  chemically synthesized
tcctatttaattaaatatcatg

SEQ ID NO: 923315 - DNA, 22 bp, Artificial Sequence
  chemically synthesized
cattagttttcatgatatttaa

SEQ ID NO: 923316 - DNA, 22 bp, Artificial Sequence
  chemically synthesized
attagttttcatgatatttaat

SEQ ID NO: 923317 - DNA, 22 bp, Artificial Sequence
  chemically synthesized
aaattgtcctatttaattaaat

SEQ ID NO: 923318 - DNA, 22 bp, Artificial Sequence
  chemically synthesized
gttttcatgatatttaattaaa

SEQ ID NO: 923319 - DNA, 22 bp, Artificial Sequence
  chemically synthesized
ttaaaattgtcctatttaatta

SEQ ID NO: 923320 - DNA, 22 bp, Artificial Sequence
  chemically synthesized
tcatgatatttaattaaatagg

SEQ ID NO: 923321 - DNA, 22 bp, Artificial Sequence
  chemically synthesized
catgatatttaattaaatagga

SEQ ID NO: 923322 - DNA, 22 bp, Artificial Sequence
  chemically synthesized
ttattaaaattgtcctatttaa

SEQ ID NO: 923323 - DNA, 22 bp, Artificial Sequence
  chemically synthesized
atgatatttaattaaataggac

SEQ ID NO: 923324 - DNA, 22 bp, Artificial Sequence
  chemically synthesized
attattaaaattgtcctattta

SEQ ID NO: 923325 - DNA, 22 bp, Artificial Sequence
  chemically synthesized
ttattattaaaattgtcctatt

SEQ ID NO: 923326 - DNA, 22 bp, Artificial Sequence
  chemically synthesized
ttcttattattaaaattgtcct

SEQ ID NO: 923327 - DNA, 22 bp, Artificial Sequence
  chemically synthesized
aattaaataggacaattttaat

SEQ ID NO: 923328 - DNA, 22 bp, Artificial Sequence
  chemically synthesized
attaaataggacaattttaata

SEQ ID NO: 923329 - DNA, 22 bp, Artificial Sequence
  chemically synthesized
aataggacaattttaataataa

SEQ ID NO: 923330 - DNA, 22 bp, Artificial Sequence
  chemically synthesized
tgcaagttattcttattattaa

SEQ ID NO: 923331 - DNA, 22 bp, Artificial Sequence
  chemically synthesized
gctatgcaagttattcttatta

SEQ ID NO: 923332 - DNA, 22 bp, Artificial Sequence
  chemically synthesized
acctggctatgcaagttattct

SEQ ID NO: 923333 - DNA, 22 bp, Artificial Sequence
  chemically synthesized
ctgacctggctatgcaagttat

SEQ ID NO: 923334 - DNA, 22 bp, Artificial Sequence
  chemically synthesized
taataataagaataacttgcat

SEQ ID NO: 923335 - DNA, 22 bp, Artificial Sequence
  chemically synthesized
aataataagaataacttgcata

SEQ ID NO: 923336 - DNA, 22 bp, Artificial Sequence
  chemically synthesized
ataataagaataacttgcatag

SEQ ID NO: 923337 - DNA, 22 bp, Artificial Sequence
  chemically synthesized
tggttcctgacctggctatgca

SEQ ID NO: 923338 - DNA, 22 bp, Artificial Sequence
  chemically synthesized
gcatagccaggtcaggaaccac

SEQ ID NO: 923339 - DNA, 22 bp, Artificial Sequence
  chemically synthesized
catagccaggtcaggaaccaca

SEQ ID NO: 923340 - DNA, 22 bp, Artificial Sequence
  chemically synthesized
caagaggcaacagtctgtggtt

SEQ ID NO: 923341 - DNA, 22 bp, Artificial Sequence
  chemically synthesized
tccaagaggcaacagtctgtgg

SEQ ID NO: 923342 - DNA, 22 bp, Artificial Sequence
  chemically synthesized
agagtatgttctccaagaggca

SEQ ID NO: 923343 - DNA, 22 bp, Artificial Sequence
  chemically synthesized
gagagtatgttctccaagaggc

SEQ ID NO: 923344 - DNA, 22 bp, Artificial Sequence
  chemically synthesized
ccaccatttgagagtatgttct

SEQ ID NO: 923345 - DNA, 22 bp, Artificial Sequence
  chemically synthesized
ttgcctcttggagaacatactc

SEQ ID NO: 923346 - DNA, 22 bp, Artificial Sequence
  chemically synthesized
cctcttggagaacatactctca

SEQ ID NO: 923347 - DNA, 22 bp, Artificial Sequence
  chemically synthesized
gctcccaccatttgagagtatg

SEQ ID NO: 923348 - DNA, 22 bp, Artificial Sequence
  chemically synthesized
ggctcccaccatttgagagtat

SEQ ID NO: 923349 - DNA, 22 bp, Artificial Sequence
  chemically synthesized
ttggagaacatactctcaaatg

SEQ ID NO: 923350 - DNA, 22 bp, Artificial Sequence
  chemically synthesized
ggagaacatactctcaaatggt

SEQ ID NO: 923351 - DNA, 22 bp, Artificial Sequence
  chemically synthesized
gagaacatactctcaaatggtg

SEQ ID NO: 923352 - DNA, 22 bp, Artificial Sequence
  chemically synthesized
gtaccatgtaccttggctccca

SEQ ID NO: 923353 - DNA, 22 bp, Artificial Sequence
  chemically synthesized
tggtaccatgtaccttggctcc

SEQ ID NO: 923354 - DNA, 22 bp, Artificial Sequence
  chemically synthesized
ctggtaccatgtaccttggctc

SEQ ID NO: 923355 - DNA, 22 bp, Artificial Sequence
  chemically synthesized
tcaaatggtgggagccaaggta

SEQ ID NO: 923356 - DNA, 22 bp, Artificial Sequence
  chemically synthesized
tctggtaccatgtaccttggct

SEQ ID NO: 923357 - DNA, 22 bp, Artificial Sequence
  chemically synthesized
aaatggtgggagccaaggtaca

SEQ ID NO: 923358 - DNA, 22 bp, Artificial Sequence
  chemically synthesized
aagtatcctttctggtaccatg

SEQ ID NO: 923359 - DNA, 22 bp, Artificial Sequence
  chemically synthesized
aaaggtgttcaagtatcctttc

SEQ ID NO: 923360 - DNA, 22 bp, Artificial Sequence
  chemically synthesized
gaaaggtgttcaagtatccttt

SEQ ID NO: 923361 - DNA, 22 bp, Artificial Sequence
  chemically synthesized
tgaaaggtgttcaagtatcctt

SEQ ID NO: 923362 - DNA, 22 bp, Artificial Sequence
  chemically synthesized
ttgaaaggtgttcaagtatcct

SEQ ID NO: 923363 - DNA, 22 bp, Artificial Sequence
  chemically synthesized
atgtttttgaaaggtgttcaag

SEQ ID NO: 923364 - DNA, 22 bp, Artificial Sequence
  chemically synthesized
ttgatgtttttgaaaggtgttc

SEQ ID NO: 923365 - DNA, 22 bp, Artificial Sequence
  chemically synthesized
gtaacctattgatgtttttgaa

SEQ ID NO: 923366 - DNA, 22 bp, Artificial Sequence
  chemically synthesized
gaacacctttcaaaaacatcaa

SEQ ID NO: 923367 - DNA, 22 bp, Artificial Sequence
  chemically synthesized
aacacctttcaaaaacatcaat

SEQ ID NO: 923368 - DNA, 22 bp, Artificial Sequence
  chemically synthesized
atggatattagtaacctattga

SEQ ID NO: 923369 - DNA, 22 bp, Artificial Sequence
  chemically synthesized
tcaaaaacatcaataggttact

SEQ ID NO: 923370 - DNA, 22 bp, Artificial Sequence
  chemically synthesized
ttgatggatattagtaacctat

SEQ ID NO: 923371 - DNA, 22 bp, Artificial Sequence
  chemically synthesized
caaaaacatcaataggttacta

SEQ ID NO: 923372 - DNA, 22 bp, Artificial Sequence
  chemically synthesized
aaaaacatcaataggttactaa

SEQ ID NO: 923373 - DNA, 22 bp, Artificial Sequence
  chemically synthesized
caaacctattgatggatattag

SEQ ID NO: 923374 - DNA, 22 bp, Artificial Sequence
  chemically synthesized
ccactccaaacctattgatgga

SEQ ID NO: 923375 - DNA, 22 bp, Artificial Sequence
  chemically synthesized
ctaatatccatcaataggtttg

SEQ ID NO: 923376 - DNA, 22 bp, Artificial Sequence
  chemically synthesized
cccaattcccactccaaaccta

SEQ ID NO: 923377 - DNA, 22 bp, Artificial Sequence
  chemically synthesized
atatccatcaataggtttggag

SEQ ID NO: 923378 - DNA, 22 bp, Artificial Sequence
  chemically synthesized
catataaactgcccaattccca

SEQ ID NO: 923379 - DNA, 22 bp, Artificial Sequence
  chemically synthesized
tacatataaactgcccaattcc

SEQ ID NO: 923380 - DNA, 22 bp, Artificial Sequence
  chemically synthesized
ctacatataaactgcccaattc

SEQ ID NO: 923381 - DNA, 22 bp, Artificial Sequence
  chemically synthesized
tctacatataaactgcccaatt

SEQ ID NO: 923382 - DNA, 22 bp, Artificial Sequence
  chemically synthesized
ggagtgggaattgggcagttta

SEQ ID NO: 923383 - DNA, 22 bp, Artificial Sequence
  chemically synthesized
attttctacatataaactgccc

SEQ ID NO: 923384 - DNA, 22 bp, Artificial Sequence
  chemically synthesized
gagtgggaattgggcagtttat

SEQ ID NO: 923385 - DNA, 22 bp, Artificial Sequence
  chemically synthesized
cattttctacatataaactgcc

SEQ ID NO: 923386 - DNA, 22 bp, Artificial Sequence
  chemically synthesized
ttcattttctacatataaactg

SEQ ID NO: 923387 - DNA, 22 bp, Artificial Sequence
  chemically synthesized
aactcttcattttctacatata

SEQ ID NO: 923388 - DNA, 22 bp, Artificial Sequence
  chemically synthesized
ggcagtttatatgtagaaaatg

SEQ ID NO: 923389 - DNA, 22 bp, Artificial Sequence
  chemically synthesized
ccctaaactcttcattttctac

SEQ ID NO: 923390 - DNA, 22 bp, Artificial Sequence
  chemically synthesized
accctaaactcttcattttcta

SEQ ID NO: 923391 - DNA, 22 bp, Artificial Sequence
  chemically synthesized
acttaccctaaactcttcattt

SEQ ID NO: 923392 - DNA, 22 bp, Artificial Sequence
  chemically synthesized
atatgtagaaaatgaagagttt

SEQ ID NO: 923393 - DNA, 22 bp, Artificial Sequence
  chemically synthesized
tatgtagaaaatgaagagttta

SEQ ID NO: 923394 - DNA, 22 bp, Artificial Sequence
  chemically synthesized
agcaagcaccattgacttaccc

SEQ ID NO: 923395 - DNA, 22 bp, Artificial Sequence
  chemically synthesized
ttaagcaagcaccattgactta

SEQ ID NO: 923396 - DNA, 22 bp, Artificial Sequence
  chemically synthesized
tgttaagcaagcaccattgact

SEQ ID NO: 923397 - DNA, 22 bp, Artificial Sequence
  chemically synthesized
agggtaagtcaatggtgcttgc

SEQ ID NO: 923398 - DNA, 22 bp, Artificial Sequence
  chemically synthesized
gggtaagtcaatggtgcttgct

SEQ ID NO: 923399 - DNA, 22 bp, Artificial Sequence
  chemically synthesized
agtataaaaaggctctgttaag

SEQ ID NO: 923400 - DNA, 22 bp, Artificial Sequence
  chemically synthesized
tacacagttcagtataaaaagg

SEQ ID NO: 923401 - DNA, 22 bp, Artificial Sequence
  chemically synthesized
gcttaacagagcctttttatac

SEQ ID NO: 923402 - DNA, 22 bp, Artificial Sequence
  chemically synthesized
cttaacagagcctttttatact

SEQ ID NO: 923403 - DNA, 22 bp, Artificial Sequence
  chemically synthesized
aacagagcctttttatactgaa

SEQ ID NO: 923404 - DNA, 22 bp, Artificial Sequence
  chemically synthesized
acagagcctttttatactgaac

SEQ ID NO: 923405 - DNA, 22 bp, Artificial Sequence
  chemically synthesized
aaggactatacacagttcagta

SEQ ID NO: 923406 - DNA, 22 bp, Artificial Sequence
  chemically synthesized
cattgaaggactatacacagtt

SEQ ID NO: 923407 - DNA, 22 bp, Artificial Sequence
  chemically synthesized
tttatactgaactgtgtatagt

SEQ ID NO: 923408 - DNA, 22 bp, Artificial Sequence
  chemically synthesized
ttatactgaactgtgtatagtc

SEQ ID NO: 923409 - DNA, 22 bp, Artificial Sequence
  chemically synthesized
tatactgaactgtgtatagtcc

SEQ ID NO: 923410 - DNA, 22 bp, Artificial Sequence
  chemically synthesized
atactgaactgtgtatagtcct

SEQ ID NO: 923411 - DNA, 22 bp, Artificial Sequence
  chemically synthesized
tactgaactgtgtatagtcctt

SEQ ID NO: 923412 - DNA, 22 bp, Artificial Sequence
  chemically synthesized
aactgtgtatagtccttcaatg

SEQ ID NO: 923413 - DNA, 22 bp, Artificial Sequence
  chemically synthesized
tgtatagtccttcaatgtaggc

SEQ ID NO: 923414 - DNA, 22 bp, Artificial Sequence
  chemically synthesized
aagcaagaaaaaatggcctaca

SEQ ID NO: 923415 - DNA, 22 bp, Artificial Sequence
  chemically synthesized
caatgtaggccattttttcttg

SEQ ID NO: 923416 - DNA, 22 bp, Artificial Sequence
  chemically synthesized
aatgtaggccattttttcttgc

SEQ ID NO: 923417 - DNA, 22 bp, Artificial Sequence
  chemically synthesized
tttcttgcttcagtgattttgc

SEQ ID NO: 923418 - DNA, 22 bp, Artificial Sequence
  chemically synthesized
ttcttgcttcagtgattttgct

SEQ ID NO: 923419 - DNA, 22 bp, Artificial Sequence
  chemically synthesized
tcttgcttcagtgattttgctc

SEQ ID NO: 923420 - DNA, 22 bp, Artificial Sequence
  chemically synthesized
cttgcttcagtgattttgctcc

SEQ ID NO: 923421 - DNA, 22 bp, Artificial Sequence
  chemically synthesized
ttgcttcagtgattttgctcct

SEQ ID NO: 923422 - DNA, 22 bp, Artificial Sequence
  chemically synthesized
gcttcagtgattttgctcctgt

SEQ ID NO: 923423 - DNA, 22 bp, Artificial Sequence
  chemically synthesized
cttcagtgattttgctcctgtc

SEQ ID NO: 923424 - DNA, 22 bp, Artificial Sequence
  chemically synthesized
cagtgattttgctcctgtcact

SEQ ID NO: 923425 - DNA, 22 bp, Artificial Sequence
  chemically synthesized
agtgattttgctcctgtcactt

SEQ ID NO: 923426 - DNA, 22 bp, Artificial Sequence
  chemically synthesized
tgctcctgtcactttttctctc

SEQ ID NO: 923427 - DNA, 22 bp, Artificial Sequence
  chemically synthesized
gctcctgtcactttttctctct

SEQ ID NO: 923428 - DNA, 22 bp, Artificial Sequence
  chemically synthesized
ctcctgtcactttttctctctg

SEQ ID NO: 923429 - DNA, 22 bp, Artificial Sequence
  chemically synthesized
ctgtcactttttctctctggca

SEQ ID NO: 923430 - DNA, 22 bp, Artificial Sequence
  chemically synthesized
tcactttttctctctggcatgt

SEQ ID NO: 923431 - DNA, 22 bp, Artificial Sequence
  chemically synthesized
tttctctctggcatgtccattt

SEQ ID NO: 923432 - DNA, 22 bp, Artificial Sequence
  chemically synthesized
ttctctctggcatgtccattta

SEQ ID NO: 923433 - DNA, 22 bp, Artificial Sequence
  chemically synthesized
tctctctggcatgtccatttac

SEQ ID NO: 923434 - DNA, 22 bp, Artificial Sequence
  chemically synthesized
ctctctggcatgtccatttact

SEQ ID NO: 923435 - DNA, 22 bp, Artificial Sequence
  chemically synthesized
tctctggcatgtccatttactc

SEQ ID NO: 923436 - DNA, 22 bp, Artificial Sequence
  chemically synthesized
tctggcatgtccatttactctt

SEQ ID NO: 923437 - DNA, 22 bp, Artificial Sequence
  chemically synthesized
tggcatgtccatttactcttca

SEQ ID NO: 923438 - DNA, 22 bp, Artificial Sequence
  chemically synthesized
gcatgtccatttactcttcatt

SEQ ID NO: 923439 - DNA, 22 bp, Artificial Sequence
  chemically synthesized
aaggatgagaagaggcaaatga

SEQ ID NO: 923440 - DNA, 22 bp, Artificial Sequence
  chemically synthesized
aaaggatgagaagaggcaaatg

SEQ ID NO: 923441 - DNA, 22 bp, Artificial Sequence
  chemically synthesized
actcttcatttgcctcttctca

SEQ ID NO: 923442 - DNA, 22 bp, Artificial Sequence
  chemically synthesized
ctcttcatttgcctcttctcat

SEQ ID NO: 923443 - DNA, 22 bp, Artificial Sequence
  chemically synthesized
ttcatttgcctcttctcatcct

SEQ ID NO: 923444 - DNA, 22 bp, Artificial Sequence
  chemically synthesized
ggatgggtcttaaaggatgaga

SEQ ID NO: 923445 - DNA, 22 bp, Artificial Sequence
  chemically synthesized
catttgcctcttctcatccttt

SEQ ID NO: 923446 - DNA, 22 bp, Artificial Sequence
  chemically synthesized
atttgcctcttctcatccttta

SEQ ID NO: 923447 - DNA, 22 bp, Artificial Sequence
  chemically synthesized
tgggatgggtcttaaaggatga

SEQ ID NO: 923448 - DNA, 22 bp, Artificial Sequence
  chemically synthesized
gcctcttctcatcctttaagac

SEQ ID NO: 923449 - DNA, 22 bp, Artificial Sequence
  chemically synthesized
cctcttctcatcctttaagacc

SEQ ID NO: 923450 - DNA, 22 bp, Artificial Sequence
  chemically synthesized
ttctcatcctttaagacccatc

SEQ ID NO: 923451 - DNA, 22 bp, Artificial Sequence
  chemically synthesized
ctcatcctttaagacccatccc

SEQ ID NO: 923452 - DNA, 22 bp, Artificial Sequence
  chemically synthesized
tcatcctttaagacccatccca

SEQ ID NO: 923453 - DNA, 22 bp, Artificial Sequence
  chemically synthesized
atcctttaagacccatcccaga

SEQ ID NO: 923454 - DNA, 22 bp, Artificial Sequence
  chemically synthesized
gggaacgtgatctctgggatgg

SEQ ID NO: 923455 - DNA, 22 bp, Artificial Sequence
  chemically synthesized
ttagggaacgtgatctctggga

SEQ ID NO: 923456 - DNA, 22 bp, Artificial Sequence
  chemically synthesized
gttagggaacgtgatctctggg

SEQ ID NO: 923457 - DNA, 22 bp, Artificial Sequence
  chemically synthesized
taagacccatcccagagatcac

SEQ ID NO: 923458 - DNA, 22 bp, Artificial Sequence
  chemically synthesized
aagacccatcccagagatcacg

SEQ ID NO: 923459 - DNA, 22 bp, Artificial Sequence
  chemically synthesized
agacccatcccagagatcacgt

SEQ ID NO: 923460 - DNA, 22 bp, Artificial Sequence
  chemically synthesized
gggagagtttgttagggaacgt

SEQ ID NO: 923461 - DNA, 22 bp, Artificial Sequence
  chemically synthesized
ggaaagtaggagttagggagag

SEQ ID NO: 923462 - DNA, 22 bp, Artificial Sequence
  chemically synthesized
cctaacaaactctccctaactc

SEQ ID NO: 923463 - DNA, 22 bp, Artificial Sequence
  chemically synthesized
acaaactctccctaactcctac

SEQ ID NO: 923464 - DNA, 22 bp, Artificial Sequence
  chemically synthesized
tgtgcctgggaaagtaggagtt

SEQ ID NO: 923465 - DNA, 22 bp, Artificial Sequence
  chemically synthesized
atgtgcctgggaaagtaggagt

SEQ ID NO: 923466 - DNA, 22 bp, Artificial Sequence
  chemically synthesized
tatgtgcctgggaaagtaggag

SEQ ID NO: 923467 - DNA, 22 bp, Artificial Sequence
  chemically synthesized
tccctaactcctactttcccag

SEQ ID NO: 923468 - DNA, 22 bp, Artificial Sequence
  chemically synthesized
cctaactcctactttcccaggc

SEQ ID NO: 923469 - DNA, 22 bp, Artificial Sequence
  chemically synthesized
catgaactttatgtgcctggga

SEQ ID NO: 923470 - DNA, 22 bp, Artificial Sequence
  chemically synthesized
ccatgaactttatgtgcctggg

SEQ ID NO: 923471 - DNA, 22 bp, Artificial Sequence
  chemically synthesized
actcctactttcccaggcacat

SEQ ID NO: 923472 - DNA, 22 bp, Artificial Sequence
  chemically synthesized
ctactttcccaggcacataaag

SEQ ID NO: 923473 - DNA, 22 bp, Artificial Sequence
  chemically synthesized
tggccttccatgaactttatgt

SEQ ID NO: 923474 - DNA, 22 bp, Artificial Sequence
  chemically synthesized
ctttcccaggcacataaagttc

SEQ ID NO: 923475 - DNA, 22 bp, Artificial Sequence
  chemically synthesized
gtggccttccatgaactttatg

SEQ ID NO: 923476 - DNA, 22 bp, Artificial Sequence
  chemically synthesized
tcccaggcacataaagttcatg

SEQ ID NO: 923477 - DNA, 22 bp, Artificial Sequence
  chemically synthesized
tttgtggccttccatgaacttt

SEQ ID NO: 923478 - DNA, 22 bp, Artificial Sequence
  chemically synthesized
cccaggcacataaagttcatgg

SEQ ID NO: 923479 - DNA, 22 bp, Artificial Sequence
  chemically synthesized
atttgtggccttccatgaactt

SEQ ID NO: 923480 - DNA, 22 bp, Artificial Sequence
  chemically synthesized
ccaggcacataaagttcatgga

SEQ ID NO: 923481 - DNA, 22 bp, Artificial Sequence
  chemically synthesized
tatttgtggccttccatgaact

SEQ ID NO: 923482 - DNA, 22 bp, Artificial Sequence
  chemically synthesized
atggaaggccacaaataaagta

SEQ ID NO: 923483 - DNA, 22 bp, Artificial Sequence
  chemically synthesized
tgtggagatatacaagtgaatg

SEQ ID NO: 923484 - DNA, 22 bp, Artificial Sequence
  chemically synthesized
acttgtatatctccacacagtg

SEQ ID NO: 923485 - DNA, 22 bp, Artificial Sequence
  chemically synthesized
gtaatgatgataccactgtgtg

SEQ ID NO: 923486 - DNA, 22 bp, Artificial Sequence
  chemically synthesized
gtatatctccacacagtggtat

SEQ ID NO: 923487 - DNA, 22 bp, Artificial Sequence
  chemically synthesized
tatatctccacacagtggtatc

SEQ ID NO: 923488 - DNA, 22 bp, Artificial Sequence
  chemically synthesized
gctggtaatgatgataccactg

SEQ ID NO: 923489 - DNA, 22 bp, Artificial Sequence
  chemically synthesized
cattggctggtaatgatgatac

SEQ ID NO: 923490 - DNA, 22 bp, Artificial Sequence
  chemically synthesized
cacacagtggtatcatcattac

SEQ ID NO: 923491 - DNA, 22 bp, Artificial Sequence
  chemically synthesized
ttgcattggctggtaatgatga

SEQ ID NO: 923492 - DNA, 22 bp, Artificial Sequence
  chemically synthesized
gcaccaaatatgttgttgcatt

SEQ ID NO: 923493 - DNA, 22 bp, Artificial Sequence
  chemically synthesized
gctggcaccaaatatgttgttg

SEQ ID NO: 923494 - DNA, 22 bp, Artificial Sequence
  chemically synthesized
ccagccaatgcaacaacatatt

SEQ ID NO: 923495 - DNA, 22 bp, Artificial Sequence
  chemically synthesized
gtgaaacagactagctggcacc

SEQ ID NO: 923496 - DNA, 22 bp, Artificial Sequence
  chemically synthesized
tagtgaaacagactagctggca

SEQ ID NO: 923497 - DNA, 22 bp, Artificial Sequence
  chemically synthesized
gttctagtgaaacagactagct

SEQ ID NO: 923498 - DNA, 22 bp, Artificial Sequence
  chemically synthesized
gctagttctagtgaaacagact

SEQ ID NO: 923499 - DNA, 22 bp, Artificial Sequence
  chemically synthesized
ggctagttctagtgaaacagac

SEQ ID NO: 923500 - DNA, 22 bp, Artificial Sequence
  chemically synthesized
ggtgccagctagtctgtttcac

SEQ ID NO: 923501 - DNA, 22 bp, Artificial Sequence
  chemically synthesized
gtgccagctagtctgtttcact

SEQ ID NO: 923502 - DNA, 22 bp, Artificial Sequence
  chemically synthesized
aacttggctagttctagtgaaa

SEQ ID NO: 923503 - DNA, 22 bp, Artificial Sequence
  chemically synthesized
caacttggctagttctagtgaa

SEQ ID NO: 923504 - DNA, 22 bp, Artificial Sequence
  chemically synthesized
tcaacttggctagttctagtga

SEQ ID NO: 923505 - DNA, 22 bp, Artificial Sequence
  chemically synthesized
ttcaacttggctagttctagtg

SEQ ID NO: 923506 - DNA, 22 bp, Artificial Sequence
  chemically synthesized
tttcaacttggctagttctagt

SEQ ID NO: 923507 - DNA, 22 bp, Artificial Sequence
  chemically synthesized
gtctgtttcactagaactagcc

SEQ ID NO: 923508 - DNA, 22 bp, Artificial Sequence
  chemically synthesized
ttttttcaacttggctagttct

SEQ ID NO: 923509 - DNA, 22 bp, Artificial Sequence
  chemically synthesized
attttttcaacttggctagttc

SEQ ID NO: 923510 - DNA, 22 bp, Artificial Sequence
  chemically synthesized
tattttttcaacttggctagtt

SEQ ID NO: 923511 - DNA, 22 bp, Artificial Sequence
  chemically synthesized
tttcactagaactagccaagtt

SEQ ID NO: 923512 - DNA, 22 bp, Artificial Sequence
  chemically synthesized
cactagaactagccaagttgaa

SEQ ID NO: 923513 - DNA, 22 bp, Artificial Sequence
  chemically synthesized
actagaactagccaagttgaaa

SEQ ID NO: 923514 - DNA, 22 bp, Artificial Sequence
  chemically synthesized
tgtcatattttattttttcaac

SEQ ID NO: 923515 - DNA, 22 bp, Artificial Sequence
  chemically synthesized
gaactagccaagttgaaaaaat

SEQ ID NO: 923516 - DNA, 22 bp, Artificial Sequence
  chemically synthesized
atgtcatattttattttttcaa

SEQ ID NO: 923517 - DNA, 22 bp, Artificial Sequence
  chemically synthesized
tatgtcatattttattttttca

SEQ ID NO: 923518 - DNA, 22 bp, Artificial Sequence
  chemically synthesized
ttttatgtcatattttattttt

SEQ ID NO: 923519 - DNA, 22 bp, Artificial Sequence
  chemically synthesized
gccaagttgaaaaaataaaata

SEQ ID NO: 923520 - DNA, 22 bp, Artificial Sequence
  chemically synthesized
attgttttatgtcatattttat

SEQ ID NO: 923521 - DNA, 22 bp, Artificial Sequence
  chemically synthesized
aaaaaataaaatatgacataaa

SEQ ID NO: 923522 - DNA, 22 bp, Artificial Sequence
  chemically synthesized
atagttaattgttttatgtcat

SEQ ID NO: 923523 - DNA, 22 bp, Artificial Sequence
  chemically synthesized
catagttaattgttttatgtca

SEQ ID NO: 923524 - DNA, 22 bp, Artificial Sequence
  chemically synthesized
tgaaaaatcagcttcatagtta

SEQ ID NO: 923525 - DNA, 22 bp, Artificial Sequence
  chemically synthesized
atcaaaagactatgaaaaatca

SEQ ID NO: 923526 - DNA, 22 bp, Artificial Sequence
  chemically synthesized
catcaaaagactatgaaaaatc

SEQ ID NO: 923527 - DNA, 22 bp, Artificial Sequence
  chemically synthesized
actatgaagctgatttttcata

SEQ ID NO: 923528 - DNA, 22 bp, Artificial Sequence
  chemically synthesized
ttcatcaaaagactatgaaaaa

SEQ ID NO: 923529 - DNA, 22 bp, Artificial Sequence
  chemically synthesized
tgaagctgatttttcatagtct

SEQ ID NO: 923530 - DNA, 22 bp, Artificial Sequence
  chemically synthesized
ataattcttcatcaaaagacta

SEQ ID NO: 923531 - DNA, 22 bp, Artificial Sequence
  chemically synthesized
atttttcatagtcttttgatga

SEQ ID NO: 923532 - DNA, 22 bp, Artificial Sequence
  chemically synthesized
ttcatagtcttttgatgaagaa

SEQ ID NO: 923533 - DNA, 22 bp, Artificial Sequence
  chemically synthesized
tcatagtcttttgatgaagaat

SEQ ID NO: 923534 - DNA, 22 bp, Artificial Sequence
  chemically synthesized
catagtcttttgatgaagaatt

SEQ ID NO: 923535 - DNA, 22 bp, Artificial Sequence
  chemically synthesized
aagggcattcataattcttcat

SEQ ID NO: 923536 - DNA, 22 bp, Artificial Sequence
  chemically synthesized
atagtcttttgatgaagaatta

SEQ ID NO: 923537 - DNA, 22 bp, Artificial Sequence
  chemically synthesized
caagggcattcataattcttca

SEQ ID NO: 923538 - DNA, 22 bp, Artificial Sequence
  chemically synthesized
tcaagggcattcataattcttc

SEQ ID NO: 923539 - DNA, 22 bp, Artificial Sequence
  chemically synthesized
ttgatgaagaattatgaatgcc

SEQ ID NO: 923540 - DNA, 22 bp, Artificial Sequence
  chemically synthesized
tgatgaagaattatgaatgccc

SEQ ID NO: 923541 - DNA, 22 bp, Artificial Sequence
  chemically synthesized
aaaagctttcaagggcattcat

SEQ ID NO: 923542 - DNA, 22 bp, Artificial Sequence
  chemically synthesized
gatgaagaattatgaatgccct

SEQ ID NO: 923543 - DNA, 22 bp, Artificial Sequence
  chemically synthesized
gaaaagctttcaagggcattca

SEQ ID NO: 923544 - DNA, 22 bp, Artificial Sequence
  chemically synthesized
atgaagaattatgaatgccctt

SEQ ID NO: 923545 - DNA, 22 bp, Artificial Sequence
  chemically synthesized
ttgaaaagctttcaagggcatt

SEQ ID NO: 923546 - DNA, 22 bp, Artificial Sequence
  chemically synthesized
atgactcttgaaaagctttcaa

SEQ ID NO: 923547 - DNA, 22 bp, Artificial Sequence
  chemically synthesized
tgatgactcttgaaaagctttc

SEQ ID NO: 923548 - DNA, 22 bp, Artificial Sequence
  chemically synthesized
tgaatgcccttgaaagcttttc

SEQ ID NO: 923549 - DNA, 22 bp, Artificial Sequence
  chemically synthesized
tctgatgactcttgaaaagctt

SEQ ID NO: 923550 - DNA, 22 bp, Artificial Sequence
  chemically synthesized
ttctctgatgactcttgaaaag

SEQ ID NO: 923551 - DNA, 22 bp, Artificial Sequence
  chemically synthesized
gaaagcttttcaagagtcatca

SEQ ID NO: 923552 - DNA, 22 bp, Artificial Sequence
  chemically synthesized
ccatctgttctctgatgactct

SEQ ID NO: 923553 - DNA, 22 bp, Artificial Sequence
  chemically synthesized
aaagcttttcaagagtcatcag

SEQ ID NO: 923554 - DNA, 22 bp, Artificial Sequence
  chemically synthesized
cccatctgttctctgatgactc

SEQ ID NO: 923555 - DNA, 22 bp, Artificial Sequence
  chemically synthesized
ttcccatctgttctctgatgac

SEQ ID NO: 923556 - DNA, 22 bp, Artificial Sequence
  chemically synthesized
ttcaagagtcatcagagaacag

SEQ ID NO: 923557 - DNA, 22 bp, Artificial Sequence
  chemically synthesized
gtctcttcccatctgttctctg

SEQ ID NO: 923558 - DNA, 22 bp, Artificial Sequence
  chemically synthesized
tcaagagtcatcagagaacaga

SEQ ID NO: 923559 - DNA, 22 bp, Artificial Sequence
  chemically synthesized
caagagtcatcagagaacagat

SEQ ID NO: 923560 - DNA, 22 bp, Artificial Sequence
  chemically synthesized
aagagtcatcagagaacagatg

SEQ ID NO: 923561 - DNA, 22 bp, Artificial Sequence
  chemically synthesized
acaggtgtcaatggaaaagctg

SEQ ID NO: 923562 - DNA, 22 bp, Artificial Sequence
  chemically synthesized
ttcacaggtgtcaatggaaaag

SEQ ID NO: 923563 - DNA, 22 bp, Artificial Sequence
  chemically synthesized
ttattcacaggtgtcaatggaa

SEQ ID NO: 923564 - DNA, 22 bp, Artificial Sequence
  chemically synthesized
ttccattgacacctgtgaataa

SEQ ID NO: 923565 - DNA, 22 bp, Artificial Sequence
  chemically synthesized
tccattgacacctgtgaataat

SEQ ID NO: 923566 - DNA, 22 bp, Artificial Sequence
  chemically synthesized
ccattgacacctgtgaataata

SEQ ID NO: 923567 - DNA, 22 bp, Artificial Sequence
  chemically synthesized
cattgacacctgtgaataataa

SEQ ID NO: 923568 - DNA, 22 bp, Artificial Sequence
  chemically synthesized
acacctgtgaataataatatct

SEQ ID NO: 923569 - DNA, 22 bp, Artificial Sequence
  chemically synthesized
atcagagagaatcatacagata

SEQ ID NO: 923570 - DNA, 22 bp, Artificial Sequence
  chemically synthesized
tgaataataatatctgtatgat

SEQ ID NO: 923571 - DNA, 22 bp, Artificial Sequence
  chemically synthesized
gattgatcagagagaatcatac

SEQ ID NO: 923572 - DNA, 22 bp, Artificial Sequence
  chemically synthesized
agattgatcagagagaatcata

SEQ ID NO: 923573 - DNA, 22 bp, Artificial Sequence
  chemically synthesized
tagattgatcagagagaatcat

SEQ ID NO: 923574 - DNA, 22 bp, Artificial Sequence
  chemically synthesized
ttagattgatcagagagaatca

SEQ ID NO: 923575 - DNA, 22 bp, Artificial Sequence
  chemically synthesized
tttttagattgatcagagagaa

SEQ ID NO: 923576 - DNA, 22 bp, Artificial Sequence
  chemically synthesized
tatgattctctctgatcaatct

SEQ ID NO: 923577 - DNA, 22 bp, Artificial Sequence
  chemically synthesized
tctctgatcaatctaaaaatag

SEQ ID NO: 923578 - DNA, 22 bp, Artificial Sequence
  chemically synthesized
tctgatcaatctaaaaatagct

SEQ ID NO: 923579 - DNA, 22 bp, Artificial Sequence
  chemically synthesized
tgatcaatctaaaaatagctct

SEQ ID NO: 923580 - DNA, 22 bp, Artificial Sequence
  chemically synthesized
atcaatctaaaaatagctcttt

SEQ ID NO: 923581 - DNA, 22 bp, Artificial Sequence
  chemically synthesized
gatgcaatccatatcaccaaag

SEQ ID NO: 923582 - DNA, 22 bp, Artificial Sequence
  chemically synthesized
agatgcaatccatatcaccaaa

SEQ ID NO: 923583 - DNA, 22 bp, Artificial Sequence
  chemically synthesized
tagatgcaatccatatcaccaa

SEQ ID NO: 923584 - DNA, 22 bp, Artificial Sequence
  chemically synthesized
aaaatagctctttggtgatatg

SEQ ID NO: 923585 - DNA, 22 bp, Artificial Sequence
  chemically synthesized
tttggtgatatggattgcatct

SEQ ID NO: 923586 - DNA, 22 bp, Artificial Sequence
  chemically synthesized
tggtgatatggattgcatctaa

SEQ ID NO: 923587 - DNA, 22 bp, Artificial Sequence
  chemically synthesized
ggtgatatggattgcatctaaa

SEQ ID NO: 923588 - DNA, 22 bp, Artificial Sequence
  chemically synthesized
gtgatatggattgcatctaaaa

SEQ ID NO: 923589 - DNA, 22 bp, Artificial Sequence
  chemically synthesized
catatagccacaagatgtttta

SEQ ID NO: 923590 - DNA, 22 bp, Artificial Sequence
  chemically synthesized
atcctacatatagccacaagat

SEQ ID NO: 923591 - DNA, 22 bp, Artificial Sequence
  chemically synthesized
catctaaaacatcttgtggcta

SEQ ID NO: 923592 - DNA, 22 bp, Artificial Sequence
  chemically synthesized
gcctcatcctacatatagccac

SEQ ID NO: 923593 - DNA, 22 bp, Artificial Sequence
  chemically synthesized
agcctcatcctacatatagcca

SEQ ID NO: 923594 - DNA, 22 bp, Artificial Sequence
  chemically synthesized
tagcctcatcctacatatagcc

SEQ ID NO: 923595 - DNA, 22 bp, Artificial Sequence
  chemically synthesized
aaacatcttgtggctatatgta

SEQ ID NO: 923596 - DNA, 22 bp, Artificial Sequence
  chemically synthesized
aatgttttagcctcatcctaca

SEQ ID NO: 923597 - DNA, 22 bp, Artificial Sequence
  chemically synthesized
gtggctatatgtaggatgaggc

SEQ ID NO: 923598 - DNA, 22 bp, Artificial Sequence
  chemically synthesized
tggctatatgtaggatgaggct

SEQ ID NO: 923599 - DNA, 22 bp, Artificial Sequence
  chemically synthesized
aaactgaatgttttagcctcat

SEQ ID NO: 923600 - DNA, 22 bp, Artificial Sequence
  chemically synthesized
tatgtaggatgaggctaaaaca

SEQ ID NO: 923601 - DNA, 22 bp, Artificial Sequence
  chemically synthesized
gccctgaaactgaatgttttag

SEQ ID NO: 923602 - DNA, 22 bp, Artificial Sequence
  chemically synthesized
agcaggaattagccctgaaact

SEQ ID NO: 923603 - DNA, 22 bp, Artificial Sequence
  chemically synthesized
aaacattcagtttcagggctaa

SEQ ID NO: 923604 - DNA, 22 bp, Artificial Sequence
  chemically synthesized
agtgaattaagcaggaattagc

SEQ ID NO: 923605 - DNA, 22 bp, Artificial Sequence
  chemically synthesized
aagtgaattaagcaggaattag

SEQ ID NO: 923606 - DNA, 22 bp, Artificial Sequence
  chemically synthesized
taagtgaattaagcaggaatta

SEQ ID NO: 923607 - DNA, 22 bp, Artificial Sequence
  chemically synthesized
agtttcagggctaattcctgct

SEQ ID NO: 923608 - DNA, 22 bp, Artificial Sequence
  chemically synthesized
ttaagtgaattaagcaggaatt

SEQ ID NO: 923609 - DNA, 22 bp, Artificial Sequence
  chemically synthesized
cagggctaattcctgcttaatt

SEQ ID NO: 923610 - DNA, 22 bp, Artificial Sequence
  chemically synthesized
agggctaattcctgcttaattc

SEQ ID NO: 923611 - DNA, 22 bp, Artificial Sequence
  chemically synthesized
ataccttttaagtgaattaagc

SEQ ID NO: 923612 - DNA, 22 bp, Artificial Sequence
  chemically synthesized
aactaataccttttaagtgaat

SEQ ID NO: 923613 - DNA, 22 bp, Artificial Sequence
  chemically synthesized
attcctgcttaattcacttaaa

SEQ ID NO: 923614 - DNA, 22 bp, Artificial Sequence
  chemically synthesized
ctgcttaattcacttaaaaggt

SEQ ID NO: 923615 - DNA, 22 bp, Artificial Sequence
  chemically synthesized
tatctcaactaataccttttaa

SEQ ID NO: 923616 - DNA, 22 bp, Artificial Sequence
  chemically synthesized
cttaattcacttaaaaggtatt

SEQ ID NO: 923617 - DNA, 22 bp, Artificial Sequence
  chemically synthesized
actgtatctcaactaatacctt

SEQ ID NO: 923618 - DNA, 22 bp, Artificial Sequence
  chemically synthesized
aattcacttaaaaggtattagt

SEQ ID NO: 923619 - DNA, 22 bp, Artificial Sequence
  chemically synthesized
attcacttaaaaggtattagtt

SEQ ID NO: 923620 - DNA, 22 bp, Artificial Sequence
  chemically synthesized
tcactgtatctcaactaatacc

SEQ ID NO: 923621 - DNA, 22 bp, Artificial Sequence
  chemically synthesized
ctctcactgtatctcaactaat

SEQ ID NO: 923622 - DNA, 22 bp, Artificial Sequence
  chemically synthesized
acttaaaaggtattagttgaga

SEQ ID NO: 923623 - DNA, 22 bp, Artificial Sequence
  chemically synthesized
aaaaggtattagttgagataca

SEQ ID NO: 923624 - DNA, 22 bp, Artificial Sequence
  chemically synthesized
tcctactctcactgtatctcaa

SEQ ID NO: 923625 - DNA, 22 bp, Artificial Sequence
  chemically synthesized
aaaggtattagttgagatacag

SEQ ID NO: 923626 - DNA, 22 bp, Artificial Sequence
  chemically synthesized
atcctactctcactgtatctca

SEQ ID NO: 923627 - DNA, 22 bp, Artificial Sequence
  chemically synthesized
tttatcctactctcactgtatc

SEQ ID NO: 923628 - DNA, 22 bp, Artificial Sequence
  chemically synthesized
gtttatcctactctcactgtat

SEQ ID NO: 923629 - DNA, 22 bp, Artificial Sequence
  chemically synthesized
gttgagatacagtgagagtagg

SEQ ID NO: 923630 - DNA, 22 bp, Artificial Sequence
  chemically synthesized
tacatttgtttatcctactctc

SEQ ID NO: 923631 - DNA, 22 bp, Artificial Sequence
  chemically synthesized
gtacatttgtttatcctactct

SEQ ID NO: 923632 - DNA, 22 bp, Artificial Sequence
  chemically synthesized
tgtacatttgtttatcctactc

SEQ ID NO: 923633 - DNA, 22 bp, Artificial Sequence
  chemically synthesized
agatacagtgagagtaggataa

SEQ ID NO: 923634 - DNA, 22 bp, Artificial Sequence
  chemically synthesized
aaacattttgtacatttgttta

SEQ ID NO: 923635 - DNA, 22 bp, Artificial Sequence
  chemically synthesized
attcaaacattttgtacatttg

SEQ ID NO: 923636 - DNA, 22 bp, Artificial Sequence
  chemically synthesized
gattcaaacattttgtacattt

SEQ ID NO: 923637 - DNA, 22 bp, Artificial Sequence
  chemically synthesized
tgattcaaacattttgtacatt

SEQ ID NO: 923638 - DNA, 22 bp, Artificial Sequence
  chemically synthesized
tttgattcaaacattttgtaca

SEQ ID NO: 923639 - DNA, 22 bp, Artificial Sequence
  chemically synthesized
tggcaaaaagcagctctttgat

SEQ ID NO: 923640 - DNA, 22 bp, Artificial Sequence
  chemically synthesized
gttatggcaaaaagcagctctt

SEQ ID NO: 923641 - DNA, 22 bp, Artificial Sequence
  chemically synthesized
gctagttatggcaaaaagcagc

SEQ ID NO: 923642 - DNA, 22 bp, Artificial Sequence
  chemically synthesized
agctagttatggcaaaaagcag

SEQ ID NO: 923643 - DNA, 22 bp, Artificial Sequence
  chemically synthesized
gaatcaaagagctgctttttgc

SEQ ID NO: 923644 - DNA, 22 bp, Artificial Sequence
  chemically synthesized
aatcaaagagctgctttttgcc

SEQ ID NO: 923645 - DNA, 22 bp, Artificial Sequence
  chemically synthesized
tttagctagttatggcaaaaag

SEQ ID NO: 923646 - DNA, 22 bp, Artificial Sequence
  chemically synthesized
atttagctagttatggcaaaaa

SEQ ID NO: 923647 - DNA, 22 bp, Artificial Sequence
  chemically synthesized
aatttatttagctagttatggc

SEQ ID NO: 923648 - DNA, 22 bp, Artificial Sequence
  chemically synthesized
caatttatttagctagttatgg

SEQ ID NO: 923649 - DNA, 22 bp, Artificial Sequence
  chemically synthesized
ctttttgccataactagctaaa

SEQ ID NO: 923650 - DNA, 22 bp, Artificial Sequence
  chemically synthesized
tttgccataactagctaaataa

SEQ ID NO: 923651 - DNA, 22 bp, Artificial Sequence
  chemically synthesized
ttgccataactagctaaataaa

SEQ ID NO: 923652 - DNA, 22 bp, Artificial Sequence
  chemically synthesized
tgccataactagctaaataaat

SEQ ID NO: 923653 - DNA, 22 bp, Artificial Sequence
  chemically synthesized
gccataactagctaaataaatt

SEQ ID NO: 923654 - DNA, 22 bp, Artificial Sequence
  chemically synthesized
ccataactagctaaataaattg

SEQ ID NO: 923655 - DNA, 22 bp, Artificial Sequence
  chemically synthesized
agagacaagtaacttcaattta

SEQ ID NO: 923656 - DNA, 22 bp, Artificial Sequence
  chemically synthesized
aagagacaagtaacttcaattt

SEQ ID NO: 923657 - DNA, 22 bp, Artificial Sequence
  chemically synthesized
gctaaataaattgaagttactt

SEQ ID NO: 923658 - DNA, 22 bp, Artificial Sequence
  chemically synthesized
gtacatttaagagacaagtaac

SEQ ID NO: 923659 - DNA, 22 bp, Artificial Sequence
  chemically synthesized
aataaattgaagttacttgtct

SEQ ID NO: 923660 - DNA, 22 bp, Artificial Sequence
  chemically synthesized
agtacatttaagagacaagtaa

SEQ ID NO: 923661 - DNA, 22 bp, Artificial Sequence
  chemically synthesized
agaatttagtacatttaagaga

SEQ ID NO: 923662 - DNA, 22 bp, Artificial Sequence
  chemically synthesized
cagaatttagtacatttaagag

SEQ ID NO: 923663 - DNA, 22 bp, Artificial Sequence
  chemically synthesized
aagttacttgtctcttaaatgt

SEQ ID NO: 923664 - DNA, 22 bp, Artificial Sequence
  chemically synthesized
ttcagaatttagtacatttaag

SEQ ID NO: 923665 - DNA, 22 bp, Artificial Sequence
  chemically synthesized
cttgtctcttaaatgtactaaa

SEQ ID NO: 923666 - DNA, 22 bp, Artificial Sequence
  chemically synthesized
ggtattcttcagaatttagtac

SEQ ID NO: 923667 - DNA, 22 bp, Artificial Sequence
  chemically synthesized
gtctcttaaatgtactaaattc

SEQ ID NO: 923668 - DNA, 22 bp, Artificial Sequence
  chemically synthesized
aggtattcttcagaatttagta

SEQ ID NO: 923669 - DNA, 22 bp, Artificial Sequence
  chemically synthesized
tctcttaaatgtactaaattct

SEQ ID NO: 923670 - DNA, 22 bp, Artificial Sequence
  chemically synthesized
taggtattcttcagaatttagt

SEQ ID NO: 923671 - DNA, 22 bp, Artificial Sequence
  chemically synthesized
ttaaatgtactaaattctgaag

SEQ ID NO: 923672 - DNA, 22 bp, Artificial Sequence
  chemically synthesized
aaatgtactaaattctgaagaa

SEQ ID NO: 923673 - DNA, 22 bp, Artificial Sequence
  chemically synthesized
aatgtactaaattctgaagaat

SEQ ID NO: 923674 - DNA, 22 bp, Artificial Sequence
  chemically synthesized
ataatattttaggtattcttca

SEQ ID NO: 923675 - DNA, 22 bp, Artificial Sequence
  chemically synthesized
gttaataatattttaggtattc

SEQ ID NO: 923676 - DNA, 22 bp, Artificial Sequence
  chemically synthesized
ggttaataatattttaggtatt

SEQ ID NO: 923677 - DNA, 22 bp, Artificial Sequence
  chemically synthesized
aattctgaagaatacctaaaat

SEQ ID NO: 923678 - DNA, 22 bp, Artificial Sequence
  chemically synthesized
tgaagaatacctaaaatattat

SEQ ID NO: 923679 - DNA, 22 bp, Artificial Sequence
  chemically synthesized
aagaatacctaaaatattatta

SEQ ID NO: 923680 - DNA, 22 bp, Artificial Sequence
  chemically synthesized
aaaaaatggaaggagtttggtt

SEQ ID NO: 923681 - DNA, 22 bp, Artificial Sequence
  chemically synthesized
aaaaaaatggaaggagtttggt

SEQ ID NO: 923682 - DNA, 22 bp, Artificial Sequence
  chemically synthesized
aaatattattaaccaaactcct

SEQ ID NO: 923683 - DNA, 22 bp, Artificial Sequence
  chemically synthesized
gtcttaaaaaaatggaaggagt

SEQ ID NO: 923684 - DNA, 22 bp, Artificial Sequence
  chemically synthesized
tagtcttaaaaaaatggaagga

SEQ ID NO: 923685 - DNA, 22 bp, Artificial Sequence
  chemically synthesized
ctagtcttaaaaaaatggaagg

SEQ ID NO: 923686 - DNA, 22 bp, Artificial Sequence
  chemically synthesized
ttaaccaaactccttccatttt

SEQ ID NO: 923687 - DNA, 22 bp, Artificial Sequence
  chemically synthesized
accaaactccttccattttttt

SEQ ID NO: 923688 - DNA, 22 bp, Artificial Sequence
  chemically synthesized
atcccttctagtcttaaaaaaa

SEQ ID NO: 923689 - DNA, 22 bp, Artificial Sequence
  chemically synthesized
gatcccttctagtcttaaaaaa

SEQ ID NO: 923690 - DNA, 22 bp, Artificial Sequence
  chemically synthesized
cttccatttttttaagactaga

SEQ ID NO: 923691 - DNA, 22 bp, Artificial Sequence
  chemically synthesized
accttgatcccttctagtctta

SEQ ID NO: 923692 - DNA, 22 bp, Artificial Sequence
  chemically synthesized
ccatttttttaagactagaagg

SEQ ID NO: 923693 - DNA, 22 bp, Artificial Sequence
  chemically synthesized
catttttttaagactagaaggg

SEQ ID NO: 923694 - DNA, 22 bp, Artificial Sequence
  chemically synthesized
gaaattgaccttgatcccttct

SEQ ID NO: 923695 - DNA, 22 bp, Artificial Sequence
  chemically synthesized
ttttaagactagaagggatcaa

SEQ ID NO: 923696 - DNA, 22 bp, Artificial Sequence
  chemically synthesized
tagaaattgaccttgatccctt

SEQ ID NO: 923697 - DNA, 22 bp, Artificial Sequence
  chemically synthesized
tttaagactagaagggatcaag

SEQ ID NO: 923698 - DNA, 22 bp, Artificial Sequence
  chemically synthesized
ttaagactagaagggatcaagg

SEQ ID NO: 923699 - DNA, 22 bp, Artificial Sequence
  chemically synthesized
taagactagaagggatcaaggt

SEQ ID NO: 923700 - DNA, 22 bp, Artificial Sequence
  chemically synthesized
aagactagaagggatcaaggtc

SEQ ID NO: 923701 - DNA, 22 bp, Artificial Sequence
  chemically synthesized
agactagaagggatcaaggtca

SEQ ID NO: 923702 - DNA, 22 bp, Artificial Sequence
  chemically synthesized
caattctagaaattgaccttga

SEQ ID NO: 923703 - DNA, 22 bp, Artificial Sequence
  chemically synthesized
gcaattctagaaattgaccttg

SEQ ID NO: 923704 - DNA, 22 bp, Artificial Sequence
  chemically synthesized
gaagggatcaaggtcaatttct

SEQ ID NO: 923705 - DNA, 22 bp, Artificial Sequence
  chemically synthesized
catggatacgtttgcaattcta

SEQ ID NO: 923706 - DNA, 22 bp, Artificial Sequence
  chemically synthesized
ccatggatacgtttgcaattct

SEQ ID NO: 923707 - DNA, 22 bp, Artificial Sequence
  chemically synthesized
tcacatttccatggatacgttt

SEQ ID NO: 923708 - DNA, 22 bp, Artificial Sequence
  chemically synthesized
ctagaattgcaaacgtatccat

SEQ ID NO: 923709 - DNA, 22 bp, Artificial Sequence
  chemically synthesized
tagaattgcaaacgtatccatg

SEQ ID NO: 923710 - DNA, 22 bp, Artificial Sequence
  chemically synthesized
gaattgcaaacgtatccatgga

SEQ ID NO: 923711 - DNA, 22 bp, Artificial Sequence
  chemically synthesized
tcatgttatcacatttccatgg

SEQ ID NO: 923712 - DNA, 22 bp, Artificial Sequence
  chemically synthesized
atcatgttatcacatttccatg

SEQ ID NO: 923713 - DNA, 22 bp, Artificial Sequence
  chemically synthesized
tatcatgttatcacatttccat

SEQ ID NO: 923714 - DNA, 22 bp, Artificial Sequence
  chemically synthesized
caaacgtatccatggaaatgtg

SEQ ID NO: 923715 - DNA, 22 bp, Artificial Sequence
  chemically synthesized
ttatcatgttatcacatttcca

SEQ ID NO: 923716 - DNA, 22 bp, Artificial Sequence
  chemically synthesized
tttttatcatgttatcacattt

SEQ ID NO: 923717 - DNA, 22 bp, Artificial Sequence
  chemically synthesized
tgtttttatcatgttatcacat

SEQ ID NO: 923718 - DNA, 22 bp, Artificial Sequence
  chemically synthesized
ctgtttttatcatgttatcaca

SEQ ID NO: 923719 - DNA, 22 bp, Artificial Sequence
  chemically synthesized
tctgtttttatcatgttatcac

SEQ ID NO: 923720 - DNA, 22 bp, Artificial Sequence
  chemically synthesized
ttctgtttttatcatgttatca

SEQ ID NO: 923721 - DNA, 22 bp, Artificial Sequence
  chemically synthesized
aagagccagaccaatttttctg

SEQ ID NO: 923722 - DNA, 22 bp, Artificial Sequence
  chemically synthesized
aaaatagatctaaagagccaga

SEQ ID NO: 923723 - DNA, 22 bp, Artificial Sequence
  chemically synthesized
tatagattaaaaatagatctaa

SEQ ID NO: 923724 - DNA, 22 bp, Artificial Sequence
  chemically synthesized
gtctggctctttagatctattt

SEQ ID NO: 923725 - DNA, 22 bp, Artificial Sequence
  chemically synthesized
ttatatagattaaaaatagatc

SEQ ID NO: 923726 - DNA, 22 bp, Artificial Sequence
  chemically synthesized
gctctttagatctatttttaat

SEQ ID NO: 923727 - DNA, 22 bp, Artificial Sequence
  chemically synthesized
acattattatatagattaaaaa

SEQ ID NO: 923728 - DNA, 22 bp, Artificial Sequence
  chemically synthesized
gacattattatatagattaaaa

SEQ ID NO: 923729 - DNA, 22 bp, Artificial Sequence
  chemically synthesized
tttagatctatttttaatctat

SEQ ID NO: 923730 - DNA, 22 bp, Artificial Sequence
  chemically synthesized
tagatctatttttaatctatat

SEQ ID NO: 923731 - DNA, 22 bp, Artificial Sequence
  chemically synthesized
agatctatttttaatctatata

SEQ ID NO: 923732 - DNA, 22 bp, Artificial Sequence
  chemically synthesized
gatctatttttaatctatataa

SEQ ID NO: 923733 - DNA, 22 bp, Artificial Sequence
  chemically synthesized
cacttgacattattatatagat

SEQ ID NO: 923734 - DNA, 22 bp, Artificial Sequence
  chemically synthesized
acacttgacattattatataga

SEQ ID NO: 923735 - DNA, 22 bp, Artificial Sequence
  chemically synthesized
tacacttgacattattatatag

SEQ ID NO: 923736 - DNA, 22 bp, Artificial Sequence
  chemically synthesized
tttttaatctatataataatgt

SEQ ID NO: 923737 - DNA, 22 bp, Artificial Sequence
  chemically synthesized
aatctttacacttgacattatt

SEQ ID NO: 923738 - DNA, 22 bp, Artificial Sequence
  chemically synthesized
ttaatctatataataatgtcaa

SEQ ID NO: 923739 - DNA, 22 bp, Artificial Sequence
  chemically synthesized
aaatctttacacttgacattat

SEQ ID NO: 923740 - DNA, 22 bp, Artificial Sequence
  chemically synthesized
taatctatataataatgtcaag

SEQ ID NO: 923741 - DNA, 22 bp, Artificial Sequence
  chemically synthesized
aatctatataataatgtcaagt

SEQ ID NO: 923742 - DNA, 22 bp, Artificial Sequence
  chemically synthesized
atctatataataatgtcaagtg

SEQ ID NO: 923743 - DNA, 22 bp, Artificial Sequence
  chemically synthesized
aagatttaaatctttacacttg

SEQ ID NO: 923744 - DNA, 22 bp, Artificial Sequence
  chemically synthesized
tataataatgtcaagtgtaaag

SEQ ID NO: 923745 - DNA, 22 bp, Artificial Sequence
  chemically synthesized
aactgaagatttaaatctttac

SEQ ID NO: 923746 - DNA, 22 bp, Artificial Sequence
  chemically synthesized
agattaaactgaagatttaaat

SEQ ID NO: 923747 - DNA, 22 bp, Artificial Sequence
  chemically synthesized
acattcagattaaactgaagat

SEQ ID NO: 923748 - DNA, 22 bp, Artificial Sequence
  chemically synthesized
ttcacattcagattaaactgaa

SEQ ID NO: 923749 - DNA, 22 bp, Artificial Sequence
  chemically synthesized
attcacattcagattaaactga

SEQ ID NO: 923750 - DNA, 22 bp, Artificial Sequence
  chemically synthesized
tattcacattcagattaaactg

SEQ ID NO: 923751 - DNA, 22 bp, Artificial Sequence
  chemically synthesized
aaatcttcagtttaatctgaat

SEQ ID NO: 923752 - DNA, 22 bp, Artificial Sequence
  chemically synthesized
aatcttcagtttaatctgaatg

SEQ ID NO: 923753 - DNA, 22 bp, Artificial Sequence
  chemically synthesized
cagtttaatctgaatgtgaata

SEQ ID NO: 923754 - DNA, 22 bp, Artificial Sequence
  chemically synthesized
agtttaatctgaatgtgaataa

SEQ ID NO: 923755 - DNA, 22 bp, Artificial Sequence
  chemically synthesized
aatcgtaagaattttattcaca

SEQ ID NO: 923756 - DNA, 22 bp, Artificial Sequence
  chemically synthesized
aaatcgtaagaattttattcac

SEQ ID NO: 923757 - DNA, 22 bp, Artificial Sequence
  chemically synthesized
aatctgaatgtgaataaaattc

SEQ ID NO: 923758 - DNA, 22 bp, Artificial Sequence
  chemically synthesized
atctgaatgtgaataaaattct

SEQ ID NO: 923759 - DNA, 22 bp, Artificial Sequence
  chemically synthesized
atttaaatcgtaagaattttat

SEQ ID NO: 923760 - DNA, 22 bp, Artificial Sequence
  chemically synthesized
aatttaaatcgtaagaatttta

SEQ ID NO: 923761 - DNA, 22 bp, Artificial Sequence
  chemically synthesized
ttaatttaaatcgtaagaattt

SEQ ID NO: 923762 - DNA, 22 bp, Artificial Sequence
  chemically synthesized
cttaatttaaatcgtaagaatt

SEQ ID NO: 923763 - DNA, 22 bp, Artificial Sequence
  chemically synthesized
aatgtgaataaaattcttacga

SEQ ID NO: 923764 - DNA, 22 bp, Artificial Sequence
  chemically synthesized
tcttaatttaaatcgtaagaat

SEQ ID NO: 923765 - DNA, 22 bp, Artificial Sequence
  chemically synthesized
ttacgatttaaattaagaaagt

SEQ ID NO: 923766 - DNA, 22 bp, Artificial Sequence
  chemically synthesized
acgatttaaattaagaaagtac

SEQ ID NO: 923767 - DNA, 22 bp, Artificial Sequence
  chemically synthesized
cgatttaaattaagaaagtact

SEQ ID NO: 923768 - DNA, 22 bp, Artificial Sequence
  chemically synthesized
tagatggccagtaagtactttc

SEQ ID NO: 923769 - DNA, 22 bp, Artificial Sequence
  chemically synthesized
aaattaagaaagtacttactgg

SEQ ID NO: 923770 - DNA, 22 bp, Artificial Sequence
  chemically synthesized
aattaagaaagtacttactggc

SEQ ID NO: 923771 - DNA, 22 bp, Artificial Sequence
  chemically synthesized
atatattgtagatggccagtaa

SEQ ID NO: 923772 - DNA, 22 bp, Artificial Sequence
  chemically synthesized
agaaagtacttactggccatct

SEQ ID NO: 923773 - DNA, 22 bp, Artificial Sequence
  chemically synthesized
ccagaaagcctgatatattgta

SEQ ID NO: 923774 - DNA, 22 bp, Artificial Sequence
  chemically synthesized
accagaaagcctgatatattgt

SEQ ID NO: 923775 - DNA, 22 bp, Artificial Sequence
  chemically synthesized
actggccatctacaatatatca

SEQ ID NO: 923776 - DNA, 22 bp, Artificial Sequence
  chemically synthesized
ctggccatctacaatatatcag

SEQ ID NO: 923777 - DNA, 22 bp, Artificial Sequence
  chemically synthesized
gccatctacaatatatcaggct

SEQ ID NO: 923778 - DNA, 22 bp, Artificial Sequence
  chemically synthesized
caatatatcaggctttctggta

SEQ ID NO: 923779 - DNA, 22 bp, Artificial Sequence
  chemically synthesized
taacccacagtacttaccagaa

SEQ ID NO: 923780 - DNA, 22 bp, Artificial Sequence
  chemically synthesized
tataacccacagtacttaccag

SEQ ID NO: 923781 - DNA, 22 bp, Artificial Sequence
  chemically synthesized
tctctataacccacagtactta

SEQ ID NO: 923782 - DNA, 22 bp, Artificial Sequence
  chemically synthesized
ttatctctataacccacagtac

SEQ ID NO: 923783 - DNA, 22 bp, Artificial Sequence
  chemically synthesized
ttgttatctctataacccacag

SEQ ID NO: 923784 - DNA, 22 bp, Artificial Sequence
  chemically synthesized
tctggtaagtactgtgggttat

SEQ ID NO: 923785 - DNA, 22 bp, Artificial Sequence
  chemically synthesized
attgttatctctataacccaca

SEQ ID NO: 923786 - DNA, 22 bp, Artificial Sequence
  chemically synthesized
ctggtaagtactgtgggttata

SEQ ID NO: 923787 - DNA, 22 bp, Artificial Sequence
  chemically synthesized
tggtaagtactgtgggttatag

SEQ ID NO: 923788 - DNA, 22 bp, Artificial Sequence
  chemically synthesized
ttattgttatctctataaccca

SEQ ID NO: 923789 - DNA, 22 bp, Artificial Sequence
  chemically synthesized
gtaagtactgtgggttatagag

SEQ ID NO: 923790 - DNA, 22 bp, Artificial Sequence
  chemically synthesized
tcttattgttatctctataacc

SEQ ID NO: 923791 - DNA, 22 bp, Artificial Sequence
  chemically synthesized
tgggttatagagataacaataa

SEQ ID NO: 923792 - DNA, 22 bp, Artificial Sequence
  chemically synthesized
tagagataacaataagagagtc

SEQ ID NO: 923793 - DNA, 22 bp, Artificial Sequence
  chemically synthesized
atgagggcagaggactctctta

SEQ ID NO: 923794 - DNA, 22 bp, Artificial Sequence
  chemically synthesized
catgagggcagaggactctctt

SEQ ID NO: 923795 - DNA, 22 bp, Artificial Sequence
  chemically synthesized
aaagcttcatgagggcagagga

SEQ ID NO: 923796 - DNA, 22 bp, Artificial Sequence
  chemically synthesized
ccccagcaagattaaaagcttc

SEQ ID NO: 923797 - DNA, 22 bp, Artificial Sequence
  chemically synthesized
cccccagcaagattaaaagctt

SEQ ID NO: 923798 - DNA, 22 bp, Artificial Sequence
  chemically synthesized
tcccccagcaagattaaaagct

SEQ ID NO: 923799 - DNA, 22 bp, Artificial Sequence
  chemically synthesized
tgccctcatgaagcttttaatc

SEQ ID NO: 923800 - DNA, 22 bp, Artificial Sequence
  chemically synthesized
ttcccccagcaagattaaaagc

SEQ ID NO: 923801 - DNA, 22 bp, Artificial Sequence
  chemically synthesized
ccctcatgaagcttttaatctt

SEQ ID NO: 923802 - DNA, 22 bp, Artificial Sequence
  chemically synthesized
atgaagcttttaatcttgctgg

SEQ ID NO: 923803 - DNA, 22 bp, Artificial Sequence
  chemically synthesized
catatgcttttcccccagcaag

SEQ ID NO: 923804 - DNA, 22 bp, Artificial Sequence
  chemically synthesized
acatatgcttttcccccagcaa

SEQ ID NO: 923805 - DNA, 22 bp, Artificial Sequence
  chemically synthesized
tttacatatgcttttcccccag

SEQ ID NO: 923806 - DNA, 22 bp, Artificial Sequence
  chemically synthesized
ttaatcttgctgggggaaaagc

SEQ ID NO: 923807 - DNA, 22 bp, Artificial Sequence
  chemically synthesized
taatcttgctgggggaaaagca

SEQ ID NO: 923808 - DNA, 22 bp, Artificial Sequence
  chemically synthesized
aatcttgctgggggaaaagcat

SEQ ID NO: 923809 - DNA, 22 bp, Artificial Sequence
  chemically synthesized
atcttgctgggggaaaagcata

SEQ ID NO: 923810 - DNA, 22 bp, Artificial Sequence
  chemically synthesized
gctgggggaaaagcatatgtaa

SEQ ID NO: 923811 - DNA, 22 bp, Artificial Sequence
  chemically synthesized
ctgggggaaaagcatatgtaaa

SEQ ID NO: 923812 - DNA, 22 bp, Artificial Sequence
  chemically synthesized
ggggaaaagcatatgtaaatag

SEQ ID NO: 923813 - DNA, 22 bp, Artificial Sequence
  chemically synthesized
tatgtatatatcatgtatcata

SEQ ID NO: 923814 - DNA, 22 bp, Artificial Sequence
  chemically synthesized
atgtaatattgtatgtatatat

SEQ ID NO: 923815 - DNA, 22 bp, Artificial Sequence
  chemically synthesized
taacactcatgtaatattgtat

SEQ ID NO: 923816 - DNA, 22 bp, Artificial Sequence
  chemically synthesized
ataacactcatgtaatattgta

SEQ ID NO: 923817 - DNA, 22 bp, Artificial Sequence
  chemically synthesized
tataacactcatgtaatattgt

SEQ ID NO: 923818 - DNA, 22 bp, Artificial Sequence
  chemically synthesized
ttataacactcatgtaatattg

SEQ ID NO: 923819 - DNA, 22 bp, Artificial Sequence
  chemically synthesized
tttataacactcatgtaatatt

SEQ ID NO: 923820 - DNA, 22 bp, Artificial Sequence
  chemically synthesized
cccctttttataacactcatgt

SEQ ID NO: 923821 - DNA, 22 bp, Artificial Sequence
  chemically synthesized
gcccctttttataacactcatg

SEQ ID NO: 923822 - DNA, 22 bp, Artificial Sequence
  chemically synthesized
ttgcccctttttataacactca

SEQ ID NO: 923823 - DNA, 22 bp, Artificial Sequence
  chemically synthesized
cttgcccctttttataacactc

SEQ ID NO: 923824 - DNA, 22 bp, Artificial Sequence
  chemically synthesized
tcttgcccctttttataacact

SEQ ID NO: 923825 - DNA, 22 bp, Artificial Sequence
  chemically synthesized
aggttttcttgcccctttttat

SEQ ID NO: 923826 - DNA, 22 bp, Artificial Sequence
  chemically synthesized
aaggttttcttgccccttttta

SEQ ID NO: 923827 - DNA, 22 bp, Artificial Sequence
  chemically synthesized
catgagtgttataaaaaggggc

SEQ ID NO: 923828 - DNA, 22 bp, Artificial Sequence
  chemically synthesized
ttaaggttttcttgcccctttt

SEQ ID NO: 923829 - DNA, 22 bp, Artificial Sequence
  chemically synthesized
tcttaaggttttcttgcccctt

SEQ ID NO: 923830 - DNA, 22 bp, Artificial Sequence
  chemically synthesized
ttctcttaaggttttcttgccc

SEQ ID NO: 923831 - DNA, 22 bp, Artificial Sequence
  chemically synthesized
attctcttaaggttttcttgcc

SEQ ID NO: 923832 - DNA, 22 bp, Artificial Sequence
  chemically synthesized
taaaaaggggcaagaaaacctt

SEQ ID NO: 923833 - DNA, 22 bp, Artificial Sequence
  chemically synthesized
aaacataagcagtttattctct

SEQ ID NO: 923834 - DNA, 22 bp, Artificial Sequence
  chemically synthesized
tcaaacataagcagtttattct

SEQ ID NO: 923835 - DNA, 22 bp, Artificial Sequence
  chemically synthesized
ctcaaacataagcagtttattc

SEQ ID NO: 923836 - DNA, 22 bp, Artificial Sequence
  chemically synthesized
ttctcaaacataagcagtttat

SEQ ID NO: 923837 - DNA, 22 bp, Artificial Sequence
  chemically synthesized
ctcttctcaaacataagcagtt

SEQ ID NO: 923838 - DNA, 22 bp, Artificial Sequence
  chemically synthesized
aagagaataaactgcttatgtt

SEQ ID NO: 923839 - DNA, 22 bp, Artificial Sequence
  chemically synthesized
agagaataaactgcttatgttt

SEQ ID NO: 923840 - DNA, 22 bp, Artificial Sequence
  chemically synthesized
tgacctgctcttctcaaacata

SEQ ID NO: 923841 - DNA, 22 bp, Artificial Sequence
  chemically synthesized
aatgaattgtgacctgctcttc

SEQ ID NO: 923842 - DNA, 22 bp, Artificial Sequence
  chemically synthesized
cttatgtttgagaagagcaggt

SEQ ID NO: 923843 - DNA, 22 bp, Artificial Sequence
  chemically synthesized
atgtttgagaagagcaggtcac

SEQ ID NO: 923844 - DNA, 22 bp, Artificial Sequence
  chemically synthesized
cctcaatgaattgtgacctgct

SEQ ID NO: 923845 - DNA, 22 bp, Artificial Sequence
  chemically synthesized
tgtttgagaagagcaggtcaca

SEQ ID NO: 923846 - DNA, 22 bp, Artificial Sequence
  chemically synthesized
ttacctcaatgaattgtgacct

SEQ ID NO: 923847 - DNA, 22 bp, Artificial Sequence
  chemically synthesized
gagaagagcaggtcacaattca

SEQ ID NO: 923848 - DNA, 22 bp, Artificial Sequence
  chemically synthesized
ctattacctcaatgaattgtga

SEQ ID NO: 923849 - DNA, 22 bp, Artificial Sequence
  chemically synthesized
agaagagcaggtcacaattcat

SEQ ID NO: 923850 - DNA, 22 bp, Artificial Sequence
  chemically synthesized
actgctattacctcaatgaatt

SEQ ID NO: 923851 - DNA, 22 bp, Artificial Sequence
  chemically synthesized
aactgctattacctcaatgaat

SEQ ID NO: 923852 - DNA, 22 bp, Artificial Sequence
  chemically synthesized
atcttaactgctattacctcaa

SEQ ID NO: 923853 - DNA, 22 bp, Artificial Sequence
  chemically synthesized
agactcatcttaactgctatta

SEQ ID NO: 923854 - DNA, 22 bp, Artificial Sequence
  chemically synthesized
aagactcatcttaactgctatt

SEQ ID NO: 923855 - DNA, 22 bp, Artificial Sequence
  chemically synthesized
attgaggtaatagcagttaaga

SEQ ID NO: 923856 - DNA, 22 bp, Artificial Sequence
  chemically synthesized
aggtaatagcagttaagatgag

SEQ ID NO: 923857 - DNA, 22 bp, Artificial Sequence
  chemically synthesized
cacatcccttaagactcatctt

SEQ ID NO: 923858 - DNA, 22 bp, Artificial Sequence
  chemically synthesized
acacatcccttaagactcatct

SEQ ID NO: 923859 - DNA, 22 bp, Artificial Sequence
  chemically synthesized
ccaaaatcttacacatccctta

SEQ ID NO: 923860 - DNA, 22 bp, Artificial Sequence
  chemically synthesized
cccaaaatcttacacatccctt

SEQ ID NO: 923861 - DNA, 22 bp, Artificial Sequence
  chemically synthesized
agatgagtcttaagggatgtgt

SEQ ID NO: 923862 - DNA, 22 bp, Artificial Sequence
  chemically synthesized
tcccaaaatcttacacatccct

SEQ ID NO: 923863 - DNA, 22 bp, Artificial Sequence
  chemically synthesized
ttcccaaaatcttacacatccc

SEQ ID NO: 923864 - DNA, 22 bp, Artificial Sequence
  chemically synthesized
tttcccaaaatcttacacatcc

SEQ ID NO: 923865 - DNA, 22 bp, Artificial Sequence
  chemically synthesized
ttttcccaaaatcttacacatc

SEQ ID NO: 923866 - DNA, 22 bp, Artificial Sequence
  chemically synthesized
tttttcccaaaatcttacacat

SEQ ID NO: 923867 - DNA, 22 bp, Artificial Sequence
  chemically synthesized
ttttttttcccaaaatcttaca

SEQ ID NO: 923868 - DNA, 22 bp, Artificial Sequence
  chemically synthesized
attttttttcccaaaatcttac

SEQ ID NO: 923869 - DNA, 22 bp, Artificial Sequence
  chemically synthesized
aagggatgtgtaagattttggg

SEQ ID NO: 923870 - DNA, 22 bp, Artificial Sequence
  chemically synthesized
agggatgtgtaagattttggga

SEQ ID NO: 923871 - DNA, 22 bp, Artificial Sequence
  chemically synthesized
cccttattttttttcccaaaat

SEQ ID NO: 923872 - DNA, 22 bp, Artificial Sequence
  chemically synthesized
ccccttattttttttcccaaaa

SEQ ID NO: 923873 - DNA, 22 bp, Artificial Sequence
  chemically synthesized
tccccttattttttttcccaaa

SEQ ID NO: 923874 - DNA, 22 bp, Artificial Sequence
  chemically synthesized
tttccccttattttttttccca

SEQ ID NO: 923875 - DNA, 22 bp, Artificial Sequence
  chemically synthesized
tctttccccttattttttttcc

SEQ ID NO: 923876 - DNA, 22 bp, Artificial Sequence
  chemically synthesized
aattctctttccccttattttt

SEQ ID NO: 923877 - DNA, 22 bp, Artificial Sequence
  chemically synthesized
gttgaattctctttccccttat

SEQ ID NO: 923878 - DNA, 22 bp, Artificial Sequence
  chemically synthesized
tgggaaaaaaaataaggggaaa

SEQ ID NO: 923879 - DNA, 22 bp, Artificial Sequence
  chemically synthesized
ggttgaattctctttcccctta

SEQ ID NO: 923880 - DNA, 22 bp, Artificial Sequence
  chemically synthesized
gggaaaaaaaataaggggaaag

SEQ ID NO: 923881 - DNA, 22 bp, Artificial Sequence
  chemically synthesized
tggttgaattctctttcccctt

SEQ ID NO: 923882 - DNA, 22 bp, Artificial Sequence
  chemically synthesized
ggaaaaaaaataaggggaaaga

SEQ ID NO: 923883 - DNA, 22 bp, Artificial Sequence
  chemically synthesized
ctttggttgaattctctttccc

SEQ ID NO: 923884 - DNA, 22 bp, Artificial Sequence
  chemically synthesized
cctttggttgaattctctttcc

SEQ ID NO: 923885 - DNA, 22 bp, Artificial Sequence
  chemically synthesized
aaccaaaggaagcggttttttt

SEQ ID NO: 923886 - DNA, 22 bp, Artificial Sequence
  chemically synthesized
ttttttttttttgtcttgtttt

SEQ ID NO: 923887 - DNA, 22 bp, Artificial Sequence
  chemically synthesized
tttttttttttgtcttgttttt

SEQ ID NO: 923888 - DNA, 22 bp, Artificial Sequence
  chemically synthesized
ttttttttttgtcttgtttttt

SEQ ID NO: 923889 - DNA, 22 bp, Artificial Sequence
  chemically synthesized
tttttttttgtcttgttttttg

SEQ ID NO: 923890 - DNA, 22 bp, Artificial Sequence
  chemically synthesized
ttttttttgtcttgttttttgt

SEQ ID NO: 923891 - DNA, 22 bp, Artificial Sequence
  chemically synthesized
tttttttgtcttgttttttgtt

SEQ ID NO: 923892 - DNA, 22 bp, Artificial Sequence
  chemically synthesized
ttttttgtcttgttttttgttc

SEQ ID NO: 923893 - DNA, 22 bp, Artificial Sequence
  chemically synthesized
tttttgtcttgttttttgttct

SEQ ID NO: 923894 - DNA, 22 bp, Artificial Sequence
  chemically synthesized
ttttgtcttgttttttgttctt

SEQ ID NO: 923895 - DNA, 22 bp, Artificial Sequence
  chemically synthesized
tttgtcttgttttttgttcttt

SEQ ID NO: 923896 - DNA, 22 bp, Artificial Sequence
  chemically synthesized
ttgtcttgttttttgttctttg

SEQ ID NO: 923897 - DNA, 22 bp, Artificial Sequence
  chemically synthesized
tgtcttgttttttgttctttgt

SEQ ID NO: 923898 - DNA, 22 bp, Artificial Sequence
  chemically synthesized
gtcttgttttttgttctttgtt

SEQ ID NO: 923899 - DNA, 22 bp, Artificial Sequence
  chemically synthesized
caaaaaaaaaaaaacaaagaac

SEQ ID NO: 923900 - DNA, 22 bp, Artificial Sequence
  chemically synthesized
tcttgttttttgttctttgttt

SEQ ID NO: 923901 - DNA, 22 bp, Artificial Sequence
  chemically synthesized
gcaaaaaaaaaaaaacaaagaa

SEQ ID NO: 923902 - DNA, 22 bp, Artificial Sequence
  chemically synthesized
tgcaaaaaaaaaaaaacaaaga

SEQ ID NO: 923903 - DNA, 22 bp, Artificial Sequence
  chemically synthesized
ttgcaaaaaaaaaaaaacaaag

SEQ ID NO: 923904 - DNA, 22 bp, Artificial Sequence
  chemically synthesized
gttttttgttctttgttttttt

SEQ ID NO: 923905 - DNA, 22 bp, Artificial Sequence
  chemically synthesized
ttttttgttctttgtttttttt

SEQ ID NO: 923906 - DNA, 22 bp, Artificial Sequence
  chemically synthesized
agcttttgcaaaaaaaaaaaaa

SEQ ID NO: 923907 - DNA, 22 bp, Artificial Sequence
  chemically synthesized
tttgttctttgttttttttttt

SEQ ID NO: 923908 - DNA, 22 bp, Artificial Sequence
  chemically synthesized
cagcttttgcaaaaaaaaaaaa

SEQ ID NO: 923909 - DNA, 22 bp, Artificial Sequence
  chemically synthesized
ttgttctttgtttttttttttt

SEQ ID NO: 923910 - DNA, 22 bp, Artificial Sequence
  chemically synthesized
tgttctttgttttttttttttt

SEQ ID NO: 923911 - DNA, 22 bp, Artificial Sequence
  chemically synthesized
ttcagcttttgcaaaaaaaaaa

SEQ ID NO: 923912 - DNA, 22 bp, Artificial Sequence
  chemically synthesized
gttctttgtttttttttttttg

SEQ ID NO: 923913 - DNA, 22 bp, Artificial Sequence
  chemically synthesized
ttctttgtttttttttttttgc

SEQ ID NO: 923914 - DNA, 22 bp, Artificial Sequence
  chemically synthesized
ttcttcagcttttgcaaaaaaa

SEQ ID NO: 923915 - DNA, 22 bp, Artificial Sequence
  chemically synthesized
tttgtttttttttttttgcaaa

SEQ ID NO: 923916 - DNA, 22 bp, Artificial Sequence
  chemically synthesized
tgttcttcagcttttgcaaaaa

SEQ ID NO: 923917 - DNA, 22 bp, Artificial Sequence
  chemically synthesized
ctgttcttcagcttttgcaaaa

SEQ ID NO: 923918 - DNA, 22 bp, Artificial Sequence
  chemically synthesized
tgtttttttttttttgcaaaag

SEQ ID NO: 923919 - DNA, 22 bp, Artificial Sequence
  chemically synthesized
tctgttcttcagcttttgcaaa

SEQ ID NO: 923920 - DNA, 22 bp, Artificial Sequence
  chemically synthesized
gtttttttttttttgcaaaagc

SEQ ID NO: 923921 - DNA, 22 bp, Artificial Sequence
  chemically synthesized
tttttttttttttgcaaaagct

SEQ ID NO: 923922 - DNA, 22 bp, Artificial Sequence
  chemically synthesized
ttttttttttgcaaaagctgaa

SEQ ID NO: 923923 - DNA, 22 bp, Artificial Sequence
  chemically synthesized
tttttttttgcaaaagctgaag

SEQ ID NO: 923924 - DNA, 22 bp, Artificial Sequence
  chemically synthesized
aagttttctgttcttcagcttt

SEQ ID NO: 923925 - DNA, 22 bp, Artificial Sequence
  chemically synthesized
ttttttttgcaaaagctgaaga

SEQ ID NO: 923926 - DNA, 22 bp, Artificial Sequence
  chemically synthesized
tttttttgcaaaagctgaagaa

SEQ ID NO: 923927 - DNA, 22 bp, Artificial Sequence
  chemically synthesized
ttttttgcaaaagctgaagaac

SEQ ID NO: 923928 - DNA, 22 bp, Artificial Sequence
  chemically synthesized
tttttgcaaaagctgaagaaca

SEQ ID NO: 923929 - DNA, 22 bp, Artificial Sequence
  chemically synthesized
ttttgcaaaagctgaagaacag

SEQ ID NO: 923930 - DNA, 22 bp, Artificial Sequence
  chemically synthesized
tttgcaaaagctgaagaacaga

SEQ ID NO: 923931 - DNA, 22 bp, Artificial Sequence
  chemically synthesized
ttgcaaaagctgaagaacagaa

SEQ ID NO: 923932 - DNA, 22 bp, Artificial Sequence
  chemically synthesized
tgcaaaagctgaagaacagaaa

SEQ ID NO: 923933 - DNA, 22 bp, Artificial Sequence
  chemically synthesized
gcaaaagctgaagaacagaaaa

SEQ ID NO: 923934 - DNA, 22 bp, Artificial Sequence
  chemically synthesized
aatgacctgaagttttctgttc

SEQ ID NO: 923935 - DNA, 22 bp, Artificial Sequence
  chemically synthesized
caaaagctgaagaacagaaaac

SEQ ID NO: 923936 - DNA, 22 bp, Artificial Sequence
  chemically synthesized
gaatgacctgaagttttctgtt

SEQ ID NO: 923937 - DNA, 22 bp, Artificial Sequence
  chemically synthesized
tgaatgacctgaagttttctgt

SEQ ID NO: 923938 - DNA, 22 bp, Artificial Sequence
  chemically synthesized
aagctttgaatgacctgaagtt

SEQ ID NO: 923939 - DNA, 22 bp, Artificial Sequence
  chemically synthesized
aagaacagaaaacttcaggtca

SEQ ID NO: 923940 - DNA, 22 bp, Artificial Sequence
  chemically synthesized
tgtctgaagctttgaatgacct

SEQ ID NO: 923941 - DNA, 22 bp, Artificial Sequence
  chemically synthesized
atgtctgaagctttgaatgacc

SEQ ID NO: 923942 - DNA, 22 bp, Artificial Sequence
  chemically synthesized
tttatgtctgaagctttgaatg

SEQ ID NO: 923943 - DNA, 22 bp, Artificial Sequence
  chemically synthesized
tgtttatgtctgaagctttgaa

SEQ ID NO: 923944 - DNA, 22 bp, Artificial Sequence
  chemically synthesized
ctgtttatgtctgaagctttga

SEQ ID NO: 923945 - DNA, 22 bp, Artificial Sequence
  chemically synthesized
tttctgtttatgtctgaagctt

SEQ ID NO: 923946 - DNA, 22 bp, Artificial Sequence
  chemically synthesized
caggtcattcaaagcttcagac

SEQ ID NO: 923947 - DNA, 22 bp, Artificial Sequence
  chemically synthesized
aggtcattcaaagcttcagaca

SEQ ID NO: 923948 - DNA, 22 bp, Artificial Sequence
  chemically synthesized
cactatttctgtttatgtctga

SEQ ID NO: 923949 - DNA, 22 bp, Artificial Sequence
  chemically synthesized
ccactatttctgtttatgtctg

SEQ ID NO: 923950 - DNA, 22 bp, Artificial Sequence
  chemically synthesized
aaagcttcagacataaacagaa

SEQ ID NO: 923951 - DNA, 22 bp, Artificial Sequence
  chemically synthesized
ataatttccactatttctgttt

SEQ ID NO: 923952 - DNA, 22 bp, Artificial Sequence
  chemically synthesized
cataatttccactatttctgtt

SEQ ID NO: 923953 - DNA, 22 bp, Artificial Sequence
  chemically synthesized
tcataatttccactatttctgt

SEQ ID NO: 923954 - DNA, 22 bp, Artificial Sequence
  chemically synthesized
ttcataatttccactatttctg

SEQ ID NO: 923955 - DNA, 22 bp, Artificial Sequence
  chemically synthesized
cagacataaacagaaatagtgg

SEQ ID NO: 923956 - DNA, 22 bp, Artificial Sequence
  chemically synthesized
agacataaacagaaatagtgga

SEQ ID NO: 923957 - DNA, 22 bp, Artificial Sequence
  chemically synthesized
tttttcataatttccactattt

SEQ ID NO: 923958 - DNA, 22 bp, Artificial Sequence
  chemically synthesized
caaccctgtttttcataatttc

SEQ ID NO: 923959 - DNA, 22 bp, Artificial Sequence
  chemically synthesized
ccaaccctgtttttcataattt

SEQ ID NO: 923960 - DNA, 22 bp, Artificial Sequence
  chemically synthesized
tccaaccctgtttttcataatt

SEQ ID NO: 923961 - DNA, 22 bp, Artificial Sequence
  chemically synthesized
tctttccaaccctgtttttcat

SEQ ID NO: 923962 - DNA, 22 bp, Artificial Sequence
  chemically synthesized
acctatctttccaaccctgttt

SEQ ID NO: 923963 - DNA, 22 bp, Artificial Sequence
  chemically synthesized
tgacctatctttccaaccctgt

SEQ ID NO: 923964 - DNA, 22 bp, Artificial Sequence
  chemically synthesized
ttctgacctatctttccaaccc

SEQ ID NO: 923965 - DNA, 22 bp, Artificial Sequence
  chemically synthesized
tgaaaaacagggttggaaagat

SEQ ID NO: 923966 - DNA, 22 bp, Artificial Sequence
  chemically synthesized
aacatagaatctgttctgacct

SEQ ID NO: 923967 - DNA, 22 bp, Artificial Sequence
  chemically synthesized
gaaagataggtcagaacagatt

SEQ ID NO: 923968 - DNA, 22 bp, Artificial Sequence
  chemically synthesized
tatgttcaattcttttgctact

SEQ ID NO: 923969 - DNA, 22 bp, Artificial Sequence
  chemically synthesized
atggccacacgtagtagcaaaa

SEQ ID NO: 923970 - DNA, 22 bp, Artificial Sequence
  chemically synthesized
gatggccacacgtagtagcaaa

SEQ ID NO: 923971 - DNA, 22 bp, Artificial Sequence
  chemically synthesized
tgttcaattcttttgctactac

SEQ ID NO: 923972 - DNA, 22 bp, Artificial Sequence
  chemically synthesized
tgatggccacacgtagtagcaa

SEQ ID NO: 923973 - DNA, 22 bp, Artificial Sequence
  chemically synthesized
cctttgatggccacacgtagta

SEQ ID NO: 923974 - DNA, 22 bp, Artificial Sequence
  chemically synthesized
aattcttttgctactacgtgtg

SEQ ID NO: 923975 - DNA, 22 bp, Artificial Sequence
  chemically synthesized
acctttgatggccacacgtagt

SEQ ID NO: 923976 - DNA, 22 bp, Artificial Sequence
  chemically synthesized
cttacctttgatggccacacgt

SEQ ID NO: 923977 - DNA, 22 bp, Artificial Sequence
  chemically synthesized
ttttgctactacgtgtggccat

SEQ ID NO: 923978 - DNA, 22 bp, Artificial Sequence
  chemically synthesized
tccttacctttgatggccacac

SEQ ID NO: 923979 - DNA, 22 bp, Artificial Sequence
  chemically synthesized
ctccttacctttgatggccaca

SEQ ID NO: 923980 - DNA, 22 bp, Artificial Sequence
  chemically synthesized
ttgctactacgtgtggccatca

SEQ ID NO: 923981 - DNA, 22 bp, Artificial Sequence
  chemically synthesized
tgctactacgtgtggccatcaa

SEQ ID NO: 923982 - DNA, 22 bp, Artificial Sequence
  chemically synthesized
gctactacgtgtggccatcaaa

SEQ ID NO: 923983 - DNA, 22 bp, Artificial Sequence
  chemically synthesized
ctactacgtgtggccatcaaag

SEQ ID NO: 923984 - DNA, 22 bp, Artificial Sequence
  chemically synthesized
ctacgtgtggccatcaaaggta

SEQ ID NO: 923985 - DNA, 22 bp, Artificial Sequence
  chemically synthesized
ccaaccttctccttacctttga

SEQ ID NO: 923986 - DNA, 22 bp, Artificial Sequence
  chemically synthesized
cgtgtggccatcaaaggtaagg

SEQ ID NO: 923987 - DNA, 22 bp, Artificial Sequence
  chemically synthesized
ctaccaaccttctccttacctt

SEQ ID NO: 923988 - DNA, 22 bp, Artificial Sequence
  chemically synthesized
cctaccaaccttctccttacct

SEQ ID NO: 923989 - DNA, 22 bp, Artificial Sequence
  chemically synthesized
ttcctaccaaccttctccttac

SEQ ID NO: 923990 - DNA, 22 bp, Artificial Sequence
  chemically synthesized
cttcctaccaaccttctcctta

SEQ ID NO: 923991 - DNA, 22 bp, Artificial Sequence
  chemically synthesized
caatttcttcctaccaaccttc

SEQ ID NO: 923992 - DNA, 22 bp, Artificial Sequence
  chemically synthesized
gcaatttcttcctaccaacctt

SEQ ID NO: 923993 - DNA, 22 bp, Artificial Sequence
  chemically synthesized
gtatacacttgcaatttcttcc

SEQ ID NO: 923994 - DNA, 22 bp, Artificial Sequence
  chemically synthesized
tggtatacacttgcaatttctt

SEQ ID NO: 923995 - DNA, 22 bp, Artificial Sequence
  chemically synthesized
tctggtatacacttgcaatttc

SEQ ID NO: 923996 - DNA, 22 bp, Artificial Sequence
  chemically synthesized
gtaggaagaaattgcaagtgta

SEQ ID NO: 923997 - DNA, 22 bp, Artificial Sequence
  chemically synthesized
tccatcaggattctctggtata

SEQ ID NO: 923998 - DNA, 22 bp, Artificial Sequence
  chemically synthesized
gtccatcaggattctctggtat

SEQ ID NO: 923999 - DNA, 22 bp, Artificial Sequence
  chemically synthesized
tgtccatcaggattctctggta

SEQ ID NO: 924000 - DNA, 22 bp, Artificial Sequence
  chemically synthesized
caagtgtataccagagaatcct

SEQ ID NO: 924001 - DNA, 22 bp, Artificial Sequence
  chemically synthesized
tcccagttttgtccatcaggat

SEQ ID NO: 924002 - DNA, 22 bp, Artificial Sequence
  chemically synthesized
atcccagttttgtccatcagga

SEQ ID NO: 924003 - DNA, 22 bp, Artificial Sequence
  chemically synthesized
tttatcccagttttgtccatca

SEQ ID NO: 924004 - DNA, 22 bp, Artificial Sequence
  chemically synthesized
cattatttatcccagttttgtc

SEQ ID NO: 924005 - DNA, 22 bp, Artificial Sequence
  chemically synthesized
gcattatttatcccagttttgt

SEQ ID NO: 924006 - DNA, 22 bp, Artificial Sequence
  chemically synthesized
tgcattatttatcccagttttg

SEQ ID NO: 924007 - DNA, 22 bp, Artificial Sequence
  chemically synthesized
atggacaaaactgggataaata

SEQ ID NO: 924008 - DNA, 22 bp, Artificial Sequence
  chemically synthesized
gatcagattttgcattatttat

SEQ ID NO: 924009 - DNA, 22 bp, Artificial Sequence
  chemically synthesized
tagatcagattttgcattattt

SEQ ID NO: 924010 - DNA, 22 bp, Artificial Sequence
  chemically synthesized
ctctagatcagattttgcatta

SEQ ID NO: 924011 - DNA, 22 bp, Artificial Sequence
  chemically synthesized
actctagatcagattttgcatt

SEQ ID NO: 924012 - DNA, 22 bp, Artificial Sequence
  chemically synthesized
ggataaataatgcaaaatctga

SEQ ID NO: 924013 - DNA, 22 bp, Artificial Sequence
  chemically synthesized
cggagtccttactctagatcag

SEQ ID NO: 924014 - DNA, 22 bp, Artificial Sequence
  chemically synthesized
cctccggagtccttactctaga

SEQ ID NO: 924015 - DNA, 22 bp, Artificial Sequence
  chemically synthesized
atctagagtaaggactccggag

SEQ ID NO: 924016 - DNA, 22 bp, Artificial Sequence
  chemically synthesized
gagtaaggactccggaggcaga

SEQ ID NO: 924017 - DNA, 22 bp, Artificial Sequence
  chemically synthesized
aaccaggatgcagtcccgcagt

SEQ ID NO: 924018 - DNA, 22 bp, Artificial Sequence
  chemically synthesized
gaaccaggatgcagtcccgcag

SEQ ID NO: 924019 - DNA, 22 bp, Artificial Sequence
  chemically synthesized
cggaggcagactgcgggactgc

SEQ ID NO: 924020 - DNA, 22 bp, Artificial Sequence
  chemically synthesized
cgggactgcatcctggttcaaa

SEQ ID NO: 924021 - DNA, 22 bp, Artificial Sequence
  chemically synthesized
cacagccagcaagtatttgaac

SEQ ID NO: 924022 - DNA, 22 bp, Artificial Sequence
  chemically synthesized
catcctggttcaaatacttgct

SEQ ID NO: 924023 - DNA, 22 bp, Artificial Sequence
  chemically synthesized
cccaagattgcacagccagcaa

SEQ ID NO: 924024 - DNA, 22 bp, Artificial Sequence
  chemically synthesized
gcccaagattgcacagccagca

SEQ ID NO: 924025 - DNA, 22 bp, Artificial Sequence
  chemically synthesized
gttcaaatacttgctggctgtg

SEQ ID NO: 924026 - DNA, 22 bp, Artificial Sequence
  chemically synthesized
tgcccaagattgcacagccagc

SEQ ID NO: 924027 - DNA, 22 bp, Artificial Sequence
  chemically synthesized
tttgcccaagattgcacagcca

SEQ ID NO: 924028 - DNA, 22 bp, Artificial Sequence
  chemically synthesized
aaatacttgctggctgtgcaat

SEQ ID NO: 924029 - DNA, 22 bp, Artificial Sequence
  chemically synthesized
ataaaactctttgcccaagatt

SEQ ID NO: 924030 - DNA, 22 bp, Artificial Sequence
  chemically synthesized
gctggctgtgcaatcttgggca

SEQ ID NO: 924031 - DNA, 22 bp, Artificial Sequence
  chemically synthesized
ctggctgtgcaatcttgggcaa

SEQ ID NO: 924032 - DNA, 22 bp, Artificial Sequence
  chemically synthesized
gctgtgcaatcttgggcaaaga

SEQ ID NO: 924033 - DNA, 22 bp, Artificial Sequence
  chemically synthesized
tgcaatcttgggcaaagagttt

SEQ ID NO: 924034 - DNA, 22 bp, Artificial Sequence
  chemically synthesized
gggcaaagagttttatcagtct

SEQ ID NO: 924035 - DNA, 22 bp, Artificial Sequence
  chemically synthesized
ggcaaagagttttatcagtctg

SEQ ID NO: 924036 - DNA, 22 bp, Artificial Sequence
  chemically synthesized
caggagggcaacgaaggcacag

SEQ ID NO: 924037 - DNA, 22 bp, Artificial Sequence
  chemically synthesized
acaggagggcaacgaaggcaca

SEQ ID NO: 924038 - DNA, 22 bp, Artificial Sequence
  chemically synthesized
tacaggagggcaacgaaggcac

SEQ ID NO: 924039 - DNA, 22 bp, Artificial Sequence
  chemically synthesized
tatcagtctgtgccttcgttgc

SEQ ID NO: 924040 - DNA, 22 bp, Artificial Sequence
  chemically synthesized
atcagtctgtgccttcgttgcc

SEQ ID NO: 924041 - DNA, 22 bp, Artificial Sequence
  chemically synthesized
attttacaggagggcaacgaag

SEQ ID NO: 924042 - DNA, 22 bp, Artificial Sequence
  chemically synthesized
tcagtctgtgccttcgttgccc

SEQ ID NO: 924043 - DNA, 22 bp, Artificial Sequence
  chemically synthesized
aattttacaggagggcaacgaa

SEQ ID NO: 924044 - DNA, 22 bp, Artificial Sequence
  chemically synthesized
taattttacaggagggcaacga

SEQ ID NO: 924045 - DNA, 22 bp, Artificial Sequence
  chemically synthesized
ttaattttacaggagggcaacg

SEQ ID NO: 924046 - DNA, 22 bp, Artificial Sequence
  chemically synthesized
cttttaattttacaggagggca

SEQ ID NO: 924047 - DNA, 22 bp, Artificial Sequence
  chemically synthesized
tccttttaattttacaggaggg

SEQ ID NO: 924048 - DNA, 22 bp, Artificial Sequence
  chemically synthesized
tgccttcgttgccctcctgtaa

SEQ ID NO: 924049 - DNA, 22 bp, Artificial Sequence
  chemically synthesized
ttctccttttaattttacagga

SEQ ID NO: 924050 - DNA, 22 bp, Artificial Sequence
  chemically synthesized
ctattctccttttaattttaca

SEQ ID NO: 924051 - DNA, 22 bp, Artificial Sequence
  chemically synthesized
cgttgccctcctgtaaaattaa

SEQ ID NO: 924052 - DNA, 22 bp, Artificial Sequence
  chemically synthesized
gttgccctcctgtaaaattaaa

SEQ ID NO: 924053 - DNA, 22 bp, Artificial Sequence
  chemically synthesized
ccctcctgtaaaattaaaagga

SEQ ID NO: 924054 - DNA, 22 bp, Artificial Sequence
  chemically synthesized
ctgtaaaattaaaaggagaata

SEQ ID NO: 924055 - DNA, 22 bp, Artificial Sequence
  chemically synthesized
tgaaatagttgctattctcctt

SEQ ID NO: 924056 - DNA, 22 bp, Artificial Sequence
  chemically synthesized
tatgaaatagttgctattctcc

SEQ ID NO: 924057 - DNA, 22 bp, Artificial Sequence
  chemically synthesized
taaaattaaaaggagaatagca

SEQ ID NO: 924058 - DNA, 22 bp, Artificial Sequence
  chemically synthesized
aaaggagaatagcaactatttc

SEQ ID NO: 924059 - DNA, 22 bp, Artificial Sequence
  chemically synthesized
taacaactctatgaaatagttg

SEQ ID NO: 924060 - DNA, 22 bp, Artificial Sequence
  chemically synthesized
ataacaactctatgaaatagtt

SEQ ID NO: 924061 - DNA, 22 bp, Artificial Sequence
  chemically synthesized
aatacttataacaactctatga

SEQ ID NO: 924062 - DNA, 22 bp, Artificial Sequence
  chemically synthesized
cgtagctcaatacttataacaa

SEQ ID NO: 924063 - DNA, 22 bp, Artificial Sequence
  chemically synthesized
acgtagctcaatacttataaca

SEQ ID NO: 924064 - DNA, 22 bp, Artificial Sequence
  chemically synthesized
tttcatagagttgttataagta

SEQ ID NO: 924065 - DNA, 22 bp, Artificial Sequence
  chemically synthesized
tacgtagctcaatacttataac

SEQ ID NO: 924066 - DNA, 22 bp, Artificial Sequence
  chemically synthesized
catagagttgttataagtattg

SEQ ID NO: 924067 - DNA, 22 bp, Artificial Sequence
  chemically synthesized
atagagttgttataagtattga

SEQ ID NO: 924068 - DNA, 22 bp, Artificial Sequence
  chemically synthesized
caagtgttttacgtagctcaat

SEQ ID NO: 924069 - DNA, 22 bp, Artificial Sequence
  chemically synthesized
ttccaagtgttttacgtagctc

SEQ ID NO: 924070 - DNA, 22 bp, Artificial Sequence
  chemically synthesized
ttataagtattgagctacgtaa

SEQ ID NO: 924071 - DNA, 22 bp, Artificial Sequence
  chemically synthesized
taagtattgagctacgtaaaac

SEQ ID NO: 924072 - DNA, 22 bp, Artificial Sequence
  chemically synthesized
ccatgcactgttccaagtgttt

SEQ ID NO: 924073 - DNA, 22 bp, Artificial Sequence
  chemically synthesized
agctacgtaaaacacttggaac

SEQ ID NO: 924074 - DNA, 22 bp, Artificial Sequence
  chemically synthesized
atattgccatgcactgttccaa

SEQ ID NO: 924075 - DNA, 22 bp, Artificial Sequence
  chemically synthesized
aatattgccatgcactgttcca

SEQ ID NO: 924076 - DNA, 22 bp, Artificial Sequence
  chemically synthesized
cgtaaaacacttggaacagtgc

SEQ ID NO: 924077 - DNA, 22 bp, Artificial Sequence
  chemically synthesized
ggaacagtgcatggcaatatta

SEQ ID NO: 924078 - DNA, 22 bp, Artificial Sequence
  chemically synthesized
gaacagtgcatggcaatattaa

SEQ ID NO: 924079 - DNA, 22 bp, Artificial Sequence
  chemically synthesized
gggtggtgatggaagtgatggt

SEQ ID NO: 924080 - DNA, 22 bp, Artificial Sequence
  chemically synthesized
agtgttatcaccatcacttcca

SEQ ID NO: 924081 - DNA, 22 bp, Artificial Sequence
  chemically synthesized
tcaccatcacttccatcaccac

SEQ ID NO: 924082 - DNA, 22 bp, Artificial Sequence
  chemically synthesized
tatgatgatgacggttagggtg

SEQ ID NO: 924083 - DNA, 22 bp, Artificial Sequence
  chemically synthesized
gtatgatgatgacggttagggt

SEQ ID NO: 924084 - DNA, 22 bp, Artificial Sequence
  chemically synthesized
tgtatgatgatgacggttaggg

SEQ ID NO: 924085 - DNA, 22 bp, Artificial Sequence
  chemically synthesized
ccatcaccaccctaaccgtcat

SEQ ID NO: 924086 - DNA, 22 bp, Artificial Sequence
  chemically synthesized
catcaccaccctaaccgtcatc

SEQ ID NO: 924087 - DNA, 22 bp, Artificial Sequence
  chemically synthesized
atgcagacctttgtatgatgat

SEQ ID NO: 924088 - DNA, 22 bp, Artificial Sequence
  chemically synthesized
accgtcatcatcatacaaaggt

SEQ ID NO: 924089 - DNA, 22 bp, Artificial Sequence
  chemically synthesized
tagtacctcatgcagacctttg

SEQ ID NO: 924090 - DNA, 22 bp, Artificial Sequence
  chemically synthesized
atagtacctcatgcagaccttt

SEQ ID NO: 924091 - DNA, 22 bp, Artificial Sequence
  chemically synthesized
tatagtacctcatgcagacctt

SEQ ID NO: 924092 - DNA, 22 bp, Artificial Sequence
  chemically synthesized
attttatagtacctcatgcaga

SEQ ID NO: 924093 - DNA, 22 bp, Artificial Sequence
  chemically synthesized
gattttatagtacctcatgcag

SEQ ID NO: 924094 - DNA, 22 bp, Artificial Sequence
  chemically synthesized
catagatatttgattttatagt

SEQ ID NO: 924095 - DNA, 22 bp, Artificial Sequence
  chemically synthesized
ccatagatatttgattttatag

SEQ ID NO: 924096 - DNA, 22 bp, Artificial Sequence
  chemically synthesized
tccatagatatttgattttata

SEQ ID NO: 924097 - DNA, 22 bp, Artificial Sequence
  chemically synthesized
ttccatagatatttgattttat

SEQ ID NO: 924098 - DNA, 22 bp, Artificial Sequence
  chemically synthesized
catgaggtactataaaatcaaa

SEQ ID NO: 924099 - DNA, 22 bp, Artificial Sequence
  chemically synthesized
cttttccatagatatttgattt

SEQ ID NO: 924100 - DNA, 22 bp, Artificial Sequence
  chemically synthesized
attgcttttccatagatatttg

SEQ ID NO: 924101 - DNA, 22 bp, Artificial Sequence
  chemically synthesized
tattaattgcttttccatagat

SEQ ID NO: 924102 - DNA, 22 bp, Artificial Sequence
  chemically synthesized
taaaatcaaatatctatggaaa

SEQ ID NO: 924103 - DNA, 22 bp, Artificial Sequence
  chemically synthesized
atattaattgcttttccataga

SEQ ID NO: 924104 - DNA, 22 bp, Artificial Sequence
  chemically synthesized
atttatattaattgcttttcca

SEQ ID NO: 924105 - DNA, 22 bp, Artificial Sequence
  chemically synthesized
ctcatttatattaattgctttt

SEQ ID NO: 924106 - DNA, 22 bp, Artificial Sequence
  chemically synthesized
gctcatttatattaattgcttt

SEQ ID NO: 924107 - DNA, 22 bp, Artificial Sequence
  chemically synthesized
tgctcatttatattaattgctt

SEQ ID NO: 924108 - DNA, 22 bp, Artificial Sequence
  chemically synthesized
tggaaaagcaattaatataaat

SEQ ID NO: 924109 - DNA, 22 bp, Artificial Sequence
  chemically synthesized
tcccactttgctcatttatatt

SEQ ID NO: 924110 - DNA, 22 bp, Artificial Sequence
  chemically synthesized
cagcacctgtcccactttgctc

SEQ ID NO: 924111 - DNA, 22 bp, Artificial Sequence
  chemically synthesized
gcagcacctgtcccactttgct

SEQ ID NO: 924112 - DNA, 22 bp, Artificial Sequence
  chemically synthesized
atataaatgagcaaagtgggac

SEQ ID NO: 924113 - DNA, 22 bp, Artificial Sequence
  chemically synthesized
agtttgcagcacctgtcccact

SEQ ID NO: 924114 - DNA, 22 bp, Artificial Sequence
  chemically synthesized
tcctcagtttgcagcacctgtc

SEQ ID NO: 924115 - DNA, 22 bp, Artificial Sequence
  chemically synthesized
gtcctcagtttgcagcacctgt

SEQ ID NO: 924116 - DNA, 22 bp, Artificial Sequence
  chemically synthesized
tgtcctcagtttgcagcacctg

SEQ ID NO: 924117 - DNA, 22 bp, Artificial Sequence
  chemically synthesized
gggtaagcaagctttgtcctca

SEQ ID NO: 924118 - DNA, 22 bp, Artificial Sequence
  chemically synthesized
cctggggtaagcaagctttgtc

SEQ ID NO: 924119 - DNA, 22 bp, Artificial Sequence
  chemically synthesized
caaactgaggacaaagcttgct

SEQ ID NO: 924120 - DNA, 22 bp, Artificial Sequence
  chemically synthesized
aggacaaagcttgcttacccca

SEQ ID NO: 924121 - DNA, 22 bp, Artificial Sequence
  chemically synthesized
agaagcattgcctggggtaagc

SEQ ID NO: 924122 - DNA, 22 bp, Artificial Sequence
  chemically synthesized
gagaagcattgcctggggtaag

SEQ ID NO: 924123 - DNA, 22 bp, Artificial Sequence
  chemically synthesized
aagtttgagaagcattgcctgg

SEQ ID NO: 924124 - DNA, 22 bp, Artificial Sequence
  chemically synthesized
gcttaccccaggcaatgcttct

SEQ ID NO: 924125 - DNA, 22 bp, Artificial Sequence
  chemically synthesized
cttaccccaggcaatgcttctc

SEQ ID NO: 924126 - DNA, 22 bp, Artificial Sequence
  chemically synthesized
accccaggcaatgcttctcaaa

SEQ ID NO: 924127 - DNA, 22 bp, Artificial Sequence
  chemically synthesized
ccccaggcaatgcttctcaaac

SEQ ID NO: 924128 - DNA, 22 bp, Artificial Sequence
  chemically synthesized
atgggcacattaaagtttgaga

SEQ ID NO: 924129 - DNA, 22 bp, Artificial Sequence
  chemically synthesized
caagtgattcatgggcacatta

SEQ ID NO: 924130 - DNA, 22 bp, Artificial Sequence
  chemically synthesized
ccaagtgattcatgggcacatt

SEQ ID NO: 924131 - DNA, 22 bp, Artificial Sequence
  chemically synthesized
ctcaaactttaatgtgcccatg

SEQ ID NO: 924132 - DNA, 22 bp, Artificial Sequence
  chemically synthesized
tcaaactttaatgtgcccatga

SEQ ID NO: 924133 - DNA, 22 bp, Artificial Sequence
  chemically synthesized
aaactttaatgtgcccatgaat

SEQ ID NO: 924134 - DNA, 22 bp, Artificial Sequence
  chemically synthesized
caagtttccaagtgattcatgg

SEQ ID NO: 924135 - DNA, 22 bp, Artificial Sequence
  chemically synthesized
ccaagtttccaagtgattcatg

SEQ ID NO: 924136 - DNA, 22 bp, Artificial Sequence
  chemically synthesized
taatgtgcccatgaatcacttg

SEQ ID NO: 924137 - DNA, 22 bp, Artificial Sequence
  chemically synthesized
aatgtgcccatgaatcacttgg

SEQ ID NO: 924138 - DNA, 22 bp, Artificial Sequence
  chemically synthesized
atgtgcccatgaatcacttgga

SEQ ID NO: 924139 - DNA, 22 bp, Artificial Sequence
  chemically synthesized
ataagatttccaagtttccaag

SEQ ID NO: 924140 - DNA, 22 bp, Artificial Sequence
  chemically synthesized
aataagatttccaagtttccaa

SEQ ID NO: 924141 - DNA, 22 bp, Artificial Sequence
  chemically synthesized
taataagatttccaagtttcca

SEQ ID NO: 924142 - DNA, 22 bp, Artificial Sequence
  chemically synthesized
ttaataagatttccaagtttcc

SEQ ID NO: 924143 - DNA, 22 bp, Artificial Sequence
  chemically synthesized
ggaaacttggaaatcttattaa

SEQ ID NO: 924144 - DNA, 22 bp, Artificial Sequence
  chemically synthesized
gaaacttggaaatcttattaaa

SEQ ID NO: 924145 - DNA, 22 bp, Artificial Sequence
  chemically synthesized
ggaaatcttattaaaaatgctg

SEQ ID NO: 924146 - DNA, 22 bp, Artificial Sequence
  chemically synthesized
ataaataacagtcagcattttt

SEQ ID NO: 924147 - DNA, 22 bp, Artificial Sequence
  chemically synthesized
gaaatcttattaaaaatgctga

SEQ ID NO: 924148 - DNA, 22 bp, Artificial Sequence
  chemically synthesized
attaaaaatgctgactgttatt

SEQ ID NO: 924149 - DNA, 22 bp, Artificial Sequence
  chemically synthesized
ttaaaaatgctgactgttattt

SEQ ID NO: 924150 - DNA, 22 bp, Artificial Sequence
  chemically synthesized
aaaatgctgactgttatttatt

SEQ ID NO: 924151 - DNA, 22 bp, Artificial Sequence
  chemically synthesized
agaaatgcagaatctaataaat

SEQ ID NO: 924152 - DNA, 22 bp, Artificial Sequence
  chemically synthesized
ctaagaaatgcagaatctaata

SEQ ID NO: 924153 - DNA, 22 bp, Artificial Sequence
  chemically synthesized
actgttatttattagattctgc

SEQ ID NO: 924154 - DNA, 22 bp, Artificial Sequence
  chemically synthesized
ttatttattagattctgcattt

SEQ ID NO: 924155 - DNA, 22 bp, Artificial Sequence
  chemically synthesized
ggagttgctaagaaatgcagaa

SEQ ID NO: 924156 - DNA, 22 bp, Artificial Sequence
  chemically synthesized
tttattagattctgcatttctt

SEQ ID NO: 924157 - DNA, 22 bp, Artificial Sequence
  chemically synthesized
attagattctgcatttcttagc

SEQ ID NO: 924158 - DNA, 22 bp, Artificial Sequence
  chemically synthesized
ttagattctgcatttcttagca

SEQ ID NO: 924159 - DNA, 22 bp, Artificial Sequence
  chemically synthesized
gattctgcatttcttagcaact

SEQ ID NO: 924160 - DNA, 22 bp, Artificial Sequence
  chemically synthesized
tgcatttcttagcaactcccag

SEQ ID NO: 924161 - DNA, 22 bp, Artificial Sequence
  chemically synthesized
catttcttagcaactcccaggt

SEQ ID NO: 924162 - DNA, 22 bp, Artificial Sequence
  chemically synthesized
cttagcaactcccaggtgatgt

SEQ ID NO: 924163 - DNA, 22 bp, Artificial Sequence
  chemically synthesized
ttagcaactcccaggtgatgtc

SEQ ID NO: 924164 - DNA, 22 bp, Artificial Sequence
  chemically synthesized
gtccagagcacagacatcacct

SEQ ID NO: 924165 - DNA, 22 bp, Artificial Sequence
  chemically synthesized
agcaactcccaggtgatgtctg

SEQ ID NO: 924166 - DNA, 22 bp, Artificial Sequence
  chemically synthesized
tggtccagagcacagacatcac

SEQ ID NO: 924167 - DNA, 22 bp, Artificial Sequence
  chemically synthesized
gcaactcccaggtgatgtctgt

SEQ ID NO: 924168 - DNA, 22 bp, Artificial Sequence
  chemically synthesized
ccaggtgatgtctgtgctctgg

SEQ ID NO: 924169 - DNA, 22 bp, Artificial Sequence
  chemically synthesized
aaagtgtggtctctggtccaga

SEQ ID NO: 924170 - DNA, 22 bp, Artificial Sequence
  chemically synthesized
ctcaaagtgtggtctctggtcc

SEQ ID NO: 924171 - DNA, 22 bp, Artificial Sequence
  chemically synthesized
ctactcaaagtgtggtctctgg

SEQ ID NO: 924172 - DNA, 22 bp, Artificial Sequence
  chemically synthesized
gctactcaaagtgtggtctctg

SEQ ID NO: 924173 - DNA, 22 bp, Artificial Sequence
  chemically synthesized
tgctctggaccagagaccacac

SEQ ID NO: 924174 - DNA, 22 bp, Artificial Sequence
  chemically synthesized
ttgctactcaaagtgtggtctc

SEQ ID NO: 924175 - DNA, 22 bp, Artificial Sequence
  chemically synthesized
cttgctactcaaagtgtggtct

SEQ ID NO: 924176 - DNA, 22 bp, Artificial Sequence
  chemically synthesized
tcttgctactcaaagtgtggtc

SEQ ID NO: 924177 - DNA, 22 bp, Artificial Sequence
  chemically synthesized
tggaccagagaccacactttga

SEQ ID NO: 924178 - DNA, 22 bp, Artificial Sequence
  chemically synthesized
attttcttgctactcaaagtgt

SEQ ID NO: 924179 - DNA, 22 bp, Artificial Sequence
  chemically synthesized
gaccagagaccacactttgagt

SEQ ID NO: 924180 - DNA, 22 bp, Artificial Sequence
  chemically synthesized
cattttcttgctactcaaagtg

SEQ ID NO: 924181 - DNA, 22 bp, Artificial Sequence
  chemically synthesized
agtaacagatgtttcattttct

SEQ ID NO: 924182 - DNA, 22 bp, Artificial Sequence
  chemically synthesized
tgagtagcaagaaaatgaaaca

SEQ ID NO: 924183 - DNA, 22 bp, Artificial Sequence
  chemically synthesized
gagtagcaagaaaatgaaacat

SEQ ID NO: 924184 - DNA, 22 bp, Artificial Sequence
  chemically synthesized
agtagcaagaaaatgaaacatc

SEQ ID NO: 924185 - DNA, 22 bp, Artificial Sequence
  chemically synthesized
caactgagtaacagatgtttca

SEQ ID NO: 924186 - DNA, 22 bp, Artificial Sequence
  chemically synthesized
gcaccatcacctacaactgagt

SEQ ID NO: 924187 - DNA, 22 bp, Artificial Sequence
  chemically synthesized
ggcaccatcacctacaactgag

SEQ ID NO: 924188 - DNA, 22 bp, Artificial Sequence
  chemically synthesized
ttggcaccatcacctacaactg

SEQ ID NO: 924189 - DNA, 22 bp, Artificial Sequence
  chemically synthesized
tcttggcaccatcacctacaac

SEQ ID NO: 924190 - DNA, 22 bp, Artificial Sequence
  chemically synthesized
ctcttggcaccatcacctacaa

SEQ ID NO: 924191 - DNA, 22 bp, Artificial Sequence
  chemically synthesized
tctcttggcaccatcacctaca

SEQ ID NO: 924192 - DNA, 22 bp, Artificial Sequence
  chemically synthesized
ttactcagttgtaggtgatggt

SEQ ID NO: 924193 - DNA, 22 bp, Artificial Sequence
  chemically synthesized
tattttctcttggcaccatcac

SEQ ID NO: 924194 - DNA, 22 bp, Artificial Sequence
  chemically synthesized
ctcagttgtaggtgatggtgcc

SEQ ID NO: 924195 - DNA, 22 bp, Artificial Sequence
  chemically synthesized
ctatattttctcttggcaccat

SEQ ID NO: 924196 - DNA, 22 bp, Artificial Sequence
  chemically synthesized
agttgtaggtgatggtgccaag

SEQ ID NO: 924197 - DNA, 22 bp, Artificial Sequence
  chemically synthesized
attactatattttctcttggca

SEQ ID NO: 924198 - DNA, 22 bp, Artificial Sequence
  chemically synthesized
taggtgatggtgccaagagaaa

SEQ ID NO: 924199 - DNA, 22 bp, Artificial Sequence
  chemically synthesized
ggcactcattactatattttct

SEQ ID NO: 924200 - DNA, 22 bp, Artificial Sequence
  chemically synthesized
ctaggcactcattactatattt

SEQ ID NO: 924201 - DNA, 22 bp, Artificial Sequence
  chemically synthesized
gctactaggcactcattactat

SEQ ID NO: 924202 - DNA, 22 bp, Artificial Sequence
  chemically synthesized
gatctggctactaggcactcat

SEQ ID NO: 924203 - DNA, 22 bp, Artificial Sequence
  chemically synthesized
agatctggctactaggcactca

SEQ ID NO: 924204 - DNA, 22 bp, Artificial Sequence
  chemically synthesized
aaaatttagatctggctactag

SEQ ID NO: 924205 - DNA, 22 bp, Artificial Sequence
  chemically synthesized
gaaaatttagatctggctacta

SEQ ID NO: 924206 - DNA, 22 bp, Artificial Sequence
  chemically synthesized
tgaaaatttagatctggctact

SEQ ID NO: 924207 - DNA, 22 bp, Artificial Sequence
  chemically synthesized
ttgaaaatttagatctggctac

SEQ ID NO: 924208 - DNA, 22 bp, Artificial Sequence
  chemically synthesized
ttttgaaaatttagatctggct

SEQ ID NO: 924209 - DNA, 22 bp, Artificial Sequence
  chemically synthesized
cttttgaaaatttagatctggc

SEQ ID NO: 924210 - DNA, 22 bp, Artificial Sequence
  chemically synthesized
tcttcttttgaaaatttagatc

SEQ ID NO: 924211 - DNA, 22 bp, Artificial Sequence
  chemically synthesized
tgtcttcttttgaaaatttaga

SEQ ID NO: 924212 - DNA, 22 bp, Artificial Sequence
  chemically synthesized
ctgtcttcttttgaaaatttag

SEQ ID NO: 924213 - DNA, 22 bp, Artificial Sequence
  chemically synthesized
gtagccagatctaaattttcaa

SEQ ID NO: 924214 - DNA, 22 bp, Artificial Sequence
  chemically synthesized
aattttcaaaagaagacagaaa

SEQ ID NO: 924215 - DNA, 22 bp, Artificial Sequence
  chemically synthesized
aaaaaatatggatttctgtctt

SEQ ID NO: 924216 - DNA, 22 bp, Artificial Sequence
  chemically synthesized
aaaaaaatatggatttctgtct

SEQ ID NO: 924217 - DNA, 22 bp, Artificial Sequence
  chemically synthesized
taaaaaaatatggatttctgtc

SEQ ID NO: 924218 - DNA, 22 bp, Artificial Sequence
  chemically synthesized
ttaaaaaaatatggatttctgt

SEQ ID NO: 924219 - DNA, 22 bp, Artificial Sequence
  chemically synthesized
tttaaaaaaatatggatttctg

SEQ ID NO: 924220 - DNA, 22 bp, Artificial Sequence
  chemically synthesized
tcaaaagaagacagaaatccat

SEQ ID NO: 924221 - DNA, 22 bp, Artificial Sequence
  chemically synthesized
caaaagaagacagaaatccata

SEQ ID NO: 924222 - DNA, 22 bp, Artificial Sequence
  chemically synthesized
aaaagaagacagaaatccatat

SEQ ID NO: 924223 - DNA, 22 bp, Artificial Sequence
  chemically synthesized
attttttaaaaaaatatggatt

SEQ ID NO: 924224 - DNA, 22 bp, Artificial Sequence
  chemically synthesized
agagacctcattttttaaaaaa

SEQ ID NO: 924225 - DNA, 22 bp, Artificial Sequence
  chemically synthesized
aaaattgagagacctcattttt

SEQ ID NO: 924226 - DNA, 22 bp, Artificial Sequence
  chemically synthesized
aaaaattgagagacctcatttt

SEQ ID NO: 924227 - DNA, 22 bp, Artificial Sequence
  chemically synthesized
taaaaattgagagacctcattt

SEQ ID NO: 924228 - DNA, 22 bp, Artificial Sequence
  chemically synthesized
ttaaaaattgagagacctcatt

SEQ ID NO: 924229 - DNA, 22 bp, Artificial Sequence
  chemically synthesized
ttttaaaaaatgaggtctctca

SEQ ID NO: 924230 - DNA, 22 bp, Artificial Sequence
  chemically synthesized
tttaaaaaatgaggtctctcaa

SEQ ID NO: 924231 - DNA, 22 bp, Artificial Sequence
  chemically synthesized
ttaaaaaatgaggtctctcaat

SEQ ID NO: 924232 - DNA, 22 bp, Artificial Sequence
  chemically synthesized
taaaaaatgaggtctctcaatt

SEQ ID NO: 924233 - DNA, 22 bp, Artificial Sequence
  chemically synthesized
acaacttttaaaaattgagaga

SEQ ID NO: 924234 - DNA, 22 bp, Artificial Sequence
  chemically synthesized
aaaaaatgaggtctctcaattt

SEQ ID NO: 924235 - DNA, 22 bp, Artificial Sequence
  chemically synthesized
aaaaatgaggtctctcaatttt

SEQ ID NO: 924236 - DNA, 22 bp, Artificial Sequence
  chemically synthesized
aataattgacaacttttaaaaa

SEQ ID NO: 924237 - DNA, 22 bp, Artificial Sequence
  chemically synthesized
aaataattgacaacttttaaaa

SEQ ID NO: 924238 - DNA, 22 bp, Artificial Sequence
  chemically synthesized
taaataattgacaacttttaaa

SEQ ID NO: 924239 - DNA, 22 bp, Artificial Sequence
  chemically synthesized
ttaaataattgacaacttttaa

SEQ ID NO: 924240 - DNA, 22 bp, Artificial Sequence
  chemically synthesized
tttttaaataattgacaacttt

SEQ ID NO: 924241 - DNA, 22 bp, Artificial Sequence
  chemically synthesized
tcaatttttaaaagttgtcaat

SEQ ID NO: 924242 - DNA, 22 bp, Artificial Sequence
  chemically synthesized
aatttttaaaagttgtcaatta

SEQ ID NO: 924243 - DNA, 22 bp, Artificial Sequence
  chemically synthesized
ttaaaagttgtcaattatttaa

SEQ ID NO: 924244 - DNA, 22 bp, Artificial Sequence
  chemically synthesized
taaaagttgtcaattatttaaa

SEQ ID NO: 924245 - DNA, 22 bp, Artificial Sequence
  chemically synthesized
aaaagttgtcaattatttaaaa

SEQ ID NO: 924246 - DNA, 22 bp, Artificial Sequence
  chemically synthesized
catagccactgtttttaaataa

SEQ ID NO: 924247 - DNA, 22 bp, Artificial Sequence
  chemically synthesized
aaagttgtcaattatttaaaaa

SEQ ID NO: 924248 - DNA, 22 bp, Artificial Sequence
  chemically synthesized
gcatagccactgtttttaaata

SEQ ID NO: 924249 - DNA, 22 bp, Artificial Sequence
  chemically synthesized
tgcatagccactgtttttaaat

SEQ ID NO: 924250 - DNA, 22 bp, Artificial Sequence
  chemically synthesized
ttgcatagccactgtttttaaa

SEQ ID NO: 924251 - DNA, 22 bp, Artificial Sequence
  chemically synthesized
tcaattatttaaaaacagtggc

SEQ ID NO: 924252 - DNA, 22 bp, Artificial Sequence
  chemically synthesized
tttaaaaacagtggctatgcaa

SEQ ID NO: 924253 - DNA, 22 bp, Artificial Sequence
  chemically synthesized
aaaaacagtggctatgcaaaaa

SEQ ID NO: 924254 - DNA, 22 bp, Artificial Sequence
  chemically synthesized
aaaacagtggctatgcaaaaat

SEQ ID NO: 924255 - DNA, 22 bp, Artificial Sequence
  chemically synthesized
aatgcatgcagtatttttgcat

SEQ ID NO: 924256 - DNA, 22 bp, Artificial Sequence
  chemically synthesized
aatcctgaatgcatgcagtatt

SEQ ID NO: 924257 - DNA, 22 bp, Artificial Sequence
  chemically synthesized
tgcaaaaatactgcatgcattc

SEQ ID NO: 924258 - DNA, 22 bp, Artificial Sequence
  chemically synthesized
agtacccacaggctgaatcctg

SEQ ID NO: 924259 - DNA, 22 bp, Artificial Sequence
  chemically synthesized
catgcattcaggattcagcctg

SEQ ID NO: 924260 - DNA, 22 bp, Artificial Sequence
  chemically synthesized
gaaactgagtacccacaggctg

SEQ ID NO: 924261 - DNA, 22 bp, Artificial Sequence
  chemically synthesized
ggaaactgagtacccacaggct

SEQ ID NO: 924262 - DNA, 22 bp, Artificial Sequence
  chemically synthesized
aggattcagcctgtgggtactc

SEQ ID NO: 924263 - DNA, 22 bp, Artificial Sequence
  chemically synthesized
agcctgtgggtactcagtttcc

SEQ ID NO: 924264 - DNA, 22 bp, Artificial Sequence
  chemically synthesized
catccagcccagagtttggaaa

SEQ ID NO: 924265 - DNA, 22 bp, Artificial Sequence
  chemically synthesized
tgggtactcagtttccaaactc

SEQ ID NO: 924266 - DNA, 22 bp, Artificial Sequence
  chemically synthesized
tccatccagcccagagtttgga

SEQ ID NO: 924267 - DNA, 22 bp, Artificial Sequence
  chemically synthesized
actctccatccagcccagagtt

SEQ ID NO: 924268 - DNA, 22 bp, Artificial Sequence
  chemically synthesized
gactctccatccagcccagagt

SEQ ID NO: 924269 - DNA, 22 bp, Artificial Sequence
  chemically synthesized
agtttccaaactctgggctgga

SEQ ID NO: 924270 - DNA, 22 bp, Artificial Sequence
  chemically synthesized
gaccttgactctccatccagcc

SEQ ID NO: 924271 - DNA, 22 bp, Artificial Sequence
  chemically synthesized
agaccttgactctccatccagc

SEQ ID NO: 924272 - DNA, 22 bp, Artificial Sequence
  chemically synthesized
ccaaactctgggctggatggag

SEQ ID NO: 924273 - DNA, 22 bp, Artificial Sequence
  chemically synthesized
caaactctgggctggatggaga

SEQ ID NO: 924274 - DNA, 22 bp, Artificial Sequence
  chemically synthesized
ccagtttagaccttgactctcc

SEQ ID NO: 924275 - DNA, 22 bp, Artificial Sequence
  chemically synthesized
tgggctggatggagagtcaagg

SEQ ID NO: 924276 - DNA, 22 bp, Artificial Sequence
  chemically synthesized
ggctggatggagagtcaaggtc

SEQ ID NO: 924277 - DNA, 22 bp, Artificial Sequence
  chemically synthesized
attgccagtttagaccttgact

SEQ ID NO: 924278 - DNA, 22 bp, Artificial Sequence
  chemically synthesized
tcattgccagtttagaccttga

SEQ ID NO: 924279 - DNA, 22 bp, Artificial Sequence
  chemically synthesized
ctcattgccagtttagaccttg

SEQ ID NO: 924280 - DNA, 22 bp, Artificial Sequence
  chemically synthesized
tctcattgccagtttagacctt

SEQ ID NO: 924281 - DNA, 22 bp, Artificial Sequence
  chemically synthesized
gatggagagtcaaggtctaaac

SEQ ID NO: 924282 - DNA, 22 bp, Artificial Sequence
  chemically synthesized
ttctcattgccagtttagacct

SEQ ID NO: 924283 - DNA, 22 bp, Artificial Sequence
  chemically synthesized
tttctcattgccagtttagacc

SEQ ID NO: 924284 - DNA, 22 bp, Artificial Sequence
  chemically synthesized
ttttctcattgccagtttagac

SEQ ID NO: 924285 - DNA, 22 bp, Artificial Sequence
  chemically synthesized
tttttctcattgccagtttaga

SEQ ID NO: 924286 - DNA, 22 bp, Artificial Sequence
  chemically synthesized
ctttttttctcattgccagttt

SEQ ID NO: 924287 - DNA, 22 bp, Artificial Sequence
  chemically synthesized
cctttttttctcattgccagtt

SEQ ID NO: 924288 - DNA, 22 bp, Artificial Sequence
  chemically synthesized
aaacttcctttttttctcattg

SEQ ID NO: 924289 - DNA, 22 bp, Artificial Sequence
  chemically synthesized
tactcaaacttcctttttttct

SEQ ID NO: 924290 - DNA, 22 bp, Artificial Sequence
  chemically synthesized
aactggcaatgagaaaaaaagg

SEQ ID NO: 924291 - DNA, 22 bp, Artificial Sequence
  chemically synthesized
tgtactcaaacttccttttttt

SEQ ID NO: 924292 - DNA, 22 bp, Artificial Sequence
  chemically synthesized
ctctgtactcaaacttcctttt

SEQ ID NO: 924293 - DNA, 22 bp, Artificial Sequence
  chemically synthesized
gcaatgagaaaaaaaggaagtt

SEQ ID NO: 924294 - DNA, 22 bp, Artificial Sequence
  chemically synthesized
gctctgtactcaaacttccttt

SEQ ID NO: 924295 - DNA, 22 bp, Artificial Sequence
  chemically synthesized
tcccgtccgcttgctctgtact

SEQ ID NO: 924296 - DNA, 22 bp, Artificial Sequence
  chemically synthesized
gagtacagagcaagcggacggg

SEQ ID NO: 924297 - DNA, 22 bp, Artificial Sequence
  chemically synthesized
agtacagagcaagcggacggga

SEQ ID NO: 924298 - DNA, 22 bp, Artificial Sequence
  chemically synthesized
cccccaggatctgtcccgtccg

SEQ ID NO: 924299 - DNA, 22 bp, Artificial Sequence
  chemically synthesized
gcccccaggatctgtcccgtcc

SEQ ID NO: 924300 - DNA, 22 bp, Artificial Sequence
  chemically synthesized
tgcccccaggatctgtcccgtc

SEQ ID NO: 924301 - DNA, 22 bp, Artificial Sequence
  chemically synthesized
acattttgcccccaggatctgt

SEQ ID NO: 924302 - DNA, 22 bp, Artificial Sequence
  chemically synthesized
acacattcacattttgccccca

SEQ ID NO: 924303 - DNA, 22 bp, Artificial Sequence
  chemically synthesized
ctcacacattcacattttgccc

SEQ ID NO: 924304 - DNA, 22 bp, Artificial Sequence
  chemically synthesized
caagcctgctcacacattcaca

SEQ ID NO: 924305 - DNA, 22 bp, Artificial Sequence
  chemically synthesized
ggggcaaaatgtgaatgtgtga

SEQ ID NO: 924306 - DNA, 22 bp, Artificial Sequence
  chemically synthesized
gtagcactggttcacacggata

SEQ ID NO: 924307 - DNA, 22 bp, Artificial Sequence
  chemically synthesized
tagcactggttcacacggatat

SEQ ID NO: 924308 - DNA, 22 bp, Artificial Sequence
  chemically synthesized
aatgtacccagtatatccgtgt

SEQ ID NO: 924309 - DNA, 22 bp, Artificial Sequence
  chemically synthesized
gttcacacggatatactgggta

SEQ ID NO: 924310 - DNA, 22 bp, Artificial Sequence
  chemically synthesized
acacggatatactgggtacatt

SEQ ID NO: 924311 - DNA, 22 bp, Artificial Sequence
  chemically synthesized
cagtgtgtgcaatatgttaaat

SEQ ID NO: 924312 - DNA, 22 bp, Artificial Sequence
  chemically synthesized
acagtgtgtgcaatatgttaaa

SEQ ID NO: 924313 - DNA, 22 bp, Artificial Sequence
  chemically synthesized
tacagtgtgtgcaatatgttaa

SEQ ID NO: 924314 - DNA, 22 bp, Artificial Sequence
  chemically synthesized
tttacagtgtgtgcaatatgtt

SEQ ID NO: 924315 - DNA, 22 bp, Artificial Sequence
  chemically synthesized
ggtacatttaacatattgcaca

SEQ ID NO: 924316 - DNA, 22 bp, Artificial Sequence
  chemically synthesized
aaatggctctttacagtgtgtg

SEQ ID NO: 924317 - DNA, 22 bp, Artificial Sequence
  chemically synthesized
aacatattgcacacactgtaaa

SEQ ID NO: 924318 - DNA, 22 bp, Artificial Sequence
  chemically synthesized
acatattgcacacactgtaaag

SEQ ID NO: 924319 - DNA, 22 bp, Artificial Sequence
  chemically synthesized
atgactcaaatggctctttaca

SEQ ID NO: 924320 - DNA, 22 bp, Artificial Sequence
  chemically synthesized
aatgactcaaatggctctttac

SEQ ID NO: 924321 - DNA, 22 bp, Artificial Sequence
  chemically synthesized
taatgactcaaatggctcttta

SEQ ID NO: 924322 - DNA, 22 bp, Artificial Sequence
  chemically synthesized
cacacactgtaaagagccattt

SEQ ID NO: 924323 - DNA, 22 bp, Artificial Sequence
  chemically synthesized
taaagagccatttgagtcatta

SEQ ID NO: 924324 - DNA, 22 bp, Artificial Sequence
  chemically synthesized
aaagcgaatattttaatgactc

SEQ ID NO: 924325 - DNA, 22 bp, Artificial Sequence
  chemically synthesized
caaattaaaagcgaatatttta

SEQ ID NO: 924326 - DNA, 22 bp, Artificial Sequence
  chemically synthesized
ctacaaattaaaagcgaatatt

SEQ ID NO: 924327 - DNA, 22 bp, Artificial Sequence
  chemically synthesized
cctacaaattaaaagcgaatat

SEQ ID NO: 924328 - DNA, 22 bp, Artificial Sequence
  chemically synthesized
gagtcattaaaatattcgcttt

SEQ ID NO: 924329 - DNA, 22 bp, Artificial Sequence
  chemically synthesized
agtcattaaaatattcgctttt

SEQ ID NO: 924330 - DNA, 22 bp, Artificial Sequence
  chemically synthesized
tttcctacaaattaaaagcgaa

SEQ ID NO: 924331 - DNA, 22 bp, Artificial Sequence
  chemically synthesized
atttcctacaaattaaaagcga

SEQ ID NO: 924332 - DNA, 22 bp, Artificial Sequence
  chemically synthesized
aaatattcgcttttaatttgta

SEQ ID NO: 924333 - DNA, 22 bp, Artificial Sequence
  chemically synthesized
agcatcttatttcctacaaatt

SEQ ID NO: 924334 - DNA, 22 bp, Artificial Sequence
  chemically synthesized
cagcatcttatttcctacaaat

SEQ ID NO: 924335 - DNA, 22 bp, Artificial Sequence
  chemically synthesized
tcagcatcttatttcctacaaa

SEQ ID NO: 924336 - DNA, 22 bp, Artificial Sequence
  chemically synthesized
ttcagcatcttatttcctacaa

SEQ ID NO: 924337 - DNA, 22 bp, Artificial Sequence
  chemically synthesized
gcttttaatttgtaggaaataa

SEQ ID NO: 924338 - DNA, 22 bp, Artificial Sequence
  chemically synthesized
ttaatttgtaggaaataagatg

SEQ ID NO: 924339 - DNA, 22 bp, Artificial Sequence
  chemically synthesized
taatttgtaggaaataagatgc

SEQ ID NO: 924340 - DNA, 22 bp, Artificial Sequence
  chemically synthesized
aatttgtaggaaataagatgct

SEQ ID NO: 924341 - DNA, 22 bp, Artificial Sequence
  chemically synthesized
atttgtaggaaataagatgctg

SEQ ID NO: 924342 - DNA, 22 bp, Artificial Sequence
  chemically synthesized
aaccaaatagcttttcagcatc

SEQ ID NO: 924343 - DNA, 22 bp, Artificial Sequence
  chemically synthesized
gtaggaaataagatgctgaaaa

SEQ ID NO: 924344 - DNA, 22 bp, Artificial Sequence
  chemically synthesized
caaccaaatagcttttcagcat

SEQ ID NO: 924345 - DNA, 22 bp, Artificial Sequence
  chemically synthesized
taggaaataagatgctgaaaag

SEQ ID NO: 924346 - DNA, 22 bp, Artificial Sequence
  chemically synthesized
tcaaccaaatagcttttcagca

SEQ ID NO: 924347 - DNA, 22 bp, Artificial Sequence
  chemically synthesized
aaaagctatttggttgaaagct

SEQ ID NO: 924348 - DNA, 22 bp, Artificial Sequence
  chemically synthesized
tttggttgaaagctatttggtt

SEQ ID NO: 924349 - DNA, 22 bp, Artificial Sequence
  chemically synthesized
agaccccacccccaaccaaata

SEQ ID NO: 924350 - DNA, 22 bp, Artificial Sequence
  chemically synthesized
ggttgaaagctatttggttggg

SEQ ID NO: 924351 - DNA, 22 bp, Artificial Sequence
  chemically synthesized
gttgaaagctatttggttgggg

SEQ ID NO: 924352 - DNA, 22 bp, Artificial Sequence
  chemically synthesized
aaagctatttggttgggggtgg

SEQ ID NO: 924353 - DNA, 22 bp, Artificial Sequence
  chemically synthesized
caaattcagaccccacccccaa

SEQ ID NO: 924354 - DNA, 22 bp, Artificial Sequence
  chemically synthesized
acaaattcagaccccaccccca

SEQ ID NO: 924355 - DNA, 22 bp, Artificial Sequence
  chemically synthesized
ttacaaattcagaccccacccc

SEQ ID NO: 924356 - DNA, 22 bp, Artificial Sequence
  chemically synthesized
cttacaaattcagaccccaccc

SEQ ID NO: 924357 - DNA, 22 bp, Artificial Sequence
  chemically synthesized
tttggttgggggtggggtctga

SEQ ID NO: 924358 - DNA, 22 bp, Artificial Sequence
  chemically synthesized
gcttcttacaaattcagacccc

SEQ ID NO: 924359 - DNA, 22 bp, Artificial Sequence
  chemically synthesized
ggcttcttacaaattcagaccc

SEQ ID NO: 924360 - DNA, 22 bp, Artificial Sequence
  chemically synthesized
ggttgggggtggggtctgaatt

SEQ ID NO: 924361 - DNA, 22 bp, Artificial Sequence
  chemically synthesized
tggcttcttacaaattcagacc

SEQ ID NO: 924362 - DNA, 22 bp, Artificial Sequence
  chemically synthesized
gttgggggtggggtctgaattt

SEQ ID NO: 924363 - DNA, 22 bp, Artificial Sequence
  chemically synthesized
actttggcttcttacaaattca

SEQ ID NO: 924364 - DNA, 22 bp, Artificial Sequence
  chemically synthesized
ggggtggggtctgaatttgtaa

SEQ ID NO: 924365 - DNA, 22 bp, Artificial Sequence
  chemically synthesized
aactttggcttcttacaaattc

SEQ ID NO: 924366 - DNA, 22 bp, Artificial Sequence
  chemically synthesized
taactttggcttcttacaaatt

SEQ ID NO: 924367 - DNA, 22 bp, Artificial Sequence
  chemically synthesized
tttaactttggcttcttacaaa

SEQ ID NO: 924368 - DNA, 22 bp, Artificial Sequence
  chemically synthesized
ctttaactttggcttcttacaa

SEQ ID NO: 924369 - DNA, 22 bp, Artificial Sequence
  chemically synthesized
tctttaactttggcttcttaca

SEQ ID NO: 924370 - DNA, 22 bp, Artificial Sequence
  chemically synthesized
agttttctttaactttggcttc

SEQ ID NO: 924371 - DNA, 22 bp, Artificial Sequence
  chemically synthesized
aagttttctttaactttggctt

SEQ ID NO: 924372 - DNA, 22 bp, Artificial Sequence
  chemically synthesized
aatttgtaagaagccaaagtta

SEQ ID NO: 924373 - DNA, 22 bp, Artificial Sequence
  chemically synthesized
ttaagttttctttaactttggc

SEQ ID NO: 924374 - DNA, 22 bp, Artificial Sequence
  chemically synthesized
tctcttaagttttctttaactt

SEQ ID NO: 924375 - DNA, 22 bp, Artificial Sequence
  chemically synthesized
gtaagaagccaaagttaaagaa

SEQ ID NO: 924376 - DNA, 22 bp, Artificial Sequence
  chemically synthesized
taagaagccaaagttaaagaaa

SEQ ID NO: 924377 - DNA, 22 bp, Artificial Sequence
  chemically synthesized
ttgtctcttaagttttctttaa

SEQ ID NO: 924378 - DNA, 22 bp, Artificial Sequence
  chemically synthesized
taagacaactgttgtctcttaa

SEQ ID NO: 924379 - DNA, 22 bp, Artificial Sequence
  chemically synthesized
gtaagacaactgttgtctctta

SEQ ID NO: 924380 - DNA, 22 bp, Artificial Sequence
  chemically synthesized
aagaaaacttaagagacaacag

SEQ ID NO: 924381 - DNA, 22 bp, Artificial Sequence
  chemically synthesized
cttgtaagacaactgttgtctc

SEQ ID NO: 924382 - DNA, 22 bp, Artificial Sequence
  chemically synthesized
ccttgtaagacaactgttgtct

SEQ ID NO: 924383 - DNA, 22 bp, Artificial Sequence
  chemically synthesized
tgcgcttccttgtaagacaact

SEQ ID NO: 924384 - DNA, 22 bp, Artificial Sequence
  chemically synthesized
aagagacaacagttgtcttaca

SEQ ID NO: 924385 - DNA, 22 bp, Artificial Sequence
  chemically synthesized
tatgcgcttccttgtaagacaa

SEQ ID NO: 924386 - DNA, 22 bp, Artificial Sequence
  chemically synthesized
agagacaacagttgtcttacaa

SEQ ID NO: 924387 - DNA, 22 bp, Artificial Sequence
  chemically synthesized
ctctatgcgcttccttgtaaga

SEQ ID NO: 924388 - DNA, 22 bp, Artificial Sequence
  chemically synthesized
atattgctctatgcgcttcctt

SEQ ID NO: 924389 - DNA, 22 bp, Artificial Sequence
  chemically synthesized
tcttacaaggaagcgcatagag

SEQ ID NO: 924390 - DNA, 22 bp, Artificial Sequence
  chemically synthesized
gcaattcatattgctctatgcg

SEQ ID NO: 924391 - DNA, 22 bp, Artificial Sequence
  chemically synthesized
acaaggaagcgcatagagcaat

SEQ ID NO: 924392 - DNA, 22 bp, Artificial Sequence
  chemically synthesized
caaggaagcgcatagagcaata

SEQ ID NO: 924393 - DNA, 22 bp, Artificial Sequence
  chemically synthesized
cattagcaattcatattgctct

SEQ ID NO: 924394 - DNA, 22 bp, Artificial Sequence
  chemically synthesized
aaagtctccattagcaattcat

SEQ ID NO: 924395 - DNA, 22 bp, Artificial Sequence
  chemically synthesized
gaaagtctccattagcaattca

SEQ ID NO: 924396 - DNA, 22 bp, Artificial Sequence
  chemically synthesized
ttgaaagtctccattagcaatt

SEQ ID NO: 924397 - DNA, 22 bp, Artificial Sequence
  chemically synthesized
cttgaaagtctccattagcaat

SEQ ID NO: 924398 - DNA, 22 bp, Artificial Sequence
  chemically synthesized
ttcttgaaagtctccattagca

SEQ ID NO: 924399 - DNA, 22 bp, Artificial Sequence
  chemically synthesized
gtcctcttcttgaaagtctcca

SEQ ID NO: 924400 - DNA, 22 bp, Artificial Sequence
  chemically synthesized
gttggtcctcttcttgaaagtc

SEQ ID NO: 924401 - DNA, 22 bp, Artificial Sequence
  chemically synthesized
ctaatggagactttcaagaaga

SEQ ID NO: 924402 - DNA, 22 bp, Artificial Sequence
  chemically synthesized
atggagactttcaagaagagga

SEQ ID NO: 924403 - DNA, 22 bp, Artificial Sequence
  chemically synthesized
aagtaggcctggttggtcctct

SEQ ID NO: 924404 - DNA, 22 bp, Artificial Sequence
  chemically synthesized
attaaagtaggcctggttggtc

SEQ ID NO: 924405 - DNA, 22 bp, Artificial Sequence
  chemically synthesized
tcaagaagaggaccaaccaggc

SEQ ID NO: 924406 - DNA, 22 bp, Artificial Sequence
  chemically synthesized
caagaagaggaccaaccaggcc

SEQ ID NO: 924407 - DNA, 22 bp, Artificial Sequence
  chemically synthesized
aagaagaggaccaaccaggcct

SEQ ID NO: 924408 - DNA, 22 bp, Artificial Sequence
  chemically synthesized
attcattaaagtaggcctggtt

SEQ ID NO: 924409 - DNA, 22 bp, Artificial Sequence
  chemically synthesized
tctaattcattaaagtaggcct

SEQ ID NO: 924410 - DNA, 22 bp, Artificial Sequence
  chemically synthesized
atctaattcattaaagtaggcc

SEQ ID NO: 924411 - DNA, 22 bp, Artificial Sequence
  chemically synthesized
gaaatgagccttatctaattca

SEQ ID NO: 924412 - DNA, 22 bp, Artificial Sequence
  chemically synthesized
attagaaatgagccttatctaa

SEQ ID NO: 924413 - DNA, 22 bp, Artificial Sequence
  chemically synthesized
ctttaatgaattagataaggct

SEQ ID NO: 924414 - DNA, 22 bp, Artificial Sequence
  chemically synthesized
ttgattagaaatgagccttatc

SEQ ID NO: 924415 - DNA, 22 bp, Artificial Sequence
  chemically synthesized
taatgaattagataaggctcat

SEQ ID NO: 924416 - DNA, 22 bp, Artificial Sequence
  chemically synthesized
aatgaattagataaggctcatt

SEQ ID NO: 924417 - DNA, 22 bp, Artificial Sequence
  chemically synthesized
atgaattagataaggctcattt

SEQ ID NO: 924418 - DNA, 22 bp, Artificial Sequence
  chemically synthesized
gataaggctcatttctaatcaa

SEQ ID NO: 924419 - DNA, 22 bp, Artificial Sequence
  chemically synthesized
catgcaaatacacgctgttgat

SEQ ID NO: 924420 - DNA, 22 bp, Artificial Sequence
  chemically synthesized
gcatgcaaatacacgctgttga

SEQ ID NO: 924421 - DNA, 22 bp, Artificial Sequence
  chemically synthesized
tttgcatgcaaatacacgctgt

SEQ ID NO: 924422 - DNA, 22 bp, Artificial Sequence
  chemically synthesized
atttctaatcaacagcgtgtat

SEQ ID NO: 924423 - DNA, 22 bp, Artificial Sequence
  chemically synthesized
attgtttgcatgcaaatacacg

SEQ ID NO: 924424 - DNA, 22 bp, Artificial Sequence
  chemically synthesized
ctaatcaacagcgtgtatttgc

SEQ ID NO: 924425 - DNA, 22 bp, Artificial Sequence
  chemically synthesized
taatcaacagcgtgtatttgca

SEQ ID NO: 924426 - DNA, 22 bp, Artificial Sequence
  chemically synthesized
atcaacagcgtgtatttgcatg

SEQ ID NO: 924427 - DNA, 22 bp, Artificial Sequence
  chemically synthesized
gctcattgtttgcatgcaaata

SEQ ID NO: 924428 - DNA, 22 bp, Artificial Sequence
  chemically synthesized
agctcattgtttgcatgcaaat

SEQ ID NO: 924429 - DNA, 22 bp, Artificial Sequence
  chemically synthesized
aagaccttagctcattgtttgc

SEQ ID NO: 924430 - DNA, 22 bp, Artificial Sequence
  chemically synthesized
aaagaccttagctcattgtttg

SEQ ID NO: 924431 - DNA, 22 bp, Artificial Sequence
  chemically synthesized
tttaaagaccttagctcattgt

SEQ ID NO: 924432 - DNA, 22 bp, Artificial Sequence
  chemically synthesized
ttgtttaaagaccttagctcat

SEQ ID NO: 924433 - DNA, 22 bp, Artificial Sequence
  chemically synthesized
gcatgcaaacaatgagctaagg

SEQ ID NO: 924434 - DNA, 22 bp, Artificial Sequence
  chemically synthesized
catgcaaacaatgagctaaggt

SEQ ID NO: 924435 - DNA, 22 bp, Artificial Sequence
  chemically synthesized
aaggaagaaattattgtttaaa

SEQ ID NO: 924436 - DNA, 22 bp, Artificial Sequence
  chemically synthesized
aaaggaagaaattattgtttaa

SEQ ID NO: 924437 - DNA, 22 bp, Artificial Sequence
  chemically synthesized
aggtctttaaacaataatttct

SEQ ID NO: 924438 - DNA, 22 bp, Artificial Sequence
  chemically synthesized
gtaaatgtacttaaaggaagaa

SEQ ID NO: 924439 - DNA, 22 bp, Artificial Sequence
  chemically synthesized
taaacaataatttcttccttta

SEQ ID NO: 924440 - DNA, 22 bp, Artificial Sequence
  chemically synthesized
aaacaataatttcttcctttaa

SEQ ID NO: 924441 - DNA, 22 bp, Artificial Sequence
  chemically synthesized
aacaataatttcttcctttaag

SEQ ID NO: 924442 - DNA, 22 bp, Artificial Sequence
  chemically synthesized
cttcctttaagtacatttacga

SEQ ID NO: 924443 - DNA, 22 bp, Artificial Sequence
  chemically synthesized
ttcctttaagtacatttacgaa

SEQ ID NO: 924444 - DNA, 22 bp, Artificial Sequence
  chemically synthesized
cctttaagtacatttacgaatg

SEQ ID NO: 924445 - DNA, 22 bp, Artificial Sequence
  chemically synthesized
ctttaagtacatttacgaatgc

SEQ ID NO: 924446 - DNA, 22 bp, Artificial Sequence
  chemically synthesized
taagtacatttacgaatgcctc

SEQ ID NO: 924447 - DNA, 22 bp, Artificial Sequence
  chemically synthesized
aagtacatttacgaatgcctcc

SEQ ID NO: 924448 - DNA, 22 bp, Artificial Sequence
  chemically synthesized
agtacatttacgaatgcctccc

SEQ ID NO: 924449 - DNA, 22 bp, Artificial Sequence
  chemically synthesized
atggtgtaaataagataatggg

SEQ ID NO: 924450 - DNA, 22 bp, Artificial Sequence
  chemically synthesized
acgaatgcctcccattatctta

SEQ ID NO: 924451 - DNA, 22 bp, Artificial Sequence
  chemically synthesized
cgaatgcctcccattatcttat

SEQ ID NO: 924452 - DNA, 22 bp, Artificial Sequence
  chemically synthesized
ccatgcaaattaatggtgtaaa

SEQ ID NO: 924453 - DNA, 22 bp, Artificial Sequence
  chemically synthesized
ccattatcttatttacaccatt

SEQ ID NO: 924454 - DNA, 22 bp, Artificial Sequence
  chemically synthesized
gccatgcaaattaatggtgtaa

SEQ ID NO: 924455 - DNA, 22 bp, Artificial Sequence
  chemically synthesized
gtttgccatgcaaattaatggt

SEQ ID NO: 924456 - DNA, 22 bp, Artificial Sequence
  chemically synthesized
tcttatttacaccattaatttg

SEQ ID NO: 924457 - DNA, 22 bp, Artificial Sequence
  chemically synthesized
tgctggtttgccatgcaaatta

SEQ ID NO: 924458 - DNA, 22 bp, Artificial Sequence
  chemically synthesized
atttacaccattaatttgcatg

SEQ ID NO: 924459 - DNA, 22 bp, Artificial Sequence
  chemically synthesized
tttacaccattaatttgcatgg

SEQ ID NO: 924460 - DNA, 22 bp, Artificial Sequence
  chemically synthesized
acaccattaatttgcatggcaa

SEQ ID NO: 924461 - DNA, 22 bp, Artificial Sequence
  chemically synthesized
caccattaatttgcatggcaaa

SEQ ID NO: 924462 - DNA, 22 bp, Artificial Sequence
  chemically synthesized
gtatataatctatgctggtttg

SEQ ID NO: 924463 - DNA, 22 bp, Artificial Sequence
  chemically synthesized
atttgcatggcaaaccagcata

SEQ ID NO: 924464 - DNA, 22 bp, Artificial Sequence
  chemically synthesized
gcatggcaaaccagcatagatt

SEQ ID NO: 924465 - DNA, 22 bp, Artificial Sequence
  chemically synthesized
catggcaaaccagcatagatta

SEQ ID NO: 924466 - DNA, 22 bp, Artificial Sequence
  chemically synthesized
aaccaaaatgtactagtatata

SEQ ID NO: 924467 - DNA, 22 bp, Artificial Sequence
  chemically synthesized
aaaccaaaatgtactagtatat

SEQ ID NO: 924468 - DNA, 22 bp, Artificial Sequence
  chemically synthesized
ttaaaccaaaatgtactagtat

SEQ ID NO: 924469 - DNA, 22 bp, Artificial Sequence
  chemically synthesized
aattcttaaaccaaaatgtact

SEQ ID NO: 924470 - DNA, 22 bp, Artificial Sequence
  chemically synthesized
tgaattcttaaaccaaaatgta

SEQ ID NO: 924471 - DNA, 22 bp, Artificial Sequence
  chemically synthesized
ctgaattcttaaaccaaaatgt

SEQ ID NO: 924472 - DNA, 22 bp, Artificial Sequence
  chemically synthesized
tatactagtacattttggttta

SEQ ID NO: 924473 - DNA, 22 bp, Artificial Sequence
  chemically synthesized
cttctgaattcttaaaccaaaa

SEQ ID NO: 924474 - DNA, 22 bp, Artificial Sequence
  chemically synthesized
tacttctgaattcttaaaccaa

SEQ ID NO: 924475 - DNA, 22 bp, Artificial Sequence
  chemically synthesized
tctacttctgaattcttaaacc

SEQ ID NO: 924476 - DNA, 22 bp, Artificial Sequence
  chemically synthesized
gtacattttggtttaagaattc

SEQ ID NO: 924477 - DNA, 22 bp, Artificial Sequence
  chemically synthesized
aacctctctacttctgaattct

SEQ ID NO: 924478 - DNA, 22 bp, Artificial Sequence
  chemically synthesized
aaacctctctacttctgaattc

SEQ ID NO: 924479 - DNA, 22 bp, Artificial Sequence
  chemically synthesized
taaacctctctacttctgaatt

SEQ ID NO: 924480 - DNA, 22 bp, Artificial Sequence
  chemically synthesized
tggtttaagaattcagaagtag

SEQ ID NO: 924481 - DNA, 22 bp, Artificial Sequence
  chemically synthesized
ctttaaacctctctacttctga

SEQ ID NO: 924482 - DNA, 22 bp, Artificial Sequence
  chemically synthesized
ggtttaagaattcagaagtaga

SEQ ID NO: 924483 - DNA, 22 bp, Artificial Sequence
  chemically synthesized
gtttaagaattcagaagtagag

SEQ ID NO: 924484 - DNA, 22 bp, Artificial Sequence
  chemically synthesized
ctcctttaaacctctctacttc

SEQ ID NO: 924485 - DNA, 22 bp, Artificial Sequence
  chemically synthesized
aagaattcagaagtagagaggt

SEQ ID NO: 924486 - DNA, 22 bp, Artificial Sequence
  chemically synthesized
ctactcctttaaacctctctac

SEQ ID NO: 924487 - DNA, 22 bp, Artificial Sequence
  chemically synthesized
agaattcagaagtagagaggtt

SEQ ID NO: 924488 - DNA, 22 bp, Artificial Sequence
  chemically synthesized
agttactactcctttaaacctc

SEQ ID NO: 924489 - DNA, 22 bp, Artificial Sequence
  chemically synthesized
agaagtagagaggtttaaagga

SEQ ID NO: 924490 - DNA, 22 bp, Artificial Sequence
  chemically synthesized
atgtacggtcattaagttacta

SEQ ID NO: 924491 - DNA, 22 bp, Artificial Sequence
  chemically synthesized
catgtacggtcattaagttact

SEQ ID NO: 924492 - DNA, 22 bp, Artificial Sequence
  chemically synthesized
aaaggagtagtaacttaatgac

SEQ ID NO: 924493 - DNA, 22 bp, Artificial Sequence
  chemically synthesized
aaggagtagtaacttaatgacc

SEQ ID NO: 924494 - DNA, 22 bp, Artificial Sequence
  chemically synthesized
tgtgagacttcatgtacggtca

SEQ ID NO: 924495 - DNA, 22 bp, Artificial Sequence
  chemically synthesized
gtgtgagacttcatgtacggtc

SEQ ID NO: 924496 - DNA, 22 bp, Artificial Sequence
  chemically synthesized
ttgtgtgagacttcatgtacgg

SEQ ID NO: 924497 - DNA, 22 bp, Artificial Sequence
  chemically synthesized
cttgtgtgagacttcatgtacg

SEQ ID NO: 924498 - DNA, 22 bp, Artificial Sequence
  chemically synthesized
aatgaccgtacatgaagtctca

SEQ ID NO: 924499 - DNA, 22 bp, Artificial Sequence
  chemically synthesized
atgaccgtacatgaagtctcac

SEQ ID NO: 924500 - DNA, 22 bp, Artificial Sequence
  chemically synthesized
aaaagcccttcttgtgtgagac

SEQ ID NO: 924501 - DNA, 22 bp, Artificial Sequence
  chemically synthesized
gacatgttaaaaagcccttctt

SEQ ID NO: 924502 - DNA, 22 bp, Artificial Sequence
  chemically synthesized
acacaagaagggctttttaaca

SEQ ID NO: 924503 - DNA, 22 bp, Artificial Sequence
  chemically synthesized
aaagtaagtctagacatgttaa

SEQ ID NO: 924504 - DNA, 22 bp, Artificial Sequence
  chemically synthesized
tttaacatgtctagacttactt

SEQ ID NO: 924505 - DNA, 22 bp, Artificial Sequence
  chemically synthesized
ttaacatgtctagacttacttt

SEQ ID NO: 924506 - DNA, 22 bp, Artificial Sequence
  chemically synthesized
taacatgtctagacttactttt

SEQ ID NO: 924507 - DNA, 22 bp, Artificial Sequence
  chemically synthesized
aacatgtctagacttactttta

SEQ ID NO: 924508 - DNA, 22 bp, Artificial Sequence
  chemically synthesized
acatgtctagacttacttttaa

SEQ ID NO: 924509 - DNA, 22 bp, Artificial Sequence
  chemically synthesized
agaatacatggaagttaaaagt

SEQ ID NO: 924510 - DNA, 22 bp, Artificial Sequence
  chemically synthesized
cagaatacatggaagttaaaag

SEQ ID NO: 924511 - DNA, 22 bp, Artificial Sequence
  chemically synthesized
tcagaatacatggaagttaaaa

SEQ ID NO: 924512 - DNA, 22 bp, Artificial Sequence
  chemically synthesized
tttcagaatacatggaagttaa

SEQ ID NO: 924513 - DNA, 22 bp, Artificial Sequence
  chemically synthesized
gacttacttttaacttccatgt

SEQ ID NO: 924514 - DNA, 22 bp, Artificial Sequence
  chemically synthesized
acttttaacttccatgtattct

SEQ ID NO: 924515 - DNA, 22 bp, Artificial Sequence
  chemically synthesized
cttttaacttccatgtattctg

SEQ ID NO: 924516 - DNA, 22 bp, Artificial Sequence
  chemically synthesized
acaaatctctttcagaatacat

SEQ ID NO: 924517 - DNA, 22 bp, Artificial Sequence
  chemically synthesized
gacaaatctctttcagaataca

SEQ ID NO: 924518 - DNA, 22 bp, Artificial Sequence
  chemically synthesized
ttaacttccatgtattctgaaa

SEQ ID NO: 924519 - DNA, 22 bp, Artificial Sequence
  chemically synthesized
ttgacaaatctctttcagaata

SEQ ID NO: 924520 - DNA, 22 bp, Artificial Sequence
  chemically synthesized
taacttccatgtattctgaaag

SEQ ID NO: 924521 - DNA, 22 bp, Artificial Sequence
  chemically synthesized
aacttccatgtattctgaaaga

SEQ ID NO: 924522 - DNA, 22 bp, Artificial Sequence
  chemically synthesized
acttccatgtattctgaaagag

SEQ ID NO: 924523 - DNA, 22 bp, Artificial Sequence
  chemically synthesized
ccatgtattctgaaagagattt

SEQ ID NO: 924524 - DNA, 22 bp, Artificial Sequence
  chemically synthesized
catgtattctgaaagagatttg

SEQ ID NO: 924525 - DNA, 22 bp, Artificial Sequence
  chemically synthesized
gaaatgattcttgacaaatctc

SEQ ID NO: 924526 - DNA, 22 bp, Artificial Sequence
  chemically synthesized
ggaaatgattcttgacaaatct

SEQ ID NO: 924527 - DNA, 22 bp, Artificial Sequence
  chemically synthesized
ccttggaaatgattcttgacaa

SEQ ID NO: 924528 - DNA, 22 bp, Artificial Sequence
  chemically synthesized
tgaaagagatttgtcaagaatc

SEQ ID NO: 924529 - DNA, 22 bp, Artificial Sequence
  chemically synthesized
aaagagatttgtcaagaatcat

SEQ ID NO: 924530 - DNA, 22 bp, Artificial Sequence
  chemically synthesized
agattaccttggaaatgattct

SEQ ID NO: 924531 - DNA, 22 bp, Artificial Sequence
  chemically synthesized
cagattaccttggaaatgattc

SEQ ID NO: 924532 - DNA, 22 bp, Artificial Sequence
  chemically synthesized
tcagattaccttggaaatgatt

SEQ ID NO: 924533 - DNA, 22 bp, Artificial Sequence
  chemically synthesized
gtcaagaatcatttccaaggta

SEQ ID NO: 924534 - DNA, 22 bp, Artificial Sequence
  chemically synthesized
tcaagaatcatttccaaggtaa

SEQ ID NO: 924535 - DNA, 22 bp, Artificial Sequence
  chemically synthesized
ccaaggtaatctgaaaatatta

SEQ ID NO: 924536 - DNA, 22 bp, Artificial Sequence
  chemically synthesized
caaggtaatctgaaaatattat

SEQ ID NO: 924537 - DNA, 22 bp, Artificial Sequence
  chemically synthesized
gcaagcagtcccaaaggagata

SEQ ID NO: 924538 - DNA, 22 bp, Artificial Sequence
  chemically synthesized
tggcaagcagtcccaaaggaga

SEQ ID NO: 924539 - DNA, 22 bp, Artificial Sequence
  chemically synthesized
ctggcaagcagtcccaaaggag

SEQ ID NO: 924540 - DNA, 22 bp, Artificial Sequence
  chemically synthesized
tctggcaagcagtcccaaagga

SEQ ID NO: 924541 - DNA, 22 bp, Artificial Sequence
  chemically synthesized
aaaatattatctcctttgggac

SEQ ID NO: 924542 - DNA, 22 bp, Artificial Sequence
  chemically synthesized
tctcctttgggactgcttgcca

SEQ ID NO: 924543 - DNA, 22 bp, Artificial Sequence
  chemically synthesized
ctttgggactgcttgccagaaa

SEQ ID NO: 924544 - DNA, 22 bp, Artificial Sequence
  chemically synthesized
tgggactgcttgccagaaaggt

SEQ ID NO: 924545 - DNA, 22 bp, Artificial Sequence
  chemically synthesized
gggactgcttgccagaaaggtg

SEQ ID NO: 924546 - DNA, 22 bp, Artificial Sequence
  chemically synthesized
ggactgcttgccagaaaggtgc

SEQ ID NO: 924547 - DNA, 22 bp, Artificial Sequence
  chemically synthesized
aatggaatgtgtgcacctttct

SEQ ID NO: 924548 - DNA, 22 bp, Artificial Sequence
  chemically synthesized
tcaatggaatgtgtgcaccttt

SEQ ID NO: 924549 - DNA, 22 bp, Artificial Sequence
  chemically synthesized
ctcaatggaatgtgtgcacctt

SEQ ID NO: 924550 - DNA, 22 bp, Artificial Sequence
  chemically synthesized
cttgccagaaaggtgcacacat

SEQ ID NO: 924551 - DNA, 22 bp, Artificial Sequence
  chemically synthesized
gccagaaaggtgcacacattcc

SEQ ID NO: 924552 - DNA, 22 bp, Artificial Sequence
  chemically synthesized
ccagaaaggtgcacacattcca

SEQ ID NO: 924553 - DNA, 22 bp, Artificial Sequence
  chemically synthesized
ggtagtagccccttctcaatgg

SEQ ID NO: 924554 - DNA, 22 bp, Artificial Sequence
  chemically synthesized
cattgagaaggggctactaccc

SEQ ID NO: 924555 - DNA, 22 bp, Artificial Sequence
  chemically synthesized
agaaggggctactacccagatg

SEQ ID NO: 924556 - DNA, 22 bp, Artificial Sequence
  chemically synthesized
ctacccagatgtacgtttctac

SEQ ID NO: 924557 - DNA, 22 bp, Artificial Sequence
  chemically synthesized
gaggtgaatagtacgtagaaac

SEQ ID NO: 924558 - DNA, 22 bp, Artificial Sequence
  chemically synthesized
cccagatgtacgtttctacgta

SEQ ID NO: 924559 - DNA, 22 bp, Artificial Sequence
  chemically synthesized
agaggtgaatagtacgtagaaa

SEQ ID NO: 924560 - DNA, 22 bp, Artificial Sequence
  chemically synthesized
tagaggtgaatagtacgtagaa

SEQ ID NO: 924561 - DNA, 22 bp, Artificial Sequence
  chemically synthesized
ttagaggtgaatagtacgtaga

SEQ ID NO: 924562 - DNA, 22 bp, Artificial Sequence
  chemically synthesized
cttttagaggtgaatagtacgt

SEQ ID NO: 924563 - DNA, 22 bp, Artificial Sequence
  chemically synthesized
gttacttttagaggtgaatagt

SEQ ID NO: 924564 - DNA, 22 bp, Artificial Sequence
  chemically synthesized
tggttacttttagaggtgaata

SEQ ID NO: 924565 - DNA, 22 bp, Artificial Sequence
  chemically synthesized
ctacgtactattcacctctaaa

SEQ ID NO: 924566 - DNA, 22 bp, Artificial Sequence
  chemically synthesized
tacgtactattcacctctaaaa

SEQ ID NO: 924567 - DNA, 22 bp, Artificial Sequence
  chemically synthesized
cgtactattcacctctaaaagt

SEQ ID NO: 924568 - DNA, 22 bp, Artificial Sequence
  chemically synthesized
aaggaactctggttacttttag

SEQ ID NO: 924569 - DNA, 22 bp, Artificial Sequence
  chemically synthesized
caaggaactctggttactttta

SEQ ID NO: 924570 - DNA, 22 bp, Artificial Sequence
  chemically synthesized
tcaaggaactctggttactttt

SEQ ID NO: 924571 - DNA, 22 bp, Artificial Sequence
  chemically synthesized
ttcaaggaactctggttacttt

SEQ ID NO: 924572 - DNA, 22 bp, Artificial Sequence
  chemically synthesized
tttcaaggaactctggttactt

SEQ ID NO: 924573 - DNA, 22 bp, Artificial Sequence
  chemically synthesized
ttcacctctaaaagtaaccaga

SEQ ID NO: 924574 - DNA, 22 bp, Artificial Sequence
  chemically synthesized
ttttcaaggaactctggttact

SEQ ID NO: 924575 - DNA, 22 bp, Artificial Sequence
  chemically synthesized
acctctaaaagtaaccagagtt

SEQ ID NO: 924576 - DNA, 22 bp, Artificial Sequence
  chemically synthesized
cccatttttttcaaggaactct

SEQ ID NO: 924577 - DNA, 22 bp, Artificial Sequence
  chemically synthesized
taaaagtaaccagagttccttg

SEQ ID NO: 924578 - DNA, 22 bp, Artificial Sequence
  chemically synthesized
aaagtaaccagagttccttgaa

SEQ ID NO: 924579 - DNA, 22 bp, Artificial Sequence
  chemically synthesized
gaattacccatttttttcaagg

SEQ ID NO: 924580 - DNA, 22 bp, Artificial Sequence
  chemically synthesized
agaattacccatttttttcaag

SEQ ID NO: 924581 - DNA, 22 bp, Artificial Sequence
  chemically synthesized
tcccagatttagaattacccat

SEQ ID NO: 924582 - DNA, 22 bp, Artificial Sequence
  chemically synthesized
cttgaaaaaaatgggtaattct

SEQ ID NO: 924583 - DNA, 22 bp, Artificial Sequence
  chemically synthesized
cctatcccagatttagaattac

SEQ ID NO: 924584 - DNA, 22 bp, Artificial Sequence
  chemically synthesized
gaaaaaaatgggtaattctaaa

SEQ ID NO: 924585 - DNA, 22 bp, Artificial Sequence
  chemically synthesized
gcctatcccagatttagaatta

SEQ ID NO: 924586 - DNA, 22 bp, Artificial Sequence
  chemically synthesized
aaaaaaatgggtaattctaaat

SEQ ID NO: 924587 - DNA, 22 bp, Artificial Sequence
  chemically synthesized
tgcctatcccagatttagaatt

SEQ ID NO: 924588 - DNA, 22 bp, Artificial Sequence
  chemically synthesized
gactttgcctatcccagattta

SEQ ID NO: 924589 - DNA, 22 bp, Artificial Sequence
  chemically synthesized
ggactttgcctatcccagattt

SEQ ID NO: 924590 - DNA, 22 bp, Artificial Sequence
  chemically synthesized
accttggactttgcctatccca

SEQ ID NO: 924591 - DNA, 22 bp, Artificial Sequence
  chemically synthesized
taaatctgggataggcaaagtc

SEQ ID NO: 924592 - DNA, 22 bp, Artificial Sequence
  chemically synthesized
aatctgggataggcaaagtcca

SEQ ID NO: 924593 - DNA, 22 bp, Artificial Sequence
  chemically synthesized
tcccaggctcaccttggacttt

SEQ ID NO: 924594 - DNA, 22 bp, Artificial Sequence
  chemically synthesized
ggataggcaaagtccaaggtga

SEQ ID NO: 924595 - DNA, 22 bp, Artificial Sequence
  chemically synthesized
aattgtcccaggctcaccttgg

SEQ ID NO: 924596 - DNA, 22 bp, Artificial Sequence
  chemically synthesized
ctcaattgtcccaggctcacct

SEQ ID NO: 924597 - DNA, 22 bp, Artificial Sequence
  chemically synthesized
ctgctcaattgtcccaggctca

SEQ ID NO: 924598 - DNA, 22 bp, Artificial Sequence
  chemically synthesized
cctgctcaattgtcccaggctc

SEQ ID NO: 924599 - DNA, 22 bp, Artificial Sequence
  chemically synthesized
cccagagcttcctgctcaattg

SEQ ID NO: 924600 - DNA, 22 bp, Artificial Sequence
  chemically synthesized
gcccagagcttcctgctcaatt

SEQ ID NO: 924601 - DNA, 22 bp, Artificial Sequence
  chemically synthesized
ttgcccagagcttcctgctcaa

SEQ ID NO: 924602 - DNA, 22 bp, Artificial Sequence
  chemically synthesized
ttcttgcccagagcttcctgct

SEQ ID NO: 924603 - DNA, 22 bp, Artificial Sequence
  chemically synthesized
ggacaattgagcaggaagctct

SEQ ID NO: 924604 - DNA, 22 bp, Artificial Sequence
  chemically synthesized
ttattcttgcccagagcttcct

SEQ ID NO: 924605 - DNA, 22 bp, Artificial Sequence
  chemically synthesized
cagttattattcttgcccagag

SEQ ID NO: 924606 - DNA, 22 bp, Artificial Sequence
  chemically synthesized
agcaggaagctctgggcaagaa

SEQ ID NO: 924607 - DNA, 22 bp, Artificial Sequence
  chemically synthesized
tgaattacagttattattcttg

SEQ ID NO: 924608 - DNA, 22 bp, Artificial Sequence
  chemically synthesized
ttatgaattacagttattattc

SEQ ID NO: 924609 - DNA, 22 bp, Artificial Sequence
  chemically synthesized
tgggcaagaataataactgtaa

SEQ ID NO: 924610 - DNA, 22 bp, Artificial Sequence
  chemically synthesized
ggcaagaataataactgtaatt

SEQ ID NO: 924611 - DNA, 22 bp, Artificial Sequence
  chemically synthesized
aatatattattatgaattacag

SEQ ID NO: 924612 - DNA, 22 bp, Artificial Sequence
  chemically synthesized
ttcaatatattattatgaatta

SEQ ID NO: 924613 - DNA, 22 bp, Artificial Sequence
  chemically synthesized
attcaatatattattatgaatt

SEQ ID NO: 924614 - DNA, 22 bp, Artificial Sequence
  chemically synthesized
tttattcaatatattattatga

SEQ ID NO: 924615 - DNA, 22 bp, Artificial Sequence
  chemically synthesized
atttattcaatatattattatg

SEQ ID NO: 924616 - DNA, 22 bp, Artificial Sequence
  chemically synthesized
tatttattcaatatattattat

SEQ ID NO: 924617 - DNA, 22 bp, Artificial Sequence
  chemically synthesized
ttatttattcaatatattatta

SEQ ID NO: 924618 - DNA, 22 bp, Artificial Sequence
  chemically synthesized
taattcataataatatattgaa

SEQ ID NO: 924619 - DNA, 22 bp, Artificial Sequence
  chemically synthesized
ataaatttttatttattcaata

SEQ ID NO: 924620 - DNA, 22 bp, Artificial Sequence
  chemically synthesized
ataataatatattgaataaata

SEQ ID NO: 924621 - DNA, 22 bp, Artificial Sequence
  chemically synthesized
tgtcaaaatggactcataaatt

SEQ ID NO: 924622 - DNA, 22 bp, Artificial Sequence
  chemically synthesized
atgtcaaaatggactcataaat

SEQ ID NO: 924623 - DNA, 22 bp, Artificial Sequence
  chemically synthesized
aataaataaaaatttatgagtc

SEQ ID NO: 924624 - DNA, 22 bp, Artificial Sequence
  chemically synthesized
tatttatgtcaaaatggactca

SEQ ID NO: 924625 - DNA, 22 bp, Artificial Sequence
  chemically synthesized
tatatttatgtcaaaatggact

SEQ ID NO: 924626 - DNA, 22 bp, Artificial Sequence
  chemically synthesized
ctctatatttatgtcaaaatgg

SEQ ID NO: 924627 - DNA, 22 bp, Artificial Sequence
  chemically synthesized
cctctatatttatgtcaaaatg

SEQ ID NO: 924628 - DNA, 22 bp, Artificial Sequence
  chemically synthesized
tcctctatatttatgtcaaaat

SEQ ID NO: 924629 - DNA, 22 bp, Artificial Sequence
  chemically synthesized
ttcctctatatttatgtcaaaa

SEQ ID NO: 924630 - DNA, 22 bp, Artificial Sequence
  chemically synthesized
atgagtccattttgacataaat

SEQ ID NO: 924631 - DNA, 22 bp, Artificial Sequence
  chemically synthesized
tgagtccattttgacataaata

SEQ ID NO: 924632 - DNA, 22 bp, Artificial Sequence
  chemically synthesized
tgacataaatatagaggaaaaa

SEQ ID NO: 924633 - DNA, 22 bp, Artificial Sequence
  chemically synthesized
gacataaatatagaggaaaaac

SEQ ID NO: 924634 - DNA, 22 bp, Artificial Sequence
  chemically synthesized
acataaatatagaggaaaaacc

SEQ ID NO: 924635 - DNA, 22 bp, Artificial Sequence
  chemically synthesized
aaaaaaaaaaaaaaaaaaggtt

SEQ ID NO: 924636 - DNA, 22 bp, Artificial Sequence
  chemically synthesized
gaaaaaaaaaaaaaaaaaaggt

SEQ ID NO: 924637 - DNA, 22 bp, Artificial Sequence
  chemically synthesized
tttgaaaaaaaaaaaaaaaaaa

SEQ ID NO: 924638 - DNA, 22 bp, Artificial Sequence
  chemically synthesized
tgtttgaaaaaaaaaaaaaaaa

SEQ ID NO: 924639 - DNA, 22 bp, Artificial Sequence
  chemically synthesized
ctgtttgaaaaaaaaaaaaaaa

SEQ ID NO: 924640 - DNA, 22 bp, Artificial Sequence
  chemically synthesized
ttctgtttgaaaaaaaaaaaaa

SEQ ID NO: 924641 - DNA, 22 bp, Artificial Sequence
  chemically synthesized
cttctgtttgaaaaaaaaaaaa

SEQ ID NO: 924642 - DNA, 22 bp, Artificial Sequence
  chemically synthesized
tcttctgtttgaaaaaaaaaaa

SEQ ID NO: 924643 - DNA, 22 bp, Artificial Sequence
  chemically synthesized
gctttcttctgtttgaaaaaaa

SEQ ID NO: 924644 - DNA, 22 bp, Artificial Sequence
  chemically synthesized
ttttttttttttttttcaaaca

SEQ ID NO: 924645 - DNA, 22 bp, Artificial Sequence
  chemically synthesized
tttttttttttttttcaaacag

SEQ ID NO: 924646 - DNA, 22 bp, Artificial Sequence
  chemically synthesized
ttttttttttttttcaaacaga

SEQ ID NO: 924647 - DNA, 22 bp, Artificial Sequence
  chemically synthesized
tttttttttttttcaaacagaa

SEQ ID NO: 924648 - DNA, 22 bp, Artificial Sequence
  chemically synthesized
ttttttttttttcaaacagaag

SEQ ID NO: 924649 - DNA, 22 bp, Artificial Sequence
  chemically synthesized
ccagctggctttcttctgtttg

SEQ ID NO: 924650 - DNA, 22 bp, Artificial Sequence
  chemically synthesized
tttttttttttcaaacagaaga

SEQ ID NO: 924651 - DNA, 22 bp, Artificial Sequence
  chemically synthesized
accagctggctttcttctgttt

SEQ ID NO: 924652 - DNA, 22 bp, Artificial Sequence
  chemically synthesized
ttttttttttcaaacagaagaa

SEQ ID NO: 924653 - DNA, 22 bp, Artificial Sequence
  chemically synthesized
tttttttttcaaacagaagaaa

SEQ ID NO: 924654 - DNA, 22 bp, Artificial Sequence
  chemically synthesized
ttttttttcaaacagaagaaag

SEQ ID NO: 924655 - DNA, 22 bp, Artificial Sequence
  chemically synthesized
tttttttcaaacagaagaaagc

SEQ ID NO: 924656 - DNA, 22 bp, Artificial Sequence
  chemically synthesized
ttttttcaaacagaagaaagcc

SEQ ID NO: 924657 - DNA, 22 bp, Artificial Sequence
  chemically synthesized
tttttcaaacagaagaaagcca

SEQ ID NO: 924658 - DNA, 22 bp, Artificial Sequence
  chemically synthesized
acatttaccagctggctttctt

SEQ ID NO: 924659 - DNA, 22 bp, Artificial Sequence
  chemically synthesized
ttttcaaacagaagaaagccag

SEQ ID NO: 924660 - DNA, 22 bp, Artificial Sequence
  chemically synthesized
aacatttaccagctggctttct

SEQ ID NO: 924661 - DNA, 22 bp, Artificial Sequence
  chemically synthesized
tttcaaacagaagaaagccagc

SEQ ID NO: 924662 - DNA, 22 bp, Artificial Sequence
  chemically synthesized
ttcaaacagaagaaagccagct

SEQ ID NO: 924663 - DNA, 22 bp, Artificial Sequence
  chemically synthesized
tcaaacagaagaaagccagctg

SEQ ID NO: 924664 - DNA, 22 bp, Artificial Sequence
  chemically synthesized
caaacagaagaaagccagctgg

SEQ ID NO: 924665 - DNA, 22 bp, Artificial Sequence
  chemically synthesized
aaacagaagaaagccagctggt

SEQ ID NO: 924666 - DNA, 22 bp, Artificial Sequence
  chemically synthesized
acatgatcttaacatttaccag

SEQ ID NO: 924667 - DNA, 22 bp, Artificial Sequence
  chemically synthesized
atctgacatgatcttaacattt

SEQ ID NO: 924668 - DNA, 22 bp, Artificial Sequence
  chemically synthesized
ctaatctgacatgatcttaaca

SEQ ID NO: 924669 - DNA, 22 bp, Artificial Sequence
  chemically synthesized
cctaatctgacatgatcttaac

SEQ ID NO: 924670 - DNA, 22 bp, Artificial Sequence
  chemically synthesized
tcctaatctgacatgatcttaa

SEQ ID NO: 924671 - DNA, 22 bp, Artificial Sequence
  chemically synthesized
gtaaatgttaagatcatgtcag

SEQ ID NO: 924672 - DNA, 22 bp, Artificial Sequence
  chemically synthesized
caaaatggaggttttcctaatc

SEQ ID NO: 924673 - DNA, 22 bp, Artificial Sequence
  chemically synthesized
agatcatgtcagattaggaaaa

SEQ ID NO: 924674 - DNA, 22 bp, Artificial Sequence
  chemically synthesized
gcaaaatggaggttttcctaat

SEQ ID NO: 924675 - DNA, 22 bp, Artificial Sequence
  chemically synthesized
gggcttgcaaaatggaggtttt

SEQ ID NO: 924676 - DNA, 22 bp, Artificial Sequence
  chemically synthesized
cactggggcttgcaaaatggag

SEQ ID NO: 924677 - DNA, 22 bp, Artificial Sequence
  chemically synthesized
ttacactggggcttgcaaaatg

SEQ ID NO: 924678 - DNA, 22 bp, Artificial Sequence
  chemically synthesized
ggaaaacctccattttgcaagc

SEQ ID NO: 924679 - DNA, 22 bp, Artificial Sequence
  chemically synthesized
agttattacactggggcttgca

SEQ ID NO: 924680 - DNA, 22 bp, Artificial Sequence
  chemically synthesized
actcagttattacactggggct

SEQ ID NO: 924681 - DNA, 22 bp, Artificial Sequence
  chemically synthesized
cattttgcaagccccagtgtaa

SEQ ID NO: 924682 - DNA, 22 bp, Artificial Sequence
  chemically synthesized
cctaactcagttattacactgg

SEQ ID NO: 924683 - DNA, 22 bp, Artificial Sequence
  chemically synthesized
ccctaactcagttattacactg

SEQ ID NO: 924684 - DNA, 22 bp, Artificial Sequence
  chemically synthesized
tgcaagccccagtgtaataact

SEQ ID NO: 924685 - DNA, 22 bp, Artificial Sequence
  chemically synthesized
gcaagccccagtgtaataactg

SEQ ID NO: 924686 - DNA, 22 bp, Artificial Sequence
  chemically synthesized
caagccccagtgtaataactga

SEQ ID NO: 924687 - DNA, 22 bp, Artificial Sequence
  chemically synthesized
atgatccttccctaactcagtt

SEQ ID NO: 924688 - DNA, 22 bp, Artificial Sequence
  chemically synthesized
gtatccattgatgatccttccc

SEQ ID NO: 924689 - DNA, 22 bp, Artificial Sequence
  chemically synthesized
agtatccattgatgatccttcc

SEQ ID NO: 924690 - DNA, 22 bp, Artificial Sequence
  chemically synthesized
tagtatccattgatgatccttc

SEQ ID NO: 924691 - DNA, 22 bp, Artificial Sequence
  chemically synthesized
agttagggaaggatcatcaatg

SEQ ID NO: 924692 - DNA, 22 bp, Artificial Sequence
  chemically synthesized
atggctttagtatccattgatg

SEQ ID NO: 924693 - DNA, 22 bp, Artificial Sequence
  chemically synthesized
gggaaggatcatcaatggatac

SEQ ID NO: 924694 - DNA, 22 bp, Artificial Sequence
  chemically synthesized
ataaatcatctaatggctttag

SEQ ID NO: 924695 - DNA, 22 bp, Artificial Sequence
  chemically synthesized
gcaattaataaatcatctaatg

SEQ ID NO: 924696 - DNA, 22 bp, Artificial Sequence
  chemically synthesized
cgcaattaataaatcatctaat

SEQ ID NO: 924697 - DNA, 22 bp, Artificial Sequence
  chemically synthesized
ttcgcaattaataaatcatcta

SEQ ID NO: 924698 - DNA, 22 bp, Artificial Sequence
  chemically synthesized
cttcgcaattaataaatcatct

SEQ ID NO: 924699 - DNA, 22 bp, Artificial Sequence
  chemically synthesized
tcttcgcaattaataaatcatc

SEQ ID NO: 924700 - DNA, 22 bp, Artificial Sequence
  chemically synthesized
ttcttcgcaattaataaatcat

SEQ ID NO: 924701 - DNA, 22 bp, Artificial Sequence
  chemically synthesized
tttcttcgcaattaataaatca

SEQ ID NO: 924702 - DNA, 22 bp, Artificial Sequence
  chemically synthesized
aagccattagatgatttattaa

SEQ ID NO: 924703 - DNA, 22 bp, Artificial Sequence
  chemically synthesized
gatgatttattaattgcgaaga

SEQ ID NO: 924704 - DNA, 22 bp, Artificial Sequence
  chemically synthesized
taatgtcacattttttcttcgc

SEQ ID NO: 924705 - DNA, 22 bp, Artificial Sequence
  chemically synthesized
attaattgcgaagaaaaaatgt

SEQ ID NO: 924706 - DNA, 22 bp, Artificial Sequence
  chemically synthesized
cattataatgtcacattttttc

SEQ ID NO: 924707 - DNA, 22 bp, Artificial Sequence
  chemically synthesized
ttaattgcgaagaaaaaatgtg

SEQ ID NO: 924708 - DNA, 22 bp, Artificial Sequence
  chemically synthesized
gcattataatgtcacatttttt

SEQ ID NO: 924709 - DNA, 22 bp, Artificial Sequence
  chemically synthesized
attgcgaagaaaaaatgtgaca

SEQ ID NO: 924710 - DNA, 22 bp, Artificial Sequence
  chemically synthesized
cgaagaaaaaatgtgacattat

SEQ ID NO: 924711 - DNA, 22 bp, Artificial Sequence
  chemically synthesized
acagatcttgcattataatgtc

SEQ ID NO: 924712 - DNA, 22 bp, Artificial Sequence
  chemically synthesized
aggtggtgactgacagatcttg

SEQ ID NO: 924713 - DNA, 22 bp, Artificial Sequence
  chemically synthesized
caggtggtgactgacagatctt

SEQ ID NO: 924714 - DNA, 22 bp, Artificial Sequence
  chemically synthesized
cttcaggtggtgactgacagat

SEQ ID NO: 924715 - DNA, 22 bp, Artificial Sequence
  chemically synthesized
gcttcaggtggtgactgacaga

SEQ ID NO: 924716 - DNA, 22 bp, Artificial Sequence
  chemically synthesized
taatgcaagatctgtcagtcac

SEQ ID NO: 924717 - DNA, 22 bp, Artificial Sequence
  chemically synthesized
cttgcttcaggtggtgactgac

SEQ ID NO: 924718 - DNA, 22 bp, Artificial Sequence
  chemically synthesized
ttacttgcttcaggtggtgact

SEQ ID NO: 924719 - DNA, 22 bp, Artificial Sequence
  chemically synthesized
attacttgcttcaggtggtgac

SEQ ID NO: 924720 - DNA, 22 bp, Artificial Sequence
  chemically synthesized
tattacttgcttcaggtggtga

SEQ ID NO: 924721 - DNA, 22 bp, Artificial Sequence
  chemically synthesized
tcagtcaccacctgaagcaagt

SEQ ID NO: 924722 - DNA, 22 bp, Artificial Sequence
  chemically synthesized
caaagttttattacttgcttca

SEQ ID NO: 924723 - DNA, 22 bp, Artificial Sequence
  chemically synthesized
aatgctgcaaagttttattact

SEQ ID NO: 924724 - DNA, 22 bp, Artificial Sequence
  chemically synthesized
actaaatgctgcaaagttttat

SEQ ID NO: 924725 - DNA, 22 bp, Artificial Sequence
  chemically synthesized
aagcaagtaataaaactttgca

SEQ ID NO: 924726 - DNA, 22 bp, Artificial Sequence
  chemically synthesized
tgcagcatttagtgagactact

SEQ ID NO: 924727 - DNA, 22 bp, Artificial Sequence
  chemically synthesized
gcagcatttagtgagactactt

SEQ ID NO: 924728 - DNA, 22 bp, Artificial Sequence
  chemically synthesized
cagcatttagtgagactacttc

SEQ ID NO: 924729 - DNA, 22 bp, Artificial Sequence
  chemically synthesized
agtgagactacttcatatgatg

SEQ ID NO: 924730 - DNA, 22 bp, Artificial Sequence
  chemically synthesized
gtgagactacttcatatgatgc

SEQ ID NO: 924731 - DNA, 22 bp, Artificial Sequence
  chemically synthesized
cgtcacatcaggaggtgcatca

SEQ ID NO: 924732 - DNA, 22 bp, Artificial Sequence
  chemically synthesized
cttcatatgatgcacctcctga

SEQ ID NO: 924733 - DNA, 22 bp, Artificial Sequence
  chemically synthesized
tattacgtcacatcaggaggtg

SEQ ID NO: 924734 - DNA, 22 bp, Artificial Sequence
  chemically synthesized
gtattacgtcacatcaggaggt

SEQ ID NO: 924735 - DNA, 22 bp, Artificial Sequence
  chemically synthesized
tgtattacgtcacatcaggagg

SEQ ID NO: 924736 - DNA, 22 bp, Artificial Sequence
  chemically synthesized
catatgatgcacctcctgatgt

SEQ ID NO: 924737 - DNA, 22 bp, Artificial Sequence
  chemically synthesized
atatgatgcacctcctgatgtg

SEQ ID NO: 924738 - DNA, 22 bp, Artificial Sequence
  chemically synthesized
tgtattttgtattacgtcacat

SEQ ID NO: 924739 - DNA, 22 bp, Artificial Sequence
  chemically synthesized
ctgatgtgacgtaatacaaaat

SEQ ID NO: 924740 - DNA, 22 bp, Artificial Sequence
  chemically synthesized
atgtgacgtaatacaaaataca

SEQ ID NO: 924741 - DNA, 22 bp, Artificial Sequence
  chemically synthesized
atatgagatgctgtgtattttg

SEQ ID NO: 924742 - DNA, 22 bp, Artificial Sequence
  chemically synthesized
catatgagatgctgtgtatttt

SEQ ID NO: 924743 - DNA, 22 bp, Artificial Sequence
  chemically synthesized
gcgagaatacttcatatgagat

SEQ ID NO: 924744 - DNA, 22 bp, Artificial Sequence
  chemically synthesized
ggcgagaatacttcatatgaga

SEQ ID NO: 924745 - DNA, 22 bp, Artificial Sequence
  chemically synthesized
atatgaagtattctcgccaaac

SEQ ID NO: 924746 - DNA, 22 bp, Artificial Sequence
  chemically synthesized
aagagatgcatgtcaaacatgt

SEQ ID NO: 924747 - DNA, 22 bp, Artificial Sequence
  chemically synthesized
caagagatgcatgtcaaacatg

SEQ ID NO: 924748 - DNA, 22 bp, Artificial Sequence
  chemically synthesized
tcgccaaacatgtttgacatgc

SEQ ID NO: 924749 - DNA, 22 bp, Artificial Sequence
  chemically synthesized
gccaaacatgtttgacatgcat

SEQ ID NO: 924750 - DNA, 22 bp, Artificial Sequence
  chemically synthesized
aataagacttcaagagatgcat

SEQ ID NO: 924751 - DNA, 22 bp, Artificial Sequence
  chemically synthesized
ggtctaaataagacttcaagag

SEQ ID NO: 924752 - DNA, 22 bp, Artificial Sequence
  chemically synthesized
gacatgcatctcttgaagtctt

SEQ ID NO: 924753 - DNA, 22 bp, Artificial Sequence
  chemically synthesized
acatgcatctcttgaagtctta

SEQ ID NO: 924754 - DNA, 22 bp, Artificial Sequence
  chemically synthesized
gaagttaggtctaaataagact

SEQ ID NO: 924755 - DNA, 22 bp, Artificial Sequence
  chemically synthesized
ttgaagtcttatttagacctaa

SEQ ID NO: 924756 - DNA, 22 bp, Artificial Sequence
  chemically synthesized
gtaaactggaagttaggtctaa

SEQ ID NO: 924757 - DNA, 22 bp, Artificial Sequence
  chemically synthesized
gaagtcttatttagacctaact

SEQ ID NO: 924758 - DNA, 22 bp, Artificial Sequence
  chemically synthesized
tagtaaactggaagttaggtct

SEQ ID NO: 924759 - DNA, 22 bp, Artificial Sequence
  chemically synthesized
aagtcttatttagacctaactt

SEQ ID NO: 924760 - DNA, 22 bp, Artificial Sequence
  chemically synthesized
ctagtaaactggaagttaggtc

SEQ ID NO: 924761 - DNA, 22 bp, Artificial Sequence
  chemically synthesized
aatttctagtaaactggaagtt

SEQ ID NO: 924762 - DNA, 22 bp, Artificial Sequence
  chemically synthesized
atttagacctaacttccagttt

SEQ ID NO: 924763 - DNA, 22 bp, Artificial Sequence
  chemically synthesized
tgaatttctagtaaactggaag

SEQ ID NO: 924764 - DNA, 22 bp, Artificial Sequence
  chemically synthesized
tttagacctaacttccagttta

SEQ ID NO: 924765 - DNA, 22 bp, Artificial Sequence
  chemically synthesized
agacctaacttccagtttacta

SEQ ID NO: 924766 - DNA, 22 bp, Artificial Sequence
  chemically synthesized
gacctaacttccagtttactag

SEQ ID NO: 924767 - DNA, 22 bp, Artificial Sequence
  chemically synthesized
tagtctctgaatttctagtaaa

SEQ ID NO: 924768 - DNA, 22 bp, Artificial Sequence
  chemically synthesized
tgtagtctctgaatttctagta

SEQ ID NO: 924769 - DNA, 22 bp, Artificial Sequence
  chemically synthesized
acttccagtttactagaaattc

SEQ ID NO: 924770 - DNA, 22 bp, Artificial Sequence
  chemically synthesized
ttctgtagtctctgaatttcta

SEQ ID NO: 924771 - DNA, 22 bp, Artificial Sequence
  chemically synthesized
gttctgtagtctctgaatttct

SEQ ID NO: 924772 - DNA, 22 bp, Artificial Sequence
  chemically synthesized
ccagtttactagaaattcagag

SEQ ID NO: 924773 - DNA, 22 bp, Artificial Sequence
  chemically synthesized
cagtttactagaaattcagaga

SEQ ID NO: 924774 - DNA, 22 bp, Artificial Sequence
  chemically synthesized
acttgttctgtagtctctgaat

SEQ ID NO: 924775 - DNA, 22 bp, Artificial Sequence
  chemically synthesized
aacttgttctgtagtctctgaa

SEQ ID NO: 924776 - DNA, 22 bp, Artificial Sequence
  chemically synthesized
actagaaattcagagactacag

SEQ ID NO: 924777 - DNA, 22 bp, Artificial Sequence
  chemically synthesized
ctagaaattcagagactacaga

SEQ ID NO: 924778 - DNA, 22 bp, Artificial Sequence
  chemically synthesized
gaaattcagagactacagaaca

SEQ ID NO: 924779 - DNA, 22 bp, Artificial Sequence
  chemically synthesized
atgggatgatttaacttgttct

SEQ ID NO: 924780 - DNA, 22 bp, Artificial Sequence
  chemically synthesized
agagactacagaacaagttaaa

SEQ ID NO: 924781 - DNA, 22 bp, Artificial Sequence
  chemically synthesized
ccctgatgggatgatttaactt

SEQ ID NO: 924782 - DNA, 22 bp, Artificial Sequence
  chemically synthesized
cccctgatgggatgatttaact

SEQ ID NO: 924783 - DNA, 22 bp, Artificial Sequence
  chemically synthesized
tcccctgatgggatgatttaac

SEQ ID NO: 924784 - DNA, 22 bp, Artificial Sequence
  chemically synthesized
ttcccctgatgggatgatttaa

SEQ ID NO: 924785 - DNA, 22 bp, Artificial Sequence
  chemically synthesized
tttcccctgatgggatgattta

SEQ ID NO: 924786 - DNA, 22 bp, Artificial Sequence
  chemically synthesized
ttttcccctgatgggatgattt

SEQ ID NO: 924787 - DNA, 22 bp, Artificial Sequence
  chemically synthesized
cagaacaagttaaatcatccca

SEQ ID NO: 924788 - DNA, 22 bp, Artificial Sequence
  chemically synthesized
tttttcccctgatgggatgatt

SEQ ID NO: 924789 - DNA, 22 bp, Artificial Sequence
  chemically synthesized
ttttttttcccctgatgggatg

SEQ ID NO: 924790 - DNA, 22 bp, Artificial Sequence
  chemically synthesized
attttttttcccctgatgggat

SEQ ID NO: 924791 - DNA, 22 bp, Artificial Sequence
  chemically synthesized
tattttttttcccctgatggga

SEQ ID NO: 924792 - DNA, 22 bp, Artificial Sequence
  chemically synthesized
ttttattttttttcccctgatg

SEQ ID NO: 924793 - DNA, 22 bp, Artificial Sequence
  chemically synthesized
gttttattttttttcccctgat

SEQ ID NO: 924794 - DNA, 22 bp, Artificial Sequence
  chemically synthesized
aatcatcccatcaggggaaaaa

SEQ ID NO: 924795 - DNA, 22 bp, Artificial Sequence
  chemically synthesized
aggatttgttttattttttttc

SEQ ID NO: 924796 - DNA, 22 bp, Artificial Sequence
  chemically synthesized
caggatttgttttatttttttt

SEQ ID NO: 924797 - DNA, 22 bp, Artificial Sequence
  chemically synthesized
tcaggatttgttttattttttt

SEQ ID NO: 924798 - DNA, 22 bp, Artificial Sequence
  chemically synthesized
atctttcaggatttgttttatt

SEQ ID NO: 924799 - DNA, 22 bp, Artificial Sequence
  chemically synthesized
aaaaaatgtctcatctttcagg

SEQ ID NO: 924800 - DNA, 22 bp, Artificial Sequence
  chemically synthesized
gcctcaaaaaatgtctcatctt

SEQ ID NO: 924801 - DNA, 22 bp, Artificial Sequence
  chemically synthesized
aaagatgagacattttttgagg

SEQ ID NO: 924802 - DNA, 22 bp, Artificial Sequence
  chemically synthesized
aaaatgtccaggacgctagcct

SEQ ID NO: 924803 - DNA, 22 bp, Artificial Sequence
  chemically synthesized
gaaaatgtccaggacgctagcc

SEQ ID NO: 924804 - DNA, 22 bp, Artificial Sequence
  chemically synthesized
aaatttgaaaatgtccaggacg

SEQ ID NO: 924805 - DNA, 22 bp, Artificial Sequence
  chemically synthesized
tttgaggctagcgtcctggaca

SEQ ID NO: 924806 - DNA, 22 bp, Artificial Sequence
  chemically synthesized
ttgaggctagcgtcctggacat

SEQ ID NO: 924807 - DNA, 22 bp, Artificial Sequence
  chemically synthesized
tgaggctagcgtcctggacatt

SEQ ID NO: 924808 - DNA, 22 bp, Artificial Sequence
  chemically synthesized
gaggctagcgtcctggacattt

SEQ ID NO: 924809 - DNA, 22 bp, Artificial Sequence
  chemically synthesized
aggctagcgtcctggacatttt

SEQ ID NO: 924810 - DNA, 22 bp, Artificial Sequence
  chemically synthesized
accgatattgaaatttgaaaat

SEQ ID NO: 924811 - DNA, 22 bp, Artificial Sequence
  chemically synthesized
gcgtcctggacattttcaaatt

SEQ ID NO: 924812 - DNA, 22 bp, Artificial Sequence
  chemically synthesized
caccgatattgaaatttgaaaa

SEQ ID NO: 924813 - DNA, 22 bp, Artificial Sequence
  chemically synthesized
tcaccgatattgaaatttgaaa

SEQ ID NO: 924814 - DNA, 22 bp, Artificial Sequence
  chemically synthesized
ttcaccgatattgaaatttgaa

SEQ ID NO: 924815 - DNA, 22 bp, Artificial Sequence
  chemically synthesized
tttcaccgatattgaaatttga

SEQ ID NO: 924816 - DNA, 22 bp, Artificial Sequence
  chemically synthesized
ttttcaccgatattgaaatttg

SEQ ID NO: 924817 - DNA, 22 bp, Artificial Sequence
  chemically synthesized
gacattttcaaatttcaatatc

SEQ ID NO: 924818 - DNA, 22 bp, Artificial Sequence
  chemically synthesized
cacatttttttcaccgatattg

SEQ ID NO: 924819 - DNA, 22 bp, Artificial Sequence
  chemically synthesized
ccacatttttttcaccgatatt

SEQ ID NO: 924820 - DNA, 22 bp, Artificial Sequence
  chemically synthesized
tcaaatttcaatatcggtgaaa

SEQ ID NO: 924821 - DNA, 22 bp, Artificial Sequence
  chemically synthesized
caaatttcaatatcggtgaaaa

SEQ ID NO: 924822 - DNA, 22 bp, Artificial Sequence
  chemically synthesized
aaatttcaatatcggtgaaaaa

SEQ ID NO: 924823 - DNA, 22 bp, Artificial Sequence
  chemically synthesized
caatatcggtgaaaaaaatgtg

SEQ ID NO: 924824 - DNA, 22 bp, Artificial Sequence
  chemically synthesized
aaatagcccttccacatttttt

SEQ ID NO: 924825 - DNA, 22 bp, Artificial Sequence
  chemically synthesized
aatatcggtgaaaaaaatgtgg

SEQ ID NO: 924826 - DNA, 22 bp, Artificial Sequence
  chemically synthesized
gtctaaaatagcccttccacat

SEQ ID NO: 924827 - DNA, 22 bp, Artificial Sequence
  chemically synthesized
agtctaaaatagcccttccaca

SEQ ID NO: 924828 - DNA, 22 bp, Artificial Sequence
  chemically synthesized
ttagtctaaaatagcccttcca

SEQ ID NO: 924829 - DNA, 22 bp, Artificial Sequence
  chemically synthesized
cttagtctaaaatagcccttcc

SEQ ID NO: 924830 - DNA, 22 bp, Artificial Sequence
  chemically synthesized
atccttcttagtctaaaatagc

SEQ ID NO: 924831 - DNA, 22 bp, Artificial Sequence
  chemically synthesized
catccttcttagtctaaaatag

SEQ ID NO: 924832 - DNA, 22 bp, Artificial Sequence
  chemically synthesized
tcatccttcttagtctaaaata

SEQ ID NO: 924833 - DNA, 22 bp, Artificial Sequence
  chemically synthesized
ttcatccttcttagtctaaaat

SEQ ID NO: 924834 - DNA, 22 bp, Artificial Sequence
  chemically synthesized
tttttcatccttcttagtctaa

SEQ ID NO: 924835 - DNA, 22 bp, Artificial Sequence
  chemically synthesized
ttatttttcatccttcttagtc

SEQ ID NO: 924836 - DNA, 22 bp, Artificial Sequence
  chemically synthesized
ttattatttttcatccttctta

SEQ ID NO: 924837 - DNA, 22 bp, Artificial Sequence
  chemically synthesized
ttttagactaagaaggatgaaa

SEQ ID NO: 924838 - DNA, 22 bp, Artificial Sequence
  chemically synthesized
gttattattatttttcatcctt

SEQ ID NO: 924839 - DNA, 22 bp, Artificial Sequence
  chemically synthesized
ggttattattatttttcatcct

SEQ ID NO: 924840 - DNA, 22 bp, Artificial Sequence
  chemically synthesized
tagactaagaaggatgaaaaat

SEQ ID NO: 924841 - DNA, 22 bp, Artificial Sequence
  chemically synthesized
agactaagaaggatgaaaaata

SEQ ID NO: 924842 - DNA, 22 bp, Artificial Sequence
  chemically synthesized
gactaagaaggatgaaaaataa

SEQ ID NO: 924843 - DNA, 22 bp, Artificial Sequence
  chemically synthesized
catttggttattattatttttc

SEQ ID NO: 924844 - DNA, 22 bp, Artificial Sequence
  chemically synthesized
agaaggatgaaaaataataata

SEQ ID NO: 924845 - DNA, 22 bp, Artificial Sequence
  chemically synthesized
atgcattacatttggttattat

SEQ ID NO: 924846 - DNA, 22 bp, Artificial Sequence
  chemically synthesized
tcatggctcatgcattacattt

SEQ ID NO: 924847 - DNA, 22 bp, Artificial Sequence
  chemically synthesized
atcatggctcatgcattacatt

SEQ ID NO: 924848 - DNA, 22 bp, Artificial Sequence
  chemically synthesized
gtaccaatatcttatcatggct

SEQ ID NO: 924849 - DNA, 22 bp, Artificial Sequence
  chemically synthesized
caggggagttagtaccaatatc

SEQ ID NO: 924850 - DNA, 22 bp, Artificial Sequence
  chemically synthesized
gcaggggagttagtaccaatat

SEQ ID NO: 924851 - DNA, 22 bp, Artificial Sequence
  chemically synthesized
tgcaggggagttagtaccaata

SEQ ID NO: 924852 - DNA, 22 bp, Artificial Sequence
  chemically synthesized
tattttgcaggggagttagtac

SEQ ID NO: 924853 - DNA, 22 bp, Artificial Sequence
  chemically synthesized
atattttgcaggggagttagta

SEQ ID NO: 924854 - DNA, 22 bp, Artificial Sequence
  chemically synthesized
tatattttgcaggggagttagt

SEQ ID NO: 924855 - DNA, 22 bp, Artificial Sequence
  chemically synthesized
ttatattttgcaggggagttag

SEQ ID NO: 924856 - DNA, 22 bp, Artificial Sequence
  chemically synthesized
gtactaactcccctgcaaaata

SEQ ID NO: 924857 - DNA, 22 bp, Artificial Sequence
  chemically synthesized
aaaaatgtcttttatattttgc

SEQ ID NO: 924858 - DNA, 22 bp, Artificial Sequence
  chemically synthesized
actcccctgcaaaatataaaag

SEQ ID NO: 924859 - DNA, 22 bp, Artificial Sequence
  chemically synthesized
atagttcaaaaatgtcttttat

SEQ ID NO: 924860 - DNA, 22 bp, Artificial Sequence
  chemically synthesized
ccctgcaaaatataaaagacat

SEQ ID NO: 924861 - DNA, 22 bp, Artificial Sequence
  chemically synthesized
aatagttcaaaaatgtctttta

SEQ ID NO: 924862 - DNA, 22 bp, Artificial Sequence
  chemically synthesized
cttaatagttcaaaaatgtctt

SEQ ID NO: 924863 - DNA, 22 bp, Artificial Sequence
  chemically synthesized
ccttaatagttcaaaaatgtct

SEQ ID NO: 924864 - DNA, 22 bp, Artificial Sequence
  chemically synthesized
caaaatataaaagacatttttg

SEQ ID NO: 924865 - DNA, 22 bp, Artificial Sequence
  chemically synthesized
atatttccttaatagttcaaaa

SEQ ID NO: 924866 - DNA, 22 bp, Artificial Sequence
  chemically synthesized
catattcatatttccttaatag

SEQ ID NO: 924867 - DNA, 22 bp, Artificial Sequence
  chemically synthesized
ttgaactattaaggaaatatga

SEQ ID NO: 924868 - DNA, 22 bp, Artificial Sequence
  chemically synthesized
tgaactattaaggaaatatgaa

SEQ ID NO: 924869 - DNA, 22 bp, Artificial Sequence
  chemically synthesized
gaactattaaggaaatatgaat

SEQ ID NO: 924870 - DNA, 22 bp, Artificial Sequence
  chemically synthesized
aactattaaggaaatatgaata

SEQ ID NO: 924871 - DNA, 22 bp, Artificial Sequence
  chemically synthesized
atatccattccatattcatatt

SEQ ID NO: 924872 - DNA, 22 bp, Artificial Sequence
  chemically synthesized
ttaatatccattccatattcat

SEQ ID NO: 924873 - DNA, 22 bp, Artificial Sequence
  chemically synthesized
ttaaggaaatatgaatatggaa

SEQ ID NO: 924874 - DNA, 22 bp, Artificial Sequence
  chemically synthesized
ttgttaatatccattccatatt

SEQ ID NO: 924875 - DNA, 22 bp, Artificial Sequence
  chemically synthesized
aggaaatatgaatatggaatgg

SEQ ID NO: 924876 - DNA, 22 bp, Artificial Sequence
  chemically synthesized
cattattgttaatatccattcc

SEQ ID NO: 924877 - DNA, 22 bp, Artificial Sequence
  chemically synthesized
aatataatactgcattattgtt

SEQ ID NO: 924878 - DNA, 22 bp, Artificial Sequence
  chemically synthesized
caaattaaatataatactgcat

SEQ ID NO: 924879 - DNA, 22 bp, Artificial Sequence
  chemically synthesized
ctccaaattaaatataatactg

SEQ ID NO: 924880 - DNA, 22 bp, Artificial Sequence
  chemically synthesized
tcctccaaattaaatataatac

SEQ ID NO: 924881 - DNA, 22 bp, Artificial Sequence
  chemically synthesized
acaataatgcagtattatattt

SEQ ID NO: 924882 - DNA, 22 bp, Artificial Sequence
  chemically synthesized
tgctctcctccaaattaaatat

SEQ ID NO: 924883 - DNA, 22 bp, Artificial Sequence
  chemically synthesized
ttatgctctcctccaaattaaa

SEQ ID NO: 924884 - DNA, 22 bp, Artificial Sequence
  chemically synthesized
attatgctctcctccaaattaa

SEQ ID NO: 924885 - DNA, 22 bp, Artificial Sequence
  chemically synthesized
tttattatgctctcctccaaat

SEQ ID NO: 924886 - DNA, 22 bp, Artificial Sequence
  chemically synthesized
tatttaatttggaggagagcat

SEQ ID NO: 924887 - DNA, 22 bp, Artificial Sequence
  chemically synthesized
aatttggaggagagcataataa

SEQ ID NO: 924888 - DNA, 22 bp, Artificial Sequence
  chemically synthesized
atttggaggagagcataataaa

SEQ ID NO: 924889 - DNA, 22 bp, Artificial Sequence
  chemically synthesized
ggaggagagcataataaacagg

SEQ ID NO: 924890 - DNA, 22 bp, Artificial Sequence
  chemically synthesized
gaggagagcataataaacaggc

SEQ ID NO: 924891 - DNA, 22 bp, Artificial Sequence
  chemically synthesized
aaatacagacatgccatatata

SEQ ID NO: 924892 - DNA, 22 bp, Artificial Sequence
  chemically synthesized
gaaatacagacatgccatatat

SEQ ID NO: 924893 - DNA, 22 bp, Artificial Sequence
  chemically synthesized
tgaaatacagacatgccatata

SEQ ID NO: 924894 - DNA, 22 bp, Artificial Sequence
  chemically synthesized
tatatggcatgtctgtatttca

SEQ ID NO: 924895 - DNA, 22 bp, Artificial Sequence
  chemically synthesized
agcatgtgtcgctttgaaatac

SEQ ID NO: 924896 - DNA, 22 bp, Artificial Sequence
  chemically synthesized
aataattcagcatgtgtcgctt

SEQ ID NO: 924897 - DNA, 22 bp, Artificial Sequence
  chemically synthesized
tatttcaaagcgacacatgctg

SEQ ID NO: 924898 - DNA, 22 bp, Artificial Sequence
  chemically synthesized
cccctaaataattcagcatgtg

SEQ ID NO: 924899 - DNA, 22 bp, Artificial Sequence
  chemically synthesized
acccctaaataattcagcatgt

SEQ ID NO: 924900 - DNA, 22 bp, Artificial Sequence
  chemically synthesized
tacccctaaataattcagcatg

SEQ ID NO: 924901 - DNA, 22 bp, Artificial Sequence
  chemically synthesized
caaagcgacacatgctgaatta

SEQ ID NO: 924902 - DNA, 22 bp, Artificial Sequence
  chemically synthesized
aaagcgacacatgctgaattat

SEQ ID NO: 924903 - DNA, 22 bp, Artificial Sequence
  chemically synthesized
tattttacccctaaataattca

SEQ ID NO: 924904 - DNA, 22 bp, Artificial Sequence
  chemically synthesized
taaataccattatattttaccc

SEQ ID NO: 924905 - DNA, 22 bp, Artificial Sequence
  chemically synthesized
aattatttaggggtaaaatata

SEQ ID NO: 924906 - DNA, 22 bp, Artificial Sequence
  chemically synthesized
tttaggggtaaaatataatggt

SEQ ID NO: 924907 - DNA, 22 bp, Artificial Sequence
  chemically synthesized
aggggtaaaatataatggtatt

SEQ ID NO: 924908 - DNA, 22 bp, Artificial Sequence
  chemically synthesized
ggggtaaaatataatggtattt

SEQ ID NO: 924909 - DNA, 22 bp, Artificial Sequence
  chemically synthesized
caaataagttataaataccatt

SEQ ID NO: 924910 - DNA, 22 bp, Artificial Sequence
  chemically synthesized
gcaaataagttataaataccat

SEQ ID NO: 924911 - DNA, 22 bp, Artificial Sequence
  chemically synthesized
tgcaaataagttataaatacca

SEQ ID NO: 924912 - DNA, 22 bp, Artificial Sequence
  chemically synthesized
ttgcaaataagttataaatacc

SEQ ID NO: 924913 - DNA, 22 bp, Artificial Sequence
  chemically synthesized
acatttttgcaaataagttata

SEQ ID NO: 924914 - DNA, 22 bp, Artificial Sequence
  chemically synthesized
aacatttttgcaaataagttat

SEQ ID NO: 924915 - DNA, 22 bp, Artificial Sequence
  chemically synthesized
taacatttttgcaaataagtta

SEQ ID NO: 924916 - DNA, 22 bp, Artificial Sequence
  chemically synthesized
ttaacatttttgcaaataagtt

SEQ ID NO: 924917 - DNA, 22 bp, Artificial Sequence
  chemically synthesized
tttaacatttttgcaaataagt

SEQ ID NO: 924918 - DNA, 22 bp, Artificial Sequence
  chemically synthesized
ataacttatttgcaaaaatgtt

SEQ ID NO: 924919 - DNA, 22 bp, Artificial Sequence
  chemically synthesized
taacttatttgcaaaaatgtta

SEQ ID NO: 924920 - DNA, 22 bp, Artificial Sequence
  chemically synthesized
atttgcaaaaatgttaaaaagt

SEQ ID NO: 924921 - DNA, 22 bp, Artificial Sequence
  chemically synthesized
tttgcaaaaatgttaaaaagtg

SEQ ID NO: 924922 - DNA, 22 bp, Artificial Sequence
  chemically synthesized
gcaaaaatgttaaaaagtgtgt

SEQ ID NO: 924923 - DNA, 22 bp, Artificial Sequence
  chemically synthesized
caaaaatgttaaaaagtgtgtg

SEQ ID NO: 924924 - DNA, 22 bp, Artificial Sequence
  chemically synthesized
aaaagtgtgtgtgtgtgtgtgt

SEQ ID NO: 924925 - DNA, 22 bp, Artificial Sequence
  chemically synthesized
atatatagggcatcacacacac

SEQ ID NO: 924926 - DNA, 22 bp, Artificial Sequence
  chemically synthesized
tcatatatagggcatcacacac

SEQ ID NO: 924927 - DNA, 22 bp, Artificial Sequence
  chemically synthesized
tatctctcatatatagggcatc

SEQ ID NO: 924928 - DNA, 22 bp, Artificial Sequence
  chemically synthesized
tgtatctctcatatatagggca

SEQ ID NO: 924929 - DNA, 22 bp, Artificial Sequence
  chemically synthesized
ctgtatctctcatatatagggc

SEQ ID NO: 924930 - DNA, 22 bp, Artificial Sequence
  chemically synthesized
tctgtatctctcatatataggg

SEQ ID NO: 924931 - DNA, 22 bp, Artificial Sequence
  chemically synthesized
tttctgtatctctcatatatag

SEQ ID NO: 924932 - DNA, 22 bp, Artificial Sequence
  chemically synthesized
ccctctttctgtatctctcata

SEQ ID NO: 924933 - DNA, 22 bp, Artificial Sequence
  chemically synthesized
taccctctttctgtatctctca

SEQ ID NO: 924934 - DNA, 22 bp, Artificial Sequence
  chemically synthesized
tctaccctctttctgtatctct

SEQ ID NO: 924935 - DNA, 22 bp, Artificial Sequence
  chemically synthesized
ctctaccctctttctgtatctc

SEQ ID NO: 924936 - DNA, 22 bp, Artificial Sequence
  chemically synthesized
tctctaccctctttctgtatct

SEQ ID NO: 924937 - DNA, 22 bp, Artificial Sequence
  chemically synthesized
tatatgagagatacagaaagag

SEQ ID NO: 924938 - DNA, 22 bp, Artificial Sequence
  chemically synthesized
gctttctctaccctctttctgt

SEQ ID NO: 924939 - DNA, 22 bp, Artificial Sequence
  chemically synthesized
tcgctttctctaccctctttct

SEQ ID NO: 924940 - DNA, 22 bp, Artificial Sequence
  chemically synthesized
tctcgctttctctaccctcttt

SEQ ID NO: 924941 - DNA, 22 bp, Artificial Sequence
  chemically synthesized
ctctcgctttctctaccctctt

SEQ ID NO: 924942 - DNA, 22 bp, Artificial Sequence
  chemically synthesized
tctctcgctttctctaccctct

SEQ ID NO: 924943 - DNA, 22 bp, Artificial Sequence
  chemically synthesized
ttctctcgctttctctaccctc

SEQ ID NO: 924944 - DNA, 22 bp, Artificial Sequence
  chemically synthesized
tttctctcgctttctctaccct

SEQ ID NO: 924945 - DNA, 22 bp, Artificial Sequence
  chemically synthesized
ttttctctcgctttctctaccc

SEQ ID NO: 924946 - DNA, 22 bp, Artificial Sequence
  chemically synthesized
tttttctctcgctttctctacc

SEQ ID NO: 924947 - DNA, 22 bp, Artificial Sequence
  chemically synthesized
ccatatatgctttttttctctc

SEQ ID NO: 924948 - DNA, 22 bp, Artificial Sequence
  chemically synthesized
gccatatatgctttttttctct

SEQ ID NO: 924949 - DNA, 22 bp, Artificial Sequence
  chemically synthesized
tgccatatatgctttttttctc

SEQ ID NO: 924950 - DNA, 22 bp, Artificial Sequence
  chemically synthesized
acattttgccatatatgctttt

SEQ ID NO: 924951 - DNA, 22 bp, Artificial Sequence
  chemically synthesized
ttaacattttgccatatatgct

SEQ ID NO: 924952 - DNA, 22 bp, Artificial Sequence
  chemically synthesized
gagtcaacaattgttaacattt

SEQ ID NO: 924953 - DNA, 22 bp, Artificial Sequence
  chemically synthesized
agagtcaacaattgttaacatt

SEQ ID NO: 924954 - DNA, 22 bp, Artificial Sequence
  chemically synthesized
ttagagtcaacaattgttaaca

SEQ ID NO: 924955 - DNA, 22 bp, Artificial Sequence
  chemically synthesized
aattcttagagtcaacaattgt

SEQ ID NO: 924956 - DNA, 22 bp, Artificial Sequence
  chemically synthesized
cccctaaattcttagagtcaac

SEQ ID NO: 924957 - DNA, 22 bp, Artificial Sequence
  chemically synthesized
ctccccctaaattcttagagtc

SEQ ID NO: 924958 - DNA, 22 bp, Artificial Sequence
  chemically synthesized
cctccccctaaattcttagagt

SEQ ID NO: 924959 - DNA, 22 bp, Artificial Sequence
  chemically synthesized
tcctccccctaaattcttagag

SEQ ID NO: 924960 - DNA, 22 bp, Artificial Sequence
  chemically synthesized
acaattgttgactctaagaatt

SEQ ID NO: 924961 - DNA, 22 bp, Artificial Sequence
  chemically synthesized
ttttcctccccctaaattctta

SEQ ID NO: 924962 - DNA, 22 bp, Artificial Sequence
  chemically synthesized
ttgactctaagaatttaggggg

SEQ ID NO: 924963 - DNA, 22 bp, Artificial Sequence
  chemically synthesized
cactgttttcctccccctaaat

SEQ ID NO: 924964 - DNA, 22 bp, Artificial Sequence
  chemically synthesized
acactgttttcctccccctaaa

SEQ ID NO: 924965 - DNA, 22 bp, Artificial Sequence
  chemically synthesized
actctaagaatttagggggagg

SEQ ID NO: 924966 - DNA, 22 bp, Artificial Sequence
  chemically synthesized
taagaatttagggggaggaaaa

SEQ ID NO: 924967 - DNA, 22 bp, Artificial Sequence
  chemically synthesized
agaatttagggggaggaaaaca

SEQ ID NO: 924968 - DNA, 22 bp, Artificial Sequence
  chemically synthesized
agggggaggaaaacagtgtaaa

SEQ ID NO: 924969 - DNA, 22 bp, Artificial Sequence
  chemically synthesized
gggggaggaaaacagtgtaaat

SEQ ID NO: 924970 - DNA, 22 bp, Artificial Sequence
  chemically synthesized
caaaacatatgcccatttacac

SEQ ID NO: 924971 - DNA, 22 bp, Artificial Sequence
  chemically synthesized
aaacaattgcaaaacatatgcc

SEQ ID NO: 924972 - DNA, 22 bp, Artificial Sequence
  chemically synthesized
aaacatatagaaaaattgaaac

SEQ ID NO: 924973 - DNA, 22 bp, Artificial Sequence
  chemically synthesized
caaacatatagaaaaattgaaa

SEQ ID NO: 924974 - DNA, 22 bp, Artificial Sequence
  chemically synthesized
tgcaattgtttcaatttttcta

SEQ ID NO: 924975 - DNA, 22 bp, Artificial Sequence
  chemically synthesized
gcaattgtttcaatttttctat

SEQ ID NO: 924976 - DNA, 22 bp, Artificial Sequence
  chemically synthesized
caattgtttcaatttttctata

SEQ ID NO: 924977 - DNA, 22 bp, Artificial Sequence
  chemically synthesized
tgaaaaatttcaaacatataga

SEQ ID NO: 924978 - DNA, 22 bp, Artificial Sequence
  chemically synthesized
gtgaaaaatttcaaacatatag

SEQ ID NO: 924979 - DNA, 22 bp, Artificial Sequence
  chemically synthesized
tttcaatttttctatatgtttg

SEQ ID NO: 924980 - DNA, 22 bp, Artificial Sequence
  chemically synthesized
tgtgaaaaatttcaaacatata

SEQ ID NO: 924981 - DNA, 22 bp, Artificial Sequence
  chemically synthesized
ttgtgaaaaatttcaaacatat

SEQ ID NO: 924982 - DNA, 22 bp, Artificial Sequence
  chemically synthesized
tttgtgaaaaatttcaaacata

SEQ ID NO: 924983 - DNA, 22 bp, Artificial Sequence
  chemically synthesized
caatttttctatatgtttgaaa

SEQ ID NO: 924984 - DNA, 22 bp, Artificial Sequence
  chemically synthesized
aatttttctatatgtttgaaat

SEQ ID NO: 924985 - DNA, 22 bp, Artificial Sequence
  chemically synthesized
ttctatatgtttgaaatttttc

SEQ ID NO: 924986 - DNA, 22 bp, Artificial Sequence
  chemically synthesized
tctatatgtttgaaatttttca

SEQ ID NO: 924987 - DNA, 22 bp, Artificial Sequence
  chemically synthesized
ctatatgtttgaaatttttcac

SEQ ID NO: 924988 - DNA, 22 bp, Artificial Sequence
  chemically synthesized
tatatgtttgaaatttttcaca

SEQ ID NO: 924989 - DNA, 22 bp, Artificial Sequence
  chemically synthesized
cccaagtctttttgtgaaaaat

SEQ ID NO: 924990 - DNA, 22 bp, Artificial Sequence
  chemically synthesized
ccccaagtctttttgtgaaaaa

SEQ ID NO: 924991 - DNA, 22 bp, Artificial Sequence
  chemically synthesized
tatgtttgaaatttttcacaaa

SEQ ID NO: 924992 - DNA, 22 bp, Artificial Sequence
  chemically synthesized
cttccccaagtctttttgtgaa

SEQ ID NO: 924993 - DNA, 22 bp, Artificial Sequence
  chemically synthesized
ccttccccaagtctttttgtga

SEQ ID NO: 924994 - DNA, 22 bp, Artificial Sequence
  chemically synthesized
tccttccccaagtctttttgtg

SEQ ID NO: 924995 - DNA, 22 bp, Artificial Sequence
  chemically synthesized
ttccttccccaagtctttttgt

SEQ ID NO: 924996 - DNA, 22 bp, Artificial Sequence
  chemically synthesized
tttccttccccaagtctttttg

SEQ ID NO: 924997 - DNA, 22 bp, Artificial Sequence
  chemically synthesized
gaaatttttcacaaaaagactt

SEQ ID NO: 924998 - DNA, 22 bp, Artificial Sequence
  chemically synthesized
aaatttttcacaaaaagacttg

SEQ ID NO: 924999 - DNA, 22 bp, Artificial Sequence
  chemically synthesized
aattttttccttccccaagtct

SEQ ID NO: 925000 - DNA, 22 bp, Artificial Sequence
  chemically synthesized
gaattttttccttccccaagtc

SEQ ID NO: 925001 - DNA, 22 bp, Artificial Sequence
  chemically synthesized
tgaattttttccttccccaagt

SEQ ID NO: 925002 - DNA, 22 bp, Artificial Sequence
  chemically synthesized
ttcacaaaaagacttggggaag

SEQ ID NO: 925003 - DNA, 22 bp, Artificial Sequence
  chemically synthesized
tcacaaaaagacttggggaagg

SEQ ID NO: 925004 - DNA, 22 bp, Artificial Sequence
  chemically synthesized
cacaaaaagacttggggaagga

SEQ ID NO: 925005 - DNA, 22 bp, Artificial Sequence
  chemically synthesized
acaaaaagacttggggaaggaa

SEQ ID NO: 925006 - DNA, 22 bp, Artificial Sequence
  chemically synthesized
atgaaaataattttgaattttt

SEQ ID NO: 925007 - DNA, 22 bp, Artificial Sequence
  chemically synthesized
aatgaaaataattttgaatttt

SEQ ID NO: 925008 - DNA, 22 bp, Artificial Sequence
  chemically synthesized
ggggaaggaaaaaattcaaaat

SEQ ID NO: 925009 - DNA, 22 bp, Artificial Sequence
  chemically synthesized
gggaaggaaaaaattcaaaatt

SEQ ID NO: 925010 - DNA, 22 bp, Artificial Sequence
  chemically synthesized
ccttaatgaaaataattttgaa

SEQ ID NO: 925011 - DNA, 22 bp, Artificial Sequence
  chemically synthesized
agtgttaccttaatgaaaataa

SEQ ID NO: 925012 - DNA, 22 bp, Artificial Sequence
  chemically synthesized
aagtgttaccttaatgaaaata

SEQ ID NO: 925013 - DNA, 22 bp, Artificial Sequence
  chemically synthesized
atttaagtgttaccttaatgaa

SEQ ID NO: 925014 - DNA, 22 bp, Artificial Sequence
  chemically synthesized
aatttaagtgttaccttaatga

SEQ ID NO: 925015 - DNA, 22 bp, Artificial Sequence
  chemically synthesized
taatttaagtgttaccttaatg

SEQ ID NO: 925016 - DNA, 22 bp, Artificial Sequence
  chemically synthesized
aaaattattttcattaaggtaa

SEQ ID NO: 925017 - DNA, 22 bp, Artificial Sequence
  chemically synthesized
ttttcattaaggtaacacttaa

SEQ ID NO: 925018 - DNA, 22 bp, Artificial Sequence
  chemically synthesized
tcattaaggtaacacttaaatt

SEQ ID NO: 925019 - DNA, 22 bp, Artificial Sequence
  chemically synthesized
cattaaggtaacacttaaatta

SEQ ID NO: 925020 - DNA, 22 bp, Artificial Sequence
  chemically synthesized
attaaggtaacacttaaattaa

SEQ ID NO: 925021 - DNA, 22 bp, Artificial Sequence
  chemically synthesized
aggaatagtggttttaatttaa

SEQ ID NO: 925022 - DNA, 22 bp, Artificial Sequence
  chemically synthesized
aggtaacacttaaattaaaacc

SEQ ID NO: 925023 - DNA, 22 bp, Artificial Sequence
  chemically synthesized
atatgcattaaggaatagtggt

SEQ ID NO: 925024 - DNA, 22 bp, Artificial Sequence
  chemically synthesized
ctaatatgcattaaggaatagt

SEQ ID NO: 925025 - DNA, 22 bp, Artificial Sequence
  chemically synthesized
aaattaaaaccactattcctta

SEQ ID NO: 925026 - DNA, 22 bp, Artificial Sequence
  chemically synthesized
aattaaaaccactattccttaa

SEQ ID NO: 925027 - DNA, 22 bp, Artificial Sequence
  chemically synthesized
tactaatatgcattaaggaata

SEQ ID NO: 925028 - DNA, 22 bp, Artificial Sequence
  chemically synthesized
ttctactaatatgcattaagga

SEQ ID NO: 925029 - DNA, 22 bp, Artificial Sequence
  chemically synthesized
aaaccactattccttaatgcat

SEQ ID NO: 925030 - DNA, 22 bp, Artificial Sequence
  chemically synthesized
ttccttaatgcatattagtaga

SEQ ID NO: 925031 - DNA, 22 bp, Artificial Sequence
  chemically synthesized
cttaatgcatattagtagaata

SEQ ID NO: 925032 - DNA, 22 bp, Artificial Sequence
  chemically synthesized
aatgcatattagtagaataatt

SEQ ID NO: 925033 - DNA, 22 bp, Artificial Sequence
  chemically synthesized
atgcatattagtagaataattg

SEQ ID NO: 925034 - DNA, 22 bp, Artificial Sequence
  chemically synthesized
tcccatatcacagataaggcaa

SEQ ID NO: 925035 - DNA, 22 bp, Artificial Sequence
  chemically synthesized
atcccatatcacagataaggca

SEQ ID NO: 925036 - DNA, 22 bp, Artificial Sequence
  chemically synthesized
gtagaataattgccttatctgt

SEQ ID NO: 925037 - DNA, 22 bp, Artificial Sequence
  chemically synthesized
cttatcccatatcacagataag

SEQ ID NO: 925038 - DNA, 22 bp, Artificial Sequence
  chemically synthesized
atattgcttatcccatatcaca

SEQ ID NO: 925039 - DNA, 22 bp, Artificial Sequence
  chemically synthesized
ccttatctgtgatatgggataa

SEQ ID NO: 925040 - DNA, 22 bp, Artificial Sequence
  chemically synthesized
atctgtgatatgggataagcaa

SEQ ID NO: 925041 - DNA, 22 bp, Artificial Sequence
  chemically synthesized
tctgtgatatgggataagcaat

SEQ ID NO: 925042 - DNA, 22 bp, Artificial Sequence
  chemically synthesized
gacaagtctgatattgcttatc

SEQ ID NO: 925043 - DNA, 22 bp, Artificial Sequence
  chemically synthesized
agacaagtctgatattgcttat

SEQ ID NO: 925044 - DNA, 22 bp, Artificial Sequence
  chemically synthesized
tagacaagtctgatattgctta

SEQ ID NO: 925045 - DNA, 22 bp, Artificial Sequence
  chemically synthesized
ttagacaagtctgatattgctt

SEQ ID NO: 925046 - DNA, 22 bp, Artificial Sequence
  chemically synthesized
tgatatgggataagcaatatca

SEQ ID NO: 925047 - DNA, 22 bp, Artificial Sequence
  chemically synthesized
ttttagacaagtctgatattgc

SEQ ID NO: 925048 - DNA, 22 bp, Artificial Sequence
  chemically synthesized
cttttagacaagtctgatattg

SEQ ID NO: 925049 - DNA, 22 bp, Artificial Sequence
  chemically synthesized
ttcttttagacaagtctgatat

SEQ ID NO: 925050 - DNA, 22 bp, Artificial Sequence
  chemically synthesized
cttcttttagacaagtctgata

SEQ ID NO: 925051 - DNA, 22 bp, Artificial Sequence
  chemically synthesized
tcttcttttagacaagtctgat

SEQ ID NO: 925052 - DNA, 22 bp, Artificial Sequence
  chemically synthesized
tttcttcttttagacaagtctg

SEQ ID NO: 925053 - DNA, 22 bp, Artificial Sequence
  chemically synthesized
taattctttcttcttttagaca

SEQ ID NO: 925054 - DNA, 22 bp, Artificial Sequence
  chemically synthesized
aaaacattataattctttcttc

SEQ ID NO: 925055 - DNA, 22 bp, Artificial Sequence
  chemically synthesized
caaaacattataattctttctt

SEQ ID NO: 925056 - DNA, 22 bp, Artificial Sequence
  chemically synthesized
gtctaaaagaagaaagaattat

SEQ ID NO: 925057 - DNA, 22 bp, Artificial Sequence
  chemically synthesized
tctaaaagaagaaagaattata

SEQ ID NO: 925058 - DNA, 22 bp, Artificial Sequence
  chemically synthesized
agatttcaaaacattataattc

SEQ ID NO: 925059 - DNA, 22 bp, Artificial Sequence
  chemically synthesized
aaagaagaaagaattataatgt

SEQ ID NO: 925060 - DNA, 22 bp, Artificial Sequence
  chemically synthesized
gcaataataattaagatttcaa

SEQ ID NO: 925061 - DNA, 22 bp, Artificial Sequence
  chemically synthesized
agcaataataattaagatttca

SEQ ID NO: 925062 - DNA, 22 bp, Artificial Sequence
  chemically synthesized
taatgttttgaaatcttaatta

SEQ ID NO: 925063 - DNA, 22 bp, Artificial Sequence
  chemically synthesized
tgaaatcttaattattattgct

SEQ ID NO: 925064 - DNA, 22 bp, Artificial Sequence
  chemically synthesized
gaaatcttaattattattgcta

SEQ ID NO: 925065 - DNA, 22 bp, Artificial Sequence
  chemically synthesized
aatcataatccttagcaataat

SEQ ID NO: 925066 - DNA, 22 bp, Artificial Sequence
  chemically synthesized
aaatcttaattattattgctaa

SEQ ID NO: 925067 - DNA, 22 bp, Artificial Sequence
  chemically synthesized
tgaatcataatccttagcaata

SEQ ID NO: 925068 - DNA, 22 bp, Artificial Sequence
  chemically synthesized
aattattattgctaaggattat

SEQ ID NO: 925069 - DNA, 22 bp, Artificial Sequence
  chemically synthesized
attattattgctaaggattatg

SEQ ID NO: 925070 - DNA, 22 bp, Artificial Sequence
  chemically synthesized
aggaacctctgaatcataatcc

SEQ ID NO: 925071 - DNA, 22 bp, Artificial Sequence
  chemically synthesized
ttattgctaaggattatgattc

SEQ ID NO: 925072 - DNA, 22 bp, Artificial Sequence
  chemically synthesized
ttgctaaggattatgattcaga

SEQ ID NO: 925073 - DNA, 22 bp, Artificial Sequence
  chemically synthesized
aattgaggaacctctgaatcat

SEQ ID NO: 925074 - DNA, 22 bp, Artificial Sequence
  chemically synthesized
ctaaggattatgattcagaggt

SEQ ID NO: 925075 - DNA, 22 bp, Artificial Sequence
  chemically synthesized
ctaaattgaggaacctctgaat

SEQ ID NO: 925076 - DNA, 22 bp, Artificial Sequence
  chemically synthesized
aggattatgattcagaggttcc

SEQ ID NO: 925077 - DNA, 22 bp, Artificial Sequence
  chemically synthesized
tgattcagaggttcctcaattt

SEQ ID NO: 925078 - DNA, 22 bp, Artificial Sequence
  chemically synthesized
agaggttcctcaatttaggaat

SEQ ID NO: 925079 - DNA, 22 bp, Artificial Sequence
  chemically synthesized
ctcaatttaggaattccacttc

SEQ ID NO: 925080 - DNA, 22 bp, Artificial Sequence
  chemically synthesized
aatttaggaattccacttccca

SEQ ID NO: 925081 - DNA, 22 bp, Artificial Sequence
  chemically synthesized
aggaattccacttcccactgcc

SEQ ID NO: 925082 - DNA, 22 bp, Artificial Sequence
  chemically synthesized
ggaattccacttcccactgcct

SEQ ID NO: 925083 - DNA, 22 bp, Artificial Sequence
  chemically synthesized
aatgggagacggaagcaaggca

SEQ ID NO: 925084 - DNA, 22 bp, Artificial Sequence
  chemically synthesized
gaatgggagacggaagcaaggc

SEQ ID NO: 925085 - DNA, 22 bp, Artificial Sequence
  chemically synthesized
cacttcccactgccttgcttcc

SEQ ID NO: 925086 - DNA, 22 bp, Artificial Sequence
  chemically synthesized
cccactgccttgcttccgtctc

SEQ ID NO: 925087 - DNA, 22 bp, Artificial Sequence
  chemically synthesized
ccactgccttgcttccgtctcc

SEQ ID NO: 925088 - DNA, 22 bp, Artificial Sequence
  chemically synthesized
ataaaagtttgaatgggagacg

SEQ ID NO: 925089 - DNA, 22 bp, Artificial Sequence
  chemically synthesized
ccttgcttccgtctcccattca

SEQ ID NO: 925090 - DNA, 22 bp, Artificial Sequence
  chemically synthesized
gcttccgtctcccattcaaact

SEQ ID NO: 925091 - DNA, 22 bp, Artificial Sequence
  chemically synthesized
cttccgtctcccattcaaactt

SEQ ID NO: 925092 - DNA, 22 bp, Artificial Sequence
  chemically synthesized
ccgtctcccattcaaactttta

SEQ ID NO: 925093 - DNA, 22 bp, Artificial Sequence
  chemically synthesized
cgtctcccattcaaacttttat

SEQ ID NO: 925094 - DNA, 22 bp, Artificial Sequence
  chemically synthesized
gaataatgtcagttgataaaag

SEQ ID NO: 925095 - DNA, 22 bp, Artificial Sequence
  chemically synthesized
agaataatgtcagttgataaaa

SEQ ID NO: 925096 - DNA, 22 bp, Artificial Sequence
  chemically synthesized
ccattcaaacttttatcaactg

SEQ ID NO: 925097 - DNA, 22 bp, Artificial Sequence
  chemically synthesized
cttagaataatgtcagttgata

SEQ ID NO: 925098 - DNA, 22 bp, Artificial Sequence
  chemically synthesized
acttagaataatgtcagttgat

SEQ ID NO: 925099 - DNA, 22 bp, Artificial Sequence
  chemically synthesized
tacttagaataatgtcagttga

SEQ ID NO: 925100 - DNA, 22 bp, Artificial Sequence
  chemically synthesized
aaacttttatcaactgacatta

SEQ ID NO: 925101 - DNA, 22 bp, Artificial Sequence
  chemically synthesized
ttatcaactgacattattctaa

SEQ ID NO: 925102 - DNA, 22 bp, Artificial Sequence
  chemically synthesized
tatcaactgacattattctaag

SEQ ID NO: 925103 - DNA, 22 bp, Artificial Sequence
  chemically synthesized
atcaactgacattattctaagt

SEQ ID NO: 925104 - DNA, 22 bp, Artificial Sequence
  chemically synthesized
tcaactgacattattctaagta

SEQ ID NO: 925105 - DNA, 22 bp, Artificial Sequence
  chemically synthesized
acattattctaagtaaaatcct

SEQ ID NO: 925106 - DNA, 22 bp, Artificial Sequence
  chemically synthesized
acaacataatgaagaggatttt

SEQ ID NO: 925107 - DNA, 22 bp, Artificial Sequence
  chemically synthesized
ctgacaacataatgaagaggat

SEQ ID NO: 925108 - DNA, 22 bp, Artificial Sequence
  chemically synthesized
ttctaagtaaaatcctcttcat

SEQ ID NO: 925109 - DNA, 22 bp, Artificial Sequence
  chemically synthesized
taagtaaaatcctcttcattat

SEQ ID NO: 925110 - DNA, 22 bp, Artificial Sequence
  chemically synthesized
agtaaaatcctcttcattatgt

SEQ ID NO: 925111 - DNA, 22 bp, Artificial Sequence
  chemically synthesized
aagcaatggattgctgacaaca

SEQ ID NO: 925112 - DNA, 22 bp, Artificial Sequence
  chemically synthesized
caagcaatggattgctgacaac

SEQ ID NO: 925113 - DNA, 22 bp, Artificial Sequence
  chemically synthesized
ttcattatgttgtcagcaatcc

SEQ ID NO: 925114 - DNA, 22 bp, Artificial Sequence
  chemically synthesized
cattatgttgtcagcaatccat

SEQ ID NO: 925115 - DNA, 22 bp, Artificial Sequence
  chemically synthesized
attatgttgtcagcaatccatt

SEQ ID NO: 925116 - DNA, 22 bp, Artificial Sequence
  chemically synthesized
tgttgtcagcaatccattgctt

SEQ ID NO: 925117 - DNA, 22 bp, Artificial Sequence
  chemically synthesized
gggagccaggccttcaagcaat

SEQ ID NO: 925118 - DNA, 22 bp, Artificial Sequence
  chemically synthesized
tcagcaatccattgcttgaagg

SEQ ID NO: 925119 - DNA, 22 bp, Artificial Sequence
  chemically synthesized
tggggagccaggccttcaagca

SEQ ID NO: 925120 - DNA, 22 bp, Artificial Sequence
  chemically synthesized
cttgaaggcctggctccccaga

SEQ ID NO: 925121 - DNA, 22 bp, Artificial Sequence
  chemically synthesized
gaaggcctggctccccagaacc

SEQ ID NO: 925122 - DNA, 22 bp, Artificial Sequence
  chemically synthesized
aaggcctggctccccagaaccc

SEQ ID NO: 925123 - DNA, 22 bp, Artificial Sequence
  chemically synthesized
gctccccagaacccctcgactg

SEQ ID NO: 925124 - DNA, 22 bp, Artificial Sequence
  chemically synthesized
ggagaagacataccagtcgagg

SEQ ID NO: 925125 - DNA, 22 bp, Artificial Sequence
  chemically synthesized
taggagaagacataccagtcga

SEQ ID NO: 925126 - DNA, 22 bp, Artificial Sequence
  chemically synthesized
cccagaacccctcgactggtat

SEQ ID NO: 925127 - DNA, 22 bp, Artificial Sequence
  chemically synthesized
gagtattctaggagaagacata

SEQ ID NO: 925128 - DNA, 22 bp, Artificial Sequence
  chemically synthesized
tggagtattctaggagaagaca

SEQ ID NO: 925129 - DNA, 22 bp, Artificial Sequence
  chemically synthesized
ctggagtattctaggagaagac

SEQ ID NO: 925130 - DNA, 22 bp, Artificial Sequence
  chemically synthesized
ttctggagtattctaggagaag

SEQ ID NO: 925131 - DNA, 22 bp, Artificial Sequence
  chemically synthesized
gactggtatgtcttctcctaga

SEQ ID NO: 925132 - DNA, 22 bp, Artificial Sequence
  chemically synthesized
cttctggagtattctaggagaa

SEQ ID NO: 925133 - DNA, 22 bp, Artificial Sequence
  chemically synthesized
tcttctggagtattctaggaga

SEQ ID NO: 925134 - DNA, 22 bp, Artificial Sequence
  chemically synthesized
ttcttctggagtattctaggag

SEQ ID NO: 925135 - DNA, 22 bp, Artificial Sequence
  chemically synthesized
gtatgtcttctcctagaatact

SEQ ID NO: 925136 - DNA, 22 bp, Artificial Sequence
  chemically synthesized
cttttcttctggagtattctag

SEQ ID NO: 925137 - DNA, 22 bp, Artificial Sequence
  chemically synthesized
atacactccttttcttctggag

SEQ ID NO: 925138 - DNA, 22 bp, Artificial Sequence
  chemically synthesized
ctcctagaatactccagaagaa

SEQ ID NO: 925139 - DNA, 22 bp, Artificial Sequence
  chemically synthesized
catacactccttttcttctgga

SEQ ID NO: 925140 - DNA, 22 bp, Artificial Sequence
  chemically synthesized
tcctagaatactccagaagaaa

SEQ ID NO: 925141 - DNA, 22 bp, Artificial Sequence
  chemically synthesized
ctagaatactccagaagaaaag

SEQ ID NO: 925142 - DNA, 22 bp, Artificial Sequence
  chemically synthesized
tcttcatacactccttttcttc

SEQ ID NO: 925143 - DNA, 22 bp, Artificial Sequence
  chemically synthesized
gaatactccagaagaaaaggag

SEQ ID NO: 925144 - DNA, 22 bp, Artificial Sequence
  chemically synthesized
cagaagaaaaggagtgtatgaa

SEQ ID NO: 925145 - DNA, 22 bp, Artificial Sequence
  chemically synthesized
atgtgcagtcactatcttcata

SEQ ID NO: 925146 - DNA, 22 bp, Artificial Sequence
  chemically synthesized
aatgtgcagtcactatcttcat

SEQ ID NO: 925147 - DNA, 22 bp, Artificial Sequence
  chemically synthesized
taatgtgcagtcactatcttca

SEQ ID NO: 925148 - DNA, 22 bp, Artificial Sequence
  chemically synthesized
agtcattttaatgtgcagtcac

SEQ ID NO: 925149 - DNA, 22 bp, Artificial Sequence
  chemically synthesized
cagtcattttaatgtgcagtca

SEQ ID NO: 925150 - DNA, 22 bp, Artificial Sequence
  chemically synthesized
tggtttcagtcattttaatgtg

SEQ ID NO: 925151 - DNA, 22 bp, Artificial Sequence
  chemically synthesized
ctatggtttcagtcattttaat

SEQ ID NO: 925152 - DNA, 22 bp, Artificial Sequence
  chemically synthesized
actatggtttcagtcattttaa

SEQ ID NO: 925153 - DNA, 22 bp, Artificial Sequence
  chemically synthesized
atttactatggtttcagtcatt

SEQ ID NO: 925154 - DNA, 22 bp, Artificial Sequence
  chemically synthesized
cacattaaaatgactgaaacca

SEQ ID NO: 925155 - DNA, 22 bp, Artificial Sequence
  chemically synthesized
atcctaatttactatggtttca

SEQ ID NO: 925156 - DNA, 22 bp, Artificial Sequence
  chemically synthesized
aaatgactgaaaccatagtaaa

SEQ ID NO: 925157 - DNA, 22 bp, Artificial Sequence
  chemically synthesized
cccagaatctcatcctaattta

SEQ ID NO: 925158 - DNA, 22 bp, Artificial Sequence
  chemically synthesized
aaaccatagtaaattaggatga

SEQ ID NO: 925159 - DNA, 22 bp, Artificial Sequence
  chemically synthesized
tctgcccagaatctcatcctaa

SEQ ID NO: 925160 - DNA, 22 bp, Artificial Sequence
  chemically synthesized
atctgcccagaatctcatccta

SEQ ID NO: 925161 - DNA, 22 bp, Artificial Sequence
  chemically synthesized
tttatctgcccagaatctcatc

SEQ ID NO: 925162 - DNA, 22 bp, Artificial Sequence
  chemically synthesized
tctgtttatctgcccagaatct

SEQ ID NO: 925163 - DNA, 22 bp, Artificial Sequence
  chemically synthesized
ggatgagattctgggcagataa

SEQ ID NO: 925164 - DNA, 22 bp, Artificial Sequence
  chemically synthesized
gccagctgtctgtttatctgcc

SEQ ID NO: 925165 - DNA, 22 bp, Artificial Sequence
  chemically synthesized
tgggcagataaacagacagctg

SEQ ID NO: 925166 - DNA, 22 bp, Artificial Sequence
  chemically synthesized
ggcagataaacagacagctggc

SEQ ID NO: 925167 - DNA, 22 bp, Artificial Sequence
  chemically synthesized
gctaggatcatttttttatgcc

SEQ ID NO: 925168 - DNA, 22 bp, Artificial Sequence
  chemically synthesized
ccaaagaagtccaaggcataaa

SEQ ID NO: 925169 - DNA, 22 bp, Artificial Sequence
  chemically synthesized
ggatcatttttttatgccttgg

SEQ ID NO: 925170 - DNA, 22 bp, Artificial Sequence
  chemically synthesized
aacagattgccaaagaagtcca

SEQ ID NO: 925171 - DNA, 22 bp, Artificial Sequence
  chemically synthesized
caacagattgccaaagaagtcc

SEQ ID NO: 925172 - DNA, 22 bp, Artificial Sequence
  chemically synthesized
ttttatgccttggacttctttg

SEQ ID NO: 925173 - DNA, 22 bp, Artificial Sequence
  chemically synthesized
tttatgccttggacttctttgg

SEQ ID NO: 925174 - DNA, 22 bp, Artificial Sequence
  chemically synthesized
ttatgccttggacttctttggc

SEQ ID NO: 925175 - DNA, 22 bp, Artificial Sequence
  chemically synthesized
tatgccttggacttctttggca

SEQ ID NO: 925176 - DNA, 22 bp, Artificial Sequence
  chemically synthesized
atgccttggacttctttggcaa

SEQ ID NO: 925177 - DNA, 22 bp, Artificial Sequence
  chemically synthesized
tgccttggacttctttggcaat

SEQ ID NO: 925178 - DNA, 22 bp, Artificial Sequence
  chemically synthesized
ggacttctttggcaatctgttg

SEQ ID NO: 925179 - DNA, 22 bp, Artificial Sequence
  chemically synthesized
gacttctttggcaatctgttga

SEQ ID NO: 925180 - DNA, 22 bp, Artificial Sequence
  chemically synthesized
aggaatgtcaggcttcaacaga

SEQ ID NO: 925181 - DNA, 22 bp, Artificial Sequence
  chemically synthesized
tgaggaatgtcaggcttcaaca

SEQ ID NO: 925182 - DNA, 22 bp, Artificial Sequence
  chemically synthesized
ctttggcaatctgttgaagcct

SEQ ID NO: 925183 - DNA, 22 bp, Artificial Sequence
  chemically synthesized
tttggcaatctgttgaagcctg

SEQ ID NO: 925184 - DNA, 22 bp, Artificial Sequence
  chemically synthesized
ttctgaggaatgtcaggcttca

SEQ ID NO: 925185 - DNA, 22 bp, Artificial Sequence
  chemically synthesized
tggcaatctgttgaagcctgac

SEQ ID NO: 925186 - DNA, 22 bp, Artificial Sequence
  chemically synthesized
ggcaatctgttgaagcctgaca

SEQ ID NO: 925187 - DNA, 22 bp, Artificial Sequence
  chemically synthesized
gcaatctgttgaagcctgacat

SEQ ID NO: 925188 - DNA, 22 bp, Artificial Sequence
  chemically synthesized
aaacattattctgaggaatgtc

SEQ ID NO: 925189 - DNA, 22 bp, Artificial Sequence
  chemically synthesized
aaaacattattctgaggaatgt

SEQ ID NO: 925190 - DNA, 22 bp, Artificial Sequence
  chemically synthesized
taaaacattattctgaggaatg

SEQ ID NO: 925191 - DNA, 22 bp, Artificial Sequence
  chemically synthesized
ttgaagcctgacattcctcaga

SEQ ID NO: 925192 - DNA, 22 bp, Artificial Sequence
  chemically synthesized
aagcctgacattcctcagaata

SEQ ID NO: 925193 - DNA, 22 bp, Artificial Sequence
  chemically synthesized
ggctttaaaacattattctgag

SEQ ID NO: 925194 - DNA, 22 bp, Artificial Sequence
  chemically synthesized
ttgggctttaaaacattattct

SEQ ID NO: 925195 - DNA, 22 bp, Artificial Sequence
  chemically synthesized
acattcctcagaataatgtttt

SEQ ID NO: 925196 - DNA, 22 bp, Artificial Sequence
  chemically synthesized
ttgttgggctttaaaacattat

SEQ ID NO: 925197 - DNA, 22 bp, Artificial Sequence
  chemically synthesized
attgttgggctttaaaacatta

SEQ ID NO: 925198 - DNA, 22 bp, Artificial Sequence
  chemically synthesized
ctcagaataatgttttaaagcc

SEQ ID NO: 925199 - DNA, 22 bp, Artificial Sequence
  chemically synthesized
agaataatgttttaaagcccaa

SEQ ID NO: 925200 - DNA, 22 bp, Artificial Sequence
  chemically synthesized
cagggtcttattgttgggcttt

SEQ ID NO: 925201 - DNA, 22 bp, Artificial Sequence
  chemically synthesized
tatgtgctacagggtcttattg

SEQ ID NO: 925202 - DNA, 22 bp, Artificial Sequence
  chemically synthesized
taaagcccaacaataagaccct

SEQ ID NO: 925203 - DNA, 22 bp, Artificial Sequence
  chemically synthesized
aaagcccaacaataagaccctg

SEQ ID NO: 925204 - DNA, 22 bp, Artificial Sequence
  chemically synthesized
ttatatgtgctacagggtctta

SEQ ID NO: 925205 - DNA, 22 bp, Artificial Sequence
  chemically synthesized
aagcccaacaataagaccctgt

SEQ ID NO: 925206 - DNA, 22 bp, Artificial Sequence
  chemically synthesized
attatatgtgctacagggtctt

SEQ ID NO: 925207 - DNA, 22 bp, Artificial Sequence
  chemically synthesized
cagtacttattatatgtgctac

SEQ ID NO: 925208 - DNA, 22 bp, Artificial Sequence
  chemically synthesized
aaaactgcagtacttattatat

SEQ ID NO: 925209 - DNA, 22 bp, Artificial Sequence
  chemically synthesized
caaaactgcagtacttattata

SEQ ID NO: 925210 - DNA, 22 bp, Artificial Sequence
  chemically synthesized
cttcaaaactgcagtacttatt

SEQ ID NO: 925211 - DNA, 22 bp, Artificial Sequence
  chemically synthesized
tagcacatataataagtactgc

SEQ ID NO: 925212 - DNA, 22 bp, Artificial Sequence
  chemically synthesized
tcactacttcaaaactgcagta

SEQ ID NO: 925213 - DNA, 22 bp, Artificial Sequence
  chemically synthesized
atcactacttcaaaactgcagt

SEQ ID NO: 925214 - DNA, 22 bp, Artificial Sequence
  chemically synthesized
tgcttatcactacttcaaaact

SEQ ID NO: 925215 - DNA, 22 bp, Artificial Sequence
  chemically synthesized
atgcttatcactacttcaaaac

SEQ ID NO: 925216 - DNA, 22 bp, Artificial Sequence
  chemically synthesized
cagttttgaagtagtgataagc

SEQ ID NO: 925217 - DNA, 22 bp, Artificial Sequence
  chemically synthesized
tgaagtagtgataagcataaat

SEQ ID NO: 925218 - DNA, 22 bp, Artificial Sequence
  chemically synthesized
gaagtagtgataagcataaatg

SEQ ID NO: 925219 - DNA, 22 bp, Artificial Sequence
  chemically synthesized
aagtagtgataagcataaatga

SEQ ID NO: 925220 - DNA, 22 bp, Artificial Sequence
  chemically synthesized
taataaatatatcaaaatatca

SEQ ID NO: 925221 - DNA, 22 bp, Artificial Sequence
  chemically synthesized
cagttataataaatatatcaaa

SEQ ID NO: 925222 - DNA, 22 bp, Artificial Sequence
  chemically synthesized
attacagttataataaatatat

SEQ ID NO: 925223 - DNA, 22 bp, Artificial Sequence
  chemically synthesized
tgatatatttattataactgta

SEQ ID NO: 925224 - DNA, 22 bp, Artificial Sequence
  chemically synthesized
gatatatttattataactgtaa

SEQ ID NO: 925225 - DNA, 22 bp, Artificial Sequence
  chemically synthesized
atatatttattataactgtaat

SEQ ID NO: 925226 - DNA, 22 bp, Artificial Sequence
  chemically synthesized
attataactgtaatgagatgtg

SEQ ID NO: 925227 - DNA, 22 bp, Artificial Sequence
  chemically synthesized
ttataactgtaatgagatgtgt

SEQ ID NO: 925228 - DNA, 22 bp, Artificial Sequence
  chemically synthesized
taactgtaatgagatgtgtaca

SEQ ID NO: 925229 - DNA, 22 bp, Artificial Sequence
  chemically synthesized
tgaagtcacagatatgtacaca

SEQ ID NO: 925230 - DNA, 22 bp, Artificial Sequence
  chemically synthesized
taatgagatgtgtacatatctg

SEQ ID NO: 925231 - DNA, 22 bp, Artificial Sequence
  chemically synthesized
tgacttcataggtactgattgt

SEQ ID NO: 925232 - DNA, 22 bp, Artificial Sequence
  chemically synthesized
cataggtactgattgtactact

SEQ ID NO: 925233 - DNA, 22 bp, Artificial Sequence
  chemically synthesized
ataggtactgattgtactactg

SEQ ID NO: 925234 - DNA, 22 bp, Artificial Sequence
  chemically synthesized
aaagtaggcaaaaaaatcacag

SEQ ID NO: 925235 - DNA, 22 bp, Artificial Sequence
  chemically synthesized
gaaagtaggcaaaaaaatcaca

SEQ ID NO: 925236 - DNA, 22 bp, Artificial Sequence
  chemically synthesized
tgaaagtaggcaaaaaaatcac

SEQ ID NO: 925237 - DNA, 22 bp, Artificial Sequence
  chemically synthesized
attgtactactgtgattttttt

SEQ ID NO: 925238 - DNA, 22 bp, Artificial Sequence
  chemically synthesized
attttgaaagtaggcaaaaaaa

SEQ ID NO: 925239 - DNA, 22 bp, Artificial Sequence
  chemically synthesized
tactactgtgatttttttgcct

SEQ ID NO: 925240 - DNA, 22 bp, Artificial Sequence
  chemically synthesized
cattttgaaagtaggcaaaaaa

SEQ ID NO: 925241 - DNA, 22 bp, Artificial Sequence
  chemically synthesized
tcattttgaaagtaggcaaaaa

SEQ ID NO: 925242 - DNA, 22 bp, Artificial Sequence
  chemically synthesized
ttcattttgaaagtaggcaaaa

SEQ ID NO: 925243 - DNA, 22 bp, Artificial Sequence
  chemically synthesized
ctgtgatttttttgcctacttt

SEQ ID NO: 925244 - DNA, 22 bp, Artificial Sequence
  chemically synthesized
cttttcattttgaaagtaggca

SEQ ID NO: 925245 - DNA, 22 bp, Artificial Sequence
  chemically synthesized
tgatttttttgcctactttcaa

SEQ ID NO: 925246 - DNA, 22 bp, Artificial Sequence
  chemically synthesized
agcattccttttcattttgaaa

SEQ ID NO: 925247 - DNA, 22 bp, Artificial Sequence
  chemically synthesized
ttttgcctactttcaaaatgaa

SEQ ID NO: 925248 - DNA, 22 bp, Artificial Sequence
  chemically synthesized
tttgcctactttcaaaatgaaa

SEQ ID NO: 925249 - DNA, 22 bp, Artificial Sequence
  chemically synthesized
ttgcctactttcaaaatgaaaa

SEQ ID NO: 925250 - DNA, 22 bp, Artificial Sequence
  chemically synthesized
tgcctactttcaaaatgaaaag

SEQ ID NO: 925251 - DNA, 22 bp, Artificial Sequence
  chemically synthesized
gcctactttcaaaatgaaaagg

SEQ ID NO: 925252 - DNA, 22 bp, Artificial Sequence
  chemically synthesized
aaattaagcattccttttcatt

SEQ ID NO: 925253 - DNA, 22 bp, Artificial Sequence
  chemically synthesized
cctactttcaaaatgaaaagga

SEQ ID NO: 925254 - DNA, 22 bp, Artificial Sequence
  chemically synthesized
actgaaattaagcattcctttt

SEQ ID NO: 925255 - DNA, 22 bp, Artificial Sequence
  chemically synthesized
ctttcaaaatgaaaaggaatgc

SEQ ID NO: 925256 - DNA, 22 bp, Artificial Sequence
  chemically synthesized
taactgaaattaagcattcctt

SEQ ID NO: 925257 - DNA, 22 bp, Artificial Sequence
  chemically synthesized
tcaaaatgaaaaggaatgctta

SEQ ID NO: 925258 - DNA, 22 bp, Artificial Sequence
  chemically synthesized
caaaatgaaaaggaatgcttaa

SEQ ID NO: 925259 - DNA, 22 bp, Artificial Sequence
  chemically synthesized
aaaatgaaaaggaatgcttaat

SEQ ID NO: 925260 - DNA, 22 bp, Artificial Sequence
  chemically synthesized
acctctaactgaaattaagcat

SEQ ID NO: 925261 - DNA, 22 bp, Artificial Sequence
  chemically synthesized
ctaacctctaactgaaattaag

SEQ ID NO: 925262 - DNA, 22 bp, Artificial Sequence
  chemically synthesized
actaacctctaactgaaattaa

SEQ ID NO: 925263 - DNA, 22 bp, Artificial Sequence
  chemically synthesized
tactaacctctaactgaaatta

SEQ ID NO: 925264 - DNA, 22 bp, Artificial Sequence
  chemically synthesized
tctttactaacctctaactgaa

SEQ ID NO: 925265 - DNA, 22 bp, Artificial Sequence
  chemically synthesized
gtctttactaacctctaactga

SEQ ID NO: 925266 - DNA, 22 bp, Artificial Sequence
  chemically synthesized
tttgtctttactaacctctaac

SEQ ID NO: 925267 - DNA, 22 bp, Artificial Sequence
  chemically synthesized
cctatttgtctttactaacctc

SEQ ID NO: 925268 - DNA, 22 bp, Artificial Sequence
  chemically synthesized
aatttcagttagaggttagtaa

SEQ ID NO: 925269 - DNA, 22 bp, Artificial Sequence
  chemically synthesized
atttcagttagaggttagtaaa

SEQ ID NO: 925270 - DNA, 22 bp, Artificial Sequence
  chemically synthesized
cagttagaggttagtaaagaca

SEQ ID NO: 925271 - DNA, 22 bp, Artificial Sequence
  chemically synthesized
agttagaggttagtaaagacaa

SEQ ID NO: 925272 - DNA, 22 bp, Artificial Sequence
  chemically synthesized
gaggttagtaaagacaaatagg

SEQ ID NO: 925273 - DNA, 22 bp, Artificial Sequence
  chemically synthesized
gagaagaaaattacctatttgt

SEQ ID NO: 925274 - DNA, 22 bp, Artificial Sequence
  chemically synthesized
actggagaagaaaattacctat

SEQ ID NO: 925275 - DNA, 22 bp, Artificial Sequence
  chemically synthesized
cactggagaagaaaattaccta

SEQ ID NO: 925276 - DNA, 22 bp, Artificial Sequence
  chemically synthesized
gtaaagacaaataggtaatttt

SEQ ID NO: 925277 - DNA, 22 bp, Artificial Sequence
  chemically synthesized
ttcactggagaagaaaattacc

SEQ ID NO: 925278 - DNA, 22 bp, Artificial Sequence
  chemically synthesized
tcttctccagtgaagagcatgg

SEQ ID NO: 925279 - DNA, 22 bp, Artificial Sequence
  chemically synthesized
cttctccagtgaagagcatggc

SEQ ID NO: 925280 - DNA, 22 bp, Artificial Sequence
  chemically synthesized
ttctccagtgaagagcatggcg

SEQ ID NO: 925281 - DNA, 22 bp, Artificial Sequence
  chemically synthesized
ctccagtgaagagcatggcgcc

SEQ ID NO: 925282 - DNA, 22 bp, Artificial Sequence
  chemically synthesized
tccagtgaagagcatggcgccc

SEQ ID NO: 925283 - DNA, 22 bp, Artificial Sequence
  chemically synthesized
cagtgaagagcatggcgcccct

SEQ ID NO: 925284 - DNA, 22 bp, Artificial Sequence
  chemically synthesized
agcaagcgtccatgaatagcaa

SEQ ID NO: 925285 - DNA, 22 bp, Artificial Sequence
  chemically synthesized
aagcaagcgtccatgaatagca

SEQ ID NO: 925286 - DNA, 22 bp, Artificial Sequence
  chemically synthesized
taagcaagcgtccatgaatagc

SEQ ID NO: 925287 - DNA, 22 bp, Artificial Sequence
  chemically synthesized
gctattcatggacgcttgctta

SEQ ID NO: 925288 - DNA, 22 bp, Artificial Sequence
  chemically synthesized
tgtacaagtctttaagcaagcg

SEQ ID NO: 925289 - DNA, 22 bp, Artificial Sequence
  chemically synthesized
ctattcatggacgcttgcttaa

SEQ ID NO: 925290 - DNA, 22 bp, Artificial Sequence
  chemically synthesized
ttcatggacgcttgcttaaaga

SEQ ID NO: 925291 - DNA, 22 bp, Artificial Sequence
  chemically synthesized
atggacgcttgcttaaagactt

SEQ ID NO: 925292 - DNA, 22 bp, Artificial Sequence
  chemically synthesized
atacaaagcaagcctgtgtaca

SEQ ID NO: 925293 - DNA, 22 bp, Artificial Sequence
  chemically synthesized
gcttaaagacttgtacacaggc

SEQ ID NO: 925294 - DNA, 22 bp, Artificial Sequence
  chemically synthesized
cttaaagacttgtacacaggct

SEQ ID NO: 925295 - DNA, 22 bp, Artificial Sequence
  chemically synthesized
aaagacttgtacacaggcttgc

SEQ ID NO: 925296 - DNA, 22 bp, Artificial Sequence
  chemically synthesized
aagacttgtacacaggcttgct

SEQ ID NO: 925297 - DNA, 22 bp, Artificial Sequence
  chemically synthesized
gtacacaggcttgctttgtatc

SEQ ID NO: 925298 - DNA, 22 bp, Artificial Sequence
  chemically synthesized
tacacaggcttgctttgtatca

SEQ ID NO: 925299 - DNA, 22 bp, Artificial Sequence
  chemically synthesized
taaggggaagtcataggttgat

SEQ ID NO: 925300 - DNA, 22 bp, Artificial Sequence
  chemically synthesized
gctttgtatcaacctatgactt

SEQ ID NO: 925301 - DNA, 22 bp, Artificial Sequence
  chemically synthesized
ctttgtatcaacctatgacttc

SEQ ID NO: 925302 - DNA, 22 bp, Artificial Sequence
  chemically synthesized
tgtatcaacctatgacttcccc

SEQ ID NO: 925303 - DNA, 22 bp, Artificial Sequence
  chemically synthesized
gtatcaacctatgacttcccct

SEQ ID NO: 925304 - DNA, 22 bp, Artificial Sequence
  chemically synthesized
tcatcggctgtaaggggaagtc

SEQ ID NO: 925305 - DNA, 22 bp, Artificial Sequence
  chemically synthesized
tatcaacctatgacttcccctt

SEQ ID NO: 925306 - DNA, 22 bp, Artificial Sequence
  chemically synthesized
tgacttccccttacagccgatg

SEQ ID NO: 925307 - DNA, 22 bp, Artificial Sequence
  chemically synthesized
ccccttacagccgatgataggt

SEQ ID NO: 925308 - DNA, 22 bp, Artificial Sequence
  chemically synthesized
cccttacagccgatgataggtt

SEQ ID NO: 925309 - DNA, 22 bp, Artificial Sequence
  chemically synthesized
acagccgatgataggtttttat

SEQ ID NO: 925310 - DNA, 22 bp, Artificial Sequence
  chemically synthesized
cagccgatgataggtttttatt

SEQ ID NO: 925311 - DNA, 22 bp, Artificial Sequence
  chemically synthesized
tacacgaaggaggtgcaaataa

SEQ ID NO: 925312 - DNA, 22 bp, Artificial Sequence
  chemically synthesized
gtacacgaaggaggtgcaaata

SEQ ID NO: 925313 - DNA, 22 bp, Artificial Sequence
  chemically synthesized
tgtacacgaaggaggtgcaaat

SEQ ID NO: 925314 - DNA, 22 bp, Artificial Sequence
  chemically synthesized
tctttgtacacgaaggaggtgc

SEQ ID NO: 925315 - DNA, 22 bp, Artificial Sequence
  chemically synthesized
ttatttgcacctccttcgtgta

SEQ ID NO: 925316 - DNA, 22 bp, Artificial Sequence
  chemically synthesized
tatttgcacctccttcgtgtac

SEQ ID NO: 925317 - DNA, 22 bp, Artificial Sequence
  chemically synthesized
atttgcacctccttcgtgtaca

SEQ ID NO: 925318 - DNA, 22 bp, Artificial Sequence
  chemically synthesized
tttgcacctccttcgtgtacaa

SEQ ID NO: 925319 - DNA, 22 bp, Artificial Sequence
  chemically synthesized
gcacctccttcgtgtacaaaga

SEQ ID NO: 925320 - DNA, 22 bp, Artificial Sequence
  chemically synthesized
cacctccttcgtgtacaaagac

SEQ ID NO: 925321 - DNA, 22 bp, Artificial Sequence
  chemically synthesized
cttcgtgtacaaagacagtttt

SEQ ID NO: 925322 - DNA, 22 bp, Artificial Sequence
  chemically synthesized
cgtgtacaaagacagttttggt

SEQ ID NO: 925323 - DNA, 22 bp, Artificial Sequence
  chemically synthesized
gtgtacaaagacagttttggtg

SEQ ID NO: 925324 - DNA, 22 bp, Artificial Sequence
  chemically synthesized
atgatggcgtagccaccaaaac

SEQ ID NO: 925325 - DNA, 22 bp, Artificial Sequence
  chemically synthesized
aatgatggcgtagccaccaaaa

SEQ ID NO: 925326 - DNA, 22 bp, Artificial Sequence
  chemically synthesized
tggtggctacgccatcattaaa

SEQ ID NO: 925327 - DNA, 22 bp, Artificial Sequence
  chemically synthesized
ggtggctacgccatcattaaac

SEQ ID NO: 925328 - DNA, 22 bp, Artificial Sequence
  chemically synthesized
gtggctacgccatcattaaact

SEQ ID NO: 925329 - DNA, 22 bp, Artificial Sequence
  chemically synthesized
agcatgataataatgagtttaa

SEQ ID NO: 925330 - DNA, 22 bp, Artificial Sequence
  chemically synthesized
aagcatgataataatgagttta

SEQ ID NO: 925331 - DNA, 22 bp, Artificial Sequence
  chemically synthesized
cgccatcattaaactcattatt

SEQ ID NO: 925332 - DNA, 22 bp, Artificial Sequence
  chemically synthesized
taggcttaagcatgataataat

SEQ ID NO: 925333 - DNA, 22 bp, Artificial Sequence
  chemically synthesized
aactcattattatcatgcttaa

SEQ ID NO: 925334 - DNA, 22 bp, Artificial Sequence
  chemically synthesized
gatacatctataggcttaagca

SEQ ID NO: 925335 - DNA, 22 bp, Artificial Sequence
  chemically synthesized
attattatcatgcttaagccta

SEQ ID NO: 925336 - DNA, 22 bp, Artificial Sequence
  chemically synthesized
ttatcatgcttaagcctataga

SEQ ID NO: 925337 - DNA, 22 bp, Artificial Sequence
  chemically synthesized
tcatgcttaagcctatagatgt

SEQ ID NO: 925338 - DNA, 22 bp, Artificial Sequence
  chemically synthesized
tgtaacagaagaactggataca

SEQ ID NO: 925339 - DNA, 22 bp, Artificial Sequence
  chemically synthesized
aagcctatagatgtatccagtt

SEQ ID NO: 925340 - DNA, 22 bp, Artificial Sequence
  chemically synthesized
agcctatagatgtatccagttc

SEQ ID NO: 925341 - DNA, 22 bp, Artificial Sequence
  chemically synthesized
aattatgtaacagaagaactgg

SEQ ID NO: 925342 - DNA, 22 bp, Artificial Sequence
  chemically synthesized
caattatgtaacagaagaactg

SEQ ID NO: 925343 - DNA, 22 bp, Artificial Sequence
  chemically synthesized
tagatgtatccagttcttctgt

SEQ ID NO: 925344 - DNA, 22 bp, Artificial Sequence
  chemically synthesized
cagcttcaattatgtaacagaa

SEQ ID NO: 925345 - DNA, 22 bp, Artificial Sequence
  chemically synthesized
actacagcttcaattatgtaac

SEQ ID NO: 925346 - DNA, 22 bp, Artificial Sequence
  chemically synthesized
ttctgttacataattgaagctg

SEQ ID NO: 925347 - DNA, 22 bp, Artificial Sequence
  chemically synthesized
ctgttacataattgaagctgta

SEQ ID NO: 925348 - DNA, 22 bp, Artificial Sequence
  chemically synthesized
tgttacataattgaagctgtag

SEQ ID NO: 925349 - DNA, 22 bp, Artificial Sequence
  chemically synthesized
ttacataattgaagctgtagtg

SEQ ID NO: 925350 - DNA, 22 bp, Artificial Sequence
  chemically synthesized
agatagacaattcactacagct

SEQ ID NO: 925351 - DNA, 22 bp, Artificial Sequence
  chemically synthesized
aagatagacaattcactacagc

SEQ ID NO: 925352 - DNA, 22 bp, Artificial Sequence
  chemically synthesized
cataattgaagctgtagtgaat

SEQ ID NO: 925353 - DNA, 22 bp, Artificial Sequence
  chemically synthesized
aagctgtagtgaattgtctatc

SEQ ID NO: 925354 - DNA, 22 bp, Artificial Sequence
  chemically synthesized
gcgatgcagtttaagatagaca

SEQ ID NO: 925355 - DNA, 22 bp, Artificial Sequence
  chemically synthesized
tagtgaattgtctatcttaaac

SEQ ID NO: 925356 - DNA, 22 bp, Artificial Sequence
  chemically synthesized
tctatcttaaactgcatcgcta

SEQ ID NO: 925357 - DNA, 22 bp, Artificial Sequence
  chemically synthesized
tcttaaactgcatcgctaactg

SEQ ID NO: 925358 - DNA, 22 bp, Artificial Sequence
  chemically synthesized
aaactgcatcgctaactgacta

SEQ ID NO: 925359 - DNA, 22 bp, Artificial Sequence
  chemically synthesized
aactgcatcgctaactgactac

SEQ ID NO: 925360 - DNA, 22 bp, Artificial Sequence
  chemically synthesized
catcgctaactgactacatttc

SEQ ID NO: 925361 - DNA, 22 bp, Artificial Sequence
  chemically synthesized
gaagcaaatgaagtgtgaaatg

SEQ ID NO: 925362 - DNA, 22 bp, Artificial Sequence
  chemically synthesized
actgactacatttcacacttca

SEQ ID NO: 925363 - DNA, 22 bp, Artificial Sequence
  chemically synthesized
tgttggaagcaaatgaagtgtg

SEQ ID NO: 925364 - DNA, 22 bp, Artificial Sequence
  chemically synthesized
actacatttcacacttcatttg

SEQ ID NO: 925365 - DNA, 22 bp, Artificial Sequence
  chemically synthesized
gtctatgttggaagcaaatgaa

SEQ ID NO: 925366 - DNA, 22 bp, Artificial Sequence
  chemically synthesized
catttcacacttcatttgcttc

SEQ ID NO: 925367 - DNA, 22 bp, Artificial Sequence
  chemically synthesized
cacacttcatttgcttccaaca

SEQ ID NO: 925368 - DNA, 22 bp, Artificial Sequence
  chemically synthesized
acacttcatttgcttccaacat

SEQ ID NO: 925369 - DNA, 22 bp, Artificial Sequence
  chemically synthesized
catttgcttccaacatagacta

SEQ ID NO: 925370 - DNA, 22 bp, Artificial Sequence
  chemically synthesized
atttgcttccaacatagactaa

SEQ ID NO: 925371 - DNA, 22 bp, Artificial Sequence
  chemically synthesized
gcttccaacatagactaacctt

SEQ ID NO: 925372 - DNA, 22 bp, Artificial Sequence
  chemically synthesized
cttccaacatagactaaccttc

SEQ ID NO: 925373 - DNA, 22 bp, Artificial Sequence
  chemically synthesized
ccaacatagactaaccttcttg

SEQ ID NO: 925374 - DNA, 22 bp, Artificial Sequence
  chemically synthesized
caacatagactaaccttcttgg

SEQ ID NO: 925375 - DNA, 22 bp, Artificial Sequence
  chemically synthesized
aaataatagtggacatccaaga

SEQ ID NO: 925376 - DNA, 22 bp, Artificial Sequence
  chemically synthesized
accttcttggatgtccactatt

SEQ ID NO: 925377 - DNA, 22 bp, Artificial Sequence
  chemically synthesized
aaaagttcaaataatagtggac

SEQ ID NO: 925378 - DNA, 22 bp, Artificial Sequence
  chemically synthesized
cttggatgtccactattatttg

SEQ ID NO: 925379 - DNA, 22 bp, Artificial Sequence
  chemically synthesized
ttggatgtccactattatttga

SEQ ID NO: 925380 - DNA, 22 bp, Artificial Sequence
  chemically synthesized
ggatgtccactattatttgaac

SEQ ID NO: 925381 - DNA, 22 bp, Artificial Sequence
  chemically synthesized
gatgtccactattatttgaact

SEQ ID NO: 925382 - DNA, 22 bp, Artificial Sequence
  chemically synthesized
ttatttgaacttttgagatttt

SEQ ID NO: 925383 - DNA, 22 bp, Artificial Sequence
  chemically synthesized
gaaataggaaaaaaaatctcaa

SEQ ID NO: 925384 - DNA, 22 bp, Artificial Sequence
  chemically synthesized
tttgaacttttgagattttttt

SEQ ID NO: 925385 - DNA, 22 bp, Artificial Sequence
  chemically synthesized
gaacttttgagattttttttcc

SEQ ID NO: 925386 - DNA, 22 bp, Artificial Sequence
  chemically synthesized
aacttttgagattttttttcct

SEQ ID NO: 925387 - DNA, 22 bp, Artificial Sequence
  chemically synthesized
agatattagaaataggaaaaaa

SEQ ID NO: 925388 - DNA, 22 bp, Artificial Sequence
  chemically synthesized
aagatattagaaataggaaaaa

SEQ ID NO: 925389 - DNA, 22 bp, Artificial Sequence
  chemically synthesized
taagatattagaaataggaaaa

SEQ ID NO: 925390 - DNA, 22 bp, Artificial Sequence
  chemically synthesized
ttgagattttttttcctatttc

SEQ ID NO: 925391 - DNA, 22 bp, Artificial Sequence
  chemically synthesized
tgagattttttttcctatttct

SEQ ID NO: 925392 - DNA, 22 bp, Artificial Sequence
  chemically synthesized
gagattttttttcctatttcta

SEQ ID NO: 925393 - DNA, 22 bp, Artificial Sequence
  chemically synthesized
agattttttttcctatttctaa

SEQ ID NO: 925394 - DNA, 22 bp, Artificial Sequence
  chemically synthesized
aaattttaagatattagaaata

SEQ ID NO: 925395 - DNA, 22 bp, Artificial Sequence
  chemically synthesized
tgaaattttaagatattagaaa

SEQ ID NO: 925396 - DNA, 22 bp, Artificial Sequence
  chemically synthesized
ctgaaattttaagatattagaa

SEQ ID NO: 925397 - DNA, 22 bp, Artificial Sequence
  chemically synthesized
tttttcctatttctaatatctt

SEQ ID NO: 925398 - DNA, 22 bp, Artificial Sequence
  chemically synthesized
ttttcctatttctaatatctta

SEQ ID NO: 925399 - DNA, 22 bp, Artificial Sequence
  chemically synthesized
tttcctatttctaatatcttaa

SEQ ID NO: 925400 - DNA, 22 bp, Artificial Sequence
  chemically synthesized
ttcctatttctaatatcttaaa

SEQ ID NO: 925401 - DNA, 22 bp, Artificial Sequence
  chemically synthesized
tcctatttctaatatcttaaaa

SEQ ID NO: 925402 - DNA, 22 bp, Artificial Sequence
  chemically synthesized
agtcttctgaaattttaagata

SEQ ID NO: 925403 - DNA, 22 bp, Artificial Sequence
  chemically synthesized
cctatttctaatatcttaaaat

SEQ ID NO: 925404 - DNA, 22 bp, Artificial Sequence
  chemically synthesized
aagtcttctgaaattttaagat

SEQ ID NO: 925405 - DNA, 22 bp, Artificial Sequence
  chemically synthesized
ctatttctaatatcttaaaatt

SEQ ID NO: 925406 - DNA, 22 bp, Artificial Sequence
  chemically synthesized
taagtcttctgaaattttaaga

SEQ ID NO: 925407 - DNA, 22 bp, Artificial Sequence
  chemically synthesized
tttctaatatcttaaaatttca

SEQ ID NO: 925408 - DNA, 22 bp, Artificial Sequence
  chemically synthesized
ctaatatcttaaaatttcagaa

SEQ ID NO: 925409 - DNA, 22 bp, Artificial Sequence
  chemically synthesized
taatatcttaaaatttcagaag

SEQ ID NO: 925410 - DNA, 22 bp, Artificial Sequence
  chemically synthesized
caaaactttaagtcttctgaaa

SEQ ID NO: 925411 - DNA, 22 bp, Artificial Sequence
  chemically synthesized
atatcttaaaatttcagaagac

SEQ ID NO: 925412 - DNA, 22 bp, Artificial Sequence
  chemically synthesized
tagttgcaaaactttaagtctt

SEQ ID NO: 925413 - DNA, 22 bp, Artificial Sequence
  chemically synthesized
aaaatttcagaagacttaaagt

SEQ ID NO: 925414 - DNA, 22 bp, Artificial Sequence
  chemically synthesized
aaatttcagaagacttaaagtt

SEQ ID NO: 925415 - DNA, 22 bp, Artificial Sequence
  chemically synthesized
cagaagacttaaagttttgcaa

SEQ ID NO: 925416 - DNA, 22 bp, Artificial Sequence
  chemically synthesized
agaagacttaaagttttgcaac

SEQ ID NO: 925417 - DNA, 22 bp, Artificial Sequence
  chemically synthesized
tatggagccctgtagttgcaaa

SEQ ID NO: 925418 - DNA, 22 bp, Artificial Sequence
  chemically synthesized
aaagttttgcaactacagggct

SEQ ID NO: 925419 - DNA, 22 bp, Artificial Sequence
  chemically synthesized
aagttttgcaactacagggctc

SEQ ID NO: 925420 - DNA, 22 bp, Artificial Sequence
  chemically synthesized
gatgtctatatggagccctgta

SEQ ID NO: 925421 - DNA, 22 bp, Artificial Sequence
  chemically synthesized
tgcaactacagggctccatata

SEQ ID NO: 925422 - DNA, 22 bp, Artificial Sequence
  chemically synthesized
aagctagatgtctatatggagc

SEQ ID NO: 925423 - DNA, 22 bp, Artificial Sequence
  chemically synthesized
gcaactacagggctccatatag

SEQ ID NO: 925424 - DNA, 22 bp, Artificial Sequence
  chemically synthesized
caactacagggctccatataga

SEQ ID NO: 925425 - DNA, 22 bp, Artificial Sequence
  chemically synthesized
cagggctccatatagacatcta

SEQ ID NO: 925426 - DNA, 22 bp, Artificial Sequence
  chemically synthesized
catatagacatctagcttgaat

SEQ ID NO: 925427 - DNA, 22 bp, Artificial Sequence
  chemically synthesized
gcttgaatttatacactttctt

SEQ ID NO: 925428 - DNA, 22 bp, Artificial Sequence
  chemically synthesized
gaatttatacactttctttcat

SEQ ID NO: 925429 - DNA, 22 bp, Artificial Sequence
  chemically synthesized
aatttatacactttctttcatt

SEQ ID NO: 925430 - DNA, 22 bp, Artificial Sequence
  chemically synthesized
gtccagggacatcaatgaaaga

SEQ ID NO: 925431 - DNA, 22 bp, Artificial Sequence
  chemically synthesized
agtccagggacatcaatgaaag

SEQ ID NO: 925432 - DNA, 22 bp, Artificial Sequence
  chemically synthesized
tagtccagggacatcaatgaaa

SEQ ID NO: 925433 - DNA, 22 bp, Artificial Sequence
  chemically synthesized
ttagtccagggacatcaatgaa

SEQ ID NO: 925434 - DNA, 22 bp, Artificial Sequence
  chemically synthesized
atacactttctttcattgatgt

SEQ ID NO: 925435 - DNA, 22 bp, Artificial Sequence
  chemically synthesized
tttagtccagggacatcaatga

SEQ ID NO: 925436 - DNA, 22 bp, Artificial Sequence
  chemically synthesized
tacactttctttcattgatgtc

SEQ ID NO: 925437 - DNA, 22 bp, Artificial Sequence
  chemically synthesized
acattttttagtccagggacat

SEQ ID NO: 925438 - DNA, 22 bp, Artificial Sequence
  chemically synthesized
aacattttttagtccagggaca

SEQ ID NO: 925439 - DNA, 22 bp, Artificial Sequence
  chemically synthesized
tctttcattgatgtccctggac

SEQ ID NO: 925440 - DNA, 22 bp, Artificial Sequence
  chemically synthesized
ctttcattgatgtccctggact

SEQ ID NO: 925441 - DNA, 22 bp, Artificial Sequence
  chemically synthesized
tttcattgatgtccctggacta

SEQ ID NO: 925442 - DNA, 22 bp, Artificial Sequence
  chemically synthesized
tcattgatgtccctggactaaa

SEQ ID NO: 925443 - DNA, 22 bp, Artificial Sequence
  chemically synthesized
cattgatgtccctggactaaaa

SEQ ID NO: 925444 - DNA, 22 bp, Artificial Sequence
  chemically synthesized
attgatgtccctggactaaaaa

SEQ ID NO: 925445 - DNA, 22 bp, Artificial Sequence
  chemically synthesized
gaaatatttaacattttttagt

SEQ ID NO: 925446 - DNA, 22 bp, Artificial Sequence
  chemically synthesized
atgtccctggactaaaaaatgt

SEQ ID NO: 925447 - DNA, 22 bp, Artificial Sequence
  chemically synthesized
gactaaaaaatgttaaatattt

SEQ ID NO: 925448 - DNA, 22 bp, Artificial Sequence
  chemically synthesized
agtacagcggttagaaatattt

SEQ ID NO: 925449 - DNA, 22 bp, Artificial Sequence
  chemically synthesized
aagtacagcggttagaaatatt

SEQ ID NO: 925450 - DNA, 22 bp, Artificial Sequence
  chemically synthesized
taagtacagcggttagaaatat

SEQ ID NO: 925451 - DNA, 22 bp, Artificial Sequence
  chemically synthesized
aaaaatgttaaatatttctaac

SEQ ID NO: 925452 - DNA, 22 bp, Artificial Sequence
  chemically synthesized
taatggactttaagtacagcgg

SEQ ID NO: 925453 - DNA, 22 bp, Artificial Sequence
  chemically synthesized
aatatttctaaccgctgtactt

SEQ ID NO: 925454 - DNA, 22 bp, Artificial Sequence
  chemically synthesized
gtaatggactttaagtacagcg

SEQ ID NO: 925455 - DNA, 22 bp, Artificial Sequence
  chemically synthesized
gtttgtaatggactttaagtac

SEQ ID NO: 925456 - DNA, 22 bp, Artificial Sequence
  chemically synthesized
cgtttgtaatggactttaagta

SEQ ID NO: 925457 - DNA, 22 bp, Artificial Sequence
  chemically synthesized
ctaaccgctgtacttaaagtcc

SEQ ID NO: 925458 - DNA, 22 bp, Artificial Sequence
  chemically synthesized
taaccgctgtacttaaagtcca

SEQ ID NO: 925459 - DNA, 22 bp, Artificial Sequence
  chemically synthesized
accgctgtacttaaagtccatt

SEQ ID NO: 925460 - DNA, 22 bp, Artificial Sequence
  chemically synthesized
tacttaaagtccattacaaacg

SEQ ID NO: 925461 - DNA, 22 bp, Artificial Sequence
  chemically synthesized
acaacagtagtcttcgtttgta

SEQ ID NO: 925462 - DNA, 22 bp, Artificial Sequence
  chemically synthesized
aacaacagtagtcttcgtttgt

SEQ ID NO: 925463 - DNA, 22 bp, Artificial Sequence
  chemically synthesized
aaagtccattacaaacgaagac

SEQ ID NO: 925464 - DNA, 22 bp, Artificial Sequence
  chemically synthesized
aagtccattacaaacgaagact

SEQ ID NO: 925465 - DNA, 22 bp, Artificial Sequence
  chemically synthesized
aacttaacaacagtagtcttcg

SEQ ID NO: 925466 - DNA, 22 bp, Artificial Sequence
  chemically synthesized
ttcaacttaacaacagtagtct

SEQ ID NO: 925467 - DNA, 22 bp, Artificial Sequence
  chemically synthesized
caaacgaagactactgttgtta

SEQ ID NO: 925468 - DNA, 22 bp, Artificial Sequence
  chemically synthesized
ctgttgttaagttgaataggca

SEQ ID NO: 925469 - DNA, 22 bp, Artificial Sequence
  chemically synthesized
ttgttaagttgaataggcatct

SEQ ID NO: 925470 - DNA, 22 bp, Artificial Sequence
  chemically synthesized
ttaagttgaataggcatcttat

SEQ ID NO: 925471 - DNA, 22 bp, Artificial Sequence
  chemically synthesized
agttgaataggcatcttatata

SEQ ID NO: 925472 - DNA, 22 bp, Artificial Sequence
  chemically synthesized
caccggtgaaaaatatataaga

SEQ ID NO: 925473 - DNA, 22 bp, Artificial Sequence
  chemically synthesized
ttgcaccggtgaaaaatatata

SEQ ID NO: 925474 - DNA, 22 bp, Artificial Sequence
  chemically synthesized
aataggcatcttatatattttt

SEQ ID NO: 925475 - DNA, 22 bp, Artificial Sequence
  chemically synthesized
attgcaccggtgaaaaatatat

SEQ ID NO: 925476 - DNA, 22 bp, Artificial Sequence
  chemically synthesized
tttattgcaccggtgaaaaata

SEQ ID NO: 925477 - DNA, 22 bp, Artificial Sequence
  chemically synthesized
atatatttttcaccggtgcaat

SEQ ID NO: 925478 - DNA, 22 bp, Artificial Sequence
  chemically synthesized
tatatttttcaccggtgcaata

SEQ ID NO: 925479 - DNA, 22 bp, Artificial Sequence
  chemically synthesized
ttcaccggtgcaataaataact

SEQ ID NO: 925480 - DNA, 22 bp, Artificial Sequence
  chemically synthesized
gaagggaatagaagttatttat

SEQ ID NO: 925481 - DNA, 22 bp, Artificial Sequence
  chemically synthesized
tcaccggtgcaataaataactt

SEQ ID NO: 925482 - DNA, 22 bp, Artificial Sequence
  chemically synthesized
caccggtgcaataaataacttc

SEQ ID NO: 925483 - DNA, 22 bp, Artificial Sequence
  chemically synthesized
accggtgcaataaataacttct

SEQ ID NO: 925484 - DNA, 22 bp, Artificial Sequence
  chemically synthesized
agtgcaacgcaagcagatgtta

SEQ ID NO: 925485 - DNA, 22 bp, Artificial Sequence
  chemically synthesized
ctattcccttctaacatctgct

SEQ ID NO: 925486 - DNA, 22 bp, Artificial Sequence
  chemically synthesized
tattcccttctaacatctgctt

SEQ ID NO: 925487 - DNA, 22 bp, Artificial Sequence
  chemically synthesized
tcagtgcaacgcaagcagatgt

SEQ ID NO: 925488 - DNA, 22 bp, Artificial Sequence
  chemically synthesized
ttcccttctaacatctgcttgc

SEQ ID NO: 925489 - DNA, 22 bp, Artificial Sequence
  chemically synthesized
ccttctaacatctgcttgcgtt

SEQ ID NO: 925490 - DNA, 22 bp, Artificial Sequence
  chemically synthesized
ctaacatctgcttgcgttgcac

SEQ ID NO: 925491 - DNA, 22 bp, Artificial Sequence
  chemically synthesized
taacatctgcttgcgttgcact

SEQ ID NO: 925492 - DNA, 22 bp, Artificial Sequence
  chemically synthesized
acatctgcttgcgttgcactga

SEQ ID NO: 925493 - DNA, 22 bp, Artificial Sequence
  chemically synthesized
atcaatagtgtactctcagtgc

SEQ ID NO: 925494 - DNA, 22 bp, Artificial Sequence
  chemically synthesized
ctaatcaatagtgtactctcag

SEQ ID NO: 925495 - DNA, 22 bp, Artificial Sequence
  chemically synthesized
cttgcgttgcactgagagtaca

SEQ ID NO: 925496 - DNA, 22 bp, Artificial Sequence
  chemically synthesized
ttgctaatcaatagtgtactct

SEQ ID NO: 925497 - DNA, 22 bp, Artificial Sequence
  chemically synthesized
gcgttgcactgagagtacacta

SEQ ID NO: 925498 - DNA, 22 bp, Artificial Sequence
  chemically synthesized
cgttgcactgagagtacactat

SEQ ID NO: 925499 - DNA, 22 bp, Artificial Sequence
  chemically synthesized
cactgagagtacactattgatt

SEQ ID NO: 925500 - DNA, 22 bp, Artificial Sequence
  chemically synthesized
agagtacactattgattagcaa

SEQ ID NO: 925501 - DNA, 22 bp, Artificial Sequence
  chemically synthesized
taatcacgaacctattgctaat

SEQ ID NO: 925502 - DNA, 22 bp, Artificial Sequence
  chemically synthesized
ttgattagcaataggttcgtga

SEQ ID NO: 925503 - DNA, 22 bp, Artificial Sequence
  chemically synthesized
tagaagggctgtaatcacgaac

SEQ ID NO: 925504 - DNA, 22 bp, Artificial Sequence
  chemically synthesized
attagcaataggttcgtgatta

SEQ ID NO: 925505 - DNA, 22 bp, Artificial Sequence
  chemically synthesized
attatagaagggctgtaatcac

SEQ ID NO: 925506 - DNA, 22 bp, Artificial Sequence
  chemically synthesized
gcaataggttcgtgattacagc

SEQ ID NO: 925507 - DNA, 22 bp, Artificial Sequence
  chemically synthesized
acaattaattatagaagggctg

SEQ ID NO: 925508 - DNA, 22 bp, Artificial Sequence
  chemically synthesized
gtgattacagcccttctataat

SEQ ID NO: 925509 - DNA, 22 bp, Artificial Sequence
  chemically synthesized
acctaacaattaattatagaag

SEQ ID NO: 925510 - DNA, 22 bp, Artificial Sequence
  chemically synthesized
cagcccttctataattaattgt

SEQ ID NO: 925511 - DNA, 22 bp, Artificial Sequence
  chemically synthesized
tgaataatatgttaacctaaca

SEQ ID NO: 925512 - DNA, 22 bp, Artificial Sequence
  chemically synthesized
ctataattaattgttaggttaa

SEQ ID NO: 925513 - DNA, 22 bp, Artificial Sequence
  chemically synthesized
atgaataatatgttaacctaac

SEQ ID NO: 925514 - DNA, 22 bp, Artificial Sequence
  chemically synthesized
tataattaattgttaggttaac

SEQ ID NO: 925515 - DNA, 22 bp, Artificial Sequence
  chemically synthesized
tatgaataatatgttaacctaa

SEQ ID NO: 925516 - DNA, 22 bp, Artificial Sequence
  chemically synthesized
taattaattgttaggttaacat

SEQ ID NO: 925517 - DNA, 22 bp, Artificial Sequence
  chemically synthesized
attgttaggttaacatattatt

SEQ ID NO: 925518 - DNA, 22 bp, Artificial Sequence
  chemically synthesized
ttaggttaacatattattcata

SEQ ID NO: 925519 - DNA, 22 bp, Artificial Sequence
  chemically synthesized
ataaaataatattttatgaata

SEQ ID NO: 925520 - DNA, 22 bp, Artificial Sequence
  chemically synthesized
ggttaacatattattcataaaa

SEQ ID NO: 925521 - DNA, 22 bp, Artificial Sequence
  chemically synthesized
acatattattcataaaatatta

SEQ ID NO: 925522 - DNA, 22 bp, Artificial Sequence
  chemically synthesized
ttcataaaatattattttatta

SEQ ID NO: 925523 - DNA, 22 bp, Artificial Sequence
  chemically synthesized
ataaaatattattttattaatt

SEQ ID NO: 925524 - DNA, 22 bp, Artificial Sequence
  chemically synthesized
ttttattaatttttacttgatt

SEQ ID NO: 925525 - DNA, 22 bp, Artificial Sequence
  chemically synthesized
agcatccagtagcaaatcaagt

SEQ ID NO: 925526 - DNA, 22 bp, Artificial Sequence
  chemically synthesized
tattaatttttacttgatttgc

SEQ ID NO: 925527 - DNA, 22 bp, Artificial Sequence
  chemically synthesized
attaatttttacttgatttgct

SEQ ID NO: 925528 - DNA, 22 bp, Artificial Sequence
  chemically synthesized
taagcatccagtagcaaatcaa

SEQ ID NO: 925529 - DNA, 22 bp, Artificial Sequence
  chemically synthesized
ttaatttttacttgatttgcta

SEQ ID NO: 925530 - DNA, 22 bp, Artificial Sequence
  chemically synthesized
ctaagcatccagtagcaaatca

SEQ ID NO: 925531 - DNA, 22 bp, Artificial Sequence
  chemically synthesized
atttttacttgatttgctactg

SEQ ID NO: 925532 - DNA, 22 bp, Artificial Sequence
  chemically synthesized
tttctaagcatccagtagcaaa

SEQ ID NO: 925533 - DNA, 22 bp, Artificial Sequence
  chemically synthesized
ttacttgatttgctactggatg

SEQ ID NO: 925534 - DNA, 22 bp, Artificial Sequence
  chemically synthesized
tacttgatttgctactggatgc

SEQ ID NO: 925535 - DNA, 22 bp, Artificial Sequence
  chemically synthesized
acttgatttgctactggatgct

SEQ ID NO: 925536 - DNA, 22 bp, Artificial Sequence
  chemically synthesized
cttgatttgctactggatgctt

SEQ ID NO: 925537 - DNA, 22 bp, Artificial Sequence
  chemically synthesized
atagctatttctaagcatccag

SEQ ID NO: 925538 - DNA, 22 bp, Artificial Sequence
  chemically synthesized
gatttgctactggatgcttaga

SEQ ID NO: 925539 - DNA, 22 bp, Artificial Sequence
  chemically synthesized
atttgctactggatgcttagaa

SEQ ID NO: 925540 - DNA, 22 bp, Artificial Sequence
  chemically synthesized
gctactggatgcttagaaatag

SEQ ID NO: 925541 - DNA, 22 bp, Artificial Sequence
  chemically synthesized
ctactggatgcttagaaatagc

SEQ ID NO: 925542 - DNA, 22 bp, Artificial Sequence
  chemically synthesized
ccaatatactcatagctatttc

SEQ ID NO: 925543 - DNA, 22 bp, Artificial Sequence
  chemically synthesized
ctggatgcttagaaatagctat

SEQ ID NO: 925544 - DNA, 22 bp, Artificial Sequence
  chemically synthesized
taccaatatactcatagctatt

SEQ ID NO: 925545 - DNA, 22 bp, Artificial Sequence
  chemically synthesized
gatgcttagaaatagctatgag

SEQ ID NO: 925546 - DNA, 22 bp, Artificial Sequence
  chemically synthesized
gttctaccaatatactcatagc

SEQ ID NO: 925547 - DNA, 22 bp, Artificial Sequence
  chemically synthesized
agaaatagctatgagtatattg

SEQ ID NO: 925548 - DNA, 22 bp, Artificial Sequence
  chemically synthesized
gaaatagctatgagtatattgg

SEQ ID NO: 925549 - DNA, 22 bp, Artificial Sequence
  chemically synthesized
tgagtatattggtagaaccagt

SEQ ID NO: 925550 - DNA, 22 bp, Artificial Sequence
  chemically synthesized
gtagaaccagtacttatatttt

SEQ ID NO: 925551 - DNA, 22 bp, Artificial Sequence
  chemically synthesized
tgaaatgtaaaaatgtaataaa

SEQ ID NO: 925552 - DNA, 22 bp, Artificial Sequence
  chemically synthesized
atgaaatgtaaaaatgtaataa

SEQ ID NO: 925553 - DNA, 22 bp, Artificial Sequence
  chemically synthesized
tatgaaatgtaaaaatgtaata

SEQ ID NO: 925554 - DNA, 22 bp, Artificial Sequence
  chemically synthesized
aattttatgaaatgtaaaaatg

SEQ ID NO: 925555 - DNA, 22 bp, Artificial Sequence
  chemically synthesized
atattttattacatttttacat

SEQ ID NO: 925556 - DNA, 22 bp, Artificial Sequence
  chemically synthesized
aaattttatgaaatgtaaaaat

SEQ ID NO: 925557 - DNA, 22 bp, Artificial Sequence
  chemically synthesized
tattttattacatttttacatt

SEQ ID NO: 925558 - DNA, 22 bp, Artificial Sequence
  chemically synthesized
tattacatttttacatttcata

SEQ ID NO: 925559 - DNA, 22 bp, Artificial Sequence
  chemically synthesized
attacatttttacatttcataa

SEQ ID NO: 925560 - DNA, 22 bp, Artificial Sequence
  chemically synthesized
ttacatttttacatttcataaa

SEQ ID NO: 925561 - DNA, 22 bp, Artificial Sequence
  chemically synthesized
tatcacttaaattttatgaaat

SEQ ID NO: 925562 - DNA, 22 bp, Artificial Sequence
  chemically synthesized
atatcacttaaattttatgaaa

SEQ ID NO: 925563 - DNA, 22 bp, Artificial Sequence
  chemically synthesized
tatatcacttaaattttatgaa

SEQ ID NO: 925564 - DNA, 22 bp, Artificial Sequence
  chemically synthesized
catttttacatttcataaaatt

SEQ ID NO: 925565 - DNA, 22 bp, Artificial Sequence
  chemically synthesized
ttatatcacttaaattttatga

SEQ ID NO: 925566 - DNA, 22 bp, Artificial Sequence
  chemically synthesized
ttacatttcataaaatttaagt

SEQ ID NO: 925567 - DNA, 22 bp, Artificial Sequence
  chemically synthesized
tacatttcataaaatttaagtg

SEQ ID NO: 925568 - DNA, 22 bp, Artificial Sequence
  chemically synthesized
acatttcataaaatttaagtga

SEQ ID NO: 925569 - DNA, 22 bp, Artificial Sequence
  chemically synthesized
aggatttttatatcacttaaat

SEQ ID NO: 925570 - DNA, 22 bp, Artificial Sequence
  chemically synthesized
catttcataaaatttaagtgat

SEQ ID NO: 925571 - DNA, 22 bp, Artificial Sequence
  chemically synthesized
ctcaggatttttatatcactta

SEQ ID NO: 925572 - DNA, 22 bp, Artificial Sequence
  chemically synthesized
cctcaggatttttatatcactt

SEQ ID NO: 925573 - DNA, 22 bp, Artificial Sequence
  chemically synthesized
cataaaatttaagtgatataaa

SEQ ID NO: 925574 - DNA, 22 bp, Artificial Sequence
  chemically synthesized
ataaaatttaagtgatataaaa

SEQ ID NO: 925575 - DNA, 22 bp, Artificial Sequence
  chemically synthesized
tggcatacttcctcaggatttt

SEQ ID NO: 925576 - DNA, 22 bp, Artificial Sequence
  chemically synthesized
gtggcatacttcctcaggattt

SEQ ID NO: 925577 - DNA, 22 bp, Artificial Sequence
  chemically synthesized
aagtgatataaaaatcctgagg

SEQ ID NO: 925578 - DNA, 22 bp, Artificial Sequence
  chemically synthesized
tgtggcatacttcctcaggatt

SEQ ID NO: 925579 - DNA, 22 bp, Artificial Sequence
  chemically synthesized
agtgatataaaaatcctgagga

SEQ ID NO: 925580 - DNA, 22 bp, Artificial Sequence
  chemically synthesized
ttgtggcatacttcctcaggat

SEQ ID NO: 925581 - DNA, 22 bp, Artificial Sequence
  chemically synthesized
agaccacttttgtggcatactt

SEQ ID NO: 925582 - DNA, 22 bp, Artificial Sequence
  chemically synthesized
cactgagaccacttttgtggca

SEQ ID NO: 925583 - DNA, 22 bp, Artificial Sequence
  chemically synthesized
ccactgagaccacttttgtggc

SEQ ID NO: 925584 - DNA, 22 bp, Artificial Sequence
  chemically synthesized
aggaagtatgccacaaaagtgg

SEQ ID NO: 925585 - DNA, 22 bp, Artificial Sequence
  chemically synthesized
aatttccactgagaccactttt

SEQ ID NO: 925586 - DNA, 22 bp, Artificial Sequence
  chemically synthesized
aaatttccactgagaccacttt

SEQ ID NO: 925587 - DNA, 22 bp, Artificial Sequence
  chemically synthesized
acatatttaaatttccactgag

SEQ ID NO: 925588 - DNA, 22 bp, Artificial Sequence
  chemically synthesized
aaaataaatgttaacatattta

SEQ ID NO: 925589 - DNA, 22 bp, Artificial Sequence
  chemically synthesized
aaaaataaatgttaacatattt

SEQ ID NO: 925590 - DNA, 22 bp, Artificial Sequence
  chemically synthesized
agtggaaatttaaatatgttaa

SEQ ID NO: 925591 - DNA, 22 bp, Artificial Sequence
  chemically synthesized
taaaaataaatgttaacatatt

SEQ ID NO: 925592 - DNA, 22 bp, Artificial Sequence
  chemically synthesized
cattttaaaaataaatgttaac

SEQ ID NO: 925593 - DNA, 22 bp, Artificial Sequence
  chemically synthesized
aaatatgttaacatttattttt

SEQ ID NO: 925594 - DNA, 22 bp, Artificial Sequence
  chemically synthesized
acgctacattttaaaaataaat

SEQ ID NO: 925595 - DNA, 22 bp, Artificial Sequence
  chemically synthesized
aatatgttaacatttattttta

SEQ ID NO: 925596 - DNA, 22 bp, Artificial Sequence
  chemically synthesized
cacgctacattttaaaaataaa

SEQ ID NO: 925597 - DNA, 22 bp, Artificial Sequence
  chemically synthesized
tttcacgctacattttaaaaat

SEQ ID NO: 925598 - DNA, 22 bp, Artificial Sequence
  chemically synthesized
tctatttcacgctacattttaa

SEQ ID NO: 925599 - DNA, 22 bp, Artificial Sequence
  chemically synthesized
acatttatttttaaaatgtagc

SEQ ID NO: 925600 - DNA, 22 bp, Artificial Sequence
  chemically synthesized
aagttgtctatttcacgctaca

SEQ ID NO: 925601 - DNA, 22 bp, Artificial Sequence
  chemically synthesized
aaagttgtctatttcacgctac

SEQ ID NO: 925602 - DNA, 22 bp, Artificial Sequence
  chemically synthesized
atttttaaaatgtagcgtgaaa

SEQ ID NO: 925603 - DNA, 22 bp, Artificial Sequence
  chemically synthesized
taaagttgtctatttcacgcta

SEQ ID NO: 925604 - DNA, 22 bp, Artificial Sequence
  chemically synthesized
tttttaaaatgtagcgtgaaat

SEQ ID NO: 925605 - DNA, 22 bp, Artificial Sequence
  chemically synthesized
ttaaagttgtctatttcacgct

SEQ ID NO: 925606 - DNA, 22 bp, Artificial Sequence
  chemically synthesized
ttaaaatgtagcgtgaaataga

SEQ ID NO: 925607 - DNA, 22 bp, Artificial Sequence
  chemically synthesized
taaaatgtagcgtgaaatagac

SEQ ID NO: 925608 - DNA, 22 bp, Artificial Sequence
  chemically synthesized
aaaatgtagcgtgaaatagaca

SEQ ID NO: 925609 - DNA, 22 bp, Artificial Sequence
  chemically synthesized
agcttttaaagttgtctatttc

SEQ ID NO: 925610 - DNA, 22 bp, Artificial Sequence
  chemically synthesized
aaatgtagcgtgaaatagacaa

SEQ ID NO: 925611 - DNA, 22 bp, Artificial Sequence
  chemically synthesized
agctgagcttttaaagttgtct

SEQ ID NO: 925612 - DNA, 22 bp, Artificial Sequence
  chemically synthesized
aagctgagcttttaaagttgtc

SEQ ID NO: 925613 - DNA, 22 bp, Artificial Sequence
  chemically synthesized
taagctgagcttttaaagttgt

SEQ ID NO: 925614 - DNA, 22 bp, Artificial Sequence
  chemically synthesized
ttaagctgagcttttaaagttg

SEQ ID NO: 925615 - DNA, 22 bp, Artificial Sequence
  chemically synthesized
tttaagctgagcttttaaagtt

SEQ ID NO: 925616 - DNA, 22 bp, Artificial Sequence
  chemically synthesized
ttttaagctgagcttttaaagt

SEQ ID NO: 925617 - DNA, 22 bp, Artificial Sequence
  chemically synthesized
tttttaagctgagcttttaaag

SEQ ID NO: 925618 - DNA, 22 bp, Artificial Sequence
  chemically synthesized
ttttttaagctgagcttttaaa

SEQ ID NO: 925619 - DNA, 22 bp, Artificial Sequence
  chemically synthesized
tttttttaagctgagcttttaa

SEQ ID NO: 925620 - DNA, 22 bp, Artificial Sequence
  chemically synthesized
agttttttttttaagctgagct

SEQ ID NO: 925621 - DNA, 22 bp, Artificial Sequence
  chemically synthesized
gagttttttttttaagctgagc

SEQ ID NO: 925622 - DNA, 22 bp, Artificial Sequence
  chemically synthesized
cttgagttttttttttaagctg

SEQ ID NO: 925623 - DNA, 22 bp, Artificial Sequence
  chemically synthesized
ccttgagttttttttttaagct

SEQ ID NO: 925624 - DNA, 22 bp, Artificial Sequence
  chemically synthesized
taaaagctcagcttaaaaaaaa

SEQ ID NO: 925625 - DNA, 22 bp, Artificial Sequence
  chemically synthesized
aaaagctcagcttaaaaaaaaa

SEQ ID NO: 925626 - DNA, 22 bp, Artificial Sequence
  chemically synthesized
aaagctcagcttaaaaaaaaaa

SEQ ID NO: 925627 - DNA, 22 bp, Artificial Sequence
  chemically synthesized
agcttccttgagtttttttttt

SEQ ID NO: 925628 - DNA, 22 bp, Artificial Sequence
  chemically synthesized
agcttaaaaaaaaaactcaagg

SEQ ID NO: 925629 - DNA, 22 bp, Artificial Sequence
  chemically synthesized
aaaaaaaaaactcaaggaagct

SEQ ID NO: 925630 - DNA, 22 bp, Artificial Sequence
  chemically synthesized
aaaaaaaaactcaaggaagctg

SEQ ID NO: 925631 - DNA, 22 bp, Artificial Sequence
  chemically synthesized
aaaagtcaagttcagcttcctt

SEQ ID NO: 925632 - DNA, 22 bp, Artificial Sequence
  chemically synthesized
aaaaagtcaagttcagcttcct

SEQ ID NO: 925633 - DNA, 22 bp, Artificial Sequence
  chemically synthesized
taaaaagtcaagttcagcttcc

SEQ ID NO: 925634 - DNA, 22 bp, Artificial Sequence
  chemically synthesized
agtgctttaaaaagtcaagttc

SEQ ID NO: 925635 - DNA, 22 bp, Artificial Sequence
  chemically synthesized
cagtgctttaaaaagtcaagtt

SEQ ID NO: 925636 - DNA, 22 bp, Artificial Sequence
  chemically synthesized
aaggaagctgaacttgactttt

SEQ ID NO: 925637 - DNA, 22 bp, Artificial Sequence
  chemically synthesized
cacttcagtgctttaaaaagtc

SEQ ID NO: 925638 - DNA, 22 bp, Artificial Sequence
  chemically synthesized
aacttgactttttaaagcactg

SEQ ID NO: 925639 - DNA, 22 bp, Artificial Sequence
  chemically synthesized
aatattgcacttcagtgcttta

SEQ ID NO: 925640 - DNA, 22 bp, Artificial Sequence
  chemically synthesized
gactttttaaagcactgaagtg

SEQ ID NO: 925641 - DNA, 22 bp, Artificial Sequence
  chemically synthesized
cattaaatattgcacttcagtg

SEQ ID NO: 925642 - DNA, 22 bp, Artificial Sequence
  chemically synthesized
actttttaaagcactgaagtgc

SEQ ID NO: 925643 - DNA, 22 bp, Artificial Sequence
  chemically synthesized
tttaaagcactgaagtgcaata

SEQ ID NO: 925644 - DNA, 22 bp, Artificial Sequence
  chemically synthesized
acctacattaaatattgcactt

SEQ ID NO: 925645 - DNA, 22 bp, Artificial Sequence
  chemically synthesized
ttaaagcactgaagtgcaatat

SEQ ID NO: 925646 - DNA, 22 bp, Artificial Sequence
  chemically synthesized
taaagcactgaagtgcaatatt

SEQ ID NO: 925647 - DNA, 22 bp, Artificial Sequence
  chemically synthesized
aaagcactgaagtgcaatattt

SEQ ID NO: 925648 - DNA, 22 bp, Artificial Sequence
  chemically synthesized
aagcactgaagtgcaatattta

SEQ ID NO: 925649 - DNA, 22 bp, Artificial Sequence
  chemically synthesized
aacatgttgacctacattaaat

SEQ ID NO: 925650 - DNA, 22 bp, Artificial Sequence
  chemically synthesized
aaacatgttgacctacattaaa

SEQ ID NO: 925651 - DNA, 22 bp, Artificial Sequence
  chemically synthesized
aagtgcaatatttaatgtaggt

SEQ ID NO: 925652 - DNA, 22 bp, Artificial Sequence
  chemically synthesized
ccatttaaacatgttgacctac

SEQ ID NO: 925653 - DNA, 22 bp, Artificial Sequence
  chemically synthesized
cccatttaaacatgttgaccta

SEQ ID NO: 925654 - DNA, 22 bp, Artificial Sequence
  chemically synthesized
tcccatttaaacatgttgacct

SEQ ID NO: 925655 - DNA, 22 bp, Artificial Sequence
  chemically synthesized
aatgtaggtcaacatgtttaaa

SEQ ID NO: 925656 - DNA, 22 bp, Artificial Sequence
  chemically synthesized
atgtaggtcaacatgtttaaat

SEQ ID NO: 925657 - DNA, 22 bp, Artificial Sequence
  chemically synthesized
ggaaaaaaattttcccatttaa

SEQ ID NO: 925658 - DNA, 22 bp, Artificial Sequence
  chemically synthesized
taattaggaaaaaaattttccc

SEQ ID NO: 925659 - DNA, 22 bp, Artificial Sequence
  chemically synthesized
gctgtaattaggaaaaaaattt

SEQ ID NO: 925660 - DNA, 22 bp, Artificial Sequence
  chemically synthesized
ggctgtaattaggaaaaaaatt

SEQ ID NO: 925661 - DNA, 22 bp, Artificial Sequence
  chemically synthesized
aaatgggaaaatttttttccta

SEQ ID NO: 925662 - DNA, 22 bp, Artificial Sequence
  chemically synthesized
aatgggaaaatttttttcctaa

SEQ ID NO: 925663 - DNA, 22 bp, Artificial Sequence
  chemically synthesized
gggatttggctgtaattaggaa

SEQ ID NO: 925664 - DNA, 22 bp, Artificial Sequence
  chemically synthesized
cagctagggatttggctgtaat

SEQ ID NO: 925665 - DNA, 22 bp, Artificial Sequence
  chemically synthesized
ttttcctaattacagccaaatc

SEQ ID NO: 925666 - DNA, 22 bp, Artificial Sequence
  chemically synthesized
attacagctagggatttggctg

SEQ ID NO: 925667 - DNA, 22 bp, Artificial Sequence
  chemically synthesized
tttcctaattacagccaaatcc

SEQ ID NO: 925668 - DNA, 22 bp, Artificial Sequence
  chemically synthesized
ttcctaattacagccaaatccc

SEQ ID NO: 925669 - DNA, 22 bp, Artificial Sequence
  chemically synthesized
tcctaattacagccaaatccct

SEQ ID NO: 925670 - DNA, 22 bp, Artificial Sequence
  chemically synthesized
cctaattacagccaaatcccta

SEQ ID NO: 925671 - DNA, 22 bp, Artificial Sequence
  chemically synthesized
ctaattacagccaaatccctag

SEQ ID NO: 925672 - DNA, 22 bp, Artificial Sequence
  chemically synthesized
agttaattacagctagggattt

SEQ ID NO: 925673 - DNA, 22 bp, Artificial Sequence
  chemically synthesized
aagttaattacagctagggatt

SEQ ID NO: 925674 - DNA, 22 bp, Artificial Sequence
  chemically synthesized
taagttaattacagctagggat

SEQ ID NO: 925675 - DNA, 22 bp, Artificial Sequence
  chemically synthesized
attacagccaaatccctagctg

SEQ ID NO: 925676 - DNA, 22 bp, Artificial Sequence
  chemically synthesized
cagccaaatccctagctgtaat

SEQ ID NO: 925677 - DNA, 22 bp, Artificial Sequence
  chemically synthesized
gctgtaattaacttaaaatttg

SEQ ID NO: 925678 - DNA, 22 bp, Artificial Sequence
  chemically synthesized
tgaaatagtatacaaattttaa

SEQ ID NO: 925679 - DNA, 22 bp, Artificial Sequence
  chemically synthesized
ttgtgaaatagtatacaaattt

SEQ ID NO: 925680 - DNA, 22 bp, Artificial Sequence
  chemically synthesized
taattaacttaaaatttgtata

SEQ ID NO: 925681 - DNA, 22 bp, Artificial Sequence
  chemically synthesized
tgttgtgaaatagtatacaaat

SEQ ID NO: 925682 - DNA, 22 bp, Artificial Sequence
  chemically synthesized
actctgttgtgaaatagtatac

SEQ ID NO: 925683 - DNA, 22 bp, Artificial Sequence
  chemically synthesized
acttaaaatttgtatactattt

SEQ ID NO: 925684 - DNA, 22 bp, Artificial Sequence
  chemically synthesized
aaaatttgtatactatttcaca

SEQ ID NO: 925685 - DNA, 22 bp, Artificial Sequence
  chemically synthesized
aaatttgtatactatttcacaa

SEQ ID NO: 925686 - DNA, 22 bp, Artificial Sequence
  chemically synthesized
gtatactatttcacaacagagt

SEQ ID NO: 925687 - DNA, 22 bp, Artificial Sequence
  chemically synthesized
tatactatttcacaacagagtc

SEQ ID NO: 925688 - DNA, 22 bp, Artificial Sequence
  chemically synthesized
tttcacaacagagtcagcatat

SEQ ID NO: 925689 - DNA, 22 bp, Artificial Sequence
  chemically synthesized
taagaaagtggtatatgctgac

SEQ ID NO: 925690 - DNA, 22 bp, Artificial Sequence
  chemically synthesized
ataagaaagtggtatatgctga

SEQ ID NO: 925691 - DNA, 22 bp, Artificial Sequence
  chemically synthesized
tataagaaagtggtatatgctg

SEQ ID NO: 925692 - DNA, 22 bp, Artificial Sequence
  chemically synthesized
cacaacagagtcagcatatacc

SEQ ID NO: 925693 - DNA, 22 bp, Artificial Sequence
  chemically synthesized
acaacagagtcagcatatacca

SEQ ID NO: 925694 - DNA, 22 bp, Artificial Sequence
  chemically synthesized
attttataagaaagtggtatat

SEQ ID NO: 925695 - DNA, 22 bp, Artificial Sequence
  chemically synthesized
taattttataagaaagtggtat

SEQ ID NO: 925696 - DNA, 22 bp, Artificial Sequence
  chemically synthesized
ctaattttataagaaagtggta

SEQ ID NO: 925697 - DNA, 22 bp, Artificial Sequence
  chemically synthesized
tctaattttataagaaagtggt

SEQ ID NO: 925698 - DNA, 22 bp, Artificial Sequence
  chemically synthesized
gatctttctaattttataagaa

SEQ ID NO: 925699 - DNA, 22 bp, Artificial Sequence
  chemically synthesized
agatctttctaattttataaga

SEQ ID NO: 925700 - DNA, 22 bp, Artificial Sequence
  chemically synthesized
tagatctttctaattttataag

SEQ ID NO: 925701 - DNA, 22 bp, Artificial Sequence
  chemically synthesized
aaattttagatctttctaattt

SEQ ID NO: 925702 - DNA, 22 bp, Artificial Sequence
  chemically synthesized
taaaattttagatctttctaat

SEQ ID NO: 925703 - DNA, 22 bp, Artificial Sequence
  chemically synthesized
tcttataaaattagaaagatct

SEQ ID NO: 925704 - DNA, 22 bp, Artificial Sequence
  chemically synthesized
cttataaaattagaaagatcta

SEQ ID NO: 925705 - DNA, 22 bp, Artificial Sequence
  chemically synthesized
ttataaaattagaaagatctaa

SEQ ID NO: 925706 - DNA, 22 bp, Artificial Sequence
  chemically synthesized
ataaaattagaaagatctaaaa

SEQ ID NO: 925707 - DNA, 22 bp, Artificial Sequence
  chemically synthesized
taaaattagaaagatctaaaat

SEQ ID NO: 925708 - DNA, 22 bp, Artificial Sequence
  chemically synthesized
accaaataagctctaaaatttt

SEQ ID NO: 925709 - DNA, 22 bp, Artificial Sequence
  chemically synthesized
caccaaataagctctaaaattt

SEQ ID NO: 925710 - DNA, 22 bp, Artificial Sequence
  chemically synthesized
gaaagatctaaaattttagagc

SEQ ID NO: 925711 - DNA, 22 bp, Artificial Sequence
  chemically synthesized
tttcaccaaataagctctaaaa

SEQ ID NO: 925712 - DNA, 22 bp, Artificial Sequence
  chemically synthesized
aaattttagagcttatttggtg

SEQ ID NO: 925713 - DNA, 22 bp, Artificial Sequence
  chemically synthesized
tagagcttatttggtgaaacag

SEQ ID NO: 925714 - DNA, 22 bp, Artificial Sequence
  chemically synthesized
agagcttatttggtgaaacagg

SEQ ID NO: 925715 - DNA, 22 bp, Artificial Sequence
  chemically synthesized
gagcttatttggtgaaacaggc

SEQ ID NO: 925716 - DNA, 22 bp, Artificial Sequence
  chemically synthesized
atttggtgaaacaggcatattg

SEQ ID NO: 925717 - DNA, 22 bp, Artificial Sequence
  chemically synthesized
tttggtgaaacaggcatattgc

SEQ ID NO: 925718 - DNA, 22 bp, Artificial Sequence
  chemically synthesized
taaacaaagatgtagcaatatg

SEQ ID NO: 925719 - DNA, 22 bp, Artificial Sequence
  chemically synthesized
ggtgaaacaggcatattgctac

SEQ ID NO: 925720 - DNA, 22 bp, Artificial Sequence
  chemically synthesized
ataaacaaagatgtagcaatat

SEQ ID NO: 925721 - DNA, 22 bp, Artificial Sequence
  chemically synthesized
gtgaaacaggcatattgctaca

SEQ ID NO: 925722 - DNA, 22 bp, Artificial Sequence
  chemically synthesized
taatttataaacaaagatgtag

SEQ ID NO: 925723 - DNA, 22 bp, Artificial Sequence
  chemically synthesized
aaggcacattataatttataaa

SEQ ID NO: 925724 - DNA, 22 bp, Artificial Sequence
  chemically synthesized
ctacatctttgtttataaatta

SEQ ID NO: 925725 - DNA, 22 bp, Artificial Sequence
  chemically synthesized
taaaggcacattataatttata

SEQ ID NO: 925726 - DNA, 22 bp, Artificial Sequence
  chemically synthesized
catctttgtttataaattataa

SEQ ID NO: 925727 - DNA, 22 bp, Artificial Sequence
  chemically synthesized
ggctctaaaggcacattataat

SEQ ID NO: 925728 - DNA, 22 bp, Artificial Sequence
  chemically synthesized
tgtttataaattataatgtgcc

SEQ ID NO: 925729 - DNA, 22 bp, Artificial Sequence
  chemically synthesized
ttgggctctaaaggcacattat

SEQ ID NO: 925730 - DNA, 22 bp, Artificial Sequence
  chemically synthesized
gtttataaattataatgtgcct

SEQ ID NO: 925731 - DNA, 22 bp, Artificial Sequence
  chemically synthesized
tttataaattataatgtgcctt

SEQ ID NO: 925732 - DNA, 22 bp, Artificial Sequence
  chemically synthesized
ttattgggctctaaaggcacat

SEQ ID NO: 925733 - DNA, 22 bp, Artificial Sequence
  chemically synthesized
ataaattataatgtgcctttag

SEQ ID NO: 925734 - DNA, 22 bp, Artificial Sequence
  chemically synthesized
taaattataatgtgcctttaga

SEQ ID NO: 925735 - DNA, 22 bp, Artificial Sequence
  chemically synthesized
tctgttattgggctctaaaggc

SEQ ID NO: 925736 - DNA, 22 bp, Artificial Sequence
  chemically synthesized
ttatctgttattgggctctaaa

SEQ ID NO: 925737 - DNA, 22 bp, Artificial Sequence
  chemically synthesized
gttatctgttattgggctctaa

SEQ ID NO: 925738 - DNA, 22 bp, Artificial Sequence
  chemically synthesized
taatgtgcctttagagcccaat

SEQ ID NO: 925739 - DNA, 22 bp, Artificial Sequence
  chemically synthesized
aaaatcttgttatctgttattg

SEQ ID NO: 925740 - DNA, 22 bp, Artificial Sequence
  chemically synthesized
caaaatcttgttatctgttatt

SEQ ID NO: 925741 - DNA, 22 bp, Artificial Sequence
  chemically synthesized
tcaaaatcttgttatctgttat

SEQ ID NO: 925742 - DNA, 22 bp, Artificial Sequence
  chemically synthesized
tagagcccaataacagataaca

SEQ ID NO: 925743 - DNA, 22 bp, Artificial Sequence
  chemically synthesized
agagcccaataacagataacaa

SEQ ID NO: 925744 - DNA, 22 bp, Artificial Sequence
  chemically synthesized
gagcccaataacagataacaag

SEQ ID NO: 925745 - DNA, 22 bp, Artificial Sequence
  chemically synthesized
aattttcaaaatcttgttatct

SEQ ID NO: 925746 - DNA, 22 bp, Artificial Sequence
  chemically synthesized
acctgaattttcaaaatcttgt

SEQ ID NO: 925747 - DNA, 22 bp, Artificial Sequence
  chemically synthesized
attcacctgaattttcaaaatc

SEQ ID NO: 925748 - DNA, 22 bp, Artificial Sequence
  chemically synthesized
taattcacctgaattttcaaaa

SEQ ID NO: 925749 - DNA, 22 bp, Artificial Sequence
  chemically synthesized
ataactctaattcacctgaatt

SEQ ID NO: 925750 - DNA, 22 bp, Artificial Sequence
  chemically synthesized
tgataactctaattcacctgaa

SEQ ID NO: 925751 - DNA, 22 bp, Artificial Sequence
  chemically synthesized
cctctgataactctaattcacc

SEQ ID NO: 925752 - DNA, 22 bp, Artificial Sequence
  chemically synthesized
tgaaaattcaggtgaattagag

SEQ ID NO: 925753 - DNA, 22 bp, Artificial Sequence
  chemically synthesized
gaaaattcaggtgaattagagt

SEQ ID NO: 925754 - DNA, 22 bp, Artificial Sequence
  chemically synthesized
aaaattcaggtgaattagagtt

SEQ ID NO: 925755 - DNA, 22 bp, Artificial Sequence
  chemically synthesized
acattccctctgataactctaa

SEQ ID NO: 925756 - DNA, 22 bp, Artificial Sequence
  chemically synthesized
aggtgaattagagttatcagag

SEQ ID NO: 925757 - DNA, 22 bp, Artificial Sequence
  chemically synthesized
aatagagtgtattaacattccc

SEQ ID NO: 925758 - DNA, 22 bp, Artificial Sequence
  chemically synthesized
gagttatcagagggaatgttaa

SEQ ID NO: 925759 - DNA, 22 bp, Artificial Sequence
  chemically synthesized
gaatagagtgtattaacattcc

SEQ ID NO: 925760 - DNA, 22 bp, Artificial Sequence
  chemically synthesized
tcagagggaatgttaatacact

SEQ ID NO: 925761 - DNA, 22 bp, Artificial Sequence
  chemically synthesized
atatagtatttgaatagagtgt

SEQ ID NO: 925762 - DNA, 22 bp, Artificial Sequence
  chemically synthesized
ctcatatagtatttgaatagag

SEQ ID NO: 925763 - DNA, 22 bp, Artificial Sequence
  chemically synthesized
actcatatagtatttgaataga

SEQ ID NO: 925764 - DNA, 22 bp, Artificial Sequence
  chemically synthesized
atacactctattcaaatactat

SEQ ID NO: 925765 - DNA, 22 bp, Artificial Sequence
  chemically synthesized
aatgtcttactcatatagtatt

SEQ ID NO: 925766 - DNA, 22 bp, Artificial Sequence
  chemically synthesized
aaatgtcttactcatatagtat

SEQ ID NO: 925767 - DNA, 22 bp, Artificial Sequence
  chemically synthesized
taaatgtcttactcatatagta

SEQ ID NO: 925768 - DNA, 22 bp, Artificial Sequence
  chemically synthesized
ttttaaatgtcttactcatata

SEQ ID NO: 925769 - DNA, 22 bp, Artificial Sequence
  chemically synthesized
tattcaaatactatatgagtaa

SEQ ID NO: 925770 - DNA, 22 bp, Artificial Sequence
  chemically synthesized
ttcaaatactatatgagtaaga

SEQ ID NO: 925771 - DNA, 22 bp, Artificial Sequence
  chemically synthesized
ctattttaaatgtcttactcat

SEQ ID NO: 925772 - DNA, 22 bp, Artificial Sequence
  chemically synthesized
cctattttaaatgtcttactca

SEQ ID NO: 925773 - DNA, 22 bp, Artificial Sequence
  chemically synthesized
aaatactatatgagtaagacat

SEQ ID NO: 925774 - DNA, 22 bp, Artificial Sequence
  chemically synthesized
tttcctattttaaatgtcttac

SEQ ID NO: 925775 - DNA, 22 bp, Artificial Sequence
  chemically synthesized
tatgagtaagacatttaaaata

SEQ ID NO: 925776 - DNA, 22 bp, Artificial Sequence
  chemically synthesized
taatatataaagtattgtttcc

SEQ ID NO: 925777 - DNA, 22 bp, Artificial Sequence
  chemically synthesized
tataatatataaagtattgttt

SEQ ID NO: 925778 - DNA, 22 bp, Artificial Sequence
  chemically synthesized
ctataatatataaagtattgtt

SEQ ID NO: 925779 - DNA, 22 bp, Artificial Sequence
  chemically synthesized
tctataatatataaagtattgt

SEQ ID NO: 925780 - DNA, 22 bp, Artificial Sequence
  chemically synthesized
ttctataatatataaagtattg

SEQ ID NO: 925781 - DNA, 22 bp, Artificial Sequence
  chemically synthesized
aaaataggaaacaatactttat

SEQ ID NO: 925782 - DNA, 22 bp, Artificial Sequence
  chemically synthesized
aaataggaaacaatactttata

SEQ ID NO: 925783 - DNA, 22 bp, Artificial Sequence
  chemically synthesized
tttttctataatatataaagta

SEQ ID NO: 925784 - DNA, 22 bp, Artificial Sequence
  chemically synthesized
gaagattatttttctataatat

SEQ ID NO: 925785 - DNA, 22 bp, Artificial Sequence
  chemically synthesized
tatatattatagaaaaataatc

SEQ ID NO: 925786 - DNA, 22 bp, Artificial Sequence
  chemically synthesized
aatcgactggaagattattttt

SEQ ID NO: 925787 - DNA, 22 bp, Artificial Sequence
  chemically synthesized
atatattatagaaaaataatct

SEQ ID NO: 925788 - DNA, 22 bp, Artificial Sequence
  chemically synthesized
tatattatagaaaaataatctt

SEQ ID NO: 925789 - DNA, 22 bp, Artificial Sequence
  chemically synthesized
tagaaaaataatcttccagtcg

SEQ ID NO: 925790 - DNA, 22 bp, Artificial Sequence
  chemically synthesized
ataaagtggattaaatcgactg

SEQ ID NO: 925791 - DNA, 22 bp, Artificial Sequence
  chemically synthesized
ccagtcgatttaatccacttta

SEQ ID NO: 925792 - DNA, 22 bp, Artificial Sequence
  chemically synthesized
cagtcgatttaatccactttat

SEQ ID NO: 925793 - DNA, 22 bp, Artificial Sequence
  chemically synthesized
aatccactttatgaattctctc

SEQ ID NO: 925794 - DNA, 22 bp, Artificial Sequence
  chemically synthesized
atccactttatgaattctctcc

SEQ ID NO: 925795 - DNA, 22 bp, Artificial Sequence
  chemically synthesized
taaatatatatatacggagaga

SEQ ID NO: 925796 - DNA, 22 bp, Artificial Sequence
  chemically synthesized
tatgaattctctccgtatatat

SEQ ID NO: 925797 - DNA, 22 bp, Artificial Sequence
  chemically synthesized
atgaattctctccgtatatata

SEQ ID NO: 925798 - DNA, 22 bp, Artificial Sequence
  chemically synthesized
tgaattctctccgtatatatat

SEQ ID NO: 925799 - DNA, 22 bp, Artificial Sequence
  chemically synthesized
aataccatactataaatatata

SEQ ID NO: 925800 - DNA, 22 bp, Artificial Sequence
  chemically synthesized
tctccgtatatatatatttata

SEQ ID NO: 925801 - DNA, 22 bp, Artificial Sequence
  chemically synthesized
tccgtatatatatatttatagt

SEQ ID NO: 925802 - DNA, 22 bp, Artificial Sequence
  chemically synthesized
cgtatatatatatttatagtat

SEQ ID NO: 925803 - DNA, 22 bp, Artificial Sequence
  chemically synthesized
aaaaaattgaataccatactat

SEQ ID NO: 925804 - DNA, 22 bp, Artificial Sequence
  chemically synthesized
atagtatggtattcaatttttt

SEQ ID NO: 925805 - DNA, 22 bp, Artificial Sequence
  chemically synthesized
tagtatggtattcaattttttt

SEQ ID NO: 925806 - DNA, 22 bp, Artificial Sequence
  chemically synthesized
agatggtaagaaatgagaaaat

SEQ ID NO: 925807 - DNA, 22 bp, Artificial Sequence
  chemically synthesized
aatttttttaattttctcattt

SEQ ID NO: 925808 - DNA, 22 bp, Artificial Sequence
  chemically synthesized
ttttaattttctcatttcttac

SEQ ID NO: 925809 - DNA, 22 bp, Artificial Sequence
  chemically synthesized
tttaattttctcatttcttacc

SEQ ID NO: 925810 - DNA, 22 bp, Artificial Sequence
  chemically synthesized
ttaattttctcatttcttacca

SEQ ID NO: 925811 - DNA, 22 bp, Artificial Sequence
  chemically synthesized
taattttctcatttcttaccat

SEQ ID NO: 925812 - DNA, 22 bp, Artificial Sequence
  chemically synthesized
atccaaattaagatggtaagaa

SEQ ID NO: 925813 - DNA, 22 bp, Artificial Sequence
  chemically synthesized
aattttctcatttcttaccatc

SEQ ID NO: 925814 - DNA, 22 bp, Artificial Sequence
  chemically synthesized
attttctcatttcttaccatct

SEQ ID NO: 925815 - DNA, 22 bp, Artificial Sequence
  chemically synthesized
tctcatttcttaccatcttaat

SEQ ID NO: 925816 - DNA, 22 bp, Artificial Sequence
  chemically synthesized
aatctaatccaaattaagatgg

SEQ ID NO: 925817 - DNA, 22 bp, Artificial Sequence
  chemically synthesized
ctcatttcttaccatcttaatt

SEQ ID NO: 925818 - DNA, 22 bp, Artificial Sequence
  chemically synthesized
tcatttcttaccatcttaattt

SEQ ID NO: 925819 - DNA, 22 bp, Artificial Sequence
  chemically synthesized
atttcttaccatcttaatttgg

SEQ ID NO: 925820 - DNA, 22 bp, Artificial Sequence
  chemically synthesized
ggctcaatctaatccaaattaa

SEQ ID NO: 925821 - DNA, 22 bp, Artificial Sequence
  chemically synthesized
cttaccatcttaatttggatta

SEQ ID NO: 925822 - DNA, 22 bp, Artificial Sequence
  chemically synthesized
ttaccatcttaatttggattag

SEQ ID NO: 925823 - DNA, 22 bp, Artificial Sequence
  chemically synthesized
aactaggctcaatctaatccaa

SEQ ID NO: 925824 - DNA, 22 bp, Artificial Sequence
  chemically synthesized
accatcttaatttggattagat

SEQ ID NO: 925825 - DNA, 22 bp, Artificial Sequence
  chemically synthesized
ccatcttaatttggattagatt

SEQ ID NO: 925826 - DNA, 22 bp, Artificial Sequence
  chemically synthesized
tgaactaggctcaatctaatcc

SEQ ID NO: 925827 - DNA, 22 bp, Artificial Sequence
  chemically synthesized
ctgaactaggctcaatctaatc

SEQ ID NO: 925828 - DNA, 22 bp, Artificial Sequence
  chemically synthesized
aatttggattagattgagccta

SEQ ID NO: 925829 - DNA, 22 bp, Artificial Sequence
  chemically synthesized
atttggattagattgagcctag

SEQ ID NO: 925830 - DNA, 22 bp, Artificial Sequence
  chemically synthesized
ggattagattgagcctagttca

SEQ ID NO: 925831 - DNA, 22 bp, Artificial Sequence
  chemically synthesized
gattagattgagcctagttcag

SEQ ID NO: 925832 - DNA, 22 bp, Artificial Sequence
  chemically synthesized
tataatgtcatttctgaactag

SEQ ID NO: 925833 - DNA, 22 bp, Artificial Sequence
  chemically synthesized
gattgagcctagttcagaaatg

SEQ ID NO: 925834 - DNA, 22 bp, Artificial Sequence
  chemically synthesized
agcctagttcagaaatgacatt

SEQ ID NO: 925835 - DNA, 22 bp, Artificial Sequence
  chemically synthesized
gttcagaaatgacattatacag

SEQ ID NO: 925836 - DNA, 22 bp, Artificial Sequence
  chemically synthesized
tgaacaggtataaacctgtata

SEQ ID NO: 925837 - DNA, 22 bp, Artificial Sequence
  chemically synthesized
agaaatgacattatacaggttt

SEQ ID NO: 925838 - DNA, 22 bp, Artificial Sequence
  chemically synthesized
tactatgaacaggtataaacct

SEQ ID NO: 925839 - DNA, 22 bp, Artificial Sequence
  chemically synthesized
atactatgaacaggtataaacc

SEQ ID NO: 925840 - DNA, 22 bp, Artificial Sequence
  chemically synthesized
tacaggtttatacctgttcata

SEQ ID NO: 925841 - DNA, 22 bp, Artificial Sequence
  chemically synthesized
atgtgcttatactatgaacagg

SEQ ID NO: 925842 - DNA, 22 bp, Artificial Sequence
  chemically synthesized
gataactgatgtgcttatacta

SEQ ID NO: 925843 - DNA, 22 bp, Artificial Sequence
  chemically synthesized
atacctgttcatagtataagca

SEQ ID NO: 925844 - DNA, 22 bp, Artificial Sequence
  chemically synthesized
agataactgatgtgcttatact

SEQ ID NO: 925845 - DNA, 22 bp, Artificial Sequence
  chemically synthesized
tacctgttcatagtataagcac

SEQ ID NO: 925846 - DNA, 22 bp, Artificial Sequence
  chemically synthesized
tttagataactgatgtgcttat

SEQ ID NO: 925847 - DNA, 22 bp, Artificial Sequence
  chemically synthesized
ttatttagataactgatgtgct

SEQ ID NO: 925848 - DNA, 22 bp, Artificial Sequence
  chemically synthesized
ttcatagtataagcacatcagt

SEQ ID NO: 925849 - DNA, 22 bp, Artificial Sequence
  chemically synthesized
attatttagataactgatgtgc

SEQ ID NO: 925850 - DNA, 22 bp, Artificial Sequence
  chemically synthesized
tattatttagataactgatgtg

SEQ ID NO: 925851 - DNA, 22 bp, Artificial Sequence
  chemically synthesized
atagtataagcacatcagttat

SEQ ID NO: 925852 - DNA, 22 bp, Artificial Sequence
  chemically synthesized
atcatacaagtattttattatt

SEQ ID NO: 925853 - DNA, 22 bp, Artificial Sequence
  chemically synthesized
aatcatacaagtattttattat

SEQ ID NO: 925854 - DNA, 22 bp, Artificial Sequence
  chemically synthesized
ttaatcatacaagtattttatt

SEQ ID NO: 925855 - DNA, 22 bp, Artificial Sequence
  chemically synthesized
tcttaatcatacaagtatttta

SEQ ID NO: 925856 - DNA, 22 bp, Artificial Sequence
  chemically synthesized
ctcttaatcatacaagtatttt

SEQ ID NO: 925857 - DNA, 22 bp, Artificial Sequence
  chemically synthesized
tctaaataataaaatacttgta

SEQ ID NO: 925858 - DNA, 22 bp, Artificial Sequence
  chemically synthesized
ttctcttaatcatacaagtatt

SEQ ID NO: 925859 - DNA, 22 bp, Artificial Sequence
  chemically synthesized
aataataaaatacttgtatgat

SEQ ID NO: 925860 - DNA, 22 bp, Artificial Sequence
  chemically synthesized
aaattcttctcttaatcataca

SEQ ID NO: 925861 - DNA, 22 bp, Artificial Sequence
  chemically synthesized
ccagattgaaattcttctctta

SEQ ID NO: 925862 - DNA, 22 bp, Artificial Sequence
  chemically synthesized
cccagattgaaattcttctctt

SEQ ID NO: 925863 - DNA, 22 bp, Artificial Sequence
  chemically synthesized
tcccagattgaaattcttctct

SEQ ID NO: 925864 - DNA, 22 bp, Artificial Sequence
  chemically synthesized
ttcccagattgaaattcttctc

SEQ ID NO: 925865 - DNA, 22 bp, Artificial Sequence
  chemically synthesized
tttcccagattgaaattcttct

SEQ ID NO: 925866 - DNA, 22 bp, Artificial Sequence
  chemically synthesized
gtatgattaagagaagaatttc

SEQ ID NO: 925867 - DNA, 22 bp, Artificial Sequence
  chemically synthesized
ttttcccagattgaaattcttc

SEQ ID NO: 925868 - DNA, 22 bp, Artificial Sequence
  chemically synthesized
tatgattaagagaagaatttca

SEQ ID NO: 925869 - DNA, 22 bp, Artificial Sequence
  chemically synthesized
agagaagaatttcaatctggga

SEQ ID NO: 925870 - DNA, 22 bp, Artificial Sequence
  chemically synthesized
ggtaagtcatatacttttttcc

SEQ ID NO: 925871 - DNA, 22 bp, Artificial Sequence
  chemically synthesized
aggtaagtcatatacttttttc

SEQ ID NO: 925872 - DNA, 22 bp, Artificial Sequence
  chemically synthesized
cttaggtaagtcatatactttt

SEQ ID NO: 925873 - DNA, 22 bp, Artificial Sequence
  chemically synthesized
caatctgggaaaaaagtatatg

SEQ ID NO: 925874 - DNA, 22 bp, Artificial Sequence
  chemically synthesized
ccttaggtaagtcatatacttt

SEQ ID NO: 925875 - DNA, 22 bp, Artificial Sequence
  chemically synthesized
aatctgggaaaaaagtatatga

SEQ ID NO: 925876 - DNA, 22 bp, Artificial Sequence
  chemically synthesized
cttccttaggtaagtcatatac

SEQ ID NO: 925877 - DNA, 22 bp, Artificial Sequence
  chemically synthesized
ggaaaaaagtatatgacttacc

SEQ ID NO: 925878 - DNA, 22 bp, Artificial Sequence
  chemically synthesized
aactacttccttaggtaagtca

SEQ ID NO: 925879 - DNA, 22 bp, Artificial Sequence
  chemically synthesized
tagttaaactacttccttaggt

SEQ ID NO: 925880 - DNA, 22 bp, Artificial Sequence
  chemically synthesized
gtagttaaactacttccttagg

SEQ ID NO: 925881 - DNA, 22 bp, Artificial Sequence
  chemically synthesized
tgtagttaaactacttccttag

SEQ ID NO: 925882 - DNA, 22 bp, Artificial Sequence
  chemically synthesized
aactttgtagttaaactacttc

SEQ ID NO: 925883 - DNA, 22 bp, Artificial Sequence
  chemically synthesized
acctaaggaagtagtttaacta

SEQ ID NO: 925884 - DNA, 22 bp, Artificial Sequence
  chemically synthesized
cctaaggaagtagtttaactac

SEQ ID NO: 925885 - DNA, 22 bp, Artificial Sequence
  chemically synthesized
aggaagtagtttaactacaaag

SEQ ID NO: 925886 - DNA, 22 bp, Artificial Sequence
  chemically synthesized
aactacaaagtttagttcttta

SEQ ID NO: 925887 - DNA, 22 bp, Artificial Sequence
  chemically synthesized
actacaaagtttagttctttat

SEQ ID NO: 925888 - DNA, 22 bp, Artificial Sequence
  chemically synthesized
tagatagataaaataaagaact

SEQ ID NO: 925889 - DNA, 22 bp, Artificial Sequence
  chemically synthesized
caaagtttagttctttatttta

SEQ ID NO: 925890 - DNA, 22 bp, Artificial Sequence
  chemically synthesized
attatagatagataaaataaag

SEQ ID NO: 925891 - DNA, 22 bp, Artificial Sequence
  chemically synthesized
gattatagatagataaaataaa

SEQ ID NO: 925892 - DNA, 22 bp, Artificial Sequence
  chemically synthesized
ttgattatagatagataaaata

SEQ ID NO: 925893 - DNA, 22 bp, Artificial Sequence
  chemically synthesized
cttgattatagatagataaaat

SEQ ID NO: 925894 - DNA, 22 bp, Artificial Sequence
  chemically synthesized
agttctttattttatctatcta

SEQ ID NO: 925895 - DNA, 22 bp, Artificial Sequence
  chemically synthesized
gttctttattttatctatctat

SEQ ID NO: 925896 - DNA, 22 bp, Artificial Sequence
  chemically synthesized
aaaatcttcttgattatagata

SEQ ID NO: 925897 - DNA, 22 bp, Artificial Sequence
  chemically synthesized
tttattttatctatctataatc

SEQ ID NO: 925898 - DNA, 22 bp, Artificial Sequence
  chemically synthesized
gaaaatcttcttgattatagat

SEQ ID NO: 925899 - DNA, 22 bp, Artificial Sequence
  chemically synthesized
tgaaaatcttcttgattataga

SEQ ID NO: 925900 - DNA, 22 bp, Artificial Sequence
  chemically synthesized
tattttatctatctataatcaa

SEQ ID NO: 925901 - DNA, 22 bp, Artificial Sequence
  chemically synthesized
attttatctatctataatcaag

SEQ ID NO: 925902 - DNA, 22 bp, Artificial Sequence
  chemically synthesized
ttttatctatctataatcaaga

SEQ ID NO: 925903 - DNA, 22 bp, Artificial Sequence
  chemically synthesized
gttttgaaaatcttcttgatta

SEQ ID NO: 925904 - DNA, 22 bp, Artificial Sequence
  chemically synthesized
ggttttgaaaatcttcttgatt

SEQ ID NO: 925905 - DNA, 22 bp, Artificial Sequence
  chemically synthesized
tatctatctataatcaagaaga

SEQ ID NO: 925906 - DNA, 22 bp, Artificial Sequence
  chemically synthesized
atctatctataatcaagaagat

SEQ ID NO: 925907 - DNA, 22 bp, Artificial Sequence
  chemically synthesized
tctatctataatcaagaagatt

SEQ ID NO: 925908 - DNA, 22 bp, Artificial Sequence
  chemically synthesized
agtcttggttttgaaaatcttc

SEQ ID NO: 925909 - DNA, 22 bp, Artificial Sequence
  chemically synthesized
tctataatcaagaagattttca

SEQ ID NO: 925910 - DNA, 22 bp, Artificial Sequence
  chemically synthesized
taatcaagaagattttcaaaac

SEQ ID NO: 925911 - DNA, 22 bp, Artificial Sequence
  chemically synthesized
aataattaagtcttggttttga

SEQ ID NO: 925912 - DNA, 22 bp, Artificial Sequence
  chemically synthesized
gaataattaagtcttggttttg

SEQ ID NO: 925913 - DNA, 22 bp, Artificial Sequence
  chemically synthesized
tgaataattaagtcttggtttt

SEQ ID NO: 925914 - DNA, 22 bp, Artificial Sequence
  chemically synthesized
tcaaaaccaagacttaattatt

SEQ ID NO: 925915 - DNA, 22 bp, Artificial Sequence
  chemically synthesized
caaaaccaagacttaattattc

SEQ ID NO: 925916 - DNA, 22 bp, Artificial Sequence
  chemically synthesized
aaaaccaagacttaattattca

SEQ ID NO: 925917 - DNA, 22 bp, Artificial Sequence
  chemically synthesized
atcaaaagatattttgaataat

SEQ ID NO: 925918 - DNA, 22 bp, Artificial Sequence
  chemically synthesized
tagcctcatcaaaagatatttt

SEQ ID NO: 925919 - DNA, 22 bp, Artificial Sequence
  chemically synthesized
aattattcaaaatatcttttga

SEQ ID NO: 925920 - DNA, 22 bp, Artificial Sequence
  chemically synthesized
attattcaaaatatcttttgat

SEQ ID NO: 925921 - DNA, 22 bp, Artificial Sequence
  chemically synthesized
aagaattatagcctcatcaaaa

SEQ ID NO: 925922 - DNA, 22 bp, Artificial Sequence
  chemically synthesized
ttcaaaatatcttttgatgagg

SEQ ID NO: 925923 - DNA, 22 bp, Artificial Sequence
  chemically synthesized
aaaatatcttttgatgaggcta

SEQ ID NO: 925924 - DNA, 22 bp, Artificial Sequence
  chemically synthesized
ccaaagttaaagaattatagcc

SEQ ID NO: 925925 - DNA, 22 bp, Artificial Sequence
  chemically synthesized
gccaaagttaaagaattatagc

SEQ ID NO: 925926 - DNA, 22 bp, Artificial Sequence
  chemically synthesized
ttgatgaggctataattcttta

SEQ ID NO: 925927 - DNA, 22 bp, Artificial Sequence
  chemically synthesized
tgatgaggctataattctttaa

SEQ ID NO: 925928 - DNA, 22 bp, Artificial Sequence
  chemically synthesized
gatgaggctataattctttaac

SEQ ID NO: 925929 - DNA, 22 bp, Artificial Sequence
  chemically synthesized
atgaggctataattctttaact

SEQ ID NO: 925930 - DNA, 22 bp, Artificial Sequence
  chemically synthesized
taattctttaactttggcaagg

SEQ ID NO: 925931 - DNA, 22 bp, Artificial Sequence
  chemically synthesized
tttaactttggcaaggggtgtg

SEQ ID NO: 925932 - DNA, 22 bp, Artificial Sequence
  chemically synthesized
taactttggcaaggggtgtgtg

SEQ ID NO: 925933 - DNA, 22 bp, Artificial Sequence
  chemically synthesized
aactttggcaaggggtgtgtgt

SEQ ID NO: 925934 - DNA, 22 bp, Artificial Sequence
  chemically synthesized
actttggcaaggggtgtgtgtg

SEQ ID NO: 925935 - DNA, 22 bp, Artificial Sequence
  chemically synthesized
tggcaaggggtgtgtgtgtgtg

SEQ ID NO: 925936 - DNA, 22 bp, Artificial Sequence
  chemically synthesized
ggcaaggggtgtgtgtgtgtgt

SEQ ID NO: 925937 - DNA, 22 bp, Artificial Sequence
  chemically synthesized
gcaaggggtgtgtgtgtgtgtg

SEQ ID NO: 925938 - DNA, 22 bp, Artificial Sequence
  chemically synthesized
aacacacacacacacacacaca

SEQ ID NO: 925939 - DNA, 22 bp, Artificial Sequence
  chemically synthesized
acctaaacacacacacacacac

SEQ ID NO: 925940 - DNA, 22 bp, Artificial Sequence
  chemically synthesized
gttgacctaaacacacacacac

SEQ ID NO: 925941 - DNA, 22 bp, Artificial Sequence
  chemically synthesized
tacaaaataaacacattagttg

SEQ ID NO: 925942 - DNA, 22 bp, Artificial Sequence
  chemically synthesized
gtacaaaataaacacattagtt

SEQ ID NO: 925943 - DNA, 22 bp, Artificial Sequence
  chemically synthesized
tgtacaaaataaacacattagt

SEQ ID NO: 925944 - DNA, 22 bp, Artificial Sequence
  chemically synthesized
aggtcaactaatgtgtttattt

SEQ ID NO: 925945 - DNA, 22 bp, Artificial Sequence
  chemically synthesized
atattttgtacaaaataaacac

SEQ ID NO: 925946 - DNA, 22 bp, Artificial Sequence
  chemically synthesized
ggtcaactaatgtgtttatttt

SEQ ID NO: 925947 - DNA, 22 bp, Artificial Sequence
  chemically synthesized
atgtgtttattttgtacaaaat

SEQ ID NO: 925948 - DNA, 22 bp, Artificial Sequence
  chemically synthesized
attttgtacaaaatatgaattg

SEQ ID NO: 925949 - DNA, 22 bp, Artificial Sequence
  chemically synthesized
agaaagtagatacaattcatat

SEQ ID NO: 925950 - DNA, 22 bp, Artificial Sequence
  chemically synthesized
ttttgtacaaaatatgaattgt

SEQ ID NO: 925951 - DNA, 22 bp, Artificial Sequence
  chemically synthesized
ttcagaaagtagatacaattca

SEQ ID NO: 925952 - DNA, 22 bp, Artificial Sequence
  chemically synthesized
tgtacaaaatatgaattgtatc

SEQ ID NO: 925953 - DNA, 22 bp, Artificial Sequence
  chemically synthesized
gtacaaaatatgaattgtatct

SEQ ID NO: 925954 - DNA, 22 bp, Artificial Sequence
  chemically synthesized
tacaaaatatgaattgtatcta

SEQ ID NO: 925955 - DNA, 22 bp, Artificial Sequence
  chemically synthesized
cattattcagaaagtagataca

SEQ ID NO: 925956 - DNA, 22 bp, Artificial Sequence
  chemically synthesized
atgttacattattcagaaagta

SEQ ID NO: 925957 - DNA, 22 bp, Artificial Sequence
  chemically synthesized
ttcatgttacattattcagaaa

SEQ ID NO: 925958 - DNA, 22 bp, Artificial Sequence
  chemically synthesized
attcatgttacattattcagaa

SEQ ID NO: 925959 - DNA, 22 bp, Artificial Sequence
  chemically synthesized
tattcatgttacattattcaga

SEQ ID NO: 925960 - DNA, 22 bp, Artificial Sequence
  chemically synthesized
tttattcatgttacattattca

SEQ ID NO: 925961 - DNA, 22 bp, Artificial Sequence
  chemically synthesized
tatctactttctgaataatgta

SEQ ID NO: 925962 - DNA, 22 bp, Artificial Sequence
  chemically synthesized
cctctttattcatgttacatta

SEQ ID NO: 925963 - DNA, 22 bp, Artificial Sequence
  chemically synthesized
ccctctttattcatgttacatt

SEQ ID NO: 925964 - DNA, 22 bp, Artificial Sequence
  chemically synthesized
tccctctttattcatgttacat

SEQ ID NO: 925965 - DNA, 22 bp, Artificial Sequence
  chemically synthesized
ctttctgaataatgtaacatga

SEQ ID NO: 925966 - DNA, 22 bp, Artificial Sequence
  chemically synthesized
tttccctctttattcatgttac

SEQ ID NO: 925967 - DNA, 22 bp, Artificial Sequence
  chemically synthesized
tctgaataatgtaacatgaata

SEQ ID NO: 925968 - DNA, 22 bp, Artificial Sequence
  chemically synthesized
ctgaataatgtaacatgaataa

SEQ ID NO: 925969 - DNA, 22 bp, Artificial Sequence
  chemically synthesized
ctctttccctctttattcatgt

SEQ ID NO: 925970 - DNA, 22 bp, Artificial Sequence
  chemically synthesized
tgaataatgtaacatgaataaa

SEQ ID NO: 925971 - DNA, 22 bp, Artificial Sequence
  chemically synthesized
aataatgtaacatgaataaaga

SEQ ID NO: 925972 - DNA, 22 bp, Artificial Sequence
  chemically synthesized
cccacctcctctttccctcttt

SEQ ID NO: 925973 - DNA, 22 bp, Artificial Sequence
  chemically synthesized
gcccacctcctctttccctctt

SEQ ID NO: 925974 - DNA, 22 bp, Artificial Sequence
  chemically synthesized
tgcccacctcctctttccctct

SEQ ID NO: 925975 - DNA, 22 bp, Artificial Sequence
  chemically synthesized
tctttgcccacctcctctttcc

SEQ ID NO: 925976 - DNA, 22 bp, Artificial Sequence
  chemically synthesized
tgtcagttgtctttgcccacct

SEQ ID NO: 925977 - DNA, 22 bp, Artificial Sequence
  chemically synthesized
gaattatgtcagttgtctttgc

SEQ ID NO: 925978 - DNA, 22 bp, Artificial Sequence
  chemically synthesized
ggaattatgtcagttgtctttg

SEQ ID NO: 925979 - DNA, 22 bp, Artificial Sequence
  chemically synthesized
tggaattatgtcagttgtcttt

SEQ ID NO: 925980 - DNA, 22 bp, Artificial Sequence
  chemically synthesized
aaaagaagattttggaattatg

SEQ ID NO: 925981 - DNA, 22 bp, Artificial Sequence
  chemically synthesized
agatgtattaaaaagaagattt

SEQ ID NO: 925982 - DNA, 22 bp, Artificial Sequence
  chemically synthesized
acataattccaaaatcttcttt

SEQ ID NO: 925983 - DNA, 22 bp, Artificial Sequence
  chemically synthesized
gttaagatgtattaaaaagaag

SEQ ID NO: 925984 - DNA, 22 bp, Artificial Sequence
  chemically synthesized
cgttaagatgtattaaaaagaa

SEQ ID NO: 925985 - DNA, 22 bp, Artificial Sequence
  chemically synthesized
tcgttaagatgtattaaaaaga

SEQ ID NO: 925986 - DNA, 22 bp, Artificial Sequence
  chemically synthesized
caaaatcttctttttaatacat

SEQ ID NO: 925987 - DNA, 22 bp, Artificial Sequence
  chemically synthesized
atgaatatctttcgttaagatg

SEQ ID NO: 925988 - DNA, 22 bp, Artificial Sequence
  chemically synthesized
ctttttaatacatcttaacgaa

SEQ ID NO: 925989 - DNA, 22 bp, Artificial Sequence
  chemically synthesized
tttttaatacatcttaacgaaa

SEQ ID NO: 925990 - DNA, 22 bp, Artificial Sequence
  chemically synthesized
attgatgaatatctttcgttaa

SEQ ID NO: 925991 - DNA, 22 bp, Artificial Sequence
  chemically synthesized
tttaatacatcttaacgaaaga

SEQ ID NO: 925992 - DNA, 22 bp, Artificial Sequence
  chemically synthesized
ttaatacatcttaacgaaagat

SEQ ID NO: 925993 - DNA, 22 bp, Artificial Sequence
  chemically synthesized
taatacatcttaacgaaagata

SEQ ID NO: 925994 - DNA, 22 bp, Artificial Sequence
  chemically synthesized
aatacatcttaacgaaagatat

SEQ ID NO: 925995 - DNA, 22 bp, Artificial Sequence
  chemically synthesized
atacatcttaacgaaagatatt

SEQ ID NO: 925996 - DNA, 22 bp, Artificial Sequence
  chemically synthesized
gaacaactcattgatgaatatc

SEQ ID NO: 925997 - DNA, 22 bp, Artificial Sequence
  chemically synthesized
aacgaaagatattcatcaatga

SEQ ID NO: 925998 - DNA, 22 bp, Artificial Sequence
  chemically synthesized
acgaaagatattcatcaatgag

SEQ ID NO: 925999 - DNA, 22 bp, Artificial Sequence
  chemically synthesized
aggaagctagaacaactcattg

SEQ ID NO: 926000 - DNA, 22 bp, Artificial Sequence
  chemically synthesized
atattcaggaagctagaacaac

SEQ ID NO: 926001 - DNA, 22 bp, Artificial Sequence
  chemically synthesized
aatattcaggaagctagaacaa

SEQ ID NO: 926002 - DNA, 22 bp, Artificial Sequence
  chemically synthesized
taatattcaggaagctagaaca

SEQ ID NO: 926003 - DNA, 22 bp, Artificial Sequence
  chemically synthesized
atcaatgagttgttctagcttc

SEQ ID NO: 926004 - DNA, 22 bp, Artificial Sequence
  chemically synthesized
ttctagcttcctgaatattaaa

SEQ ID NO: 926005 - DNA, 22 bp, Artificial Sequence
  chemically synthesized
tagcttcctgaatattaaaatc

SEQ ID NO: 926006 - DNA, 22 bp, Artificial Sequence
  chemically synthesized
gcttcctgaatattaaaatcca

SEQ ID NO: 926007 - DNA, 22 bp, Artificial Sequence
  chemically synthesized
cctgaatattaaaatccaccta

SEQ ID NO: 926008 - DNA, 22 bp, Artificial Sequence
  chemically synthesized
ctgaatattaaaatccacctat

SEQ ID NO: 926009 - DNA, 22 bp, Artificial Sequence
  chemically synthesized
aatattaaaatccacctattat

SEQ ID NO: 926010 - DNA, 22 bp, Artificial Sequence
  chemically synthesized
aaatccacctattatgtggatg

SEQ ID NO: 926011 - DNA, 22 bp, Artificial Sequence
  chemically synthesized
catcccacccatcatccacata

SEQ ID NO: 926012 - DNA, 22 bp, Artificial Sequence
  chemically synthesized
gcatcccacccatcatccacat

SEQ ID NO: 926013 - DNA, 22 bp, Artificial Sequence
  chemically synthesized
ttgcatcccacccatcatccac

SEQ ID NO: 926014 - DNA, 22 bp, Artificial Sequence
  chemically synthesized
ttatgtggatgatgggtgggat

SEQ ID NO: 926015 - DNA, 22 bp, Artificial Sequence
  chemically synthesized
ccaagctcttgcatcccaccca

SEQ ID NO: 926016 - DNA, 22 bp, Artificial Sequence
  chemically synthesized
gccaagctcttgcatcccaccc

SEQ ID NO: 926017 - DNA, 22 bp, Artificial Sequence
  chemically synthesized
tgccaagctcttgcatcccacc

SEQ ID NO: 926018 - DNA, 22 bp, Artificial Sequence
  chemically synthesized
tgtggatgatgggtgggatgca

SEQ ID NO: 926019 - DNA, 22 bp, Artificial Sequence
  chemically synthesized
ttgccaagctcttgcatcccac

SEQ ID NO: 926020 - DNA, 22 bp, Artificial Sequence
  chemically synthesized
ttttgccaagctcttgcatccc

SEQ ID NO: 926021 - DNA, 22 bp, Artificial Sequence
  chemically synthesized
gttcttttgccaagctcttgca

SEQ ID NO: 926022 - DNA, 22 bp, Artificial Sequence
  chemically synthesized
cgttcttttgccaagctcttgc

SEQ ID NO: 926023 - DNA, 22 bp, Artificial Sequence
  chemically synthesized
tgaacaatgaaaacttcgttct

SEQ ID NO: 926024 - DNA, 22 bp, Artificial Sequence
  chemically synthesized
ttatgaacaatgaaaacttcgt

SEQ ID NO: 926025 - DNA, 22 bp, Artificial Sequence
  chemically synthesized
ggcaaaagaacgaagttttcat

SEQ ID NO: 926026 - DNA, 22 bp, Artificial Sequence
  chemically synthesized
ttgttatgaacaatgaaaactt

SEQ ID NO: 926027 - DNA, 22 bp, Artificial Sequence
  chemically synthesized
gcaaaagaacgaagttttcatt

SEQ ID NO: 926028 - DNA, 22 bp, Artificial Sequence
  chemically synthesized
ccaaatgagactattgttatga

SEQ ID NO: 926029 - DNA, 22 bp, Artificial Sequence
  chemically synthesized
accaaatgagactattgttatg

SEQ ID NO: 926030 - DNA, 22 bp, Artificial Sequence
  chemically synthesized
tttaccaaatgagactattgtt

SEQ ID NO: 926031 - DNA, 22 bp, Artificial Sequence
  chemically synthesized
tcattgttcataacaatagtct

SEQ ID NO: 926032 - DNA, 22 bp, Artificial Sequence
  chemically synthesized
atttaccaaatgagactattgt

SEQ ID NO: 926033 - DNA, 22 bp, Artificial Sequence
  chemically synthesized
cattgttcataacaatagtctc

SEQ ID NO: 926034 - DNA, 22 bp, Artificial Sequence
  chemically synthesized
tatttaccaaatgagactattg

SEQ ID NO: 926035 - DNA, 22 bp, Artificial Sequence
  chemically synthesized
attgttcataacaatagtctca

SEQ ID NO: 926036 - DNA, 22 bp, Artificial Sequence
  chemically synthesized
ttcataacaatagtctcatttg

SEQ ID NO: 926037 - DNA, 22 bp, Artificial Sequence
  chemically synthesized
gcctttatttaccaaatgagac

SEQ ID NO: 926038 - DNA, 22 bp, Artificial Sequence
  chemically synthesized
ggcctttatttaccaaatgaga

SEQ ID NO: 926039 - DNA, 22 bp, Artificial Sequence
  chemically synthesized
ataacaatagtctcatttggta

SEQ ID NO: 926040 - DNA, 22 bp, Artificial Sequence
  chemically synthesized
gtaaaggaagacttggccttta

SEQ ID NO: 926041 - DNA, 22 bp, Artificial Sequence
  chemically synthesized
cgtaaaggaagacttggccttt

SEQ ID NO: 926042 - DNA, 22 bp, Artificial Sequence
  chemically synthesized
atttggtaaataaaggccaagt

SEQ ID NO: 926043 - DNA, 22 bp, Artificial Sequence
  chemically synthesized
tttcgtaaaggaagacttggcc

SEQ ID NO: 926044 - DNA, 22 bp, Artificial Sequence
  chemically synthesized
gtttcgtaaaggaagacttggc

SEQ ID NO: 926045 - DNA, 22 bp, Artificial Sequence
  chemically synthesized
ggtaaataaaggccaagtcttc

SEQ ID NO: 926046 - DNA, 22 bp, Artificial Sequence
  chemically synthesized
gtaaataaaggccaagtcttcc

SEQ ID NO: 926047 - DNA, 22 bp, Artificial Sequence
  chemically synthesized
atgtgtcttgtttcgtaaagga

SEQ ID NO: 926048 - DNA, 22 bp, Artificial Sequence
  chemically synthesized
atgttaatgtgtcttgtttcgt

SEQ ID NO: 926049 - DNA, 22 bp, Artificial Sequence
  chemically synthesized
ttgatgttaatgtgtcttgttt

SEQ ID NO: 926050 - DNA, 22 bp, Artificial Sequence
  chemically synthesized
cctttacgaaacaagacacatt

SEQ ID NO: 926051 - DNA, 22 bp, Artificial Sequence
  chemically synthesized
ctttacgaaacaagacacatta

SEQ ID NO: 926052 - DNA, 22 bp, Artificial Sequence
  chemically synthesized
cagttgttgatgttaatgtgtc

SEQ ID NO: 926053 - DNA, 22 bp, Artificial Sequence
  chemically synthesized
ccagttgttgatgttaatgtgt

SEQ ID NO: 926054 - DNA, 22 bp, Artificial Sequence
  chemically synthesized
tacgaaacaagacacattaaca

SEQ ID NO: 926055 - DNA, 22 bp, Artificial Sequence
  chemically synthesized
acgaaacaagacacattaacat

SEQ ID NO: 926056 - DNA, 22 bp, Artificial Sequence
  chemically synthesized
cgaaacaagacacattaacatc

SEQ ID NO: 926057 - DNA, 22 bp, Artificial Sequence
  chemically synthesized
tgcttccagttgttgatgttaa

SEQ ID NO: 926058 - DNA, 22 bp, Artificial Sequence
  chemically synthesized
tattatgcttccagttgttgat

SEQ ID NO: 926059 - DNA, 22 bp, Artificial Sequence
  chemically synthesized
gtattatgcttccagttgttga

SEQ ID NO: 926060 - DNA, 22 bp, Artificial Sequence
  chemically synthesized
tgtattatgcttccagttgttg

SEQ ID NO: 926061 - DNA, 22 bp, Artificial Sequence
  chemically synthesized
acatcaacaactggaagcataa

SEQ ID NO: 926062 - DNA, 22 bp, Artificial Sequence
  chemically synthesized
taaatgggattttgtattatgc

SEQ ID NO: 926063 - DNA, 22 bp, Artificial Sequence
  chemically synthesized
ataaatgggattttgtattatg

SEQ ID NO: 926064 - DNA, 22 bp, Artificial Sequence
  chemically synthesized
gaagcataatacaaaatcccat

SEQ ID NO: 926065 - DNA, 22 bp, Artificial Sequence
  chemically synthesized
gagagtttataaatgggatttt

SEQ ID NO: 926066 - DNA, 22 bp, Artificial Sequence
  chemically synthesized
gaaagcctagagagtttataaa

SEQ ID NO: 926067 - DNA, 22 bp, Artificial Sequence
  chemically synthesized
cagttggaaagcctagagagtt

SEQ ID NO: 926068 - DNA, 22 bp, Artificial Sequence
  chemically synthesized
ctgcagttggaaagcctagaga

SEQ ID NO: 926069 - DNA, 22 bp, Artificial Sequence
  chemically synthesized
ataaactctctaggctttccaa

SEQ ID NO: 926070 - DNA, 22 bp, Artificial Sequence
  chemically synthesized
taaactctctaggctttccaac

SEQ ID NO: 926071 - DNA, 22 bp, Artificial Sequence
  chemically synthesized
tctaggctttccaactgcagca

SEQ ID NO: 926072 - DNA, 22 bp, Artificial Sequence
  chemically synthesized
taggctttccaactgcagcagc

SEQ ID NO: 926073 - DNA, 22 bp, Artificial Sequence
  chemically synthesized
ggctttccaactgcagcagcac

SEQ ID NO: 926074 - DNA, 22 bp, Artificial Sequence
  chemically synthesized
tccaactgcagcagcacgcatt

SEQ ID NO: 926075 - DNA, 22 bp, Artificial Sequence
  chemically synthesized
ccaactgcagcagcacgcattt

SEQ ID NO: 926076 - DNA, 22 bp, Artificial Sequence
  chemically synthesized
caactgcagcagcacgcatttg

SEQ ID NO: 926077 - DNA, 22 bp, Artificial Sequence
  chemically synthesized
aaggcacagaaagccaaatgcg

SEQ ID NO: 926078 - DNA, 22 bp, Artificial Sequence
  chemically synthesized
cagcagcacgcatttggctttc

SEQ ID NO: 926079 - DNA, 22 bp, Artificial Sequence
  chemically synthesized
gaatgtattgaaggcacagaaa

SEQ ID NO: 926080 - DNA, 22 bp, Artificial Sequence
  chemically synthesized
ggaatgtattgaaggcacagaa

SEQ ID NO: 926081 - DNA, 22 bp, Artificial Sequence
  chemically synthesized
ccttggaatgtattgaaggcac

SEQ ID NO: 926082 - DNA, 22 bp, Artificial Sequence
  chemically synthesized
cccttggaatgtattgaaggca

SEQ ID NO: 926083 - DNA, 22 bp, Artificial Sequence
  chemically synthesized
ggctttctgtgccttcaataca

SEQ ID NO: 926084 - DNA, 22 bp, Artificial Sequence
  chemically synthesized
gctttctgtgccttcaatacat

SEQ ID NO: 926085 - DNA, 22 bp, Artificial Sequence
  chemically synthesized
aatttcccttggaatgtattga

SEQ ID NO: 926086 - DNA, 22 bp, Artificial Sequence
  chemically synthesized
aaatttcccttggaatgtattg

SEQ ID NO: 926087 - DNA, 22 bp, Artificial Sequence
  chemically synthesized
tctgtgccttcaatacattcca

SEQ ID NO: 926088 - DNA, 22 bp, Artificial Sequence
  chemically synthesized
ctgtgccttcaatacattccaa

SEQ ID NO: 926089 - DNA, 22 bp, Artificial Sequence
  chemically synthesized
tgtgccttcaatacattccaag

SEQ ID NO: 926090 - DNA, 22 bp, Artificial Sequence
  chemically synthesized
tgccttcaatacattccaaggg

SEQ ID NO: 926091 - DNA, 22 bp, Artificial Sequence
  chemically synthesized
aatcatcatttaaatttccctt

SEQ ID NO: 926092 - DNA, 22 bp, Artificial Sequence
  chemically synthesized
caatacattccaagggaaattt

SEQ ID NO: 926093 - DNA, 22 bp, Artificial Sequence
  chemically synthesized
aatacattccaagggaaattta

SEQ ID NO: 926094 - DNA, 22 bp, Artificial Sequence
  chemically synthesized
tcaaattcaatcatcatttaaa

SEQ ID NO: 926095 - DNA, 22 bp, Artificial Sequence
  chemically synthesized
caagggaaatttaaatgatgat

SEQ ID NO: 926096 - DNA, 22 bp, Artificial Sequence
  chemically synthesized
ctgtcaaattcaatcatcattt

SEQ ID NO: 926097 - DNA, 22 bp, Artificial Sequence
  chemically synthesized
aaaaaggttactgtcaaattca

SEQ ID NO: 926098 - DNA, 22 bp, Artificial Sequence
  chemically synthesized
aaatgatgattgaatttgacag

SEQ ID NO: 926099 - DNA, 22 bp, Artificial Sequence
  chemically synthesized
aatgatgattgaatttgacagt

SEQ ID NO: 926100 - DNA, 22 bp, Artificial Sequence
  chemically synthesized
aatttgacagtaacctttttga

SEQ ID NO: 926101 - DNA, 22 bp, Artificial Sequence
  chemically synthesized
gacagtaacctttttgaggttt

SEQ ID NO: 926102 - DNA, 22 bp, Artificial Sequence
  chemically synthesized
atggggaaaacaaaacctcaaa

SEQ ID NO: 926103 - DNA, 22 bp, Artificial Sequence
  chemically synthesized
acagtaacctttttgaggtttt

SEQ ID NO: 926104 - DNA, 22 bp, Artificial Sequence
  chemically synthesized
aatggggaaaacaaaacctcaa

SEQ ID NO: 926105 - DNA, 22 bp, Artificial Sequence
  chemically synthesized
tttgaggttttgttttccccat

SEQ ID NO: 926106 - DNA, 22 bp, Artificial Sequence
  chemically synthesized
ttgaggttttgttttccccatt

SEQ ID NO: 926107 - DNA, 22 bp, Artificial Sequence
  chemically synthesized
tgaggttttgttttccccatta

SEQ ID NO: 926108 - DNA, 22 bp, Artificial Sequence
  chemically synthesized
gaggttttgttttccccattaa

SEQ ID NO: 926109 - DNA, 22 bp, Artificial Sequence
  chemically synthesized
aggttttgttttccccattaaa

SEQ ID NO: 926110 - DNA, 22 bp, Artificial Sequence
  chemically synthesized
agccaaagaggtacaagtttaa

SEQ ID NO: 926111 - DNA, 22 bp, Artificial Sequence
  chemically synthesized
tgttttccccattaaacttgta

SEQ ID NO: 926112 - DNA, 22 bp, Artificial Sequence
  chemically synthesized
gagccaaagaggtacaagttta

SEQ ID NO: 926113 - DNA, 22 bp, Artificial Sequence
  chemically synthesized
gttttccccattaaacttgtac

SEQ ID NO: 926114 - DNA, 22 bp, Artificial Sequence
  chemically synthesized
ttttccccattaaacttgtacc

SEQ ID NO: 926115 - DNA, 22 bp, Artificial Sequence
  chemically synthesized
tccccattaaacttgtacctct

SEQ ID NO: 926116 - DNA, 22 bp, Artificial Sequence
  chemically synthesized
ccccattaaacttgtacctctt

SEQ ID NO: 926117 - DNA, 22 bp, Artificial Sequence
  chemically synthesized
cccattaaacttgtacctcttt

SEQ ID NO: 926118 - DNA, 22 bp, Artificial Sequence
  chemically synthesized
aaggggaacttgagccaaagag

SEQ ID NO: 926119 - DNA, 22 bp, Artificial Sequence
  chemically synthesized
gaaggggaacttgagccaaaga

SEQ ID NO: 926120 - DNA, 22 bp, Artificial Sequence
  chemically synthesized
aacttgtacctctttggctcaa

SEQ ID NO: 926121 - DNA, 22 bp, Artificial Sequence
  chemically synthesized
ttgaaggggaacttgagccaaa

SEQ ID NO: 926122 - DNA, 22 bp, Artificial Sequence
  chemically synthesized
gtacctctttggctcaagttcc

SEQ ID NO: 926123 - DNA, 22 bp, Artificial Sequence
  chemically synthesized
tacctctttggctcaagttccc

SEQ ID NO: 926124 - DNA, 22 bp, Artificial Sequence
  chemically synthesized
tgaatacattcttgaaggggaa

SEQ ID NO: 926125 - DNA, 22 bp, Artificial Sequence
  chemically synthesized
tttggctcaagttccccttcaa

SEQ ID NO: 926126 - DNA, 22 bp, Artificial Sequence
  chemically synthesized
gtgaatacattcttgaagggga

SEQ ID NO: 926127 - DNA, 22 bp, Artificial Sequence
  chemically synthesized
tggctcaagttccccttcaaga

SEQ ID NO: 926128 - DNA, 22 bp, Artificial Sequence
  chemically synthesized
ggctcaagttccccttcaagaa

SEQ ID NO: 926129 - DNA, 22 bp, Artificial Sequence
  chemically synthesized
gctcaagttccccttcaagaat

SEQ ID NO: 926130 - DNA, 22 bp, Artificial Sequence
  chemically synthesized
aagttccccttcaagaatgtat

SEQ ID NO: 926131 - DNA, 22 bp, Artificial Sequence
  chemically synthesized
accacatttgtgaatacattct

SEQ ID NO: 926132 - DNA, 22 bp, Artificial Sequence
  chemically synthesized
caccacatttgtgaatacattc

SEQ ID NO: 926133 - DNA, 22 bp, Artificial Sequence
  chemically synthesized
cccttcaagaatgtattcacaa

SEQ ID NO: 926134 - DNA, 22 bp, Artificial Sequence
  chemically synthesized
gtttcaccacatttgtgaatac

SEQ ID NO: 926135 - DNA, 22 bp, Artificial Sequence
  chemically synthesized
tagtttcaccacatttgtgaat

SEQ ID NO: 926136 - DNA, 22 bp, Artificial Sequence
  chemically synthesized
caagaatgtattcacaaatgtg

SEQ ID NO: 926137 - DNA, 22 bp, Artificial Sequence
  chemically synthesized
aagaatgtattcacaaatgtgg

SEQ ID NO: 926138 - DNA, 22 bp, Artificial Sequence
  chemically synthesized
cctctagtttcaccacatttgt

SEQ ID NO: 926139 - DNA, 22 bp, Artificial Sequence
  chemically synthesized
acctctagtttcaccacatttg

SEQ ID NO: 926140 - DNA, 22 bp, Artificial Sequence
  chemically synthesized
acaaatgtggtgaaactagagg

SEQ ID NO: 926141 - DNA, 22 bp, Artificial Sequence
  chemically synthesized
aaaaaagtgatagtgtcactta

SEQ ID NO: 926142 - DNA, 22 bp, Artificial Sequence
  chemically synthesized
gaggtaagtgacactatcactt

SEQ ID NO: 926143 - DNA, 22 bp, Artificial Sequence
  chemically synthesized
tgaagctaaaaaaagtgatagt

SEQ ID NO: 926144 - DNA, 22 bp, Artificial Sequence
  chemically synthesized
tgaatatgactatgaagctaaa

SEQ ID NO: 926145 - DNA, 22 bp, Artificial Sequence
  chemically synthesized
tcactttttttagcttcatagt

SEQ ID NO: 926146 - DNA, 22 bp, Artificial Sequence
  chemically synthesized
tttttagcttcatagtcatatt

SEQ ID NO: 926147 - DNA, 22 bp, Artificial Sequence
  chemically synthesized
aaaatagctatgaatatgacta

SEQ ID NO: 926148 - DNA, 22 bp, Artificial Sequence
  chemically synthesized
ttttagcttcatagtcatattc

SEQ ID NO: 926149 - DNA, 22 bp, Artificial Sequence
  chemically synthesized
aaaaatagctatgaatatgact

SEQ ID NO: 926150 - DNA, 22 bp, Artificial Sequence
  chemically synthesized
tttagcttcatagtcatattca

SEQ ID NO: 926151 - DNA, 22 bp, Artificial Sequence
  chemically synthesized
taaaaatagctatgaatatgac

SEQ ID NO: 926152 - DNA, 22 bp, Artificial Sequence
  chemically synthesized
ttagcttcatagtcatattcat

SEQ ID NO: 926153 - DNA, 22 bp, Artificial Sequence
  chemically synthesized
tagcttcatagtcatattcata

SEQ ID NO: 926154 - DNA, 22 bp, Artificial Sequence
  chemically synthesized
agcttcatagtcatattcatag

SEQ ID NO: 926155 - DNA, 22 bp, Artificial Sequence
  chemically synthesized
gcttcatagtcatattcatagc

SEQ ID NO: 926156 - DNA, 22 bp, Artificial Sequence
  chemically synthesized
gttttaaaaatagctatgaata

SEQ ID NO: 926157 - DNA, 22 bp, Artificial Sequence
  chemically synthesized
agttttaaaaatagctatgaat

SEQ ID NO: 926158 - DNA, 22 bp, Artificial Sequence
  chemically synthesized
catagtcatattcatagctatt

SEQ ID NO: 926159 - DNA, 22 bp, Artificial Sequence
  chemically synthesized
cttagttttaaaaatagctatg

SEQ ID NO: 926160 - DNA, 22 bp, Artificial Sequence
  chemically synthesized
atagtcatattcatagctattt

SEQ ID NO: 926161 - DNA, 22 bp, Artificial Sequence
  chemically synthesized
gcttagttttaaaaatagctat

SEQ ID NO: 926162 - DNA, 22 bp, Artificial Sequence
  chemically synthesized
tgcttagttttaaaaatagcta

SEQ ID NO: 926163 - DNA, 22 bp, Artificial Sequence
  chemically synthesized
atagctatttttaaaactaagc

SEQ ID NO: 926164 - DNA, 22 bp, Artificial Sequence
  chemically synthesized
taggaaagacagatctttgctt

SEQ ID NO: 926165 - DNA, 22 bp, Artificial Sequence
  chemically synthesized
tttttaaaactaagcaaagatc

SEQ ID NO: 926166 - DNA, 22 bp, Artificial Sequence
  chemically synthesized
gtaggaaagacagatctttgct

SEQ ID NO: 926167 - DNA, 22 bp, Artificial Sequence
  chemically synthesized
tgtaggaaagacagatctttgc

SEQ ID NO: 926168 - DNA, 22 bp, Artificial Sequence
  chemically synthesized
ttaaaactaagcaaagatctgt

SEQ ID NO: 926169 - DNA, 22 bp, Artificial Sequence
  chemically synthesized
taaaactaagcaaagatctgtc

SEQ ID NO: 926170 - DNA, 22 bp, Artificial Sequence
  chemically synthesized
ttttgtaggaaagacagatctt

SEQ ID NO: 926171 - DNA, 22 bp, Artificial Sequence
  chemically synthesized
aaaactaagcaaagatctgtct

SEQ ID NO: 926172 - DNA, 22 bp, Artificial Sequence
  chemically synthesized
aaactaagcaaagatctgtctt

SEQ ID NO: 926173 - DNA, 22 bp, Artificial Sequence
  chemically synthesized
agcaaagatctgtctttcctac

SEQ ID NO: 926174 - DNA, 22 bp, Artificial Sequence
  chemically synthesized
taaatgattgttttgtaggaaa

SEQ ID NO: 926175 - DNA, 22 bp, Artificial Sequence
  chemically synthesized
tctttcctacaaaacaatcatt

SEQ ID NO: 926176 - DNA, 22 bp, Artificial Sequence
  chemically synthesized
gaaagcaattataaatgattgt

SEQ ID NO: 926177 - DNA, 22 bp, Artificial Sequence
  chemically synthesized
agaaagcaattataaatgattg

SEQ ID NO: 926178 - DNA, 22 bp, Artificial Sequence
  chemically synthesized
tagaaagcaattataaatgatt

SEQ ID NO: 926179 - DNA, 22 bp, Artificial Sequence
  chemically synthesized
tcctacaaaacaatcatttata

SEQ ID NO: 926180 - DNA, 22 bp, Artificial Sequence
  chemically synthesized
cctacaaaacaatcatttataa

SEQ ID NO: 926181 - DNA, 22 bp, Artificial Sequence
  chemically synthesized
ctacaaaacaatcatttataat

SEQ ID NO: 926182 - DNA, 22 bp, Artificial Sequence
  chemically synthesized
caaaacaatcatttataattgc

SEQ ID NO: 926183 - DNA, 22 bp, Artificial Sequence
  chemically synthesized
aagaagattttagaaagcaatt

SEQ ID NO: 926184 - DNA, 22 bp, Artificial Sequence
  chemically synthesized
caagaagattttagaaagcaat

SEQ ID NO: 926185 - DNA, 22 bp, Artificial Sequence
  chemically synthesized
tcaagaagattttagaaagcaa

SEQ ID NO: 926186 - DNA, 22 bp, Artificial Sequence
  chemically synthesized
ttcaagaagattttagaaagca

SEQ ID NO: 926187 - DNA, 22 bp, Artificial Sequence
  chemically synthesized
tttttcaagaagattttagaaa

SEQ ID NO: 926188 - DNA, 22 bp, Artificial Sequence
  chemically synthesized
ataattgctttctaaaatcttc

SEQ ID NO: 926189 - DNA, 22 bp, Artificial Sequence
  chemically synthesized
taattgctttctaaaatcttct

SEQ ID NO: 926190 - DNA, 22 bp, Artificial Sequence
  chemically synthesized
agttgtttttcaagaagatttt

SEQ ID NO: 926191 - DNA, 22 bp, Artificial Sequence
  chemically synthesized
ctttctaaaatcttcttgaaaa

SEQ ID NO: 926192 - DNA, 22 bp, Artificial Sequence
  chemically synthesized
aatctcagttgtttttcaagaa

SEQ ID NO: 926193 - DNA, 22 bp, Artificial Sequence
  chemically synthesized
tctaaaatcttcttgaaaaaca

SEQ ID NO: 926194 - DNA, 22 bp, Artificial Sequence
  chemically synthesized
ctaaaatcttcttgaaaaacaa

SEQ ID NO: 926195 - DNA, 22 bp, Artificial Sequence
  chemically synthesized
taaaatcttcttgaaaaacaac

SEQ ID NO: 926196 - DNA, 22 bp, Artificial Sequence
  chemically synthesized
aaatcttcttgaaaaacaactg

SEQ ID NO: 926197 - DNA, 22 bp, Artificial Sequence
  chemically synthesized
aacaagctgaatctcagttgtt

SEQ ID NO: 926198 - DNA, 22 bp, Artificial Sequence
  chemically synthesized
caacaagctgaatctcagttgt

SEQ ID NO: 926199 - DNA, 22 bp, Artificial Sequence
  chemically synthesized
cttgaaaaacaactgagattca

SEQ ID NO: 926200 - DNA, 22 bp, Artificial Sequence
  chemically synthesized
acttcaacaagctgaatctcag

SEQ ID NO: 926201 - DNA, 22 bp, Artificial Sequence
  chemically synthesized
ttgaaaaacaactgagattcag

SEQ ID NO: 926202 - DNA, 22 bp, Artificial Sequence
  chemically synthesized
aacttcaacaagctgaatctca

SEQ ID NO: 926203 - DNA, 22 bp, Artificial Sequence
  chemically synthesized
taacttcaacaagctgaatctc

SEQ ID NO: 926204 - DNA, 22 bp, Artificial Sequence
  chemically synthesized
gaaaaacaactgagattcagct

SEQ ID NO: 926205 - DNA, 22 bp, Artificial Sequence
  chemically synthesized
aaaaacaactgagattcagctt

SEQ ID NO: 926206 - DNA, 22 bp, Artificial Sequence
  chemically synthesized
aatatattttaacttcaacaag

SEQ ID NO: 926207 - DNA, 22 bp, Artificial Sequence
  chemically synthesized
caatatattttaacttcaacaa

SEQ ID NO: 926208 - DNA, 22 bp, Artificial Sequence
  chemically synthesized
agattcagcttgttgaagttaa

SEQ ID NO: 926209 - DNA, 22 bp, Artificial Sequence
  chemically synthesized
agcttgttgaagttaaaatata

SEQ ID NO: 926210 - DNA, 22 bp, Artificial Sequence
  chemically synthesized
gttgaagttaaaatatattgaa

SEQ ID NO: 926211 - DNA, 22 bp, Artificial Sequence
  chemically synthesized
aaggtgaatatcttcaatatat

SEQ ID NO: 926212 - DNA, 22 bp, Artificial Sequence
  chemically synthesized
ttgaagttaaaatatattgaag

SEQ ID NO: 926213 - DNA, 22 bp, Artificial Sequence
  chemically synthesized
aaaggtgaatatcttcaatata

SEQ ID NO: 926214 - DNA, 22 bp, Artificial Sequence
  chemically synthesized
aagttaaaatatattgaagata

SEQ ID NO: 926215 - DNA, 22 bp, Artificial Sequence
  chemically synthesized
cttaaaggtgaatatcttcaat

SEQ ID NO: 926216 - DNA, 22 bp, Artificial Sequence
  chemically synthesized
aaatatattgaagatattcacc

SEQ ID NO: 926217 - DNA, 22 bp, Artificial Sequence
  chemically synthesized
aagatattcacctttaagcaat

SEQ ID NO: 926218 - DNA, 22 bp, Artificial Sequence
  chemically synthesized
aaaatcacccatgattgcttaa

SEQ ID NO: 926219 - DNA, 22 bp, Artificial Sequence
  chemically synthesized
aaaaatcacccatgattgctta

SEQ ID NO: 926220 - DNA, 22 bp, Artificial Sequence
  chemically synthesized
taaaaatcacccatgattgctt

SEQ ID NO: 926221 - DNA, 22 bp, Artificial Sequence
  chemically synthesized
ctttaaaaatcacccatgattg

SEQ ID NO: 926222 - DNA, 22 bp, Artificial Sequence
  chemically synthesized
gctttaaaaatcacccatgatt

SEQ ID NO: 926223 - DNA, 22 bp, Artificial Sequence
  chemically synthesized
acctttaagcaatcatgggtga

SEQ ID NO: 926224 - DNA, 22 bp, Artificial Sequence
  chemically synthesized
aagtttgctttaaaaatcaccc

SEQ ID NO: 926225 - DNA, 22 bp, Artificial Sequence
  chemically synthesized
taagcaatcatgggtgattttt

SEQ ID NO: 926226 - DNA, 22 bp, Artificial Sequence
  chemically synthesized
gaagtttgctttaaaaatcacc

SEQ ID NO: 926227 - DNA, 22 bp, Artificial Sequence
  chemically synthesized
aagcaatcatgggtgattttta

SEQ ID NO: 926228 - DNA, 22 bp, Artificial Sequence
  chemically synthesized
agcaatcatgggtgatttttaa

SEQ ID NO: 926229 - DNA, 22 bp, Artificial Sequence
  chemically synthesized
aacttgaagtttgctttaaaaa

SEQ ID NO: 926230 - DNA, 22 bp, Artificial Sequence
  chemically synthesized
aaacttgaagtttgctttaaaa

SEQ ID NO: 926231 - DNA, 22 bp, Artificial Sequence
  chemically synthesized
taaacttgaagtttgctttaaa

SEQ ID NO: 926232 - DNA, 22 bp, Artificial Sequence
  chemically synthesized
ttttaaacttgaagtttgcttt

SEQ ID NO: 926233 - DNA, 22 bp, Artificial Sequence
  chemically synthesized
ctattttaaacttgaagtttgc

SEQ ID NO: 926234 - DNA, 22 bp, Artificial Sequence
  chemically synthesized
tgctattttaaacttgaagttt

SEQ ID NO: 926235 - DNA, 22 bp, Artificial Sequence
  chemically synthesized
ctgctattttaaacttgaagtt

SEQ ID NO: 926236 - DNA, 22 bp, Artificial Sequence
  chemically synthesized
tctgctattttaaacttgaagt

SEQ ID NO: 926237 - DNA, 22 bp, Artificial Sequence
  chemically synthesized
ttaaagcaaacttcaagtttaa

SEQ ID NO: 926238 - DNA, 22 bp, Artificial Sequence
  chemically synthesized
taaagcaaacttcaagtttaaa

SEQ ID NO: 926239 - DNA, 22 bp, Artificial Sequence
  chemically synthesized
aaagcaaacttcaagtttaaaa

SEQ ID NO: 926240 - DNA, 22 bp, Artificial Sequence
  chemically synthesized
aagcaaacttcaagtttaaaat

SEQ ID NO: 926241 - DNA, 22 bp, Artificial Sequence
  chemically synthesized
gtggttttctgctattttaaac

SEQ ID NO: 926242 - DNA, 22 bp, Artificial Sequence
  chemically synthesized
gttagtggttttctgctatttt

SEQ ID NO: 926243 - DNA, 22 bp, Artificial Sequence
  chemically synthesized
caagtttaaaatagcagaaaac

SEQ ID NO: 926244 - DNA, 22 bp, Artificial Sequence
  chemically synthesized
aagtttaaaatagcagaaaacc

SEQ ID NO: 926245 - DNA, 22 bp, Artificial Sequence
  chemically synthesized
tggctagttagtggttttctgc

SEQ ID NO: 926246 - DNA, 22 bp, Artificial Sequence
  chemically synthesized
gtggctagttagtggttttctg

SEQ ID NO: 926247 - DNA, 22 bp, Artificial Sequence
  chemically synthesized
aaaatagcagaaaaccactaac

SEQ ID NO: 926248 - DNA, 22 bp, Artificial Sequence
  chemically synthesized
aaatagcagaaaaccactaact

SEQ ID NO: 926249 - DNA, 22 bp, Artificial Sequence
  chemically synthesized
aaatatatacttgtggctagtt

SEQ ID NO: 926250 - DNA, 22 bp, Artificial Sequence
  chemically synthesized
atatactaaaatatatacttgt

SEQ ID NO: 926251 - DNA, 22 bp, Artificial Sequence
  chemically synthesized
catatactaaaatatatacttg

SEQ ID NO: 926252 - DNA, 22 bp, Artificial Sequence
  chemically synthesized
tcatatactaaaatatatactt

SEQ ID NO: 926253 - DNA, 22 bp, Artificial Sequence
  chemically synthesized
ttcatatactaaaatatatact

SEQ ID NO: 926254 - DNA, 22 bp, Artificial Sequence
  chemically synthesized
tttcatatactaaaatatatac

SEQ ID NO: 926255 - DNA, 22 bp, Artificial Sequence
  chemically synthesized
actagccacaagtatatatttt

SEQ ID NO: 926256 - DNA, 22 bp, Artificial Sequence
  chemically synthesized
ttttcatatactaaaatatata

SEQ ID NO: 926257 - DNA, 22 bp, Artificial Sequence
  chemically synthesized
tttttcatatactaaaatatat

SEQ ID NO: 926258 - DNA, 22 bp, Artificial Sequence
  chemically synthesized
tttttttcatatactaaaatat

SEQ ID NO: 926259 - DNA, 22 bp, Artificial Sequence
  chemically synthesized
gccacaagtatatattttagta

SEQ ID NO: 926260 - DNA, 22 bp, Artificial Sequence
  chemically synthesized
ctttttttcatatactaaaata

SEQ ID NO: 926261 - DNA, 22 bp, Artificial Sequence
  chemically synthesized
tttctttttttcatatactaaa

SEQ ID NO: 926262 - DNA, 22 bp, Artificial Sequence
  chemically synthesized
atttctttttttcatatactaa

SEQ ID NO: 926263 - DNA, 22 bp, Artificial Sequence
  chemically synthesized
tatttctttttttcatatacta

SEQ ID NO: 926264 - DNA, 22 bp, Artificial Sequence
  chemically synthesized
ttatttctttttttcatatact

SEQ ID NO: 926265 - DNA, 22 bp, Artificial Sequence
  chemically synthesized
tttatttctttttttcatatac

SEQ ID NO: 926266 - DNA, 22 bp, Artificial Sequence
  chemically synthesized
tagtatatgaaaaaaagaaata

SEQ ID NO: 926267 - DNA, 22 bp, Artificial Sequence
  chemically synthesized
agtatatgaaaaaaagaaataa

SEQ ID NO: 926268 - DNA, 22 bp, Artificial Sequence
  chemically synthesized
gtatatgaaaaaaagaaataaa

SEQ ID NO: 926269 - DNA, 22 bp, Artificial Sequence
  chemically synthesized
atcaacagcagtaaagaaattt

SEQ ID NO: 926270 - DNA, 22 bp, Artificial Sequence
  chemically synthesized
tcaaccattaatcaacagcagt

SEQ ID NO: 926271 - DNA, 22 bp, Artificial Sequence
  chemically synthesized
ctttactgctgttgattaatgg

SEQ ID NO: 926272 - DNA, 22 bp, Artificial Sequence
  chemically synthesized
tttactgctgttgattaatggt

SEQ ID NO: 926273 - DNA, 22 bp, Artificial Sequence
  chemically synthesized
aagaacctatcaaccattaatc

SEQ ID NO: 926274 - DNA, 22 bp, Artificial Sequence
  chemically synthesized
tactgctgttgattaatggttg

SEQ ID NO: 926275 - DNA, 22 bp, Artificial Sequence
  chemically synthesized
actgctgttgattaatggttga

SEQ ID NO: 926276 - DNA, 22 bp, Artificial Sequence
  chemically synthesized
ctgctgttgattaatggttgat

SEQ ID NO: 926277 - DNA, 22 bp, Artificial Sequence
  chemically synthesized
acattaaagaacctatcaacca

SEQ ID NO: 926278 - DNA, 22 bp, Artificial Sequence
  chemically synthesized
ctgttgattaatggttgatagg

SEQ ID NO: 926279 - DNA, 22 bp, Artificial Sequence
  chemically synthesized
ttgattaatggttgataggttc

SEQ ID NO: 926280 - DNA, 22 bp, Artificial Sequence
  chemically synthesized
attaatggttgataggttcttt

SEQ ID NO: 926281 - DNA, 22 bp, Artificial Sequence
  chemically synthesized
atggttgataggttctttaatg

SEQ ID NO: 926282 - DNA, 22 bp, Artificial Sequence
  chemically synthesized
ataggttctttaatgttagtgc

SEQ ID NO: 926283 - DNA, 22 bp, Artificial Sequence
  chemically synthesized
taagcagggtgaaaggcactaa

SEQ ID NO: 926284 - DNA, 22 bp, Artificial Sequence
  chemically synthesized
tttaatgttagtgcctttcacc

SEQ ID NO: 926285 - DNA, 22 bp, Artificial Sequence
  chemically synthesized
taatgttagtgcctttcaccct

SEQ ID NO: 926286 - DNA, 22 bp, Artificial Sequence
  chemically synthesized
aatgttagtgcctttcaccctg

SEQ ID NO: 926287 - DNA, 22 bp, Artificial Sequence
  chemically synthesized
atgttagtgcctttcaccctgc

SEQ ID NO: 926288 - DNA, 22 bp, Artificial Sequence
  chemically synthesized
atgagagattataagcagggtg

SEQ ID NO: 926289 - DNA, 22 bp, Artificial Sequence
  chemically synthesized
catgagagattataagcagggt

SEQ ID NO: 926290 - DNA, 22 bp, Artificial Sequence
  chemically synthesized
gtgcctttcaccctgcttataa

SEQ ID NO: 926291 - DNA, 22 bp, Artificial Sequence
  chemically synthesized
tcaccctgcttataatctctca

SEQ ID NO: 926292 - DNA, 22 bp, Artificial Sequence
  chemically synthesized
caccctgcttataatctctcat

SEQ ID NO: 926293 - DNA, 22 bp, Artificial Sequence
  chemically synthesized
gaagaatatttcatgagagatt

SEQ ID NO: 926294 - DNA, 22 bp, Artificial Sequence
  chemically synthesized
accctgcttataatctctcatg

SEQ ID NO: 926295 - DNA, 22 bp, Artificial Sequence
  chemically synthesized
agaagaatatttcatgagagat

SEQ ID NO: 926296 - DNA, 22 bp, Artificial Sequence
  chemically synthesized
tagaagaatatttcatgagaga

SEQ ID NO: 926297 - DNA, 22 bp, Artificial Sequence
  chemically synthesized
tttagaagaatatttcatgaga

SEQ ID NO: 926298 - DNA, 22 bp, Artificial Sequence
  chemically synthesized
ctttagaagaatatttcatgag

SEQ ID NO: 926299 - DNA, 22 bp, Artificial Sequence
  chemically synthesized
tctttagaagaatatttcatga

SEQ ID NO: 926300 - DNA, 22 bp, Artificial Sequence
  chemically synthesized
cttataatctctcatgaaatat

SEQ ID NO: 926301 - DNA, 22 bp, Artificial Sequence
  chemically synthesized
ataatctctcatgaaatattct

SEQ ID NO: 926302 - DNA, 22 bp, Artificial Sequence
  chemically synthesized
taatctctcatgaaatattctt

SEQ ID NO: 926303 - DNA, 22 bp, Artificial Sequence
  chemically synthesized
agctttctttagaagaatattt

SEQ ID NO: 926304 - DNA, 22 bp, Artificial Sequence
  chemically synthesized
aagctttctttagaagaatatt

SEQ ID NO: 926305 - DNA, 22 bp, Artificial Sequence
  chemically synthesized
taagctttctttagaagaatat

SEQ ID NO: 926306 - DNA, 22 bp, Artificial Sequence
  chemically synthesized
ttaagctttctttagaagaata

SEQ ID NO: 926307 - DNA, 22 bp, Artificial Sequence
  chemically synthesized
tttaagctttctttagaagaat

SEQ ID NO: 926308 - DNA, 22 bp, Artificial Sequence
  chemically synthesized
tcatgaaatattcttctaaaga

SEQ ID NO: 926309 - DNA, 22 bp, Artificial Sequence
  chemically synthesized
atgaaatattcttctaaagaaa

SEQ ID NO: 926310 - DNA, 22 bp, Artificial Sequence
  chemically synthesized
gcagactttttaagctttcttt

SEQ ID NO: 926311 - DNA, 22 bp, Artificial Sequence
  chemically synthesized
agcagactttttaagctttctt

SEQ ID NO: 926312 - DNA, 22 bp, Artificial Sequence
  chemically synthesized
tagcagactttttaagctttct

SEQ ID NO: 926313 - DNA, 22 bp, Artificial Sequence
  chemically synthesized
ttctaaagaaagcttaaaaagt

SEQ ID NO: 926314 - DNA, 22 bp, Artificial Sequence
  chemically synthesized
ctaaagaaagcttaaaaagtct

SEQ ID NO: 926315 - DNA, 22 bp, Artificial Sequence
  chemically synthesized
taaagaaagcttaaaaagtctg

SEQ ID NO: 926316 - DNA, 22 bp, Artificial Sequence
  chemically synthesized
aagaaagcttaaaaagtctgct

SEQ ID NO: 926317 - DNA, 22 bp, Artificial Sequence
  chemically synthesized
ataggaatgaaaacattttagc

SEQ ID NO: 926318 - DNA, 22 bp, Artificial Sequence
  chemically synthesized
aaaaagtctgctaaaatgtttt

SEQ ID NO: 926319 - DNA, 22 bp, Artificial Sequence
  chemically synthesized
aaaagtctgctaaaatgttttc

SEQ ID NO: 926320 - DNA, 22 bp, Artificial Sequence
  chemically synthesized
ctaaaatgttttcattcctatt

SEQ ID NO: 926321 - DNA, 22 bp, Artificial Sequence
  chemically synthesized
aaatgttttcattcctattaga

SEQ ID NO: 926322 - DNA, 22 bp, Artificial Sequence
  chemically synthesized
tcattcctattagatctgtcgc

SEQ ID NO: 926323 - DNA, 22 bp, Artificial Sequence
  chemically synthesized
cattcctattagatctgtcgcc

SEQ ID NO: 926324 - DNA, 22 bp, Artificial Sequence
  chemically synthesized
attcctattagatctgtcgccc

SEQ ID NO: 926325 - DNA, 22 bp, Artificial Sequence
  chemically synthesized
ctattagatctgtcgccctacc

SEQ ID NO: 926326 - DNA, 22 bp, Artificial Sequence
  chemically synthesized
ttagatctgtcgccctacctct

SEQ ID NO: 926327 - DNA, 22 bp, Artificial Sequence
  chemically synthesized
tcagacagaaaaaagaggtagg

SEQ ID NO: 926328 - DNA, 22 bp, Artificial Sequence
  chemically synthesized
gatctgtcgccctacctctttt

SEQ ID NO: 926329 - DNA, 22 bp, Artificial Sequence
  chemically synthesized
tcgccctacctcttttttctgt

SEQ ID NO: 926330 - DNA, 22 bp, Artificial Sequence
  chemically synthesized
caaacagctgtcagacagaaaa

SEQ ID NO: 926331 - DNA, 22 bp, Artificial Sequence
  chemically synthesized
cctcttttttctgtctgacagc

SEQ ID NO: 926332 - DNA, 22 bp, Artificial Sequence
  chemically synthesized
ttttttctgtctgacagctgtt

SEQ ID NO: 926333 - DNA, 22 bp, Artificial Sequence
  chemically synthesized
ttttctgtctgacagctgtttg

SEQ ID NO: 926334 - DNA, 22 bp, Artificial Sequence
  chemically synthesized
tttctgtctgacagctgtttgc

SEQ ID NO: 926335 - DNA, 22 bp, Artificial Sequence
  chemically synthesized
ttctgtctgacagctgtttgca

SEQ ID NO: 926336 - DNA, 22 bp, Artificial Sequence
  chemically synthesized
tctgtctgacagctgtttgcag

SEQ ID NO: 926337 - DNA, 22 bp, Artificial Sequence
  chemically synthesized
ctgtctgacagctgtttgcaga

SEQ ID NO: 926338 - DNA, 22 bp, Artificial Sequence
  chemically synthesized
tgtctgacagctgtttgcagac

SEQ ID NO: 926339 - DNA, 22 bp, Artificial Sequence
  chemically synthesized
cggtggcaggaggtctgcaaac

SEQ ID NO: 926340 - DNA, 22 bp, Artificial Sequence
  chemically synthesized
tctgacagctgtttgcagacct

SEQ ID NO: 926341 - DNA, 22 bp, Artificial Sequence
  chemically synthesized
acagctgtttgcagacctcctg

SEQ ID NO: 926342 - DNA, 22 bp, Artificial Sequence
  chemically synthesized
aatctgcggtggcaggaggtct

SEQ ID NO: 926343 - DNA, 22 bp, Artificial Sequence
  chemically synthesized
tttgcagacctcctgccaccgc

SEQ ID NO: 926344 - DNA, 22 bp, Artificial Sequence
  chemically synthesized
ggaagcctgaatctgcggtggc

SEQ ID NO: 926345 - DNA, 22 bp, Artificial Sequence
  chemically synthesized
gcagacctcctgccaccgcaga

SEQ ID NO: 926346 - DNA, 22 bp, Artificial Sequence
  chemically synthesized
cagacctcctgccaccgcagat

SEQ ID NO: 926347 - DNA, 22 bp, Artificial Sequence
  chemically synthesized
ctgccaccgcagattcaggctt

SEQ ID NO: 926348 - DNA, 22 bp, Artificial Sequence
  chemically synthesized
caggaaaaattgggaagcctga

SEQ ID NO: 926349 - DNA, 22 bp, Artificial Sequence
  chemically synthesized
ccaccgcagattcaggcttccc

SEQ ID NO: 926350 - DNA, 22 bp, Artificial Sequence
  chemically synthesized
tacaggaaaaattgggaagcct

SEQ ID NO: 926351 - DNA, 22 bp, Artificial Sequence
  chemically synthesized
aggcttcccaatttttcctgta

SEQ ID NO: 926352 - DNA, 22 bp, Artificial Sequence
  chemically synthesized
cccaatttttcctgtagaatac

SEQ ID NO: 926353 - DNA, 22 bp, Artificial Sequence
  chemically synthesized
ccaatttttcctgtagaatact

SEQ ID NO: 926354 - DNA, 22 bp, Artificial Sequence
  chemically synthesized
aaaaacagatgccagtattcta

SEQ ID NO: 926355 - DNA, 22 bp, Artificial Sequence
  chemically synthesized
ttcctgtagaatactggcatct

SEQ ID NO: 926356 - DNA, 22 bp, Artificial Sequence
  chemically synthesized
tcctgtagaatactggcatctg

SEQ ID NO: 926357 - DNA, 22 bp, Artificial Sequence
  chemically synthesized
cctgtagaatactggcatctgt

SEQ ID NO: 926358 - DNA, 22 bp, Artificial Sequence
  chemically synthesized
ctgtagaatactggcatctgtt

SEQ ID NO: 926359 - DNA, 22 bp, Artificial Sequence
  chemically synthesized
agcaatcctcaaaaacagatgc

SEQ ID NO: 926360 - DNA, 22 bp, Artificial Sequence
  chemically synthesized
tagaatactggcatctgttttt

SEQ ID NO: 926361 - DNA, 22 bp, Artificial Sequence
  chemically synthesized
gcatctgtttttgaggattgct

SEQ ID NO: 926362 - DNA, 22 bp, Artificial Sequence
  chemically synthesized
gggaagaaataattcagcaatc

SEQ ID NO: 926363 - DNA, 22 bp, Artificial Sequence
  chemically synthesized
tttttgaggattgctgaattat

SEQ ID NO: 926364 - DNA, 22 bp, Artificial Sequence
  chemically synthesized
ttgaggattgctgaattatttc

SEQ ID NO: 926365 - DNA, 22 bp, Artificial Sequence
  chemically synthesized
tgaggattgctgaattatttct

SEQ ID NO: 926366 - DNA, 22 bp, Artificial Sequence
  chemically synthesized
gaggattgctgaattatttctt

SEQ ID NO: 926367 - DNA, 22 bp, Artificial Sequence
  chemically synthesized
aggattgctgaattatttcttc

SEQ ID NO: 926368 - DNA, 22 bp, Artificial Sequence
  chemically synthesized
aatgcaactggggaagaaataa

SEQ ID NO: 926369 - DNA, 22 bp, Artificial Sequence
  chemically synthesized
ctgaattatttcttccccagtt

SEQ ID NO: 926370 - DNA, 22 bp, Artificial Sequence
  chemically synthesized
aattatttcttccccagttgca

SEQ ID NO: 926371 - DNA, 22 bp, Artificial Sequence
  chemically synthesized
tcagaacattgaatgcaactgg

SEQ ID NO: 926372 - DNA, 22 bp, Artificial Sequence
  chemically synthesized
ttgtcagaacattgaatgcaac

SEQ ID NO: 926373 - DNA, 22 bp, Artificial Sequence
  chemically synthesized
tttcttccccagttgcattcaa

SEQ ID NO: 926374 - DNA, 22 bp, Artificial Sequence
  chemically synthesized
cttccccagttgcattcaatgt

SEQ ID NO: 926375 - DNA, 22 bp, Artificial Sequence
  chemically synthesized
ttccccagttgcattcaatgtt

SEQ ID NO: 926376 - DNA, 22 bp, Artificial Sequence
  chemically synthesized
ccccagttgcattcaatgttct

SEQ ID NO: 926377 - DNA, 22 bp, Artificial Sequence
  chemically synthesized
cccagttgcattcaatgttctg

SEQ ID NO: 926378 - DNA, 22 bp, Artificial Sequence
  chemically synthesized
ggcagcggcaaactgttgtcag

SEQ ID NO: 926379 - DNA, 22 bp, Artificial Sequence
  chemically synthesized
cattcaatgttctgacaacagt

SEQ ID NO: 926380 - DNA, 22 bp, Artificial Sequence
  chemically synthesized
aatgttctgacaacagtttgcc

SEQ ID NO: 926381 - DNA, 22 bp, Artificial Sequence
  chemically synthesized
tgacaacagtttgccgctgccc

SEQ ID NO: 926382 - DNA, 22 bp, Artificial Sequence
  chemically synthesized
caggatggcattgggcagcggc

SEQ ID NO: 926383 - DNA, 22 bp, Artificial Sequence
  chemically synthesized
acaacagtttgccgctgcccaa

SEQ ID NO: 926384 - DNA, 22 bp, Artificial Sequence
  chemically synthesized
caggaactccaggatggcattg

SEQ ID NO: 926385 - DNA, 22 bp, Artificial Sequence
  chemically synthesized
acaggaactccaggatggcatt

SEQ ID NO: 926386 - DNA, 22 bp, Artificial Sequence
  chemically synthesized
gccgctgcccaatgccatcctg

SEQ ID NO: 926387 - DNA, 22 bp, Artificial Sequence
  chemically synthesized
ccgctgcccaatgccatcctgg

SEQ ID NO: 926388 - DNA, 22 bp, Artificial Sequence
  chemically synthesized
gtatcttacaggaactccagga

SEQ ID NO: 926389 - DNA, 22 bp, Artificial Sequence
  chemically synthesized
ggtatcttacaggaactccagg

SEQ ID NO: 926390 - DNA, 22 bp, Artificial Sequence
  chemically synthesized
cccaatgccatcctggagttcc

SEQ ID NO: 926391 - DNA, 22 bp, Artificial Sequence
  chemically synthesized
tggtatcttacaggaactccag

SEQ ID NO: 926392 - DNA, 22 bp, Artificial Sequence
  chemically synthesized
ttggtatcttacaggaactcca

SEQ ID NO: 926393 - DNA, 22 bp, Artificial Sequence
  chemically synthesized
tttggtatcttacaggaactcc

SEQ ID NO: 926394 - DNA, 22 bp, Artificial Sequence
  chemically synthesized
cctttttggtatcttacaggaa

SEQ ID NO: 926395 - DNA, 22 bp, Artificial Sequence
  chemically synthesized
gcctttttggtatcttacagga

SEQ ID NO: 926396 - DNA, 22 bp, Artificial Sequence
  chemically synthesized
tgcctttttggtatcttacagg

SEQ ID NO: 926397 - DNA, 22 bp, Artificial Sequence
  chemically synthesized
ttttgcctttttggtatcttac

SEQ ID NO: 926398 - DNA, 22 bp, Artificial Sequence
  chemically synthesized
gttttgcctttttggtatctta

SEQ ID NO: 926399 - DNA, 22 bp, Artificial Sequence
  chemically synthesized
tgttttgcctttttggtatctt

SEQ ID NO: 926400 - DNA, 22 bp, Artificial Sequence
  chemically synthesized
ttgttttgcctttttggtatct

SEQ ID NO: 926401 - DNA, 22 bp, Artificial Sequence
  chemically synthesized
gagttcctgtaagataccaaaa

SEQ ID NO: 926402 - DNA, 22 bp, Artificial Sequence
  chemically synthesized
atttttgttttgcctttttggt

SEQ ID NO: 926403 - DNA, 22 bp, Artificial Sequence
  chemically synthesized
catttttgttttgcctttttgg

SEQ ID NO: 926404 - DNA, 22 bp, Artificial Sequence
  chemically synthesized
ctgtaagataccaaaaaggcaa

SEQ ID NO: 926405 - DNA, 22 bp, Artificial Sequence
  chemically synthesized
taagataccaaaaaggcaaaac

SEQ ID NO: 926406 - DNA, 22 bp, Artificial Sequence
  chemically synthesized
aaataaaaagacatggggcttc

SEQ ID NO: 926407 - DNA, 22 bp, Artificial Sequence
  chemically synthesized
tcaaataaaaagacatggggct

SEQ ID NO: 926408 - DNA, 22 bp, Artificial Sequence
  chemically synthesized
ctcaaataaaaagacatggggc

SEQ ID NO: 926409 - DNA, 22 bp, Artificial Sequence
  chemically synthesized
tctcaaataaaaagacatgggg

SEQ ID NO: 926410 - DNA, 22 bp, Artificial Sequence
  chemically synthesized
ttctcaaataaaaagacatggg

SEQ ID NO: 926411 - DNA, 22 bp, Artificial Sequence
  chemically synthesized
atcttttctcaaataaaaagac

SEQ ID NO: 926412 - DNA, 22 bp, Artificial Sequence
  chemically synthesized
aatcttttctcaaataaaaaga

SEQ ID NO: 926413 - DNA, 22 bp, Artificial Sequence
  chemically synthesized
tttaatcttttctcaaataaaa

SEQ ID NO: 926414 - DNA, 22 bp, Artificial Sequence
  chemically synthesized
tttatttgagaaaagattaaac

SEQ ID NO: 926415 - DNA, 22 bp, Artificial Sequence
  chemically synthesized
ttatttgagaaaagattaaaca

SEQ ID NO: 926416 - DNA, 22 bp, Artificial Sequence
  chemically synthesized
tatttgagaaaagattaaacag

SEQ ID NO: 926417 - DNA, 22 bp, Artificial Sequence
  chemically synthesized
atttgagaaaagattaaacagt

SEQ ID NO: 926418 - DNA, 22 bp, Artificial Sequence
  chemically synthesized
tttgagaaaagattaaacagtg

SEQ ID NO: 926419 - DNA, 22 bp, Artificial Sequence
  chemically synthesized
catgtggtagcacactgtttaa

SEQ ID NO: 926420 - DNA, 22 bp, Artificial Sequence
  chemically synthesized
gagaaaagattaaacagtgtgc

SEQ ID NO: 926421 - DNA, 22 bp, Artificial Sequence
  chemically synthesized
agaaaagattaaacagtgtgct

SEQ ID NO: 926422 - DNA, 22 bp, Artificial Sequence
  chemically synthesized
ccagtacaactgcatgtggtag

SEQ ID NO: 926423 - DNA, 22 bp, Artificial Sequence
  chemically synthesized
gccagtacaactgcatgtggta

SEQ ID NO: 926424 - DNA, 22 bp, Artificial Sequence
  chemically synthesized
tgccagtacaactgcatgtggt

SEQ ID NO: 926425 - DNA, 22 bp, Artificial Sequence
  chemically synthesized
aacagtgtgctaccacatgcag

SEQ ID NO: 926426 - DNA, 22 bp, Artificial Sequence
  chemically synthesized
tttgccagtacaactgcatgtg

SEQ ID NO: 926427 - DNA, 22 bp, Artificial Sequence
  chemically synthesized
ctttgccagtacaactgcatgt

SEQ ID NO: 926428 - DNA, 22 bp, Artificial Sequence
  chemically synthesized
tctttgccagtacaactgcatg

SEQ ID NO: 926429 - DNA, 22 bp, Artificial Sequence
  chemically synthesized
tttctttgccagtacaactgca

SEQ ID NO: 926430 - DNA, 22 bp, Artificial Sequence
  chemically synthesized
ctttctttgccagtacaactgc

SEQ ID NO: 926431 - DNA, 22 bp, Artificial Sequence
  chemically synthesized
tatttctttctttgccagtaca

SEQ ID NO: 926432 - DNA, 22 bp, Artificial Sequence
  chemically synthesized
ccacatgcagttgtactggcaa

SEQ ID NO: 926433 - DNA, 22 bp, Artificial Sequence
  chemically synthesized
gtatttctttctttgccagtac

SEQ ID NO: 926434 - DNA, 22 bp, Artificial Sequence
  chemically synthesized
tgtatttctttctttgccagta

SEQ ID NO: 926435 - DNA, 22 bp, Artificial Sequence
  chemically synthesized
ttgtatttctttctttgccagt

SEQ ID NO: 926436 - DNA, 22 bp, Artificial Sequence
  chemically synthesized
tactggcaaagaaagaaataca

SEQ ID NO: 926437 - DNA, 22 bp, Artificial Sequence
  chemically synthesized
acatggagcttttgtatttctt

SEQ ID NO: 926438 - DNA, 22 bp, Artificial Sequence
  chemically synthesized
cacatggagcttttgtatttct

SEQ ID NO: 926439 - DNA, 22 bp, Artificial Sequence
  chemically synthesized
tcacatggagcttttgtatttc

SEQ ID NO: 926440 - DNA, 22 bp, Artificial Sequence
  chemically synthesized
gcaaagaaagaaatacaaaagc

SEQ ID NO: 926441 - DNA, 22 bp, Artificial Sequence
  chemically synthesized
atagggaaattttcacatggag

SEQ ID NO: 926442 - DNA, 22 bp, Artificial Sequence
  chemically synthesized
catagggaaattttcacatgga

SEQ ID NO: 926443 - DNA, 22 bp, Artificial Sequence
  chemically synthesized
catgtgaaaatttccctatgaa

SEQ ID NO: 926444 - DNA, 22 bp, Artificial Sequence
  chemically synthesized
gatatgggcatgtcagtttcat

SEQ ID NO: 926445 - DNA, 22 bp, Artificial Sequence
  chemically synthesized
ggatatgggcatgtcagtttca

SEQ ID NO: 926446 - DNA, 22 bp, Artificial Sequence
  chemically synthesized
tggatatgggcatgtcagtttc

SEQ ID NO: 926447 - DNA, 22 bp, Artificial Sequence
  chemically synthesized
ccctatgaaactgacatgccca

SEQ ID NO: 926448 - DNA, 22 bp, Artificial Sequence
  chemically synthesized
cctatgaaactgacatgcccat

SEQ ID NO: 926449 - DNA, 22 bp, Artificial Sequence
  chemically synthesized
tatcctttggatatgggcatgt

SEQ ID NO: 926450 - DNA, 22 bp, Artificial Sequence
  chemically synthesized
gtatcctttggatatgggcatg

SEQ ID NO: 926451 - DNA, 22 bp, Artificial Sequence
  chemically synthesized
tgaaactgacatgcccatatcc

SEQ ID NO: 926452 - DNA, 22 bp, Artificial Sequence
  chemically synthesized
tcttgtatcctttggatatggg

SEQ ID NO: 926453 - DNA, 22 bp, Artificial Sequence
  chemically synthesized
tgtcttgtatcctttggatatg

SEQ ID NO: 926454 - DNA, 22 bp, Artificial Sequence
  chemically synthesized
ctgtcttgtatcctttggatat

SEQ ID NO: 926455 - DNA, 22 bp, Artificial Sequence
  chemically synthesized
tctgtcttgtatcctttggata

SEQ ID NO: 926456 - DNA, 22 bp, Artificial Sequence
  chemically synthesized
acatgcccatatccaaaggata

SEQ ID NO: 926457 - DNA, 22 bp, Artificial Sequence
  chemically synthesized
acacataaaaggtgtctttctg

SEQ ID NO: 926458 - DNA, 22 bp, Artificial Sequence
  chemically synthesized
cctgacacataaaaggtgtctt

SEQ ID NO: 926459 - DNA, 22 bp, Artificial Sequence
  chemically synthesized
ccctgacacataaaaggtgtct

SEQ ID NO: 926460 - DNA, 22 bp, Artificial Sequence
  chemically synthesized
tccctgacacataaaaggtgtc

SEQ ID NO: 926461 - DNA, 22 bp, Artificial Sequence
  chemically synthesized
ttccctgacacataaaaggtgt

SEQ ID NO: 926462 - DNA, 22 bp, Artificial Sequence
  chemically synthesized
tttccctgacacataaaaggtg

SEQ ID NO: 926463 - DNA, 22 bp, Artificial Sequence
  chemically synthesized
ttttccctgacacataaaaggt

SEQ ID NO: 926464 - DNA, 22 bp, Artificial Sequence
  chemically synthesized
accgagagggtgcttttttccc

SEQ ID NO: 926465 - DNA, 22 bp, Artificial Sequence
  chemically synthesized
ttatgtgtcagggaaaaaagca

SEQ ID NO: 926466 - DNA, 22 bp, Artificial Sequence
  chemically synthesized
tatgtgtcagggaaaaaagcac

SEQ ID NO: 926467 - DNA, 22 bp, Artificial Sequence
  chemically synthesized
atgtgtcagggaaaaaagcacc

SEQ ID NO: 926468 - DNA, 22 bp, Artificial Sequence
  chemically synthesized
tgtgtcagggaaaaaagcaccc

SEQ ID NO: 926469 - DNA, 22 bp, Artificial Sequence
  chemically synthesized
gagctaaccgagagggtgcttt

SEQ ID NO: 926470 - DNA, 22 bp, Artificial Sequence
  chemically synthesized
caaaaataaaaactggagctaa

SEQ ID NO: 926471 - DNA, 22 bp, Artificial Sequence
  chemically synthesized
acaaaaataaaaactggagcta

SEQ ID NO: 926472 - DNA, 22 bp, Artificial Sequence
  chemically synthesized
tcggttagctccagtttttatt

SEQ ID NO: 926473 - DNA, 22 bp, Artificial Sequence
  chemically synthesized
acaagcttacaaaaataaaaac

SEQ ID NO: 926474 - DNA, 22 bp, Artificial Sequence
  chemically synthesized
ggttagctccagtttttatttt

SEQ ID NO: 926475 - DNA, 22 bp, Artificial Sequence
  chemically synthesized
gctgacaagcttacaaaaataa

SEQ ID NO: 926476 - DNA, 22 bp, Artificial Sequence
  chemically synthesized
gctccagtttttatttttgtaa

SEQ ID NO: 926477 - DNA, 22 bp, Artificial Sequence
  chemically synthesized
tagctgacaagcttacaaaaat

SEQ ID NO: 926478 - DNA, 22 bp, Artificial Sequence
  chemically synthesized
cagtttttatttttgtaagctt

SEQ ID NO: 926479 - DNA, 22 bp, Artificial Sequence
  chemically synthesized
ttatttttgtaagcttgtcagc

SEQ ID NO: 926480 - DNA, 22 bp, Artificial Sequence
  chemically synthesized
taacatcctctagctgacaagc

SEQ ID NO: 926481 - DNA, 22 bp, Artificial Sequence
  chemically synthesized
tatttttgtaagcttgtcagct

SEQ ID NO: 926482 - DNA, 22 bp, Artificial Sequence
  chemically synthesized
atttttgtaagcttgtcagcta

SEQ ID NO: 926483 - DNA, 22 bp, Artificial Sequence
  chemically synthesized
tttttgtaagcttgtcagctag

SEQ ID NO: 926484 - DNA, 22 bp, Artificial Sequence
  chemically synthesized
ttgtaagcttgtcagctagagg

SEQ ID NO: 926485 - DNA, 22 bp, Artificial Sequence
  chemically synthesized
tgtaagcttgtcagctagagga

SEQ ID NO: 926486 - DNA, 22 bp, Artificial Sequence
  chemically synthesized
gtaagcttgtcagctagaggat

SEQ ID NO: 926487 - DNA, 22 bp, Artificial Sequence
  chemically synthesized
taagcttgtcagctagaggatg

SEQ ID NO: 926488 - DNA, 22 bp, Artificial Sequence
  chemically synthesized
taggacattataacatcctcta

SEQ ID NO: 926489 - DNA, 22 bp, Artificial Sequence
  chemically synthesized
gtaggacattataacatcctct

SEQ ID NO: 926490 - DNA, 22 bp, Artificial Sequence
  chemically synthesized
atttgtaggacattataacatc

SEQ ID NO: 926491 - DNA, 22 bp, Artificial Sequence
  chemically synthesized
gtcagctagaggatgttataat

SEQ ID NO: 926492 - DNA, 22 bp, Artificial Sequence
  chemically synthesized
tcagctagaggatgttataatg

SEQ ID NO: 926493 - DNA, 22 bp, Artificial Sequence
  chemically synthesized
attgatttgtaggacattataa

SEQ ID NO: 926494 - DNA, 22 bp, Artificial Sequence
  chemically synthesized
gaggatgttataatgtcctaca

SEQ ID NO: 926495 - DNA, 22 bp, Artificial Sequence
  chemically synthesized
caactaattgatttgtaggaca

SEQ ID NO: 926496 - DNA, 22 bp, Artificial Sequence
  chemically synthesized
ccaactaattgatttgtaggac

SEQ ID NO: 926497 - DNA, 22 bp, Artificial Sequence
  chemically synthesized
taatgtcctacaaatcaattag

SEQ ID NO: 926498 - DNA, 22 bp, Artificial Sequence
  chemically synthesized
aaaaggtttccaactaattgat

SEQ ID NO: 926499 - DNA, 22 bp, Artificial Sequence
  chemically synthesized
gaaaaggtttccaactaattga

SEQ ID NO: 926500 - DNA, 22 bp, Artificial Sequence
  chemically synthesized
ttgaaaaggtttccaactaatt

SEQ ID NO: 926501 - DNA, 22 bp, Artificial Sequence
  chemically synthesized
ctcttgaaaaggtttccaacta

SEQ ID NO: 926502 - DNA, 22 bp, Artificial Sequence
  chemically synthesized
gctcttgaaaaggtttccaact

SEQ ID NO: 926503 - DNA, 22 bp, Artificial Sequence
  chemically synthesized
caaatcaattagttggaaacct

SEQ ID NO: 926504 - DNA, 22 bp, Artificial Sequence
  chemically synthesized
gttggaaaccttttcaagagca

SEQ ID NO: 926505 - DNA, 22 bp, Artificial Sequence
  chemically synthesized
gaaaccttttcaagagcaaatt

SEQ ID NO: 926506 - DNA, 22 bp, Artificial Sequence
  chemically synthesized
tggggacaagaaatcgaatttg

SEQ ID NO: 926507 - DNA, 22 bp, Artificial Sequence
  chemically synthesized
gtggggacaagaaatcgaattt

SEQ ID NO: 926508 - DNA, 22 bp, Artificial Sequence
  chemically synthesized
ttcaagagcaaattcgatttct

SEQ ID NO: 926509 - DNA, 22 bp, Artificial Sequence
  chemically synthesized
tcaagagcaaattcgatttctt

SEQ ID NO: 926510 - DNA, 22 bp, Artificial Sequence
  chemically synthesized
caagagcaaattcgatttcttg

SEQ ID NO: 926511 - DNA, 22 bp, Artificial Sequence
  chemically synthesized
aagagcaaattcgatttcttgt

SEQ ID NO: 926512 - DNA, 22 bp, Artificial Sequence
  chemically synthesized
aacatggaacatccttgtgggg

SEQ ID NO: 926513 - DNA, 22 bp, Artificial Sequence
  chemically synthesized
gatttcttgtccccacaaggat

SEQ ID NO: 926514 - DNA, 22 bp, Artificial Sequence
  chemically synthesized
ttaaacatggaacatccttgtg

SEQ ID NO: 926515 - DNA, 22 bp, Artificial Sequence
  chemically synthesized
cttgtccccacaaggatgttcc

SEQ ID NO: 926516 - DNA, 22 bp, Artificial Sequence
  chemically synthesized
ttgtccccacaaggatgttcca

SEQ ID NO: 926517 - DNA, 22 bp, Artificial Sequence
  chemically synthesized
gtccccacaaggatgttccatg

SEQ ID NO: 926518 - DNA, 22 bp, Artificial Sequence
  chemically synthesized
tccccacaaggatgttccatgt

SEQ ID NO: 926519 - DNA, 22 bp, Artificial Sequence
  chemically synthesized
atagactattaaacatggaaca

SEQ ID NO: 926520 - DNA, 22 bp, Artificial Sequence
  chemically synthesized
catagactattaaacatggaac

SEQ ID NO: 926521 - DNA, 22 bp, Artificial Sequence
  chemically synthesized
caacatttcatagactattaaa

SEQ ID NO: 926522 - DNA, 22 bp, Artificial Sequence
  chemically synthesized
acaacatttcatagactattaa

SEQ ID NO: 926523 - DNA, 22 bp, Artificial Sequence
  chemically synthesized
tacaacatttcatagactatta

SEQ ID NO: 926524 - DNA, 22 bp, Artificial Sequence
  chemically synthesized
aattttacaacatttcatagac

SEQ ID NO: 926525 - DNA, 22 bp, Artificial Sequence
  chemically synthesized
catgtttaatagtctatgaaat

SEQ ID NO: 926526 - DNA, 22 bp, Artificial Sequence
  chemically synthesized
aaattttacaacatttcataga

SEQ ID NO: 926527 - DNA, 22 bp, Artificial Sequence
  chemically synthesized
atgtttaaattttacaacattt

SEQ ID NO: 926528 - DNA, 22 bp, Artificial Sequence
  chemically synthesized
aatagtctatgaaatgttgtaa

SEQ ID NO: 926529 - DNA, 22 bp, Artificial Sequence
  chemically synthesized
atagtctatgaaatgttgtaaa

SEQ ID NO: 926530 - DNA, 22 bp, Artificial Sequence
  chemically synthesized
ttcatgtttaaattttacaaca

SEQ ID NO: 926531 - DNA, 22 bp, Artificial Sequence
  chemically synthesized
gttcatgtttaaattttacaac

SEQ ID NO: 926532 - DNA, 22 bp, Artificial Sequence
  chemically synthesized
tgttcatgtttaaattttacaa

SEQ ID NO: 926533 - DNA, 22 bp, Artificial Sequence
  chemically synthesized
tgaaatgttgtaaaatttaaac

SEQ ID NO: 926534 - DNA, 22 bp, Artificial Sequence
  chemically synthesized
taaaatttaaacatgaacaaag

SEQ ID NO: 926535 - DNA, 22 bp, Artificial Sequence
  chemically synthesized
agaaacccaaatactttgttca

SEQ ID NO: 926536 - DNA, 22 bp, Artificial Sequence
  chemically synthesized
aaacatgaacaaagtatttggg

SEQ ID NO: 926537 - DNA, 22 bp, Artificial Sequence
  chemically synthesized
aacatgaacaaagtatttgggt

SEQ ID NO: 926538 - DNA, 22 bp, Artificial Sequence
  chemically synthesized
gtatccacgatcactaagaaac

SEQ ID NO: 926539 - DNA, 22 bp, Artificial Sequence
  chemically synthesized
tcgtatccacgatcactaagaa

SEQ ID NO: 926540 - DNA, 22 bp, Artificial Sequence
  chemically synthesized
acctctcgtatccacgatcact

SEQ ID NO: 926541 - DNA, 22 bp, Artificial Sequence
  chemically synthesized
cacctctcgtatccacgatcac

SEQ ID NO: 926542 - DNA, 22 bp, Artificial Sequence
  chemically synthesized
tcacctctcgtatccacgatca

SEQ ID NO: 926543 - DNA, 22 bp, Artificial Sequence
  chemically synthesized
gggtttcttagtgatcgtggat

SEQ ID NO: 926544 - DNA, 22 bp, Artificial Sequence
  chemically synthesized
ttcacctctcgtatccacgatc

SEQ ID NO: 926545 - DNA, 22 bp, Artificial Sequence
  chemically synthesized
ggtttcttagtgatcgtggata

SEQ ID NO: 926546 - DNA, 22 bp, Artificial Sequence
  chemically synthesized
tttcacctctcgtatccacgat

SEQ ID NO: 926547 - DNA, 22 bp, Artificial Sequence
  chemically synthesized
tttttcacctctcgtatccacg

SEQ ID NO: 926548 - DNA, 22 bp, Artificial Sequence
  chemically synthesized
cttagtgatcgtggatacgaga

SEQ ID NO: 926549 - DNA, 22 bp, Artificial Sequence
  chemically synthesized
ttctttttcacctctcgtatcc

SEQ ID NO: 926550 - DNA, 22 bp, Artificial Sequence
  chemically synthesized
ttagtgatcgtggatacgagag

SEQ ID NO: 926551 - DNA, 22 bp, Artificial Sequence
  chemically synthesized
gttctttttcacctctcgtatc

SEQ ID NO: 926552 - DNA, 22 bp, Artificial Sequence
  chemically synthesized
agtgatcgtggatacgagaggt

SEQ ID NO: 926553 - DNA, 22 bp, Artificial Sequence
  chemically synthesized
gtgatcgtggatacgagaggtg

SEQ ID NO: 926554 - DNA, 22 bp, Artificial Sequence
  chemically synthesized
tgtttgttctttttcacctctc

SEQ ID NO: 926555 - DNA, 22 bp, Artificial Sequence
  chemically synthesized
acctatgtttgttctttttcac

SEQ ID NO: 926556 - DNA, 22 bp, Artificial Sequence
  chemically synthesized
tgactaacctatgtttgttctt

SEQ ID NO: 926557 - DNA, 22 bp, Artificial Sequence
  chemically synthesized
atactgtgactaacctatgttt

SEQ ID NO: 926558 - DNA, 22 bp, Artificial Sequence
  chemically synthesized
aatactgtgactaacctatgtt

SEQ ID NO: 926559 - DNA, 22 bp, Artificial Sequence
  chemically synthesized
taatactgtgactaacctatgt

SEQ ID NO: 926560 - DNA, 22 bp, Artificial Sequence
  chemically synthesized
ttaatactgtgactaacctatg

SEQ ID NO: 926561 - DNA, 22 bp, Artificial Sequence
  chemically synthesized
tttaatactgtgactaacctat

SEQ ID NO: 926562 - DNA, 22 bp, Artificial Sequence
  chemically synthesized
ttttaatactgtgactaaccta

SEQ ID NO: 926563 - DNA, 22 bp, Artificial Sequence
  chemically synthesized
tttttaatactgtgactaacct

SEQ ID NO: 926564 - DNA, 22 bp, Artificial Sequence
  chemically synthesized
ttttttaatactgtgactaacc

SEQ ID NO: 926565 - DNA, 22 bp, Artificial Sequence
  chemically synthesized
gagtttttttttaatactgtga

SEQ ID NO: 926566 - DNA, 22 bp, Artificial Sequence
  chemically synthesized
tagagtttttttttaatactgt

SEQ ID NO: 926567 - DNA, 22 bp, Artificial Sequence
  chemically synthesized
aatatctctagagttttttttt

SEQ ID NO: 926568 - DNA, 22 bp, Artificial Sequence
  chemically synthesized
gtcacagtattaaaaaaaaact

SEQ ID NO: 926569 - DNA, 22 bp, Artificial Sequence
  chemically synthesized
aaatatctctagagtttttttt

SEQ ID NO: 926570 - DNA, 22 bp, Artificial Sequence
  chemically synthesized
tttaaatatctctagagttttt

SEQ ID NO: 926571 - DNA, 22 bp, Artificial Sequence
  chemically synthesized
atttaaatatctctagagtttt

SEQ ID NO: 926572 - DNA, 22 bp, Artificial Sequence
  chemically synthesized
tatttaaatatctctagagttt

SEQ ID NO: 926573 - DNA, 22 bp, Artificial Sequence
  chemically synthesized
attttatttaaatatctctaga

SEQ ID NO: 926574 - DNA, 22 bp, Artificial Sequence
  chemically synthesized
aaaaaaaactctagagatattt

SEQ ID NO: 926575 - DNA, 22 bp, Artificial Sequence
  chemically synthesized
atatagcaattaattttattta

SEQ ID NO: 926576 - DNA, 22 bp, Artificial Sequence
  chemically synthesized
tagagatatttaaataaaatta

SEQ ID NO: 926577 - DNA, 22 bp, Artificial Sequence
  chemically synthesized
taatatagcaattaattttatt

SEQ ID NO: 926578 - DNA, 22 bp, Artificial Sequence
  chemically synthesized
ctaatatagcaattaattttat

SEQ ID NO: 926579 - DNA, 22 bp, Artificial Sequence
  chemically synthesized
gagatatttaaataaaattaat

SEQ ID NO: 926580 - DNA, 22 bp, Artificial Sequence
  chemically synthesized
ttctaatatagcaattaatttt

SEQ ID NO: 926581 - DNA, 22 bp, Artificial Sequence
  chemically synthesized
cttctaatatagcaattaattt

SEQ ID NO: 926582 - DNA, 22 bp, Artificial Sequence
  chemically synthesized
tcttctaatatagcaattaatt

SEQ ID NO: 926583 - DNA, 22 bp, Artificial Sequence
  chemically synthesized
aaataaaattaattgctatatt

SEQ ID NO: 926584 - DNA, 22 bp, Artificial Sequence
  chemically synthesized
aataaaattaattgctatatta

SEQ ID NO: 926585 - DNA, 22 bp, Artificial Sequence
  chemically synthesized
aaatgaattttcttctaatata

SEQ ID NO: 926586 - DNA, 22 bp, Artificial Sequence
  chemically synthesized
gaaatgaattttcttctaatat

SEQ ID NO: 926587 - DNA, 22 bp, Artificial Sequence
  chemically synthesized
attgctatattagaagaaaatt

SEQ ID NO: 926588 - DNA, 22 bp, Artificial Sequence
  chemically synthesized
ctatattagaagaaaattcatt

SEQ ID NO: 926589 - DNA, 22 bp, Artificial Sequence
  chemically synthesized
tattagaagaaaattcatttca

SEQ ID NO: 926590 - DNA, 22 bp, Artificial Sequence
  chemically synthesized
acgcagacagaatttgaaatga

SEQ ID NO: 926591 - DNA, 22 bp, Artificial Sequence
  chemically synthesized
gaagaaaattcatttcaaattc

SEQ ID NO: 926592 - DNA, 22 bp, Artificial Sequence
  chemically synthesized
atttcaaattctgtctgcgtca

SEQ ID NO: 926593 - DNA, 22 bp, Artificial Sequence
  chemically synthesized
atgcaaaatacattgacgcaga

SEQ ID NO: 926594 - DNA, 22 bp, Artificial Sequence
  chemically synthesized
taatgcaaaatacattgacgca

SEQ ID NO: 926595 - DNA, 22 bp, Artificial Sequence
  chemically synthesized
caaattctgtctgcgtcaatgt

SEQ ID NO: 926596 - DNA, 22 bp, Artificial Sequence
  chemically synthesized
ctaatgcaaaatacattgacgc

SEQ ID NO: 926597 - DNA, 22 bp, Artificial Sequence
  chemically synthesized
aaattctgtctgcgtcaatgta

SEQ ID NO: 926598 - DNA, 22 bp, Artificial Sequence
  chemically synthesized
tggcttctaatgcaaaatacat

SEQ ID NO: 926599 - DNA, 22 bp, Artificial Sequence
  chemically synthesized
tgtctgcgtcaatgtattttgc

SEQ ID NO: 926600 - DNA, 22 bp, Artificial Sequence
  chemically synthesized
gtggcttctaatgcaaaataca

SEQ ID NO: 926601 - DNA, 22 bp, Artificial Sequence
  chemically synthesized
tgtggcttctaatgcaaaatac

SEQ ID NO: 926602 - DNA, 22 bp, Artificial Sequence
  chemically synthesized
tctgcgtcaatgtattttgcat

SEQ ID NO: 926603 - DNA, 22 bp, Artificial Sequence
  chemically synthesized
ttgtggcttctaatgcaaaata

SEQ ID NO: 926604 - DNA, 22 bp, Artificial Sequence
  chemically synthesized
tttgtggcttctaatgcaaaat

SEQ ID NO: 926605 - DNA, 22 bp, Artificial Sequence
  chemically synthesized
cgtcaatgtattttgcattaga

SEQ ID NO: 926606 - DNA, 22 bp, Artificial Sequence
  chemically synthesized
agttttttgtggcttctaatgc

SEQ ID NO: 926607 - DNA, 22 bp, Artificial Sequence
  chemically synthesized
tcagttttttgtggcttctaat

SEQ ID NO: 926608 - DNA, 22 bp, Artificial Sequence
  chemically synthesized
attctcagttttttgtggcttc

SEQ ID NO: 926609 - DNA, 22 bp, Artificial Sequence
  chemically synthesized
tgcattagaagccacaaaaaac

SEQ ID NO: 926610 - DNA, 22 bp, Artificial Sequence
  chemically synthesized
gcattagaagccacaaaaaact

SEQ ID NO: 926611 - DNA, 22 bp, Artificial Sequence
  chemically synthesized
cattagaagccacaaaaaactg

SEQ ID NO: 926612 - DNA, 22 bp, Artificial Sequence
  chemically synthesized
aaagcaattaattctcagtttt

SEQ ID NO: 926613 - DNA, 22 bp, Artificial Sequence
  chemically synthesized
gaagccacaaaaaactgagaat

SEQ ID NO: 926614 - DNA, 22 bp, Artificial Sequence
  chemically synthesized
ctgaaagcaattaattctcagt

SEQ ID NO: 926615 - DNA, 22 bp, Artificial Sequence
  chemically synthesized
atgggatgctcctgaaagcaat

SEQ ID NO: 926616 - DNA, 22 bp, Artificial Sequence
  chemically synthesized
gatgggatgctcctgaaagcaa

SEQ ID NO: 926617 - DNA, 22 bp, Artificial Sequence
  chemically synthesized
agaattaattgctttcaggagc

SEQ ID NO: 926618 - DNA, 22 bp, Artificial Sequence
  chemically synthesized
gggatatcttgatgggatgctc

SEQ ID NO: 926619 - DNA, 22 bp, Artificial Sequence
  chemically synthesized
attgctttcaggagcatcccat

SEQ ID NO: 926620 - DNA, 22 bp, Artificial Sequence
  chemically synthesized
agggatatcttgatgggatgct

SEQ ID NO: 926621 - DNA, 22 bp, Artificial Sequence
  chemically synthesized
ctttcaggagcatcccatcaag

SEQ ID NO: 926622 - DNA, 22 bp, Artificial Sequence
  chemically synthesized
tagcttagggatatcttgatgg

SEQ ID NO: 926623 - DNA, 22 bp, Artificial Sequence
  chemically synthesized
tcaggagcatcccatcaagata

SEQ ID NO: 926624 - DNA, 22 bp, Artificial Sequence
  chemically synthesized
caggagcatcccatcaagatat

SEQ ID NO: 926625 - DNA, 22 bp, Artificial Sequence
  chemically synthesized
aggagcatcccatcaagatatc

SEQ ID NO: 926626 - DNA, 22 bp, Artificial Sequence
  chemically synthesized
ctgtagcttagggatatcttga

SEQ ID NO: 926627 - DNA, 22 bp, Artificial Sequence
  chemically synthesized
ttactgtagcttagggatatct

SEQ ID NO: 926628 - DNA, 22 bp, Artificial Sequence
  chemically synthesized
attactgtagcttagggatatc

SEQ ID NO: 926629 - DNA, 22 bp, Artificial Sequence
  chemically synthesized
aaatttattactgtagcttagg

SEQ ID NO: 926630 - DNA, 22 bp, Artificial Sequence
  chemically synthesized
aaaatttattactgtagcttag

SEQ ID NO: 926631 - DNA, 22 bp, Artificial Sequence
  chemically synthesized
taaaatttattactgtagctta

SEQ ID NO: 926632 - DNA, 22 bp, Artificial Sequence
  chemically synthesized
ttttaaaatttattactgtagc

SEQ ID NO: 926633 - DNA, 22 bp, Artificial Sequence
  chemically synthesized
tagattattttaaaatttatta

SEQ ID NO: 926634 - DNA, 22 bp, Artificial Sequence
  chemically synthesized
agctacagtaataaattttaaa

SEQ ID NO: 926635 - DNA, 22 bp, Artificial Sequence
  chemically synthesized
gtgactatagattattttaaaa

SEQ ID NO: 926636 - DNA, 22 bp, Artificial Sequence
  chemically synthesized
cagtaataaattttaaaataat

SEQ ID NO: 926637 - DNA, 22 bp, Artificial Sequence
  chemically synthesized
tggtgactatagattattttaa

SEQ ID NO: 926638 - DNA, 22 bp, Artificial Sequence
  chemically synthesized
taaaataatctatagtcaccag

SEQ ID NO: 926639 - DNA, 22 bp, Artificial Sequence
  chemically synthesized
aaaataatctatagtcaccaga

SEQ ID NO: 926640 - DNA, 22 bp, Artificial Sequence
  chemically synthesized
aaataatctatagtcaccagag

SEQ ID NO: 926641 - DNA, 22 bp, Artificial Sequence
  chemically synthesized
acaatcataaaaatgctctggt

SEQ ID NO: 926642 - DNA, 22 bp, Artificial Sequence
  chemically synthesized
gacaatcataaaaatgctctgg

SEQ ID NO: 926643 - DNA, 22 bp, Artificial Sequence
  chemically synthesized
agcttgacaatcataaaaatgc

SEQ ID NO: 926644 - DNA, 22 bp, Artificial Sequence
  chemically synthesized
tagtcaccagagcatttttatg

SEQ ID NO: 926645 - DNA, 22 bp, Artificial Sequence
  chemically synthesized
aagcttgacaatcataaaaatg

SEQ ID NO: 926646 - DNA, 22 bp, Artificial Sequence
  chemically synthesized
ttatgattgtcaagcttaaata

SEQ ID NO: 926647 - DNA, 22 bp, Artificial Sequence
  chemically synthesized
tatgattgtcaagcttaaatat

SEQ ID NO: 926648 - DNA, 22 bp, Artificial Sequence
  chemically synthesized
atgattgtcaagcttaaatatt

SEQ ID NO: 926649 - DNA, 22 bp, Artificial Sequence
  chemically synthesized
tgattgtcaagcttaaatattg

SEQ ID NO: 926650 - DNA, 22 bp, Artificial Sequence
  chemically synthesized
aggaaaaaagtaaacaatattt

SEQ ID NO: 926651 - DNA, 22 bp, Artificial Sequence
  chemically synthesized
tcaagcttaaatattgtttact

SEQ ID NO: 926652 - DNA, 22 bp, Artificial Sequence
  chemically synthesized
attcaggaaaaaagtaaacaat

SEQ ID NO: 926653 - DNA, 22 bp, Artificial Sequence
  chemically synthesized
cattcaggaaaaaagtaaacaa

SEQ ID NO: 926654 - DNA, 22 bp, Artificial Sequence
  chemically synthesized
aaatttcattcaggaaaaaagt

SEQ ID NO: 926655 - DNA, 22 bp, Artificial Sequence
  chemically synthesized
aaatattgtttacttttttcct

SEQ ID NO: 926656 - DNA, 22 bp, Artificial Sequence
  chemically synthesized
aaaatttcattcaggaaaaaag

SEQ ID NO: 926657 - DNA, 22 bp, Artificial Sequence
  chemically synthesized
aatattgtttacttttttcctg

SEQ ID NO: 926658 - DNA, 22 bp, Artificial Sequence
  chemically synthesized
ttaaaatttcattcaggaaaaa

SEQ ID NO: 926659 - DNA, 22 bp, Artificial Sequence
  chemically synthesized
ctcttaaaatttcattcaggaa

SEQ ID NO: 926660 - DNA, 22 bp, Artificial Sequence
  chemically synthesized
actcttaaaatttcattcagga

SEQ ID NO: 926661 - DNA, 22 bp, Artificial Sequence
  chemically synthesized
tactcttaaaatttcattcagg

SEQ ID NO: 926662 - DNA, 22 bp, Artificial Sequence
  chemically synthesized
tttacttttttcctgaatgaaa

SEQ ID NO: 926663 - DNA, 22 bp, Artificial Sequence
  chemically synthesized
acttttttcctgaatgaaattt

SEQ ID NO: 926664 - DNA, 22 bp, Artificial Sequence
  chemically synthesized
cttttttcctgaatgaaatttt

SEQ ID NO: 926665 - DNA, 22 bp, Artificial Sequence
  chemically synthesized
atactttactcttaaaatttca

SEQ ID NO: 926666 - DNA, 22 bp, Artificial Sequence
  chemically synthesized
ttttcctgaatgaaattttaag

SEQ ID NO: 926667 - DNA, 22 bp, Artificial Sequence
  chemically synthesized
tgatactttactcttaaaattt

SEQ ID NO: 926668 - DNA, 22 bp, Artificial Sequence
  chemically synthesized
tttcctgaatgaaattttaaga

SEQ ID NO: 926669 - DNA, 22 bp, Artificial Sequence
  chemically synthesized
ctgatactttactcttaaaatt

SEQ ID NO: 926670 - DNA, 22 bp, Artificial Sequence
  chemically synthesized
ttcctgaatgaaattttaagag

SEQ ID NO: 926671 - DNA, 22 bp, Artificial Sequence
  chemically synthesized
tctgatactttactcttaaaat

SEQ ID NO: 926672 - DNA, 22 bp, Artificial Sequence
  chemically synthesized
tcctgaatgaaattttaagagt

SEQ ID NO: 926673 - DNA, 22 bp, Artificial Sequence
  chemically synthesized
ttctgatactttactcttaaaa

SEQ ID NO: 926674 - DNA, 22 bp, Artificial Sequence
  chemically synthesized
cctgaatgaaattttaagagta

SEQ ID NO: 926675 - DNA, 22 bp, Artificial Sequence
  chemically synthesized
ctgaatgaaattttaagagtaa

SEQ ID NO: 926676 - DNA, 22 bp, Artificial Sequence
  chemically synthesized
tttttctgatactttactctta

SEQ ID NO: 926677 - DNA, 22 bp, Artificial Sequence
  chemically synthesized
aatgaaattttaagagtaaagt

SEQ ID NO: 926678 - DNA, 22 bp, Artificial Sequence
  chemically synthesized
agctatttttctgatactttac

SEQ ID NO: 926679 - DNA, 22 bp, Artificial Sequence
  chemically synthesized
aattgagctatttttctgatac

SEQ ID NO: 926680 - DNA, 22 bp, Artificial Sequence
  chemically synthesized
caattgagctatttttctgata

SEQ ID NO: 926681 - DNA, 22 bp, Artificial Sequence
  chemically synthesized
taagagtaaagtatcagaaaaa

SEQ ID NO: 926682 - DNA, 22 bp, Artificial Sequence
  chemically synthesized
tcaattgagctatttttctgat

SEQ ID NO: 926683 - DNA, 22 bp, Artificial Sequence
  chemically synthesized
aagagtaaagtatcagaaaaat

SEQ ID NO: 926684 - DNA, 22 bp, Artificial Sequence
  chemically synthesized
ttcaattgagctatttttctga

SEQ ID NO: 926685 - DNA, 22 bp, Artificial Sequence
  chemically synthesized
agagtaaagtatcagaaaaata

SEQ ID NO: 926686 - DNA, 22 bp, Artificial Sequence
  chemically synthesized
cttttcaattgagctatttttc

SEQ ID NO: 926687 - DNA, 22 bp, Artificial Sequence
  chemically synthesized
tccttttcaattgagctatttt

SEQ ID NO: 926688 - DNA, 22 bp, Artificial Sequence
  chemically synthesized
taatattctccttttcaattga

SEQ ID NO: 926689 - DNA, 22 bp, Artificial Sequence
  chemically synthesized
gttgtaatattctccttttcaa

SEQ ID NO: 926690 - DNA, 22 bp, Artificial Sequence
  chemically synthesized
ggttgtaatattctccttttca

SEQ ID NO: 926691 - DNA, 22 bp, Artificial Sequence
  chemically synthesized
aattgaaaaggagaatattaca

SEQ ID NO: 926692 - DNA, 22 bp, Artificial Sequence
  chemically synthesized
tgtgtacttggttgtaatattc

SEQ ID NO: 926693 - DNA, 22 bp, Artificial Sequence
  chemically synthesized
gtgtgtacttggttgtaatatt

SEQ ID NO: 926694 - DNA, 22 bp, Artificial Sequence
  chemically synthesized
tgtgtgtacttggttgtaatat

SEQ ID NO: 926695 - DNA, 22 bp, Artificial Sequence
  chemically synthesized
ttgtgtgtacttggttgtaata

SEQ ID NO: 926696 - DNA, 22 bp, Artificial Sequence
  chemically synthesized
aaaaggagaatattacaaccaa

SEQ ID NO: 926697 - DNA, 22 bp, Artificial Sequence
  chemically synthesized
tttttgtgtgtacttggttgta

SEQ ID NO: 926698 - DNA, 22 bp, Artificial Sequence
  chemically synthesized
gtttttgtgtgtacttggttgt

SEQ ID NO: 926699 - DNA, 22 bp, Artificial Sequence
  chemically synthesized
tgtttttgtgtgtacttggttg

SEQ ID NO: 926700 - DNA, 22 bp, Artificial Sequence
  chemically synthesized
ttgtttttgtgtgtacttggtt

SEQ ID NO: 926701 - DNA, 22 bp, Artificial Sequence
  chemically synthesized
caaccaagtacacacaaaaaca

SEQ ID NO: 926702 - DNA, 22 bp, Artificial Sequence
  chemically synthesized
atggtaaaaagcatttttgttt

SEQ ID NO: 926703 - DNA, 22 bp, Artificial Sequence
  chemically synthesized
aatggtaaaaagcatttttgtt

SEQ ID NO: 926704 - DNA, 22 bp, Artificial Sequence
  chemically synthesized
tttaatggtaaaaagcattttt

SEQ ID NO: 926705 - DNA, 22 bp, Artificial Sequence
  chemically synthesized
atttaatggtaaaaagcatttt

SEQ ID NO: 926706 - DNA, 22 bp, Artificial Sequence
  chemically synthesized
tatttaatggtaaaaagcattt

SEQ ID NO: 926707 - DNA, 22 bp, Artificial Sequence
  chemically synthesized
ttatttaatggtaaaaagcatt

SEQ ID NO: 926708 - DNA, 22 bp, Artificial Sequence
  chemically synthesized
ccatttttatttaatggtaaaa

SEQ ID NO: 926709 - DNA, 22 bp, Artificial Sequence
  chemically synthesized
tttaccattaaataaaaatggc

SEQ ID NO: 926710 - DNA, 22 bp, Artificial Sequence
  chemically synthesized
ttaccattaaataaaaatggca

SEQ ID NO: 926711 - DNA, 22 bp, Artificial Sequence
  chemically synthesized
taccattaaataaaaatggcaa

SEQ ID NO: 926712 - DNA, 22 bp, Artificial Sequence
  chemically synthesized
aatagaacgtaattgccatttt

SEQ ID NO: 926713 - DNA, 22 bp, Artificial Sequence
  chemically synthesized
accattaaataaaaatggcaat

SEQ ID NO: 926714 - DNA, 22 bp, Artificial Sequence
  chemically synthesized
ccattaaataaaaatggcaatt

SEQ ID NO: 926715 - DNA, 22 bp, Artificial Sequence
  chemically synthesized
aataaaaatggcaattacgttc

SEQ ID NO: 926716 - DNA, 22 bp, Artificial Sequence
  chemically synthesized
aaaagttaaatagaacgtaatt

SEQ ID NO: 926717 - DNA, 22 bp, Artificial Sequence
  chemically synthesized
aaaaagttaaatagaacgtaat

SEQ ID NO: 926718 - DNA, 22 bp, Artificial Sequence
  chemically synthesized
taaaaagttaaatagaacgtaa

SEQ ID NO: 926719 - DNA, 22 bp, Artificial Sequence
  chemically synthesized
ttaaaaagttaaatagaacgta

SEQ ID NO: 926720 - DNA, 22 bp, Artificial Sequence
  chemically synthesized
tttaaaaagttaaatagaacgt

SEQ ID NO: 926721 - DNA, 22 bp, Artificial Sequence
  chemically synthesized
ttttaaaaagttaaatagaacg

SEQ ID NO: 926722 - DNA, 22 bp, Artificial Sequence
  chemically synthesized
tcttttttaaaaagttaaatag

SEQ ID NO: 926723 - DNA, 22 bp, Artificial Sequence
  chemically synthesized
gattatcttttttaaaaagtta

SEQ ID NO: 926724 - DNA, 22 bp, Artificial Sequence
  chemically synthesized
tagattatcttttttaaaaagt

SEQ ID NO: 926725 - DNA, 22 bp, Artificial Sequence
  chemically synthesized
cgttctatttaactttttaaaa

SEQ ID NO: 926726 - DNA, 22 bp, Artificial Sequence
  chemically synthesized
tatttaactttttaaaaaagat

SEQ ID NO: 926727 - DNA, 22 bp, Artificial Sequence
  chemically synthesized
caaattctagattatctttttt

SEQ ID NO: 926728 - DNA, 22 bp, Artificial Sequence
  chemically synthesized
tttaactttttaaaaaagataa

SEQ ID NO: 926729 - DNA, 22 bp, Artificial Sequence
  chemically synthesized
acaaattctagattatcttttt

SEQ ID NO: 926730 - DNA, 22 bp, Artificial Sequence
  chemically synthesized
aactttttaaaaaagataatct

SEQ ID NO: 926731 - DNA, 22 bp, Artificial Sequence
  chemically synthesized
actttttaaaaaagataatcta

SEQ ID NO: 926732 - DNA, 22 bp, Artificial Sequence
  chemically synthesized
tttaaaaaagataatctagaat

SEQ ID NO: 926733 - DNA, 22 bp, Artificial Sequence
  chemically synthesized
atggccttacaaattctagatt

SEQ ID NO: 926734 - DNA, 22 bp, Artificial Sequence
  chemically synthesized
ttaaaaaagataatctagaatt

SEQ ID NO: 926735 - DNA, 22 bp, Artificial Sequence
  chemically synthesized
aatggccttacaaattctagat

SEQ ID NO: 926736 - DNA, 22 bp, Artificial Sequence
  chemically synthesized
taaaaaagataatctagaattt

SEQ ID NO: 926737 - DNA, 22 bp, Artificial Sequence
  chemically synthesized
taatggccttacaaattctaga

SEQ ID NO: 926738 - DNA, 22 bp, Artificial Sequence
  chemically synthesized
aaaaaagataatctagaatttg

SEQ ID NO: 926739 - DNA, 22 bp, Artificial Sequence
  chemically synthesized
aaaaagataatctagaatttgt

SEQ ID NO: 926740 - DNA, 22 bp, Artificial Sequence
  chemically synthesized
ttttaatggccttacaaattct

SEQ ID NO: 926741 - DNA, 22 bp, Artificial Sequence
  chemically synthesized
atatgttattttaatggcctta

SEQ ID NO: 926742 - DNA, 22 bp, Artificial Sequence
  chemically synthesized
gttaatatgttattttaatggc

SEQ ID NO: 926743 - DNA, 22 bp, Artificial Sequence
  chemically synthesized
gaatttgtaaggccattaaaat

SEQ ID NO: 926744 - DNA, 22 bp, Artificial Sequence
  chemically synthesized
agttaatatgttattttaatgg

SEQ ID NO: 926745 - DNA, 22 bp, Artificial Sequence
  chemically synthesized
gtaaggccattaaaataacata

SEQ ID NO: 926746 - DNA, 22 bp, Artificial Sequence
  chemically synthesized
gtatttagttaatatgttattt

SEQ ID NO: 926747 - DNA, 22 bp, Artificial Sequence
  chemically synthesized
taaggccattaaaataacatat

SEQ ID NO: 926748 - DNA, 22 bp, Artificial Sequence
  chemically synthesized
aggttcgtatttagttaatatg

SEQ ID NO: 926749 - DNA, 22 bp, Artificial Sequence
  chemically synthesized
taaggttcgtatttagttaata

SEQ ID NO: 926750 - DNA, 22 bp, Artificial Sequence
  chemically synthesized
ctaaggttcgtatttagttaat

SEQ ID NO: 926751 - DNA, 22 bp, Artificial Sequence
  chemically synthesized
tctaaggttcgtatttagttaa

SEQ ID NO: 926752 - DNA, 22 bp, Artificial Sequence
  chemically synthesized
aaataacatattaactaaatac

SEQ ID NO: 926753 - DNA, 22 bp, Artificial Sequence
  chemically synthesized
attttctaaggttcgtatttag

SEQ ID NO: 926754 - DNA, 22 bp, Artificial Sequence
  chemically synthesized
cattttctaaggttcgtattta

SEQ ID NO: 926755 - DNA, 22 bp, Artificial Sequence
  chemically synthesized
tttcattttctaaggttcgtat

SEQ ID NO: 926756 - DNA, 22 bp, Artificial Sequence
  chemically synthesized
actaaatacgaaccttagaaaa

SEQ ID NO: 926757 - DNA, 22 bp, Artificial Sequence
  chemically synthesized
agatattatttcattttctaag

SEQ ID NO: 926758 - DNA, 22 bp, Artificial Sequence
  chemically synthesized
tcagatattatttcattttcta

SEQ ID NO: 926759 - DNA, 22 bp, Artificial Sequence
  chemically synthesized
aatacgaaccttagaaaatgaa

SEQ ID NO: 926760 - DNA, 22 bp, Artificial Sequence
  chemically synthesized
aagttctcagatattatttcat

SEQ ID NO: 926761 - DNA, 22 bp, Artificial Sequence
  chemically synthesized
agaaaatgaaataatatctgag

SEQ ID NO: 926762 - DNA, 22 bp, Artificial Sequence
  chemically synthesized
gaaaatgaaataatatctgaga

SEQ ID NO: 926763 - DNA, 22 bp, Artificial Sequence
  chemically synthesized
aatacggtaggtacctcaagtt

SEQ ID NO: 926764 - DNA, 22 bp, Artificial Sequence
  chemically synthesized
aaatacggtaggtacctcaagt

SEQ ID NO: 926765 - DNA, 22 bp, Artificial Sequence
  chemically synthesized
agatttaaatacggtaggtacc

SEQ ID NO: 926766 - DNA, 22 bp, Artificial Sequence
  chemically synthesized
agaacttgaggtacctaccgta

SEQ ID NO: 926767 - DNA, 22 bp, Artificial Sequence
  chemically synthesized
agtcattcagatttaaatacgg

SEQ ID NO: 926768 - DNA, 22 bp, Artificial Sequence
  chemically synthesized
gagtcattcagatttaaatacg

SEQ ID NO: 926769 - DNA, 22 bp, Artificial Sequence
  chemically synthesized
gaggtacctaccgtatttaaat

SEQ ID NO: 926770 - DNA, 22 bp, Artificial Sequence
  chemically synthesized
aggtacctaccgtatttaaatc

SEQ ID NO: 926771 - DNA, 22 bp, Artificial Sequence
  chemically synthesized
ccgtatttaaatctgaatgact

SEQ ID NO: 926772 - DNA, 22 bp, Artificial Sequence
  chemically synthesized
tcagtgacataaggatttgagt

SEQ ID NO: 926773 - DNA, 22 bp, Artificial Sequence
  chemically synthesized
aaatctgaatgactcaaatcct

SEQ ID NO: 926774 - DNA, 22 bp, Artificial Sequence
  chemically synthesized
aatctgaatgactcaaatcctt

SEQ ID NO: 926775 - DNA, 22 bp, Artificial Sequence
  chemically synthesized
tgtcagtgacataaggatttga

SEQ ID NO: 926776 - DNA, 22 bp, Artificial Sequence
  chemically synthesized
ttctgtcagtgacataaggatt

SEQ ID NO: 926777 - DNA, 22 bp, Artificial Sequence
  chemically synthesized
aatgactcaaatccttatgtca

SEQ ID NO: 926778 - DNA, 22 bp, Artificial Sequence
  chemically synthesized
aaatccttatgtcactgacaga

SEQ ID NO: 926779 - DNA, 22 bp, Artificial Sequence
  chemically synthesized
catacgcacattattctgtcag

SEQ ID NO: 926780 - DNA, 22 bp, Artificial Sequence
  chemically synthesized
tacatacgcacattattctgtc

SEQ ID NO: 926781 - DNA, 22 bp, Artificial Sequence
  chemically synthesized
ctacatacgcacattattctgt

SEQ ID NO: 926782 - DNA, 22 bp, Artificial Sequence
  chemically synthesized
tctacatacgcacattattctg

SEQ ID NO: 926783 - DNA, 22 bp, Artificial Sequence
  chemically synthesized
atgtcactgacagaataatgtg

SEQ ID NO: 926784 - DNA, 22 bp, Artificial Sequence
  chemically synthesized
tgtcactgacagaataatgtgc

SEQ ID NO: 926785 - DNA, 22 bp, Artificial Sequence
  chemically synthesized
ggagagttttctacatacgcac

SEQ ID NO: 926786 - DNA, 22 bp, Artificial Sequence
  chemically synthesized
acagaataatgtgcgtatgtag

SEQ ID NO: 926787 - DNA, 22 bp, Artificial Sequence
  chemically synthesized
ttaggagagttttctacatacg

SEQ ID NO: 926788 - DNA, 22 bp, Artificial Sequence
  chemically synthesized
gagaatatgaatcacatctatt

SEQ ID NO: 926789 - DNA, 22 bp, Artificial Sequence
  chemically synthesized
tcctaatagatgtgattcatat

SEQ ID NO: 926790 - DNA, 22 bp, Artificial Sequence
  chemically synthesized
ctaatagatgtgattcatattc

SEQ ID NO: 926791 - DNA, 22 bp, Artificial Sequence
  chemically synthesized
atagatgtgattcatattctct

SEQ ID NO: 926792 - DNA, 22 bp, Artificial Sequence
  chemically synthesized
atattctctaatatttttgtat

SEQ ID NO: 926793 - DNA, 22 bp, Artificial Sequence
  chemically synthesized
tgtcaaggagtaggagaataca

SEQ ID NO: 926794 - DNA, 22 bp, Artificial Sequence
  chemically synthesized
tctaatatttttgtattctcct

SEQ ID NO: 926795 - DNA, 22 bp, Artificial Sequence
  chemically synthesized
taatatttttgtattctcctac

SEQ ID NO: 926796 - DNA, 22 bp, Artificial Sequence
  chemically synthesized
ttgtgtcaaggagtaggagaat

SEQ ID NO: 926797 - DNA, 22 bp, Artificial Sequence
  chemically synthesized
atatttttgtattctcctactc

SEQ ID NO: 926798 - DNA, 22 bp, Artificial Sequence
  chemically synthesized
ctattgtgtcaaggagtaggag

SEQ ID NO: 926799 - DNA, 22 bp, Artificial Sequence
  chemically synthesized
gctattgtgtcaaggagtagga

SEQ ID NO: 926800 - DNA, 22 bp, Artificial Sequence
  chemically synthesized
ttgtattctcctactccttgac

SEQ ID NO: 926801 - DNA, 22 bp, Artificial Sequence
  chemically synthesized
tgtattctcctactccttgaca

SEQ ID NO: 926802 - DNA, 22 bp, Artificial Sequence
  chemically synthesized
gtattctcctactccttgacac

SEQ ID NO: 926803 - DNA, 22 bp, Artificial Sequence
  chemically synthesized
tattctcctactccttgacaca

SEQ ID NO: 926804 - DNA, 22 bp, Artificial Sequence
  chemically synthesized
tcagcttgctattgtgtcaagg

SEQ ID NO: 926805 - DNA, 22 bp, Artificial Sequence
  chemically synthesized
ctgtcagcttgctattgtgtca

SEQ ID NO: 926806 - DNA, 22 bp, Artificial Sequence
  chemically synthesized
tcctactccttgacacaatagc

SEQ ID NO: 926807 - DNA, 22 bp, Artificial Sequence
  chemically synthesized
ctactccttgacacaatagcaa

SEQ ID NO: 926808 - DNA, 22 bp, Artificial Sequence
  chemically synthesized
ctccttgacacaatagcaagct

SEQ ID NO: 926809 - DNA, 22 bp, Artificial Sequence
  chemically synthesized
gggtctactgtcagcttgctat

SEQ ID NO: 926810 - DNA, 22 bp, Artificial Sequence
  chemically synthesized
cttgacacaatagcaagctgac

SEQ ID NO: 926811 - DNA, 22 bp, Artificial Sequence
  chemically synthesized
gacacaatagcaagctgacagt

SEQ ID NO: 926812 - DNA, 22 bp, Artificial Sequence
  chemically synthesized
acacaatagcaagctgacagta

SEQ ID NO: 926813 - DNA, 22 bp, Artificial Sequence
  chemically synthesized
ggaagcatgtactggggtctac

SEQ ID NO: 926814 - DNA, 22 bp, Artificial Sequence
  chemically synthesized
aggaagcatgtactggggtcta

SEQ ID NO: 926815 - DNA, 22 bp, Artificial Sequence
  chemically synthesized
atttaggaagcatgtactgggg

SEQ ID NO: 926816 - DNA, 22 bp, Artificial Sequence
  chemically synthesized
catttaggaagcatgtactggg

SEQ ID NO: 926817 - DNA, 22 bp, Artificial Sequence
  chemically synthesized
acagtagaccccagtacatgct

SEQ ID NO: 926818 - DNA, 22 bp, Artificial Sequence
  chemically synthesized
cttcatttaggaagcatgtact

SEQ ID NO: 926819 - DNA, 22 bp, Artificial Sequence
  chemically synthesized
ccttcatttaggaagcatgtac

SEQ ID NO: 926820 - DNA, 22 bp, Artificial Sequence
  chemically synthesized
cttccttcatttaggaagcatg

SEQ ID NO: 926821 - DNA, 22 bp, Artificial Sequence
  chemically synthesized
agaaaacatgcattccttcctt

SEQ ID NO: 926822 - DNA, 22 bp, Artificial Sequence
  chemically synthesized
cctaaatgaaggaaggaatgca

SEQ ID NO: 926823 - DNA, 22 bp, Artificial Sequence
  chemically synthesized
ctaaatgaaggaaggaatgcat

SEQ ID NO: 926824 - DNA, 22 bp, Artificial Sequence
  chemically synthesized
agtctcagaaaacatgcattcc

SEQ ID NO: 926825 - DNA, 22 bp, Artificial Sequence
  chemically synthesized
aatgaaggaaggaatgcatgtt

SEQ ID NO: 926826 - DNA, 22 bp, Artificial Sequence
  chemically synthesized
cctcagtctcagaaaacatgca

SEQ ID NO: 926827 - DNA, 22 bp, Artificial Sequence
  chemically synthesized
acctcagtctcagaaaacatgc

SEQ ID NO: 926828 - DNA, 22 bp, Artificial Sequence
  chemically synthesized
tacctcagtctcagaaaacatg

SEQ ID NO: 926829 - DNA, 22 bp, Artificial Sequence
  chemically synthesized
agggagctttacctcagtctca

SEQ ID NO: 926830 - DNA, 22 bp, Artificial Sequence
  chemically synthesized
tctgagactgaggtaaagctcc

SEQ ID NO: 926831 - DNA, 22 bp, Artificial Sequence
  chemically synthesized
ctgagactgaggtaaagctccc

SEQ ID NO: 926832 - DNA, 22 bp, Artificial Sequence
  chemically synthesized
tgagactgaggtaaagctccct

SEQ ID NO: 926833 - DNA, 22 bp, Artificial Sequence
  chemically synthesized
agactgaggtaaagctccctta

SEQ ID NO: 926834 - DNA, 22 bp, Artificial Sequence
  chemically synthesized
aggtaaagctcccttagactct

SEQ ID NO: 926835 - DNA, 22 bp, Artificial Sequence
  chemically synthesized
ccttagactctcgtttcacata

SEQ ID NO: 926836 - DNA, 22 bp, Artificial Sequence
  chemically synthesized
agactctcgtttcacatacatt

SEQ ID NO: 926837 - DNA, 22 bp, Artificial Sequence
  chemically synthesized
gactctcgtttcacatacattt

SEQ ID NO: 926838 - DNA, 22 bp, Artificial Sequence
  chemically synthesized
tcgtttcacatacatttcttgg

SEQ ID NO: 926839 - DNA, 22 bp, Artificial Sequence
  chemically synthesized
gtttcacatacatttcttggct

SEQ ID NO: 926840 - DNA, 22 bp, Artificial Sequence
  chemically synthesized
cacatacatttcttggcttttt

SEQ ID NO: 926841 - DNA, 22 bp, Artificial Sequence
  chemically synthesized
acatacatttcttggctttttt

SEQ ID NO: 926842 - DNA, 22 bp, Artificial Sequence
  chemically synthesized
aatgtagaaaaagaaaaaagcc

SEQ ID NO: 926843 - DNA, 22 bp, Artificial Sequence
  chemically synthesized
gaatgtagaaaaagaaaaaagc

SEQ ID NO: 926844 - DNA, 22 bp, Artificial Sequence
  chemically synthesized
cttgaatgtagaaaaagaaaaa

SEQ ID NO: 926845 - DNA, 22 bp, Artificial Sequence
  chemically synthesized
gcttgaatgtagaaaaagaaaa

SEQ ID NO: 926846 - DNA, 22 bp, Artificial Sequence
  chemically synthesized
tgcttgaatgtagaaaaagaaa

SEQ ID NO: 926847 - DNA, 22 bp, Artificial Sequence
  chemically synthesized
cttggcttttttctttttctac

SEQ ID NO: 926848 - DNA, 22 bp, Artificial Sequence
  chemically synthesized
ttggcttttttctttttctaca

SEQ ID NO: 926849 - DNA, 22 bp, Artificial Sequence
  chemically synthesized
ggcttttttctttttctacatt

SEQ ID NO: 926850 - DNA, 22 bp, Artificial Sequence
  chemically synthesized
gcttttttctttttctacattc

SEQ ID NO: 926851 - DNA, 22 bp, Artificial Sequence
  chemically synthesized
ttttctttttctacattcaagc

SEQ ID NO: 926852 - DNA, 22 bp, Artificial Sequence
  chemically synthesized
gaaaataattttgcttgaatgt

SEQ ID NO: 926853 - DNA, 22 bp, Artificial Sequence
  chemically synthesized
tttctttttctacattcaagca

SEQ ID NO: 926854 - DNA, 22 bp, Artificial Sequence
  chemically synthesized
ttctttttctacattcaagcaa

SEQ ID NO: 926855 - DNA, 22 bp, Artificial Sequence
  chemically synthesized
tctttttctacattcaagcaaa

SEQ ID NO: 926856 - DNA, 22 bp, Artificial Sequence
  chemically synthesized
ctttttctacattcaagcaaaa

SEQ ID NO: 926857 - DNA, 22 bp, Artificial Sequence
  chemically synthesized
tttttctacattcaagcaaaat

SEQ ID NO: 926858 - DNA, 22 bp, Artificial Sequence
  chemically synthesized
tttctacattcaagcaaaatta

SEQ ID NO: 926859 - DNA, 22 bp, Artificial Sequence
  chemically synthesized
ttctacattcaagcaaaattat

SEQ ID NO: 926860 - DNA, 22 bp, Artificial Sequence
  chemically synthesized
cagtattcgaaaataattttgc

SEQ ID NO: 926861 - DNA, 22 bp, Artificial Sequence
  chemically synthesized
tctacattcaagcaaaattatt

SEQ ID NO: 926862 - DNA, 22 bp, Artificial Sequence
  chemically synthesized
ccagtattcgaaaataattttg

SEQ ID NO: 926863 - DNA, 22 bp, Artificial Sequence
  chemically synthesized
ctacattcaagcaaaattattt

SEQ ID NO: 926864 - DNA, 22 bp, Artificial Sequence
  chemically synthesized
tacattcaagcaaaattatttt

SEQ ID NO: 926865 - DNA, 22 bp, Artificial Sequence
  chemically synthesized
cattcaagcaaaattattttcg

SEQ ID NO: 926866 - DNA, 22 bp, Artificial Sequence
  chemically synthesized
aagcaaaattattttcgaatac

SEQ ID NO: 926867 - DNA, 22 bp, Artificial Sequence
  chemically synthesized
ccaaaatttccagtattcgaaa

SEQ ID NO: 926868 - DNA, 22 bp, Artificial Sequence
  chemically synthesized
tatgctaccaaaatttccagta

SEQ ID NO: 926869 - DNA, 22 bp, Artificial Sequence
  chemically synthesized
ttttcgaatactggaaattttg

SEQ ID NO: 926870 - DNA, 22 bp, Artificial Sequence
  chemically synthesized
actgtatgctaccaaaatttcc

SEQ ID NO: 926871 - DNA, 22 bp, Artificial Sequence
  chemically synthesized
tcgaatactggaaattttggta

SEQ ID NO: 926872 - DNA, 22 bp, Artificial Sequence
  chemically synthesized
ctaactgtatgctaccaaaatt

SEQ ID NO: 926873 - DNA, 22 bp, Artificial Sequence
  chemically synthesized
cgaatactggaaattttggtag

SEQ ID NO: 926874 - DNA, 22 bp, Artificial Sequence
  chemically synthesized
gaatactggaaattttggtagc

SEQ ID NO: 926875 - DNA, 22 bp, Artificial Sequence
  chemically synthesized
attgctaactgtatgctaccaa

SEQ ID NO: 926876 - DNA, 22 bp, Artificial Sequence
  chemically synthesized
aattgctaactgtatgctacca

SEQ ID NO: 926877 - DNA, 22 bp, Artificial Sequence
  chemically synthesized
taattgctaactgtatgctacc

SEQ ID NO: 926878 - DNA, 22 bp, Artificial Sequence
  chemically synthesized
gaaattttggtagcatacagtt

SEQ ID NO: 926879 - DNA, 22 bp, Artificial Sequence
  chemically synthesized
cagagtattttaattgctaact

SEQ ID NO: 926880 - DNA, 22 bp, Artificial Sequence
  chemically synthesized
tggtagcatacagttagcaatt

SEQ ID NO: 926881 - DNA, 22 bp, Artificial Sequence
  chemically synthesized
acagagtattttaattgctaac

SEQ ID NO: 926882 - DNA, 22 bp, Artificial Sequence
  chemically synthesized
ggtagcatacagttagcaatta

SEQ ID NO: 926883 - DNA, 22 bp, Artificial Sequence
  chemically synthesized
gtagcatacagttagcaattaa

SEQ ID NO: 926884 - DNA, 22 bp, Artificial Sequence
  chemically synthesized
atttacagagtattttaattgc

SEQ ID NO: 926885 - DNA, 22 bp, Artificial Sequence
  chemically synthesized
ctgatttacagagtattttaat

SEQ ID NO: 926886 - DNA, 22 bp, Artificial Sequence
  chemically synthesized
gctgatttacagagtattttaa

SEQ ID NO: 926887 - DNA, 22 bp, Artificial Sequence
  chemically synthesized
gcaattaaaatactctgtaaat

SEQ ID NO: 926888 - DNA, 22 bp, Artificial Sequence
  chemically synthesized
aaatactctgtaaatcagcaaa

SEQ ID NO: 926889 - DNA, 22 bp, Artificial Sequence
  chemically synthesized
tgaggcaccgtgtcaccggttt

SEQ ID NO: 926890 - DNA, 22 bp, Artificial Sequence
  chemically synthesized
tgtaaatcagcaaaccggtgac

SEQ ID NO: 926891 - DNA, 22 bp, Artificial Sequence
  chemically synthesized
taaatcagcaaaccggtgacac

SEQ ID NO: 926892 - DNA, 22 bp, Artificial Sequence
  chemically synthesized
attgtgaggcaccgtgtcaccg

SEQ ID NO: 926893 - DNA, 22 bp, Artificial Sequence
  chemically synthesized
tattcattgtgaggcaccgtgt

SEQ ID NO: 926894 - DNA, 22 bp, Artificial Sequence
  chemically synthesized
atattcattgtgaggcaccgtg

SEQ ID NO: 926895 - DNA, 22 bp, Artificial Sequence
  chemically synthesized
tatattcattgtgaggcaccgt

SEQ ID NO: 926896 - DNA, 22 bp, Artificial Sequence
  chemically synthesized
tgcatagttttatattcattgt

SEQ ID NO: 926897 - DNA, 22 bp, Artificial Sequence
  chemically synthesized
agtaactgtgcatagttttata

SEQ ID NO: 926898 - DNA, 22 bp, Artificial Sequence
  chemically synthesized
acaatgaatataaaactatgca

SEQ ID NO: 926899 - DNA, 22 bp, Artificial Sequence
  chemically synthesized
tgaatagttcagtaactgtgca

SEQ ID NO: 926900 - DNA, 22 bp, Artificial Sequence
  chemically synthesized
gtgaatagttcagtaactgtgc

SEQ ID NO: 926901 - DNA, 22 bp, Artificial Sequence
  chemically synthesized
tgcacagttactgaactattca

SEQ ID NO: 926902 - DNA, 22 bp, Artificial Sequence
  chemically synthesized
ctgaactattcacaagctgtcc

SEQ ID NO: 926903 - DNA, 22 bp, Artificial Sequence
  chemically synthesized
aactattcacaagctgtcctgg

SEQ ID NO: 926904 - DNA, 22 bp, Artificial Sequence
  chemically synthesized
aagagagtatggccaggacagc

SEQ ID NO: 926905 - DNA, 22 bp, Artificial Sequence
  chemically synthesized
ttcacaagctgtcctggccata

SEQ ID NO: 926906 - DNA, 22 bp, Artificial Sequence
  chemically synthesized
acaagctgtcctggccatactc

SEQ ID NO: 926907 - DNA, 22 bp, Artificial Sequence
  chemically synthesized
atgggcattcaagagagtatgg

SEQ ID NO: 926908 - DNA, 22 bp, Artificial Sequence
  chemically synthesized
tcctggccatactctcttgaat

SEQ ID NO: 926909 - DNA, 22 bp, Artificial Sequence
  chemically synthesized
gccatactctcttgaatgccca

SEQ ID NO: 926910 - DNA, 22 bp, Artificial Sequence
  chemically synthesized
gagcacatctcatgggcattca

SEQ ID NO: 926911 - DNA, 22 bp, Artificial Sequence
  chemically synthesized
ctagagcacatctcatgggcat

SEQ ID NO: 926912 - DNA, 22 bp, Artificial Sequence
  chemically synthesized
actagagcacatctcatgggca

SEQ ID NO: 926913 - DNA, 22 bp, Artificial Sequence
  chemically synthesized
tcttgaatgcccatgagatgtg

SEQ ID NO: 926914 - DNA, 22 bp, Artificial Sequence
  chemically synthesized
ttgaatgcccatgagatgtgct

SEQ ID NO: 926915 - DNA, 22 bp, Artificial Sequence
  chemically synthesized
gaatgcccatgagatgtgctct

SEQ ID NO: 926916 - DNA, 22 bp, Artificial Sequence
  chemically synthesized
aatgcccatgagatgtgctcta

SEQ ID NO: 926917 - DNA, 22 bp, Artificial Sequence
  chemically synthesized
caaggaaatatcacatgtttac

SEQ ID NO: 926918 - DNA, 22 bp, Artificial Sequence
  chemically synthesized
gttacaaggaaatatcacatgt

SEQ ID NO: 926919 - DNA, 22 bp, Artificial Sequence
  chemically synthesized
tagtaaacatgtgatatttcct

SEQ ID NO: 926920 - DNA, 22 bp, Artificial Sequence
  chemically synthesized
gtaaacatgtgatatttccttg

SEQ ID NO: 926921 - DNA, 22 bp, Artificial Sequence
  chemically synthesized
ccttgtaactagttggctttgc

SEQ ID NO: 926922 - DNA, 22 bp, Artificial Sequence
  chemically synthesized
cttgtaactagttggctttgct

SEQ ID NO: 926923 - DNA, 22 bp, Artificial Sequence
  chemically synthesized
gtaactagttggctttgctcca

SEQ ID NO: 926924 - DNA, 22 bp, Artificial Sequence
  chemically synthesized
taactagttggctttgctccat

SEQ ID NO: 926925 - DNA, 22 bp, Artificial Sequence
  chemically synthesized
gttggctttgctccattgctta

SEQ ID NO: 926926 - DNA, 22 bp, Artificial Sequence
  chemically synthesized
gctttgctccattgcttacatc

SEQ ID NO: 926927 - DNA, 22 bp, Artificial Sequence
  chemically synthesized
tgctccattgcttacatctcac

SEQ ID NO: 926928 - DNA, 22 bp, Artificial Sequence
  chemically synthesized
gctccattgcttacatctcact

SEQ ID NO: 926929 - DNA, 22 bp, Artificial Sequence
  chemically synthesized
ctccattgcttacatctcactc

SEQ ID NO: 926930 - DNA, 22 bp, Artificial Sequence
  chemically synthesized
aacaggtggtaaagagtgagat

SEQ ID NO: 926931 - DNA, 22 bp, Artificial Sequence
  chemically synthesized
cattgcttacatctcactcttt

SEQ ID NO: 926932 - DNA, 22 bp, Artificial Sequence
  chemically synthesized
atctgaacaggtggtaaagagt

SEQ ID NO: 926933 - DNA, 22 bp, Artificial Sequence
  chemically synthesized
cttacatctcactctttaccac

SEQ ID NO: 926934 - DNA, 22 bp, Artificial Sequence
  chemically synthesized
acatctcactctttaccacctg

SEQ ID NO: 926935 - DNA, 22 bp, Artificial Sequence
  chemically synthesized
catctcactctttaccacctgt

SEQ ID NO: 926936 - DNA, 22 bp, Artificial Sequence
  chemically synthesized
actctttaccacctgttcagat

SEQ ID NO: 926937 - DNA, 22 bp, Artificial Sequence
  chemically synthesized
tcacatgcaacgctgatctgaa

SEQ ID NO: 926938 - DNA, 22 bp, Artificial Sequence
  chemically synthesized
tttaccacctgttcagatcagc

SEQ ID NO: 926939 - DNA, 22 bp, Artificial Sequence
  chemically synthesized
taccacctgttcagatcagcgt

SEQ ID NO: 926940 - DNA, 22 bp, Artificial Sequence
  chemically synthesized
accacctgttcagatcagcgtt

SEQ ID NO: 926941 - DNA, 22 bp, Artificial Sequence
  chemically synthesized
ccacctgttcagatcagcgttg

SEQ ID NO: 926942 - DNA, 22 bp, Artificial Sequence
  chemically synthesized
agcaatgactgtcacatgcaac

SEQ ID NO: 926943 - DNA, 22 bp, Artificial Sequence
  chemically synthesized
ttcagatcagcgttgcatgtga

SEQ ID NO: 926944 - DNA, 22 bp, Artificial Sequence
  chemically synthesized
ctaagcaatgactgtcacatgc

SEQ ID NO: 926945 - DNA, 22 bp, Artificial Sequence
  chemically synthesized
agatcagcgttgcatgtgacag

SEQ ID NO: 926946 - DNA, 22 bp, Artificial Sequence
  chemically synthesized
ttactaagcaatgactgtcaca

SEQ ID NO: 926947 - DNA, 22 bp, Artificial Sequence
  chemically synthesized
tattactaagcaatgactgtca

SEQ ID NO: 926948 - DNA, 22 bp, Artificial Sequence
  chemically synthesized
gtgtctctattactaagcaatg

SEQ ID NO: 926949 - DNA, 22 bp, Artificial Sequence
  chemically synthesized
catgtgacagtcattgcttagt

SEQ ID NO: 926950 - DNA, 22 bp, Artificial Sequence
  chemically synthesized
tgactggtgtctctattactaa

SEQ ID NO: 926951 - DNA, 22 bp, Artificial Sequence
  chemically synthesized
ttatgactggtgtctctattac

SEQ ID NO: 926952 - DNA, 22 bp, Artificial Sequence
  chemically synthesized
gttatgactggtgtctctatta

SEQ ID NO: 926953 - DNA, 22 bp, Artificial Sequence
  chemically synthesized
cttagtaatagagacaccagtc

SEQ ID NO: 926954 - DNA, 22 bp, Artificial Sequence
  chemically synthesized
agtaatagagacaccagtcata

SEQ ID NO: 926955 - DNA, 22 bp, Artificial Sequence
  chemically synthesized
gtaatagagacaccagtcataa

SEQ ID NO: 926956 - DNA, 22 bp, Artificial Sequence
  chemically synthesized
atatatagacacagtttgttat

SEQ ID NO: 926957 - DNA, 22 bp, Artificial Sequence
  chemically synthesized
caccaacctaatatatagacac

SEQ ID NO: 926958 - DNA, 22 bp, Artificial Sequence
  chemically synthesized
gcaccaacctaatatatagaca

SEQ ID NO: 926959 - DNA, 22 bp, Artificial Sequence
  chemically synthesized
tgcaccaacctaatatatagac

SEQ ID NO: 926960 - DNA, 22 bp, Artificial Sequence
  chemically synthesized
ttgcaccaacctaatatataga

SEQ ID NO: 926961 - DNA, 22 bp, Artificial Sequence
  chemically synthesized
cttttgcaccaacctaatatat

SEQ ID NO: 926962 - DNA, 22 bp, Artificial Sequence
  chemically synthesized
tgtctatatattaggttggtgc

SEQ ID NO: 926963 - DNA, 22 bp, Artificial Sequence
  chemically synthesized
tatattaggttggtgcaaaagt

SEQ ID NO: 926964 - DNA, 22 bp, Artificial Sequence
  chemically synthesized
ggttggtgcaaaagtaatcacg

SEQ ID NO: 926965 - DNA, 22 bp, Artificial Sequence
  chemically synthesized
gtgcaaaagtaatcacggttta

SEQ ID NO: 926966 - DNA, 22 bp, Artificial Sequence
  chemically synthesized
tgatataaaagtaatggcataa

SEQ ID NO: 926967 - DNA, 22 bp, Artificial Sequence
  chemically synthesized
atgatataaaagtaatggcata

SEQ ID NO: 926968 - DNA, 22 bp, Artificial Sequence
  chemically synthesized
aaagaatttatgatataaaagt

SEQ ID NO: 926969 - DNA, 22 bp, Artificial Sequence
  chemically synthesized
atgccattacttttatatcata

SEQ ID NO: 926970 - DNA, 22 bp, Artificial Sequence
  chemically synthesized
tgccattacttttatatcataa

SEQ ID NO: 926971 - DNA, 22 bp, Artificial Sequence
  chemically synthesized
acctcaaagaatttatgatata

SEQ ID NO: 926972 - DNA, 22 bp, Artificial Sequence
  chemically synthesized
cttttatatcataaattctttg

SEQ ID NO: 926973 - DNA, 22 bp, Artificial Sequence
  chemically synthesized
ttatatcataaattctttgagg

SEQ ID NO: 926974 - DNA, 22 bp, Artificial Sequence
  chemically synthesized
tatatcataaattctttgaggt

SEQ ID NO: 926975 - DNA, 22 bp, Artificial Sequence
  chemically synthesized
atatcataaattctttgaggtc

SEQ ID NO: 926976 - DNA, 22 bp, Artificial Sequence
  chemically synthesized
tatcataaattctttgaggtca

SEQ ID NO: 926977 - DNA, 22 bp, Artificial Sequence
  chemically synthesized
tcatgaataagacacaatatct

SEQ ID NO: 926978 - DNA, 22 bp, Artificial Sequence
  chemically synthesized
tttgaggtcagatattgtgtct

SEQ ID NO: 926979 - DNA, 22 bp, Artificial Sequence
  chemically synthesized
tgaggtcagatattgtgtctta

SEQ ID NO: 926980 - DNA, 22 bp, Artificial Sequence
  chemically synthesized
gaggtcagatattgtgtcttat

SEQ ID NO: 926981 - DNA, 22 bp, Artificial Sequence
  chemically synthesized
aggtcagatattgtgtcttatt

SEQ ID NO: 926982 - DNA, 22 bp, Artificial Sequence
  chemically synthesized
aacaataggaaactatcatgaa

SEQ ID NO: 926983 - DNA, 22 bp, Artificial Sequence
  chemically synthesized
tgtcttattcatgatagtttcc

SEQ ID NO: 926984 - DNA, 22 bp, Artificial Sequence
  chemically synthesized
tactaaacaataggaaactatc

SEQ ID NO: 926985 - DNA, 22 bp, Artificial Sequence
  chemically synthesized
attcatgatagtttcctattgt

SEQ ID NO: 926986 - DNA, 22 bp, Artificial Sequence
  chemically synthesized
ttcatgatagtttcctattgtt

SEQ ID NO: 926987 - DNA, 22 bp, Artificial Sequence
  chemically synthesized
atgatagtttcctattgtttag

SEQ ID NO: 926988 - DNA, 22 bp, Artificial Sequence
  chemically synthesized
catgcatcagacattgtactaa

SEQ ID NO: 926989 - DNA, 22 bp, Artificial Sequence
  chemically synthesized
ccatgcatcagacattgtacta

SEQ ID NO: 926990 - DNA, 22 bp, Artificial Sequence
  chemically synthesized
cctattgtttagtacaatgtct

SEQ ID NO: 926991 - DNA, 22 bp, Artificial Sequence
  chemically synthesized
ctattgtttagtacaatgtctg

SEQ ID NO: 926992 - DNA, 22 bp, Artificial Sequence
  chemically synthesized
ttgtttagtacaatgtctgatg

SEQ ID NO: 926993 - DNA, 22 bp, Artificial Sequence
  chemically synthesized
aaaccttccatgcatcagacat

SEQ ID NO: 926994 - DNA, 22 bp, Artificial Sequence
  chemically synthesized
tttagtacaatgtctgatgcat

SEQ ID NO: 926995 - DNA, 22 bp, Artificial Sequence
  chemically synthesized
ctgaaaccttccatgcatcaga

SEQ ID NO: 926996 - DNA, 22 bp, Artificial Sequence
  chemically synthesized
actgaaaccttccatgcatcag

SEQ ID NO: 926997 - DNA, 22 bp, Artificial Sequence
  chemically synthesized
agtacaatgtctgatgcatgga

SEQ ID NO: 926998 - DNA, 22 bp, Artificial Sequence
  chemically synthesized
gtacaatgtctgatgcatggaa

SEQ ID NO: 926999 - DNA, 22 bp, Artificial Sequence
  chemically synthesized
agcaaatgcttactgaaacctt

SEQ ID NO: 927000 - DNA, 22 bp, Artificial Sequence
  chemically synthesized
atgcatggaaggtttcagtaag

SEQ ID NO: 927001 - DNA, 22 bp, Artificial Sequence
  chemically synthesized
actcagcaaatgcttactgaaa

SEQ ID NO: 927002 - DNA, 22 bp, Artificial Sequence
  chemically synthesized
atgcgttcactcagcaaatgct

SEQ ID NO: 927003 - DNA, 22 bp, Artificial Sequence
  chemically synthesized
cagtaagcatttgctgagtgaa

SEQ ID NO: 927004 - DNA, 22 bp, Artificial Sequence
  chemically synthesized
agtaagcatttgctgagtgaac

SEQ ID NO: 927005 - DNA, 22 bp, Artificial Sequence
  chemically synthesized
atagattcatgcgttcactcag

SEQ ID NO: 927006 - DNA, 22 bp, Artificial Sequence
  chemically synthesized
ttcatagattcatgcgttcact

SEQ ID NO: 927007 - DNA, 22 bp, Artificial Sequence
  chemically synthesized
attcatagattcatgcgttcac

SEQ ID NO: 927008 - DNA, 22 bp, Artificial Sequence
  chemically synthesized
ccttattcatagattcatgcgt

SEQ ID NO: 927009 - DNA, 22 bp, Artificial Sequence
  chemically synthesized
cccttattcatagattcatgcg

SEQ ID NO: 927010 - DNA, 22 bp, Artificial Sequence
  chemically synthesized
gctgagtgaacgcatgaatcta

SEQ ID NO: 927011 - DNA, 22 bp, Artificial Sequence
  chemically synthesized
ctgagtgaacgcatgaatctat

SEQ ID NO: 927012 - DNA, 22 bp, Artificial Sequence
  chemically synthesized
agtgaacgcatgaatctatgaa

SEQ ID NO: 927013 - DNA, 22 bp, Artificial Sequence
  chemically synthesized
cccacttcccttattcatagat

SEQ ID NO: 927014 - DNA, 22 bp, Artificial Sequence
  chemically synthesized
ccccacttcccttattcataga

SEQ ID NO: 927015 - DNA, 22 bp, Artificial Sequence
  chemically synthesized
ttccccacttcccttattcata

SEQ ID NO: 927016 - DNA, 22 bp, Artificial Sequence
  chemically synthesized
cttccccacttcccttattcat

SEQ ID NO: 927017 - DNA, 22 bp, Artificial Sequence
  chemically synthesized
cgcttcttccccacttccctta

SEQ ID NO: 927018 - DNA, 22 bp, Artificial Sequence
  chemically synthesized
cctccgcttcttccccacttcc

SEQ ID NO: 927019 - DNA, 22 bp, Artificial Sequence
  chemically synthesized
ctccctccgcttcttccccact

SEQ ID NO: 927020 - DNA, 22 bp, Artificial Sequence
  chemically synthesized
tgaataagggaagtggggaaga

SEQ ID NO: 927021 - DNA, 22 bp, Artificial Sequence
  chemically synthesized
cctccctccgcttcttccccac

SEQ ID NO: 927022 - DNA, 22 bp, Artificial Sequence
  chemically synthesized
ttcctccctccgcttcttcccc

SEQ ID NO: 927023 - DNA, 22 bp, Artificial Sequence
  chemically synthesized
tcttcctccctccgcttcttcc

SEQ ID NO: 927024 - DNA, 22 bp, Artificial Sequence
  chemically synthesized
ctctcttcctccctccgcttct

SEQ ID NO: 927025 - DNA, 22 bp, Artificial Sequence
  chemically synthesized
cctctcttcctccctccgcttc

SEQ ID NO: 927026 - DNA, 22 bp, Artificial Sequence
  chemically synthesized
cttcctctcttcctccctccgc

SEQ ID NO: 927027 - DNA, 22 bp, Artificial Sequence
  chemically synthesized
cattccttcctctcttcctccc

SEQ ID NO: 927028 - DNA, 22 bp, Artificial Sequence
  chemically synthesized
ctccattccttcctctcttcct

SEQ ID NO: 927029 - DNA, 22 bp, Artificial Sequence
  chemically synthesized
cctccattccttcctctcttcc

SEQ ID NO: 927030 - DNA, 22 bp, Artificial Sequence
  chemically synthesized
ttcctccattccttcctctctt

SEQ ID NO: 927031 - DNA, 22 bp, Artificial Sequence
  chemically synthesized
cttcctccattccttcctctct

SEQ ID NO: 927032 - DNA, 22 bp, Artificial Sequence
  chemically synthesized
tcttcctccattccttcctctc

SEQ ID NO: 927033 - DNA, 22 bp, Artificial Sequence
  chemically synthesized
ttcttcctccattccttcctct

SEQ ID NO: 927034 - DNA, 22 bp, Artificial Sequence
  chemically synthesized
ttttcttcctccattccttcct

SEQ ID NO: 927035 - DNA, 22 bp, Artificial Sequence
  chemically synthesized
cttttcttcctccattccttcc

SEQ ID NO: 927036 - DNA, 22 bp, Artificial Sequence
  chemically synthesized
ccttcttttcttcctccattcc

SEQ ID NO: 927037 - DNA, 22 bp, Artificial Sequence
  chemically synthesized
ctcccttcttttcttcctccat

SEQ ID NO: 927038 - DNA, 22 bp, Artificial Sequence
  chemically synthesized
cctcccttcttttcttcctcca

SEQ ID NO: 927039 - DNA, 22 bp, Artificial Sequence
  chemically synthesized
tcctcccttcttttcttcctcc

SEQ ID NO: 927040 - DNA, 22 bp, Artificial Sequence
  chemically synthesized
ctttcctcccttcttttcttcc

SEQ ID NO: 927041 - DNA, 22 bp, Artificial Sequence
  chemically synthesized
tcctttcctcccttcttttctt

SEQ ID NO: 927042 - DNA, 22 bp, Artificial Sequence
  chemically synthesized
tctcctttcctcccttcttttc

SEQ ID NO: 927043 - DNA, 22 bp, Artificial Sequence
  chemically synthesized
cctctctcctttcctcccttct

SEQ ID NO: 927044 - DNA, 22 bp, Artificial Sequence
  chemically synthesized
tacctctctcctttcctccctt

SEQ ID NO: 927045 - DNA, 22 bp, Artificial Sequence
  chemically synthesized
ctacctctctcctttcctccct

SEQ ID NO: 927046 - DNA, 22 bp, Artificial Sequence
  chemically synthesized
tctacctctctcctttcctccc

SEQ ID NO: 927047 - DNA, 22 bp, Artificial Sequence
  chemically synthesized
tttctacctctctcctttcctc

SEQ ID NO: 927048 - DNA, 22 bp, Artificial Sequence
  chemically synthesized
ctttctacctctctcctttcct

SEQ ID NO: 927049 - DNA, 22 bp, Artificial Sequence
  chemically synthesized
tctttctacctctctcctttcc

SEQ ID NO: 927050 - DNA, 22 bp, Artificial Sequence
  chemically synthesized
ctttctttctacctctctcctt

SEQ ID NO: 927051 - DNA, 22 bp, Artificial Sequence
  chemically synthesized
cctttctttctacctctctcct

SEQ ID NO: 927052 - DNA, 22 bp, Artificial Sequence
  chemically synthesized
ccttcctttctttctacctctc

SEQ ID NO: 927053 - DNA, 22 bp, Artificial Sequence
  chemically synthesized
ctcccttcctttctttctacct

SEQ ID NO: 927054 - DNA, 22 bp, Artificial Sequence
  chemically synthesized
cctcccttcctttctttctacc

SEQ ID NO: 927055 - DNA, 22 bp, Artificial Sequence
  chemically synthesized
aacttcctcccttcctttcttt

SEQ ID NO: 927056 - DNA, 22 bp, Artificial Sequence
  chemically synthesized
catggtgatgatgagcctgaac

SEQ ID NO: 927057 - DNA, 22 bp, Artificial Sequence
  chemically synthesized
atgactccatggtgatgatgag

SEQ ID NO: 927058 - DNA, 22 bp, Artificial Sequence
  chemically synthesized
atactaatgactccatggtgat

SEQ ID NO: 927059 - DNA, 22 bp, Artificial Sequence
  chemically synthesized
aggctcatcatcaccatggagt

SEQ ID NO: 927060 - DNA, 22 bp, Artificial Sequence
  chemically synthesized
atcatcaccatggagtcattag

SEQ ID NO: 927061 - DNA, 22 bp, Artificial Sequence
  chemically synthesized
ggaggatcagtaatgggtatta

SEQ ID NO: 927062 - DNA, 22 bp, Artificial Sequence
  chemically synthesized
taggaggatcagtaatgggtat

SEQ ID NO: 927063 - DNA, 22 bp, Artificial Sequence
  chemically synthesized
gtattaatacccattactgatc

SEQ ID NO: 927064 - DNA, 22 bp, Artificial Sequence
  chemically synthesized
aatctctaggaggatcagtaat

SEQ ID NO: 927065 - DNA, 22 bp, Artificial Sequence
  chemically synthesized
gaatctctaggaggatcagtaa

SEQ ID NO: 927066 - DNA, 22 bp, Artificial Sequence
  chemically synthesized
tttgaatctctaggaggatcag

SEQ ID NO: 927067 - DNA, 22 bp, Artificial Sequence
  chemically synthesized
atttgaatctctaggaggatca

SEQ ID NO: 927068 - DNA, 22 bp, Artificial Sequence
  chemically synthesized
atacccattactgatcctccta

SEQ ID NO: 927069 - DNA, 22 bp, Artificial Sequence
  chemically synthesized
tttatttgaatctctaggagga

SEQ ID NO: 927070 - DNA, 22 bp, Artificial Sequence
  chemically synthesized
atttatttgaatctctaggagg

SEQ ID NO: 927071 - DNA, 22 bp, Artificial Sequence
  chemically synthesized
tgcttatttatttgaatctcta

SEQ ID NO: 927072 - DNA, 22 bp, Artificial Sequence
  chemically synthesized
ctgatcctcctagagattcaaa

SEQ ID NO: 927073 - DNA, 22 bp, Artificial Sequence
  chemically synthesized
atcctcctagagattcaaataa

SEQ ID NO: 927074 - DNA, 22 bp, Artificial Sequence
  chemically synthesized
gaaaattgtgcttatttatttg

SEQ ID NO: 927075 - DNA, 22 bp, Artificial Sequence
  chemically synthesized
ctagagattcaaataaataagc

SEQ ID NO: 927076 - DNA, 22 bp, Artificial Sequence
  chemically synthesized
gagattcaaataaataagcaca

SEQ ID NO: 927077 - DNA, 22 bp, Artificial Sequence
  chemically synthesized
agacctagaaaattgtgcttat

SEQ ID NO: 927078 - DNA, 22 bp, Artificial Sequence
  chemically synthesized
cctaagacctagaaaattgtgc

SEQ ID NO: 927079 - DNA, 22 bp, Artificial Sequence
  chemically synthesized
aaataaataagcacaattttct

SEQ ID NO: 927080 - DNA, 22 bp, Artificial Sequence
  chemically synthesized
tgtactgcctaagacctagaaa

SEQ ID NO: 927081 - DNA, 22 bp, Artificial Sequence
  chemically synthesized
gattatgtactgcctaagacct

SEQ ID NO: 927082 - DNA, 22 bp, Artificial Sequence
  chemically synthesized
aactagattatgtactgcctaa

SEQ ID NO: 927083 - DNA, 22 bp, Artificial Sequence
  chemically synthesized
caactagattatgtactgccta

SEQ ID NO: 927084 - DNA, 22 bp, Artificial Sequence
  chemically synthesized
tcaactagattatgtactgcct

SEQ ID NO: 927085 - DNA, 22 bp, Artificial Sequence
  chemically synthesized
ttcaactagattatgtactgcc

SEQ ID NO: 927086 - DNA, 22 bp, Artificial Sequence
  chemically synthesized
tctaggtcttaggcagtacata

SEQ ID NO: 927087 - DNA, 22 bp, Artificial Sequence
  chemically synthesized
tttcaactagattatgtactgc

SEQ ID NO: 927088 - DNA, 22 bp, Artificial Sequence
  chemically synthesized
ctaggtcttaggcagtacataa

SEQ ID NO: 927089 - DNA, 22 bp, Artificial Sequence
  chemically synthesized
taggtcttaggcagtacataat

SEQ ID NO: 927090 - DNA, 22 bp, Artificial Sequence
  chemically synthesized
ttttttcaactagattatgtac

SEQ ID NO: 927091 - DNA, 22 bp, Artificial Sequence
  chemically synthesized
ggtcttaggcagtacataatct

SEQ ID NO: 927092 - DNA, 22 bp, Artificial Sequence
  chemically synthesized
attttttcaactagattatgta

SEQ ID NO: 927093 - DNA, 22 bp, Artificial Sequence
  chemically synthesized
aggcagtacataatctagttga

SEQ ID NO: 927094 - DNA, 22 bp, Artificial Sequence
  chemically synthesized
tgtcttattttttcaactagat

SEQ ID NO: 927095 - DNA, 22 bp, Artificial Sequence
  chemically synthesized
ggcagtacataatctagttgaa

SEQ ID NO: 927096 - DNA, 22 bp, Artificial Sequence
  chemically synthesized
caactgtgtcttattttttcaa

SEQ ID NO: 927097 - DNA, 22 bp, Artificial Sequence
  chemically synthesized
gcaactgtgtcttattttttca

SEQ ID NO: 927098 - DNA, 22 bp, Artificial Sequence
  chemically synthesized
tcacttgcaactgtgtcttatt

SEQ ID NO: 927099 - DNA, 22 bp, Artificial Sequence
  chemically synthesized
gttgaaaaaataagacacagtt

SEQ ID NO: 927100 - DNA, 22 bp, Artificial Sequence
  chemically synthesized
aaaaaataagacacagttgcaa

SEQ ID NO: 927101 - DNA, 22 bp, Artificial Sequence
  chemically synthesized
tatgtagtataacaaattatca

SEQ ID NO: 927102 - DNA, 22 bp, Artificial Sequence
  chemically synthesized
ctgtatgtagtataacaaatta

SEQ ID NO: 927103 - DNA, 22 bp, Artificial Sequence
  chemically synthesized
caagtgataatttgttatacta

SEQ ID NO: 927104 - DNA, 22 bp, Artificial Sequence
  chemically synthesized
tcctactgtatgtagtataaca

SEQ ID NO: 927105 - DNA, 22 bp, Artificial Sequence
  chemically synthesized
atcctactgtatgtagtataac

SEQ ID NO: 927106 - DNA, 22 bp, Artificial Sequence
  chemically synthesized
tatcctactgtatgtagtataa

SEQ ID NO: 927107 - DNA, 22 bp, Artificial Sequence
  chemically synthesized
ttatcctactgtatgtagtata

SEQ ID NO: 927108 - DNA, 22 bp, Artificial Sequence
  chemically synthesized
tttatcctactgtatgtagtat

SEQ ID NO: 927109 - DNA, 22 bp, Artificial Sequence
  chemically synthesized
ttttatcctactgtatgtagta

SEQ ID NO: 927110 - DNA, 22 bp, Artificial Sequence
  chemically synthesized
tttttatcctactgtatgtagt

SEQ ID NO: 927111 - DNA, 22 bp, Artificial Sequence
  chemically synthesized
ttttttatcctactgtatgtag

SEQ ID NO: 927112 - DNA, 22 bp, Artificial Sequence
  chemically synthesized
tttttttatcctactgtatgta

SEQ ID NO: 927113 - DNA, 22 bp, Artificial Sequence
  chemically synthesized
ctttttttttatcctactgtat

SEQ ID NO: 927114 - DNA, 22 bp, Artificial Sequence
  chemically synthesized
gctttttttttatcctactgta

SEQ ID NO: 927115 - DNA, 22 bp, Artificial Sequence
  chemically synthesized
gttatactacatacagtaggat

SEQ ID NO: 927116 - DNA, 22 bp, Artificial Sequence
  chemically synthesized
ttatactacatacagtaggata

SEQ ID NO: 927117 - DNA, 22 bp, Artificial Sequence
  chemically synthesized
tactacatacagtaggataaaa

SEQ ID NO: 927118 - DNA, 22 bp, Artificial Sequence
  chemically synthesized
atcaccttgctttttttttatc

SEQ ID NO: 927119 - DNA, 22 bp, Artificial Sequence
  chemically synthesized
catacagtaggataaaaaaaaa

SEQ ID NO: 927120 - DNA, 22 bp, Artificial Sequence
  chemically synthesized
ttgatcaccttgcttttttttt

SEQ ID NO: 927121 - DNA, 22 bp, Artificial Sequence
  chemically synthesized
gttgatcaccttgctttttttt

SEQ ID NO: 927122 - DNA, 22 bp, Artificial Sequence
  chemically synthesized
ccatttgttgatcaccttgctt

SEQ ID NO: 927123 - DNA, 22 bp, Artificial Sequence
  chemically synthesized
gcctaccatttgttgatcacct

SEQ ID NO: 927124 - DNA, 22 bp, Artificial Sequence
  chemically synthesized
tggcctaccatttgttgatcac

SEQ ID NO: 927125 - DNA, 22 bp, Artificial Sequence
  chemically synthesized
ctggcctaccatttgttgatca

SEQ ID NO: 927126 - DNA, 22 bp, Artificial Sequence
  chemically synthesized
ttctggcctaccatttgttgat

SEQ ID NO: 927127 - DNA, 22 bp, Artificial Sequence
  chemically synthesized
agatcatccctcttctggccta

SEQ ID NO: 927128 - DNA, 22 bp, Artificial Sequence
  chemically synthesized
actgagatcatccctcttctgg

SEQ ID NO: 927129 - DNA, 22 bp, Artificial Sequence
  chemically synthesized
cactgagatcatccctcttctg

SEQ ID NO: 927130 - DNA, 22 bp, Artificial Sequence
  chemically synthesized
tcactgagatcatccctcttct

SEQ ID NO: 927131 - DNA, 22 bp, Artificial Sequence
  chemically synthesized
ttcactgagatcatccctcttc

SEQ ID NO: 927132 - DNA, 22 bp, Artificial Sequence
  chemically synthesized
atccttttcactgagatcatcc

SEQ ID NO: 927133 - DNA, 22 bp, Artificial Sequence
  chemically synthesized
cgctcatccttttcactgagat

SEQ ID NO: 927134 - DNA, 22 bp, Artificial Sequence
  chemically synthesized
ctccgctcatccttttcactga

SEQ ID NO: 927135 - DNA, 22 bp, Artificial Sequence
  chemically synthesized
acccagaagtctcctccgctca

SEQ ID NO: 927136 - DNA, 22 bp, Artificial Sequence
  chemically synthesized
agtgaaaaggatgagcggagga

SEQ ID NO: 927137 - DNA, 22 bp, Artificial Sequence
  chemically synthesized
caaattgacccagaagtctcct

SEQ ID NO: 927138 - DNA, 22 bp, Artificial Sequence
  chemically synthesized
aattccaaattgacccagaagt

SEQ ID NO: 927139 - DNA, 22 bp, Artificial Sequence
  chemically synthesized
aaattccaaattgacccagaag

SEQ ID NO: 927140 - DNA, 22 bp, Artificial Sequence
  chemically synthesized
taaattccaaattgacccagaa

SEQ ID NO: 927141 - DNA, 22 bp, Artificial Sequence
  chemically synthesized
tttaaattccaaattgacccag

SEQ ID NO: 927142 - DNA, 22 bp, Artificial Sequence
  chemically synthesized
cgattctttaaattccaaattg

SEQ ID NO: 927143 - DNA, 22 bp, Artificial Sequence
  chemically synthesized
tacgattctttaaattccaaat

SEQ ID NO: 927144 - DNA, 22 bp, Artificial Sequence
  chemically synthesized
ctgggtcaatttggaatttaaa

SEQ ID NO: 927145 - DNA, 22 bp, Artificial Sequence
  chemically synthesized
tgggtcaatttggaatttaaag

SEQ ID NO: 927146 - DNA, 22 bp, Artificial Sequence
  chemically synthesized
agttctacgattctttaaattc

SEQ ID NO: 927147 - DNA, 22 bp, Artificial Sequence
  chemically synthesized
ggtcaatttggaatttaaagaa

SEQ ID NO: 927148 - DNA, 22 bp, Artificial Sequence
  chemically synthesized
catatgcctaagttctacgatt

SEQ ID NO: 927149 - DNA, 22 bp, Artificial Sequence
  chemically synthesized
ggaatttaaagaatcgtagaac

SEQ ID NO: 927150 - DNA, 22 bp, Artificial Sequence
  chemically synthesized
gaatttaaagaatcgtagaact

SEQ ID NO: 927151 - DNA, 22 bp, Artificial Sequence
  chemically synthesized
accctccatatgcctaagttct

SEQ ID NO: 927152 - DNA, 22 bp, Artificial Sequence
  chemically synthesized
aaagaatcgtagaacttaggca

SEQ ID NO: 927153 - DNA, 22 bp, Artificial Sequence
  chemically synthesized
taaccctccatatgcctaagtt

SEQ ID NO: 927154 - DNA, 22 bp, Artificial Sequence
  chemically synthesized
aagaatcgtagaacttaggcat

SEQ ID NO: 927155 - DNA, 22 bp, Artificial Sequence
  chemically synthesized
cctctaaccctccatatgccta

SEQ ID NO: 927156 - DNA, 22 bp, Artificial Sequence
  chemically synthesized
actgcctctaaccctccatatg

SEQ ID NO: 927157 - DNA, 22 bp, Artificial Sequence
  chemically synthesized
tcactgcctctaaccctccata

SEQ ID NO: 927158 - DNA, 22 bp, Artificial Sequence
  chemically synthesized
aggcatatggagggttagaggc

SEQ ID NO: 927159 - DNA, 22 bp, Artificial Sequence
  chemically synthesized
ggcatatggagggttagaggca

SEQ ID NO: 927160 - DNA, 22 bp, Artificial Sequence
  chemically synthesized
ccgtactctcactgcctctaac

SEQ ID NO: 927161 - DNA, 22 bp, Artificial Sequence
  chemically synthesized
tgccgtactctcactgcctcta

SEQ ID NO: 927162 - DNA, 22 bp, Artificial Sequence
  chemically synthesized
ctgccgtactctcactgcctct

SEQ ID NO: 927163 - DNA, 22 bp, Artificial Sequence
  chemically synthesized
acttctgccgtactctcactgc

SEQ ID NO: 927164 - DNA, 22 bp, Artificial Sequence
  chemically synthesized
aacttctgccgtactctcactg

SEQ ID NO: 927165 - DNA, 22 bp, Artificial Sequence
  chemically synthesized
taacttctgccgtactctcact

SEQ ID NO: 927166 - DNA, 22 bp, Artificial Sequence
  chemically synthesized
gaggcagtgagagtacggcaga

SEQ ID NO: 927167 - DNA, 22 bp, Artificial Sequence
  chemically synthesized
cacaccacaggctttaacttct

SEQ ID NO: 927168 - DNA, 22 bp, Artificial Sequence
  chemically synthesized
gtcacatcatggagattgcaca

SEQ ID NO: 927169 - DNA, 22 bp, Artificial Sequence
  chemically synthesized
ggtcacatcatggagattgcac

SEQ ID NO: 927170 - DNA, 22 bp, Artificial Sequence
  chemically synthesized
aagcctgtggtgtgcaatctcc

SEQ ID NO: 927171 - DNA, 22 bp, Artificial Sequence
  chemically synthesized
ttggtcacatcatggagattgc

SEQ ID NO: 927172 - DNA, 22 bp, Artificial Sequence
  chemically synthesized
tgctcttggtcacatcatggag

SEQ ID NO: 927173 - DNA, 22 bp, Artificial Sequence
  chemically synthesized
tggtgtgcaatctccatgatgt

SEQ ID NO: 927174 - DNA, 22 bp, Artificial Sequence
  chemically synthesized
atgctcttggtcacatcatgga

SEQ ID NO: 927175 - DNA, 22 bp, Artificial Sequence
  chemically synthesized
tatgctcttggtcacatcatgg

SEQ ID NO: 927176 - DNA, 22 bp, Artificial Sequence
  chemically synthesized
catgatgtgaccaagagcataa

SEQ ID NO: 927177 - DNA, 22 bp, Artificial Sequence
  chemically synthesized
atacagtggcatagagcccagt

SEQ ID NO: 927178 - DNA, 22 bp, Artificial Sequence
  chemically synthesized
tcatacagtggcatagagccca

SEQ ID NO: 927179 - DNA, 22 bp, Artificial Sequence
  chemically synthesized
ctctcatacagtggcatagagc

SEQ ID NO: 927180 - DNA, 22 bp, Artificial Sequence
  chemically synthesized
acgcctgctctcatacagtggc

SEQ ID NO: 927181 - DNA, 22 bp, Artificial Sequence
  chemically synthesized
ggctctatgccactgtatgaga

SEQ ID NO: 927182 - DNA, 22 bp, Artificial Sequence
  chemically synthesized
ccctaacgcctgctctcataca

SEQ ID NO: 927183 - DNA, 22 bp, Artificial Sequence
  chemically synthesized
ctcccctaacgcctgctctcat

SEQ ID NO: 927184 - DNA, 22 bp, Artificial Sequence
  chemically synthesized
tatgccactgtatgagagcagg

SEQ ID NO: 927185 - DNA, 22 bp, Artificial Sequence
  chemically synthesized
tgccactgtatgagagcaggcg

SEQ ID NO: 927186 - DNA, 22 bp, Artificial Sequence
  chemically synthesized
tactcctcccctaacgcctgct

SEQ ID NO: 927187 - DNA, 22 bp, Artificial Sequence
  chemically synthesized
tatgagagcaggcgttagggga

SEQ ID NO: 927188 - DNA, 22 bp, Artificial Sequence
  chemically synthesized
ggggaggagtacagccctcggt

SEQ ID NO: 927189 - DNA, 22 bp, Artificial Sequence
  chemically synthesized
cccaggccccaatatacaccga

SEQ ID NO: 927190 - DNA, 22 bp, Artificial Sequence
  chemically synthesized
tgcccaggccccaatatacacc

SEQ ID NO: 927191 - DNA, 22 bp, Artificial Sequence
  chemically synthesized
tctgcccaggccccaatataca

SEQ ID NO: 927192 - DNA, 22 bp, Artificial Sequence
  chemically synthesized
aagttctctgcccaggccccaa

SEQ ID NO: 927193 - DNA, 22 bp, Artificial Sequence
  chemically synthesized
ggtgtatattggggcctgggca

SEQ ID NO: 927194 - DNA, 22 bp, Artificial Sequence
  chemically synthesized
cctcaagttctctgcccaggcc

SEQ ID NO: 927195 - DNA, 22 bp, Artificial Sequence
  chemically synthesized
cgttgcctcaagttctctgccc

SEQ ID NO: 927196 - DNA, 22 bp, Artificial Sequence
  chemically synthesized
acgttgcctcaagttctctgcc

SEQ ID NO: 927197 - DNA, 22 bp, Artificial Sequence
  chemically synthesized
gggcctgggcagagaacttgag

SEQ ID NO: 927198 - DNA, 22 bp, Artificial Sequence
  chemically synthesized
ataatttacgttgcctcaagtt

SEQ ID NO: 927199 - DNA, 22 bp, Artificial Sequence
  chemically synthesized
aataatttacgttgcctcaagt

SEQ ID NO: 927200 - DNA, 22 bp, Artificial Sequence
  chemically synthesized
ggcagagaacttgaggcaacgt

SEQ ID NO: 927201 - DNA, 22 bp, Artificial Sequence
  chemically synthesized
ccttaataatttacgttgcctc

SEQ ID NO: 927202 - DNA, 22 bp, Artificial Sequence
  chemically synthesized
atgttgccttaataatttacgt

SEQ ID NO: 927203 - DNA, 22 bp, Artificial Sequence
  chemically synthesized
gaggcaacgtaaattattaagg

SEQ ID NO: 927204 - DNA, 22 bp, Artificial Sequence
  chemically synthesized
aggcaacgtaaattattaaggc

SEQ ID NO: 927205 - DNA, 22 bp, Artificial Sequence
  chemically synthesized
atgtaatagttcatgttgcctt

SEQ ID NO: 927206 - DNA, 22 bp, Artificial Sequence
  chemically synthesized
tcatgtaatagttcatgttgcc

SEQ ID NO: 927207 - DNA, 22 bp, Artificial Sequence
  chemically synthesized
ttaaggcaacatgaactattac

SEQ ID NO: 927208 - DNA, 22 bp, Artificial Sequence
  chemically synthesized
aggcaacatgaactattacatg

SEQ ID NO: 927209 - DNA, 22 bp, Artificial Sequence
  chemically synthesized
caaaacaatggtgattctcatg

SEQ ID NO: 927210 - DNA, 22 bp, Artificial Sequence
  chemically synthesized
ttccaaaacaatggtgattctc

SEQ ID NO: 927211 - DNA, 22 bp, Artificial Sequence
  chemically synthesized
attccaaaacaatggtgattct

SEQ ID NO: 927212 - DNA, 22 bp, Artificial Sequence
  chemically synthesized
ttacatgagaatcaccattgtt

SEQ ID NO: 927213 - DNA, 22 bp, Artificial Sequence
  chemically synthesized
catgagaatcaccattgttttg

SEQ ID NO: 927214 - DNA, 22 bp, Artificial Sequence
  chemically synthesized
cacgatgcagtttattccaaaa

SEQ ID NO: 927215 - DNA, 22 bp, Artificial Sequence
  chemically synthesized
gcacgatgcagtttattccaaa

SEQ ID NO: 927216 - DNA, 22 bp, Artificial Sequence
  chemically synthesized
atgcttgcacgatgcagtttat

SEQ ID NO: 927217 - DNA, 22 bp, Artificial Sequence
  chemically synthesized
ttttggaataaactgcatcgtg

SEQ ID NO: 927218 - DNA, 22 bp, Artificial Sequence
  chemically synthesized
tggaataaactgcatcgtgcaa

SEQ ID NO: 927219 - DNA, 22 bp, Artificial Sequence
  chemically synthesized
ggaataaactgcatcgtgcaag

SEQ ID NO: 927220 - DNA, 22 bp, Artificial Sequence
  chemically synthesized
gaataaactgcatcgtgcaagc

SEQ ID NO: 927221 - DNA, 22 bp, Artificial Sequence
  chemically synthesized
agtagtcactgatgcttgcacg

SEQ ID NO: 927222 - DNA, 22 bp, Artificial Sequence
  chemically synthesized
cagtagtcactgatgcttgcac

SEQ ID NO: 927223 - DNA, 22 bp, Artificial Sequence
  chemically synthesized
ccatttcagtagtcactgatgc

SEQ ID NO: 927224 - DNA, 22 bp, Artificial Sequence
  chemically synthesized
cccatttcagtagtcactgatg

SEQ ID NO: 927225 - DNA, 22 bp, Artificial Sequence
  chemically synthesized
catcgtgcaagcatcagtgact

SEQ ID NO: 927226 - DNA, 22 bp, Artificial Sequence
  chemically synthesized
tcccatttcagtagtcactgat

SEQ ID NO: 927227 - DNA, 22 bp, Artificial Sequence
  chemically synthesized
ttcccatttcagtagtcactga

SEQ ID NO: 927228 - DNA, 22 bp, Artificial Sequence
  chemically synthesized
tttcccatttcagtagtcactg

SEQ ID NO: 927229 - DNA, 22 bp, Artificial Sequence
  chemically synthesized
ttttcccatttcagtagtcact

SEQ ID NO: 927230 - DNA, 22 bp, Artificial Sequence
  chemically synthesized
ggcaaaatttttttcccatttc

SEQ ID NO: 927231 - DNA, 22 bp, Artificial Sequence
  chemically synthesized
aggcaaaatttttttcccattt

SEQ ID NO: 927232 - DNA, 22 bp, Artificial Sequence
  chemically synthesized
taggcaaaatttttttcccatt

SEQ ID NO: 927233 - DNA, 22 bp, Artificial Sequence
  chemically synthesized
tgttttaggcaaaatttttttc

SEQ ID NO: 927234 - DNA, 22 bp, Artificial Sequence
  chemically synthesized
ctgaaatgggaaaaaaattttg

SEQ ID NO: 927235 - DNA, 22 bp, Artificial Sequence
  chemically synthesized
aaatgggaaaaaaattttgcct

SEQ ID NO: 927236 - DNA, 22 bp, Artificial Sequence
  chemically synthesized
acatctatgttttaggcaaaat

SEQ ID NO: 927237 - DNA, 22 bp, Artificial Sequence
  chemically synthesized
cctgacatctatgttttaggca

SEQ ID NO: 927238 - DNA, 22 bp, Artificial Sequence
  chemically synthesized
aatacctccctgacatctatgt

SEQ ID NO: 927239 - DNA, 22 bp, Artificial Sequence
  chemically synthesized
taaatacctccctgacatctat

SEQ ID NO: 927240 - DNA, 22 bp, Artificial Sequence
  chemically synthesized
tgcctaaaacatagatgtcagg

SEQ ID NO: 927241 - DNA, 22 bp, Artificial Sequence
  chemically synthesized
tctaaatacctccctgacatct

SEQ ID NO: 927242 - DNA, 22 bp, Artificial Sequence
  chemically synthesized
gcctaaaacatagatgtcaggg

SEQ ID NO: 927243 - DNA, 22 bp, Artificial Sequence
  chemically synthesized
cctaaaacatagatgtcaggga

SEQ ID NO: 927244 - DNA, 22 bp, Artificial Sequence
  chemically synthesized
ctctctaaatacctccctgaca

SEQ ID NO: 927245 - DNA, 22 bp, Artificial Sequence
  chemically synthesized
actctctaaatacctccctgac

SEQ ID NO: 927246 - DNA, 22 bp, Artificial Sequence
  chemically synthesized
tactctctaaatacctccctga

SEQ ID NO: 927247 - DNA, 22 bp, Artificial Sequence
  chemically synthesized
aaacatagatgtcagggaggta

SEQ ID NO: 927248 - DNA, 22 bp, Artificial Sequence
  chemically synthesized
agagagtaaagaccatggctct

SEQ ID NO: 927249 - DNA, 22 bp, Artificial Sequence
  chemically synthesized
aaggaacaaataagagccatgg

SEQ ID NO: 927250 - DNA, 22 bp, Artificial Sequence
  chemically synthesized
gagagtaaagaccatggctctt

SEQ ID NO: 927251 - DNA, 22 bp, Artificial Sequence
  chemically synthesized
gaaggaacaaataagagccatg

SEQ ID NO: 927252 - DNA, 22 bp, Artificial Sequence
  chemically synthesized
ttgaaggaacaaataagagcca

SEQ ID NO: 927253 - DNA, 22 bp, Artificial Sequence
  chemically synthesized
gacactcttgaaggaacaaata

SEQ ID NO: 927254 - DNA, 22 bp, Artificial Sequence
  chemically synthesized
taagtattggacactcttgaag

SEQ ID NO: 927255 - DNA, 22 bp, Artificial Sequence
  chemically synthesized
ttatttgttccttcaagagtgt

SEQ ID NO: 927256 - DNA, 22 bp, Artificial Sequence
  chemically synthesized
atttgttccttcaagagtgtcc

SEQ ID NO: 927257 - DNA, 22 bp, Artificial Sequence
  chemically synthesized
tttgttccttcaagagtgtcca

SEQ ID NO: 927258 - DNA, 22 bp, Artificial Sequence
  chemically synthesized
gttccttcaagagtgtccaata

SEQ ID NO: 927259 - DNA, 22 bp, Artificial Sequence
  chemically synthesized
ttccttcaagagtgtccaatac

SEQ ID NO: 927260 - DNA, 22 bp, Artificial Sequence
  chemically synthesized
cttcaagagtgtccaatactta

SEQ ID NO: 927261 - DNA, 22 bp, Artificial Sequence
  chemically synthesized
caagagtgtccaatacttacaa

SEQ ID NO: 927262 - DNA, 22 bp, Artificial Sequence
  chemically synthesized
aagagtgtccaatacttacaac

SEQ ID NO: 927263 - DNA, 22 bp, Artificial Sequence
  chemically synthesized
aaagtatgaagtaatagttgta

SEQ ID NO: 927264 - DNA, 22 bp, Artificial Sequence
  chemically synthesized
aaaagtatgaagtaatagttgt

SEQ ID NO: 927265 - DNA, 22 bp, Artificial Sequence
  chemically synthesized
taaaagtatgaagtaatagttg

SEQ ID NO: 927266 - DNA, 22 bp, Artificial Sequence
  chemically synthesized
ttaaaagtatgaagtaatagtt

SEQ ID NO: 927267 - DNA, 22 bp, Artificial Sequence
  chemically synthesized
tttaaaagtatgaagtaatagt

SEQ ID NO: 927268 - DNA, 22 bp, Artificial Sequence
  chemically synthesized
acaactattacttcatactttt

SEQ ID NO: 927269 - DNA, 22 bp, Artificial Sequence
  chemically synthesized
caactattacttcatactttta

SEQ ID NO: 927270 - DNA, 22 bp, Artificial Sequence
  chemically synthesized
ttacttcatacttttaaaaaat

SEQ ID NO: 927271 - DNA, 22 bp, Artificial Sequence
  chemically synthesized
atgtgtgcccatgcatttttta

SEQ ID NO: 927272 - DNA, 22 bp, Artificial Sequence
  chemically synthesized
cttcatacttttaaaaaatgca

SEQ ID NO: 927273 - DNA, 22 bp, Artificial Sequence
  chemically synthesized
catacttttaaaaaatgcatgg

SEQ ID NO: 927274 - DNA, 22 bp, Artificial Sequence
  chemically synthesized
atacttttaaaaaatgcatggg

SEQ ID NO: 927275 - DNA, 22 bp, Artificial Sequence
  chemically synthesized
ttaaaaaatgcatgggcacaca

SEQ ID NO: 927276 - DNA, 22 bp, Artificial Sequence
  chemically synthesized
taaaaaatgcatgggcacacat

SEQ ID NO: 927277 - DNA, 22 bp, Artificial Sequence
  chemically synthesized
aaaaaatgcatgggcacacatc

SEQ ID NO: 927278 - DNA, 22 bp, Artificial Sequence
  chemically synthesized
tggtatacatctgatgtgtgcc

SEQ ID NO: 927279 - DNA, 22 bp, Artificial Sequence
  chemically synthesized
aaaaatgcatgggcacacatca

SEQ ID NO: 927280 - DNA, 22 bp, Artificial Sequence
  chemically synthesized
ggaagcaccgctatggtataca

SEQ ID NO: 927281 - DNA, 22 bp, Artificial Sequence
  chemically synthesized
aagtctaggaagcaccgctatg

SEQ ID NO: 927282 - DNA, 22 bp, Artificial Sequence
  chemically synthesized
tatgcgcattaaagtctaggaa

SEQ ID NO: 927283 - DNA, 22 bp, Artificial Sequence
  chemically synthesized
gtatgcgcattaaagtctagga

SEQ ID NO: 927284 - DNA, 22 bp, Artificial Sequence
  chemically synthesized
caggagatttgtatgcgcatta

SEQ ID NO: 927285 - DNA, 22 bp, Artificial Sequence
  chemically synthesized
cctagactttaatgcgcataca

SEQ ID NO: 927286 - DNA, 22 bp, Artificial Sequence
  chemically synthesized
ctagactttaatgcgcatacaa

SEQ ID NO: 927287 - DNA, 22 bp, Artificial Sequence
  chemically synthesized
gactttaatgcgcatacaaatc

SEQ ID NO: 927288 - DNA, 22 bp, Artificial Sequence
  chemically synthesized
gtaagatctccaggagatttgt

SEQ ID NO: 927289 - DNA, 22 bp, Artificial Sequence
  chemically synthesized
agtaagatctccaggagatttg

SEQ ID NO: 927290 - DNA, 22 bp, Artificial Sequence
  chemically synthesized
taatgcgcatacaaatctcctg

SEQ ID NO: 927291 - DNA, 22 bp, Artificial Sequence
  chemically synthesized
aatgcgcatacaaatctcctgg

SEQ ID NO: 927292 - DNA, 22 bp, Artificial Sequence
  chemically synthesized
atgcgcatacaaatctcctgga

SEQ ID NO: 927293 - DNA, 22 bp, Artificial Sequence
  chemically synthesized
cagtttagtaagatctccagga

SEQ ID NO: 927294 - DNA, 22 bp, Artificial Sequence
  chemically synthesized
gcagtttagtaagatctccagg

SEQ ID NO: 927295 - DNA, 22 bp, Artificial Sequence
  chemically synthesized
ctggagatcttactaaactgca

SEQ ID NO: 927296 - DNA, 22 bp, Artificial Sequence
  chemically synthesized
atgcagcagaacttgcagttta

SEQ ID NO: 927297 - DNA, 22 bp, Artificial Sequence
  chemically synthesized
gagatcttactaaactgcaagt

SEQ ID NO: 927298 - DNA, 22 bp, Artificial Sequence
  chemically synthesized
actaaactgcaagttctgctgc

SEQ ID NO: 927299 - DNA, 22 bp, Artificial Sequence
  chemically synthesized
cacggacctaatgcagcagaac

SEQ ID NO: 927300 - DNA, 22 bp, Artificial Sequence
  chemically synthesized
ctaaactgcaagttctgctgca

SEQ ID NO: 927301 - DNA, 22 bp, Artificial Sequence
  chemically synthesized
aactgcaagttctgctgcatta

SEQ ID NO: 927302 - DNA, 22 bp, Artificial Sequence
  chemically synthesized
gtgcctccacggacctaatgca

SEQ ID NO: 927303 - DNA, 22 bp, Artificial Sequence
  chemically synthesized
ggtgcctccacggacctaatgc

SEQ ID NO: 927304 - DNA, 22 bp, Artificial Sequence
  chemically synthesized
caagttctgctgcattaggtcc

SEQ ID NO: 927305 - DNA, 22 bp, Artificial Sequence
  chemically synthesized
tggtgcctccacggacctaatg

SEQ ID NO: 927306 - DNA, 22 bp, Artificial Sequence
  chemically synthesized
tgctgcattaggtccgtggagg

SEQ ID NO: 927307 - DNA, 22 bp, Artificial Sequence
  chemically synthesized
ctgcattaggtccgtggaggca

SEQ ID NO: 927308 - DNA, 22 bp, Artificial Sequence
  chemically synthesized
cattaggtccgtggaggcacca

SEQ ID NO: 927309 - DNA, 22 bp, Artificial Sequence
  chemically synthesized
ggtccgtggaggcaccaaaatt

SEQ ID NO: 927310 - DNA, 22 bp, Artificial Sequence
  chemically synthesized
taggaaatgcagaattttggtg

SEQ ID NO: 927311 - DNA, 22 bp, Artificial Sequence
  chemically synthesized
gtaggaaatgcagaattttggt

SEQ ID NO: 927312 - DNA, 22 bp, Artificial Sequence
  chemically synthesized
aagtttgtaggaaatgcagaat

SEQ ID NO: 927313 - DNA, 22 bp, Artificial Sequence
  chemically synthesized
gaagtttgtaggaaatgcagaa

SEQ ID NO: 927314 - DNA, 22 bp, Artificial Sequence
  chemically synthesized
tgaagtttgtaggaaatgcaga

SEQ ID NO: 927315 - DNA, 22 bp, Artificial Sequence
  chemically synthesized
ttgaagtttgtaggaaatgcag

SEQ ID NO: 927316 - DNA, 22 bp, Artificial Sequence
  chemically synthesized
tttgaagtttgtaggaaatgca

SEQ ID NO: 927317 - DNA, 22 bp, Artificial Sequence
  chemically synthesized
ttttgaagtttgtaggaaatgc

SEQ ID NO: 927318 - DNA, 22 bp, Artificial Sequence
  chemically synthesized
gcatttttttgaagtttgtagg

SEQ ID NO: 927319 - DNA, 22 bp, Artificial Sequence
  chemically synthesized
tgcatttcctacaaacttcaaa

SEQ ID NO: 927320 - DNA, 22 bp, Artificial Sequence
  chemically synthesized
catttcctacaaacttcaaaaa

SEQ ID NO: 927321 - DNA, 22 bp, Artificial Sequence
  chemically synthesized
cctacaaacttcaaaaaaatgc

SEQ ID NO: 927322 - DNA, 22 bp, Artificial Sequence
  chemically synthesized
ctacaaacttcaaaaaaatgcc

SEQ ID NO: 927323 - DNA, 22 bp, Artificial Sequence
  chemically synthesized
gaccagcagtattggcattttt

SEQ ID NO: 927324 - DNA, 22 bp, Artificial Sequence
  chemically synthesized
caaacttcaaaaaaatgccaat

SEQ ID NO: 927325 - DNA, 22 bp, Artificial Sequence
  chemically synthesized
ctggaccagcagtattggcatt

SEQ ID NO: 927326 - DNA, 22 bp, Artificial Sequence
  chemically synthesized
caaaaaaatgccaatactgctg

SEQ ID NO: 927327 - DNA, 22 bp, Artificial Sequence
  chemically synthesized
aaaaaaatgccaatactgctgg

SEQ ID NO: 927328 - DNA, 22 bp, Artificial Sequence
  chemically synthesized
aaagaggtattcctggaccagc

SEQ ID NO: 927329 - DNA, 22 bp, Artificial Sequence
  chemically synthesized
caactcaaagaggtattcctgg

SEQ ID NO: 927330 - DNA, 22 bp, Artificial Sequence
  chemically synthesized
acaactcaaagaggtattcctg

SEQ ID NO: 927331 - DNA, 22 bp, Artificial Sequence
  chemically synthesized
ccttacaactcaaagaggtatt

SEQ ID NO: 927332 - DNA, 22 bp, Artificial Sequence
  chemically synthesized
ctggtccaggaatacctctttg

SEQ ID NO: 927333 - DNA, 22 bp, Artificial Sequence
  chemically synthesized
gtccaggaatacctctttgagt

SEQ ID NO: 927334 - DNA, 22 bp, Artificial Sequence
  chemically synthesized
cattaccttacaactcaaagag

SEQ ID NO: 927335 - DNA, 22 bp, Artificial Sequence
  chemically synthesized
ctccattaccttacaactcaaa

SEQ ID NO: 927336 - DNA, 22 bp, Artificial Sequence
  chemically synthesized
actccattaccttacaactcaa

SEQ ID NO: 927337 - DNA, 22 bp, Artificial Sequence
  chemically synthesized
tttgagttgtaaggtaatggag

SEQ ID NO: 927338 - DNA, 22 bp, Artificial Sequence
  chemically synthesized
aaaaggcatttactccattacc

SEQ ID NO: 927339 - DNA, 22 bp, Artificial Sequence
  chemically synthesized
tgagttgtaaggtaatggagta

SEQ ID NO: 927340 - DNA, 22 bp, Artificial Sequence
  chemically synthesized
gagttgtaaggtaatggagtaa

SEQ ID NO: 927341 - DNA, 22 bp, Artificial Sequence
  chemically synthesized
agttgtaaggtaatggagtaaa

SEQ ID NO: 927342 - DNA, 22 bp, Artificial Sequence
  chemically synthesized
taaggtaatggagtaaatgcct

SEQ ID NO: 927343 - DNA, 22 bp, Artificial Sequence
  chemically synthesized
acaaagactcaaaaggcattta

SEQ ID NO: 927344 - DNA, 22 bp, Artificial Sequence
  chemically synthesized
aacaaagactcaaaaggcattt

SEQ ID NO: 927345 - DNA, 22 bp, Artificial Sequence
  chemically synthesized
cttaacaaagactcaaaaggca

SEQ ID NO: 927346 - DNA, 22 bp, Artificial Sequence
  chemically synthesized
attgcttaacaaagactcaaaa

SEQ ID NO: 927347 - DNA, 22 bp, Artificial Sequence
  chemically synthesized
gattgcttaacaaagactcaaa

SEQ ID NO: 927348 - DNA, 22 bp, Artificial Sequence
  chemically synthesized
cttgattgcttaacaaagactc

SEQ ID NO: 927349 - DNA, 22 bp, Artificial Sequence
  chemically synthesized
ttgagtctttgttaagcaatca

SEQ ID NO: 927350 - DNA, 22 bp, Artificial Sequence
  chemically synthesized
tgagtctttgttaagcaatcaa

SEQ ID NO: 927351 - DNA, 22 bp, Artificial Sequence
  chemically synthesized
gagtctttgttaagcaatcaag

SEQ ID NO: 927352 - DNA, 22 bp, Artificial Sequence
  chemically synthesized
agtctttgttaagcaatcaagg

SEQ ID NO: 927353 - DNA, 22 bp, Artificial Sequence
  chemically synthesized
tgttaagcaatcaaggaattct

SEQ ID NO: 927354 - DNA, 22 bp, Artificial Sequence
  chemically synthesized
taagcagcaataagaattcctt

SEQ ID NO: 927355 - DNA, 22 bp, Artificial Sequence
  chemically synthesized
gttaagcaatcaaggaattctt

SEQ ID NO: 927356 - DNA, 22 bp, Artificial Sequence
  chemically synthesized
ttaagcaatcaaggaattctta

SEQ ID NO: 927357 - DNA, 22 bp, Artificial Sequence
  chemically synthesized
agcaatcaaggaattcttattg

SEQ ID NO: 927358 - DNA, 22 bp, Artificial Sequence
  chemically synthesized
tagcattataagcagcaataag

SEQ ID NO: 927359 - DNA, 22 bp, Artificial Sequence
  chemically synthesized
atagcattataagcagcaataa

SEQ ID NO: 927360 - DNA, 22 bp, Artificial Sequence
  chemically synthesized
gtttatagcattataagcagca

SEQ ID NO: 927361 - DNA, 22 bp, Artificial Sequence
  chemically synthesized
ttattgctgcttataatgctat

SEQ ID NO: 927362 - DNA, 22 bp, Artificial Sequence
  chemically synthesized
cagcattagtttatagcattat

SEQ ID NO: 927363 - DNA, 22 bp, Artificial Sequence
  chemically synthesized
attgctgcttataatgctataa

SEQ ID NO: 927364 - DNA, 22 bp, Artificial Sequence
  chemically synthesized
ttgctgcttataatgctataaa

SEQ ID NO: 927365 - DNA, 22 bp, Artificial Sequence
  chemically synthesized
ctgcttataatgctataaacta

SEQ ID NO: 927366 - DNA, 22 bp, Artificial Sequence
  chemically synthesized
cttataatgctataaactaatg

SEQ ID NO: 927367 - DNA, 22 bp, Artificial Sequence
  chemically synthesized
ataatgctataaactaatgctg

SEQ ID NO: 927368 - DNA, 22 bp, Artificial Sequence
  chemically synthesized
taatgctataaactaatgctgc

SEQ ID NO: 927369 - DNA, 22 bp, Artificial Sequence
  chemically synthesized
agataaaaatgctgcagcatta

SEQ ID NO: 927370 - DNA, 22 bp, Artificial Sequence
  chemically synthesized
taaactaatgctgcagcatttt

SEQ ID NO: 927371 - DNA, 22 bp, Artificial Sequence
  chemically synthesized
atgctgcagcatttttatctca

SEQ ID NO: 927372 - DNA, 22 bp, Artificial Sequence
  chemically synthesized
caaagcaaagaggctgagataa

SEQ ID NO: 927373 - DNA, 22 bp, Artificial Sequence
  chemically synthesized
cagcatttttatctcagcctct

SEQ ID NO: 927374 - DNA, 22 bp, Artificial Sequence
  chemically synthesized
ttatctcagcctctttgctttg

SEQ ID NO: 927375 - DNA, 22 bp, Artificial Sequence
  chemically synthesized
tatctcagcctctttgctttgt

SEQ ID NO: 927376 - DNA, 22 bp, Artificial Sequence
  chemically synthesized
atctcagcctctttgctttgta

SEQ ID NO: 927377 - DNA, 22 bp, Artificial Sequence
  chemically synthesized
tctcagcctctttgctttgtag

SEQ ID NO: 927378 - DNA, 22 bp, Artificial Sequence
  chemically synthesized
agcctctttgctttgtagtttt

SEQ ID NO: 927379 - DNA, 22 bp, Artificial Sequence
  chemically synthesized
tttgctttgtagttttgatctt

SEQ ID NO: 927380 - DNA, 22 bp, Artificial Sequence
  chemically synthesized
tgctttgtagttttgatcttgg

SEQ ID NO: 927381 - DNA, 22 bp, Artificial Sequence
  chemically synthesized
gctttgtagttttgatcttggc

SEQ ID NO: 927382 - DNA, 22 bp, Artificial Sequence
  chemically synthesized
ctttgtagttttgatcttggca

SEQ ID NO: 927383 - DNA, 22 bp, Artificial Sequence
  chemically synthesized
tgtagttttgatcttggcactt

SEQ ID NO: 927384 - DNA, 22 bp, Artificial Sequence
  chemically synthesized
gtagttttgatcttggcacttt

SEQ ID NO: 927385 - DNA, 22 bp, Artificial Sequence
  chemically synthesized
tagttttgatcttggcactttt

SEQ ID NO: 927386 - DNA, 22 bp, Artificial Sequence
  chemically synthesized
tgatcttggcacttttgcttca

SEQ ID NO: 927387 - DNA, 22 bp, Artificial Sequence
  chemically synthesized
gatcttggcacttttgcttcat

SEQ ID NO: 927388 - DNA, 22 bp, Artificial Sequence
  chemically synthesized
atcttggcacttttgcttcatg

SEQ ID NO: 927389 - DNA, 22 bp, Artificial Sequence
  chemically synthesized
ggcacttttgcttcatggctga

SEQ ID NO: 927390 - DNA, 22 bp, Artificial Sequence
  chemically synthesized
gcacttttgcttcatggctgat

SEQ ID NO: 927391 - DNA, 22 bp, Artificial Sequence
  chemically synthesized
taaaagtcaccgtagccatcag

SEQ ID NO: 927392 - DNA, 22 bp, Artificial Sequence
  chemically synthesized
ttgcttcatggctgatggctac

SEQ ID NO: 927393 - DNA, 22 bp, Artificial Sequence
  chemically synthesized
tgcttcatggctgatggctacg

SEQ ID NO: 927394 - DNA, 22 bp, Artificial Sequence
  chemically synthesized
gcttcatggctgatggctacgg

SEQ ID NO: 927395 - DNA, 22 bp, Artificial Sequence
  chemically synthesized
cttcatggctgatggctacggt

SEQ ID NO: 927396 - DNA, 22 bp, Artificial Sequence
  chemically synthesized
ggttgtaaaagtcaccgtagcc

SEQ ID NO: 927397 - DNA, 22 bp, Artificial Sequence
  chemically synthesized
catggctgatggctacggtgac

SEQ ID NO: 927398 - DNA, 22 bp, Artificial Sequence
  chemically synthesized
atggctgatggctacggtgact

SEQ ID NO: 927399 - DNA, 22 bp, Artificial Sequence
  chemically synthesized
cacaattaggttgtaaaagtca

SEQ ID NO: 927400 - DNA, 22 bp, Artificial Sequence
  chemically synthesized
atggctacggtgacttttacaa

SEQ ID NO: 927401 - DNA, 22 bp, Artificial Sequence
  chemically synthesized
attccacaattaggttgtaaaa

SEQ ID NO: 927402 - DNA, 22 bp, Artificial Sequence
  chemically synthesized
ctgattccacaattaggttgta

SEQ ID NO: 927403 - DNA, 22 bp, Artificial Sequence
  chemically synthesized
cggtgacttttacaacctaatt

SEQ ID NO: 927404 - DNA, 22 bp, Artificial Sequence
  chemically synthesized
ttacaacctaattgtggaatca

SEQ ID NO: 927405 - DNA, 22 bp, Artificial Sequence
  chemically synthesized
tacaacctaattgtggaatcag

SEQ ID NO: 927406 - DNA, 22 bp, Artificial Sequence
  chemically synthesized
acaacctaattgtggaatcagc

SEQ ID NO: 927407 - DNA, 22 bp, Artificial Sequence
  chemically synthesized
caacctaattgtggaatcagca

SEQ ID NO: 927408 - DNA, 22 bp, Artificial Sequence
  chemically synthesized
attgtggaatcagcaatggttt

SEQ ID NO: 927409 - DNA, 22 bp, Artificial Sequence
  chemically synthesized
tggaatcagcaatggttttatt

SEQ ID NO: 927410 - DNA, 22 bp, Artificial Sequence
  chemically synthesized
ggaaaccgaaataataaaacca

SEQ ID NO: 927411 - DNA, 22 bp, Artificial Sequence
  chemically synthesized
gggaaaccgaaataataaaacc

SEQ ID NO: 927412 - DNA, 22 bp, Artificial Sequence
  chemically synthesized
tttgggaaaccgaaataataaa

SEQ ID NO: 927413 - DNA, 22 bp, Artificial Sequence
  chemically synthesized
atttgggaaaccgaaataataa

SEQ ID NO: 927414 - DNA, 22 bp, Artificial Sequence
  chemically synthesized
ttatttgggaaaccgaaataat

SEQ ID NO: 927415 - DNA, 22 bp, Artificial Sequence
  chemically synthesized
tctcttatttgggaaaccgaaa

SEQ ID NO: 927416 - DNA, 22 bp, Artificial Sequence
  chemically synthesized
tatctcttatttgggaaaccga

SEQ ID NO: 927417 - DNA, 22 bp, Artificial Sequence
  chemically synthesized
tattatttcggtttcccaaata

SEQ ID NO: 927418 - DNA, 22 bp, Artificial Sequence
  chemically synthesized
aattctatctcttatttgggaa

SEQ ID NO: 927419 - DNA, 22 bp, Artificial Sequence
  chemically synthesized
attatttcggtttcccaaataa

SEQ ID NO: 927420 - DNA, 22 bp, Artificial Sequence
  chemically synthesized
ttatttcggtttcccaaataag

SEQ ID NO: 927421 - DNA, 22 bp, Artificial Sequence
  chemically synthesized
ttcaattctatctcttatttgg

SEQ ID NO: 927422 - DNA, 22 bp, Artificial Sequence
  chemically synthesized
tttcggtttcccaaataagaga

SEQ ID NO: 927423 - DNA, 22 bp, Artificial Sequence
  chemically synthesized
gctgttcaattctatctcttat

SEQ ID NO: 927424 - DNA, 22 bp, Artificial Sequence
  chemically synthesized
cggtttcccaaataagagatag

SEQ ID NO: 927425 - DNA, 22 bp, Artificial Sequence
  chemically synthesized
agctgttcaattctatctctta

SEQ ID NO: 927426 - DNA, 22 bp, Artificial Sequence
  chemically synthesized
ggtttcccaaataagagataga

SEQ ID NO: 927427 - DNA, 22 bp, Artificial Sequence
  chemically synthesized
ttagctgttcaattctatctct

SEQ ID NO: 927428 - DNA, 22 bp, Artificial Sequence
  chemically synthesized
cccaaataagagatagaattga

SEQ ID NO: 927429 - DNA, 22 bp, Artificial Sequence
  chemically synthesized
actcttagctgttcaattctat

SEQ ID NO: 927430 - DNA, 22 bp, Artificial Sequence
  chemically synthesized
ccaaataagagatagaattgaa

SEQ ID NO: 927431 - DNA, 22 bp, Artificial Sequence
  chemically synthesized
cactcttagctgttcaattcta

SEQ ID NO: 927432 - DNA, 22 bp, Artificial Sequence
  chemically synthesized
cttcactcttagctgttcaatt

SEQ ID NO: 927433 - DNA, 22 bp, Artificial Sequence
  chemically synthesized
ttgcttcactcttagctgttca

SEQ ID NO: 927434 - DNA, 22 bp, Artificial Sequence
  chemically synthesized
aattattgcttcactcttagct

SEQ ID NO: 927435 - DNA, 22 bp, Artificial Sequence
  chemically synthesized
aaattattgcttcactcttagc

SEQ ID NO: 927436 - DNA, 22 bp, Artificial Sequence
  chemically synthesized
taaattattgcttcactcttag

SEQ ID NO: 927437 - DNA, 22 bp, Artificial Sequence
  chemically synthesized
aacagctaagagtgaagcaata

SEQ ID NO: 927438 - DNA, 22 bp, Artificial Sequence
  chemically synthesized
acaattttaaattattgcttca

SEQ ID NO: 927439 - DNA, 22 bp, Artificial Sequence
  chemically synthesized
gatctaacaattttaaattatt

SEQ ID NO: 927440 - DNA, 22 bp, Artificial Sequence
  chemically synthesized
agatctaacaattttaaattat

SEQ ID NO: 927441 - DNA, 22 bp, Artificial Sequence
  chemically synthesized
agagtgaagcaataatttaaaa

SEQ ID NO: 927442 - DNA, 22 bp, Artificial Sequence
  chemically synthesized
tacaaatgagatttagatctaa

SEQ ID NO: 927443 - DNA, 22 bp, Artificial Sequence
  chemically synthesized
tatacaaatgagatttagatct

SEQ ID NO: 927444 - DNA, 22 bp, Artificial Sequence
  chemically synthesized
aaaattgttagatctaaatctc

SEQ ID NO: 927445 - DNA, 22 bp, Artificial Sequence
  chemically synthesized
aaattgttagatctaaatctca

SEQ ID NO: 927446 - DNA, 22 bp, Artificial Sequence
  chemically synthesized
cgattctatacaaatgagattt

SEQ ID NO: 927447 - DNA, 22 bp, Artificial Sequence
  chemically synthesized
gcgattctatacaaatgagatt

SEQ ID NO: 927448 - DNA, 22 bp, Artificial Sequence
  chemically synthesized
ttagatctaaatctcatttgta

SEQ ID NO: 927449 - DNA, 22 bp, Artificial Sequence
  chemically synthesized
atttgcgattctatacaaatga

SEQ ID NO: 927450 - DNA, 22 bp, Artificial Sequence
  chemically synthesized
gatctaaatctcatttgtatag

SEQ ID NO: 927451 - DNA, 22 bp, Artificial Sequence
  chemically synthesized
aatctcatttgtatagaatcgc

SEQ ID NO: 927452 - DNA, 22 bp, Artificial Sequence
  chemically synthesized
aaagccctgatttgcgattcta

SEQ ID NO: 927453 - DNA, 22 bp, Artificial Sequence
  chemically synthesized
atttgtatagaatcgcaaatca

SEQ ID NO: 927454 - DNA, 22 bp, Artificial Sequence
  chemically synthesized
gtatagaatcgcaaatcagggc

SEQ ID NO: 927455 - DNA, 22 bp, Artificial Sequence
  chemically synthesized
tatagaatcgcaaatcagggct

SEQ ID NO: 927456 - DNA, 22 bp, Artificial Sequence
  chemically synthesized
aaaaaacctgaaagccctgatt

SEQ ID NO: 927457 - DNA, 22 bp, Artificial Sequence
  chemically synthesized
acaaaattaaaaaaacctgaaa

SEQ ID NO: 927458 - DNA, 22 bp, Artificial Sequence
  chemically synthesized
cacaaaattaaaaaaacctgaa

SEQ ID NO: 927459 - DNA, 22 bp, Artificial Sequence
  chemically synthesized
tcacaaaattaaaaaaacctga

SEQ ID NO: 927460 - DNA, 22 bp, Artificial Sequence
  chemically synthesized
tttcacaaaattaaaaaaacct

SEQ ID NO: 927461 - DNA, 22 bp, Artificial Sequence
  chemically synthesized
ctttcacaaaattaaaaaaacc

SEQ ID NO: 927462 - DNA, 22 bp, Artificial Sequence
  chemically synthesized
ttctttcacaaaattaaaaaaa

SEQ ID NO: 927463 - DNA, 22 bp, Artificial Sequence
  chemically synthesized
tcaggtttttttaattttgtga

SEQ ID NO: 927464 - DNA, 22 bp, Artificial Sequence
  chemically synthesized
caggtttttttaattttgtgaa

SEQ ID NO: 927465 - DNA, 22 bp, Artificial Sequence
  chemically synthesized
aggtttttttaattttgtgaaa

SEQ ID NO: 927466 - DNA, 22 bp, Artificial Sequence
  chemically synthesized
tgtaatgagctcttctttcaca

SEQ ID NO: 927467 - DNA, 22 bp, Artificial Sequence
  chemically synthesized
ttttaattttgtgaaagaagag

SEQ ID NO: 927468 - DNA, 22 bp, Artificial Sequence
  chemically synthesized
tttaattttgtgaaagaagagc

SEQ ID NO: 927469 - DNA, 22 bp, Artificial Sequence
  chemically synthesized
ttaattttgtgaaagaagagct

SEQ ID NO: 927470 - DNA, 22 bp, Artificial Sequence
  chemically synthesized
taattttgtgaaagaagagctc

SEQ ID NO: 927471 - DNA, 22 bp, Artificial Sequence
  chemically synthesized
aattttgtgaaagaagagctca

SEQ ID NO: 927472 - DNA, 22 bp, Artificial Sequence
  chemically synthesized
attttgtgaaagaagagctcat

SEQ ID NO: 927473 - DNA, 22 bp, Artificial Sequence
  chemically synthesized
tgtgaaagaagagctcattaca

SEQ ID NO: 927474 - DNA, 22 bp, Artificial Sequence
  chemically synthesized
gtgaaagaagagctcattacac

SEQ ID NO: 927475 - DNA, 22 bp, Artificial Sequence
  chemically synthesized
tgaaagaagagctcattacaca

SEQ ID NO: 927476 - DNA, 22 bp, Artificial Sequence
  chemically synthesized
atacaaatgcagtagactgtgt

SEQ ID NO: 927477 - DNA, 22 bp, Artificial Sequence
  chemically synthesized
tcatacaaatgcagtagactgt

SEQ ID NO: 927478 - DNA, 22 bp, Artificial Sequence
  chemically synthesized
ctcatacaaatgcagtagactg

SEQ ID NO: 927479 - DNA, 22 bp, Artificial Sequence
  chemically synthesized
attacacagtctactgcatttg

SEQ ID NO: 927480 - DNA, 22 bp, Artificial Sequence
  chemically synthesized
caaaaccttctcatacaaatgc

SEQ ID NO: 927481 - DNA, 22 bp, Artificial Sequence
  chemically synthesized
cacagtctactgcatttgtatg

SEQ ID NO: 927482 - DNA, 22 bp, Artificial Sequence
  chemically synthesized
gttgcaaaaccttctcatacaa

SEQ ID NO: 927483 - DNA, 22 bp, Artificial Sequence
  chemically synthesized
ctggttgcaaaaccttctcata

SEQ ID NO: 927484 - DNA, 22 bp, Artificial Sequence
  chemically synthesized
tcctggttgcaaaaccttctca

SEQ ID NO: 927485 - DNA, 22 bp, Artificial Sequence
  chemically synthesized
ctgcatttgtatgagaaggttt

SEQ ID NO: 927486 - DNA, 22 bp, Artificial Sequence
  chemically synthesized
ctcctggttgcaaaaccttctc

SEQ ID NO: 927487 - DNA, 22 bp, Artificial Sequence
  chemically synthesized
catttgtatgagaaggttttgc

SEQ ID NO: 927488 - DNA, 22 bp, Artificial Sequence
  chemically synthesized
gtatgagaaggttttgcaacca

SEQ ID NO: 927489 - DNA, 22 bp, Artificial Sequence
  chemically synthesized
tatgagaaggttttgcaaccag

SEQ ID NO: 927490 - DNA, 22 bp, Artificial Sequence
  chemically synthesized
taaatatttctcctggttgcaa

SEQ ID NO: 927491 - DNA, 22 bp, Artificial Sequence
  chemically synthesized
tgcaaccaggagaaatatttac

SEQ ID NO: 927492 - DNA, 22 bp, Artificial Sequence
  chemically synthesized
gcaaccaggagaaatatttaca

SEQ ID NO: 927493 - DNA, 22 bp, Artificial Sequence
  chemically synthesized
caaccaggagaaatatttacag

SEQ ID NO: 927494 - DNA, 22 bp, Artificial Sequence
  chemically synthesized
agcaggccatgcactgtaaata

SEQ ID NO: 927495 - DNA, 22 bp, Artificial Sequence
  chemically synthesized
gagcaggccatgcactgtaaat

SEQ ID NO: 927496 - DNA, 22 bp, Artificial Sequence
  chemically synthesized
cttgagcaggccatgcactgta

SEQ ID NO: 927497 - DNA, 22 bp, Artificial Sequence
  chemically synthesized
tccttgagcaggccatgcactg

SEQ ID NO: 927498 - DNA, 22 bp, Artificial Sequence
  chemically synthesized
aaaactctccttgagcaggcca

SEQ ID NO: 927499 - DNA, 22 bp, Artificial Sequence
  chemically synthesized
acagtgcatggcctgctcaagg

SEQ ID NO: 927500 - DNA, 22 bp, Artificial Sequence
  chemically synthesized
cagtgcatggcctgctcaagga

SEQ ID NO: 927501 - DNA, 22 bp, Artificial Sequence
  chemically synthesized
tcactgaaaactctccttgagc

SEQ ID NO: 927502 - DNA, 22 bp, Artificial Sequence
  chemically synthesized
atcactgaaaactctccttgag

SEQ ID NO: 927503 - DNA, 22 bp, Artificial Sequence
  chemically synthesized
tatcactgaaaactctccttga

SEQ ID NO: 927504 - DNA, 22 bp, Artificial Sequence
  chemically synthesized
tgctttatcactgaaaactctc

SEQ ID NO: 927505 - DNA, 22 bp, Artificial Sequence
  chemically synthesized
atgctttatcactgaaaactct

SEQ ID NO: 927506 - DNA, 22 bp, Artificial Sequence
  chemically synthesized
ttatgctttatcactgaaaact

SEQ ID NO: 927507 - DNA, 22 bp, Artificial Sequence
  chemically synthesized
cttatgctttatcactgaaaac

SEQ ID NO: 927508 - DNA, 22 bp, Artificial Sequence
  chemically synthesized
tcttatgctttatcactgaaaa

SEQ ID NO: 927509 - DNA, 22 bp, Artificial Sequence
  chemically synthesized
ctcaaggagagttttcagtgat

SEQ ID NO: 927510 - DNA, 22 bp, Artificial Sequence
  chemically synthesized
tttcttatgctttatcactgaa

SEQ ID NO: 927511 - DNA, 22 bp, Artificial Sequence
  chemically synthesized
ctttcttatgctttatcactga

SEQ ID NO: 927512 - DNA, 22 bp, Artificial Sequence
  chemically synthesized
aaggagagttttcagtgataaa

SEQ ID NO: 927513 - DNA, 22 bp, Artificial Sequence
  chemically synthesized
tctttcttatgctttatcactg

SEQ ID NO: 927514 - DNA, 22 bp, Artificial Sequence
  chemically synthesized
ttctttcttatgctttatcact

SEQ ID NO: 927515 - DNA, 22 bp, Artificial Sequence
  chemically synthesized
tttttctttcttatgctttatc

SEQ ID NO: 927516 - DNA, 22 bp, Artificial Sequence
  chemically synthesized
atttttctttcttatgctttat

SEQ ID NO: 927517 - DNA, 22 bp, Artificial Sequence
  chemically synthesized
tcagtgataaagcataagaaag

SEQ ID NO: 927518 - DNA, 22 bp, Artificial Sequence
  chemically synthesized
cagtgataaagcataagaaaga

SEQ ID NO: 927519 - DNA, 22 bp, Artificial Sequence
  chemically synthesized
atcccttatttttctttcttat

SEQ ID NO: 927520 - DNA, 22 bp, Artificial Sequence
  chemically synthesized
agtgataaagcataagaaagaa

SEQ ID NO: 927521 - DNA, 22 bp, Artificial Sequence
  chemically synthesized
gatcccttatttttctttctta

SEQ ID NO: 927522 - DNA, 22 bp, Artificial Sequence
  chemically synthesized
tgatcccttatttttctttctt

SEQ ID NO: 927523 - DNA, 22 bp, Artificial Sequence
  chemically synthesized
ttttgatcccttatttttcttt

SEQ ID NO: 927524 - DNA, 22 bp, Artificial Sequence
  chemically synthesized
tgttttgatcccttatttttct

SEQ ID NO: 927525 - DNA, 22 bp, Artificial Sequence
  chemically synthesized
ctgttttgatcccttatttttc

SEQ ID NO: 927526 - DNA, 22 bp, Artificial Sequence
  chemically synthesized
tctgttttgatcccttattttt

SEQ ID NO: 927527 - DNA, 22 bp, Artificial Sequence
  chemically synthesized
ctttctgttttgatcccttatt

SEQ ID NO: 927528 - DNA, 22 bp, Artificial Sequence
  chemically synthesized
ctactttctgttttgatccctt

SEQ ID NO: 927529 - DNA, 22 bp, Artificial Sequence
  chemically synthesized
agaaaacaccacatacaagcta

SEQ ID NO: 927530 - DNA, 22 bp, Artificial Sequence
  chemically synthesized
cagctcagaaaacaccacatac

SEQ ID NO: 927531 - DNA, 22 bp, Artificial Sequence
  chemically synthesized
ccagctcagaaaacaccacata

SEQ ID NO: 927532 - DNA, 22 bp, Artificial Sequence
  chemically synthesized
tccagctcagaaaacaccacat

SEQ ID NO: 927533 - DNA, 22 bp, Artificial Sequence
  chemically synthesized
ttccagctcagaaaacaccaca

SEQ ID NO: 927534 - DNA, 22 bp, Artificial Sequence
  chemically synthesized
tcttttccagctcagaaaacac

SEQ ID NO: 927535 - DNA, 22 bp, Artificial Sequence
  chemically synthesized
gtatgtggtgttttctgagctg

SEQ ID NO: 927536 - DNA, 22 bp, Artificial Sequence
  chemically synthesized
tatgtggtgttttctgagctgg

SEQ ID NO: 927537 - DNA, 22 bp, Artificial Sequence
  chemically synthesized
taaacccagtgttatcttttcc

SEQ ID NO: 927538 - DNA, 22 bp, Artificial Sequence
  chemically synthesized
gtaaacccagtgttatcttttc

SEQ ID NO: 927539 - DNA, 22 bp, Artificial Sequence
  chemically synthesized
tgtaaacccagtgttatctttt

SEQ ID NO: 927540 - DNA, 22 bp, Artificial Sequence
  chemically synthesized
tctgagctggaaaagataacac

SEQ ID NO: 927541 - DNA, 22 bp, Artificial Sequence
  chemically synthesized
ctgagctggaaaagataacact

SEQ ID NO: 927542 - DNA, 22 bp, Artificial Sequence
  chemically synthesized
tgagctggaaaagataacactg

SEQ ID NO: 927543 - DNA, 22 bp, Artificial Sequence
  chemically synthesized
attttgtaaacccagtgttatc

SEQ ID NO: 927544 - DNA, 22 bp, Artificial Sequence
  chemically synthesized
aattttgtaaacccagtgttat

SEQ ID NO: 927545 - DNA, 22 bp, Artificial Sequence
  chemically synthesized
agctggaaaagataacactggg

SEQ ID NO: 927546 - DNA, 22 bp, Artificial Sequence
  chemically synthesized
catttaattttgtaaacccagt

SEQ ID NO: 927547 - DNA, 22 bp, Artificial Sequence
  chemically synthesized
gaaaagataacactgggtttac

SEQ ID NO: 927548 - DNA, 22 bp, Artificial Sequence
  chemically synthesized
acatttaattttgtaaacccag

SEQ ID NO: 927549 - DNA, 22 bp, Artificial Sequence
  chemically synthesized
tacatttaattttgtaaaccca

SEQ ID NO: 927550 - DNA, 22 bp, Artificial Sequence
  chemically synthesized
agattttacatttaattttgta

SEQ ID NO: 927551 - DNA, 22 bp, Artificial Sequence
  chemically synthesized
attgagattttacatttaattt

SEQ ID NO: 927552 - DNA, 22 bp, Artificial Sequence
  chemically synthesized
ggtttacaaaattaaatgtaaa

SEQ ID NO: 927553 - DNA, 22 bp, Artificial Sequence
  chemically synthesized
acaaaattaaatgtaaaatctc

SEQ ID NO: 927554 - DNA, 22 bp, Artificial Sequence
  chemically synthesized
caaaattaaatgtaaaatctca

SEQ ID NO: 927555 - DNA, 22 bp, Artificial Sequence
  chemically synthesized
tgtgaataaagttgattgagat

SEQ ID NO: 927556 - DNA, 22 bp, Artificial Sequence
  chemically synthesized
aatgtaaaatctcaatcaactt

SEQ ID NO: 927557 - DNA, 22 bp, Artificial Sequence
  chemically synthesized
actgtgtgaataaagttgattg

SEQ ID NO: 927558 - DNA, 22 bp, Artificial Sequence
  chemically synthesized
ttcactgtgtgaataaagttga

SEQ ID NO: 927559 - DNA, 22 bp, Artificial Sequence
  chemically synthesized
atgttgttcactgtgtgaataa

SEQ ID NO: 927560 - DNA, 22 bp, Artificial Sequence
  chemically synthesized
aatcaactttattcacacagtg

SEQ ID NO: 927561 - DNA, 22 bp, Artificial Sequence
  chemically synthesized
attaatgttgttcactgtgtga

SEQ ID NO: 927562 - DNA, 22 bp, Artificial Sequence
  chemically synthesized
aaattaattaatgttgttcact

SEQ ID NO: 927563 - DNA, 22 bp, Artificial Sequence
  chemically synthesized
tattcacacagtgaacaacatt

SEQ ID NO: 927564 - DNA, 22 bp, Artificial Sequence
  chemically synthesized
attcacacagtgaacaacatta

SEQ ID NO: 927565 - DNA, 22 bp, Artificial Sequence
  chemically synthesized
ttcacacagtgaacaacattaa

SEQ ID NO: 927566 - DNA, 22 bp, Artificial Sequence
  chemically synthesized
acacagtgaacaacattaatta

SEQ ID NO: 927567 - DNA, 22 bp, Artificial Sequence
  chemically synthesized
tagaattaaaattaattaatgt

SEQ ID NO: 927568 - DNA, 22 bp, Artificial Sequence
  chemically synthesized
gaagctatagaattaaaattaa

SEQ ID NO: 927569 - DNA, 22 bp, Artificial Sequence
  chemically synthesized
agaagctatagaattaaaatta

SEQ ID NO: 927570 - DNA, 22 bp, Artificial Sequence
  chemically synthesized
aaatatttagaagctatagaat

SEQ ID NO: 927571 - DNA, 22 bp, Artificial Sequence
  chemically synthesized
aaaatatttagaagctatagaa

SEQ ID NO: 927572 - DNA, 22 bp, Artificial Sequence
  chemically synthesized
attaattttaattctatagctt

SEQ ID NO: 927573 - DNA, 22 bp, Artificial Sequence
  chemically synthesized
attttaattctatagcttctaa

SEQ ID NO: 927574 - DNA, 22 bp, Artificial Sequence
  chemically synthesized
agtacttaaaatatttagaagc

SEQ ID NO: 927575 - DNA, 22 bp, Artificial Sequence
  chemically synthesized
taattctatagcttctaaatat

SEQ ID NO: 927576 - DNA, 22 bp, Artificial Sequence
  chemically synthesized
aattctatagcttctaaatatt

SEQ ID NO: 927577 - DNA, 22 bp, Artificial Sequence
  chemically synthesized
attctatagcttctaaatattt

SEQ ID NO: 927578 - DNA, 22 bp, Artificial Sequence
  chemically synthesized
tatagcttctaaatattttaag

SEQ ID NO: 927579 - DNA, 22 bp, Artificial Sequence
  chemically synthesized
tagcttctaaatattttaagta

SEQ ID NO: 927580 - DNA, 22 bp, Artificial Sequence
  chemically synthesized
gtaatgaataattcagtactta

SEQ ID NO: 927581 - DNA, 22 bp, Artificial Sequence
  chemically synthesized
ctaaatattttaagtactgaat

SEQ ID NO: 927582 - DNA, 22 bp, Artificial Sequence
  chemically synthesized
taaatattttaagtactgaatt

SEQ ID NO: 927583 - DNA, 22 bp, Artificial Sequence
  chemically synthesized
ttggtaatgaataattcagtac

SEQ ID NO: 927584 - DNA, 22 bp, Artificial Sequence
  chemically synthesized
attggtaatgaataattcagta

SEQ ID NO: 927585 - DNA, 22 bp, Artificial Sequence
  chemically synthesized
aatattttaagtactgaattat

SEQ ID NO: 927586 - DNA, 22 bp, Artificial Sequence
  chemically synthesized
tattggtaatgaataattcagt

SEQ ID NO: 927587 - DNA, 22 bp, Artificial Sequence
  chemically synthesized
taagtactgaattattcattac

SEQ ID NO: 927588 - DNA, 22 bp, Artificial Sequence
  chemically synthesized
gaaattttattggtaatgaata

SEQ ID NO: 927589 - DNA, 22 bp, Artificial Sequence
  chemically synthesized
aagtactgaattattcattacc

SEQ ID NO: 927590 - DNA, 22 bp, Artificial Sequence
  chemically synthesized
ggaaattttattggtaatgaat

SEQ ID NO: 927591 - DNA, 22 bp, Artificial Sequence
  chemically synthesized
agtactgaattattcattacca

SEQ ID NO: 927592 - DNA, 22 bp, Artificial Sequence
  chemically synthesized
aattattcattaccaataaaat

SEQ ID NO: 927593 - DNA, 22 bp, Artificial Sequence
  chemically synthesized
ttcattaccaataaaatttcca

SEQ ID NO: 927594 - DNA, 22 bp, Artificial Sequence
  chemically synthesized
attaccaataaaatttccaagc

SEQ ID NO: 927595 - DNA, 22 bp, Artificial Sequence
  chemically synthesized
atatgatatcaaagcttggaaa

SEQ ID NO: 927596 - DNA, 22 bp, Artificial Sequence
  chemically synthesized
ccaataaaatttccaagctttg

SEQ ID NO: 927597 - DNA, 22 bp, Artificial Sequence
  chemically synthesized
ccaagctttgatatcatattaa

SEQ ID NO: 927598 - DNA, 22 bp, Artificial Sequence
  chemically synthesized
caagctttgatatcatattaat

SEQ ID NO: 927599 - DNA, 22 bp, Artificial Sequence
  chemically synthesized
tgacagcagtacattaatatga

SEQ ID NO: 927600 - DNA, 22 bp, Artificial Sequence
  chemically synthesized
tgatatcatattaatgtactgc

SEQ ID NO: 927601 - DNA, 22 bp, Artificial Sequence
  chemically synthesized
gatatcatattaatgtactgct

SEQ ID NO: 927602 - DNA, 22 bp, Artificial Sequence
  chemically synthesized
atatcatattaatgtactgctg

SEQ ID NO: 927603 - DNA, 22 bp, Artificial Sequence
  chemically synthesized
atgtactgctgtcataggcatt

SEQ ID NO: 927604 - DNA, 22 bp, Artificial Sequence
  chemically synthesized
ccagagaaatagataagaatgc

SEQ ID NO: 927605 - DNA, 22 bp, Artificial Sequence
  chemically synthesized
ctgtcataggcattcttatcta

SEQ ID NO: 927606 - DNA, 22 bp, Artificial Sequence
  chemically synthesized
attgccagagaaatagataaga

SEQ ID NO: 927607 - DNA, 22 bp, Artificial Sequence
  chemically synthesized
tcataggcattcttatctattt

SEQ ID NO: 927608 - DNA, 22 bp, Artificial Sequence
  chemically synthesized
gatgttaattgccagagaaata

SEQ ID NO: 927609 - DNA, 22 bp, Artificial Sequence
  chemically synthesized
ttatctatttctctggcaatta

SEQ ID NO: 927610 - DNA, 22 bp, Artificial Sequence
  chemically synthesized
atctatttctctggcaattaac

SEQ ID NO: 927611 - DNA, 22 bp, Artificial Sequence
  chemically synthesized
tctatttctctggcaattaaca

SEQ ID NO: 927612 - DNA, 22 bp, Artificial Sequence
  chemically synthesized
tttctctggcaattaacatcta

SEQ ID NO: 927613 - DNA, 22 bp, Artificial Sequence
  chemically synthesized
tccagaaccaagactagatgtt

SEQ ID NO: 927614 - DNA, 22 bp, Artificial Sequence
  chemically synthesized
ctctggcaattaacatctagtc

SEQ ID NO: 927615 - DNA, 22 bp, Artificial Sequence
  chemically synthesized
gtccagaaccaagactagatgt

SEQ ID NO: 927616 - DNA, 22 bp, Artificial Sequence
  chemically synthesized
tctggcaattaacatctagtct

SEQ ID NO: 927617 - DNA, 22 bp, Artificial Sequence
  chemically synthesized
tgtccagaaccaagactagatg

SEQ ID NO: 927618 - DNA, 22 bp, Artificial Sequence
  chemically synthesized
ttgtccagaaccaagactagat

SEQ ID NO: 927619 - DNA, 22 bp, Artificial Sequence
  chemically synthesized
tggcaattaacatctagtcttg

SEQ ID NO: 927620 - DNA, 22 bp, Artificial Sequence
  chemically synthesized
tttgtccagaaccaagactaga

SEQ ID NO: 927621 - DNA, 22 bp, Artificial Sequence
  chemically synthesized
gcaattaacatctagtcttggt

SEQ ID NO: 927622 - DNA, 22 bp, Artificial Sequence
  chemically synthesized
tttttgtccagaaccaagacta

SEQ ID NO: 927623 - DNA, 22 bp, Artificial Sequence
  chemically synthesized
ctttttgtccagaaccaagact

SEQ ID NO: 927624 - DNA, 22 bp, Artificial Sequence
  chemically synthesized
tctttttgtccagaaccaagac

SEQ ID NO: 927625 - DNA, 22 bp, Artificial Sequence
  chemically synthesized
acatctagtcttggttctggac

SEQ ID NO: 927626 - DNA, 22 bp, Artificial Sequence
  chemically synthesized
tgattttctttttgtccagaac

SEQ ID NO: 927627 - DNA, 22 bp, Artificial Sequence
  chemically synthesized
attatgattttctttttgtcca

SEQ ID NO: 927628 - DNA, 22 bp, Artificial Sequence
  chemically synthesized
aattatgattttctttttgtcc

SEQ ID NO: 927629 - DNA, 22 bp, Artificial Sequence
  chemically synthesized
gtcttggttctggacaaaaaga

SEQ ID NO: 927630 - DNA, 22 bp, Artificial Sequence
  chemically synthesized
ggttctggacaaaaagaaaatc

SEQ ID NO: 927631 - DNA, 22 bp, Artificial Sequence
  chemically synthesized
gttctggacaaaaagaaaatca

SEQ ID NO: 927632 - DNA, 22 bp, Artificial Sequence
  chemically synthesized
tggacaaaaagaaaatcataat

SEQ ID NO: 927633 - DNA, 22 bp, Artificial Sequence
  chemically synthesized
gacaaaaagaaaatcataatta

SEQ ID NO: 927634 - DNA, 22 bp, Artificial Sequence
  chemically synthesized
tgatgaataatccaacagattt

SEQ ID NO: 927635 - DNA, 22 bp, Artificial Sequence
  chemically synthesized
actatgatgaataatccaacag

SEQ ID NO: 927636 - DNA, 22 bp, Artificial Sequence
  chemically synthesized
taactatgatgaataatccaac

SEQ ID NO: 927637 - DNA, 22 bp, Artificial Sequence
  chemically synthesized
ctaactatgatgaataatccaa

SEQ ID NO: 927638 - DNA, 22 bp, Artificial Sequence
  chemically synthesized
tctaactatgatgaataatcca

SEQ ID NO: 927639 - DNA, 22 bp, Artificial Sequence
  chemically synthesized
aatctgttggattattcatcat

SEQ ID NO: 927640 - DNA, 22 bp, Artificial Sequence
  chemically synthesized
ttggattattcatcatagttag

SEQ ID NO: 927641 - DNA, 22 bp, Artificial Sequence
  chemically synthesized
gattattcatcatagttagaaa

SEQ ID NO: 927642 - DNA, 22 bp, Artificial Sequence
  chemically synthesized
ttcatcatagttagaaagctta

SEQ ID NO: 927643 - DNA, 22 bp, Artificial Sequence
  chemically synthesized
gaatcaaaacacaataagcttt

SEQ ID NO: 927644 - DNA, 22 bp, Artificial Sequence
  chemically synthesized
atcatagttagaaagcttattg

SEQ ID NO: 927645 - DNA, 22 bp, Artificial Sequence
  chemically synthesized
atattggaatcaaaacacaata

SEQ ID NO: 927646 - DNA, 22 bp, Artificial Sequence
  chemically synthesized
aatattggaatcaaaacacaat

SEQ ID NO: 927647 - DNA, 22 bp, Artificial Sequence
  chemically synthesized
gaaagcttattgtgttttgatt

SEQ ID NO: 927648 - DNA, 22 bp, Artificial Sequence
  chemically synthesized
attgtgttttgattccaatatt

SEQ ID NO: 927649 - DNA, 22 bp, Artificial Sequence
  chemically synthesized
ttgtgttttgattccaatatta

SEQ ID NO: 927650 - DNA, 22 bp, Artificial Sequence
  chemically synthesized
agaatgaatgcttaatattgga

SEQ ID NO: 927651 - DNA, 22 bp, Artificial Sequence
  chemically synthesized
tgttttgattccaatattaagc

SEQ ID NO: 927652 - DNA, 22 bp, Artificial Sequence
  chemically synthesized
ttaagaatgaatgcttaatatt

SEQ ID NO: 927653 - DNA, 22 bp, Artificial Sequence
  chemically synthesized
attaagaatgaatgcttaatat

SEQ ID NO: 927654 - DNA, 22 bp, Artificial Sequence
  chemically synthesized
ttattaagaatgaatgcttaat

SEQ ID NO: 927655 - DNA, 22 bp, Artificial Sequence
  chemically synthesized
cttattaagaatgaatgcttaa

SEQ ID NO: 927656 - DNA, 22 bp, Artificial Sequence
  chemically synthesized
tgattccaatattaagcattca

SEQ ID NO: 927657 - DNA, 22 bp, Artificial Sequence
  chemically synthesized
gattccaatattaagcattcat

SEQ ID NO: 927658 - DNA, 22 bp, Artificial Sequence
  chemically synthesized
attccaatattaagcattcatt

SEQ ID NO: 927659 - DNA, 22 bp, Artificial Sequence
  chemically synthesized
caatattaagcattcattctta

SEQ ID NO: 927660 - DNA, 22 bp, Artificial Sequence
  chemically synthesized
gatatgcacttcttattaagaa

SEQ ID NO: 927661 - DNA, 22 bp, Artificial Sequence
  chemically synthesized
agcattcattcttaataagaag

SEQ ID NO: 927662 - DNA, 22 bp, Artificial Sequence
  chemically synthesized
attcttaataagaagtgcatat

SEQ ID NO: 927663 - DNA, 22 bp, Artificial Sequence
  chemically synthesized
cccacgggagttagatatgcac

SEQ ID NO: 927664 - DNA, 22 bp, Artificial Sequence
  chemically synthesized
ttaataagaagtgcatatctaa

SEQ ID NO: 927665 - DNA, 22 bp, Artificial Sequence
  chemically synthesized
aataagaagtgcatatctaact

SEQ ID NO: 927666 - DNA, 22 bp, Artificial Sequence
  chemically synthesized
ataagaagtgcatatctaactc

SEQ ID NO: 927667 - DNA, 22 bp, Artificial Sequence
  chemically synthesized
aaaagctccccacgggagttag

SEQ ID NO: 927668 - DNA, 22 bp, Artificial Sequence
  chemically synthesized
gaaaagctccccacgggagtta

SEQ ID NO: 927669 - DNA, 22 bp, Artificial Sequence
  chemically synthesized
tgaaaagctccccacgggagtt

SEQ ID NO: 927670 - DNA, 22 bp, Artificial Sequence
  chemically synthesized
tattttgaaaagctccccacgg

SEQ ID NO: 927671 - DNA, 22 bp, Artificial Sequence
  chemically synthesized
atattttgaaaagctccccacg

SEQ ID NO: 927672 - DNA, 22 bp, Artificial Sequence
  chemically synthesized
tatattttgaaaagctccccac

SEQ ID NO: 927673 - DNA, 22 bp, Artificial Sequence
  chemically synthesized
ttatattttgaaaagctcccca

SEQ ID NO: 927674 - DNA, 22 bp, Artificial Sequence
  chemically synthesized
actcccgtggggagcttttcaa

SEQ ID NO: 927675 - DNA, 22 bp, Artificial Sequence
  chemically synthesized
ggcttttatattttgaaaagct

SEQ ID NO: 927676 - DNA, 22 bp, Artificial Sequence
  chemically synthesized
tgggcttttatattttgaaaag

SEQ ID NO: 927677 - DNA, 22 bp, Artificial Sequence
  chemically synthesized
ccgtggggagcttttcaaaata

SEQ ID NO: 927678 - DNA, 22 bp, Artificial Sequence
  chemically synthesized
gaatggaattctgggcttttat

SEQ ID NO: 927679 - DNA, 22 bp, Artificial Sequence
  chemically synthesized
agaatggaattctgggctttta

SEQ ID NO: 927680 - DNA, 22 bp, Artificial Sequence
  chemically synthesized
ttcaaaatataaaagcccagaa

SEQ ID NO: 927681 - DNA, 22 bp, Artificial Sequence
  chemically synthesized
tcaaaatataaaagcccagaat

SEQ ID NO: 927682 - DNA, 22 bp, Artificial Sequence
  chemically synthesized
caaaatataaaagcccagaatt

SEQ ID NO: 927683 - DNA, 22 bp, Artificial Sequence
  chemically synthesized
aaaatataaaagcccagaattc

SEQ ID NO: 927684 - DNA, 22 bp, Artificial Sequence
  chemically synthesized
agtagacttagaatggaattct

SEQ ID NO: 927685 - DNA, 22 bp, Artificial Sequence
  chemically synthesized
attcagtagacttagaatggaa

SEQ ID NO: 927686 - DNA, 22 bp, Artificial Sequence
  chemically synthesized
tgattcagtagacttagaatgg

SEQ ID NO: 927687 - DNA, 22 bp, Artificial Sequence
  chemically synthesized
cattctaagtctactgaatcag

SEQ ID NO: 927688 - DNA, 22 bp, Artificial Sequence
  chemically synthesized
tccccagaaattctgattcagt

SEQ ID NO: 927689 - DNA, 22 bp, Artificial Sequence
  chemically synthesized
gtccccagaaattctgattcag

SEQ ID NO: 927690 - DNA, 22 bp, Artificial Sequence
  chemically synthesized
tgtccccagaaattctgattca

SEQ ID NO: 927691 - DNA, 22 bp, Artificial Sequence
  chemically synthesized
taagtctactgaatcagaattt

SEQ ID NO: 927692 - DNA, 22 bp, Artificial Sequence
  chemically synthesized
agtctactgaatcagaatttct

SEQ ID NO: 927693 - DNA, 22 bp, Artificial Sequence
  chemically synthesized
atatacctttgtccccagaaat

SEQ ID NO: 927694 - DNA, 22 bp, Artificial Sequence
  chemically synthesized
catatacctttgtccccagaaa

SEQ ID NO: 927695 - DNA, 22 bp, Artificial Sequence
  chemically synthesized
ctgaatcagaatttctggggac

SEQ ID NO: 927696 - DNA, 22 bp, Artificial Sequence
  chemically synthesized
tcatatacctttgtccccagaa

SEQ ID NO: 927697 - DNA, 22 bp, Artificial Sequence
  chemically synthesized
tttcatatacctttgtccccag

SEQ ID NO: 927698 - DNA, 22 bp, Artificial Sequence
  chemically synthesized
aatcagaatttctggggacaaa

SEQ ID NO: 927699 - DNA, 22 bp, Artificial Sequence
  chemically synthesized
gtgtatctctttcatatacctt

SEQ ID NO: 927700 - DNA, 22 bp, Artificial Sequence
  chemically synthesized
agtgtatctctttcatatacct

SEQ ID NO: 927701 - DNA, 22 bp, Artificial Sequence
  chemically synthesized
tagtgtatctctttcatatacc

SEQ ID NO: 927702 - DNA, 22 bp, Artificial Sequence
  chemically synthesized
ctggggacaaaggtatatgaaa

SEQ ID NO: 927703 - DNA, 22 bp, Artificial Sequence
  chemically synthesized
ttagtgtatctctttcatatac

SEQ ID NO: 927704 - DNA, 22 bp, Artificial Sequence
  chemically synthesized
tggggacaaaggtatatgaaag

SEQ ID NO: 927705 - DNA, 22 bp, Artificial Sequence
  chemically synthesized
tttagtgtatctctttcatata

SEQ ID NO: 927706 - DNA, 22 bp, Artificial Sequence
  chemically synthesized
ttttagtgtatctctttcatat

SEQ ID NO: 927707 - DNA, 22 bp, Artificial Sequence
  chemically synthesized
gggacaaaggtatatgaaagag

SEQ ID NO: 927708 - DNA, 22 bp, Artificial Sequence
  chemically synthesized
ttttttagtgtatctctttcat

SEQ ID NO: 927709 - DNA, 22 bp, Artificial Sequence
  chemically synthesized
cttttttagtgtatctctttca

SEQ ID NO: 927710 - DNA, 22 bp, Artificial Sequence
  chemically synthesized
tcttttttagtgtatctctttc

SEQ ID NO: 927711 - DNA, 22 bp, Artificial Sequence
  chemically synthesized
ccctttcttttttagtgtatct

SEQ ID NO: 927712 - DNA, 22 bp, Artificial Sequence
  chemically synthesized
taacctcccctttcttttttag

SEQ ID NO: 927713 - DNA, 22 bp, Artificial Sequence
  chemically synthesized
gtaacctcccctttctttttta

SEQ ID NO: 927714 - DNA, 22 bp, Artificial Sequence
  chemically synthesized
cacatgtttgtaacctcccctt

SEQ ID NO: 927715 - DNA, 22 bp, Artificial Sequence
  chemically synthesized
tgcacatgtttgtaacctcccc

SEQ ID NO: 927716 - DNA, 22 bp, Artificial Sequence
  chemically synthesized
tctgcacatgtttgtaacctcc

SEQ ID NO: 927717 - DNA, 22 bp, Artificial Sequence
  chemically synthesized
aaaaagaaaggggaggttacaa

SEQ ID NO: 927718 - DNA, 22 bp, Artificial Sequence
  chemically synthesized
ccaactctctgcacatgtttgt

SEQ ID NO: 927719 - DNA, 22 bp, Artificial Sequence
  chemically synthesized
cccaactctctgcacatgtttg

SEQ ID NO: 927720 - DNA, 22 bp, Artificial Sequence
  chemically synthesized
cttcccaactctctgcacatgt

SEQ ID NO: 927721 - DNA, 22 bp, Artificial Sequence
  chemically synthesized
ctgcttcccaactctctgcaca

SEQ ID NO: 927722 - DNA, 22 bp, Artificial Sequence
  chemically synthesized
cctgcttcccaactctctgcac

SEQ ID NO: 927723 - DNA, 22 bp, Artificial Sequence
  chemically synthesized
caaacatgtgcagagagttggg

SEQ ID NO: 927724 - DNA, 22 bp, Artificial Sequence
  chemically synthesized
catgtccttcctgcttcccaac

SEQ ID NO: 927725 - DNA, 22 bp, Artificial Sequence
  chemically synthesized
tacatgtccttcctgcttccca

SEQ ID NO: 927726 - DNA, 22 bp, Artificial Sequence
  chemically synthesized
ggaagcaggaaggacatgtaga

SEQ ID NO: 927727 - DNA, 22 bp, Artificial Sequence
  chemically synthesized
aaaataatatagtaattctaca

SEQ ID NO: 927728 - DNA, 22 bp, Artificial Sequence
  chemically synthesized
aaaagcagaagagaagttgaaa

SEQ ID NO: 927729 - DNA, 22 bp, Artificial Sequence
  chemically synthesized
aaaaagcagaagagaagttgaa

SEQ ID NO: 927730 - DNA, 22 bp, Artificial Sequence
  chemically synthesized
ctatattattttcaacttctct

SEQ ID NO: 927731 - DNA, 22 bp, Artificial Sequence
  chemically synthesized
acttaaaaagcagaagagaagt

SEQ ID NO: 927732 - DNA, 22 bp, Artificial Sequence
  chemically synthesized
tattattttcaacttctcttct

SEQ ID NO: 927733 - DNA, 22 bp, Artificial Sequence
  chemically synthesized
gacttaaaaagcagaagagaag

SEQ ID NO: 927734 - DNA, 22 bp, Artificial Sequence
  chemically synthesized
tgacttaaaaagcagaagagaa

SEQ ID NO: 927735 - DNA, 22 bp, Artificial Sequence
  chemically synthesized
ttgacttaaaaagcagaagaga

SEQ ID NO: 927736 - DNA, 22 bp, Artificial Sequence
  chemically synthesized
ttttcaacttctcttctgcttt

SEQ ID NO: 927737 - DNA, 22 bp, Artificial Sequence
  chemically synthesized
tcaacttctcttctgcttttta

SEQ ID NO: 927738 - DNA, 22 bp, Artificial Sequence
  chemically synthesized
caacttctcttctgctttttaa

SEQ ID NO: 927739 - DNA, 22 bp, Artificial Sequence
  chemically synthesized
aacttctcttctgctttttaag

SEQ ID NO: 927740 - DNA, 22 bp, Artificial Sequence
  chemically synthesized
ggaacagcttttgacttaaaaa

SEQ ID NO: 927741 - DNA, 22 bp, Artificial Sequence
  chemically synthesized
aggaacagcttttgacttaaaa

SEQ ID NO: 927742 - DNA, 22 bp, Artificial Sequence
  chemically synthesized
ctcttctgctttttaagtcaaa

SEQ ID NO: 927743 - DNA, 22 bp, Artificial Sequence
  chemically synthesized
tcttctgctttttaagtcaaaa

SEQ ID NO: 927744 - DNA, 22 bp, Artificial Sequence
  chemically synthesized
ttctgctttttaagtcaaaagc

SEQ ID NO: 927745 - DNA, 22 bp, Artificial Sequence
  chemically synthesized
taatttaggaacagcttttgac

SEQ ID NO: 927746 - DNA, 22 bp, Artificial Sequence
  chemically synthesized
ctgctttttaagtcaaaagctg

SEQ ID NO: 927747 - DNA, 22 bp, Artificial Sequence
  chemically synthesized
tgctttttaagtcaaaagctgt

SEQ ID NO: 927748 - DNA, 22 bp, Artificial Sequence
  chemically synthesized
tataatttaggaacagcttttg

SEQ ID NO: 927749 - DNA, 22 bp, Artificial Sequence
  chemically synthesized
ctataatttaggaacagctttt

SEQ ID NO: 927750 - DNA, 22 bp, Artificial Sequence
  chemically synthesized
ctttttaagtcaaaagctgttc

SEQ ID NO: 927751 - DNA, 22 bp, Artificial Sequence
  chemically synthesized
tctataatttaggaacagcttt

SEQ ID NO: 927752 - DNA, 22 bp, Artificial Sequence
  chemically synthesized
tttaagtcaaaagctgttccta

SEQ ID NO: 927753 - DNA, 22 bp, Artificial Sequence
  chemically synthesized
ttttctataatttaggaacagc

SEQ ID NO: 927754 - DNA, 22 bp, Artificial Sequence
  chemically synthesized
ttaagtcaaaagctgttcctaa

SEQ ID NO: 927755 - DNA, 22 bp, Artificial Sequence
  chemically synthesized
taagtcaaaagctgttcctaaa

SEQ ID NO: 927756 - DNA, 22 bp, Artificial Sequence
  chemically synthesized
aagtcaaaagctgttcctaaat

SEQ ID NO: 927757 - DNA, 22 bp, Artificial Sequence
  chemically synthesized
agtcaaaagctgttcctaaatt

SEQ ID NO: 927758 - DNA, 22 bp, Artificial Sequence
  chemically synthesized
ttcctaaattatagaaaataac

SEQ ID NO: 927759 - DNA, 22 bp, Artificial Sequence
  chemically synthesized
gatatgtaacagtgttattttc

SEQ ID NO: 927760 - DNA, 22 bp, Artificial Sequence
  chemically synthesized
agatatgtaacagtgttatttt

SEQ ID NO: 927761 - DNA, 22 bp, Artificial Sequence
  chemically synthesized
ctaaattatagaaaataacact

SEQ ID NO: 927762 - DNA, 22 bp, Artificial Sequence
  chemically synthesized
aattatagaaaataacactgtt

SEQ ID NO: 927763 - DNA, 22 bp, Artificial Sequence
  chemically synthesized
aaggacttagatatgtaacagt

SEQ ID NO: 927764 - DNA, 22 bp, Artificial Sequence
  chemically synthesized
tagaaaataacactgttacata

SEQ ID NO: 927765 - DNA, 22 bp, Artificial Sequence
  chemically synthesized
gaaggacttagatatgtaacag

SEQ ID NO: 927766 - DNA, 22 bp, Artificial Sequence
  chemically synthesized
accagacttgaaggacttagat

SEQ ID NO: 927767 - DNA, 22 bp, Artificial Sequence
  chemically synthesized
gaccagacttgaaggacttaga

SEQ ID NO: 927768 - DNA, 22 bp, Artificial Sequence
  chemically synthesized
ttacatatctaagtccttcaag

SEQ ID NO: 927769 - DNA, 22 bp, Artificial Sequence
  chemically synthesized
catatctaagtccttcaagtct

SEQ ID NO: 927770 - DNA, 22 bp, Artificial Sequence
  chemically synthesized
ccccaatttgaccagacttgaa

SEQ ID NO: 927771 - DNA, 22 bp, Artificial Sequence
  chemically synthesized
cccccaatttgaccagacttga

SEQ ID NO: 927772 - DNA, 22 bp, Artificial Sequence
  chemically synthesized
cttcccccaatttgaccagact

SEQ ID NO: 927773 - DNA, 22 bp, Artificial Sequence
  chemically synthesized
ccttcccccaatttgaccagac

SEQ ID NO: 927774 - DNA, 22 bp, Artificial Sequence
  chemically synthesized
tccttcccccaatttgaccaga

SEQ ID NO: 927775 - DNA, 22 bp, Artificial Sequence
  chemically synthesized
agtccttcaagtctggtcaaat

SEQ ID NO: 927776 - DNA, 22 bp, Artificial Sequence
  chemically synthesized
tttccttcccccaatttgacca

SEQ ID NO: 927777 - DNA, 22 bp, Artificial Sequence
  chemically synthesized
ctctttccttcccccaatttga

SEQ ID NO: 927778 - DNA, 22 bp, Artificial Sequence
  chemically synthesized
cctctttccttcccccaatttg

SEQ ID NO: 927779 - DNA, 22 bp, Artificial Sequence
  chemically synthesized
caagtctggtcaaattggggga

SEQ ID NO: 927780 - DNA, 22 bp, Artificial Sequence
  chemically synthesized
aagtctggtcaaattgggggaa

SEQ ID NO: 927781 - DNA, 22 bp, Artificial Sequence
  chemically synthesized
tgtttcctctttccttccccca

SEQ ID NO: 927782 - DNA, 22 bp, Artificial Sequence
  chemically synthesized
cctatgtttcctctttccttcc

SEQ ID NO: 927783 - DNA, 22 bp, Artificial Sequence
  chemically synthesized
gtcaaattgggggaaggaaaga

SEQ ID NO: 927784 - DNA, 22 bp, Artificial Sequence
  chemically synthesized
gcctatgtttcctctttccttc

SEQ ID NO: 927785 - DNA, 22 bp, Artificial Sequence
  chemically synthesized
tgcctatgtttcctctttcctt

SEQ ID NO: 927786 - DNA, 22 bp, Artificial Sequence
  chemically synthesized
tttgcctatgtttcctctttcc

SEQ ID NO: 927787 - DNA, 22 bp, Artificial Sequence
  chemically synthesized
ctttgcctatgtttcctctttc

SEQ ID NO: 927788 - DNA, 22 bp, Artificial Sequence
  chemically synthesized
tctttgcctatgtttcctcttt

SEQ ID NO: 927789 - DNA, 22 bp, Artificial Sequence
  chemically synthesized
tttctttgcctatgtttcctct

SEQ ID NO: 927790 - DNA, 22 bp, Artificial Sequence
  chemically synthesized
ggggaaggaaagaggaaacata

SEQ ID NO: 927791 - DNA, 22 bp, Artificial Sequence
  chemically synthesized
tataaaaataaaaatgtagcag

SEQ ID NO: 927792 - DNA, 22 bp, Artificial Sequence
  chemically synthesized
cctgtataaaaataaaaatgta

SEQ ID NO: 927793 - DNA, 22 bp, Artificial Sequence
  chemically synthesized
ccctgtataaaaataaaaatgt

SEQ ID NO: 927794 - DNA, 22 bp, Artificial Sequence
  chemically synthesized
tatccttccctgtataaaaata

SEQ ID NO: 927795 - DNA, 22 bp, Artificial Sequence
  chemically synthesized
atatccttccctgtataaaaat

SEQ ID NO: 927796 - DNA, 22 bp, Artificial Sequence
  chemically synthesized
ctacatttttatttttatacag

SEQ ID NO: 927797 - DNA, 22 bp, Artificial Sequence
  chemically synthesized
ttatatccttccctgtataaaa

SEQ ID NO: 927798 - DNA, 22 bp, Artificial Sequence
  chemically synthesized
cttatatccttccctgtataaa

SEQ ID NO: 927799 - DNA, 22 bp, Artificial Sequence
  chemically synthesized
tcttatatccttccctgtataa

SEQ ID NO: 927800 - DNA, 22 bp, Artificial Sequence
  chemically synthesized
catttttatttttatacaggga

SEQ ID NO: 927801 - DNA, 22 bp, Artificial Sequence
  chemically synthesized
ttcttatatccttccctgtata

SEQ ID NO: 927802 - DNA, 22 bp, Artificial Sequence
  chemically synthesized
tttcttatatccttccctgtat

SEQ ID NO: 927803 - DNA, 22 bp, Artificial Sequence
  chemically synthesized
tttttcttatatccttccctgt

SEQ ID NO: 927804 - DNA, 22 bp, Artificial Sequence
  chemically synthesized
ctttttcttatatccttccctg

SEQ ID NO: 927805 - DNA, 22 bp, Artificial Sequence
  chemically synthesized
ttatttttatacagggaaggat

SEQ ID NO: 927806 - DNA, 22 bp, Artificial Sequence
  chemically synthesized
tatttttatacagggaaggata

SEQ ID NO: 927807 - DNA, 22 bp, Artificial Sequence
  chemically synthesized
atttttatacagggaaggatat

SEQ ID NO: 927808 - DNA, 22 bp, Artificial Sequence
  chemically synthesized
tttttatacagggaaggatata

SEQ ID NO: 927809 - DNA, 22 bp, Artificial Sequence
  chemically synthesized
ttatacagggaaggatataaga

SEQ ID NO: 927810 - DNA, 22 bp, Artificial Sequence
  chemically synthesized
tatacagggaaggatataagaa

SEQ ID NO: 927811 - DNA, 22 bp, Artificial Sequence
  chemically synthesized
atacagggaaggatataagaaa

SEQ ID NO: 927812 - DNA, 22 bp, Artificial Sequence
  chemically synthesized
tacagggaaggatataagaaaa

SEQ ID NO: 927813 - DNA, 22 bp, Artificial Sequence
  chemically synthesized
atagaaaaggtagtggtttctt

SEQ ID NO: 927814 - DNA, 22 bp, Artificial Sequence
  chemically synthesized
catagaaaaggtagtggtttct

SEQ ID NO: 927815 - DNA, 22 bp, Artificial Sequence
  chemically synthesized
tcatagaaaaggtagtggtttc

SEQ ID NO: 927816 - DNA, 22 bp, Artificial Sequence
  chemically synthesized
aaaaaatgtacgtaatgttttc

SEQ ID NO: 927817 - DNA, 22 bp, Artificial Sequence
  chemically synthesized
aaaaaaatgtacgtaatgtttt

SEQ ID NO: 927818 - DNA, 22 bp, Artificial Sequence
  chemically synthesized
ccttttctatgaaaacattacg

SEQ ID NO: 927819 - DNA, 22 bp, Artificial Sequence
  chemically synthesized
taaaaaaatgtacgtaatgttt

SEQ ID NO: 927820 - DNA, 22 bp, Artificial Sequence
  chemically synthesized
ttaaaaaaatgtacgtaatgtt

SEQ ID NO: 927821 - DNA, 22 bp, Artificial Sequence
  chemically synthesized
ttctatgaaaacattacgtaca

SEQ ID NO: 927822 - DNA, 22 bp, Artificial Sequence
  chemically synthesized
tctatgaaaacattacgtacat

SEQ ID NO: 927823 - DNA, 22 bp, Artificial Sequence
  chemically synthesized
ctatgaaaacattacgtacatt

SEQ ID NO: 927824 - DNA, 22 bp, Artificial Sequence
  chemically synthesized
tatgaaaacattacgtacattt

SEQ ID NO: 927825 - DNA, 22 bp, Artificial Sequence
  chemically synthesized
tgaaaacattacgtacattttt

SEQ ID NO: 927826 - DNA, 22 bp, Artificial Sequence
  chemically synthesized
caaatagacttttaaaaaaatg

SEQ ID NO: 927827 - DNA, 22 bp, Artificial Sequence
  chemically synthesized
acaaatagacttttaaaaaaat

SEQ ID NO: 927828 - DNA, 22 bp, Artificial Sequence
  chemically synthesized
tacaaatagacttttaaaaaaa

SEQ ID NO: 927829 - DNA, 22 bp, Artificial Sequence
  chemically synthesized
cgtacatttttttaaaagtcta

SEQ ID NO: 927830 - DNA, 22 bp, Artificial Sequence
  chemically synthesized
gaaagttttacaaatagacttt

SEQ ID NO: 927831 - DNA, 22 bp, Artificial Sequence
  chemically synthesized
ggaaagttttacaaatagactt

SEQ ID NO: 927832 - DNA, 22 bp, Artificial Sequence
  chemically synthesized
tggaaagttttacaaatagact

SEQ ID NO: 927833 - DNA, 22 bp, Artificial Sequence
  chemically synthesized
ttttaaaagtctatttgtaaaa

SEQ ID NO: 927834 - DNA, 22 bp, Artificial Sequence
  chemically synthesized
tttaaaagtctatttgtaaaac

SEQ ID NO: 927835 - DNA, 22 bp, Artificial Sequence
  chemically synthesized
ttaaaagtctatttgtaaaact

SEQ ID NO: 927836 - DNA, 22 bp, Artificial Sequence
  chemically synthesized
taaaagtctatttgtaaaactt

SEQ ID NO: 927837 - DNA, 22 bp, Artificial Sequence
  chemically synthesized
aaaagtctatttgtaaaacttt

SEQ ID NO: 927838 - DNA, 22 bp, Artificial Sequence
  chemically synthesized
atgcagttttggaaagttttac

SEQ ID NO: 927839 - DNA, 22 bp, Artificial Sequence
  chemically synthesized
aaagtctatttgtaaaactttc

SEQ ID NO: 927840 - DNA, 22 bp, Artificial Sequence
  chemically synthesized
catgcagttttggaaagtttta

SEQ ID NO: 927841 - DNA, 22 bp, Artificial Sequence
  chemically synthesized
tcatgcagttttggaaagtttt

SEQ ID NO: 927842 - DNA, 22 bp, Artificial Sequence
  chemically synthesized
tgttttcatgcagttttggaaa

SEQ ID NO: 927843 - DNA, 22 bp, Artificial Sequence
  chemically synthesized
tttgtaaaactttccaaaactg

SEQ ID NO: 927844 - DNA, 22 bp, Artificial Sequence
  chemically synthesized
ttgtgttttcatgcagttttgg

SEQ ID NO: 927845 - DNA, 22 bp, Artificial Sequence
  chemically synthesized
gtaaaactttccaaaactgcat

SEQ ID NO: 927846 - DNA, 22 bp, Artificial Sequence
  chemically synthesized
taaaactttccaaaactgcatg

SEQ ID NO: 927847 - DNA, 22 bp, Artificial Sequence
  chemically synthesized
atctattgtgttttcatgcagt

SEQ ID NO: 927848 - DNA, 22 bp, Artificial Sequence
  chemically synthesized
catctattgtgttttcatgcag

SEQ ID NO: 927849 - DNA, 22 bp, Artificial Sequence
  chemically synthesized
tcatctattgtgttttcatgca

SEQ ID NO: 927850 - DNA, 22 bp, Artificial Sequence
  chemically synthesized
ttcatctattgtgttttcatgc

SEQ ID NO: 927851 - DNA, 22 bp, Artificial Sequence
  chemically synthesized
tccaaaactgcatgaaaacaca

SEQ ID NO: 927852 - DNA, 22 bp, Artificial Sequence
  chemically synthesized
tttttcatctattgtgttttca

SEQ ID NO: 927853 - DNA, 22 bp, Artificial Sequence
  chemically synthesized
ccaaaactgcatgaaaacacaa

SEQ ID NO: 927854 - DNA, 22 bp, Artificial Sequence
  chemically synthesized
caaaactgcatgaaaacacaat

SEQ ID NO: 927855 - DNA, 22 bp, Artificial Sequence
  chemically synthesized
tatttttcatctattgtgtttt

SEQ ID NO: 927856 - DNA, 22 bp, Artificial Sequence
  chemically synthesized
catgaaaacacaatagatgaaa

SEQ ID NO: 927857 - DNA, 22 bp, Artificial Sequence
  chemically synthesized
tcacattctatttttcatctat

SEQ ID NO: 927858 - DNA, 22 bp, Artificial Sequence
  chemically synthesized
gtcacattctatttttcatcta

SEQ ID NO: 927859 - DNA, 22 bp, Artificial Sequence
  chemically synthesized
atttgtcacattctatttttca

SEQ ID NO: 927860 - DNA, 22 bp, Artificial Sequence
  chemically synthesized
catttgtcacattctatttttc

SEQ ID NO: 927861 - DNA, 22 bp, Artificial Sequence
  chemically synthesized
ttcatttgtcacattctatttt

SEQ ID NO: 927862 - DNA, 22 bp, Artificial Sequence
  chemically synthesized
cttcatttgtcacattctattt

SEQ ID NO: 927863 - DNA, 22 bp, Artificial Sequence
  chemically synthesized
tcttcatttgtcacattctatt

SEQ ID NO: 927864 - DNA, 22 bp, Artificial Sequence
  chemically synthesized
ttcttcatttgtcacattctat

SEQ ID NO: 927865 - DNA, 22 bp, Artificial Sequence
  chemically synthesized
cttttcttcatttgtcacattc

SEQ ID NO: 927866 - DNA, 22 bp, Artificial Sequence
  chemically synthesized
ttccttttcttcatttgtcaca

SEQ ID NO: 927867 - DNA, 22 bp, Artificial Sequence
  chemically synthesized
attccttttcttcatttgtcac

SEQ ID NO: 927868 - DNA, 22 bp, Artificial Sequence
  chemically synthesized
gcttattccttttcttcatttg

SEQ ID NO: 927869 - DNA, 22 bp, Artificial Sequence
  chemically synthesized
agcttattccttttcttcattt

SEQ ID NO: 927870 - DNA, 22 bp, Artificial Sequence
  chemically synthesized
ttagcttattccttttcttcat

SEQ ID NO: 927871 - DNA, 22 bp, Artificial Sequence
  chemically synthesized
cttagcttattccttttcttca

SEQ ID NO: 927872 - DNA, 22 bp, Artificial Sequence
  chemically synthesized
cttcttagcttattccttttct

SEQ ID NO: 927873 - DNA, 22 bp, Artificial Sequence
  chemically synthesized
taactgcttcttagcttattcc

SEQ ID NO: 927874 - DNA, 22 bp, Artificial Sequence
  chemically synthesized
ataactgcttcttagcttattc

SEQ ID NO: 927875 - DNA, 22 bp, Artificial Sequence
  chemically synthesized
ttataactgcttcttagcttat

SEQ ID NO: 927876 - DNA, 22 bp, Artificial Sequence
  chemically synthesized
cttataactgcttcttagctta

SEQ ID NO: 927877 - DNA, 22 bp, Artificial Sequence
  chemically synthesized
tacaatttcttataactgcttc

SEQ ID NO: 927878 - DNA, 22 bp, Artificial Sequence
  chemically synthesized
tcattgtacaatttcttataac

SEQ ID NO: 927879 - DNA, 22 bp, Artificial Sequence
  chemically synthesized
agaagcagttataagaaattgt

SEQ ID NO: 927880 - DNA, 22 bp, Artificial Sequence
  chemically synthesized
atccaatctgtcattgtacaat

SEQ ID NO: 927881 - DNA, 22 bp, Artificial Sequence
  chemically synthesized
taagaaattgtacaatgacaga

SEQ ID NO: 927882 - DNA, 22 bp, Artificial Sequence
  chemically synthesized
cataattcatccaatctgtcat

SEQ ID NO: 927883 - DNA, 22 bp, Artificial Sequence
  chemically synthesized
ctacataattcatccaatctgt

SEQ ID NO: 927884 - DNA, 22 bp, Artificial Sequence
  chemically synthesized
cctacataattcatccaatctg

SEQ ID NO: 927885 - DNA, 22 bp, Artificial Sequence
  chemically synthesized
tttcctacataattcatccaat

SEQ ID NO: 927886 - DNA, 22 bp, Artificial Sequence
  chemically synthesized
tacaatgacagattggatgaat

SEQ ID NO: 927887 - DNA, 22 bp, Artificial Sequence
  chemically synthesized
atttcctacataattcatccaa

SEQ ID NO: 927888 - DNA, 22 bp, Artificial Sequence
  chemically synthesized
tatttcctacataattcatcca

SEQ ID NO: 927889 - DNA, 22 bp, Artificial Sequence
  chemically synthesized
ttatttcctacataattcatcc

SEQ ID NO: 927890 - DNA, 22 bp, Artificial Sequence
  chemically synthesized
tttatttcctacataattcatc

SEQ ID NO: 927891 - DNA, 22 bp, Artificial Sequence
  chemically synthesized
ccaattttttatttcctacata

SEQ ID NO: 927892 - DNA, 22 bp, Artificial Sequence
  chemically synthesized
gccaattttttatttcctacat

SEQ ID NO: 927893 - DNA, 22 bp, Artificial Sequence
  chemically synthesized
tgccaattttttatttcctaca

SEQ ID NO: 927894 - DNA, 22 bp, Artificial Sequence
  chemically synthesized
ttgccaattttttatttcctac

SEQ ID NO: 927895 - DNA, 22 bp, Artificial Sequence
  chemically synthesized
tttgccaattttttatttccta

SEQ ID NO: 927896 - DNA, 22 bp, Artificial Sequence
  chemically synthesized
gatgaattatgtaggaaataaa

SEQ ID NO: 927897 - DNA, 22 bp, Artificial Sequence
  chemically synthesized
tgattttttgccaattttttat

SEQ ID NO: 927898 - DNA, 22 bp, Artificial Sequence
  chemically synthesized
gtgattttttgccaatttttta

SEQ ID NO: 927899 - DNA, 22 bp, Artificial Sequence
  chemically synthesized
tgtaggaaataaaaaattggca

SEQ ID NO: 927900 - DNA, 22 bp, Artificial Sequence
  chemically synthesized
gtttgtgattttttgccaattt

SEQ ID NO: 927901 - DNA, 22 bp, Artificial Sequence
  chemically synthesized
cctagtttgtgattttttgcca

SEQ ID NO: 927902 - DNA, 22 bp, Artificial Sequence
  chemically synthesized
ctccctagtttgtgattttttg

SEQ ID NO: 927903 - DNA, 22 bp, Artificial Sequence
  chemically synthesized
gctccctagtttgtgatttttt

SEQ ID NO: 927904 - DNA, 22 bp, Artificial Sequence
  chemically synthesized
tcttgctccctagtttgtgatt

SEQ ID NO: 927905 - DNA, 22 bp, Artificial Sequence
  chemically synthesized
atcttgctccctagtttgtgat

SEQ ID NO: 927906 - DNA, 22 bp, Artificial Sequence
  chemically synthesized
tatcttgctccctagtttgtga

SEQ ID NO: 927907 - DNA, 22 bp, Artificial Sequence
  chemically synthesized
ttatcttgctccctagtttgtg

SEQ ID NO: 927908 - DNA, 22 bp, Artificial Sequence
  chemically synthesized
tttatcttgctccctagtttgt

SEQ ID NO: 927909 - DNA, 22 bp, Artificial Sequence
  chemically synthesized
ttttatcttgctccctagtttg

SEQ ID NO: 927910 - DNA, 22 bp, Artificial Sequence
  chemically synthesized
gcaaaaaatcacaaactaggga

SEQ ID NO: 927911 - DNA, 22 bp, Artificial Sequence
  chemically synthesized
tttttttatcttgctccctagt

SEQ ID NO: 927912 - DNA, 22 bp, Artificial Sequence
  chemically synthesized
tgtttttttatcttgctcccta

SEQ ID NO: 927913 - DNA, 22 bp, Artificial Sequence
  chemically synthesized
ctgtttttttatcttgctccct

SEQ ID NO: 927914 - DNA, 22 bp, Artificial Sequence
  chemically synthesized
ttctgtttttttatcttgctcc

SEQ ID NO: 927915 - DNA, 22 bp, Artificial Sequence
  chemically synthesized
tctcttctgtttttttatcttg

SEQ ID NO: 927916 - DNA, 22 bp, Artificial Sequence
  chemically synthesized
atctcttctgtttttttatctt

SEQ ID NO: 927917 - DNA, 22 bp, Artificial Sequence
  chemically synthesized
tatctcttctgtttttttatct

SEQ ID NO: 927918 - DNA, 22 bp, Artificial Sequence
  chemically synthesized
gggagcaagataaaaaaacaga

SEQ ID NO: 927919 - DNA, 22 bp, Artificial Sequence
  chemically synthesized
cattttatctcttctgtttttt

SEQ ID NO: 927920 - DNA, 22 bp, Artificial Sequence
  chemically synthesized
cagttgcattttatctcttctg

SEQ ID NO: 927921 - DNA, 22 bp, Artificial Sequence
  chemically synthesized
ccagttgcattttatctcttct

SEQ ID NO: 927922 - DNA, 22 bp, Artificial Sequence
  chemically synthesized
ttccagttgcattttatctctt

SEQ ID NO: 927923 - DNA, 22 bp, Artificial Sequence
  chemically synthesized
cttccagttgcattttatctct

SEQ ID NO: 927924 - DNA, 22 bp, Artificial Sequence
  chemically synthesized
tcttccagttgcattttatctc

SEQ ID NO: 927925 - DNA, 22 bp, Artificial Sequence
  chemically synthesized
ttcttccagttgcattttatct

SEQ ID NO: 927926 - DNA, 22 bp, Artificial Sequence
  chemically synthesized
tcttttcttccagttgcatttt

SEQ ID NO: 927927 - DNA, 22 bp, Artificial Sequence
  chemically synthesized
atcttttcttccagttgcattt

SEQ ID NO: 927928 - DNA, 22 bp, Artificial Sequence
  chemically synthesized
tatttatcttttcttccagttg

SEQ ID NO: 927929 - DNA, 22 bp, Artificial Sequence
  chemically synthesized
cctgtatttatcttttcttcca

SEQ ID NO: 927930 - DNA, 22 bp, Artificial Sequence
  chemically synthesized
ccctgtatttatcttttcttcc

SEQ ID NO: 927931 - DNA, 22 bp, Artificial Sequence
  chemically synthesized
tttccctgtatttatcttttct

SEQ ID NO: 927932 - DNA, 22 bp, Artificial Sequence
  chemically synthesized
tatttccctgtatttatctttt

SEQ ID NO: 927933 - DNA, 22 bp, Artificial Sequence
  chemically synthesized
cctctatttccctgtatttatc

SEQ ID NO: 927934 - DNA, 22 bp, Artificial Sequence
  chemically synthesized
ccctctatttccctgtatttat

SEQ ID NO: 927935 - DNA, 22 bp, Artificial Sequence
  chemically synthesized
ttccctctatttccctgtattt

SEQ ID NO: 927936 - DNA, 22 bp, Artificial Sequence
  chemically synthesized
gaagaaaagataaatacaggga

SEQ ID NO: 927937 - DNA, 22 bp, Artificial Sequence
  chemically synthesized
cttccctctatttccctgtatt

SEQ ID NO: 927938 - DNA, 22 bp, Artificial Sequence
  chemically synthesized
tcttccctctatttccctgtat

SEQ ID NO: 927939 - DNA, 22 bp, Artificial Sequence
  chemically synthesized
ttcttccctctatttccctgta

SEQ ID NO: 927940 - DNA, 22 bp, Artificial Sequence
  chemically synthesized
tttcttccctctatttccctgt

SEQ ID NO: 927941 - DNA, 22 bp, Artificial Sequence
  chemically synthesized
ctttttcttccctctatttccc

SEQ ID NO: 927942 - DNA, 22 bp, Artificial Sequence
  chemically synthesized
cctttttcttccctctatttcc

SEQ ID NO: 927943 - DNA, 22 bp, Artificial Sequence
  chemically synthesized
aatgaagtttcctttttcttcc

SEQ ID NO: 927944 - DNA, 22 bp, Artificial Sequence
  chemically synthesized
ttcaatgaagtttcctttttct

SEQ ID NO: 927945 - DNA, 22 bp, Artificial Sequence
  chemically synthesized
gttcaatgaagtttcctttttc

SEQ ID NO: 927946 - DNA, 22 bp, Artificial Sequence
  chemically synthesized
cttgttcaatgaagtttccttt

SEQ ID NO: 927947 - DNA, 22 bp, Artificial Sequence
  chemically synthesized
aaacatctccttgttcaatgaa

SEQ ID NO: 927948 - DNA, 22 bp, Artificial Sequence
  chemically synthesized
gaaacatctccttgttcaatga

SEQ ID NO: 927949 - DNA, 22 bp, Artificial Sequence
  chemically synthesized
ttgaaacatctccttgttcaat

SEQ ID NO: 927950 - DNA, 22 bp, Artificial Sequence
  chemically synthesized
gattcttgaaacatctccttgt

SEQ ID NO: 927951 - DNA, 22 bp, Artificial Sequence
  chemically synthesized
cattgaacaaggagatgtttca

SEQ ID NO: 927952 - DNA, 22 bp, Artificial Sequence
  chemically synthesized
attgaacaaggagatgtttcaa

SEQ ID NO: 927953 - DNA, 22 bp, Artificial Sequence
  chemically synthesized
agtattggattcttgaaacatc

SEQ ID NO: 927954 - DNA, 22 bp, Artificial Sequence
  chemically synthesized
aacaaggagatgtttcaagaat

SEQ ID NO: 927955 - DNA, 22 bp, Artificial Sequence
  chemically synthesized
caagtaaatctcagtattggat

SEQ ID NO: 927956 - DNA, 22 bp, Artificial Sequence
  chemically synthesized
caagaatccaatactgagattt

SEQ ID NO: 927957 - DNA, 22 bp, Artificial Sequence
  chemically synthesized
aagaatccaatactgagattta

SEQ ID NO: 927958 - DNA, 22 bp, Artificial Sequence
  chemically synthesized
atgaacaaaattacaagtaaat

SEQ ID NO: 927959 - DNA, 22 bp, Artificial Sequence
  chemically synthesized
agatttacttgtaattttgttc

SEQ ID NO: 927960 - DNA, 22 bp, Artificial Sequence
  chemically synthesized
aaaataattcatgaacaaaatt

SEQ ID NO: 927961 - DNA, 22 bp, Artificial Sequence
  chemically synthesized
tctcaaaataattcatgaacaa

SEQ ID NO: 927962 - DNA, 22 bp, Artificial Sequence
  chemically synthesized
acttgtaattttgttcatgaat

SEQ ID NO: 927963 - DNA, 22 bp, Artificial Sequence
  chemically synthesized
cttgtaattttgttcatgaatt

SEQ ID NO: 927964 - DNA, 22 bp, Artificial Sequence
  chemically synthesized
cctgtctcaaaataattcatga

SEQ ID NO: 927965 - DNA, 22 bp, Artificial Sequence
  chemically synthesized
acctgtctcaaaataattcatg

SEQ ID NO: 927966 - DNA, 22 bp, Artificial Sequence
  chemically synthesized
gtaattttgttcatgaattatt

SEQ ID NO: 927967 - DNA, 22 bp, Artificial Sequence
  chemically synthesized
taattttgttcatgaattattt

SEQ ID NO: 927968 - DNA, 22 bp, Artificial Sequence
  chemically synthesized
atgatttacctgtctcaaaata

SEQ ID NO: 927969 - DNA, 22 bp, Artificial Sequence
  chemically synthesized
tgttcatgaattattttgagac

SEQ ID NO: 927970 - DNA, 22 bp, Artificial Sequence
  chemically synthesized
gttcatgaattattttgagaca

SEQ ID NO: 927971 - DNA, 22 bp, Artificial Sequence
  chemically synthesized
ttcatgaattattttgagacag

SEQ ID NO: 927972 - DNA, 22 bp, Artificial Sequence
  chemically synthesized
ggttaatgatttacctgtctca

SEQ ID NO: 927973 - DNA, 22 bp, Artificial Sequence
  chemically synthesized
atgaattattttgagacaggta

SEQ ID NO: 927974 - DNA, 22 bp, Artificial Sequence
  chemically synthesized
ttttgagacaggtaaatcatta

SEQ ID NO: 927975 - DNA, 22 bp, Artificial Sequence
  chemically synthesized
tgagacaggtaaatcattaacc

SEQ ID NO: 927976 - DNA, 22 bp, Artificial Sequence
  chemically synthesized
gagacaggtaaatcattaaccg

SEQ ID NO: 927977 - DNA, 22 bp, Artificial Sequence
  chemically synthesized
agacaggtaaatcattaaccga

SEQ ID NO: 927978 - DNA, 22 bp, Artificial Sequence
  chemically synthesized
accaatcagtaaactcggttaa

SEQ ID NO: 927979 - DNA, 22 bp, Artificial Sequence
  chemically synthesized
gaccaatcagtaaactcggtta

SEQ ID NO: 927980 - DNA, 22 bp, Artificial Sequence
  chemically synthesized
ttgaccaatcagtaaactcggt

SEQ ID NO: 927981 - DNA, 22 bp, Artificial Sequence
  chemically synthesized
tcttgaccaatcagtaaactcg

SEQ ID NO: 927982 - DNA, 22 bp, Artificial Sequence
  chemically synthesized
ctcttgaccaatcagtaaactc

SEQ ID NO: 927983 - DNA, 22 bp, Artificial Sequence
  chemically synthesized
tctcttgaccaatcagtaaact

SEQ ID NO: 927984 - DNA, 22 bp, Artificial Sequence
  chemically synthesized
ttctcttgaccaatcagtaaac

SEQ ID NO: 927985 - DNA, 22 bp, Artificial Sequence
  chemically synthesized
catcttttctcttgaccaatca

SEQ ID NO: 927986 - DNA, 22 bp, Artificial Sequence
  chemically synthesized
accgagtttactgattggtcaa

SEQ ID NO: 927987 - DNA, 22 bp, Artificial Sequence
  chemically synthesized
ttacatcttttctcttgaccaa

SEQ ID NO: 927988 - DNA, 22 bp, Artificial Sequence
  chemically synthesized
attacatcttttctcttgacca

SEQ ID NO: 927989 - DNA, 22 bp, Artificial Sequence
  chemically synthesized
tattacatcttttctcttgacc

SEQ ID NO: 927990 - DNA, 22 bp, Artificial Sequence
  chemically synthesized
attttattacatcttttctctt

SEQ ID NO: 927991 - DNA, 22 bp, Artificial Sequence
  chemically synthesized
actgattggtcaagagaaaaga

SEQ ID NO: 927992 - DNA, 22 bp, Artificial Sequence
  chemically synthesized
cattttattacatcttttctct

SEQ ID NO: 927993 - DNA, 22 bp, Artificial Sequence
  chemically synthesized
ctgattggtcaagagaaaagat

SEQ ID NO: 927994 - DNA, 22 bp, Artificial Sequence
  chemically synthesized
attggtcaagagaaaagatgta

SEQ ID NO: 927995 - DNA, 22 bp, Artificial Sequence
  chemically synthesized
gtcaagagaaaagatgtaataa

SEQ ID NO: 927996 - DNA, 22 bp, Artificial Sequence
  chemically synthesized
ccaaatttcattttattacatc

SEQ ID NO: 927997 - DNA, 22 bp, Artificial Sequence
  chemically synthesized
tcccaaatttcattttattaca

SEQ ID NO: 927998 - DNA, 22 bp, Artificial Sequence
  chemically synthesized
acaactctcccaaatttcattt

SEQ ID NO: 927999 - DNA, 22 bp, Artificial Sequence
  chemically synthesized
cacaactctcccaaatttcatt

SEQ ID NO: 928000 - DNA, 22 bp, Artificial Sequence
  chemically synthesized
tttcacaactctcccaaatttc

SEQ ID NO: 928001 - DNA, 22 bp, Artificial Sequence
  chemically synthesized
caccataaaagtctgtttcaca

SEQ ID NO: 928002 - DNA, 22 bp, Artificial Sequence
  chemically synthesized
gggagagttgtgaaacagactt

SEQ ID NO: 928003 - DNA, 22 bp, Artificial Sequence
  chemically synthesized
ggagagttgtgaaacagacttt

SEQ ID NO: 928004 - DNA, 22 bp, Artificial Sequence
  chemically synthesized
taggaaattgcaccataaaagt

SEQ ID NO: 928005 - DNA, 22 bp, Artificial Sequence
  chemically synthesized
gtaggaaattgcaccataaaag

SEQ ID NO: 928006 - DNA, 22 bp, Artificial Sequence
  chemically synthesized
tgaaacagacttttatggtgca

SEQ ID NO: 928007 - DNA, 22 bp, Artificial Sequence
  chemically synthesized
ttatggtgcaatttcctacaaa

SEQ ID NO: 928008 - DNA, 22 bp, Artificial Sequence
  chemically synthesized
tatggtgcaatttcctacaaat

SEQ ID NO: 928009 - DNA, 22 bp, Artificial Sequence
  chemically synthesized
atggtgcaatttcctacaaata

SEQ ID NO: 928010 - DNA, 22 bp, Artificial Sequence
  chemically synthesized
tggtgcaatttcctacaaatat

SEQ ID NO: 928011 - DNA, 22 bp, Artificial Sequence
  chemically synthesized
cctacaaatatggtgctttatc

SEQ ID NO: 928012 - DNA, 22 bp, Artificial Sequence
  chemically synthesized
ctacaaatatggtgctttatct

SEQ ID NO: 928013 - DNA, 22 bp, Artificial Sequence
  chemically synthesized
ggataaaaaaacaagataaagc

SEQ ID NO: 928014 - DNA, 22 bp, Artificial Sequence
  chemically synthesized
aggataaaaaaacaagataaag

SEQ ID NO: 928015 - DNA, 22 bp, Artificial Sequence
  chemically synthesized
caaatatggtgctttatcttgt

SEQ ID NO: 928016 - DNA, 22 bp, Artificial Sequence
  chemically synthesized
tatcttgtttttttatcctaag

SEQ ID NO: 928017 - DNA, 22 bp, Artificial Sequence
  chemically synthesized
atcttgtttttttatcctaagg

SEQ ID NO: 928018 - DNA, 22 bp, Artificial Sequence
  chemically synthesized
tcttgtttttttatcctaaggt

SEQ ID NO: 928019 - DNA, 22 bp, Artificial Sequence
  chemically synthesized
gtttttttatcctaaggtcatt

SEQ ID NO: 928020 - DNA, 22 bp, Artificial Sequence
  chemically synthesized
tttttttatcctaaggtcattc

SEQ ID NO: 928021 - DNA, 22 bp, Artificial Sequence
  chemically synthesized
ttttatcctaaggtcattctca

SEQ ID NO: 928022 - DNA, 22 bp, Artificial Sequence
  chemically synthesized
tttatcctaaggtcattctcat

SEQ ID NO: 928023 - DNA, 22 bp, Artificial Sequence
  chemically synthesized
ttatcctaaggtcattctcatt

SEQ ID NO: 928024 - DNA, 22 bp, Artificial Sequence
  chemically synthesized
acgaagagacacaatgagaatg

SEQ ID NO: 928025 - DNA, 22 bp, Artificial Sequence
  chemically synthesized
tatcctaaggtcattctcattg

SEQ ID NO: 928026 - DNA, 22 bp, Artificial Sequence
  chemically synthesized
atcctaaggtcattctcattgt

SEQ ID NO: 928027 - DNA, 22 bp, Artificial Sequence
  chemically synthesized
tcctaaggtcattctcattgtg

SEQ ID NO: 928028 - DNA, 22 bp, Artificial Sequence
  chemically synthesized
gcactgacgaagagacacaatg

SEQ ID NO: 928029 - DNA, 22 bp, Artificial Sequence
  chemically synthesized
ggcactgacgaagagacacaat

SEQ ID NO: 928030 - DNA, 22 bp, Artificial Sequence
  chemically synthesized
aggtcattctcattgtgtctct

SEQ ID NO: 928031 - DNA, 22 bp, Artificial Sequence
  chemically synthesized
ttggcactgacgaagagacaca

SEQ ID NO: 928032 - DNA, 22 bp, Artificial Sequence
  chemically synthesized
aattcttggcactgacgaagag

SEQ ID NO: 928033 - DNA, 22 bp, Artificial Sequence
  chemically synthesized
tcattgtgtctcttcgtcagtg

SEQ ID NO: 928034 - DNA, 22 bp, Artificial Sequence
  chemically synthesized
ctgaattcttggcactgacgaa

SEQ ID NO: 928035 - DNA, 22 bp, Artificial Sequence
  chemically synthesized
attgtgtctcttcgtcagtgcc

SEQ ID NO: 928036 - DNA, 22 bp, Artificial Sequence
  chemically synthesized
tgtctcttcgtcagtgccaaga

SEQ ID NO: 928037 - DNA, 22 bp, Artificial Sequence
  chemically synthesized
ttcgtcagtgccaagaattcag

SEQ ID NO: 928038 - DNA, 22 bp, Artificial Sequence
  chemically synthesized
tatatcaaactcctgaattctt

SEQ ID NO: 928039 - DNA, 22 bp, Artificial Sequence
  chemically synthesized
cgtcagtgccaagaattcagga

SEQ ID NO: 928040 - DNA, 22 bp, Artificial Sequence
  chemically synthesized
gtcagtgccaagaattcaggag

SEQ ID NO: 928041 - DNA, 22 bp, Artificial Sequence
  chemically synthesized
aaaaaagtatcagaaactgtat

SEQ ID NO: 928042 - DNA, 22 bp, Artificial Sequence
  chemically synthesized
aggagtttgatatacagtttct

SEQ ID NO: 928043 - DNA, 22 bp, Artificial Sequence
  chemically synthesized
tcattgaaaaaagtatcagaaa

SEQ ID NO: 928044 - DNA, 22 bp, Artificial Sequence
  chemically synthesized
atcattgaaaaaagtatcagaa

SEQ ID NO: 928045 - DNA, 22 bp, Artificial Sequence
  chemically synthesized
gatatacagtttctgatacttt

SEQ ID NO: 928046 - DNA, 22 bp, Artificial Sequence
  chemically synthesized
atatacagtttctgatactttt

SEQ ID NO: 928047 - DNA, 22 bp, Artificial Sequence
  chemically synthesized
tttatcattgaaaaaagtatca

SEQ ID NO: 928048 - DNA, 22 bp, Artificial Sequence
  chemically synthesized
atttatcattgaaaaaagtatc

SEQ ID NO: 928049 - DNA, 22 bp, Artificial Sequence
  chemically synthesized
tatttatcattgaaaaaagtat

SEQ ID NO: 928050 - DNA, 22 bp, Artificial Sequence
  chemically synthesized
ctttatttatcattgaaaaaag

SEQ ID NO: 928051 - DNA, 22 bp, Artificial Sequence
  chemically synthesized
gctttatttatcattgaaaaaa

SEQ ID NO: 928052 - DNA, 22 bp, Artificial Sequence
  chemically synthesized
acttgctttatttatcattgaa

SEQ ID NO: 928053 - DNA, 22 bp, Artificial Sequence
  chemically synthesized
ctgatacttttttcaatgataa

SEQ ID NO: 928054 - DNA, 22 bp, Artificial Sequence
  chemically synthesized
tgatacttttttcaatgataaa

SEQ ID NO: 928055 - DNA, 22 bp, Artificial Sequence
  chemically synthesized
atacttttttcaatgataaata

SEQ ID NO: 928056 - DNA, 22 bp, Artificial Sequence
  chemically synthesized
gttaacttgctttatttatcat

SEQ ID NO: 928057 - DNA, 22 bp, Artificial Sequence
  chemically synthesized
ttttcaatgataaataaagcaa

SEQ ID NO: 928058 - DNA, 22 bp, Artificial Sequence
  chemically synthesized
tttcaatgataaataaagcaag

SEQ ID NO: 928059 - DNA, 22 bp, Artificial Sequence
  chemically synthesized
ttcaatgataaataaagcaagt

SEQ ID NO: 928060 - DNA, 22 bp, Artificial Sequence
  chemically synthesized
tcaatgataaataaagcaagtt

SEQ ID NO: 928061 - DNA, 22 bp, Artificial Sequence
  chemically synthesized
gcatgactggttaacttgcttt

SEQ ID NO: 928062 - DNA, 22 bp, Artificial Sequence
  chemically synthesized
caatgataaataaagcaagtta

SEQ ID NO: 928063 - DNA, 22 bp, Artificial Sequence
  chemically synthesized
aatgataaataaagcaagttaa

SEQ ID NO: 928064 - DNA, 22 bp, Artificial Sequence
  chemically synthesized
ataattagcatgactggttaac

SEQ ID NO: 928065 - DNA, 22 bp, Artificial Sequence
  chemically synthesized
taataattagcatgactggtta

SEQ ID NO: 928066 - DNA, 22 bp, Artificial Sequence
  chemically synthesized
ctaataattagcatgactggtt

SEQ ID NO: 928067 - DNA, 22 bp, Artificial Sequence
  chemically synthesized
tctaataattagcatgactggt

SEQ ID NO: 928068 - DNA, 22 bp, Artificial Sequence
  chemically synthesized
tattttctaataattagcatga

SEQ ID NO: 928069 - DNA, 22 bp, Artificial Sequence
  chemically synthesized
gctatattttctaataattagc

SEQ ID NO: 928070 - DNA, 22 bp, Artificial Sequence
  chemically synthesized
accagtcatgctaattattaga

SEQ ID NO: 928071 - DNA, 22 bp, Artificial Sequence
  chemically synthesized
aaaacagtattggctatatttt

SEQ ID NO: 928072 - DNA, 22 bp, Artificial Sequence
  chemically synthesized
tgaaaacagtattggctatatt

SEQ ID NO: 928073 - DNA, 22 bp, Artificial Sequence
  chemically synthesized
attattagaaaatatagccaat

SEQ ID NO: 928074 - DNA, 22 bp, Artificial Sequence
  chemically synthesized
ttagaaaatatagccaatactg

SEQ ID NO: 928075 - DNA, 22 bp, Artificial Sequence
  chemically synthesized
aaatctctgaaaacagtattgg

SEQ ID NO: 928076 - DNA, 22 bp, Artificial Sequence
  chemically synthesized
gaaaatatagccaatactgttt

SEQ ID NO: 928077 - DNA, 22 bp, Artificial Sequence
  chemically synthesized
aagcacattaaaatctctgaaa

SEQ ID NO: 928078 - DNA, 22 bp, Artificial Sequence
  chemically synthesized
ctgaagcacattaaaatctctg

SEQ ID NO: 928079 - DNA, 22 bp, Artificial Sequence
  chemically synthesized
gctgaagcacattaaaatctct

SEQ ID NO: 928080 - DNA, 22 bp, Artificial Sequence
  chemically synthesized
ttttcagagattttaatgtgct

SEQ ID NO: 928081 - DNA, 22 bp, Artificial Sequence
  chemically synthesized
tcagagattttaatgtgcttca

SEQ ID NO: 928082 - DNA, 22 bp, Artificial Sequence
  chemically synthesized
aaagaaacttgctgaagcacat

SEQ ID NO: 928083 - DNA, 22 bp, Artificial Sequence
  chemically synthesized
cagagattttaatgtgcttcag

SEQ ID NO: 928084 - DNA, 22 bp, Artificial Sequence
  chemically synthesized
agagattttaatgtgcttcagc

SEQ ID NO: 928085 - DNA, 22 bp, Artificial Sequence
  chemically synthesized
taatgtgcttcagcaagtttct

SEQ ID NO: 928086 - DNA, 22 bp, Artificial Sequence
  chemically synthesized
aatgtgcttcagcaagtttctt

SEQ ID NO: 928087 - DNA, 22 bp, Artificial Sequence
  chemically synthesized
atgtgcttcagcaagtttcttt

SEQ ID NO: 928088 - DNA, 22 bp, Artificial Sequence
  chemically synthesized
cagcaagtttctttcaacttct

SEQ ID NO: 928089 - DNA, 22 bp, Artificial Sequence
  chemically synthesized
agcaagtttctttcaacttcta

SEQ ID NO: 928090 - DNA, 22 bp, Artificial Sequence
  chemically synthesized
caaaaatccatcatccgataga

SEQ ID NO: 928091 - DNA, 22 bp, Artificial Sequence
  chemically synthesized
acaaaaatccatcatccgatag

SEQ ID NO: 928092 - DNA, 22 bp, Artificial Sequence
  chemically synthesized
tacaaaaatccatcatccgata

SEQ ID NO: 928093 - DNA, 22 bp, Artificial Sequence
  chemically synthesized
ctttcaacttctatcggatgat

SEQ ID NO: 928094 - DNA, 22 bp, Artificial Sequence
  chemically synthesized
tttcaacttctatcggatgatg

SEQ ID NO: 928095 - DNA, 22 bp, Artificial Sequence
  chemically synthesized
tttacaaaaatccatcatccga

SEQ ID NO: 928096 - DNA, 22 bp, Artificial Sequence
  chemically synthesized
ctttacaaaaatccatcatccg

SEQ ID NO: 928097 - DNA, 22 bp, Artificial Sequence
  chemically synthesized
tcaacttctatcggatgatgga

SEQ ID NO: 928098 - DNA, 22 bp, Artificial Sequence
  chemically synthesized
caacttctatcggatgatggat

SEQ ID NO: 928099 - DNA, 22 bp, Artificial Sequence
  chemically synthesized
aacttctatcggatgatggatt

SEQ ID NO: 928100 - DNA, 22 bp, Artificial Sequence
  chemically synthesized
cttctttacaaaaatccatcat

SEQ ID NO: 928101 - DNA, 22 bp, Artificial Sequence
  chemically synthesized
gcttctttacaaaaatccatca

SEQ ID NO: 928102 - DNA, 22 bp, Artificial Sequence
  chemically synthesized
tgcttctttacaaaaatccatc

SEQ ID NO: 928103 - DNA, 22 bp, Artificial Sequence
  chemically synthesized
ctatcggatgatggatttttgt

SEQ ID NO: 928104 - DNA, 22 bp, Artificial Sequence
  chemically synthesized
ttttgcttctttacaaaaatcc

SEQ ID NO: 928105 - DNA, 22 bp, Artificial Sequence
  chemically synthesized
tatcggatgatggatttttgta

SEQ ID NO: 928106 - DNA, 22 bp, Artificial Sequence
  chemically synthesized
attttgcttctttacaaaaatc

SEQ ID NO: 928107 - DNA, 22 bp, Artificial Sequence
  chemically synthesized
tcggatgatggatttttgtaaa

SEQ ID NO: 928108 - DNA, 22 bp, Artificial Sequence
  chemically synthesized
tgcatttattttgcttctttac

SEQ ID NO: 928109 - DNA, 22 bp, Artificial Sequence
  chemically synthesized
gtgcatttattttgcttcttta

SEQ ID NO: 928110 - DNA, 22 bp, Artificial Sequence
  chemically synthesized
agtatttgtgcatttattttgc

SEQ ID NO: 928111 - DNA, 22 bp, Artificial Sequence
  chemically synthesized
gagtatttgtgcatttattttg

SEQ ID NO: 928112 - DNA, 22 bp, Artificial Sequence
  chemically synthesized
ttgtaaagaagcaaaataaatg

SEQ ID NO: 928113 - DNA, 22 bp, Artificial Sequence
  chemically synthesized
tgtaaagaagcaaaataaatgc

SEQ ID NO: 928114 - DNA, 22 bp, Artificial Sequence
  chemically synthesized
gtaaagaagcaaaataaatgca

SEQ ID NO: 928115 - DNA, 22 bp, Artificial Sequence
  chemically synthesized
taaagaagcaaaataaatgcac

SEQ ID NO: 928116 - DNA, 22 bp, Artificial Sequence
  chemically synthesized
gcatatgccttgagtatttgtg

SEQ ID NO: 928117 - DNA, 22 bp, Artificial Sequence
  chemically synthesized
agcatatgccttgagtatttgt

SEQ ID NO: 928118 - DNA, 22 bp, Artificial Sequence
  chemically synthesized
tgcttagcatatgccttgagta

SEQ ID NO: 928119 - DNA, 22 bp, Artificial Sequence
  chemically synthesized
gtgctgtgcttagcatatgcct

SEQ ID NO: 928120 - DNA, 22 bp, Artificial Sequence
  chemically synthesized
aaggcatatgctaagcacagca

SEQ ID NO: 928121 - DNA, 22 bp, Artificial Sequence
  chemically synthesized
aatgggtcctggtgctgtgctt

SEQ ID NO: 928122 - DNA, 22 bp, Artificial Sequence
  chemically synthesized
agttgaatgggtcctggtgctg

SEQ ID NO: 928123 - DNA, 22 bp, Artificial Sequence
  chemically synthesized
agcacagcaccaggacccattc

SEQ ID NO: 928124 - DNA, 22 bp, Artificial Sequence
  chemically synthesized
tggacaggctaagttgaatggg

SEQ ID NO: 928125 - DNA, 22 bp, Artificial Sequence
  chemically synthesized
agtctatggacaggctaagttg

SEQ ID NO: 928126 - DNA, 22 bp, Artificial Sequence
  chemically synthesized
aacttagcctgtccatagactg

SEQ ID NO: 928127 - DNA, 22 bp, Artificial Sequence
  chemically synthesized
agcctgtccatagactgaggga

SEQ ID NO: 928128 - DNA, 22 bp, Artificial Sequence
  chemically synthesized
gcctgtccatagactgagggat

SEQ ID NO: 928129 - DNA, 22 bp, Artificial Sequence
  chemically synthesized
caccaagacggaatccctcagt

SEQ ID NO: 928130 - DNA, 22 bp, Artificial Sequence
  chemically synthesized
ccaccaagacggaatccctcag

SEQ ID NO: 928131 - DNA, 22 bp, Artificial Sequence
  chemically synthesized
tccatagactgagggattccgt

SEQ ID NO: 928132 - DNA, 22 bp, Artificial Sequence
  chemically synthesized
tcagaccttccaccaagacgga

SEQ ID NO: 928133 - DNA, 22 bp, Artificial Sequence
  chemically synthesized
agggattccgtcttggtggaag

SEQ ID NO: 928134 - DNA, 22 bp, Artificial Sequence
  chemically synthesized
ccacaaggttatcagaccttcc

SEQ ID NO: 928135 - DNA, 22 bp, Artificial Sequence
  chemically synthesized
cgtcttggtggaaggtctgata

SEQ ID NO: 928136 - DNA, 22 bp, Artificial Sequence
  chemically synthesized
aggtgctcccacaaggttatca

SEQ ID NO: 928137 - DNA, 22 bp, Artificial Sequence
  chemically synthesized
ggtggaaggtctgataaccttg

SEQ ID NO: 928138 - DNA, 22 bp, Artificial Sequence
  chemically synthesized
gtggaaggtctgataaccttgt

SEQ ID NO: 928139 - DNA, 22 bp, Artificial Sequence
  chemically synthesized
tcctcaggtgctcccacaaggt

SEQ ID NO: 928140 - DNA, 22 bp, Artificial Sequence
  chemically synthesized
actatcctcaggtgctcccaca

SEQ ID NO: 928141 - DNA, 22 bp, Artificial Sequence
  chemically synthesized
tgactatcctcaggtgctccca

SEQ ID NO: 928142 - DNA, 22 bp, Artificial Sequence
  chemically synthesized
ataaccttgtgggagcacctga

SEQ ID NO: 928143 - DNA, 22 bp, Artificial Sequence
  chemically synthesized
ttctgactatcctcaggtgctc

SEQ ID NO: 928144 - DNA, 22 bp, Artificial Sequence
  chemically synthesized
aattgttctgactatcctcagg

SEQ ID NO: 928145 - DNA, 22 bp, Artificial Sequence
  chemically synthesized
caattgttctgactatcctcag

SEQ ID NO: 928146 - DNA, 22 bp, Artificial Sequence
  chemically synthesized
tcaattgttctgactatcctca

SEQ ID NO: 928147 - DNA, 22 bp, Artificial Sequence
  chemically synthesized
gtgggagcacctgaggatagtc

SEQ ID NO: 928148 - DNA, 22 bp, Artificial Sequence
  chemically synthesized
tgggagcacctgaggatagtca

SEQ ID NO: 928149 - DNA, 22 bp, Artificial Sequence
  chemically synthesized
gccatctttcaattgttctgac

SEQ ID NO: 928150 - DNA, 22 bp, Artificial Sequence
  chemically synthesized
agccatctttcaattgttctga

SEQ ID NO: 928151 - DNA, 22 bp, Artificial Sequence
  chemically synthesized
tagccatctttcaattgttctg

SEQ ID NO: 928152 - DNA, 22 bp, Artificial Sequence
  chemically synthesized
aggatagtcagaacaattgaaa

SEQ ID NO: 928153 - DNA, 22 bp, Artificial Sequence
  chemically synthesized
cccaattttagccatctttcaa

SEQ ID NO: 928154 - DNA, 22 bp, Artificial Sequence
  chemically synthesized
ccccaattttagccatctttca

SEQ ID NO: 928155 - DNA, 22 bp, Artificial Sequence
  chemically synthesized
gatttccccaattttagccatc

SEQ ID NO: 928156 - DNA, 22 bp, Artificial Sequence
  chemically synthesized
ctagatttccccaattttagcc

SEQ ID NO: 928157 - DNA, 22 bp, Artificial Sequence
  chemically synthesized
actgctagatttccccaatttt

SEQ ID NO: 928158 - DNA, 22 bp, Artificial Sequence
  chemically synthesized
aaagatggctaaaattggggaa

SEQ ID NO: 928159 - DNA, 22 bp, Artificial Sequence
  chemically synthesized
ctaactgctagatttccccaat

SEQ ID NO: 928160 - DNA, 22 bp, Artificial Sequence
  chemically synthesized
cctaactgctagatttccccaa

SEQ ID NO: 928161 - DNA, 22 bp, Artificial Sequence
  chemically synthesized
tcctaactgctagatttcccca

SEQ ID NO: 928162 - DNA, 22 bp, Artificial Sequence
  chemically synthesized
cattttcctaactgctagattt

SEQ ID NO: 928163 - DNA, 22 bp, Artificial Sequence
  chemically synthesized
tccattttcctaactgctagat

SEQ ID NO: 928164 - DNA, 22 bp, Artificial Sequence
  chemically synthesized
aaattggggaaatctagcagtt

SEQ ID NO: 928165 - DNA, 22 bp, Artificial Sequence
  chemically synthesized
tctccattttcctaactgctag

SEQ ID NO: 928166 - DNA, 22 bp, Artificial Sequence
  chemically synthesized
ctctccattttcctaactgcta

SEQ ID NO: 928167 - DNA, 22 bp, Artificial Sequence
  chemically synthesized
gggaaatctagcagttaggaaa

SEQ ID NO: 928168 - DNA, 22 bp, Artificial Sequence
  chemically synthesized
cccttctctccattttcctaac

SEQ ID NO: 928169 - DNA, 22 bp, Artificial Sequence
  chemically synthesized
gcccttctctccattttcctaa

SEQ ID NO: 928170 - DNA, 22 bp, Artificial Sequence
  chemically synthesized
tgcccttctctccattttccta

SEQ ID NO: 928171 - DNA, 22 bp, Artificial Sequence
  chemically synthesized
ttttgcccttctctccattttc

SEQ ID NO: 928172 - DNA, 22 bp, Artificial Sequence
  chemically synthesized
gcagttaggaaaatggagagaa

SEQ ID NO: 928173 - DNA, 22 bp, Artificial Sequence
  chemically synthesized
tactattttgcccttctctcca

SEQ ID NO: 928174 - DNA, 22 bp, Artificial Sequence
  chemically synthesized
tatactattttgcccttctctc

SEQ ID NO: 928175 - DNA, 22 bp, Artificial Sequence
  chemically synthesized
ctatactattttgcccttctct

SEQ ID NO: 928176 - DNA, 22 bp, Artificial Sequence
  chemically synthesized
tctatactattttgcccttctc

SEQ ID NO: 928177 - DNA, 22 bp, Artificial Sequence
  chemically synthesized
ttctatactattttgcccttct

SEQ ID NO: 928178 - DNA, 22 bp, Artificial Sequence
  chemically synthesized
ggaaaatggagagaagggcaaa

SEQ ID NO: 928179 - DNA, 22 bp, Artificial Sequence
  chemically synthesized
tttctatactattttgcccttc

SEQ ID NO: 928180 - DNA, 22 bp, Artificial Sequence
  chemically synthesized
ttttctatactattttgccctt

SEQ ID NO: 928181 - DNA, 22 bp, Artificial Sequence
  chemically synthesized
tttttctatactattttgccct

SEQ ID NO: 928182 - DNA, 22 bp, Artificial Sequence
  chemically synthesized
ttttttctatactattttgccc

SEQ ID NO: 928183 - DNA, 22 bp, Artificial Sequence
  chemically synthesized
tttttttctatactattttgcc

SEQ ID NO: 928184 - DNA, 22 bp, Artificial Sequence
  chemically synthesized
ttttttttctatactattttgc

SEQ ID NO: 928185 - DNA, 22 bp, Artificial Sequence
  chemically synthesized
ttttttttttctatactatttt

SEQ ID NO: 928186 - DNA, 22 bp, Artificial Sequence
  chemically synthesized
cactcttttttttttctatact

SEQ ID NO: 928187 - DNA, 22 bp, Artificial Sequence
  chemically synthesized
ccactcttttttttttctatac

SEQ ID NO: 928188 - DNA, 22 bp, Artificial Sequence
  chemically synthesized
tccactcttttttttttctata

SEQ ID NO: 928189 - DNA, 22 bp, Artificial Sequence
  chemically synthesized
ttccactcttttttttttctat

SEQ ID NO: 928190 - DNA, 22 bp, Artificial Sequence
  chemically synthesized
tttttccactcttttttttttc

SEQ ID NO: 928191 - DNA, 22 bp, Artificial Sequence
  chemically synthesized
tactatttttccactctttttt

SEQ ID NO: 928192 - DNA, 22 bp, Artificial Sequence
  chemically synthesized
tatactatttttccactctttt

SEQ ID NO: 928193 - DNA, 22 bp, Artificial Sequence
  chemically synthesized
ctatactatttttccactcttt

SEQ ID NO: 928194 - DNA, 22 bp, Artificial Sequence
  chemically synthesized
tctatactatttttccactctt

SEQ ID NO: 928195 - DNA, 22 bp, Artificial Sequence
  chemically synthesized
ttctatactatttttccactct

SEQ ID NO: 928196 - DNA, 22 bp, Artificial Sequence
  chemically synthesized
cttttctatactatttttccac

SEQ ID NO: 928197 - DNA, 22 bp, Artificial Sequence
  chemically synthesized
gttgcttttctatactattttt

SEQ ID NO: 928198 - DNA, 22 bp, Artificial Sequence
  chemically synthesized
ctagttgcttttctatactatt

SEQ ID NO: 928199 - DNA, 22 bp, Artificial Sequence
  chemically synthesized
cctagttgcttttctatactat

SEQ ID NO: 928200 - DNA, 22 bp, Artificial Sequence
  chemically synthesized
tccttcctagttgcttttctat

SEQ ID NO: 928201 - DNA, 22 bp, Artificial Sequence
  chemically synthesized
atccttcctagttgcttttcta

SEQ ID NO: 928202 - DNA, 22 bp, Artificial Sequence
  chemically synthesized
ttatccttcctagttgcttttc

SEQ ID NO: 928203 - DNA, 22 bp, Artificial Sequence
  chemically synthesized
cttatccttcctagttgctttt

SEQ ID NO: 928204 - DNA, 22 bp, Artificial Sequence
  chemically synthesized
tcttatccttcctagttgcttt

SEQ ID NO: 928205 - DNA, 22 bp, Artificial Sequence
  chemically synthesized
ttttcttatccttcctagttgc

SEQ ID NO: 928206 - DNA, 22 bp, Artificial Sequence
  chemically synthesized
actgttttcttatccttcctag

SEQ ID NO: 928207 - DNA, 22 bp, Artificial Sequence
  chemically synthesized
cactgttttcttatccttccta

SEQ ID NO: 928208 - DNA, 22 bp, Artificial Sequence
  chemically synthesized
tcactgttttcttatccttcct

SEQ ID NO: 928209 - DNA, 22 bp, Artificial Sequence
  chemically synthesized
ttcactgttttcttatccttcc

SEQ ID NO: 928210 - DNA, 22 bp, Artificial Sequence
  chemically synthesized
agccatttttcactgttttctt

SEQ ID NO: 928211 - DNA, 22 bp, Artificial Sequence
  chemically synthesized
cagccatttttcactgttttct

SEQ ID NO: 928212 - DNA, 22 bp, Artificial Sequence
  chemically synthesized
ggaaggataagaaaacagtgaa

SEQ ID NO: 928213 - DNA, 22 bp, Artificial Sequence
  chemically synthesized
tttcagccatttttcactgttt

SEQ ID NO: 928214 - DNA, 22 bp, Artificial Sequence
  chemically synthesized
atttcagccatttttcactgtt

SEQ ID NO: 928215 - DNA, 22 bp, Artificial Sequence
  chemically synthesized
aaaaaaaggccatttatttcag

SEQ ID NO: 928216 - DNA, 22 bp, Artificial Sequence
  chemically synthesized
ctcaaaaaaaggccatttattt

SEQ ID NO: 928217 - DNA, 22 bp, Artificial Sequence
  chemically synthesized
actcaaaaaaaggccatttatt

SEQ ID NO: 928218 - DNA, 22 bp, Artificial Sequence
  chemically synthesized
tactcaaaaaaaggccatttat

SEQ ID NO: 928219 - DNA, 22 bp, Artificial Sequence
  chemically synthesized
tttactcaaaaaaaggccattt

SEQ ID NO: 928220 - DNA, 22 bp, Artificial Sequence
  chemically synthesized
ctttactcaaaaaaaggccatt

SEQ ID NO: 928221 - DNA, 22 bp, Artificial Sequence
  chemically synthesized
tctttactcaaaaaaaggccat

SEQ ID NO: 928222 - DNA, 22 bp, Artificial Sequence
  chemically synthesized
tttctttactcaaaaaaaggcc

SEQ ID NO: 928223 - DNA, 22 bp, Artificial Sequence
  chemically synthesized
aaataaatggcctttttttgag

SEQ ID NO: 928224 - DNA, 22 bp, Artificial Sequence
  chemically synthesized
attctttctttactcaaaaaaa

SEQ ID NO: 928225 - DNA, 22 bp, Artificial Sequence
  chemically synthesized
cattctttctttactcaaaaaa

SEQ ID NO: 928226 - DNA, 22 bp, Artificial Sequence
  chemically synthesized
tcattctttctttactcaaaaa

SEQ ID NO: 928227 - DNA, 22 bp, Artificial Sequence
  chemically synthesized
taactttcattctttctttact

SEQ ID NO: 928228 - DNA, 22 bp, Artificial Sequence
  chemically synthesized
ctataactttcattctttcttt

SEQ ID NO: 928229 - DNA, 22 bp, Artificial Sequence
  chemically synthesized
tttttgagtaaagaaagaatga

SEQ ID NO: 928230 - DNA, 22 bp, Artificial Sequence
  chemically synthesized
ttttgagtaaagaaagaatgaa

SEQ ID NO: 928231 - DNA, 22 bp, Artificial Sequence
  chemically synthesized
cctcctataactttcattcttt

SEQ ID NO: 928232 - DNA, 22 bp, Artificial Sequence
  chemically synthesized
tttgagtaaagaaagaatgaaa

SEQ ID NO: 928233 - DNA, 22 bp, Artificial Sequence
  chemically synthesized
acctcctataactttcattctt

SEQ ID NO: 928234 - DNA, 22 bp, Artificial Sequence
  chemically synthesized
ttgagtaaagaaagaatgaaag

SEQ ID NO: 928235 - DNA, 22 bp, Artificial Sequence
  chemically synthesized
tgagtaaagaaagaatgaaagt

SEQ ID NO: 928236 - DNA, 22 bp, Artificial Sequence
  chemically synthesized
ttacctcctataactttcattc

SEQ ID NO: 928237 - DNA, 22 bp, Artificial Sequence
  chemically synthesized
gagtaaagaaagaatgaaagtt

SEQ ID NO: 928238 - DNA, 22 bp, Artificial Sequence
  chemically synthesized
agtaaagaaagaatgaaagtta

SEQ ID NO: 928239 - DNA, 22 bp, Artificial Sequence
  chemically synthesized
attcttacctcctataactttc

SEQ ID NO: 928240 - DNA, 22 bp, Artificial Sequence
  chemically synthesized
gattcttacctcctataacttt

SEQ ID NO: 928241 - DNA, 22 bp, Artificial Sequence
  chemically synthesized
accttgattcttacctcctata

SEQ ID NO: 928242 - DNA, 22 bp, Artificial Sequence
  chemically synthesized
gaccttgattcttacctcctat

SEQ ID NO: 928243 - DNA, 22 bp, Artificial Sequence
  chemically synthesized
cttgaccttgattcttacctcc

SEQ ID NO: 928244 - DNA, 22 bp, Artificial Sequence
  chemically synthesized
tccttgaccttgattcttacct

SEQ ID NO: 928245 - DNA, 22 bp, Artificial Sequence
  chemically synthesized
agctctccttgaccttgattct

SEQ ID NO: 928246 - DNA, 22 bp, Artificial Sequence
  chemically synthesized
tgagctctccttgaccttgatt

SEQ ID NO: 928247 - DNA, 22 bp, Artificial Sequence
  chemically synthesized
taggaggtaagaatcaaggtca

SEQ ID NO: 928248 - DNA, 22 bp, Artificial Sequence
  chemically synthesized
attctgagctctccttgacctt

SEQ ID NO: 928249 - DNA, 22 bp, Artificial Sequence
  chemically synthesized
tcattctgagctctccttgacc

SEQ ID NO: 928250 - DNA, 22 bp, Artificial Sequence
  chemically synthesized
ctcattctgagctctccttgac

SEQ ID NO: 928251 - DNA, 22 bp, Artificial Sequence
  chemically synthesized
tccttctcattctgagctctcc

SEQ ID NO: 928252 - DNA, 22 bp, Artificial Sequence
  chemically synthesized
gtccttctcattctgagctctc

SEQ ID NO: 928253 - DNA, 22 bp, Artificial Sequence
  chemically synthesized
ttgtccttctcattctgagctc

SEQ ID NO: 928254 - DNA, 22 bp, Artificial Sequence
  chemically synthesized
gattcttgtccttctcattctg

SEQ ID NO: 928255 - DNA, 22 bp, Artificial Sequence
  chemically synthesized
atatatggactggattcttgtc

SEQ ID NO: 928256 - DNA, 22 bp, Artificial Sequence
  chemically synthesized
agaatgagaaggacaagaatcc

SEQ ID NO: 928257 - DNA, 22 bp, Artificial Sequence
  chemically synthesized
catatatggactggattcttgt

SEQ ID NO: 928258 - DNA, 22 bp, Artificial Sequence
  chemically synthesized
tacttcatatatggactggatt

SEQ ID NO: 928259 - DNA, 22 bp, Artificial Sequence
  chemically synthesized
atacttcatatatggactggat

SEQ ID NO: 928260 - DNA, 22 bp, Artificial Sequence
  chemically synthesized
tcttatacttcatatatggact

SEQ ID NO: 928261 - DNA, 22 bp, Artificial Sequence
  chemically synthesized
gatattatcttatacttcatat

SEQ ID NO: 928262 - DNA, 22 bp, Artificial Sequence
  chemically synthesized
ggatattatcttatacttcata

SEQ ID NO: 928263 - DNA, 22 bp, Artificial Sequence
  chemically synthesized
acatgtttggatattatcttat

SEQ ID NO: 928264 - DNA, 22 bp, Artificial Sequence
  chemically synthesized
tactaacatgtttggatattat

SEQ ID NO: 928265 - DNA, 22 bp, Artificial Sequence
  chemically synthesized
ttgtactaacatgtttggatat

SEQ ID NO: 928266 - DNA, 22 bp, Artificial Sequence
  chemically synthesized
cctgttgtactaacatgtttgg

SEQ ID NO: 928267 - DNA, 22 bp, Artificial Sequence
  chemically synthesized
catgctccctgttgtactaaca

SEQ ID NO: 928268 - DNA, 22 bp, Artificial Sequence
  chemically synthesized
ccatgctccctgttgtactaac

SEQ ID NO: 928269 - DNA, 22 bp, Artificial Sequence
  chemically synthesized
tccatgctccctgttgtactaa

SEQ ID NO: 928270 - DNA, 22 bp, Artificial Sequence
  chemically synthesized
gtacaacagggagcatggaaag

SEQ ID NO: 928271 - DNA, 22 bp, Artificial Sequence
  chemically synthesized
ctcttctccccactgccttctc

SEQ ID NO: 928272 - DNA, 22 bp, Artificial Sequence
  chemically synthesized
ttctccccactgccttctcggc

SEQ ID NO: 928273 - DNA, 22 bp, Artificial Sequence
  chemically synthesized
ctccccactgccttctcggctc

SEQ ID NO: 928274 - DNA, 22 bp, Artificial Sequence
  chemically synthesized
tccccactgccttctcggctcc

SEQ ID NO: 928275 - DNA, 22 bp, Artificial Sequence
  chemically synthesized
cccactgccttctcggctccgt

SEQ ID NO: 928276 - DNA, 22 bp, Artificial Sequence
  chemically synthesized
ccttctcggctccgtctcctgc

SEQ ID NO: 928277 - DNA, 22 bp, Artificial Sequence
  chemically synthesized
ctcggctccgtctcctgccgct

SEQ ID NO: 928278 - DNA, 22 bp, Artificial Sequence
  chemically synthesized
tcggctccgtctcctgccgctt

SEQ ID NO: 928279 - DNA, 22 bp, Artificial Sequence
  chemically synthesized
ggctccgtctcctgccgcttct

SEQ ID NO: 928280 - DNA, 22 bp, Artificial Sequence
  chemically synthesized
aaagtgaggaggagaagcggca

SEQ ID NO: 928281 - DNA, 22 bp, Artificial Sequence
  chemically synthesized
gaaagtgaggaggagaagcggc

SEQ ID NO: 928282 - DNA, 22 bp, Artificial Sequence
  chemically synthesized
cgtctcctgccgcttctcctcc

SEQ ID NO: 928283 - DNA, 22 bp, Artificial Sequence
  chemically synthesized
agcttgaaagtgaggaggagaa

SEQ ID NO: 928284 - DNA, 22 bp, Artificial Sequence
  chemically synthesized
ctgccgcttctcctcctcactt

SEQ ID NO: 928285 - DNA, 22 bp, Artificial Sequence
  chemically synthesized
gagctaagcttgaaagtgagga

SEQ ID NO: 928286 - DNA, 22 bp, Artificial Sequence
  chemically synthesized
ccgcttctcctcctcactttca

SEQ ID NO: 928287 - DNA, 22 bp, Artificial Sequence
  chemically synthesized
ggcattggagctaagcttgaaa

SEQ ID NO: 928288 - DNA, 22 bp, Artificial Sequence
  chemically synthesized
ctcctcctcactttcaagctta

SEQ ID NO: 928289 - DNA, 22 bp, Artificial Sequence
  chemically synthesized
tcctcctcactttcaagcttag

SEQ ID NO: 928290 - DNA, 22 bp, Artificial Sequence
  chemically synthesized
ctgggcattggagctaagcttg

SEQ ID NO: 928291 - DNA, 22 bp, Artificial Sequence
  chemically synthesized
ctcctcactttcaagcttagct

SEQ ID NO: 928292 - DNA, 22 bp, Artificial Sequence
  chemically synthesized
actgggcattggagctaagctt

SEQ ID NO: 928293 - DNA, 22 bp, Artificial Sequence
  chemically synthesized
tactgggcattggagctaagct

SEQ ID NO: 928294 - DNA, 22 bp, Artificial Sequence
  chemically synthesized
ctcactttcaagcttagctcca

SEQ ID NO: 928295 - DNA, 22 bp, Artificial Sequence
  chemically synthesized
actttcaagcttagctccaatg

SEQ ID NO: 928296 - DNA, 22 bp, Artificial Sequence
  chemically synthesized
agttttactgggcattggagct

SEQ ID NO: 928297 - DNA, 22 bp, Artificial Sequence
  chemically synthesized
ctcagttttactgggcattgga

SEQ ID NO: 928298 - DNA, 22 bp, Artificial Sequence
  chemically synthesized
tcaagcttagctccaatgccca

SEQ ID NO: 928299 - DNA, 22 bp, Artificial Sequence
  chemically synthesized
caagcttagctccaatgcccag

SEQ ID NO: 928300 - DNA, 22 bp, Artificial Sequence
  chemically synthesized
aagcttagctccaatgcccagt

SEQ ID NO: 928301 - DNA, 22 bp, Artificial Sequence
  chemically synthesized
agctccaatgcccagtaaaact

SEQ ID NO: 928302 - DNA, 22 bp, Artificial Sequence
  chemically synthesized
gctccaatgcccagtaaaactg

SEQ ID NO: 928303 - DNA, 22 bp, Artificial Sequence
  chemically synthesized
caatgcccagtaaaactgagta

SEQ ID NO: 928304 - DNA, 22 bp, Artificial Sequence
  chemically synthesized
acagtatcgtcaaggaagtaga

SEQ ID NO: 928305 - DNA, 22 bp, Artificial Sequence
  chemically synthesized
aacagtatcgtcaaggaagtag

SEQ ID NO: 928306 - DNA, 22 bp, Artificial Sequence
  chemically synthesized
agtaactttctacttccttgac

SEQ ID NO: 928307 - DNA, 22 bp, Artificial Sequence
  chemically synthesized
tacaacttaacagtatcgtcaa

SEQ ID NO: 928308 - DNA, 22 bp, Artificial Sequence
  chemically synthesized
tctacttccttgacgatactgt

SEQ ID NO: 928309 - DNA, 22 bp, Artificial Sequence
  chemically synthesized
ctacttccttgacgatactgtt

SEQ ID NO: 928310 - DNA, 22 bp, Artificial Sequence
  chemically synthesized
tacttccttgacgatactgtta

SEQ ID NO: 928311 - DNA, 22 bp, Artificial Sequence
  chemically synthesized
tcctatacaacttaacagtatc

SEQ ID NO: 928312 - DNA, 22 bp, Artificial Sequence
  chemically synthesized
gtcctatacaacttaacagtat

SEQ ID NO: 928313 - DNA, 22 bp, Artificial Sequence
  chemically synthesized
cttccttgacgatactgttaag

SEQ ID NO: 928314 - DNA, 22 bp, Artificial Sequence
  chemically synthesized
ccttgacgatactgttaagttg

SEQ ID NO: 928315 - DNA, 22 bp, Artificial Sequence
  chemically synthesized
cttgacgatactgttaagttgt

SEQ ID NO: 928316 - DNA, 22 bp, Artificial Sequence
  chemically synthesized
gacgatactgttaagttgtata

SEQ ID NO: 928317 - DNA, 22 bp, Artificial Sequence
  chemically synthesized
acgatactgttaagttgtatag

SEQ ID NO: 928318 - DNA, 22 bp, Artificial Sequence
  chemically synthesized
ttaagttgtataggacaaattc

SEQ ID NO: 928319 - DNA, 22 bp, Artificial Sequence
  chemically synthesized
aagatgagtaacgaatttgtcc

SEQ ID NO: 928320 - DNA, 22 bp, Artificial Sequence
  chemically synthesized
agttgtataggacaaattcgtt

SEQ ID NO: 928321 - DNA, 22 bp, Artificial Sequence
  chemically synthesized
ttaaagatgagtaacgaatttg

SEQ ID NO: 928322 - DNA, 22 bp, Artificial Sequence
  chemically synthesized
actattaaagatgagtaacgaa

SEQ ID NO: 928323 - DNA, 22 bp, Artificial Sequence
  chemically synthesized
tataggacaaattcgttactca

SEQ ID NO: 928324 - DNA, 22 bp, Artificial Sequence
  chemically synthesized
tgctaactattaaagatgagta

SEQ ID NO: 928325 - DNA, 22 bp, Artificial Sequence
  chemically synthesized
atgctaactattaaagatgagt

SEQ ID NO: 928326 - DNA, 22 bp, Artificial Sequence
  chemically synthesized
tatgctaactattaaagatgag

SEQ ID NO: 928327 - DNA, 22 bp, Artificial Sequence
  chemically synthesized
ttatgctaactattaaagatga

SEQ ID NO: 928328 - DNA, 22 bp, Artificial Sequence
  chemically synthesized
gttactcatctttaatagttag

SEQ ID NO: 928329 - DNA, 22 bp, Artificial Sequence
  chemically synthesized
ctcatctttaatagttagcata

SEQ ID NO: 928330 - DNA, 22 bp, Artificial Sequence
  chemically synthesized
atctttaatagttagcataaaa

SEQ ID NO: 928331 - DNA, 22 bp, Artificial Sequence
  chemically synthesized
gaaagagggtacttttatgcta

SEQ ID NO: 928332 - DNA, 22 bp, Artificial Sequence
  chemically synthesized
tagaaagagggtacttttatgc

SEQ ID NO: 928333 - DNA, 22 bp, Artificial Sequence
  chemically synthesized
taatagttagcataaaagtacc

SEQ ID NO: 928334 - DNA, 22 bp, Artificial Sequence
  chemically synthesized
aatagttagcataaaagtaccc

SEQ ID NO: 928335 - DNA, 22 bp, Artificial Sequence
  chemically synthesized
atagttagcataaaagtaccct

SEQ ID NO: 928336 - DNA, 22 bp, Artificial Sequence
  chemically synthesized
aaagtcctctagaaagagggta

SEQ ID NO: 928337 - DNA, 22 bp, Artificial Sequence
  chemically synthesized
aaaagtcctctagaaagagggt

SEQ ID NO: 928338 - DNA, 22 bp, Artificial Sequence
  chemically synthesized
gcataaaagtaccctctttcta

SEQ ID NO: 928339 - DNA, 22 bp, Artificial Sequence
  chemically synthesized
ttaaaagtcctctagaaagagg

SEQ ID NO: 928340 - DNA, 22 bp, Artificial Sequence
  chemically synthesized
ggcctcttaaaagtcctctaga

SEQ ID NO: 928341 - DNA, 22 bp, Artificial Sequence
  chemically synthesized
ccctaggcctcttaaaagtcct

SEQ ID NO: 928342 - DNA, 22 bp, Artificial Sequence
  chemically synthesized
gttcccctaggcctcttaaaag

SEQ ID NO: 928343 - DNA, 22 bp, Artificial Sequence
  chemically synthesized
tttctagaggacttttaagagg

SEQ ID NO: 928344 - DNA, 22 bp, Artificial Sequence
  chemically synthesized
agttcccctaggcctcttaaaa

SEQ ID NO: 928345 - DNA, 22 bp, Artificial Sequence
  chemically synthesized
tctagaggacttttaagaggcc

SEQ ID NO: 928346 - DNA, 22 bp, Artificial Sequence
  chemically synthesized
ctagaggacttttaagaggcct

SEQ ID NO: 928347 - DNA, 22 bp, Artificial Sequence
  chemically synthesized
tagaggacttttaagaggccta

SEQ ID NO: 928348 - DNA, 22 bp, Artificial Sequence
  chemically synthesized
gaggacttttaagaggcctagg

SEQ ID NO: 928349 - DNA, 22 bp, Artificial Sequence
  chemically synthesized
ttaagaggcctaggggaactaa

SEQ ID NO: 928350 - DNA, 22 bp, Artificial Sequence
  chemically synthesized
taagaggcctaggggaactaag

SEQ ID NO: 928351 - DNA, 22 bp, Artificial Sequence
  chemically synthesized
aagaggcctaggggaactaagt

SEQ ID NO: 928352 - DNA, 22 bp, Artificial Sequence
  chemically synthesized
agaggcctaggggaactaagtg

SEQ ID NO: 928353 - DNA, 22 bp, Artificial Sequence
  chemically synthesized
tacaaaggaggggcacttagtt

SEQ ID NO: 928354 - DNA, 22 bp, Artificial Sequence
  chemically synthesized
ggggaactaagtgcccctcctt

SEQ ID NO: 928355 - DNA, 22 bp, Artificial Sequence
  chemically synthesized
taaatacctatacaaaggaggg

SEQ ID NO: 928356 - DNA, 22 bp, Artificial Sequence
  chemically synthesized
ataaatacctatacaaaggagg

SEQ ID NO: 928357 - DNA, 22 bp, Artificial Sequence
  chemically synthesized
tataaatacctatacaaaggag

SEQ ID NO: 928358 - DNA, 22 bp, Artificial Sequence
  chemically synthesized
agtgcccctcctttgtataggt

SEQ ID NO: 928359 - DNA, 22 bp, Artificial Sequence
  chemically synthesized
ctttgtataggtatttataaaa

SEQ ID NO: 928360 - DNA, 22 bp, Artificial Sequence
  chemically synthesized
tgtataggtatttataaaatgt

SEQ ID NO: 928361 - DNA, 22 bp, Artificial Sequence
  chemically synthesized
gtataggtatttataaaatgtt

SEQ ID NO: 928362 - DNA, 22 bp, Artificial Sequence
  chemically synthesized
tataggtatttataaaatgttt

SEQ ID NO: 928363 - DNA, 22 bp, Artificial Sequence
  chemically synthesized
ataaaatgtttccatttgtgtc

SEQ ID NO: 928364 - DNA, 22 bp, Artificial Sequence
  chemically synthesized
taaaatgtttccatttgtgtca

SEQ ID NO: 928365 - DNA, 22 bp, Artificial Sequence
  chemically synthesized
ccatttgtgtcattctcatatg

SEQ ID NO: 928366 - DNA, 22 bp, Artificial Sequence
  chemically synthesized
taaagtccaaaacatatgagaa

SEQ ID NO: 928367 - DNA, 22 bp, Artificial Sequence
  chemically synthesized
catttgtgtcattctcatatgt

SEQ ID NO: 928368 - DNA, 22 bp, Artificial Sequence
  chemically synthesized
agctgtaaagtccaaaacatat

SEQ ID NO: 928369 - DNA, 22 bp, Artificial Sequence
  chemically synthesized
gtgtcattctcatatgttttgg

SEQ ID NO: 928370 - DNA, 22 bp, Artificial Sequence
  chemically synthesized
tgtcattctcatatgttttgga

SEQ ID NO: 928371 - DNA, 22 bp, Artificial Sequence
  chemically synthesized
atattcagctgtaaagtccaaa

SEQ ID NO: 928372 - DNA, 22 bp, Artificial Sequence
  chemically synthesized
aatattcagctgtaaagtccaa

SEQ ID NO: 928373 - DNA, 22 bp, Artificial Sequence
  chemically synthesized
tcatatgttttggactttacag

SEQ ID NO: 928374 - DNA, 22 bp, Artificial Sequence
  chemically synthesized
atatgttttggactttacagct

SEQ ID NO: 928375 - DNA, 22 bp, Artificial Sequence
  chemically synthesized
ggtcatgcttaatattcagctg

SEQ ID NO: 928376 - DNA, 22 bp, Artificial Sequence
  chemically synthesized
tggactttacagctgaatatta

SEQ ID NO: 928377 - DNA, 22 bp, Artificial Sequence
  chemically synthesized
ggactttacagctgaatattaa

SEQ ID NO: 928378 - DNA, 22 bp, Artificial Sequence
  chemically synthesized
attcggtcatgcttaatattca

SEQ ID NO: 928379 - DNA, 22 bp, Artificial Sequence
  chemically synthesized
gactttacagctgaatattaag

SEQ ID NO: 928380 - DNA, 22 bp, Artificial Sequence
  chemically synthesized
tacagctgaatattaagcatga

SEQ ID NO: 928381 - DNA, 22 bp, Artificial Sequence
  chemically synthesized
acagctgaatattaagcatgac

SEQ ID NO: 928382 - DNA, 22 bp, Artificial Sequence
  chemically synthesized
cagctgaatattaagcatgacc

SEQ ID NO: 928383 - DNA, 22 bp, Artificial Sequence
  chemically synthesized
aatattaagcatgaccgaatga

SEQ ID NO: 928384 - DNA, 22 bp, Artificial Sequence
  chemically synthesized
aagagaagaaagccctcattcg

SEQ ID NO: 928385 - DNA, 22 bp, Artificial Sequence
  chemically synthesized
ttcaagagaagaaagccctcat

SEQ ID NO: 928386 - DNA, 22 bp, Artificial Sequence
  chemically synthesized
agcatgaccgaatgagggcttt

SEQ ID NO: 928387 - DNA, 22 bp, Artificial Sequence
  chemically synthesized
tgttcaagagaagaaagccctc

SEQ ID NO: 928388 - DNA, 22 bp, Artificial Sequence
  chemically synthesized
ctgttcaagagaagaaagccct

SEQ ID NO: 928389 - DNA, 22 bp, Artificial Sequence
  chemically synthesized
tctgttcaagagaagaaagccc

SEQ ID NO: 928390 - DNA, 22 bp, Artificial Sequence
  chemically synthesized
gagatgtattttctgttcaaga

SEQ ID NO: 928391 - DNA, 22 bp, Artificial Sequence
  chemically synthesized
agagatgtattttctgttcaag

SEQ ID NO: 928392 - DNA, 22 bp, Artificial Sequence
  chemically synthesized
tcttctcttgaacagaaaatac

SEQ ID NO: 928393 - DNA, 22 bp, Artificial Sequence
  chemically synthesized
aaatttagagatgtattttctg

SEQ ID NO: 928394 - DNA, 22 bp, Artificial Sequence
  chemically synthesized
cttctcttgaacagaaaataca

SEQ ID NO: 928395 - DNA, 22 bp, Artificial Sequence
  chemically synthesized
ttctcttgaacagaaaatacat

SEQ ID NO: 928396 - DNA, 22 bp, Artificial Sequence
  chemically synthesized
ctcttgaacagaaaatacatct

SEQ ID NO: 928397 - DNA, 22 bp, Artificial Sequence
  chemically synthesized
tcttgaacagaaaatacatctc

SEQ ID NO: 928398 - DNA, 22 bp, Artificial Sequence
  chemically synthesized
ttgaacagaaaatacatctcta

SEQ ID NO: 928399 - DNA, 22 bp, Artificial Sequence
  chemically synthesized
gaacagaaaatacatctctaaa

SEQ ID NO: 928400 - DNA, 22 bp, Artificial Sequence
  chemically synthesized
aacagaaaatacatctctaaat

SEQ ID NO: 928401 - DNA, 22 bp, Artificial Sequence
  chemically synthesized
tagtgccgttcaaatttagaga

SEQ ID NO: 928402 - DNA, 22 bp, Artificial Sequence
  chemically synthesized
aatctgtagtgccgttcaaatt

SEQ ID NO: 928403 - DNA, 22 bp, Artificial Sequence
  chemically synthesized
aaagttgaatctgtagtgccgt

SEQ ID NO: 928404 - DNA, 22 bp, Artificial Sequence
  chemically synthesized
taaatttgaacggcactacaga

SEQ ID NO: 928405 - DNA, 22 bp, Artificial Sequence
  chemically synthesized
gttaaaagttgaatctgtagtg

SEQ ID NO: 928406 - DNA, 22 bp, Artificial Sequence
  chemically synthesized
aatttgaacggcactacagatt

SEQ ID NO: 928407 - DNA, 22 bp, Artificial Sequence
  chemically synthesized
agttaaaagttgaatctgtagt

SEQ ID NO: 928408 - DNA, 22 bp, Artificial Sequence
  chemically synthesized
gaacggcactacagattcaact

SEQ ID NO: 928409 - DNA, 22 bp, Artificial Sequence
  chemically synthesized
aacggcactacagattcaactt

SEQ ID NO: 928410 - DNA, 22 bp, Artificial Sequence
  chemically synthesized
gaggtccttagttaaaagttga

SEQ ID NO: 928411 - DNA, 22 bp, Artificial Sequence
  chemically synthesized
cagattcaacttttaactaagg

SEQ ID NO: 928412 - DNA, 22 bp, Artificial Sequence
  chemically synthesized
ataaaagatctggaggtcctta

SEQ ID NO: 928413 - DNA, 22 bp, Artificial Sequence
  chemically synthesized
aacttttaactaaggacctcca

SEQ ID NO: 928414 - DNA, 22 bp, Artificial Sequence
  chemically synthesized
ctaataaaagatctggaggtcc

SEQ ID NO: 928415 - DNA, 22 bp, Artificial Sequence
  chemically synthesized
ttaactaaggacctccagatct

SEQ ID NO: 928416 - DNA, 22 bp, Artificial Sequence
  chemically synthesized
taactaaggacctccagatctt

SEQ ID NO: 928417 - DNA, 22 bp, Artificial Sequence
  chemically synthesized
aactaaggacctccagatcttt

SEQ ID NO: 928418 - DNA, 22 bp, Artificial Sequence
  chemically synthesized
actaaggacctccagatctttt

SEQ ID NO: 928419 - DNA, 22 bp, Artificial Sequence
  chemically synthesized
caaattactaataaaagatctg

SEQ ID NO: 928420 - DNA, 22 bp, Artificial Sequence
  chemically synthesized
gcaaattactaataaaagatct

SEQ ID NO: 928421 - DNA, 22 bp, Artificial Sequence
  chemically synthesized
aggacctccagatcttttatta

SEQ ID NO: 928422 - DNA, 22 bp, Artificial Sequence
  chemically synthesized
cttgcaaattactaataaaaga

SEQ ID NO: 928423 - DNA, 22 bp, Artificial Sequence
  chemically synthesized
agttccttgcaaattactaata

SEQ ID NO: 928424 - DNA, 22 bp, Artificial Sequence
  chemically synthesized
cagatcttttattagtaatttg

SEQ ID NO: 928425 - DNA, 22 bp, Artificial Sequence
  chemically synthesized
actgagttccttgcaaattact

SEQ ID NO: 928426 - DNA, 22 bp, Artificial Sequence
  chemically synthesized
gactgagttccttgcaaattac

SEQ ID NO: 928427 - DNA, 22 bp, Artificial Sequence
  chemically synthesized
tttgactgagttccttgcaaat

SEQ ID NO: 928428 - DNA, 22 bp, Artificial Sequence
  chemically synthesized
atttgactgagttccttgcaaa

SEQ ID NO: 928429 - DNA, 22 bp, Artificial Sequence
  chemically synthesized
tatttgactgagttccttgcaa

SEQ ID NO: 928430 - DNA, 22 bp, Artificial Sequence
  chemically synthesized
ttattagtaatttgcaaggaac

SEQ ID NO: 928431 - DNA, 22 bp, Artificial Sequence
  chemically synthesized
ttatttgactgagttccttgca

SEQ ID NO: 928432 - DNA, 22 bp, Artificial Sequence
  chemically synthesized
tattagtaatttgcaaggaact

SEQ ID NO: 928433 - DNA, 22 bp, Artificial Sequence
  chemically synthesized
tttatttgactgagttccttgc

SEQ ID NO: 928434 - DNA, 22 bp, Artificial Sequence
  chemically synthesized
attagtaatttgcaaggaactc

SEQ ID NO: 928435 - DNA, 22 bp, Artificial Sequence
  chemically synthesized
ttagtaatttgcaaggaactca

SEQ ID NO: 928436 - DNA, 22 bp, Artificial Sequence
  chemically synthesized
gtaatttgcaaggaactcagtc

SEQ ID NO: 928437 - DNA, 22 bp, Artificial Sequence
  chemically synthesized
gcaaggaactcagtcaaataaa

SEQ ID NO: 928438 - DNA, 22 bp, Artificial Sequence
  chemically synthesized
caaggaactcagtcaaataaaa

SEQ ID NO: 928439 - DNA, 22 bp, Artificial Sequence
  chemically synthesized
agtcaaataaaaaggtcctgtc

SEQ ID NO: 928440 - DNA, 22 bp, Artificial Sequence
  chemically synthesized
tgaatagcacaagacaggacct

SEQ ID NO: 928441 - DNA, 22 bp, Artificial Sequence
  chemically synthesized
ttgtgaatagcacaagacagga

SEQ ID NO: 928442 - DNA, 22 bp, Artificial Sequence
  chemically synthesized
ctattgtgaatagcacaagaca

SEQ ID NO: 928443 - DNA, 22 bp, Artificial Sequence
  chemically synthesized
gctattgtgaatagcacaagac

SEQ ID NO: 928444 - DNA, 22 bp, Artificial Sequence
  chemically synthesized
tgctattgtgaatagcacaaga

SEQ ID NO: 928445 - DNA, 22 bp, Artificial Sequence
  chemically synthesized
catgtctttgctattgtgaata

SEQ ID NO: 928446 - DNA, 22 bp, Artificial Sequence
  chemically synthesized
tcttgtgctattcacaatagca

SEQ ID NO: 928447 - DNA, 22 bp, Artificial Sequence
  chemically synthesized
gtgctattcacaatagcaaaga

SEQ ID NO: 928448 - DNA, 22 bp, Artificial Sequence
  chemically synthesized
tgctattcacaatagcaaagac

SEQ ID NO: 928449 - DNA, 22 bp, Artificial Sequence
  chemically synthesized
gatggattccatgtctttgcta

SEQ ID NO: 928450 - DNA, 22 bp, Artificial Sequence
  chemically synthesized
ttcacaatagcaaagacatgga

SEQ ID NO: 928451 - DNA, 22 bp, Artificial Sequence
  chemically synthesized
acaactagatggattccatgtc

SEQ ID NO: 928452 - DNA, 22 bp, Artificial Sequence
  chemically synthesized
acaatagcaaagacatggaatc

SEQ ID NO: 928453 - DNA, 22 bp, Artificial Sequence
  chemically synthesized
cacaactagatggattccatgt

SEQ ID NO: 928454 - DNA, 22 bp, Artificial Sequence
  chemically synthesized
tttcacaactagatggattcca

SEQ ID NO: 928455 - DNA, 22 bp, Artificial Sequence
  chemically synthesized
ccattgtttcacaactagatgg

SEQ ID NO: 928456 - DNA, 22 bp, Artificial Sequence
  chemically synthesized
tccaatctaccattgtttcaca

SEQ ID NO: 928457 - DNA, 22 bp, Artificial Sequence
  chemically synthesized
atccaatctaccattgtttcac

SEQ ID NO: 928458 - DNA, 22 bp, Artificial Sequence
  chemically synthesized
tatccaatctaccattgtttca

SEQ ID NO: 928459 - DNA, 22 bp, Artificial Sequence
  chemically synthesized
tttatccaatctaccattgttt

SEQ ID NO: 928460 - DNA, 22 bp, Artificial Sequence
  chemically synthesized
ctttatccaatctaccattgtt

SEQ ID NO: 928461 - DNA, 22 bp, Artificial Sequence
  chemically synthesized
tctttatccaatctaccattgt

SEQ ID NO: 928462 - DNA, 22 bp, Artificial Sequence
  chemically synthesized
gttgtgaaacaatggtagattg

SEQ ID NO: 928463 - DNA, 22 bp, Artificial Sequence
  chemically synthesized
tgaaacaatggtagattggata

SEQ ID NO: 928464 - DNA, 22 bp, Artificial Sequence
  chemically synthesized
atggtgtatatgtaccacattt

SEQ ID NO: 928465 - DNA, 22 bp, Artificial Sequence
  chemically synthesized
catggtgtatatgtaccacatt

SEQ ID NO: 928466 - DNA, 22 bp, Artificial Sequence
  chemically synthesized
gataaagaaaatgtggtacata

SEQ ID NO: 928467 - DNA, 22 bp, Artificial Sequence
  chemically synthesized
tgtagtatttcatggtgtatat

SEQ ID NO: 928468 - DNA, 22 bp, Artificial Sequence
  chemically synthesized
tgactatgtagtatttcatggt

SEQ ID NO: 928469 - DNA, 22 bp, Artificial Sequence
  chemically synthesized
atgactatgtagtatttcatgg

SEQ ID NO: 928470 - DNA, 22 bp, Artificial Sequence
  chemically synthesized
tatgactatgtagtatttcatg

SEQ ID NO: 928471 - DNA, 22 bp, Artificial Sequence
  chemically synthesized
ttatgactatgtagtatttcat

SEQ ID NO: 928472 - DNA, 22 bp, Artificial Sequence
  chemically synthesized
tttatgactatgtagtatttca

SEQ ID NO: 928473 - DNA, 22 bp, Artificial Sequence
  chemically synthesized
tttttatgactatgtagtattt

SEQ ID NO: 928474 - DNA, 22 bp, Artificial Sequence
  chemically synthesized
attctttttatgactatgtagt

SEQ ID NO: 928475 - DNA, 22 bp, Artificial Sequence
  chemically synthesized
cattctttttatgactatgtag

SEQ ID NO: 928476 - DNA, 22 bp, Artificial Sequence
  chemically synthesized
catagtcataaaaagaatgaaa

SEQ ID NO: 928477 - DNA, 22 bp, Artificial Sequence
  chemically synthesized
cgcaaaggacatgatttcattc

SEQ ID NO: 928478 - DNA, 22 bp, Artificial Sequence
  chemically synthesized
ccgcaaaggacatgatttcatt

SEQ ID NO: 928479 - DNA, 22 bp, Artificial Sequence
  chemically synthesized
catccgtgcttccgcaaaggac

SEQ ID NO: 928480 - DNA, 22 bp, Artificial Sequence
  chemically synthesized
caactgcatccgtgcttccgca

SEQ ID NO: 928481 - DNA, 22 bp, Artificial Sequence
  chemically synthesized
tggcctccaactgcatccgtgc

SEQ ID NO: 928482 - DNA, 22 bp, Artificial Sequence
  chemically synthesized
tgcggaagcacggatgcagttg

SEQ ID NO: 928483 - DNA, 22 bp, Artificial Sequence
  chemically synthesized
gcggaagcacggatgcagttgg

SEQ ID NO: 928484 - DNA, 22 bp, Artificial Sequence
  chemically synthesized
tgattatggcctccaactgcat

SEQ ID NO: 928485 - DNA, 22 bp, Artificial Sequence
  chemically synthesized
cggaagcacggatgcagttgga

SEQ ID NO: 928486 - DNA, 22 bp, Artificial Sequence
  chemically synthesized
atgattatggcctccaactgca

SEQ ID NO: 928487 - DNA, 22 bp, Artificial Sequence
  chemically synthesized
cttatgattatggcctccaact

SEQ ID NO: 928488 - DNA, 22 bp, Artificial Sequence
  chemically synthesized
gcttatgattatggcctccaac

SEQ ID NO: 928489 - DNA, 22 bp, Artificial Sequence
  chemically synthesized
atttgcttatgattatggcctc

SEQ ID NO: 928490 - DNA, 22 bp, Artificial Sequence
  chemically synthesized
cgttaatttgcttatgattatg

SEQ ID NO: 928491 - DNA, 22 bp, Artificial Sequence
  chemically synthesized
ctgcgttaatttgcttatgatt

SEQ ID NO: 928492 - DNA, 22 bp, Artificial Sequence
  chemically synthesized
ttcctgcgttaatttgcttatg

SEQ ID NO: 928493 - DNA, 22 bp, Artificial Sequence
  chemically synthesized
gaggccataatcataagcaaat

SEQ ID NO: 928494 - DNA, 22 bp, Artificial Sequence
  chemically synthesized
ctgttcctgcgttaatttgctt

SEQ ID NO: 928495 - DNA, 22 bp, Artificial Sequence
  chemically synthesized
cctgttcctgcgttaatttgct

SEQ ID NO: 928496 - DNA, 22 bp, Artificial Sequence
  chemically synthesized
tcctgttcctgcgttaatttgc

SEQ ID NO: 928497 - DNA, 22 bp, Artificial Sequence
  chemically synthesized
ttcctgttcctgcgttaatttg

SEQ ID NO: 928498 - DNA, 22 bp, Artificial Sequence
  chemically synthesized
tttttcctgttcctgcgttaat

SEQ ID NO: 928499 - DNA, 22 bp, Artificial Sequence
  chemically synthesized
gtttttcctgttcctgcgttaa

SEQ ID NO: 928500 - DNA, 22 bp, Artificial Sequence
  chemically synthesized
acgcaggaacaggaaaaacaaa

SEQ ID NO: 928501 - DNA, 22 bp, Artificial Sequence
  chemically synthesized
taagtgagaacatatagtgttt

SEQ ID NO: 928502 - DNA, 22 bp, Artificial Sequence
  chemically synthesized
ataagtgagaacatatagtgtt

SEQ ID NO: 928503 - DNA, 22 bp, Artificial Sequence
  chemically synthesized
ccacttataagtgagaacatat

SEQ ID NO: 928504 - DNA, 22 bp, Artificial Sequence
  chemically synthesized
gctcccacttataagtgagaac

SEQ ID NO: 928505 - DNA, 22 bp, Artificial Sequence
  chemically synthesized
agctcccacttataagtgagaa

SEQ ID NO: 928506 - DNA, 22 bp, Artificial Sequence
  chemically synthesized
tgtttagctcccacttataagt

SEQ ID NO: 928507 - DNA, 22 bp, Artificial Sequence
  chemically synthesized
tatgtttagctcccacttataa

SEQ ID NO: 928508 - DNA, 22 bp, Artificial Sequence
  chemically synthesized
tatgttctcacttataagtggg

SEQ ID NO: 928509 - DNA, 22 bp, Artificial Sequence
  chemically synthesized
tcacttataagtgggagctaaa

SEQ ID NO: 928510 - DNA, 22 bp, Artificial Sequence
  chemically synthesized
acttataagtgggagctaaaca

SEQ ID NO: 928511 - DNA, 22 bp, Artificial Sequence
  chemically synthesized
ataagtgggagctaaacataga

SEQ ID NO: 928512 - DNA, 22 bp, Artificial Sequence
  chemically synthesized
taagtgggagctaaacatagag

SEQ ID NO: 928513 - DNA, 22 bp, Artificial Sequence
  chemically synthesized
cgtccatatatgctctatgttt

SEQ ID NO: 928514 - DNA, 22 bp, Artificial Sequence
  chemically synthesized
acgtccatatatgctctatgtt

SEQ ID NO: 928515 - DNA, 22 bp, Artificial Sequence
  chemically synthesized
gcatatttacgtccatatatgc

SEQ ID NO: 928516 - DNA, 22 bp, Artificial Sequence
  chemically synthesized
ttcgcatatttacgtccatata

SEQ ID NO: 928517 - DNA, 22 bp, Artificial Sequence
  chemically synthesized
aacatagagcatatatggacgt

SEQ ID NO: 928518 - DNA, 22 bp, Artificial Sequence
  chemically synthesized
ttgttcgcatatttacgtccat

SEQ ID NO: 928519 - DNA, 22 bp, Artificial Sequence
  chemically synthesized
gtccgcggtatctgttgttcgc

SEQ ID NO: 928520 - DNA, 22 bp, Artificial Sequence
  chemically synthesized
ctagtccgcggtatctgttgtt

SEQ ID NO: 928521 - DNA, 22 bp, Artificial Sequence
  chemically synthesized
ccacatctactagtccgcggta

SEQ ID NO: 928522 - DNA, 22 bp, Artificial Sequence
  chemically synthesized
cccacatctactagtccgcggt

SEQ ID NO: 928523 - DNA, 22 bp, Artificial Sequence
  chemically synthesized
cttcccacatctactagtccgc

SEQ ID NO: 928524 - DNA, 22 bp, Artificial Sequence
  chemically synthesized
cctccttcccacatctactagt

SEQ ID NO: 928525 - DNA, 22 bp, Artificial Sequence
  chemically synthesized
gtagatgtgggaaggagggagg

SEQ ID NO: 928526 - DNA, 22 bp, Artificial Sequence
  chemically synthesized
aaccaatgcgcaccctccctcc

SEQ ID NO: 928527 - DNA, 22 bp, Artificial Sequence
  chemically synthesized
caaccaatgcgcaccctccctc

SEQ ID NO: 928528 - DNA, 22 bp, Artificial Sequence
  chemically synthesized
tcaaccaatgcgcaccctccct

SEQ ID NO: 928529 - DNA, 22 bp, Artificial Sequence
  chemically synthesized
ttcaaccaatgcgcaccctccc

SEQ ID NO: 928530 - DNA, 22 bp, Artificial Sequence
  chemically synthesized
atgagtagtttttcaaccaatg

SEQ ID NO: 928531 - DNA, 22 bp, Artificial Sequence
  chemically synthesized
cctgatgagtagtttttcaacc

SEQ ID NO: 928532 - DNA, 22 bp, Artificial Sequence
  chemically synthesized
gttgaaaaactactcatcaggt

SEQ ID NO: 928533 - DNA, 22 bp, Artificial Sequence
  chemically synthesized
aaaaactactcatcaggtaggt

SEQ ID NO: 928534 - DNA, 22 bp, Artificial Sequence
  chemically synthesized
ctcatcaggtaggtactatgct

SEQ ID NO: 928535 - DNA, 22 bp, Artificial Sequence
  chemically synthesized
atcaggtaggtactatgctcac

SEQ ID NO: 928536 - DNA, 22 bp, Artificial Sequence
  chemically synthesized
atcacccaaacagtgagcatag

SEQ ID NO: 928537 - DNA, 22 bp, Artificial Sequence
  chemically synthesized
gggtacagatctcatcacccaa

SEQ ID NO: 928538 - DNA, 22 bp, Artificial Sequence
  chemically synthesized
ggggtacagatctcatcaccca

SEQ ID NO: 928539 - DNA, 22 bp, Artificial Sequence
  chemically synthesized
tgctcactgtttgggtgatgag

SEQ ID NO: 928540 - DNA, 22 bp, Artificial Sequence
  chemically synthesized
actgtttgggtgatgagatctg

SEQ ID NO: 928541 - DNA, 22 bp, Artificial Sequence
  chemically synthesized
aggtttggggtacagatctcat

SEQ ID NO: 928542 - DNA, 22 bp, Artificial Sequence
  chemically synthesized
tttgggtgatgagatctgtacc

SEQ ID NO: 928543 - DNA, 22 bp, Artificial Sequence
  chemically synthesized
gggtgatgagatctgtacccca

SEQ ID NO: 928544 - DNA, 22 bp, Artificial Sequence
  chemically synthesized
ggtgatgagatctgtaccccaa

SEQ ID NO: 928545 - DNA, 22 bp, Artificial Sequence
  chemically synthesized
taccccaaacctcagcatcatg

SEQ ID NO: 928546 - DNA, 22 bp, Artificial Sequence
  chemically synthesized
tcacaggggaatagcgcatgat

SEQ ID NO: 928547 - DNA, 22 bp, Artificial Sequence
  chemically synthesized
gtcacaggggaatagcgcatga

SEQ ID NO: 928548 - DNA, 22 bp, Artificial Sequence
  chemically synthesized
agcatcatgcgctattcccctg

SEQ ID NO: 928549 - DNA, 22 bp, Artificial Sequence
  chemically synthesized
ttcccctgtgacaagcctgtac

SEQ ID NO: 928550 - DNA, 22 bp, Artificial Sequence
  chemically synthesized
ccctgtgacaagcctgtacatg

SEQ ID NO: 928551 - DNA, 22 bp, Artificial Sequence
  chemically synthesized
tatacagagggtacatgtacag

SEQ ID NO: 928552 - DNA, 22 bp, Artificial Sequence
  chemically synthesized
atatacagagggtacatgtaca

SEQ ID NO: 928553 - DNA, 22 bp, Artificial Sequence
  chemically synthesized
tatatacagagggtacatgtac

SEQ ID NO: 928554 - DNA, 22 bp, Artificial Sequence
  chemically synthesized
tgacaagcctgtacatgtaccc

SEQ ID NO: 928555 - DNA, 22 bp, Artificial Sequence
  chemically synthesized
ttttatatacagagggtacatg

SEQ ID NO: 928556 - DNA, 22 bp, Artificial Sequence
  chemically synthesized
attttatatacagagggtacat

SEQ ID NO: 928557 - DNA, 22 bp, Artificial Sequence
  chemically synthesized
tattttatatacagagggtaca

SEQ ID NO: 928558 - DNA, 22 bp, Artificial Sequence
  chemically synthesized
tacatgtaccctctgtatataa

SEQ ID NO: 928559 - DNA, 22 bp, Artificial Sequence
  chemically synthesized
aaataatcaaattttattttat

SEQ ID NO: 928560 - DNA, 22 bp, Artificial Sequence
  chemically synthesized
aaaataatcaaattttatttta

SEQ ID NO: 928561 - DNA, 22 bp, Artificial Sequence
  chemically synthesized
taaaataatcaaattttatttt

SEQ ID NO: 928562 - DNA, 22 bp, Artificial Sequence
  chemically synthesized
ttaaaataatcaaattttattt

SEQ ID NO: 928563 - DNA, 22 bp, Artificial Sequence
  chemically synthesized
tttaaaataatcaaattttatt

SEQ ID NO: 928564 - DNA, 22 bp, Artificial Sequence
  chemically synthesized
tgtatataaaataaaatttgat

SEQ ID NO: 928565 - DNA, 22 bp, Artificial Sequence
  chemically synthesized
ctttttaaaataatcaaatttt

SEQ ID NO: 928566 - DNA, 22 bp, Artificial Sequence
  chemically synthesized
tatataaaataaaatttgatta

SEQ ID NO: 928567 - DNA, 22 bp, Artificial Sequence
  chemically synthesized
ctcctttttaaaataatcaaat

SEQ ID NO: 928568 - DNA, 22 bp, Artificial Sequence
  chemically synthesized
taaagactgctcctttttaaaa

SEQ ID NO: 928569 - DNA, 22 bp, Artificial Sequence
  chemically synthesized
attgtaaagactgctccttttt

SEQ ID NO: 928570 - DNA, 22 bp, Artificial Sequence
  chemically synthesized
gattattttaaaaaggagcagt

SEQ ID NO: 928571 - DNA, 22 bp, Artificial Sequence
  chemically synthesized
attattttaaaaaggagcagtc

SEQ ID NO: 928572 - DNA, 22 bp, Artificial Sequence
  chemically synthesized
atcgttcattgtaaagactgct

SEQ ID NO: 928573 - DNA, 22 bp, Artificial Sequence
  chemically synthesized
ttttaaaaaggagcagtcttta

SEQ ID NO: 928574 - DNA, 22 bp, Artificial Sequence
  chemically synthesized
tgatcgttcattgtaaagactg

SEQ ID NO: 928575 - DNA, 22 bp, Artificial Sequence
  chemically synthesized
ctgatcgttcattgtaaagact

SEQ ID NO: 928576 - DNA, 22 bp, Artificial Sequence
  chemically synthesized
taaaaaggagcagtctttacaa

SEQ ID NO: 928577 - DNA, 22 bp, Artificial Sequence
  chemically synthesized
aaaaaggagcagtctttacaat

SEQ ID NO: 928578 - DNA, 22 bp, Artificial Sequence
  chemically synthesized
aaaaggagcagtctttacaatg

SEQ ID NO: 928579 - DNA, 22 bp, Artificial Sequence
  chemically synthesized
tttctgatcgttcattgtaaag

SEQ ID NO: 928580 - DNA, 22 bp, Artificial Sequence
  chemically synthesized
atttctgatcgttcattgtaaa

SEQ ID NO: 928581 - DNA, 22 bp, Artificial Sequence
  chemically synthesized
tatttctgatcgttcattgtaa

SEQ ID NO: 928582 - DNA, 22 bp, Artificial Sequence
  chemically synthesized
tacaatgaacgatcagaaataa

SEQ ID NO: 928583 - DNA, 22 bp, Artificial Sequence
  chemically synthesized
aaaaggtgcattttatttctga

SEQ ID NO: 928584 - DNA, 22 bp, Artificial Sequence
  chemically synthesized
acaatgaacgatcagaaataaa

SEQ ID NO: 928585 - DNA, 22 bp, Artificial Sequence
  chemically synthesized
caatgaacgatcagaaataaaa

SEQ ID NO: 928586 - DNA, 22 bp, Artificial Sequence
  chemically synthesized
tttagcctcttctttctcctgt

SEQ ID NO: 928587 - DNA, 22 bp, Artificial Sequence
  chemically synthesized
ttagcctcttctttctcctgtt

SEQ ID NO: 928588 - DNA, 22 bp, Artificial Sequence
  chemically synthesized
tagcctcttctttctcctgtta

SEQ ID NO: 928589 - DNA, 22 bp, Artificial Sequence
  chemically synthesized
agcctcttctttctcctgttat

SEQ ID NO: 928590 - DNA, 22 bp, Artificial Sequence
  chemically synthesized
aaaaaaaaaaagataacaggag

SEQ ID NO: 928591 - DNA, 22 bp, Artificial Sequence
  chemically synthesized
gcctcttctttctcctgttatc

SEQ ID NO: 928592 - DNA, 22 bp, Artificial Sequence
  chemically synthesized
ttctttctcctgttatcttttt

SEQ ID NO: 928593 - DNA, 22 bp, Artificial Sequence
  chemically synthesized
aaattgaaaaaaaaaaagataa

SEQ ID NO: 928594 - DNA, 22 bp, Artificial Sequence
  chemically synthesized
ctttctcctgttatcttttttt

SEQ ID NO: 928595 - DNA, 22 bp, Artificial Sequence
  chemically synthesized
tttctcctgttatctttttttt

SEQ ID NO: 928596 - DNA, 22 bp, Artificial Sequence
  chemically synthesized
ctgaaattgaaaaaaaaaaaga

SEQ ID NO: 928597 - DNA, 22 bp, Artificial Sequence
  chemically synthesized
actgaaattgaaaaaaaaaaag

SEQ ID NO: 928598 - DNA, 22 bp, Artificial Sequence
  chemically synthesized
tctcctgttatctttttttttt

SEQ ID NO: 928599 - DNA, 22 bp, Artificial Sequence
  chemically synthesized
ctcctgttatcttttttttttt

SEQ ID NO: 928600 - DNA, 22 bp, Artificial Sequence
  chemically synthesized
tcctgttatctttttttttttc

SEQ ID NO: 928601 - DNA, 22 bp, Artificial Sequence
  chemically synthesized
ctgttatctttttttttttcaa

SEQ ID NO: 928602 - DNA, 22 bp, Artificial Sequence
  chemically synthesized
ttatctttttttttttcaattt

SEQ ID NO: 928603 - DNA, 22 bp, Artificial Sequence
  chemically synthesized
tctttttttttttcaatttcag

SEQ ID NO: 928604 - DNA, 22 bp, Artificial Sequence
  chemically synthesized
tttttttttcaatttcagtaaa

SEQ ID NO: 928605 - DNA, 22 bp, Artificial Sequence
  chemically synthesized
ttttttttcaatttcagtaaac

SEQ ID NO: 928606 - DNA, 22 bp, Artificial Sequence
  chemically synthesized
tttttttcaatttcagtaaaca

SEQ ID NO: 928607 - DNA, 22 bp, Artificial Sequence
  chemically synthesized
ttttttcaatttcagtaaacat

SEQ ID NO: 928608 - DNA, 22 bp, Artificial Sequence
  chemically synthesized
tttttcaatttcagtaaacatt

SEQ ID NO: 928609 - DNA, 22 bp, Artificial Sequence
  chemically synthesized
ttttcaatttcagtaaacattt

SEQ ID NO: 928610 - DNA, 22 bp, Artificial Sequence
  chemically synthesized
gtaaggtacaataaatgtttac

SEQ ID NO: 928611 - DNA, 22 bp, Artificial Sequence
  chemically synthesized
tttcaatttcagtaaacattta

SEQ ID NO: 928612 - DNA, 22 bp, Artificial Sequence
  chemically synthesized
ttcaatttcagtaaacatttat

SEQ ID NO: 928613 - DNA, 22 bp, Artificial Sequence
  chemically synthesized
tcaatttcagtaaacatttatt

SEQ ID NO: 928614 - DNA, 22 bp, Artificial Sequence
  chemically synthesized
caatttcagtaaacatttattg

SEQ ID NO: 928615 - DNA, 22 bp, Artificial Sequence
  chemically synthesized
aatttcagtaaacatttattgt

SEQ ID NO: 928616 - DNA, 22 bp, Artificial Sequence
  chemically synthesized
tattagtaaggtacaataaatg

SEQ ID NO: 928617 - DNA, 22 bp, Artificial Sequence
  chemically synthesized
gtattagtaaggtacaataaat

SEQ ID NO: 928618 - DNA, 22 bp, Artificial Sequence
  chemically synthesized
cagtaaacatttattgtacctt

SEQ ID NO: 928619 - DNA, 22 bp, Artificial Sequence
  chemically synthesized
agtaaacatttattgtacctta

SEQ ID NO: 928620 - DNA, 22 bp, Artificial Sequence
  chemically synthesized
agcatttgtattagtaaggtac

SEQ ID NO: 928621 - DNA, 22 bp, Artificial Sequence
  chemically synthesized
cagcatttgtattagtaaggta

SEQ ID NO: 928622 - DNA, 22 bp, Artificial Sequence
  chemically synthesized
attgtaccttactaatacaaat

SEQ ID NO: 928623 - DNA, 22 bp, Artificial Sequence
  chemically synthesized
tatggtttcagcatttgtatta

SEQ ID NO: 928624 - DNA, 22 bp, Artificial Sequence
  chemically synthesized
ttgtaccttactaatacaaatg

SEQ ID NO: 928625 - DNA, 22 bp, Artificial Sequence
  chemically synthesized
gtatggtttcagcatttgtatt

SEQ ID NO: 928626 - DNA, 22 bp, Artificial Sequence
  chemically synthesized
taccttactaatacaaatgctg

SEQ ID NO: 928627 - DNA, 22 bp, Artificial Sequence
  chemically synthesized
actaatacaaatgctgaaacca

SEQ ID NO: 928628 - DNA, 22 bp, Artificial Sequence
  chemically synthesized
ctaatacaaatgctgaaaccat

SEQ ID NO: 928629 - DNA, 22 bp, Artificial Sequence
  chemically synthesized
atacaaatgctgaaaccataca

SEQ ID NO: 928630 - DNA, 22 bp, Artificial Sequence
  chemically synthesized
taacaaatgaacacacacattt

SEQ ID NO: 928631 - DNA, 22 bp, Artificial Sequence
  chemically synthesized
aaaccatacaaatgtgtgtgtt

SEQ ID NO: 928632 - DNA, 22 bp, Artificial Sequence
  chemically synthesized
ctgtaacaaatgaacacacaca

SEQ ID NO: 928633 - DNA, 22 bp, Artificial Sequence
  chemically synthesized
gttcctgtaacaaatgaacaca

SEQ ID NO: 928634 - DNA, 22 bp, Artificial Sequence
  chemically synthesized
tagttcctgtaacaaatgaaca

SEQ ID NO: 928635 - DNA, 22 bp, Artificial Sequence
  chemically synthesized
actctagttcctgtaacaaatg

SEQ ID NO: 928636 - DNA, 22 bp, Artificial Sequence
  chemically synthesized
ctgactctagttcctgtaacaa

SEQ ID NO: 928637 - DNA, 22 bp, Artificial Sequence
  chemically synthesized
ctcctgactctagttcctgtaa

SEQ ID NO: 928638 - DNA, 22 bp, Artificial Sequence
  chemically synthesized
atttgttacaggaactagagtc

SEQ ID NO: 928639 - DNA, 22 bp, Artificial Sequence
  chemically synthesized
acaaggcctgctcctgactcta

SEQ ID NO: 928640 - DNA, 22 bp, Artificial Sequence
  chemically synthesized
gttacaggaactagagtcagga

SEQ ID NO: 928641 - DNA, 22 bp, Artificial Sequence
  chemically synthesized
ttacaggaactagagtcaggag

SEQ ID NO: 928642 - DNA, 22 bp, Artificial Sequence
  chemically synthesized
caggaactagagtcaggagcag

SEQ ID NO: 928643 - DNA, 22 bp, Artificial Sequence
  chemically synthesized
aatgaaatctaacaaggcctgc

SEQ ID NO: 928644 - DNA, 22 bp, Artificial Sequence
  chemically synthesized
gagtcaggagcaggccttgtta

SEQ ID NO: 928645 - DNA, 22 bp, Artificial Sequence
  chemically synthesized
acaggaaaaagagagtattaaa

SEQ ID NO: 928646 - DNA, 22 bp, Artificial Sequence
  chemically synthesized
gttagatttcatttaatactct

SEQ ID NO: 928647 - DNA, 22 bp, Artificial Sequence
  chemically synthesized
ttagatttcatttaatactctc

SEQ ID NO: 928648 - DNA, 22 bp, Artificial Sequence
  chemically synthesized
gatttcatttaatactctcttt

SEQ ID NO: 928649 - DNA, 22 bp, Artificial Sequence
  chemically synthesized
tacctcacaggaaaaagagagt

SEQ ID NO: 928650 - DNA, 22 bp, Artificial Sequence
  chemically synthesized
ttatacctcacaggaaaaagag

SEQ ID NO: 928651 - DNA, 22 bp, Artificial Sequence
  chemically synthesized
catttaatactctctttttcct

SEQ ID NO: 928652 - DNA, 22 bp, Artificial Sequence
  chemically synthesized
atttaatactctctttttcctg

SEQ ID NO: 928653 - DNA, 22 bp, Artificial Sequence
  chemically synthesized
ctattatacctcacaggaaaaa

SEQ ID NO: 928654 - DNA, 22 bp, Artificial Sequence
  chemically synthesized
aatactctctttttcctgtgag

SEQ ID NO: 928655 - DNA, 22 bp, Artificial Sequence
  chemically synthesized
atactctctttttcctgtgagg

SEQ ID NO: 928656 - DNA, 22 bp, Artificial Sequence
  chemically synthesized
tctttttcctgtgaggtataat

SEQ ID NO: 928657 - DNA, 22 bp, Artificial Sequence
  chemically synthesized
tttttcctgtgaggtataatag

SEQ ID NO: 928658 - DNA, 22 bp, Artificial Sequence
  chemically synthesized
tttcctgtgaggtataatagta

SEQ ID NO: 928659 - DNA, 22 bp, Artificial Sequence
  chemically synthesized
ttcctgtgaggtataatagtag

SEQ ID NO: 928660 - DNA, 22 bp, Artificial Sequence
  chemically synthesized
tcctgtgaggtataatagtaga

SEQ ID NO: 928661 - DNA, 22 bp, Artificial Sequence
  chemically synthesized
cctgtgaggtataatagtagat

SEQ ID NO: 928662 - DNA, 22 bp, Artificial Sequence
  chemically synthesized
taccaagagcatatctactatt

SEQ ID NO: 928663 - DNA, 22 bp, Artificial Sequence
  chemically synthesized
ctgtgaggtataatagtagata

SEQ ID NO: 928664 - DNA, 22 bp, Artificial Sequence
  chemically synthesized
tgaggtataatagtagatatgc

SEQ ID NO: 928665 - DNA, 22 bp, Artificial Sequence
  chemically synthesized
tcaggagcagatgggaaattgt

SEQ ID NO: 928666 - DNA, 22 bp, Artificial Sequence
  chemically synthesized
ttggtacaatttcccatctgct

SEQ ID NO: 928667 - DNA, 22 bp, Artificial Sequence
  chemically synthesized
ggtacaatttcccatctgctcc

SEQ ID NO: 928668 - DNA, 22 bp, Artificial Sequence
  chemically synthesized
gtacaatttcccatctgctcct

SEQ ID NO: 928669 - DNA, 22 bp, Artificial Sequence
  chemically synthesized
tagcaaccattatcaggagcag

SEQ ID NO: 928670 - DNA, 22 bp, Artificial Sequence
  chemically synthesized
atagcaaccattatcaggagca

SEQ ID NO: 928671 - DNA, 22 bp, Artificial Sequence
  chemically synthesized
tatagcaaccattatcaggagc

SEQ ID NO: 928672 - DNA, 22 bp, Artificial Sequence
  chemically synthesized
ttatagcaaccattatcaggag

SEQ ID NO: 928673 - DNA, 22 bp, Artificial Sequence
  chemically synthesized
ttttatagcaaccattatcagg

SEQ ID NO: 928674 - DNA, 22 bp, Artificial Sequence
  chemically synthesized
cccatctgctcctgataatggt

SEQ ID NO: 928675 - DNA, 22 bp, Artificial Sequence
  chemically synthesized
ccatctgctcctgataatggtt

SEQ ID NO: 928676 - DNA, 22 bp, Artificial Sequence
  chemically synthesized
ttcttttatagcaaccattatc

SEQ ID NO: 928677 - DNA, 22 bp, Artificial Sequence
  chemically synthesized
attattcttttatagcaaccat

SEQ ID NO: 928678 - DNA, 22 bp, Artificial Sequence
  chemically synthesized
tcattattcttttatagcaacc

SEQ ID NO: 928679 - DNA, 22 bp, Artificial Sequence
  chemically synthesized
ctcctgataatggttgctataa

SEQ ID NO: 928680 - DNA, 22 bp, Artificial Sequence
  chemically synthesized
ctgataatggttgctataaaag

SEQ ID NO: 928681 - DNA, 22 bp, Artificial Sequence
  chemically synthesized
ataatggttgctataaaagaat

SEQ ID NO: 928682 - DNA, 22 bp, Artificial Sequence
  chemically synthesized
gaaggaattctcattattcttt

SEQ ID NO: 928683 - DNA, 22 bp, Artificial Sequence
  chemically synthesized
agaaggaattctcattattctt

SEQ ID NO: 928684 - DNA, 22 bp, Artificial Sequence
  chemically synthesized
tagaaggaattctcattattct

SEQ ID NO: 928685 - DNA, 22 bp, Artificial Sequence
  chemically synthesized
gttttagaaggaattctcatta

SEQ ID NO: 928686 - DNA, 22 bp, Artificial Sequence
  chemically synthesized
ctataaaagaataatgagaatt

SEQ ID NO: 928687 - DNA, 22 bp, Artificial Sequence
  chemically synthesized
tagttttagaaggaattctcat

SEQ ID NO: 928688 - DNA, 22 bp, Artificial Sequence
  chemically synthesized
ctagttttagaaggaattctca

SEQ ID NO: 928689 - DNA, 22 bp, Artificial Sequence
  chemically synthesized
taaaagaataatgagaattcct

SEQ ID NO: 928690 - DNA, 22 bp, Artificial Sequence
  chemically synthesized
tttctagttttagaaggaattc

SEQ ID NO: 928691 - DNA, 22 bp, Artificial Sequence
  chemically synthesized
gaaaataaacagtctatttcta

SEQ ID NO: 928692 - DNA, 22 bp, Artificial Sequence
  chemically synthesized
ggaaaataaacagtctatttct

SEQ ID NO: 928693 - DNA, 22 bp, Artificial Sequence
  chemically synthesized
cttctaaaactagaaatagact

SEQ ID NO: 928694 - DNA, 22 bp, Artificial Sequence
  chemically synthesized
tggaaaataaacagtctatttc

SEQ ID NO: 928695 - DNA, 22 bp, Artificial Sequence
  chemically synthesized
ctaaaactagaaatagactgtt

SEQ ID NO: 928696 - DNA, 22 bp, Artificial Sequence
  chemically synthesized
ctttggaaaataaacagtctat

SEQ ID NO: 928697 - DNA, 22 bp, Artificial Sequence
  chemically synthesized
taaaactagaaatagactgttt

SEQ ID NO: 928698 - DNA, 22 bp, Artificial Sequence
  chemically synthesized
gctttggaaaataaacagtcta

SEQ ID NO: 928699 - DNA, 22 bp, Artificial Sequence
  chemically synthesized
aaactagaaatagactgtttat

SEQ ID NO: 928700 - DNA, 22 bp, Artificial Sequence
  chemically synthesized
gaaatagactgtttattttcca

SEQ ID NO: 928701 - DNA, 22 bp, Artificial Sequence
  chemically synthesized
gcaggatgtttgctttggaaaa

SEQ ID NO: 928702 - DNA, 22 bp, Artificial Sequence
  chemically synthesized
attggcaggatgtttgctttgg

SEQ ID NO: 928703 - DNA, 22 bp, Artificial Sequence
  chemically synthesized
tttattttccaaagcaaacatc

SEQ ID NO: 928704 - DNA, 22 bp, Artificial Sequence
  chemically synthesized
agttcattggcaggatgtttgc

SEQ ID NO: 928705 - DNA, 22 bp, Artificial Sequence
  chemically synthesized
cagttcattggcaggatgtttg

SEQ ID NO: 928706 - DNA, 22 bp, Artificial Sequence
  chemically synthesized
attttccaaagcaaacatcctg

SEQ ID NO: 928707 - DNA, 22 bp, Artificial Sequence
  chemically synthesized
ttttccaaagcaaacatcctgc

SEQ ID NO: 928708 - DNA, 22 bp, Artificial Sequence
  chemically synthesized
cttcagttcattggcaggatgt

SEQ ID NO: 928709 - DNA, 22 bp, Artificial Sequence
  chemically synthesized
ccttcagttcattggcaggatg

SEQ ID NO: 928710 - DNA, 22 bp, Artificial Sequence
  chemically synthesized
tccaaagcaaacatcctgccaa

SEQ ID NO: 928711 - DNA, 22 bp, Artificial Sequence
  chemically synthesized
tccttcagttcattggcaggat

SEQ ID NO: 928712 - DNA, 22 bp, Artificial Sequence
  chemically synthesized
ccaaagcaaacatcctgccaat

SEQ ID NO: 928713 - DNA, 22 bp, Artificial Sequence
  chemically synthesized
caaagcaaacatcctgccaatg

SEQ ID NO: 928714 - DNA, 22 bp, Artificial Sequence
  chemically synthesized
tacataattttccttcagttca

SEQ ID NO: 928715 - DNA, 22 bp, Artificial Sequence
  chemically synthesized
ctgtacataattttccttcagt

SEQ ID NO: 928716 - DNA, 22 bp, Artificial Sequence
  chemically synthesized
ctactgtacataattttccttc

SEQ ID NO: 928717 - DNA, 22 bp, Artificial Sequence
  chemically synthesized
ccaatgaactgaaggaaaatta

SEQ ID NO: 928718 - DNA, 22 bp, Artificial Sequence
  chemically synthesized
aaataaattgctactgtacata

SEQ ID NO: 928719 - DNA, 22 bp, Artificial Sequence
  chemically synthesized
aaggaaaattatgtacagtagc

SEQ ID NO: 928720 - DNA, 22 bp, Artificial Sequence
  chemically synthesized
tgtacagtagcaatttatttta

SEQ ID NO: 928721 - DNA, 22 bp, Artificial Sequence
  chemically synthesized
ggtaaatgtcccattaaaataa

SEQ ID NO: 928722 - DNA, 22 bp, Artificial Sequence
  chemically synthesized
atattaggtaaatgtcccatta

SEQ ID NO: 928723 - DNA, 22 bp, Artificial Sequence
  chemically synthesized
gatattaggtaaatgtcccatt

SEQ ID NO: 928724 - DNA, 22 bp, Artificial Sequence
  chemically synthesized
caatttgatattaggtaaatgt

SEQ ID NO: 928725 - DNA, 22 bp, Artificial Sequence
  chemically synthesized
attttaatgggacatttaccta

SEQ ID NO: 928726 - DNA, 22 bp, Artificial Sequence
  chemically synthesized
ttttaatgggacatttacctaa

SEQ ID NO: 928727 - DNA, 22 bp, Artificial Sequence
  chemically synthesized
attacaatttgatattaggtaa

SEQ ID NO: 928728 - DNA, 22 bp, Artificial Sequence
  chemically synthesized
taatgggacatttacctaatat

SEQ ID NO: 928729 - DNA, 22 bp, Artificial Sequence
  chemically synthesized
cattacaatttgatattaggta

SEQ ID NO: 928730 - DNA, 22 bp, Artificial Sequence
  chemically synthesized
aatgggacatttacctaatatc

SEQ ID NO: 928731 - DNA, 22 bp, Artificial Sequence
  chemically synthesized
atgggacatttacctaatatca

SEQ ID NO: 928732 - DNA, 22 bp, Artificial Sequence
  chemically synthesized
acctaatatcaaattgtaatga

SEQ ID NO: 928733 - DNA, 22 bp, Artificial Sequence
  chemically synthesized
cctaatatcaaattgtaatgaa

SEQ ID NO: 928734 - DNA, 22 bp, Artificial Sequence
  chemically synthesized
atatcaaattgtaatgaaattt

SEQ ID NO: 928735 - DNA, 22 bp, Artificial Sequence
  chemically synthesized
taatgaaatttccttttgatgt

SEQ ID NO: 928736 - DNA, 22 bp, Artificial Sequence
  chemically synthesized
atatgaataagataaatacatc

SEQ ID NO: 928737 - DNA, 22 bp, Artificial Sequence
  chemically synthesized
ccttttgatgtatttatcttat

SEQ ID NO: 928738 - DNA, 22 bp, Artificial Sequence
  chemically synthesized
cttttgatgtatttatcttatt

SEQ ID NO: 928739 - DNA, 22 bp, Artificial Sequence
  chemically synthesized
ttgatgtatttatcttattcat

SEQ ID NO: 928740 - DNA, 22 bp, Artificial Sequence
  chemically synthesized
tgatgtatttatcttattcata

SEQ ID NO: 928741 - DNA, 22 bp, Artificial Sequence
  chemically synthesized
gatgtatttatcttattcatat

SEQ ID NO: 928742 - DNA, 22 bp, Artificial Sequence
  chemically synthesized
atgtatttatcttattcatatc

SEQ ID NO: 928743 - DNA, 22 bp, Artificial Sequence
  chemically synthesized
tatatatatatataattgatat

SEQ ID NO: 928744 - DNA, 22 bp, Artificial Sequence
  chemically synthesized
atcttattcatatcaattatat

SEQ ID NO: 928745 - DNA, 22 bp, Artificial Sequence
  chemically synthesized
tcttattcatatcaattatata

SEQ ID NO: 928746 - DNA, 22 bp, Artificial Sequence
  chemically synthesized
attcatatcaattatatatata

SEQ ID NO: 928747 - DNA, 22 bp, Artificial Sequence
  chemically synthesized
ttcatatcaattatatatatat

SEQ ID NO: 928748 - DNA, 22 bp, Artificial Sequence
  chemically synthesized
atatcaattatatatatatata

SEQ ID NO: 928749 - DNA, 22 bp, Artificial Sequence
  chemically synthesized
tatatatatatatagatttgtt

SEQ ID NO: 928750 - DNA, 22 bp, Artificial Sequence
  chemically synthesized
atagcagtgataataacaaatc

SEQ ID NO: 928751 - DNA, 22 bp, Artificial Sequence
  chemically synthesized
gtatacacattaatagcagtga

SEQ ID NO: 928752 - DNA, 22 bp, Artificial Sequence
  chemically synthesized
ggtatacacattaatagcagtg

SEQ ID NO: 928753 - DNA, 22 bp, Artificial Sequence
  chemically synthesized
tggtatacacattaatagcagt

SEQ ID NO: 928754 - DNA, 22 bp, Artificial Sequence
  chemically synthesized
gttattatcactgctattaatg

SEQ ID NO: 928755 - DNA, 22 bp, Artificial Sequence
  chemically synthesized
ttattatcactgctattaatgt

SEQ ID NO: 928756 - DNA, 22 bp, Artificial Sequence
  chemically synthesized
attttggtatacacattaatag

SEQ ID NO: 928757 - DNA, 22 bp, Artificial Sequence
  chemically synthesized
ttatcactgctattaatgtgta

SEQ ID NO: 928758 - DNA, 22 bp, Artificial Sequence
  chemically synthesized
tcactgctattaatgtgtatac

SEQ ID NO: 928759 - DNA, 22 bp, Artificial Sequence
  chemically synthesized
tgatgaattaattttggtatac

SEQ ID NO: 928760 - DNA, 22 bp, Artificial Sequence
  chemically synthesized
atgatgaattaattttggtata

SEQ ID NO: 928761 - DNA, 22 bp, Artificial Sequence
  chemically synthesized
ctattaatgtgtataccaaaat

SEQ ID NO: 928762 - DNA, 22 bp, Artificial Sequence
  chemically synthesized
tatgatgaattaattttggtat

SEQ ID NO: 928763 - DNA, 22 bp, Artificial Sequence
  chemically synthesized
tttatgatgaattaattttggt

SEQ ID NO: 928764 - DNA, 22 bp, Artificial Sequence
  chemically synthesized
ttaatgtgtataccaaaattaa

SEQ ID NO: 928765 - DNA, 22 bp, Artificial Sequence
  chemically synthesized
atgtgtataccaaaattaattc

SEQ ID NO: 928766 - DNA, 22 bp, Artificial Sequence
  chemically synthesized
aagctctttatgatgaattaat

SEQ ID NO: 928767 - DNA, 22 bp, Artificial Sequence
  chemically synthesized
aaagctctttatgatgaattaa

SEQ ID NO: 928768 - DNA, 22 bp, Artificial Sequence
  chemically synthesized
attcatcataaagagctttaag

SEQ ID NO: 928769 - DNA, 22 bp, Artificial Sequence
  chemically synthesized
caaaacatgtagtacttaaagc

SEQ ID NO: 928770 - DNA, 22 bp, Artificial Sequence
  chemically synthesized
acaaaacatgtagtacttaaag

SEQ ID NO: 928771 - DNA, 22 bp, Artificial Sequence
  chemically synthesized
atcataaagagctttaagtact

SEQ ID NO: 928772 - DNA, 22 bp, Artificial Sequence
  chemically synthesized
taagtactacatgttttgtaag

SEQ ID NO: 928773 - DNA, 22 bp, Artificial Sequence
  chemically synthesized
aagtactacatgttttgtaagg

SEQ ID NO: 928774 - DNA, 22 bp, Artificial Sequence
  chemically synthesized
agtactacatgttttgtaaggg

SEQ ID NO: 928775 - DNA, 22 bp, Artificial Sequence
  chemically synthesized
catgttttgtaagggtatcttg

SEQ ID NO: 928776 - DNA, 22 bp, Artificial Sequence
  chemically synthesized
tgtaagggtatcttgggttgtt

SEQ ID NO: 928777 - DNA, 22 bp, Artificial Sequence
  chemically synthesized
gtaagggtatcttgggttgttt

SEQ ID NO: 928778 - DNA, 22 bp, Artificial Sequence
  chemically synthesized
gaagagaaagaaaaacaaccca

SEQ ID NO: 928779 - DNA, 22 bp, Artificial Sequence
  chemically synthesized
taagggtatcttgggttgtttt

SEQ ID NO: 928780 - DNA, 22 bp, Artificial Sequence
  chemically synthesized
ggaagagaaagaaaaacaaccc

SEQ ID NO: 928781 - DNA, 22 bp, Artificial Sequence
  chemically synthesized
ttggaagagaaagaaaaacaac

SEQ ID NO: 928782 - DNA, 22 bp, Artificial Sequence
  chemically synthesized
cttggaagagaaagaaaaacaa

SEQ ID NO: 928783 - DNA, 22 bp, Artificial Sequence
  chemically synthesized
gggttgtttttctttctcttcc

SEQ ID NO: 928784 - DNA, 22 bp, Artificial Sequence
  chemically synthesized
ggttgtttttctttctcttcca

SEQ ID NO: 928785 - DNA, 22 bp, Artificial Sequence
  chemically synthesized
tttttctttctcttccaagaaa

SEQ ID NO: 928786 - DNA, 22 bp, Artificial Sequence
  chemically synthesized
gcccagggcagcatttcttgga

SEQ ID NO: 928787 - DNA, 22 bp, Artificial Sequence
  chemically synthesized
ggcccagggcagcatttcttgg

SEQ ID NO: 928788 - DNA, 22 bp, Artificial Sequence
  chemically synthesized
ttctttctcttccaagaaatgc

SEQ ID NO: 928789 - DNA, 22 bp, Artificial Sequence
  chemically synthesized
tggcccagggcagcatttcttg

SEQ ID NO: 928790 - DNA, 22 bp, Artificial Sequence
  chemically synthesized
tctttctcttccaagaaatgct

SEQ ID NO: 928791 - DNA, 22 bp, Artificial Sequence
  chemically synthesized
ttggcccagggcagcatttctt

SEQ ID NO: 928792 - DNA, 22 bp, Artificial Sequence
  chemically synthesized
ctttctcttccaagaaatgctg

SEQ ID NO: 928793 - DNA, 22 bp, Artificial Sequence
  chemically synthesized
tttggcccagggcagcatttct

SEQ ID NO: 928794 - DNA, 22 bp, Artificial Sequence
  chemically synthesized
tttctcttccaagaaatgctgc

SEQ ID NO: 928795 - DNA, 22 bp, Artificial Sequence
  chemically synthesized
tttttggcccagggcagcattt

SEQ ID NO: 928796 - DNA, 22 bp, Artificial Sequence
  chemically synthesized
tctcttccaagaaatgctgccc

SEQ ID NO: 928797 - DNA, 22 bp, Artificial Sequence
  chemically synthesized
ctttttggcccagggcagcatt

SEQ ID NO: 928798 - DNA, 22 bp, Artificial Sequence
  chemically synthesized
ctcttccaagaaatgctgccct

SEQ ID NO: 928799 - DNA, 22 bp, Artificial Sequence
  chemically synthesized
tctttttggcccagggcagcat

SEQ ID NO: 928800 - DNA, 22 bp, Artificial Sequence
  chemically synthesized
tcttccaagaaatgctgccctg

SEQ ID NO: 928801 - DNA, 22 bp, Artificial Sequence
  chemically synthesized
ttctttttggcccagggcagca

SEQ ID NO: 928802 - DNA, 22 bp, Artificial Sequence
  chemically synthesized
tttctttttggcccagggcagc

SEQ ID NO: 928803 - DNA, 22 bp, Artificial Sequence
  chemically synthesized
ttccaagaaatgctgccctggg

SEQ ID NO: 928804 - DNA, 22 bp, Artificial Sequence
  chemically synthesized
ccaagaaatgctgccctgggcc

SEQ ID NO: 928805 - DNA, 22 bp, Artificial Sequence
  chemically synthesized
caagaaatgctgccctgggcca

SEQ ID NO: 928806 - DNA, 22 bp, Artificial Sequence
  chemically synthesized
aggagcacgtgattttttcttt

SEQ ID NO: 928807 - DNA, 22 bp, Artificial Sequence
  chemically synthesized
ccctgggccaaaaagaaaaaat

SEQ ID NO: 928808 - DNA, 22 bp, Artificial Sequence
  chemically synthesized
ggccaaaaagaaaaaatcacgt

SEQ ID NO: 928809 - DNA, 22 bp, Artificial Sequence
  chemically synthesized
aaattgaggagcacgtgatttt

SEQ ID NO: 928810 - DNA, 22 bp, Artificial Sequence
  chemically synthesized
gaaattgaggagcacgtgattt

SEQ ID NO: 928811 - DNA, 22 bp, Artificial Sequence
  chemically synthesized
cttgaaattgaggagcacgtga

SEQ ID NO: 928812 - DNA, 22 bp, Artificial Sequence
  chemically synthesized
tgcttgaaattgaggagcacgt

SEQ ID NO: 928813 - DNA, 22 bp, Artificial Sequence
  chemically synthesized
aatctctgcttgaaattgagga

SEQ ID NO: 928814 - DNA, 22 bp, Artificial Sequence
  chemically synthesized
tattgaatctctgcttgaaatt

SEQ ID NO: 928815 - DNA, 22 bp, Artificial Sequence
  chemically synthesized
ctcaatttcaagcagagattca

SEQ ID NO: 928816 - DNA, 22 bp, Artificial Sequence
  chemically synthesized
ggtaacactgtattgaatctct

SEQ ID NO: 928817 - DNA, 22 bp, Artificial Sequence
  chemically synthesized
aggtaacactgtattgaatctc

SEQ ID NO: 928818 - DNA, 22 bp, Artificial Sequence
  chemically synthesized
aatttcaagcagagattcaata

SEQ ID NO: 928819 - DNA, 22 bp, Artificial Sequence
  chemically synthesized
taggtaacactgtattgaatct

SEQ ID NO: 928820 - DNA, 22 bp, Artificial Sequence
  chemically synthesized
actttaggtaacactgtattga

SEQ ID NO: 928821 - DNA, 22 bp, Artificial Sequence
  chemically synthesized
caagcagagattcaatacagtg

SEQ ID NO: 928822 - DNA, 22 bp, Artificial Sequence
  chemically synthesized
aagcagagattcaatacagtgt

SEQ ID NO: 928823 - DNA, 22 bp, Artificial Sequence
  chemically synthesized
ctcactttaggtaacactgtat

SEQ ID NO: 928824 - DNA, 22 bp, Artificial Sequence
  chemically synthesized
cctcactttaggtaacactgta

SEQ ID NO: 928825 - DNA, 22 bp, Artificial Sequence
  chemically synthesized
tcctcactttaggtaacactgt

SEQ ID NO: 928826 - DNA, 22 bp, Artificial Sequence
  chemically synthesized
tattttcctcactttaggtaac

SEQ ID NO: 928827 - DNA, 22 bp, Artificial Sequence
  chemically synthesized
atattttcctcactttaggtaa

SEQ ID NO: 928828 - DNA, 22 bp, Artificial Sequence
  chemically synthesized
aatacagtgttacctaaagtga

SEQ ID NO: 928829 - DNA, 22 bp, Artificial Sequence
  chemically synthesized
acatatttatattttcctcact

SEQ ID NO: 928830 - DNA, 22 bp, Artificial Sequence
  chemically synthesized
aacatatttatattttcctcac

SEQ ID NO: 928831 - DNA, 22 bp, Artificial Sequence
  chemically synthesized
cctaaagtgaggaaaatataaa

SEQ ID NO: 928832 - DNA, 22 bp, Artificial Sequence
  chemically synthesized
aagtgaggaaaatataaatatg

SEQ ID NO: 928833 - DNA, 22 bp, Artificial Sequence
  chemically synthesized
agagggcaaaaacttaacatat

SEQ ID NO: 928834 - DNA, 22 bp, Artificial Sequence
  chemically synthesized
cagagggcaaaaacttaacata

SEQ ID NO: 928835 - DNA, 22 bp, Artificial Sequence
  chemically synthesized
agtttcagagggcaaaaactta

SEQ ID NO: 928836 - DNA, 22 bp, Artificial Sequence
  chemically synthesized
aaatgtagccctcagtttcaga

SEQ ID NO: 928837 - DNA, 22 bp, Artificial Sequence
  chemically synthesized
agtttttgccctctgaaactga

SEQ ID NO: 928838 - DNA, 22 bp, Artificial Sequence
  chemically synthesized
aaaatgtagccctcagtttcag

SEQ ID NO: 928839 - DNA, 22 bp, Artificial Sequence
  chemically synthesized
ttgccctctgaaactgagggct

SEQ ID NO: 928840 - DNA, 22 bp, Artificial Sequence
  chemically synthesized
tgccctctgaaactgagggcta

SEQ ID NO: 928841 - DNA, 22 bp, Artificial Sequence
  chemically synthesized
gccctctgaaactgagggctac

SEQ ID NO: 928842 - DNA, 22 bp, Artificial Sequence
  chemically synthesized
ccctctgaaactgagggctaca

SEQ ID NO: 928843 - DNA, 22 bp, Artificial Sequence
  chemically synthesized
ggaccagatttaaaatgtagcc

SEQ ID NO: 928844 - DNA, 22 bp, Artificial Sequence
  chemically synthesized
tgaaactgagggctacatttta

SEQ ID NO: 928845 - DNA, 22 bp, Artificial Sequence
  chemically synthesized
aaactgagggctacattttaaa

SEQ ID NO: 928846 - DNA, 22 bp, Artificial Sequence
  chemically synthesized
agggctacattttaaatctggt

SEQ ID NO: 928847 - DNA, 22 bp, Artificial Sequence
  chemically synthesized
cattttaaatctggtcccagac

SEQ ID NO: 928848 - DNA, 22 bp, Artificial Sequence
  chemically synthesized
acgccaaaacatgtctgggacc

SEQ ID NO: 928849 - DNA, 22 bp, Artificial Sequence
  chemically synthesized
taacgccaaaacatgtctggga

SEQ ID NO: 928850 - DNA, 22 bp, Artificial Sequence
  chemically synthesized
taaatctggtcccagacatgtt

SEQ ID NO: 928851 - DNA, 22 bp, Artificial Sequence
  chemically synthesized
aaatctggtcccagacatgttt

SEQ ID NO: 928852 - DNA, 22 bp, Artificial Sequence
  chemically synthesized
aatctggtcccagacatgtttt

SEQ ID NO: 928853 - DNA, 22 bp, Artificial Sequence
  chemically synthesized
gtcccagacatgttttggcgtt

SEQ ID NO: 928854 - DNA, 22 bp, Artificial Sequence
  chemically synthesized
atcaaacaaagttctaacgcca

SEQ ID NO: 928855 - DNA, 22 bp, Artificial Sequence
  chemically synthesized
aaatcattaatcaaacaaagtt

SEQ ID NO: 928856 - DNA, 22 bp, Artificial Sequence
  chemically synthesized
tggcgttagaactttgtttgat

SEQ ID NO: 928857 - DNA, 22 bp, Artificial Sequence
  chemically synthesized
ggcgttagaactttgtttgatt

SEQ ID NO: 928858 - DNA, 22 bp, Artificial Sequence
  chemically synthesized
gcgttagaactttgtttgatta

SEQ ID NO: 928859 - DNA, 22 bp, Artificial Sequence
  chemically synthesized
aaggcattcaaatcattaatca

SEQ ID NO: 928860 - DNA, 22 bp, Artificial Sequence
  chemically synthesized
gaactttgtttgattaatgatt

SEQ ID NO: 928861 - DNA, 22 bp, Artificial Sequence
  chemically synthesized
tgtttgattaatgatttgaatg

SEQ ID NO: 928862 - DNA, 22 bp, Artificial Sequence
  chemically synthesized
gtttgattaatgatttgaatgc

SEQ ID NO: 928863 - DNA, 22 bp, Artificial Sequence
  chemically synthesized
tttgattaatgatttgaatgcc

SEQ ID NO: 928864 - DNA, 22 bp, Artificial Sequence
  chemically synthesized
atgccccacctaaaggcattca

SEQ ID NO: 928865 - DNA, 22 bp, Artificial Sequence
  chemically synthesized
gattaatgatttgaatgccttt

SEQ ID NO: 928866 - DNA, 22 bp, Artificial Sequence
  chemically synthesized
catgccccacctaaaggcattc

SEQ ID NO: 928867 - DNA, 22 bp, Artificial Sequence
  chemically synthesized
attaatgatttgaatgccttta

SEQ ID NO: 928868 - DNA, 22 bp, Artificial Sequence
  chemically synthesized
tcatgccccacctaaaggcatt

SEQ ID NO: 928869 - DNA, 22 bp, Artificial Sequence
  chemically synthesized
atgatttgaatgcctttaggtg

SEQ ID NO: 928870 - DNA, 22 bp, Artificial Sequence
  chemically synthesized
aatgctttcatgccccacctaa

SEQ ID NO: 928871 - DNA, 22 bp, Artificial Sequence
  chemically synthesized
gaatgcctttaggtggggcatg

SEQ ID NO: 928872 - DNA, 22 bp, Artificial Sequence
  chemically synthesized
aatgcctttaggtggggcatga

SEQ ID NO: 928873 - DNA, 22 bp, Artificial Sequence
  chemically synthesized
cagaatgattgaatgctttcat

SEQ ID NO: 928874 - DNA, 22 bp, Artificial Sequence
  chemically synthesized
acagaatgattgaatgctttca

SEQ ID NO: 928875 - DNA, 22 bp, Artificial Sequence
  chemically synthesized
taggtggggcatgaaagcattc

SEQ ID NO: 928876 - DNA, 22 bp, Artificial Sequence
  chemically synthesized
tacagaatgattgaatgctttc

SEQ ID NO: 928877 - DNA, 22 bp, Artificial Sequence
  chemically synthesized
aggtggggcatgaaagcattca

SEQ ID NO: 928878 - DNA, 22 bp, Artificial Sequence
  chemically synthesized
ggtggggcatgaaagcattcaa

SEQ ID NO: 928879 - DNA, 22 bp, Artificial Sequence
  chemically synthesized
aaatgcctttacagaatgattg

SEQ ID NO: 928880 - DNA, 22 bp, Artificial Sequence
  chemically synthesized
aatcattctgtaaaggcatttg

SEQ ID NO: 928881 - DNA, 22 bp, Artificial Sequence
  chemically synthesized
aaacaagagccaccaattcaaa

SEQ ID NO: 928882 - DNA, 22 bp, Artificial Sequence
  chemically synthesized
aaaacaagagccaccaattcaa

SEQ ID NO: 928883 - DNA, 22 bp, Artificial Sequence
  chemically synthesized
tgtaaaggcatttgaattggtg

SEQ ID NO: 928884 - DNA, 22 bp, Artificial Sequence
  chemically synthesized
taaaacaagagccaccaattca

SEQ ID NO: 928885 - DNA, 22 bp, Artificial Sequence
  chemically synthesized
taaaggcatttgaattggtggc

SEQ ID NO: 928886 - DNA, 22 bp, Artificial Sequence
  chemically synthesized
tttaaaacaagagccaccaatt

SEQ ID NO: 928887 - DNA, 22 bp, Artificial Sequence
  chemically synthesized
ctttaaaacaagagccaccaat

SEQ ID NO: 928888 - DNA, 22 bp, Artificial Sequence
  chemically synthesized
tctttaaaacaagagccaccaa

SEQ ID NO: 928889 - DNA, 22 bp, Artificial Sequence
  chemically synthesized
gaattggtggctcttgttttaa

SEQ ID NO: 928890 - DNA, 22 bp, Artificial Sequence
  chemically synthesized
aattggtggctcttgttttaaa

SEQ ID NO: 928891 - DNA, 22 bp, Artificial Sequence
  chemically synthesized
taacaacagttttctttaaaac

SEQ ID NO: 928892 - DNA, 22 bp, Artificial Sequence
  chemically synthesized
gtaacaacagttttctttaaaa

SEQ ID NO: 928893 - DNA, 22 bp, Artificial Sequence
  chemically synthesized
tgtaacaacagttttctttaaa

SEQ ID NO: 928894 - DNA, 22 bp, Artificial Sequence
  chemically synthesized
gtggctcttgttttaaagaaaa

SEQ ID NO: 928895 - DNA, 22 bp, Artificial Sequence
  chemically synthesized
tactttgtaacaacagttttct

SEQ ID NO: 928896 - DNA, 22 bp, Artificial Sequence
  chemically synthesized
tgtactttgtaacaacagtttt

SEQ ID NO: 928897 - DNA, 22 bp, Artificial Sequence
  chemically synthesized
ttgttttaaagaaaactgttgt

SEQ ID NO: 928898 - DNA, 22 bp, Artificial Sequence
  chemically synthesized
gttttaaagaaaactgttgtta

SEQ ID NO: 928899 - DNA, 22 bp, Artificial Sequence
  chemically synthesized
ttctgtactttgtaacaacagt

SEQ ID NO: 928900 - DNA, 22 bp, Artificial Sequence
  chemically synthesized
ttttaaagaaaactgttgttac

SEQ ID NO: 928901 - DNA, 22 bp, Artificial Sequence
  chemically synthesized
tgttctgtactttgtaacaaca

SEQ ID NO: 928902 - DNA, 22 bp, Artificial Sequence
  chemically synthesized
taaagaaaactgttgttacaaa

SEQ ID NO: 928903 - DNA, 22 bp, Artificial Sequence
  chemically synthesized
aaagaaaactgttgttacaaag

SEQ ID NO: 928904 - DNA, 22 bp, Artificial Sequence
  chemically synthesized
aagaaaactgttgttacaaagt

SEQ ID NO: 928905 - DNA, 22 bp, Artificial Sequence
  chemically synthesized
caaagttctgttctgtactttg

SEQ ID NO: 928906 - DNA, 22 bp, Artificial Sequence
  chemically synthesized
gcaaagttctgttctgtacttt

SEQ ID NO: 928907 - DNA, 22 bp, Artificial Sequence
  chemically synthesized
tgcaaagttctgttctgtactt

SEQ ID NO: 928908 - DNA, 22 bp, Artificial Sequence
  chemically synthesized
ttgttacaaagtacagaacaga

SEQ ID NO: 928909 - DNA, 22 bp, Artificial Sequence
  chemically synthesized
gctttgcaaagttctgttctgt

SEQ ID NO: 928910 - DNA, 22 bp, Artificial Sequence
  chemically synthesized
ttacaaagtacagaacagaact

SEQ ID NO: 928911 - DNA, 22 bp, Artificial Sequence
  chemically synthesized
ttcgctttgcaaagttctgttc

SEQ ID NO: 928912 - DNA, 22 bp, Artificial Sequence
  chemically synthesized
caaagtacagaacagaactttg

SEQ ID NO: 928913 - DNA, 22 bp, Artificial Sequence
  chemically synthesized
aaacctattcgctttgcaaagt

SEQ ID NO: 928914 - DNA, 22 bp, Artificial Sequence
  chemically synthesized
gcaaactaaaacctattcgctt

SEQ ID NO: 928915 - DNA, 22 bp, Artificial Sequence
  chemically synthesized
agcaaactaaaacctattcgct

SEQ ID NO: 928916 - DNA, 22 bp, Artificial Sequence
  chemically synthesized
tagcaaactaaaacctattcgc

SEQ ID NO: 928917 - DNA, 22 bp, Artificial Sequence
  chemically synthesized
ttttagcaaactaaaacctatt

SEQ ID NO: 928918 - DNA, 22 bp, Artificial Sequence
  chemically synthesized
attttagcaaactaaaacctat

SEQ ID NO: 928919 - DNA, 22 bp, Artificial Sequence
  chemically synthesized
tgcaaagcgaataggttttagt

SEQ ID NO: 928920 - DNA, 22 bp, Artificial Sequence
  chemically synthesized
gcaaagcgaataggttttagtt

SEQ ID NO: 928921 - DNA, 22 bp, Artificial Sequence
  chemically synthesized
caaagcgaataggttttagttt

SEQ ID NO: 928922 - DNA, 22 bp, Artificial Sequence
  chemically synthesized
acatttattttagcaaactaaa

SEQ ID NO: 928923 - DNA, 22 bp, Artificial Sequence
  chemically synthesized
tagtttgctaaaataaatgtta

SEQ ID NO: 928924 - DNA, 22 bp, Artificial Sequence
  chemically synthesized
agtttgctaaaataaatgttag

SEQ ID NO: 928925 - DNA, 22 bp, Artificial Sequence
  chemically synthesized
gtttgctaaaataaatgttagc

SEQ ID NO: 928926 - DNA, 22 bp, Artificial Sequence
  chemically synthesized
aacgtagagagagctaacattt

SEQ ID NO: 928927 - DNA, 22 bp, Artificial Sequence
  chemically synthesized
gaacgtagagagagctaacatt

SEQ ID NO: 928928 - DNA, 22 bp, Artificial Sequence
  chemically synthesized
gctaaaataaatgttagctctc

SEQ ID NO: 928929 - DNA, 22 bp, Artificial Sequence
  chemically synthesized
ctaaaataaatgttagctctct

SEQ ID NO: 928930 - DNA, 22 bp, Artificial Sequence
  chemically synthesized
aaataaatgttagctctctcta

SEQ ID NO: 928931 - DNA, 22 bp, Artificial Sequence
  chemically synthesized
aataaatccttgaacgtagaga

SEQ ID NO: 928932 - DNA, 22 bp, Artificial Sequence
  chemically synthesized
gctctctctacgttcaaggatt

SEQ ID NO: 928933 - DNA, 22 bp, Artificial Sequence
  chemically synthesized
tctctacgttcaaggatttatt

SEQ ID NO: 928934 - DNA, 22 bp, Artificial Sequence
  chemically synthesized
tctacgttcaaggatttattta

SEQ ID NO: 928935 - DNA, 22 bp, Artificial Sequence
  chemically synthesized
tacgttcaaggatttatttaat

SEQ ID NO: 928936 - DNA, 22 bp, Artificial Sequence
  chemically synthesized
gaaggcgagaaggattaaataa

SEQ ID NO: 928937 - DNA, 22 bp, Artificial Sequence
  chemically synthesized
cgttcaaggatttatttaatcc

SEQ ID NO: 928938 - DNA, 22 bp, Artificial Sequence
  chemically synthesized
aaggatttatttaatccttctc

SEQ ID NO: 928939 - DNA, 22 bp, Artificial Sequence
  chemically synthesized
atgaatgagttagaaggcgaga

SEQ ID NO: 928940 - DNA, 22 bp, Artificial Sequence
  chemically synthesized
atttaatccttctcgccttcta

SEQ ID NO: 928941 - DNA, 22 bp, Artificial Sequence
  chemically synthesized
tcatgaatgagttagaaggcga

SEQ ID NO: 928942 - DNA, 22 bp, Artificial Sequence
  chemically synthesized
tttaatccttctcgccttctaa

SEQ ID NO: 928943 - DNA, 22 bp, Artificial Sequence
  chemically synthesized
aatccttctcgccttctaactc

SEQ ID NO: 928944 - DNA, 22 bp, Artificial Sequence
  chemically synthesized
atccttctcgccttctaactca

SEQ ID NO: 928945 - DNA, 22 bp, Artificial Sequence
  chemically synthesized
aagttctcatgaatgagttaga

SEQ ID NO: 928946 - DNA, 22 bp, Artificial Sequence
  chemically synthesized
ctcgccttctaactcattcatg

SEQ ID NO: 928947 - DNA, 22 bp, Artificial Sequence
  chemically synthesized
tcctgaagttctcatgaatgag

SEQ ID NO: 928948 - DNA, 22 bp, Artificial Sequence
  chemically synthesized
tcgccttctaactcattcatga

SEQ ID NO: 928949 - DNA, 22 bp, Artificial Sequence
  chemically synthesized
gtcctgaagttctcatgaatga

SEQ ID NO: 928950 - DNA, 22 bp, Artificial Sequence
  chemically synthesized
gccttctaactcattcatgaga

SEQ ID NO: 928951 - DNA, 22 bp, Artificial Sequence
  chemically synthesized
tttgtcctgaagttctcatgaa

SEQ ID NO: 928952 - DNA, 22 bp, Artificial Sequence
  chemically synthesized
tatttgtcctgaagttctcatg

SEQ ID NO: 928953 - DNA, 22 bp, Artificial Sequence
  chemically synthesized
ctatttgtcctgaagttctcat

SEQ ID NO: 928954 - DNA, 22 bp, Artificial Sequence
  chemically synthesized
ctaactcattcatgagaacttc

SEQ ID NO: 928955 - DNA, 22 bp, Artificial Sequence
  chemically synthesized
tctatttgtcctgaagttctca

SEQ ID NO: 928956 - DNA, 22 bp, Artificial Sequence
  chemically synthesized
taactcattcatgagaacttca

SEQ ID NO: 928957 - DNA, 22 bp, Artificial Sequence
  chemically synthesized
actcattcatgagaacttcagg

SEQ ID NO: 928958 - DNA, 22 bp, Artificial Sequence
  chemically synthesized
attcatgagaacttcaggacaa

SEQ ID NO: 928959 - DNA, 22 bp, Artificial Sequence
  chemically synthesized
aatgttttctatttgtcctgaa

SEQ ID NO: 928960 - DNA, 22 bp, Artificial Sequence
  chemically synthesized
aaatgttttctatttgtcctga

SEQ ID NO: 928961 - DNA, 22 bp, Artificial Sequence
  chemically synthesized
atgagaacttcaggacaaatag

SEQ ID NO: 928962 - DNA, 22 bp, Artificial Sequence
  chemically synthesized
caggacaaatagaaaacattta

SEQ ID NO: 928963 - DNA, 22 bp, Artificial Sequence
  chemically synthesized
aggacaaatagaaaacatttaa

SEQ ID NO: 928964 - DNA, 22 bp, Artificial Sequence
  chemically synthesized
agtaaatggagagaaaaacaca

SEQ ID NO: 928965 - DNA, 22 bp, Artificial Sequence
  chemically synthesized
aagggctgtgtttttctctcca

SEQ ID NO: 928966 - DNA, 22 bp, Artificial Sequence
  chemically synthesized
agggctgtgtttttctctccat

SEQ ID NO: 928967 - DNA, 22 bp, Artificial Sequence
  chemically synthesized
caaatctaagtaaatggagaga

SEQ ID NO: 928968 - DNA, 22 bp, Artificial Sequence
  chemically synthesized
gcaaatctaagtaaatggagag

SEQ ID NO: 928969 - DNA, 22 bp, Artificial Sequence
  chemically synthesized
tgcaaatctaagtaaatggaga

SEQ ID NO: 928970 - DNA, 22 bp, Artificial Sequence
  chemically synthesized
tttgcaaatctaagtaaatgga

SEQ ID NO: 928971 - DNA, 22 bp, Artificial Sequence
  chemically synthesized
ctttgcaaatctaagtaaatgg

SEQ ID NO: 928972 - DNA, 22 bp, Artificial Sequence
  chemically synthesized
tgtttttctctccatttactta

SEQ ID NO: 928973 - DNA, 22 bp, Artificial Sequence
  chemically synthesized
tctttgcaaatctaagtaaatg

SEQ ID NO: 928974 - DNA, 22 bp, Artificial Sequence
  chemically synthesized
ttttctttgcaaatctaagtaa

SEQ ID NO: 928975 - DNA, 22 bp, Artificial Sequence
  chemically synthesized
gttttctttgcaaatctaagta

SEQ ID NO: 928976 - DNA, 22 bp, Artificial Sequence
  chemically synthesized
ttctctccatttacttagattt

SEQ ID NO: 928977 - DNA, 22 bp, Artificial Sequence
  chemically synthesized
tctctccatttacttagatttg

SEQ ID NO: 928978 - DNA, 22 bp, Artificial Sequence
  chemically synthesized
ctctccatttacttagatttgc

SEQ ID NO: 928979 - DNA, 22 bp, Artificial Sequence
  chemically synthesized
tctccatttacttagatttgca

SEQ ID NO: 928980 - DNA, 22 bp, Artificial Sequence
  chemically synthesized
tccatttacttagatttgcaaa

SEQ ID NO: 928981 - DNA, 22 bp, Artificial Sequence
  chemically synthesized
catttacttagatttgcaaaga

SEQ ID NO: 928982 - DNA, 22 bp, Artificial Sequence
  chemically synthesized
acttagatttgcaaagaaaaca

SEQ ID NO: 928983 - DNA, 22 bp, Artificial Sequence
  chemically synthesized
cttagatttgcaaagaaaacaa

SEQ ID NO: 928984 - DNA, 22 bp, Artificial Sequence
  chemically synthesized
agatttgcaaagaaaacaaatt

SEQ ID NO: 928985 - DNA, 22 bp, Artificial Sequence
  chemically synthesized
gatttgcaaagaaaacaaattg

SEQ ID NO: 928986 - DNA, 22 bp, Artificial Sequence
  chemically synthesized
tcagggaaaggccaatttgttt

SEQ ID NO: 928987 - DNA, 22 bp, Artificial Sequence
  chemically synthesized
atcagggaaaggccaatttgtt

SEQ ID NO: 928988 - DNA, 22 bp, Artificial Sequence
  chemically synthesized
tatcagggaaaggccaatttgt

SEQ ID NO: 928989 - DNA, 22 bp, Artificial Sequence
  chemically synthesized
ttatcagggaaaggccaatttg

SEQ ID NO: 928990 - DNA, 22 bp, Artificial Sequence
  chemically synthesized
tttatcagggaaaggccaattt

SEQ ID NO: 928991 - DNA, 22 bp, Artificial Sequence
  chemically synthesized
gcaaagaaaacaaattggcctt

SEQ ID NO: 928992 - DNA, 22 bp, Artificial Sequence
  chemically synthesized
caaagaaaacaaattggccttt

SEQ ID NO: 928993 - DNA, 22 bp, Artificial Sequence
  chemically synthesized
tggacaagatgcctttttatca

SEQ ID NO: 928994 - DNA, 22 bp, Artificial Sequence
  chemically synthesized
gcctttccctgataaaaaggca

SEQ ID NO: 928995 - DNA, 22 bp, Artificial Sequence
  chemically synthesized
tccctgataaaaaggcatcttg

SEQ ID NO: 928996 - DNA, 22 bp, Artificial Sequence
  chemically synthesized
ccctgataaaaaggcatcttgt

SEQ ID NO: 928997 - DNA, 22 bp, Artificial Sequence
  chemically synthesized
cctgataaaaaggcatcttgtc

SEQ ID NO: 928998 - DNA, 22 bp, Artificial Sequence
  chemically synthesized
ataaaaaggcatcttgtccaca

SEQ ID NO: 928999 - DNA, 22 bp, Artificial Sequence
  chemically synthesized
ataagaaaacaagtacagctgt

SEQ ID NO: 929000 - DNA, 22 bp, Artificial Sequence
  chemically synthesized
aataagaaaacaagtacagctg

SEQ ID NO: 929001 - DNA, 22 bp, Artificial Sequence
  chemically synthesized
gtccacagctgtacttgttttc

SEQ ID NO: 929002 - DNA, 22 bp, Artificial Sequence
  chemically synthesized
tccacagctgtacttgttttct

SEQ ID NO: 929003 - DNA, 22 bp, Artificial Sequence
  chemically synthesized
taaccaggatcacttaataaga

SEQ ID NO: 929004 - DNA, 22 bp, Artificial Sequence
  chemically synthesized
tataaccaggatcacttaataa

SEQ ID NO: 929005 - DNA, 22 bp, Artificial Sequence
  chemically synthesized
tacttgttttcttattaagtga

SEQ ID NO: 929006 - DNA, 22 bp, Artificial Sequence
  chemically synthesized
gttttcttattaagtgatcctg

SEQ ID NO: 929007 - DNA, 22 bp, Artificial Sequence
  chemically synthesized
ttttcttattaagtgatcctgg

SEQ ID NO: 929008 - DNA, 22 bp, Artificial Sequence
  chemically synthesized
tcttattaagtgatcctggtta

SEQ ID NO: 929009 - DNA, 22 bp, Artificial Sequence
  chemically synthesized
cttattaagtgatcctggttat

SEQ ID NO: 929010 - DNA, 22 bp, Artificial Sequence
  chemically synthesized
ttattaagtgatcctggttata

SEQ ID NO: 929011 - DNA, 22 bp, Artificial Sequence
  chemically synthesized
aagtcacatgttctataaccag

SEQ ID NO: 929012 - DNA, 22 bp, Artificial Sequence
  chemically synthesized
attaagtgatcctggttataga

SEQ ID NO: 929013 - DNA, 22 bp, Artificial Sequence
  chemically synthesized
ttaagtgatcctggttatagaa

SEQ ID NO: 929014 - DNA, 22 bp, Artificial Sequence
  chemically synthesized
agtgatcctggttatagaacat

SEQ ID NO: 929015 - DNA, 22 bp, Artificial Sequence
  chemically synthesized
tgcctgaagtcacatgttctat

SEQ ID NO: 929016 - DNA, 22 bp, Artificial Sequence
  chemically synthesized
atgcctgaagtcacatgttcta

SEQ ID NO: 929017 - DNA, 22 bp, Artificial Sequence
  chemically synthesized
tatgcctgaagtcacatgttct

SEQ ID NO: 929018 - DNA, 22 bp, Artificial Sequence
  chemically synthesized
gttatagaacatgtgacttcag

SEQ ID NO: 929019 - DNA, 22 bp, Artificial Sequence
  chemically synthesized
tagaacatgtgacttcaggcat

SEQ ID NO: 929020 - DNA, 22 bp, Artificial Sequence
  chemically synthesized
gtaatcatgtagaaagaatttt

SEQ ID NO: 929021 - DNA, 22 bp, Artificial Sequence
  chemically synthesized
caggcataaaattctttctaca

SEQ ID NO: 929022 - DNA, 22 bp, Artificial Sequence
  chemically synthesized
aggcataaaattctttctacat

SEQ ID NO: 929023 - DNA, 22 bp, Artificial Sequence
  chemically synthesized
agaggcatgctagtaatcatgt

SEQ ID NO: 929024 - DNA, 22 bp, Artificial Sequence
  chemically synthesized
tttctacatgattactagcatg

SEQ ID NO: 929025 - DNA, 22 bp, Artificial Sequence
  chemically synthesized
atgtgttcagaggcatgctagt

SEQ ID NO: 929026 - DNA, 22 bp, Artificial Sequence
  chemically synthesized
tctacatgattactagcatgcc

SEQ ID NO: 929027 - DNA, 22 bp, Artificial Sequence
  chemically synthesized
aatgtgttcagaggcatgctag

SEQ ID NO: 929028 - DNA, 22 bp, Artificial Sequence
  chemically synthesized
ctacatgattactagcatgcct

SEQ ID NO: 929029 - DNA, 22 bp, Artificial Sequence
  chemically synthesized
tacatgattactagcatgcctc

SEQ ID NO: 929030 - DNA, 22 bp, Artificial Sequence
  chemically synthesized
catgattactagcatgcctctg

SEQ ID NO: 929031 - DNA, 22 bp, Artificial Sequence
  chemically synthesized
ctagcatgcctctgaacacatt

SEQ ID NO: 929032 - DNA, 22 bp, Artificial Sequence
  chemically synthesized
gcatgcctctgaacacattaaa

SEQ ID NO: 929033 - DNA, 22 bp, Artificial Sequence
  chemically synthesized
cacgatgaaacatttaatgtgt

SEQ ID NO: 929034 - DNA, 22 bp, Artificial Sequence
  chemically synthesized
tgaacacattaaatgtttcatc

SEQ ID NO: 929035 - DNA, 22 bp, Artificial Sequence
  chemically synthesized
aacacattaaatgtttcatcgt

SEQ ID NO: 929036 - DNA, 22 bp, Artificial Sequence
  chemically synthesized
cgtgcaatatgttccacgatga

SEQ ID NO: 929037 - DNA, 22 bp, Artificial Sequence
  chemically synthesized
agttacgtgcaatatgttccac

SEQ ID NO: 929038 - DNA, 22 bp, Artificial Sequence
  chemically synthesized
aatgtttcatcgtggaacatat

SEQ ID NO: 929039 - DNA, 22 bp, Artificial Sequence
  chemically synthesized
gagttacgtgcaatatgttcca

SEQ ID NO: 929040 - DNA, 22 bp, Artificial Sequence
  chemically synthesized
tgagttacgtgcaatatgttcc

SEQ ID NO: 929041 - DNA, 22 bp, Artificial Sequence
  chemically synthesized
ttgagttacgtgcaatatgttc

SEQ ID NO: 929042 - DNA, 22 bp, Artificial Sequence
  chemically synthesized
tttgagttacgtgcaatatgtt

SEQ ID NO: 929043 - DNA, 22 bp, Artificial Sequence
  chemically synthesized
catcgtggaacatattgcacgt

SEQ ID NO: 929044 - DNA, 22 bp, Artificial Sequence
  chemically synthesized
atcgtggaacatattgcacgta

SEQ ID NO: 929045 - DNA, 22 bp, Artificial Sequence
  chemically synthesized
agacagtgttttttgagttacg

SEQ ID NO: 929046 - DNA, 22 bp, Artificial Sequence
  chemically synthesized
cacgtaactcaaaaaacactgt

SEQ ID NO: 929047 - DNA, 22 bp, Artificial Sequence
  chemically synthesized
gaatatcacgtcctgagacagt

SEQ ID NO: 929048 - DNA, 22 bp, Artificial Sequence
  chemically synthesized
cgaatatcacgtcctgagacag

SEQ ID NO: 929049 - DNA, 22 bp, Artificial Sequence
  chemically synthesized
tcgaatatcacgtcctgagaca

SEQ ID NO: 929050 - DNA, 22 bp, Artificial Sequence
  chemically synthesized
aaaaaacactgtctcaggacgt

SEQ ID NO: 929051 - DNA, 22 bp, Artificial Sequence
  chemically synthesized
ctttcgaatatcacgtcctgag

SEQ ID NO: 929052 - DNA, 22 bp, Artificial Sequence
  chemically synthesized
cctttcgaatatcacgtcctga

SEQ ID NO: 929053 - DNA, 22 bp, Artificial Sequence
  chemically synthesized
tgcttcctttcgaatatcacgt

SEQ ID NO: 929054 - DNA, 22 bp, Artificial Sequence
  chemically synthesized
tctcaggacgtgatattcgaaa

SEQ ID NO: 929055 - DNA, 22 bp, Artificial Sequence
  chemically synthesized
aggacgtgatattcgaaaggaa

SEQ ID NO: 929056 - DNA, 22 bp, Artificial Sequence
  chemically synthesized
aaatgacctatgcttcctttcg

SEQ ID NO: 929057 - DNA, 22 bp, Artificial Sequence
  chemically synthesized
aaaatgacctatgcttcctttc

SEQ ID NO: 929058 - DNA, 22 bp, Artificial Sequence
  chemically synthesized
taaaatgacctatgcttccttt

SEQ ID NO: 929059 - DNA, 22 bp, Artificial Sequence
  chemically synthesized
gaaattttaaaatgacctatgc

SEQ ID NO: 929060 - DNA, 22 bp, Artificial Sequence
  chemically synthesized
gaaaggaagcataggtcatttt

SEQ ID NO: 929061 - DNA, 22 bp, Artificial Sequence
  chemically synthesized
gagagaagagaaattagaaatt

SEQ ID NO: 929062 - DNA, 22 bp, Artificial Sequence
  chemically synthesized
tagagagaagagaaattagaaa

SEQ ID NO: 929063 - DNA, 22 bp, Artificial Sequence
  chemically synthesized
taaaatttctaatttctcttct

SEQ ID NO: 929064 - DNA, 22 bp, Artificial Sequence
  chemically synthesized
aaaatttctaatttctcttctc

SEQ ID NO: 929065 - DNA, 22 bp, Artificial Sequence
  chemically synthesized
aaatttctaatttctcttctct

SEQ ID NO: 929066 - DNA, 22 bp, Artificial Sequence
  chemically synthesized
ataatacctctagagagaagag

SEQ ID NO: 929067 - DNA, 22 bp, Artificial Sequence
  chemically synthesized
ctaatttctcttctctctagag

SEQ ID NO: 929068 - DNA, 22 bp, Artificial Sequence
  chemically synthesized
taatttctcttctctctagagg

SEQ ID NO: 929069 - DNA, 22 bp, Artificial Sequence
  chemically synthesized
caaattgataatacctctagag

SEQ ID NO: 929070 - DNA, 22 bp, Artificial Sequence
  chemically synthesized
atttctcttctctctagaggta

SEQ ID NO: 929071 - DNA, 22 bp, Artificial Sequence
  chemically synthesized
ctcttctctctagaggtattat

SEQ ID NO: 929072 - DNA, 22 bp, Artificial Sequence
  chemically synthesized
tcttctctctagaggtattatc

SEQ ID NO: 929073 - DNA, 22 bp, Artificial Sequence
  chemically synthesized
ttctctctagaggtattatcaa

SEQ ID NO: 929074 - DNA, 22 bp, Artificial Sequence
  chemically synthesized
tgtggctccaaattgataatac

SEQ ID NO: 929075 - DNA, 22 bp, Artificial Sequence
  chemically synthesized
atgtggctccaaattgataata

SEQ ID NO: 929076 - DNA, 22 bp, Artificial Sequence
  chemically synthesized
ctctctagaggtattatcaatt

SEQ ID NO: 929077 - DNA, 22 bp, Artificial Sequence
  chemically synthesized
tctctagaggtattatcaattt

SEQ ID NO: 929078 - DNA, 22 bp, Artificial Sequence
  chemically synthesized
tctagaggtattatcaatttgg

SEQ ID NO: 929079 - DNA, 22 bp, Artificial Sequence
  chemically synthesized
tagaggtattatcaatttggag

SEQ ID NO: 929080 - DNA, 22 bp, Artificial Sequence
  chemically synthesized
gaggtattatcaatttggagcc

SEQ ID NO: 929081 - DNA, 22 bp, Artificial Sequence
  chemically synthesized
aagaagtatttatgtggctcca

SEQ ID NO: 929082 - DNA, 22 bp, Artificial Sequence
  chemically synthesized
gaagaagtatttatgtggctcc

SEQ ID NO: 929083 - DNA, 22 bp, Artificial Sequence
  chemically synthesized
tgaagaagtatttatgtggctc

SEQ ID NO: 929084 - DNA, 22 bp, Artificial Sequence
  chemically synthesized
ttgaagaagtatttatgtggct

SEQ ID NO: 929085 - DNA, 22 bp, Artificial Sequence
  chemically synthesized
tcaatttggagccacataaata

SEQ ID NO: 929086 - DNA, 22 bp, Artificial Sequence
  chemically synthesized
ggagccacataaatacttcttc

SEQ ID NO: 929087 - DNA, 22 bp, Artificial Sequence
  chemically synthesized
gagccacataaatacttcttca

SEQ ID NO: 929088 - DNA, 22 bp, Artificial Sequence
  chemically synthesized
cccgccaaatggcttttgaaga

SEQ ID NO: 929089 - DNA, 22 bp, Artificial Sequence
  chemically synthesized
tacccgccaaatggcttttgaa

SEQ ID NO: 929090 - DNA, 22 bp, Artificial Sequence
  chemically synthesized
tatcaccctctacccgccaaat

SEQ ID NO: 929091 - DNA, 22 bp, Artificial Sequence
  chemically synthesized
cttcaaaagccatttggcgggt

SEQ ID NO: 929092 - DNA, 22 bp, Artificial Sequence
  chemically synthesized
ttcaaaagccatttggcgggta

SEQ ID NO: 929093 - DNA, 22 bp, Artificial Sequence
  chemically synthesized
caaaagccatttggcgggtaga

SEQ ID NO: 929094 - DNA, 22 bp, Artificial Sequence
  chemically synthesized
aaaagccatttggcgggtagag

SEQ ID NO: 929095 - DNA, 22 bp, Artificial Sequence
  chemically synthesized
ggcgggtagagggtgatacaat

SEQ ID NO: 929096 - DNA, 22 bp, Artificial Sequence
  chemically synthesized
gcgggtagagggtgatacaata

SEQ ID NO: 929097 - DNA, 22 bp, Artificial Sequence
  chemically synthesized
tatgcacacatacatattgtat

SEQ ID NO: 929098 - DNA, 22 bp, Artificial Sequence
  chemically synthesized
tatatgcacacatacatattgt

SEQ ID NO: 929099 - DNA, 22 bp, Artificial Sequence
  chemically synthesized
ctatatgcacacatacatattg

SEQ ID NO: 929100 - DNA, 22 bp, Artificial Sequence
  chemically synthesized
tctatatgcacacatacatatt

SEQ ID NO: 929101 - DNA, 22 bp, Artificial Sequence
  chemically synthesized
ttctatatgcacacatacatat

SEQ ID NO: 929102 - DNA, 22 bp, Artificial Sequence
  chemically synthesized
tttctatatgcacacatacata

SEQ ID NO: 929103 - DNA, 22 bp, Artificial Sequence
  chemically synthesized
gctttttctatatgcacacata

SEQ ID NO: 929104 - DNA, 22 bp, Artificial Sequence
  chemically synthesized
ttggctttttctatatgcacac

SEQ ID NO: 929105 - DNA, 22 bp, Artificial Sequence
  chemically synthesized
gttggctttttctatatgcaca

SEQ ID NO: 929106 - DNA, 22 bp, Artificial Sequence
  chemically synthesized
tgttggctttttctatatgcac

SEQ ID NO: 929107 - DNA, 22 bp, Artificial Sequence
  chemically synthesized
aaaaacaattttgttggctttt

SEQ ID NO: 929108 - DNA, 22 bp, Artificial Sequence
  chemically synthesized
gaaaaacaattttgttggcttt

SEQ ID NO: 929109 - DNA, 22 bp, Artificial Sequence
  chemically synthesized
tgaaaaacaattttgttggctt

SEQ ID NO: 929110 - DNA, 22 bp, Artificial Sequence
  chemically synthesized
ttgaaaaacaattttgttggct

SEQ ID NO: 929111 - DNA, 22 bp, Artificial Sequence
  chemically synthesized
tttttgaaaaacaattttgttg

SEQ ID NO: 929112 - DNA, 22 bp, Artificial Sequence
  chemically synthesized
atttttgaaaaacaattttgtt

SEQ ID NO: 929113 - DNA, 22 bp, Artificial Sequence
  chemically synthesized
tcttatttttgaaaaacaattt

SEQ ID NO: 929114 - DNA, 22 bp, Artificial Sequence
  chemically synthesized
cacattgtcttatttttgaaaa

SEQ ID NO: 929115 - DNA, 22 bp, Artificial Sequence
  chemically synthesized
gcacattgtcttatttttgaaa

SEQ ID NO: 929116 - DNA, 22 bp, Artificial Sequence
  chemically synthesized
acttgcacattgtcttattttt

SEQ ID NO: 929117 - DNA, 22 bp, Artificial Sequence
  chemically synthesized
tttttcaaaaataagacaatgt

SEQ ID NO: 929118 - DNA, 22 bp, Artificial Sequence
  chemically synthesized
ttcaaaaataagacaatgtgca

SEQ ID NO: 929119 - DNA, 22 bp, Artificial Sequence
  chemically synthesized
tcaaaaataagacaatgtgcaa

SEQ ID NO: 929120 - DNA, 22 bp, Artificial Sequence
  chemically synthesized
caaaaataagacaatgtgcaag

SEQ ID NO: 929121 - DNA, 22 bp, Artificial Sequence
  chemically synthesized
aaaaataagacaatgtgcaagt

SEQ ID NO: 929122 - DNA, 22 bp, Artificial Sequence
  chemically synthesized
cagtgtataatcaagttgactt

SEQ ID NO: 929123 - DNA, 22 bp, Artificial Sequence
  chemically synthesized
acagtgtataatcaagttgact

SEQ ID NO: 929124 - DNA, 22 bp, Artificial Sequence
  chemically synthesized
catcaaatatttacagtgtata

SEQ ID NO: 929125 - DNA, 22 bp, Artificial Sequence
  chemically synthesized
ccatcaaatatttacagtgtat

SEQ ID NO: 929126 - DNA, 22 bp, Artificial Sequence
  chemically synthesized
gatacttccatcaaatatttac

SEQ ID NO: 929127 - DNA, 22 bp, Artificial Sequence
  chemically synthesized
gattatacactgtaaatatttg

SEQ ID NO: 929128 - DNA, 22 bp, Artificial Sequence
  chemically synthesized
attatacactgtaaatatttga

SEQ ID NO: 929129 - DNA, 22 bp, Artificial Sequence
  chemically synthesized
tacactgtaaatatttgatgga

SEQ ID NO: 929130 - DNA, 22 bp, Artificial Sequence
  chemically synthesized
taaatatttgatggaagtatct

SEQ ID NO: 929131 - DNA, 22 bp, Artificial Sequence
  chemically synthesized
gaaccaatgacattagatactt

SEQ ID NO: 929132 - DNA, 22 bp, Artificial Sequence
  chemically synthesized
agaaccaatgacattagatact

SEQ ID NO: 929133 - DNA, 22 bp, Artificial Sequence
  chemically synthesized
tagaaccaatgacattagatac

SEQ ID NO: 929134 - DNA, 22 bp, Artificial Sequence
  chemically synthesized
gatggaagtatctaatgtcatt

SEQ ID NO: 929135 - DNA, 22 bp, Artificial Sequence
  chemically synthesized
atggaagtatctaatgtcattg

SEQ ID NO: 929136 - DNA, 22 bp, Artificial Sequence
  chemically synthesized
cagggttttagaaccaatgaca

SEQ ID NO: 929137 - DNA, 22 bp, Artificial Sequence
  chemically synthesized
atgtcattggttctaaaaccct

SEQ ID NO: 929138 - DNA, 22 bp, Artificial Sequence
  chemically synthesized
gttctaaaaccctgtagttctc

SEQ ID NO: 929139 - DNA, 22 bp, Artificial Sequence
  chemically synthesized
taaaaccctgtagttctctact

SEQ ID NO: 929140 - DNA, 22 bp, Artificial Sequence
  chemically synthesized
aaaccctgtagttctctactgg

SEQ ID NO: 929141 - DNA, 22 bp, Artificial Sequence
  chemically synthesized
tagttctctactggtatttgcc

SEQ ID NO: 929142 - DNA, 22 bp, Artificial Sequence
  chemically synthesized
tctactggtatttgccatgcct

SEQ ID NO: 929143 - DNA, 22 bp, Artificial Sequence
  chemically synthesized
tactggtatttgccatgcctat

SEQ ID NO: 929144 - DNA, 22 bp, Artificial Sequence
  chemically synthesized
cagagtgaaaatataggcatgg

SEQ ID NO: 929145 - DNA, 22 bp, Artificial Sequence
  chemically synthesized
acagagtgaaaatataggcatg

SEQ ID NO: 929146 - DNA, 22 bp, Artificial Sequence
  chemically synthesized
ctggtatttgccatgcctatat

SEQ ID NO: 929147 - DNA, 22 bp, Artificial Sequence
  chemically synthesized
gtatttgccatgcctatatttt

SEQ ID NO: 929148 - DNA, 22 bp, Artificial Sequence
  chemically synthesized
acttacagagtgaaaatatagg

SEQ ID NO: 929149 - DNA, 22 bp, Artificial Sequence
  chemically synthesized
gccatgcctatattttcactct

SEQ ID NO: 929150 - DNA, 22 bp, Artificial Sequence
  chemically synthesized
ccatgcctatattttcactctg

SEQ ID NO: 929151 - DNA, 22 bp, Artificial Sequence
  chemically synthesized
tattttcactctgtaagtcaat

SEQ ID NO: 929152 - DNA, 22 bp, Artificial Sequence
  chemically synthesized
tcactctgtaagtcaattattg

SEQ ID NO: 929153 - DNA, 22 bp, Artificial Sequence
  chemically synthesized
cactctgtaagtcaattattga

SEQ ID NO: 929154 - DNA, 22 bp, Artificial Sequence
  chemically synthesized
actctgtaagtcaattattgat

SEQ ID NO: 929155 - DNA, 22 bp, Artificial Sequence
  chemically synthesized
ataggaggtatccaatcaataa

SEQ ID NO: 929156 - DNA, 22 bp, Artificial Sequence
  chemically synthesized
tgtaagtcaattattgattgga

SEQ ID NO: 929157 - DNA, 22 bp, Artificial Sequence
  chemically synthesized
taagtcaattattgattggata

SEQ ID NO: 929158 - DNA, 22 bp, Artificial Sequence
  chemically synthesized
gctaataggaggtatccaatca

SEQ ID NO: 929159 - DNA, 22 bp, Artificial Sequence
  chemically synthesized
ttgattggatacctcctattag

SEQ ID NO: 929160 - DNA, 22 bp, Artificial Sequence
  chemically synthesized
cacagtgtctggctaataggag

SEQ ID NO: 929161 - DNA, 22 bp, Artificial Sequence
  chemically synthesized
ccacagtgtctggctaatagga

SEQ ID NO: 929162 - DNA, 22 bp, Artificial Sequence
  chemically synthesized
attggatacctcctattagcca

SEQ ID NO: 929163 - DNA, 22 bp, Artificial Sequence
  chemically synthesized
gatacctcctattagccagaca

SEQ ID NO: 929164 - DNA, 22 bp, Artificial Sequence
  chemically synthesized
gcaccttccacagtgtctggct

SEQ ID NO: 929165 - DNA, 22 bp, Artificial Sequence
  chemically synthesized
ctattagccagacactgtggaa

SEQ ID NO: 929166 - DNA, 22 bp, Artificial Sequence
  chemically synthesized
ttagccagacactgtggaaggt

SEQ ID NO: 929167 - DNA, 22 bp, Artificial Sequence
  chemically synthesized
gccagacactgtggaaggtgct

SEQ ID NO: 929168 - DNA, 22 bp, Artificial Sequence
  chemically synthesized
cagcagagaatgatgactagca

SEQ ID NO: 929169 - DNA, 22 bp, Artificial Sequence
  chemically synthesized
tggaaggtgctagtcatcattc

SEQ ID NO: 929170 - DNA, 22 bp, Artificial Sequence
  chemically synthesized
atcctccagcagagaatgatga

SEQ ID NO: 929171 - DNA, 22 bp, Artificial Sequence
  chemically synthesized
caatccattcatcctccagcag

SEQ ID NO: 929172 - DNA, 22 bp, Artificial Sequence
  chemically synthesized
gtcatcattctctgctggagga

SEQ ID NO: 929173 - DNA, 22 bp, Artificial Sequence
  chemically synthesized
ctccaatccattcatcctccag

SEQ ID NO: 929174 - DNA, 22 bp, Artificial Sequence
  chemically synthesized
tctgctggaggatgaatggatt

SEQ ID NO: 929175 - DNA, 22 bp, Artificial Sequence
  chemically synthesized
ccgggctcctccaatccattca

SEQ ID NO: 929176 - DNA, 22 bp, Artificial Sequence
  chemically synthesized
tgctggaggatgaatggattgg

SEQ ID NO: 929177 - DNA, 22 bp, Artificial Sequence
  chemically synthesized
ttcccgggctcctccaatccat

SEQ ID NO: 929178 - DNA, 22 bp, Artificial Sequence
  chemically synthesized
ctggaggatgaatggattggag

SEQ ID NO: 929179 - DNA, 22 bp, Artificial Sequence
  chemically synthesized
tattcccgggctcctccaatcc

SEQ ID NO: 929180 - DNA, 22 bp, Artificial Sequence
  chemically synthesized
ctattcccgggctcctccaatc

SEQ ID NO: 929181 - DNA, 22 bp, Artificial Sequence
  chemically synthesized
gaggatgaatggattggaggag

SEQ ID NO: 929182 - DNA, 22 bp, Artificial Sequence
  chemically synthesized
cttctattcccgggctcctcca

SEQ ID NO: 929183 - DNA, 22 bp, Artificial Sequence
  chemically synthesized
acttctattcccgggctcctcc

SEQ ID NO: 929184 - DNA, 22 bp, Artificial Sequence
  chemically synthesized
cttacttctattcccgggctcc

SEQ ID NO: 929185 - DNA, 22 bp, Artificial Sequence
  chemically synthesized
gtctccttacttctattcccgg

SEQ ID NO: 929186 - DNA, 22 bp, Artificial Sequence
  chemically synthesized
ggtctccttacttctattcccg

SEQ ID NO: 929187 - DNA, 22 bp, Artificial Sequence
  chemically synthesized
cttggtctccttacttctattc

SEQ ID NO: 929188 - DNA, 22 bp, Artificial Sequence
  chemically synthesized
gaggagcccgggaatagaagta

SEQ ID NO: 929189 - DNA, 22 bp, Artificial Sequence
  chemically synthesized
ctgcttggtctccttacttcta

SEQ ID NO: 929190 - DNA, 22 bp, Artificial Sequence
  chemically synthesized
ccatgatatctcctgcttggtc

SEQ ID NO: 929191 - DNA, 22 bp, Artificial Sequence
  chemically synthesized
actaccatgatatctcctgctt

SEQ ID NO: 929192 - DNA, 22 bp, Artificial Sequence
  chemically synthesized
aactaccatgatatctcctgct

SEQ ID NO: 929193 - DNA, 22 bp, Artificial Sequence
  chemically synthesized
taactaccatgatatctcctgc

SEQ ID NO: 929194 - DNA, 22 bp, Artificial Sequence
  chemically synthesized
actttaactaccatgatatctc

SEQ ID NO: 929195 - DNA, 22 bp, Artificial Sequence
  chemically synthesized
ctcactttaactaccatgatat

SEQ ID NO: 929196 - DNA, 22 bp, Artificial Sequence
  chemically synthesized
cctcactttaactaccatgata

SEQ ID NO: 929197 - DNA, 22 bp, Artificial Sequence
  chemically synthesized
tcctcactttaactaccatgat

SEQ ID NO: 929198 - DNA, 22 bp, Artificial Sequence
  chemically synthesized
aatccaagcgaccatctttcct

SEQ ID NO: 929199 - DNA, 22 bp, Artificial Sequence
  chemically synthesized
ctcaatccaagcgaccatcttt

SEQ ID NO: 929200 - DNA, 22 bp, Artificial Sequence
  chemically synthesized
ctcctcaatccaagcgaccatc

SEQ ID NO: 929201 - DNA, 22 bp, Artificial Sequence
  chemically synthesized
aagtgaggaaagatggtcgctt

SEQ ID NO: 929202 - DNA, 22 bp, Artificial Sequence
  chemically synthesized
actcctcctcaatccaagcgac

SEQ ID NO: 929203 - DNA, 22 bp, Artificial Sequence
  chemically synthesized
ccactgactcctcctcaatcca

SEQ ID NO: 929204 - DNA, 22 bp, Artificial Sequence
  chemically synthesized
tgccactgactcctcctcaatc

SEQ ID NO: 929205 - DNA, 22 bp, Artificial Sequence
  chemically synthesized
ctgccactgactcctcctcaat

SEQ ID NO: 929206 - DNA, 22 bp, Artificial Sequence
  chemically synthesized
catttctgccactgactcctcc

SEQ ID NO: 929207 - DNA, 22 bp, Artificial Sequence
  chemically synthesized
tccatttctgccactgactcct

SEQ ID NO: 929208 - DNA, 22 bp, Artificial Sequence
  chemically synthesized
tctccatttctgccactgactc

SEQ ID NO: 929209 - DNA, 22 bp, Artificial Sequence
  chemically synthesized
ggattgaggaggagtcagtggc

SEQ ID NO: 929210 - DNA, 22 bp, Artificial Sequence
  chemically synthesized
ctctccatttctgccactgact

SEQ ID NO: 929211 - DNA, 22 bp, Artificial Sequence
  chemically synthesized
gattgaggaggagtcagtggca

SEQ ID NO: 929212 - DNA, 22 bp, Artificial Sequence
  chemically synthesized
aggaggagtcagtggcagaaat

SEQ ID NO: 929213 - DNA, 22 bp, Artificial Sequence
  chemically synthesized
catgcacttctctccatttctg

SEQ ID NO: 929214 - DNA, 22 bp, Artificial Sequence
  chemically synthesized
gttccatgcacttctctccatt

SEQ ID NO: 929215 - DNA, 22 bp, Artificial Sequence
  chemically synthesized
ggttccatgcacttctctccat

SEQ ID NO: 929216 - DNA, 22 bp, Artificial Sequence
  chemically synthesized
caaatgccacttggttccatgc

SEQ ID NO: 929217 - DNA, 22 bp, Artificial Sequence
  chemically synthesized
ccaaatgccacttggttccatg

SEQ ID NO: 929218 - DNA, 22 bp, Artificial Sequence
  chemically synthesized
tccaaatgccacttggttccat

SEQ ID NO: 929219 - DNA, 22 bp, Artificial Sequence
  chemically synthesized
ctttccaaatgccacttggttc

SEQ ID NO: 929220 - DNA, 22 bp, Artificial Sequence
  chemically synthesized
actttccaaatgccacttggtt

SEQ ID NO: 929221 - DNA, 22 bp, Artificial Sequence
  chemically synthesized
tgtatttactttccaaatgcca

SEQ ID NO: 929222 - DNA, 22 bp, Artificial Sequence
  chemically synthesized
agtcctgtgtatttactttcca

SEQ ID NO: 929223 - DNA, 22 bp, Artificial Sequence
  chemically synthesized
caatgcattaagtcctgtgtat

SEQ ID NO: 929224 - DNA, 22 bp, Artificial Sequence
  chemically synthesized
ggaaagtaaatacacaggactt

SEQ ID NO: 929225 - DNA, 22 bp, Artificial Sequence
  chemically synthesized
gaaagtaaatacacaggactta

SEQ ID NO: 929226 - DNA, 22 bp, Artificial Sequence
  chemically synthesized
tctccaatgcattaagtcctgt

SEQ ID NO: 929227 - DNA, 22 bp, Artificial Sequence
  chemically synthesized
tgtctccaatgcattaagtcct

SEQ ID NO: 929228 - DNA, 22 bp, Artificial Sequence
  chemically synthesized
ctgtctccaatgcattaagtcc

SEQ ID NO: 929229 - DNA, 22 bp, Artificial Sequence
  chemically synthesized
atttctgtctccaatgcattaa

SEQ ID NO: 929230 - DNA, 22 bp, Artificial Sequence
  chemically synthesized
catttctgtctccaatgcatta

SEQ ID NO: 929231 - DNA, 22 bp, Artificial Sequence
  chemically synthesized
cttcatttctgtctccaatgca

SEQ ID NO: 929232 - DNA, 22 bp, Artificial Sequence
  chemically synthesized
tccttcatttctgtctccaatg

SEQ ID NO: 929233 - DNA, 22 bp, Artificial Sequence
  chemically synthesized
tctccttcatttctgtctccaa

SEQ ID NO: 929234 - DNA, 22 bp, Artificial Sequence
  chemically synthesized
aatgcattggagacagaaatga

SEQ ID NO: 929235 - DNA, 22 bp, Artificial Sequence
  chemically synthesized
atactctctccttcatttctgt

SEQ ID NO: 929236 - DNA, 22 bp, Artificial Sequence
  chemically synthesized
atgcattggagacagaaatgaa

SEQ ID NO: 929237 - DNA, 22 bp, Artificial Sequence
  chemically synthesized
attgatactctctccttcattt

SEQ ID NO: 929238 - DNA, 22 bp, Artificial Sequence
  chemically synthesized
tctgattgatactctctccttc

SEQ ID NO: 929239 - DNA, 22 bp, Artificial Sequence
  chemically synthesized
gagacagaaatgaaggagagag

SEQ ID NO: 929240 - DNA, 22 bp, Artificial Sequence
  chemically synthesized
aactgtctgattgatactctct

SEQ ID NO: 929241 - DNA, 22 bp, Artificial Sequence
  chemically synthesized
caactgtctgattgatactctc

SEQ ID NO: 929242 - DNA, 22 bp, Artificial Sequence
  chemically synthesized
cagaccagtatcttcaactgtc

SEQ ID NO: 929243 - DNA, 22 bp, Artificial Sequence
  chemically synthesized
agttccagaccagtatcttcaa

SEQ ID NO: 929244 - DNA, 22 bp, Artificial Sequence
  chemically synthesized
tgagttccagaccagtatcttc

SEQ ID NO: 929245 - DNA, 22 bp, Artificial Sequence
  chemically synthesized
ctctgagttccagaccagtatc

SEQ ID NO: 929246 - DNA, 22 bp, Artificial Sequence
  chemically synthesized
cctctgagttccagaccagtat

SEQ ID NO: 929247 - DNA, 22 bp, Artificial Sequence
  chemically synthesized
atatttcctctgagttccagac

SEQ ID NO: 929248 - DNA, 22 bp, Artificial Sequence
  chemically synthesized
aagatactggtctggaactcag

SEQ ID NO: 929249 - DNA, 22 bp, Artificial Sequence
  chemically synthesized
agtcctaatatttcctctgagt

SEQ ID NO: 929250 - DNA, 22 bp, Artificial Sequence
  chemically synthesized
cagtcctaatatttcctctgag

SEQ ID NO: 929251 - DNA, 22 bp, Artificial Sequence
  chemically synthesized
tcagtcctaatatttcctctga

SEQ ID NO: 929252 - DNA, 22 bp, Artificial Sequence
  chemically synthesized
gtctggaactcagaggaaatat

SEQ ID NO: 929253 - DNA, 22 bp, Artificial Sequence
  chemically synthesized
tattttcagtcctaatatttcc

SEQ ID NO: 929254 - DNA, 22 bp, Artificial Sequence
  chemically synthesized
gaactcagaggaaatattagga

SEQ ID NO: 929255 - DNA, 22 bp, Artificial Sequence
  chemically synthesized
agttatattttcagtcctaata

SEQ ID NO: 929256 - DNA, 22 bp, Artificial Sequence
  chemically synthesized
tcagttatattttcagtcctaa

SEQ ID NO: 929257 - DNA, 22 bp, Artificial Sequence
  chemically synthesized
agaggaaatattaggactgaaa

SEQ ID NO: 929258 - DNA, 22 bp, Artificial Sequence
  chemically synthesized
ccaataatgctctcagttatat

SEQ ID NO: 929259 - DNA, 22 bp, Artificial Sequence
  chemically synthesized
tgccaataatgctctcagttat

SEQ ID NO: 929260 - DNA, 22 bp, Artificial Sequence
  chemically synthesized
ggactgaaaatataactgagag

SEQ ID NO: 929261 - DNA, 22 bp, Artificial Sequence
  chemically synthesized
aaaatataactgagagcattat

SEQ ID NO: 929262 - DNA, 22 bp, Artificial Sequence
  chemically synthesized
gacatagctctgccaataatgc

SEQ ID NO: 929263 - DNA, 22 bp, Artificial Sequence
  chemically synthesized
agacatagctctgccaataatg

SEQ ID NO: 929264 - DNA, 22 bp, Artificial Sequence
  chemically synthesized
tagacatagctctgccaataat

SEQ ID NO: 929265 - DNA, 22 bp, Artificial Sequence
  chemically synthesized
agagcattattggcagagctat

SEQ ID NO: 929266 - DNA, 22 bp, Artificial Sequence
  chemically synthesized
acatcataaattttagacatag

SEQ ID NO: 929267 - DNA, 22 bp, Artificial Sequence
  chemically synthesized
ttggcagagctatgtctaaaat

SEQ ID NO: 929268 - DNA, 22 bp, Artificial Sequence
  chemically synthesized
gcagagctatgtctaaaattta

SEQ ID NO: 929269 - DNA, 22 bp, Artificial Sequence
  chemically synthesized
gagcaaaactcacatcataaat

SEQ ID NO: 929270 - DNA, 22 bp, Artificial Sequence
  chemically synthesized
ggagcaaaactcacatcataaa

SEQ ID NO: 929271 - DNA, 22 bp, Artificial Sequence
  chemically synthesized
tgtctaaaatttatgatgtgag

SEQ ID NO: 929272 - DNA, 22 bp, Artificial Sequence
  chemically synthesized
aaatttatgatgtgagttttgc

SEQ ID NO: 929273 - DNA, 22 bp, Artificial Sequence
  chemically synthesized
aaacacatttggagcaaaactc

SEQ ID NO: 929274 - DNA, 22 bp, Artificial Sequence
  chemically synthesized
atgatgtgagttttgctccaaa

SEQ ID NO: 929275 - DNA, 22 bp, Artificial Sequence
  chemically synthesized
tgatgtgagttttgctccaaat

SEQ ID NO: 929276 - DNA, 22 bp, Artificial Sequence
  chemically synthesized
tgctccaaatgtgtttgagtcc

SEQ ID NO: 929277 - DNA, 22 bp, Artificial Sequence
  chemically synthesized
aataaaaataagggactcaaac

SEQ ID NO: 929278 - DNA, 22 bp, Artificial Sequence
  chemically synthesized
gctccaaatgtgtttgagtccc

SEQ ID NO: 929279 - DNA, 22 bp, Artificial Sequence
  chemically synthesized
caataaaaataagggactcaaa

SEQ ID NO: 929280 - DNA, 22 bp, Artificial Sequence
  chemically synthesized
ctccaaatgtgtttgagtccct

SEQ ID NO: 929281 - DNA, 22 bp, Artificial Sequence
  chemically synthesized
caaatgtgtttgagtcccttat

SEQ ID NO: 929282 - DNA, 22 bp, Artificial Sequence
  chemically synthesized
cccagaatcgtttcaataaaaa

SEQ ID NO: 929283 - DNA, 22 bp, Artificial Sequence
  chemically synthesized
gcccagaatcgtttcaataaaa

SEQ ID NO: 929284 - DNA, 22 bp, Artificial Sequence
  chemically synthesized
gagtcccttatttttattgaaa

SEQ ID NO: 929285 - DNA, 22 bp, Artificial Sequence
  chemically synthesized
agtcccttatttttattgaaac

SEQ ID NO: 929286 - DNA, 22 bp, Artificial Sequence
  chemically synthesized
agtttgcccagaatcgtttcaa

SEQ ID NO: 929287 - DNA, 22 bp, Artificial Sequence
  chemically synthesized
gagtttgcccagaatcgtttca

SEQ ID NO: 929288 - DNA, 22 bp, Artificial Sequence
  chemically synthesized
tgagtttgcccagaatcgtttc

SEQ ID NO: 929289 - DNA, 22 bp, Artificial Sequence
  chemically synthesized
atttttattgaaacgattctgg

SEQ ID NO: 929290 - DNA, 22 bp, Artificial Sequence
  chemically synthesized
tttttattgaaacgattctggg

SEQ ID NO: 929291 - DNA, 22 bp, Artificial Sequence
  chemically synthesized
gctttgagtttgcccagaatcg

SEQ ID NO: 929292 - DNA, 22 bp, Artificial Sequence
  chemically synthesized
ttattgaaacgattctgggcaa

SEQ ID NO: 929293 - DNA, 22 bp, Artificial Sequence
  chemically synthesized
ctagctttgagtttgcccagaa

SEQ ID NO: 929294 - DNA, 22 bp, Artificial Sequence
  chemically synthesized
tattgaaacgattctgggcaaa

SEQ ID NO: 929295 - DNA, 22 bp, Artificial Sequence
  chemically synthesized
attgaaacgattctgggcaaac

SEQ ID NO: 929296 - DNA, 22 bp, Artificial Sequence
  chemically synthesized
ttgaaacgattctgggcaaact

SEQ ID NO: 929297 - DNA, 22 bp, Artificial Sequence
  chemically synthesized
aaacgattctgggcaaactcaa

SEQ ID NO: 929298 - DNA, 22 bp, Artificial Sequence
  chemically synthesized
tgattgctagctttgagtttgc

SEQ ID NO: 929299 - DNA, 22 bp, Artificial Sequence
  chemically synthesized
gattatgattgctagctttgag

SEQ ID NO: 929300 - DNA, 22 bp, Artificial Sequence
  chemically synthesized
ggattatgattgctagctttga

SEQ ID NO: 929301 - DNA, 22 bp, Artificial Sequence
  chemically synthesized
tgggcaaactcaaagctagcaa

SEQ ID NO: 929302 - DNA, 22 bp, Artificial Sequence
  chemically synthesized
ggcaaactcaaagctagcaatc

SEQ ID NO: 929303 - DNA, 22 bp, Artificial Sequence
  chemically synthesized
ccaaaatatgtttggattatga

SEQ ID NO: 929304 - DNA, 22 bp, Artificial Sequence
  chemically synthesized
aaagctagcaatcataatccaa

SEQ ID NO: 929305 - DNA, 22 bp, Artificial Sequence
  chemically synthesized
gcaatcataatccaaacatatt

SEQ ID NO: 929306 - DNA, 22 bp, Artificial Sequence
  chemically synthesized
agggattcccaaaatatgtttg

SEQ ID NO: 929307 - DNA, 22 bp, Artificial Sequence
  chemically synthesized
gtcatcatgcagatactcaggg

SEQ ID NO: 929308 - DNA, 22 bp, Artificial Sequence
  chemically synthesized
tgggaatccctgagtatctgca

SEQ ID NO: 929309 - DNA, 22 bp, Artificial Sequence
  chemically synthesized
gggaatccctgagtatctgcat

SEQ ID NO: 929310 - DNA, 22 bp, Artificial Sequence
  chemically synthesized
ggaatccctgagtatctgcatg

SEQ ID NO: 929311 - DNA, 22 bp, Artificial Sequence
  chemically synthesized
agtatctgcatgatgactaatt

SEQ ID NO: 929312 - DNA, 22 bp, Artificial Sequence
  chemically synthesized
catgatgactaattttgtcatt

SEQ ID NO: 929313 - DNA, 22 bp, Artificial Sequence
  chemically synthesized
gatgtagcaaatgtcaataatg

SEQ ID NO: 929314 - DNA, 22 bp, Artificial Sequence
  chemically synthesized
attttgtcattattgacatttg

SEQ ID NO: 929315 - DNA, 22 bp, Artificial Sequence
  chemically synthesized
tgtcattattgacatttgctac

SEQ ID NO: 929316 - DNA, 22 bp, Artificial Sequence
  chemically synthesized
gtcattattgacatttgctaca

SEQ ID NO: 929317 - DNA, 22 bp, Artificial Sequence
  chemically synthesized
tcattattgacatttgctacat

SEQ ID NO: 929318 - DNA, 22 bp, Artificial Sequence
  chemically synthesized
ttgacatttgctacatctaata

SEQ ID NO: 929319 - DNA, 22 bp, Artificial Sequence
  chemically synthesized
acatttgctacatctaatatgt

SEQ ID NO: 929320 - DNA, 22 bp, Artificial Sequence
  chemically synthesized
gctacatctaatatgtattatt

SEQ ID NO: 929321 - DNA, 22 bp, Artificial Sequence
  chemically synthesized
ccagcaaatgaaaataatacat

SEQ ID NO: 929322 - DNA, 22 bp, Artificial Sequence
  chemically synthesized
ctacatctaatatgtattattt

SEQ ID NO: 929323 - DNA, 22 bp, Artificial Sequence
  chemically synthesized
tgccagcaaatgaaaataatac

SEQ ID NO: 929324 - DNA, 22 bp, Artificial Sequence
  chemically synthesized
catctaatatgtattattttca

SEQ ID NO: 929325 - DNA, 22 bp, Artificial Sequence
  chemically synthesized
tctgccagcaaatgaaaataat

SEQ ID NO: 929326 - DNA, 22 bp, Artificial Sequence
  chemically synthesized
atctctctgccagcaaatgaaa

SEQ ID NO: 929327 - DNA, 22 bp, Artificial Sequence
  chemically synthesized
atatgtattattttcatttgct

SEQ ID NO: 929328 - DNA, 22 bp, Artificial Sequence
  chemically synthesized
tgatattaatctctctgccagc

SEQ ID NO: 929329 - DNA, 22 bp, Artificial Sequence
  chemically synthesized
ttttcatttgctggcagagaga

SEQ ID NO: 929330 - DNA, 22 bp, Artificial Sequence
  chemically synthesized
attatgatattaatctctctgc

SEQ ID NO: 929331 - DNA, 22 bp, Artificial Sequence
  chemically synthesized
tcatttgctggcagagagatta

SEQ ID NO: 929332 - DNA, 22 bp, Artificial Sequence
  chemically synthesized
catttgctggcagagagattaa

SEQ ID NO: 929333 - DNA, 22 bp, Artificial Sequence
  chemically synthesized
atttgctggcagagagattaat

SEQ ID NO: 929334 - DNA, 22 bp, Artificial Sequence
  chemically synthesized
tgctaattatgatattaatctc

SEQ ID NO: 929335 - DNA, 22 bp, Artificial Sequence
  chemically synthesized
gctggcagagagattaatatca

SEQ ID NO: 929336 - DNA, 22 bp, Artificial Sequence
  chemically synthesized
ctggcagagagattaatatcat

SEQ ID NO: 929337 - DNA, 22 bp, Artificial Sequence
  chemically synthesized
cattatgctaattatgatatta

SEQ ID NO: 929338 - DNA, 22 bp, Artificial Sequence
  chemically synthesized
gcagagagattaatatcataat

SEQ ID NO: 929339 - DNA, 22 bp, Artificial Sequence
  chemically synthesized
tacattatgctaattatgatat

SEQ ID NO: 929340 - DNA, 22 bp, Artificial Sequence
  chemically synthesized
ctacattatgctaattatgata

SEQ ID NO: 929341 - DNA, 22 bp, Artificial Sequence
  chemically synthesized
tctacattatgctaattatgat

SEQ ID NO: 929342 - DNA, 22 bp, Artificial Sequence
  chemically synthesized
aattttctacattatgctaatt

SEQ ID NO: 929343 - DNA, 22 bp, Artificial Sequence
  chemically synthesized
tcaattttctacattatgctaa

SEQ ID NO: 929344 - DNA, 22 bp, Artificial Sequence
  chemically synthesized
atatcataattagcataatgta

SEQ ID NO: 929345 - DNA, 22 bp, Artificial Sequence
  chemically synthesized
gcataatgtagaaaattgagag

SEQ ID NO: 929346 - DNA, 22 bp, Artificial Sequence
  chemically synthesized
tggggaatcatacggcctctca

SEQ ID NO: 929347 - DNA, 22 bp, Artificial Sequence
  chemically synthesized
gtggggaatcatacggcctctc

SEQ ID NO: 929348 - DNA, 22 bp, Artificial Sequence
  chemically synthesized
aaatttgtggggaatcatacgg

SEQ ID NO: 929349 - DNA, 22 bp, Artificial Sequence
  chemically synthesized
caaatttgtggggaatcatacg

SEQ ID NO: 929350 - DNA, 22 bp, Artificial Sequence
  chemically synthesized
ttcaaatttgtggggaatcata

SEQ ID NO: 929351 - DNA, 22 bp, Artificial Sequence
  chemically synthesized
cttcaaatttgtggggaatcat

SEQ ID NO: 929352 - DNA, 22 bp, Artificial Sequence
  chemically synthesized
tcttcaaatttgtggggaatca

SEQ ID NO: 929353 - DNA, 22 bp, Artificial Sequence
  chemically synthesized
agaggccgtatgattccccaca

SEQ ID NO: 929354 - DNA, 22 bp, Artificial Sequence
  chemically synthesized
ttttcttcaaatttgtggggaa

SEQ ID NO: 929355 - DNA, 22 bp, Artificial Sequence
  chemically synthesized
tattttcttcaaatttgtgggg

SEQ ID NO: 929356 - DNA, 22 bp, Artificial Sequence
  chemically synthesized
cccacaaatttgaagaaaatag

SEQ ID NO: 929357 - DNA, 22 bp, Artificial Sequence
  chemically synthesized
atcaaaacgatattctattttc

SEQ ID NO: 929358 - DNA, 22 bp, Artificial Sequence
  chemically synthesized
catcaaaacgatattctatttt

SEQ ID NO: 929359 - DNA, 22 bp, Artificial Sequence
  chemically synthesized
gaagaaaatagaatatcgtttt

SEQ ID NO: 929360 - DNA, 22 bp, Artificial Sequence
  chemically synthesized
aagaaaatagaatatcgttttg

SEQ ID NO: 929361 - DNA, 22 bp, Artificial Sequence
  chemically synthesized
gggtaggaaaacacaagcagct

SEQ ID NO: 929362 - DNA, 22 bp, Artificial Sequence
  chemically synthesized
tgatgaagctgcttgtgttttc

SEQ ID NO: 929363 - DNA, 22 bp, Artificial Sequence
  chemically synthesized
gatgaagctgcttgtgttttcc

SEQ ID NO: 929364 - DNA, 22 bp, Artificial Sequence
  chemically synthesized
atgaagctgcttgtgttttcct

SEQ ID NO: 929365 - DNA, 22 bp, Artificial Sequence
  chemically synthesized
cttgtgttttcctaccctaact

SEQ ID NO: 929366 - DNA, 22 bp, Artificial Sequence
  chemically synthesized
ataggtgggtgggagttagggt

SEQ ID NO: 929367 - DNA, 22 bp, Artificial Sequence
  chemically synthesized
gtgttttcctaccctaactccc

SEQ ID NO: 929368 - DNA, 22 bp, Artificial Sequence
  chemically synthesized
tgttttcctaccctaactccca

SEQ ID NO: 929369 - DNA, 22 bp, Artificial Sequence
  chemically synthesized
actaataggtgggtgggagtta

SEQ ID NO: 929370 - DNA, 22 bp, Artificial Sequence
  chemically synthesized
aactaataggtgggtgggagtt

SEQ ID NO: 929371 - DNA, 22 bp, Artificial Sequence
  chemically synthesized
taactaataggtgggtgggagt

SEQ ID NO: 929372 - DNA, 22 bp, Artificial Sequence
  chemically synthesized
ttaactaataggtgggtgggag

SEQ ID NO: 929373 - DNA, 22 bp, Artificial Sequence
  chemically synthesized
tcctaccctaactcccacccac

SEQ ID NO: 929374 - DNA, 22 bp, Artificial Sequence
  chemically synthesized
tttaactaataggtgggtggga

SEQ ID NO: 929375 - DNA, 22 bp, Artificial Sequence
  chemically synthesized
cctaccctaactcccacccacc

SEQ ID NO: 929376 - DNA, 22 bp, Artificial Sequence
  chemically synthesized
ttttaactaataggtgggtggg

SEQ ID NO: 929377 - DNA, 22 bp, Artificial Sequence
  chemically synthesized
ctaccctaactcccacccacct

SEQ ID NO: 929378 - DNA, 22 bp, Artificial Sequence
  chemically synthesized
tttttaactaataggtgggtgg

SEQ ID NO: 929379 - DNA, 22 bp, Artificial Sequence
  chemically synthesized
ccctaactcccacccacctatt

SEQ ID NO: 929380 - DNA, 22 bp, Artificial Sequence
  chemically synthesized
accattttttttaactaatagg

SEQ ID NO: 929381 - DNA, 22 bp, Artificial Sequence
  chemically synthesized
actcccacccacctattagtta

SEQ ID NO: 929382 - DNA, 22 bp, Artificial Sequence
  chemically synthesized
gaccattttttttaactaatag

SEQ ID NO: 929383 - DNA, 22 bp, Artificial Sequence
  chemically synthesized
tgaccattttttttaactaata

SEQ ID NO: 929384 - DNA, 22 bp, Artificial Sequence
  chemically synthesized
ccacccacctattagttaaaaa

SEQ ID NO: 929385 - DNA, 22 bp, Artificial Sequence
  chemically synthesized
aaatcacctttgaccatttttt

SEQ ID NO: 929386 - DNA, 22 bp, Artificial Sequence
  chemically synthesized
gaaatcacctttgaccattttt

SEQ ID NO: 929387 - DNA, 22 bp, Artificial Sequence
  chemically synthesized
tgaaatcacctttgaccatttt

SEQ ID NO: 929388 - DNA, 22 bp, Artificial Sequence
  chemically synthesized
ttagttaaaaaaaatggtcaaa

SEQ ID NO: 929389 - DNA, 22 bp, Artificial Sequence
  chemically synthesized
gttaaaaaaaatggtcaaaggt

SEQ ID NO: 929390 - DNA, 22 bp, Artificial Sequence
  chemically synthesized
aaaaaaatggtcaaaggtgatt

SEQ ID NO: 929391 - DNA, 22 bp, Artificial Sequence
  chemically synthesized
aaaacatattttgaaatcacct

SEQ ID NO: 929392 - DNA, 22 bp, Artificial Sequence
  chemically synthesized
tcaaaacatattttgaaatcac

SEQ ID NO: 929393 - DNA, 22 bp, Artificial Sequence
  chemically synthesized
ctcaaaacatattttgaaatca

SEQ ID NO: 929394 - DNA, 22 bp, Artificial Sequence
  chemically synthesized
tctcaaaacatattttgaaatc

SEQ ID NO: 929395 - DNA, 22 bp, Artificial Sequence
  chemically synthesized
aagcacaacactttctcaaaac

SEQ ID NO: 929396 - DNA, 22 bp, Artificial Sequence
  chemically synthesized
aaagcacaacactttctcaaaa

SEQ ID NO: 929397 - DNA, 22 bp, Artificial Sequence
  chemically synthesized
ttaaagcacaacactttctcaa

SEQ ID NO: 929398 - DNA, 22 bp, Artificial Sequence
  chemically synthesized
caaaatatgttttgagaaagtg

SEQ ID NO: 929399 - DNA, 22 bp, Artificial Sequence
  chemically synthesized
aaaatatgttttgagaaagtgt

SEQ ID NO: 929400 - DNA, 22 bp, Artificial Sequence
  chemically synthesized
tcttaaagcacaacactttctc

SEQ ID NO: 929401 - DNA, 22 bp, Artificial Sequence
  chemically synthesized
ttctcttaaagcacaacacttt

SEQ ID NO: 929402 - DNA, 22 bp, Artificial Sequence
  chemically synthesized
tgttctcttaaagcacaacact

SEQ ID NO: 929403 - DNA, 22 bp, Artificial Sequence
  chemically synthesized
attctgttctcttaaagcacaa

SEQ ID NO: 929404 - DNA, 22 bp, Artificial Sequence
  chemically synthesized
aattctgttctcttaaagcaca

SEQ ID NO: 929405 - DNA, 22 bp, Artificial Sequence
  chemically synthesized
tgagaaagtgttgtgctttaag

SEQ ID NO: 929406 - DNA, 22 bp, Artificial Sequence
  chemically synthesized
gagaaagtgttgtgctttaaga

SEQ ID NO: 929407 - DNA, 22 bp, Artificial Sequence
  chemically synthesized
agaaagtgttgtgctttaagag

SEQ ID NO: 929408 - DNA, 22 bp, Artificial Sequence
  chemically synthesized
aggaacaagcttaattctgttc

SEQ ID NO: 929409 - DNA, 22 bp, Artificial Sequence
  chemically synthesized
tgctttaagagaacagaattaa

SEQ ID NO: 929410 - DNA, 22 bp, Artificial Sequence
  chemically synthesized
taagagaacagaattaagcttg

SEQ ID NO: 929411 - DNA, 22 bp, Artificial Sequence
  chemically synthesized
aagagaacagaattaagcttgt

SEQ ID NO: 929412 - DNA, 22 bp, Artificial Sequence
  chemically synthesized
agagaacagaattaagcttgtt

SEQ ID NO: 929413 - DNA, 22 bp, Artificial Sequence
  chemically synthesized
agcttgttccttaatacacttc

SEQ ID NO: 929414 - DNA, 22 bp, Artificial Sequence
  chemically synthesized
tgaacacagaatagaagtgtat

SEQ ID NO: 929415 - DNA, 22 bp, Artificial Sequence
  chemically synthesized
gtgaacacagaatagaagtgta

SEQ ID NO: 929416 - DNA, 22 bp, Artificial Sequence
  chemically synthesized
ttgtgaacacagaatagaagtg

SEQ ID NO: 929417 - DNA, 22 bp, Artificial Sequence
  chemically synthesized
gttccttaatacacttctattc

SEQ ID NO: 929418 - DNA, 22 bp, Artificial Sequence
  chemically synthesized
ttccttaatacacttctattct

SEQ ID NO: 929419 - DNA, 22 bp, Artificial Sequence
  chemically synthesized
cttaatacacttctattctgtg

SEQ ID NO: 929420 - DNA, 22 bp, Artificial Sequence
  chemically synthesized
aatacacttctattctgtgttc

SEQ ID NO: 929421 - DNA, 22 bp, Artificial Sequence
  chemically synthesized
atacacttctattctgtgttca

SEQ ID NO: 929422 - DNA, 22 bp, Artificial Sequence
  chemically synthesized
ctattctgtgttcacaagaatt

SEQ ID NO: 929423 - DNA, 22 bp, Artificial Sequence
  chemically synthesized
tattctgtgttcacaagaattc

SEQ ID NO: 929424 - DNA, 22 bp, Artificial Sequence
  chemically synthesized
ttctgtgttcacaagaattcca

SEQ ID NO: 929425 - DNA, 22 bp, Artificial Sequence
  chemically synthesized
tgtgttcacaagaattccatgg

SEQ ID NO: 929426 - DNA, 22 bp, Artificial Sequence
  chemically synthesized
tgttcacaagaattccatgggc

SEQ ID NO: 929427 - DNA, 22 bp, Artificial Sequence
  chemically synthesized
tgccacagcaaaggcccatgga

SEQ ID NO: 929428 - DNA, 22 bp, Artificial Sequence
  chemically synthesized
acaagaattccatgggcctttg

SEQ ID NO: 929429 - DNA, 22 bp, Artificial Sequence
  chemically synthesized
aagactatgccacagcaaaggc

SEQ ID NO: 929430 - DNA, 22 bp, Artificial Sequence
  chemically synthesized
aaagactatgccacagcaaagg

SEQ ID NO: 929431 - DNA, 22 bp, Artificial Sequence
  chemically synthesized
catgggcctttgctgtggcata

SEQ ID NO: 929432 - DNA, 22 bp, Artificial Sequence
  chemically synthesized
gacagcatttaaagactatgcc

SEQ ID NO: 929433 - DNA, 22 bp, Artificial Sequence
  chemically synthesized
cattagacagcatttaaagact

SEQ ID NO: 929434 - DNA, 22 bp, Artificial Sequence
  chemically synthesized
tgctgtggcatagtctttaaat

SEQ ID NO: 929435 - DNA, 22 bp, Artificial Sequence
  chemically synthesized
gctgtggcatagtctttaaatg

SEQ ID NO: 929436 - DNA, 22 bp, Artificial Sequence
  chemically synthesized
ctgtggcatagtctttaaatgc

SEQ ID NO: 929437 - DNA, 22 bp, Artificial Sequence
  chemically synthesized
cctacattagacagcatttaaa

SEQ ID NO: 929438 - DNA, 22 bp, Artificial Sequence
  chemically synthesized
acctacattagacagcatttaa

SEQ ID NO: 929439 - DNA, 22 bp, Artificial Sequence
  chemically synthesized
tggcatagtctttaaatgctgt

SEQ ID NO: 929440 - DNA, 22 bp, Artificial Sequence
  chemically synthesized
aacaatttacctacattagaca

SEQ ID NO: 929441 - DNA, 22 bp, Artificial Sequence
  chemically synthesized
taaatgctgtctaatgtaggta

SEQ ID NO: 929442 - DNA, 22 bp, Artificial Sequence
  chemically synthesized
cattgaacaatttacctacatt

SEQ ID NO: 929443 - DNA, 22 bp, Artificial Sequence
  chemically synthesized
aaatgctgtctaatgtaggtaa

SEQ ID NO: 929444 - DNA, 22 bp, Artificial Sequence
  chemically synthesized
aatgctgtctaatgtaggtaaa

SEQ ID NO: 929445 - DNA, 22 bp, Artificial Sequence
  chemically synthesized
ctgcattgaacaatttacctac

SEQ ID NO: 929446 - DNA, 22 bp, Artificial Sequence
  chemically synthesized
actgcattgaacaatttaccta

SEQ ID NO: 929447 - DNA, 22 bp, Artificial Sequence
  chemically synthesized
tctaatgtaggtaaattgttca

SEQ ID NO: 929448 - DNA, 22 bp, Artificial Sequence
  chemically synthesized
atgtaggtaaattgttcaatgc

SEQ ID NO: 929449 - DNA, 22 bp, Artificial Sequence
  chemically synthesized
aagagaacacttactgcattga

SEQ ID NO: 929450 - DNA, 22 bp, Artificial Sequence
  chemically synthesized
ttcaatgcagtaagtgttctct

SEQ ID NO: 929451 - DNA, 22 bp, Artificial Sequence
  chemically synthesized
aatgcagtaagtgttctcttta

SEQ ID NO: 929452 - DNA, 22 bp, Artificial Sequence
  chemically synthesized
gagtcagtcacactaaagagaa

SEQ ID NO: 929453 - DNA, 22 bp, Artificial Sequence
  chemically synthesized
ttggagtcagtcacactaaaga

SEQ ID NO: 929454 - DNA, 22 bp, Artificial Sequence
  chemically synthesized
gttggagtcagtcacactaaag

SEQ ID NO: 929455 - DNA, 22 bp, Artificial Sequence
  chemically synthesized
aatatttgttggagtcagtcac

SEQ ID NO: 929456 - DNA, 22 bp, Artificial Sequence
  chemically synthesized
tctttagtgtgactgactccaa

SEQ ID NO: 929457 - DNA, 22 bp, Artificial Sequence
  chemically synthesized
aattaaatatttgttggagtca

SEQ ID NO: 929458 - DNA, 22 bp, Artificial Sequence
  chemically synthesized
tttagtgtgactgactccaaca

SEQ ID NO: 929459 - DNA, 22 bp, Artificial Sequence
  chemically synthesized
tagtgtgactgactccaacaaa

SEQ ID NO: 929460 - DNA, 22 bp, Artificial Sequence
  chemically synthesized
agtgtgactgactccaacaaat

SEQ ID NO: 929461 - DNA, 22 bp, Artificial Sequence
  chemically synthesized
gtgtgactgactccaacaaata

SEQ ID NO: 929462 - DNA, 22 bp, Artificial Sequence
  chemically synthesized
ccctaaattaaatatttgttgg

SEQ ID NO: 929463 - DNA, 22 bp, Artificial Sequence
  chemically synthesized
gtagttaccctaaattaaatat

SEQ ID NO: 929464 - DNA, 22 bp, Artificial Sequence
  chemically synthesized
actccaacaaatatttaattta

SEQ ID NO: 929465 - DNA, 22 bp, Artificial Sequence
  chemically synthesized
caacaaatatttaatttagggt

SEQ ID NO: 929466 - DNA, 22 bp, Artificial Sequence
  chemically synthesized
agacacctagtagttaccctaa

SEQ ID NO: 929467 - DNA, 22 bp, Artificial Sequence
  chemically synthesized
gagacacctagtagttacccta

SEQ ID NO: 929468 - DNA, 22 bp, Artificial Sequence
  chemically synthesized
aatttagggtaactactaggtg

SEQ ID NO: 929469 - DNA, 22 bp, Artificial Sequence
  chemically synthesized
taaaacttgagacacctagtag

SEQ ID NO: 929470 - DNA, 22 bp, Artificial Sequence
  chemically synthesized
atttagggtaactactaggtgt

SEQ ID NO: 929471 - DNA, 22 bp, Artificial Sequence
  chemically synthesized
agggtaactactaggtgtctca

SEQ ID NO: 929472 - DNA, 22 bp, Artificial Sequence
  chemically synthesized
gggtaactactaggtgtctcaa

SEQ ID NO: 929473 - DNA, 22 bp, Artificial Sequence
  chemically synthesized
tcattgtaaaacttgagacacc

SEQ ID NO: 929474 - DNA, 22 bp, Artificial Sequence
  chemically synthesized
atcattgtaaaacttgagacac

SEQ ID NO: 929475 - DNA, 22 bp, Artificial Sequence
  chemically synthesized
tttatcattgtaaaacttgaga

SEQ ID NO: 929476 - DNA, 22 bp, Artificial Sequence
  chemically synthesized
atttatcattgtaaaacttgag

SEQ ID NO: 929477 - DNA, 22 bp, Artificial Sequence
  chemically synthesized
ctaggtgtctcaagttttacaa

SEQ ID NO: 929478 - DNA, 22 bp, Artificial Sequence
  chemically synthesized
ggtgtctcaagttttacaatga

SEQ ID NO: 929479 - DNA, 22 bp, Artificial Sequence
  chemically synthesized
aagttttacaatgataaataag

SEQ ID NO: 929480 - DNA, 22 bp, Artificial Sequence
  chemically synthesized
acaagaaaatacaagcttattt

SEQ ID NO: 929481 - DNA, 22 bp, Artificial Sequence
  chemically synthesized
tacaatgataaataagcttgta

SEQ ID NO: 929482 - DNA, 22 bp, Artificial Sequence
  chemically synthesized
acaatgataaataagcttgtat

SEQ ID NO: 929483 - DNA, 22 bp, Artificial Sequence
  chemically synthesized
caatgataaataagcttgtatt

SEQ ID NO: 929484 - DNA, 22 bp, Artificial Sequence
  chemically synthesized
agagtgttgacaagaaaataca

SEQ ID NO: 929485 - DNA, 22 bp, Artificial Sequence
  chemically synthesized
agttgagagtgttgacaagaaa

SEQ ID NO: 929486 - DNA, 22 bp, Artificial Sequence
  chemically synthesized
gtattttcttgtcaacactctc

SEQ ID NO: 929487 - DNA, 22 bp, Artificial Sequence
  chemically synthesized
tattttcttgtcaacactctca

SEQ ID NO: 929488 - DNA, 22 bp, Artificial Sequence
  chemically synthesized
tcttgtcaacactctcaactta

SEQ ID NO: 929489 - DNA, 22 bp, Artificial Sequence
  chemically synthesized
gggtgtccccattaagttgaga

SEQ ID NO: 929490 - DNA, 22 bp, Artificial Sequence
  chemically synthesized
cttgtcaacactctcaacttaa

SEQ ID NO: 929491 - DNA, 22 bp, Artificial Sequence
  chemically synthesized
ttgtcaacactctcaacttaat

SEQ ID NO: 929492 - DNA, 22 bp, Artificial Sequence
  chemically synthesized
tagggtgtccccattaagttga

SEQ ID NO: 929493 - DNA, 22 bp, Artificial Sequence
  chemically synthesized
ctagggtgtccccattaagttg

SEQ ID NO: 929494 - DNA, 22 bp, Artificial Sequence
  chemically synthesized
gtcaacactctcaacttaatgg

SEQ ID NO: 929495 - DNA, 22 bp, Artificial Sequence
  chemically synthesized
tctagggtgtccccattaagtt

SEQ ID NO: 929496 - DNA, 22 bp, Artificial Sequence
  chemically synthesized
tcaacactctcaacttaatggg

SEQ ID NO: 929497 - DNA, 22 bp, Artificial Sequence
  chemically synthesized
tcaacttaatggggacacccta

SEQ ID NO: 929498 - DNA, 22 bp, Artificial Sequence
  chemically synthesized
aacttaatggggacaccctaga

SEQ ID NO: 929499 - DNA, 22 bp, Artificial Sequence
  chemically synthesized
taacacagcattttctagggtg

SEQ ID NO: 929500 - DNA, 22 bp, Artificial Sequence
  chemically synthesized
aatggggacaccctagaaaatg

SEQ ID NO: 929501 - DNA, 22 bp, Artificial Sequence
  chemically synthesized
atggggacaccctagaaaatgc

SEQ ID NO: 929502 - DNA, 22 bp, Artificial Sequence
  chemically synthesized
tattgtaacacagcattttcta

SEQ ID NO: 929503 - DNA, 22 bp, Artificial Sequence
  chemically synthesized
gaaaatgctgtgttacaatata

SEQ ID NO: 929504 - DNA, 22 bp, Artificial Sequence
  chemically synthesized
aaagcaatcgccatagttatat

SEQ ID NO: 929505 - DNA, 22 bp, Artificial Sequence
  chemically synthesized
tcaaagcaatcgccatagttat

SEQ ID NO: 929506 - DNA, 22 bp, Artificial Sequence
  chemically synthesized
tgttacaatataactatggcga

SEQ ID NO: 929507 - DNA, 22 bp, Artificial Sequence
  chemically synthesized
ttctcaaagcaatcgccatagt

SEQ ID NO: 929508 - DNA, 22 bp, Artificial Sequence
  chemically synthesized
gttctcaaagcaatcgccatag

SEQ ID NO: 929509 - DNA, 22 bp, Artificial Sequence
  chemically synthesized
caatataactatggcgattgct

SEQ ID NO: 929510 - DNA, 22 bp, Artificial Sequence
  chemically synthesized
tcttgttctcaaagcaatcgcc

SEQ ID NO: 929511 - DNA, 22 bp, Artificial Sequence
  chemically synthesized
atctatcttgttctcaaagcaa

SEQ ID NO: 929512 - DNA, 22 bp, Artificial Sequence
  chemically synthesized
attgatctatcttgttctcaaa

SEQ ID NO: 929513 - DNA, 22 bp, Artificial Sequence
  chemically synthesized
tggcgattgctttgagaacaag

SEQ ID NO: 929514 - DNA, 22 bp, Artificial Sequence
  chemically synthesized
gccaaattcattgatctatctt

SEQ ID NO: 929515 - DNA, 22 bp, Artificial Sequence
  chemically synthesized
cgccaaattcattgatctatct

SEQ ID NO: 929516 - DNA, 22 bp, Artificial Sequence
  chemically synthesized
ctttgagaacaagatagatcaa

SEQ ID NO: 929517 - DNA, 22 bp, Artificial Sequence
  chemically synthesized
tgagaacaagatagatcaatga

SEQ ID NO: 929518 - DNA, 22 bp, Artificial Sequence
  chemically synthesized
gagaacaagatagatcaatgaa

SEQ ID NO: 929519 - DNA, 22 bp, Artificial Sequence
  chemically synthesized
agaacaagatagatcaatgaat

SEQ ID NO: 929520 - DNA, 22 bp, Artificial Sequence
  chemically synthesized
ccatttcgccaaattcattgat

SEQ ID NO: 929521 - DNA, 22 bp, Artificial Sequence
  chemically synthesized
accatttcgccaaattcattga

SEQ ID NO: 929522 - DNA, 22 bp, Artificial Sequence
  chemically synthesized
cttaccatttcgccaaattcat

SEQ ID NO: 929523 - DNA, 22 bp, Artificial Sequence
  chemically synthesized
ccttaccatttcgccaaattca

SEQ ID NO: 929524 - DNA, 22 bp, Artificial Sequence
  chemically synthesized
tccttaccatttcgccaaattc

SEQ ID NO: 929525 - DNA, 22 bp, Artificial Sequence
  chemically synthesized
ttccttaccatttcgccaaatt

SEQ ID NO: 929526 - DNA, 22 bp, Artificial Sequence
  chemically synthesized
ttttccttaccatttcgccaaa

SEQ ID NO: 929527 - DNA, 22 bp, Artificial Sequence
  chemically synthesized
cttttccttaccatttcgccaa

SEQ ID NO: 929528 - DNA, 22 bp, Artificial Sequence
  chemically synthesized
tttcttttccttaccatttcgc

SEQ ID NO: 929529 - DNA, 22 bp, Artificial Sequence
  chemically synthesized
tctgtttcttttccttaccatt

SEQ ID NO: 929530 - DNA, 22 bp, Artificial Sequence
  chemically synthesized
gtctgtttcttttccttaccat

SEQ ID NO: 929531 - DNA, 22 bp, Artificial Sequence
  chemically synthesized
aacttgtctgtttcttttcctt

SEQ ID NO: 929532 - DNA, 22 bp, Artificial Sequence
  chemically synthesized
ggcgaaatggtaaggaaaagaa

SEQ ID NO: 929533 - DNA, 22 bp, Artificial Sequence
  chemically synthesized
gcgaaatggtaaggaaaagaaa

SEQ ID NO: 929534 - DNA, 22 bp, Artificial Sequence
  chemically synthesized
cctcaacttgtctgtttctttt

SEQ ID NO: 929535 - DNA, 22 bp, Artificial Sequence
  chemically synthesized
taatagtaattacctcaacttg

SEQ ID NO: 929536 - DNA, 22 bp, Artificial Sequence
  chemically synthesized
ataatagtaattacctcaactt

SEQ ID NO: 929537 - DNA, 22 bp, Artificial Sequence
  chemically synthesized
tataatagtaattacctcaact

SEQ ID NO: 929538 - DNA, 22 bp, Artificial Sequence
  chemically synthesized
aggcctttataatagtaattac

SEQ ID NO: 929539 - DNA, 22 bp, Artificial Sequence
  chemically synthesized
aaggcctttataatagtaatta

SEQ ID NO: 929540 - DNA, 22 bp, Artificial Sequence
  chemically synthesized
taaggcctttataatagtaatt

SEQ ID NO: 929541 - DNA, 22 bp, Artificial Sequence
  chemically synthesized
tctttaaggcctttataatagt

SEQ ID NO: 929542 - DNA, 22 bp, Artificial Sequence
  chemically synthesized
aggtaattactattataaaggc

SEQ ID NO: 929543 - DNA, 22 bp, Artificial Sequence
  chemically synthesized
ctattataaaggccttaaagac

SEQ ID NO: 929544 - DNA, 22 bp, Artificial Sequence
  chemically synthesized
ttataaaggccttaaagacagt

SEQ ID NO: 929545 - DNA, 22 bp, Artificial Sequence
  chemically synthesized
taaaggccttaaagacagtctt

SEQ ID NO: 929546 - DNA, 22 bp, Artificial Sequence
  chemically synthesized
gtgatataggaaatggggaaaa

SEQ ID NO: 929547 - DNA, 22 bp, Artificial Sequence
  chemically synthesized
ggtgatataggaaatggggaaa

SEQ ID NO: 929548 - DNA, 22 bp, Artificial Sequence
  chemically synthesized
aaagacagtcttttccccattt

SEQ ID NO: 929549 - DNA, 22 bp, Artificial Sequence
  chemically synthesized
aagacagtcttttccccatttc

SEQ ID NO: 929550 - DNA, 22 bp, Artificial Sequence
  chemically synthesized
tacttggtgatataggaaatgg

SEQ ID NO: 929551 - DNA, 22 bp, Artificial Sequence
  chemically synthesized
agcgctgtacttggtgatatag

SEQ ID NO: 929552 - DNA, 22 bp, Artificial Sequence
  chemically synthesized
ttccccatttcctatatcacca

SEQ ID NO: 929553 - DNA, 22 bp, Artificial Sequence
  chemically synthesized
tccccatttcctatatcaccaa

SEQ ID NO: 929554 - DNA, 22 bp, Artificial Sequence
  chemically synthesized
ccccatttcctatatcaccaag

SEQ ID NO: 929555 - DNA, 22 bp, Artificial Sequence
  chemically synthesized
cccatttcctatatcaccaagt

SEQ ID NO: 929556 - DNA, 22 bp, Artificial Sequence
  chemically synthesized
agcagtgctcagcgctgtactt

SEQ ID NO: 929557 - DNA, 22 bp, Artificial Sequence
  chemically synthesized
cctatatcaccaagtacagcgc

SEQ ID NO: 929558 - DNA, 22 bp, Artificial Sequence
  chemically synthesized
ctatatcaccaagtacagcgct

SEQ ID NO: 929559 - DNA, 22 bp, Artificial Sequence
  chemically synthesized
tatcaccaagtacagcgctgag

SEQ ID NO: 929560 - DNA, 22 bp, Artificial Sequence
  chemically synthesized
agctgagcagtgctcagcgctg

SEQ ID NO: 929561 - DNA, 22 bp, Artificial Sequence
  chemically synthesized
ttaagctgagcagtgctcagcg

SEQ ID NO: 929562 - DNA, 22 bp, Artificial Sequence
  chemically synthesized
agcaattattaagctgagcagt

SEQ ID NO: 929563 - DNA, 22 bp, Artificial Sequence
  chemically synthesized
aagcaattattaagctgagcag

SEQ ID NO: 929564 - DNA, 22 bp, Artificial Sequence
  chemically synthesized
ttaagcaattattaagctgagc

SEQ ID NO: 929565 - DNA, 22 bp, Artificial Sequence
  chemically synthesized
cttaagcaattattaagctgag

SEQ ID NO: 929566 - DNA, 22 bp, Artificial Sequence
  chemically synthesized
agcactgctcagcttaataatt

SEQ ID NO: 929567 - DNA, 22 bp, Artificial Sequence
  chemically synthesized
ctcagcttaataattgcttaag

SEQ ID NO: 929568 - DNA, 22 bp, Artificial Sequence
  chemically synthesized
tcaacaaatatttcttaagcaa

SEQ ID NO: 929569 - DNA, 22 bp, Artificial Sequence
  chemically synthesized
atcaacaaatatttcttaagca

SEQ ID NO: 929570 - DNA, 22 bp, Artificial Sequence
  chemically synthesized
agcttaataattgcttaagaaa

SEQ ID NO: 929571 - DNA, 22 bp, Artificial Sequence
  chemically synthesized
aatttatcaacaaatatttctt

SEQ ID NO: 929572 - DNA, 22 bp, Artificial Sequence
  chemically synthesized
aataattgcttaagaaatattt

SEQ ID NO: 929573 - DNA, 22 bp, Artificial Sequence
  chemically synthesized
ataattgcttaagaaatatttg

SEQ ID NO: 929574 - DNA, 22 bp, Artificial Sequence
  chemically synthesized
ctcaatttatcaacaaatattt

SEQ ID NO: 929575 - DNA, 22 bp, Artificial Sequence
  chemically synthesized
tgctcaatttatcaacaaatat

SEQ ID NO: 929576 - DNA, 22 bp, Artificial Sequence
  chemically synthesized
ctgctcaatttatcaacaaata

SEQ ID NO: 929577 - DNA, 22 bp, Artificial Sequence
  chemically synthesized
tctgctcaatttatcaacaaat

SEQ ID NO: 929578 - DNA, 22 bp, Artificial Sequence
  chemically synthesized
cttaagaaatatttgttgataa

SEQ ID NO: 929579 - DNA, 22 bp, Artificial Sequence
  chemically synthesized
gttttctgctcaatttatcaac

SEQ ID NO: 929580 - DNA, 22 bp, Artificial Sequence
  chemically synthesized
aagaaatatttgttgataaatt

SEQ ID NO: 929581 - DNA, 22 bp, Artificial Sequence
  chemically synthesized
agttttctgctcaatttatcaa

SEQ ID NO: 929582 - DNA, 22 bp, Artificial Sequence
  chemically synthesized
agaaatatttgttgataaattg

SEQ ID NO: 929583 - DNA, 22 bp, Artificial Sequence
  chemically synthesized
cttagttttctgctcaatttat

SEQ ID NO: 929584 - DNA, 22 bp, Artificial Sequence
  chemically synthesized
gcttagttttctgctcaattta

SEQ ID NO: 929585 - DNA, 22 bp, Artificial Sequence
  chemically synthesized
gttgataaattgagcagaaaac

SEQ ID NO: 929586 - DNA, 22 bp, Artificial Sequence
  chemically synthesized
ttgataaattgagcagaaaact

SEQ ID NO: 929587 - DNA, 22 bp, Artificial Sequence
  chemically synthesized
taatatcttgcttagttttctg

SEQ ID NO: 929588 - DNA, 22 bp, Artificial Sequence
  chemically synthesized
ataaattgagcagaaaactaag

SEQ ID NO: 929589 - DNA, 22 bp, Artificial Sequence
  chemically synthesized
agcagaaaactaagcaagatat

SEQ ID NO: 929590 - DNA, 22 bp, Artificial Sequence
  chemically synthesized
agcaagatattataatcttctt

SEQ ID NO: 929591 - DNA, 22 bp, Artificial Sequence
  chemically synthesized
cagaatgagaaagcaatcaaga

SEQ ID NO: 929592 - DNA, 22 bp, Artificial Sequence
  chemically synthesized
ccagaatgagaaagcaatcaag

SEQ ID NO: 929593 - DNA, 22 bp, Artificial Sequence
  chemically synthesized
tccagaatgagaaagcaatcaa

SEQ ID NO: 929594 - DNA, 22 bp, Artificial Sequence
  chemically synthesized
taatcttcttgattgctttctc

SEQ ID NO: 929595 - DNA, 22 bp, Artificial Sequence
  chemically synthesized
accctttccagaatgagaaagc

SEQ ID NO: 929596 - DNA, 22 bp, Artificial Sequence
  chemically synthesized
gaccctttccagaatgagaaag

SEQ ID NO: 929597 - DNA, 22 bp, Artificial Sequence
  chemically synthesized
tgaccctttccagaatgagaaa

SEQ ID NO: 929598 - DNA, 22 bp, Artificial Sequence
  chemically synthesized
ttgaccctttccagaatgagaa

SEQ ID NO: 929599 - DNA, 22 bp, Artificial Sequence
  chemically synthesized
cttgattgctttctcattctgg

SEQ ID NO: 929600 - DNA, 22 bp, Artificial Sequence
  chemically synthesized
ttgattgctttctcattctgga

SEQ ID NO: 929601 - DNA, 22 bp, Artificial Sequence
  chemically synthesized
cttttgaccctttccagaatga

SEQ ID NO: 929602 - DNA, 22 bp, Artificial Sequence
  chemically synthesized
gattgctttctcattctggaaa

SEQ ID NO: 929603 - DNA, 22 bp, Artificial Sequence
  chemically synthesized
attgctttctcattctggaaag

SEQ ID NO: 929604 - DNA, 22 bp, Artificial Sequence
  chemically synthesized
ctttctcattctggaaagggtc

SEQ ID NO: 929605 - DNA, 22 bp, Artificial Sequence
  chemically synthesized
aaaaagttacttttgacccttt

SEQ ID NO: 929606 - DNA, 22 bp, Artificial Sequence
  chemically synthesized
tctcattctggaaagggtcaaa

SEQ ID NO: 929607 - DNA, 22 bp, Artificial Sequence
  chemically synthesized
caaaaagttacttttgaccctt

SEQ ID NO: 929608 - DNA, 22 bp, Artificial Sequence
  chemically synthesized
ctcattctggaaagggtcaaaa

SEQ ID NO: 929609 - DNA, 22 bp, Artificial Sequence
  chemically synthesized
tcattctggaaagggtcaaaag

SEQ ID NO: 929610 - DNA, 22 bp, Artificial Sequence
  chemically synthesized
attctggaaagggtcaaaagta

SEQ ID NO: 929611 - DNA, 22 bp, Artificial Sequence
  chemically synthesized
tggaaagggtcaaaagtaactt

SEQ ID NO: 929612 - DNA, 22 bp, Artificial Sequence
  chemically synthesized
tatgtatttcaaaaagttactt

SEQ ID NO: 929613 - DNA, 22 bp, Artificial Sequence
  chemically synthesized
gaaagggtcaaaagtaactttt

SEQ ID NO: 929614 - DNA, 22 bp, Artificial Sequence
  chemically synthesized
ttgtatgtatttcaaaaagtta

SEQ ID NO: 929615 - DNA, 22 bp, Artificial Sequence
  chemically synthesized
ggctgttgtatgtatttcaaaa

SEQ ID NO: 929616 - DNA, 22 bp, Artificial Sequence
  chemically synthesized
taggctgttgtatgtatttcaa

SEQ ID NO: 929617 - DNA, 22 bp, Artificial Sequence
  chemically synthesized
actctaggctgttgtatgtatt

SEQ ID NO: 929618 - DNA, 22 bp, Artificial Sequence
  chemically synthesized
cactctaggctgttgtatgtat

SEQ ID NO: 929619 - DNA, 22 bp, Artificial Sequence
  chemically synthesized
tcactctaggctgttgtatgta

SEQ ID NO: 929620 - DNA, 22 bp, Artificial Sequence
  chemically synthesized
ttcactctaggctgttgtatgt

SEQ ID NO: 929621 - DNA, 22 bp, Artificial Sequence
  chemically synthesized
tttcactctaggctgttgtatg

SEQ ID NO: 929622 - DNA, 22 bp, Artificial Sequence
  chemically synthesized
tttttcactctaggctgttgta

SEQ ID NO: 929623 - DNA, 22 bp, Artificial Sequence
  chemically synthesized
tttgaaatacatacaacagcct

SEQ ID NO: 929624 - DNA, 22 bp, Artificial Sequence
  chemically synthesized
ttgaaatacatacaacagccta

SEQ ID NO: 929625 - DNA, 22 bp, Artificial Sequence
  chemically synthesized
tgaaatacatacaacagcctag

SEQ ID NO: 929626 - DNA, 22 bp, Artificial Sequence
  chemically synthesized
gaaatacatacaacagcctaga

SEQ ID NO: 929627 - DNA, 22 bp, Artificial Sequence
  chemically synthesized
aaatacatacaacagcctagag

SEQ ID NO: 929628 - DNA, 22 bp, Artificial Sequence
  chemically synthesized
aatgtctctttttcactctagg

SEQ ID NO: 929629 - DNA, 22 bp, Artificial Sequence
  chemically synthesized
aaatgtctctttttcactctag

SEQ ID NO: 929630 - DNA, 22 bp, Artificial Sequence
  chemically synthesized
taaatgtctctttttcactcta

SEQ ID NO: 929631 - DNA, 22 bp, Artificial Sequence
  chemically synthesized
ttaaatgtctctttttcactct

SEQ ID NO: 929632 - DNA, 22 bp, Artificial Sequence
  chemically synthesized
tttttaaatgtctctttttcac

SEQ ID NO: 929633 - DNA, 22 bp, Artificial Sequence
  chemically synthesized
gagtgaaaaagagacatttaaa

SEQ ID NO: 929634 - DNA, 22 bp, Artificial Sequence
  chemically synthesized
ataaaaacacaattatttttaa

SEQ ID NO: 929635 - DNA, 22 bp, Artificial Sequence
  chemically synthesized
gataaaaacacaattattttta

SEQ ID NO: 929636 - DNA, 22 bp, Artificial Sequence
  chemically synthesized
tgataaaaacacaattattttt

SEQ ID NO: 929637 - DNA, 22 bp, Artificial Sequence
  chemically synthesized
aaaaataattgtgtttttatca

SEQ ID NO: 929638 - DNA, 22 bp, Artificial Sequence
  chemically synthesized
aaaataattgtgtttttatcaa

SEQ ID NO: 929639 - DNA, 22 bp, Artificial Sequence
  chemically synthesized
tggtaggagatgaaactttgat

SEQ ID NO: 929640 - DNA, 22 bp, Artificial Sequence
  chemically synthesized
gtggtaggagatgaaactttga

SEQ ID NO: 929641 - DNA, 22 bp, Artificial Sequence
  chemically synthesized
tttgtggtaggagatgaaactt

SEQ ID NO: 929642 - DNA, 22 bp, Artificial Sequence
  chemically synthesized
tgtttttatcaaagtttcatct

SEQ ID NO: 929643 - DNA, 22 bp, Artificial Sequence
  chemically synthesized
ttatttgtggtaggagatgaaa

SEQ ID NO: 929644 - DNA, 22 bp, Artificial Sequence
  chemically synthesized
gttatttgtggtaggagatgaa

SEQ ID NO: 929645 - DNA, 22 bp, Artificial Sequence
  chemically synthesized
ttatcaaagtttcatctcctac

SEQ ID NO: 929646 - DNA, 22 bp, Artificial Sequence
  chemically synthesized
tatcaaagtttcatctcctacc

SEQ ID NO: 929647 - DNA, 22 bp, Artificial Sequence
  chemically synthesized
atcaaagtttcatctcctacca

SEQ ID NO: 929648 - DNA, 22 bp, Artificial Sequence
  chemically synthesized
tcaaagtttcatctcctaccac

SEQ ID NO: 929649 - DNA, 22 bp, Artificial Sequence
  chemically synthesized
ataacttgttatttgtggtagg

SEQ ID NO: 929650 - DNA, 22 bp, Artificial Sequence
  chemically synthesized
aataacttgttatttgtggtag

SEQ ID NO: 929651 - DNA, 22 bp, Artificial Sequence
  chemically synthesized
cttaataacttgttatttgtgg

SEQ ID NO: 929652 - DNA, 22 bp, Artificial Sequence
  chemically synthesized
ccttaataacttgttatttgtg

SEQ ID NO: 929653 - DNA, 22 bp, Artificial Sequence
  chemically synthesized
tccttaataacttgttatttgt

SEQ ID NO: 929654 - DNA, 22 bp, Artificial Sequence
  chemically synthesized
catctcctaccacaaataacaa

SEQ ID NO: 929655 - DNA, 22 bp, Artificial Sequence
  chemically synthesized
atctcctaccacaaataacaag

SEQ ID NO: 929656 - DNA, 22 bp, Artificial Sequence
  chemically synthesized
ctaccacaaataacaagttatt

SEQ ID NO: 929657 - DNA, 22 bp, Artificial Sequence
  chemically synthesized
ccacaaataacaagttattaag

SEQ ID NO: 929658 - DNA, 22 bp, Artificial Sequence
  chemically synthesized
agaaacgacagctttccttaat

SEQ ID NO: 929659 - DNA, 22 bp, Artificial Sequence
  chemically synthesized
aagagcctgagaaacgacagct

SEQ ID NO: 929660 - DNA, 22 bp, Artificial Sequence
  chemically synthesized
tcaagagcctgagaaacgacag

SEQ ID NO: 929661 - DNA, 22 bp, Artificial Sequence
  chemically synthesized
ttaaggaaagctgtcgtttctc

SEQ ID NO: 929662 - DNA, 22 bp, Artificial Sequence
  chemically synthesized
aggaaagctgtcgtttctcagg

SEQ ID NO: 929663 - DNA, 22 bp, Artificial Sequence
  chemically synthesized
ccattctcaagagcctgagaaa

SEQ ID NO: 929664 - DNA, 22 bp, Artificial Sequence
  chemically synthesized
cccattctcaagagcctgagaa

SEQ ID NO: 929665 - DNA, 22 bp, Artificial Sequence
  chemically synthesized
ggccttcccattctcaagagcc

SEQ ID NO: 929666 - DNA, 22 bp, Artificial Sequence
  chemically synthesized
tcgtttctcaggctcttgagaa

SEQ ID NO: 929667 - DNA, 22 bp, Artificial Sequence
  chemically synthesized
taggccttcccattctcaagag

SEQ ID NO: 929668 - DNA, 22 bp, Artificial Sequence
  chemically synthesized
ctaggccttcccattctcaaga

SEQ ID NO: 929669 - DNA, 22 bp, Artificial Sequence
  chemically synthesized
ctcaggctcttgagaatgggaa

SEQ ID NO: 929670 - DNA, 22 bp, Artificial Sequence
  chemically synthesized
tcaggctcttgagaatgggaag

SEQ ID NO: 929671 - DNA, 22 bp, Artificial Sequence
  chemically synthesized
aggctcttgagaatgggaaggc

SEQ ID NO: 929672 - DNA, 22 bp, Artificial Sequence
  chemically synthesized
tcgtatttctaggccttcccat

SEQ ID NO: 929673 - DNA, 22 bp, Artificial Sequence
  chemically synthesized
atcgtatttctaggccttccca

SEQ ID NO: 929674 - DNA, 22 bp, Artificial Sequence
  chemically synthesized
tatcgtatttctaggccttccc

SEQ ID NO: 929675 - DNA, 22 bp, Artificial Sequence
  chemically synthesized
tttatcgtatttctaggccttc

SEQ ID NO: 929676 - DNA, 22 bp, Artificial Sequence
  chemically synthesized
ttgagaatgggaaggcctagaa

SEQ ID NO: 929677 - DNA, 22 bp, Artificial Sequence
  chemically synthesized
gagaatgggaaggcctagaaat

SEQ ID NO: 929678 - DNA, 22 bp, Artificial Sequence
  chemically synthesized
agaatgggaaggcctagaaata

SEQ ID NO: 929679 - DNA, 22 bp, Artificial Sequence
  chemically synthesized
atccctctttatcgtatttcta

SEQ ID NO: 929680 - DNA, 22 bp, Artificial Sequence
  chemically synthesized
gatccctctttatcgtatttct

SEQ ID NO: 929681 - DNA, 22 bp, Artificial Sequence
  chemically synthesized
tgatccctctttatcgtatttc

SEQ ID NO: 929682 - DNA, 22 bp, Artificial Sequence
  chemically synthesized
ctttgatccctctttatcgtat

SEQ ID NO: 929683 - DNA, 22 bp, Artificial Sequence
  chemically synthesized
gaaatacgataaagagggatca

SEQ ID NO: 929684 - DNA, 22 bp, Artificial Sequence
  chemically synthesized
gacacagagatctgctttgatc

SEQ ID NO: 929685 - DNA, 22 bp, Artificial Sequence
  chemically synthesized
atgttagacacagagatctgct

SEQ ID NO: 929686 - DNA, 22 bp, Artificial Sequence
  chemically synthesized
attgatgttagacacagagatc

SEQ ID NO: 929687 - DNA, 22 bp, Artificial Sequence
  chemically synthesized
aaaatcaattaattgatgttag

SEQ ID NO: 929688 - DNA, 22 bp, Artificial Sequence
  chemically synthesized
tgtgtctaacatcaattaattg

SEQ ID NO: 929689 - DNA, 22 bp, Artificial Sequence
  chemically synthesized
aatgctcaaaatcaattaattg

SEQ ID NO: 929690 - DNA, 22 bp, Artificial Sequence
  chemically synthesized
tgtctaacatcaattaattgat

SEQ ID NO: 929691 - DNA, 22 bp, Artificial Sequence
  chemically synthesized
agctaaatgctcaaaatcaatt

SEQ ID NO: 929692 - DNA, 22 bp, Artificial Sequence
  chemically synthesized
acatcaattaattgattttgag

SEQ ID NO: 929693 - DNA, 22 bp, Artificial Sequence
  chemically synthesized
taatctaagctaaatgctcaaa

SEQ ID NO: 929694 - DNA, 22 bp, Artificial Sequence
  chemically synthesized
tgtaatctaagctaaatgctca

SEQ ID NO: 929695 - DNA, 22 bp, Artificial Sequence
  chemically synthesized
attgattttgagcatttagctt

SEQ ID NO: 929696 - DNA, 22 bp, Artificial Sequence
  chemically synthesized
ggggttctgtaatctaagctaa

SEQ ID NO: 929697 - DNA, 22 bp, Artificial Sequence
  chemically synthesized
attttgagcatttagcttagat

SEQ ID NO: 929698 - DNA, 22 bp, Artificial Sequence
  chemically synthesized
gggggttctgtaatctaagcta

SEQ ID NO: 929699 - DNA, 22 bp, Artificial Sequence
  chemically synthesized
tgagcatttagcttagattaca

SEQ ID NO: 929700 - DNA, 22 bp, Artificial Sequence
  chemically synthesized
gagcatttagcttagattacag

SEQ ID NO: 929701 - DNA, 22 bp, Artificial Sequence
  chemically synthesized
agcatttagcttagattacaga

SEQ ID NO: 929702 - DNA, 22 bp, Artificial Sequence
  chemically synthesized
atgtcttgggggttctgtaatc

SEQ ID NO: 929703 - DNA, 22 bp, Artificial Sequence
  chemically synthesized
gttgatgtcttgggggttctgt

SEQ ID NO: 929704 - DNA, 22 bp, Artificial Sequence
  chemically synthesized
agcttagattacagaaccccca

SEQ ID NO: 929705 - DNA, 22 bp, Artificial Sequence
  chemically synthesized
gcttagattacagaacccccaa

SEQ ID NO: 929706 - DNA, 22 bp, Artificial Sequence
  chemically synthesized
ttagttgatgtcttgggggttc

SEQ ID NO: 929707 - DNA, 22 bp, Artificial Sequence
  chemically synthesized
agattacagaacccccaagaca

SEQ ID NO: 929708 - DNA, 22 bp, Artificial Sequence
  chemically synthesized
gattacagaacccccaagacat

SEQ ID NO: 929709 - DNA, 22 bp, Artificial Sequence
  chemically synthesized
cagaacccccaagacatcaact

SEQ ID NO: 929710 - DNA, 22 bp, Artificial Sequence
  chemically synthesized
gatgtggattgttagttgatgt

SEQ ID NO: 929711 - DNA, 22 bp, Artificial Sequence
  chemically synthesized
agatgtggattgttagttgatg

SEQ ID NO: 929712 - DNA, 22 bp, Artificial Sequence
  chemically synthesized
gtgatgcccaacatgtgcttag

SEQ ID NO: 929713 - DNA, 22 bp, Artificial Sequence
  chemically synthesized
acaatccacatctaagcacatg

SEQ ID NO: 929714 - DNA, 22 bp, Artificial Sequence
  chemically synthesized
agtgatgcccaacatgtgctta

SEQ ID NO: 929715 - DNA, 22 bp, Artificial Sequence
  chemically synthesized
agcacatgttgggcatcactaa

SEQ ID NO: 929716 - DNA, 22 bp, Artificial Sequence
  chemically synthesized
gcaagagggacatataaggctt

SEQ ID NO: 929717 - DNA, 22 bp, Artificial Sequence
  chemically synthesized
ggcaagagggacatataaggct

SEQ ID NO: 929718 - DNA, 22 bp, Artificial Sequence
  chemically synthesized
ggcatcactaagccttatatgt

SEQ ID NO: 929719 - DNA, 22 bp, Artificial Sequence
  chemically synthesized
tataacttggcaagagggacat

SEQ ID NO: 929720 - DNA, 22 bp, Artificial Sequence
  chemically synthesized
agccttatatgtccctcttgcc

SEQ ID NO: 929721 - DNA, 22 bp, Artificial Sequence
  chemically synthesized
atgcctgtataacttggcaaga

SEQ ID NO: 929722 - DNA, 22 bp, Artificial Sequence
  chemically synthesized
aatgcctgtataacttggcaag

SEQ ID NO: 929723 - DNA, 22 bp, Artificial Sequence
  chemically synthesized
atatgtccctcttgccaagtta

SEQ ID NO: 929724 - DNA, 22 bp, Artificial Sequence
  chemically synthesized
tatgtccctcttgccaagttat

SEQ ID NO: 929725 - DNA, 22 bp, Artificial Sequence
  chemically synthesized
tgtttaatgcctgtataacttg

SEQ ID NO: 929726 - DNA, 22 bp, Artificial Sequence
  chemically synthesized
gtgtttaatgcctgtataactt

SEQ ID NO: 929727 - DNA, 22 bp, Artificial Sequence
  chemically synthesized
ttgccaagttatacaggcatta

SEQ ID NO: 929728 - DNA, 22 bp, Artificial Sequence
  chemically synthesized
gccaagttatacaggcattaaa

SEQ ID NO: 929729 - DNA, 22 bp, Artificial Sequence
  chemically synthesized
ccaagttatacaggcattaaac

SEQ ID NO: 929730 - DNA, 22 bp, Artificial Sequence
  chemically synthesized
tacaggcattaaacacaaatta

SEQ ID NO: 929731 - DNA, 22 bp, Artificial Sequence
  chemically synthesized
gggaaaaataaaagagtaattt

SEQ ID NO: 929732 - DNA, 22 bp, Artificial Sequence
  chemically synthesized
ggggaaaaataaaagagtaatt

SEQ ID NO: 929733 - DNA, 22 bp, Artificial Sequence
  chemically synthesized
aacacaaattactcttttattt

SEQ ID NO: 929734 - DNA, 22 bp, Artificial Sequence
  chemically synthesized
aggcttggggaaaaataaaaga

SEQ ID NO: 929735 - DNA, 22 bp, Artificial Sequence
  chemically synthesized
aaggcttggggaaaaataaaag

SEQ ID NO: 929736 - DNA, 22 bp, Artificial Sequence
  chemically synthesized
agaacttaaggcttggggaaaa

SEQ ID NO: 929737 - DNA, 22 bp, Artificial Sequence
  chemically synthesized
ctcttttatttttccccaagcc

SEQ ID NO: 929738 - DNA, 22 bp, Artificial Sequence
  chemically synthesized
acctcagaacttaaggcttggg

SEQ ID NO: 929739 - DNA, 22 bp, Artificial Sequence
  chemically synthesized
ttttatttttccccaagcctta

SEQ ID NO: 929740 - DNA, 22 bp, Artificial Sequence
  chemically synthesized
ttatttttccccaagccttaag

SEQ ID NO: 929741 - DNA, 22 bp, Artificial Sequence
  chemically synthesized
tatttttccccaagccttaagt

SEQ ID NO: 929742 - DNA, 22 bp, Artificial Sequence
  chemically synthesized
atttttccccaagccttaagtt

SEQ ID NO: 929743 - DNA, 22 bp, Artificial Sequence
  chemically synthesized
tttttccccaagccttaagttc

SEQ ID NO: 929744 - DNA, 22 bp, Artificial Sequence
  chemically synthesized
ttccccaagccttaagttctga

SEQ ID NO: 929745 - DNA, 22 bp, Artificial Sequence
  chemically synthesized
tccccaagccttaagttctgag

SEQ ID NO: 929746 - DNA, 22 bp, Artificial Sequence
  chemically synthesized
ccccaagccttaagttctgagg

SEQ ID NO: 929747 - DNA, 22 bp, Artificial Sequence
  chemically synthesized
cccaagccttaagttctgaggt

SEQ ID NO: 929748 - DNA, 22 bp, Artificial Sequence
  chemically synthesized
gaaaacaagaaacctaacctca

SEQ ID NO: 929749 - DNA, 22 bp, Artificial Sequence
  chemically synthesized
aagttctgaggttaggtttctt

SEQ ID NO: 929750 - DNA, 22 bp, Artificial Sequence
  chemically synthesized
agttctgaggttaggtttcttg

SEQ ID NO: 929751 - DNA, 22 bp, Artificial Sequence
  chemically synthesized
tgaggttaggtttcttgttttc

SEQ ID NO: 929752 - DNA, 22 bp, Artificial Sequence
  chemically synthesized
aggttaggtttcttgttttcca

SEQ ID NO: 929753 - DNA, 22 bp, Artificial Sequence
  chemically synthesized
ggtttcttgttttccaactcat

SEQ ID NO: 929754 - DNA, 22 bp, Artificial Sequence
  chemically synthesized
ccatacaacagataatgagttg

SEQ ID NO: 929755 - DNA, 22 bp, Artificial Sequence
  chemically synthesized
cttgttttccaactcattatct

SEQ ID NO: 929756 - DNA, 22 bp, Artificial Sequence
  chemically synthesized
ttgttttccaactcattatctg

SEQ ID NO: 929757 - DNA, 22 bp, Artificial Sequence
  chemically synthesized
gttttccaactcattatctgtt

SEQ ID NO: 929758 - DNA, 22 bp, Artificial Sequence
  chemically synthesized
ttttccaactcattatctgttg

SEQ ID NO: 929759 - DNA, 22 bp, Artificial Sequence
  chemically synthesized
tccaactcattatctgttgtat

SEQ ID NO: 929760 - DNA, 22 bp, Artificial Sequence
  chemically synthesized
ccaactcattatctgttgtatg

SEQ ID NO: 929761 - DNA, 22 bp, Artificial Sequence
  chemically synthesized
caactcattatctgttgtatgg

SEQ ID NO: 929762 - DNA, 22 bp, Artificial Sequence
  chemically synthesized
attatctgttgtatggtaatac

SEQ ID NO: 929763 - DNA, 22 bp, Artificial Sequence
  chemically synthesized
catgaaggagagtagtattacc

SEQ ID NO: 929764 - DNA, 22 bp, Artificial Sequence
  chemically synthesized
tctgttgtatggtaatactact

SEQ ID NO: 929765 - DNA, 22 bp, Artificial Sequence
  chemically synthesized
attccatgaaggagagtagtat

SEQ ID NO: 929766 - DNA, 22 bp, Artificial Sequence
  chemically synthesized
ttgtatggtaatactactctcc

SEQ ID NO: 929767 - DNA, 22 bp, Artificial Sequence
  chemically synthesized
tatggtaatactactctccttc

SEQ ID NO: 929768 - DNA, 22 bp, Artificial Sequence
  chemically synthesized
atctaattccatgaaggagagt

SEQ ID NO: 929769 - DNA, 22 bp, Artificial Sequence
  chemically synthesized
tcatctaattccatgaaggaga

SEQ ID NO: 929770 - DNA, 22 bp, Artificial Sequence
  chemically synthesized
ctcatctaattccatgaaggag

SEQ ID NO: 929771 - DNA, 22 bp, Artificial Sequence
  chemically synthesized
ttctcatctaattccatgaagg

SEQ ID NO: 929772 - DNA, 22 bp, Artificial Sequence
  chemically synthesized
ctctccttcatggaattagatg

SEQ ID NO: 929773 - DNA, 22 bp, Artificial Sequence
  chemically synthesized
tcatcacctcttctcatctaat

SEQ ID NO: 929774 - DNA, 22 bp, Artificial Sequence
  chemically synthesized
tccttcatggaattagatgaga

SEQ ID NO: 929775 - DNA, 22 bp, Artificial Sequence
  chemically synthesized
atcatcacctcttctcatctaa

SEQ ID NO: 929776 - DNA, 22 bp, Artificial Sequence
  chemically synthesized
tatcatcacctcttctcatcta

SEQ ID NO: 929777 - DNA, 22 bp, Artificial Sequence
  chemically synthesized
cttcatggaattagatgagaag

SEQ ID NO: 929778 - DNA, 22 bp, Artificial Sequence
  chemically synthesized
ttatcatcacctcttctcatct

SEQ ID NO: 929779 - DNA, 22 bp, Artificial Sequence
  chemically synthesized
catggaattagatgagaagagg

SEQ ID NO: 929780 - DNA, 22 bp, Artificial Sequence
  chemically synthesized
tttttatcatcacctcttctca

SEQ ID NO: 929781 - DNA, 22 bp, Artificial Sequence
  chemically synthesized
atggaattagatgagaagaggt

SEQ ID NO: 929782 - DNA, 22 bp, Artificial Sequence
  chemically synthesized
gatgagaagaggtgatgataaa

SEQ ID NO: 929783 - DNA, 22 bp, Artificial Sequence
  chemically synthesized
cagagggcgtgcccagtcaaca

SEQ ID NO: 929784 - DNA, 22 bp, Artificial Sequence
  chemically synthesized
gcagagggcgtgcccagtcaac

SEQ ID NO: 929785 - DNA, 22 bp, Artificial Sequence
  chemically synthesized
tgcctctcttgttgactgggca

SEQ ID NO: 929786 - DNA, 22 bp, Artificial Sequence
  chemically synthesized
atttgcagagggcgtgcccagt

SEQ ID NO: 929787 - DNA, 22 bp, Artificial Sequence
  chemically synthesized
gatttgcagagggcgtgcccag

SEQ ID NO: 929788 - DNA, 22 bp, Artificial Sequence
  chemically synthesized
tgatttgcagagggcgtgccca

SEQ ID NO: 929789 - DNA, 22 bp, Artificial Sequence
  chemically synthesized
ttgatttgcagagggcgtgccc

SEQ ID NO: 929790 - DNA, 22 bp, Artificial Sequence
  chemically synthesized
tcttgttgactgggcacgccct

SEQ ID NO: 929791 - DNA, 22 bp, Artificial Sequence
  chemically synthesized
tttgatttgcagagggcgtgcc

SEQ ID NO: 929792 - DNA, 22 bp, Artificial Sequence
  chemically synthesized
ttttgatttgcagagggcgtgc

SEQ ID NO: 929793 - DNA, 22 bp, Artificial Sequence
  chemically synthesized
ttgttgactgggcacgccctct

SEQ ID NO: 929794 - DNA, 22 bp, Artificial Sequence
  chemically synthesized
tttttgatttgcagagggcgtg

SEQ ID NO: 929795 - DNA, 22 bp, Artificial Sequence
  chemically synthesized
ttttttgatttgcagagggcgt

SEQ ID NO: 929796 - DNA, 22 bp, Artificial Sequence
  chemically synthesized
gttgactgggcacgccctctgc

SEQ ID NO: 929797 - DNA, 22 bp, Artificial Sequence
  chemically synthesized
tttttttgatttgcagagggcg

SEQ ID NO: 929798 - DNA, 22 bp, Artificial Sequence
  chemically synthesized
ttgactgggcacgccctctgca

SEQ ID NO: 929799 - DNA, 22 bp, Artificial Sequence
  chemically synthesized
ttttttttgatttgcagagggc

SEQ ID NO: 929800 - DNA, 22 bp, Artificial Sequence
  chemically synthesized
tttttttttgatttgcagaggg

SEQ ID NO: 929801 - DNA, 22 bp, Artificial Sequence
  chemically synthesized
ttttttttttgatttgcagagg

SEQ ID NO: 929802 - DNA, 22 bp, Artificial Sequence
  chemically synthesized
actgggcacgccctctgcaaat

SEQ ID NO: 929803 - DNA, 22 bp, Artificial Sequence
  chemically synthesized
tttttttttttgatttgcagag

SEQ ID NO: 929804 - DNA, 22 bp, Artificial Sequence
  chemically synthesized
ttttttttttttgatttgcaga

SEQ ID NO: 929805 - DNA, 22 bp, Artificial Sequence
  chemically synthesized
tttttttttttttgatttgcag

SEQ ID NO: 929806 - DNA, 22 bp, Artificial Sequence
  chemically synthesized
ttttttttttttttgatttgca

SEQ ID NO: 929807 - DNA, 22 bp, Artificial Sequence
  chemically synthesized
ggcacgccctctgcaaatcaaa

SEQ ID NO: 929808 - DNA, 22 bp, Artificial Sequence
  chemically synthesized
tttttttttttttttgatttgc

SEQ ID NO: 929809 - DNA, 22 bp, Artificial Sequence
  chemically synthesized
ttttttttttttttttgatttg

SEQ ID NO: 929810 - DNA, 22 bp, Artificial Sequence
  chemically synthesized
ttttttttttttttttttgatt

SEQ ID NO: 929811 - DNA, 22 bp, Artificial Sequence
  chemically synthesized
tgcattcttttttttttttttt

SEQ ID NO: 929812 - DNA, 22 bp, Artificial Sequence
  chemically synthesized
tgcaaatcaaaaaaaaaaaaaa

SEQ ID NO: 929813 - DNA, 22 bp, Artificial Sequence
  chemically synthesized
gtgcattctttttttttttttt

SEQ ID NO: 929814 - DNA, 22 bp, Artificial Sequence
  chemically synthesized
caaatcaaaaaaaaaaaaaaaa

SEQ ID NO: 929815 - DNA, 22 bp, Artificial Sequence
  chemically synthesized
ataatggggagtgaatccatgc

SEQ ID NO: 929816 - DNA, 22 bp, Artificial Sequence
  chemically synthesized
tacaatgtactgataatgggga

SEQ ID NO: 929817 - DNA, 22 bp, Artificial Sequence
  chemically synthesized
atattgtacaatgtactgataa

SEQ ID NO: 929818 - DNA, 22 bp, Artificial Sequence
  chemically synthesized
actccccattatcagtacattg

SEQ ID NO: 929819 - DNA, 22 bp, Artificial Sequence
  chemically synthesized
cccattatcagtacattgtaca

SEQ ID NO: 929820 - DNA, 22 bp, Artificial Sequence
  chemically synthesized
tcagtacattgtacaatatcaa

SEQ ID NO: 929821 - DNA, 22 bp, Artificial Sequence
  chemically synthesized
aataaaatacagatcattgata

SEQ ID NO: 929822 - DNA, 22 bp, Artificial Sequence
  chemically synthesized
ttcaataaaatacagatcattg

SEQ ID NO: 929823 - DNA, 22 bp, Artificial Sequence
  chemically synthesized
tacaatatcaatgatctgtatt

SEQ ID NO: 929824 - DNA, 22 bp, Artificial Sequence
  chemically synthesized
tatattgttcaataaaatacag

SEQ ID NO: 929825 - DNA, 22 bp, Artificial Sequence
  chemically synthesized
atatattgttcaataaaataca

SEQ ID NO: 929826 - DNA, 22 bp, Artificial Sequence
  chemically synthesized
gcttatatattgttcaataaaa

SEQ ID NO: 929827 - DNA, 22 bp, Artificial Sequence
  chemically synthesized
tggcttatatattgttcaataa

SEQ ID NO: 929828 - DNA, 22 bp, Artificial Sequence
  chemically synthesized
ctctggcttatatattgttcaa

SEQ ID NO: 929829 - DNA, 22 bp, Artificial Sequence
  chemically synthesized
tattttattgaacaatatataa

SEQ ID NO: 929830 - DNA, 22 bp, Artificial Sequence
  chemically synthesized
ggttcctctggcttatatattg

SEQ ID NO: 929831 - DNA, 22 bp, Artificial Sequence
  chemically synthesized
aggttcctctggcttatatatt

SEQ ID NO: 929832 - DNA, 22 bp, Artificial Sequence
  chemically synthesized
tattgaacaatatataagccag

SEQ ID NO: 929833 - DNA, 22 bp, Artificial Sequence
  chemically synthesized
attgaacaatatataagccaga

SEQ ID NO: 929834 - DNA, 22 bp, Artificial Sequence
  chemically synthesized
tccttaggttcctctggcttat

SEQ ID NO: 929835 - DNA, 22 bp, Artificial Sequence
  chemically synthesized
ttgaacaatatataagccagag

SEQ ID NO: 929836 - DNA, 22 bp, Artificial Sequence
  chemically synthesized
atccttaggttcctctggctta

SEQ ID NO: 929837 - DNA, 22 bp, Artificial Sequence
  chemically synthesized
tatccttaggttcctctggctt

SEQ ID NO: 929838 - DNA, 22 bp, Artificial Sequence
  chemically synthesized
aacaatatataagccagaggaa

SEQ ID NO: 929839 - DNA, 22 bp, Artificial Sequence
  chemically synthesized
ctttatccttaggttcctctgg

SEQ ID NO: 929840 - DNA, 22 bp, Artificial Sequence
  chemically synthesized
tctgctttatccttaggttcct

SEQ ID NO: 929841 - DNA, 22 bp, Artificial Sequence
  chemically synthesized
gtctgctttatccttaggttcc

SEQ ID NO: 929842 - DNA, 22 bp, Artificial Sequence
  chemically synthesized
tgtcatttgtctgctttatcct

SEQ ID NO: 929843 - DNA, 22 bp, Artificial Sequence
  chemically synthesized
atgtcatttgtctgctttatcc

SEQ ID NO: 929844 - DNA, 22 bp, Artificial Sequence
  chemically synthesized
cttatgtcatttgtctgcttta

SEQ ID NO: 929845 - DNA, 22 bp, Artificial Sequence
  chemically synthesized
gcttatgtcatttgtctgcttt

SEQ ID NO: 929846 - DNA, 22 bp, Artificial Sequence
  chemically synthesized
aggataaagcagacaaatgaca

SEQ ID NO: 929847 - DNA, 22 bp, Artificial Sequence
  chemically synthesized
acagatgacttgcttatgtcat

SEQ ID NO: 929848 - DNA, 22 bp, Artificial Sequence
  chemically synthesized
agaaaaatctaacagatgactt

SEQ ID NO: 929849 - DNA, 22 bp, Artificial Sequence
  chemically synthesized
acatgaataattgagaaaaatc

SEQ ID NO: 929850 - DNA, 22 bp, Artificial Sequence
  chemically synthesized
gatattcacatgaataattgag

SEQ ID NO: 929851 - DNA, 22 bp, Artificial Sequence
  chemically synthesized
agatattcacatgaataattga

SEQ ID NO: 929852 - DNA, 22 bp, Artificial Sequence
  chemically synthesized
ttagatttttctcaattattca

SEQ ID NO: 929853 - DNA, 22 bp, Artificial Sequence
  chemically synthesized
tagatattcacatgaataattg

SEQ ID NO: 929854 - DNA, 22 bp, Artificial Sequence
  chemically synthesized
ttagatattcacatgaataatt

SEQ ID NO: 929855 - DNA, 22 bp, Artificial Sequence
  chemically synthesized
gatttttctcaattattcatgt

SEQ ID NO: 929856 - DNA, 22 bp, Artificial Sequence
  chemically synthesized
accttttagatattcacatgaa

SEQ ID NO: 929857 - DNA, 22 bp, Artificial Sequence
  chemically synthesized
ttctcaattattcatgtgaata

SEQ ID NO: 929858 - DNA, 22 bp, Artificial Sequence
  chemically synthesized
tctcaattattcatgtgaatat

SEQ ID NO: 929859 - DNA, 22 bp, Artificial Sequence
  chemically synthesized
ctcaattattcatgtgaatatc

SEQ ID NO: 929860 - DNA, 22 bp, Artificial Sequence
  chemically synthesized
tcaattattcatgtgaatatct

SEQ ID NO: 929861 - DNA, 22 bp, Artificial Sequence
  chemically synthesized
aattattcatgtgaatatctaa

SEQ ID NO: 929862 - DNA, 22 bp, Artificial Sequence
  chemically synthesized
ttcatgtgaatatctaaaaggt

SEQ ID NO: 929863 - DNA, 22 bp, Artificial Sequence
  chemically synthesized
caaatatccctaaccttttaga

SEQ ID NO: 929864 - DNA, 22 bp, Artificial Sequence
  chemically synthesized
acaaatatccctaaccttttag

SEQ ID NO: 929865 - DNA, 22 bp, Artificial Sequence
  chemically synthesized
tacaaatatccctaacctttta

SEQ ID NO: 929866 - DNA, 22 bp, Artificial Sequence
  chemically synthesized
atgtgaatatctaaaaggttag

SEQ ID NO: 929867 - DNA, 22 bp, Artificial Sequence
  chemically synthesized
ttacaaatatccctaacctttt

SEQ ID NO: 929868 - DNA, 22 bp, Artificial Sequence
  chemically synthesized
ttttacaaatatccctaacctt

SEQ ID NO: 929869 - DNA, 22 bp, Artificial Sequence
  chemically synthesized
accactcttttacaaatatccc

SEQ ID NO: 929870 - DNA, 22 bp, Artificial Sequence
  chemically synthesized
caccactcttttacaaatatcc

SEQ ID NO: 929871 - DNA, 22 bp, Artificial Sequence
  chemically synthesized
tcaccactcttttacaaatatc

SEQ ID NO: 929872 - DNA, 22 bp, Artificial Sequence
  chemically synthesized
aaaggttagggatatttgtaaa

SEQ ID NO: 929873 - DNA, 22 bp, Artificial Sequence
  chemically synthesized
tagttttcaccactcttttaca

SEQ ID NO: 929874 - DNA, 22 bp, Artificial Sequence
  chemically synthesized
gggatatttgtaaaagagtggt

SEQ ID NO: 929875 - DNA, 22 bp, Artificial Sequence
  chemically synthesized
gtaaaagagtggtgaaaactat

SEQ ID NO: 929876 - DNA, 22 bp, Artificial Sequence
  chemically synthesized
taaaagagtggtgaaaactata

SEQ ID NO: 929877 - DNA, 22 bp, Artificial Sequence
  chemically synthesized
ataagaaagtaaaacctatagt

SEQ ID NO: 929878 - DNA, 22 bp, Artificial Sequence
  chemically synthesized
aattgataagaaagtaaaacct

SEQ ID NO: 929879 - DNA, 22 bp, Artificial Sequence
  chemically synthesized
atacaagctaaattgataagaa

SEQ ID NO: 929880 - DNA, 22 bp, Artificial Sequence
  chemically synthesized
taggttttactttcttatcaat

SEQ ID NO: 929881 - DNA, 22 bp, Artificial Sequence
  chemically synthesized
catacaagctaaattgataaga

SEQ ID NO: 929882 - DNA, 22 bp, Artificial Sequence
  chemically synthesized
cttcatacaagctaaattgata

SEQ ID NO: 929883 - DNA, 22 bp, Artificial Sequence
  chemically synthesized
ccttcatacaagctaaattgat

SEQ ID NO: 929884 - DNA, 22 bp, Artificial Sequence
  chemically synthesized
tccttcatacaagctaaattga

SEQ ID NO: 929885 - DNA, 22 bp, Artificial Sequence
  chemically synthesized
ttccttcatacaagctaaattg

SEQ ID NO: 929886 - DNA, 22 bp, Artificial Sequence
  chemically synthesized
tactttcttatcaatttagctt

SEQ ID NO: 929887 - DNA, 22 bp, Artificial Sequence
  chemically synthesized
actttcttatcaatttagcttg

SEQ ID NO: 929888 - DNA, 22 bp, Artificial Sequence
  chemically synthesized
ctttcttatcaatttagcttgt

SEQ ID NO: 929889 - DNA, 22 bp, Artificial Sequence
  chemically synthesized
atcttttccttcatacaagcta

SEQ ID NO: 929890 - DNA, 22 bp, Artificial Sequence
  chemically synthesized
tcttatcaatttagcttgtatg

SEQ ID NO: 929891 - DNA, 22 bp, Artificial Sequence
  chemically synthesized
aatcttttccttcatacaagct

SEQ ID NO: 929892 - DNA, 22 bp, Artificial Sequence
  chemically synthesized
cttatcaatttagcttgtatga

SEQ ID NO: 929893 - DNA, 22 bp, Artificial Sequence
  chemically synthesized
ttatcaatttagcttgtatgaa

SEQ ID NO: 929894 - DNA, 22 bp, Artificial Sequence
  chemically synthesized
atcaatttagcttgtatgaagg

SEQ ID NO: 929895 - DNA, 22 bp, Artificial Sequence
  chemically synthesized
tcaatttagcttgtatgaagga

SEQ ID NO: 929896 - DNA, 22 bp, Artificial Sequence
  chemically synthesized
ataatttaatcttttccttcat

SEQ ID NO: 929897 - DNA, 22 bp, Artificial Sequence
  chemically synthesized
gataatttaatcttttccttca

SEQ ID NO: 929898 - DNA, 22 bp, Artificial Sequence
  chemically synthesized
agcttgtatgaaggaaaagatt

SEQ ID NO: 929899 - DNA, 22 bp, Artificial Sequence
  chemically synthesized
gcttgtatgaaggaaaagatta

SEQ ID NO: 929900 - DNA, 22 bp, Artificial Sequence
  chemically synthesized
catttgataatttaatcttttc

SEQ ID NO: 929901 - DNA, 22 bp, Artificial Sequence
  chemically synthesized
acatttgataatttaatctttt

SEQ ID NO: 929902 - DNA, 22 bp, Artificial Sequence
  chemically synthesized
gtatgaaggaaaagattaaatt

SEQ ID NO: 929903 - DNA, 22 bp, Artificial Sequence
  chemically synthesized
tatgaaggaaaagattaaatta

SEQ ID NO: 929904 - DNA, 22 bp, Artificial Sequence
  chemically synthesized
gaaaagatttacatttgataat

SEQ ID NO: 929905 - DNA, 22 bp, Artificial Sequence
  chemically synthesized
aattatcaaatgtaaatctttt

SEQ ID NO: 929906 - DNA, 22 bp, Artificial Sequence
  chemically synthesized
gagagaaaaaaattagaaaaga

SEQ ID NO: 929907 - DNA, 22 bp, Artificial Sequence
  chemically synthesized
tcaaatgtaaatcttttctaat

SEQ ID NO: 929908 - DNA, 22 bp, Artificial Sequence
  chemically synthesized
ctagagagaaaaaaattagaaa

SEQ ID NO: 929909 - DNA, 22 bp, Artificial Sequence
  chemically synthesized
ttctaatttttttctctctagg

SEQ ID NO: 929910 - DNA, 22 bp, Artificial Sequence
  chemically synthesized
tctaatttttttctctctagga

SEQ ID NO: 929911 - DNA, 22 bp, Artificial Sequence
  chemically synthesized
agaaggaagcgttcctagagag

SEQ ID NO: 929912 - DNA, 22 bp, Artificial Sequence
  chemically synthesized
ctaatttttttctctctaggaa

SEQ ID NO: 929913 - DNA, 22 bp, Artificial Sequence
  chemically synthesized
taatttttttctctctaggaac

SEQ ID NO: 929914 - DNA, 22 bp, Artificial Sequence
  chemically synthesized
atttttttctctctaggaacgc

SEQ ID NO: 929915 - DNA, 22 bp, Artificial Sequence
  chemically synthesized
ttttctctctaggaacgcttcc

SEQ ID NO: 929916 - DNA, 22 bp, Artificial Sequence
  chemically synthesized
tttctctctaggaacgcttcct

SEQ ID NO: 929917 - DNA, 22 bp, Artificial Sequence
  chemically synthesized
ttctctctaggaacgcttcctt

SEQ ID NO: 929918 - DNA, 22 bp, Artificial Sequence
  chemically synthesized
tctctctaggaacgcttccttc

SEQ ID NO: 929919 - DNA, 22 bp, Artificial Sequence
  chemically synthesized
ctctctaggaacgcttccttct

SEQ ID NO: 929920 - DNA, 22 bp, Artificial Sequence
  chemically synthesized
cgtggtagcctaagaaggaagc

SEQ ID NO: 929921 - DNA, 22 bp, Artificial Sequence
  chemically synthesized
tctctaggaacgcttccttctt

SEQ ID NO: 929922 - DNA, 22 bp, Artificial Sequence
  chemically synthesized
tctaggaacgcttccttcttag

SEQ ID NO: 929923 - DNA, 22 bp, Artificial Sequence
  chemically synthesized
taggaacgcttccttcttaggc

SEQ ID NO: 929924 - DNA, 22 bp, Artificial Sequence
  chemically synthesized
ggaacgcttccttcttaggcta

SEQ ID NO: 929925 - DNA, 22 bp, Artificial Sequence
  chemically synthesized
aaatgctacgtggtagcctaag

SEQ ID NO: 929926 - DNA, 22 bp, Artificial Sequence
  chemically synthesized
ccttcttaggctaccacgtagc

SEQ ID NO: 929927 - DNA, 22 bp, Artificial Sequence
  chemically synthesized
cttcttaggctaccacgtagca

SEQ ID NO: 929928 - DNA, 22 bp, Artificial Sequence
  chemically synthesized
cttaggctaccacgtagcattt

SEQ ID NO: 929929 - DNA, 22 bp, Artificial Sequence
  chemically synthesized
ttaggctaccacgtagcatttc

SEQ ID NO: 929930 - DNA, 22 bp, Artificial Sequence
  chemically synthesized
aggctaccacgtagcatttcag

SEQ ID NO: 929931 - DNA, 22 bp, Artificial Sequence
  chemically synthesized
ggctaccacgtagcatttcagg

SEQ ID NO: 929932 - DNA, 22 bp, Artificial Sequence
  chemically synthesized
agtcaaatgaaaaggtcctgaa

SEQ ID NO: 929933 - DNA, 22 bp, Artificial Sequence
  chemically synthesized
ccacgtagcatttcaggacctt

SEQ ID NO: 929934 - DNA, 22 bp, Artificial Sequence
  chemically synthesized
cagtcaaatgaaaaggtcctga

SEQ ID NO: 929935 - DNA, 22 bp, Artificial Sequence
  chemically synthesized
aggtttcagtcaaatgaaaagg

SEQ ID NO: 929936 - DNA, 22 bp, Artificial Sequence
  chemically synthesized
gaggtttcagtcaaatgaaaag

SEQ ID NO: 929937 - DNA, 22 bp, Artificial Sequence
  chemically synthesized
tgaggtttcagtcaaatgaaaa

SEQ ID NO: 929938 - DNA, 22 bp, Artificial Sequence
  chemically synthesized
ctttgaggtttcagtcaaatga

SEQ ID NO: 929939 - DNA, 22 bp, Artificial Sequence
  chemically synthesized
cctttgaggtttcagtcaaatg

SEQ ID NO: 929940 - DNA, 22 bp, Artificial Sequence
  chemically synthesized
caggaccttttcatttgactga

SEQ ID NO: 929941 - DNA, 22 bp, Artificial Sequence
  chemically synthesized
aggaccttttcatttgactgaa

SEQ ID NO: 929942 - DNA, 22 bp, Artificial Sequence
  chemically synthesized
aaaatatttcctttgaggtttc

SEQ ID NO: 929943 - DNA, 22 bp, Artificial Sequence
  chemically synthesized
ttcatttgactgaaacctcaaa

SEQ ID NO: 929944 - DNA, 22 bp, Artificial Sequence
  chemically synthesized
gaaaatatttcctttgaggttt

SEQ ID NO: 929945 - DNA, 22 bp, Artificial Sequence
  chemically synthesized
tcatttgactgaaacctcaaag

SEQ ID NO: 929946 - DNA, 22 bp, Artificial Sequence
  chemically synthesized
catttgactgaaacctcaaagg

SEQ ID NO: 929947 - DNA, 22 bp, Artificial Sequence
  chemically synthesized
atttgactgaaacctcaaagga

SEQ ID NO: 929948 - DNA, 22 bp, Artificial Sequence
  chemically synthesized
gcttgaaaatatttcctttgag

SEQ ID NO: 929949 - DNA, 22 bp, Artificial Sequence
  chemically synthesized
gactgaaacctcaaaggaaata

SEQ ID NO: 929950 - DNA, 22 bp, Artificial Sequence
  chemically synthesized
actgaaacctcaaaggaaatat

SEQ ID NO: 929951 - DNA, 22 bp, Artificial Sequence
  chemically synthesized
aaacctcaaaggaaatattttc

SEQ ID NO: 929952 - DNA, 22 bp, Artificial Sequence
  chemically synthesized
aaaggaaatattttcaagccaa

SEQ ID NO: 929953 - DNA, 22 bp, Artificial Sequence
  chemically synthesized
ggagtgaagtggatgttggctt

SEQ ID NO: 929954 - DNA, 22 bp, Artificial Sequence
  chemically synthesized
aggagtgaagtggatgttggct

SEQ ID NO: 929955 - DNA, 22 bp, Artificial Sequence
  chemically synthesized
taggagtgaagtggatgttggc

SEQ ID NO: 929956 - DNA, 22 bp, Artificial Sequence
  chemically synthesized
tcaagccaacatccacttcact

SEQ ID NO: 929957 - DNA, 22 bp, Artificial Sequence
  chemically synthesized
caagccaacatccacttcactc

SEQ ID NO: 929958 - DNA, 22 bp, Artificial Sequence
  chemically synthesized
aagccaacatccacttcactcc

SEQ ID NO: 929959 - DNA, 22 bp, Artificial Sequence
  chemically synthesized
cactcctaaaactggtttctta

SEQ ID NO: 929960 - DNA, 22 bp, Artificial Sequence
  chemically synthesized
actcctaaaactggtttcttat

SEQ ID NO: 929961 - DNA, 22 bp, Artificial Sequence
  chemically synthesized
ctaaaactggtttcttatattc

SEQ ID NO: 929962 - DNA, 22 bp, Artificial Sequence
  chemically synthesized
aaactggtttcttatattcatt

SEQ ID NO: 929963 - DNA, 22 bp, Artificial Sequence
  chemically synthesized
aaataaataatgtaatgaatat

SEQ ID NO: 929964 - DNA, 22 bp, Artificial Sequence
  chemically synthesized
gtttcttatattcattacatta

SEQ ID NO: 929965 - DNA, 22 bp, Artificial Sequence
  chemically synthesized
cttatattcattacattattta

SEQ ID NO: 929966 - DNA, 22 bp, Artificial Sequence
  chemically synthesized
ttatattcattacattatttat

SEQ ID NO: 929967 - DNA, 22 bp, Artificial Sequence
  chemically synthesized
atattcattacattatttattt

SEQ ID NO: 929968 - DNA, 22 bp, Artificial Sequence
  chemically synthesized
tattcattacattatttatttg

SEQ ID NO: 929969 - DNA, 22 bp, Artificial Sequence
  chemically synthesized
attacattatttatttgaatga

SEQ ID NO: 929970 - DNA, 22 bp, Artificial Sequence
  chemically synthesized
gaaaatacagatgtcattcaaa

SEQ ID NO: 929971 - DNA, 22 bp, Artificial Sequence
  chemically synthesized
cattatttatttgaatgacatc

SEQ ID NO: 929972 - DNA, 22 bp, Artificial Sequence
  chemically synthesized
tttatttgaatgacatctgtat

SEQ ID NO: 929973 - DNA, 22 bp, Artificial Sequence
  chemically synthesized
atttgaatgacatctgtatttt

SEQ ID NO: 929974 - DNA, 22 bp, Artificial Sequence
  chemically synthesized
tttgaatgacatctgtattttc

SEQ ID NO: 929975 - DNA, 22 bp, Artificial Sequence
  chemically synthesized
gtatccatactggaaaatacag

SEQ ID NO: 929976 - DNA, 22 bp, Artificial Sequence
  chemically synthesized
gaatgacatctgtattttccag

SEQ ID NO: 929977 - DNA, 22 bp, Artificial Sequence
  chemically synthesized
ctggtatccatactggaaaata

SEQ ID NO: 929978 - DNA, 22 bp, Artificial Sequence
  chemically synthesized
aatgacatctgtattttccagt

SEQ ID NO: 929979 - DNA, 22 bp, Artificial Sequence
  chemically synthesized
aactgctggtatccatactgga

SEQ ID NO: 929980 - DNA, 22 bp, Artificial Sequence
  chemically synthesized
tattttccagtatggataccag

SEQ ID NO: 929981 - DNA, 22 bp, Artificial Sequence
  chemically synthesized
tccagtatggataccagcagtt

SEQ ID NO: 929982 - DNA, 22 bp, Artificial Sequence
  chemically synthesized
ccagtatggataccagcagttc

SEQ ID NO: 929983 - DNA, 22 bp, Artificial Sequence
  chemically synthesized
cagtatggataccagcagttca

SEQ ID NO: 929984 - DNA, 22 bp, Artificial Sequence
  chemically synthesized
gaggaatgaaaaaaaaagggac

SEQ ID NO: 929985 - DNA, 22 bp, Artificial Sequence
  chemically synthesized
aactttgttttgtccctttttt

SEQ ID NO: 929986 - DNA, 22 bp, Artificial Sequence
  chemically synthesized
gattggaggaatgaaaaaaaaa

SEQ ID NO: 929987 - DNA, 22 bp, Artificial Sequence
  chemically synthesized
tgttttgtccctttttttttca

SEQ ID NO: 929988 - DNA, 22 bp, Artificial Sequence
  chemically synthesized
ggattggaggaatgaaaaaaaa

SEQ ID NO: 929989 - DNA, 22 bp, Artificial Sequence
  chemically synthesized
gttttgtccctttttttttcat

SEQ ID NO: 929990 - DNA, 22 bp, Artificial Sequence
  chemically synthesized
ttttgtccctttttttttcatt

SEQ ID NO: 929991 - DNA, 22 bp, Artificial Sequence
  chemically synthesized
tgtccctttttttttcattcct

SEQ ID NO: 929992 - DNA, 22 bp, Artificial Sequence
  chemically synthesized
gtccctttttttttcattcctc

SEQ ID NO: 929993 - DNA, 22 bp, Artificial Sequence
  chemically synthesized
tccctttttttttcattcctcc

SEQ ID NO: 929994 - DNA, 22 bp, Artificial Sequence
  chemically synthesized
tttttttcattcctccaatcca

SEQ ID NO: 929995 - DNA, 22 bp, Artificial Sequence
  chemically synthesized
ttttttcattcctccaatccaa

SEQ ID NO: 929996 - DNA, 22 bp, Artificial Sequence
  chemically synthesized
tttttcattcctccaatccaaa

SEQ ID NO: 929997 - DNA, 22 bp, Artificial Sequence
  chemically synthesized
ttttcattcctccaatccaaat

SEQ ID NO: 929998 - DNA, 22 bp, Artificial Sequence
  chemically synthesized
tttcattcctccaatccaaatt

SEQ ID NO: 929999 - DNA, 22 bp, Artificial Sequence
  chemically synthesized
ttcattcctccaatccaaattc

SEQ ID NO: 930000 - DNA, 22 bp, Artificial Sequence
  chemically synthesized
tcattcctccaatccaaattct

SEQ ID NO: 930001 - DNA, 22 bp, Artificial Sequence
  chemically synthesized
cattcctccaatccaaattcta

SEQ ID NO: 930002 - DNA, 22 bp, Artificial Sequence
  chemically synthesized
ggatcagtaaaatagaatttgg

SEQ ID NO: 930003 - DNA, 22 bp, Artificial Sequence
  chemically synthesized
attcctccaatccaaattctat

SEQ ID NO: 930004 - DNA, 22 bp, Artificial Sequence
  chemically synthesized
ctccaatccaaattctatttta

SEQ ID NO: 930005 - DNA, 22 bp, Artificial Sequence
  chemically synthesized
caatccaaattctattttactg

SEQ ID NO: 930006 - DNA, 22 bp, Artificial Sequence
  chemically synthesized
tattttactgatcctaattgtt

SEQ ID NO: 930007 - DNA, 22 bp, Artificial Sequence
  chemically synthesized
ttttactgatcctaattgttat

SEQ ID NO: 930008 - DNA, 22 bp, Artificial Sequence
  chemically synthesized
tactgatcctaattgttatact

SEQ ID NO: 930009 - DNA, 22 bp, Artificial Sequence
  chemically synthesized
actgatcctaattgttatactt

SEQ ID NO: 930010 - DNA, 22 bp, Artificial Sequence
  chemically synthesized
ctgatcctaattgttatacttc

SEQ ID NO: 930011 - DNA, 22 bp, Artificial Sequence
  chemically synthesized
atcctaattgttatacttcttg

SEQ ID NO: 930012 - DNA, 22 bp, Artificial Sequence
  chemically synthesized
attgttatacttcttgcccggt

SEQ ID NO: 930013 - DNA, 22 bp, Artificial Sequence
  chemically synthesized
ttatacttcttgcccggttgat

SEQ ID NO: 930014 - DNA, 22 bp, Artificial Sequence
  chemically synthesized
tacttcttgcccggttgattcc

SEQ ID NO: 930015 - DNA, 22 bp, Artificial Sequence
  chemically synthesized
cttgcccggttgattccatcgt

SEQ ID NO: 930016 - DNA, 22 bp, Artificial Sequence
  chemically synthesized
ttgcccggttgattccatcgtt

SEQ ID NO: 930017 - DNA, 22 bp, Artificial Sequence
  chemically synthesized
gaggaaaagcaataacgatgga

SEQ ID NO: 930018 - DNA, 22 bp, Artificial Sequence
  chemically synthesized
gcccggttgattccatcgttat

SEQ ID NO: 930019 - DNA, 22 bp, Artificial Sequence
  chemically synthesized
cccggttgattccatcgttatt

SEQ ID NO: 930020 - DNA, 22 bp, Artificial Sequence
  chemically synthesized
attccatcgttattgcttttcc

SEQ ID NO: 930021 - DNA, 22 bp, Artificial Sequence
  chemically synthesized
catcgttattgcttttcctcca

SEQ ID NO: 930022 - DNA, 22 bp, Artificial Sequence
  chemically synthesized
ttgcttttcctccagcctggtt

SEQ ID NO: 930023 - DNA, 22 bp, Artificial Sequence
  chemically synthesized
cttttcctccagcctggttatt

SEQ ID NO: 930024 - DNA, 22 bp, Artificial Sequence
  chemically synthesized
ttcctccagcctggttattcat

SEQ ID NO: 930025 - DNA, 22 bp, Artificial Sequence
  chemically synthesized
tcctccagcctggttattcatt

SEQ ID NO: 930026 - DNA, 22 bp, Artificial Sequence
  chemically synthesized
cctccagcctggttattcatta

SEQ ID NO: 930027 - DNA, 22 bp, Artificial Sequence
  chemically synthesized
ctccagcctggttattcattac

SEQ ID NO: 930028 - DNA, 22 bp, Artificial Sequence
  chemically synthesized
cagcctggttattcattacact

SEQ ID NO: 930029 - DNA, 22 bp, Artificial Sequence
  chemically synthesized
ataacataggtgaagtgtaatg

SEQ ID NO: 930030 - DNA, 22 bp, Artificial Sequence
  chemically synthesized
gttattcattacacttcaccta

SEQ ID NO: 930031 - DNA, 22 bp, Artificial Sequence
  chemically synthesized
ttcattacacttcacctatgtt

SEQ ID NO: 930032 - DNA, 22 bp, Artificial Sequence
  chemically synthesized
attacacttcacctatgttatt

SEQ ID NO: 930033 - DNA, 22 bp, Artificial Sequence
  chemically synthesized
ggagggtgtattaataacatag

SEQ ID NO: 930034 - DNA, 22 bp, Artificial Sequence
  chemically synthesized
cacttcacctatgttattaata

SEQ ID NO: 930035 - DNA, 22 bp, Artificial Sequence
  chemically synthesized
cacctatgttattaatacaccc

SEQ ID NO: 930036 - DNA, 22 bp, Artificial Sequence
  chemically synthesized
acctatgttattaatacaccct

SEQ ID NO: 930037 - DNA, 22 bp, Artificial Sequence
  chemically synthesized
agatgaaacagttaggagggtg

SEQ ID NO: 930038 - DNA, 22 bp, Artificial Sequence
  chemically synthesized
tgttattaatacaccctcctaa

SEQ ID NO: 930039 - DNA, 22 bp, Artificial Sequence
  chemically synthesized
ttaatacaccctcctaactgtt

SEQ ID NO: 930040 - DNA, 22 bp, Artificial Sequence
  chemically synthesized
atacaccctcctaactgtttca

SEQ ID NO: 930041 - DNA, 22 bp, Artificial Sequence
  chemically synthesized
tgcagtgaaagagtctgagatg

SEQ ID NO: 930042 - DNA, 22 bp, Artificial Sequence
  chemically synthesized
ctaactgtttcatctcagactc

SEQ ID NO: 930043 - DNA, 22 bp, Artificial Sequence
  chemically synthesized
actgtttcatctcagactcttt

SEQ ID NO: 930044 - DNA, 22 bp, Artificial Sequence
  chemically synthesized
tttcatctcagactctttcact

SEQ ID NO: 930045 - DNA, 22 bp, Artificial Sequence
  chemically synthesized
catctcagactctttcactgca

SEQ ID NO: 930046 - DNA, 22 bp, Artificial Sequence
  chemically synthesized
tgtagaatgttatgcagtgaaa

SEQ ID NO: 930047 - DNA, 22 bp, Artificial Sequence
  chemically synthesized
atctcagactctttcactgcat

SEQ ID NO: 930048 - DNA, 22 bp, Artificial Sequence
  chemically synthesized
agactctttcactgcataacat

SEQ ID NO: 930049 - DNA, 22 bp, Artificial Sequence
  chemically synthesized
gaaagattgtgtagaatgttat

SEQ ID NO: 930050 - DNA, 22 bp, Artificial Sequence
  chemically synthesized
tttcactgcataacattctaca

SEQ ID NO: 930051 - DNA, 22 bp, Artificial Sequence
  chemically synthesized
tcactgcataacattctacaca

SEQ ID NO: 930052 - DNA, 22 bp, Artificial Sequence
  chemically synthesized
atctggaaagattgtgtagaat

SEQ ID NO: 930053 - DNA, 22 bp, Artificial Sequence
  chemically synthesized
cactgcataacattctacacaa

SEQ ID NO: 930054 - DNA, 22 bp, Artificial Sequence
  chemically synthesized
actgcataacattctacacaat

SEQ ID NO: 930055 - DNA, 22 bp, Artificial Sequence
  chemically synthesized
cataacattctacacaatcttt

SEQ ID NO: 930056 - DNA, 22 bp, Artificial Sequence
  chemically synthesized
gaggattaatctggaaagattg

SEQ ID NO: 930057 - DNA, 22 bp, Artificial Sequence
  chemically synthesized
tacacaatctttccagattaat

SEQ ID NO: 930058 - DNA, 22 bp, Artificial Sequence
  chemically synthesized
tgcatctggaggattaatctgg

SEQ ID NO: 930059 - DNA, 22 bp, Artificial Sequence
  chemically synthesized
cacaatctttccagattaatcc

SEQ ID NO: 930060 - DNA, 22 bp, Artificial Sequence
  chemically synthesized
tccagattaatcctccagatgc

SEQ ID NO: 930061 - DNA, 22 bp, Artificial Sequence
  chemically synthesized
ccagattaatcctccagatgca

SEQ ID NO: 930062 - DNA, 22 bp, Artificial Sequence
  chemically synthesized
cagattaatcctccagatgcat

SEQ ID NO: 930063 - DNA, 22 bp, Artificial Sequence
  chemically synthesized
atcctccagatgcatagttctt

SEQ ID NO: 930064 - DNA, 22 bp, Artificial Sequence
  chemically synthesized
agcagggaatccaccagaagaa

SEQ ID NO: 930065 - DNA, 22 bp, Artificial Sequence
  chemically synthesized
cagatgcatagttcttctggtg

SEQ ID NO: 930066 - DNA, 22 bp, Artificial Sequence
  chemically synthesized
gagcagggaatccaccagaaga

SEQ ID NO: 930067 - DNA, 22 bp, Artificial Sequence
  chemically synthesized
tgagcagggaatccaccagaag

SEQ ID NO: 930068 - DNA, 22 bp, Artificial Sequence
  chemically synthesized
ttgagcagggaatccaccagaa

SEQ ID NO: 930069 - DNA, 22 bp, Artificial Sequence
  chemically synthesized
agtataaatttttgagcaggga

SEQ ID NO: 930070 - DNA, 22 bp, Artificial Sequence
  chemically synthesized
ttctggtggattccctgctcaa

SEQ ID NO: 930071 - DNA, 22 bp, Artificial Sequence
  chemically synthesized
ctggtggattccctgctcaaaa

SEQ ID NO: 930072 - DNA, 22 bp, Artificial Sequence
  chemically synthesized
tggtggattccctgctcaaaaa

SEQ ID NO: 930073 - DNA, 22 bp, Artificial Sequence
  chemically synthesized
gtggattccctgctcaaaaatt

SEQ ID NO: 930074 - DNA, 22 bp, Artificial Sequence
  chemically synthesized
agtattcagtataaatttttga

SEQ ID NO: 930075 - DNA, 22 bp, Artificial Sequence
  chemically synthesized
cctgctcaaaaatttatactga

SEQ ID NO: 930076 - DNA, 22 bp, Artificial Sequence
  chemically synthesized
ctcaaaaatttatactgaatac

SEQ ID NO: 930077 - DNA, 22 bp, Artificial Sequence
  chemically synthesized
aaaaatttatactgaatactca

SEQ ID NO: 930078 - DNA, 22 bp, Artificial Sequence
  chemically synthesized
aacaggcaggcactgagtattc

SEQ ID NO: 930079 - DNA, 22 bp, Artificial Sequence
  chemically synthesized
caacaggcaggcactgagtatt

SEQ ID NO: 930080 - DNA, 22 bp, Artificial Sequence
  chemically synthesized
ggcttcaacaggcaggcactga

SEQ ID NO: 930081 - DNA, 22 bp, Artificial Sequence
  chemically synthesized
atactgaatactcagtgcctgc

SEQ ID NO: 930082 - DNA, 22 bp, Artificial Sequence
  chemically synthesized
gggcttcaacaggcaggcactg

SEQ ID NO: 930083 - DNA, 22 bp, Artificial Sequence
  chemically synthesized
tactgaatactcagtgcctgcc

SEQ ID NO: 930084 - DNA, 22 bp, Artificial Sequence
  chemically synthesized
tttgggcttcaacaggcaggca

SEQ ID NO: 930085 - DNA, 22 bp, Artificial Sequence
  chemically synthesized
aatactcagtgcctgcctgttg

SEQ ID NO: 930086 - DNA, 22 bp, Artificial Sequence
  chemically synthesized
tgtacgctatttgggcttcaac

SEQ ID NO: 930087 - DNA, 22 bp, Artificial Sequence
  chemically synthesized
agtgcctgcctgttgaagccca

SEQ ID NO: 930088 - DNA, 22 bp, Artificial Sequence
  chemically synthesized
aatgttatgtacgctatttggg

SEQ ID NO: 930089 - DNA, 22 bp, Artificial Sequence
  chemically synthesized
cctgttgaagcccaaatagcgt

SEQ ID NO: 930090 - DNA, 22 bp, Artificial Sequence
  chemically synthesized
tgaatgttatgtacgctatttg

SEQ ID NO: 930091 - DNA, 22 bp, Artificial Sequence
  chemically synthesized
ttgaagcccaaatagcgtacat

SEQ ID NO: 930092 - DNA, 22 bp, Artificial Sequence
  chemically synthesized
aagcccaaatagcgtacataac

SEQ ID NO: 930093 - DNA, 22 bp, Artificial Sequence
  chemically synthesized
tgaggttctgaatgttatgtac

SEQ ID NO: 930094 - DNA, 22 bp, Artificial Sequence
  chemically synthesized
agggatgctatgaggttctgaa

SEQ ID NO: 930095 - DNA, 22 bp, Artificial Sequence
  chemically synthesized
tcagggatgctatgaggttctg

SEQ ID NO: 930096 - DNA, 22 bp, Artificial Sequence
  chemically synthesized
aaaaggtatctctcagggatgc

SEQ ID NO: 930097 - DNA, 22 bp, Artificial Sequence
  chemically synthesized
agaacctcatagcatccctgag

SEQ ID NO: 930098 - DNA, 22 bp, Artificial Sequence
  chemically synthesized
atagcatccctgagagatacct

SEQ ID NO: 930099 - DNA, 22 bp, Artificial Sequence
  chemically synthesized
taagaagcctaaaaaggtatct

SEQ ID NO: 930100 - DNA, 22 bp, Artificial Sequence
  chemically synthesized
agagatacctttttaggcttct

SEQ ID NO: 930101 - DNA, 22 bp, Artificial Sequence
  chemically synthesized
gaaagtcattgtaagaagccta

SEQ ID NO: 930102 - DNA, 22 bp, Artificial Sequence
  chemically synthesized
tttaggcttcttacaatgactt

SEQ ID NO: 930103 - DNA, 22 bp, Artificial Sequence
  chemically synthesized
ttaggcttcttacaatgacttt

SEQ ID NO: 930104 - DNA, 22 bp, Artificial Sequence
  chemically synthesized
taggcttcttacaatgactttc

SEQ ID NO: 930105 - DNA, 22 bp, Artificial Sequence
  chemically synthesized
aggcttcttacaatgactttcc

SEQ ID NO: 930106 - DNA, 22 bp, Artificial Sequence
  chemically synthesized
ggcttcttacaatgactttcca

SEQ ID NO: 930107 - DNA, 22 bp, Artificial Sequence
  chemically synthesized
cttacaatgactttccaattct

SEQ ID NO: 930108 - DNA, 22 bp, Artificial Sequence
  chemically synthesized
aagcatggatgaagaattggaa

SEQ ID NO: 930109 - DNA, 22 bp, Artificial Sequence
  chemically synthesized
ttacaatgactttccaattctt

SEQ ID NO: 930110 - DNA, 22 bp, Artificial Sequence
  chemically synthesized
acaatgactttccaattcttca

SEQ ID NO: 930111 - DNA, 22 bp, Artificial Sequence
  chemically synthesized
caatgactttccaattcttcat

SEQ ID NO: 930112 - DNA, 22 bp, Artificial Sequence
  chemically synthesized
cactgaagcatggatgaagaat

SEQ ID NO: 930113 - DNA, 22 bp, Artificial Sequence
  chemically synthesized
attgcactgaagcatggatgaa

SEQ ID NO: 930114 - DNA, 22 bp, Artificial Sequence
  chemically synthesized
tccaattcttcatccatgcttc

SEQ ID NO: 930115 - DNA, 22 bp, Artificial Sequence
  chemically synthesized
tctaattgcactgaagcatgga

SEQ ID NO: 930116 - DNA, 22 bp, Artificial Sequence
  chemically synthesized
ccaattcttcatccatgcttca

SEQ ID NO: 930117 - DNA, 22 bp, Artificial Sequence
  chemically synthesized
caattcttcatccatgcttcag

SEQ ID NO: 930118 - DNA, 22 bp, Artificial Sequence
  chemically synthesized
tgagttgtctaattgcactgaa

SEQ ID NO: 930119 - DNA, 22 bp, Artificial Sequence
  chemically synthesized
ttcatccatgcttcagtgcaat

SEQ ID NO: 930120 - DNA, 22 bp, Artificial Sequence
  chemically synthesized
catccatgcttcagtgcaatta

SEQ ID NO: 930121 - DNA, 22 bp, Artificial Sequence
  chemically synthesized
atccatgcttcagtgcaattag

SEQ ID NO: 930122 - DNA, 22 bp, Artificial Sequence
  chemically synthesized
cagtgcaattagacaactcaca

SEQ ID NO: 930123 - DNA, 22 bp, Artificial Sequence
  chemically synthesized
agtgcaattagacaactcacag

SEQ ID NO: 930124 - DNA, 22 bp, Artificial Sequence
  chemically synthesized
gagaatgaccaggacgtcactg

SEQ ID NO: 930125 - DNA, 22 bp, Artificial Sequence
  chemically synthesized
gacaactcacagtgacgtcctg

SEQ ID NO: 930126 - DNA, 22 bp, Artificial Sequence
  chemically synthesized
acagtgacgtcctggtcattct

SEQ ID NO: 930127 - DNA, 22 bp, Artificial Sequence
  chemically synthesized
gtcattctccagacctttgact

SEQ ID NO: 930128 - DNA, 22 bp, Artificial Sequence
  chemically synthesized
tccagacctttgactattctcc

SEQ ID NO: 930129 - DNA, 22 bp, Artificial Sequence
  chemically synthesized
cagacctttgactattctccat

SEQ ID NO: 930130 - DNA, 22 bp, Artificial Sequence
  chemically synthesized
tgactattctccatcctccatc

SEQ ID NO: 930131 - DNA, 22 bp, Artificial Sequence
  chemically synthesized
gactattctccatcctccatca

SEQ ID NO: 930132 - DNA, 22 bp, Artificial Sequence
  chemically synthesized
actattctccatcctccatcat

SEQ ID NO: 930133 - DNA, 22 bp, Artificial Sequence
  chemically synthesized
ttctccatcctccatcatgtgt

SEQ ID NO: 930134 - DNA, 22 bp, Artificial Sequence
  chemically synthesized
tccatcctccatcatgtgtgtc

SEQ ID NO: 930135 - DNA, 22 bp, Artificial Sequence
  chemically synthesized
catcctccatcatgtgtgtctt

SEQ ID NO: 930136 - DNA, 22 bp, Artificial Sequence
  chemically synthesized
cataagtagaggtaaagacaca

SEQ ID NO: 930137 - DNA, 22 bp, Artificial Sequence
  chemically synthesized
catcatgtgtgtctttacctct

SEQ ID NO: 930138 - DNA, 22 bp, Artificial Sequence
  chemically synthesized
gaatgaaaggattacataagta

SEQ ID NO: 930139 - DNA, 22 bp, Artificial Sequence
  chemically synthesized
tacctctacttatgtaatcctt

SEQ ID NO: 930140 - DNA, 22 bp, Artificial Sequence
  chemically synthesized
acctctacttatgtaatccttt

SEQ ID NO: 930141 - DNA, 22 bp, Artificial Sequence
  chemically synthesized
cctctacttatgtaatcctttc

SEQ ID NO: 930142 - DNA, 22 bp, Artificial Sequence
  chemically synthesized
gtcaactggaatgaaaggatta

SEQ ID NO: 930143 - DNA, 22 bp, Artificial Sequence
  chemically synthesized
tacttatgtaatcctttcattc

SEQ ID NO: 930144 - DNA, 22 bp, Artificial Sequence
  chemically synthesized
cttatgtaatcctttcattcca

SEQ ID NO: 930145 - DNA, 22 bp, Artificial Sequence
  chemically synthesized
atggtctagtcaactggaatga

SEQ ID NO: 930146 - DNA, 22 bp, Artificial Sequence
  chemically synthesized
atgtaatcctttcattccagtt

SEQ ID NO: 930147 - DNA, 22 bp, Artificial Sequence
  chemically synthesized
tgtaatcctttcattccagttg

SEQ ID NO: 930148 - DNA, 22 bp, Artificial Sequence
  chemically synthesized
atggatctcatggtctagtcaa

SEQ ID NO: 930149 - DNA, 22 bp, Artificial Sequence
  chemically synthesized
tcatggatctcatggtctagtc

SEQ ID NO: 930150 - DNA, 22 bp, Artificial Sequence
  chemically synthesized
tcattccagttgactagaccat

SEQ ID NO: 930151 - DNA, 22 bp, Artificial Sequence
  chemically synthesized
cattccagttgactagaccatg

SEQ ID NO: 930152 - DNA, 22 bp, Artificial Sequence
  chemically synthesized
attccagttgactagaccatga

SEQ ID NO: 930153 - DNA, 22 bp, Artificial Sequence
  chemically synthesized
ctctcatggatctcatggtcta

SEQ ID NO: 930154 - DNA, 22 bp, Artificial Sequence
  chemically synthesized
ctgctctcatggatctcatggt

SEQ ID NO: 930155 - DNA, 22 bp, Artificial Sequence
  chemically synthesized
cagttgactagaccatgagatc

SEQ ID NO: 930156 - DNA, 22 bp, Artificial Sequence
  chemically synthesized
cagttcctgctctcatggatct

SEQ ID NO: 930157 - DNA, 22 bp, Artificial Sequence
  chemically synthesized
actagaccatgagatccatgag

SEQ ID NO: 930158 - DNA, 22 bp, Artificial Sequence
  chemically synthesized
gaccatgagatccatgagagca

SEQ ID NO: 930159 - DNA, 22 bp, Artificial Sequence
  chemically synthesized
gagtgagaaaagattacagttc

SEQ ID NO: 930160 - DNA, 22 bp, Artificial Sequence
  chemically synthesized
ggcactagagtgagaaaagatt

SEQ ID NO: 930161 - DNA, 22 bp, Artificial Sequence
  chemically synthesized
ctaggcactagagtgagaaaag

SEQ ID NO: 930162 - DNA, 22 bp, Artificial Sequence
  chemically synthesized
taatcttttctcactctagtgc

SEQ ID NO: 930163 - DNA, 22 bp, Artificial Sequence
  chemically synthesized
ttctcactctagtgcctagtaa

SEQ ID NO: 930164 - DNA, 22 bp, Artificial Sequence
  chemically synthesized
tctcactctagtgcctagtaac

SEQ ID NO: 930165 - DNA, 22 bp, Artificial Sequence
  chemically synthesized
ctcactctagtgcctagtaacg

SEQ ID NO: 930166 - DNA, 22 bp, Artificial Sequence
  chemically synthesized
tcactctagtgcctagtaacgt

SEQ ID NO: 930167 - DNA, 22 bp, Artificial Sequence
  chemically synthesized
ccaggtagcaacacgttactag

SEQ ID NO: 930168 - DNA, 22 bp, Artificial Sequence
  chemically synthesized
actctagtgcctagtaacgtgt

SEQ ID NO: 930169 - DNA, 22 bp, Artificial Sequence
  chemically synthesized
tagtgcctagtaacgtgttgct

SEQ ID NO: 930170 - DNA, 22 bp, Artificial Sequence
  chemically synthesized
agcactgccaggtagcaacacg

SEQ ID NO: 930171 - DNA, 22 bp, Artificial Sequence
  chemically synthesized
gtgcctagtaacgtgttgctac

SEQ ID NO: 930172 - DNA, 22 bp, Artificial Sequence
  chemically synthesized
gagcactgccaggtagcaacac

SEQ ID NO: 930173 - DNA, 22 bp, Artificial Sequence
  chemically synthesized
tgagcactgccaggtagcaaca

SEQ ID NO: 930174 - DNA, 22 bp, Artificial Sequence
  chemically synthesized
gtaacgtgttgctacctggcag

SEQ ID NO: 930175 - DNA, 22 bp, Artificial Sequence
  chemically synthesized
acaaacatgttttgagcactgc

SEQ ID NO: 930176 - DNA, 22 bp, Artificial Sequence
  chemically synthesized
aacaaacatgttttgagcactg

SEQ ID NO: 930177 - DNA, 22 bp, Artificial Sequence
  chemically synthesized
ctacctggcagtgctcaaaaca

SEQ ID NO: 930178 - DNA, 22 bp, Artificial Sequence
  chemically synthesized
cctggcagtgctcaaaacatgt

SEQ ID NO: 930179 - DNA, 22 bp, Artificial Sequence
  chemically synthesized
tccatttaacaaacatgttttg

SEQ ID NO: 930180 - DNA, 22 bp, Artificial Sequence
  chemically synthesized
atccatttaacaaacatgtttt

SEQ ID NO: 930181 - DNA, 22 bp, Artificial Sequence
  chemically synthesized
tatccatttaacaaacatgttt

SEQ ID NO: 930182 - DNA, 22 bp, Artificial Sequence
  chemically synthesized
gcagtgctcaaaacatgtttgt

SEQ ID NO: 930183 - DNA, 22 bp, Artificial Sequence
  chemically synthesized
aaaacatgtttgttaaatggat

SEQ ID NO: 930184 - DNA, 22 bp, Artificial Sequence
  chemically synthesized
gggcacacctttatccatttaa

SEQ ID NO: 930185 - DNA, 22 bp, Artificial Sequence
  chemically synthesized
ggggcacacctttatccattta

SEQ ID NO: 930186 - DNA, 22 bp, Artificial Sequence
  chemically synthesized
gtatttggggcacacctttatc

SEQ ID NO: 930187 - DNA, 22 bp, Artificial Sequence
  chemically synthesized
gttaaatggataaaggtgtgcc

SEQ ID NO: 930188 - DNA, 22 bp, Artificial Sequence
  chemically synthesized
ttaaatggataaaggtgtgccc

SEQ ID NO: 930189 - DNA, 22 bp, Artificial Sequence
  chemically synthesized
aatggataaaggtgtgccccaa

SEQ ID NO: 930190 - DNA, 22 bp, Artificial Sequence
  chemically synthesized
acaatagagttagtatttgggg

SEQ ID NO: 930191 - DNA, 22 bp, Artificial Sequence
  chemically synthesized
aaaatgtattcacaatagagtt

SEQ ID NO: 930192 - DNA, 22 bp, Artificial Sequence
  chemically synthesized
gaaaatgtattcacaatagagt

SEQ ID NO: 930193 - DNA, 22 bp, Artificial Sequence
  chemically synthesized
cttgaaaatgtattcacaatag

SEQ ID NO: 930194 - DNA, 22 bp, Artificial Sequence
  chemically synthesized
gcttgaaaatgtattcacaata

SEQ ID NO: 930195 - DNA, 22 bp, Artificial Sequence
  chemically synthesized
tgcttgaaaatgtattcacaat

SEQ ID NO: 930196 - DNA, 22 bp, Artificial Sequence
  chemically synthesized
ttgcttgaaaatgtattcacaa

SEQ ID NO: 930197 - DNA, 22 bp, Artificial Sequence
  chemically synthesized
actctattgtgaatacattttc

SEQ ID NO: 930198 - DNA, 22 bp, Artificial Sequence
  chemically synthesized
tattgtgaatacattttcaagc

SEQ ID NO: 930199 - DNA, 22 bp, Artificial Sequence
  chemically synthesized
ttgtgaatacattttcaagcaa

SEQ ID NO: 930200 - DNA, 22 bp, Artificial Sequence
  chemically synthesized
tgaatacattttcaagcaaaag

SEQ ID NO: 930201 - DNA, 22 bp, Artificial Sequence
  chemically synthesized
taggatagataacttttgcttg

SEQ ID NO: 930202 - DNA, 22 bp, Artificial Sequence
  chemically synthesized
ataggatagataacttttgctt

SEQ ID NO: 930203 - DNA, 22 bp, Artificial Sequence
  chemically synthesized
ccaatttataggatagataact

SEQ ID NO: 930204 - DNA, 22 bp, Artificial Sequence
  chemically synthesized
tcaagcaaaagttatctatcct

SEQ ID NO: 930205 - DNA, 22 bp, Artificial Sequence
  chemically synthesized
caagcaaaagttatctatccta

SEQ ID NO: 930206 - DNA, 22 bp, Artificial Sequence
  chemically synthesized
aagcaaaagttatctatcctat

SEQ ID NO: 930207 - DNA, 22 bp, Artificial Sequence
  chemically synthesized
aaaatgtattcccaatttatag

SEQ ID NO: 930208 - DNA, 22 bp, Artificial Sequence
  chemically synthesized
gaaaatgtattcccaatttata

SEQ ID NO: 930209 - DNA, 22 bp, Artificial Sequence
  chemically synthesized
cttgaaaatgtattcccaattt

SEQ ID NO: 930210 - DNA, 22 bp, Artificial Sequence
  chemically synthesized
gcttgaaaatgtattcccaatt

SEQ ID NO: 930211 - DNA, 22 bp, Artificial Sequence
  chemically synthesized
tctatcctataaattgggaata

SEQ ID NO: 930212 - DNA, 22 bp, Artificial Sequence
  chemically synthesized
tgcttgaaaatgtattcccaat

SEQ ID NO: 930213 - DNA, 22 bp, Artificial Sequence
  chemically synthesized
ttgcttgaaaatgtattcccaa

SEQ ID NO: 930214 - DNA, 22 bp, Artificial Sequence
  chemically synthesized
tcctataaattgggaatacatt

SEQ ID NO: 930215 - DNA, 22 bp, Artificial Sequence
  chemically synthesized
taaattgggaatacattttcaa

SEQ ID NO: 930216 - DNA, 22 bp, Artificial Sequence
  chemically synthesized
ggaatacattttcaagcaaaag

SEQ ID NO: 930217 - DNA, 22 bp, Artificial Sequence
  chemically synthesized
taggatagataacttttgcttg

SEQ ID NO: 930218 - DNA, 22 bp, Artificial Sequence
  chemically synthesized
ataggatagataacttttgctt

SEQ ID NO: 930219 - DNA, 22 bp, Artificial Sequence
  chemically synthesized
tataggatagataacttttgct

SEQ ID NO: 930220 - DNA, 22 bp, Artificial Sequence
  chemically synthesized
tcaagcaaaagttatctatcct

SEQ ID NO: 930221 - DNA, 22 bp, Artificial Sequence
  chemically synthesized
caagcaaaagttatctatccta

SEQ ID NO: 930222 - DNA, 22 bp, Artificial Sequence
  chemically synthesized
aagcaaaagttatctatcctat

SEQ ID NO: 930223 - DNA, 22 bp, Artificial Sequence
  chemically synthesized
aagtacagtatgattttatagg

SEQ ID NO: 930224 - DNA, 22 bp, Artificial Sequence
  chemically synthesized
tctatcctataaaatcatactg

SEQ ID NO: 930225 - DNA, 22 bp, Artificial Sequence
  chemically synthesized
tcctataaaatcatactgtact

SEQ ID NO: 930226 - DNA, 22 bp, Artificial Sequence
  chemically synthesized
tgtagatacagttcaagtacag

SEQ ID NO: 930227 - DNA, 22 bp, Artificial Sequence
  chemically synthesized
taaaatcatactgtacttgaac

SEQ ID NO: 930228 - DNA, 22 bp, Artificial Sequence
  chemically synthesized
tgaaaaaccattatgtagatac

SEQ ID NO: 930229 - DNA, 22 bp, Artificial Sequence
  chemically synthesized
tacttgaactgtatctacataa

SEQ ID NO: 930230 - DNA, 22 bp, Artificial Sequence
  chemically synthesized
gaactgtatctacataatggtt

SEQ ID NO: 930231 - DNA, 22 bp, Artificial Sequence
  chemically synthesized
tagactgtgaaaaaccattatg

SEQ ID NO: 930232 - DNA, 22 bp, Artificial Sequence
  chemically synthesized
aactgtatctacataatggttt

SEQ ID NO: 930233 - DNA, 22 bp, Artificial Sequence
  chemically synthesized
atagactgtgaaaaaccattat

SEQ ID NO: 930234 - DNA, 22 bp, Artificial Sequence
  chemically synthesized
tatagactgtgaaaaaccatta

SEQ ID NO: 930235 - DNA, 22 bp, Artificial Sequence
  chemically synthesized
ttatagactgtgaaaaaccatt

SEQ ID NO: 930236 - DNA, 22 bp, Artificial Sequence
  chemically synthesized
tatctacataatggtttttcac

SEQ ID NO: 930237 - DNA, 22 bp, Artificial Sequence
  chemically synthesized
atttttatagactgtgaaaaac

SEQ ID NO: 930238 - DNA, 22 bp, Artificial Sequence
  chemically synthesized
aatttttatagactgtgaaaaa

SEQ ID NO: 930239 - DNA, 22 bp, Artificial Sequence
  chemically synthesized
cataatggtttttcacagtcta

SEQ ID NO: 930240 - DNA, 22 bp, Artificial Sequence
  chemically synthesized
ttcacagtctataaaaattaaa

SEQ ID NO: 930241 - DNA, 22 bp, Artificial Sequence
  chemically synthesized
ataataacaaaatttaattttt

SEQ ID NO: 930242 - DNA, 22 bp, Artificial Sequence
  chemically synthesized
tcacagtctataaaaattaaat

SEQ ID NO: 930243 - DNA, 22 bp, Artificial Sequence
  chemically synthesized
cacagtctataaaaattaaatt

SEQ ID NO: 930244 - DNA, 22 bp, Artificial Sequence
  chemically synthesized
taataataacaaaatttaattt

SEQ ID NO: 930245 - DNA, 22 bp, Artificial Sequence
  chemically synthesized
acagtctataaaaattaaattt

SEQ ID NO: 930246 - DNA, 22 bp, Artificial Sequence
  chemically synthesized
tctctaataataacaaaattta

SEQ ID NO: 930247 - DNA, 22 bp, Artificial Sequence
  chemically synthesized
gtctctaataataacaaaattt

SEQ ID NO: 930248 - DNA, 22 bp, Artificial Sequence
  chemically synthesized
taaaaattaaattttgttatta

SEQ ID NO: 930249 - DNA, 22 bp, Artificial Sequence
  chemically synthesized
aattttgttattattagagaca

SEQ ID NO: 930250 - DNA, 22 bp, Artificial Sequence
  chemically synthesized
tgttattattagagacaaggac

SEQ ID NO: 930251 - DNA, 22 bp, Artificial Sequence
  chemically synthesized
gttattattagagacaaggact

SEQ ID NO: 930252 - DNA, 22 bp, Artificial Sequence
  chemically synthesized
catgacagaatgagtccttgtc

SEQ ID NO: 930253 - DNA, 22 bp, Artificial Sequence
  chemically synthesized
ttattattagagacaaggactc

SEQ ID NO: 930254 - DNA, 22 bp, Artificial Sequence
  chemically synthesized
gcatgacagaatgagtccttgt

SEQ ID NO: 930255 - DNA, 22 bp, Artificial Sequence
  chemically synthesized
ttattagagacaaggactcatt

SEQ ID NO: 930256 - DNA, 22 bp, Artificial Sequence
  chemically synthesized
ttagagacaaggactcattctg

SEQ ID NO: 930257 - DNA, 22 bp, Artificial Sequence
  chemically synthesized
aaacttgcatgacagaatgagt

SEQ ID NO: 930258 - DNA, 22 bp, Artificial Sequence
  chemically synthesized
gagacaaggactcattctgtca

SEQ ID NO: 930259 - DNA, 22 bp, Artificial Sequence
  chemically synthesized
cactcaaacttgcatgacagaa

SEQ ID NO: 930260 - DNA, 22 bp, Artificial Sequence
  chemically synthesized
taccactgcactcaaacttgca

SEQ ID NO: 930261 - DNA, 22 bp, Artificial Sequence
  chemically synthesized
attctgtcatgcaagtttgagt

SEQ ID NO: 930262 - DNA, 22 bp, Artificial Sequence
  chemically synthesized
tgattgtaccactgcactcaaa

SEQ ID NO: 930263 - DNA, 22 bp, Artificial Sequence
  chemically synthesized
tgtcatgcaagtttgagtgcag

SEQ ID NO: 930264 - DNA, 22 bp, Artificial Sequence
  chemically synthesized
tcatgcaagtttgagtgcagtg

SEQ ID NO: 930265 - DNA, 22 bp, Artificial Sequence
  chemically synthesized
cagtgagctatgattgtaccac

SEQ ID NO: 930266 - DNA, 22 bp, Artificial Sequence
  chemically synthesized
gagtgcagtggtacaatcatag

SEQ ID NO: 930267 - DNA, 22 bp, Artificial Sequence
  chemically synthesized
agtgcagtggtacaatcatagc

SEQ ID NO: 930268 - DNA, 22 bp, Artificial Sequence
  chemically synthesized
gagactacagtgagctatgatt

SEQ ID NO: 930269 - DNA, 22 bp, Artificial Sequence
  chemically synthesized
aggggttggagactacagtgag

SEQ ID NO: 930270 - DNA, 22 bp, Artificial Sequence
  chemically synthesized
actgtagtctccaacccctgag

SEQ ID NO: 930271 - DNA, 22 bp, Artificial Sequence
  chemically synthesized
tagtctccaacccctgagctct

SEQ ID NO: 930272 - DNA, 22 bp, Artificial Sequence
  chemically synthesized
aggtggaggatcaccagagctc

SEQ ID NO: 930273 - DNA, 22 bp, Artificial Sequence
  chemically synthesized
caacccctgagctctggtgatc

SEQ ID NO: 930274 - DNA, 22 bp, Artificial Sequence
  chemically synthesized
aagaggctgaggtggaggatca

SEQ ID NO: 930275 - DNA, 22 bp, Artificial Sequence
  chemically synthesized
ctcaagaggctgaggtggagga

SEQ ID NO: 930276 - DNA, 22 bp, Artificial Sequence
  chemically synthesized
agctctggtgatcctccacctc

SEQ ID NO: 930277 - DNA, 22 bp, Artificial Sequence
  chemically synthesized
agctactcaagaggctgaggtg

SEQ ID NO: 930278 - DNA, 22 bp, Artificial Sequence
  chemically synthesized
tggtgatcctccacctcagcct

SEQ ID NO: 930279 - DNA, 22 bp, Artificial Sequence
  chemically synthesized
gtgatcctccacctcagcctct

SEQ ID NO: 930280 - DNA, 22 bp, Artificial Sequence
  chemically synthesized
cacctcagcctcttgagtagct

SEQ ID NO: 930281 - DNA, 22 bp, Artificial Sequence
  chemically synthesized
agcctcttgagtagctgagacc

SEQ ID NO: 930282 - DNA, 22 bp, Artificial Sequence
  chemically synthesized
ttgagtagctgagaccaccggt

SEQ ID NO: 930283 - DNA, 22 bp, Artificial Sequence
  chemically synthesized
gagtagctgagaccaccggtgc

SEQ ID NO: 930284 - DNA, 22 bp, Artificial Sequence
  chemically synthesized
agtagctgagaccaccggtgca

SEQ ID NO: 930285 - DNA, 22 bp, Artificial Sequence
  chemically synthesized
ggtgtggtggtatgcaccggtg

SEQ ID NO: 930286 - DNA, 22 bp, Artificial Sequence
  chemically synthesized
tctgggtgtggtggtatgcacc

SEQ ID NO: 930287 - DNA, 22 bp, Artificial Sequence
  chemically synthesized
agaccaccggtgcataccacca

SEQ ID NO: 930288 - DNA, 22 bp, Artificial Sequence
  chemically synthesized
aaaattatctgggtgtggtggt

SEQ ID NO: 930289 - DNA, 22 bp, Artificial Sequence
  chemically synthesized
aaaaattatctgggtgtggtgg

SEQ ID NO: 930290 - DNA, 22 bp, Artificial Sequence
  chemically synthesized
taaaaattatctgggtgtggtg

SEQ ID NO: 930291 - DNA, 22 bp, Artificial Sequence
  chemically synthesized
cacaaaaaaattttaaaaatta

SEQ ID NO: 930292 - DNA, 22 bp, Artificial Sequence
  chemically synthesized
tctccacaaaaaaattttaaaa

SEQ ID NO: 930293 - DNA, 22 bp, Artificial Sequence
  chemically synthesized
ttaaaatttttttgtggagaca

SEQ ID NO: 930294 - DNA, 22 bp, Artificial Sequence
  chemically synthesized
taaaatttttttgtggagacag

SEQ ID NO: 930295 - DNA, 22 bp, Artificial Sequence
  chemically synthesized
aaaatttttttgtggagacagg

SEQ ID NO: 930296 - DNA, 22 bp, Artificial Sequence
  chemically synthesized
aaatttttttgtggagacaggg

SEQ ID NO: 930297 - DNA, 22 bp, Artificial Sequence
  chemically synthesized
agcaaaaaagtgagaccctgtc

SEQ ID NO: 930298 - DNA, 22 bp, Artificial Sequence
  chemically synthesized
ttttgtggagacagggtctcac

SEQ ID NO: 930299 - DNA, 22 bp, Artificial Sequence
  chemically synthesized
tttgtggagacagggtctcact

SEQ ID NO: 930300 - DNA, 22 bp, Artificial Sequence
  chemically synthesized
ttgtggagacagggtctcactt

SEQ ID NO: 930301 - DNA, 22 bp, Artificial Sequence
  chemically synthesized
tgtggagacagggtctcacttt

SEQ ID NO: 930302 - DNA, 22 bp, Artificial Sequence
  chemically synthesized
gtggagacagggtctcactttt

SEQ ID NO: 930303 - DNA, 22 bp, Artificial Sequence
  chemically synthesized
tggagacagggtctcacttttt

SEQ ID NO: 930304 - DNA, 22 bp, Artificial Sequence
  chemically synthesized
aagaccagcctcagcaaaaaag

SEQ ID NO: 930305 - DNA, 22 bp, Artificial Sequence
  chemically synthesized
acttttttgctgaggctggtct

SEQ ID NO: 930306 - DNA, 22 bp, Artificial Sequence
  chemically synthesized
aggccaggagttcaagaccagc

SEQ ID NO: 930307 - DNA, 22 bp, Artificial Sequence
  chemically synthesized
gaggccaggagttcaagaccag

SEQ ID NO: 930308 - DNA, 22 bp, Artificial Sequence
  chemically synthesized
ttttgctgaggctggtcttgaa

SEQ ID NO: 930309 - DNA, 22 bp, Artificial Sequence
  chemically synthesized
tttgctgaggctggtcttgaac

SEQ ID NO: 930310 - DNA, 22 bp, Artificial Sequence
  chemically synthesized
ttgctgaggctggtcttgaact

SEQ ID NO: 930311 - DNA, 22 bp, Artificial Sequence
  chemically synthesized
tttgaggccaggagttcaagac

SEQ ID NO: 930312 - DNA, 22 bp, Artificial Sequence
  chemically synthesized
tgctgaggctggtcttgaactc

SEQ ID NO: 930313 - DNA, 22 bp, Artificial Sequence
  chemically synthesized
gctgaggctggtcttgaactcc

SEQ ID NO: 930314 - DNA, 22 bp, Artificial Sequence
  chemically synthesized
ctgaggctggtcttgaactcct

SEQ ID NO: 930315 - DNA, 22 bp, Artificial Sequence
  chemically synthesized
aggctggtcttgaactcctggc

SEQ ID NO: 930316 - DNA, 22 bp, Artificial Sequence
  chemically synthesized
gtcttgaactcctggcctcaaa

SEQ ID NO: 930317 - DNA, 22 bp, Artificial Sequence
  chemically synthesized
aggtgggaggattgtttgaggc

SEQ ID NO: 930318 - DNA, 22 bp, Artificial Sequence
  chemically synthesized
gaactcctggcctcaaacaatc

SEQ ID NO: 930319 - DNA, 22 bp, Artificial Sequence
  chemically synthesized
aactcctggcctcaaacaatcc

SEQ ID NO: 930320 - DNA, 22 bp, Artificial Sequence
  chemically synthesized
gaaggctaaggtgggaggattg

SEQ ID NO: 930321 - DNA, 22 bp, Artificial Sequence
  chemically synthesized
ctggcctcaaacaatcctccca

SEQ ID NO: 930322 - DNA, 22 bp, Artificial Sequence
  chemically synthesized
ggaaggctaaggtgggaggatt

SEQ ID NO: 930323 - DNA, 22 bp, Artificial Sequence
  chemically synthesized
tggaaggctaaggtgggaggat

SEQ ID NO: 930324 - DNA, 22 bp, Artificial Sequence
  chemically synthesized
gcctcaaacaatcctcccacct

SEQ ID NO: 930325 - DNA, 22 bp, Artificial Sequence
  chemically synthesized
gcactttggaaggctaaggtgg

SEQ ID NO: 930326 - DNA, 22 bp, Artificial Sequence
  chemically synthesized
aaacaatcctcccaccttagcc

SEQ ID NO: 930327 - DNA, 22 bp, Artificial Sequence
  chemically synthesized
tgatcctagcactttggaaggc

SEQ ID NO: 930328 - DNA, 22 bp, Artificial Sequence
  chemically synthesized
ccaccttagccttccaaagtgc

SEQ ID NO: 930329 - DNA, 22 bp, Artificial Sequence
  chemically synthesized
atgcctatgatcctagcacttt

SEQ ID NO: 930330 - DNA, 22 bp, Artificial Sequence
  chemically synthesized
agccttccaaagtgctaggatc

SEQ ID NO: 930331 - DNA, 22 bp, Artificial Sequence
  chemically synthesized
gccttccaaagtgctaggatca

SEQ ID NO: 930332 - DNA, 22 bp, Artificial Sequence
  chemically synthesized
ccaaagtgctaggatcataggc

SEQ ID NO: 930333 - DNA, 22 bp, Artificial Sequence
  chemically synthesized
caaagtgctaggatcataggca

SEQ ID NO: 930334 - DNA, 22 bp, Artificial Sequence
  chemically synthesized
ggcatggtggctcatgcctatg

SEQ ID NO: 930335 - DNA, 22 bp, Artificial Sequence
  chemically synthesized
ggctgggcatggtggctcatgc

SEQ ID NO: 930336 - DNA, 22 bp, Artificial Sequence
  chemically synthesized
aggctgggcatggtggctcatg

SEQ ID NO: 930337 - DNA, 22 bp, Artificial Sequence
  chemically synthesized
ggatcataggcatgagccacca

SEQ ID NO: 930338 - DNA, 22 bp, Artificial Sequence
  chemically synthesized
aatcaaaataatgaaatttagg

SEQ ID NO: 930339 - DNA, 22 bp, Artificial Sequence
  chemically synthesized
caatcaaaataatgaaatttag

SEQ ID NO: 930340 - DNA, 22 bp, Artificial Sequence
  chemically synthesized
tcaatcaaaataatgaaattta

SEQ ID NO: 930341 - DNA, 22 bp, Artificial Sequence
  chemically synthesized
aatttcattattttgattgaaa

SEQ ID NO: 930342 - DNA, 22 bp, Artificial Sequence
  chemically synthesized
cattattttgattgaaaattta

SEQ ID NO: 930343 - DNA, 22 bp, Artificial Sequence
  chemically synthesized
attattttgattgaaaatttat

SEQ ID NO: 930344 - DNA, 22 bp, Artificial Sequence
  chemically synthesized
aaataaagacaatcataaattt

SEQ ID NO: 930345 - DNA, 22 bp, Artificial Sequence
  chemically synthesized
ttttgattgaaaatttatgatt

SEQ ID NO: 930346 - DNA, 22 bp, Artificial Sequence
  chemically synthesized
tgattgaaaatttatgattgtc

SEQ ID NO: 930347 - DNA, 22 bp, Artificial Sequence
  chemically synthesized
gattgaaaatttatgattgtct

SEQ ID NO: 930348 - DNA, 22 bp, Artificial Sequence
  chemically synthesized
attgaaaatttatgattgtctt

SEQ ID NO: 930349 - DNA, 22 bp, Artificial Sequence
  chemically synthesized
aaaatttatgattgtctttatt

SEQ ID NO: 930350 - DNA, 22 bp, Artificial Sequence
  chemically synthesized
atgattgtctttatttcaggga

SEQ ID NO: 930351 - DNA, 22 bp, Artificial Sequence
  chemically synthesized
tgattgtctttatttcagggac

SEQ ID NO: 930352 - DNA, 22 bp, Artificial Sequence
  chemically synthesized
tctttatttcagggacattgtc

SEQ ID NO: 930353 - DNA, 22 bp, Artificial Sequence
  chemically synthesized
aaaggtaaagaagacaatgtcc

SEQ ID NO: 930354 - DNA, 22 bp, Artificial Sequence
  chemically synthesized
tatttcagggacattgtcttct

SEQ ID NO: 930355 - DNA, 22 bp, Artificial Sequence
  chemically synthesized
atttcagggacattgtcttctt

SEQ ID NO: 930356 - DNA, 22 bp, Artificial Sequence
  chemically synthesized
tttcagggacattgtcttcttt

SEQ ID NO: 930357 - DNA, 22 bp, Artificial Sequence
  chemically synthesized
cagggacattgtcttctttacc

SEQ ID NO: 930358 - DNA, 22 bp, Artificial Sequence
  chemically synthesized
agggacattgtcttctttacct

SEQ ID NO: 930359 - DNA, 22 bp, Artificial Sequence
  chemically synthesized
tcttctttacctttgaggtctc

SEQ ID NO: 930360 - DNA, 22 bp, Artificial Sequence
  chemically synthesized
atgagcatagtggagacctcaa

SEQ ID NO: 930361 - DNA, 22 bp, Artificial Sequence
  chemically synthesized
ctttacctttgaggtctccact

SEQ ID NO: 930362 - DNA, 22 bp, Artificial Sequence
  chemically synthesized
actgatgagcatagtggagacc

SEQ ID NO: 930363 - DNA, 22 bp, Artificial Sequence
  chemically synthesized
tttacctttgaggtctccacta

SEQ ID NO: 930364 - DNA, 22 bp, Artificial Sequence
  chemically synthesized
tacctttgaggtctccactatg

SEQ ID NO: 930365 - DNA, 22 bp, Artificial Sequence
  chemically synthesized
acctttgaggtctccactatgc

SEQ ID NO: 930366 - DNA, 22 bp, Artificial Sequence
  chemically synthesized
cctttgaggtctccactatgct

SEQ ID NO: 930367 - DNA, 22 bp, Artificial Sequence
  chemically synthesized
tgaggtctccactatgctcatc

SEQ ID NO: 930368 - DNA, 22 bp, Artificial Sequence
  chemically synthesized
gaggtctccactatgctcatca

SEQ ID NO: 930369 - DNA, 22 bp, Artificial Sequence
  chemically synthesized
aggtctccactatgctcatcag

SEQ ID NO: 930370 - DNA, 22 bp, Artificial Sequence
  chemically synthesized
gtaaaaagaacaaattaactga

SEQ ID NO: 930371 - DNA, 22 bp, Artificial Sequence
  chemically synthesized
cactatgctcatcagttaattt

SEQ ID NO: 930372 - DNA, 22 bp, Artificial Sequence
  chemically synthesized
agtaaaaagaacaaattaactg

SEQ ID NO: 930373 - DNA, 22 bp, Artificial Sequence
  chemically synthesized
tgctcatcagttaatttgttct

SEQ ID NO: 930374 - DNA, 22 bp, Artificial Sequence
  chemically synthesized
gccatttagtaaaaagaacaaa

SEQ ID NO: 930375 - DNA, 22 bp, Artificial Sequence
  chemically synthesized
agccatttagtaaaaagaacaa

SEQ ID NO: 930376 - DNA, 22 bp, Artificial Sequence
  chemically synthesized
atcagttaatttgttcttttta

SEQ ID NO: 930377 - DNA, 22 bp, Artificial Sequence
  chemically synthesized
atttagccatttagtaaaaaga

SEQ ID NO: 930378 - DNA, 22 bp, Artificial Sequence
  chemically synthesized
atttgttctttttactaaatgg

SEQ ID NO: 930379 - DNA, 22 bp, Artificial Sequence
  chemically synthesized
agtcactcatttagccatttag

SEQ ID NO: 930380 - DNA, 22 bp, Artificial Sequence
  chemically synthesized
gttctttttactaaatggctaa

SEQ ID NO: 930381 - DNA, 22 bp, Artificial Sequence
  chemically synthesized
ttctttttactaaatggctaaa

SEQ ID NO: 930382 - DNA, 22 bp, Artificial Sequence
  chemically synthesized
tttttactaaatggctaaatga

SEQ ID NO: 930383 - DNA, 22 bp, Artificial Sequence
  chemically synthesized
tttactaaatggctaaatgagt

SEQ ID NO: 930384 - DNA, 22 bp, Artificial Sequence
  chemically synthesized
ttactaaatggctaaatgagtg

SEQ ID NO: 930385 - DNA, 22 bp, Artificial Sequence
  chemically synthesized
tactaaatggctaaatgagtga

SEQ ID NO: 930386 - DNA, 22 bp, Artificial Sequence
  chemically synthesized
actaaatggctaaatgagtgac

SEQ ID NO: 930387 - DNA, 22 bp, Artificial Sequence
  chemically synthesized
ctaaatggctaaatgagtgact

SEQ ID NO: 930388 - DNA, 22 bp, Artificial Sequence
  chemically synthesized
aatggctaaatgagtgactgag

SEQ ID NO: 930389 - DNA, 22 bp, Artificial Sequence
  chemically synthesized
aatgagtgactgagtttctttt

SEQ ID NO: 930390 - DNA, 22 bp, Artificial Sequence
  chemically synthesized
accacataccagtaaaagaaac

SEQ ID NO: 930391 - DNA, 22 bp, Artificial Sequence
  chemically synthesized
caccacataccagtaaaagaaa

SEQ ID NO: 930392 - DNA, 22 bp, Artificial Sequence
  chemically synthesized
cagtttcaccacataccagtaa

SEQ ID NO: 930393 - DNA, 22 bp, Artificial Sequence
  chemically synthesized
tgcagtttcaccacataccagt

SEQ ID NO: 930394 - DNA, 22 bp, Artificial Sequence
  chemically synthesized
agtttcttttactggtatgtgg

SEQ ID NO: 930395 - DNA, 22 bp, Artificial Sequence
  chemically synthesized
cttttactggtatgtggtgaaa

SEQ ID NO: 930396 - DNA, 22 bp, Artificial Sequence
  chemically synthesized
ttttactggtatgtggtgaaac

SEQ ID NO: 930397 - DNA, 22 bp, Artificial Sequence
  chemically synthesized
ttactggtatgtggtgaaactg

SEQ ID NO: 930398 - DNA, 22 bp, Artificial Sequence
  chemically synthesized
tactggtatgtggtgaaactgc

SEQ ID NO: 930399 - DNA, 22 bp, Artificial Sequence
  chemically synthesized
actggtatgtggtgaaactgca

SEQ ID NO: 930400 - DNA, 22 bp, Artificial Sequence
  chemically synthesized
ctggtatgtggtgaaactgcag

SEQ ID NO: 930401 - DNA, 22 bp, Artificial Sequence
  chemically synthesized
gtatgtggtgaaactgcagaat

SEQ ID NO: 930402 - DNA, 22 bp, Artificial Sequence
  chemically synthesized
aacgtgcataaaaattctgcag

SEQ ID NO: 930403 - DNA, 22 bp, Artificial Sequence
  chemically synthesized
caacgtgcataaaaattctgca

SEQ ID NO: 930404 - DNA, 22 bp, Artificial Sequence
  chemically synthesized
tcaacgtgcataaaaattctgc

SEQ ID NO: 930405 - DNA, 22 bp, Artificial Sequence
  chemically synthesized
tttcaacgtgcataaaaattct

SEQ ID NO: 930406 - DNA, 22 bp, Artificial Sequence
  chemically synthesized
gagattctttcaacgtgcataa

SEQ ID NO: 930407 - DNA, 22 bp, Artificial Sequence
  chemically synthesized
agagattctttcaacgtgcata

SEQ ID NO: 930408 - DNA, 22 bp, Artificial Sequence
  chemically synthesized
ttagagattctttcaacgtgca

SEQ ID NO: 930409 - DNA, 22 bp, Artificial Sequence
  chemically synthesized
cagaatttttatgcacgttgaa

SEQ ID NO: 930410 - DNA, 22 bp, Artificial Sequence
  chemically synthesized
tgctcttagagattctttcaac

SEQ ID NO: 930411 - DNA, 22 bp, Artificial Sequence
  chemically synthesized
ttatgcacgttgaaagaatctc

SEQ ID NO: 930412 - DNA, 22 bp, Artificial Sequence
  chemically synthesized
tatgcacgttgaaagaatctct

SEQ ID NO: 930413 - DNA, 22 bp, Artificial Sequence
  chemically synthesized
atgcacgttgaaagaatctcta

SEQ ID NO: 930414 - DNA, 22 bp, Artificial Sequence
  chemically synthesized
tgcacgttgaaagaatctctaa

SEQ ID NO: 930415 - DNA, 22 bp, Artificial Sequence
  chemically synthesized
ccaaatgtgctatgctcttaga

SEQ ID NO: 930416 - DNA, 22 bp, Artificial Sequence
  chemically synthesized
accaaatgtgctatgctcttag

SEQ ID NO: 930417 - DNA, 22 bp, Artificial Sequence
  chemically synthesized
taccaaatgtgctatgctctta

SEQ ID NO: 930418 - DNA, 22 bp, Artificial Sequence
  chemically synthesized
ttaccaaatgtgctatgctctt

SEQ ID NO: 930419 - DNA, 22 bp, Artificial Sequence
  chemically synthesized
aaagaatctctaagagcatagc

SEQ ID NO: 930420 - DNA, 22 bp, Artificial Sequence
  chemically synthesized
tttaccaaatgtgctatgctct

SEQ ID NO: 930421 - DNA, 22 bp, Artificial Sequence
  chemically synthesized
atcatgctttttaccaaatgtg

SEQ ID NO: 930422 - DNA, 22 bp, Artificial Sequence
  chemically synthesized
taagagcatagcacatttggta

SEQ ID NO: 930423 - DNA, 22 bp, Artificial Sequence
  chemically synthesized
aatcatgctttttaccaaatgt

SEQ ID NO: 930424 - DNA, 22 bp, Artificial Sequence
  chemically synthesized
agagcatagcacatttggtaaa

SEQ ID NO: 930425 - DNA, 22 bp, Artificial Sequence
  chemically synthesized
ggtaaaaagcatgattaaattc

SEQ ID NO: 930426 - DNA, 22 bp, Artificial Sequence
  chemically synthesized
gtaaaaagcatgattaaattct

SEQ ID NO: 930427 - DNA, 22 bp, Artificial Sequence
  chemically synthesized
aaagtacagaaatagaatttaa

SEQ ID NO: 930428 - DNA, 22 bp, Artificial Sequence
  chemically synthesized
aaaagtacagaaatagaattta

SEQ ID NO: 930429 - DNA, 22 bp, Artificial Sequence
  chemically synthesized
gtaggtatttaaaagtacagaa

SEQ ID NO: 930430 - DNA, 22 bp, Artificial Sequence
  chemically synthesized
aattctatttctgtacttttaa

SEQ ID NO: 930431 - DNA, 22 bp, Artificial Sequence
  chemically synthesized
gacccctagtaggtatttaaaa

SEQ ID NO: 930432 - DNA, 22 bp, Artificial Sequence
  chemically synthesized
tatttctgtacttttaaatacc

SEQ ID NO: 930433 - DNA, 22 bp, Artificial Sequence
  chemically synthesized
tttctgtacttttaaataccta

SEQ ID NO: 930434 - DNA, 22 bp, Artificial Sequence
  chemically synthesized
ctagacccctagtaggtattta

SEQ ID NO: 930435 - DNA, 22 bp, Artificial Sequence
  chemically synthesized
gctagacccctagtaggtattt

SEQ ID NO: 930436 - DNA, 22 bp, Artificial Sequence
  chemically synthesized
tgctagacccctagtaggtatt

SEQ ID NO: 930437 - DNA, 22 bp, Artificial Sequence
  chemically synthesized
ctgtacttttaaatacctacta

SEQ ID NO: 930438 - DNA, 22 bp, Artificial Sequence
  chemically synthesized
ttgctagacccctagtaggtat

SEQ ID NO: 930439 - DNA, 22 bp, Artificial Sequence
  chemically synthesized
tgtacttttaaatacctactag

SEQ ID NO: 930440 - DNA, 22 bp, Artificial Sequence
  chemically synthesized
tttgctagacccctagtaggta

SEQ ID NO: 930441 - DNA, 22 bp, Artificial Sequence
  chemically synthesized
ttttgctagacccctagtaggt

SEQ ID NO: 930442 - DNA, 22 bp, Artificial Sequence
  chemically synthesized
tacttttaaatacctactaggg

SEQ ID NO: 930443 - DNA, 22 bp, Artificial Sequence
  chemically synthesized
tttttgctagacccctagtagg

SEQ ID NO: 930444 - DNA, 22 bp, Artificial Sequence
  chemically synthesized
ttttttgctagacccctagtag

SEQ ID NO: 930445 - DNA, 22 bp, Artificial Sequence
  chemically synthesized
tttttttgctagacccctagta

SEQ ID NO: 930446 - DNA, 22 bp, Artificial Sequence
  chemically synthesized
ttttttttgctagacccctagt

SEQ ID NO: 930447 - DNA, 22 bp, Artificial Sequence
  chemically synthesized
tttttttttgctagacccctag

SEQ ID NO: 930448 - DNA, 22 bp, Artificial Sequence
  chemically synthesized
ttaaatacctactaggggtcta

SEQ ID NO: 930449 - DNA, 22 bp, Artificial Sequence
  chemically synthesized
taaatacctactaggggtctag

SEQ ID NO: 930450 - DNA, 22 bp, Artificial Sequence
  chemically synthesized
aaatacctactaggggtctagc

SEQ ID NO: 930451 - DNA, 22 bp, Artificial Sequence
  chemically synthesized
ttttttttttttgctagacccc

SEQ ID NO: 930452 - DNA, 22 bp, Artificial Sequence
  chemically synthesized
aatacctactaggggtctagca

SEQ ID NO: 930453 - DNA, 22 bp, Artificial Sequence
  chemically synthesized
ctaggggtctagcaaaaaaaaa

SEQ ID NO: 930454 - DNA, 22 bp, Artificial Sequence
  chemically synthesized
ggggtctagcaaaaaaaaaaaa

SEQ ID NO: 930455 - DNA, 22 bp, Artificial Sequence
  chemically synthesized
agcatcagcactattttttttt

SEQ ID NO: 930456 - DNA, 22 bp, Artificial Sequence
  chemically synthesized
cagcatcagcactatttttttt

SEQ ID NO: 930457 - DNA, 22 bp, Artificial Sequence
  chemically synthesized
gcaaaaaaaaaaaatagtgctg

SEQ ID NO: 930458 - DNA, 22 bp, Artificial Sequence
  chemically synthesized
accagcttcagcatcagcacta

SEQ ID NO: 930459 - DNA, 22 bp, Artificial Sequence
  chemically synthesized
gaccagcttcagcatcagcact

SEQ ID NO: 930460 - DNA, 22 bp, Artificial Sequence
  chemically synthesized
tgaccagcttcagcatcagcac

SEQ ID NO: 930461 - DNA, 22 bp, Artificial Sequence
  chemically synthesized
tctttgaccagcttcagcatca

SEQ ID NO: 930462 - DNA, 22 bp, Artificial Sequence
  chemically synthesized
aattgtctttgaccagcttcag

SEQ ID NO: 930463 - DNA, 22 bp, Artificial Sequence
  chemically synthesized
gaattgtctttgaccagcttca

SEQ ID NO: 930464 - DNA, 22 bp, Artificial Sequence
  chemically synthesized
atgctgaagctggtcaaagaca

SEQ ID NO: 930465 - DNA, 22 bp, Artificial Sequence
  chemically synthesized
aagctggtcaaagacaattcaa

SEQ ID NO: 930466 - DNA, 22 bp, Artificial Sequence
  chemically synthesized
gtcaaagacaattcaaatgttc

SEQ ID NO: 930467 - DNA, 22 bp, Artificial Sequence
  chemically synthesized
atatgaagtgcagaacatttga

SEQ ID NO: 930468 - DNA, 22 bp, Artificial Sequence
  chemically synthesized
aaatgttctgcacttcatatta

SEQ ID NO: 930469 - DNA, 22 bp, Artificial Sequence
  chemically synthesized
gcaaccccaccactaatatgaa

SEQ ID NO: 930470 - DNA, 22 bp, Artificial Sequence
  chemically synthesized
ggcaaccccaccactaatatga

SEQ ID NO: 930471 - DNA, 22 bp, Artificial Sequence
  chemically synthesized
cttggcaaccccaccactaata

SEQ ID NO: 930472 - DNA, 22 bp, Artificial Sequence
  chemically synthesized
tgcacttcatattagtggtggg

SEQ ID NO: 930473 - DNA, 22 bp, Artificial Sequence
  chemically synthesized
ttccttggcaaccccaccacta

SEQ ID NO: 930474 - DNA, 22 bp, Artificial Sequence
  chemically synthesized
cacttcatattagtggtggggt

SEQ ID NO: 930475 - DNA, 22 bp, Artificial Sequence
  chemically synthesized
tgttccttggcaaccccaccac

SEQ ID NO: 930476 - DNA, 22 bp, Artificial Sequence
  chemically synthesized
catattagtggtggggttgcca

SEQ ID NO: 930477 - DNA, 22 bp, Artificial Sequence
  chemically synthesized
atattagtggtggggttgccaa

SEQ ID NO: 930478 - DNA, 22 bp, Artificial Sequence
  chemically synthesized
taaaagctctgttccttggcaa

SEQ ID NO: 930479 - DNA, 22 bp, Artificial Sequence
  chemically synthesized
gtaaaagctctgttccttggca

SEQ ID NO: 930480 - DNA, 22 bp, Artificial Sequence
  chemically synthesized
tgtaaaagctctgttccttggc

SEQ ID NO: 930481 - DNA, 22 bp, Artificial Sequence
  chemically synthesized
gtggtggggttgccaaggaaca

SEQ ID NO: 930482 - DNA, 22 bp, Artificial Sequence
  chemically synthesized
gctttgtaaaagctctgttcct

SEQ ID NO: 930483 - DNA, 22 bp, Artificial Sequence
  chemically synthesized
ccaaggaacagagcttttacaa

SEQ ID NO: 930484 - DNA, 22 bp, Artificial Sequence
  chemically synthesized
agcagcagggcattagctttgt

SEQ ID NO: 930485 - DNA, 22 bp, Artificial Sequence
  chemically synthesized
cctgagcagcagggcattagct

SEQ ID NO: 930486 - DNA, 22 bp, Artificial Sequence
  chemically synthesized
ctgcctgagcagcagggcatta

SEQ ID NO: 930487 - DNA, 22 bp, Artificial Sequence
  chemically synthesized
ttacaaagctaatgccctgctg

SEQ ID NO: 930488 - DNA, 22 bp, Artificial Sequence
  chemically synthesized
tacaaagctaatgccctgctgc

SEQ ID NO: 930489 - DNA, 22 bp, Artificial Sequence
  chemically synthesized
acaaagctaatgccctgctgct

SEQ ID NO: 930490 - DNA, 22 bp, Artificial Sequence
  chemically synthesized
caaagctaatgccctgctgctc

SEQ ID NO: 930491 - DNA, 22 bp, Artificial Sequence
  chemically synthesized
gaatgcagtgttgctgcctgag

SEQ ID NO: 930492 - DNA, 22 bp, Artificial Sequence
  chemically synthesized
atgccctgctgctcaggcagca

SEQ ID NO: 930493 - DNA, 22 bp, Artificial Sequence
  chemically synthesized
ctagaatgcagtgttgctgcct

SEQ ID NO: 930494 - DNA, 22 bp, Artificial Sequence
  chemically synthesized
ctgctcaggcagcaacactgca

SEQ ID NO: 930495 - DNA, 22 bp, Artificial Sequence
  chemically synthesized
ctcaggcagcaacactgcattc

SEQ ID NO: 930496 - DNA, 22 bp, Artificial Sequence
  chemically synthesized
aagagtctactagaatgcagtg

SEQ ID NO: 930497 - DNA, 22 bp, Artificial Sequence
  chemically synthesized
aggcagcaacactgcattctag

SEQ ID NO: 930498 - DNA, 22 bp, Artificial Sequence
  chemically synthesized
tctgaagagtctactagaatgc

SEQ ID NO: 930499 - DNA, 22 bp, Artificial Sequence
  chemically synthesized
atctgaagagtctactagaatg

SEQ ID NO: 930500 - DNA, 22 bp, Artificial Sequence
  chemically synthesized
tatctgaagagtctactagaat

SEQ ID NO: 930501 - DNA, 22 bp, Artificial Sequence
  chemically synthesized
ctttatctgaagagtctactag

SEQ ID NO: 930502 - DNA, 22 bp, Artificial Sequence
  chemically synthesized
actttatctgaagagtctacta

SEQ ID NO: 930503 - DNA, 22 bp, Artificial Sequence
  chemically synthesized
tactttatctgaagagtctact

SEQ ID NO: 930504 - DNA, 22 bp, Artificial Sequence
  chemically synthesized
ttactttatctgaagagtctac

SEQ ID NO: 930505 - DNA, 22 bp, Artificial Sequence
  chemically synthesized
tttactttatctgaagagtcta

SEQ ID NO: 930506 - DNA, 22 bp, Artificial Sequence
  chemically synthesized
tttttactttatctgaagagtc

SEQ ID NO: 930507 - DNA, 22 bp, Artificial Sequence
  chemically synthesized
ctttttactttatctgaagagt

SEQ ID NO: 930508 - DNA, 22 bp, Artificial Sequence
  chemically synthesized
cattctagtagactcttcagat

SEQ ID NO: 930509 - DNA, 22 bp, Artificial Sequence
  chemically synthesized
tctttttactttatctgaagag

SEQ ID NO: 930510 - DNA, 22 bp, Artificial Sequence
  chemically synthesized
ttctttttactttatctgaaga

SEQ ID NO: 930511 - DNA, 22 bp, Artificial Sequence
  chemically synthesized
ttttctttttactttatctgaa

SEQ ID NO: 930512 - DNA, 22 bp, Artificial Sequence
  chemically synthesized
cttttctttttactttatctga

SEQ ID NO: 930513 - DNA, 22 bp, Artificial Sequence
  chemically synthesized
tagtagactcttcagataaagt

SEQ ID NO: 930514 - DNA, 22 bp, Artificial Sequence
  chemically synthesized
gtagactcttcagataaagtaa

SEQ ID NO: 930515 - DNA, 22 bp, Artificial Sequence
  chemically synthesized
tttcttttctttttactttatc

SEQ ID NO: 930516 - DNA, 22 bp, Artificial Sequence
  chemically synthesized
gtttcttttctttttactttat

SEQ ID NO: 930517 - DNA, 22 bp, Artificial Sequence
  chemically synthesized
tgtttcttttctttttacttta

SEQ ID NO: 930518 - DNA, 22 bp, Artificial Sequence
  chemically synthesized
ttttgtttcttttctttttact

SEQ ID NO: 930519 - DNA, 22 bp, Artificial Sequence
  chemically synthesized
ttcagataaagtaaaaagaaaa

SEQ ID NO: 930520 - DNA, 22 bp, Artificial Sequence
  chemically synthesized
ctgttttgtttcttttcttttt

SEQ ID NO: 930521 - DNA, 22 bp, Artificial Sequence
  chemically synthesized
cctgttttgtttcttttctttt

SEQ ID NO: 930522 - DNA, 22 bp, Artificial Sequence
  chemically synthesized
cagataaagtaaaaagaaaaga

SEQ ID NO: 930523 - DNA, 22 bp, Artificial Sequence
  chemically synthesized
tcctgttttgtttcttttcttt

SEQ ID NO: 930524 - DNA, 22 bp, Artificial Sequence
  chemically synthesized
agataaagtaaaaagaaaagaa

SEQ ID NO: 930525 - DNA, 22 bp, Artificial Sequence
  chemically synthesized
ggaatgacagacattttcctgt

SEQ ID NO: 930526 - DNA, 22 bp, Artificial Sequence
  chemically synthesized
aagactgggaatgacagacatt

SEQ ID NO: 930527 - DNA, 22 bp, Artificial Sequence
  chemically synthesized
gaagactgggaatgacagacat

SEQ ID NO: 930528 - DNA, 22 bp, Artificial Sequence
  chemically synthesized
atataacttgaagactgggaat

SEQ ID NO: 930529 - DNA, 22 bp, Artificial Sequence
  chemically synthesized
aggtcattcatataacttgaag

SEQ ID NO: 930530 - DNA, 22 bp, Artificial Sequence
  chemically synthesized
tcattcccagtcttcaagttat

SEQ ID NO: 930531 - DNA, 22 bp, Artificial Sequence
  chemically synthesized
gaggtcattcatataacttgaa

SEQ ID NO: 930532 - DNA, 22 bp, Artificial Sequence
  chemically synthesized
tgaggtcattcatataacttga

SEQ ID NO: 930533 - DNA, 22 bp, Artificial Sequence
  chemically synthesized
ccagtcttcaagttatatgaat

SEQ ID NO: 930534 - DNA, 22 bp, Artificial Sequence
  chemically synthesized
caagttatatgaatgacctcaa

SEQ ID NO: 930535 - DNA, 22 bp, Artificial Sequence
  chemically synthesized
aagttatatgaatgacctcaaa

SEQ ID NO: 930536 - DNA, 22 bp, Artificial Sequence
  chemically synthesized
ggtgaaaatagtatcattttga

SEQ ID NO: 930537 - DNA, 22 bp, Artificial Sequence
  chemically synthesized
tatgaatgacctcaaaatgata

SEQ ID NO: 930538 - DNA, 22 bp, Artificial Sequence
  chemically synthesized
ttgggtgaaaatagtatcattt

SEQ ID NO: 930539 - DNA, 22 bp, Artificial Sequence
  chemically synthesized
tgattattgggtgaaaatagta

SEQ ID NO: 930540 - DNA, 22 bp, Artificial Sequence
  chemically synthesized
atgattattgggtgaaaatagt

SEQ ID NO: 930541 - DNA, 22 bp, Artificial Sequence
  chemically synthesized
tatgattattgggtgaaaatag

SEQ ID NO: 930542 - DNA, 22 bp, Artificial Sequence
  chemically synthesized
aaaatgatactattttcaccca

SEQ ID NO: 930543 - DNA, 22 bp, Artificial Sequence
  chemically synthesized
cctttatgattattgggtgaaa

SEQ ID NO: 930544 - DNA, 22 bp, Artificial Sequence
  chemically synthesized
ttacctttatgattattgggtg

SEQ ID NO: 930545 - DNA, 22 bp, Artificial Sequence
  chemically synthesized
aagattattacctttatgatta

SEQ ID NO: 930546 - DNA, 22 bp, Artificial Sequence
  chemically synthesized
ttttcacccaataatcataaag

SEQ ID NO: 930547 - DNA, 22 bp, Artificial Sequence
  chemically synthesized
tcacccaataatcataaaggta

SEQ ID NO: 930548 - DNA, 22 bp, Artificial Sequence
  chemically synthesized
cacccaataatcataaaggtaa

SEQ ID NO: 930549 - DNA, 22 bp, Artificial Sequence
  chemically synthesized
acccaataatcataaaggtaat

SEQ ID NO: 930550 - DNA, 22 bp, Artificial Sequence
  chemically synthesized
tgtgtgttgaagattattacct

SEQ ID NO: 930551 - DNA, 22 bp, Artificial Sequence
  chemically synthesized
atatagattatgtgtgttgaag

SEQ ID NO: 930552 - DNA, 22 bp, Artificial Sequence
  chemically synthesized
gacattcatatagattatgtgt

SEQ ID NO: 930553 - DNA, 22 bp, Artificial Sequence
  chemically synthesized
ttggacattcatatagattatg

SEQ ID NO: 930554 - DNA, 22 bp, Artificial Sequence
  chemically synthesized
attggacattcatatagattat

SEQ ID NO: 930555 - DNA, 22 bp, Artificial Sequence
  chemically synthesized
caacacacataatctatatgaa

SEQ ID NO: 930556 - DNA, 22 bp, Artificial Sequence
  chemically synthesized
aacacacataatctatatgaat

SEQ ID NO: 930557 - DNA, 22 bp, Artificial Sequence
  chemically synthesized
atggatttattggacattcata

SEQ ID NO: 930558 - DNA, 22 bp, Artificial Sequence
  chemically synthesized
catggatttattggacattcat

SEQ ID NO: 930559 - DNA, 22 bp, Artificial Sequence
  chemically synthesized
tcatggatttattggacattca

SEQ ID NO: 930560 - DNA, 22 bp, Artificial Sequence
  chemically synthesized
ttcatggatttattggacattc

SEQ ID NO: 930561 - DNA, 22 bp, Artificial Sequence
  chemically synthesized
agcatcttttcatggatttatt

SEQ ID NO: 930562 - DNA, 22 bp, Artificial Sequence
  chemically synthesized
tatgaatgtccaataaatccat

SEQ ID NO: 930563 - DNA, 22 bp, Artificial Sequence
  chemically synthesized
ttaagcatcttttcatggattt

SEQ ID NO: 930564 - DNA, 22 bp, Artificial Sequence
  chemically synthesized
gcactattaagcatcttttcat

SEQ ID NO: 930565 - DNA, 22 bp, Artificial Sequence
  chemically synthesized
ctagcactattaagcatctttt

SEQ ID NO: 930566 - DNA, 22 bp, Artificial Sequence
  chemically synthesized
attactagcactattaagcatc

SEQ ID NO: 930567 - DNA, 22 bp, Artificial Sequence
  chemically synthesized
tgattactagcactattaagca

SEQ ID NO: 930568 - DNA, 22 bp, Artificial Sequence
  chemically synthesized
ctctgattactagcactattaa

SEQ ID NO: 930569 - DNA, 22 bp, Artificial Sequence
  chemically synthesized
tattcctctgattactagcact

SEQ ID NO: 930570 - DNA, 22 bp, Artificial Sequence
  chemically synthesized
atattcctctgattactagcac

SEQ ID NO: 930571 - DNA, 22 bp, Artificial Sequence
  chemically synthesized
acttatattcctctgattacta

SEQ ID NO: 930572 - DNA, 22 bp, Artificial Sequence
  chemically synthesized
aacttatattcctctgattact

SEQ ID NO: 930573 - DNA, 22 bp, Artificial Sequence
  chemically synthesized
taacttatattcctctgattac

SEQ ID NO: 930574 - DNA, 22 bp, Artificial Sequence
  chemically synthesized
aatagtgctagtaatcagagga

SEQ ID NO: 930575 - DNA, 22 bp, Artificial Sequence
  chemically synthesized
atagtgctagtaatcagaggaa

SEQ ID NO: 930576 - DNA, 22 bp, Artificial Sequence
  chemically synthesized
tggttttaacttatattcctct

SEQ ID NO: 930577 - DNA, 22 bp, Artificial Sequence
  chemically synthesized
ttgtggttttaacttatattcc

SEQ ID NO: 930578 - DNA, 22 bp, Artificial Sequence
  chemically synthesized
gtaatcagaggaatataagtta

SEQ ID NO: 930579 - DNA, 22 bp, Artificial Sequence
  chemically synthesized
cagaatatgtaggtatattgtt

SEQ ID NO: 930580 - DNA, 22 bp, Artificial Sequence
  chemically synthesized
acagaatatgtaggtatattgt

SEQ ID NO: 930581 - DNA, 22 bp, Artificial Sequence
  chemically synthesized
aaaccacaacaatatacctaca

SEQ ID NO: 930582 - DNA, 22 bp, Artificial Sequence
  chemically synthesized
tcttacagaatatgtaggtata

SEQ ID NO: 930583 - DNA, 22 bp, Artificial Sequence
  chemically synthesized
ctatcttacagaatatgtaggt

SEQ ID NO: 930584 - DNA, 22 bp, Artificial Sequence
  chemically synthesized
gctatcttacagaatatgtagg

SEQ ID NO: 930585 - DNA, 22 bp, Artificial Sequence
  chemically synthesized
tgctatcttacagaatatgtag

SEQ ID NO: 930586 - DNA, 22 bp, Artificial Sequence
  chemically synthesized
ttgctatcttacagaatatgta

SEQ ID NO: 930587 - DNA, 22 bp, Artificial Sequence
  chemically synthesized
atttttgctatcttacagaata

SEQ ID NO: 930588 - DNA, 22 bp, Artificial Sequence
  chemically synthesized
aatttttgctatcttacagaat

SEQ ID NO: 930589 - DNA, 22 bp, Artificial Sequence
  chemically synthesized
taatttttgctatcttacagaa

SEQ ID NO: 930590 - DNA, 22 bp, Artificial Sequence
  chemically synthesized
catattctgtaagatagcaaaa

SEQ ID NO: 930591 - DNA, 22 bp, Artificial Sequence
  chemically synthesized
tcagtcattttaatttttgcta

SEQ ID NO: 930592 - DNA, 22 bp, Artificial Sequence
  chemically synthesized
gtcagtcattttaatttttgct

SEQ ID NO: 930593 - DNA, 22 bp, Artificial Sequence
  chemically synthesized
tgtaagatagcaaaaattaaaa

SEQ ID NO: 930594 - DNA, 22 bp, Artificial Sequence
  chemically synthesized
gtcttgtcagtcattttaattt

SEQ ID NO: 930595 - DNA, 22 bp, Artificial Sequence
  chemically synthesized
taagatagcaaaaattaaaatg

SEQ ID NO: 930596 - DNA, 22 bp, Artificial Sequence
  chemically synthesized
ggtcttgtcagtcattttaatt

SEQ ID NO: 930597 - DNA, 22 bp, Artificial Sequence
  chemically synthesized
tcaatatttggtcttgtcagtc

SEQ ID NO: 930598 - DNA, 22 bp, Artificial Sequence
  chemically synthesized
gtcaatatttggtcttgtcagt

SEQ ID NO: 930599 - DNA, 22 bp, Artificial Sequence
  chemically synthesized
tgtcaatatttggtcttgtcag

SEQ ID NO: 930600 - DNA, 22 bp, Artificial Sequence
  chemically synthesized
aaatgactgacaagaccaaata

SEQ ID NO: 930601 - DNA, 22 bp, Artificial Sequence
  chemically synthesized
catctttgtcaatatttggtct

SEQ ID NO: 930602 - DNA, 22 bp, Artificial Sequence
  chemically synthesized
tacatctttgtcaatatttggt

SEQ ID NO: 930603 - DNA, 22 bp, Artificial Sequence
  chemically synthesized
ctctacatctttgtcaatattt

SEQ ID NO: 930604 - DNA, 22 bp, Artificial Sequence
  chemically synthesized
acaagaccaaatattgacaaag

SEQ ID NO: 930605 - DNA, 22 bp, Artificial Sequence
  chemically synthesized
cagttactctacatctttgtca

SEQ ID NO: 930606 - DNA, 22 bp, Artificial Sequence
  chemically synthesized
acaaagatgtagagtaactgga

SEQ ID NO: 930607 - DNA, 22 bp, Artificial Sequence
  chemically synthesized
caatgccaccagtgatgatgga

SEQ ID NO: 930608 - DNA, 22 bp, Artificial Sequence
  chemically synthesized
gcaatgccaccagtgatgatgg

SEQ ID NO: 930609 - DNA, 22 bp, Artificial Sequence
  chemically synthesized
tgcaatgccaccagtgatgatg

SEQ ID NO: 930610 - DNA, 22 bp, Artificial Sequence
  chemically synthesized
gaactctccatcatcactggtg

SEQ ID NO: 930611 - DNA, 22 bp, Artificial Sequence
  chemically synthesized
tgccattttgcaatgccaccag

SEQ ID NO: 930612 - DNA, 22 bp, Artificial Sequence
  chemically synthesized
tccatcatcactggtggcattg

SEQ ID NO: 930613 - DNA, 22 bp, Artificial Sequence
  chemically synthesized
catcatcactggtggcattgca

SEQ ID NO: 930614 - DNA, 22 bp, Artificial Sequence
  chemically synthesized
aagtggttgtgccattttgcaa

SEQ ID NO: 930615 - DNA, 22 bp, Artificial Sequence
  chemically synthesized
taaagtggttgtgccattttgc

SEQ ID NO: 930616 - DNA, 22 bp, Artificial Sequence
  chemically synthesized
ctaaagtggttgtgccattttg

SEQ ID NO: 930617 - DNA, 22 bp, Artificial Sequence
  chemically synthesized
tctaaagtggttgtgccatttt

SEQ ID NO: 930618 - DNA, 22 bp, Artificial Sequence
  chemically synthesized
gtggcattgcaaaatggcacaa

SEQ ID NO: 930619 - DNA, 22 bp, Artificial Sequence
  chemically synthesized
aacagttttctaaagtggttgt

SEQ ID NO: 930620 - DNA, 22 bp, Artificial Sequence
  chemically synthesized
caaaatggcacaaccactttag

SEQ ID NO: 930621 - DNA, 22 bp, Artificial Sequence
  chemically synthesized
tcaaacagcacctaaacagttt

SEQ ID NO: 930622 - DNA, 22 bp, Artificial Sequence
  chemically synthesized
tagaaaactgtttaggtgctgt

SEQ ID NO: 930623 - DNA, 22 bp, Artificial Sequence
  chemically synthesized
agaaaactgtttaggtgctgtt

SEQ ID NO: 930624 - DNA, 22 bp, Artificial Sequence
  chemically synthesized
gaaaactgtttaggtgctgttt

SEQ ID NO: 930625 - DNA, 22 bp, Artificial Sequence
  chemically synthesized
tgagatattgtcaaacagcacc

SEQ ID NO: 930626 - DNA, 22 bp, Artificial Sequence
  chemically synthesized
atgagatattgtcaaacagcac

SEQ ID NO: 930627 - DNA, 22 bp, Artificial Sequence
  chemically synthesized
aatttatgagatattgtcaaac

SEQ ID NO: 930628 - DNA, 22 bp, Artificial Sequence
  chemically synthesized
aaatttatgagatattgtcaaa

SEQ ID NO: 930629 - DNA, 22 bp, Artificial Sequence
  chemically synthesized
tttaggtgctgtttgacaatat

SEQ ID NO: 930630 - DNA, 22 bp, Artificial Sequence
  chemically synthesized
aggtgctgtttgacaatatctc

SEQ ID NO: 930631 - DNA, 22 bp, Artificial Sequence
  chemically synthesized
ggtgctgtttgacaatatctca

SEQ ID NO: 930632 - DNA, 22 bp, Artificial Sequence
  chemically synthesized
tttgacaatatctcataaattt

SEQ ID NO: 930633 - DNA, 22 bp, Artificial Sequence
  chemically synthesized
ggtgaaatgtttaaatttatga

SEQ ID NO: 930634 - DNA, 22 bp, Artificial Sequence
  chemically synthesized
gacaatatctcataaatttaaa

SEQ ID NO: 930635 - DNA, 22 bp, Artificial Sequence
  chemically synthesized
acaatatctcataaatttaaac

SEQ ID NO: 930636 - DNA, 22 bp, Artificial Sequence
  chemically synthesized
ataaatttaaacatttcaccca

SEQ ID NO: 930637 - DNA, 22 bp, Artificial Sequence
  chemically synthesized
tagaagtggaatggctgggtga

SEQ ID NO: 930638 - DNA, 22 bp, Artificial Sequence
  chemically synthesized
tgtagaagtggaatggctgggt

SEQ ID NO: 930639 - DNA, 22 bp, Artificial Sequence
  chemically synthesized
aaacatttcacccagccattcc

SEQ ID NO: 930640 - DNA, 22 bp, Artificial Sequence
  chemically synthesized
aacatttcacccagccattcca

SEQ ID NO: 930641 - DNA, 22 bp, Artificial Sequence
  chemically synthesized
agtaactctgtagaagtggaat

SEQ ID NO: 930642 - DNA, 22 bp, Artificial Sequence
  chemically synthesized
gagtaactctgtagaagtggaa

SEQ ID NO: 930643 - DNA, 22 bp, Artificial Sequence
  chemically synthesized
cacccagccattccacttctac

SEQ ID NO: 930644 - DNA, 22 bp, Artificial Sequence
  chemically synthesized
acccagccattccacttctaca

SEQ ID NO: 930645 - DNA, 22 bp, Artificial Sequence
  chemically synthesized
gtttgagtaactctgtagaagt

SEQ ID NO: 930646 - DNA, 22 bp, Artificial Sequence
  chemically synthesized
agtttgagtaactctgtagaag

SEQ ID NO: 930647 - DNA, 22 bp, Artificial Sequence
  chemically synthesized
atttagtttgagtaactctgta

SEQ ID NO: 930648 - DNA, 22 bp, Artificial Sequence
  chemically synthesized
catttagtttgagtaactctgt

SEQ ID NO: 930649 - DNA, 22 bp, Artificial Sequence
  chemically synthesized
tcatttagtttgagtaactctg

SEQ ID NO: 930650 - DNA, 22 bp, Artificial Sequence
  chemically synthesized
cacttctacagagttactcaaa

SEQ ID NO: 930651 - DNA, 22 bp, Artificial Sequence
  chemically synthesized
ctacagagttactcaaactaaa

SEQ ID NO: 930652 - DNA, 22 bp, Artificial Sequence
  chemically synthesized
tacagagttactcaaactaaat

SEQ ID NO: 930653 - DNA, 22 bp, Artificial Sequence
  chemically synthesized
cagagttactcaaactaaatga

SEQ ID NO: 930654 - DNA, 22 bp, Artificial Sequence
  chemically synthesized
tgagcatatgttttcatttagt

SEQ ID NO: 930655 - DNA, 22 bp, Artificial Sequence
  chemically synthesized
gtgagcatatgttttcatttag

SEQ ID NO: 930656 - DNA, 22 bp, Artificial Sequence
  chemically synthesized
ctcaaactaaatgaaaacatat

SEQ ID NO: 930657 - DNA, 22 bp, Artificial Sequence
  chemically synthesized
aaactaaatgaaaacatatgct

SEQ ID NO: 930658 - DNA, 22 bp, Artificial Sequence
  chemically synthesized
tgtacaagccatttgtgagcat

SEQ ID NO: 930659 - DNA, 22 bp, Artificial Sequence
  chemically synthesized
aatgaaaacatatgctcacaaa

SEQ ID NO: 930660 - DNA, 22 bp, Artificial Sequence
  chemically synthesized
gtgtacaagccatttgtgagca

SEQ ID NO: 930661 - DNA, 22 bp, Artificial Sequence
  chemically synthesized
tggacatttgtgtacaagccat

SEQ ID NO: 930662 - DNA, 22 bp, Artificial Sequence
  chemically synthesized
acaaatggcttgtacacaaatg

SEQ ID NO: 930663 - DNA, 22 bp, Artificial Sequence
  chemically synthesized
tgaataagatgctgtggacatt

SEQ ID NO: 930664 - DNA, 22 bp, Artificial Sequence
  chemically synthesized
ttatgaataagatgctgtggac

SEQ ID NO: 930665 - DNA, 22 bp, Artificial Sequence
  chemically synthesized
gtacacaaatgtccacagcatc

SEQ ID NO: 930666 - DNA, 22 bp, Artificial Sequence
  chemically synthesized
tacacaaatgtccacagcatct

SEQ ID NO: 930667 - DNA, 22 bp, Artificial Sequence
  chemically synthesized
gctgttatgaataagatgctgt

SEQ ID NO: 930668 - DNA, 22 bp, Artificial Sequence
  chemically synthesized
ggctgttatgaataagatgctg

SEQ ID NO: 930669 - DNA, 22 bp, Artificial Sequence
  chemically synthesized
tggctgttatgaataagatgct

SEQ ID NO: 930670 - DNA, 22 bp, Artificial Sequence
  chemically synthesized
ttggctgttatgaataagatgc

SEQ ID NO: 930671 - DNA, 22 bp, Artificial Sequence
  chemically synthesized
agtttttggctgttatgaataa

SEQ ID NO: 930672 - DNA, 22 bp, Artificial Sequence
  chemically synthesized
cagtttttggctgttatgaata

SEQ ID NO: 930673 - DNA, 22 bp, Artificial Sequence
  chemically synthesized
tcagtttttggctgttatgaat

SEQ ID NO: 930674 - DNA, 22 bp, Artificial Sequence
  chemically synthesized
aggtggttttcagtttttggct

SEQ ID NO: 930675 - DNA, 22 bp, Artificial Sequence
  chemically synthesized
attcataacagccaaaaactga

SEQ ID NO: 930676 - DNA, 22 bp, Artificial Sequence
  chemically synthesized
ttcataacagccaaaaactgaa

SEQ ID NO: 930677 - DNA, 22 bp, Artificial Sequence
  chemically synthesized
ataacagccaaaaactgaaaac

SEQ ID NO: 930678 - DNA, 22 bp, Artificial Sequence
  chemically synthesized
atggacattcaggtggttttca

SEQ ID NO: 930679 - DNA, 22 bp, Artificial Sequence
  chemically synthesized
gatggacattcaggtggttttc

SEQ ID NO: 930680 - DNA, 22 bp, Artificial Sequence
  chemically synthesized
tgatggacattcaggtggtttt

SEQ ID NO: 930681 - DNA, 22 bp, Artificial Sequence
  chemically synthesized
ttgatggacattcaggtggttt

SEQ ID NO: 930682 - DNA, 22 bp, Artificial Sequence
  chemically synthesized
cttttgatggacattcaggtgg

SEQ ID NO: 930683 - DNA, 22 bp, Artificial Sequence
  chemically synthesized
tccttttgatggacattcaggt

SEQ ID NO: 930684 - DNA, 22 bp, Artificial Sequence
  chemically synthesized
ttctccttttgatggacattca

SEQ ID NO: 930685 - DNA, 22 bp, Artificial Sequence
  chemically synthesized
aaaaccacctgaatgtccatca

SEQ ID NO: 930686 - DNA, 22 bp, Artificial Sequence
  chemically synthesized
tctattctccttttgatggaca

SEQ ID NO: 930687 - DNA, 22 bp, Artificial Sequence
  chemically synthesized
atctattctccttttgatggac

SEQ ID NO: 930688 - DNA, 22 bp, Artificial Sequence
  chemically synthesized
tttatctattctccttttgatg

SEQ ID NO: 930689 - DNA, 22 bp, Artificial Sequence
  chemically synthesized
atttatctattctccttttgat

SEQ ID NO: 930690 - DNA, 22 bp, Artificial Sequence
  chemically synthesized
aatgtccatcaaaaggagaata

SEQ ID NO: 930691 - DNA, 22 bp, Artificial Sequence
  chemically synthesized
tatagatataccacaatttatt

SEQ ID NO: 930692 - DNA, 22 bp, Artificial Sequence
  chemically synthesized
ttgtatagatataccacaattt

SEQ ID NO: 930693 - DNA, 22 bp, Artificial Sequence
  chemically synthesized
tattgtatagatataccacaat

SEQ ID NO: 930694 - DNA, 22 bp, Artificial Sequence
  chemically synthesized
atattctattgtatagatatac

SEQ ID NO: 930695 - DNA, 22 bp, Artificial Sequence
  chemically synthesized
atgattaatattctattgtata

SEQ ID NO: 930696 - DNA, 22 bp, Artificial Sequence
  chemically synthesized
tggtatatctatacaatagaat

SEQ ID NO: 930697 - DNA, 22 bp, Artificial Sequence
  chemically synthesized
ttgatgattaatattctattgt

SEQ ID NO: 930698 - DNA, 22 bp, Artificial Sequence
  chemically synthesized
attgatgattaatattctattg

SEQ ID NO: 930699 - DNA, 22 bp, Artificial Sequence
  chemically synthesized
tattgatgattaatattctatt

SEQ ID NO: 930700 - DNA, 22 bp, Artificial Sequence
  chemically synthesized
ctttattgatgattaatattct

SEQ ID NO: 930701 - DNA, 22 bp, Artificial Sequence
  chemically synthesized
attcctttattgatgattaata

SEQ ID NO: 930702 - DNA, 22 bp, Artificial Sequence
  chemically synthesized
tacaatagaatattaatcatca

SEQ ID NO: 930703 - DNA, 22 bp, Artificial Sequence
  chemically synthesized
ttcattcctttattgatgatta

SEQ ID NO: 930704 - DNA, 22 bp, Artificial Sequence
  chemically synthesized
atcatcaataaaggaatgaaca

SEQ ID NO: 930705 - DNA, 22 bp, Artificial Sequence
  chemically synthesized
atccatgtaagtgtatcagctg

SEQ ID NO: 930706 - DNA, 22 bp, Artificial Sequence
  chemically synthesized
agattcatccatgtaagtgtat

SEQ ID NO: 930707 - DNA, 22 bp, Artificial Sequence
  chemically synthesized
gagattcatccatgtaagtgta

SEQ ID NO: 930708 - DNA, 22 bp, Artificial Sequence
  chemically synthesized
tgagattcatccatgtaagtgt

SEQ ID NO: 930709 - DNA, 22 bp, Artificial Sequence
  chemically synthesized
ttgagattcatccatgtaagtg

SEQ ID NO: 930710 - DNA, 22 bp, Artificial Sequence
  chemically synthesized
cttttgagattcatccatgtaa

SEQ ID NO: 930711 - DNA, 22 bp, Artificial Sequence
  chemically synthesized
atacacttacatggatgaatct

SEQ ID NO: 930712 - DNA, 22 bp, Artificial Sequence
  chemically synthesized
atcagcatactacttttgagat

SEQ ID NO: 930713 - DNA, 22 bp, Artificial Sequence
  chemically synthesized
gatcagcatactacttttgaga

SEQ ID NO: 930714 - DNA, 22 bp, Artificial Sequence
  chemically synthesized
acatggatgaatctcaaaagta

SEQ ID NO: 930715 - DNA, 22 bp, Artificial Sequence
  chemically synthesized
tgatcagcatactacttttgag

SEQ ID NO: 930716 - DNA, 22 bp, Artificial Sequence
  chemically synthesized
catggatgaatctcaaaagtag

SEQ ID NO: 930717 - DNA, 22 bp, Artificial Sequence
  chemically synthesized
ttttgatcagcatactactttt

SEQ ID NO: 930718 - DNA, 22 bp, Artificial Sequence
  chemically synthesized
aaaagtagtatgctgatcaaaa

SEQ ID NO: 930719 - DNA, 22 bp, Artificial Sequence
  chemically synthesized
atcaaaatagtacattttgtat

SEQ ID NO: 930720 - DNA, 22 bp, Artificial Sequence
  chemically synthesized
tataaatgaaatcatacaaaat

SEQ ID NO: 930721 - DNA, 22 bp, Artificial Sequence
  chemically synthesized
gtataaatgaaatcatacaaaa

SEQ ID NO: 930722 - DNA, 22 bp, Artificial Sequence
  chemically synthesized
aaaatttgtataaatgaaatca

SEQ ID NO: 930723 - DNA, 22 bp, Artificial Sequence
  chemically synthesized
aaaaatttgtataaatgaaatc

SEQ ID NO: 930724 - DNA, 22 bp, Artificial Sequence
  chemically synthesized
taaaaatttgtataaatgaaat

SEQ ID NO: 930725 - DNA, 22 bp, Artificial Sequence
  chemically synthesized
ttaaaaatttgtataaatgaaa

SEQ ID NO: 930726 - DNA, 22 bp, Artificial Sequence
  chemically synthesized
tttaaaaatttgtataaatgaa

SEQ ID NO: 930727 - DNA, 22 bp, Artificial Sequence
  chemically synthesized
tgtatgatttcatttatacaaa

SEQ ID NO: 930728 - DNA, 22 bp, Artificial Sequence
  chemically synthesized
tctttttaaaaatttgtataaa

SEQ ID NO: 930729 - DNA, 22 bp, Artificial Sequence
  chemically synthesized
gtatgatttcatttatacaaat

SEQ ID NO: 930730 - DNA, 22 bp, Artificial Sequence
  chemically synthesized
gtctttttaaaaatttgtataa

SEQ ID NO: 930731 - DNA, 22 bp, Artificial Sequence
  chemically synthesized
tatgatttcatttatacaaatt

SEQ ID NO: 930732 - DNA, 22 bp, Artificial Sequence
  chemically synthesized
tgtctttttaaaaatttgtata

SEQ ID NO: 930733 - DNA, 22 bp, Artificial Sequence
  chemically synthesized
gttttgtctttttaaaaatttg

SEQ ID NO: 930734 - DNA, 22 bp, Artificial Sequence
  chemically synthesized
catttatacaaatttttaaaaa

SEQ ID NO: 930735 - DNA, 22 bp, Artificial Sequence
  chemically synthesized
atttatacaaatttttaaaaag

SEQ ID NO: 930736 - DNA, 22 bp, Artificial Sequence
  chemically synthesized
atacaaatttttaaaaagacaa

SEQ ID NO: 930737 - DNA, 22 bp, Artificial Sequence
  chemically synthesized
tacaaatttttaaaaagacaaa

SEQ ID NO: 930738 - DNA, 22 bp, Artificial Sequence
  chemically synthesized
tatcaccatagattagttttgt

SEQ ID NO: 930739 - DNA, 22 bp, Artificial Sequence
  chemically synthesized
atatcaccatagattagttttg

SEQ ID NO: 930740 - DNA, 22 bp, Artificial Sequence
  chemically synthesized
ttaaaaagacaaaactaatcta

SEQ ID NO: 930741 - DNA, 22 bp, Artificial Sequence
  chemically synthesized
taaaaagacaaaactaatctat

SEQ ID NO: 930742 - DNA, 22 bp, Artificial Sequence
  chemically synthesized
atttatatcaccatagattagt

SEQ ID NO: 930743 - DNA, 22 bp, Artificial Sequence
  chemically synthesized
aaaaagacaaaactaatctatg

SEQ ID NO: 930744 - DNA, 22 bp, Artificial Sequence
  chemically synthesized
aaaagacaaaactaatctatgg

SEQ ID NO: 930745 - DNA, 22 bp, Artificial Sequence
  chemically synthesized
tgatttatatcaccatagatta

SEQ ID NO: 930746 - DNA, 22 bp, Artificial Sequence
  chemically synthesized
ctgatttatatcaccatagatt

SEQ ID NO: 930747 - DNA, 22 bp, Artificial Sequence
  chemically synthesized
ttctgatttatatcaccataga

SEQ ID NO: 930748 - DNA, 22 bp, Artificial Sequence
  chemically synthesized
ttcttctgatttatatcaccat

SEQ ID NO: 930749 - DNA, 22 bp, Artificial Sequence
  chemically synthesized
atctatggtgatataaatcaga

SEQ ID NO: 930750 - DNA, 22 bp, Artificial Sequence
  chemically synthesized
tggtgatataaatcagaagaat

SEQ ID NO: 930751 - DNA, 22 bp, Artificial Sequence
  chemically synthesized
ccagccccaataggcacctatt

SEQ ID NO: 930752 - DNA, 22 bp, Artificial Sequence
  chemically synthesized
cagtcaattcccagccccaata

SEQ ID NO: 930753 - DNA, 22 bp, Artificial Sequence
  chemically synthesized
ccagtcaattcccagccccaat

SEQ ID NO: 930754 - DNA, 22 bp, Artificial Sequence
  chemically synthesized
ccttccagtcaattcccagccc

SEQ ID NO: 930755 - DNA, 22 bp, Artificial Sequence
  chemically synthesized
atgctaccttccagtcaattcc

SEQ ID NO: 930756 - DNA, 22 bp, Artificial Sequence
  chemically synthesized
catgctaccttccagtcaattc

SEQ ID NO: 930757 - DNA, 22 bp, Artificial Sequence
  chemically synthesized
tcatgctaccttccagtcaatt

SEQ ID NO: 930758 - DNA, 22 bp, Artificial Sequence
  chemically synthesized
ttggggctgggaattgactgga

SEQ ID NO: 930759 - DNA, 22 bp, Artificial Sequence
  chemically synthesized
ttcatgctaccttccagtcaat

SEQ ID NO: 930760 - DNA, 22 bp, Artificial Sequence
  chemically synthesized
tttcatgctaccttccagtcaa

SEQ ID NO: 930761 - DNA, 22 bp, Artificial Sequence
  chemically synthesized
gggctgggaattgactggaagg

SEQ ID NO: 930762 - DNA, 22 bp, Artificial Sequence
  chemically synthesized
ggaattgactggaaggtagcat

SEQ ID NO: 930763 - DNA, 22 bp, Artificial Sequence
  chemically synthesized
agaaagctttttcatgctacct

SEQ ID NO: 930764 - DNA, 22 bp, Artificial Sequence
  chemically synthesized
cctcagaaagctttttcatgct

SEQ ID NO: 930765 - DNA, 22 bp, Artificial Sequence
  chemically synthesized
actggaaggtagcatgaaaaag

SEQ ID NO: 930766 - DNA, 22 bp, Artificial Sequence
  chemically synthesized
cattacctcagaaagctttttc

SEQ ID NO: 930767 - DNA, 22 bp, Artificial Sequence
  chemically synthesized
gaaggtagcatgaaaaagcttt

SEQ ID NO: 930768 - DNA, 22 bp, Artificial Sequence
  chemically synthesized
ccattacctcagaaagcttttt

SEQ ID NO: 930769 - DNA, 22 bp, Artificial Sequence
  chemically synthesized
aataaaataaaaatttccatta

SEQ ID NO: 930770 - DNA, 22 bp, Artificial Sequence
  chemically synthesized
tctgaggtaatggaaattttta

SEQ ID NO: 930771 - DNA, 22 bp, Artificial Sequence
  chemically synthesized
ctgaggtaatggaaatttttat

SEQ ID NO: 930772 - DNA, 22 bp, Artificial Sequence
  chemically synthesized
tgaggtaatggaaatttttatt

SEQ ID NO: 930773 - DNA, 22 bp, Artificial Sequence
  chemically synthesized
aggtaatggaaatttttatttt

SEQ ID NO: 930774 - DNA, 22 bp, Artificial Sequence
  chemically synthesized
ataaagtgacacctcaataaaa

SEQ ID NO: 930775 - DNA, 22 bp, Artificial Sequence
  chemically synthesized
ttattttattgaggtgtcactt

SEQ ID NO: 930776 - DNA, 22 bp, Artificial Sequence
  chemically synthesized
tattttattgaggtgtcacttt

SEQ ID NO: 930777 - DNA, 22 bp, Artificial Sequence
  chemically synthesized
attttattgaggtgtcacttta

SEQ ID NO: 930778 - DNA, 22 bp, Artificial Sequence
  chemically synthesized
ttttattgaggtgtcactttat

SEQ ID NO: 930779 - DNA, 22 bp, Artificial Sequence
  chemically synthesized
tattgaggtgtcactttatcag

SEQ ID NO: 930780 - DNA, 22 bp, Artificial Sequence
  chemically synthesized
attgaggtgtcactttatcagt

SEQ ID NO: 930781 - DNA, 22 bp, Artificial Sequence
  chemically synthesized
tgaagtggtcccactgataaag

SEQ ID NO: 930782 - DNA, 22 bp, Artificial Sequence
  chemically synthesized
ttgaggtgtcactttatcagtg

SEQ ID NO: 930783 - DNA, 22 bp, Artificial Sequence
  chemically synthesized
gtgaagtggtcccactgataaa

SEQ ID NO: 930784 - DNA, 22 bp, Artificial Sequence
  chemically synthesized
tgtgaagtggtcccactgataa

SEQ ID NO: 930785 - DNA, 22 bp, Artificial Sequence
  chemically synthesized
ttgtgaagtggtcccactgata

SEQ ID NO: 930786 - DNA, 22 bp, Artificial Sequence
  chemically synthesized
aggtgtcactttatcagtggga

SEQ ID NO: 930787 - DNA, 22 bp, Artificial Sequence
  chemically synthesized
acttttgtgaagtggtcccact

SEQ ID NO: 930788 - DNA, 22 bp, Artificial Sequence
  chemically synthesized
ttaacttttgtgaagtggtccc

SEQ ID NO: 930789 - DNA, 22 bp, Artificial Sequence
  chemically synthesized
tatcagtgggaccacttcacaa

SEQ ID NO: 930790 - DNA, 22 bp, Artificial Sequence
  chemically synthesized
atcagtgggaccacttcacaaa

SEQ ID NO: 930791 - DNA, 22 bp, Artificial Sequence
  chemically synthesized
aatctgttaacttttgtgaagt

SEQ ID NO: 930792 - DNA, 22 bp, Artificial Sequence
  chemically synthesized
tcagtgggaccacttcacaaaa

SEQ ID NO: 930793 - DNA, 22 bp, Artificial Sequence
  chemically synthesized
aatgctcaatctgttaactttt

SEQ ID NO: 930794 - DNA, 22 bp, Artificial Sequence
  chemically synthesized
cacaaaagttaacagattgagc

SEQ ID NO: 930795 - DNA, 22 bp, Artificial Sequence
  chemically synthesized
acaaaagttaacagattgagca

SEQ ID NO: 930796 - DNA, 22 bp, Artificial Sequence
  chemically synthesized
gtaaagatattaaatgctcaat

SEQ ID NO: 930797 - DNA, 22 bp, Artificial Sequence
  chemically synthesized
acagattgagcatttaatatct

SEQ ID NO: 930798 - DNA, 22 bp, Artificial Sequence
  chemically synthesized
agcatttaatatctttactaac

SEQ ID NO: 930799 - DNA, 22 bp, Artificial Sequence
  chemically synthesized
tggcaggtgtataagttagtaa

SEQ ID NO: 930800 - DNA, 22 bp, Artificial Sequence
  chemically synthesized
aatatctttactaacttataca

SEQ ID NO: 930801 - DNA, 22 bp, Artificial Sequence
  chemically synthesized
tactgtggcaggtgtataagtt

SEQ ID NO: 930802 - DNA, 22 bp, Artificial Sequence
  chemically synthesized
atatctttactaacttatacac

SEQ ID NO: 930803 - DNA, 22 bp, Artificial Sequence
  chemically synthesized
atactgtggcaggtgtataagt

SEQ ID NO: 930804 - DNA, 22 bp, Artificial Sequence
  chemically synthesized
tactaacttatacacctgccac

SEQ ID NO: 930805 - DNA, 22 bp, Artificial Sequence
  chemically synthesized
actaacttatacacctgccaca

SEQ ID NO: 930806 - DNA, 22 bp, Artificial Sequence
  chemically synthesized
ctaacttatacacctgccacag

SEQ ID NO: 930807 - DNA, 22 bp, Artificial Sequence
  chemically synthesized
acttatacacctgccacagtat

SEQ ID NO: 930808 - DNA, 22 bp, Artificial Sequence
  chemically synthesized
atacacctgccacagtataagt

SEQ ID NO: 930809 - DNA, 22 bp, Artificial Sequence
  chemically synthesized
ggtgtgacagtaacttatactg

SEQ ID NO: 930810 - DNA, 22 bp, Artificial Sequence
  chemically synthesized
tacacctgccacagtataagtt

SEQ ID NO: 930811 - DNA, 22 bp, Artificial Sequence
  chemically synthesized
ctgggtgtgacagtaacttata

SEQ ID NO: 930812 - DNA, 22 bp, Artificial Sequence
  chemically synthesized
actgggtgtgacagtaacttat

SEQ ID NO: 930813 - DNA, 22 bp, Artificial Sequence
  chemically synthesized
ttactgggtgtgacagtaactt

SEQ ID NO: 930814 - DNA, 22 bp, Artificial Sequence
  chemically synthesized
cttactgggtgtgacagtaact

SEQ ID NO: 930815 - DNA, 22 bp, Artificial Sequence
  chemically synthesized
tcttactgggtgtgacagtaac

SEQ ID NO: 930816 - DNA, 22 bp, Artificial Sequence
  chemically synthesized
ccacagtataagttactgtcac

SEQ ID NO: 930817 - DNA, 22 bp, Artificial Sequence
  chemically synthesized
cacgctttcttactgggtgtga

SEQ ID NO: 930818 - DNA, 22 bp, Artificial Sequence
  chemically synthesized
ccacgctttcttactgggtgtg

SEQ ID NO: 930819 - DNA, 22 bp, Artificial Sequence
  chemically synthesized
tccacgctttcttactgggtgt

SEQ ID NO: 930820 - DNA, 22 bp, Artificial Sequence
  chemically synthesized
ctgtcacacccagtaagaaagc

SEQ ID NO: 930821 - DNA, 22 bp, Artificial Sequence
  chemically synthesized
atatattttccacgctttctta

SEQ ID NO: 930822 - DNA, 22 bp, Artificial Sequence
  chemically synthesized
tcacacccagtaagaaagcgtg

SEQ ID NO: 930823 - DNA, 22 bp, Artificial Sequence
  chemically synthesized
ccatctaatatattttccacgc

SEQ ID NO: 930824 - DNA, 22 bp, Artificial Sequence
  chemically synthesized
tgccatctaatatattttccac

SEQ ID NO: 930825 - DNA, 22 bp, Artificial Sequence
  chemically synthesized
agattctgccatctaatatatt

SEQ ID NO: 930826 - DNA, 22 bp, Artificial Sequence
  chemically synthesized
tataatattcagattctgccat

SEQ ID NO: 930827 - DNA, 22 bp, Artificial Sequence
  chemically synthesized
gtataatattcagattctgcca

SEQ ID NO: 930828 - DNA, 22 bp, Artificial Sequence
  chemically synthesized
tgtataatattcagattctgcc

SEQ ID NO: 930829 - DNA, 22 bp, Artificial Sequence
  chemically synthesized
gatggcagaatctgaatattat

SEQ ID NO: 930830 - DNA, 22 bp, Artificial Sequence
  chemically synthesized
tcaagatactttgtataatatt

SEQ ID NO: 930831 - DNA, 22 bp, Artificial Sequence
  chemically synthesized
aatctgtcaagatactttgtat

SEQ ID NO: 930832 - DNA, 22 bp, Artificial Sequence
  chemically synthesized
caatctgtcaagatactttgta

SEQ ID NO: 930833 - DNA, 22 bp, Artificial Sequence
  chemically synthesized
aatattatacaaagtatcttga

SEQ ID NO: 930834 - DNA, 22 bp, Artificial Sequence
  chemically synthesized
agaacttcaatctgtcaagata

SEQ ID NO: 930835 - DNA, 22 bp, Artificial Sequence
  chemically synthesized
gttgagaacttcaatctgtcaa

SEQ ID NO: 930836 - DNA, 22 bp, Artificial Sequence
  chemically synthesized
tacaaagtatcttgacagattg

SEQ ID NO: 930837 - DNA, 22 bp, Artificial Sequence
  chemically synthesized
agttgagaacttcaatctgtca

SEQ ID NO: 930838 - DNA, 22 bp, Artificial Sequence
  chemically synthesized
tcatatttagttgagaacttca

SEQ ID NO: 930839 - DNA, 22 bp, Artificial Sequence
  chemically synthesized
gacagattgaagttctcaacta

SEQ ID NO: 930840 - DNA, 22 bp, Artificial Sequence
  chemically synthesized
acagattgaagttctcaactaa

SEQ ID NO: 930841 - DNA, 22 bp, Artificial Sequence
  chemically synthesized
aacctgtcatatttagttgaga

SEQ ID NO: 930842 - DNA, 22 bp, Artificial Sequence
  chemically synthesized
caacctgtcatatttagttgag

SEQ ID NO: 930843 - DNA, 22 bp, Artificial Sequence
  chemically synthesized
aagttctcaactaaatatgaca

SEQ ID NO: 930844 - DNA, 22 bp, Artificial Sequence
  chemically synthesized
cataacatttcaacctgtcata

SEQ ID NO: 930845 - DNA, 22 bp, Artificial Sequence
  chemically synthesized
acataacatttcaacctgtcat

SEQ ID NO: 930846 - DNA, 22 bp, Artificial Sequence
  chemically synthesized
tcaactaaatatgacaggttga

SEQ ID NO: 930847 - DNA, 22 bp, Artificial Sequence
  chemically synthesized
ttacataacatttcaacctgtc

SEQ ID NO: 930848 - DNA, 22 bp, Artificial Sequence
  chemically synthesized
aactaaatatgacaggttgaaa

SEQ ID NO: 930849 - DNA, 22 bp, Artificial Sequence
  chemically synthesized
ttcttacataacatttcaacct

SEQ ID NO: 930850 - DNA, 22 bp, Artificial Sequence
  chemically synthesized
gttcttacataacatttcaacc

SEQ ID NO: 930851 - DNA, 22 bp, Artificial Sequence
  chemically synthesized
aatatgacaggttgaaatgtta

SEQ ID NO: 930852 - DNA, 22 bp, Artificial Sequence
  chemically synthesized
aaatgttatgtaagaacaaact

SEQ ID NO: 930853 - DNA, 22 bp, Artificial Sequence
  chemically synthesized
ggagaggaggaagagtttgttc

SEQ ID NO: 930854 - DNA, 22 bp, Artificial Sequence
  chemically synthesized
gggagaggaggaagagtttgtt

SEQ ID NO: 930855 - DNA, 22 bp, Artificial Sequence
  chemically synthesized
tttgggagaggaggaagagttt

SEQ ID NO: 930856 - DNA, 22 bp, Artificial Sequence
  chemically synthesized
atttgggagaggaggaagagtt

SEQ ID NO: 930857 - DNA, 22 bp, Artificial Sequence
  chemically synthesized
tgtaagaacaaactcttcctcc

SEQ ID NO: 930858 - DNA, 22 bp, Artificial Sequence
  chemically synthesized
ttcctcctctcccaaataagtc

SEQ ID NO: 930859 - DNA, 22 bp, Artificial Sequence
  chemically synthesized
cctcctctcccaaataagtctg

SEQ ID NO: 930860 - DNA, 22 bp, Artificial Sequence
  chemically synthesized
tataagatgaaacagacttatt

SEQ ID NO: 930861 - DNA, 22 bp, Artificial Sequence
  chemically synthesized
ctcctctcccaaataagtctgt

SEQ ID NO: 930862 - DNA, 22 bp, Artificial Sequence
  chemically synthesized
atataagatgaaacagacttat

SEQ ID NO: 930863 - DNA, 22 bp, Artificial Sequence
  chemically synthesized
tatataagatgaaacagactta

SEQ ID NO: 930864 - DNA, 22 bp, Artificial Sequence
  chemically synthesized
ctctcccaaataagtctgtttc

SEQ ID NO: 930865 - DNA, 22 bp, Artificial Sequence
  chemically synthesized
tcccaaataagtctgtttcatc

SEQ ID NO: 930866 - DNA, 22 bp, Artificial Sequence
  chemically synthesized
ccaaataagtctgtttcatctt

SEQ ID NO: 930867 - DNA, 22 bp, Artificial Sequence
  chemically synthesized
aggtaaaattttatataagatg

SEQ ID NO: 930868 - DNA, 22 bp, Artificial Sequence
  chemically synthesized
attgaggtaaaattttatataa

SEQ ID NO: 930869 - DNA, 22 bp, Artificial Sequence
  chemically synthesized
aattgaggtaaaattttatata

SEQ ID NO: 930870 - DNA, 22 bp, Artificial Sequence
  chemically synthesized
ttaattgaggtaaaattttata

SEQ ID NO: 930871 - DNA, 22 bp, Artificial Sequence
  chemically synthesized
cttaattgaggtaaaattttat

SEQ ID NO: 930872 - DNA, 22 bp, Artificial Sequence
  chemically synthesized
tttcatcttatataaaatttta

SEQ ID NO: 930873 - DNA, 22 bp, Artificial Sequence
  chemically synthesized
tttcttaattgaggtaaaattt

SEQ ID NO: 930874 - DNA, 22 bp, Artificial Sequence
  chemically synthesized
catcttatataaaattttacct

SEQ ID NO: 930875 - DNA, 22 bp, Artificial Sequence
  chemically synthesized
atttcttaattgaggtaaaatt

SEQ ID NO: 930876 - DNA, 22 bp, Artificial Sequence
  chemically synthesized
atcttatataaaattttacctc

SEQ ID NO: 930877 - DNA, 22 bp, Artificial Sequence
  chemically synthesized
tatttcttaattgaggtaaaat

SEQ ID NO: 930878 - DNA, 22 bp, Artificial Sequence
  chemically synthesized
ttatttcttaattgaggtaaaa

SEQ ID NO: 930879 - DNA, 22 bp, Artificial Sequence
  chemically synthesized
tttttatttcttaattgaggta

SEQ ID NO: 930880 - DNA, 22 bp, Artificial Sequence
  chemically synthesized
atataaaattttacctcaatta

SEQ ID NO: 930881 - DNA, 22 bp, Artificial Sequence
  chemically synthesized
tataaaattttacctcaattaa

SEQ ID NO: 930882 - DNA, 22 bp, Artificial Sequence
  chemically synthesized
tacctcaattaagaaataaaaa

SEQ ID NO: 930883 - DNA, 22 bp, Artificial Sequence
  chemically synthesized
aaaatgatattgtttttatttc

SEQ ID NO: 930884 - DNA, 22 bp, Artificial Sequence
  chemically synthesized
acctcaattaagaaataaaaac

SEQ ID NO: 930885 - DNA, 22 bp, Artificial Sequence
  chemically synthesized
cctcaattaagaaataaaaaca

SEQ ID NO: 930886 - DNA, 22 bp, Artificial Sequence
  chemically synthesized
aattaagaaataaaaacaatat

SEQ ID NO: 930887 - DNA, 22 bp, Artificial Sequence
  chemically synthesized
agaaataaaaacaatatcattt

SEQ ID NO: 930888 - DNA, 22 bp, Artificial Sequence
  chemically synthesized
tgtaagtaaggagagcagttaa

SEQ ID NO: 930889 - DNA, 22 bp, Artificial Sequence
  chemically synthesized
aggtattgtgtaagtaaggaga

SEQ ID NO: 930890 - DNA, 22 bp, Artificial Sequence
  chemically synthesized
ttaactgctctccttacttaca

SEQ ID NO: 930891 - DNA, 22 bp, Artificial Sequence
  chemically synthesized
taactgctctccttacttacac

SEQ ID NO: 930892 - DNA, 22 bp, Artificial Sequence
  chemically synthesized
aactgctctccttacttacaca

SEQ ID NO: 930893 - DNA, 22 bp, Artificial Sequence
  chemically synthesized
actgctctccttacttacacaa

SEQ ID NO: 930894 - DNA, 22 bp, Artificial Sequence
  chemically synthesized
gcatggctaaggtattgtgtaa

SEQ ID NO: 930895 - DNA, 22 bp, Artificial Sequence
  chemically synthesized
ctctccttacttacacaatacc

SEQ ID NO: 930896 - DNA, 22 bp, Artificial Sequence
  chemically synthesized
ttagcatggctaaggtattgtg

SEQ ID NO: 930897 - DNA, 22 bp, Artificial Sequence
  chemically synthesized
tccttacttacacaatacctta

SEQ ID NO: 930898 - DNA, 22 bp, Artificial Sequence
  chemically synthesized
cttacttacacaataccttagc

SEQ ID NO: 930899 - DNA, 22 bp, Artificial Sequence
  chemically synthesized
attgttagcatggctaaggtat

SEQ ID NO: 930900 - DNA, 22 bp, Artificial Sequence
  chemically synthesized
acttacacaataccttagccat

SEQ ID NO: 930901 - DNA, 22 bp, Artificial Sequence
  chemically synthesized
cttacacaataccttagccatg

SEQ ID NO: 930902 - DNA, 22 bp, Artificial Sequence
  chemically synthesized
acacaataccttagccatgcta

SEQ ID NO: 930903 - DNA, 22 bp, Artificial Sequence
  chemically synthesized
cacaataccttagccatgctaa

SEQ ID NO: 930904 - DNA, 22 bp, Artificial Sequence
  chemically synthesized
gatgccctgattgttagcatgg

SEQ ID NO: 930905 - DNA, 22 bp, Artificial Sequence
  chemically synthesized
ctggatgccctgattgttagca

SEQ ID NO: 930906 - DNA, 22 bp, Artificial Sequence
  chemically synthesized
gctggatgccctgattgttagc

SEQ ID NO: 930907 - DNA, 22 bp, Artificial Sequence
  chemically synthesized
gatttgctggatgccctgattg

SEQ ID NO: 930908 - DNA, 22 bp, Artificial Sequence
  chemically synthesized
agccatgctaacaatcagggca

SEQ ID NO: 930909 - DNA, 22 bp, Artificial Sequence
  chemically synthesized
agatttgctggatgccctgatt

SEQ ID NO: 930910 - DNA, 22 bp, Artificial Sequence
  chemically synthesized
gccatgctaacaatcagggcat

SEQ ID NO: 930911 - DNA, 22 bp, Artificial Sequence
  chemically synthesized
acaatcagggcatccagcaaat

SEQ ID NO: 930912 - DNA, 22 bp, Artificial Sequence
  chemically synthesized
tgtgaagtaagagagagaaagt

SEQ ID NO: 930913 - DNA, 22 bp, Artificial Sequence
  chemically synthesized
agtactttctctctcttacttc

SEQ ID NO: 930914 - DNA, 22 bp, Artificial Sequence
  chemically synthesized
tctctctcttacttcacacagt

SEQ ID NO: 930915 - DNA, 22 bp, Artificial Sequence
  chemically synthesized
ctctctcttacttcacacagta

SEQ ID NO: 930916 - DNA, 22 bp, Artificial Sequence
  chemically synthesized
tctctcttacttcacacagtac

SEQ ID NO: 930917 - DNA, 22 bp, Artificial Sequence
  chemically synthesized
tctcttacttcacacagtacat

SEQ ID NO: 930918 - DNA, 22 bp, Artificial Sequence
  chemically synthesized
tcttacttcacacagtacatat

SEQ ID NO: 930919 - DNA, 22 bp, Artificial Sequence
  chemically synthesized
ttacttcacacagtacatatgg

SEQ ID NO: 930920 - DNA, 22 bp, Artificial Sequence
  chemically synthesized
cataagaagggtccatatgtac

SEQ ID NO: 930921 - DNA, 22 bp, Artificial Sequence
  chemically synthesized
gcataagaagggtccatatgta

SEQ ID NO: 930922 - DNA, 22 bp, Artificial Sequence
  chemically synthesized
acttcacacagtacatatggac

SEQ ID NO: 930923 - DNA, 22 bp, Artificial Sequence
  chemically synthesized
cttcacacagtacatatggacc

SEQ ID NO: 930924 - DNA, 22 bp, Artificial Sequence
  chemically synthesized
ttgcataagaagggtccatatg

SEQ ID NO: 930925 - DNA, 22 bp, Artificial Sequence
  chemically synthesized
cttgcataagaagggtccatat

SEQ ID NO: 930926 - DNA, 22 bp, Artificial Sequence
  chemically synthesized
tcttgcataagaagggtccata

SEQ ID NO: 930927 - DNA, 22 bp, Artificial Sequence
  chemically synthesized
cacacagtacatatggaccctt

SEQ ID NO: 930928 - DNA, 22 bp, Artificial Sequence
  chemically synthesized
acacagtacatatggacccttc

SEQ ID NO: 930929 - DNA, 22 bp, Artificial Sequence
  chemically synthesized
ttttcttgcataagaagggtcc

SEQ ID NO: 930930 - DNA, 22 bp, Artificial Sequence
  chemically synthesized
gttgttttcttgcataagaagg

SEQ ID NO: 930931 - DNA, 22 bp, Artificial Sequence
  chemically synthesized
agttagttgttttcttgcataa

SEQ ID NO: 930932 - DNA, 22 bp, Artificial Sequence
  chemically synthesized
cagttagttgttttcttgcata

SEQ ID NO: 930933 - DNA, 22 bp, Artificial Sequence
  chemically synthesized
tttcagttagttgttttcttgc

SEQ ID NO: 930934 - DNA, 22 bp, Artificial Sequence
  chemically synthesized
cttatgcaagaaaacaactaac

SEQ ID NO: 930935 - DNA, 22 bp, Artificial Sequence
  chemically synthesized
ttatgcaagaaaacaactaact

SEQ ID NO: 930936 - DNA, 22 bp, Artificial Sequence
  chemically synthesized
atgcaagaaaacaactaactga

SEQ ID NO: 930937 - DNA, 22 bp, Artificial Sequence
  chemically synthesized
tgcaagaaaacaactaactgaa

SEQ ID NO: 930938 - DNA, 22 bp, Artificial Sequence
  chemically synthesized
gcaatcagcctatttcagttag

SEQ ID NO: 930939 - DNA, 22 bp, Artificial Sequence
  chemically synthesized
ggcaatcagcctatttcagtta

SEQ ID NO: 930940 - DNA, 22 bp, Artificial Sequence
  chemically synthesized
aggtttggcaatcagcctattt

SEQ ID NO: 930941 - DNA, 22 bp, Artificial Sequence
  chemically synthesized
actgaaataggctgattgccaa

SEQ ID NO: 930942 - DNA, 22 bp, Artificial Sequence
  chemically synthesized
caaatgactgaggtttggcaat

SEQ ID NO: 930943 - DNA, 22 bp, Artificial Sequence
  chemically synthesized
aaataggctgattgccaaacct

SEQ ID NO: 930944 - DNA, 22 bp, Artificial Sequence
  chemically synthesized
tctgcaaatgactgaggtttgg

SEQ ID NO: 930945 - DNA, 22 bp, Artificial Sequence
  chemically synthesized
tgtctgcaaatgactgaggttt

SEQ ID NO: 930946 - DNA, 22 bp, Artificial Sequence
  chemically synthesized
aattctgtctgcaaatgactga

SEQ ID NO: 930947 - DNA, 22 bp, Artificial Sequence
  chemically synthesized
attgccaaacctcagtcatttg

SEQ ID NO: 930948 - DNA, 22 bp, Artificial Sequence
  chemically synthesized
aaattctgtctgcaaatgactg

SEQ ID NO: 930949 - DNA, 22 bp, Artificial Sequence
  chemically synthesized
taaattctgtctgcaaatgact

SEQ ID NO: 930950 - DNA, 22 bp, Artificial Sequence
  chemically synthesized
ttaaattctgtctgcaaatgac

SEQ ID NO: 930951 - DNA, 22 bp, Artificial Sequence
  chemically synthesized
ccaaacctcagtcatttgcaga

SEQ ID NO: 930952 - DNA, 22 bp, Artificial Sequence
  chemically synthesized
ttttaaattctgtctgcaaatg

SEQ ID NO: 930953 - DNA, 22 bp, Artificial Sequence
  chemically synthesized
aactcttttaaattctgtctgc

SEQ ID NO: 930954 - DNA, 22 bp, Artificial Sequence
  chemically synthesized
tgaactcttttaaattctgtct

SEQ ID NO: 930955 - DNA, 22 bp, Artificial Sequence
  chemically synthesized
ctgaactcttttaaattctgtc

SEQ ID NO: 930956 - DNA, 22 bp, Artificial Sequence
  chemically synthesized
agtcatttgcagacagaattta

SEQ ID NO: 930957 - DNA, 22 bp, Artificial Sequence
  chemically synthesized
gtcttctgaactcttttaaatt

SEQ ID NO: 930958 - DNA, 22 bp, Artificial Sequence
  chemically synthesized
gcagacagaatttaaaagagtt

SEQ ID NO: 930959 - DNA, 22 bp, Artificial Sequence
  chemically synthesized
attagtcttctgaactctttta

SEQ ID NO: 930960 - DNA, 22 bp, Artificial Sequence
  chemically synthesized
cagacagaatttaaaagagttc

SEQ ID NO: 930961 - DNA, 22 bp, Artificial Sequence
  chemically synthesized
tataacctgattagtcttctga

SEQ ID NO: 930962 - DNA, 22 bp, Artificial Sequence
  chemically synthesized
ctgtataacctgattagtcttc

SEQ ID NO: 930963 - DNA, 22 bp, Artificial Sequence
  chemically synthesized
aaaagagttcagaagactaatc

SEQ ID NO: 930964 - DNA, 22 bp, Artificial Sequence
  chemically synthesized
aaagagttcagaagactaatca

SEQ ID NO: 930965 - DNA, 22 bp, Artificial Sequence
  chemically synthesized
ttcctgtataacctgattagtc

SEQ ID NO: 930966 - DNA, 22 bp, Artificial Sequence
  chemically synthesized
agaagactaatcaggttataca

SEQ ID NO: 930967 - DNA, 22 bp, Artificial Sequence
  chemically synthesized
acgaagtctgttcctgtataac

SEQ ID NO: 930968 - DNA, 22 bp, Artificial Sequence
  chemically synthesized
atcaggttatacaggaacagac

SEQ ID NO: 930969 - DNA, 22 bp, Artificial Sequence
  chemically synthesized
atggttcacgaagtctgttcct

SEQ ID NO: 930970 - DNA, 22 bp, Artificial Sequence
  chemically synthesized
tacaggaacagacttcgtgaac

SEQ ID NO: 930971 - DNA, 22 bp, Artificial Sequence
  chemically synthesized
tataatatccctgatggttcac

SEQ ID NO: 930972 - DNA, 22 bp, Artificial Sequence
  chemically synthesized
cgtgaaccatcagggatattat

SEQ ID NO: 930973 - DNA, 22 bp, Artificial Sequence
  chemically synthesized
gtgaaccatcagggatattata

SEQ ID NO: 930974 - DNA, 22 bp, Artificial Sequence
  chemically synthesized
tgtgtggggataaaagggtgaa

SEQ ID NO: 930975 - DNA, 22 bp, Artificial Sequence
  chemically synthesized
tacaattcacccttttatcccc

SEQ ID NO: 930976 - DNA, 22 bp, Artificial Sequence
  chemically synthesized
atcattgtgtgtggggataaaa

SEQ ID NO: 930977 - DNA, 22 bp, Artificial Sequence
  chemically synthesized
aattgatcattgtgtgtgggga

SEQ ID NO: 930978 - DNA, 22 bp, Artificial Sequence
  chemically synthesized
acccttttatccccacacacaa

SEQ ID NO: 930979 - DNA, 22 bp, Artificial Sequence
  chemically synthesized
tctaaattgatcattgtgtgtg

SEQ ID NO: 930980 - DNA, 22 bp, Artificial Sequence
  chemically synthesized
ttatccccacacacaatgatca

SEQ ID NO: 930981 - DNA, 22 bp, Artificial Sequence
  chemically synthesized
tatccccacacacaatgatcaa

SEQ ID NO: 930982 - DNA, 22 bp, Artificial Sequence
  chemically synthesized
atccccacacacaatgatcaat

SEQ ID NO: 930983 - DNA, 22 bp, Artificial Sequence
  chemically synthesized
tagattgtctaaattgatcatt

SEQ ID NO: 930984 - DNA, 22 bp, Artificial Sequence
  chemically synthesized
tccccacacacaatgatcaatt

SEQ ID NO: 930985 - DNA, 22 bp, Artificial Sequence
  chemically synthesized
atagattgtctaaattgatcat

SEQ ID NO: 930986 - DNA, 22 bp, Artificial Sequence
  chemically synthesized
gtcttatagattgtctaaattg

SEQ ID NO: 930987 - DNA, 22 bp, Artificial Sequence
  chemically synthesized
actcgtcttatagattgtctaa

SEQ ID NO: 930988 - DNA, 22 bp, Artificial Sequence
  chemically synthesized
gactcgtcttatagattgtcta

SEQ ID NO: 930989 - DNA, 22 bp, Artificial Sequence
  chemically synthesized
agacaatctataagacgagtca

SEQ ID NO: 930990 - DNA, 22 bp, Artificial Sequence
  chemically synthesized
gacaatctataagacgagtcaa

SEQ ID NO: 930991 - DNA, 22 bp, Artificial Sequence
  chemically synthesized
aaagacagatgccacttgactc

SEQ ID NO: 930992 - DNA, 22 bp, Artificial Sequence
  chemically synthesized
ctgaaagacagatgccacttga

SEQ ID NO: 930993 - DNA, 22 bp, Artificial Sequence
  chemically synthesized
taagacgagtcaagtggcatct

SEQ ID NO: 930994 - DNA, 22 bp, Artificial Sequence
  chemically synthesized
tctttcaggaacacacgtgtgt

SEQ ID NO: 930995 - DNA, 22 bp, Artificial Sequence
  chemically synthesized
tcaggaacacacgtgtgtatgt

SEQ ID NO: 930996 - DNA, 22 bp, Artificial Sequence
  chemically synthesized
caggaacacacgtgtgtatgtg

SEQ ID NO: 930997 - DNA, 22 bp, Artificial Sequence
  chemically synthesized
aggaacacacgtgtgtatgtgg

SEQ ID NO: 930998 - DNA, 22 bp, Artificial Sequence
  chemically synthesized
ataaacatacacccccacatac

SEQ ID NO: 930999 - DNA, 22 bp, Artificial Sequence
  chemically synthesized
atctaataaacatacaccccca

SEQ ID NO: 931000 - DNA, 22 bp, Artificial Sequence
  chemically synthesized
aatctaataaacatacaccccc

SEQ ID NO: 931001 - DNA, 22 bp, Artificial Sequence
  chemically synthesized
ttaatctaataaacatacaccc

SEQ ID NO: 931002 - DNA, 22 bp, Artificial Sequence
  chemically synthesized
cttaatctaataaacatacacc

SEQ ID NO: 931003 - DNA, 22 bp, Artificial Sequence
  chemically synthesized
cttcttaatctaataaacatac

SEQ ID NO: 931004 - DNA, 22 bp, Artificial Sequence
  chemically synthesized
ccttcttaatctaataaacata

SEQ ID NO: 931005 - DNA, 22 bp, Artificial Sequence
  chemically synthesized
tccttcttaatctaataaacat

SEQ ID NO: 931006 - DNA, 22 bp, Artificial Sequence
  chemically synthesized
ttccttcttaatctaataaaca

SEQ ID NO: 931007 - DNA, 22 bp, Artificial Sequence
  chemically synthesized
tttccttcttaatctaataaac

SEQ ID NO: 931008 - DNA, 22 bp, Artificial Sequence
  chemically synthesized
cgctttttccttcttaatctaa

SEQ ID NO: 931009 - DNA, 22 bp, Artificial Sequence
  chemically synthesized
tacgctttttccttcttaatct

SEQ ID NO: 931010 - DNA, 22 bp, Artificial Sequence
  chemically synthesized
aatctctacgctttttccttct

SEQ ID NO: 931011 - DNA, 22 bp, Artificial Sequence
  chemically synthesized
attagattaagaaggaaaaagc

SEQ ID NO: 931012 - DNA, 22 bp, Artificial Sequence
  chemically synthesized
ttagattaagaaggaaaaagcg

SEQ ID NO: 931013 - DNA, 22 bp, Artificial Sequence
  chemically synthesized
gattaagaaggaaaaagcgtag

SEQ ID NO: 931014 - DNA, 22 bp, Artificial Sequence
  chemically synthesized
aagatcgttgaatctctacgct

SEQ ID NO: 931015 - DNA, 22 bp, Artificial Sequence
  chemically synthesized
agaaggaaaaagcgtagagatt

SEQ ID NO: 931016 - DNA, 22 bp, Artificial Sequence
  chemically synthesized
aaattcaagatcgttgaatctc

SEQ ID NO: 931017 - DNA, 22 bp, Artificial Sequence
  chemically synthesized
gaaattcaagatcgttgaatct

SEQ ID NO: 931018 - DNA, 22 bp, Artificial Sequence
  chemically synthesized
ttgaaattcaagatcgttgaat

SEQ ID NO: 931019 - DNA, 22 bp, Artificial Sequence
  chemically synthesized
tcttgaaattcaagatcgttga

SEQ ID NO: 931020 - DNA, 22 bp, Artificial Sequence
  chemically synthesized
ctcttgaaattcaagatcgttg

SEQ ID NO: 931021 - DNA, 22 bp, Artificial Sequence
  chemically synthesized
tctcttgaaattcaagatcgtt

SEQ ID NO: 931022 - DNA, 22 bp, Artificial Sequence
  chemically synthesized
agccattttctcttgaaattca

SEQ ID NO: 931023 - DNA, 22 bp, Artificial Sequence
  chemically synthesized
gagccattttctcttgaaattc

SEQ ID NO: 931024 - DNA, 22 bp, Artificial Sequence
  chemically synthesized
ttgagccattttctcttgaaat

SEQ ID NO: 931025 - DNA, 22 bp, Artificial Sequence
  chemically synthesized
aacgatcttgaatttcaagaga

SEQ ID NO: 931026 - DNA, 22 bp, Artificial Sequence
  chemically synthesized
cttgagccattttctcttgaaa

SEQ ID NO: 931027 - DNA, 22 bp, Artificial Sequence
  chemically synthesized
tcttgagccattttctcttgaa

SEQ ID NO: 931028 - DNA, 22 bp, Artificial Sequence
  chemically synthesized
caggctttcttgagccattttc

SEQ ID NO: 931029 - DNA, 22 bp, Artificial Sequence
  chemically synthesized
gaatttcaagagaaaatggctc

SEQ ID NO: 931030 - DNA, 22 bp, Artificial Sequence
  chemically synthesized
acaggctttcttgagccatttt

SEQ ID NO: 931031 - DNA, 22 bp, Artificial Sequence
  chemically synthesized
aatttcaagagaaaatggctca

SEQ ID NO: 931032 - DNA, 22 bp, Artificial Sequence
  chemically synthesized
tacaggctttcttgagccattt

SEQ ID NO: 931033 - DNA, 22 bp, Artificial Sequence
  chemically synthesized
ttacaggctttcttgagccatt

SEQ ID NO: 931034 - DNA, 22 bp, Artificial Sequence
  chemically synthesized
caagagaaaatggctcaagaaa

SEQ ID NO: 931035 - DNA, 22 bp, Artificial Sequence
  chemically synthesized
aagagaaaatggctcaagaaag

SEQ ID NO: 931036 - DNA, 22 bp, Artificial Sequence
  chemically synthesized
aagagcttttacaggctttctt

SEQ ID NO: 931037 - DNA, 22 bp, Artificial Sequence
  chemically synthesized
taaagagcttttacaggctttc

SEQ ID NO: 931038 - DNA, 22 bp, Artificial Sequence
  chemically synthesized
ttctaaagagcttttacaggct

SEQ ID NO: 931039 - DNA, 22 bp, Artificial Sequence
  chemically synthesized
attctaaagagcttttacaggc

SEQ ID NO: 931040 - DNA, 22 bp, Artificial Sequence
  chemically synthesized
tattctaaagagcttttacagg

SEQ ID NO: 931041 - DNA, 22 bp, Artificial Sequence
  chemically synthesized
aagaaagcctgtaaaagctctt

SEQ ID NO: 931042 - DNA, 22 bp, Artificial Sequence
  chemically synthesized
tcaaaattttattctaaagagc

SEQ ID NO: 931043 - DNA, 22 bp, Artificial Sequence
  chemically synthesized
tattgtcaaaattttattctaa

SEQ ID NO: 931044 - DNA, 22 bp, Artificial Sequence
  chemically synthesized
taaaagctctttagaataaaat

SEQ ID NO: 931045 - DNA, 22 bp, Artificial Sequence
  chemically synthesized
ccattatattgtcaaaatttta

SEQ ID NO: 931046 - DNA, 22 bp, Artificial Sequence
  chemically synthesized
gccattatattgtcaaaatttt

SEQ ID NO: 931047 - DNA, 22 bp, Artificial Sequence
  chemically synthesized
tttagaataaaattttgacaat

SEQ ID NO: 931048 - DNA, 22 bp, Artificial Sequence
  chemically synthesized
tagaataaaattttgacaatat

SEQ ID NO: 931049 - DNA, 22 bp, Artificial Sequence
  chemically synthesized
agaataaaattttgacaatata

SEQ ID NO: 931050 - DNA, 22 bp, Artificial Sequence
  chemically synthesized
gaataaaattttgacaatataa

SEQ ID NO: 931051 - DNA, 22 bp, Artificial Sequence
  chemically synthesized
ggatgatttgccattatattgt

SEQ ID NO: 931052 - DNA, 22 bp, Artificial Sequence
  chemically synthesized
actgggatgatttgccattata

SEQ ID NO: 931053 - DNA, 22 bp, Artificial Sequence
  chemically synthesized
tactcactgggatgatttgcca

SEQ ID NO: 931054 - DNA, 22 bp, Artificial Sequence
  chemically synthesized
tgacaatataatggcaaatcat

SEQ ID NO: 931055 - DNA, 22 bp, Artificial Sequence
  chemically synthesized
atactcactgggatgatttgcc

SEQ ID NO: 931056 - DNA, 22 bp, Artificial Sequence
  chemically synthesized
gacaatataatggcaaatcatc

SEQ ID NO: 931057 - DNA, 22 bp, Artificial Sequence
  chemically synthesized
tatactcactgggatgatttgc

SEQ ID NO: 931058 - DNA, 22 bp, Artificial Sequence
  chemically synthesized
acaatataatggcaaatcatcc

SEQ ID NO: 931059 - DNA, 22 bp, Artificial Sequence
  chemically synthesized
ttttatactcactgggatgatt

SEQ ID NO: 931060 - DNA, 22 bp, Artificial Sequence
  chemically synthesized
gttttatactcactgggatgat

SEQ ID NO: 931061 - DNA, 22 bp, Artificial Sequence
  chemically synthesized
tgttttatactcactgggatga

SEQ ID NO: 931062 - DNA, 22 bp, Artificial Sequence
  chemically synthesized
tccatacagtggcacacatctt

SEQ ID NO: 931063 - DNA, 22 bp, Artificial Sequence
  chemically synthesized
aggttgtccatacagtggcaca

SEQ ID NO: 931064 - DNA, 22 bp, Artificial Sequence
  chemically synthesized
gaggttgtccatacagtggcac

SEQ ID NO: 931065 - DNA, 22 bp, Artificial Sequence
  chemically synthesized
tgaggttgtccatacagtggca

SEQ ID NO: 931066 - DNA, 22 bp, Artificial Sequence
  chemically synthesized
agcacctttgaggttgtccata

SEQ ID NO: 931067 - DNA, 22 bp, Artificial Sequence
  chemically synthesized
gaatctgagcacctttgaggtt

SEQ ID NO: 931068 - DNA, 22 bp, Artificial Sequence
  chemically synthesized
ttagaatctgagcacctttgag

SEQ ID NO: 931069 - DNA, 22 bp, Artificial Sequence
  chemically synthesized
tatggacaacctcaaaggtgct

SEQ ID NO: 931070 - DNA, 22 bp, Artificial Sequence
  chemically synthesized
tattagaatctgagcacctttg

SEQ ID NO: 931071 - DNA, 22 bp, Artificial Sequence
  chemically synthesized
atactctattagaatctgagca

SEQ ID NO: 931072 - DNA, 22 bp, Artificial Sequence
  chemically synthesized
aaaggtgctcagattctaatag

SEQ ID NO: 931073 - DNA, 22 bp, Artificial Sequence
  chemically synthesized
ccatgttcatactctattagaa

SEQ ID NO: 931074 - DNA, 22 bp, Artificial Sequence
  chemically synthesized
cccatgttcatactctattaga

SEQ ID NO: 931075 - DNA, 22 bp, Artificial Sequence
  chemically synthesized
ttcccatgttcatactctatta

SEQ ID NO: 931076 - DNA, 22 bp, Artificial Sequence
  chemically synthesized
cttcccatgttcatactctatt

SEQ ID NO: 931077 - DNA, 22 bp, Artificial Sequence
  chemically synthesized
gtttcttcccatgttcatactc

SEQ ID NO: 931078 - DNA, 22 bp, Artificial Sequence
  chemically synthesized
agattctaatagagtatgaaca

SEQ ID NO: 931079 - DNA, 22 bp, Artificial Sequence
  chemically synthesized
tccctcgtttcttcccatgttc

SEQ ID NO: 931080 - DNA, 22 bp, Artificial Sequence
  chemically synthesized
taatagagtatgaacatgggaa

SEQ ID NO: 931081 - DNA, 22 bp, Artificial Sequence
  chemically synthesized
tgtccctcgtttcttcccatgt

SEQ ID NO: 931082 - DNA, 22 bp, Artificial Sequence
  chemically synthesized
atagagtatgaacatgggaaga

SEQ ID NO: 931083 - DNA, 22 bp, Artificial Sequence
  chemically synthesized
tctgtccctcgtttcttcccat

SEQ ID NO: 931084 - DNA, 22 bp, Artificial Sequence
  chemically synthesized
agttctctgtccctcgtttctt

SEQ ID NO: 931085 - DNA, 22 bp, Artificial Sequence
  chemically synthesized
ccctcagttctctgtccctcgt

SEQ ID NO: 931086 - DNA, 22 bp, Artificial Sequence
  chemically synthesized
gccctcagttctctgtccctcg

SEQ ID NO: 931087 - DNA, 22 bp, Artificial Sequence
  chemically synthesized
atatttgccctcagttctctgt

SEQ ID NO: 931088 - DNA, 22 bp, Artificial Sequence
  chemically synthesized
taatatttgccctcagttctct

SEQ ID NO: 931089 - DNA, 22 bp, Artificial Sequence
  chemically synthesized
ctaatatttgccctcagttctc

SEQ ID NO: 931090 - DNA, 22 bp, Artificial Sequence
  chemically synthesized
ttctaatatttgccctcagttc

SEQ ID NO: 931091 - DNA, 22 bp, Artificial Sequence
  chemically synthesized
ttcttctaatatttgccctcag

SEQ ID NO: 931092 - DNA, 22 bp, Artificial Sequence
  chemically synthesized
tattgttcttctaatatttgcc

SEQ ID NO: 931093 - DNA, 22 bp, Artificial Sequence
  chemically synthesized
tatattgttcttctaatatttg

SEQ ID NO: 931094 - DNA, 22 bp, Artificial Sequence
  chemically synthesized
agggcaaatattagaagaacaa

SEQ ID NO: 931095 - DNA, 22 bp, Artificial Sequence
  chemically synthesized
tacagttctatattgttcttct

SEQ ID NO: 931096 - DNA, 22 bp, Artificial Sequence
  chemically synthesized
atacagttctatattgttcttc

SEQ ID NO: 931097 - DNA, 22 bp, Artificial Sequence
  chemically synthesized
tttatacagttctatattgttc

SEQ ID NO: 931098 - DNA, 22 bp, Artificial Sequence
  chemically synthesized
actgtttatacagttctatatt

SEQ ID NO: 931099 - DNA, 22 bp, Artificial Sequence
  chemically synthesized
ctcactgtttatacagttctat

SEQ ID NO: 931100 - DNA, 22 bp, Artificial Sequence
  chemically synthesized
cctcactgtttatacagttcta

SEQ ID NO: 931101 - DNA, 22 bp, Artificial Sequence
  chemically synthesized
gaagaacaatatagaactgtat

SEQ ID NO: 931102 - DNA, 22 bp, Artificial Sequence
  chemically synthesized
tcctcactgtttatacagttct

SEQ ID NO: 931103 - DNA, 22 bp, Artificial Sequence
  chemically synthesized
ttcctcactgtttatacagttc

SEQ ID NO: 931104 - DNA, 22 bp, Artificial Sequence
  chemically synthesized
agcttttcctcactgtttatac

SEQ ID NO: 931105 - DNA, 22 bp, Artificial Sequence
  chemically synthesized
caagctcagcttttcctcactg

SEQ ID NO: 931106 - DNA, 22 bp, Artificial Sequence
  chemically synthesized
attccaagctcagcttttcctc

SEQ ID NO: 931107 - DNA, 22 bp, Artificial Sequence
  chemically synthesized
tataaacagtgaggaaaagctg

SEQ ID NO: 931108 - DNA, 22 bp, Artificial Sequence
  chemically synthesized
aattcattccaagctcagcttt

SEQ ID NO: 931109 - DNA, 22 bp, Artificial Sequence
  chemically synthesized
tcacgagcctcaattcattcca

SEQ ID NO: 931110 - DNA, 22 bp, Artificial Sequence
  chemically synthesized
ccattatcacgagcctcaattc

SEQ ID NO: 931111 - DNA, 22 bp, Artificial Sequence
  chemically synthesized
accattatcacgagcctcaatt

SEQ ID NO: 931112 - DNA, 22 bp, Artificial Sequence
  chemically synthesized
agcttggaatgaattgaggctc

SEQ ID NO: 931113 - DNA, 22 bp, Artificial Sequence
  chemically synthesized
taccattatcacgagcctcaat

SEQ ID NO: 931114 - DNA, 22 bp, Artificial Sequence
  chemically synthesized
tctttaccattatcacgagcct

SEQ ID NO: 931115 - DNA, 22 bp, Artificial Sequence
  chemically synthesized
ggaatgaattgaggctcgtgat

SEQ ID NO: 931116 - DNA, 22 bp, Artificial Sequence
  chemically synthesized
gaatgaattgaggctcgtgata

SEQ ID NO: 931117 - DNA, 22 bp, Artificial Sequence
  chemically synthesized
aatgttgtctttaccattatca

SEQ ID NO: 931118 - DNA, 22 bp, Artificial Sequence
  chemically synthesized
aggctcgtgataatggtaaaga

SEQ ID NO: 931119 - DNA, 22 bp, Artificial Sequence
  chemically synthesized
gtgataatggtaaagacaacat

SEQ ID NO: 931120 - DNA, 22 bp, Artificial Sequence
  chemically synthesized
caaatggaagtaaaaaggccct

SEQ ID NO: 931121 - DNA, 22 bp, Artificial Sequence
  chemically synthesized
ctccaaatggaagtaaaaaggc

SEQ ID NO: 931122 - DNA, 22 bp, Artificial Sequence
  chemically synthesized
cctccaaatggaagtaaaaagg

SEQ ID NO: 931123 - DNA, 22 bp, Artificial Sequence
  chemically synthesized
ttcctccaaatggaagtaaaaa

SEQ ID NO: 931124 - DNA, 22 bp, Artificial Sequence
  chemically synthesized
cttcctccaaatggaagtaaaa

SEQ ID NO: 931125 - DNA, 22 bp, Artificial Sequence
  chemically synthesized
ttcttcctccaaatggaagtaa

SEQ ID NO: 931126 - DNA, 22 bp, Artificial Sequence
  chemically synthesized
agggcctttttacttccatttg

SEQ ID NO: 931127 - DNA, 22 bp, Artificial Sequence
  chemically synthesized
gttcttcttcctccaaatggaa

SEQ ID NO: 931128 - DNA, 22 bp, Artificial Sequence
  chemically synthesized
tggttcttcttcctccaaatgg

SEQ ID NO: 931129 - DNA, 22 bp, Artificial Sequence
  chemically synthesized
ctggttcttcttcctccaaatg

SEQ ID NO: 931130 - DNA, 22 bp, Artificial Sequence
  chemically synthesized
tctggttcttcttcctccaaat

SEQ ID NO: 931131 - DNA, 22 bp, Artificial Sequence
  chemically synthesized
tttacttccatttggaggaaga

SEQ ID NO: 931132 - DNA, 22 bp, Artificial Sequence
  chemically synthesized
ttacttccatttggaggaagaa

SEQ ID NO: 931133 - DNA, 22 bp, Artificial Sequence
  chemically synthesized
tacttccatttggaggaagaag

SEQ ID NO: 931134 - DNA, 22 bp, Artificial Sequence
  chemically synthesized
gtctttctggttcttcttcctc

SEQ ID NO: 931135 - DNA, 22 bp, Artificial Sequence
  chemically synthesized
acttccatttggaggaagaaga

SEQ ID NO: 931136 - DNA, 22 bp, Artificial Sequence
  chemically synthesized
cgtctttctggttcttcttcct

SEQ ID NO: 931137 - DNA, 22 bp, Artificial Sequence
  chemically synthesized
cttccatttggaggaagaagaa

SEQ ID NO: 931138 - DNA, 22 bp, Artificial Sequence
  chemically synthesized
ccatttggaggaagaagaacca

SEQ ID NO: 931139 - DNA, 22 bp, Artificial Sequence
  chemically synthesized
catttggaggaagaagaaccag

SEQ ID NO: 931140 - DNA, 22 bp, Artificial Sequence
  chemically synthesized
ggaggaagaagaaccagaaaga

SEQ ID NO: 931141 - DNA, 22 bp, Artificial Sequence
  chemically synthesized
gaggaagaagaaccagaaagac

SEQ ID NO: 931142 - DNA, 22 bp, Artificial Sequence
  chemically synthesized
ccccaatcagtgaaccttcgtc

SEQ ID NO: 931143 - DNA, 22 bp, Artificial Sequence
  chemically synthesized
tgccccaatcagtgaaccttcg

SEQ ID NO: 931144 - DNA, 22 bp, Artificial Sequence
  chemically synthesized
ctgccccaatcagtgaaccttc

SEQ ID NO: 931145 - DNA, 22 bp, Artificial Sequence
  chemically synthesized
ccttctgccccaatcagtgaac

SEQ ID NO: 931146 - DNA, 22 bp, Artificial Sequence
  chemically synthesized
tcccttctgccccaatcagtga

SEQ ID NO: 931147 - DNA, 22 bp, Artificial Sequence
  chemically synthesized
ctcccttctgccccaatcagtg

SEQ ID NO: 931148 - DNA, 22 bp, Artificial Sequence
  chemically synthesized
accttctcccttctgccccaat

SEQ ID NO: 931149 - DNA, 22 bp, Artificial Sequence
  chemically synthesized
tccctaaccttctcccttctgc

SEQ ID NO: 931150 - DNA, 22 bp, Artificial Sequence
  chemically synthesized
actgattggggcagaagggaga

SEQ ID NO: 931151 - DNA, 22 bp, Artificial Sequence
  chemically synthesized
tatccctaaccttctcccttct

SEQ ID NO: 931152 - DNA, 22 bp, Artificial Sequence
  chemically synthesized
attggggcagaagggagaaggt

SEQ ID NO: 931153 - DNA, 22 bp, Artificial Sequence
  chemically synthesized
gggcagaagggagaaggttagg

SEQ ID NO: 931154 - DNA, 22 bp, Artificial Sequence
  chemically synthesized
tgtcgtctctatccctaacctt

SEQ ID NO: 931155 - DNA, 22 bp, Artificial Sequence
  chemically synthesized
tgtgtcgtctctatccctaacc

SEQ ID NO: 931156 - DNA, 22 bp, Artificial Sequence
  chemically synthesized
ctgtgtcgtctctatccctaac

SEQ ID NO: 931157 - DNA, 22 bp, Artificial Sequence
  chemically synthesized
tctgtgtcgtctctatccctaa

SEQ ID NO: 931158 - DNA, 22 bp, Artificial Sequence
  chemically synthesized
ctttctgtgtcgtctctatccc

SEQ ID NO: 931159 - DNA, 22 bp, Artificial Sequence
  chemically synthesized
ctgctttctgtgtcgtctctat

SEQ ID NO: 931160 - DNA, 22 bp, Artificial Sequence
  chemically synthesized
cacactgctgctttctgtgtcg

SEQ ID NO: 931161 - DNA, 22 bp, Artificial Sequence
  chemically synthesized
gggatagagacgacacagaaag

SEQ ID NO: 931162 - DNA, 22 bp, Artificial Sequence
  chemically synthesized
acagagcagacaagcaaaagga

SEQ ID NO: 931163 - DNA, 22 bp, Artificial Sequence
  chemically synthesized
gacagagcagacaagcaaaagg

SEQ ID NO: 931164 - DNA, 22 bp, Artificial Sequence
  chemically synthesized
cttgacagagcagacaagcaaa

SEQ ID NO: 931165 - DNA, 22 bp, Artificial Sequence
  chemically synthesized
tccttgacagagcagacaagca

SEQ ID NO: 931166 - DNA, 22 bp, Artificial Sequence
  chemically synthesized
cttttgcttgtctgctctgtca

SEQ ID NO: 931167 - DNA, 22 bp, Artificial Sequence
  chemically synthesized
atgaacattctccttgacagag

SEQ ID NO: 931168 - DNA, 22 bp, Artificial Sequence
  chemically synthesized
ttgcttgtctgctctgtcaagg

SEQ ID NO: 931169 - DNA, 22 bp, Artificial Sequence
  chemically synthesized
tgcttgtctgctctgtcaagga

SEQ ID NO: 931170 - DNA, 22 bp, Artificial Sequence
  chemically synthesized
gcttgtctgctctgtcaaggag

SEQ ID NO: 931171 - DNA, 22 bp, Artificial Sequence
  chemically synthesized
cttgtctgctctgtcaaggaga

SEQ ID NO: 931172 - DNA, 22 bp, Artificial Sequence
  chemically synthesized
gtctgctctgtcaaggagaatg

SEQ ID NO: 931173 - DNA, 22 bp, Artificial Sequence
  chemically synthesized
cagtctgatgaacattctcctt

SEQ ID NO: 931174 - DNA, 22 bp, Artificial Sequence
  chemically synthesized
tctgctctgtcaaggagaatgt

SEQ ID NO: 931175 - DNA, 22 bp, Artificial Sequence
  chemically synthesized
ccagtctgatgaacattctcct

SEQ ID NO: 931176 - DNA, 22 bp, Artificial Sequence
  chemically synthesized
tccagtctgatgaacattctcc

SEQ ID NO: 931177 - DNA, 22 bp, Artificial Sequence
  chemically synthesized
ttccagtctgatgaacattctc

SEQ ID NO: 931178 - DNA, 22 bp, Artificial Sequence
  chemically synthesized
ctctgtcaaggagaatgttcat

SEQ ID NO: 931179 - DNA, 22 bp, Artificial Sequence
  chemically synthesized
tgtcaaggagaatgttcatcag

SEQ ID NO: 931180 - DNA, 22 bp, Artificial Sequence
  chemically synthesized
tgccttttccagtctgatgaac

SEQ ID NO: 931181 - DNA, 22 bp, Artificial Sequence
  chemically synthesized
tcaaggagaatgttcatcagac

SEQ ID NO: 931182 - DNA, 22 bp, Artificial Sequence
  chemically synthesized
tacggttatgccttttccagtc

SEQ ID NO: 931183 - DNA, 22 bp, Artificial Sequence
  chemically synthesized
atacggttatgccttttccagt

SEQ ID NO: 931184 - DNA, 22 bp, Artificial Sequence
  chemically synthesized
ccttatacggttatgccttttc

SEQ ID NO: 931185 - DNA, 22 bp, Artificial Sequence
  chemically synthesized
cccttatacggttatgcctttt

SEQ ID NO: 931186 - DNA, 22 bp, Artificial Sequence
  chemically synthesized
atcagactggaaaaggcataac

SEQ ID NO: 931187 - DNA, 22 bp, Artificial Sequence
  chemically synthesized
atttcccttatacggttatgcc

SEQ ID NO: 931188 - DNA, 22 bp, Artificial Sequence
  chemically synthesized
catttcccttatacggttatgc

SEQ ID NO: 931189 - DNA, 22 bp, Artificial Sequence
  chemically synthesized
ggcttcatttcccttatacggt

SEQ ID NO: 931190 - DNA, 22 bp, Artificial Sequence
  chemically synthesized
gaaaaggcataaccgtataagg

SEQ ID NO: 931191 - DNA, 22 bp, Artificial Sequence
  chemically synthesized
gggcttcatttcccttatacgg

SEQ ID NO: 931192 - DNA, 22 bp, Artificial Sequence
  chemically synthesized
tgggcttcatttcccttatacg

SEQ ID NO: 931193 - DNA, 22 bp, Artificial Sequence
  chemically synthesized
ttttgggcttcatttcccttat

SEQ ID NO: 931194 - DNA, 22 bp, Artificial Sequence
  chemically synthesized
acctattttgggcttcatttcc

SEQ ID NO: 931195 - DNA, 22 bp, Artificial Sequence
  chemically synthesized
cctcacctattttgggcttcat

SEQ ID NO: 931196 - DNA, 22 bp, Artificial Sequence
  chemically synthesized
aaattccctcacctattttggg

SEQ ID NO: 931197 - DNA, 22 bp, Artificial Sequence
  chemically synthesized
aaaattccctcacctattttgg

SEQ ID NO: 931198 - DNA, 22 bp, Artificial Sequence
  chemically synthesized
taaaattccctcacctattttg

SEQ ID NO: 931199 - DNA, 22 bp, Artificial Sequence
  chemically synthesized
ttaaaattccctcacctatttt

SEQ ID NO: 931200 - DNA, 22 bp, Artificial Sequence
  chemically synthesized
ttttaaaattccctcacctatt

SEQ ID NO: 931201 - DNA, 22 bp, Artificial Sequence
  chemically synthesized
gagcagcaaggtgctcttttaa

SEQ ID NO: 931202 - DNA, 22 bp, Artificial Sequence
  chemically synthesized
agagcagcaaggtgctctttta

SEQ ID NO: 931203 - DNA, 22 bp, Artificial Sequence
  chemically synthesized
atttagagcagcaaggtgctct

SEQ ID NO: 931204 - DNA, 22 bp, Artificial Sequence
  chemically synthesized
gctcatttagagcagcaaggtg

SEQ ID NO: 931205 - DNA, 22 bp, Artificial Sequence
  chemically synthesized
agctcatttagagcagcaaggt

SEQ ID NO: 931206 - DNA, 22 bp, Artificial Sequence
  chemically synthesized
tagctcatttagagcagcaagg

SEQ ID NO: 931207 - DNA, 22 bp, Artificial Sequence
  chemically synthesized
taaaagagcaccttgctgctct

SEQ ID NO: 931208 - DNA, 22 bp, Artificial Sequence
  chemically synthesized
aaaagagcaccttgctgctcta

SEQ ID NO: 931209 - DNA, 22 bp, Artificial Sequence
  chemically synthesized
aaagagcaccttgctgctctaa

SEQ ID NO: 931210 - DNA, 22 bp, Artificial Sequence
  chemically synthesized
gctgctctaaatgagctaaaat

SEQ ID NO: 931211 - DNA, 22 bp, Artificial Sequence
  chemically synthesized
ctgctctaaatgagctaaaatc

SEQ ID NO: 931212 - DNA, 22 bp, Artificial Sequence
  chemically synthesized
gtccagggccagagattttagc

SEQ ID NO: 931213 - DNA, 22 bp, Artificial Sequence
  chemically synthesized
ctctaaatgagctaaaatctct

SEQ ID NO: 931214 - DNA, 22 bp, Artificial Sequence
  chemically synthesized
taaatgagctaaaatctctggc

SEQ ID NO: 931215 - DNA, 22 bp, Artificial Sequence
  chemically synthesized
aatgagctaaaatctctggccc

SEQ ID NO: 931216 - DNA, 22 bp, Artificial Sequence
  chemically synthesized
gaatataattggtccagggcca

SEQ ID NO: 931217 - DNA, 22 bp, Artificial Sequence
  chemically synthesized
cctagaatataattggtccagg

SEQ ID NO: 931218 - DNA, 22 bp, Artificial Sequence
  chemically synthesized
aaatctctggccctggaccaat

SEQ ID NO: 931219 - DNA, 22 bp, Artificial Sequence
  chemically synthesized
ccctagaatataattggtccag

SEQ ID NO: 931220 - DNA, 22 bp, Artificial Sequence
  chemically synthesized
atttccctagaatataattggt

SEQ ID NO: 931221 - DNA, 22 bp, Artificial Sequence
  chemically synthesized
tcatttccctagaatataattg

SEQ ID NO: 931222 - DNA, 22 bp, Artificial Sequence
  chemically synthesized
tggccctggaccaattatattc

SEQ ID NO: 931223 - DNA, 22 bp, Artificial Sequence
  chemically synthesized
tctcatttccctagaatataat

SEQ ID NO: 931224 - DNA, 22 bp, Artificial Sequence
  chemically synthesized
gccctggaccaattatattcta

SEQ ID NO: 931225 - DNA, 22 bp, Artificial Sequence
  chemically synthesized
gaccaattatattctagggaaa

SEQ ID NO: 931226 - DNA, 22 bp, Artificial Sequence
  chemically synthesized
cgcaagttctctcatttcccta

SEQ ID NO: 931227 - DNA, 22 bp, Artificial Sequence
  chemically synthesized
tattgcgcaagttctctcattt

SEQ ID NO: 931228 - DNA, 22 bp, Artificial Sequence
  chemically synthesized
tattctagggaaatgagagaac

SEQ ID NO: 931229 - DNA, 22 bp, Artificial Sequence
  chemically synthesized
tagggaaatgagagaacttgcg

SEQ ID NO: 931230 - DNA, 22 bp, Artificial Sequence
  chemically synthesized
gggaaatgagagaacttgcgca

SEQ ID NO: 931231 - DNA, 22 bp, Artificial Sequence
  chemically synthesized
acagtggggtaggactgtattg

SEQ ID NO: 931232 - DNA, 22 bp, Artificial Sequence
  chemically synthesized
gcgcaatacagtcctaccccac

SEQ ID NO: 931233 - DNA, 22 bp, Artificial Sequence
  chemically synthesized
cgcaatacagtcctaccccact

SEQ ID NO: 931234 - DNA, 22 bp, Artificial Sequence
  chemically synthesized
aaagaccactgacagtggggta

SEQ ID NO: 931235 - DNA, 22 bp, Artificial Sequence
  chemically synthesized
ctcaaagaccactgacagtggg

SEQ ID NO: 931236 - DNA, 22 bp, Artificial Sequence
  chemically synthesized
acatagttcctcaaagaccact

SEQ ID NO: 931237 - DNA, 22 bp, Artificial Sequence
  chemically synthesized
ccccactgtcagtggtctttga

SEQ ID NO: 931238 - DNA, 22 bp, Artificial Sequence
  chemically synthesized
cagtgttaacatagttcctcaa

SEQ ID NO: 931239 - DNA, 22 bp, Artificial Sequence
  chemically synthesized
tcagtggtctttgaggaactat

SEQ ID NO: 931240 - DNA, 22 bp, Artificial Sequence
  chemically synthesized
cccatctgcagtgttaacatag

SEQ ID NO: 931241 - DNA, 22 bp, Artificial Sequence
  chemically synthesized
gcccatctgcagtgttaacata

SEQ ID NO: 931242 - DNA, 22 bp, Artificial Sequence
  chemically synthesized
tgaggaactatgttaacactgc

SEQ ID NO: 931243 - DNA, 22 bp, Artificial Sequence
  chemically synthesized
gaggaactatgttaacactgca

SEQ ID NO: 931244 - DNA, 22 bp, Artificial Sequence
  chemically synthesized
aggaactatgttaacactgcag

SEQ ID NO: 931245 - DNA, 22 bp, Artificial Sequence
  chemically synthesized
tgttaacactgcagatgggcaa

SEQ ID NO: 931246 - DNA, 22 bp, Artificial Sequence
  chemically synthesized
aaaatcgagatgacatttgccc

SEQ ID NO: 931247 - DNA, 22 bp, Artificial Sequence
  chemically synthesized
acactgcagatgggcaaatgtc

SEQ ID NO: 931248 - DNA, 22 bp, Artificial Sequence
  chemically synthesized
aaaaatcgagatgacatttgcc

SEQ ID NO: 931249 - DNA, 22 bp, Artificial Sequence
  chemically synthesized
taaaaatcgagatgacatttgc

SEQ ID NO: 931250 - DNA, 22 bp, Artificial Sequence
  chemically synthesized
tctttaaaaatcgagatgacat

SEQ ID NO: 931251 - DNA, 22 bp, Artificial Sequence
  chemically synthesized
cagatgggcaaatgtcatctcg

SEQ ID NO: 931252 - DNA, 22 bp, Artificial Sequence
  chemically synthesized
ctgtctttaaaaatcgagatga

SEQ ID NO: 931253 - DNA, 22 bp, Artificial Sequence
  chemically synthesized
cctgtctttaaaaatcgagatg

SEQ ID NO: 931254 - DNA, 22 bp, Artificial Sequence
  chemically synthesized
ttcctgtctttaaaaatcgaga

SEQ ID NO: 931255 - DNA, 22 bp, Artificial Sequence
  chemically synthesized
gatttttaaagacaggaagagg

SEQ ID NO: 931256 - DNA, 22 bp, Artificial Sequence
  chemically synthesized
ttaaagacaggaagaggtcact

SEQ ID NO: 931257 - DNA, 22 bp, Artificial Sequence
  chemically synthesized
taaagacaggaagaggtcactg

SEQ ID NO: 931258 - DNA, 22 bp, Artificial Sequence
  chemically synthesized
aaagacaggaagaggtcactgc

SEQ ID NO: 931259 - DNA, 22 bp, Artificial Sequence
  chemically synthesized
aagacaggaagaggtcactgcg

SEQ ID NO: 931260 - DNA, 22 bp, Artificial Sequence
  chemically synthesized
atggaacacagtcgcagtgacc

SEQ ID NO: 931261 - DNA, 22 bp, Artificial Sequence
  chemically synthesized
gcaggaattgatggaacacagt

SEQ ID NO: 931262 - DNA, 22 bp, Artificial Sequence
  chemically synthesized
agcaggaattgatggaacacag

SEQ ID NO: 931263 - DNA, 22 bp, Artificial Sequence
  chemically synthesized
tagcaggaattgatggaacaca

SEQ ID NO: 931264 - DNA, 22 bp, Artificial Sequence
  chemically synthesized
tttagcaggaattgatggaaca

SEQ ID NO: 931265 - DNA, 22 bp, Artificial Sequence
  chemically synthesized
cgactgtgttccatcaattcct

SEQ ID NO: 931266 - DNA, 22 bp, Artificial Sequence
  chemically synthesized
agaaatgctctttagcaggaat

SEQ ID NO: 931267 - DNA, 22 bp, Artificial Sequence
  chemically synthesized
tgttccatcaattcctgctaaa

SEQ ID NO: 931268 - DNA, 22 bp, Artificial Sequence
  chemically synthesized
catcaattcctgctaaagagca

SEQ ID NO: 931269 - DNA, 22 bp, Artificial Sequence
  chemically synthesized
catcattcagaaatgctcttta

SEQ ID NO: 931270 - DNA, 22 bp, Artificial Sequence
  chemically synthesized
ttccatcattcagaaatgctct

SEQ ID NO: 931271 - DNA, 22 bp, Artificial Sequence
  chemically synthesized
gttccatcattcagaaatgctc

SEQ ID NO: 931272 - DNA, 22 bp, Artificial Sequence
  chemically synthesized
cttgttccatcattcagaaatg

SEQ ID NO: 931273 - DNA, 22 bp, Artificial Sequence
  chemically synthesized
ctgctaaagagcatttctgaat

SEQ ID NO: 931274 - DNA, 22 bp, Artificial Sequence
  chemically synthesized
ctccttgttccatcattcagaa

SEQ ID NO: 931275 - DNA, 22 bp, Artificial Sequence
  chemically synthesized
ctaaagagcatttctgaatgat

SEQ ID NO: 931276 - DNA, 22 bp, Artificial Sequence
  chemically synthesized
gctccttgttccatcattcaga

SEQ ID NO: 931277 - DNA, 22 bp, Artificial Sequence
  chemically synthesized
aagagcatttctgaatgatgga

SEQ ID NO: 931278 - DNA, 22 bp, Artificial Sequence
  chemically synthesized
tttgctccttgttccatcattc

SEQ ID NO: 931279 - DNA, 22 bp, Artificial Sequence
  chemically synthesized
gtttgctccttgttccatcatt

SEQ ID NO: 931280 - DNA, 22 bp, Artificial Sequence
  chemically synthesized
ctgaatgatggaacaaggagca

SEQ ID NO: 931281 - DNA, 22 bp, Artificial Sequence
  chemically synthesized
tgaatgatggaacaaggagcaa

SEQ ID NO: 931282 - DNA, 22 bp, Artificial Sequence
  chemically synthesized
acaagtgtttgtttgctccttg

SEQ ID NO: 931283 - DNA, 22 bp, Artificial Sequence
  chemically synthesized
aatgatggaacaaggagcaaac

SEQ ID NO: 931284 - DNA, 22 bp, Artificial Sequence
  chemically synthesized
ttaacaagtgtttgtttgctcc

SEQ ID NO: 931285 - DNA, 22 bp, Artificial Sequence
  chemically synthesized
gttaacaagtgtttgtttgctc

SEQ ID NO: 931286 - DNA, 22 bp, Artificial Sequence
  chemically synthesized
tgttaacaagtgtttgtttgct

SEQ ID NO: 931287 - DNA, 22 bp, Artificial Sequence
  chemically synthesized
tctttgttaacaagtgtttgtt

SEQ ID NO: 931288 - DNA, 22 bp, Artificial Sequence
  chemically synthesized
cacgttgtctttgttaacaagt

SEQ ID NO: 931289 - DNA, 22 bp, Artificial Sequence
  chemically synthesized
cctccacgttgtctttgttaac

SEQ ID NO: 931290 - DNA, 22 bp, Artificial Sequence
  chemically synthesized
gctgcctccacgttgtctttgt

SEQ ID NO: 931291 - DNA, 22 bp, Artificial Sequence
  chemically synthesized
gttaacaaagacaacgtggagg

SEQ ID NO: 931292 - DNA, 22 bp, Artificial Sequence
  chemically synthesized
ttaacaaagacaacgtggaggc

SEQ ID NO: 931293 - DNA, 22 bp, Artificial Sequence
  chemically synthesized
acaaagacaacgtggaggcagc

SEQ ID NO: 931294 - DNA, 22 bp, Artificial Sequence
  chemically synthesized
tcatacaaacccaaattagctg

SEQ ID NO: 931295 - DNA, 22 bp, Artificial Sequence
  chemically synthesized
gtgtaagaacgagttgtcatac

SEQ ID NO: 931296 - DNA, 22 bp, Artificial Sequence
  chemically synthesized
atttgggtttgtatgacaactc

SEQ ID NO: 931297 - DNA, 22 bp, Artificial Sequence
  chemically synthesized
gggtttgtatgacaactcgttc

SEQ ID NO: 931298 - DNA, 22 bp, Artificial Sequence
  chemically synthesized
ggtttgtatgacaactcgttct

SEQ ID NO: 931299 - DNA, 22 bp, Artificial Sequence
  chemically synthesized
gtatgacaactcgttcttacac

SEQ ID NO: 931300 - DNA, 22 bp, Artificial Sequence
  chemically synthesized
tatgacaactcgttcttacacc

SEQ ID NO: 931301 - DNA, 22 bp, Artificial Sequence
  chemically synthesized
caaacacaggcacacatgtctg

SEQ ID NO: 931302 - DNA, 22 bp, Artificial Sequence
  chemically synthesized
gttcttacaccagacatgtgtg

SEQ ID NO: 931303 - DNA, 22 bp, Artificial Sequence
  chemically synthesized
aactgcaaacacaggcacacat

SEQ ID NO: 931304 - DNA, 22 bp, Artificial Sequence
  chemically synthesized
ttacaccagacatgtgtgcctg

SEQ ID NO: 931305 - DNA, 22 bp, Artificial Sequence
  chemically synthesized
acaccagacatgtgtgcctgtg

SEQ ID NO: 931306 - DNA, 22 bp, Artificial Sequence
  chemically synthesized
caccagacatgtgtgcctgtgt

SEQ ID NO: 931307 - DNA, 22 bp, Artificial Sequence
  chemically synthesized
caaaagagattcaactgcaaac

SEQ ID NO: 931308 - DNA, 22 bp, Artificial Sequence
  chemically synthesized
atactgcaaaagagattcaact

SEQ ID NO: 931309 - DNA, 22 bp, Artificial Sequence
  chemically synthesized
catactgcaaaagagattcaac

SEQ ID NO: 931310 - DNA, 22 bp, Artificial Sequence
  chemically synthesized
tcatactgcaaaagagattcaa

SEQ ID NO: 931311 - DNA, 22 bp, Artificial Sequence
  chemically synthesized
tgtttgcagttgaatctctttt

SEQ ID NO: 931312 - DNA, 22 bp, Artificial Sequence
  chemically synthesized
aattttcatactgcaaaagaga

SEQ ID NO: 931313 - DNA, 22 bp, Artificial Sequence
  chemically synthesized
gcagttgaatctcttttgcagt

SEQ ID NO: 931314 - DNA, 22 bp, Artificial Sequence
  chemically synthesized
cagttgaatctcttttgcagta

SEQ ID NO: 931315 - DNA, 22 bp, Artificial Sequence
  chemically synthesized
aatctcttttgcagtatgaaaa

SEQ ID NO: 931316 - DNA, 22 bp, Artificial Sequence
  chemically synthesized
gaaatgtgaaattcaattttca

SEQ ID NO: 931317 - DNA, 22 bp, Artificial Sequence
  chemically synthesized
agaaatgtgaaattcaattttc

SEQ ID NO: 931318 - DNA, 22 bp, Artificial Sequence
  chemically synthesized
ttttgcagtatgaaaattgaat

SEQ ID NO: 931319 - DNA, 22 bp, Artificial Sequence
  chemically synthesized
ttgcagtatgaaaattgaattt

SEQ ID NO: 931320 - DNA, 22 bp, Artificial Sequence
  chemically synthesized
tttagaaatgtgaaattcaatt

SEQ ID NO: 931321 - DNA, 22 bp, Artificial Sequence
  chemically synthesized
tgcagtatgaaaattgaatttc

SEQ ID NO: 931322 - DNA, 22 bp, Artificial Sequence
  chemically synthesized
gcagtatgaaaattgaatttca

SEQ ID NO: 931323 - DNA, 22 bp, Artificial Sequence
  chemically synthesized
cagtatgaaaattgaatttcac

SEQ ID NO: 931324 - DNA, 22 bp, Artificial Sequence
  chemically synthesized
agttgtttagaaatgtgaaatt

SEQ ID NO: 931325 - DNA, 22 bp, Artificial Sequence
  chemically synthesized
aagttgtttagaaatgtgaaat

SEQ ID NO: 931326 - DNA, 22 bp, Artificial Sequence
  chemically synthesized
taagttgtttagaaatgtgaaa

SEQ ID NO: 931327 - DNA, 22 bp, Artificial Sequence
  chemically synthesized
ttaagttgtttagaaatgtgaa

SEQ ID NO: 931328 - DNA, 22 bp, Artificial Sequence
  chemically synthesized
aatttcacatttctaaacaact

SEQ ID NO: 931329 - DNA, 22 bp, Artificial Sequence
  chemically synthesized
cacatttctaaacaacttaaaa

SEQ ID NO: 931330 - DNA, 22 bp, Artificial Sequence
  chemically synthesized
acatttctaaacaacttaaaaa

SEQ ID NO: 931331 - DNA, 22 bp, Artificial Sequence
  chemically synthesized
gaaaaaaaaagaagtggttttt

SEQ ID NO: 931332 - DNA, 22 bp, Artificial Sequence
  chemically synthesized
ctaaacaacttaaaaaccactt

SEQ ID NO: 931333 - DNA, 22 bp, Artificial Sequence
  chemically synthesized
taaacaacttaaaaaccacttc

SEQ ID NO: 931334 - DNA, 22 bp, Artificial Sequence
  chemically synthesized
aacaacttaaaaaccacttctt

SEQ ID NO: 931335 - DNA, 22 bp, Artificial Sequence
  chemically synthesized
gctggaaaaaaaaagaagtggt

SEQ ID NO: 931336 - DNA, 22 bp, Artificial Sequence
  chemically synthesized
attagctggaaaaaaaaagaag

SEQ ID NO: 931337 - DNA, 22 bp, Artificial Sequence
  chemically synthesized
cattagctggaaaaaaaaagaa

SEQ ID NO: 931338 - DNA, 22 bp, Artificial Sequence
  chemically synthesized
tcattagctggaaaaaaaaaga

SEQ ID NO: 931339 - DNA, 22 bp, Artificial Sequence
  chemically synthesized
aaaaaccacttctttttttttc

SEQ ID NO: 931340 - DNA, 22 bp, Artificial Sequence
  chemically synthesized
aaaaccacttctttttttttcc

SEQ ID NO: 931341 - DNA, 22 bp, Artificial Sequence
  chemically synthesized
actttcattagctggaaaaaaa

SEQ ID NO: 931342 - DNA, 22 bp, Artificial Sequence
  chemically synthesized
aactttcattagctggaaaaaa

SEQ ID NO: 931343 - DNA, 22 bp, Artificial Sequence
  chemically synthesized
ctttttttttccagctaatgaa

SEQ ID NO: 931344 - DNA, 22 bp, Artificial Sequence
  chemically synthesized
tttttttttccagctaatgaaa

SEQ ID NO: 931345 - DNA, 22 bp, Artificial Sequence
  chemically synthesized
agaaaatttaactttcattagc

SEQ ID NO: 931346 - DNA, 22 bp, Artificial Sequence
  chemically synthesized
aagaaaatttaactttcattag

SEQ ID NO: 931347 - DNA, 22 bp, Artificial Sequence
  chemically synthesized
tttttttccagctaatgaaagt

SEQ ID NO: 931348 - DNA, 22 bp, Artificial Sequence
  chemically synthesized
taagaaaatttaactttcatta

SEQ ID NO: 931349 - DNA, 22 bp, Artificial Sequence
  chemically synthesized
ttttttccagctaatgaaagtt

SEQ ID NO: 931350 - DNA, 22 bp, Artificial Sequence
  chemically synthesized
tttttccagctaatgaaagtta

SEQ ID NO: 931351 - DNA, 22 bp, Artificial Sequence
  chemically synthesized
ttttccagctaatgaaagttaa

SEQ ID NO: 931352 - DNA, 22 bp, Artificial Sequence
  chemically synthesized
tttccagctaatgaaagttaaa

SEQ ID NO: 931353 - DNA, 22 bp, Artificial Sequence
  chemically synthesized
attttaagaaaatttaactttc

SEQ ID NO: 931354 - DNA, 22 bp, Artificial Sequence
  chemically synthesized
ttccagctaatgaaagttaaat

SEQ ID NO: 931355 - DNA, 22 bp, Artificial Sequence
  chemically synthesized
cattttaagaaaatttaacttt

SEQ ID NO: 931356 - DNA, 22 bp, Artificial Sequence
  chemically synthesized
tccagctaatgaaagttaaatt

SEQ ID NO: 931357 - DNA, 22 bp, Artificial Sequence
  chemically synthesized
ccagctaatgaaagttaaattt

SEQ ID NO: 931358 - DNA, 22 bp, Artificial Sequence
  chemically synthesized
cagctaatgaaagttaaatttt

SEQ ID NO: 931359 - DNA, 22 bp, Artificial Sequence
  chemically synthesized
tttcattttaagaaaatttaac

SEQ ID NO: 931360 - DNA, 22 bp, Artificial Sequence
  chemically synthesized
atgaaagttaaattttcttaaa

SEQ ID NO: 931361 - DNA, 22 bp, Artificial Sequence
  chemically synthesized
tatggttatttcattttaagaa

SEQ ID NO: 931362 - DNA, 22 bp, Artificial Sequence
  chemically synthesized
atatggttatttcattttaaga

SEQ ID NO: 931363 - DNA, 22 bp, Artificial Sequence
  chemically synthesized
tttatatggttatttcatttta

SEQ ID NO: 931364 - DNA, 22 bp, Artificial Sequence
  chemically synthesized
aattttcttaaaatgaaataac

SEQ ID NO: 931365 - DNA, 22 bp, Artificial Sequence
  chemically synthesized
attatttatatggttatttcat

SEQ ID NO: 931366 - DNA, 22 bp, Artificial Sequence
  chemically synthesized
tcttaaaatgaaataaccatat

SEQ ID NO: 931367 - DNA, 22 bp, Artificial Sequence
  chemically synthesized
cttaaaatgaaataaccatata

SEQ ID NO: 931368 - DNA, 22 bp, Artificial Sequence
  chemically synthesized
ttaaaatgaaataaccatataa

SEQ ID NO: 931369 - DNA, 22 bp, Artificial Sequence
  chemically synthesized
aaaatgaaataaccatataaat

SEQ ID NO: 931370 - DNA, 22 bp, Artificial Sequence
  chemically synthesized
aaatgaaataaccatataaata

SEQ ID NO: 931371 - DNA, 22 bp, Artificial Sequence
  chemically synthesized
tacaacagaacacaattcatta

SEQ ID NO: 931372 - DNA, 22 bp, Artificial Sequence
  chemically synthesized
gtacaacagaacacaattcatt

SEQ ID NO: 931373 - DNA, 22 bp, Artificial Sequence
  chemically synthesized
cttgtacaacagaacacaattc

SEQ ID NO: 931374 - DNA, 22 bp, Artificial Sequence
  chemically synthesized
ctccttgtacaacagaacacaa

SEQ ID NO: 931375 - DNA, 22 bp, Artificial Sequence
  chemically synthesized
gatgtcatgctgctccttgtac

SEQ ID NO: 931376 - DNA, 22 bp, Artificial Sequence
  chemically synthesized
tgttctgttgtacaaggagcag

SEQ ID NO: 931377 - DNA, 22 bp, Artificial Sequence
  chemically synthesized
tgttgtacaaggagcagcatga

SEQ ID NO: 931378 - DNA, 22 bp, Artificial Sequence
  chemically synthesized
ttgtacaaggagcagcatgaca

SEQ ID NO: 931379 - DNA, 22 bp, Artificial Sequence
  chemically synthesized
tacaaggagcagcatgacatcc

SEQ ID NO: 931380 - DNA, 22 bp, Artificial Sequence
  chemically synthesized
aggtggtgggcaactggatgtc

SEQ ID NO: 931381 - DNA, 22 bp, Artificial Sequence
  chemically synthesized
caggtggtgggcaactggatgt

SEQ ID NO: 931382 - DNA, 22 bp, Artificial Sequence
  chemically synthesized
tcaggtggtgggcaactggatg

SEQ ID NO: 931383 - DNA, 22 bp, Artificial Sequence
  chemically synthesized
ttcaggtggtgggcaactggat

SEQ ID NO: 931384 - DNA, 22 bp, Artificial Sequence
  chemically synthesized
tttcaggtggtgggcaactgga

SEQ ID NO: 931385 - DNA, 22 bp, Artificial Sequence
  chemically synthesized
aaactttttcaggtggtgggca

SEQ ID NO: 931386 - DNA, 22 bp, Artificial Sequence
  chemically synthesized
ccagaggacctcaaactttttc

SEQ ID NO: 931387 - DNA, 22 bp, Artificial Sequence
  chemically synthesized
gccagaggacctcaaacttttt

SEQ ID NO: 931388 - DNA, 22 bp, Artificial Sequence
  chemically synthesized
cccaccacctgaaaaagtttga

SEQ ID NO: 931389 - DNA, 22 bp, Artificial Sequence
  chemically synthesized
tttgccagaggacctcaaactt

SEQ ID NO: 931390 - DNA, 22 bp, Artificial Sequence
  chemically synthesized
tccattatttgccagaggacct

SEQ ID NO: 931391 - DNA, 22 bp, Artificial Sequence
  chemically synthesized
aaaaagtttgaggtcctctggc

SEQ ID NO: 931392 - DNA, 22 bp, Artificial Sequence
  chemically synthesized
tgtccattatttgccagaggac

SEQ ID NO: 931393 - DNA, 22 bp, Artificial Sequence
  chemically synthesized
tctctgtccattatttgccaga

SEQ ID NO: 931394 - DNA, 22 bp, Artificial Sequence
  chemically synthesized
gaggtcctctggcaaataatgg

SEQ ID NO: 931395 - DNA, 22 bp, Artificial Sequence
  chemically synthesized
aggtcctctggcaaataatgga

SEQ ID NO: 931396 - DNA, 22 bp, Artificial Sequence
  chemically synthesized
tggcaaataatggacagagaca

SEQ ID NO: 931397 - DNA, 22 bp, Artificial Sequence
  chemically synthesized
gcaaataatggacagagacaat

SEQ ID NO: 931398 - DNA, 22 bp, Artificial Sequence
  chemically synthesized
atacgtgcaccattttgtgtta

SEQ ID NO: 931399 - DNA, 22 bp, Artificial Sequence
  chemically synthesized
tacgtgcaccattttgtgttat

SEQ ID NO: 931400 - DNA, 22 bp, Artificial Sequence
  chemically synthesized
tcaccatgtcaaataacacaaa

SEQ ID NO: 931401 - DNA, 22 bp, Artificial Sequence
  chemically synthesized
tgtgttatttgacatggtgaca

SEQ ID NO: 931402 - DNA, 22 bp, Artificial Sequence
  chemically synthesized
gtgttatttgacatggtgacaa

SEQ ID NO: 931403 - DNA, 22 bp, Artificial Sequence
  chemically synthesized
tgttatttgacatggtgacaat

SEQ ID NO: 931404 - DNA, 22 bp, Artificial Sequence
  chemically synthesized
tagaaaggagacccattgtcac

SEQ ID NO: 931405 - DNA, 22 bp, Artificial Sequence
  chemically synthesized
gtagaaaggagacccattgtca

SEQ ID NO: 931406 - DNA, 22 bp, Artificial Sequence
  chemically synthesized
tttgacatggtgacaatgggtc

SEQ ID NO: 931407 - DNA, 22 bp, Artificial Sequence
  chemically synthesized
ttgtagaaaggagacccattgt

SEQ ID NO: 931408 - DNA, 22 bp, Artificial Sequence
  chemically synthesized
gacatggtgacaatgggtctcc

SEQ ID NO: 931409 - DNA, 22 bp, Artificial Sequence
  chemically synthesized
ttcttgtagaaaggagacccat

SEQ ID NO: 931410 - DNA, 22 bp, Artificial Sequence
  chemically synthesized
acatggtgacaatgggtctcct

SEQ ID NO: 931411 - DNA, 22 bp, Artificial Sequence
  chemically synthesized
tgttcttgtagaaaggagaccc

SEQ ID NO: 931412 - DNA, 22 bp, Artificial Sequence
  chemically synthesized
ttctgttcttgtagaaaggaga

SEQ ID NO: 931413 - DNA, 22 bp, Artificial Sequence
  chemically synthesized
gttctgttcttgtagaaaggag

SEQ ID NO: 931414 - DNA, 22 bp, Artificial Sequence
  chemically synthesized
ttgttctgttcttgtagaaagg

SEQ ID NO: 931415 - DNA, 22 bp, Artificial Sequence
  chemically synthesized
ctcttgttctgttcttgtagaa

SEQ ID NO: 931416 - DNA, 22 bp, Artificial Sequence
  chemically synthesized
cctcttgttctgttcttgtaga

SEQ ID NO: 931417 - DNA, 22 bp, Artificial Sequence
  chemically synthesized
tttcctcttgttctgttcttgt

SEQ ID NO: 931418 - DNA, 22 bp, Artificial Sequence
  chemically synthesized
atttcctcttgttctgttcttg

SEQ ID NO: 931419 - DNA, 22 bp, Artificial Sequence
  chemically synthesized
ctttctacaagaacagaacaag

SEQ ID NO: 931420 - DNA, 22 bp, Artificial Sequence
  chemically synthesized
caatcttatttcctcttgttct

SEQ ID NO: 931421 - DNA, 22 bp, Artificial Sequence
  chemically synthesized
tctacaagaacagaacaagagg

SEQ ID NO: 931422 - DNA, 22 bp, Artificial Sequence
  chemically synthesized
ctacaagaacagaacaagagga

SEQ ID NO: 931423 - DNA, 22 bp, Artificial Sequence
  chemically synthesized
tgcaatcttatttcctcttgtt

SEQ ID NO: 931424 - DNA, 22 bp, Artificial Sequence
  chemically synthesized
tacaagaacagaacaagaggaa

SEQ ID NO: 931425 - DNA, 22 bp, Artificial Sequence
  chemically synthesized
caagaacagaacaagaggaaat

SEQ ID NO: 931426 - DNA, 22 bp, Artificial Sequence
  chemically synthesized
ctctgcaatcttatttcctctt

SEQ ID NO: 931427 - DNA, 22 bp, Artificial Sequence
  chemically synthesized
cccaactactctgcaatcttat

SEQ ID NO: 931428 - DNA, 22 bp, Artificial Sequence
  chemically synthesized
tgtaggttccccaactactctg

SEQ ID NO: 931429 - DNA, 22 bp, Artificial Sequence
  chemically synthesized
ctgtgtaggttccccaactact

SEQ ID NO: 931430 - DNA, 22 bp, Artificial Sequence
  chemically synthesized
cctcctgtgtaggttccccaac

SEQ ID NO: 931431 - DNA, 22 bp, Artificial Sequence
  chemically synthesized
cagagtagttggggaacctaca

SEQ ID NO: 931432 - DNA, 22 bp, Artificial Sequence
  chemically synthesized
ggaagactccctcctgtgtagg

SEQ ID NO: 931433 - DNA, 22 bp, Artificial Sequence
  chemically synthesized
cggaagactccctcctgtgtag

SEQ ID NO: 931434 - DNA, 22 bp, Artificial Sequence
  chemically synthesized
tcggaagactccctcctgtgta

SEQ ID NO: 931435 - DNA, 22 bp, Artificial Sequence
  chemically synthesized
ttcggaagactccctcctgtgt

SEQ ID NO: 931436 - DNA, 22 bp, Artificial Sequence
  chemically synthesized
ttttcggaagactccctcctgt

SEQ ID NO: 931437 - DNA, 22 bp, Artificial Sequence
  chemically synthesized
gggaacctacacaggagggagt

SEQ ID NO: 931438 - DNA, 22 bp, Artificial Sequence
  chemically synthesized
aatctcttttcggaagactccc

SEQ ID NO: 931439 - DNA, 22 bp, Artificial Sequence
  chemically synthesized
cacaggagggagtcttccgaaa

SEQ ID NO: 931440 - DNA, 22 bp, Artificial Sequence
  chemically synthesized
atacagtctaaatctcttttcg

SEQ ID NO: 931441 - DNA, 22 bp, Artificial Sequence
  chemically synthesized
gatattgatacagtctaaatct

SEQ ID NO: 931442 - DNA, 22 bp, Artificial Sequence
  chemically synthesized
tggatattgatacagtctaaat

SEQ ID NO: 931443 - DNA, 22 bp, Artificial Sequence
  chemically synthesized
ctggatattgatacagtctaaa

SEQ ID NO: 931444 - DNA, 22 bp, Artificial Sequence
  chemically synthesized
ccgaaaagagatttagactgta

SEQ ID NO: 931445 - DNA, 22 bp, Artificial Sequence
  chemically synthesized
tctggatattgatacagtctaa

SEQ ID NO: 931446 - DNA, 22 bp, Artificial Sequence
  chemically synthesized
cgaaaagagatttagactgtat

SEQ ID NO: 931447 - DNA, 22 bp, Artificial Sequence
  chemically synthesized
ttctggatattgatacagtcta

SEQ ID NO: 931448 - DNA, 22 bp, Artificial Sequence
  chemically synthesized
gacatttttctggatattgata

SEQ ID NO: 931449 - DNA, 22 bp, Artificial Sequence
  chemically synthesized
cgacatttttctggatattgat

SEQ ID NO: 931450 - DNA, 22 bp, Artificial Sequence
  chemically synthesized
agactgtatcaatatccagaaa

SEQ ID NO: 931451 - DNA, 22 bp, Artificial Sequence
  chemically synthesized
gactgtatcaatatccagaaaa

SEQ ID NO: 931452 - DNA, 22 bp, Artificial Sequence
  chemically synthesized
tatcaatatccagaaaaatgtc

SEQ ID NO: 931453 - DNA, 22 bp, Artificial Sequence
  chemically synthesized
caaaaatcaccttcgacatttt

SEQ ID NO: 931454 - DNA, 22 bp, Artificial Sequence
  chemically synthesized
ccaaaaatcaccttcgacattt

SEQ ID NO: 931455 - DNA, 22 bp, Artificial Sequence
  chemically synthesized
tccaaaaatcaccttcgacatt

SEQ ID NO: 931456 - DNA, 22 bp, Artificial Sequence
  chemically synthesized
ttggaaaatggcatcattgttt

SEQ ID NO: 931457 - DNA, 22 bp, Artificial Sequence
  chemically synthesized
tggaaaatggcatcattgttta

SEQ ID NO: 931458 - DNA, 22 bp, Artificial Sequence
  chemically synthesized
ggaaaatggcatcattgtttac

SEQ ID NO: 931459 - DNA, 22 bp, Artificial Sequence
  chemically synthesized
gaaaatggcatcattgtttaca

SEQ ID NO: 931460 - DNA, 22 bp, Artificial Sequence
  chemically synthesized
tttacatttattcttttggttt

SEQ ID NO: 931461 - DNA, 22 bp, Artificial Sequence
  chemically synthesized
aaagtgatagaagaaaaccaaa

SEQ ID NO: 931462 - DNA, 22 bp, Artificial Sequence
  chemically synthesized
acatttattcttttggttttct

SEQ ID NO: 931463 - DNA, 22 bp, Artificial Sequence
  chemically synthesized
catttattcttttggttttctt

SEQ ID NO: 931464 - DNA, 22 bp, Artificial Sequence
  chemically synthesized
attcttttggttttcttctatc

SEQ ID NO: 931465 - DNA, 22 bp, Artificial Sequence
  chemically synthesized
ttcttttggttttcttctatca

SEQ ID NO: 931466 - DNA, 22 bp, Artificial Sequence
  chemically synthesized
ttttggttttcttctatcactt

SEQ ID NO: 931467 - DNA, 22 bp, Artificial Sequence
  chemically synthesized
ttggttttcttctatcactttt

SEQ ID NO: 931468 - DNA, 22 bp, Artificial Sequence
  chemically synthesized
taaaaatccactaaaagtgata

SEQ ID NO: 931469 - DNA, 22 bp, Artificial Sequence
  chemically synthesized
tggttttcttctatcactttta

SEQ ID NO: 931470 - DNA, 22 bp, Artificial Sequence
  chemically synthesized
ggttttcttctatcacttttag

SEQ ID NO: 931471 - DNA, 22 bp, Artificial Sequence
  chemically synthesized
gttttcttctatcacttttagt

SEQ ID NO: 931472 - DNA, 22 bp, Artificial Sequence
  chemically synthesized
attataaaaatccactaaaagt

SEQ ID NO: 931473 - DNA, 22 bp, Artificial Sequence
  chemically synthesized
cattataaaaatccactaaaag

SEQ ID NO: 931474 - DNA, 22 bp, Artificial Sequence
  chemically synthesized
tcttctatcacttttagtggat

SEQ ID NO: 931475 - DNA, 22 bp, Artificial Sequence
  chemically synthesized
ttcattataaaaatccactaaa

SEQ ID NO: 931476 - DNA, 22 bp, Artificial Sequence
  chemically synthesized
cttctatcacttttagtggatt

SEQ ID NO: 931477 - DNA, 22 bp, Artificial Sequence
  chemically synthesized
ttctatcacttttagtggattt

SEQ ID NO: 931478 - DNA, 22 bp, Artificial Sequence
  chemically synthesized
ctatcacttttagtggattttt

SEQ ID NO: 931479 - DNA, 22 bp, Artificial Sequence
  chemically synthesized
tatcacttttagtggattttta

SEQ ID NO: 931480 - DNA, 22 bp, Artificial Sequence
  chemically synthesized
tcacttttagtggatttttata

SEQ ID NO: 931481 - DNA, 22 bp, Artificial Sequence
  chemically synthesized
ttagtggatttttataatgaag

SEQ ID NO: 931482 - DNA, 22 bp, Artificial Sequence
  chemically synthesized
tagtggatttttataatgaaga

SEQ ID NO: 931483 - DNA, 22 bp, Artificial Sequence
  chemically synthesized
agtggatttttataatgaagag

SEQ ID NO: 931484 - DNA, 22 bp, Artificial Sequence
  chemically synthesized
gtggatttttataatgaagaga

SEQ ID NO: 931485 - DNA, 22 bp, Artificial Sequence
  chemically synthesized
atcataaacgtatgtctcttca

SEQ ID NO: 931486 - DNA, 22 bp, Artificial Sequence
  chemically synthesized
tgatcataaacgtatgtctctt

SEQ ID NO: 931487 - DNA, 22 bp, Artificial Sequence
  chemically synthesized
ctgatcataaacgtatgtctct

SEQ ID NO: 931488 - DNA, 22 bp, Artificial Sequence
  chemically synthesized
tctgatcataaacgtatgtctc

SEQ ID NO: 931489 - DNA, 22 bp, Artificial Sequence
  chemically synthesized
ttctgatcataaacgtatgtct

SEQ ID NO: 931490 - DNA, 22 bp, Artificial Sequence
  chemically synthesized
ttataatgaagagacatacgtt

SEQ ID NO: 931491 - DNA, 22 bp, Artificial Sequence
  chemically synthesized
tttctgatcataaacgtatgtc

SEQ ID NO: 931492 - DNA, 22 bp, Artificial Sequence
  chemically synthesized
tataatgaagagacatacgttt

SEQ ID NO: 931493 - DNA, 22 bp, Artificial Sequence
  chemically synthesized
ttttctgatcataaacgtatgt

SEQ ID NO: 931494 - DNA, 22 bp, Artificial Sequence
  chemically synthesized
ataatgaagagacatacgttta

SEQ ID NO: 931495 - DNA, 22 bp, Artificial Sequence
  chemically synthesized
taatgaagagacatacgtttat

SEQ ID NO: 931496 - DNA, 22 bp, Artificial Sequence
  chemically synthesized
tttttttctgatcataaacgta

SEQ ID NO: 931497 - DNA, 22 bp, Artificial Sequence
  chemically synthesized
atgatcagaaaaaaataaccct

SEQ ID NO: 931498 - DNA, 22 bp, Artificial Sequence
  chemically synthesized
ccaaatgggtagagggttattt

SEQ ID NO: 931499 - DNA, 22 bp, Artificial Sequence
  chemically synthesized
tgatcagaaaaaaataaccctc

SEQ ID NO: 931500 - DNA, 22 bp, Artificial Sequence
  chemically synthesized
cccaaatgggtagagggttatt

SEQ ID NO: 931501 - DNA, 22 bp, Artificial Sequence
  chemically synthesized
tttcccaaatgggtagagggtt

SEQ ID NO: 931502 - DNA, 22 bp, Artificial Sequence
  chemically synthesized
atttcccaaatgggtagagggt

SEQ ID NO: 931503 - DNA, 22 bp, Artificial Sequence
  chemically synthesized
tatcaatttatttcccaaatgg

SEQ ID NO: 931504 - DNA, 22 bp, Artificial Sequence
  chemically synthesized
tacccatttgggaaataaattg

SEQ ID NO: 931505 - DNA, 22 bp, Artificial Sequence
  chemically synthesized
gtaagattatatcaatttattt

SEQ ID NO: 931506 - DNA, 22 bp, Artificial Sequence
  chemically synthesized
ggtaagattatatcaatttatt

SEQ ID NO: 931507 - DNA, 22 bp, Artificial Sequence
  chemically synthesized
cccatttgggaaataaattgat

SEQ ID NO: 931508 - DNA, 22 bp, Artificial Sequence
  chemically synthesized
tggtaagattatatcaatttat

SEQ ID NO: 931509 - DNA, 22 bp, Artificial Sequence
  chemically synthesized
ttttggtaagattatatcaatt

SEQ ID NO: 931510 - DNA, 22 bp, Artificial Sequence
  chemically synthesized
gttttggtaagattatatcaat

SEQ ID NO: 931511 - DNA, 22 bp, Artificial Sequence
  chemically synthesized
gggaaataaattgatataatct

SEQ ID NO: 931512 - DNA, 22 bp, Artificial Sequence
  chemically synthesized
ggaaataaattgatataatctt

SEQ ID NO: 931513 - DNA, 22 bp, Artificial Sequence
  chemically synthesized
atataatcttaccaaaacaagg

SEQ ID NO: 931514 - DNA, 22 bp, Artificial Sequence
  chemically synthesized
accaaaacaaggtatttttttc

SEQ ID NO: 931515 - DNA, 22 bp, Artificial Sequence
  chemically synthesized
ccaaaacaaggtatttttttct

SEQ ID NO: 931516 - DNA, 22 bp, Artificial Sequence
  chemically synthesized
aataaaaaaatccagaaaaaaa

SEQ ID NO: 931517 - DNA, 22 bp, Artificial Sequence
  chemically synthesized
gaataaaaaaatccagaaaaaa

SEQ ID NO: 931518 - DNA, 22 bp, Artificial Sequence
  chemically synthesized
ttgaataaaaaaatccagaaaa

SEQ ID NO: 931519 - DNA, 22 bp, Artificial Sequence
  chemically synthesized
actcttgaataaaaaaatccag

SEQ ID NO: 931520 - DNA, 22 bp, Artificial Sequence
  chemically synthesized
tcactcttgaataaaaaaatcc

SEQ ID NO: 931521 - DNA, 22 bp, Artificial Sequence
  chemically synthesized
tctcactcttgaataaaaaaat

SEQ ID NO: 931522 - DNA, 22 bp, Artificial Sequence
  chemically synthesized
ttctctcactcttgaataaaaa

SEQ ID NO: 931523 - DNA, 22 bp, Artificial Sequence
  chemically synthesized
ttttctggatttttttattcaa

SEQ ID NO: 931524 - DNA, 22 bp, Artificial Sequence
  chemically synthesized
tttctggatttttttattcaag

SEQ ID NO: 931525 - DNA, 22 bp, Artificial Sequence
  chemically synthesized
ttctggatttttttattcaaga

SEQ ID NO: 931526 - DNA, 22 bp, Artificial Sequence
  chemically synthesized
tctggatttttttattcaagag

SEQ ID NO: 931527 - DNA, 22 bp, Artificial Sequence
  chemically synthesized
tctattctctcactcttgaata

SEQ ID NO: 931528 - DNA, 22 bp, Artificial Sequence
  chemically synthesized
ctggatttttttattcaagagt

SEQ ID NO: 931529 - DNA, 22 bp, Artificial Sequence
  chemically synthesized
atctattctctcactcttgaat

SEQ ID NO: 931530 - DNA, 22 bp, Artificial Sequence
  chemically synthesized
tggatttttttattcaagagtg

SEQ ID NO: 931531 - DNA, 22 bp, Artificial Sequence
  chemically synthesized
tatctattctctcactcttgaa

SEQ ID NO: 931532 - DNA, 22 bp, Artificial Sequence
  chemically synthesized
gatttttttattcaagagtgag

SEQ ID NO: 931533 - DNA, 22 bp, Artificial Sequence
  chemically synthesized
ttttatctattctctcactctt

SEQ ID NO: 931534 - DNA, 22 bp, Artificial Sequence
  chemically synthesized
ttttattcaagagtgagagaat

SEQ ID NO: 931535 - DNA, 22 bp, Artificial Sequence
  chemically synthesized
tttattcaagagtgagagaata

SEQ ID NO: 931536 - DNA, 22 bp, Artificial Sequence
  chemically synthesized
ttattcaagagtgagagaatag

SEQ ID NO: 931537 - DNA, 22 bp, Artificial Sequence
  chemically synthesized
tattcaagagtgagagaataga

SEQ ID NO: 931538 - DNA, 22 bp, Artificial Sequence
  chemically synthesized
attcaagagtgagagaatagat

SEQ ID NO: 931539 - DNA, 22 bp, Artificial Sequence
  chemically synthesized
ttcaagagtgagagaatagata

SEQ ID NO: 931540 - DNA, 22 bp, Artificial Sequence
  chemically synthesized
ggaaagactattttatctattc

SEQ ID NO: 931541 - DNA, 22 bp, Artificial Sequence
  chemically synthesized
aagagtgagagaatagataaaa

SEQ ID NO: 931542 - DNA, 22 bp, Artificial Sequence
  chemically synthesized
atatacagtactgggaaagact

SEQ ID NO: 931543 - DNA, 22 bp, Artificial Sequence
  chemically synthesized
aataattaatatacagtactgg

SEQ ID NO: 931544 - DNA, 22 bp, Artificial Sequence
  chemically synthesized
aaataattaatatacagtactg

SEQ ID NO: 931545 - DNA, 22 bp, Artificial Sequence
  chemically synthesized
tcccagtactgtatattaatta

SEQ ID NO: 931546 - DNA, 22 bp, Artificial Sequence
  chemically synthesized
cccagtactgtatattaattat

SEQ ID NO: 931547 - DNA, 22 bp, Artificial Sequence
  chemically synthesized
ccagtactgtatattaattatt

SEQ ID NO: 931548 - DNA, 22 bp, Artificial Sequence
  chemically synthesized
aaatatcatatttaaataatta

SEQ ID NO: 931549 - DNA, 22 bp, Artificial Sequence
  chemically synthesized
aaaatatcatatttaaataatt

SEQ ID NO: 931550 - DNA, 22 bp, Artificial Sequence
  chemically synthesized
taaaatatcatatttaaataat

SEQ ID NO: 931551 - DNA, 22 bp, Artificial Sequence
  chemically synthesized
ttttaaaatatcatatttaaat

SEQ ID NO: 931552 - DNA, 22 bp, Artificial Sequence
  chemically synthesized
attttaaaatatcatatttaaa

SEQ ID NO: 931553 - DNA, 22 bp, Artificial Sequence
  chemically synthesized
tatattaattatttaaatatga

SEQ ID NO: 931554 - DNA, 22 bp, Artificial Sequence
  chemically synthesized
tattttaaaatatcatatttaa

SEQ ID NO: 931555 - DNA, 22 bp, Artificial Sequence
  chemically synthesized
attatttaaatatgatatttta

SEQ ID NO: 931556 - DNA, 22 bp, Artificial Sequence
  chemically synthesized
tttaaatatgatattttaaaat

SEQ ID NO: 931557 - DNA, 22 bp, Artificial Sequence
  chemically synthesized
aaatatgatattttaaaataaa

SEQ ID NO: 931558 - DNA, 22 bp, Artificial Sequence
  chemically synthesized
aatatgatattttaaaataaag

SEQ ID NO: 931559 - DNA, 22 bp, Artificial Sequence
  chemically synthesized
taaaataaagttatcatacttt

SEQ ID NO: 931560 - DNA, 22 bp, Artificial Sequence
  chemically synthesized
aaaataaagttatcatacttta

SEQ ID NO: 931561 - DNA, 22 bp, Artificial Sequence
  chemically synthesized
aaataaagttatcatactttat

SEQ ID NO: 931562 - DNA, 22 bp, Artificial Sequence
  chemically synthesized
ataccatagtagataaagtatg

SEQ ID NO: 931563 - DNA, 22 bp, Artificial Sequence
  chemically synthesized
caggtgctgataccatagtaga

SEQ ID NO: 931564 - DNA, 22 bp, Artificial Sequence
  chemically synthesized
tcatactttatctactatggta

SEQ ID NO: 931565 - DNA, 22 bp, Artificial Sequence
  chemically synthesized
tgtctacaggtgctgataccat

SEQ ID NO: 931566 - DNA, 22 bp, Artificial Sequence
  chemically synthesized
tatctactatggtatcagcacc

SEQ ID NO: 931567 - DNA, 22 bp, Artificial Sequence
  chemically synthesized
atctactatggtatcagcacct

SEQ ID NO: 931568 - DNA, 22 bp, Artificial Sequence
  chemically synthesized
tctactatggtatcagcacctg

SEQ ID NO: 931569 - DNA, 22 bp, Artificial Sequence
  chemically synthesized
ctatggtatcagcacctgtaga

SEQ ID NO: 931570 - DNA, 22 bp, Artificial Sequence
  chemically synthesized
tggtatcagcacctgtagacat

SEQ ID NO: 931571 - DNA, 22 bp, Artificial Sequence
  chemically synthesized
atgcaaatatggtagtaaatta

SEQ ID NO: 931572 - DNA, 22 bp, Artificial Sequence
  chemically synthesized
tagacataatttactaccatat

SEQ ID NO: 931573 - DNA, 22 bp, Artificial Sequence
  chemically synthesized
gtaatatgtactaatgcaaata

SEQ ID NO: 931574 - DNA, 22 bp, Artificial Sequence
  chemically synthesized
agtaatatgtactaatgcaaat

SEQ ID NO: 931575 - DNA, 22 bp, Artificial Sequence
  chemically synthesized
tagtaatatgtactaatgcaaa

SEQ ID NO: 931576 - DNA, 22 bp, Artificial Sequence
  chemically synthesized
actaccatatttgcattagtac

SEQ ID NO: 931577 - DNA, 22 bp, Artificial Sequence
  chemically synthesized
ctaccatatttgcattagtaca

SEQ ID NO: 931578 - DNA, 22 bp, Artificial Sequence
  chemically synthesized
ccatatttgcattagtacatat

SEQ ID NO: 931579 - DNA, 22 bp, Artificial Sequence
  chemically synthesized
aaaaactttagtaatatgtact

SEQ ID NO: 931580 - DNA, 22 bp, Artificial Sequence
  chemically synthesized
tgaaaaactttagtaatatgta

SEQ ID NO: 931581 - DNA, 22 bp, Artificial Sequence
  chemically synthesized
gcattagtacatattactaaag

SEQ ID NO: 931582 - DNA, 22 bp, Artificial Sequence
  chemically synthesized
cattagtacatattactaaagt

SEQ ID NO: 931583 - DNA, 22 bp, Artificial Sequence
  chemically synthesized
gtacatattactaaagtttttc

SEQ ID NO: 931584 - DNA, 22 bp, Artificial Sequence
  chemically synthesized
tatatggccatatctctgaaaa

SEQ ID NO: 931585 - DNA, 22 bp, Artificial Sequence
  chemically synthesized
ctaaagtttttcagagatatgg

SEQ ID NO: 931586 - DNA, 22 bp, Artificial Sequence
  chemically synthesized
cccactatatatggccatatct

SEQ ID NO: 931587 - DNA, 22 bp, Artificial Sequence
  chemically synthesized
aagtttttcagagatatggcca

SEQ ID NO: 931588 - DNA, 22 bp, Artificial Sequence
  chemically synthesized
acccactatatatggccatatc

SEQ ID NO: 931589 - DNA, 22 bp, Artificial Sequence
  chemically synthesized
tacccactatatatggccatat

SEQ ID NO: 931590 - DNA, 22 bp, Artificial Sequence
  chemically synthesized
ttacccactatatatggccata

SEQ ID NO: 931591 - DNA, 22 bp, Artificial Sequence
  chemically synthesized
ttcagagatatggccatatata

SEQ ID NO: 931592 - DNA, 22 bp, Artificial Sequence
  chemically synthesized
tcagagatatggccatatatag

SEQ ID NO: 931593 - DNA, 22 bp, Artificial Sequence
  chemically synthesized
cagagatatggccatatatagt

SEQ ID NO: 931594 - DNA, 22 bp, Artificial Sequence
  chemically synthesized
agagatatggccatatatagtg

SEQ ID NO: 931595 - DNA, 22 bp, Artificial Sequence
  chemically synthesized
gtatcttttacccactatatat

SEQ ID NO: 931596 - DNA, 22 bp, Artificial Sequence
  chemically synthesized
ggtatcttttacccactatata

SEQ ID NO: 931597 - DNA, 22 bp, Artificial Sequence
  chemically synthesized
tggtatcttttacccactatat

SEQ ID NO: 931598 - DNA, 22 bp, Artificial Sequence
  chemically synthesized
ttggtatcttttacccactata

SEQ ID NO: 931599 - DNA, 22 bp, Artificial Sequence
  chemically synthesized
tgatttttggtatcttttaccc

SEQ ID NO: 931600 - DNA, 22 bp, Artificial Sequence
  chemically synthesized
atgatttttggtatcttttacc

SEQ ID NO: 931601 - DNA, 22 bp, Artificial Sequence
  chemically synthesized
tttatgatttttggtatctttt

SEQ ID NO: 931602 - DNA, 22 bp, Artificial Sequence
  chemically synthesized
agaaagaataaaatgttattta

SEQ ID NO: 931603 - DNA, 22 bp, Artificial Sequence
  chemically synthesized
gagaaagaataaaatgttattt

SEQ ID NO: 931604 - DNA, 22 bp, Artificial Sequence
  chemically synthesized
cttgagaaagaataaaatgtta

SEQ ID NO: 931605 - DNA, 22 bp, Artificial Sequence
  chemically synthesized
aataatgttacttgagaaagaa

SEQ ID NO: 931606 - DNA, 22 bp, Artificial Sequence
  chemically synthesized
gaggagctgaataatgttactt

SEQ ID NO: 931607 - DNA, 22 bp, Artificial Sequence
  chemically synthesized
tattctttctcaagtaacatta

SEQ ID NO: 931608 - DNA, 22 bp, Artificial Sequence
  chemically synthesized
attctttctcaagtaacattat

SEQ ID NO: 931609 - DNA, 22 bp, Artificial Sequence
  chemically synthesized
ttctttctcaagtaacattatt

SEQ ID NO: 931610 - DNA, 22 bp, Artificial Sequence
  chemically synthesized
tattagaggagctgaataatgt

SEQ ID NO: 931611 - DNA, 22 bp, Artificial Sequence
  chemically synthesized
tttctcaagtaacattattcag

SEQ ID NO: 931612 - DNA, 22 bp, Artificial Sequence
  chemically synthesized
tctcaagtaacattattcagct

SEQ ID NO: 931613 - DNA, 22 bp, Artificial Sequence
  chemically synthesized
ctcaagtaacattattcagctc

SEQ ID NO: 931614 - DNA, 22 bp, Artificial Sequence
  chemically synthesized
tcaagtaacattattcagctcc

SEQ ID NO: 931615 - DNA, 22 bp, Artificial Sequence
  chemically synthesized
aaattatattagaggagctgaa

SEQ ID NO: 931616 - DNA, 22 bp, Artificial Sequence
  chemically synthesized
aagtaacattattcagctcctc

SEQ ID NO: 931617 - DNA, 22 bp, Artificial Sequence
  chemically synthesized
tgaaattatattagaggagctg

SEQ ID NO: 931618 - DNA, 22 bp, Artificial Sequence
  chemically synthesized
ttcagctcctctaatataattt

SEQ ID NO: 931619 - DNA, 22 bp, Artificial Sequence
  chemically synthesized
acaaaagctctgaaattatatt

SEQ ID NO: 931620 - DNA, 22 bp, Artificial Sequence
  chemically synthesized
agctcctctaatataatttcag

SEQ ID NO: 931621 - DNA, 22 bp, Artificial Sequence
  chemically synthesized
ctctaatataatttcagagctt

SEQ ID NO: 931622 - DNA, 22 bp, Artificial Sequence
  chemically synthesized
taatataatttcagagcttttg

SEQ ID NO: 931623 - DNA, 22 bp, Artificial Sequence
  chemically synthesized
atataatttcagagcttttgtt

SEQ ID NO: 931624 - DNA, 22 bp, Artificial Sequence
  chemically synthesized
gtatgtagaaaaataccattaa

SEQ ID NO: 931625 - DNA, 22 bp, Artificial Sequence
  chemically synthesized
cagagcttttgttaatggtatt

SEQ ID NO: 931626 - DNA, 22 bp, Artificial Sequence
  chemically synthesized
agagcttttgttaatggtattt

SEQ ID NO: 931627 - DNA, 22 bp, Artificial Sequence
  chemically synthesized
aaaactagtatgtagaaaaata

SEQ ID NO: 931628 - DNA, 22 bp, Artificial Sequence
  chemically synthesized
ttgttaatggtatttttctaca

SEQ ID NO: 931629 - DNA, 22 bp, Artificial Sequence
  chemically synthesized
tgttaatggtatttttctacat

SEQ ID NO: 931630 - DNA, 22 bp, Artificial Sequence
  chemically synthesized
ttcaaaactagtatgtagaaaa

SEQ ID NO: 931631 - DNA, 22 bp, Artificial Sequence
  chemically synthesized
gttaatggtatttttctacata

SEQ ID NO: 931632 - DNA, 22 bp, Artificial Sequence
  chemically synthesized
attcaaaactagtatgtagaaa

SEQ ID NO: 931633 - DNA, 22 bp, Artificial Sequence
  chemically synthesized
ttaatggtatttttctacatac

SEQ ID NO: 931634 - DNA, 22 bp, Artificial Sequence
  chemically synthesized
atggtatttttctacatactag

SEQ ID NO: 931635 - DNA, 22 bp, Artificial Sequence
  chemically synthesized
ttctacatactagttttgaata

SEQ ID NO: 931636 - DNA, 22 bp, Artificial Sequence
  chemically synthesized
tctacatactagttttgaataa

SEQ ID NO: 931637 - DNA, 22 bp, Artificial Sequence
  chemically synthesized
ctacatactagttttgaataaa

SEQ ID NO: 931638 - DNA, 22 bp, Artificial Sequence
  chemically synthesized
tacatactagttttgaataaat

SEQ ID NO: 931639 - DNA, 22 bp, Artificial Sequence
  chemically synthesized
atggtagacatgaatttattca

SEQ ID NO: 931640 - DNA, 22 bp, Artificial Sequence
  chemically synthesized
catactagttttgaataaattc

SEQ ID NO: 931641 - DNA, 22 bp, Artificial Sequence
  chemically synthesized
gttttgaataaattcatgtcta

SEQ ID NO: 931642 - DNA, 22 bp, Artificial Sequence
  chemically synthesized
gatagttcatggtagacatgaa

SEQ ID NO: 931643 - DNA, 22 bp, Artificial Sequence
  chemically synthesized
tgaataaattcatgtctaccat

SEQ ID NO: 931644 - DNA, 22 bp, Artificial Sequence
  chemically synthesized
cctagatagttcatggtagaca

SEQ ID NO: 931645 - DNA, 22 bp, Artificial Sequence
  chemically synthesized
gaataaattcatgtctaccatg

SEQ ID NO: 931646 - DNA, 22 bp, Artificial Sequence
  chemically synthesized
aataaattcatgtctaccatga

SEQ ID NO: 931647 - DNA, 22 bp, Artificial Sequence
  chemically synthesized
tccctagatagttcatggtaga

SEQ ID NO: 931648 - DNA, 22 bp, Artificial Sequence
  chemically synthesized
ctccctagatagttcatggtag

SEQ ID NO: 931649 - DNA, 22 bp, Artificial Sequence
  chemically synthesized
atgtctaccatgaactatctag

SEQ ID NO: 931650 - DNA, 22 bp, Artificial Sequence
  chemically synthesized
acaacatttctccctagatagt

SEQ ID NO: 931651 - DNA, 22 bp, Artificial Sequence
  chemically synthesized
aacaacatttctccctagatag

SEQ ID NO: 931652 - DNA, 22 bp, Artificial Sequence
  chemically synthesized
taacaacatttctccctagata

SEQ ID NO: 931653 - DNA, 22 bp, Artificial Sequence
  chemically synthesized
ttaacaacatttctccctagat

SEQ ID NO: 931654 - DNA, 22 bp, Artificial Sequence
  chemically synthesized
ccatgaactatctagggagaaa

SEQ ID NO: 931655 - DNA, 22 bp, Artificial Sequence
  chemically synthesized
taacagcatttttaacaacatt

SEQ ID NO: 931656 - DNA, 22 bp, Artificial Sequence
  chemically synthesized
gtaacagcatttttaacaacat

SEQ ID NO: 931657 - DNA, 22 bp, Artificial Sequence
  chemically synthesized
tctagggagaaatgttgttaaa

SEQ ID NO: 931658 - DNA, 22 bp, Artificial Sequence
  chemically synthesized
gggagaaatgttgttaaaaatg

SEQ ID NO: 931659 - DNA, 22 bp, Artificial Sequence
  chemically synthesized
tggaacttgtaacagcattttt

SEQ ID NO: 931660 - DNA, 22 bp, Artificial Sequence
  chemically synthesized
atggaacttgtaacagcatttt

SEQ ID NO: 931661 - DNA, 22 bp, Artificial Sequence
  chemically synthesized
agtttatggaacttgtaacagc

SEQ ID NO: 931662 - DNA, 22 bp, Artificial Sequence
  chemically synthesized
ttaaaaatgctgttacaagttc

SEQ ID NO: 931663 - DNA, 22 bp, Artificial Sequence
  chemically synthesized
aaaatgctgttacaagttccat

SEQ ID NO: 931664 - DNA, 22 bp, Artificial Sequence
  chemically synthesized
ttacaagttccataaacttagt

SEQ ID NO: 931665 - DNA, 22 bp, Artificial Sequence
  chemically synthesized
caagttccataaacttagttta

SEQ ID NO: 931666 - DNA, 22 bp, Artificial Sequence
  chemically synthesized
taagatatcaagtaaactaagt

SEQ ID NO: 931667 - DNA, 22 bp, Artificial Sequence
  chemically synthesized
ataagatatcaagtaaactaag

SEQ ID NO: 931668 - DNA, 22 bp, Artificial Sequence
  chemically synthesized
cataaacttagtttacttgata

SEQ ID NO: 931669 - DNA, 22 bp, Artificial Sequence
  chemically synthesized
agtttacttgatatcttataaa

SEQ ID NO: 931670 - DNA, 22 bp, Artificial Sequence
  chemically synthesized
gtttacttgatatcttataaac

SEQ ID NO: 931671 - DNA, 22 bp, Artificial Sequence
  chemically synthesized
caaaaggcagcatgtttataag

SEQ ID NO: 931672 - DNA, 22 bp, Artificial Sequence
  chemically synthesized
gcaaaaggcagcatgtttataa

SEQ ID NO: 931673 - DNA, 22 bp, Artificial Sequence
  chemically synthesized
tgcaaaaggcagcatgtttata

SEQ ID NO: 931674 - DNA, 22 bp, Artificial Sequence
  chemically synthesized
acttgatatcttataaacatgc

SEQ ID NO: 931675 - DNA, 22 bp, Artificial Sequence
  chemically synthesized
cttgatatcttataaacatgct

SEQ ID NO: 931676 - DNA, 22 bp, Artificial Sequence
  chemically synthesized
gatatcttataaacatgctgcc

SEQ ID NO: 931677 - DNA, 22 bp, Artificial Sequence
  chemically synthesized
tattttgcaaaaggcagcatgt

SEQ ID NO: 931678 - DNA, 22 bp, Artificial Sequence
  chemically synthesized
atatcttataaacatgctgcct

SEQ ID NO: 931679 - DNA, 22 bp, Artificial Sequence
  chemically synthesized
ataaacatgctgccttttgcaa

SEQ ID NO: 931680 - DNA, 22 bp, Artificial Sequence
  chemically synthesized
taaacatgctgccttttgcaaa

SEQ ID NO: 931681 - DNA, 22 bp, Artificial Sequence
  chemically synthesized
agtagtaatctgtattttgcaa

SEQ ID NO: 931682 - DNA, 22 bp, Artificial Sequence
  chemically synthesized
cagtagtaatctgtattttgca

SEQ ID NO: 931683 - DNA, 22 bp, Artificial Sequence
  chemically synthesized
atttcagtagtaatctgtattt

SEQ ID NO: 931684 - DNA, 22 bp, Artificial Sequence
  chemically synthesized
ccttttgcaaaatacagattac

SEQ ID NO: 931685 - DNA, 22 bp, Artificial Sequence
  chemically synthesized
ctgatttcagtagtaatctgta

SEQ ID NO: 931686 - DNA, 22 bp, Artificial Sequence
  chemically synthesized
cctgatttcagtagtaatctgt

SEQ ID NO: 931687 - DNA, 22 bp, Artificial Sequence
  chemically synthesized
tcctgatttcagtagtaatctg

SEQ ID NO: 931688 - DNA, 22 bp, Artificial Sequence
  chemically synthesized
ttgcaaaatacagattactact

SEQ ID NO: 931689 - DNA, 22 bp, Artificial Sequence
  chemically synthesized
tgcaaaatacagattactactg

SEQ ID NO: 931690 - DNA, 22 bp, Artificial Sequence
  chemically synthesized
gcaaaatacagattactactga

SEQ ID NO: 931691 - DNA, 22 bp, Artificial Sequence
  chemically synthesized
caaaatacagattactactgaa

SEQ ID NO: 931692 - DNA, 22 bp, Artificial Sequence
  chemically synthesized
agctttcctgatttcagtagta

SEQ ID NO: 931693 - DNA, 22 bp, Artificial Sequence
  chemically synthesized
taagctttcctgatttcagtag

SEQ ID NO: 931694 - DNA, 22 bp, Artificial Sequence
  chemically synthesized
ataattctaagctttcctgatt

SEQ ID NO: 931695 - DNA, 22 bp, Artificial Sequence
  chemically synthesized
aataattctaagctttcctgat

SEQ ID NO: 931696 - DNA, 22 bp, Artificial Sequence
  chemically synthesized
ctactgaaatcaggaaagctta

SEQ ID NO: 931697 - DNA, 22 bp, Artificial Sequence
  chemically synthesized
tcttaataattctaagctttcc

SEQ ID NO: 931698 - DNA, 22 bp, Artificial Sequence
  chemically synthesized
ctgaaatcaggaaagcttagaa

SEQ ID NO: 931699 - DNA, 22 bp, Artificial Sequence
  chemically synthesized
aaatcaggaaagcttagaatta

SEQ ID NO: 931700 - DNA, 22 bp, Artificial Sequence
  chemically synthesized
caatacgtctgtcttaataatt

SEQ ID NO: 931701 - DNA, 22 bp, Artificial Sequence
  chemically synthesized
cctacaatacgtctgtcttaat

SEQ ID NO: 931702 - DNA, 22 bp, Artificial Sequence
  chemically synthesized
ccctacaatacgtctgtcttaa

SEQ ID NO: 931703 - DNA, 22 bp, Artificial Sequence
  chemically synthesized
tttccctacaatacgtctgtct

SEQ ID NO: 931704 - DNA, 22 bp, Artificial Sequence
  chemically synthesized
atttccctacaatacgtctgtc

SEQ ID NO: 931705 - DNA, 22 bp, Artificial Sequence
  chemically synthesized
agaattattaagacagacgtat

SEQ ID NO: 931706 - DNA, 22 bp, Artificial Sequence
  chemically synthesized
gaattattaagacagacgtatt

SEQ ID NO: 931707 - DNA, 22 bp, Artificial Sequence
  chemically synthesized
ccttatttccctacaatacgtc

SEQ ID NO: 931708 - DNA, 22 bp, Artificial Sequence
  chemically synthesized
cccttatttccctacaatacgt

SEQ ID NO: 931709 - DNA, 22 bp, Artificial Sequence
  chemically synthesized
tcccttatttccctacaatacg

SEQ ID NO: 931710 - DNA, 22 bp, Artificial Sequence
  chemically synthesized
ttaagacagacgtattgtaggg

SEQ ID NO: 931711 - DNA, 22 bp, Artificial Sequence
  chemically synthesized
agacagacgtattgtagggaaa

SEQ ID NO: 931712 - DNA, 22 bp, Artificial Sequence
  chemically synthesized
gagcaattttcccttatttccc

SEQ ID NO: 931713 - DNA, 22 bp, Artificial Sequence
  chemically synthesized
tagggaaataagggaaaattgc

SEQ ID NO: 931714 - DNA, 22 bp, Artificial Sequence
  chemically synthesized
aatgtcagaacaaaattagagc

SEQ ID NO: 931715 - DNA, 22 bp, Artificial Sequence
  chemically synthesized
tgaatgtcagaacaaaattaga

SEQ ID NO: 931716 - DNA, 22 bp, Artificial Sequence
  chemically synthesized
tattctgaatgtcagaacaaaa

SEQ ID NO: 931717 - DNA, 22 bp, Artificial Sequence
  chemically synthesized
atattctgaatgtcagaacaaa

SEQ ID NO: 931718 - DNA, 22 bp, Artificial Sequence
  chemically synthesized
tatattctgaatgtcagaacaa

SEQ ID NO: 931719 - DNA, 22 bp, Artificial Sequence
  chemically synthesized
ctctaattttgttctgacattc

SEQ ID NO: 931720 - DNA, 22 bp, Artificial Sequence
  chemically synthesized
tctttatattctgaatgtcaga

SEQ ID NO: 931721 - DNA, 22 bp, Artificial Sequence
  chemically synthesized
taattttgttctgacattcaga

SEQ ID NO: 931722 - DNA, 22 bp, Artificial Sequence
  chemically synthesized
ttatctttatattctgaatgtc

SEQ ID NO: 931723 - DNA, 22 bp, Artificial Sequence
  chemically synthesized
attttgttctgacattcagaat

SEQ ID NO: 931724 - DNA, 22 bp, Artificial Sequence
  chemically synthesized
tgttctgacattcagaatataa

SEQ ID NO: 931725 - DNA, 22 bp, Artificial Sequence
  chemically synthesized
gttctgacattcagaatataaa

SEQ ID NO: 931726 - DNA, 22 bp, Artificial Sequence
  chemically synthesized
ttctgacattcagaatataaag

SEQ ID NO: 931727 - DNA, 22 bp, Artificial Sequence
  chemically synthesized
tgacattcagaatataaagata

SEQ ID NO: 931728 - DNA, 22 bp, Artificial Sequence
  chemically synthesized
acattcagaatataaagataat

SEQ ID NO: 931729 - DNA, 22 bp, Artificial Sequence
  chemically synthesized
acatcatgataatacctattat

SEQ ID NO: 931730 - DNA, 22 bp, Artificial Sequence
  chemically synthesized
agaatataaagataataggtat

SEQ ID NO: 931731 - DNA, 22 bp, Artificial Sequence
  chemically synthesized
atggagcatgttgacatcatga

SEQ ID NO: 931732 - DNA, 22 bp, Artificial Sequence
  chemically synthesized
gatggagcatgttgacatcatg

SEQ ID NO: 931733 - DNA, 22 bp, Artificial Sequence
  chemically synthesized
tgatggagcatgttgacatcat

SEQ ID NO: 931734 - DNA, 22 bp, Artificial Sequence
  chemically synthesized
tcatgatgtcaacatgctccat

SEQ ID NO: 931735 - DNA, 22 bp, Artificial Sequence
  chemically synthesized
aatgggagttttgatggagcat

SEQ ID NO: 931736 - DNA, 22 bp, Artificial Sequence
  chemically synthesized
catcaaaactcccattcaatac

SEQ ID NO: 931737 - DNA, 22 bp, Artificial Sequence
  chemically synthesized
ccattcaataccattctttttc

SEQ ID NO: 931738 - DNA, 22 bp, Artificial Sequence
  chemically synthesized
aataccattctttttccatata

SEQ ID NO: 931739 - DNA, 22 bp, Artificial Sequence
  chemically synthesized
tttttccatatatacttacttt

SEQ ID NO: 931740 - DNA, 22 bp, Artificial Sequence
  chemically synthesized
tttccatatatacttacttttt

SEQ ID NO: 931741 - DNA, 22 bp, Artificial Sequence
  chemically synthesized
ttccatatatacttactttttt

SEQ ID NO: 931742 - DNA, 22 bp, Artificial Sequence
  chemically synthesized
tccatatatacttacttttttt

SEQ ID NO: 931743 - DNA, 22 bp, Artificial Sequence
  chemically synthesized
ccatatatacttactttttttt

SEQ ID NO: 931744 - DNA, 22 bp, Artificial Sequence
  chemically synthesized
catatatacttacttttttttt

SEQ ID NO: 931745 - DNA, 22 bp, Artificial Sequence
  chemically synthesized
aggccaaggatgaggaaaaaaa

SEQ ID NO: 931746 - DNA, 22 bp, Artificial Sequence
  chemically synthesized
tattaaggccaaggatgaggaa

SEQ ID NO: 931747 - DNA, 22 bp, Artificial Sequence
  chemically synthesized
gtattaaggccaaggatgagga

SEQ ID NO: 931748 - DNA, 22 bp, Artificial Sequence
  chemically synthesized
tgtattaaggccaaggatgagg

SEQ ID NO: 931749 - DNA, 22 bp, Artificial Sequence
  chemically synthesized
actttttttttcctcatccttg

SEQ ID NO: 931750 - DNA, 22 bp, Artificial Sequence
  chemically synthesized
ctttttttttcctcatccttgg

SEQ ID NO: 931751 - DNA, 22 bp, Artificial Sequence
  chemically synthesized
tttttttcctcatccttggcct

SEQ ID NO: 931752 - DNA, 22 bp, Artificial Sequence
  chemically synthesized
agttttgtattaaggccaagga

SEQ ID NO: 931753 - DNA, 22 bp, Artificial Sequence
  chemically synthesized
ttttttcctcatccttggcctt

SEQ ID NO: 931754 - DNA, 22 bp, Artificial Sequence
  chemically synthesized
tttttcctcatccttggcctta

SEQ ID NO: 931755 - DNA, 22 bp, Artificial Sequence
  chemically synthesized
ttttcctcatccttggccttaa

SEQ ID NO: 931756 - DNA, 22 bp, Artificial Sequence
  chemically synthesized
tttcctcatccttggccttaat

SEQ ID NO: 931757 - DNA, 22 bp, Artificial Sequence
  chemically synthesized
ttcctcatccttggccttaata

SEQ ID NO: 931758 - DNA, 22 bp, Artificial Sequence
  chemically synthesized
tcctcatccttggccttaatac

SEQ ID NO: 931759 - DNA, 22 bp, Artificial Sequence
  chemically synthesized
cctcatccttggccttaataca

SEQ ID NO: 931760 - DNA, 22 bp, Artificial Sequence
  chemically synthesized
ctcatccttggccttaatacaa

SEQ ID NO: 931761 - DNA, 22 bp, Artificial Sequence
  chemically synthesized
atccttggccttaatacaaaac

SEQ ID NO: 931762 - DNA, 22 bp, Artificial Sequence
  chemically synthesized
taaatgaaatattgagttttgt

SEQ ID NO: 931763 - DNA, 22 bp, Artificial Sequence
  chemically synthesized
ggccttaatacaaaactcaata

SEQ ID NO: 931764 - DNA, 22 bp, Artificial Sequence
  chemically synthesized
gccttaatacaaaactcaatat

SEQ ID NO: 931765 - DNA, 22 bp, Artificial Sequence
  chemically synthesized
aaactataaatgaaatattgag

SEQ ID NO: 931766 - DNA, 22 bp, Artificial Sequence
  chemically synthesized
caaactataaatgaaatattga

SEQ ID NO: 931767 - DNA, 22 bp, Artificial Sequence
  chemically synthesized
aatacaaaactcaatatttcat

SEQ ID NO: 931768 - DNA, 22 bp, Artificial Sequence
  chemically synthesized
atacaaaactcaatatttcatt

SEQ ID NO: 931769 - DNA, 22 bp, Artificial Sequence
  chemically synthesized
aatatttcatttatagtttgaa

SEQ ID NO: 931770 - DNA, 22 bp, Artificial Sequence
  chemically synthesized
catttatagtttgaaattttgt

SEQ ID NO: 931771 - DNA, 22 bp, Artificial Sequence
  chemically synthesized
gggtagtatgtaacaaaatttc

SEQ ID NO: 931772 - DNA, 22 bp, Artificial Sequence
  chemically synthesized
atttatagtttgaaattttgtt

SEQ ID NO: 931773 - DNA, 22 bp, Artificial Sequence
  chemically synthesized
atagtttgaaattttgttacat

SEQ ID NO: 931774 - DNA, 22 bp, Artificial Sequence
  chemically synthesized
tagtttgaaattttgttacata

SEQ ID NO: 931775 - DNA, 22 bp, Artificial Sequence
  chemically synthesized
gaaattttgttacatactaccc

SEQ ID NO: 931776 - DNA, 22 bp, Artificial Sequence
  chemically synthesized
aaattttgttacatactaccct

SEQ ID NO: 931777 - DNA, 22 bp, Artificial Sequence
  chemically synthesized
aatccacataggattagggtag

SEQ ID NO: 931778 - DNA, 22 bp, Artificial Sequence
  chemically synthesized
caatccacataggattagggta

SEQ ID NO: 931779 - DNA, 22 bp, Artificial Sequence
  chemically synthesized
tgttacatactaccctaatcct

SEQ ID NO: 931780 - DNA, 22 bp, Artificial Sequence
  chemically synthesized
ttcaatccacataggattaggg

SEQ ID NO: 931781 - DNA, 22 bp, Artificial Sequence
  chemically synthesized
gttacatactaccctaatccta

SEQ ID NO: 931782 - DNA, 22 bp, Artificial Sequence
  chemically synthesized
cttcaatccacataggattagg

SEQ ID NO: 931783 - DNA, 22 bp, Artificial Sequence
  chemically synthesized
ttacatactaccctaatcctat

SEQ ID NO: 931784 - DNA, 22 bp, Artificial Sequence
  chemically synthesized
catactaccctaatcctatgtg

SEQ ID NO: 931785 - DNA, 22 bp, Artificial Sequence
  chemically synthesized
tacccttcttcaatccacatag

SEQ ID NO: 931786 - DNA, 22 bp, Artificial Sequence
  chemically synthesized
atacccttcttcaatccacata

SEQ ID NO: 931787 - DNA, 22 bp, Artificial Sequence
  chemically synthesized
ccctaatcctatgtggattgaa

SEQ ID NO: 931788 - DNA, 22 bp, Artificial Sequence
  chemically synthesized
atttatacccttcttcaatcca

SEQ ID NO: 931789 - DNA, 22 bp, Artificial Sequence
  chemically synthesized
ttgatttatacccttcttcaat

SEQ ID NO: 931790 - DNA, 22 bp, Artificial Sequence
  chemically synthesized
atcctatgtggattgaagaagg

SEQ ID NO: 931791 - DNA, 22 bp, Artificial Sequence
  chemically synthesized
attgatttatacccttcttcaa

SEQ ID NO: 931792 - DNA, 22 bp, Artificial Sequence
  chemically synthesized
tattgatttatacccttcttca

SEQ ID NO: 931793 - DNA, 22 bp, Artificial Sequence
  chemically synthesized
tgtggattgaagaagggtataa

SEQ ID NO: 931794 - DNA, 22 bp, Artificial Sequence
  chemically synthesized
agttttattgatttataccctt

SEQ ID NO: 931795 - DNA, 22 bp, Artificial Sequence
  chemically synthesized
aagttttattgatttataccct

SEQ ID NO: 931796 - DNA, 22 bp, Artificial Sequence
  chemically synthesized
taagttttattgatttataccc

SEQ ID NO: 931797 - DNA, 22 bp, Artificial Sequence
  chemically synthesized
agttttaagttttattgattta

SEQ ID NO: 931798 - DNA, 22 bp, Artificial Sequence
  chemically synthesized
aagaagggtataaatcaataaa

SEQ ID NO: 931799 - DNA, 22 bp, Artificial Sequence
  chemically synthesized
aaggagaaaattcagttttaag

SEQ ID NO: 931800 - DNA, 22 bp, Artificial Sequence
  chemically synthesized
aaaggagaaaattcagttttaa

SEQ ID NO: 931801 - DNA, 22 bp, Artificial Sequence
  chemically synthesized
cttaaaggagaaaattcagttt

SEQ ID NO: 931802 - DNA, 22 bp, Artificial Sequence
  chemically synthesized
aactgcttaaaggagaaaattc

SEQ ID NO: 931803 - DNA, 22 bp, Artificial Sequence
  chemically synthesized
aaaactgaattttctcctttaa

SEQ ID NO: 931804 - DNA, 22 bp, Artificial Sequence
  chemically synthesized
aaactgaattttctcctttaag

SEQ ID NO: 931805 - DNA, 22 bp, Artificial Sequence
  chemically synthesized
aaatatctaaactgcttaaagg

SEQ ID NO: 931806 - DNA, 22 bp, Artificial Sequence
  chemically synthesized
aattttctcctttaagcagttt

SEQ ID NO: 931807 - DNA, 22 bp, Artificial Sequence
  chemically synthesized
attaaaatatctaaactgctta

SEQ ID NO: 931808 - DNA, 22 bp, Artificial Sequence
  chemically synthesized
ctaattaaaatatctaaactgc

SEQ ID NO: 931809 - DNA, 22 bp, Artificial Sequence
  chemically synthesized
actaattaaaatatctaaactg

SEQ ID NO: 931810 - DNA, 22 bp, Artificial Sequence
  chemically synthesized
tctcctttaagcagtttagata

SEQ ID NO: 931811 - DNA, 22 bp, Artificial Sequence
  chemically synthesized
ctcctttaagcagtttagatat

SEQ ID NO: 931812 - DNA, 22 bp, Artificial Sequence
  chemically synthesized
tcctttaagcagtttagatatt

SEQ ID NO: 931813 - DNA, 22 bp, Artificial Sequence
  chemically synthesized
ctttaagcagtttagatatttt

SEQ ID NO: 931814 - DNA, 22 bp, Artificial Sequence
  chemically synthesized
tgtttactaattaaaatatcta

SEQ ID NO: 931815 - DNA, 22 bp, Artificial Sequence
  chemically synthesized
gtgtttactaattaaaatatct

SEQ ID NO: 931816 - DNA, 22 bp, Artificial Sequence
  chemically synthesized
taagcagtttagatattttaat

SEQ ID NO: 931817 - DNA, 22 bp, Artificial Sequence
  chemically synthesized
aagcagtttagatattttaatt

SEQ ID NO: 931818 - DNA, 22 bp, Artificial Sequence
  chemically synthesized
tttgtgtttactaattaaaata

SEQ ID NO: 931819 - DNA, 22 bp, Artificial Sequence
  chemically synthesized
agcagtttagatattttaatta

SEQ ID NO: 931820 - DNA, 22 bp, Artificial Sequence
  chemically synthesized
gtttgtgtttactaattaaaat

SEQ ID NO: 931821 - DNA, 22 bp, Artificial Sequence
  chemically synthesized
tttgtttgtgtttactaattaa

SEQ ID NO: 931822 - DNA, 22 bp, Artificial Sequence
  chemically synthesized
atttgtttgtgtttactaatta

SEQ ID NO: 931823 - DNA, 22 bp, Artificial Sequence
  chemically synthesized
agatattttaattagtaaacac

SEQ ID NO: 931824 - DNA, 22 bp, Artificial Sequence
  chemically synthesized
gatattttaattagtaaacaca

SEQ ID NO: 931825 - DNA, 22 bp, Artificial Sequence
  chemically synthesized
accttatttgtttgtgtttact

SEQ ID NO: 931826 - DNA, 22 bp, Artificial Sequence
  chemically synthesized
taattagtaaacacaaacaaat

SEQ ID NO: 931827 - DNA, 22 bp, Artificial Sequence
  chemically synthesized
aattagtaaacacaaacaaata

SEQ ID NO: 931828 - DNA, 22 bp, Artificial Sequence
  chemically synthesized
attagtaaacacaaacaaataa

SEQ ID NO: 931829 - DNA, 22 bp, Artificial Sequence
  chemically synthesized
gtaaacacaaacaaataaggtt

SEQ ID NO: 931830 - DNA, 22 bp, Artificial Sequence
  chemically synthesized
aatgtgcaatacatagctaacc

SEQ ID NO: 931831 - DNA, 22 bp, Artificial Sequence
  chemically synthesized
aaatgtgcaatacatagctaac

SEQ ID NO: 931832 - DNA, 22 bp, Artificial Sequence
  chemically synthesized
taaatgtgcaatacatagctaa

SEQ ID NO: 931833 - DNA, 22 bp, Artificial Sequence
  chemically synthesized
tttaaatgtgcaatacatagct

SEQ ID NO: 931834 - DNA, 22 bp, Artificial Sequence
  chemically synthesized
ctttaaatgtgcaatacatagc

SEQ ID NO: 931835 - DNA, 22 bp, Artificial Sequence
  chemically synthesized
gctatgtattgcacatttaaag

SEQ ID NO: 931836 - DNA, 22 bp, Artificial Sequence
  chemically synthesized
acagtgtgatatttctttaaat

SEQ ID NO: 931837 - DNA, 22 bp, Artificial Sequence
  chemically synthesized
tgtattgcacatttaaagaaat

SEQ ID NO: 931838 - DNA, 22 bp, Artificial Sequence
  chemically synthesized
acattgacagtgtgatatttct

SEQ ID NO: 931839 - DNA, 22 bp, Artificial Sequence
  chemically synthesized
cacattgacagtgtgatatttc

SEQ ID NO: 931840 - DNA, 22 bp, Artificial Sequence
  chemically synthesized
tcacattgacagtgtgatattt

SEQ ID NO: 931841 - DNA, 22 bp, Artificial Sequence
  chemically synthesized
cacatttaaagaaatatcacac

SEQ ID NO: 931842 - DNA, 22 bp, Artificial Sequence
  chemically synthesized
ttcacattgacagtgtgatatt

SEQ ID NO: 931843 - DNA, 22 bp, Artificial Sequence
  chemically synthesized
ttttcacattgacagtgtgata

SEQ ID NO: 931844 - DNA, 22 bp, Artificial Sequence
  chemically synthesized
cttttcacattgacagtgtgat

SEQ ID NO: 931845 - DNA, 22 bp, Artificial Sequence
  chemically synthesized
aaagaaatatcacactgtcaat

SEQ ID NO: 931846 - DNA, 22 bp, Artificial Sequence
  chemically synthesized
aagaaatatcacactgtcaatg

SEQ ID NO: 931847 - DNA, 22 bp, Artificial Sequence
  chemically synthesized
caaatttcttttcacattgaca

SEQ ID NO: 931848 - DNA, 22 bp, Artificial Sequence
  chemically synthesized
acaaatttcttttcacattgac

SEQ ID NO: 931849 - DNA, 22 bp, Artificial Sequence
  chemically synthesized
cttacaaatttcttttcacatt

SEQ ID NO: 931850 - DNA, 22 bp, Artificial Sequence
  chemically synthesized
ccttacaaatttcttttcacat

SEQ ID NO: 931851 - DNA, 22 bp, Artificial Sequence
  chemically synthesized
tccttacaaatttcttttcaca

SEQ ID NO: 931852 - DNA, 22 bp, Artificial Sequence
  chemically synthesized
ttccttacaaatttcttttcac

SEQ ID NO: 931853 - DNA, 22 bp, Artificial Sequence
  chemically synthesized
tttccttacaaatttcttttca

SEQ ID NO: 931854 - DNA, 22 bp, Artificial Sequence
  chemically synthesized
ttttccttacaaatttcttttc

SEQ ID NO: 931855 - DNA, 22 bp, Artificial Sequence
  chemically synthesized
tttttccttacaaatttctttt

SEQ ID NO: 931856 - DNA, 22 bp, Artificial Sequence
  chemically synthesized
ttttttccttacaaatttcttt

SEQ ID NO: 931857 - DNA, 22 bp, Artificial Sequence
  chemically synthesized
ttttttttccttacaaatttct

SEQ ID NO: 931858 - DNA, 22 bp, Artificial Sequence
  chemically synthesized
tcaatgtgaaaagaaatttgta

SEQ ID NO: 931859 - DNA, 22 bp, Artificial Sequence
  chemically synthesized
ttcttttttttccttacaaatt

SEQ ID NO: 931860 - DNA, 22 bp, Artificial Sequence
  chemically synthesized
gttcttttttttccttacaaat

SEQ ID NO: 931861 - DNA, 22 bp, Artificial Sequence
  chemically synthesized
tgttcttttttttccttacaaa

SEQ ID NO: 931862 - DNA, 22 bp, Artificial Sequence
  chemically synthesized
atctttgttcttttttttcctt

SEQ ID NO: 931863 - DNA, 22 bp, Artificial Sequence
  chemically synthesized
gtaaggaaaaaaaagaacaaag

SEQ ID NO: 931864 - DNA, 22 bp, Artificial Sequence
  chemically synthesized
taaggaaaaaaaagaacaaaga

SEQ ID NO: 931865 - DNA, 22 bp, Artificial Sequence
  chemically synthesized
cagatgtcccagactgatcttt

SEQ ID NO: 931866 - DNA, 22 bp, Artificial Sequence
  chemically synthesized
gaatgtattgcagatgtcccag

SEQ ID NO: 931867 - DNA, 22 bp, Artificial Sequence
  chemically synthesized
aatctggaatgtattgcagatg

SEQ ID NO: 931868 - DNA, 22 bp, Artificial Sequence
  chemically synthesized
ctgaatctggaatgtattgcag

SEQ ID NO: 931869 - DNA, 22 bp, Artificial Sequence
  chemically synthesized
ttcctgaatctggaatgtattg

SEQ ID NO: 931870 - DNA, 22 bp, Artificial Sequence
  chemically synthesized
ggacatctgcaatacattccag

SEQ ID NO: 931871 - DNA, 22 bp, Artificial Sequence
  chemically synthesized
ttgttcctgaatctggaatgta

SEQ ID NO: 931872 - DNA, 22 bp, Artificial Sequence
  chemically synthesized
gttgttcctgaatctggaatgt

SEQ ID NO: 931873 - DNA, 22 bp, Artificial Sequence
  chemically synthesized
acttgttgttcctgaatctgga

SEQ ID NO: 931874 - DNA, 22 bp, Artificial Sequence
  chemically synthesized
aacttgttgttcctgaatctgg

SEQ ID NO: 931875 - DNA, 22 bp, Artificial Sequence
  chemically synthesized
caatacattccagattcaggaa

SEQ ID NO: 931876 - DNA, 22 bp, Artificial Sequence
  chemically synthesized
cagattcaggaacaacaagtta

SEQ ID NO: 931877 - DNA, 22 bp, Artificial Sequence
  chemically synthesized
aggaacaacaagttaagtatct

SEQ ID NO: 931878 - DNA, 22 bp, Artificial Sequence
  chemically synthesized
agtatctacctactcatctttt

SEQ ID NO: 931879 - DNA, 22 bp, Artificial Sequence
  chemically synthesized
acagaagatcatgccagaaaag

SEQ ID NO: 931880 - DNA, 22 bp, Artificial Sequence
  chemically synthesized
aacagaagatcatgccagaaaa

SEQ ID NO: 931881 - DNA, 22 bp, Artificial Sequence
  chemically synthesized
taacagaagatcatgccagaaa

SEQ ID NO: 931882 - DNA, 22 bp, Artificial Sequence
  chemically synthesized
cctactcatcttttctggcatg

SEQ ID NO: 931883 - DNA, 22 bp, Artificial Sequence
  chemically synthesized
ttttaacagaagatcatgccag

SEQ ID NO: 931884 - DNA, 22 bp, Artificial Sequence
  chemically synthesized
gttttaacagaagatcatgcca

SEQ ID NO: 931885 - DNA, 22 bp, Artificial Sequence
  chemically synthesized
ctcatcttttctggcatgatct

SEQ ID NO: 931886 - DNA, 22 bp, Artificial Sequence
  chemically synthesized
cttgttttaacagaagatcatg

SEQ ID NO: 931887 - DNA, 22 bp, Artificial Sequence
  chemically synthesized
atcttttctggcatgatcttct

SEQ ID NO: 931888 - DNA, 22 bp, Artificial Sequence
  chemically synthesized
ccttgttttaacagaagatcat

SEQ ID NO: 931889 - DNA, 22 bp, Artificial Sequence
  chemically synthesized
tccttgttttaacagaagatca

SEQ ID NO: 931890 - DNA, 22 bp, Artificial Sequence
  chemically synthesized
ttctggcatgatcttctgttaa

SEQ ID NO: 931891 - DNA, 22 bp, Artificial Sequence
  chemically synthesized
cctttccttgttttaacagaag

SEQ ID NO: 931892 - DNA, 22 bp, Artificial Sequence
  chemically synthesized
tctggcatgatcttctgttaaa

SEQ ID NO: 931893 - DNA, 22 bp, Artificial Sequence
  chemically synthesized
ctggcatgatcttctgttaaaa

SEQ ID NO: 931894 - DNA, 22 bp, Artificial Sequence
  chemically synthesized
tggcatgatcttctgttaaaac

SEQ ID NO: 931895 - DNA, 22 bp, Artificial Sequence
  chemically synthesized
gcatgatcttctgttaaaacaa

SEQ ID NO: 931896 - DNA, 22 bp, Artificial Sequence
  chemically synthesized
tatggtaactgcctttccttgt

SEQ ID NO: 931897 - DNA, 22 bp, Artificial Sequence
  chemically synthesized
tgtatggtaactgcctttcctt

SEQ ID NO: 931898 - DNA, 22 bp, Artificial Sequence
  chemically synthesized
ctgtatggtaactgcctttcct

SEQ ID NO: 931899 - DNA, 22 bp, Artificial Sequence
  chemically synthesized
ctgttaaaacaaggaaaggcag

SEQ ID NO: 931900 - DNA, 22 bp, Artificial Sequence
  chemically synthesized
tgttaaaacaaggaaaggcagt

SEQ ID NO: 931901 - DNA, 22 bp, Artificial Sequence
  chemically synthesized
ttaaaacaaggaaaggcagtta

SEQ ID NO: 931902 - DNA, 22 bp, Artificial Sequence
  chemically synthesized
aaacaaggaaaggcagttacca

SEQ ID NO: 931903 - DNA, 22 bp, Artificial Sequence
  chemically synthesized
acaaaatcaacatttctgtatg

SEQ ID NO: 931904 - DNA, 22 bp, Artificial Sequence
  chemically synthesized
tctgacaaaatcaacatttctg

SEQ ID NO: 931905 - DNA, 22 bp, Artificial Sequence
  chemically synthesized
tctgtctgacaaaatcaacatt

SEQ ID NO: 931906 - DNA, 22 bp, Artificial Sequence
  chemically synthesized
atctgtctgacaaaatcaacat

SEQ ID NO: 931907 - DNA, 22 bp, Artificial Sequence
  chemically synthesized
tatctgtctgacaaaatcaaca

SEQ ID NO: 931908 - DNA, 22 bp, Artificial Sequence
  chemically synthesized
ccatacagaaatgttgattttg

SEQ ID NO: 931909 - DNA, 22 bp, Artificial Sequence
  chemically synthesized
gtgatgtctttatctgtctgac

SEQ ID NO: 931910 - DNA, 22 bp, Artificial Sequence
  chemically synthesized
attttgtcagacagataaagac

SEQ ID NO: 931911 - DNA, 22 bp, Artificial Sequence
  chemically synthesized
tgtcagacagataaagacatca

SEQ ID NO: 931912 - DNA, 22 bp, Artificial Sequence
  chemically synthesized
gcatagtattagtgatgtcttt

SEQ ID NO: 931913 - DNA, 22 bp, Artificial Sequence
  chemically synthesized
gtcagacagataaagacatcac

SEQ ID NO: 931914 - DNA, 22 bp, Artificial Sequence
  chemically synthesized
ggcatagtattagtgatgtctt

SEQ ID NO: 931915 - DNA, 22 bp, Artificial Sequence
  chemically synthesized
tcagacagataaagacatcact

SEQ ID NO: 931916 - DNA, 22 bp, Artificial Sequence
  chemically synthesized
tggcatagtattagtgatgtct

SEQ ID NO: 931917 - DNA, 22 bp, Artificial Sequence
  chemically synthesized
tttggcatagtattagtgatgt

SEQ ID NO: 931918 - DNA, 22 bp, Artificial Sequence
  chemically synthesized
ttctttggcatagtattagtga

SEQ ID NO: 931919 - DNA, 22 bp, Artificial Sequence
  chemically synthesized
caattattctttggcatagtat

SEQ ID NO: 931920 - DNA, 22 bp, Artificial Sequence
  chemically synthesized
atactatgccaaagaataattg

SEQ ID NO: 931921 - DNA, 22 bp, Artificial Sequence
  chemically synthesized
tcacaataagataattgcaatt

SEQ ID NO: 931922 - DNA, 22 bp, Artificial Sequence
  chemically synthesized
tgccaaagaataattgcaatta

SEQ ID NO: 931923 - DNA, 22 bp, Artificial Sequence
  chemically synthesized
caattatcttattgtgataatt

SEQ ID NO: 931924 - DNA, 22 bp, Artificial Sequence
  chemically synthesized
tcttattgtgataatttattgc

SEQ ID NO: 931925 - DNA, 22 bp, Artificial Sequence
  chemically synthesized
tgaagtatatgaaagcaataaa

SEQ ID NO: 931926 - DNA, 22 bp, Artificial Sequence
  chemically synthesized
atgaagtatatgaaagcaataa

SEQ ID NO: 931927 - DNA, 22 bp, Artificial Sequence
  chemically synthesized
attgtgataatttattgctttc

SEQ ID NO: 931928 - DNA, 22 bp, Artificial Sequence
  chemically synthesized
tatgaagtatatgaaagcaata

SEQ ID NO: 931929 - DNA, 22 bp, Artificial Sequence
  chemically synthesized
ttgtgataatttattgctttca

SEQ ID NO: 931930 - DNA, 22 bp, Artificial Sequence
  chemically synthesized
tgataatttattgctttcatat

SEQ ID NO: 931931 - DNA, 22 bp, Artificial Sequence
  chemically synthesized
atagcactttatgaagtatatg

SEQ ID NO: 931932 - DNA, 22 bp, Artificial Sequence
  chemically synthesized
attgctttcatatacttcataa

SEQ ID NO: 931933 - DNA, 22 bp, Artificial Sequence
  chemically synthesized
ttgctttcatatacttcataaa

SEQ ID NO: 931934 - DNA, 22 bp, Artificial Sequence
  chemically synthesized
ctttcatatacttcataaagtg

SEQ ID NO: 931935 - DNA, 22 bp, Artificial Sequence
  chemically synthesized
tcatatacttcataaagtgcta

SEQ ID NO: 931936 - DNA, 22 bp, Artificial Sequence
  chemically synthesized
catatacttcataaagtgctat

SEQ ID NO: 931937 - DNA, 22 bp, Artificial Sequence
  chemically synthesized
atatacttcataaagtgctatc

SEQ ID NO: 931938 - DNA, 22 bp, Artificial Sequence
  chemically synthesized
aaatggaacaatcatctgatag

SEQ ID NO: 931939 - DNA, 22 bp, Artificial Sequence
  chemically synthesized
cataaagtgctatcagatgatt

SEQ ID NO: 931940 - DNA, 22 bp, Artificial Sequence
  chemically synthesized
ataaagtgctatcagatgattg

SEQ ID NO: 931941 - DNA, 22 bp, Artificial Sequence
  chemically synthesized
acgtggatctcaaatggaacaa

SEQ ID NO: 931942 - DNA, 22 bp, Artificial Sequence
  chemically synthesized
cacgtggatctcaaatggaaca

SEQ ID NO: 931943 - DNA, 22 bp, Artificial Sequence
  chemically synthesized
tcagatgattgttccatttgag

SEQ ID NO: 931944 - DNA, 22 bp, Artificial Sequence
  chemically synthesized
atacttcacgtggatctcaaat

SEQ ID NO: 931945 - DNA, 22 bp, Artificial Sequence
  chemically synthesized
acctcatacttcacgtggatct

SEQ ID NO: 931946 - DNA, 22 bp, Artificial Sequence
  chemically synthesized
tgacctcatacttcacgtggat

SEQ ID NO: 931947 - DNA, 22 bp, Artificial Sequence
  chemically synthesized
ttccatttgagatccacgtgaa

SEQ ID NO: 931948 - DNA, 22 bp, Artificial Sequence
  chemically synthesized
ctgacctcatacttcacgtgga

SEQ ID NO: 931949 - DNA, 22 bp, Artificial Sequence
  chemically synthesized
tctgacctcatacttcacgtgg

SEQ ID NO: 931950 - DNA, 22 bp, Artificial Sequence
  chemically synthesized
ttctgacctcatacttcacgtg

SEQ ID NO: 931951 - DNA, 22 bp, Artificial Sequence
  chemically synthesized
catttgagatccacgtgaagta

SEQ ID NO: 931952 - DNA, 22 bp, Artificial Sequence
  chemically synthesized
gagatccacgtgaagtatgagg

SEQ ID NO: 931953 - DNA, 22 bp, Artificial Sequence
  chemically synthesized
agatccacgtgaagtatgaggt

SEQ ID NO: 931954 - DNA, 22 bp, Artificial Sequence
  chemically synthesized
ggaataataacacatttttctg

SEQ ID NO: 931955 - DNA, 22 bp, Artificial Sequence
  chemically synthesized
ccctaggaataataacacattt

SEQ ID NO: 931956 - DNA, 22 bp, Artificial Sequence
  chemically synthesized
accctaggaataataacacatt

SEQ ID NO: 931957 - DNA, 22 bp, Artificial Sequence
  chemically synthesized
taccctaggaataataacacat

SEQ ID NO: 931958 - DNA, 22 bp, Artificial Sequence
  chemically synthesized
gtctttaccctaggaataataa

SEQ ID NO: 931959 - DNA, 22 bp, Artificial Sequence
  chemically synthesized
ctcgtctttaccctaggaataa

SEQ ID NO: 931960 - DNA, 22 bp, Artificial Sequence
  chemically synthesized
ttattcctagggtaaagacgag

SEQ ID NO: 931961 - DNA, 22 bp, Artificial Sequence
  chemically synthesized
gacccccaattcctcgtcttta

SEQ ID NO: 931962 - DNA, 22 bp, Artificial Sequence
  chemically synthesized
agacccccaattcctcgtcttt

SEQ ID NO: 931963 - DNA, 22 bp, Artificial Sequence
  chemically synthesized
ttcctagggtaaagacgaggaa

SEQ ID NO: 931964 - DNA, 22 bp, Artificial Sequence
  chemically synthesized
ctagggtaaagacgaggaattg

SEQ ID NO: 931965 - DNA, 22 bp, Artificial Sequence
  chemically synthesized
gggtaaagacgaggaattgggg

SEQ ID NO: 931966 - DNA, 22 bp, Artificial Sequence
  chemically synthesized
gacaaatatttagacccccaat

SEQ ID NO: 931967 - DNA, 22 bp, Artificial Sequence
  chemically synthesized
ggacaaatatttagacccccaa

SEQ ID NO: 931968 - DNA, 22 bp, Artificial Sequence
  chemically synthesized
caggacaacttggacaaatatt

SEQ ID NO: 931969 - DNA, 22 bp, Artificial Sequence
  chemically synthesized
ggggtctaaatatttgtccaag

SEQ ID NO: 931970 - DNA, 22 bp, Artificial Sequence
  chemically synthesized
tctgcaggacaacttggacaaa

SEQ ID NO: 931971 - DNA, 22 bp, Artificial Sequence
  chemically synthesized
atctgcaggacaacttggacaa

SEQ ID NO: 931972 - DNA, 22 bp, Artificial Sequence
  chemically synthesized
tatctgcaggacaacttggaca

SEQ ID NO: 931973 - DNA, 22 bp, Artificial Sequence
  chemically synthesized
aatatttgtccaagttgtcctg

SEQ ID NO: 931974 - DNA, 22 bp, Artificial Sequence
  chemically synthesized
ggacctttatctgcaggacaac

SEQ ID NO: 931975 - DNA, 22 bp, Artificial Sequence
  chemically synthesized
gtccaagttgtcctgcagataa

SEQ ID NO: 931976 - DNA, 22 bp, Artificial Sequence
  chemically synthesized
gtcctgggacctttatctgcag

SEQ ID NO: 931977 - DNA, 22 bp, Artificial Sequence
  chemically synthesized
tccaagttgtcctgcagataaa

SEQ ID NO: 931978 - DNA, 22 bp, Artificial Sequence
  chemically synthesized
gggcctggtcctgggaccttta

SEQ ID NO: 931979 - DNA, 22 bp, Artificial Sequence
  chemically synthesized
tcctgcagataaaggtcccagg

SEQ ID NO: 931980 - DNA, 22 bp, Artificial Sequence
  chemically synthesized
cagataaaggtcccaggaccag

SEQ ID NO: 931981 - DNA, 22 bp, Artificial Sequence
  chemically synthesized
aaatgtgataacaatctggggc

SEQ ID NO: 931982 - DNA, 22 bp, Artificial Sequence
  chemically synthesized
actgaaatgtgataacaatctg

SEQ ID NO: 931983 - DNA, 22 bp, Artificial Sequence
  chemically synthesized
ttatcacatttcagtgagattc

SEQ ID NO: 931984 - DNA, 22 bp, Artificial Sequence
  chemically synthesized
tcacatttcagtgagattccca

SEQ ID NO: 931985 - DNA, 22 bp, Artificial Sequence
  chemically synthesized
cagtgagattcccattattcgg

SEQ ID NO: 931986 - DNA, 22 bp, Artificial Sequence
  chemically synthesized
agtgagattcccattattcggt

SEQ ID NO: 931987 - DNA, 22 bp, Artificial Sequence
  chemically synthesized
agtcagaaaagagccagtaccg

SEQ ID NO: 931988 - DNA, 22 bp, Artificial Sequence
  chemically synthesized
gagtcagaaaagagccagtacc

SEQ ID NO: 931989 - DNA, 22 bp, Artificial Sequence
  chemically synthesized
ccattattcggtactggctctt

SEQ ID NO: 931990 - DNA, 22 bp, Artificial Sequence
  chemically synthesized
agtatttgagtcagaaaagagc

SEQ ID NO: 931991 - DNA, 22 bp, Artificial Sequence
  chemically synthesized
ttcggtactggctcttttctga

SEQ ID NO: 931992 - DNA, 22 bp, Artificial Sequence
  chemically synthesized
ggtactggctcttttctgactc

SEQ ID NO: 931993 - DNA, 22 bp, Artificial Sequence
  chemically synthesized
atatctaagtatttgagtcaga

SEQ ID NO: 931994 - DNA, 22 bp, Artificial Sequence
  chemically synthesized
aatatctaagtatttgagtcag

SEQ ID NO: 931995 - DNA, 22 bp, Artificial Sequence
  chemically synthesized
taatatctaagtatttgagtca

SEQ ID NO: 931996 - DNA, 22 bp, Artificial Sequence
  chemically synthesized
tttaatatctaagtatttgagt

SEQ ID NO: 931997 - DNA, 22 bp, Artificial Sequence
  chemically synthesized
gctcttttctgactcaaatact

SEQ ID NO: 931998 - DNA, 22 bp, Artificial Sequence
  chemically synthesized
ttttctgactcaaatacttaga

SEQ ID NO: 931999 - DNA, 22 bp, Artificial Sequence
  chemically synthesized
ttctgactcaaatacttagata

SEQ ID NO: 932000 - DNA, 22 bp, Artificial Sequence
  chemically synthesized
tctgactcaaatacttagatat

SEQ ID NO: 932001 - DNA, 22 bp, Artificial Sequence
  chemically synthesized
ctgactcaaatacttagatatt

SEQ ID NO: 932002 - DNA, 22 bp, Artificial Sequence
  chemically synthesized
tgactcaaatacttagatatta

SEQ ID NO: 932003 - DNA, 22 bp, Artificial Sequence
  chemically synthesized
gcatatatctctttaatatcta

SEQ ID NO: 932004 - DNA, 22 bp, Artificial Sequence
  chemically synthesized
actcaaatacttagatattaaa

SEQ ID NO: 932005 - DNA, 22 bp, Artificial Sequence
  chemically synthesized
aaatacttagatattaaagaga

SEQ ID NO: 932006 - DNA, 22 bp, Artificial Sequence
  chemically synthesized
atgtctcgcatatatctcttta

SEQ ID NO: 932007 - DNA, 22 bp, Artificial Sequence
  chemically synthesized
catgtctcgcatatatctcttt

SEQ ID NO: 932008 - DNA, 22 bp, Artificial Sequence
  chemically synthesized
tcatgtctcgcatatatctctt

SEQ ID NO: 932009 - DNA, 22 bp, Artificial Sequence
  chemically synthesized
ttcatgtctcgcatatatctct

SEQ ID NO: 932010 - DNA, 22 bp, Artificial Sequence
  chemically synthesized
agatattaaagagatatatgcg

SEQ ID NO: 932011 - DNA, 22 bp, Artificial Sequence
  chemically synthesized
cttttcatgtctcgcatatatc

SEQ ID NO: 932012 - DNA, 22 bp, Artificial Sequence
  chemically synthesized
gatattaaagagatatatgcga

SEQ ID NO: 932013 - DNA, 22 bp, Artificial Sequence
  chemically synthesized
tacttttcatgtctcgcatata

SEQ ID NO: 932014 - DNA, 22 bp, Artificial Sequence
  chemically synthesized
ctacttttcatgtctcgcatat

SEQ ID NO: 932015 - DNA, 22 bp, Artificial Sequence
  chemically synthesized
tctacttttcatgtctcgcata

SEQ ID NO: 932016 - DNA, 22 bp, Artificial Sequence
  chemically synthesized
aagagatatatgcgagacatga

SEQ ID NO: 932017 - DNA, 22 bp, Artificial Sequence
  chemically synthesized
tactttctacttttcatgtctc

SEQ ID NO: 932018 - DNA, 22 bp, Artificial Sequence
  chemically synthesized
gtactttctacttttcatgtct

SEQ ID NO: 932019 - DNA, 22 bp, Artificial Sequence
  chemically synthesized
tgtactttctacttttcatgtc

SEQ ID NO: 932020 - DNA, 22 bp, Artificial Sequence
  chemically synthesized
ttgtactttctacttttcatgt

SEQ ID NO: 932021 - DNA, 22 bp, Artificial Sequence
  chemically synthesized
tttgtactttctacttttcatg

SEQ ID NO: 932022 - DNA, 22 bp, Artificial Sequence
  chemically synthesized
ttttgtactttctacttttcat

SEQ ID NO: 932023 - DNA, 22 bp, Artificial Sequence
  chemically synthesized
ccgatttttttgtactttctac

SEQ ID NO: 932024 - DNA, 22 bp, Artificial Sequence
  chemically synthesized
gccgatttttttgtactttcta

SEQ ID NO: 932025 - DNA, 22 bp, Artificial Sequence
  chemically synthesized
aaagtgtacaacttgccgattt

SEQ ID NO: 932026 - DNA, 22 bp, Artificial Sequence
  chemically synthesized
aaaagtgtacaacttgccgatt

SEQ ID NO: 932027 - DNA, 22 bp, Artificial Sequence
  chemically synthesized
acaataatttaaaagtgtacaa

SEQ ID NO: 932028 - DNA, 22 bp, Artificial Sequence
  chemically synthesized
cacaataatttaaaagtgtaca

SEQ ID NO: 932029 - DNA, 22 bp, Artificial Sequence
  chemically synthesized
tcacaataatttaaaagtgtac

SEQ ID NO: 932030 - DNA, 22 bp, Artificial Sequence
  chemically synthesized
ttttcacaataatttaaaagtg

SEQ ID NO: 932031 - DNA, 22 bp, Artificial Sequence
  chemically synthesized
attattttcacaataatttaaa

SEQ ID NO: 932032 - DNA, 22 bp, Artificial Sequence
  chemically synthesized
gttaattattttcacaataatt

SEQ ID NO: 932033 - DNA, 22 bp, Artificial Sequence
  chemically synthesized
ggttaattattttcacaataat

SEQ ID NO: 932034 - DNA, 22 bp, Artificial Sequence
  chemically synthesized
tacacttttaaattattgtgaa

SEQ ID NO: 932035 - DNA, 22 bp, Artificial Sequence
  chemically synthesized
ttaaattattgtgaaaataatt

SEQ ID NO: 932036 - DNA, 22 bp, Artificial Sequence
  chemically synthesized
taaattattgtgaaaataatta

SEQ ID NO: 932037 - DNA, 22 bp, Artificial Sequence
  chemically synthesized
aaattattgtgaaaataattaa

SEQ ID NO: 932038 - DNA, 22 bp, Artificial Sequence
  chemically synthesized
tgaagtatttggttaattattt

SEQ ID NO: 932039 - DNA, 22 bp, Artificial Sequence
  chemically synthesized
aattattgtgaaaataattaac

SEQ ID NO: 932040 - DNA, 22 bp, Artificial Sequence
  chemically synthesized
ttgtgaaaataattaaccaaat

SEQ ID NO: 932041 - DNA, 22 bp, Artificial Sequence
  chemically synthesized
taattatgaagtatttggttaa

SEQ ID NO: 932042 - DNA, 22 bp, Artificial Sequence
  chemically synthesized
tgaaaataattaaccaaatact

SEQ ID NO: 932043 - DNA, 22 bp, Artificial Sequence
  chemically synthesized
ccaaaaacatctataattatga

SEQ ID NO: 932044 - DNA, 22 bp, Artificial Sequence
  chemically synthesized
accaaatacttcataattatag

SEQ ID NO: 932045 - DNA, 22 bp, Artificial Sequence
  chemically synthesized
taccaaaaacatctataattat

SEQ ID NO: 932046 - DNA, 22 bp, Artificial Sequence
  chemically synthesized
ctaccaaaaacatctataatta

SEQ ID NO: 932047 - DNA, 22 bp, Artificial Sequence
  chemically synthesized
tctaccaaaaacatctataatt

SEQ ID NO: 932048 - DNA, 22 bp, Artificial Sequence
  chemically synthesized
ttctaccaaaaacatctataat

SEQ ID NO: 932049 - DNA, 22 bp, Artificial Sequence
  chemically synthesized
tttctaccaaaaacatctataa

SEQ ID NO: 932050 - DNA, 22 bp, Artificial Sequence
  chemically synthesized
ttttctaccaaaaacatctata

SEQ ID NO: 932051 - DNA, 22 bp, Artificial Sequence
  chemically synthesized
cataattatagatgtttttggt

SEQ ID NO: 932052 - DNA, 22 bp, Artificial Sequence
  chemically synthesized
ataattatagatgtttttggta

SEQ ID NO: 932053 - DNA, 22 bp, Artificial Sequence
  chemically synthesized
tagatgtttttggtagaaaaaa

SEQ ID NO: 932054 - DNA, 22 bp, Artificial Sequence
  chemically synthesized
ttggtagaaaaaagatgattcg

SEQ ID NO: 932055 - DNA, 22 bp, Artificial Sequence
  chemically synthesized
tggtagaaaaaagatgattcga

SEQ ID NO: 932056 - DNA, 22 bp, Artificial Sequence
  chemically synthesized
ggtagaaaaaagatgattcgat

SEQ ID NO: 932057 - DNA, 22 bp, Artificial Sequence
  chemically synthesized
gtagaaaaaagatgattcgata

SEQ ID NO: 932058 - DNA, 22 bp, Artificial Sequence
  chemically synthesized
ataggaaagtgagtatcgaatc

SEQ ID NO: 932059 - DNA, 22 bp, Artificial Sequence
  chemically synthesized
aataggaaagtgagtatcgaat

SEQ ID NO: 932060 - DNA, 22 bp, Artificial Sequence
  chemically synthesized
gatactcactttcctattaaac

SEQ ID NO: 932061 - DNA, 22 bp, Artificial Sequence
  chemically synthesized
actttcctattaaacatctatt

SEQ ID NO: 932062 - DNA, 22 bp, Artificial Sequence
  chemically synthesized
tcctattaaacatctattttgt

SEQ ID NO: 932063 - DNA, 22 bp, Artificial Sequence
  chemically synthesized
tcaaagtgaaagacaaaataga

SEQ ID NO: 932064 - DNA, 22 bp, Artificial Sequence
  chemically synthesized
cctattaaacatctattttgtc

SEQ ID NO: 932065 - DNA, 22 bp, Artificial Sequence
  chemically synthesized
ctattaaacatctattttgtct

SEQ ID NO: 932066 - DNA, 22 bp, Artificial Sequence
  chemically synthesized
ttaaacatctattttgtctttc

SEQ ID NO: 932067 - DNA, 22 bp, Artificial Sequence
  chemically synthesized
aacatctattttgtctttcact

SEQ ID NO: 932068 - DNA, 22 bp, Artificial Sequence
  chemically synthesized
aagataacagcattatcaaagt

SEQ ID NO: 932069 - DNA, 22 bp, Artificial Sequence
  chemically synthesized
ttttgtctttcactttgataat

SEQ ID NO: 932070 - DNA, 22 bp, Artificial Sequence
  chemically synthesized
tgtctttcactttgataatgct

SEQ ID NO: 932071 - DNA, 22 bp, Artificial Sequence
  chemically synthesized
actgaagataacagcattatca

SEQ ID NO: 932072 - DNA, 22 bp, Artificial Sequence
  chemically synthesized
gtctttcactttgataatgctg

SEQ ID NO: 932073 - DNA, 22 bp, Artificial Sequence
  chemically synthesized
aactgaagataacagcattatc

SEQ ID NO: 932074 - DNA, 22 bp, Artificial Sequence
  chemically synthesized
tctttcactttgataatgctgt

SEQ ID NO: 932075 - DNA, 22 bp, Artificial Sequence
  chemically synthesized
tcactttgataatgctgttatc

SEQ ID NO: 932076 - DNA, 22 bp, Artificial Sequence
  chemically synthesized
tatttaactgaagataacagca

SEQ ID NO: 932077 - DNA, 22 bp, Artificial Sequence
  chemically synthesized
cactttgataatgctgttatct

SEQ ID NO: 932078 - DNA, 22 bp, Artificial Sequence
  chemically synthesized
actttgataatgctgttatctt

SEQ ID NO: 932079 - DNA, 22 bp, Artificial Sequence
  chemically synthesized
tgataatgctgttatcttcagt

SEQ ID NO: 932080 - DNA, 22 bp, Artificial Sequence
  chemically synthesized
gataatgctgttatcttcagtt

SEQ ID NO: 932081 - DNA, 22 bp, Artificial Sequence
  chemically synthesized
ataatgctgttatcttcagtta

SEQ ID NO: 932082 - DNA, 22 bp, Artificial Sequence
  chemically synthesized
acataatgattatatttaactg

SEQ ID NO: 932083 - DNA, 22 bp, Artificial Sequence
  chemically synthesized
ttcacataatgattatatttaa

SEQ ID NO: 932084 - DNA, 22 bp, Artificial Sequence
  chemically synthesized
attcacataatgattatattta

SEQ ID NO: 932085 - DNA, 22 bp, Artificial Sequence
  chemically synthesized
ttatcttcagttaaatataatc

SEQ ID NO: 932086 - DNA, 22 bp, Artificial Sequence
  chemically synthesized
tttattcacataatgattatat

SEQ ID NO: 932087 - DNA, 22 bp, Artificial Sequence
  chemically synthesized
tcttcagttaaatataatcatt

SEQ ID NO: 932088 - DNA, 22 bp, Artificial Sequence
  chemically synthesized
cagttaaatataatcattatgt

SEQ ID NO: 932089 - DNA, 22 bp, Artificial Sequence
  chemically synthesized
agttaaatataatcattatgtg

SEQ ID NO: 932090 - DNA, 22 bp, Artificial Sequence
  chemically synthesized
atccacattgtttattcacata

SEQ ID NO: 932091 - DNA, 22 bp, Artificial Sequence
  chemically synthesized
aatataatcattatgtgaataa

SEQ ID NO: 932092 - DNA, 22 bp, Artificial Sequence
  chemically synthesized
gatccacattgtttattcacat

SEQ ID NO: 932093 - DNA, 22 bp, Artificial Sequence
  chemically synthesized
tgatccacattgtttattcaca

SEQ ID NO: 932094 - DNA, 22 bp, Artificial Sequence
  chemically synthesized
ttgatccacattgtttattcac

SEQ ID NO: 932095 - DNA, 22 bp, Artificial Sequence
  chemically synthesized
tttgatccacattgtttattca

SEQ ID NO: 932096 - DNA, 22 bp, Artificial Sequence
  chemically synthesized
ttttgatccacattgtttattc

SEQ ID NO: 932097 - DNA, 22 bp, Artificial Sequence
  chemically synthesized
ttttttgatccacattgtttat

SEQ ID NO: 932098 - DNA, 22 bp, Artificial Sequence
  chemically synthesized
attcttttttgatccacattgt

SEQ ID NO: 932099 - DNA, 22 bp, Artificial Sequence
  chemically synthesized
tcattcttttttgatccacatt

SEQ ID NO: 932100 - DNA, 22 bp, Artificial Sequence
  chemically synthesized
tgtgaataaacaatgtggatca

SEQ ID NO: 932101 - DNA, 22 bp, Artificial Sequence
  chemically synthesized
ctcattcttttttgatccacat

SEQ ID NO: 932102 - DNA, 22 bp, Artificial Sequence
  chemically synthesized
atatttctcattcttttttgat

SEQ ID NO: 932103 - DNA, 22 bp, Artificial Sequence
  chemically synthesized
ggttgatatttctcattctttt

SEQ ID NO: 932104 - DNA, 22 bp, Artificial Sequence
  chemically synthesized
tgggttgatatttctcattctt

SEQ ID NO: 932105 - DNA, 22 bp, Artificial Sequence
  chemically synthesized
aaacatattctgggttgatatt

SEQ ID NO: 932106 - DNA, 22 bp, Artificial Sequence
  chemically synthesized
caaacatattctgggttgatat

SEQ ID NO: 932107 - DNA, 22 bp, Artificial Sequence
  chemically synthesized
aatcagcttcaaacatattctg

SEQ ID NO: 932108 - DNA, 22 bp, Artificial Sequence
  chemically synthesized
aaatcagcttcaaacatattct

SEQ ID NO: 932109 - DNA, 22 bp, Artificial Sequence
  chemically synthesized
taaatcagcttcaaacatattc

SEQ ID NO: 932110 - DNA, 22 bp, Artificial Sequence
  chemically synthesized
tttaaatcagcttcaaacatat

SEQ ID NO: 932111 - DNA, 22 bp, Artificial Sequence
  chemically synthesized
tcctctttaaatcagcttcaaa

SEQ ID NO: 932112 - DNA, 22 bp, Artificial Sequence
  chemically synthesized
ttgtcctctttaaatcagcttc

SEQ ID NO: 932113 - DNA, 22 bp, Artificial Sequence
  chemically synthesized
gggatgctgttgtcctctttaa

SEQ ID NO: 932114 - DNA, 22 bp, Artificial Sequence
  chemically synthesized
gaagctgatttaaagaggacaa

SEQ ID NO: 932115 - DNA, 22 bp, Artificial Sequence
  chemically synthesized
aagctgatttaaagaggacaac

SEQ ID NO: 932116 - DNA, 22 bp, Artificial Sequence
  chemically synthesized
atctagggatgctgttgtcctc

SEQ ID NO: 932117 - DNA, 22 bp, Artificial Sequence
  chemically synthesized
atttaaagaggacaacagcatc

SEQ ID NO: 932118 - DNA, 22 bp, Artificial Sequence
  chemically synthesized
aaagaggacaacagcatcccta

SEQ ID NO: 932119 - DNA, 22 bp, Artificial Sequence
  chemically synthesized
aagaggacaacagcatccctag

SEQ ID NO: 932120 - DNA, 22 bp, Artificial Sequence
  chemically synthesized
caaaaacatgtaatctaatcta

SEQ ID NO: 932121 - DNA, 22 bp, Artificial Sequence
  chemically synthesized
acaaaaacatgtaatctaatct

SEQ ID NO: 932122 - DNA, 22 bp, Artificial Sequence
  chemically synthesized
tacaaaaacatgtaatctaatc

SEQ ID NO: 932123 - DNA, 22 bp, Artificial Sequence
  chemically synthesized
gattagattacatgtttttgta

SEQ ID NO: 932124 - DNA, 22 bp, Artificial Sequence
  chemically synthesized
atatagcagctttacaaaaaca

SEQ ID NO: 932125 - DNA, 22 bp, Artificial Sequence
  chemically synthesized
taatatagcagctttacaaaaa

SEQ ID NO: 932126 - DNA, 22 bp, Artificial Sequence
  chemically synthesized
gattacatgtttttgtaaagct

SEQ ID NO: 932127 - DNA, 22 bp, Artificial Sequence
  chemically synthesized
catgtttttgtaaagctgctat

SEQ ID NO: 932128 - DNA, 22 bp, Artificial Sequence
  chemically synthesized
ttgtaaagctgctatattagaa

SEQ ID NO: 932129 - DNA, 22 bp, Artificial Sequence
  chemically synthesized
tgtaaagctgctatattagaat

SEQ ID NO: 932130 - DNA, 22 bp, Artificial Sequence
  chemically synthesized
gtaaagctgctatattagaatg

SEQ ID NO: 932131 - DNA, 22 bp, Artificial Sequence
  chemically synthesized
taaagctgctatattagaatgt

SEQ ID NO: 932132 - DNA, 22 bp, Artificial Sequence
  chemically synthesized
ctatattagaatgtcatgctga

SEQ ID NO: 932133 - DNA, 22 bp, Artificial Sequence
  chemically synthesized
tcaagaatcatgtcagcatgac

SEQ ID NO: 932134 - DNA, 22 bp, Artificial Sequence
  chemically synthesized
tattagaatgtcatgctgacat

SEQ ID NO: 932135 - DNA, 22 bp, Artificial Sequence
  chemically synthesized
gaatgtcatgctgacatgattc

SEQ ID NO: 932136 - DNA, 22 bp, Artificial Sequence
  chemically synthesized
aatacattatcaagaatcatgt

SEQ ID NO: 932137 - DNA, 22 bp, Artificial Sequence
  chemically synthesized
cccattaaatacattatcaaga

SEQ ID NO: 932138 - DNA, 22 bp, Artificial Sequence
  chemically synthesized
acccattaaatacattatcaag

SEQ ID NO: 932139 - DNA, 22 bp, Artificial Sequence
  chemically synthesized
tacccattaaatacattatcaa

SEQ ID NO: 932140 - DNA, 22 bp, Artificial Sequence
  chemically synthesized
acatgattcttgataatgtatt

SEQ ID NO: 932141 - DNA, 22 bp, Artificial Sequence
  chemically synthesized
tgcatactttacccattaaata

SEQ ID NO: 932142 - DNA, 22 bp, Artificial Sequence
  chemically synthesized
ttgataatgtatttaatgggta

SEQ ID NO: 932143 - DNA, 22 bp, Artificial Sequence
  chemically synthesized
actatgcatactttacccatta

SEQ ID NO: 932144 - DNA, 22 bp, Artificial Sequence
  chemically synthesized
gataatgtatttaatgggtaaa

SEQ ID NO: 932145 - DNA, 22 bp, Artificial Sequence
  chemically synthesized
ataatgtatttaatgggtaaag

SEQ ID NO: 932146 - DNA, 22 bp, Artificial Sequence
  chemically synthesized
cacaaatgttcactatgcatac

SEQ ID NO: 932147 - DNA, 22 bp, Artificial Sequence
  chemically synthesized
aatgggtaaagtatgcatagtg

SEQ ID NO: 932148 - DNA, 22 bp, Artificial Sequence
  chemically synthesized
tacacaaatgttcactatgcat

SEQ ID NO: 932149 - DNA, 22 bp, Artificial Sequence
  chemically synthesized
atgggtaaagtatgcatagtga

SEQ ID NO: 932150 - DNA, 22 bp, Artificial Sequence
  chemically synthesized
gatgtgatgaactctacacaaa

SEQ ID NO: 932151 - DNA, 22 bp, Artificial Sequence
  chemically synthesized
gtgtagagttcatcacatctaa

SEQ ID NO: 932152 - DNA, 22 bp, Artificial Sequence
  chemically synthesized
tgtagagttcatcacatctaat

SEQ ID NO: 932153 - DNA, 22 bp, Artificial Sequence
  chemically synthesized
atcacatctaattttctgtttt

SEQ ID NO: 932154 - DNA, 22 bp, Artificial Sequence
  chemically synthesized
gtgtatcaaaagaaaacagaaa

SEQ ID NO: 932155 - DNA, 22 bp, Artificial Sequence
  chemically synthesized
cgtgtatcaaaagaaaacagaa

SEQ ID NO: 932156 - DNA, 22 bp, Artificial Sequence
  chemically synthesized
accttcgtgtatcaaaagaaaa

SEQ ID NO: 932157 - DNA, 22 bp, Artificial Sequence
  chemically synthesized
attttctgttttcttttgatac

SEQ ID NO: 932158 - DNA, 22 bp, Artificial Sequence
  chemically synthesized
tctgttttcttttgatacacga

SEQ ID NO: 932159 - DNA, 22 bp, Artificial Sequence
  chemically synthesized
catcattcaccttcgtgtatca

SEQ ID NO: 932160 - DNA, 22 bp, Artificial Sequence
  chemically synthesized
ctgttttcttttgatacacgaa

SEQ ID NO: 932161 - DNA, 22 bp, Artificial Sequence
  chemically synthesized
tgttttcttttgatacacgaag

SEQ ID NO: 932162 - DNA, 22 bp, Artificial Sequence
  chemically synthesized
ttttcttttgatacacgaaggt

SEQ ID NO: 932163 - DNA, 22 bp, Artificial Sequence
  chemically synthesized
tcttttgatacacgaaggtgaa

SEQ ID NO: 932164 - DNA, 22 bp, Artificial Sequence
  chemically synthesized
cttttgatacacgaaggtgaat

SEQ ID NO: 932165 - DNA, 22 bp, Artificial Sequence
  chemically synthesized
ttttgatacacgaaggtgaatg

SEQ ID NO: 932166 - DNA, 22 bp, Artificial Sequence
  chemically synthesized
ttgatacacgaaggtgaatgat

SEQ ID NO: 932167 - DNA, 22 bp, Artificial Sequence
  chemically synthesized
tgatacacgaaggtgaatgatg

SEQ ID NO: 932168 - DNA, 22 bp, Artificial Sequence
  chemically synthesized
gatacacgaaggtgaatgatgc

SEQ ID NO: 932169 - DNA, 22 bp, Artificial Sequence
  chemically synthesized
atacacgaaggtgaatgatgca

SEQ ID NO: 932170 - DNA, 22 bp, Artificial Sequence
  chemically synthesized
aacagcagaaataccacaattg

SEQ ID NO: 932171 - DNA, 22 bp, Artificial Sequence
  chemically synthesized
agttcaacagcagaaataccac

SEQ ID NO: 932172 - DNA, 22 bp, Artificial Sequence
  chemically synthesized
attaagttcaacagcagaaata

SEQ ID NO: 932173 - DNA, 22 bp, Artificial Sequence
  chemically synthesized
cattaagttcaacagcagaaat

SEQ ID NO: 932174 - DNA, 22 bp, Artificial Sequence
  chemically synthesized
tcattaagttcaacagcagaaa

SEQ ID NO: 932175 - DNA, 22 bp, Artificial Sequence
  chemically synthesized
tggtatttctgctgttgaactt

SEQ ID NO: 932176 - DNA, 22 bp, Artificial Sequence
  chemically synthesized
ctgctgttgaacttaatgaaaa

SEQ ID NO: 932177 - DNA, 22 bp, Artificial Sequence
  chemically synthesized
tgctgttgaacttaatgaaaat

SEQ ID NO: 932178 - DNA, 22 bp, Artificial Sequence
  chemically synthesized
atagtggacagaattttcatta

SEQ ID NO: 932179 - DNA, 22 bp, Artificial Sequence
  chemically synthesized
ctgttgaacttaatgaaaattc

SEQ ID NO: 932180 - DNA, 22 bp, Artificial Sequence
  chemically synthesized
attgatagtggacagaattttc

SEQ ID NO: 932181 - DNA, 22 bp, Artificial Sequence
  chemically synthesized
ttgaacttaatgaaaattctgt

SEQ ID NO: 932182 - DNA, 22 bp, Artificial Sequence
  chemically synthesized
gattgatagtggacagaatttt

SEQ ID NO: 932183 - DNA, 22 bp, Artificial Sequence
  chemically synthesized
aacttaatgaaaattctgtcca

SEQ ID NO: 932184 - DNA, 22 bp, Artificial Sequence
  chemically synthesized
tttgattgatagtggacagaat

SEQ ID NO: 932185 - DNA, 22 bp, Artificial Sequence
  chemically synthesized
aatgaaaattctgtccactatc

SEQ ID NO: 932186 - DNA, 22 bp, Artificial Sequence
  chemically synthesized
atgaaaattctgtccactatca

SEQ ID NO: 932187 - DNA, 22 bp, Artificial Sequence
  chemically synthesized
tgtccactatcaatcaaataga

SEQ ID NO: 932188 - DNA, 22 bp, Artificial Sequence
  chemically synthesized
tccactatcaatcaaatagatc

SEQ ID NO: 932189 - DNA, 22 bp, Artificial Sequence
  chemically synthesized
tcaatcaaatagatcttttctc

SEQ ID NO: 932190 - DNA, 22 bp, Artificial Sequence
  chemically synthesized
gacaacaaacaagagaaaagat

SEQ ID NO: 932191 - DNA, 22 bp, Artificial Sequence
  chemically synthesized
ggacaacaaacaagagaaaaga

SEQ ID NO: 932192 - DNA, 22 bp, Artificial Sequence
  chemically synthesized
tttggacaacaaacaagagaaa

SEQ ID NO: 932193 - DNA, 22 bp, Artificial Sequence
  chemically synthesized
gtttggacaacaaacaagagaa

SEQ ID NO: 932194 - DNA, 22 bp, Artificial Sequence
  chemically synthesized
aacatatttgtttggacaacaa

SEQ ID NO: 932195 - DNA, 22 bp, Artificial Sequence
  chemically synthesized
gaacatatttgtttggacaaca

SEQ ID NO: 932196 - DNA, 22 bp, Artificial Sequence
  chemically synthesized
tgaacatatttgtttggacaac

SEQ ID NO: 932197 - DNA, 22 bp, Artificial Sequence
  chemically synthesized
ttctcttgtttgttgtccaaac

SEQ ID NO: 932198 - DNA, 22 bp, Artificial Sequence
  chemically synthesized
ttgaacatatttgtttggacaa

SEQ ID NO: 932199 - DNA, 22 bp, Artificial Sequence
  chemically synthesized
tctcttgtttgttgtccaaaca

SEQ ID NO: 932200 - DNA, 22 bp, Artificial Sequence
  chemically synthesized
ctcttgtttgttgtccaaacaa

SEQ ID NO: 932201 - DNA, 22 bp, Artificial Sequence
  chemically synthesized
tcttgtttgttgtccaaacaaa

SEQ ID NO: 932202 - DNA, 22 bp, Artificial Sequence
  chemically synthesized
cttttgaacatatttgtttgga

SEQ ID NO: 932203 - DNA, 22 bp, Artificial Sequence
  chemically synthesized
ttgtttgttgtccaaacaaata

SEQ ID NO: 932204 - DNA, 22 bp, Artificial Sequence
  chemically synthesized
gtttgttgtccaaacaaatatg

SEQ ID NO: 932205 - DNA, 22 bp, Artificial Sequence
  chemically synthesized
tttgttgtccaaacaaatatgt

SEQ ID NO: 932206 - DNA, 22 bp, Artificial Sequence
  chemically synthesized
gttgtccaaacaaatatgttca

SEQ ID NO: 932207 - DNA, 22 bp, Artificial Sequence
  chemically synthesized
ttgtccaaacaaatatgttcaa

SEQ ID NO: 932208 - DNA, 22 bp, Artificial Sequence
  chemically synthesized
tccaaacaaatatgttcaaaag

SEQ ID NO: 932209 - DNA, 22 bp, Artificial Sequence
  chemically synthesized
aataaaaatgaattacttttga

SEQ ID NO: 932210 - DNA, 22 bp, Artificial Sequence
  chemically synthesized
caataaaaatgaattacttttg

SEQ ID NO: 932211 - DNA, 22 bp, Artificial Sequence
  chemically synthesized
tcaataaaaatgaattactttt

SEQ ID NO: 932212 - DNA, 22 bp, Artificial Sequence
  chemically synthesized
ttcaataaaaatgaattacttt

SEQ ID NO: 932213 - DNA, 22 bp, Artificial Sequence
  chemically synthesized
aaaagtaattcatttttattga

SEQ ID NO: 932214 - DNA, 22 bp, Artificial Sequence
  chemically synthesized
atcatgtgagtacaagactttt

SEQ ID NO: 932215 - DNA, 22 bp, Artificial Sequence
  chemically synthesized
catcatgtgagtacaagacttt

SEQ ID NO: 932216 - DNA, 22 bp, Artificial Sequence
  chemically synthesized
atttttattgaaaagtcttgta

SEQ ID NO: 932217 - DNA, 22 bp, Artificial Sequence
  chemically synthesized
tcatcatgtgagtacaagactt

SEQ ID NO: 932218 - DNA, 22 bp, Artificial Sequence
  chemically synthesized
ttcatcatgtgagtacaagact

SEQ ID NO: 932219 - DNA, 22 bp, Artificial Sequence
  chemically synthesized
tttcatcatgtgagtacaagac

SEQ ID NO: 932220 - DNA, 22 bp, Artificial Sequence
  chemically synthesized
ttttcatcatgtgagtacaaga

SEQ ID NO: 932221 - DNA, 22 bp, Artificial Sequence
  chemically synthesized
ttattgaaaagtcttgtactca

SEQ ID NO: 932222 - DNA, 22 bp, Artificial Sequence
  chemically synthesized
tattgaaaagtcttgtactcac

SEQ ID NO: 932223 - DNA, 22 bp, Artificial Sequence
  chemically synthesized
attgaaaagtcttgtactcaca

SEQ ID NO: 932224 - DNA, 22 bp, Artificial Sequence
  chemically synthesized
ttgaaaagtcttgtactcacat

SEQ ID NO: 932225 - DNA, 22 bp, Artificial Sequence
  chemically synthesized
tgtttttttcatcatgtgagta

SEQ ID NO: 932226 - DNA, 22 bp, Artificial Sequence
  chemically synthesized
gtgtttttttcatcatgtgagt

SEQ ID NO: 932227 - DNA, 22 bp, Artificial Sequence
  chemically synthesized
aaaagtcttgtactcacatgat

SEQ ID NO: 932228 - DNA, 22 bp, Artificial Sequence
  chemically synthesized
tttgtgtttttttcatcatgtg

SEQ ID NO: 932229 - DNA, 22 bp, Artificial Sequence
  chemically synthesized
gtttgtgtttttttcatcatgt

SEQ ID NO: 932230 - DNA, 22 bp, Artificial Sequence
  chemically synthesized
gtactcacatgatgaaaaaaac

SEQ ID NO: 932231 - DNA, 22 bp, Artificial Sequence
  chemically synthesized
tactcacatgatgaaaaaaaca

SEQ ID NO: 932232 - DNA, 22 bp, Artificial Sequence
  chemically synthesized
aagccttgtttgtgtttttttc

SEQ ID NO: 932233 - DNA, 22 bp, Artificial Sequence
  chemically synthesized
acatgatgaaaaaaacacaaac

SEQ ID NO: 932234 - DNA, 22 bp, Artificial Sequence
  chemically synthesized
caagcaagtgcatgtgaaataa

SEQ ID NO: 932235 - DNA, 22 bp, Artificial Sequence
  chemically synthesized
gcaagcaagtgcatgtgaaata

SEQ ID NO: 932236 - DNA, 22 bp, Artificial Sequence
  chemically synthesized
taatttatttcacatgcacttg

SEQ ID NO: 932237 - DNA, 22 bp, Artificial Sequence
  chemically synthesized
aatttatttcacatgcacttgc

SEQ ID NO: 932238 - DNA, 22 bp, Artificial Sequence
  chemically synthesized
atttatttcacatgcacttgct

SEQ ID NO: 932239 - DNA, 22 bp, Artificial Sequence
  chemically synthesized
atttcacatgcacttgcttgca

SEQ ID NO: 932240 - DNA, 22 bp, Artificial Sequence
  chemically synthesized
cagtgtatagcttgcaagcaag

SEQ ID NO: 932241 - DNA, 22 bp, Artificial Sequence
  chemically synthesized
tttcacatgcacttgcttgcaa

SEQ ID NO: 932242 - DNA, 22 bp, Artificial Sequence
  chemically synthesized
tccagtgtatagcttgcaagca

SEQ ID NO: 932243 - DNA, 22 bp, Artificial Sequence
  chemically synthesized
ctccagtgtatagcttgcaagc

SEQ ID NO: 932244 - DNA, 22 bp, Artificial Sequence
  chemically synthesized
cacatgcacttgcttgcaagct

SEQ ID NO: 932245 - DNA, 22 bp, Artificial Sequence
  chemically synthesized
acatgcacttgcttgcaagcta

SEQ ID NO: 932246 - DNA, 22 bp, Artificial Sequence
  chemically synthesized
ttctccagtgtatagcttgcaa

SEQ ID NO: 932247 - DNA, 22 bp, Artificial Sequence
  chemically synthesized
ccctcttctccagtgtatagct

SEQ ID NO: 932248 - DNA, 22 bp, Artificial Sequence
  chemically synthesized
cccctcttctccagtgtatagc

SEQ ID NO: 932249 - DNA, 22 bp, Artificial Sequence
  chemically synthesized
gcttgcaagctatacactggag

SEQ ID NO: 932250 - DNA, 22 bp, Artificial Sequence
  chemically synthesized
cttgcaagctatacactggaga

SEQ ID NO: 932251 - DNA, 22 bp, Artificial Sequence
  chemically synthesized
aacttcccctcttctccagtgt

SEQ ID NO: 932252 - DNA, 22 bp, Artificial Sequence
  chemically synthesized
gcaagctatacactggagaaga

SEQ ID NO: 932253 - DNA, 22 bp, Artificial Sequence
  chemically synthesized
caagctatacactggagaagag

SEQ ID NO: 932254 - DNA, 22 bp, Artificial Sequence
  chemically synthesized
tacactggagaagaggggaagt

SEQ ID NO: 932255 - DNA, 22 bp, Artificial Sequence
  chemically synthesized
cataaatataaaactaaacttc

SEQ ID NO: 932256 - DNA, 22 bp, Artificial Sequence
  chemically synthesized
gagaagaggggaagtttagttt

SEQ ID NO: 932257 - DNA, 22 bp, Artificial Sequence
  chemically synthesized
aattacataaatataaaactaa

SEQ ID NO: 932258 - DNA, 22 bp, Artificial Sequence
  chemically synthesized
gaattacataaatataaaacta

SEQ ID NO: 932259 - DNA, 22 bp, Artificial Sequence
  chemically synthesized
cataacttgaattacataaata

SEQ ID NO: 932260 - DNA, 22 bp, Artificial Sequence
  chemically synthesized
tctacataacttgaattacata

SEQ ID NO: 932261 - DNA, 22 bp, Artificial Sequence
  chemically synthesized
agttttatatttatgtaattca

SEQ ID NO: 932262 - DNA, 22 bp, Artificial Sequence
  chemically synthesized
gttttatatttatgtaattcaa

SEQ ID NO: 932263 - DNA, 22 bp, Artificial Sequence
  chemically synthesized
gtctatctacataacttgaatt

SEQ ID NO: 932264 - DNA, 22 bp, Artificial Sequence
  chemically synthesized
tatatttatgtaattcaagtta

SEQ ID NO: 932265 - DNA, 22 bp, Artificial Sequence
  chemically synthesized
atatttatgtaattcaagttat

SEQ ID NO: 932266 - DNA, 22 bp, Artificial Sequence
  chemically synthesized
tatttatgtaattcaagttatg

SEQ ID NO: 932267 - DNA, 22 bp, Artificial Sequence
  chemically synthesized
atgtaattcaagttatgtagat

SEQ ID NO: 932268 - DNA, 22 bp, Artificial Sequence
  chemically synthesized
tgtaattcaagttatgtagata

SEQ ID NO: 932269 - DNA, 22 bp, Artificial Sequence
  chemically synthesized
tataacacctggtctatctaca

SEQ ID NO: 932270 - DNA, 22 bp, Artificial Sequence
  chemically synthesized
atataacacctggtctatctac

SEQ ID NO: 932271 - DNA, 22 bp, Artificial Sequence
  chemically synthesized
aagttatgtagatagaccaggt

SEQ ID NO: 932272 - DNA, 22 bp, Artificial Sequence
  chemically synthesized
tccatttatataacacctggtc

SEQ ID NO: 932273 - DNA, 22 bp, Artificial Sequence
  chemically synthesized
tgtagatagaccaggtgttata

SEQ ID NO: 932274 - DNA, 22 bp, Artificial Sequence
  chemically synthesized
aaaatctgtccatttatataac

SEQ ID NO: 932275 - DNA, 22 bp, Artificial Sequence
  chemically synthesized
aaaaatctgtccatttatataa

SEQ ID NO: 932276 - DNA, 22 bp, Artificial Sequence
  chemically synthesized
gtttaaaaatctgtccatttat

SEQ ID NO: 932277 - DNA, 22 bp, Artificial Sequence
  chemically synthesized
aaacatactagtttaaaaatct

SEQ ID NO: 932278 - DNA, 22 bp, Artificial Sequence
  chemically synthesized
tataaatggacagatttttaaa

SEQ ID NO: 932279 - DNA, 22 bp, Artificial Sequence
  chemically synthesized
ttgaaacatactagtttaaaaa

SEQ ID NO: 932280 - DNA, 22 bp, Artificial Sequence
  chemically synthesized
attgaaacatactagtttaaaa

SEQ ID NO: 932281 - DNA, 22 bp, Artificial Sequence
  chemically synthesized
tttattgaaacatactagttta

SEQ ID NO: 932282 - DNA, 22 bp, Artificial Sequence
  chemically synthesized
atattatttattgaaacatact

SEQ ID NO: 932283 - DNA, 22 bp, Artificial Sequence
  chemically synthesized
gctcatattatttattgaaaca

SEQ ID NO: 932284 - DNA, 22 bp, Artificial Sequence
  chemically synthesized
ttaaactagtatgtttcaataa

SEQ ID NO: 932285 - DNA, 22 bp, Artificial Sequence
  chemically synthesized
taaactagtatgtttcaataaa

SEQ ID NO: 932286 - DNA, 22 bp, Artificial Sequence
  chemically synthesized
aaactagtatgtttcaataaat

SEQ ID NO: 932287 - DNA, 22 bp, Artificial Sequence
  chemically synthesized
aactagtatgtttcaataaata

SEQ ID NO: 932288 - DNA, 22 bp, Artificial Sequence
  chemically synthesized
aagattggctcatattatttat

SEQ ID NO: 932289 - DNA, 22 bp, Artificial Sequence
  chemically synthesized
gtatgtttcaataaataatatg

SEQ ID NO: 932290 - DNA, 22 bp, Artificial Sequence
  chemically synthesized
tgaagattggctcatattattt

SEQ ID NO: 932291 - DNA, 22 bp, Artificial Sequence
  chemically synthesized
ctgaagattggctcatattatt

SEQ ID NO: 932292 - DNA, 22 bp, Artificial Sequence
  chemically synthesized
atttctgaagattggctcatat

SEQ ID NO: 932293 - DNA, 22 bp, Artificial Sequence
  chemically synthesized
caataaataatatgagccaatc

SEQ ID NO: 932294 - DNA, 22 bp, Artificial Sequence
  chemically synthesized
aataaataatatgagccaatct

SEQ ID NO: 932295 - DNA, 22 bp, Artificial Sequence
  chemically synthesized
tattcatttctgaagattggct

SEQ ID NO: 932296 - DNA, 22 bp, Artificial Sequence
  chemically synthesized
atattcatttctgaagattggc

SEQ ID NO: 932297 - DNA, 22 bp, Artificial Sequence
  chemically synthesized
cagaaatgaatataaacatgtg

SEQ ID NO: 932298 - DNA, 22 bp, Artificial Sequence
  chemically synthesized
agaaatgaatataaacatgtgg

SEQ ID NO: 932299 - DNA, 22 bp, Artificial Sequence
  chemically synthesized
tagagaaggatgccacatgttt

SEQ ID NO: 932300 - DNA, 22 bp, Artificial Sequence
  chemically synthesized
atagagaaggatgccacatgtt

SEQ ID NO: 932301 - DNA, 22 bp, Artificial Sequence
  chemically synthesized
tatagagaaggatgccacatgt

SEQ ID NO: 932302 - DNA, 22 bp, Artificial Sequence
  chemically synthesized
ttatagagaaggatgccacatg

SEQ ID NO: 932303 - DNA, 22 bp, Artificial Sequence
  chemically synthesized
tgtttttatagagaaggatgcc

SEQ ID NO: 932304 - DNA, 22 bp, Artificial Sequence
  chemically synthesized
gtgtttttatagagaaggatgc

SEQ ID NO: 932305 - DNA, 22 bp, Artificial Sequence
  chemically synthesized
aaccttgtgtttttatagagaa

SEQ ID NO: 932306 - DNA, 22 bp, Artificial Sequence
  chemically synthesized
ctctataaaaacacaaggttga

SEQ ID NO: 932307 - DNA, 22 bp, Artificial Sequence
  chemically synthesized
tctataaaaacacaaggttgaa

SEQ ID NO: 932308 - DNA, 22 bp, Artificial Sequence
  chemically synthesized
agatgagccccattcaaccttg

SEQ ID NO: 932309 - DNA, 22 bp, Artificial Sequence
  chemically synthesized
cagatgagccccattcaacctt

SEQ ID NO: 932310 - DNA, 22 bp, Artificial Sequence
  chemically synthesized
tataaaaacacaaggttgaatg

SEQ ID NO: 932311 - DNA, 22 bp, Artificial Sequence
  chemically synthesized
taaaaacacaaggttgaatggg

SEQ ID NO: 932312 - DNA, 22 bp, Artificial Sequence
  chemically synthesized
cagcaacacttcagatgagccc

SEQ ID NO: 932313 - DNA, 22 bp, Artificial Sequence
  chemically synthesized
ttgcagcaacacttcagatgag

SEQ ID NO: 932314 - DNA, 22 bp, Artificial Sequence
  chemically synthesized
aatggggctcatctgaagtgtt

SEQ ID NO: 932315 - DNA, 22 bp, Artificial Sequence
  chemically synthesized
atctgaagtgttgctgcaacag

SEQ ID NO: 932316 - DNA, 22 bp, Artificial Sequence
  chemically synthesized
aagtgttgctgcaacagtgtga

SEQ ID NO: 932317 - DNA, 22 bp, Artificial Sequence
  chemically synthesized
ggccaggacagacatcacactg

SEQ ID NO: 932318 - DNA, 22 bp, Artificial Sequence
  chemically synthesized
tcggccaggacagacatcacac

SEQ ID NO: 932319 - DNA, 22 bp, Artificial Sequence
  chemically synthesized
ctgcaacagtgtgatgtctgtc

SEQ ID NO: 932320 - DNA, 22 bp, Artificial Sequence
  chemically synthesized
caacagtgtgatgtctgtcctg

SEQ ID NO: 932321 - DNA, 22 bp, Artificial Sequence
  chemically synthesized
agataaatcatcccacatactc

SEQ ID NO: 932322 - DNA, 22 bp, Artificial Sequence
  chemically synthesized
tcctggccgagagtatgtggga

SEQ ID NO: 932323 - DNA, 22 bp, Artificial Sequence
  chemically synthesized
gccgagagtatgtgggatgatt

SEQ ID NO: 932324 - DNA, 22 bp, Artificial Sequence
  chemically synthesized
caaaaacatattgagataaatc

SEQ ID NO: 932325 - DNA, 22 bp, Artificial Sequence
  chemically synthesized
ctgcaaaaacatattgagataa

SEQ ID NO: 932326 - DNA, 22 bp, Artificial Sequence
  chemically synthesized
ttactgcaaaaacatattgaga

SEQ ID NO: 932327 - DNA, 22 bp, Artificial Sequence
  chemically synthesized
atctcaatatgtttttgcagta

SEQ ID NO: 932328 - DNA, 22 bp, Artificial Sequence
  chemically synthesized
agtatgacctgttactgcaaaa

SEQ ID NO: 932329 - DNA, 22 bp, Artificial Sequence
  chemically synthesized
tctcaatatgtttttgcagtaa

SEQ ID NO: 932330 - DNA, 22 bp, Artificial Sequence
  chemically synthesized
cagtatgacctgttactgcaaa

SEQ ID NO: 932331 - DNA, 22 bp, Artificial Sequence
  chemically synthesized
tttcagtatgacctgttactgc

SEQ ID NO: 932332 - DNA, 22 bp, Artificial Sequence
  chemically synthesized
aatatgtttttgcagtaacagg

SEQ ID NO: 932333 - DNA, 22 bp, Artificial Sequence
  chemically synthesized
ttgcagtaacaggtcatactga

SEQ ID NO: 932334 - DNA, 22 bp, Artificial Sequence
  chemically synthesized
tgcagtaacaggtcatactgaa

SEQ ID NO: 932335 - DNA, 22 bp, Artificial Sequence
  chemically synthesized
tcccatcattgtttcagtatga

SEQ ID NO: 932336 - DNA, 22 bp, Artificial Sequence
  chemically synthesized
gcagtaacaggtcatactgaaa

SEQ ID NO: 932337 - DNA, 22 bp, Artificial Sequence
  chemically synthesized
cagtaacaggtcatactgaaac

SEQ ID NO: 932338 - DNA, 22 bp, Artificial Sequence
  chemically synthesized
ttgtcccatcattgtttcagta

SEQ ID NO: 932339 - DNA, 22 bp, Artificial Sequence
  chemically synthesized
gttgtcccatcattgtttcagt

SEQ ID NO: 932340 - DNA, 22 bp, Artificial Sequence
  chemically synthesized
tgatttgttgtcccatcattgt

SEQ ID NO: 932341 - DNA, 22 bp, Artificial Sequence
  chemically synthesized
aaacaatgatgggacaacaaat

SEQ ID NO: 932342 - DNA, 22 bp, Artificial Sequence
  chemically synthesized
tatggcatacattgtgatttgt

SEQ ID NO: 932343 - DNA, 22 bp, Artificial Sequence
  chemically synthesized
gtatggcatacattgtgatttg

SEQ ID NO: 932344 - DNA, 22 bp, Artificial Sequence
  chemically synthesized
tgtatggcatacattgtgattt

SEQ ID NO: 932345 - DNA, 22 bp, Artificial Sequence
  chemically synthesized
tttgtatggcatacattgtgat

SEQ ID NO: 932346 - DNA, 22 bp, Artificial Sequence
  chemically synthesized
ctttgtatggcatacattgtga

SEQ ID NO: 932347 - DNA, 22 bp, Artificial Sequence
  chemically synthesized
ccatatcatttctttgtatggc

SEQ ID NO: 932348 - DNA, 22 bp, Artificial Sequence
  chemically synthesized
cccatatcatttctttgtatgg

SEQ ID NO: 932349 - DNA, 22 bp, Artificial Sequence
  chemically synthesized
ttcccatatcatttctttgtat

SEQ ID NO: 932350 - DNA, 22 bp, Artificial Sequence
  chemically synthesized
ttcttcccatatcatttctttg

SEQ ID NO: 932351 - DNA, 22 bp, Artificial Sequence
  chemically synthesized
ggaatgaaattattcttcccat

SEQ ID NO: 932352 - DNA, 22 bp, Artificial Sequence
  chemically synthesized
gggaatgaaattattcttccca

SEQ ID NO: 932353 - DNA, 22 bp, Artificial Sequence
  chemically synthesized
aatacttgggaatgaaattatt

SEQ ID NO: 932354 - DNA, 22 bp, Artificial Sequence
  chemically synthesized
aaatacttgggaatgaaattat

SEQ ID NO: 932355 - DNA, 22 bp, Artificial Sequence
  chemically synthesized
taaatacttgggaatgaaatta

SEQ ID NO: 932356 - DNA, 22 bp, Artificial Sequence
  chemically synthesized
cattcccaagtatttaaaattg

SEQ ID NO: 932357 - DNA, 22 bp, Artificial Sequence
  chemically synthesized
aaaatagagtatcaattttaaa

SEQ ID NO: 932358 - DNA, 22 bp, Artificial Sequence
  chemically synthesized
attcccaagtatttaaaattga

SEQ ID NO: 932359 - DNA, 22 bp, Artificial Sequence
  chemically synthesized
caaaatagagtatcaattttaa

SEQ ID NO: 932360 - DNA, 22 bp, Artificial Sequence
  chemically synthesized
ccaagtatttaaaattgatact

SEQ ID NO: 932361 - DNA, 22 bp, Artificial Sequence
  chemically synthesized
tggtgatcttcaaaatagagta

SEQ ID NO: 932362 - DNA, 22 bp, Artificial Sequence
  chemically synthesized
tatggtgatcttcaaaatagag

SEQ ID NO: 932363 - DNA, 22 bp, Artificial Sequence
  chemically synthesized
aaaattgatactctattttgaa

SEQ ID NO: 932364 - DNA, 22 bp, Artificial Sequence
  chemically synthesized
aaattgatactctattttgaag

SEQ ID NO: 932365 - DNA, 22 bp, Artificial Sequence
  chemically synthesized
attctatggtgatcttcaaaat

SEQ ID NO: 932366 - DNA, 22 bp, Artificial Sequence
  chemically synthesized
taattctatggtgatcttcaaa

SEQ ID NO: 932367 - DNA, 22 bp, Artificial Sequence
  chemically synthesized
ctaattctatggtgatcttcaa

SEQ ID NO: 932368 - DNA, 22 bp, Artificial Sequence
  chemically synthesized
atactctattttgaagatcacc

SEQ ID NO: 932369 - DNA, 22 bp, Artificial Sequence
  chemically synthesized
tttctaattctatggtgatctt

SEQ ID NO: 932370 - DNA, 22 bp, Artificial Sequence
  chemically synthesized
tattttgaagatcaccatagaa

SEQ ID NO: 932371 - DNA, 22 bp, Artificial Sequence
  chemically synthesized
cattgtttctaattctatggtg

SEQ ID NO: 932372 - DNA, 22 bp, Artificial Sequence
  chemically synthesized
acattgtttctaattctatggt

SEQ ID NO: 932373 - DNA, 22 bp, Artificial Sequence
  chemically synthesized
ttttgaagatcaccatagaatt

SEQ ID NO: 932374 - DNA, 22 bp, Artificial Sequence
  chemically synthesized
tacattgtttctaattctatgg

SEQ ID NO: 932375 - DNA, 22 bp, Artificial Sequence
  chemically synthesized
ttacattgtttctaattctatg

SEQ ID NO: 932376 - DNA, 22 bp, Artificial Sequence
  chemically synthesized
tgaagatcaccatagaattaga

SEQ ID NO: 932377 - DNA, 22 bp, Artificial Sequence
  chemically synthesized
ttttacattgtttctaattcta

SEQ ID NO: 932378 - DNA, 22 bp, Artificial Sequence
  chemically synthesized
gaagatcaccatagaattagaa

SEQ ID NO: 932379 - DNA, 22 bp, Artificial Sequence
  chemically synthesized
aagatcaccatagaattagaaa

SEQ ID NO: 932380 - DNA, 22 bp, Artificial Sequence
  chemically synthesized
ttcttttacattgtttctaatt

SEQ ID NO: 932381 - DNA, 22 bp, Artificial Sequence
  chemically synthesized
ccaggtctattcttttacattg

SEQ ID NO: 932382 - DNA, 22 bp, Artificial Sequence
  chemically synthesized
ttaccaggtctattcttttaca

SEQ ID NO: 932383 - DNA, 22 bp, Artificial Sequence
  chemically synthesized
ttattaccaggtctattctttt

SEQ ID NO: 932384 - DNA, 22 bp, Artificial Sequence
  chemically synthesized
gaaacaatgtaaaagaatagac

SEQ ID NO: 932385 - DNA, 22 bp, Artificial Sequence
  chemically synthesized
tagttattattaccaggtctat

SEQ ID NO: 932386 - DNA, 22 bp, Artificial Sequence
  chemically synthesized
aaagaaattatagttattatta

SEQ ID NO: 932387 - DNA, 22 bp, Artificial Sequence
  chemically synthesized
gaaagaaattatagttattatt

SEQ ID NO: 932388 - DNA, 22 bp, Artificial Sequence
  chemically synthesized
tgaaagaaattatagttattat

SEQ ID NO: 932389 - DNA, 22 bp, Artificial Sequence
  chemically synthesized
ttgaaagaaattatagttatta

SEQ ID NO: 932390 - DNA, 22 bp, Artificial Sequence
  chemically synthesized
tttgaaagaaattatagttatt

SEQ ID NO: 932391 - DNA, 22 bp, Artificial Sequence
  chemically synthesized
tttttgaaagaaattatagtta

SEQ ID NO: 932392 - DNA, 22 bp, Artificial Sequence
  chemically synthesized
tctttttgaaagaaattatagt

SEQ ID NO: 932393 - DNA, 22 bp, Artificial Sequence
  chemically synthesized
gtaataataactataatttctt

SEQ ID NO: 932394 - DNA, 22 bp, Artificial Sequence
  chemically synthesized
tgaattctctttttgaaagaaa

SEQ ID NO: 932395 - DNA, 22 bp, Artificial Sequence
  chemically synthesized
atgaattctctttttgaaagaa

SEQ ID NO: 932396 - DNA, 22 bp, Artificial Sequence
  chemically synthesized
tgtttatgaattctctttttga

SEQ ID NO: 932397 - DNA, 22 bp, Artificial Sequence
  chemically synthesized
tatgtttatgaattctcttttt

SEQ ID NO: 932398 - DNA, 22 bp, Artificial Sequence
  chemically synthesized
taatttctttcaaaaagagaat

SEQ ID NO: 932399 - DNA, 22 bp, Artificial Sequence
  chemically synthesized
ctatgtttatgaattctctttt

SEQ ID NO: 932400 - DNA, 22 bp, Artificial Sequence
  chemically synthesized
gtttctatgtttatgaattctc

SEQ ID NO: 932401 - DNA, 22 bp, Artificial Sequence
  chemically synthesized
ggtttctatgtttatgaattct

SEQ ID NO: 932402 - DNA, 22 bp, Artificial Sequence
  chemically synthesized
ctttcaaaaagagaattcataa

SEQ ID NO: 932403 - DNA, 22 bp, Artificial Sequence
  chemically synthesized
tttcaaaaagagaattcataaa

SEQ ID NO: 932404 - DNA, 22 bp, Artificial Sequence
  chemically synthesized
tcaaaaagagaattcataaaca

SEQ ID NO: 932405 - DNA, 22 bp, Artificial Sequence
  chemically synthesized
caaaaagagaattcataaacat

SEQ ID NO: 932406 - DNA, 22 bp, Artificial Sequence
  chemically synthesized
aaaaagagaattcataaacata

SEQ ID NO: 932407 - DNA, 22 bp, Artificial Sequence
  chemically synthesized
agtccttggtttctatgtttat

SEQ ID NO: 932408 - DNA, 22 bp, Artificial Sequence
  chemically synthesized
tgagtccttggtttctatgttt

SEQ ID NO: 932409 - DNA, 22 bp, Artificial Sequence
  chemically synthesized
tctgagtccttggtttctatgt

SEQ ID NO: 932410 - DNA, 22 bp, Artificial Sequence
  chemically synthesized
ctctgagtccttggtttctatg

SEQ ID NO: 932411 - DNA, 22 bp, Artificial Sequence
  chemically synthesized
ttctctgagtccttggtttcta

SEQ ID NO: 932412 - DNA, 22 bp, Artificial Sequence
  chemically synthesized
ataaacatagaaaccaaggact

SEQ ID NO: 932413 - DNA, 22 bp, Artificial Sequence
  chemically synthesized
taagtggttcttctctgagtcc

SEQ ID NO: 932414 - DNA, 22 bp, Artificial Sequence
  chemically synthesized
ataagtggttcttctctgagtc

SEQ ID NO: 932415 - DNA, 22 bp, Artificial Sequence
  chemically synthesized
atgtttataagtggttcttctc

SEQ ID NO: 932416 - DNA, 22 bp, Artificial Sequence
  chemically synthesized
taatgtttataagtggttcttc

SEQ ID NO: 932417 - DNA, 22 bp, Artificial Sequence
  chemically synthesized
agagaagaaccacttataaaca

SEQ ID NO: 932418 - DNA, 22 bp, Artificial Sequence
  chemically synthesized
ggaatggcagaaggtaatattc

SEQ ID NO: 932419 - DNA, 22 bp, Artificial Sequence
  chemically synthesized
ataaacattagaatattacctt

SEQ ID NO: 932420 - DNA, 22 bp, Artificial Sequence
  chemically synthesized
taaacattagaatattaccttc

SEQ ID NO: 932421 - DNA, 22 bp, Artificial Sequence
  chemically synthesized
aattaggaatggcagaaggtaa

SEQ ID NO: 932422 - DNA, 22 bp, Artificial Sequence
  chemically synthesized
gaatattaccttctgccattcc

SEQ ID NO: 932423 - DNA, 22 bp, Artificial Sequence
  chemically synthesized
tatgctaaattaggaatggcag

SEQ ID NO: 932424 - DNA, 22 bp, Artificial Sequence
  chemically synthesized
atatgctaaattaggaatggca

SEQ ID NO: 932425 - DNA, 22 bp, Artificial Sequence
  chemically synthesized
tatatgctaaattaggaatggc

SEQ ID NO: 932426 - DNA, 22 bp, Artificial Sequence
  chemically synthesized
cctttatatgctaaattaggaa

SEQ ID NO: 932427 - DNA, 22 bp, Artificial Sequence
  chemically synthesized
ccttctgccattcctaatttag

SEQ ID NO: 932428 - DNA, 22 bp, Artificial Sequence
  chemically synthesized
ctgccattcctaatttagcata

SEQ ID NO: 932429 - DNA, 22 bp, Artificial Sequence
  chemically synthesized
tgccattcctaatttagcatat

SEQ ID NO: 932430 - DNA, 22 bp, Artificial Sequence
  chemically synthesized
aaaagttacctttatatgctaa

SEQ ID NO: 932431 - DNA, 22 bp, Artificial Sequence
  chemically synthesized
ccattcctaatttagcatataa

SEQ ID NO: 932432 - DNA, 22 bp, Artificial Sequence
  chemically synthesized
aaaaagttacctttatatgcta

SEQ ID NO: 932433 - DNA, 22 bp, Artificial Sequence
  chemically synthesized
taaaaagttacctttatatgct

SEQ ID NO: 932434 - DNA, 22 bp, Artificial Sequence
  chemically synthesized
ctaatttagcatataaaggtaa

SEQ ID NO: 932435 - DNA, 22 bp, Artificial Sequence
  chemically synthesized
atttagcatataaaggtaactt

SEQ ID NO: 932436 - DNA, 22 bp, Artificial Sequence
  chemically synthesized
agcatataaaggtaacttttta

SEQ ID NO: 932437 - DNA, 22 bp, Artificial Sequence
  chemically synthesized
gcatataaaggtaactttttaa

SEQ ID NO: 932438 - DNA, 22 bp, Artificial Sequence
  chemically synthesized
tgaaaagcagagattttaaaaa

SEQ ID NO: 932439 - DNA, 22 bp, Artificial Sequence
  chemically synthesized
agttatgaaaagcagagatttt

SEQ ID NO: 932440 - DNA, 22 bp, Artificial Sequence
  chemically synthesized
tcagttatgaaaagcagagatt

SEQ ID NO: 932441 - DNA, 22 bp, Artificial Sequence
  chemically synthesized
gctctcagttatgaaaagcaga

SEQ ID NO: 932442 - DNA, 22 bp, Artificial Sequence
  chemically synthesized
tggctctcagttatgaaaagca

SEQ ID NO: 932443 - DNA, 22 bp, Artificial Sequence
  chemically synthesized
tttaaaatctctgcttttcata

SEQ ID NO: 932444 - DNA, 22 bp, Artificial Sequence
  chemically synthesized
ctggctctcagttatgaaaagc

SEQ ID NO: 932445 - DNA, 22 bp, Artificial Sequence
  chemically synthesized
ttaaaatctctgcttttcataa

SEQ ID NO: 932446 - DNA, 22 bp, Artificial Sequence
  chemically synthesized
taaaatctctgcttttcataac

SEQ ID NO: 932447 - DNA, 22 bp, Artificial Sequence
  chemically synthesized
aaaatctctgcttttcataact

SEQ ID NO: 932448 - DNA, 22 bp, Artificial Sequence
  chemically synthesized
tttctggctctcagttatgaaa

SEQ ID NO: 932449 - DNA, 22 bp, Artificial Sequence
  chemically synthesized
aaatctctgcttttcataactg

SEQ ID NO: 932450 - DNA, 22 bp, Artificial Sequence
  chemically synthesized
gtttctggctctcagttatgaa

SEQ ID NO: 932451 - DNA, 22 bp, Artificial Sequence
  chemically synthesized
tgtttctggctctcagttatga

SEQ ID NO: 932452 - DNA, 22 bp, Artificial Sequence
  chemically synthesized
tgcttttcataactgagagcca

SEQ ID NO: 932453 - DNA, 22 bp, Artificial Sequence
  chemically synthesized
cttttcataactgagagccaga

SEQ ID NO: 932454 - DNA, 22 bp, Artificial Sequence
  chemically synthesized
ttcataactgagagccagaaac

SEQ ID NO: 932455 - DNA, 22 bp, Artificial Sequence
  chemically synthesized
tcataactgagagccagaaaca

SEQ ID NO: 932456 - DNA, 22 bp, Artificial Sequence
  chemically synthesized
cataactgagagccagaaacaa

SEQ ID NO: 932457 - DNA, 22 bp, Artificial Sequence
  chemically synthesized
ataactgagagccagaaacaaa

SEQ ID NO: 932458 - DNA, 22 bp, Artificial Sequence
  chemically synthesized
atcatcatgcagacgttttgtt

SEQ ID NO: 932459 - DNA, 22 bp, Artificial Sequence
  chemically synthesized
agagccagaaacaaaacgtctg

SEQ ID NO: 932460 - DNA, 22 bp, Artificial Sequence
  chemically synthesized
tatacaaagaacacctaatcat

SEQ ID NO: 932461 - DNA, 22 bp, Artificial Sequence
  chemically synthesized
ctatatacaaagaacacctaat

SEQ ID NO: 932462 - DNA, 22 bp, Artificial Sequence
  chemically synthesized
ttgctatatacaaagaacacct

SEQ ID NO: 932463 - DNA, 22 bp, Artificial Sequence
  chemically synthesized
catgatgattaggtgttctttg

SEQ ID NO: 932464 - DNA, 22 bp, Artificial Sequence
  chemically synthesized
ggtgttctttgtatatagcaac

SEQ ID NO: 932465 - DNA, 22 bp, Artificial Sequence
  chemically synthesized
gcaaggggatactgttgctata

SEQ ID NO: 932466 - DNA, 22 bp, Artificial Sequence
  chemically synthesized
tttgtatatagcaacagtatcc

SEQ ID NO: 932467 - DNA, 22 bp, Artificial Sequence
  chemically synthesized
aaattggcaaggggatactgtt

SEQ ID NO: 932468 - DNA, 22 bp, Artificial Sequence
  chemically synthesized
tgtatatagcaacagtatcccc

SEQ ID NO: 932469 - DNA, 22 bp, Artificial Sequence
  chemically synthesized
gtatatagcaacagtatcccct

SEQ ID NO: 932470 - DNA, 22 bp, Artificial Sequence
  chemically synthesized
ttaaaattggcaaggggatact

SEQ ID NO: 932471 - DNA, 22 bp, Artificial Sequence
  chemically synthesized
tatatagcaacagtatcccctt

SEQ ID NO: 932472 - DNA, 22 bp, Artificial Sequence
  chemically synthesized
atattgttaaaattggcaaggg

SEQ ID NO: 932473 - DNA, 22 bp, Artificial Sequence
  chemically synthesized
aatattgttaaaattggcaagg

SEQ ID NO: 932474 - DNA, 22 bp, Artificial Sequence
  chemically synthesized
ttaatattgttaaaattggcaa

SEQ ID NO: 932475 - DNA, 22 bp, Artificial Sequence
  chemically synthesized
cttaatattgttaaaattggca

SEQ ID NO: 932476 - DNA, 22 bp, Artificial Sequence
  chemically synthesized
gccaattttaacaatattaaga

SEQ ID NO: 932477 - DNA, 22 bp, Artificial Sequence
  chemically synthesized
ccaattttaacaatattaagaa

SEQ ID NO: 932478 - DNA, 22 bp, Artificial Sequence
  chemically synthesized
gagagtggggcatatgtttctt

SEQ ID NO: 932479 - DNA, 22 bp, Artificial Sequence
  chemically synthesized
taacaatattaagaaacatatg

SEQ ID NO: 932480 - DNA, 22 bp, Artificial Sequence
  chemically synthesized
tggagagtggggcatatgtttc

SEQ ID NO: 932481 - DNA, 22 bp, Artificial Sequence
  chemically synthesized
aacaatattaagaaacatatgc

SEQ ID NO: 932482 - DNA, 22 bp, Artificial Sequence
  chemically synthesized
acaatattaagaaacatatgcc

SEQ ID NO: 932483 - DNA, 22 bp, Artificial Sequence
  chemically synthesized
ttctggagagtggggcatatgt

SEQ ID NO: 932484 - DNA, 22 bp, Artificial Sequence
  chemically synthesized
attctggagagtggggcatatg

SEQ ID NO: 932485 - DNA, 22 bp, Artificial Sequence
  chemically synthesized
tttattctggagagtggggcat

SEQ ID NO: 932486 - DNA, 22 bp, Artificial Sequence
  chemically synthesized
agaaacatatgccccactctcc

SEQ ID NO: 932487 - DNA, 22 bp, Artificial Sequence
  chemically synthesized
cacagctatttattctggagag

SEQ ID NO: 932488 - DNA, 22 bp, Artificial Sequence
  chemically synthesized
tacacagctatttattctggag

SEQ ID NO: 932489 - DNA, 22 bp, Artificial Sequence
  chemically synthesized
ctacacagctatttattctgga

SEQ ID NO: 932490 - DNA, 22 bp, Artificial Sequence
  chemically synthesized
ttctacacagctatttattctg

SEQ ID NO: 932491 - DNA, 22 bp, Artificial Sequence
  chemically synthesized
cttctacacagctatttattct

SEQ ID NO: 932492 - DNA, 22 bp, Artificial Sequence
  chemically synthesized
tcttctacacagctatttattc

SEQ ID NO: 932493 - DNA, 22 bp, Artificial Sequence
  chemically synthesized
tccagaataaatagctgtgtag

SEQ ID NO: 932494 - DNA, 22 bp, Artificial Sequence
  chemically synthesized
aaagcattttcttctacacagc

SEQ ID NO: 932495 - DNA, 22 bp, Artificial Sequence
  chemically synthesized
cagaataaatagctgtgtagaa

SEQ ID NO: 932496 - DNA, 22 bp, Artificial Sequence
  chemically synthesized
caaagcattttcttctacacag

SEQ ID NO: 932497 - DNA, 22 bp, Artificial Sequence
  chemically synthesized
tgtagaagaaaatgctttgaaa

SEQ ID NO: 932498 - DNA, 22 bp, Artificial Sequence
  chemically synthesized
agaagacaatgaatgtttcaaa

SEQ ID NO: 932499 - DNA, 22 bp, Artificial Sequence
  chemically synthesized
aagaagacaatgaatgtttcaa

SEQ ID NO: 932500 - DNA, 22 bp, Artificial Sequence
  chemically synthesized
taagaagacaatgaatgtttca

SEQ ID NO: 932501 - DNA, 22 bp, Artificial Sequence
  chemically synthesized
atattttaagaagacaatgaat

SEQ ID NO: 932502 - DNA, 22 bp, Artificial Sequence
  chemically synthesized
catattttaagaagacaatgaa

SEQ ID NO: 932503 - DNA, 22 bp, Artificial Sequence
  chemically synthesized
tcatattttaagaagacaatga

SEQ ID NO: 932504 - DNA, 22 bp, Artificial Sequence
  chemically synthesized
tgaaacattcattgtcttctta

SEQ ID NO: 932505 - DNA, 22 bp, Artificial Sequence
  chemically synthesized
attttcatattttaagaagaca

SEQ ID NO: 932506 - DNA, 22 bp, Artificial Sequence
  chemically synthesized
gaaacattcattgtcttcttaa

SEQ ID NO: 932507 - DNA, 22 bp, Artificial Sequence
  chemically synthesized
aaacattcattgtcttcttaaa

SEQ ID NO: 932508 - DNA, 22 bp, Artificial Sequence
  chemically synthesized
aatgttgattttcatattttaa

SEQ ID NO: 932509 - DNA, 22 bp, Artificial Sequence
  chemically synthesized
attgtcttcttaaaatatgaaa

SEQ ID NO: 932510 - DNA, 22 bp, Artificial Sequence
  chemically synthesized
ctaaatgttgattttcatattt

SEQ ID NO: 932511 - DNA, 22 bp, Artificial Sequence
  chemically synthesized
cctaaatgttgattttcatatt

SEQ ID NO: 932512 - DNA, 22 bp, Artificial Sequence
  chemically synthesized
tcctaaatgttgattttcatat

SEQ ID NO: 932513 - DNA, 22 bp, Artificial Sequence
  chemically synthesized
tcttcttaaaatatgaaaatca

SEQ ID NO: 932514 - DNA, 22 bp, Artificial Sequence
  chemically synthesized
cttaaaatatgaaaatcaacat

SEQ ID NO: 932515 - DNA, 22 bp, Artificial Sequence
  chemically synthesized
ttaaaatatgaaaatcaacatt

SEQ ID NO: 932516 - DNA, 22 bp, Artificial Sequence
  chemically synthesized
aaaatatgaaaatcaacattta

SEQ ID NO: 932517 - DNA, 22 bp, Artificial Sequence
  chemically synthesized
aaatatgaaaatcaacatttag

SEQ ID NO: 932518 - DNA, 22 bp, Artificial Sequence
  chemically synthesized
tgtagaagcgacataaatattt

SEQ ID NO: 932519 - DNA, 22 bp, Artificial Sequence
  chemically synthesized
ttatgtagaagcgacataaata

SEQ ID NO: 932520 - DNA, 22 bp, Artificial Sequence
  chemically synthesized
aggaaaatatttatgtcgcttc

SEQ ID NO: 932521 - DNA, 22 bp, Artificial Sequence
  chemically synthesized
ggaaaatatttatgtcgcttct

SEQ ID NO: 932522 - DNA, 22 bp, Artificial Sequence
  chemically synthesized
cccaaaggctattatgtagaag

SEQ ID NO: 932523 - DNA, 22 bp, Artificial Sequence
  chemically synthesized
acccaaaggctattatgtagaa

SEQ ID NO: 932524 - DNA, 22 bp, Artificial Sequence
  chemically synthesized
atgtcgcttctacataatagcc

SEQ ID NO: 932525 - DNA, 22 bp, Artificial Sequence
  chemically synthesized
tacttacccaaaggctattatg

SEQ ID NO: 932526 - DNA, 22 bp, Artificial Sequence
  chemically synthesized
tgtcgcttctacataatagcct

SEQ ID NO: 932527 - DNA, 22 bp, Artificial Sequence
  chemically synthesized
atctgtacttacccaaaggcta

SEQ ID NO: 932528 - DNA, 22 bp, Artificial Sequence
  chemically synthesized
ctacataatagcctttgggtaa

SEQ ID NO: 932529 - DNA, 22 bp, Artificial Sequence
  chemically synthesized
tacataatagcctttgggtaag

SEQ ID NO: 932530 - DNA, 22 bp, Artificial Sequence
  chemically synthesized
cataatagcctttgggtaagta

SEQ ID NO: 932531 - DNA, 22 bp, Artificial Sequence
  chemically synthesized
tcaagttaatctgtacttaccc

SEQ ID NO: 932532 - DNA, 22 bp, Artificial Sequence
  chemically synthesized
tgtcaagttaatctgtacttac

SEQ ID NO: 932533 - DNA, 22 bp, Artificial Sequence
  chemically synthesized
tgggtaagtacagattaacttg

SEQ ID NO: 932534 - DNA, 22 bp, Artificial Sequence
  chemically synthesized
gggtaagtacagattaacttga

SEQ ID NO: 932535 - DNA, 22 bp, Artificial Sequence
  chemically synthesized
ggtaagtacagattaacttgac

SEQ ID NO: 932536 - DNA, 22 bp, Artificial Sequence
  chemically synthesized
agcgtgaaagacctctgtcaag

SEQ ID NO: 932537 - DNA, 22 bp, Artificial Sequence
  chemically synthesized
aagcgtgaaagacctctgtcaa

SEQ ID NO: 932538 - DNA, 22 bp, Artificial Sequence
  chemically synthesized
acttgacagaggtctttcacgc

SEQ ID NO: 932539 - DNA, 22 bp, Artificial Sequence
  chemically synthesized
aatgtcgatgtttaagcgtgaa

SEQ ID NO: 932540 - DNA, 22 bp, Artificial Sequence
  chemically synthesized
gacagaggtctttcacgcttaa

SEQ ID NO: 932541 - DNA, 22 bp, Artificial Sequence
  chemically synthesized
aaatgtcgatgtttaagcgtga

SEQ ID NO: 932542 - DNA, 22 bp, Artificial Sequence
  chemically synthesized
acagaggtctttcacgcttaaa

SEQ ID NO: 932543 - DNA, 22 bp, Artificial Sequence
  chemically synthesized
tcacgcttaaacatcgacattt

SEQ ID NO: 932544 - DNA, 22 bp, Artificial Sequence
  chemically synthesized
cacgcttaaacatcgacattta

SEQ ID NO: 932545 - DNA, 22 bp, Artificial Sequence
  chemically synthesized
tcaatcaaaatttaaatgtcga

SEQ ID NO: 932546 - DNA, 22 bp, Artificial Sequence
  chemically synthesized
acgcttaaacatcgacatttaa

SEQ ID NO: 932547 - DNA, 22 bp, Artificial Sequence
  chemically synthesized
gttgtcaatcaaaatttaaatg

SEQ ID NO: 932548 - DNA, 22 bp, Artificial Sequence
  chemically synthesized
aaacatcgacatttaaattttg

SEQ ID NO: 932549 - DNA, 22 bp, Artificial Sequence
  chemically synthesized
ttggttgtcaatcaaaatttaa

SEQ ID NO: 932550 - DNA, 22 bp, Artificial Sequence
  chemically synthesized
aacatcgacatttaaattttga

SEQ ID NO: 932551 - DNA, 22 bp, Artificial Sequence
  chemically synthesized
ctgttggttgtcaatcaaaatt

SEQ ID NO: 932552 - DNA, 22 bp, Artificial Sequence
  chemically synthesized
gttactgttggttgtcaatcaa

SEQ ID NO: 932553 - DNA, 22 bp, Artificial Sequence
  chemically synthesized
ctcgttactgttggttgtcaat

SEQ ID NO: 932554 - DNA, 22 bp, Artificial Sequence
  chemically synthesized
aaattttgattgacaaccaaca

SEQ ID NO: 932555 - DNA, 22 bp, Artificial Sequence
  chemically synthesized
aattttgattgacaaccaacag

SEQ ID NO: 932556 - DNA, 22 bp, Artificial Sequence
  chemically synthesized
tgattgacaaccaacagtaacg

SEQ ID NO: 932557 - DNA, 22 bp, Artificial Sequence
  chemically synthesized
gattgacaaccaacagtaacga

SEQ ID NO: 932558 - DNA, 22 bp, Artificial Sequence
  chemically synthesized
attgacaaccaacagtaacgag

SEQ ID NO: 932559 - DNA, 22 bp, Artificial Sequence
  chemically synthesized
aaatgaaagcgttactcgttac

SEQ ID NO: 932560 - DNA, 22 bp, Artificial Sequence
  chemically synthesized
acaaccaacagtaacgagtaac

SEQ ID NO: 932561 - DNA, 22 bp, Artificial Sequence
  chemically synthesized
aatatctaaaatgaaagcgtta

SEQ ID NO: 932562 - DNA, 22 bp, Artificial Sequence
  chemically synthesized
aaatatctaaaatgaaagcgtt

SEQ ID NO: 932563 - DNA, 22 bp, Artificial Sequence
  chemically synthesized
tatatttaaatatctaaaatga

SEQ ID NO: 932564 - DNA, 22 bp, Artificial Sequence
  chemically synthesized
tgtatatttaaatatctaaaat

SEQ ID NO: 932565 - DNA, 22 bp, Artificial Sequence
  chemically synthesized
ctgtatatttaaatatctaaaa

SEQ ID NO: 932566 - DNA, 22 bp, Artificial Sequence
  chemically synthesized
tcattttagatatttaaatata

SEQ ID NO: 932567 - DNA, 22 bp, Artificial Sequence
  chemically synthesized
cattttagatatttaaatatac

SEQ ID NO: 932568 - DNA, 22 bp, Artificial Sequence
  chemically synthesized
attttagatatttaaatataca

SEQ ID NO: 932569 - DNA, 22 bp, Artificial Sequence
  chemically synthesized
tagatatttaaatatacagaag

SEQ ID NO: 932570 - DNA, 22 bp, Artificial Sequence
  chemically synthesized
agatatttaaatatacagaagt

SEQ ID NO: 932571 - DNA, 22 bp, Artificial Sequence
  chemically synthesized
caggcaaatggtacttctgtat

SEQ ID NO: 932572 - DNA, 22 bp, Artificial Sequence
  chemically synthesized
gatatttaaatatacagaagta

SEQ ID NO: 932573 - DNA, 22 bp, Artificial Sequence
  chemically synthesized
gcaggcaaatggtacttctgta

SEQ ID NO: 932574 - DNA, 22 bp, Artificial Sequence
  chemically synthesized
agtcttgcaggcaaatggtact

SEQ ID NO: 932575 - DNA, 22 bp, Artificial Sequence
  chemically synthesized
aaatatacagaagtaccatttg

SEQ ID NO: 932576 - DNA, 22 bp, Artificial Sequence
  chemically synthesized
aatatacagaagtaccatttgc

SEQ ID NO: 932577 - DNA, 22 bp, Artificial Sequence
  chemically synthesized
ctcagtcttgcaggcaaatggt

SEQ ID NO: 932578 - DNA, 22 bp, Artificial Sequence
  chemically synthesized
gctcagtcttgcaggcaaatgg

SEQ ID NO: 932579 - DNA, 22 bp, Artificial Sequence
  chemically synthesized
atttgctcagtcttgcaggcaa

SEQ ID NO: 932580 - DNA, 22 bp, Artificial Sequence
  chemically synthesized
attcatttgctcagtcttgcag

SEQ ID NO: 932581 - DNA, 22 bp, Artificial Sequence
  chemically synthesized
aacaaattaattcatttgctca

SEQ ID NO: 932582 - DNA, 22 bp, Artificial Sequence
  chemically synthesized
gcctgcaagactgagcaaatga

SEQ ID NO: 932583 - DNA, 22 bp, Artificial Sequence
  chemically synthesized
cctgcaagactgagcaaatgaa

SEQ ID NO: 932584 - DNA, 22 bp, Artificial Sequence
  chemically synthesized
ctgaacaaattaattcatttgc

SEQ ID NO: 932585 - DNA, 22 bp, Artificial Sequence
  chemically synthesized
actgaacaaattaattcatttg

SEQ ID NO: 932586 - DNA, 22 bp, Artificial Sequence
  chemically synthesized
caagactgagcaaatgaattaa

SEQ ID NO: 932587 - DNA, 22 bp, Artificial Sequence
  chemically synthesized
agcaaatgaattaatttgttca

SEQ ID NO: 932588 - DNA, 22 bp, Artificial Sequence
  chemically synthesized
aataaatatttactgaacaaat

SEQ ID NO: 932589 - DNA, 22 bp, Artificial Sequence
  chemically synthesized
atttgttcagtaaatatttatt

SEQ ID NO: 932590 - DNA, 22 bp, Artificial Sequence
  chemically synthesized
gttcagtaaatatttattgagc

SEQ ID NO: 932591 - DNA, 22 bp, Artificial Sequence
  chemically synthesized
ttcagtaaatatttattgagcg

SEQ ID NO: 932592 - DNA, 22 bp, Artificial Sequence
  chemically synthesized
agtaaatatttattgagcgcat

SEQ ID NO: 932593 - DNA, 22 bp, Artificial Sequence
  chemically synthesized
atgcaggatgcaatgcgctcaa

SEQ ID NO: 932594 - DNA, 22 bp, Artificial Sequence
  chemically synthesized
tctgatgcaggatgcaatgcgc

SEQ ID NO: 932595 - DNA, 22 bp, Artificial Sequence
  chemically synthesized
attgagcgcattgcatcctgca

SEQ ID NO: 932596 - DNA, 22 bp, Artificial Sequence
  chemically synthesized
ttgagcgcattgcatcctgcat

SEQ ID NO: 932597 - DNA, 22 bp, Artificial Sequence
  chemically synthesized
agcgcattgcatcctgcatcag

SEQ ID NO: 932598 - DNA, 22 bp, Artificial Sequence
  chemically synthesized
aggtcaggaactgtctgatgca

SEQ ID NO: 932599 - DNA, 22 bp, Artificial Sequence
  chemically synthesized
catcctgcatcagacagttcct

SEQ ID NO: 932600 - DNA, 22 bp, Artificial Sequence
  chemically synthesized
catcagacagttcctgacctta

SEQ ID NO: 932601 - DNA, 22 bp, Artificial Sequence
  chemically synthesized
caatgaaatgcctaaggtcagg

SEQ ID NO: 932602 - DNA, 22 bp, Artificial Sequence
  chemically synthesized
tacctgcaatgaaatgcctaag

SEQ ID NO: 932603 - DNA, 22 bp, Artificial Sequence
  chemically synthesized
tctatacctgcaatgaaatgcc

SEQ ID NO: 932604 - DNA, 22 bp, Artificial Sequence
  chemically synthesized
gtctatacctgcaatgaaatgc

SEQ ID NO: 932605 - DNA, 22 bp, Artificial Sequence
  chemically synthesized
ctgaccttaggcatttcattgc

SEQ ID NO: 932606 - DNA, 22 bp, Artificial Sequence
  chemically synthesized
tttgtctatacctgcaatgaaa

SEQ ID NO: 932607 - DNA, 22 bp, Artificial Sequence
  chemically synthesized
accttaggcatttcattgcagg

SEQ ID NO: 932608 - DNA, 22 bp, Artificial Sequence
  chemically synthesized
ttgtttgtctatacctgcaatg

SEQ ID NO: 932609 - DNA, 22 bp, Artificial Sequence
  chemically synthesized
attgtttgtctatacctgcaat

SEQ ID NO: 932610 - DNA, 22 bp, Artificial Sequence
  chemically synthesized
aggcatttcattgcaggtatag

SEQ ID NO: 932611 - DNA, 22 bp, Artificial Sequence
  chemically synthesized
tttattgtttgtctatacctgc

SEQ ID NO: 932612 - DNA, 22 bp, Artificial Sequence
  chemically synthesized
ggcatttcattgcaggtataga

SEQ ID NO: 932613 - DNA, 22 bp, Artificial Sequence
  chemically synthesized
gtttattgtttgtctatacctg

SEQ ID NO: 932614 - DNA, 22 bp, Artificial Sequence
  chemically synthesized
tttgtttattgtttgtctatac

SEQ ID NO: 932615 - DNA, 22 bp, Artificial Sequence
  chemically synthesized
gtttgtttattgtttgtctata

SEQ ID NO: 932616 - DNA, 22 bp, Artificial Sequence
  chemically synthesized
tgtttgtttattgtttgtctat

SEQ ID NO: 932617 - DNA, 22 bp, Artificial Sequence
  chemically synthesized
cattgcaggtatagacaaacaa

SEQ ID NO: 932618 - DNA, 22 bp, Artificial Sequence
  chemically synthesized
attgcaggtatagacaaacaat

SEQ ID NO: 932619 - DNA, 22 bp, Artificial Sequence
  chemically synthesized
caggtatagacaaacaataaac

SEQ ID NO: 932620 - DNA, 22 bp, Artificial Sequence
  chemically synthesized
cgtgtatgtacatctttgtttg

SEQ ID NO: 932621 - DNA, 22 bp, Artificial Sequence
  chemically synthesized
ttccgtgtatgtacatctttgt

SEQ ID NO: 932622 - DNA, 22 bp, Artificial Sequence
  chemically synthesized
attccgtgtatgtacatctttg

SEQ ID NO: 932623 - DNA, 22 bp, Artificial Sequence
  chemically synthesized
ccacaatatgtgtttattccgt

SEQ ID NO: 932624 - DNA, 22 bp, Artificial Sequence
  chemically synthesized
ttaccacaatatgtgtttattc

SEQ ID NO: 932625 - DNA, 22 bp, Artificial Sequence
  chemically synthesized
tccctattaccacaatatgtgt

SEQ ID NO: 932626 - DNA, 22 bp, Artificial Sequence
  chemically synthesized
gtccctattaccacaatatgtg

SEQ ID NO: 932627 - DNA, 22 bp, Artificial Sequence
  chemically synthesized
tgtccctattaccacaatatgt

SEQ ID NO: 932628 - DNA, 22 bp, Artificial Sequence
  chemically synthesized
ttgtccctattaccacaatatg

SEQ ID NO: 932629 - DNA, 22 bp, Artificial Sequence
  chemically synthesized
ttttgtccctattaccacaata

SEQ ID NO: 932630 - DNA, 22 bp, Artificial Sequence
  chemically synthesized
cttttgtccctattaccacaat

SEQ ID NO: 932631 - DNA, 22 bp, Artificial Sequence
  chemically synthesized
tcttttgtccctattaccacaa

SEQ ID NO: 932632 - DNA, 22 bp, Artificial Sequence
  chemically synthesized
tggtaatagggacaaaagaaaa

SEQ ID NO: 932633 - DNA, 22 bp, Artificial Sequence
  chemically synthesized
tgaaagcatcccgtgattttct

SEQ ID NO: 932634 - DNA, 22 bp, Artificial Sequence
  chemically synthesized
tgtgaaagcatcccgtgatttt

SEQ ID NO: 932635 - DNA, 22 bp, Artificial Sequence
  chemically synthesized
tctgtgaaagcatcccgtgatt

SEQ ID NO: 932636 - DNA, 22 bp, Artificial Sequence
  chemically synthesized
ttctctgtgaaagcatcccgtg

SEQ ID NO: 932637 - DNA, 22 bp, Artificial Sequence
  chemically synthesized
cattattctctgtgaaagcatc

SEQ ID NO: 932638 - DNA, 22 bp, Artificial Sequence
  chemically synthesized
tccattattctctgtgaaagca

SEQ ID NO: 932639 - DNA, 22 bp, Artificial Sequence
  chemically synthesized
ttctccattattctctgtgaaa

SEQ ID NO: 932640 - DNA, 22 bp, Artificial Sequence
  chemically synthesized
tcattattctccattattctct

SEQ ID NO: 932641 - DNA, 22 bp, Artificial Sequence
  chemically synthesized
cgttatcattattctccattat

SEQ ID NO: 932642 - DNA, 22 bp, Artificial Sequence
  chemically synthesized
tcacagagaataatggagaata

SEQ ID NO: 932643 - DNA, 22 bp, Artificial Sequence
  chemically synthesized
cacagagaataatggagaataa

SEQ ID NO: 932644 - DNA, 22 bp, Artificial Sequence
  chemically synthesized
acagagaataatggagaataat

SEQ ID NO: 932645 - DNA, 22 bp, Artificial Sequence
  chemically synthesized
gtctccgttatcattattctcc

SEQ ID NO: 932646 - DNA, 22 bp, Artificial Sequence
  chemically synthesized
ttagtctccgttatcattattc

SEQ ID NO: 932647 - DNA, 22 bp, Artificial Sequence
  chemically synthesized
agcattattagtctccgttatc

SEQ ID NO: 932648 - DNA, 22 bp, Artificial Sequence
  chemically synthesized
ttgagcattattagtctccgtt

SEQ ID NO: 932649 - DNA, 22 bp, Artificial Sequence
  chemically synthesized
aactattgagcattattagtct

SEQ ID NO: 932650 - DNA, 22 bp, Artificial Sequence
  chemically synthesized
caaatcctcaactattgagcat

SEQ ID NO: 932651 - DNA, 22 bp, Artificial Sequence
  chemically synthesized
gcaaatcctcaactattgagca

SEQ ID NO: 932652 - DNA, 22 bp, Artificial Sequence
  chemically synthesized
ataatgctcaatagttgaggat

SEQ ID NO: 932653 - DNA, 22 bp, Artificial Sequence
  chemically synthesized
caccataatcttgcaaatcctc

SEQ ID NO: 932654 - DNA, 22 bp, Artificial Sequence
  chemically synthesized
aatagttgaggatttgcaagat

SEQ ID NO: 932655 - DNA, 22 bp, Artificial Sequence
  chemically synthesized
aagttacaccataatcttgcaa

SEQ ID NO: 932656 - DNA, 22 bp, Artificial Sequence
  chemically synthesized
tctaaagttacaccataatctt

SEQ ID NO: 932657 - DNA, 22 bp, Artificial Sequence
  chemically synthesized
atctaaagttacaccataatct

SEQ ID NO: 932658 - DNA, 22 bp, Artificial Sequence
  chemically synthesized
tatctaaagttacaccataatc

SEQ ID NO: 932659 - DNA, 22 bp, Artificial Sequence
  chemically synthesized
aggatttgcaagattatggtgt

SEQ ID NO: 932660 - DNA, 22 bp, Artificial Sequence
  chemically synthesized
gcaagattatggtgtaacttta

SEQ ID NO: 932661 - DNA, 22 bp, Artificial Sequence
  chemically synthesized
caagattatggtgtaactttag

SEQ ID NO: 932662 - DNA, 22 bp, Artificial Sequence
  chemically synthesized
caggtcactttatctaaagtta

SEQ ID NO: 932663 - DNA, 22 bp, Artificial Sequence
  chemically synthesized
ccaggtcactttatctaaagtt

SEQ ID NO: 932664 - DNA, 22 bp, Artificial Sequence
  chemically synthesized
tccaggtcactttatctaaagt

SEQ ID NO: 932665 - DNA, 22 bp, Artificial Sequence
  chemically synthesized
tggtgtaactttagataaagtg

SEQ ID NO: 932666 - DNA, 22 bp, Artificial Sequence
  chemically synthesized
caaagcctttccaggtcacttt

SEQ ID NO: 932667 - DNA, 22 bp, Artificial Sequence
  chemically synthesized
atctccaaagcctttccaggtc

SEQ ID NO: 932668 - DNA, 22 bp, Artificial Sequence
  chemically synthesized
catctccaaagcctttccaggt

SEQ ID NO: 932669 - DNA, 22 bp, Artificial Sequence
  chemically synthesized
tagataaagtgacctggaaagg

SEQ ID NO: 932670 - DNA, 22 bp, Artificial Sequence
  chemically synthesized
agataaagtgacctggaaaggc

SEQ ID NO: 932671 - DNA, 22 bp, Artificial Sequence
  chemically synthesized
gataaagtgacctggaaaggct

SEQ ID NO: 932672 - DNA, 22 bp, Artificial Sequence
  chemically synthesized
agtaacttcatctccaaagcct

SEQ ID NO: 932673 - DNA, 22 bp, Artificial Sequence
  chemically synthesized
cagtaacttcatctccaaagcc

SEQ ID NO: 932674 - DNA, 22 bp, Artificial Sequence
  chemically synthesized
ccgtttcagtaacttcatctcc

SEQ ID NO: 932675 - DNA, 22 bp, Artificial Sequence
  chemically synthesized
gaaaggctttggagatgaagtt

SEQ ID NO: 932676 - DNA, 22 bp, Artificial Sequence
  chemically synthesized
tgcatctcccgtttcagtaact

SEQ ID NO: 932677 - DNA, 22 bp, Artificial Sequence
  chemically synthesized
gtgcatctcccgtttcagtaac

SEQ ID NO: 932678 - DNA, 22 bp, Artificial Sequence
  chemically synthesized
tgtgcatctcccgtttcagtaa

SEQ ID NO: 932679 - DNA, 22 bp, Artificial Sequence
  chemically synthesized
tggagatgaagttactgaaacg

SEQ ID NO: 932680 - DNA, 22 bp, Artificial Sequence
  chemically synthesized
ggagatgaagttactgaaacgg

SEQ ID NO: 932681 - DNA, 22 bp, Artificial Sequence
  chemically synthesized
tttgtgcatctcccgtttcagt

SEQ ID NO: 932682 - DNA, 22 bp, Artificial Sequence
  chemically synthesized
gagatgaagttactgaaacggg

SEQ ID NO: 932683 - DNA, 22 bp, Artificial Sequence
  chemically synthesized
ctttgtgcatctcccgtttcag

SEQ ID NO: 932684 - DNA, 22 bp, Artificial Sequence
  chemically synthesized
ttctttgtgcatctcccgtttc

SEQ ID NO: 932685 - DNA, 22 bp, Artificial Sequence
  chemically synthesized
ttcttctttgtgcatctcccgt

SEQ ID NO: 932686 - DNA, 22 bp, Artificial Sequence
  chemically synthesized
tgttcttctttgtgcatctccc

SEQ ID NO: 932687 - DNA, 22 bp, Artificial Sequence
  chemically synthesized
attctgttcttctttgtgcatc

SEQ ID NO: 932688 - DNA, 22 bp, Artificial Sequence
  chemically synthesized
ctgaaacgggagatgcacaaag

SEQ ID NO: 932689 - DNA, 22 bp, Artificial Sequence
  chemically synthesized
aaacgggagatgcacaaagaag

SEQ ID NO: 932690 - DNA, 22 bp, Artificial Sequence
  chemically synthesized
gataagtagttaattctgttct

SEQ ID NO: 932691 - DNA, 22 bp, Artificial Sequence
  chemically synthesized
catctggataagtagttaattc

SEQ ID NO: 932692 - DNA, 22 bp, Artificial Sequence
  chemically synthesized
tccatctggataagtagttaat

SEQ ID NO: 932693 - DNA, 22 bp, Artificial Sequence
  chemically synthesized
ctccatctggataagtagttaa

SEQ ID NO: 932694 - DNA, 22 bp, Artificial Sequence
  chemically synthesized
tctccatctggataagtagtta

SEQ ID NO: 932695 - DNA, 22 bp, Artificial Sequence
  chemically synthesized
ttttctccatctggataagtag

SEQ ID NO: 932696 - DNA, 22 bp, Artificial Sequence
  chemically synthesized
actacttatccagatggagaaa

SEQ ID NO: 932697 - DNA, 22 bp, Artificial Sequence
  chemically synthesized
cttatccagatggagaaaacag

SEQ ID NO: 932698 - DNA, 22 bp, Artificial Sequence
  chemically synthesized
atccagatggagaaaacagcat

SEQ ID NO: 932699 - DNA, 22 bp, Artificial Sequence
  chemically synthesized
tccagatggagaaaacagcatg

SEQ ID NO: 932700 - DNA, 22 bp, Artificial Sequence
  chemically synthesized
gggagcgtcatacatgctgttt

SEQ ID NO: 932701 - DNA, 22 bp, Artificial Sequence
  chemically synthesized
actcgggagcgtcatacatgct

SEQ ID NO: 932702 - DNA, 22 bp, Artificial Sequence
  chemically synthesized
ctgactcgggagcgtcatacat

SEQ ID NO: 932703 - DNA, 22 bp, Artificial Sequence
  chemically synthesized
cctgactcgggagcgtcataca

SEQ ID NO: 932704 - DNA, 22 bp, Artificial Sequence
  chemically synthesized
cttcctgactcgggagcgtcat

SEQ ID NO: 932705 - DNA, 22 bp, Artificial Sequence
  chemically synthesized
tatccaggcatataaagttcct

SEQ ID NO: 932706 - DNA, 22 bp, Artificial Sequence
  chemically synthesized
ccgagtcaggaaggaactttat

SEQ ID NO: 932707 - DNA, 22 bp, Artificial Sequence
  chemically synthesized
atatccaggcatataaagttcc

SEQ ID NO: 932708 - DNA, 22 bp, Artificial Sequence
  chemically synthesized
tatatccaggcatataaagttc

SEQ ID NO: 932709 - DNA, 22 bp, Artificial Sequence
  chemically synthesized
tttatatccaggcatataaagt

SEQ ID NO: 932710 - DNA, 22 bp, Artificial Sequence
  chemically synthesized
ctttatatccaggcatataaag

SEQ ID NO: 932711 - DNA, 22 bp, Artificial Sequence
  chemically synthesized
agcttctttatatccaggcata

SEQ ID NO: 932712 - DNA, 22 bp, Artificial Sequence
  chemically synthesized
cagcttctttatatccaggcat

SEQ ID NO: 932713 - DNA, 22 bp, Artificial Sequence
  chemically synthesized
tcagcttctttatatccaggca

SEQ ID NO: 932714 - DNA, 22 bp, Artificial Sequence
  chemically synthesized
tttcagcttctttatatccagg

SEQ ID NO: 932715 - DNA, 22 bp, Artificial Sequence
  chemically synthesized
ctttcagcttctttatatccag

SEQ ID NO: 932716 - DNA, 22 bp, Artificial Sequence
  chemically synthesized
tctttcagcttctttatatcca

SEQ ID NO: 932717 - DNA, 22 bp, Artificial Sequence
  chemically synthesized
tatatgcctggatataaagaag

SEQ ID NO: 932718 - DNA, 22 bp, Artificial Sequence
  chemically synthesized
gttttctttcagcttctttata

SEQ ID NO: 932719 - DNA, 22 bp, Artificial Sequence
  chemically synthesized
atatgcctggatataaagaagc

SEQ ID NO: 932720 - DNA, 22 bp, Artificial Sequence
  chemically synthesized
tatgcctggatataaagaagct

SEQ ID NO: 932721 - DNA, 22 bp, Artificial Sequence
  chemically synthesized
tcgttttctttcagcttcttta

SEQ ID NO: 932722 - DNA, 22 bp, Artificial Sequence
  chemically synthesized
gatataaagaagctgaaagaaa

SEQ ID NO: 932723 - DNA, 22 bp, Artificial Sequence
  chemically synthesized
caaccattctcgttttctttca

SEQ ID NO: 932724 - DNA, 22 bp, Artificial Sequence
  chemically synthesized
aaggggctccaaccattctcgt

SEQ ID NO: 932725 - DNA, 22 bp, Artificial Sequence
  chemically synthesized
attcaaggggctccaaccattc

SEQ ID NO: 932726 - DNA, 22 bp, Artificial Sequence
  chemically synthesized
aaagaaaacgagaatggttgga

SEQ ID NO: 932727 - DNA, 22 bp, Artificial Sequence
  chemically synthesized
cattcaaggggctccaaccatt

SEQ ID NO: 932728 - DNA, 22 bp, Artificial Sequence
  chemically synthesized
cccttcattcaaggggctccaa

SEQ ID NO: 932729 - DNA, 22 bp, Artificial Sequence
  chemically synthesized
cacactccccttcattcaaggg

SEQ ID NO: 932730 - DNA, 22 bp, Artificial Sequence
  chemically synthesized
attccacactccccttcattca

SEQ ID NO: 932731 - DNA, 22 bp, Artificial Sequence
  chemically synthesized
cattccacactccccttcattc

SEQ ID NO: 932732 - DNA, 22 bp, Artificial Sequence
  chemically synthesized
gagccccttgaatgaaggggag

SEQ ID NO: 932733 - DNA, 22 bp, Artificial Sequence
  chemically synthesized
atttcattccacactccccttc

SEQ ID NO: 932734 - DNA, 22 bp, Artificial Sequence
  chemically synthesized
aagttgatttcattccacactc

SEQ ID NO: 932735 - DNA, 22 bp, Artificial Sequence
  chemically synthesized
gaatgaaggggagtgtggaatg

SEQ ID NO: 932736 - DNA, 22 bp, Artificial Sequence
  chemically synthesized
aatgaaggggagtgtggaatga

SEQ ID NO: 932737 - DNA, 22 bp, Artificial Sequence
  chemically synthesized
tatgttgaagttgatttcattc

SEQ ID NO: 932738 - DNA, 22 bp, Artificial Sequence
  chemically synthesized
tacatgaatctgtatgttgaag

SEQ ID NO: 932739 - DNA, 22 bp, Artificial Sequence
  chemically synthesized
gtacatgaatctgtatgttgaa

SEQ ID NO: 932740 - DNA, 22 bp, Artificial Sequence
  chemically synthesized
caacatacagattcatgtacaa

SEQ ID NO: 932741 - DNA, 22 bp, Artificial Sequence
  chemically synthesized
cagtgaacatccttgtacatga

SEQ ID NO: 932742 - DNA, 22 bp, Artificial Sequence
  chemically synthesized
aacatacagattcatgtacaag

SEQ ID NO: 932743 - DNA, 22 bp, Artificial Sequence
  chemically synthesized
gtcactgcagtgaacatccttg

SEQ ID NO: 932744 - DNA, 22 bp, Artificial Sequence
  chemically synthesized
ggtcactgcagtgaacatcctt

SEQ ID NO: 932745 - DNA, 22 bp, Artificial Sequence
  chemically synthesized
tggtcactgcagtgaacatcct

SEQ ID NO: 932746 - DNA, 22 bp, Artificial Sequence
  chemically synthesized
atgtacaaggatgttcactgca

SEQ ID NO: 932747 - DNA, 22 bp, Artificial Sequence
  chemically synthesized
cacattttggtcactgcagtga

SEQ ID NO: 932748 - DNA, 22 bp, Artificial Sequence
  chemically synthesized
ccacattttggtcactgcagtg

SEQ ID NO: 932749 - DNA, 22 bp, Artificial Sequence
  chemically synthesized
cttccacattttggtcactgca

SEQ ID NO: 932750 - DNA, 22 bp, Artificial Sequence
  chemically synthesized
ggactgcttccacattttggtc

SEQ ID NO: 932751 - DNA, 22 bp, Artificial Sequence
  chemically synthesized
actgcagtgaccaaaatgtgga

SEQ ID NO: 932752 - DNA, 22 bp, Artificial Sequence
  chemically synthesized
ggcattgggactgcttccacat

SEQ ID NO: 932753 - DNA, 22 bp, Artificial Sequence
  chemically synthesized
cagtgaccaaaatgtggaagca

SEQ ID NO: 932754 - DNA, 22 bp, Artificial Sequence
  chemically synthesized
ttgggcattgggactgcttcca

SEQ ID NO: 932755 - DNA, 22 bp, Artificial Sequence
  chemically synthesized
ccattattgggcattgggactg

SEQ ID NO: 932756 - DNA, 22 bp, Artificial Sequence
  chemically synthesized
tcccattattgggcattgggac

SEQ ID NO: 932757 - DNA, 22 bp, Artificial Sequence
  chemically synthesized
ttctcccattattgggcattgg

SEQ ID NO: 932758 - DNA, 22 bp, Artificial Sequence
  chemically synthesized
attattctcccattattgggca

SEQ ID NO: 932759 - DNA, 22 bp, Artificial Sequence
  chemically synthesized
taaataattaattattctccca

SEQ ID NO: 932760 - DNA, 22 bp, Artificial Sequence
  chemically synthesized
ccagatgtgattgtaaataatt

SEQ ID NO: 932761 - DNA, 22 bp, Artificial Sequence
  chemically synthesized
attatttacaatcacatctggg

SEQ ID NO: 932762 - DNA, 22 bp, Artificial Sequence
  chemically synthesized
tttacaatcacatctgggagtt

SEQ ID NO: 932763 - DNA, 22 bp, Artificial Sequence
  chemically synthesized
acaatcacatctgggagtttac

SEQ ID NO: 932764 - DNA, 22 bp, Artificial Sequence
  chemically synthesized
caatcacatctgggagtttact

SEQ ID NO: 932765 - DNA, 22 bp, Artificial Sequence
  chemically synthesized
aaatgcaatacaatatagtaaa

SEQ ID NO: 932766 - DNA, 22 bp, Artificial Sequence
  chemically synthesized
aaaatgcaatacaatatagtaa

SEQ ID NO: 932767 - DNA, 22 bp, Artificial Sequence
  chemically synthesized
taaaatgcaatacaatatagta

SEQ ID NO: 932768 - DNA, 22 bp, Artificial Sequence
  chemically synthesized
ggagtttactatattgtattgc

SEQ ID NO: 932769 - DNA, 22 bp, Artificial Sequence
  chemically synthesized
tatgtcattttaaaatgcaata

SEQ ID NO: 932770 - DNA, 22 bp, Artificial Sequence
  chemically synthesized
atatgtcattttaaaatgcaat

SEQ ID NO: 932771 - DNA, 22 bp, Artificial Sequence
  chemically synthesized
tatatgtcattttaaaatgcaa

SEQ ID NO: 932772 - DNA, 22 bp, Artificial Sequence
  chemically synthesized
actatattgtattgcattttaa

SEQ ID NO: 932773 - DNA, 22 bp, Artificial Sequence
  chemically synthesized
ctatattgtattgcattttaaa

SEQ ID NO: 932774 - DNA, 22 bp, Artificial Sequence
  chemically synthesized
tattgtattgcattttaaaatg

SEQ ID NO: 932775 - DNA, 22 bp, Artificial Sequence
  chemically synthesized
aattttatatgtcattttaaaa

SEQ ID NO: 932776 - DNA, 22 bp, Artificial Sequence
  chemically synthesized
aaattttatatgtcattttaaa

SEQ ID NO: 932777 - DNA, 22 bp, Artificial Sequence
  chemically synthesized
taaattttatatgtcattttaa

SEQ ID NO: 932778 - DNA, 22 bp, Artificial Sequence
  chemically synthesized
tattgcattttaaaatgacata

SEQ ID NO: 932779 - DNA, 22 bp, Artificial Sequence
  chemically synthesized
ttttaaattttatatgtcattt

SEQ ID NO: 932780 - DNA, 22 bp, Artificial Sequence
  chemically synthesized
cattttaaaatgacatataaaa

SEQ ID NO: 932781 - DNA, 22 bp, Artificial Sequence
  chemically synthesized
gaattattttaaattttatatg

SEQ ID NO: 932782 - DNA, 22 bp, Artificial Sequence
  chemically synthesized
taaaatgacatataaaatttaa

SEQ ID NO: 932783 - DNA, 22 bp, Artificial Sequence
  chemically synthesized
aaaatgacatataaaatttaaa

SEQ ID NO: 932784 - DNA, 22 bp, Artificial Sequence
  chemically synthesized
aaatgacatataaaatttaaaa

SEQ ID NO: 932785 - DNA, 22 bp, Artificial Sequence
  chemically synthesized
ataattagaattattttaaatt

SEQ ID NO: 932786 - DNA, 22 bp, Artificial Sequence
  chemically synthesized
aataattagaattattttaaat

SEQ ID NO: 932787 - DNA, 22 bp, Artificial Sequence
  chemically synthesized
atgtttaataattagaattatt

SEQ ID NO: 932788 - DNA, 22 bp, Artificial Sequence
  chemically synthesized
ttgatgtttaataattagaatt

SEQ ID NO: 932789 - DNA, 22 bp, Artificial Sequence
  chemically synthesized
attgatgtttaataattagaat

SEQ ID NO: 932790 - DNA, 22 bp, Artificial Sequence
  chemically synthesized
tattgatgtttaataattagaa

SEQ ID NO: 932791 - DNA, 22 bp, Artificial Sequence
  chemically synthesized
aaaataattctaattattaaac

SEQ ID NO: 932792 - DNA, 22 bp, Artificial Sequence
  chemically synthesized
aaataattctaattattaaaca

SEQ ID NO: 932793 - DNA, 22 bp, Artificial Sequence
  chemically synthesized
atattttattgatgtttaataa

SEQ ID NO: 932794 - DNA, 22 bp, Artificial Sequence
  chemically synthesized
aatattttattgatgtttaata

SEQ ID NO: 932795 - DNA, 22 bp, Artificial Sequence
  chemically synthesized
tttaatattttattgatgttta

SEQ ID NO: 932796 - DNA, 22 bp, Artificial Sequence
  chemically synthesized
atttaatattttattgatgttt

SEQ ID NO: 932797 - DNA, 22 bp, Artificial Sequence
  chemically synthesized
tatttaatattttattgatgtt

SEQ ID NO: 932798 - DNA, 22 bp, Artificial Sequence
  chemically synthesized
ttatttaatattttattgatgt

SEQ ID NO: 932799 - DNA, 22 bp, Artificial Sequence
  chemically synthesized
taattattaaacatcaataaaa

SEQ ID NO: 932800 - DNA, 22 bp, Artificial Sequence
  chemically synthesized
attattaaacatcaataaaata

SEQ ID NO: 932801 - DNA, 22 bp, Artificial Sequence
  chemically synthesized
tcatcttttatttaatatttta

SEQ ID NO: 932802 - DNA, 22 bp, Artificial Sequence
  chemically synthesized
ttaaacatcaataaaatattaa

SEQ ID NO: 932803 - DNA, 22 bp, Artificial Sequence
  chemically synthesized
atcatcttttatttaatatttt

SEQ ID NO: 932804 - DNA, 22 bp, Artificial Sequence
  chemically synthesized
tatcatcttttatttaatattt

SEQ ID NO: 932805 - DNA, 22 bp, Artificial Sequence
  chemically synthesized
aacatcaataaaatattaaata

SEQ ID NO: 932806 - DNA, 22 bp, Artificial Sequence
  chemically synthesized
tacaaaaaaaattttatcatct

SEQ ID NO: 932807 - DNA, 22 bp, Artificial Sequence
  chemically synthesized
aataaaagatgataaaattttt

SEQ ID NO: 932808 - DNA, 22 bp, Artificial Sequence
  chemically synthesized
gcaagtagtattgtacaaaaaa

SEQ ID NO: 932809 - DNA, 22 bp, Artificial Sequence
  chemically synthesized
tcccattagcaagtagtattgt

SEQ ID NO: 932810 - DNA, 22 bp, Artificial Sequence
  chemically synthesized
tgtcccattagcaagtagtatt

SEQ ID NO: 932811 - DNA, 22 bp, Artificial Sequence
  chemically synthesized
tttttgtacaatactacttgct

SEQ ID NO: 932812 - DNA, 22 bp, Artificial Sequence
  chemically synthesized
ttttgtacaatactacttgcta

SEQ ID NO: 932813 - DNA, 22 bp, Artificial Sequence
  chemically synthesized
tttgtacaatactacttgctaa

SEQ ID NO: 932814 - DNA, 22 bp, Artificial Sequence
  chemically synthesized
agttctgtcccattagcaagta

SEQ ID NO: 932815 - DNA, 22 bp, Artificial Sequence
  chemically synthesized
ttgtacaatactacttgctaat

SEQ ID NO: 932816 - DNA, 22 bp, Artificial Sequence
  chemically synthesized
gagttctgtcccattagcaagt

SEQ ID NO: 932817 - DNA, 22 bp, Artificial Sequence
  chemically synthesized
tgtacaatactacttgctaatg

SEQ ID NO: 932818 - DNA, 22 bp, Artificial Sequence
  chemically synthesized
gtacaatactacttgctaatgg

SEQ ID NO: 932819 - DNA, 22 bp, Artificial Sequence
  chemically synthesized
ttgagttctgtcccattagcaa

SEQ ID NO: 932820 - DNA, 22 bp, Artificial Sequence
  chemically synthesized
tacaatactacttgctaatggg

SEQ ID NO: 932821 - DNA, 22 bp, Artificial Sequence
  chemically synthesized
cttgagttctgtcccattagca

SEQ ID NO: 932822 - DNA, 22 bp, Artificial Sequence
  chemically synthesized
tcttgagttctgtcccattagc

SEQ ID NO: 932823 - DNA, 22 bp, Artificial Sequence
  chemically synthesized
atgttttcttgagttctgtccc

SEQ ID NO: 932824 - DNA, 22 bp, Artificial Sequence
  chemically synthesized
gatgttttcttgagttctgtcc

SEQ ID NO: 932825 - DNA, 22 bp, Artificial Sequence
  chemically synthesized
tgatgttttcttgagttctgtc

SEQ ID NO: 932826 - DNA, 22 bp, Artificial Sequence
  chemically synthesized
cttgctaatgggacagaactca

SEQ ID NO: 932827 - DNA, 22 bp, Artificial Sequence
  chemically synthesized
ttgatgttttcttgagttctgt

SEQ ID NO: 932828 - DNA, 22 bp, Artificial Sequence
  chemically synthesized
gctaatgggacagaactcaaga

SEQ ID NO: 932829 - DNA, 22 bp, Artificial Sequence
  chemically synthesized
ctaatgggacagaactcaagaa

SEQ ID NO: 932830 - DNA, 22 bp, Artificial Sequence
  chemically synthesized
caccttttgatgttttcttgag

SEQ ID NO: 932831 - DNA, 22 bp, Artificial Sequence
  chemically synthesized
atgggacagaactcaagaaaac

SEQ ID NO: 932832 - DNA, 22 bp, Artificial Sequence
  chemically synthesized
acaccttttgatgttttcttga

SEQ ID NO: 932833 - DNA, 22 bp, Artificial Sequence
  chemically synthesized
tacaccttttgatgttttcttg

SEQ ID NO: 932834 - DNA, 22 bp, Artificial Sequence
  chemically synthesized
atgggttttacaccttttgatg

SEQ ID NO: 932835 - DNA, 22 bp, Artificial Sequence
  chemically synthesized
aatgggttttacaccttttgat

SEQ ID NO: 932836 - DNA, 22 bp, Artificial Sequence
  chemically synthesized
ttaatgggttttacaccttttg

SEQ ID NO: 932837 - DNA, 22 bp, Artificial Sequence
  chemically synthesized
cttaatgggttttacacctttt

SEQ ID NO: 932838 - DNA, 22 bp, Artificial Sequence
  chemically synthesized
aagaaaacatcaaaaggtgtaa

SEQ ID NO: 932839 - DNA, 22 bp, Artificial Sequence
  chemically synthesized
ccttcttaatgggttttacacc

SEQ ID NO: 932840 - DNA, 22 bp, Artificial Sequence
  chemically synthesized
ccataggttgccttcttaatgg

SEQ ID NO: 932841 - DNA, 22 bp, Artificial Sequence
  chemically synthesized
tcccataggttgccttcttaat

SEQ ID NO: 932842 - DNA, 22 bp, Artificial Sequence
  chemically synthesized
ctcccataggttgccttcttaa

SEQ ID NO: 932843 - DNA, 22 bp, Artificial Sequence
  chemically synthesized
tctcccataggttgccttctta

SEQ ID NO: 932844 - DNA, 22 bp, Artificial Sequence
  chemically synthesized
tagtctttctcccataggttgc

SEQ ID NO: 932845 - DNA, 22 bp, Artificial Sequence
  chemically synthesized
agaaggcaacctatgggagaaa

SEQ ID NO: 932846 - DNA, 22 bp, Artificial Sequence
  chemically synthesized
tgggagaaagactataggtgct

SEQ ID NO: 932847 - DNA, 22 bp, Artificial Sequence
  chemically synthesized
taggtgcttttttgtttgtttg

SEQ ID NO: 932848 - DNA, 22 bp, Artificial Sequence
  chemically synthesized
agaaaaaaaacaaaacaaacaa

SEQ ID NO: 932849 - DNA, 22 bp, Artificial Sequence
  chemically synthesized
tctcagaaaaaaaacaaaacaa

SEQ ID NO: 932850 - DNA, 22 bp, Artificial Sequence
  chemically synthesized
ttttgtttgtttgttttgtttt

SEQ ID NO: 932851 - DNA, 22 bp, Artificial Sequence
  chemically synthesized
tgtctcagaaaaaaaacaaaac

SEQ ID NO: 932852 - DNA, 22 bp, Artificial Sequence
  chemically synthesized
tttgtttgtttgttttgttttt

SEQ ID NO: 932853 - DNA, 22 bp, Artificial Sequence
  chemically synthesized
ttgtttgtttgttttgtttttt

SEQ ID NO: 932854 - DNA, 22 bp, Artificial Sequence
  chemically synthesized
tgtttgtttgttttgttttttt

SEQ ID NO: 932855 - DNA, 22 bp, Artificial Sequence
  chemically synthesized
gtttgtttgttttgtttttttt

SEQ ID NO: 932856 - DNA, 22 bp, Artificial Sequence
  chemically synthesized
tttgtttgttttgttttttttc

SEQ ID NO: 932857 - DNA, 22 bp, Artificial Sequence
  chemically synthesized
gtttgttttgttttttttctga

SEQ ID NO: 932858 - DNA, 22 bp, Artificial Sequence
  chemically synthesized
tttgttttgttttttttctgag

SEQ ID NO: 932859 - DNA, 22 bp, Artificial Sequence
  chemically synthesized
gttttgttttttttctgagaca

SEQ ID NO: 932860 - DNA, 22 bp, Artificial Sequence
  chemically synthesized
ttttgttttttttctgagacag

SEQ ID NO: 932861 - DNA, 22 bp, Artificial Sequence
  chemically synthesized
tgttttttttctgagacagagt

SEQ ID NO: 932862 - DNA, 22 bp, Artificial Sequence
  chemically synthesized
gttttttttctgagacagagtc

SEQ ID NO: 932863 - DNA, 22 bp, Artificial Sequence
  chemically synthesized
gtgacagagcgagactctgtct

SEQ ID NO: 932864 - DNA, 22 bp, Artificial Sequence
  chemically synthesized
ttttttttctgagacagagtct

SEQ ID NO: 932865 - DNA, 22 bp, Artificial Sequence
  chemically synthesized
tttttctgagacagagtctcgc

SEQ ID NO: 932866 - DNA, 22 bp, Artificial Sequence
  chemically synthesized
ttttctgagacagagtctcgct

SEQ ID NO: 932867 - DNA, 22 bp, Artificial Sequence
  chemically synthesized
tttctgagacagagtctcgctc

SEQ ID NO: 932868 - DNA, 22 bp, Artificial Sequence
  chemically synthesized
ttctgagacagagtctcgctct

SEQ ID NO: 932869 - DNA, 22 bp, Artificial Sequence
  chemically synthesized
cagcctggtgacagagcgagac

SEQ ID NO: 932870 - DNA, 22 bp, Artificial Sequence
  chemically synthesized
tctgagacagagtctcgctctg

SEQ ID NO: 932871 - DNA, 22 bp, Artificial Sequence
  chemically synthesized
ctgagacagagtctcgctctgt

SEQ ID NO: 932872 - DNA, 22 bp, Artificial Sequence
  chemically synthesized
tgagacagagtctcgctctgtc

SEQ ID NO: 932873 - DNA, 22 bp, Artificial Sequence
  chemically synthesized
agacagagtctcgctctgtcac

SEQ ID NO: 932874 - DNA, 22 bp, Artificial Sequence
  chemically synthesized
tattccagcctggtgacagagc

SEQ ID NO: 932875 - DNA, 22 bp, Artificial Sequence
  chemically synthesized
gctctgtcaccaggctggaata

SEQ ID NO: 932876 - DNA, 22 bp, Artificial Sequence
  chemically synthesized
tgtcaccaggctggaatacagt

SEQ ID NO: 932877 - DNA, 22 bp, Artificial Sequence
  chemically synthesized
tcaccaggctggaatacagtgg

SEQ ID NO: 932878 - DNA, 22 bp, Artificial Sequence
  chemically synthesized
cagtgagccgggatcacaccac

SEQ ID NO: 932879 - DNA, 22 bp, Artificial Sequence
  chemically synthesized
gaatacagtggtgtgatcccgg

SEQ ID NO: 932880 - DNA, 22 bp, Artificial Sequence
  chemically synthesized
aacccgggaggcagaggttgca

SEQ ID NO: 932881 - DNA, 22 bp, Artificial Sequence
  chemically synthesized
gaacccgggaggcagaggttgc

SEQ ID NO: 932882 - DNA, 22 bp, Artificial Sequence
  chemically synthesized
actgcaacctctgcctcccggg

SEQ ID NO: 932883 - DNA, 22 bp, Artificial Sequence
  chemically synthesized
caacctctgcctcccgggttca

SEQ ID NO: 932884 - DNA, 22 bp, Artificial Sequence
  chemically synthesized
aggcaggagaatcgcttgaacc

SEQ ID NO: 932885 - DNA, 22 bp, Artificial Sequence
  chemically synthesized
tgcctcccgggttcaagcgatt

SEQ ID NO: 932886 - DNA, 22 bp, Artificial Sequence
  chemically synthesized
cctcccgggttcaagcgattct

SEQ ID NO: 932887 - DNA, 22 bp, Artificial Sequence
  chemically synthesized
ccgggttcaagcgattctcctg

SEQ ID NO: 932888 - DNA, 22 bp, Artificial Sequence
  chemically synthesized
gggaggctgaggcaggagaatc

SEQ ID NO: 932889 - DNA, 22 bp, Artificial Sequence
  chemically synthesized
ctcgggaggctgaggcaggaga

SEQ ID NO: 932890 - DNA, 22 bp, Artificial Sequence
  chemically synthesized
aagcgattctcctgcctcagcc

SEQ ID NO: 932891 - DNA, 22 bp, Artificial Sequence
  chemically synthesized
tagtcccagctactcgggaggc

SEQ ID NO: 932892 - DNA, 22 bp, Artificial Sequence
  chemically synthesized
tcctgcctcagcctcccgagta

SEQ ID NO: 932893 - DNA, 22 bp, Artificial Sequence
  chemically synthesized
ctgcctcagcctcccgagtagc

SEQ ID NO: 932894 - DNA, 22 bp, Artificial Sequence
  chemically synthesized
cctcagcctcccgagtagctgg

SEQ ID NO: 932895 - DNA, 22 bp, Artificial Sequence
  chemically synthesized
agcctcccgagtagctgggact

SEQ ID NO: 932896 - DNA, 22 bp, Artificial Sequence
  chemically synthesized
ccgagtagctgggactacaggc

SEQ ID NO: 932897 - DNA, 22 bp, Artificial Sequence
  chemically synthesized
agcatggtggtgtgtgcctgta

SEQ ID NO: 932898 - DNA, 22 bp, Artificial Sequence
  chemically synthesized
gctgagcatggtggtgtgtgcc

SEQ ID NO: 932899 - DNA, 22 bp, Artificial Sequence
  chemically synthesized
ggactacaggcacacaccacca

SEQ ID NO: 932900 - DNA, 22 bp, Artificial Sequence
  chemically synthesized
caggcacacaccaccatgctca

SEQ ID NO: 932901 - DNA, 22 bp, Artificial Sequence
  chemically synthesized
aaaatacaaaaattagctgagc

SEQ ID NO: 932902 - DNA, 22 bp, Artificial Sequence
  chemically synthesized
ctaaaaatacaaaaattagctg

SEQ ID NO: 932903 - DNA, 22 bp, Artificial Sequence
  chemically synthesized
tactaaaaatacaaaaattagc

SEQ ID NO: 932904 - DNA, 22 bp, Artificial Sequence
  chemically synthesized
agctaatttttgtatttttagt

SEQ ID NO: 932905 - DNA, 22 bp, Artificial Sequence
  chemically synthesized
atttttgtatttttagtagaga

SEQ ID NO: 932906 - DNA, 22 bp, Artificial Sequence
  chemically synthesized
ttgtatttttagtagagacggg

SEQ ID NO: 932907 - DNA, 22 bp, Artificial Sequence
  chemically synthesized
tgtatttttagtagagacggga

SEQ ID NO: 932908 - DNA, 22 bp, Artificial Sequence
  chemically synthesized
gtatttttagtagagacgggat

SEQ ID NO: 932909 - DNA, 22 bp, Artificial Sequence
  chemically synthesized
tatttttagtagagacgggatt

SEQ ID NO: 932910 - DNA, 22 bp, Artificial Sequence
  chemically synthesized
gccaacatggtgaatcccgtct

SEQ ID NO: 932911 - DNA, 22 bp, Artificial Sequence
  chemically synthesized
ttagtagagacgggattcacca

SEQ ID NO: 932912 - DNA, 22 bp, Artificial Sequence
  chemically synthesized
tagtagagacgggattcaccat

SEQ ID NO: 932913 - DNA, 22 bp, Artificial Sequence
  chemically synthesized
agtagagacgggattcaccatg

SEQ ID NO: 932914 - DNA, 22 bp, Artificial Sequence
  chemically synthesized
gtagagacgggattcaccatgt

SEQ ID NO: 932915 - DNA, 22 bp, Artificial Sequence
  chemically synthesized
accatgttggccaggatggtgt

SEQ ID NO: 932916 - DNA, 22 bp, Artificial Sequence
  chemically synthesized
gccaggatggtgtcgatctctt

SEQ ID NO: 932917 - DNA, 22 bp, Artificial Sequence
  chemically synthesized
gggaggccaaggtgggtggatc

SEQ ID NO: 932918 - DNA, 22 bp, Artificial Sequence
  chemically synthesized
cgggaggccaaggtgggtggat

SEQ ID NO: 932919 - DNA, 22 bp, Artificial Sequence
  chemically synthesized
ttgacctcgtgatccacccacc

SEQ ID NO: 932920 - DNA, 22 bp, Artificial Sequence
  chemically synthesized
gacctcgtgatccacccacctt

SEQ ID NO: 932921 - DNA, 22 bp, Artificial Sequence
  chemically synthesized
acctcgtgatccacccaccttg

SEQ ID NO: 932922 - DNA, 22 bp, Artificial Sequence
  chemically synthesized
gtgatccacccaccttggcctc

SEQ ID NO: 932923 - DNA, 22 bp, Artificial Sequence
  chemically synthesized
taatcccagcacttcgggaggc

SEQ ID NO: 932924 - DNA, 22 bp, Artificial Sequence
  chemically synthesized
acgcctgtaatcccagcacttc

SEQ ID NO: 932925 - DNA, 22 bp, Artificial Sequence
  chemically synthesized
ggcctcccgaagtgctgggatt

SEQ ID NO: 932926 - DNA, 22 bp, Artificial Sequence
  chemically synthesized
gcctcccgaagtgctgggatta

SEQ ID NO: 932927 - DNA, 22 bp, Artificial Sequence
  chemically synthesized
ccgaagtgctgggattacaggc

SEQ ID NO: 932928 - DNA, 22 bp, Artificial Sequence
  chemically synthesized
ggcacagtggctcacgcctgta

SEQ ID NO: 932929 - DNA, 22 bp, Artificial Sequence
  chemically synthesized
ggattacaggcgtgagccactg

SEQ ID NO: 932930 - DNA, 22 bp, Artificial Sequence
  chemically synthesized
agacagctgggcacagtggctc

SEQ ID NO: 932931 - DNA, 22 bp, Artificial Sequence
  chemically synthesized
caggcgtgagccactgtgccca

SEQ ID NO: 932932 - DNA, 22 bp, Artificial Sequence
  chemically synthesized
aattaagacagctgggcacagt

SEQ ID NO: 932933 - DNA, 22 bp, Artificial Sequence
  chemically synthesized
tgcccagctgtcttaatttaat

SEQ ID NO: 932934 - DNA, 22 bp, Artificial Sequence
  chemically synthesized
aaaatacacaaaagtattaaat

SEQ ID NO: 932935 - DNA, 22 bp, Artificial Sequence
  chemically synthesized
gaaaatacacaaaagtattaaa

SEQ ID NO: 932936 - DNA, 22 bp, Artificial Sequence
  chemically synthesized
tcttaatttaatacttttgtgt

SEQ ID NO: 932937 - DNA, 22 bp, Artificial Sequence
  chemically synthesized
aatttaatacttttgtgtattt

SEQ ID NO: 932938 - DNA, 22 bp, Artificial Sequence
  chemically synthesized
atttaatacttttgtgtatttt

SEQ ID NO: 932939 - DNA, 22 bp, Artificial Sequence
  chemically synthesized
aatacttttgtgtattttcaaa

SEQ ID NO: 932940 - DNA, 22 bp, Artificial Sequence
  chemically synthesized
agtgtagaaaagtttgaaaata

SEQ ID NO: 932941 - DNA, 22 bp, Artificial Sequence
  chemically synthesized
atacttttgtgtattttcaaac

SEQ ID NO: 932942 - DNA, 22 bp, Artificial Sequence
  chemically synthesized
aagctcagtgtagaaaagtttg

SEQ ID NO: 932943 - DNA, 22 bp, Artificial Sequence
  chemically synthesized
ttgtgtattttcaaacttttct

SEQ ID NO: 932944 - DNA, 22 bp, Artificial Sequence
  chemically synthesized
aaagctcagtgtagaaaagttt

SEQ ID NO: 932945 - DNA, 22 bp, Artificial Sequence
  chemically synthesized
tgtgtattttcaaacttttcta

SEQ ID NO: 932946 - DNA, 22 bp, Artificial Sequence
  chemically synthesized
taaagctcagtgtagaaaagtt

SEQ ID NO: 932947 - DNA, 22 bp, Artificial Sequence
  chemically synthesized
gtgtattttcaaacttttctac

SEQ ID NO: 932948 - DNA, 22 bp, Artificial Sequence
  chemically synthesized
ttaaagctcagtgtagaaaagt

SEQ ID NO: 932949 - DNA, 22 bp, Artificial Sequence
  chemically synthesized
tgtattttcaaacttttctaca

SEQ ID NO: 932950 - DNA, 22 bp, Artificial Sequence
  chemically synthesized
tttaaagctcagtgtagaaaag

SEQ ID NO: 932951 - DNA, 22 bp, Artificial Sequence
  chemically synthesized
tactttttaaagctcagtgtag

SEQ ID NO: 932952 - DNA, 22 bp, Artificial Sequence
  chemically synthesized
atactttttaaagctcagtgta

SEQ ID NO: 932953 - DNA, 22 bp, Artificial Sequence
  chemically synthesized
tcaaacttttctacactgagct

SEQ ID NO: 932954 - DNA, 22 bp, Artificial Sequence
  chemically synthesized
caaacttttctacactgagctt

SEQ ID NO: 932955 - DNA, 22 bp, Artificial Sequence
  chemically synthesized
aaacttttctacactgagcttt

SEQ ID NO: 932956 - DNA, 22 bp, Artificial Sequence
  chemically synthesized
cttatactttttaaagctcagt

SEQ ID NO: 932957 - DNA, 22 bp, Artificial Sequence
  chemically synthesized
gcttatactttttaaagctcag

SEQ ID NO: 932958 - DNA, 22 bp, Artificial Sequence
  chemically synthesized
tgcttatactttttaaagctca

SEQ ID NO: 932959 - DNA, 22 bp, Artificial Sequence
  chemically synthesized
ttgcttatactttttaaagctc

SEQ ID NO: 932960 - DNA, 22 bp, Artificial Sequence
  chemically synthesized
ttctacactgagctttaaaaag

SEQ ID NO: 932961 - DNA, 22 bp, Artificial Sequence
  chemically synthesized
tctacactgagctttaaaaagt

SEQ ID NO: 932962 - DNA, 22 bp, Artificial Sequence
  chemically synthesized
atttttgcttatactttttaaa

SEQ ID NO: 932963 - DNA, 22 bp, Artificial Sequence
  chemically synthesized
ctacactgagctttaaaaagta

SEQ ID NO: 932964 - DNA, 22 bp, Artificial Sequence
  chemically synthesized
catttttgcttatactttttaa

SEQ ID NO: 932965 - DNA, 22 bp, Artificial Sequence
  chemically synthesized
tacactgagctttaaaaagtat

SEQ ID NO: 932966 - DNA, 22 bp, Artificial Sequence
  chemically synthesized
tcatttttgcttatacttttta

SEQ ID NO: 932967 - DNA, 22 bp, Artificial Sequence
  chemically synthesized
ttcatttttgcttatacttttt

SEQ ID NO: 932968 - DNA, 22 bp, Artificial Sequence
  chemically synthesized
cactgagctttaaaaagtataa

SEQ ID NO: 932969 - DNA, 22 bp, Artificial Sequence
  chemically synthesized
tttttcatttttgcttatactt

SEQ ID NO: 932970 - DNA, 22 bp, Artificial Sequence
  chemically synthesized
gtttttcatttttgcttatact

SEQ ID NO: 932971 - DNA, 22 bp, Artificial Sequence
  chemically synthesized
tgtttttcatttttgcttatac

SEQ ID NO: 932972 - DNA, 22 bp, Artificial Sequence
  chemically synthesized
agctttaaaaagtataagcaaa

SEQ ID NO: 932973 - DNA, 22 bp, Artificial Sequence
  chemically synthesized
actttgtttttcatttttgctt

SEQ ID NO: 932974 - DNA, 22 bp, Artificial Sequence
  chemically synthesized
cactttgtttttcatttttgct

SEQ ID NO: 932975 - DNA, 22 bp, Artificial Sequence
  chemically synthesized
taaaaagtataagcaaaaatga

SEQ ID NO: 932976 - DNA, 22 bp, Artificial Sequence
  chemically synthesized
aaaaagtataagcaaaaatgaa

SEQ ID NO: 932977 - DNA, 22 bp, Artificial Sequence
  chemically synthesized
aaaagtataagcaaaaatgaaa

SEQ ID NO: 932978 - DNA, 22 bp, Artificial Sequence
  chemically synthesized
aggacaaaggcaatatggcggt

SEQ ID NO: 932979 - DNA, 22 bp, Artificial Sequence
  chemically synthesized
caggacaaaggcaatatggcgg

SEQ ID NO: 932980 - DNA, 22 bp, Artificial Sequence
  chemically synthesized
atatttcaggacaaaggcaata

SEQ ID NO: 932981 - DNA, 22 bp, Artificial Sequence
  chemically synthesized
aatatttcaggacaaaggcaat

SEQ ID NO: 932982 - DNA, 22 bp, Artificial Sequence
  chemically synthesized
taatatttcaggacaaaggcaa

SEQ ID NO: 932983 - DNA, 22 bp, Artificial Sequence
  chemically synthesized
ttaatatttcaggacaaaggca

SEQ ID NO: 932984 - DNA, 22 bp, Artificial Sequence
  chemically synthesized
tttaatatttcaggacaaaggc

SEQ ID NO: 932985 - DNA, 22 bp, Artificial Sequence
  chemically synthesized
gttttttaatatttcaggacaa

SEQ ID NO: 932986 - DNA, 22 bp, Artificial Sequence
  chemically synthesized
gttcgttttttaatatttcagg

SEQ ID NO: 932987 - DNA, 22 bp, Artificial Sequence
  chemically synthesized
agttcgttttttaatatttcag

SEQ ID NO: 932988 - DNA, 22 bp, Artificial Sequence
  chemically synthesized
tagttcgttttttaatatttca

SEQ ID NO: 932989 - DNA, 22 bp, Artificial Sequence
  chemically synthesized
cctttgtcctgaaatattaaaa

SEQ ID NO: 932990 - DNA, 22 bp, Artificial Sequence
  chemically synthesized
tgtcctgaaatattaaaaaacg

SEQ ID NO: 932991 - DNA, 22 bp, Artificial Sequence
  chemically synthesized
gtcctgaaatattaaaaaacga

SEQ ID NO: 932992 - DNA, 22 bp, Artificial Sequence
  chemically synthesized
tcctgaaatattaaaaaacgaa

SEQ ID NO: 932993 - DNA, 22 bp, Artificial Sequence
  chemically synthesized
tgcccattttagttcgtttttt

SEQ ID NO: 932994 - DNA, 22 bp, Artificial Sequence
  chemically synthesized
tgtgcccattttagttcgtttt

SEQ ID NO: 932995 - DNA, 22 bp, Artificial Sequence
  chemically synthesized
aaatattaaaaaacgaactaaa

SEQ ID NO: 932996 - DNA, 22 bp, Artificial Sequence
  chemically synthesized
ttctgtgcccattttagttcgt

SEQ ID NO: 932997 - DNA, 22 bp, Artificial Sequence
  chemically synthesized
gttctgtgcccattttagttcg

SEQ ID NO: 932998 - DNA, 22 bp, Artificial Sequence
  chemically synthesized
tgttctgtgcccattttagttc

SEQ ID NO: 932999 - DNA, 22 bp, Artificial Sequence
  chemically synthesized
ttgttctgtgcccattttagtt

SEQ ID NO: 933000 - DNA, 22 bp, Artificial Sequence
  chemically synthesized
aaaaacgaactaaaatgggcac

SEQ ID NO: 933001 - DNA, 22 bp, Artificial Sequence
  chemically synthesized
tagtttttgttctgtgcccatt

SEQ ID NO: 933002 - DNA, 22 bp, Artificial Sequence
  chemically synthesized
aaatgggcacagaacaaaaact

SEQ ID NO: 933003 - DNA, 22 bp, Artificial Sequence
  chemically synthesized
aatgtgaacatgcatataggaa

SEQ ID NO: 933004 - DNA, 22 bp, Artificial Sequence
  chemically synthesized
tcaatgtgaacatgcatatagg

SEQ ID NO: 933005 - DNA, 22 bp, Artificial Sequence
  chemically synthesized
ctcaatgtgaacatgcatatag

SEQ ID NO: 933006 - DNA, 22 bp, Artificial Sequence
  chemically synthesized
tctcaatgtgaacatgcatata

SEQ ID NO: 933007 - DNA, 22 bp, Artificial Sequence
  chemically synthesized
ttctcaatgtgaacatgcatat

SEQ ID NO: 933008 - DNA, 22 bp, Artificial Sequence
  chemically synthesized
taatattcctatatgcatgttc

SEQ ID NO: 933009 - DNA, 22 bp, Artificial Sequence
  chemically synthesized
tttttctcaatgtgaacatgca

SEQ ID NO: 933010 - DNA, 22 bp, Artificial Sequence
  chemically synthesized
actatttttctcaatgtgaaca

SEQ ID NO: 933011 - DNA, 22 bp, Artificial Sequence
  chemically synthesized
ctatatgcatgttcacattgag

SEQ ID NO: 933012 - DNA, 22 bp, Artificial Sequence
  chemically synthesized
tctcactatttttctcaatgtg

SEQ ID NO: 933013 - DNA, 22 bp, Artificial Sequence
  chemically synthesized
gtctcactatttttctcaatgt

SEQ ID NO: 933014 - DNA, 22 bp, Artificial Sequence
  chemically synthesized
tatgcatgttcacattgagaaa

SEQ ID NO: 933015 - DNA, 22 bp, Artificial Sequence
  chemically synthesized
tgtctcactatttttctcaatg

SEQ ID NO: 933016 - DNA, 22 bp, Artificial Sequence
  chemically synthesized
agacattttgtctcactatttt

SEQ ID NO: 933017 - DNA, 22 bp, Artificial Sequence
  chemically synthesized
acattgagaaaaatagtgagac

SEQ ID NO: 933018 - DNA, 22 bp, Artificial Sequence
  chemically synthesized
agaaaaatagtgagacaaaatg

SEQ ID NO: 933019 - DNA, 22 bp, Artificial Sequence
  chemically synthesized
ccaggattcagacattttgtct

SEQ ID NO: 933020 - DNA, 22 bp, Artificial Sequence
  chemically synthesized
tcatagttaccaggattcagac

SEQ ID NO: 933021 - DNA, 22 bp, Artificial Sequence
  chemically synthesized
tatcatagttaccaggattcag

SEQ ID NO: 933022 - DNA, 22 bp, Artificial Sequence
  chemically synthesized
ctatcatagttaccaggattca

SEQ ID NO: 933023 - DNA, 22 bp, Artificial Sequence
  chemically synthesized
catttctatcatagttaccagg

SEQ ID NO: 933024 - DNA, 22 bp, Artificial Sequence
  chemically synthesized
aatcctggtaactatgatagaa

SEQ ID NO: 933025 - DNA, 22 bp, Artificial Sequence
  chemically synthesized
gtaactatgatagaaatggagt

SEQ ID NO: 933026 - DNA, 22 bp, Artificial Sequence
  chemically synthesized
tgatagaaatggagtgtgccta

SEQ ID NO: 933027 - DNA, 22 bp, Artificial Sequence
  chemically synthesized
acacacgtgcatataggcacac

SEQ ID NO: 933028 - DNA, 22 bp, Artificial Sequence
  chemically synthesized
cacacacgtgcatataggcaca

SEQ ID NO: 933029 - DNA, 22 bp, Artificial Sequence
  chemically synthesized
ccttcacacacgtgcatatagg

SEQ ID NO: 933030 - DNA, 22 bp, Artificial Sequence
  chemically synthesized
cccttcacacacgtgcatatag

SEQ ID NO: 933031 - DNA, 22 bp, Artificial Sequence
  chemically synthesized
tcccttcacacacgtgcatata

SEQ ID NO: 933032 - DNA, 22 bp, Artificial Sequence
  chemically synthesized
tatgcacgtgtgtgaagggaaa

SEQ ID NO: 933033 - DNA, 22 bp, Artificial Sequence
  chemically synthesized
tctctcgattatctatatttat

SEQ ID NO: 933034 - DNA, 22 bp, Artificial Sequence
  chemically synthesized
tctcgattatctatatttatct

SEQ ID NO: 933035 - DNA, 22 bp, Artificial Sequence
  chemically synthesized
tcgattatctatatttatctat

SEQ ID NO: 933036 - DNA, 22 bp, Artificial Sequence
  chemically synthesized
gattatctatatttatctattt

SEQ ID NO: 933037 - DNA, 22 bp, Artificial Sequence
  chemically synthesized
tctatatttatctatttatcat

SEQ ID NO: 933038 - DNA, 22 bp, Artificial Sequence
  chemically synthesized
atagatgacagataaatgataa

SEQ ID NO: 933039 - DNA, 22 bp, Artificial Sequence
  chemically synthesized
tatttatctatttatcatttat

SEQ ID NO: 933040 - DNA, 22 bp, Artificial Sequence
  chemically synthesized
atctatttatcatttatctgtc

SEQ ID NO: 933041 - DNA, 22 bp, Artificial Sequence
  chemically synthesized
tctatttatcatttatctgtca

SEQ ID NO: 933042 - DNA, 22 bp, Artificial Sequence
  chemically synthesized
tttatcatttatctgtcatcta

SEQ ID NO: 933043 - DNA, 22 bp, Artificial Sequence
  chemically synthesized
atagataactaatagatgacag

SEQ ID NO: 933044 - DNA, 22 bp, Artificial Sequence
  chemically synthesized
atcatttatctgtcatctatta

SEQ ID NO: 933045 - DNA, 22 bp, Artificial Sequence
  chemically synthesized
tcatttatctgtcatctattag

SEQ ID NO: 933046 - DNA, 22 bp, Artificial Sequence
  chemically synthesized
atctgtcatctattagttatct

SEQ ID NO: 933047 - DNA, 22 bp, Artificial Sequence
  chemically synthesized
tctgtcatctattagttatcta

SEQ ID NO: 933048 - DNA, 22 bp, Artificial Sequence
  chemically synthesized
tcatctattagttatctatcag

SEQ ID NO: 933049 - DNA, 22 bp, Artificial Sequence
  chemically synthesized
ttagttatctatcagttatcta

SEQ ID NO: 933050 - DNA, 22 bp, Artificial Sequence
  chemically synthesized
gttatctatcagttatctatct

SEQ ID NO: 933051 - DNA, 22 bp, Artificial Sequence
  chemically synthesized
tctatcagttatctatctatca

SEQ ID NO: 933052 - DNA, 22 bp, Artificial Sequence
  chemically synthesized
tcagttatctatctatcatcta

SEQ ID NO: 933053 - DNA, 22 bp, Artificial Sequence
  chemically synthesized
gatggtaaacagatagatgata

SEQ ID NO: 933054 - DNA, 22 bp, Artificial Sequence
  chemically synthesized
tctatctatcatctatctgttt

SEQ ID NO: 933055 - DNA, 22 bp, Artificial Sequence
  chemically synthesized
cagctagatggtaaacagatag

SEQ ID NO: 933056 - DNA, 22 bp, Artificial Sequence
  chemically synthesized
tctatcatctatctgtttacca

SEQ ID NO: 933057 - DNA, 22 bp, Artificial Sequence
  chemically synthesized
tgacctacagctagatggtaaa

SEQ ID NO: 933058 - DNA, 22 bp, Artificial Sequence
  chemically synthesized
tcatctatctgtttaccatcta

SEQ ID NO: 933059 - DNA, 22 bp, Artificial Sequence
  chemically synthesized
atgacctacagctagatggtaa

SEQ ID NO: 933060 - DNA, 22 bp, Artificial Sequence
  chemically synthesized
tttatgacctacagctagatgg

SEQ ID NO: 933061 - DNA, 22 bp, Artificial Sequence
  chemically synthesized
tatttatgacctacagctagat

SEQ ID NO: 933062 - DNA, 22 bp, Artificial Sequence
  chemically synthesized
ctatttatgacctacagctaga

SEQ ID NO: 933063 - DNA, 22 bp, Artificial Sequence
  chemically synthesized
tctgtttaccatctagctgtag

SEQ ID NO: 933064 - DNA, 22 bp, Artificial Sequence
  chemically synthesized
tttaccatctagctgtaggtca

SEQ ID NO: 933065 - DNA, 22 bp, Artificial Sequence
  chemically synthesized
accatctagctgtaggtcataa

SEQ ID NO: 933066 - DNA, 22 bp, Artificial Sequence
  chemically synthesized
ccatctagctgtaggtcataaa

SEQ ID NO: 933067 - DNA, 22 bp, Artificial Sequence
  chemically synthesized
aaatgtcttctatttatgacct

SEQ ID NO: 933068 - DNA, 22 bp, Artificial Sequence
  chemically synthesized
attaaaatgtcttctatttatg

SEQ ID NO: 933069 - DNA, 22 bp, Artificial Sequence
  chemically synthesized
gctgtaggtcataaatagaaga

SEQ ID NO: 933070 - DNA, 22 bp, Artificial Sequence
  chemically synthesized
taggtcataaatagaagacatt

SEQ ID NO: 933071 - DNA, 22 bp, Artificial Sequence
  chemically synthesized
agaataggtcaatagcaaatat

SEQ ID NO: 933072 - DNA, 22 bp, Artificial Sequence
  chemically synthesized
gagaataggtcaatagcaaata

SEQ ID NO: 933073 - DNA, 22 bp, Artificial Sequence
  chemically synthesized
tgagaataggtcaatagcaaat

SEQ ID NO: 933074 - DNA, 22 bp, Artificial Sequence
  chemically synthesized
ttgagaataggtcaatagcaaa

SEQ ID NO: 933075 - DNA, 22 bp, Artificial Sequence
  chemically synthesized
taattaatatttgctattgacc

SEQ ID NO: 933076 - DNA, 22 bp, Artificial Sequence
  chemically synthesized
aattaatatttgctattgacct

SEQ ID NO: 933077 - DNA, 22 bp, Artificial Sequence
  chemically synthesized
attaatatttgctattgaccta

SEQ ID NO: 933078 - DNA, 22 bp, Artificial Sequence
  chemically synthesized
atatttgctattgacctattct

SEQ ID NO: 933079 - DNA, 22 bp, Artificial Sequence
  chemically synthesized
agtagtgatttttgagaatagg

SEQ ID NO: 933080 - DNA, 22 bp, Artificial Sequence
  chemically synthesized
gctattgacctattctcaaaaa

SEQ ID NO: 933081 - DNA, 22 bp, Artificial Sequence
  chemically synthesized
ctattgacctattctcaaaaat

SEQ ID NO: 933082 - DNA, 22 bp, Artificial Sequence
  chemically synthesized
ttgacctattctcaaaaatcac

SEQ ID NO: 933083 - DNA, 22 bp, Artificial Sequence
  chemically synthesized
taaacaattcagtagtgatttt

SEQ ID NO: 933084 - DNA, 22 bp, Artificial Sequence
  chemically synthesized
acctattctcaaaaatcactac

SEQ ID NO: 933085 - DNA, 22 bp, Artificial Sequence
  chemically synthesized
gtaaacaattcagtagtgattt

SEQ ID NO: 933086 - DNA, 22 bp, Artificial Sequence
  chemically synthesized
tgtaaacaattcagtagtgatt

SEQ ID NO: 933087 - DNA, 22 bp, Artificial Sequence
  chemically synthesized
ttctcaaaaatcactactgaat

SEQ ID NO: 933088 - DNA, 22 bp, Artificial Sequence
  chemically synthesized
agttttgtaaacaattcagtag

SEQ ID NO: 933089 - DNA, 22 bp, Artificial Sequence
  chemically synthesized
tcaaaaatcactactgaattgt

SEQ ID NO: 933090 - DNA, 22 bp, Artificial Sequence
  chemically synthesized
aaaaatcactactgaattgttt

SEQ ID NO: 933091 - DNA, 22 bp, Artificial Sequence
  chemically synthesized
gcaaagcatgctgagttttgta

SEQ ID NO: 933092 - DNA, 22 bp, Artificial Sequence
  chemically synthesized
ggcaaagcatgctgagttttgt

SEQ ID NO: 933093 - DNA, 22 bp, Artificial Sequence
  chemically synthesized
ctgaattgtttacaaaactcag

SEQ ID NO: 933094 - DNA, 22 bp, Artificial Sequence
  chemically synthesized
tttggcaaagcatgctgagttt

SEQ ID NO: 933095 - DNA, 22 bp, Artificial Sequence
  chemically synthesized
aattgtttacaaaactcagcat

SEQ ID NO: 933096 - DNA, 22 bp, Artificial Sequence
  chemically synthesized
attatttggcaaagcatgctga

SEQ ID NO: 933097 - DNA, 22 bp, Artificial Sequence
  chemically synthesized
aattatttggcaaagcatgctg

SEQ ID NO: 933098 - DNA, 22 bp, Artificial Sequence
  chemically synthesized
tttacaaaactcagcatgcttt

SEQ ID NO: 933099 - DNA, 22 bp, Artificial Sequence
  chemically synthesized
acaaaactcagcatgctttgcc

SEQ ID NO: 933100 - DNA, 22 bp, Artificial Sequence
  chemically synthesized
caaaactcagcatgctttgcca

SEQ ID NO: 933101 - DNA, 22 bp, Artificial Sequence
  chemically synthesized
agcatgctttgccaaataatta

SEQ ID NO: 933102 - DNA, 22 bp, Artificial Sequence
  chemically synthesized
atgaatacaaataaaggtctta

SEQ ID NO: 933103 - DNA, 22 bp, Artificial Sequence
  chemically synthesized
tgccaaataattaagaccttta

SEQ ID NO: 933104 - DNA, 22 bp, Artificial Sequence
  chemically synthesized
gccaaataattaagacctttat

SEQ ID NO: 933105 - DNA, 22 bp, Artificial Sequence
  chemically synthesized
ccaaataattaagacctttatt

SEQ ID NO: 933106 - DNA, 22 bp, Artificial Sequence
  chemically synthesized
agactcatgaatacaaataaag

SEQ ID NO: 933107 - DNA, 22 bp, Artificial Sequence
  chemically synthesized
gcaattaagactcatgaataca

SEQ ID NO: 933108 - DNA, 22 bp, Artificial Sequence
  chemically synthesized
agacctttatttgtattcatga

SEQ ID NO: 933109 - DNA, 22 bp, Artificial Sequence
  chemically synthesized
ggcaattaagactcatgaatac

SEQ ID NO: 933110 - DNA, 22 bp, Artificial Sequence
  chemically synthesized
tttggcaattaagactcatgaa

SEQ ID NO: 933111 - DNA, 22 bp, Artificial Sequence
  chemically synthesized
tatttgtattcatgagtcttaa

SEQ ID NO: 933112 - DNA, 22 bp, Artificial Sequence
  chemically synthesized
attgtttggcaattaagactca

SEQ ID NO: 933113 - DNA, 22 bp, Artificial Sequence
  chemically synthesized
atttgtattcatgagtcttaat

SEQ ID NO: 933114 - DNA, 22 bp, Artificial Sequence
  chemically synthesized
aattgtttggcaattaagactc

SEQ ID NO: 933115 - DNA, 22 bp, Artificial Sequence
  chemically synthesized
tttgtattcatgagtcttaatt

SEQ ID NO: 933116 - DNA, 22 bp, Artificial Sequence
  chemically synthesized
gtattcatgagtcttaattgcc

SEQ ID NO: 933117 - DNA, 22 bp, Artificial Sequence
  chemically synthesized
tattcatgagtcttaattgcca

SEQ ID NO: 933118 - DNA, 22 bp, Artificial Sequence
  chemically synthesized
atgagtcttaattgccaaacaa

SEQ ID NO: 933119 - DNA, 22 bp, Artificial Sequence
  chemically synthesized
atcaagtaaaggtcttaattgt

SEQ ID NO: 933120 - DNA, 22 bp, Artificial Sequence
  chemically synthesized
gatcaagtaaaggtcttaattg

SEQ ID NO: 933121 - DNA, 22 bp, Artificial Sequence
  chemically synthesized
aattgccaaacaattaagacct

SEQ ID NO: 933122 - DNA, 22 bp, Artificial Sequence
  chemically synthesized
attgccaaacaattaagacctt

SEQ ID NO: 933123 - DNA, 22 bp, Artificial Sequence
  chemically synthesized
atttgatcaagtaaaggtctta

SEQ ID NO: 933124 - DNA, 22 bp, Artificial Sequence
  chemically synthesized
gatttgatcaagtaaaggtctt

SEQ ID NO: 933125 - DNA, 22 bp, Artificial Sequence
  chemically synthesized
ccaaacaattaagacctttact

SEQ ID NO: 933126 - DNA, 22 bp, Artificial Sequence
  chemically synthesized
ttgatttgatcaagtaaaggtc

SEQ ID NO: 933127 - DNA, 22 bp, Artificial Sequence
  chemically synthesized
cttgatttgatcaagtaaaggt

SEQ ID NO: 933128 - DNA, 22 bp, Artificial Sequence
  chemically synthesized
tcttgatttgatcaagtaaagg

SEQ ID NO: 933129 - DNA, 22 bp, Artificial Sequence
  chemically synthesized
attttcttgatttgatcaagta

SEQ ID NO: 933130 - DNA, 22 bp, Artificial Sequence
  chemically synthesized
agacctttacttgatcaaatca

SEQ ID NO: 933131 - DNA, 22 bp, Artificial Sequence
  chemically synthesized
tacttgatcaaatcaagaaaat

SEQ ID NO: 933132 - DNA, 22 bp, Artificial Sequence
  chemically synthesized
acttgatcaaatcaagaaaatt

SEQ ID NO: 933133 - DNA, 22 bp, Artificial Sequence
  chemically synthesized
aggtgatatgctaattttcttg

SEQ ID NO: 933134 - DNA, 22 bp, Artificial Sequence
  chemically synthesized
cttgatcaaatcaagaaaatta

SEQ ID NO: 933135 - DNA, 22 bp, Artificial Sequence
  chemically synthesized
gaggtgatatgctaattttctt

SEQ ID NO: 933136 - DNA, 22 bp, Artificial Sequence
  chemically synthesized
gatcaaatcaagaaaattagca

SEQ ID NO: 933137 - DNA, 22 bp, Artificial Sequence
  chemically synthesized
atcaaatcaagaaaattagcat

SEQ ID NO: 933138 - DNA, 22 bp, Artificial Sequence
  chemically synthesized
gcatatcacctcaaacatttac

SEQ ID NO: 933139 - DNA, 22 bp, Artificial Sequence
  chemically synthesized
ccccaaataaatggtaaatgtt

SEQ ID NO: 933140 - DNA, 22 bp, Artificial Sequence
  chemically synthesized
taccccaaataaatggtaaatg

SEQ ID NO: 933141 - DNA, 22 bp, Artificial Sequence
  chemically synthesized
ctaccccaaataaatggtaaat

SEQ ID NO: 933142 - DNA, 22 bp, Artificial Sequence
  chemically synthesized
aaggtttctaccccaaataaat

SEQ ID NO: 933143 - DNA, 22 bp, Artificial Sequence
  chemically synthesized
aaacatttaccatttatttggg

SEQ ID NO: 933144 - DNA, 22 bp, Artificial Sequence
  chemically synthesized
gaaggtttctaccccaaataaa

SEQ ID NO: 933145 - DNA, 22 bp, Artificial Sequence
  chemically synthesized
tgaaggtttctaccccaaataa

SEQ ID NO: 933146 - DNA, 22 bp, Artificial Sequence
  chemically synthesized
accatttatttggggtagaaac

SEQ ID NO: 933147 - DNA, 22 bp, Artificial Sequence
  chemically synthesized
ccatttatttggggtagaaacc

SEQ ID NO: 933148 - DNA, 22 bp, Artificial Sequence
  chemically synthesized
gaagagagggttttgaaggttt

SEQ ID NO: 933149 - DNA, 22 bp, Artificial Sequence
  chemically synthesized
atttggggtagaaaccttcaaa

SEQ ID NO: 933150 - DNA, 22 bp, Artificial Sequence
  chemically synthesized
tttggggtagaaaccttcaaaa

SEQ ID NO: 933151 - DNA, 22 bp, Artificial Sequence
  chemically synthesized
ggggtagaaaccttcaaaaccc

SEQ ID NO: 933152 - DNA, 22 bp, Artificial Sequence
  chemically synthesized
gggtagaaaccttcaaaaccct

SEQ ID NO: 933153 - DNA, 22 bp, Artificial Sequence
  chemically synthesized
aaaacggctagaagagagggtt

SEQ ID NO: 933154 - DNA, 22 bp, Artificial Sequence
  chemically synthesized
cgtatctcaaaacggctagaag

SEQ ID NO: 933155 - DNA, 22 bp, Artificial Sequence
  chemically synthesized
caaaaccctctcttctagccgt

SEQ ID NO: 933156 - DNA, 22 bp, Artificial Sequence
  chemically synthesized
aaaaccctctcttctagccgtt

SEQ ID NO: 933157 - DNA, 22 bp, Artificial Sequence
  chemically synthesized
tcttctagccgttttgagatac

SEQ ID NO: 933158 - DNA, 22 bp, Artificial Sequence
  chemically synthesized
ttctagccgttttgagatacgc

SEQ ID NO: 933159 - DNA, 22 bp, Artificial Sequence
  chemically synthesized
ctagccgttttgagatacgcaa

SEQ ID NO: 933160 - DNA, 22 bp, Artificial Sequence
  chemically synthesized
tagccgttttgagatacgcaat

SEQ ID NO: 933161 - DNA, 22 bp, Artificial Sequence
  chemically synthesized
tcaacagtaaggtattgcgtat

SEQ ID NO: 933162 - DNA, 22 bp, Artificial Sequence
  chemically synthesized
gccgttttgagatacgcaatac

SEQ ID NO: 933163 - DNA, 22 bp, Artificial Sequence
  chemically synthesized
ttgtcaacagtaaggtattgcg

SEQ ID NO: 933164 - DNA, 22 bp, Artificial Sequence
  chemically synthesized
tgagatacgcaataccttactg

SEQ ID NO: 933165 - DNA, 22 bp, Artificial Sequence
  chemically synthesized
gagatacgcaataccttactgt

SEQ ID NO: 933166 - DNA, 22 bp, Artificial Sequence
  chemically synthesized
agatacgcaataccttactgtt

SEQ ID NO: 933167 - DNA, 22 bp, Artificial Sequence
  chemically synthesized
catagtatggagactattgtca

SEQ ID NO: 933168 - DNA, 22 bp, Artificial Sequence
  chemically synthesized
ttgcatagtatggagactattg

SEQ ID NO: 933169 - DNA, 22 bp, Artificial Sequence
  chemically synthesized
actgttgacaatagtctccata

SEQ ID NO: 933170 - DNA, 22 bp, Artificial Sequence
  chemically synthesized
ctgttgacaatagtctccatac

SEQ ID NO: 933171 - DNA, 22 bp, Artificial Sequence
  chemically synthesized
ttgacaatagtctccatactat

SEQ ID NO: 933172 - DNA, 22 bp, Artificial Sequence
  chemically synthesized
gtgtcctgttgcatagtatgga

SEQ ID NO: 933173 - DNA, 22 bp, Artificial Sequence
  chemically synthesized
tggtgtcctgttgcatagtatg

SEQ ID NO: 933174 - DNA, 22 bp, Artificial Sequence
  chemically synthesized
acaatagtctccatactatgca

SEQ ID NO: 933175 - DNA, 22 bp, Artificial Sequence
  chemically synthesized
gttctggtgtcctgttgcatag

SEQ ID NO: 933176 - DNA, 22 bp, Artificial Sequence
  chemically synthesized
catactatgcaacaggacacca

SEQ ID NO: 933177 - DNA, 22 bp, Artificial Sequence
  chemically synthesized
gaaaggaagaattagttctggt

SEQ ID NO: 933178 - DNA, 22 bp, Artificial Sequence
  chemically synthesized
tgcaacaggacaccagaactaa

SEQ ID NO: 933179 - DNA, 22 bp, Artificial Sequence
  chemically synthesized
attcttcctttctaatcgtgac

SEQ ID NO: 933180 - DNA, 22 bp, Artificial Sequence
  chemically synthesized
tcaatgggtacaaagtcacgat

SEQ ID NO: 933181 - DNA, 22 bp, Artificial Sequence
  chemically synthesized
ttcctttctaatcgtgactttg

SEQ ID NO: 933182 - DNA, 22 bp, Artificial Sequence
  chemically synthesized
cctttctaatcgtgactttgta

SEQ ID NO: 933183 - DNA, 22 bp, Artificial Sequence
  chemically synthesized
ctttctaatcgtgactttgtac

SEQ ID NO: 933184 - DNA, 22 bp, Artificial Sequence
  chemically synthesized
tctaatcgtgactttgtaccca

SEQ ID NO: 933185 - DNA, 22 bp, Artificial Sequence
  chemically synthesized
ctaatcgtgactttgtacccat

SEQ ID NO: 933186 - DNA, 22 bp, Artificial Sequence
  chemically synthesized
taatcgtgactttgtacccatt

SEQ ID NO: 933187 - DNA, 22 bp, Artificial Sequence
  chemically synthesized
atcgtgactttgtacccattga

SEQ ID NO: 933188 - DNA, 22 bp, Artificial Sequence
  chemically synthesized
tgtacccattgacaatcctctc

SEQ ID NO: 933189 - DNA, 22 bp, Artificial Sequence
  chemically synthesized
gtacccattgacaatcctctcc

SEQ ID NO: 933190 - DNA, 22 bp, Artificial Sequence
  chemically synthesized
tacccattgacaatcctctccc

SEQ ID NO: 933191 - DNA, 22 bp, Artificial Sequence
  chemically synthesized
acaatcctctccccattctcgc

SEQ ID NO: 933192 - DNA, 22 bp, Artificial Sequence
  chemically synthesized
tccccattctcgcttttcccct

SEQ ID NO: 933193 - DNA, 22 bp, Artificial Sequence
  chemically synthesized
cccattctcgcttttcccctac

SEQ ID NO: 933194 - DNA, 22 bp, Artificial Sequence
  chemically synthesized
tcgcttttcccctacttccccc

SEQ ID NO: 933195 - DNA, 22 bp, Artificial Sequence
  chemically synthesized
gcttttcccctacttcccccat

SEQ ID NO: 933196 - DNA, 22 bp, Artificial Sequence
  chemically synthesized
ttcccctacttcccccattctt

SEQ ID NO: 933197 - DNA, 22 bp, Artificial Sequence
  chemically synthesized
tcccctacttcccccattcttt

SEQ ID NO: 933198 - DNA, 22 bp, Artificial Sequence
  chemically synthesized
cccctacttcccccattctttg

SEQ ID NO: 933199 - DNA, 22 bp, Artificial Sequence
  chemically synthesized
ccctacttcccccattctttgg

SEQ ID NO: 933200 - DNA, 22 bp, Artificial Sequence
  chemically synthesized
cttcccccattctttggtgacc

SEQ ID NO: 933201 - DNA, 22 bp, Artificial Sequence
  chemically synthesized
cccccattctttggtgaccacc

SEQ ID NO: 933202 - DNA, 22 bp, Artificial Sequence
  chemically synthesized
ccccattctttggtgaccaccg

SEQ ID NO: 933203 - DNA, 22 bp, Artificial Sequence
  chemically synthesized
atagaagcagtaaatggacggt

SEQ ID NO: 933204 - DNA, 22 bp, Artificial Sequence
  chemically synthesized
tttggtgaccaccgtccattta

SEQ ID NO: 933205 - DNA, 22 bp, Artificial Sequence
  chemically synthesized
tggtgaccaccgtccatttact

SEQ ID NO: 933206 - DNA, 22 bp, Artificial Sequence
  chemically synthesized
ggtgaccaccgtccatttactg

SEQ ID NO: 933207 - DNA, 22 bp, Artificial Sequence
  chemically synthesized
gtgaccaccgtccatttactgc

SEQ ID NO: 933208 - DNA, 22 bp, Artificial Sequence
  chemically synthesized
aaaacatcgatctcatagaagc

SEQ ID NO: 933209 - DNA, 22 bp, Artificial Sequence
  chemically synthesized
actgcttctatgagatcgatgt

SEQ ID NO: 933210 - DNA, 22 bp, Artificial Sequence
  chemically synthesized
ctgcttctatgagatcgatgtt

SEQ ID NO: 933211 - DNA, 22 bp, Artificial Sequence
  chemically synthesized
cttctatgagatcgatgttttt

SEQ ID NO: 933212 - DNA, 22 bp, Artificial Sequence
  chemically synthesized
atatgcacaatctaaaaacatc

SEQ ID NO: 933213 - DNA, 22 bp, Artificial Sequence
  chemically synthesized
ctatgagatcgatgtttttaga

SEQ ID NO: 933214 - DNA, 22 bp, Artificial Sequence
  chemically synthesized
tatgagatcgatgtttttagat

SEQ ID NO: 933215 - DNA, 22 bp, Artificial Sequence
  chemically synthesized
attcatatgcacaatctaaaaa

SEQ ID NO: 933216 - DNA, 22 bp, Artificial Sequence
  chemically synthesized
tgagatcgatgtttttagattg

SEQ ID NO: 933217 - DNA, 22 bp, Artificial Sequence
  chemically synthesized
tcattcatatgcacaatctaaa

SEQ ID NO: 933218 - DNA, 22 bp, Artificial Sequence
  chemically synthesized
ttctcattcatatgcacaatct

SEQ ID NO: 933219 - DNA, 22 bp, Artificial Sequence
  chemically synthesized
gttctcattcatatgcacaatc

SEQ ID NO: 933220 - DNA, 22 bp, Artificial Sequence
  chemically synthesized
ttagattgtgcatatgaatgag

SEQ ID NO: 933221 - DNA, 22 bp, Artificial Sequence
  chemically synthesized
tagattgtgcatatgaatgaga

SEQ ID NO: 933222 - DNA, 22 bp, Artificial Sequence
  chemically synthesized
agattgtgcatatgaatgagaa

SEQ ID NO: 933223 - DNA, 22 bp, Artificial Sequence
  chemically synthesized
gattgtgcatatgaatgagaac

SEQ ID NO: 933224 - DNA, 22 bp, Artificial Sequence
  chemically synthesized
tgcatatgaatgagaacaagct

SEQ ID NO: 933225 - DNA, 22 bp, Artificial Sequence
  chemically synthesized
agccaaacacagaaagacaaat

SEQ ID NO: 933226 - DNA, 22 bp, Artificial Sequence
  chemically synthesized
actaagccaaacacagaaagac

SEQ ID NO: 933227 - DNA, 22 bp, Artificial Sequence
  chemically synthesized
tattaactaagccaaacacaga

SEQ ID NO: 933228 - DNA, 22 bp, Artificial Sequence
  chemically synthesized
catttgtctttctgtgtttggc

SEQ ID NO: 933229 - DNA, 22 bp, Artificial Sequence
  chemically synthesized
gtctttctgtgtttggcttagt

SEQ ID NO: 933230 - DNA, 22 bp, Artificial Sequence
  chemically synthesized
tctttctgtgtttggcttagtt

SEQ ID NO: 933231 - DNA, 22 bp, Artificial Sequence
  chemically synthesized
atatgttgtattaactaagcca

SEQ ID NO: 933232 - DNA, 22 bp, Artificial Sequence
  chemically synthesized
catatgttgtattaactaagcc

SEQ ID NO: 933233 - DNA, 22 bp, Artificial Sequence
  chemically synthesized
tcatatgttgtattaactaagc

SEQ ID NO: 933234 - DNA, 22 bp, Artificial Sequence
  chemically synthesized
ttcatatgttgtattaactaag

SEQ ID NO: 933235 - DNA, 22 bp, Artificial Sequence
  chemically synthesized
tctgtgtttggcttagttaata

SEQ ID NO: 933236 - DNA, 22 bp, Artificial Sequence
  chemically synthesized
tttcatatgttgtattaactaa

SEQ ID NO: 933237 - DNA, 22 bp, Artificial Sequence
  chemically synthesized
ctgtgtttggcttagttaatac

SEQ ID NO: 933238 - DNA, 22 bp, Artificial Sequence
  chemically synthesized
tgtgtttggcttagttaataca

SEQ ID NO: 933239 - DNA, 22 bp, Artificial Sequence
  chemically synthesized
tgtttggcttagttaatacaac

SEQ ID NO: 933240 - DNA, 22 bp, Artificial Sequence
  chemically synthesized
aacattttttcatatgttgtat

SEQ ID NO: 933241 - DNA, 22 bp, Artificial Sequence
  chemically synthesized
ggcttagttaatacaacatatg

SEQ ID NO: 933242 - DNA, 22 bp, Artificial Sequence
  chemically synthesized
gcttagttaatacaacatatga

SEQ ID NO: 933243 - DNA, 22 bp, Artificial Sequence
  chemically synthesized
agttaatacaacatatgaaaaa

SEQ ID NO: 933244 - DNA, 22 bp, Artificial Sequence
  chemically synthesized
gttaatacaacatatgaaaaaa

SEQ ID NO: 933245 - DNA, 22 bp, Artificial Sequence
  chemically synthesized
atacaacatatgaaaaaatgtt

SEQ ID NO: 933246 - DNA, 22 bp, Artificial Sequence
  chemically synthesized
atagtgatgttgaacatttttt

SEQ ID NO: 933247 - DNA, 22 bp, Artificial Sequence
  chemically synthesized
ctgatagtgatgttgaacattt

SEQ ID NO: 933248 - DNA, 22 bp, Artificial Sequence
  chemically synthesized
cctgatagtgatgttgaacatt

SEQ ID NO: 933249 - DNA, 22 bp, Artificial Sequence
  chemically synthesized
tcctgatagtgatgttgaacat

SEQ ID NO: 933250 - DNA, 22 bp, Artificial Sequence
  chemically synthesized
cattttcctgatagtgatgttg

SEQ ID NO: 933251 - DNA, 22 bp, Artificial Sequence
  chemically synthesized
gcattttcctgatagtgatgtt

SEQ ID NO: 933252 - DNA, 22 bp, Artificial Sequence
  chemically synthesized
atttgcattttcctgatagtga

SEQ ID NO: 933253 - DNA, 22 bp, Artificial Sequence
  chemically synthesized
gatttgcattttcctgatagtg

SEQ ID NO: 933254 - DNA, 22 bp, Artificial Sequence
  chemically synthesized
tgatttgcattttcctgatagt

SEQ ID NO: 933255 - DNA, 22 bp, Artificial Sequence
  chemically synthesized
aacatcactatcaggaaaatgc

SEQ ID NO: 933256 - DNA, 22 bp, Artificial Sequence
  chemically synthesized
tggttttgatttgcattttcct

SEQ ID NO: 933257 - DNA, 22 bp, Artificial Sequence
  chemically synthesized
attgtggttttgatttgcattt

SEQ ID NO: 933258 - DNA, 22 bp, Artificial Sequence
  chemically synthesized
tcaggaaaatgcaaatcaaaac

SEQ ID NO: 933259 - DNA, 22 bp, Artificial Sequence
  chemically synthesized
gaatgagatgatatctcattgt

SEQ ID NO: 933260 - DNA, 22 bp, Artificial Sequence
  chemically synthesized
actggaatgagatgatatctca

SEQ ID NO: 933261 - DNA, 22 bp, Artificial Sequence
  chemically synthesized
taactggaatgagatgatatct

SEQ ID NO: 933262 - DNA, 22 bp, Artificial Sequence
  chemically synthesized
ataatagccattctaactggaa

SEQ ID NO: 933263 - DNA, 22 bp, Artificial Sequence
  chemically synthesized
gataatagccattctaactgga

SEQ ID NO: 933264 - DNA, 22 bp, Artificial Sequence
  chemically synthesized
tgataatagccattctaactgg

SEQ ID NO: 933265 - DNA, 22 bp, Artificial Sequence
  chemically synthesized
tattttgataatagccattcta

SEQ ID NO: 933266 - DNA, 22 bp, Artificial Sequence
  chemically synthesized
gtattttgataatagccattct

SEQ ID NO: 933267 - DNA, 22 bp, Artificial Sequence
  chemically synthesized
tgtattttgataatagccattc

SEQ ID NO: 933268 - DNA, 22 bp, Artificial Sequence
  chemically synthesized
ttgtattttgataatagccatt

SEQ ID NO: 933269 - DNA, 22 bp, Artificial Sequence
  chemically synthesized
attccagttagaatggctatta

SEQ ID NO: 933270 - DNA, 22 bp, Artificial Sequence
  chemically synthesized
tcttttgtattttgataatagc

SEQ ID NO: 933271 - DNA, 22 bp, Artificial Sequence
  chemically synthesized
cagttagaatggctattatcaa

SEQ ID NO: 933272 - DNA, 22 bp, Artificial Sequence
  chemically synthesized
atcttttgtattttgataatag

SEQ ID NO: 933273 - DNA, 22 bp, Artificial Sequence
  chemically synthesized
tatcttttgtattttgataata

SEQ ID NO: 933274 - DNA, 22 bp, Artificial Sequence
  chemically synthesized
ttatcttttgtattttgataat

SEQ ID NO: 933275 - DNA, 22 bp, Artificial Sequence
  chemically synthesized
tttatcttttgtattttgataa

SEQ ID NO: 933276 - DNA, 22 bp, Artificial Sequence
  chemically synthesized
gaatggctattatcaaaataca

SEQ ID NO: 933277 - DNA, 22 bp, Artificial Sequence
  chemically synthesized
ccaacactttttatcttttgta

SEQ ID NO: 933278 - DNA, 22 bp, Artificial Sequence
  chemically synthesized
gccaacactttttatcttttgt

SEQ ID NO: 933279 - DNA, 22 bp, Artificial Sequence
  chemically synthesized
ttatcaaaatacaaaagataaa

SEQ ID NO: 933280 - DNA, 22 bp, Artificial Sequence
  chemically synthesized
ttgccaacactttttatctttt

SEQ ID NO: 933281 - DNA, 22 bp, Artificial Sequence
  chemically synthesized
tcaaaatacaaaagataaaaag

SEQ ID NO: 933282 - DNA, 22 bp, Artificial Sequence
  chemically synthesized
catattcttgccaacacttttt

SEQ ID NO: 933283 - DNA, 22 bp, Artificial Sequence
  chemically synthesized
tccatattcttgccaacacttt

SEQ ID NO: 933284 - DNA, 22 bp, Artificial Sequence
  chemically synthesized
ctccatattcttgccaacactt

SEQ ID NO: 933285 - DNA, 22 bp, Artificial Sequence
  chemically synthesized
tctccatattcttgccaacact

SEQ ID NO: 933286 - DNA, 22 bp, Artificial Sequence
  chemically synthesized
ttctccatattcttgccaacac

SEQ ID NO: 933287 - DNA, 22 bp, Artificial Sequence
  chemically synthesized
ccttttctccatattcttgcca

SEQ ID NO: 933288 - DNA, 22 bp, Artificial Sequence
  chemically synthesized
gcaagaatatggagaaaaggga

SEQ ID NO: 933289 - DNA, 22 bp, Artificial Sequence
  chemically synthesized
ccaccaacagtgcataagggtt

SEQ ID NO: 933290 - DNA, 22 bp, Artificial Sequence
  chemically synthesized
cattcccaccaacagtgcataa

SEQ ID NO: 933291 - DNA, 22 bp, Artificial Sequence
  chemically synthesized
acattcccaccaacagtgcata

SEQ ID NO: 933292 - DNA, 22 bp, Artificial Sequence
  chemically synthesized
atttacattcccaccaacagtg

SEQ ID NO: 933293 - DNA, 22 bp, Artificial Sequence
  chemically synthesized
atgcactgttggtgggaatgta

SEQ ID NO: 933294 - DNA, 22 bp, Artificial Sequence
  chemically synthesized
tgcactgttggtgggaatgtaa

SEQ ID NO: 933295 - DNA, 22 bp, Artificial Sequence
  chemically synthesized
cataatggatgtactcatttac

SEQ ID NO: 933296 - DNA, 22 bp, Artificial Sequence
  chemically synthesized
ttggtgggaatgtaaatgagta

SEQ ID NO: 933297 - DNA, 22 bp, Artificial Sequence
  chemically synthesized
gtgggaatgtaaatgagtacat

SEQ ID NO: 933298 - DNA, 22 bp, Artificial Sequence
  chemically synthesized
cataccgtcctccataatggat

SEQ ID NO: 933299 - DNA, 22 bp, Artificial Sequence
  chemically synthesized
gaggaacctccataccgtcctc

SEQ ID NO: 933300 - DNA, 22 bp, Artificial Sequence
  chemically synthesized
cgaggaacctccataccgtcct

SEQ ID NO: 933301 - DNA, 22 bp, Artificial Sequence
  chemically synthesized
tcgaggaacctccataccgtcc

SEQ ID NO: 933302 - DNA, 22 bp, Artificial Sequence
  chemically synthesized
agttttcgaggaacctccatac

SEQ ID NO: 933303 - DNA, 22 bp, Artificial Sequence
  chemically synthesized
aagttttcgaggaacctccata

SEQ ID NO: 933304 - DNA, 22 bp, Artificial Sequence
  chemically synthesized
taagttttcgaggaacctccat

SEQ ID NO: 933305 - DNA, 22 bp, Artificial Sequence
  chemically synthesized
tggaggacggtatggaggttcc

SEQ ID NO: 933306 - DNA, 22 bp, Artificial Sequence
  chemically synthesized
ttaagttttcgaggaacctcca

SEQ ID NO: 933307 - DNA, 22 bp, Artificial Sequence
  chemically synthesized
tttttaagttttcgaggaacct

SEQ ID NO: 933308 - DNA, 22 bp, Artificial Sequence
  chemically synthesized
tatttttaagttttcgaggaac

SEQ ID NO: 933309 - DNA, 22 bp, Artificial Sequence
  chemically synthesized
ctcgaaaacttaaaaatagaac

SEQ ID NO: 933310 - DNA, 22 bp, Artificial Sequence
  chemically synthesized
tatcgtatggtagttctatttt

SEQ ID NO: 933311 - DNA, 22 bp, Artificial Sequence
  chemically synthesized
gaaaacttaaaaatagaactac

SEQ ID NO: 933312 - DNA, 22 bp, Artificial Sequence
  chemically synthesized
ctgtatcgtatggtagttctat

SEQ ID NO: 933313 - DNA, 22 bp, Artificial Sequence
  chemically synthesized
aaaaatagaactaccatacgat

SEQ ID NO: 933314 - DNA, 22 bp, Artificial Sequence
  chemically synthesized
aaaatagaactaccatacgata

SEQ ID NO: 933315 - DNA, 22 bp, Artificial Sequence
  chemically synthesized
tccccagtagtggaattgctgt

SEQ ID NO: 933316 - DNA, 22 bp, Artificial Sequence
  chemically synthesized
tgtccccagtagtggaattgct

SEQ ID NO: 933317 - DNA, 22 bp, Artificial Sequence
  chemically synthesized
ccatacgatacagcaattccac

SEQ ID NO: 933318 - DNA, 22 bp, Artificial Sequence
  chemically synthesized
tctctgtccccagtagtggaat

SEQ ID NO: 933319 - DNA, 22 bp, Artificial Sequence
  chemically synthesized
gtctctgtccccagtagtggaa

SEQ ID NO: 933320 - DNA, 22 bp, Artificial Sequence
  chemically synthesized
tgtctctgtccccagtagtgga

SEQ ID NO: 933321 - DNA, 22 bp, Artificial Sequence
  chemically synthesized
ctttgtctctgtccccagtagt

SEQ ID NO: 933322 - DNA, 22 bp, Artificial Sequence
  chemically synthesized
gctttgtctctgtccccagtag

SEQ ID NO: 933323 - DNA, 22 bp, Artificial Sequence
  chemically synthesized
tttgctttgtctctgtccccag

SEQ ID NO: 933324 - DNA, 22 bp, Artificial Sequence
  chemically synthesized
atttgctttgtctctgtcccca

SEQ ID NO: 933325 - DNA, 22 bp, Artificial Sequence
  chemically synthesized
tatttgctttgtctctgtcccc

SEQ ID NO: 933326 - DNA, 22 bp, Artificial Sequence
  chemically synthesized
attttatttgctttgtctctgt

SEQ ID NO: 933327 - DNA, 22 bp, Artificial Sequence
  chemically synthesized
cactactggggacagagacaaa

SEQ ID NO: 933328 - DNA, 22 bp, Artificial Sequence
  chemically synthesized
ctggggacagagacaaagcaaa

SEQ ID NO: 933329 - DNA, 22 bp, Artificial Sequence
  chemically synthesized
gggacagagacaaagcaaataa

SEQ ID NO: 933330 - DNA, 22 bp, Artificial Sequence
  chemically synthesized
tgacatactgattttatttgct

SEQ ID NO: 933331 - DNA, 22 bp, Artificial Sequence
  chemically synthesized
tatgacatactgattttatttg

SEQ ID NO: 933332 - DNA, 22 bp, Artificial Sequence
  chemically synthesized
caataaacatgggaatgcagat

SEQ ID NO: 933333 - DNA, 22 bp, Artificial Sequence
  chemically synthesized
tgaataatgctgcaataaacat

SEQ ID NO: 933334 - DNA, 22 bp, Artificial Sequence
  chemically synthesized
ttgtgaataatgctgcaataaa

SEQ ID NO: 933335 - DNA, 22 bp, Artificial Sequence
  chemically synthesized
cattcccatgtttattgcagca

SEQ ID NO: 933336 - DNA, 22 bp, Artificial Sequence
  chemically synthesized
gctattgtgaataatgctgcaa

SEQ ID NO: 933337 - DNA, 22 bp, Artificial Sequence
  chemically synthesized
ggctattgtgaataatgctgca

SEQ ID NO: 933338 - DNA, 22 bp, Artificial Sequence
  chemically synthesized
ccatgtttattgcagcattatt

SEQ ID NO: 933339 - DNA, 22 bp, Artificial Sequence
  chemically synthesized
tatcttggctattgtgaataat

SEQ ID NO: 933340 - DNA, 22 bp, Artificial Sequence
  chemically synthesized
tatatcttggctattgtgaata

SEQ ID NO: 933341 - DNA, 22 bp, Artificial Sequence
  chemically synthesized
attgcagcattattcacaatag

SEQ ID NO: 933342 - DNA, 22 bp, Artificial Sequence
  chemically synthesized
ttgcagcattattcacaatagc

SEQ ID NO: 933343 - DNA, 22 bp, Artificial Sequence
  chemically synthesized
attctatatcttggctattgtg

SEQ ID NO: 933344 - DNA, 22 bp, Artificial Sequence
  chemically synthesized
cagcattattcacaatagccaa

SEQ ID NO: 933345 - DNA, 22 bp, Artificial Sequence
  chemically synthesized
agttgattctatatcttggcta

SEQ ID NO: 933346 - DNA, 22 bp, Artificial Sequence
  chemically synthesized
aagttgattctatatcttggct

SEQ ID NO: 933347 - DNA, 22 bp, Artificial Sequence
  chemically synthesized
ttcacaatagccaagatataga

SEQ ID NO: 933348 - DNA, 22 bp, Artificial Sequence
  chemically synthesized
acaatagccaagatatagaatc

SEQ ID NO: 933349 - DNA, 22 bp, Artificial Sequence
  chemically synthesized
aacacttaagttgattctatat

SEQ ID NO: 933350 - DNA, 22 bp, Artificial Sequence
  chemically synthesized
ttaaacacttaagttgattcta

SEQ ID NO: 933351 - DNA, 22 bp, Artificial Sequence
  chemically synthesized
atccattattaaacacttaagt

SEQ ID NO: 933352 - DNA, 22 bp, Artificial Sequence
  chemically synthesized
ttcatccattattaaacactta

SEQ ID NO: 933353 - DNA, 22 bp, Artificial Sequence
  chemically synthesized
attcatccattattaaacactt

SEQ ID NO: 933354 - DNA, 22 bp, Artificial Sequence
  chemically synthesized
tattcatccattattaaacact

SEQ ID NO: 933355 - DNA, 22 bp, Artificial Sequence
  chemically synthesized
tttattcatccattattaaaca

SEQ ID NO: 933356 - DNA, 22 bp, Artificial Sequence
  chemically synthesized
ctttattcatccattattaaac

SEQ ID NO: 933357 - DNA, 22 bp, Artificial Sequence
  chemically synthesized
tctttattcatccattattaaa

SEQ ID NO: 933358 - DNA, 22 bp, Artificial Sequence
  chemically synthesized
aagtgtttaataatggatgaat

SEQ ID NO: 933359 - DNA, 22 bp, Artificial Sequence
  chemically synthesized
agtgtttaataatggatgaata

SEQ ID NO: 933360 - DNA, 22 bp, Artificial Sequence
  chemically synthesized
aataatggatgaataaagaaaa

SEQ ID NO: 933361 - DNA, 22 bp, Artificial Sequence
  chemically synthesized
ataatggatgaataaagaaaat

SEQ ID NO: 933362 - DNA, 22 bp, Artificial Sequence
  chemically synthesized
catatatatgcaatattttctt

SEQ ID NO: 933363 - DNA, 22 bp, Artificial Sequence
  chemically synthesized
aataatatcccattgcatatat

SEQ ID NO: 933364 - DNA, 22 bp, Artificial Sequence
  chemically synthesized
tatgactcaataatatcccatt

SEQ ID NO: 933365 - DNA, 22 bp, Artificial Sequence
  chemically synthesized
catatatatgcaatgggatatt

SEQ ID NO: 933366 - DNA, 22 bp, Artificial Sequence
  chemically synthesized
atatgactcaataatatcccat

SEQ ID NO: 933367 - DNA, 22 bp, Artificial Sequence
  chemically synthesized
tatatgactcaataatatccca

SEQ ID NO: 933368 - DNA, 22 bp, Artificial Sequence
  chemically synthesized
ttatatgactcaataatatccc

SEQ ID NO: 933369 - DNA, 22 bp, Artificial Sequence
  chemically synthesized
ttttatatgactcaataatatc

SEQ ID NO: 933370 - DNA, 22 bp, Artificial Sequence
  chemically synthesized
ttcttttatatgactcaataat

SEQ ID NO: 933371 - DNA, 22 bp, Artificial Sequence
  chemically synthesized
attcttttatatgactcaataa

SEQ ID NO: 933372 - DNA, 22 bp, Artificial Sequence
  chemically synthesized
tattcttttatatgactcaata

SEQ ID NO: 933373 - DNA, 22 bp, Artificial Sequence
  chemically synthesized
ttgagtcatataaaagaataaa

SEQ ID NO: 933374 - DNA, 22 bp, Artificial Sequence
  chemically synthesized
agtcatataaaagaataaaatc

SEQ ID NO: 933375 - DNA, 22 bp, Artificial Sequence
  chemically synthesized
tcataaatgacaggattttatt

SEQ ID NO: 933376 - DNA, 22 bp, Artificial Sequence
  chemically synthesized
atccatgttgtcataaatgaca

SEQ ID NO: 933377 - DNA, 22 bp, Artificial Sequence
  chemically synthesized
aggttcatccatgttgtcataa

SEQ ID NO: 933378 - DNA, 22 bp, Artificial Sequence
  chemically synthesized
tcatttatgacaacatggatga

SEQ ID NO: 933379 - DNA, 22 bp, Artificial Sequence
  chemically synthesized
acatagtatcctcaggttcatc

SEQ ID NO: 933380 - DNA, 22 bp, Artificial Sequence
  chemically synthesized
atgacaacatggatgaacctga

SEQ ID NO: 933381 - DNA, 22 bp, Artificial Sequence
  chemically synthesized
aacatagtatcctcaggttcat

SEQ ID NO: 933382 - DNA, 22 bp, Artificial Sequence
  chemically synthesized
tgacaacatggatgaacctgag

SEQ ID NO: 933383 - DNA, 22 bp, Artificial Sequence
  chemically synthesized
agacacttaacatagtatcctc

SEQ ID NO: 933384 - DNA, 22 bp, Artificial Sequence
  chemically synthesized
cagacacttaacatagtatcct

SEQ ID NO: 933385 - DNA, 22 bp, Artificial Sequence
  chemically synthesized
aggatactatgttaagtgtctg

SEQ ID NO: 933386 - DNA, 22 bp, Artificial Sequence
  chemically synthesized
aggagtcaaaacttcagacact

SEQ ID NO: 933387 - DNA, 22 bp, Artificial Sequence
  chemically synthesized
caggagtcaaaacttcagacac

SEQ ID NO: 933388 - DNA, 22 bp, Artificial Sequence
  chemically synthesized
tgttaagtgtctgaagttttga

SEQ ID NO: 933389 - DNA, 22 bp, Artificial Sequence
  chemically synthesized
taacatttcaggagtcaaaact

SEQ ID NO: 933390 - DNA, 22 bp, Artificial Sequence
  chemically synthesized
agtgtctgaagttttgactcct

SEQ ID NO: 933391 - DNA, 22 bp, Artificial Sequence
  chemically synthesized
aagttttgactcctgaaatgtt

SEQ ID NO: 933392 - DNA, 22 bp, Artificial Sequence
  chemically synthesized
aaccgaggacattataacattt

SEQ ID NO: 933393 - DNA, 22 bp, Artificial Sequence
  chemically synthesized
tgactcctgaaatgttataatg

SEQ ID NO: 933394 - DNA, 22 bp, Artificial Sequence
  chemically synthesized
gactcctgaaatgttataatgt

SEQ ID NO: 933395 - DNA, 22 bp, Artificial Sequence
  chemically synthesized
actcctgaaatgttataatgtc

SEQ ID NO: 933396 - DNA, 22 bp, Artificial Sequence
  chemically synthesized
atatcctaaaccgaggacatta

SEQ ID NO: 933397 - DNA, 22 bp, Artificial Sequence
  chemically synthesized
ctgaaatgttataatgtcctcg

SEQ ID NO: 933398 - DNA, 22 bp, Artificial Sequence
  chemically synthesized
aaatgttataatgtcctcggtt

SEQ ID NO: 933399 - DNA, 22 bp, Artificial Sequence
  chemically synthesized
aagctaatatcctaaaccgagg

SEQ ID NO: 933400 - DNA, 22 bp, Artificial Sequence
  chemically synthesized
ctcaagctaatatcctaaaccg

SEQ ID NO: 933401 - DNA, 22 bp, Artificial Sequence
  chemically synthesized
tactcaagctaatatcctaaac

SEQ ID NO: 933402 - DNA, 22 bp, Artificial Sequence
  chemically synthesized
taatgtcctcggtttaggatat

SEQ ID NO: 933403 - DNA, 22 bp, Artificial Sequence
  chemically synthesized
ccattctactcaagctaatatc

SEQ ID NO: 933404 - DNA, 22 bp, Artificial Sequence
  chemically synthesized
ttgccattctactcaagctaat

SEQ ID NO: 933405 - DNA, 22 bp, Artificial Sequence
  chemically synthesized
gttgccattctactcaagctaa

SEQ ID NO: 933406 - DNA, 22 bp, Artificial Sequence
  chemically synthesized
ggtttaggatattagcttgagt

SEQ ID NO: 933407 - DNA, 22 bp, Artificial Sequence
  chemically synthesized
aggatattagcttgagtagaat

SEQ ID NO: 933408 - DNA, 22 bp, Artificial Sequence
  chemically synthesized
ggatattagcttgagtagaatg

SEQ ID NO: 933409 - DNA, 22 bp, Artificial Sequence
  chemically synthesized
tgcaaaccttgttgccattcta

SEQ ID NO: 933410 - DNA, 22 bp, Artificial Sequence
  chemically synthesized
gtgcaaaccttgttgccattct

SEQ ID NO: 933411 - DNA, 22 bp, Artificial Sequence
  chemically synthesized
gcttgagtagaatggcaacaag

SEQ ID NO: 933412 - DNA, 22 bp, Artificial Sequence
  chemically synthesized
aatatttgtgcaaaccttgttg

SEQ ID NO: 933413 - DNA, 22 bp, Artificial Sequence
  chemically synthesized
gagtagaatggcaacaaggttt

SEQ ID NO: 933414 - DNA, 22 bp, Artificial Sequence
  chemically synthesized
aaatatttgtgcaaaccttgtt

SEQ ID NO: 933415 - DNA, 22 bp, Artificial Sequence
  chemically synthesized
agtagaatggcaacaaggtttg

SEQ ID NO: 933416 - DNA, 22 bp, Artificial Sequence
  chemically synthesized
taaatatttgtgcaaaccttgt

SEQ ID NO: 933417 - DNA, 22 bp, Artificial Sequence
  chemically synthesized
ttaaatatttgtgcaaaccttg

SEQ ID NO: 933418 - DNA, 22 bp, Artificial Sequence
  chemically synthesized
tttaaatatttgtgcaaacctt

SEQ ID NO: 933419 - DNA, 22 bp, Artificial Sequence
  chemically synthesized
tgagtcactttttaaatatttg

SEQ ID NO: 933420 - DNA, 22 bp, Artificial Sequence
  chemically synthesized
gtgagtcactttttaaatattt

SEQ ID NO: 933421 - DNA, 22 bp, Artificial Sequence
  chemically synthesized
ttgtgagtcactttttaaatat

SEQ ID NO: 933422 - DNA, 22 bp, Artificial Sequence
  chemically synthesized
cttgtgagtcactttttaaata

SEQ ID NO: 933423 - DNA, 22 bp, Artificial Sequence
  chemically synthesized
tcttgtgagtcactttttaaat

SEQ ID NO: 933424 - DNA, 22 bp, Artificial Sequence
  chemically synthesized
ttcttgtgagtcactttttaaa

SEQ ID NO: 933425 - DNA, 22 bp, Artificial Sequence
  chemically synthesized
tttcttgtgagtcactttttaa

SEQ ID NO: 933426 - DNA, 22 bp, Artificial Sequence
  chemically synthesized
gcacaaatatttaaaaagtgac

SEQ ID NO: 933427 - DNA, 22 bp, Artificial Sequence
  chemically synthesized
cacaaatatttaaaaagtgact

SEQ ID NO: 933428 - DNA, 22 bp, Artificial Sequence
  chemically synthesized
aatagcactttttcttgtgagt

SEQ ID NO: 933429 - DNA, 22 bp, Artificial Sequence
  chemically synthesized
aaatagcactttttcttgtgag

SEQ ID NO: 933430 - DNA, 22 bp, Artificial Sequence
  chemically synthesized
aaaaagtgactcacaagaaaaa

SEQ ID NO: 933431 - DNA, 22 bp, Artificial Sequence
  chemically synthesized
aaaagtgactcacaagaaaaag

SEQ ID NO: 933432 - DNA, 22 bp, Artificial Sequence
  chemically synthesized
acaagaaaaagtgctatttaag

SEQ ID NO: 933433 - DNA, 22 bp, Artificial Sequence
  chemically synthesized
caggcatgagccaccatgcccg

SEQ ID NO: 933434 - DNA, 22 bp, Artificial Sequence
  chemically synthesized
tttaagccgggcatggtggctc

SEQ ID NO: 933435 - DNA, 22 bp, Artificial Sequence
  chemically synthesized
ggattacaggcatgagccacca

SEQ ID NO: 933436 - DNA, 22 bp, Artificial Sequence
  chemically synthesized
aagccgggcatggtggctcatg

SEQ ID NO: 933437 - DNA, 22 bp, Artificial Sequence
  chemically synthesized
agccgggcatggtggctcatgc

SEQ ID NO: 933438 - DNA, 22 bp, Artificial Sequence
  chemically synthesized
ccaaagtgctgggattacaggc

SEQ ID NO: 933439 - DNA, 22 bp, Artificial Sequence
  chemically synthesized
gcctcccaaagtgctgggatta

SEQ ID NO: 933440 - DNA, 22 bp, Artificial Sequence
  chemically synthesized
ggcctcccaaagtgctgggatt

SEQ ID NO: 933441 - DNA, 22 bp, Artificial Sequence
  chemically synthesized
atgcctgtaatcccagcacttt

SEQ ID NO: 933442 - DNA, 22 bp, Artificial Sequence
  chemically synthesized
taatcccagcactttgggaggc

SEQ ID NO: 933443 - DNA, 22 bp, Artificial Sequence
  chemically synthesized
atgatccacccaccttggcctc

SEQ ID NO: 933444 - DNA, 22 bp, Artificial Sequence
  chemically synthesized
acctcatgatccacccaccttg

SEQ ID NO: 933445 - DNA, 22 bp, Artificial Sequence
  chemically synthesized
ctgacctcatgatccacccacc

SEQ ID NO: 933446 - DNA, 22 bp, Artificial Sequence
  chemically synthesized
tgggaggccaaggtgggtggat

SEQ ID NO: 933447 - DNA, 22 bp, Artificial Sequence
  chemically synthesized
gggaggccaaggtgggtggatc

SEQ ID NO: 933448 - DNA, 22 bp, Artificial Sequence
  chemically synthesized
ggaggccaaggtgggtggatca

SEQ ID NO: 933449 - DNA, 22 bp, Artificial Sequence
  chemically synthesized
gatctcctgacctcatgatcca

SEQ ID NO: 933450 - DNA, 22 bp, Artificial Sequence
  chemically synthesized
tcgatctcctgacctcatgatc

SEQ ID NO: 933451 - DNA, 22 bp, Artificial Sequence
  chemically synthesized
ttctcgatctcctgacctcatg

SEQ ID NO: 933452 - DNA, 22 bp, Artificial Sequence
  chemically synthesized
gccaggttgttctcgatctcct

SEQ ID NO: 933453 - DNA, 22 bp, Artificial Sequence
  chemically synthesized
accgtgttagccaggttgttct

SEQ ID NO: 933454 - DNA, 22 bp, Artificial Sequence
  chemically synthesized
caccgtgttagccaggttgttc

SEQ ID NO: 933455 - DNA, 22 bp, Artificial Sequence
  chemically synthesized
gtagagacggagtttcaccgtg

SEQ ID NO: 933456 - DNA, 22 bp, Artificial Sequence
  chemically synthesized
agtagagacggagtttcaccgt

SEQ ID NO: 933457 - DNA, 22 bp, Artificial Sequence
  chemically synthesized
tagtagagacggagtttcaccg

SEQ ID NO: 933458 - DNA, 22 bp, Artificial Sequence
  chemically synthesized
ttagtagagacggagtttcacc

SEQ ID NO: 933459 - DNA, 22 bp, Artificial Sequence
  chemically synthesized
tttagtagagacggagtttcac

SEQ ID NO: 933460 - DNA, 22 bp, Artificial Sequence
  chemically synthesized
ttttagtagagacggagtttca

SEQ ID NO: 933461 - DNA, 22 bp, Artificial Sequence
  chemically synthesized
gctaacacggtgaaactccgtc

SEQ ID NO: 933462 - DNA, 22 bp, Artificial Sequence
  chemically synthesized
tatttttttagtagagacggag

SEQ ID NO: 933463 - DNA, 22 bp, Artificial Sequence
  chemically synthesized
acacggtgaaactccgtctcta

SEQ ID NO: 933464 - DNA, 22 bp, Artificial Sequence
  chemically synthesized
gtatttttttagtagagacgga

SEQ ID NO: 933465 - DNA, 22 bp, Artificial Sequence
  chemically synthesized
tgtatttttttagtagagacgg

SEQ ID NO: 933466 - DNA, 22 bp, Artificial Sequence
  chemically synthesized
ttgtatttttttagtagagacg

SEQ ID NO: 933467 - DNA, 22 bp, Artificial Sequence
  chemically synthesized
tttgtatttttttagtagagac

SEQ ID NO: 933468 - DNA, 22 bp, Artificial Sequence
  chemically synthesized
cgtctctactaaaaaaatacaa

SEQ ID NO: 933469 - DNA, 22 bp, Artificial Sequence
  chemically synthesized
tactaaaaaaatacaaaaaatt

SEQ ID NO: 933470 - DNA, 22 bp, Artificial Sequence
  chemically synthesized
ctaaaaaaatacaaaaaattac

SEQ ID NO: 933471 - DNA, 22 bp, Artificial Sequence
  chemically synthesized
aaaaaatacaaaaaattacccg

SEQ ID NO: 933472 - DNA, 22 bp, Artificial Sequence
  chemically synthesized
caggcggccgccaccacgtccg

SEQ ID NO: 933473 - DNA, 22 bp, Artificial Sequence
  chemically synthesized
ggactacaggcggccgccacca

SEQ ID NO: 933474 - DNA, 22 bp, Artificial Sequence
  chemically synthesized
cccggacgtggtggcggccgcc

SEQ ID NO: 933475 - DNA, 22 bp, Artificial Sequence
  chemically synthesized
ccaagtagctgggactacaggc

SEQ ID NO: 933476 - DNA, 22 bp, Artificial Sequence
  chemically synthesized
agcctcccaagtagctgggact

SEQ ID NO: 933477 - DNA, 22 bp, Artificial Sequence
  chemically synthesized
cctcagcctcccaagtagctgg

SEQ ID NO: 933478 - DNA, 22 bp, Artificial Sequence
  chemically synthesized
ctgcctcagcctcccaagtagc

SEQ ID NO: 933479 - DNA, 22 bp, Artificial Sequence
  chemically synthesized
tcctgcctcagcctcccaagta

SEQ ID NO: 933480 - DNA, 22 bp, Artificial Sequence
  chemically synthesized
tagtcccagctacttgggaggc

SEQ ID NO: 933481 - DNA, 22 bp, Artificial Sequence
  chemically synthesized
acgccattctcctgcctcagcc

SEQ ID NO: 933482 - DNA, 22 bp, Artificial Sequence
  chemically synthesized
cttgggaggctgaggcaggaga

SEQ ID NO: 933483 - DNA, 22 bp, Artificial Sequence
  chemically synthesized
gggaggctgaggcaggagaatg

SEQ ID NO: 933484 - DNA, 22 bp, Artificial Sequence
  chemically synthesized
ggaggctgaggcaggagaatgg

SEQ ID NO: 933485 - DNA, 22 bp, Artificial Sequence
  chemically synthesized
cccgggttcacgccattctcct

SEQ ID NO: 933486 - DNA, 22 bp, Artificial Sequence
  chemically synthesized
cactgcccgggttcacgccatt

SEQ ID NO: 933487 - DNA, 22 bp, Artificial Sequence
  chemically synthesized
aggcaggagaatggcgtgaacc

SEQ ID NO: 933488 - DNA, 22 bp, Artificial Sequence
  chemically synthesized
caagctccactgcccgggttca

SEQ ID NO: 933489 - DNA, 22 bp, Artificial Sequence
  chemically synthesized
actgcaagctccactgcccggg

SEQ ID NO: 933490 - DNA, 22 bp, Artificial Sequence
  chemically synthesized
ggctcactgcaagctccactgc

SEQ ID NO: 933491 - DNA, 22 bp, Artificial Sequence
  chemically synthesized
gagtgcagtggcatgatctcgg

SEQ ID NO: 933492 - DNA, 22 bp, Artificial Sequence
  chemically synthesized
gcagtgagccgagatcatgcca

SEQ ID NO: 933493 - DNA, 22 bp, Artificial Sequence
  chemically synthesized
cagtgagccgagatcatgccac

SEQ ID NO: 933494 - DNA, 22 bp, Artificial Sequence
  chemically synthesized
cccaggctggagtgcagtggca

SEQ ID NO: 933495 - DNA, 22 bp, Artificial Sequence
  chemically synthesized
ttgcccaggctggagtgcagtg

SEQ ID NO: 933496 - DNA, 22 bp, Artificial Sequence
  chemically synthesized
tgttgcccaggctggagtgcag

SEQ ID NO: 933497 - DNA, 22 bp, Artificial Sequence
  chemically synthesized
actctgttgcccaggctggagt

SEQ ID NO: 933498 - DNA, 22 bp, Artificial Sequence
  chemically synthesized
cactccagcctgggcaacagag

SEQ ID NO: 933499 - DNA, 22 bp, Artificial Sequence
  chemically synthesized
agatggagtctcactctgttgc

SEQ ID NO: 933500 - DNA, 22 bp, Artificial Sequence
  chemically synthesized
gagatggagtctcactctgttg

SEQ ID NO: 933501 - DNA, 22 bp, Artificial Sequence
  chemically synthesized
tgagatggagtctcactctgtt

SEQ ID NO: 933502 - DNA, 22 bp, Artificial Sequence
  chemically synthesized
ttgagatggagtctcactctgt

SEQ ID NO: 933503 - DNA, 22 bp, Artificial Sequence
  chemically synthesized
cagcctgggcaacagagtgaga

SEQ ID NO: 933504 - DNA, 22 bp, Artificial Sequence
  chemically synthesized
tttgagatggagtctcactctg

SEQ ID NO: 933505 - DNA, 22 bp, Artificial Sequence
  chemically synthesized
ttttgagatggagtctcactct

SEQ ID NO: 933506 - DNA, 22 bp, Artificial Sequence
  chemically synthesized
tttttgagatggagtctcactc

SEQ ID NO: 933507 - DNA, 22 bp, Artificial Sequence
  chemically synthesized
ttttttgagatggagtctcact

SEQ ID NO: 933508 - DNA, 22 bp, Artificial Sequence
  chemically synthesized
tttttttgagatggagtctcac

SEQ ID NO: 933509 - DNA, 22 bp, Artificial Sequence
  chemically synthesized
ttttttttgagatggagtctca

SEQ ID NO: 933510 - DNA, 22 bp, Artificial Sequence
  chemically synthesized
tttttttttgagatggagtctc

SEQ ID NO: 933511 - DNA, 22 bp, Artificial Sequence
  chemically synthesized
ggcaacagagtgagactccatc

SEQ ID NO: 933512 - DNA, 22 bp, Artificial Sequence
  chemically synthesized
ttttttttttgagatggagtct

SEQ ID NO: 933513 - DNA, 22 bp, Artificial Sequence
  chemically synthesized
tttttttttttgagatggagtc

SEQ ID NO: 933514 - DNA, 22 bp, Artificial Sequence
  chemically synthesized
ttttttttttttgagatggagt

SEQ ID NO: 933515 - DNA, 22 bp, Artificial Sequence
  chemically synthesized
tttttttttttttgagatggag

SEQ ID NO: 933516 - DNA, 22 bp, Artificial Sequence
  chemically synthesized
ttttttttttttttgagatgga

SEQ ID NO: 933517 - DNA, 22 bp, Artificial Sequence
  chemically synthesized
tttttttttttttttgagatgg

SEQ ID NO: 933518 - DNA, 22 bp, Artificial Sequence
  chemically synthesized
ttttttttttttttttgagatg

SEQ ID NO: 933519 - DNA, 22 bp, Artificial Sequence
  chemically synthesized
tttttttttttttttttgagat

SEQ ID NO: 933520 - DNA, 22 bp, Artificial Sequence
  chemically synthesized
ttttttttttttttttttgaga

SEQ ID NO: 933521 - DNA, 22 bp, Artificial Sequence
  chemically synthesized
tttttttttttttttttttgag

SEQ ID NO: 933522 - DNA, 22 bp, Artificial Sequence
  chemically synthesized
ttttttttttttttttttttga

SEQ ID NO: 933523 - DNA, 22 bp, Artificial Sequence
  chemically synthesized
tttttttttttttttttttttg

SEQ ID NO: 933524 - DNA, 22 bp, Artificial Sequence
  chemically synthesized
tttttttttttttttttttttt

SEQ ID NO: 933525 - DNA, 22 bp, Artificial Sequence
  chemically synthesized
tttttttttttttttttttttt

SEQ ID NO: 933526 - DNA, 22 bp, Artificial Sequence
  chemically synthesized
tttttttttttttttttttttt

SEQ ID NO: 933527 - DNA, 22 bp, Artificial Sequence
  chemically synthesized
tttttttttttttttttttttt

SEQ ID NO: 933528 - DNA, 22 bp, Artificial Sequence
  chemically synthesized
catctcaaaaaaaaaaaaaaaa

SEQ ID NO: 933529 - DNA, 22 bp, Artificial Sequence
  chemically synthesized
cttttttttttttttttttttt

SEQ ID NO: 933530 - DNA, 22 bp, Artificial Sequence
  chemically synthesized
cctttttttttttttttttttt

SEQ ID NO: 933531 - DNA, 22 bp, Artificial Sequence
  chemically synthesized
tccttttttttttttttttttt

SEQ ID NO: 933532 - DNA, 22 bp, Artificial Sequence
  chemically synthesized
ttcctttttttttttttttttt

SEQ ID NO: 933533 - DNA, 22 bp, Artificial Sequence
  chemically synthesized
ttttcctttttttttttttttt

SEQ ID NO: 933534 - DNA, 22 bp, Artificial Sequence
  chemically synthesized
aaaaaaaaaaaaaaaaaaaaaa

SEQ ID NO: 933535 - DNA, 22 bp, Artificial Sequence
  chemically synthesized
cttttccttttttttttttttt

SEQ ID NO: 933536 - DNA, 22 bp, Artificial Sequence
  chemically synthesized
tcttttcctttttttttttttt

SEQ ID NO: 933537 - DNA, 22 bp, Artificial Sequence
  chemically synthesized
ttcttttccttttttttttttt

SEQ ID NO: 933538 - DNA, 22 bp, Artificial Sequence
  chemically synthesized
tttcttttcctttttttttttt

SEQ ID NO: 933539 - DNA, 22 bp, Artificial Sequence
  chemically synthesized
aatagcactttttcttttcctt

SEQ ID NO: 933540 - DNA, 22 bp, Artificial Sequence
  chemically synthesized
aaatagcactttttcttttcct

SEQ ID NO: 933541 - DNA, 22 bp, Artificial Sequence
  chemically synthesized
taaatagcactttttcttttcc

SEQ ID NO: 933542 - DNA, 22 bp, Artificial Sequence
  chemically synthesized
ttaaatagcactttttcttttc

SEQ ID NO: 933543 - DNA, 22 bp, Artificial Sequence
  chemically synthesized
tttttaaatagcactttttctt

SEQ ID NO: 933544 - DNA, 22 bp, Artificial Sequence
  chemically synthesized
ctatttttaaatagcacttttt

SEQ ID NO: 933545 - DNA, 22 bp, Artificial Sequence
  chemically synthesized
gtgttgctatttttaaatagca

SEQ ID NO: 933546 - DNA, 22 bp, Artificial Sequence
  chemically synthesized
agtgttgctatttttaaatagc

SEQ ID NO: 933547 - DNA, 22 bp, Artificial Sequence
  chemically synthesized
ttagtgttgctatttttaaata

SEQ ID NO: 933548 - DNA, 22 bp, Artificial Sequence
  chemically synthesized
ttcttagtgttgctatttttaa

SEQ ID NO: 933549 - DNA, 22 bp, Artificial Sequence
  chemically synthesized
tattattcttagtgttgctatt

SEQ ID NO: 933550 - DNA, 22 bp, Artificial Sequence
  chemically synthesized
tttaaaaatagcaacactaaga

SEQ ID NO: 933551 - DNA, 22 bp, Artificial Sequence
  chemically synthesized
atattgtattattcttagtgtt

SEQ ID NO: 933552 - DNA, 22 bp, Artificial Sequence
  chemically synthesized
aatattgtattattcttagtgt

SEQ ID NO: 933553 - DNA, 22 bp, Artificial Sequence
  chemically synthesized
aaaaatagcaacactaagaata

SEQ ID NO: 933554 - DNA, 22 bp, Artificial Sequence
  chemically synthesized
aaaatagcaacactaagaataa

SEQ ID NO: 933555 - DNA, 22 bp, Artificial Sequence
  chemically synthesized
tgaaaatttaatattgtattat

SEQ ID NO: 933556 - DNA, 22 bp, Artificial Sequence
  chemically synthesized
aaatactatgaaaatttaatat

SEQ ID NO: 933557 - DNA, 22 bp, Artificial Sequence
  chemically synthesized
agaataatacaatattaaattt

SEQ ID NO: 933558 - DNA, 22 bp, Artificial Sequence
  chemically synthesized
aaaatactatgaaaatttaata

SEQ ID NO: 933559 - DNA, 22 bp, Artificial Sequence
  chemically synthesized
taaaatactatgaaaatttaat

SEQ ID NO: 933560 - DNA, 22 bp, Artificial Sequence
  chemically synthesized
tggaggctttaaaatactatga

SEQ ID NO: 933561 - DNA, 22 bp, Artificial Sequence
  chemically synthesized
aattttcatagtattttaaagc

SEQ ID NO: 933562 - DNA, 22 bp, Artificial Sequence
  chemically synthesized
atatgctatggaggctttaaaa

SEQ ID NO: 933563 - DNA, 22 bp, Artificial Sequence
  chemically synthesized
tcatagtattttaaagcctcca

SEQ ID NO: 933564 - DNA, 22 bp, Artificial Sequence
  chemically synthesized
catagtattttaaagcctccat

SEQ ID NO: 933565 - DNA, 22 bp, Artificial Sequence
  chemically synthesized
atagtattttaaagcctccata

SEQ ID NO: 933566 - DNA, 22 bp, Artificial Sequence
  chemically synthesized
aataaattaatatgctatggag

SEQ ID NO: 933567 - DNA, 22 bp, Artificial Sequence
  chemically synthesized
gaataaattaatatgctatgga

SEQ ID NO: 933568 - DNA, 22 bp, Artificial Sequence
  chemically synthesized
tttgaataaattaatatgctat

SEQ ID NO: 933569 - DNA, 22 bp, Artificial Sequence
  chemically synthesized
taaagcctccatagcatattaa

SEQ ID NO: 933570 - DNA, 22 bp, Artificial Sequence
  chemically synthesized
aaagcctccatagcatattaat

SEQ ID NO: 933571 - DNA, 22 bp, Artificial Sequence
  chemically synthesized
aagcctccatagcatattaatt

SEQ ID NO: 933572 - DNA, 22 bp, Artificial Sequence
  chemically synthesized
aaagttatttgaataaattaat

SEQ ID NO: 933573 - DNA, 22 bp, Artificial Sequence
  chemically synthesized
catagcatattaatttattcaa

SEQ ID NO: 933574 - DNA, 22 bp, Artificial Sequence
  chemically synthesized
gtgtcctgaaagttatttgaat

SEQ ID NO: 933575 - DNA, 22 bp, Artificial Sequence
  chemically synthesized
tggtgtcctgaaagttatttga

SEQ ID NO: 933576 - DNA, 22 bp, Artificial Sequence
  chemically synthesized
gttctggtgtcctgaaagttat

SEQ ID NO: 933577 - DNA, 22 bp, Artificial Sequence
  chemically synthesized
atttattcaaataactttcagg

SEQ ID NO: 933578 - DNA, 22 bp, Artificial Sequence
  chemically synthesized
attcaaataactttcaggacac

SEQ ID NO: 933579 - DNA, 22 bp, Artificial Sequence
  chemically synthesized
ttcaaataactttcaggacacc

SEQ ID NO: 933580 - DNA, 22 bp, Artificial Sequence
  chemically synthesized
aaataactttcaggacaccaga

SEQ ID NO: 933581 - DNA, 22 bp, Artificial Sequence
  chemically synthesized
aaaaggaagaattagttctggt

SEQ ID NO: 933582 - DNA, 22 bp, Artificial Sequence
  chemically synthesized
tcaggacaccagaactaattct

SEQ ID NO: 933583 - DNA, 22 bp, Artificial Sequence
  chemically synthesized
caggacaccagaactaattctt

SEQ ID NO: 933584 - DNA, 22 bp, Artificial Sequence
  chemically synthesized
aggacaccagaactaattcttc

SEQ ID NO: 933585 - DNA, 22 bp, Artificial Sequence
  chemically synthesized
atgtatgaaagtcacaattaaa

SEQ ID NO: 933586 - DNA, 22 bp, Artificial Sequence
  chemically synthesized
attcttcctttttaattgtgac

SEQ ID NO: 933587 - DNA, 22 bp, Artificial Sequence
  chemically synthesized
ttcctttttaattgtgactttc

SEQ ID NO: 933588 - DNA, 22 bp, Artificial Sequence
  chemically synthesized
cctttttaattgtgactttcat

SEQ ID NO: 933589 - DNA, 22 bp, Artificial Sequence
  chemically synthesized
ctttttaattgtgactttcata

SEQ ID NO: 933590 - DNA, 22 bp, Artificial Sequence
  chemically synthesized
atggagttaatgtatgaaagtc

SEQ ID NO: 933591 - DNA, 22 bp, Artificial Sequence
  chemically synthesized
catggagttaatgtatgaaagt

SEQ ID NO: 933592 - DNA, 22 bp, Artificial Sequence
  chemically synthesized
tcatggagttaatgtatgaaag

SEQ ID NO: 933593 - DNA, 22 bp, Artificial Sequence
  chemically synthesized
tttaattgtgactttcatacat

SEQ ID NO: 933594 - DNA, 22 bp, Artificial Sequence
  chemically synthesized
ttcatggagttaatgtatgaaa

SEQ ID NO: 933595 - DNA, 22 bp, Artificial Sequence
  chemically synthesized
ttaattgtgactttcatacatt

SEQ ID NO: 933596 - DNA, 22 bp, Artificial Sequence
  chemically synthesized
taattgtgactttcatacatta

SEQ ID NO: 933597 - DNA, 22 bp, Artificial Sequence
  chemically synthesized
aattgtgactttcatacattaa

SEQ ID NO: 933598 - DNA, 22 bp, Artificial Sequence
  chemically synthesized
attgtgactttcatacattaac

SEQ ID NO: 933599 - DNA, 22 bp, Artificial Sequence
  chemically synthesized
aatttttcatggagttaatgta

SEQ ID NO: 933600 - DNA, 22 bp, Artificial Sequence
  chemically synthesized
tgactttcatacattaactcca

SEQ ID NO: 933601 - DNA, 22 bp, Artificial Sequence
  chemically synthesized
tcatacattaactccatgaaaa

SEQ ID NO: 933602 - DNA, 22 bp, Artificial Sequence
  chemically synthesized
catacattaactccatgaaaaa

SEQ ID NO: 933603 - DNA, 22 bp, Artificial Sequence
  chemically synthesized
atacattaactccatgaaaaat

SEQ ID NO: 933604 - DNA, 22 bp, Artificial Sequence
  chemically synthesized
gtataaaaggtgacctcaattt

SEQ ID NO: 933605 - DNA, 22 bp, Artificial Sequence
  chemically synthesized
actccatgaaaaattgaggtca

SEQ ID NO: 933606 - DNA, 22 bp, Artificial Sequence
  chemically synthesized
catgaaaaattgaggtcacctt

SEQ ID NO: 933607 - DNA, 22 bp, Artificial Sequence
  chemically synthesized
taaaattggtataaaaggtgac

SEQ ID NO: 933608 - DNA, 22 bp, Artificial Sequence
  chemically synthesized
aaagttataaaattggtataaa

SEQ ID NO: 933609 - DNA, 22 bp, Artificial Sequence
  chemically synthesized
caaagttataaaattggtataa

SEQ ID NO: 933610 - DNA, 22 bp, Artificial Sequence
  chemically synthesized
aggtcaccttttataccaattt

SEQ ID NO: 933611 - DNA, 22 bp, Artificial Sequence
  chemically synthesized
ttcaaagttataaaattggtat

SEQ ID NO: 933612 - DNA, 22 bp, Artificial Sequence
  chemically synthesized
ctcttcaaagttataaaattgg

SEQ ID NO: 933613 - DNA, 22 bp, Artificial Sequence
  chemically synthesized
gttactcttcaaagttataaaa

SEQ ID NO: 933614 - DNA, 22 bp, Artificial Sequence
  chemically synthesized
ttataccaattttataactttg

SEQ ID NO: 933615 - DNA, 22 bp, Artificial Sequence
  chemically synthesized
tataccaattttataactttga

SEQ ID NO: 933616 - DNA, 22 bp, Artificial Sequence
  chemically synthesized
ataccaattttataactttgaa

SEQ ID NO: 933617 - DNA, 22 bp, Artificial Sequence
  chemically synthesized
taccaattttataactttgaag

SEQ ID NO: 933618 - DNA, 22 bp, Artificial Sequence
  chemically synthesized
aatatcactggttactcttcaa

SEQ ID NO: 933619 - DNA, 22 bp, Artificial Sequence
  chemically synthesized
taaatatcactggttactcttc

SEQ ID NO: 933620 - DNA, 22 bp, Artificial Sequence
  chemically synthesized
tctaaatatcactggttactct

SEQ ID NO: 933621 - DNA, 22 bp, Artificial Sequence
  chemically synthesized
tataactttgaagagtaaccag

SEQ ID NO: 933622 - DNA, 22 bp, Artificial Sequence
  chemically synthesized
ctctaaatatcactggttactc

SEQ ID NO: 933623 - DNA, 22 bp, Artificial Sequence
  chemically synthesized
ataactttgaagagtaaccagt

SEQ ID NO: 933624 - DNA, 22 bp, Artificial Sequence
  chemically synthesized
taactttgaagagtaaccagtg

SEQ ID NO: 933625 - DNA, 22 bp, Artificial Sequence
  chemically synthesized
tgaagagtaaccagtgatattt

SEQ ID NO: 933626 - DNA, 22 bp, Artificial Sequence
  chemically synthesized
gaagagtaaccagtgatattta

SEQ ID NO: 933627 - DNA, 22 bp, Artificial Sequence
  chemically synthesized
atataatttctctaaatatcac

SEQ ID NO: 933628 - DNA, 22 bp, Artificial Sequence
  chemically synthesized
aagagtaaccagtgatatttag

SEQ ID NO: 933629 - DNA, 22 bp, Artificial Sequence
  chemically synthesized
agagaaattatattagggcact

SEQ ID NO: 933630 - DNA, 22 bp, Artificial Sequence
  chemically synthesized
gagaaattatattagggcactc

SEQ ID NO: 933631 - DNA, 22 bp, Artificial Sequence
  chemically synthesized
tattagggcactctcacactca

SEQ ID NO: 933632 - DNA, 22 bp, Artificial Sequence
  chemically synthesized
gggcactctcacactcacgttc

SEQ ID NO: 933633 - DNA, 22 bp, Artificial Sequence
  chemically synthesized
tcacactcacgttcttgtgctc

SEQ ID NO: 933634 - DNA, 22 bp, Artificial Sequence
  chemically synthesized
acactcacgttcttgtgctctc

SEQ ID NO: 933635 - DNA, 22 bp, Artificial Sequence
  chemically synthesized
acgttcttgtgctctcatttct

SEQ ID NO: 933636 - DNA, 22 bp, Artificial Sequence
  chemically synthesized
ttgtgctctcatttctctctct

SEQ ID NO: 933637 - DNA, 22 bp, Artificial Sequence
  chemically synthesized
gtgctctcatttctctctctgt

SEQ ID NO: 933638 - DNA, 22 bp, Artificial Sequence
  chemically synthesized
tgctctcatttctctctctgtc

SEQ ID NO: 933639 - DNA, 22 bp, Artificial Sequence
  chemically synthesized
tcatttctctctctgtctctct

SEQ ID NO: 933640 - DNA, 22 bp, Artificial Sequence
  chemically synthesized
gagagagagagagagagagaca

SEQ ID NO: 933641 - DNA, 22 bp, Artificial Sequence
  chemically synthesized
atttctctctctgtctctctct

SEQ ID NO: 933642 - DNA, 22 bp, Artificial Sequence
  chemically synthesized
cgagagagagagagagagagac

SEQ ID NO: 933643 - DNA, 22 bp, Artificial Sequence
  chemically synthesized
ctctctctgtctctctctctct

SEQ ID NO: 933644 - DNA, 22 bp, Artificial Sequence
  chemically synthesized
gtttcgagagagagagagagag

SEQ ID NO: 933645 - DNA, 22 bp, Artificial Sequence
  chemically synthesized
tctctctgtctctctctctctc

SEQ ID NO: 933646 - DNA, 22 bp, Artificial Sequence
  chemically synthesized
tggtttcgagagagagagagag

SEQ ID NO: 933647 - DNA, 22 bp, Artificial Sequence
  chemically synthesized
tctctgtctctctctctctctc

SEQ ID NO: 933648 - DNA, 22 bp, Artificial Sequence
  chemically synthesized
tctggtttcgagagagagagag

SEQ ID NO: 933649 - DNA, 22 bp, Artificial Sequence
  chemically synthesized
tctgtctctctctctctctctc

SEQ ID NO: 933650 - DNA, 22 bp, Artificial Sequence
  chemically synthesized
tgtctctctctctctctctctc

SEQ ID NO: 933651 - DNA, 22 bp, Artificial Sequence
  chemically synthesized
cctctctggtttcgagagagag

SEQ ID NO: 933652 - DNA, 22 bp, Artificial Sequence
  chemically synthesized
tctctctctctctctctctcga

SEQ ID NO: 933653 - DNA, 22 bp, Artificial Sequence
  chemically synthesized
tccctctctggtttcgagagag

SEQ ID NO: 933654 - DNA, 22 bp, Artificial Sequence
  chemically synthesized
tctctctctctctctcgaaacc

SEQ ID NO: 933655 - DNA, 22 bp, Artificial Sequence
  chemically synthesized
tctctctctctctcgaaaccag

SEQ ID NO: 933656 - DNA, 22 bp, Artificial Sequence
  chemically synthesized
tctctctctctcgaaaccagag

SEQ ID NO: 933657 - DNA, 22 bp, Artificial Sequence
  chemically synthesized
tctctctctcgaaaccagagag

SEQ ID NO: 933658 - DNA, 22 bp, Artificial Sequence
  chemically synthesized
tctctctcgaaaccagagaggg

SEQ ID NO: 933659 - DNA, 22 bp, Artificial Sequence
  chemically synthesized
caataagtctctccctctctgg

SEQ ID NO: 933660 - DNA, 22 bp, Artificial Sequence
  chemically synthesized
tctctcgaaaccagagagggag

SEQ ID NO: 933661 - DNA, 22 bp, Artificial Sequence
  chemically synthesized
ttacaataagtctctccctctc

SEQ ID NO: 933662 - DNA, 22 bp, Artificial Sequence
  chemically synthesized
tctcgaaaccagagagggagag

SEQ ID NO: 933663 - DNA, 22 bp, Artificial Sequence
  chemically synthesized
attacaataagtctctccctct

SEQ ID NO: 933664 - DNA, 22 bp, Artificial Sequence
  chemically synthesized
tcgaaaccagagagggagagac

SEQ ID NO: 933665 - DNA, 22 bp, Artificial Sequence
  chemically synthesized
gaaaccagagagggagagactt

SEQ ID NO: 933666 - DNA, 22 bp, Artificial Sequence
  chemically synthesized
gtaatgagccaatttattacaa

SEQ ID NO: 933667 - DNA, 22 bp, Artificial Sequence
  chemically synthesized
cagattcgtaatgagccaattt

SEQ ID NO: 933668 - DNA, 22 bp, Artificial Sequence
  chemically synthesized
tccagattcgtaatgagccaat

SEQ ID NO: 933669 - DNA, 22 bp, Artificial Sequence
  chemically synthesized
ctccagattcgtaatgagccaa

SEQ ID NO: 933670 - DNA, 22 bp, Artificial Sequence
  chemically synthesized
attgtaataaattggctcatta

SEQ ID NO: 933671 - DNA, 22 bp, Artificial Sequence
  chemically synthesized
ttgtaataaattggctcattac

SEQ ID NO: 933672 - DNA, 22 bp, Artificial Sequence
  chemically synthesized
taataaattggctcattacgaa

SEQ ID NO: 933673 - DNA, 22 bp, Artificial Sequence
  chemically synthesized
ggacttctccagattcgtaatg

SEQ ID NO: 933674 - DNA, 22 bp, Artificial Sequence
  chemically synthesized
gggacttctccagattcgtaat

SEQ ID NO: 933675 - DNA, 22 bp, Artificial Sequence
  chemically synthesized
gctcattacgaatctggagaag

SEQ ID NO: 933676 - DNA, 22 bp, Artificial Sequence
  chemically synthesized
taaatcttgggacttctccaga

SEQ ID NO: 933677 - DNA, 22 bp, Artificial Sequence
  chemically synthesized
attacgaatctggagaagtccc

SEQ ID NO: 933678 - DNA, 22 bp, Artificial Sequence
  chemically synthesized
actgtaaatcttgggacttctc

SEQ ID NO: 933679 - DNA, 22 bp, Artificial Sequence
  chemically synthesized
ctgactgtaaatcttgggactt

SEQ ID NO: 933680 - DNA, 22 bp, Artificial Sequence
  chemically synthesized
cgaatctggagaagtcccaaga

SEQ ID NO: 933681 - DNA, 22 bp, Artificial Sequence
  chemically synthesized
gctgactgtaaatcttgggact

SEQ ID NO: 933682 - DNA, 22 bp, Artificial Sequence
  chemically synthesized
cagcttgctgactgtaaatctt

SEQ ID NO: 933683 - DNA, 22 bp, Artificial Sequence
  chemically synthesized
gagaagtcccaagatttacagt

SEQ ID NO: 933684 - DNA, 22 bp, Artificial Sequence
  chemically synthesized
ggtctccagcttgctgactgta

SEQ ID NO: 933685 - DNA, 22 bp, Artificial Sequence
  chemically synthesized
ctgggtctccagcttgctgact

SEQ ID NO: 933686 - DNA, 22 bp, Artificial Sequence
  chemically synthesized
cctgggtctccagcttgctgac

SEQ ID NO: 933687 - DNA, 22 bp, Artificial Sequence
  chemically synthesized
tcctgggtctccagcttgctga

SEQ ID NO: 933688 - DNA, 22 bp, Artificial Sequence
  chemically synthesized
gctttcctgggtctccagcttg

SEQ ID NO: 933689 - DNA, 22 bp, Artificial Sequence
  chemically synthesized
acagtcagcaagctggagaccc

SEQ ID NO: 933690 - DNA, 22 bp, Artificial Sequence
  chemically synthesized
cagtcagcaagctggagaccca

SEQ ID NO: 933691 - DNA, 22 bp, Artificial Sequence
  chemically synthesized
catcattggctttcctgggtct

SEQ ID NO: 933692 - DNA, 22 bp, Artificial Sequence
  chemically synthesized
gagacccaggaaagccaatgat

SEQ ID NO: 933693 - DNA, 22 bp, Artificial Sequence
  chemically synthesized
agacaggaactacatcattggc

SEQ ID NO: 933694 - DNA, 22 bp, Artificial Sequence
  chemically synthesized
gactcagacaggaactacatca

SEQ ID NO: 933695 - DNA, 22 bp, Artificial Sequence
  chemically synthesized
ggactcagacaggaactacatc

SEQ ID NO: 933696 - DNA, 22 bp, Artificial Sequence
  chemically synthesized
tggactcagacaggaactacat

SEQ ID NO: 933697 - DNA, 22 bp, Artificial Sequence
  chemically synthesized
atgcctttggactcagacagga

SEQ ID NO: 933698 - DNA, 22 bp, Artificial Sequence
  chemically synthesized
tcatgcctttggactcagacag

SEQ ID NO: 933699 - DNA, 22 bp, Artificial Sequence
  chemically synthesized
gttctcatgcctttggactcag

SEQ ID NO: 933700 - DNA, 22 bp, Artificial Sequence
  chemically synthesized
ggttctcatgcctttggactca

SEQ ID NO: 933701 - DNA, 22 bp, Artificial Sequence
  chemically synthesized
ttggttctcatgcctttggact

SEQ ID NO: 933702 - DNA, 22 bp, Artificial Sequence
  chemically synthesized
cttggttctcatgcctttggac

SEQ ID NO: 933703 - DNA, 22 bp, Artificial Sequence
  chemically synthesized
tcttggttctcatgcctttgga

SEQ ID NO: 933704 - DNA, 22 bp, Artificial Sequence
  chemically synthesized
ctgtctgagtccaaaggcatga

SEQ ID NO: 933705 - DNA, 22 bp, Artificial Sequence
  chemically synthesized
gctttcttggttctcatgcctt

SEQ ID NO: 933706 - DNA, 22 bp, Artificial Sequence
  chemically synthesized
tctgagtccaaaggcatgagaa

SEQ ID NO: 933707 - DNA, 22 bp, Artificial Sequence
  chemically synthesized
agtccaaaggcatgagaaccaa

SEQ ID NO: 933708 - DNA, 22 bp, Artificial Sequence
  chemically synthesized
acgtcattggctttcttggttc

SEQ ID NO: 933709 - DNA, 22 bp, Artificial Sequence
  chemically synthesized
aacgtcattggctttcttggtt

SEQ ID NO: 933710 - DNA, 22 bp, Artificial Sequence
  chemically synthesized
gaacttaacgtcattggctttc

SEQ ID NO: 933711 - DNA, 22 bp, Artificial Sequence
  chemically synthesized
gggctggaacttaacgtcattg

SEQ ID NO: 933712 - DNA, 22 bp, Artificial Sequence
  chemically synthesized
tggggctggaacttaacgtcat

SEQ ID NO: 933713 - DNA, 22 bp, Artificial Sequence
  chemically synthesized
cagttctggggctggaacttaa

SEQ ID NO: 933714 - DNA, 22 bp, Artificial Sequence
  chemically synthesized
agcctccagttctggggctgga

SEQ ID NO: 933715 - DNA, 22 bp, Artificial Sequence
  chemically synthesized
aagcctccagttctggggctgg

SEQ ID NO: 933716 - DNA, 22 bp, Artificial Sequence
  chemically synthesized
agtcttaagcctccagttctgg

SEQ ID NO: 933717 - DNA, 22 bp, Artificial Sequence
  chemically synthesized
gagtcttaagcctccagttctg

SEQ ID NO: 933718 - DNA, 22 bp, Artificial Sequence
  chemically synthesized
agttccagccccagaactggag

SEQ ID NO: 933719 - DNA, 22 bp, Artificial Sequence
  chemically synthesized
ttgagtcttaagcctccagttc

SEQ ID NO: 933720 - DNA, 22 bp, Artificial Sequence
  chemically synthesized
cttgagtcttaagcctccagtt

SEQ ID NO: 933721 - DNA, 22 bp, Artificial Sequence
  chemically synthesized
cagccccagaactggaggctta

SEQ ID NO: 933722 - DNA, 22 bp, Artificial Sequence
  chemically synthesized
ggtcttcttgagtcttaagcct

SEQ ID NO: 933723 - DNA, 22 bp, Artificial Sequence
  chemically synthesized
gggtcttcttgagtcttaagcc

SEQ ID NO: 933724 - DNA, 22 bp, Artificial Sequence
  chemically synthesized
aaaccttgggtcttcttgagtc

SEQ ID NO: 933725 - DNA, 22 bp, Artificial Sequence
  chemically synthesized
gaggcttaagactcaagaagac

SEQ ID NO: 933726 - DNA, 22 bp, Artificial Sequence
  chemically synthesized
aattgaaaccttgggtcttctt

SEQ ID NO: 933727 - DNA, 22 bp, Artificial Sequence
  chemically synthesized
gaattgaaaccttgggtcttct

SEQ ID NO: 933728 - DNA, 22 bp, Artificial Sequence
  chemically synthesized
aagactcaagaagacccaaggt

SEQ ID NO: 933729 - DNA, 22 bp, Artificial Sequence
  chemically synthesized
agactcaagaagacccaaggtt

SEQ ID NO: 933730 - DNA, 22 bp, Artificial Sequence
  chemically synthesized
agcttgaattgaaaccttgggt

SEQ ID NO: 933731 - DNA, 22 bp, Artificial Sequence
  chemically synthesized
gagcttgaattgaaaccttggg

SEQ ID NO: 933732 - DNA, 22 bp, Artificial Sequence
  chemically synthesized
tgagcttgaattgaaaccttgg

SEQ ID NO: 933733 - DNA, 22 bp, Artificial Sequence
  chemically synthesized
aagaagacccaaggtttcaatt

SEQ ID NO: 933734 - DNA, 22 bp, Artificial Sequence
  chemically synthesized
cctttgagcttgaattgaaacc

SEQ ID NO: 933735 - DNA, 22 bp, Artificial Sequence
  chemically synthesized
ctgcctttgagcttgaattgaa

SEQ ID NO: 933736 - DNA, 22 bp, Artificial Sequence
  chemically synthesized
cctgcctttgagcttgaattga

SEQ ID NO: 933737 - DNA, 22 bp, Artificial Sequence
  chemically synthesized
tcctgcctttgagcttgaattg

SEQ ID NO: 933738 - DNA, 22 bp, Artificial Sequence
  chemically synthesized
ttcctgcctttgagcttgaatt

SEQ ID NO: 933739 - DNA, 22 bp, Artificial Sequence
  chemically synthesized
caattcaagctcaaaggcagga

SEQ ID NO: 933740 - DNA, 22 bp, Artificial Sequence
  chemically synthesized
aattcaagctcaaaggcaggaa

SEQ ID NO: 933741 - DNA, 22 bp, Artificial Sequence
  chemically synthesized
gaacacccatcttttcctgcct

SEQ ID NO: 933742 - DNA, 22 bp, Artificial Sequence
  chemically synthesized
aagctcaaaggcaggaaaagat

SEQ ID NO: 933743 - DNA, 22 bp, Artificial Sequence
  chemically synthesized
aagctggaacacccatcttttc

SEQ ID NO: 933744 - DNA, 22 bp, Artificial Sequence
  chemically synthesized
aaaggcaggaaaagatgggtgt

SEQ ID NO: 933745 - DNA, 22 bp, Artificial Sequence
  chemically synthesized
atagctaaagctggaacaccca

SEQ ID NO: 933746 - DNA, 22 bp, Artificial Sequence
  chemically synthesized
cctgatagctaaagctggaaca

SEQ ID NO: 933747 - DNA, 22 bp, Artificial Sequence
  chemically synthesized
ctgcctgatagctaaagctgga

SEQ ID NO: 933748 - DNA, 22 bp, Artificial Sequence
  chemically synthesized
aaaggaactcctgcctgatagc

SEQ ID NO: 933749 - DNA, 22 bp, Artificial Sequence
  chemically synthesized
cagctttagctatcaggcagga

SEQ ID NO: 933750 - DNA, 22 bp, Artificial Sequence
  chemically synthesized
attaaaaggaactcctgcctga

SEQ ID NO: 933751 - DNA, 22 bp, Artificial Sequence
  chemically synthesized
tagctatcaggcaggagttcct

SEQ ID NO: 933752 - DNA, 22 bp, Artificial Sequence
  chemically synthesized
agctatcaggcaggagttcctt

SEQ ID NO: 933753 - DNA, 22 bp, Artificial Sequence
  chemically synthesized
gctatcaggcaggagttccttt

SEQ ID NO: 933754 - DNA, 22 bp, Artificial Sequence
  chemically synthesized
tcaggcaggagttccttttaat

SEQ ID NO: 933755 - DNA, 22 bp, Artificial Sequence
  chemically synthesized
atcaaaaagcctgattaaaagg

SEQ ID NO: 933756 - DNA, 22 bp, Artificial Sequence
  chemically synthesized
aagacctaatcaaaaagcctga

SEQ ID NO: 933757 - DNA, 22 bp, Artificial Sequence
  chemically synthesized
cttttaatcaggctttttgatt

SEQ ID NO: 933758 - DNA, 22 bp, Artificial Sequence
  chemically synthesized
ttaatcaggctttttgattagg

SEQ ID NO: 933759 - DNA, 22 bp, Artificial Sequence
  chemically synthesized
taatcaggctttttgattaggt

SEQ ID NO: 933760 - DNA, 22 bp, Artificial Sequence
  chemically synthesized
aatcaggctttttgattaggtc

SEQ ID NO: 933761 - DNA, 22 bp, Artificial Sequence
  chemically synthesized
atcaggctttttgattaggtct

SEQ ID NO: 933762 - DNA, 22 bp, Artificial Sequence
  chemically synthesized
agtccaatcgattgaagaccta

SEQ ID NO: 933763 - DNA, 22 bp, Artificial Sequence
  chemically synthesized
tttgattaggtcttcaatcgat

SEQ ID NO: 933764 - DNA, 22 bp, Artificial Sequence
  chemically synthesized
ttgattaggtcttcaatcgatt

SEQ ID NO: 933765 - DNA, 22 bp, Artificial Sequence
  chemically synthesized
tgattaggtcttcaatcgattg

SEQ ID NO: 933766 - DNA, 22 bp, Artificial Sequence
  chemically synthesized
aggacctaagtccaatcgattg

SEQ ID NO: 933767 - DNA, 22 bp, Artificial Sequence
  chemically synthesized
gattaggtcttcaatcgattgg

SEQ ID NO: 933768 - DNA, 22 bp, Artificial Sequence
  chemically synthesized
attaggtcttcaatcgattgga

SEQ ID NO: 933769 - DNA, 22 bp, Artificial Sequence
  chemically synthesized
ggtcttcaatcgattggactta

SEQ ID NO: 933770 - DNA, 22 bp, Artificial Sequence
  chemically synthesized
caatcgattggacttaggtcct

SEQ ID NO: 933771 - DNA, 22 bp, Artificial Sequence
  chemically synthesized
aatcgattggacttaggtcctc

SEQ ID NO: 933772 - DNA, 22 bp, Artificial Sequence
  chemically synthesized
atccaatcaattgaggacctaa

SEQ ID NO: 933773 - DNA, 22 bp, Artificial Sequence
  chemically synthesized
gacttaggtcctcaattgattg

SEQ ID NO: 933774 - DNA, 22 bp, Artificial Sequence
  chemically synthesized
aggtcctcaattgattggatca

SEQ ID NO: 933775 - DNA, 22 bp, Artificial Sequence
  chemically synthesized
tgtgggtgggtctgatccaatc

SEQ ID NO: 933776 - DNA, 22 bp, Artificial Sequence
  chemically synthesized
ggtcctcaattgattggatcag

SEQ ID NO: 933777 - DNA, 22 bp, Artificial Sequence
  chemically synthesized
gtgtgggtgggtctgatccaat

SEQ ID NO: 933778 - DNA, 22 bp, Artificial Sequence
  chemically synthesized
ccttgtgtgggtgggtctgatc

SEQ ID NO: 933779 - DNA, 22 bp, Artificial Sequence
  chemically synthesized
tcccttgtgtgggtgggtctga

SEQ ID NO: 933780 - DNA, 22 bp, Artificial Sequence
  chemically synthesized
aattgattggatcagacccacc

SEQ ID NO: 933781 - DNA, 22 bp, Artificial Sequence
  chemically synthesized
ttctcccttgtgtgggtgggtc

SEQ ID NO: 933782 - DNA, 22 bp, Artificial Sequence
  chemically synthesized
attggatcagacccacccacac

SEQ ID NO: 933783 - DNA, 22 bp, Artificial Sequence
  chemically synthesized
gatcagacccacccacacaagg

SEQ ID NO: 933784 - DNA, 22 bp, Artificial Sequence
  chemically synthesized
aatcagtagagggagcaaagcc

SEQ ID NO: 933785 - DNA, 22 bp, Artificial Sequence
  chemically synthesized
gaatcagtagagggagcaaagc

SEQ ID NO: 933786 - DNA, 22 bp, Artificial Sequence
  chemically synthesized
acatttgaatcagtagagggag

SEQ ID NO: 933787 - DNA, 22 bp, Artificial Sequence
  chemically synthesized
gagagattcacatttgaatcag

SEQ ID NO: 933788 - DNA, 22 bp, Artificial Sequence
  chemically synthesized
tgctccctctactgattcaaat

SEQ ID NO: 933789 - DNA, 22 bp, Artificial Sequence
  chemically synthesized
gctccctctactgattcaaatg

SEQ ID NO: 933790 - DNA, 22 bp, Artificial Sequence
  chemically synthesized
tggagagattcacatttgaatc

SEQ ID NO: 933791 - DNA, 22 bp, Artificial Sequence
  chemically synthesized
ctccctctactgattcaaatgt

SEQ ID NO: 933792 - DNA, 22 bp, Artificial Sequence
  chemically synthesized
ctggagagattcacatttgaat

SEQ ID NO: 933793 - DNA, 22 bp, Artificial Sequence
  chemically synthesized
cctctactgattcaaatgtgaa

SEQ ID NO: 933794 - DNA, 22 bp, Artificial Sequence
  chemically synthesized
tttctggagagattcacatttg

SEQ ID NO: 933795 - DNA, 22 bp, Artificial Sequence
  chemically synthesized
tactgattcaaatgtgaatctc

SEQ ID NO: 933796 - DNA, 22 bp, Artificial Sequence
  chemically synthesized
ctgattcaaatgtgaatctctc

SEQ ID NO: 933797 - DNA, 22 bp, Artificial Sequence
  chemically synthesized
tgaggctgtttctggagagatt

SEQ ID NO: 933798 - DNA, 22 bp, Artificial Sequence
  chemically synthesized
attcaaatgtgaatctctccag

SEQ ID NO: 933799 - DNA, 22 bp, Artificial Sequence
  chemically synthesized
atgaggctgtttctggagagat

SEQ ID NO: 933800 - DNA, 22 bp, Artificial Sequence
  chemically synthesized
aaatgtgaatctctccagaaac

SEQ ID NO: 933801 - DNA, 22 bp, Artificial Sequence
  chemically synthesized
ggtgtgtttatgaggctgtttc

SEQ ID NO: 933802 - DNA, 22 bp, Artificial Sequence
  chemically synthesized
tgggtgtgtttatgaggctgtt

SEQ ID NO: 933803 - DNA, 22 bp, Artificial Sequence
  chemically synthesized
ttctgggtgtgtttatgaggct

SEQ ID NO: 933804 - DNA, 22 bp, Artificial Sequence
  chemically synthesized
tccagaaacagcctcataaaca

SEQ ID NO: 933805 - DNA, 22 bp, Artificial Sequence
  chemically synthesized
cagaaacagcctcataaacaca

SEQ ID NO: 933806 - DNA, 22 bp, Artificial Sequence
  chemically synthesized
gtcaaacattattctgggtgtg

SEQ ID NO: 933807 - DNA, 22 bp, Artificial Sequence
  chemically synthesized
ggtcaaacattattctgggtgt

SEQ ID NO: 933808 - DNA, 22 bp, Artificial Sequence
  chemically synthesized
ataaacacacccagaataatgt

SEQ ID NO: 933809 - DNA, 22 bp, Artificial Sequence
  chemically synthesized
ggccgcagggtaccgagacatt

SEQ ID NO: 933810 - DNA, 22 bp, Artificial Sequence
  chemically synthesized
gctgggccgcagggtaccgaga

SEQ ID NO: 933811 - DNA, 22 bp, Artificial Sequence
  chemically synthesized
ggctgggccgcagggtaccgag

SEQ ID NO: 933812 - DNA, 22 bp, Artificial Sequence
  chemically synthesized
gaccaaatgtctcggtaccctg

SEQ ID NO: 933813 - DNA, 22 bp, Artificial Sequence
  chemically synthesized
accaaatgtctcggtaccctgc

SEQ ID NO: 933814 - DNA, 22 bp, Artificial Sequence
  chemically synthesized
atgtgtcaacttggctgggccg

SEQ ID NO: 933815 - DNA, 22 bp, Artificial Sequence
  chemically synthesized
catgtgtcaacttggctgggcc

SEQ ID NO: 933816 - DNA, 22 bp, Artificial Sequence
  chemically synthesized
ggtaccctgcggcccagccaag

SEQ ID NO: 933817 - DNA, 22 bp, Artificial Sequence
  chemically synthesized
atttcatgtgtcaacttggctg

SEQ ID NO: 933818 - DNA, 22 bp, Artificial Sequence
  chemically synthesized
cggcccagccaagttgacacat

SEQ ID NO: 933819 - DNA, 22 bp, Artificial Sequence
  chemically synthesized
tgatggttaatttcatgtgtca

SEQ ID NO: 933820 - DNA, 22 bp, Artificial Sequence
  chemically synthesized
tgtgatggttaatttcatgtgt

SEQ ID NO: 933821 - DNA, 22 bp, Artificial Sequence
  chemically synthesized
ctgtgatggttaatttcatgtg

SEQ ID NO: 933822 - DNA, 22 bp, Artificial Sequence
  chemically synthesized
atttctgtgatggttaatttca

SEQ ID NO: 933823 - DNA, 22 bp, Artificial Sequence
  chemically synthesized
aatttctgtgatggttaatttc

SEQ ID NO: 933824 - DNA, 22 bp, Artificial Sequence
  chemically synthesized
cttaatttctgtgatggttaat

SEQ ID NO: 933825 - DNA, 22 bp, Artificial Sequence
  chemically synthesized
acacatgaaattaaccatcaca

SEQ ID NO: 933826 - DNA, 22 bp, Artificial Sequence
  chemically synthesized
aacaaattacttaatttctgtg

SEQ ID NO: 933827 - DNA, 22 bp, Artificial Sequence
  chemically synthesized
caacaaattacttaatttctgt

SEQ ID NO: 933828 - DNA, 22 bp, Artificial Sequence
  chemically synthesized
acttcaacaaattacttaattt

SEQ ID NO: 933829 - DNA, 22 bp, Artificial Sequence
  chemically synthesized
aacttcaacaaattacttaatt

SEQ ID NO: 933830 - DNA, 22 bp, Artificial Sequence
  chemically synthesized
accatcacagaaattaagtaat

SEQ ID NO: 933831 - DNA, 22 bp, Artificial Sequence
  chemically synthesized
tcaatttaacttcaacaaatta

SEQ ID NO: 933832 - DNA, 22 bp, Artificial Sequence
  chemically synthesized
aagtctatcaatttaacttcaa

SEQ ID NO: 933833 - DNA, 22 bp, Artificial Sequence
  chemically synthesized
agtaatttgttgaagttaaatt

SEQ ID NO: 933834 - DNA, 22 bp, Artificial Sequence
  chemically synthesized
aaaatctcaagtctatcaattt

SEQ ID NO: 933835 - DNA, 22 bp, Artificial Sequence
  chemically synthesized
gttgaagttaaattgatagact

SEQ ID NO: 933836 - DNA, 22 bp, Artificial Sequence
  chemically synthesized
ttaaaaatctcaagtctatcaa

SEQ ID NO: 933837 - DNA, 22 bp, Artificial Sequence
  chemically synthesized
ttgaagttaaattgatagactt

SEQ ID NO: 933838 - DNA, 22 bp, Artificial Sequence
  chemically synthesized
ttattaaaaatctcaagtctat

SEQ ID NO: 933839 - DNA, 22 bp, Artificial Sequence
  chemically synthesized
aagttaaattgatagacttgag

SEQ ID NO: 933840 - DNA, 22 bp, Artificial Sequence
  chemically synthesized
aattgatagacttgagattttt

SEQ ID NO: 933841 - DNA, 22 bp, Artificial Sequence
  chemically synthesized
gaaccgattgttattaaaaatc

SEQ ID NO: 933842 - DNA, 22 bp, Artificial Sequence
  chemically synthesized
ggaaccgattgttattaaaaat

SEQ ID NO: 933843 - DNA, 22 bp, Artificial Sequence
  chemically synthesized
atagacttgagatttttaataa

SEQ ID NO: 933844 - DNA, 22 bp, Artificial Sequence
  chemically synthesized
gaatttggaaccgattgttatt

SEQ ID NO: 933845 - DNA, 22 bp, Artificial Sequence
  chemically synthesized
gagatttttaataacaatcggt

SEQ ID NO: 933846 - DNA, 22 bp, Artificial Sequence
  chemically synthesized
agatttttaataacaatcggtt

SEQ ID NO: 933847 - DNA, 22 bp, Artificial Sequence
  chemically synthesized
ttaataacaatcggttccaaat

SEQ ID NO: 933848 - DNA, 22 bp, Artificial Sequence
  chemically synthesized
taataacaatcggttccaaatt

SEQ ID NO: 933849 - DNA, 22 bp, Artificial Sequence
  chemically synthesized
aataacaatcggttccaaattc

SEQ ID NO: 933850 - DNA, 22 bp, Artificial Sequence
  chemically synthesized
ataacaatcggttccaaattct

SEQ ID NO: 933851 - DNA, 22 bp, Artificial Sequence
  chemically synthesized
caaattctagcctgatgtgttt

SEQ ID NO: 933852 - DNA, 22 bp, Artificial Sequence
  chemically synthesized
atataataaaaggaaaaaacac

SEQ ID NO: 933853 - DNA, 22 bp, Artificial Sequence
  chemically synthesized
aatataataaaaggaaaaaaca

SEQ ID NO: 933854 - DNA, 22 bp, Artificial Sequence
  chemically synthesized
tagcctgatgtgttttttcctt

SEQ ID NO: 933855 - DNA, 22 bp, Artificial Sequence
  chemically synthesized
gcctgatgtgttttttcctttt

SEQ ID NO: 933856 - DNA, 22 bp, Artificial Sequence
  chemically synthesized
atgtgttttttccttttattat

SEQ ID NO: 933857 - DNA, 22 bp, Artificial Sequence
  chemically synthesized
caataaatttaatataataaaa

SEQ ID NO: 933858 - DNA, 22 bp, Artificial Sequence
  chemically synthesized
gcaataaatttaatataataaa

SEQ ID NO: 933859 - DNA, 22 bp, Artificial Sequence
  chemically synthesized
tgcaataaatttaatataataa

SEQ ID NO: 933860 - DNA, 22 bp, Artificial Sequence
  chemically synthesized
tttccttttattatattaaatt

SEQ ID NO: 933861 - DNA, 22 bp, Artificial Sequence
  chemically synthesized
ttccttttattatattaaattt

SEQ ID NO: 933862 - DNA, 22 bp, Artificial Sequence
  chemically synthesized
tccttttattatattaaattta

SEQ ID NO: 933863 - DNA, 22 bp, Artificial Sequence
  chemically synthesized
ccttttattatattaaatttat

SEQ ID NO: 933864 - DNA, 22 bp, Artificial Sequence
  chemically synthesized
cttttattatattaaatttatt

SEQ ID NO: 933865 - DNA, 22 bp, Artificial Sequence
  chemically synthesized
agaacattttgcaataaattta

SEQ ID NO: 933866 - DNA, 22 bp, Artificial Sequence
  chemically synthesized
aagaacattttgcaataaattt

SEQ ID NO: 933867 - DNA, 22 bp, Artificial Sequence
  chemically synthesized
taagaacattttgcaataaatt

SEQ ID NO: 933868 - DNA, 22 bp, Artificial Sequence
  chemically synthesized
ttattatattaaatttattgca

SEQ ID NO: 933869 - DNA, 22 bp, Artificial Sequence
  chemically synthesized
tattatattaaatttattgcaa

SEQ ID NO: 933870 - DNA, 22 bp, Artificial Sequence
  chemically synthesized
attatattaaatttattgcaaa

SEQ ID NO: 933871 - DNA, 22 bp, Artificial Sequence
  chemically synthesized
ctttaagaacattttgcaataa

SEQ ID NO: 933872 - DNA, 22 bp, Artificial Sequence
  chemically synthesized
ttatattaaatttattgcaaaa

SEQ ID NO: 933873 - DNA, 22 bp, Artificial Sequence
  chemically synthesized
gctttaagaacattttgcaata

SEQ ID NO: 933874 - DNA, 22 bp, Artificial Sequence
  chemically synthesized
tattaaatttattgcaaaatgt

SEQ ID NO: 933875 - DNA, 22 bp, Artificial Sequence
  chemically synthesized
caaatttgctttaagaacattt

SEQ ID NO: 933876 - DNA, 22 bp, Artificial Sequence
  chemically synthesized
aatttattgcaaaatgttctta

SEQ ID NO: 933877 - DNA, 22 bp, Artificial Sequence
  chemically synthesized
ccaaatttgctttaagaacatt

SEQ ID NO: 933878 - DNA, 22 bp, Artificial Sequence
  chemically synthesized
tccaaatttgctttaagaacat

SEQ ID NO: 933879 - DNA, 22 bp, Artificial Sequence
  chemically synthesized
ttccaaatttgctttaagaaca

SEQ ID NO: 933880 - DNA, 22 bp, Artificial Sequence
  chemically synthesized
attgcaaaatgttcttaaagca

SEQ ID NO: 933881 - DNA, 22 bp, Artificial Sequence
  chemically synthesized
ttgcaaaatgttcttaaagcaa

SEQ ID NO: 933882 - DNA, 22 bp, Artificial Sequence
  chemically synthesized
gccttttccaaatttgctttaa

SEQ ID NO: 933883 - DNA, 22 bp, Artificial Sequence
  chemically synthesized
caaaatgttcttaaagcaaatt

SEQ ID NO: 933884 - DNA, 22 bp, Artificial Sequence
  chemically synthesized
aagaaatctagccttttccaaa

SEQ ID NO: 933885 - DNA, 22 bp, Artificial Sequence
  chemically synthesized
ttaaagcaaatttggaaaaggc

SEQ ID NO: 933886 - DNA, 22 bp, Artificial Sequence
  chemically synthesized
aaagcaaatttggaaaaggcta

SEQ ID NO: 933887 - DNA, 22 bp, Artificial Sequence
  chemically synthesized
aagcaaatttggaaaaggctag

SEQ ID NO: 933888 - DNA, 22 bp, Artificial Sequence
  chemically synthesized
acctgaagaaatctagcctttt

SEQ ID NO: 933889 - DNA, 22 bp, Artificial Sequence
  chemically synthesized
tgacctgaagaaatctagcctt

SEQ ID NO: 933890 - DNA, 22 bp, Artificial Sequence
  chemically synthesized
ctgacctgaagaaatctagcct

SEQ ID NO: 933891 - DNA, 22 bp, Artificial Sequence
  chemically synthesized
ggaaaaggctagatttcttcag

SEQ ID NO: 933892 - DNA, 22 bp, Artificial Sequence
  chemically synthesized
gaaaaggctagatttcttcagg

SEQ ID NO: 933893 - DNA, 22 bp, Artificial Sequence
  chemically synthesized
aatacggcagaatttctgacct

SEQ ID NO: 933894 - DNA, 22 bp, Artificial Sequence
  chemically synthesized
gatttcttcaggtcagaaattc

SEQ ID NO: 933895 - DNA, 22 bp, Artificial Sequence
  chemically synthesized
cttcaggtcagaaattctgccg

SEQ ID NO: 933896 - DNA, 22 bp, Artificial Sequence
  chemically synthesized
atgcattgaatacggcagaatt

SEQ ID NO: 933897 - DNA, 22 bp, Artificial Sequence
  chemically synthesized
ttcaggtcagaaattctgccgt

SEQ ID NO: 933898 - DNA, 22 bp, Artificial Sequence
  chemically synthesized
catgcattgaatacggcagaat

SEQ ID NO: 933899 - DNA, 22 bp, Artificial Sequence
  chemically synthesized
caggtcagaaattctgccgtat

SEQ ID NO: 933900 - DNA, 22 bp, Artificial Sequence
  chemically synthesized
ttcatgcattgaatacggcaga

SEQ ID NO: 933901 - DNA, 22 bp, Artificial Sequence
  chemically synthesized
aggtcagaaattctgccgtatt

SEQ ID NO: 933902 - DNA, 22 bp, Artificial Sequence
  chemically synthesized
cttcatgcattgaatacggcag

SEQ ID NO: 933903 - DNA, 22 bp, Artificial Sequence
  chemically synthesized
tcttcatgcattgaatacggca

SEQ ID NO: 933904 - DNA, 22 bp, Artificial Sequence
  chemically synthesized
agctttcttcatgcattgaata

SEQ ID NO: 933905 - DNA, 22 bp, Artificial Sequence
  chemically synthesized
gagctttcttcatgcattgaat

SEQ ID NO: 933906 - DNA, 22 bp, Artificial Sequence
  chemically synthesized
atttgagctttcttcatgcatt

SEQ ID NO: 933907 - DNA, 22 bp, Artificial Sequence
  chemically synthesized
tgccgtattcaatgcatgaaga

SEQ ID NO: 933908 - DNA, 22 bp, Artificial Sequence
  chemically synthesized
ccgtattcaatgcatgaagaaa

SEQ ID NO: 933909 - DNA, 22 bp, Artificial Sequence
  chemically synthesized
aatgcatgaagaaagctcaaat

SEQ ID NO: 933910 - DNA, 22 bp, Artificial Sequence
  chemically synthesized
tcaaatagattcatttgagctt

SEQ ID NO: 933911 - DNA, 22 bp, Artificial Sequence
  chemically synthesized
caggtctgtcaaatagattcat

SEQ ID NO: 933912 - DNA, 22 bp, Artificial Sequence
  chemically synthesized
ctccaggtctgtcaaatagatt

SEQ ID NO: 933913 - DNA, 22 bp, Artificial Sequence
  chemically synthesized
aaatgaatctatttgacagacc

SEQ ID NO: 933914 - DNA, 22 bp, Artificial Sequence
  chemically synthesized
tttgacagacctggagcagtta

SEQ ID NO: 933915 - DNA, 22 bp, Artificial Sequence
  chemically synthesized
gcatcagacaaaataactgctc

SEQ ID NO: 933916 - DNA, 22 bp, Artificial Sequence
  chemically synthesized
agcatcagacaaaataactgct

SEQ ID NO: 933917 - DNA, 22 bp, Artificial Sequence
  chemically synthesized
gacagacctggagcagttattt

SEQ ID NO: 933918 - DNA, 22 bp, Artificial Sequence
  chemically synthesized
acagacctggagcagttatttt

SEQ ID NO: 933919 - DNA, 22 bp, Artificial Sequence
  chemically synthesized
gagcagttattttgtctgatgc

SEQ ID NO: 933920 - DNA, 22 bp, Artificial Sequence
  chemically synthesized
taaatcaaaaccttagcatcag

SEQ ID NO: 933921 - DNA, 22 bp, Artificial Sequence
  chemically synthesized
gtaaatcaaaaccttagcatca

SEQ ID NO: 933922 - DNA, 22 bp, Artificial Sequence
  chemically synthesized
ttttgtctgatgctaaggtttt

SEQ ID NO: 933923 - DNA, 22 bp, Artificial Sequence
  chemically synthesized
cgcttgtaaatcaaaaccttag

SEQ ID NO: 933924 - DNA, 22 bp, Artificial Sequence
  chemically synthesized
gcgcttgtaaatcaaaacctta

SEQ ID NO: 933925 - DNA, 22 bp, Artificial Sequence
  chemically synthesized
tgtctgatgctaaggttttgat

SEQ ID NO: 933926 - DNA, 22 bp, Artificial Sequence
  chemically synthesized
ttgcgcttgtaaatcaaaacct

SEQ ID NO: 933927 - DNA, 22 bp, Artificial Sequence
  chemically synthesized
gtctgatgctaaggttttgatt

SEQ ID NO: 933928 - DNA, 22 bp, Artificial Sequence
  chemically synthesized
cttgcgcttgtaaatcaaaacc

SEQ ID NO: 933929 - DNA, 22 bp, Artificial Sequence
  chemically synthesized
tctgatgctaaggttttgattt

SEQ ID NO: 933930 - DNA, 22 bp, Artificial Sequence
  chemically synthesized
tcttgcgcttgtaaatcaaaac

SEQ ID NO: 933931 - DNA, 22 bp, Artificial Sequence
  chemically synthesized
ttcttgcgcttgtaaatcaaaa

SEQ ID NO: 933932 - DNA, 22 bp, Artificial Sequence
  chemically synthesized
tttcttgcgcttgtaaatcaaa

SEQ ID NO: 933933 - DNA, 22 bp, Artificial Sequence
  chemically synthesized
atgctaaggttttgatttacaa

SEQ ID NO: 933934 - DNA, 22 bp, Artificial Sequence
  chemically synthesized
aggttttgatttacaagcgcaa

SEQ ID NO: 933935 - DNA, 22 bp, Artificial Sequence
  chemically synthesized
tgatttacaagcgcaagaaaaa

SEQ ID NO: 933936 - DNA, 22 bp, Artificial Sequence
  chemically synthesized
gatttacaagcgcaagaaaaaa

SEQ ID NO: 933937 - DNA, 22 bp, Artificial Sequence
  chemically synthesized
atttacaagcgcaagaaaaaat

SEQ ID NO: 933938 - DNA, 22 bp, Artificial Sequence
  chemically synthesized
acaagcgcaagaaaaaattgtc

SEQ ID NO: 933939 - DNA, 22 bp, Artificial Sequence
  chemically synthesized
caagcgcaagaaaaaattgtct

SEQ ID NO: 933940 - DNA, 22 bp, Artificial Sequence
  chemically synthesized
ccacaatcagaaagcacaaaga

SEQ ID NO: 933941 - DNA, 22 bp, Artificial Sequence
  chemically synthesized
gctgccacaatcagaaagcaca

SEQ ID NO: 933942 - DNA, 22 bp, Artificial Sequence
  chemically synthesized
ggctgccacaatcagaaagcac

SEQ ID NO: 933943 - DNA, 22 bp, Artificial Sequence
  chemically synthesized
aacttggctgccacaatcagaa

SEQ ID NO: 933944 - DNA, 22 bp, Artificial Sequence
  chemically synthesized
tctttgtgctttctgattgtgg

SEQ ID NO: 933945 - DNA, 22 bp, Artificial Sequence
  chemically synthesized
tgtgctttctgattgtggcagc

SEQ ID NO: 933946 - DNA, 22 bp, Artificial Sequence
  chemically synthesized
gtgctttctgattgtggcagcc

SEQ ID NO: 933947 - DNA, 22 bp, Artificial Sequence
  chemically synthesized
cccactcaacttggctgccaca

SEQ ID NO: 933948 - DNA, 22 bp, Artificial Sequence
  chemically synthesized
tgctttctgattgtggcagcca

SEQ ID NO: 933949 - DNA, 22 bp, Artificial Sequence
  chemically synthesized
ccccactcaacttggctgccac

SEQ ID NO: 933950 - DNA, 22 bp, Artificial Sequence
  chemically synthesized
tccccactcaacttggctgcca

SEQ ID NO: 933951 - DNA, 22 bp, Artificial Sequence
  chemically synthesized
ttccccactcaacttggctgcc

SEQ ID NO: 933952 - DNA, 22 bp, Artificial Sequence
  chemically synthesized
tctgattgtggcagccaagttg

SEQ ID NO: 933953 - DNA, 22 bp, Artificial Sequence
  chemically synthesized
tttttccccactcaacttggct

SEQ ID NO: 933954 - DNA, 22 bp, Artificial Sequence
  chemically synthesized
ctgattgtggcagccaagttga

SEQ ID NO: 933955 - DNA, 22 bp, Artificial Sequence
  chemically synthesized
tgattgtggcagccaagttgag

SEQ ID NO: 933956 - DNA, 22 bp, Artificial Sequence
  chemically synthesized
ctgtttttccccactcaacttg

SEQ ID NO: 933957 - DNA, 22 bp, Artificial Sequence
  chemically synthesized
attgtggcagccaagttgagtg

SEQ ID NO: 933958 - DNA, 22 bp, Artificial Sequence
  chemically synthesized
tcctgtttttccccactcaact

SEQ ID NO: 933959 - DNA, 22 bp, Artificial Sequence
  chemically synthesized
ctcctgtttttccccactcaac

SEQ ID NO: 933960 - DNA, 22 bp, Artificial Sequence
  chemically synthesized
tctcctgtttttccccactcaa

SEQ ID NO: 933961 - DNA, 22 bp, Artificial Sequence
  chemically synthesized
tggcagccaagttgagtgggga

SEQ ID NO: 933962 - DNA, 22 bp, Artificial Sequence
  chemically synthesized
ttctcctgtttttccccactca

SEQ ID NO: 933963 - DNA, 22 bp, Artificial Sequence
  chemically synthesized
gcatgtttttctcctgtttttc

SEQ ID NO: 933964 - DNA, 22 bp, Artificial Sequence
  chemically synthesized
agtggggaaaaacaggagaaaa

SEQ ID NO: 933965 - DNA, 22 bp, Artificial Sequence
  chemically synthesized
cccgtattagcatgtttttctc

SEQ ID NO: 933966 - DNA, 22 bp, Artificial Sequence
  chemically synthesized
ccccgtattagcatgtttttct

SEQ ID NO: 933967 - DNA, 22 bp, Artificial Sequence
  chemically synthesized
tccccgtattagcatgtttttc

SEQ ID NO: 933968 - DNA, 22 bp, Artificial Sequence
  chemically synthesized
ttccccgtattagcatgttttt

SEQ ID NO: 933969 - DNA, 22 bp, Artificial Sequence
  chemically synthesized
tttccccgtattagcatgtttt

SEQ ID NO: 933970 - DNA, 22 bp, Artificial Sequence
  chemically synthesized
ttttccccgtattagcatgttt

SEQ ID NO: 933971 - DNA, 22 bp, Artificial Sequence
  chemically synthesized
tgtttttttccccgtattagca

SEQ ID NO: 933972 - DNA, 22 bp, Artificial Sequence
  chemically synthesized
atgtttttttccccgtattagc

SEQ ID NO: 933973 - DNA, 22 bp, Artificial Sequence
  chemically synthesized
tatgtttttttccccgtattag

SEQ ID NO: 933974 - DNA, 22 bp, Artificial Sequence
  chemically synthesized
tttatgtttttttccccgtatt

SEQ ID NO: 933975 - DNA, 22 bp, Artificial Sequence
  chemically synthesized
tctttatgtttttttccccgta

SEQ ID NO: 933976 - DNA, 22 bp, Artificial Sequence
  chemically synthesized
atacggggaaaaaaacataaag

SEQ ID NO: 933977 - DNA, 22 bp, Artificial Sequence
  chemically synthesized
caaaaatcctctctttatgttt

SEQ ID NO: 933978 - DNA, 22 bp, Artificial Sequence
  chemically synthesized
agttgcaaaaatcctctcttta

SEQ ID NO: 933979 - DNA, 22 bp, Artificial Sequence
  chemically synthesized
tgagttgcaaaaatcctctctt

SEQ ID NO: 933980 - DNA, 22 bp, Artificial Sequence
  chemically synthesized
ctgagttgcaaaaatcctctct

SEQ ID NO: 933981 - DNA, 22 bp, Artificial Sequence
  chemically synthesized
atttctgagttgcaaaaatcct

SEQ ID NO: 933982 - DNA, 22 bp, Artificial Sequence
  chemically synthesized
tatataagttcatttctgagtt

SEQ ID NO: 933983 - DNA, 22 bp, Artificial Sequence
  chemically synthesized
attgtatataagttcatttctg

SEQ ID NO: 933984 - DNA, 22 bp, Artificial Sequence
  chemically synthesized
cattgtatataagttcatttct

SEQ ID NO: 933985 - DNA, 22 bp, Artificial Sequence
  chemically synthesized
ttcattgtatataagttcattt

SEQ ID NO: 933986 - DNA, 22 bp, Artificial Sequence
  chemically synthesized
ttgcaactcagaaatgaactta

SEQ ID NO: 933987 - DNA, 22 bp, Artificial Sequence
  chemically synthesized
tgcaactcagaaatgaacttat

SEQ ID NO: 933988 - DNA, 22 bp, Artificial Sequence
  chemically synthesized
gcaactcagaaatgaacttata

SEQ ID NO: 933989 - DNA, 22 bp, Artificial Sequence
  chemically synthesized
caactcagaaatgaacttatat

SEQ ID NO: 933990 - DNA, 22 bp, Artificial Sequence
  chemically synthesized
agaaatgaacttatatacaatg

SEQ ID NO: 933991 - DNA, 22 bp, Artificial Sequence
  chemically synthesized
ggaataaaataggctcttcatt

SEQ ID NO: 933992 - DNA, 22 bp, Artificial Sequence
  chemically synthesized
aggaataaaataggctcttcat

SEQ ID NO: 933993 - DNA, 22 bp, Artificial Sequence
  chemically synthesized
taggaataaaataggctcttca

SEQ ID NO: 933994 - DNA, 22 bp, Artificial Sequence
  chemically synthesized
ttttaggaataaaataggctct

SEQ ID NO: 933995 - DNA, 22 bp, Artificial Sequence
  chemically synthesized
atatacaatgaagagcctattt

SEQ ID NO: 933996 - DNA, 22 bp, Artificial Sequence
  chemically synthesized
tatacaatgaagagcctatttt

SEQ ID NO: 933997 - DNA, 22 bp, Artificial Sequence
  chemically synthesized
ttattttaggaataaaataggc

SEQ ID NO: 933998 - DNA, 22 bp, Artificial Sequence
  chemically synthesized
gattattattttaggaataaaa

SEQ ID NO: 933999 - DNA, 22 bp, Artificial Sequence
  chemically synthesized
agattattattttaggaataaa

SEQ ID NO: 934000 - DNA, 22 bp, Artificial Sequence
  chemically synthesized
tagattattattttaggaataa

SEQ ID NO: 934001 - DNA, 22 bp, Artificial Sequence
  chemically synthesized
ttttattcctaaaataataatc

SEQ ID NO: 934002 - DNA, 22 bp, Artificial Sequence
  chemically synthesized
aaataaaattttagattattat

SEQ ID NO: 934003 - DNA, 22 bp, Artificial Sequence
  chemically synthesized
aaaataaaattttagattatta

SEQ ID NO: 934004 - DNA, 22 bp, Artificial Sequence
  chemically synthesized
tattcctaaaataataatctaa

SEQ ID NO: 934005 - DNA, 22 bp, Artificial Sequence
  chemically synthesized
taaaataaaattttagattatt

SEQ ID NO: 934006 - DNA, 22 bp, Artificial Sequence
  chemically synthesized
attcctaaaataataatctaaa

SEQ ID NO: 934007 - DNA, 22 bp, Artificial Sequence
  chemically synthesized
ttaaaataaaattttagattat

SEQ ID NO: 934008 - DNA, 22 bp, Artificial Sequence
  chemically synthesized
ttcctaaaataataatctaaaa

SEQ ID NO: 934009 - DNA, 22 bp, Artificial Sequence
  chemically synthesized
ctaaaataataatctaaaattt

SEQ ID NO: 934010 - DNA, 22 bp, Artificial Sequence
  chemically synthesized
atttttaaaataaaattttaga

SEQ ID NO: 934011 - DNA, 22 bp, Artificial Sequence
  chemically synthesized
tcatttttaaaataaaatttta

SEQ ID NO: 934012 - DNA, 22 bp, Artificial Sequence
  chemically synthesized
aaataataatctaaaattttat

SEQ ID NO: 934013 - DNA, 22 bp, Artificial Sequence
  chemically synthesized
ctcatttttaaaataaaatttt

SEQ ID NO: 934014 - DNA, 22 bp, Artificial Sequence
  chemically synthesized
tctcatttttaaaataaaattt

SEQ ID NO: 934015 - DNA, 22 bp, Artificial Sequence
  chemically synthesized
aagctttctcatttttaaaata

SEQ ID NO: 934016 - DNA, 22 bp, Artificial Sequence
  chemically synthesized
tcaagctttctcatttttaaaa

SEQ ID NO: 934017 - DNA, 22 bp, Artificial Sequence
  chemically synthesized
aaattttattttaaaaatgaga

SEQ ID NO: 934018 - DNA, 22 bp, Artificial Sequence
  chemically synthesized
tattttaaaaatgagaaagctt

SEQ ID NO: 934019 - DNA, 22 bp, Artificial Sequence
  chemically synthesized
attttaaaaatgagaaagcttg

SEQ ID NO: 934020 - DNA, 22 bp, Artificial Sequence
  chemically synthesized
ataaatacctctcaagctttct

SEQ ID NO: 934021 - DNA, 22 bp, Artificial Sequence
  chemically synthesized
ttttaaaaatgagaaagcttga

SEQ ID NO: 934022 - DNA, 22 bp, Artificial Sequence
  chemically synthesized
taaaaatgagaaagcttgagag

SEQ ID NO: 934023 - DNA, 22 bp, Artificial Sequence
  chemically synthesized
aaaaatgagaaagcttgagagg

SEQ ID NO: 934024 - DNA, 22 bp, Artificial Sequence
  chemically synthesized
aaaatgagaaagcttgagaggt

SEQ ID NO: 934025 - DNA, 22 bp, Artificial Sequence
  chemically synthesized
gagaggtatttattagattata

SEQ ID NO: 934026 - DNA, 22 bp, Artificial Sequence
  chemically synthesized
agaggtatttattagattatat

SEQ ID NO: 934027 - DNA, 22 bp, Artificial Sequence
  chemically synthesized
aaaaaaggaaatcagtatataa

SEQ ID NO: 934028 - DNA, 22 bp, Artificial Sequence
  chemically synthesized
attagattatatactgatttcc

SEQ ID NO: 934029 - DNA, 22 bp, Artificial Sequence
  chemically synthesized
ttagattatatactgatttcct

SEQ ID NO: 934030 - DNA, 22 bp, Artificial Sequence
  chemically synthesized
gattatatactgatttcctttt

SEQ ID NO: 934031 - DNA, 22 bp, Artificial Sequence
  chemically synthesized
aaaatagagattaaaaaaagga

SEQ ID NO: 934032 - DNA, 22 bp, Artificial Sequence
  chemically synthesized
tatactgatttcctttttttaa

SEQ ID NO: 934033 - DNA, 22 bp, Artificial Sequence
  chemically synthesized
cattaaaaatagagattaaaaa

SEQ ID NO: 934034 - DNA, 22 bp, Artificial Sequence
  chemically synthesized
atttcctttttttaatctctat

SEQ ID NO: 934035 - DNA, 22 bp, Artificial Sequence
  chemically synthesized
agtctacattaaaaatagagat

SEQ ID NO: 934036 - DNA, 22 bp, Artificial Sequence
  chemically synthesized
cctttttttaatctctattttt

SEQ ID NO: 934037 - DNA, 22 bp, Artificial Sequence
  chemically synthesized
ctttttttaatctctattttta

SEQ ID NO: 934038 - DNA, 22 bp, Artificial Sequence
  chemically synthesized
tttttaatctctatttttaatg

SEQ ID NO: 934039 - DNA, 22 bp, Artificial Sequence
  chemically synthesized
ttttaatctctatttttaatgt

SEQ ID NO: 934040 - DNA, 22 bp, Artificial Sequence
  chemically synthesized
tttaatctctatttttaatgta

SEQ ID NO: 934041 - DNA, 22 bp, Artificial Sequence
  chemically synthesized
ttaatctctatttttaatgtag

SEQ ID NO: 934042 - DNA, 22 bp, Artificial Sequence
  chemically synthesized
taatctctatttttaatgtaga

SEQ ID NO: 934043 - DNA, 22 bp, Artificial Sequence
  chemically synthesized
aatctctatttttaatgtagac

SEQ ID NO: 934044 - DNA, 22 bp, Artificial Sequence
  chemically synthesized
atctctatttttaatgtagact

SEQ ID NO: 934045 - DNA, 22 bp, Artificial Sequence
  chemically synthesized
tatttttaatgtagactcaggg

SEQ ID NO: 934046 - DNA, 22 bp, Artificial Sequence
  chemically synthesized
tttttaatgtagactcaggggt

SEQ ID NO: 934047 - DNA, 22 bp, Artificial Sequence
  chemically synthesized
ttaatgtagactcaggggtaca

SEQ ID NO: 934048 - DNA, 22 bp, Artificial Sequence
  chemically synthesized
taatgtagactcaggggtacat

SEQ ID NO: 934049 - DNA, 22 bp, Artificial Sequence
  chemically synthesized
aatgtagactcaggggtacatg

SEQ ID NO: 934050 - DNA, 22 bp, Artificial Sequence
  chemically synthesized
atgtagactcaggggtacatgt

SEQ ID NO: 934051 - DNA, 22 bp, Artificial Sequence
  chemically synthesized
taacaaaccaacacatgtaccc

SEQ ID NO: 934052 - DNA, 22 bp, Artificial Sequence
  chemically synthesized
gtaacaaaccaacacatgtacc

SEQ ID NO: 934053 - DNA, 22 bp, Artificial Sequence
  chemically synthesized
aggggtacatgtgttggtttgt

SEQ ID NO: 934054 - DNA, 22 bp, Artificial Sequence
  chemically synthesized
agcatcacgcagtatacccttg

SEQ ID NO: 934055 - DNA, 22 bp, Artificial Sequence
  chemically synthesized
gtttgttacaagggtatactgc

SEQ ID NO: 934056 - DNA, 22 bp, Artificial Sequence
  chemically synthesized
gttacaagggtatactgcgtga

SEQ ID NO: 934057 - DNA, 22 bp, Artificial Sequence
  chemically synthesized
ttacaagggtatactgcgtgat

SEQ ID NO: 934058 - DNA, 22 bp, Artificial Sequence
  chemically synthesized
caagggtatactgcgtgatgct

SEQ ID NO: 934059 - DNA, 22 bp, Artificial Sequence
  chemically synthesized
cgtgatgctgaggtttgggctt

SEQ ID NO: 934060 - DNA, 22 bp, Artificial Sequence
  chemically synthesized
ggtgatggaatcaacagaagcc

SEQ ID NO: 934061 - DNA, 22 bp, Artificial Sequence
  chemically synthesized
tctgggtgatggaatcaacaga

SEQ ID NO: 934062 - DNA, 22 bp, Artificial Sequence
  chemically synthesized
aggtttgggcttctgttgattc

SEQ ID NO: 934063 - DNA, 22 bp, Artificial Sequence
  chemically synthesized
actatctgggtgatggaatcaa

SEQ ID NO: 934064 - DNA, 22 bp, Artificial Sequence
  chemically synthesized
gggcttctgttgattccatcac

SEQ ID NO: 934065 - DNA, 22 bp, Artificial Sequence
  chemically synthesized
ggcttctgttgattccatcacc

SEQ ID NO: 934066 - DNA, 22 bp, Artificial Sequence
  chemically synthesized
tgttcactatctgggtgatgga

SEQ ID NO: 934067 - DNA, 22 bp, Artificial Sequence
  chemically synthesized
ctgttgattccatcacccagat

SEQ ID NO: 934068 - DNA, 22 bp, Artificial Sequence
  chemically synthesized
tgttgattccatcacccagata

SEQ ID NO: 934069 - DNA, 22 bp, Artificial Sequence
  chemically synthesized
ttgattccatcacccagatagt

SEQ ID NO: 934070 - DNA, 22 bp, Artificial Sequence
  chemically synthesized
ggtactatgttcactatctggg

SEQ ID NO: 934071 - DNA, 22 bp, Artificial Sequence
  chemically synthesized
attccatcacccagatagtgaa

SEQ ID NO: 934072 - DNA, 22 bp, Artificial Sequence
  chemically synthesized
ttgggtactatgttcactatct

SEQ ID NO: 934073 - DNA, 22 bp, Artificial Sequence
  chemically synthesized
ctgttgggtactatgttcacta

SEQ ID NO: 934074 - DNA, 22 bp, Artificial Sequence
  chemically synthesized
catcacccagatagtgaacata

SEQ ID NO: 934075 - DNA, 22 bp, Artificial Sequence
  chemically synthesized
cctgttgggtactatgttcact

SEQ ID NO: 934076 - DNA, 22 bp, Artificial Sequence
  chemically synthesized
caaaacttcctgttgggtacta

SEQ ID NO: 934077 - DNA, 22 bp, Artificial Sequence
  chemically synthesized
tgcagcacttgctcccctccct

SEQ ID NO: 934078 - DNA, 22 bp, Artificial Sequence
  chemically synthesized
gcagcacttgctcccctccctc

SEQ ID NO: 934079 - DNA, 22 bp, Artificial Sequence
  chemically synthesized
cagcacttgctcccctccctcc

SEQ ID NO: 934080 - DNA, 22 bp, Artificial Sequence
  chemically synthesized
cgaaaggaggaggggagggagg

SEQ ID NO: 934081 - DNA, 22 bp, Artificial Sequence
  chemically synthesized
gctcccctccctcccctcctcc

SEQ ID NO: 934082 - DNA, 22 bp, Artificial Sequence
  chemically synthesized
ggcactccgaaaggaggagggg

SEQ ID NO: 934083 - DNA, 22 bp, Artificial Sequence
  chemically synthesized
ctcccctccctcccctcctcct

SEQ ID NO: 934084 - DNA, 22 bp, Artificial Sequence
  chemically synthesized
ccctccctcccctcctcctttc

SEQ ID NO: 934085 - DNA, 22 bp, Artificial Sequence
  chemically synthesized
cctcccctcctcctttcggagt

SEQ ID NO: 934086 - DNA, 22 bp, Artificial Sequence
  chemically synthesized
caacacgaattaggcactccga

SEQ ID NO: 934087 - DNA, 22 bp, Artificial Sequence
  chemically synthesized
ccctcctcctttcggagtgcct

SEQ ID NO: 934088 - DNA, 22 bp, Artificial Sequence
  chemically synthesized
ccaacacgaattaggcactccg

SEQ ID NO: 934089 - DNA, 22 bp, Artificial Sequence
  chemically synthesized
ctcctttcggagtgcctaattc

SEQ ID NO: 934090 - DNA, 22 bp, Artificial Sequence
  chemically synthesized
ctttcggagtgcctaattcgtg

SEQ ID NO: 934091 - DNA, 22 bp, Artificial Sequence
  chemically synthesized
aagcaaatttccaacacgaatt

SEQ ID NO: 934092 - DNA, 22 bp, Artificial Sequence
  chemically synthesized
tcggagtgcctaattcgtgttg

SEQ ID NO: 934093 - DNA, 22 bp, Artificial Sequence
  chemically synthesized
cggagtgcctaattcgtgttgg

SEQ ID NO: 934094 - DNA, 22 bp, Artificial Sequence
  chemically synthesized
ggagtgcctaattcgtgttgga

SEQ ID NO: 934095 - DNA, 22 bp, Artificial Sequence
  chemically synthesized
agattaaagcaaatttccaaca

SEQ ID NO: 934096 - DNA, 22 bp, Artificial Sequence
  chemically synthesized
ccctaagattaaagcaaatttc

SEQ ID NO: 934097 - DNA, 22 bp, Artificial Sequence
  chemically synthesized
attcgtgttggaaatttgcttt

SEQ ID NO: 934098 - DNA, 22 bp, Artificial Sequence
  chemically synthesized
gtgttggaaatttgctttaatc

SEQ ID NO: 934099 - DNA, 22 bp, Artificial Sequence
  chemically synthesized
tgaatgttcccctaagattaaa

SEQ ID NO: 934100 - DNA, 22 bp, Artificial Sequence
  chemically synthesized
tatgaatgttcccctaagatta

SEQ ID NO: 934101 - DNA, 22 bp, Artificial Sequence
  chemically synthesized
gaaatttgctttaatcttaggg

SEQ ID NO: 934102 - DNA, 22 bp, Artificial Sequence
  chemically synthesized
ctatgaatgttcccctaagatt

SEQ ID NO: 934103 - DNA, 22 bp, Artificial Sequence
  chemically synthesized
tctatgaatgttcccctaagat

SEQ ID NO: 934104 - DNA, 22 bp, Artificial Sequence
  chemically synthesized
ttctatgaatgttcccctaaga

SEQ ID NO: 934105 - DNA, 22 bp, Artificial Sequence
  chemically synthesized
tttctatgaatgttcccctaag

SEQ ID NO: 934106 - DNA, 22 bp, Artificial Sequence
  chemically synthesized
gctttaatcttaggggaacatt

SEQ ID NO: 934107 - DNA, 22 bp, Artificial Sequence
  chemically synthesized
ctttaatcttaggggaacattc

SEQ ID NO: 934108 - DNA, 22 bp, Artificial Sequence
  chemically synthesized
taatcttaggggaacattcata

SEQ ID NO: 934109 - DNA, 22 bp, Artificial Sequence
  chemically synthesized
tacagttttttctatgaatgtt

SEQ ID NO: 934110 - DNA, 22 bp, Artificial Sequence
  chemically synthesized
aatcttaggggaacattcatag

SEQ ID NO: 934111 - DNA, 22 bp, Artificial Sequence
  chemically synthesized
gtacagttttttctatgaatgt

SEQ ID NO: 934112 - DNA, 22 bp, Artificial Sequence
  chemically synthesized
atcttaggggaacattcataga

SEQ ID NO: 934113 - DNA, 22 bp, Artificial Sequence
  chemically synthesized
tgtacagttttttctatgaatg

SEQ ID NO: 934114 - DNA, 22 bp, Artificial Sequence
  chemically synthesized
aggggaacattcatagaaaaaa

SEQ ID NO: 934115 - DNA, 22 bp, Artificial Sequence
  chemically synthesized
ggggaacattcatagaaaaaac

SEQ ID NO: 934116 - DNA, 22 bp, Artificial Sequence
  chemically synthesized
atagaaaaaactgtacaaaggg

SEQ ID NO: 934117 - DNA, 22 bp, Artificial Sequence
  chemically synthesized
agaatgcgtaaagaaacccttt

SEQ ID NO: 934118 - DNA, 22 bp, Artificial Sequence
  chemically synthesized
atcattgagaatgcgtaaagaa

SEQ ID NO: 934119 - DNA, 22 bp, Artificial Sequence
  chemically synthesized
catcattgagaatgcgtaaaga

SEQ ID NO: 934120 - DNA, 22 bp, Artificial Sequence
  chemically synthesized
tacaaagggtttctttacgcat

SEQ ID NO: 934121 - DNA, 22 bp, Artificial Sequence
  chemically synthesized
tcatcattgagaatgcgtaaag

SEQ ID NO: 934122 - DNA, 22 bp, Artificial Sequence
  chemically synthesized
ctttacgcattctcaatgatga

SEQ ID NO: 934123 - DNA, 22 bp, Artificial Sequence
  chemically synthesized
tttacgcattctcaatgatgaa

SEQ ID NO: 934124 - DNA, 22 bp, Artificial Sequence
  chemically synthesized
tacgcattctcaatgatgaaaa

SEQ ID NO: 934125 - DNA, 22 bp, Artificial Sequence
  chemically synthesized
acgcattctcaatgatgaaaat

SEQ ID NO: 934126 - DNA, 22 bp, Artificial Sequence
  chemically synthesized
cgcattctcaatgatgaaaatc

SEQ ID NO: 934127 - DNA, 22 bp, Artificial Sequence
  chemically synthesized
tcaatgatgaaaatcatgttga

SEQ ID NO: 934128 - DNA, 22 bp, Artificial Sequence
  chemically synthesized
aatgatgaaaatcatgttgaca

SEQ ID NO: 934129 - DNA, 22 bp, Artificial Sequence
  chemically synthesized
atgacagaacaatgtcaacatg

SEQ ID NO: 934130 - DNA, 22 bp, Artificial Sequence
  chemically synthesized
taatgacagaacaatgtcaaca

SEQ ID NO: 934131 - DNA, 22 bp, Artificial Sequence
  chemically synthesized
ctaatgacagaacaatgtcaac

SEQ ID NO: 934132 - DNA, 22 bp, Artificial Sequence
  chemically synthesized
tacatgtcttctaatgacagaa

SEQ ID NO: 934133 - DNA, 22 bp, Artificial Sequence
  chemically synthesized
gtacatgtcttctaatgacaga

SEQ ID NO: 934134 - DNA, 22 bp, Artificial Sequence
  chemically synthesized
tgtacatgtcttctaatgacag

SEQ ID NO: 934135 - DNA, 22 bp, Artificial Sequence
  chemically synthesized
ttgtacatgtcttctaatgaca

SEQ ID NO: 934136 - DNA, 22 bp, Artificial Sequence
  chemically synthesized
acattgttctgtcattagaaga

SEQ ID NO: 934137 - DNA, 22 bp, Artificial Sequence
  chemically synthesized
tttttgtacatgtcttctaatg

SEQ ID NO: 934138 - DNA, 22 bp, Artificial Sequence
  chemically synthesized
ttctgtcattagaagacatgta

SEQ ID NO: 934139 - DNA, 22 bp, Artificial Sequence
  chemically synthesized
tgtcattagaagacatgtacaa

SEQ ID NO: 934140 - DNA, 22 bp, Artificial Sequence
  chemically synthesized
tcaaaaactatttttgtacatg

SEQ ID NO: 934141 - DNA, 22 bp, Artificial Sequence
  chemically synthesized
tcattagaagacatgtacaaaa

SEQ ID NO: 934142 - DNA, 22 bp, Artificial Sequence
  chemically synthesized
atcaaaaactatttttgtacat

SEQ ID NO: 934143 - DNA, 22 bp, Artificial Sequence
  chemically synthesized
gtttatcaaaaactatttttgt

SEQ ID NO: 934144 - DNA, 22 bp, Artificial Sequence
  chemically synthesized
gaagacatgtacaaaaatagtt

SEQ ID NO: 934145 - DNA, 22 bp, Artificial Sequence
  chemically synthesized
agcgctagtttatcaaaaacta

SEQ ID NO: 934146 - DNA, 22 bp, Artificial Sequence
  chemically synthesized
tgaagacattaagcgctagttt

SEQ ID NO: 934147 - DNA, 22 bp, Artificial Sequence
  chemically synthesized
cgttatgaagacattaagcgct

SEQ ID NO: 934148 - DNA, 22 bp, Artificial Sequence
  chemically synthesized
acgttatgaagacattaagcgc

SEQ ID NO: 934149 - DNA, 22 bp, Artificial Sequence
  chemically synthesized
ttgataaactagcgcttaatgt

SEQ ID NO: 934150 - DNA, 22 bp, Artificial Sequence
  chemically synthesized
tgataaactagcgcttaatgtc

SEQ ID NO: 934151 - DNA, 22 bp, Artificial Sequence
  chemically synthesized
gataaactagcgcttaatgtct

SEQ ID NO: 934152 - DNA, 22 bp, Artificial Sequence
  chemically synthesized
ataaactagcgcttaatgtctt

SEQ ID NO: 934153 - DNA, 22 bp, Artificial Sequence
  chemically synthesized
cacttacgttatgaagacatta

SEQ ID NO: 934154 - DNA, 22 bp, Artificial Sequence
  chemically synthesized
ccacttacgttatgaagacatt

SEQ ID NO: 934155 - DNA, 22 bp, Artificial Sequence
  chemically synthesized
gcgcttaatgtcttcataacgt

SEQ ID NO: 934156 - DNA, 22 bp, Artificial Sequence
  chemically synthesized
atcgcttccacttacgttatga

SEQ ID NO: 934157 - DNA, 22 bp, Artificial Sequence
  chemically synthesized
catcgcttccacttacgttatg

SEQ ID NO: 934158 - DNA, 22 bp, Artificial Sequence
  chemically synthesized
tcatcgcttccacttacgttat

SEQ ID NO: 934159 - DNA, 22 bp, Artificial Sequence
  chemically synthesized
aatgtcttcataacgtaagtgg

SEQ ID NO: 934160 - DNA, 22 bp, Artificial Sequence
  chemically synthesized
atgtcttcataacgtaagtgga

SEQ ID NO: 934161 - DNA, 22 bp, Artificial Sequence
  chemically synthesized
cagtatattttcatcgcttcca

SEQ ID NO: 934162 - DNA, 22 bp, Artificial Sequence
  chemically synthesized
cataacgtaagtggaagcgatg

SEQ ID NO: 934163 - DNA, 22 bp, Artificial Sequence
  chemically synthesized
gcagtatattttcatcgcttcc

SEQ ID NO: 934164 - DNA, 22 bp, Artificial Sequence
  chemically synthesized
ataacgtaagtggaagcgatga

SEQ ID NO: 934165 - DNA, 22 bp, Artificial Sequence
  chemically synthesized
ttgcagtatattttcatcgctt

SEQ ID NO: 934166 - DNA, 22 bp, Artificial Sequence
  chemically synthesized
cttgcagtatattttcatcgct

SEQ ID NO: 934167 - DNA, 22 bp, Artificial Sequence
  chemically synthesized
aaaaatagtttcttgcagtata

SEQ ID NO: 934168 - DNA, 22 bp, Artificial Sequence
  chemically synthesized
gaaaaatagtttcttgcagtat

SEQ ID NO: 934169 - DNA, 22 bp, Artificial Sequence
  chemically synthesized
tgaaaaatagtttcttgcagta

SEQ ID NO: 934170 - DNA, 22 bp, Artificial Sequence
  chemically synthesized
caagaaactatttttcaaagtc

SEQ ID NO: 934171 - DNA, 22 bp, Artificial Sequence
  chemically synthesized
aaaaaaagtaaaaatgtcgaag

SEQ ID NO: 934172 - DNA, 22 bp, Artificial Sequence
  chemically synthesized
tttttcaaagtcttcgacattt

SEQ ID NO: 934173 - DNA, 22 bp, Artificial Sequence
  chemically synthesized
ttcaaagtcttcgacattttta

SEQ ID NO: 934174 - DNA, 22 bp, Artificial Sequence
  chemically synthesized
gttgaaaaaaagtaaaaatgtc

SEQ ID NO: 934175 - DNA, 22 bp, Artificial Sequence
  chemically synthesized
tcaaagtcttcgacatttttac

SEQ ID NO: 934176 - DNA, 22 bp, Artificial Sequence
  chemically synthesized
agttgaaaaaaagtaaaaatgt

SEQ ID NO: 934177 - DNA, 22 bp, Artificial Sequence
  chemically synthesized
caaagtcttcgacatttttact

SEQ ID NO: 934178 - DNA, 22 bp, Artificial Sequence
  chemically synthesized
aaagtcttcgacatttttactt

SEQ ID NO: 934179 - DNA, 22 bp, Artificial Sequence
  chemically synthesized
aagtgtttagttgaaaaaaagt

SEQ ID NO: 934180 - DNA, 22 bp, Artificial Sequence
  chemically synthesized
cgacatttttactttttttcaa

SEQ ID NO: 934181 - DNA, 22 bp, Artificial Sequence
  chemically synthesized
gacatttttactttttttcaac

SEQ ID NO: 934182 - DNA, 22 bp, Artificial Sequence
  chemically synthesized
ttactttttttcaactaaacac

SEQ ID NO: 934183 - DNA, 22 bp, Artificial Sequence
  chemically synthesized
tactttttttcaactaaacact

SEQ ID NO: 934184 - DNA, 22 bp, Artificial Sequence
  chemically synthesized
actttttttcaactaaacactt

SEQ ID NO: 934185 - DNA, 22 bp, Artificial Sequence
  chemically synthesized
ctttttttcaactaaacacttc

SEQ ID NO: 934186 - DNA, 22 bp, Artificial Sequence
  chemically synthesized
acccaaaaggactgaagtgttt

SEQ ID NO: 934187 - DNA, 22 bp, Artificial Sequence
  chemically synthesized
tttttcaactaaacacttcagt

SEQ ID NO: 934188 - DNA, 22 bp, Artificial Sequence
  chemically synthesized
ttttcaactaaacacttcagtc

SEQ ID NO: 934189 - DNA, 22 bp, Artificial Sequence
  chemically synthesized
tttcaactaaacacttcagtcc

SEQ ID NO: 934190 - DNA, 22 bp, Artificial Sequence
  chemically synthesized
ttcaactaaacacttcagtcct

SEQ ID NO: 934191 - DNA, 22 bp, Artificial Sequence
  chemically synthesized
tcaactaaacacttcagtcctt

SEQ ID NO: 934192 - DNA, 22 bp, Artificial Sequence
  chemically synthesized
caactaaacacttcagtccttt

SEQ ID NO: 934193 - DNA, 22 bp, Artificial Sequence
  chemically synthesized
aactaaacacttcagtcctttt

SEQ ID NO: 934194 - DNA, 22 bp, Artificial Sequence
  chemically synthesized
aacacttcagtccttttgggtg

SEQ ID NO: 934195 - DNA, 22 bp, Artificial Sequence
  chemically synthesized
aataatataaagagctcaccca

SEQ ID NO: 934196 - DNA, 22 bp, Artificial Sequence
  chemically synthesized
aaataatataaagagctcaccc

SEQ ID NO: 934197 - DNA, 22 bp, Artificial Sequence
  chemically synthesized
taaataatataaagagctcacc

SEQ ID NO: 934198 - DNA, 22 bp, Artificial Sequence
  chemically synthesized
cagtccttttgggtgagctctt

SEQ ID NO: 934199 - DNA, 22 bp, Artificial Sequence
  chemically synthesized
ttaaataatataaagagctcac

SEQ ID NO: 934200 - DNA, 22 bp, Artificial Sequence
  chemically synthesized
agtccttttgggtgagctcttt

SEQ ID NO: 934201 - DNA, 22 bp, Artificial Sequence
  chemically synthesized
ttgggtgagctctttatattat

SEQ ID NO: 934202 - DNA, 22 bp, Artificial Sequence
  chemically synthesized
tgggtgagctctttatattatt

SEQ ID NO: 934203 - DNA, 22 bp, Artificial Sequence
  chemically synthesized
gggtgagctctttatattattt

SEQ ID NO: 934204 - DNA, 22 bp, Artificial Sequence
  chemically synthesized
ggtgagctctttatattattta

SEQ ID NO: 934205 - DNA, 22 bp, Artificial Sequence
  chemically synthesized
ggaaaagaaccttttaaataat

SEQ ID NO: 934206 - DNA, 22 bp, Artificial Sequence
  chemically synthesized
tctaggaaaagaaccttttaaa

SEQ ID NO: 934207 - DNA, 22 bp, Artificial Sequence
  chemically synthesized
tttatattatttaaaaggttct

SEQ ID NO: 934208 - DNA, 22 bp, Artificial Sequence
  chemically synthesized
tatattatttaaaaggttcttt

SEQ ID NO: 934209 - DNA, 22 bp, Artificial Sequence
  chemically synthesized
atattatttaaaaggttctttt

SEQ ID NO: 934210 - DNA, 22 bp, Artificial Sequence
  chemically synthesized
tattatttaaaaggttcttttc

SEQ ID NO: 934211 - DNA, 22 bp, Artificial Sequence
  chemically synthesized
cataaactatctaggaaaagaa

SEQ ID NO: 934212 - DNA, 22 bp, Artificial Sequence
  chemically synthesized
acataaactatctaggaaaaga

SEQ ID NO: 934213 - DNA, 22 bp, Artificial Sequence
  chemically synthesized
tttaaaaggttcttttcctaga

SEQ ID NO: 934214 - DNA, 22 bp, Artificial Sequence
  chemically synthesized
aaaaggttcttttcctagatag

SEQ ID NO: 934215 - DNA, 22 bp, Artificial Sequence
  chemically synthesized
aaaggttcttttcctagatagt

SEQ ID NO: 934216 - DNA, 22 bp, Artificial Sequence
  chemically synthesized
ttttcctagatagtttatgtaa

SEQ ID NO: 934217 - DNA, 22 bp, Artificial Sequence
  chemically synthesized
caggaaaaggcatttacataaa

SEQ ID NO: 934218 - DNA, 22 bp, Artificial Sequence
  chemically synthesized
ttcctagatagtttatgtaaat

SEQ ID NO: 934219 - DNA, 22 bp, Artificial Sequence
  chemically synthesized
tcctagatagtttatgtaaatg

SEQ ID NO: 934220 - DNA, 22 bp, Artificial Sequence
  chemically synthesized
cctagatagtttatgtaaatgc

SEQ ID NO: 934221 - DNA, 22 bp, Artificial Sequence
  chemically synthesized
ctccaggaaaaggcatttacat

SEQ ID NO: 934222 - DNA, 22 bp, Artificial Sequence
  chemically synthesized
ctagatagtttatgtaaatgcc

SEQ ID NO: 934223 - DNA, 22 bp, Artificial Sequence
  chemically synthesized
gatagtttatgtaaatgccttt

SEQ ID NO: 934224 - DNA, 22 bp, Artificial Sequence
  chemically synthesized
aaggttactccaggaaaaggca

SEQ ID NO: 934225 - DNA, 22 bp, Artificial Sequence
  chemically synthesized
aaaggttactccaggaaaaggc

SEQ ID NO: 934226 - DNA, 22 bp, Artificial Sequence
  chemically synthesized
atgtaaatgccttttcctggag

SEQ ID NO: 934227 - DNA, 22 bp, Artificial Sequence
  chemically synthesized
tgtaaatgccttttcctggagt

SEQ ID NO: 934228 - DNA, 22 bp, Artificial Sequence
  chemically synthesized
caaataatgccttaaaggttac

SEQ ID NO: 934229 - DNA, 22 bp, Artificial Sequence
  chemically synthesized
ccaaataatgccttaaaggtta

SEQ ID NO: 934230 - DNA, 22 bp, Artificial Sequence
  chemically synthesized
ttcctggagtaacctttaaggc

SEQ ID NO: 934231 - DNA, 22 bp, Artificial Sequence
  chemically synthesized
tttccaaataatgccttaaagg

SEQ ID NO: 934232 - DNA, 22 bp, Artificial Sequence
  chemically synthesized
tcctggagtaacctttaaggca

SEQ ID NO: 934233 - DNA, 22 bp, Artificial Sequence
  chemically synthesized
cctggagtaacctttaaggcat

SEQ ID NO: 934234 - DNA, 22 bp, Artificial Sequence
  chemically synthesized
ctggagtaacctttaaggcatt

SEQ ID NO: 934235 - DNA, 22 bp, Artificial Sequence
  chemically synthesized
tgttatttccaaataatgcctt

SEQ ID NO: 934236 - DNA, 22 bp, Artificial Sequence
  chemically synthesized
gagtaacctttaaggcattatt

SEQ ID NO: 934237 - DNA, 22 bp, Artificial Sequence
  chemically synthesized
ggagaaactatgttatttccaa

SEQ ID NO: 934238 - DNA, 22 bp, Artificial Sequence
  chemically synthesized
taaggcattatttggaaataac

SEQ ID NO: 934239 - DNA, 22 bp, Artificial Sequence
  chemically synthesized
aggagaaactatgttatttcca

SEQ ID NO: 934240 - DNA, 22 bp, Artificial Sequence
  chemically synthesized
aaggcattatttggaaataaca

SEQ ID NO: 934241 - DNA, 22 bp, Artificial Sequence
  chemically synthesized
taggagaaactatgttatttcc

SEQ ID NO: 934242 - DNA, 22 bp, Artificial Sequence
  chemically synthesized
aggcattatttggaaataacat

SEQ ID NO: 934243 - DNA, 22 bp, Artificial Sequence
  chemically synthesized
tttggaaataacatagtttctc

SEQ ID NO: 934244 - DNA, 22 bp, Artificial Sequence
  chemically synthesized
ggaaataacatagtttctccta

SEQ ID NO: 934245 - DNA, 22 bp, Artificial Sequence
  chemically synthesized
gaaataacatagtttctcctaa

SEQ ID NO: 934246 - DNA, 22 bp, Artificial Sequence
  chemically synthesized
tggataaaaacagacatacttt

SEQ ID NO: 934247 - DNA, 22 bp, Artificial Sequence
  chemically synthesized
ttgtggataaaaacagacatac

SEQ ID NO: 934248 - DNA, 22 bp, Artificial Sequence
  chemically synthesized
ctgttgtggataaaaacagaca

SEQ ID NO: 934249 - DNA, 22 bp, Artificial Sequence
  chemically synthesized
ctcctaaagtatgtctgttttt

SEQ ID NO: 934250 - DNA, 22 bp, Artificial Sequence
  chemically synthesized
tcctaaagtatgtctgttttta

SEQ ID NO: 934251 - DNA, 22 bp, Artificial Sequence
  chemically synthesized
tactgttgtggataaaaacaga

SEQ ID NO: 934252 - DNA, 22 bp, Artificial Sequence
  chemically synthesized
ctaaagtatgtctgtttttatc

SEQ ID NO: 934253 - DNA, 22 bp, Artificial Sequence
  chemically synthesized
ctctactgttgtggataaaaac

SEQ ID NO: 934254 - DNA, 22 bp, Artificial Sequence
  chemically synthesized
aagtatgtctgtttttatccac

SEQ ID NO: 934255 - DNA, 22 bp, Artificial Sequence
  chemically synthesized
ctactctactgttgtggataaa

SEQ ID NO: 934256 - DNA, 22 bp, Artificial Sequence
  chemically synthesized
ctactactctactgttgtggat

SEQ ID NO: 934257 - DNA, 22 bp, Artificial Sequence
  chemically synthesized
cctactactctactgttgtgga

SEQ ID NO: 934258 - DNA, 22 bp, Artificial Sequence
  chemically synthesized
tcctactactctactgttgtgg

SEQ ID NO: 934259 - DNA, 22 bp, Artificial Sequence
  chemically synthesized
tttttatccacaacagtagagt

SEQ ID NO: 934260 - DNA, 22 bp, Artificial Sequence
  chemically synthesized
ttatccacaacagtagagtagt

SEQ ID NO: 934261 - DNA, 22 bp, Artificial Sequence
  chemically synthesized
tatccacaacagtagagtagta

SEQ ID NO: 934262 - DNA, 22 bp, Artificial Sequence
  chemically synthesized
atccacaacagtagagtagtag

SEQ ID NO: 934263 - DNA, 22 bp, Artificial Sequence
  chemically synthesized
gcacacactttcctactactct

SEQ ID NO: 934264 - DNA, 22 bp, Artificial Sequence
  chemically synthesized
tccacaacagtagagtagtagg

SEQ ID NO: 934265 - DNA, 22 bp, Artificial Sequence
  chemically synthesized
agcacacactttcctactactc

SEQ ID NO: 934266 - DNA, 22 bp, Artificial Sequence
  chemically synthesized
ttagcacacactttcctactac

SEQ ID NO: 934267 - DNA, 22 bp, Artificial Sequence
  chemically synthesized
cttagcacacactttcctacta

SEQ ID NO: 934268 - DNA, 22 bp, Artificial Sequence
  chemically synthesized
tcttagcacacactttcctact

SEQ ID NO: 934269 - DNA, 22 bp, Artificial Sequence
  chemically synthesized
tactttcttagcacacactttc

SEQ ID NO: 934270 - DNA, 22 bp, Artificial Sequence
  chemically synthesized
agaaagtacaatattctctttg

SEQ ID NO: 934271 - DNA, 22 bp, Artificial Sequence
  chemically synthesized
caataatgtacagtgacaaaga

SEQ ID NO: 934272 - DNA, 22 bp, Artificial Sequence
  chemically synthesized
tctttgtcactgtacattattg

SEQ ID NO: 934273 - DNA, 22 bp, Artificial Sequence
  chemically synthesized
atatggtaactacaataatgta

SEQ ID NO: 934274 - DNA, 22 bp, Artificial Sequence
  chemically synthesized
tttgtcactgtacattattgta

SEQ ID NO: 934275 - DNA, 22 bp, Artificial Sequence
  chemically synthesized
tgtcactgtacattattgtagt

SEQ ID NO: 934276 - DNA, 22 bp, Artificial Sequence
  chemically synthesized
gctcatatggtaactacaataa

SEQ ID NO: 934277 - DNA, 22 bp, Artificial Sequence
  chemically synthesized
gtcactgtacattattgtagtt

SEQ ID NO: 934278 - DNA, 22 bp, Artificial Sequence
  chemically synthesized
agctcatatggtaactacaata

SEQ ID NO: 934279 - DNA, 22 bp, Artificial Sequence
  chemically synthesized
tcactgtacattattgtagtta

SEQ ID NO: 934280 - DNA, 22 bp, Artificial Sequence
  chemically synthesized
ttagctcatatggtaactacaa

SEQ ID NO: 934281 - DNA, 22 bp, Artificial Sequence
  chemically synthesized
tacattattgtagttaccatat

SEQ ID NO: 934282 - DNA, 22 bp, Artificial Sequence
  chemically synthesized
gcatagtctcttagctcatatg

SEQ ID NO: 934283 - DNA, 22 bp, Artificial Sequence
  chemically synthesized
ttgtagttaccatatgagctaa

SEQ ID NO: 934284 - DNA, 22 bp, Artificial Sequence
  chemically synthesized
tagttaccatatgagctaagag

SEQ ID NO: 934285 - DNA, 22 bp, Artificial Sequence
  chemically synthesized
acactagcatagtctcttagct

SEQ ID NO: 934286 - DNA, 22 bp, Artificial Sequence
  chemically synthesized
aacactagcatagtctcttagc

SEQ ID NO: 934287 - DNA, 22 bp, Artificial Sequence
  chemically synthesized
ccatatgagctaagagactatg

SEQ ID NO: 934288 - DNA, 22 bp, Artificial Sequence
  chemically synthesized
taaaggcaaccttaacactagc

SEQ ID NO: 934289 - DNA, 22 bp, Artificial Sequence
  chemically synthesized
agagactatgctagtgttaagg

SEQ ID NO: 934290 - DNA, 22 bp, Artificial Sequence
  chemically synthesized
tgctagtgttaaggttgccttt

SEQ ID NO: 934291 - DNA, 22 bp, Artificial Sequence
  chemically synthesized
gtgttaaggttgcctttatagt

SEQ ID NO: 934292 - DNA, 22 bp, Artificial Sequence
  chemically synthesized
aggttgcctttatagtatgatt

SEQ ID NO: 934293 - DNA, 22 bp, Artificial Sequence
  chemically synthesized
cctttatagtatgattatacct

SEQ ID NO: 934294 - DNA, 22 bp, Artificial Sequence
  chemically synthesized
tatagtatgattatacctgtta

SEQ ID NO: 934295 - DNA, 22 bp, Artificial Sequence
  chemically synthesized
gagcaaggaaaataacaggtat

SEQ ID NO: 934296 - DNA, 22 bp, Artificial Sequence
  chemically synthesized
atagtatgattatacctgttat

SEQ ID NO: 934297 - DNA, 22 bp, Artificial Sequence
  chemically synthesized
agagcaaggaaaataacaggta

SEQ ID NO: 934298 - DNA, 22 bp, Artificial Sequence
  chemically synthesized
tagtatgattatacctgttatt

SEQ ID NO: 934299 - DNA, 22 bp, Artificial Sequence
  chemically synthesized
tacctgttattttccttgctct

SEQ ID NO: 934300 - DNA, 22 bp, Artificial Sequence
  chemically synthesized
ttattttccttgctctaagttt

SEQ ID NO: 934301 - DNA, 22 bp, Artificial Sequence
  chemically synthesized
tgaaatgccaacaaacttagag

SEQ ID NO: 934302 - DNA, 22 bp, Artificial Sequence
  chemically synthesized
gtgaaatgccaacaaacttaga

SEQ ID NO: 934303 - DNA, 22 bp, Artificial Sequence
  chemically synthesized
ttttccttgctctaagtttgtt

SEQ ID NO: 934304 - DNA, 22 bp, Artificial Sequence
  chemically synthesized
ttgtgaaatgccaacaaactta

SEQ ID NO: 934305 - DNA, 22 bp, Artificial Sequence
  chemically synthesized
cttgtgaaatgccaacaaactt

SEQ ID NO: 934306 - DNA, 22 bp, Artificial Sequence
  chemically synthesized
tccttgctctaagtttgttggc

SEQ ID NO: 934307 - DNA, 22 bp, Artificial Sequence
  chemically synthesized
ccttgctctaagtttgttggca

SEQ ID NO: 934308 - DNA, 22 bp, Artificial Sequence
  chemically synthesized
tttcttgtgaaatgccaacaaa

SEQ ID NO: 934309 - DNA, 22 bp, Artificial Sequence
  chemically synthesized
cttgctctaagtttgttggcat

SEQ ID NO: 934310 - DNA, 22 bp, Artificial Sequence
  chemically synthesized
gctctaagtttgttggcatttc

SEQ ID NO: 934311 - DNA, 22 bp, Artificial Sequence
  chemically synthesized
ctctaagtttgttggcatttca

SEQ ID NO: 934312 - DNA, 22 bp, Artificial Sequence
  chemically synthesized
taagtttgttggcatttcacaa

SEQ ID NO: 934313 - DNA, 22 bp, Artificial Sequence
  chemically synthesized
tacgtattatttcttgtgaaat

SEQ ID NO: 934314 - DNA, 22 bp, Artificial Sequence
  chemically synthesized
agtttgttggcatttcacaaga

SEQ ID NO: 934315 - DNA, 22 bp, Artificial Sequence
  chemically synthesized
gttggcatttcacaagaaataa

SEQ ID NO: 934316 - DNA, 22 bp, Artificial Sequence
  chemically synthesized
tggttgtacgtattatttcttg

SEQ ID NO: 934317 - DNA, 22 bp, Artificial Sequence
  chemically synthesized
ttggcatttcacaagaaataat

SEQ ID NO: 934318 - DNA, 22 bp, Artificial Sequence
  chemically synthesized
gtggttgtacgtattatttctt

SEQ ID NO: 934319 - DNA, 22 bp, Artificial Sequence
  chemically synthesized
tgtggttgtacgtattatttct

SEQ ID NO: 934320 - DNA, 22 bp, Artificial Sequence
  chemically synthesized
gcatttcacaagaaataatacg

SEQ ID NO: 934321 - DNA, 22 bp, Artificial Sequence
  chemically synthesized
actttgtggttgtacgtattat

SEQ ID NO: 934322 - DNA, 22 bp, Artificial Sequence
  chemically synthesized
cacaagaaataatacgtacaac

SEQ ID NO: 934323 - DNA, 22 bp, Artificial Sequence
  chemically synthesized
acaagaaataatacgtacaacc

SEQ ID NO: 934324 - DNA, 22 bp, Artificial Sequence
  chemically synthesized
aagttaactttgtggttgtacg

SEQ ID NO: 934325 - DNA, 22 bp, Artificial Sequence
  chemically synthesized
ataatcacagctcaagttaact

SEQ ID NO: 934326 - DNA, 22 bp, Artificial Sequence
  chemically synthesized
tcataatcacagctcaagttaa

SEQ ID NO: 934327 - DNA, 22 bp, Artificial Sequence
  chemically synthesized
ctcataatcacagctcaagtta

SEQ ID NO: 934328 - DNA, 22 bp, Artificial Sequence
  chemically synthesized
tctcataatcacagctcaagtt

SEQ ID NO: 934329 - DNA, 22 bp, Artificial Sequence
  chemically synthesized
taccattttctcataatcacag

SEQ ID NO: 934330 - DNA, 22 bp, Artificial Sequence
  chemically synthesized
ttgtaccattttctcataatca

SEQ ID NO: 934331 - DNA, 22 bp, Artificial Sequence
  chemically synthesized
attgtaccattttctcataatc

SEQ ID NO: 934332 - DNA, 22 bp, Artificial Sequence
  chemically synthesized
acttgagctgtgattatgagaa

SEQ ID NO: 934333 - DNA, 22 bp, Artificial Sequence
  chemically synthesized
acttattgtaccattttctcat

SEQ ID NO: 934334 - DNA, 22 bp, Artificial Sequence
  chemically synthesized
gagctgtgattatgagaaaatg

SEQ ID NO: 934335 - DNA, 22 bp, Artificial Sequence
  chemically synthesized
aacttattgtaccattttctca

SEQ ID NO: 934336 - DNA, 22 bp, Artificial Sequence
  chemically synthesized
agctgtgattatgagaaaatgg

SEQ ID NO: 934337 - DNA, 22 bp, Artificial Sequence
  chemically synthesized
cttaacttattgtaccattttc

SEQ ID NO: 934338 - DNA, 22 bp, Artificial Sequence
  chemically synthesized
tgattatgagaaaatggtacaa

SEQ ID NO: 934339 - DNA, 22 bp, Artificial Sequence
  chemically synthesized
tgagaaaatggtacaataagtt

SEQ ID NO: 934340 - DNA, 22 bp, Artificial Sequence
  chemically synthesized
aatgtgttgcttaacttattgt

SEQ ID NO: 934341 - DNA, 22 bp, Artificial Sequence
  chemically synthesized
aaatgtgttgcttaacttattg

SEQ ID NO: 934342 - DNA, 22 bp, Artificial Sequence
  chemically synthesized
taaatgtgttgcttaacttatt

SEQ ID NO: 934343 - DNA, 22 bp, Artificial Sequence
  chemically synthesized
ttttaaatgtgttgcttaactt

SEQ ID NO: 934344 - DNA, 22 bp, Artificial Sequence
  chemically synthesized
gttttaaatgtgttgcttaact

SEQ ID NO: 934345 - DNA, 22 bp, Artificial Sequence
  chemically synthesized
tttgttttaaatgtgttgctta

SEQ ID NO: 934346 - DNA, 22 bp, Artificial Sequence
  chemically synthesized
aactatttgttttaaatgtgtt

SEQ ID NO: 934347 - DNA, 22 bp, Artificial Sequence
  chemically synthesized
agtaattgaactatttgtttta

SEQ ID NO: 934348 - DNA, 22 bp, Artificial Sequence
  chemically synthesized
agcaacacatttaaaacaaata

SEQ ID NO: 934349 - DNA, 22 bp, Artificial Sequence
  chemically synthesized
aaaacaaatagttcaattactc

SEQ ID NO: 934350 - DNA, 22 bp, Artificial Sequence
  chemically synthesized
aaacaaatagttcaattactca

SEQ ID NO: 934351 - DNA, 22 bp, Artificial Sequence
  chemically synthesized
taccgcatgaaattgagtaatt

SEQ ID NO: 934352 - DNA, 22 bp, Artificial Sequence
  chemically synthesized
aaactgtaccgcatgaaattga

SEQ ID NO: 934353 - DNA, 22 bp, Artificial Sequence
  chemically synthesized
aattactcaatttcatgcggta

SEQ ID NO: 934354 - DNA, 22 bp, Artificial Sequence
  chemically synthesized
gcaatgttaaaactgtaccgca

SEQ ID NO: 934355 - DNA, 22 bp, Artificial Sequence
  chemically synthesized
ctcaatttcatgcggtacagtt

SEQ ID NO: 934356 - DNA, 22 bp, Artificial Sequence
  chemically synthesized
aatttcatgcggtacagtttta

SEQ ID NO: 934357 - DNA, 22 bp, Artificial Sequence
  chemically synthesized
catgcggtacagttttaacatt

SEQ ID NO: 934358 - DNA, 22 bp, Artificial Sequence
  chemically synthesized
atgcggtacagttttaacattg

SEQ ID NO: 934359 - DNA, 22 bp, Artificial Sequence
  chemically synthesized
aggatgtactagcaatgttaaa

SEQ ID NO: 934360 - DNA, 22 bp, Artificial Sequence
  chemically synthesized
atctgaggatgtactagcaatg

SEQ ID NO: 934361 - DNA, 22 bp, Artificial Sequence
  chemically synthesized
aatctgaggatgtactagcaat

SEQ ID NO: 934362 - DNA, 22 bp, Artificial Sequence
  chemically synthesized
taacattgctagtacatcctca

SEQ ID NO: 934363 - DNA, 22 bp, Artificial Sequence
  chemically synthesized
gtatatttaatctgaggatgta

SEQ ID NO: 934364 - DNA, 22 bp, Artificial Sequence
  chemically synthesized
aacattgctagtacatcctcag

SEQ ID NO: 934365 - DNA, 22 bp, Artificial Sequence
  chemically synthesized
cgtatatttaatctgaggatgt

SEQ ID NO: 934366 - DNA, 22 bp, Artificial Sequence
  chemically synthesized
acattgctagtacatcctcaga

SEQ ID NO: 934367 - DNA, 22 bp, Artificial Sequence
  chemically synthesized
tcgtatatttaatctgaggatg

SEQ ID NO: 934368 - DNA, 22 bp, Artificial Sequence
  chemically synthesized
ctagtacatcctcagattaaat

SEQ ID NO: 934369 - DNA, 22 bp, Artificial Sequence
  chemically synthesized
atgttttcgtatatttaatctg

SEQ ID NO: 934370 - DNA, 22 bp, Artificial Sequence
  chemically synthesized
gtacatcctcagattaaatata

SEQ ID NO: 934371 - DNA, 22 bp, Artificial Sequence
  chemically synthesized
ttaatgttttcgtatatttaat

SEQ ID NO: 934372 - DNA, 22 bp, Artificial Sequence
  chemically synthesized
cgtgagttattaatgttttcgt

SEQ ID NO: 934373 - DNA, 22 bp, Artificial Sequence
  chemically synthesized
agattaaatatacgaaaacatt

SEQ ID NO: 934374 - DNA, 22 bp, Artificial Sequence
  chemically synthesized
acgtgagttattaatgttttcg

SEQ ID NO: 934375 - DNA, 22 bp, Artificial Sequence
  chemically synthesized
cttacgtgagttattaatgttt

SEQ ID NO: 934376 - DNA, 22 bp, Artificial Sequence
  chemically synthesized
gcttacgtgagttattaatgtt

SEQ ID NO: 934377 - DNA, 22 bp, Artificial Sequence
  chemically synthesized
aatatacgaaaacattaataac

SEQ ID NO: 934378 - DNA, 22 bp, Artificial Sequence
  chemically synthesized
caccttgcttacgtgagttatt

SEQ ID NO: 934379 - DNA, 22 bp, Artificial Sequence
  chemically synthesized
acaccttgcttacgtgagttat

SEQ ID NO: 934380 - DNA, 22 bp, Artificial Sequence
  chemically synthesized
ccttacaccttgcttacgtgag

SEQ ID NO: 934381 - DNA, 22 bp, Artificial Sequence
  chemically synthesized
ataactcacgtaagcaaggtgt

SEQ ID NO: 934382 - DNA, 22 bp, Artificial Sequence
  chemically synthesized
acgtaagcaaggtgtaaggcag

SEQ ID NO: 934383 - DNA, 22 bp, Artificial Sequence
  chemically synthesized
cacgtggtaggatgtgtaactg

SEQ ID NO: 934384 - DNA, 22 bp, Artificial Sequence
  chemically synthesized
acacgtggtaggatgtgtaact

SEQ ID NO: 934385 - DNA, 22 bp, Artificial Sequence
  chemically synthesized
tacacgtggtaggatgtgtaac

SEQ ID NO: 934386 - DNA, 22 bp, Artificial Sequence
  chemically synthesized
gtagcatactttacacgtggta

SEQ ID NO: 934387 - DNA, 22 bp, Artificial Sequence
  chemically synthesized
agtagcatactttacacgtggt

SEQ ID NO: 934388 - DNA, 22 bp, Artificial Sequence
  chemically synthesized
cacatcctaccacgtgtaaagt

SEQ ID NO: 934389 - DNA, 22 bp, Artificial Sequence
  chemically synthesized
agatttagtagcatactttaca

SEQ ID NO: 934390 - DNA, 22 bp, Artificial Sequence
  chemically synthesized
attcagatttagtagcatactt

SEQ ID NO: 934391 - DNA, 22 bp, Artificial Sequence
  chemically synthesized
aattcagatttagtagcatact

SEQ ID NO: 934392 - DNA, 22 bp, Artificial Sequence
  chemically synthesized
taattcagatttagtagcatac

SEQ ID NO: 934393 - DNA, 22 bp, Artificial Sequence
  chemically synthesized
ccacgtgtaaagtatgctacta

SEQ ID NO: 934394 - DNA, 22 bp, Artificial Sequence
  chemically synthesized
ttttaattcagatttagtagca

SEQ ID NO: 934395 - DNA, 22 bp, Artificial Sequence
  chemically synthesized
attttaattcagatttagtagc

SEQ ID NO: 934396 - DNA, 22 bp, Artificial Sequence
  chemically synthesized
tatttattttaattcagattta

SEQ ID NO: 934397 - DNA, 22 bp, Artificial Sequence
  chemically synthesized
atatttattttaattcagattt

SEQ ID NO: 934398 - DNA, 22 bp, Artificial Sequence
  chemically synthesized
atcttatatttattttaattca

SEQ ID NO: 934399 - DNA, 22 bp, Artificial Sequence
  chemically synthesized
aatcttatatttattttaattc

SEQ ID NO: 934400 - DNA, 22 bp, Artificial Sequence
  chemically synthesized
ctaaatctgaattaaaataaat

SEQ ID NO: 934401 - DNA, 22 bp, Artificial Sequence
  chemically synthesized
aatctgaattaaaataaatata

SEQ ID NO: 934402 - DNA, 22 bp, Artificial Sequence
  chemically synthesized
aattaaaataaatataagatta

SEQ ID NO: 934403 - DNA, 22 bp, Artificial Sequence
  chemically synthesized
gaaagtaatagtttaatcttat

SEQ ID NO: 934404 - DNA, 22 bp, Artificial Sequence
  chemically synthesized
ctagaaagtaatagtttaatct

SEQ ID NO: 934405 - DNA, 22 bp, Artificial Sequence
  chemically synthesized
aaataaatataagattaaacta

SEQ ID NO: 934406 - DNA, 22 bp, Artificial Sequence
  chemically synthesized
acctactagaaagtaatagttt

SEQ ID NO: 934407 - DNA, 22 bp, Artificial Sequence
  chemically synthesized
acggagtgttaacctactagaa

SEQ ID NO: 934408 - DNA, 22 bp, Artificial Sequence
  chemically synthesized
aactattactttctagtaggtt

SEQ ID NO: 934409 - DNA, 22 bp, Artificial Sequence
  chemically synthesized
ctcacggagtgttaacctacta

SEQ ID NO: 934410 - DNA, 22 bp, Artificial Sequence
  chemically synthesized
cctcacggagtgttaacctact

SEQ ID NO: 934411 - DNA, 22 bp, Artificial Sequence
  chemically synthesized
ttactttctagtaggttaacac

SEQ ID NO: 934412 - DNA, 22 bp, Artificial Sequence
  chemically synthesized
tttcctcacggagtgttaacct

SEQ ID NO: 934413 - DNA, 22 bp, Artificial Sequence
  chemically synthesized
gtttcctcacggagtgttaacc

SEQ ID NO: 934414 - DNA, 22 bp, Artificial Sequence
  chemically synthesized
ctttctagtaggttaacactcc

SEQ ID NO: 934415 - DNA, 22 bp, Artificial Sequence
  chemically synthesized
tctagtaggttaacactccgtg

SEQ ID NO: 934416 - DNA, 22 bp, Artificial Sequence
  chemically synthesized
ctagtaggttaacactccgtga

SEQ ID NO: 934417 - DNA, 22 bp, Artificial Sequence
  chemically synthesized
catcttgtttcctcacggagtg

SEQ ID NO: 934418 - DNA, 22 bp, Artificial Sequence
  chemically synthesized
tagtaggttaacactccgtgag

SEQ ID NO: 934419 - DNA, 22 bp, Artificial Sequence
  chemically synthesized
acatcttgtttcctcacggagt

SEQ ID NO: 934420 - DNA, 22 bp, Artificial Sequence
  chemically synthesized
gtaggttaacactccgtgagga

SEQ ID NO: 934421 - DNA, 22 bp, Artificial Sequence
  chemically synthesized
tatgcttacatcttgtttcctc

SEQ ID NO: 934422 - DNA, 22 bp, Artificial Sequence
  chemically synthesized
atatgcttacatcttgtttcct

SEQ ID NO: 934423 - DNA, 22 bp, Artificial Sequence
  chemically synthesized
tatatgcttacatcttgtttcc

SEQ ID NO: 934424 - DNA, 22 bp, Artificial Sequence
  chemically synthesized
acactccgtgaggaaacaagat

SEQ ID NO: 934425 - DNA, 22 bp, Artificial Sequence
  chemically synthesized
ttatatgcttacatcttgtttc

SEQ ID NO: 934426 - DNA, 22 bp, Artificial Sequence
  chemically synthesized
tttatatgcttacatcttgttt

SEQ ID NO: 934427 - DNA, 22 bp, Artificial Sequence
  chemically synthesized
actttttatatgcttacatctt

SEQ ID NO: 934428 - DNA, 22 bp, Artificial Sequence
  chemically synthesized
cgtgaggaaacaagatgtaagc

SEQ ID NO: 934429 - DNA, 22 bp, Artificial Sequence
  chemically synthesized
gactttttatatgcttacatct

SEQ ID NO: 934430 - DNA, 22 bp, Artificial Sequence
  chemically synthesized
tttgactttttatatgcttaca

SEQ ID NO: 934431 - DNA, 22 bp, Artificial Sequence
  chemically synthesized
atttgactttttatatgcttac

SEQ ID NO: 934432 - DNA, 22 bp, Artificial Sequence
  chemically synthesized
tatttgactttttatatgctta

SEQ ID NO: 934433 - DNA, 22 bp, Artificial Sequence
  chemically synthesized
aaactttatttgactttttata

SEQ ID NO: 934434 - DNA, 22 bp, Artificial Sequence
  chemically synthesized
attaaaactttatttgactttt

SEQ ID NO: 934435 - DNA, 22 bp, Artificial Sequence
  chemically synthesized
aacattaattaaaactttattt

SEQ ID NO: 934436 - DNA, 22 bp, Artificial Sequence
  chemically synthesized
gaacattaattaaaactttatt

SEQ ID NO: 934437 - DNA, 22 bp, Artificial Sequence
  chemically synthesized
tcttgaacattaattaaaactt

SEQ ID NO: 934438 - DNA, 22 bp, Artificial Sequence
  chemically synthesized
ttgtcttgaacattaattaaaa

SEQ ID NO: 934439 - DNA, 22 bp, Artificial Sequence
  chemically synthesized
tattgtcttgaacattaattaa

SEQ ID NO: 934440 - DNA, 22 bp, Artificial Sequence
  chemically synthesized
ctattgtcttgaacattaatta

SEQ ID NO: 934441 - DNA, 22 bp, Artificial Sequence
  chemically synthesized
taattaatgttcaagacaatag

SEQ ID NO: 934442 - DNA, 22 bp, Artificial Sequence
  chemically synthesized
aattaatgttcaagacaataga

SEQ ID NO: 934443 - DNA, 22 bp, Artificial Sequence
  chemically synthesized
attaatgttcaagacaatagaa

SEQ ID NO: 934444 - DNA, 22 bp, Artificial Sequence
  chemically synthesized
aaatatgacatgtcttctattg

SEQ ID NO: 934445 - DNA, 22 bp, Artificial Sequence
  chemically synthesized
atgttcaagacaatagaagaca

SEQ ID NO: 934446 - DNA, 22 bp, Artificial Sequence
  chemically synthesized
aagacaatagaagacatgtcat

SEQ ID NO: 934447 - DNA, 22 bp, Artificial Sequence
  chemically synthesized
atcaggtattgaaatatgacat

SEQ ID NO: 934448 - DNA, 22 bp, Artificial Sequence
  chemically synthesized
gaaattcatcaggtattgaaat

SEQ ID NO: 934449 - DNA, 22 bp, Artificial Sequence
  chemically synthesized
ggaaattcatcaggtattgaaa

SEQ ID NO: 934450 - DNA, 22 bp, Artificial Sequence
  chemically synthesized
tataatcaatttggaaattcat

SEQ ID NO: 934451 - DNA, 22 bp, Artificial Sequence
  chemically synthesized
caatacctgatgaatttccaaa

SEQ ID NO: 934452 - DNA, 22 bp, Artificial Sequence
  chemically synthesized
aatacctgatgaatttccaaat

SEQ ID NO: 934453 - DNA, 22 bp, Artificial Sequence
  chemically synthesized
tctgtataatcaatttggaaat

SEQ ID NO: 934454 - DNA, 22 bp, Artificial Sequence
  chemically synthesized
gtctgtataatcaatttggaaa

SEQ ID NO: 934455 - DNA, 22 bp, Artificial Sequence
  chemically synthesized
tgtctgtataatcaatttggaa

SEQ ID NO: 934456 - DNA, 22 bp, Artificial Sequence
  chemically synthesized
atgaatttccaaattgattata

SEQ ID NO: 934457 - DNA, 22 bp, Artificial Sequence
  chemically synthesized
caatattttgtctgtataatca

SEQ ID NO: 934458 - DNA, 22 bp, Artificial Sequence
  chemically synthesized
aactacaatattttgtctgtat

SEQ ID NO: 934459 - DNA, 22 bp, Artificial Sequence
  chemically synthesized
ccaaattgattatacagacaaa

SEQ ID NO: 934460 - DNA, 22 bp, Artificial Sequence
  chemically synthesized
caaattgattatacagacaaaa

SEQ ID NO: 934461 - DNA, 22 bp, Artificial Sequence
  chemically synthesized
tgaactacaatattttgtctgt

SEQ ID NO: 934462 - DNA, 22 bp, Artificial Sequence
  chemically synthesized
tctgaactacaatattttgtct

SEQ ID NO: 934463 - DNA, 22 bp, Artificial Sequence
  chemically synthesized
tctctgaactacaatattttgt

SEQ ID NO: 934464 - DNA, 22 bp, Artificial Sequence
  chemically synthesized
attatacagacaaaatattgta

SEQ ID NO: 934465 - DNA, 22 bp, Artificial Sequence
  chemically synthesized
tacagacaaaatattgtagttc

SEQ ID NO: 934466 - DNA, 22 bp, Artificial Sequence
  chemically synthesized
aagatctctctctgaactacaa

SEQ ID NO: 934467 - DNA, 22 bp, Artificial Sequence
  chemically synthesized
gaagatctctctctgaactaca

SEQ ID NO: 934468 - DNA, 22 bp, Artificial Sequence
  chemically synthesized
tgaagatctctctctgaactac

SEQ ID NO: 934469 - DNA, 22 bp, Artificial Sequence
  chemically synthesized
tcatctttgaagatctctctct

SEQ ID NO: 934470 - DNA, 22 bp, Artificial Sequence
  chemically synthesized
gtcatctttgaagatctctctc

SEQ ID NO: 934471 - DNA, 22 bp, Artificial Sequence
  chemically synthesized
tttgtcatctttgaagatctct

SEQ ID NO: 934472 - DNA, 22 bp, Artificial Sequence
  chemically synthesized
gtttgtcatctttgaagatctc

SEQ ID NO: 934473 - DNA, 22 bp, Artificial Sequence
  chemically synthesized
tagttcagagagagatcttcaa

SEQ ID NO: 934474 - DNA, 22 bp, Artificial Sequence
  chemically synthesized
tgtttgtcatctttgaagatct

SEQ ID NO: 934475 - DNA, 22 bp, Artificial Sequence
  chemically synthesized
ttgtttgtcatctttgaagatc

SEQ ID NO: 934476 - DNA, 22 bp, Artificial Sequence
  chemically synthesized
agagagagatcttcaaagatga

SEQ ID NO: 934477 - DNA, 22 bp, Artificial Sequence
  chemically synthesized
tagaccttttgtttgtcatctt

SEQ ID NO: 934478 - DNA, 22 bp, Artificial Sequence
  chemically synthesized
gtagaccttttgtttgtcatct

SEQ ID NO: 934479 - DNA, 22 bp, Artificial Sequence
  chemically synthesized
tgtagaccttttgtttgtcatc

SEQ ID NO: 934480 - DNA, 22 bp, Artificial Sequence
  chemically synthesized
ttgtagaccttttgtttgtcat

SEQ ID NO: 934481 - DNA, 22 bp, Artificial Sequence
  chemically synthesized
ttttgtagaccttttgtttgtc

SEQ ID NO: 934482 - DNA, 22 bp, Artificial Sequence
  chemically synthesized
ttcttttgtagaccttttgttt

SEQ ID NO: 934483 - DNA, 22 bp, Artificial Sequence
  chemically synthesized
caaagatgacaaacaaaaggtc

SEQ ID NO: 934484 - DNA, 22 bp, Artificial Sequence
  chemically synthesized
aaagatgacaaacaaaaggtct

SEQ ID NO: 934485 - DNA, 22 bp, Artificial Sequence
  chemically synthesized
ataaattattcttttgtagacc

SEQ ID NO: 934486 - DNA, 22 bp, Artificial Sequence
  chemically synthesized
aggaaaactcataaattattct

SEQ ID NO: 934487 - DNA, 22 bp, Artificial Sequence
  chemically synthesized
caggaaaactcataaattattc

SEQ ID NO: 934488 - DNA, 22 bp, Artificial Sequence
  chemically synthesized
tcaggaaaactcataaattatt

SEQ ID NO: 934489 - DNA, 22 bp, Artificial Sequence
  chemically synthesized
gttttcaggaaaactcataaat

SEQ ID NO: 934490 - DNA, 22 bp, Artificial Sequence
  chemically synthesized
caaaagaataatttatgagttt

SEQ ID NO: 934491 - DNA, 22 bp, Artificial Sequence
  chemically synthesized
tattggttttcaggaaaactca

SEQ ID NO: 934492 - DNA, 22 bp, Artificial Sequence
  chemically synthesized
aaaacctgtattggttttcagg

SEQ ID NO: 934493 - DNA, 22 bp, Artificial Sequence
  chemically synthesized
tcaaaacctgtattggttttca

SEQ ID NO: 934494 - DNA, 22 bp, Artificial Sequence
  chemically synthesized
atgagttttcctgaaaaccaat

SEQ ID NO: 934495 - DNA, 22 bp, Artificial Sequence
  chemically synthesized
tgagttttcctgaaaaccaata

SEQ ID NO: 934496 - DNA, 22 bp, Artificial Sequence
  chemically synthesized
tcaactctcaaaacctgtattg

SEQ ID NO: 934497 - DNA, 22 bp, Artificial Sequence
  chemically synthesized
atcaactctcaaaacctgtatt

SEQ ID NO: 934498 - DNA, 22 bp, Artificial Sequence
  chemically synthesized
tcctgaaaaccaatacaggttt

SEQ ID NO: 934499 - DNA, 22 bp, Artificial Sequence
  chemically synthesized
cctgaaaaccaatacaggtttt

SEQ ID NO: 934500 - DNA, 22 bp, Artificial Sequence
  chemically synthesized
ctgaaaaccaatacaggttttg

SEQ ID NO: 934501 - DNA, 22 bp, Artificial Sequence
  chemically synthesized
aaaaccaatacaggttttgaga

SEQ ID NO: 934502 - DNA, 22 bp, Artificial Sequence
  chemically synthesized
atcaaccatgtcttatcaactc

SEQ ID NO: 934503 - DNA, 22 bp, Artificial Sequence
  chemically synthesized
tacatctcatcaaccatgtctt

SEQ ID NO: 934504 - DNA, 22 bp, Artificial Sequence
  chemically synthesized
tgagagttgataagacatggtt

SEQ ID NO: 934505 - DNA, 22 bp, Artificial Sequence
  chemically synthesized
atacatctcatcaaccatgtct

SEQ ID NO: 934506 - DNA, 22 bp, Artificial Sequence
  chemically synthesized
gagagttgataagacatggttg

SEQ ID NO: 934507 - DNA, 22 bp, Artificial Sequence
  chemically synthesized
agagttgataagacatggttga

SEQ ID NO: 934508 - DNA, 22 bp, Artificial Sequence
  chemically synthesized
ttatacatctcatcaaccatgt

SEQ ID NO: 934509 - DNA, 22 bp, Artificial Sequence
  chemically synthesized
cttatacatctcatcaaccatg

SEQ ID NO: 934510 - DNA, 22 bp, Artificial Sequence
  chemically synthesized
tttcttatacatctcatcaacc

SEQ ID NO: 934511 - DNA, 22 bp, Artificial Sequence
  chemically synthesized
atttcttatacatctcatcaac

SEQ ID NO: 934512 - DNA, 22 bp, Artificial Sequence
  chemically synthesized
tatttcttatacatctcatcaa

SEQ ID NO: 934513 - DNA, 22 bp, Artificial Sequence
  chemically synthesized
ataagacatggttgatgagatg

SEQ ID NO: 934514 - DNA, 22 bp, Artificial Sequence
  chemically synthesized
ttatttcttatacatctcatca

SEQ ID NO: 934515 - DNA, 22 bp, Artificial Sequence
  chemically synthesized
tttatttcttatacatctcatc

SEQ ID NO: 934516 - DNA, 22 bp, Artificial Sequence
  chemically synthesized
cactttttatttcttatacatc

SEQ ID NO: 934517 - DNA, 22 bp, Artificial Sequence
  chemically synthesized
gcactttttatttcttatacat

SEQ ID NO: 934518 - DNA, 22 bp, Artificial Sequence
  chemically synthesized
ttgcactttttatttcttatac

SEQ ID NO: 934519 - DNA, 22 bp, Artificial Sequence
  chemically synthesized
atgagatgtataagaaataaaa

SEQ ID NO: 934520 - DNA, 22 bp, Artificial Sequence
  chemically synthesized
tgttcttgcactttttatttct

SEQ ID NO: 934521 - DNA, 22 bp, Artificial Sequence
  chemically synthesized
tgcgtcataaatccccctgtgt

SEQ ID NO: 934522 - DNA, 22 bp, Artificial Sequence
  chemically synthesized
aatattatgcgtcataaatccc

SEQ ID NO: 934523 - DNA, 22 bp, Artificial Sequence
  chemically synthesized
atataatctcaatattatgcgt

SEQ ID NO: 934524 - DNA, 22 bp, Artificial Sequence
  chemically synthesized
aatataatctcaatattatgcg

SEQ ID NO: 934525 - DNA, 22 bp, Artificial Sequence
  chemically synthesized
taatataatctcaatattatgc

SEQ ID NO: 934526 - DNA, 22 bp, Artificial Sequence
  chemically synthesized
ttttaatataatctcaatatta

SEQ ID NO: 934527 - DNA, 22 bp, Artificial Sequence
  chemically synthesized
atgacgcataatattgagatta

SEQ ID NO: 934528 - DNA, 22 bp, Artificial Sequence
  chemically synthesized
tgacgcataatattgagattat

SEQ ID NO: 934529 - DNA, 22 bp, Artificial Sequence
  chemically synthesized
aatgcctgttttaatataatct

SEQ ID NO: 934530 - DNA, 22 bp, Artificial Sequence
  chemically synthesized
atattcaatgcctgttttaata

SEQ ID NO: 934531 - DNA, 22 bp, Artificial Sequence
  chemically synthesized
ctgatattcaatgcctgtttta

SEQ ID NO: 934532 - DNA, 22 bp, Artificial Sequence
  chemically synthesized
cctgatattcaatgcctgtttt

SEQ ID NO: 934533 - DNA, 22 bp, Artificial Sequence
  chemically synthesized
agattatattaaaacaggcatt

SEQ ID NO: 934534 - DNA, 22 bp, Artificial Sequence
  chemically synthesized
tattaaaacaggcattgaatat

SEQ ID NO: 934535 - DNA, 22 bp, Artificial Sequence
  chemically synthesized
aaacaggcattgaatatcagga

SEQ ID NO: 934536 - DNA, 22 bp, Artificial Sequence
  chemically synthesized
gtataaaatcacccttcctgat

SEQ ID NO: 934537 - DNA, 22 bp, Artificial Sequence
  chemically synthesized
aatatcaggaagggtgatttta

SEQ ID NO: 934538 - DNA, 22 bp, Artificial Sequence
  chemically synthesized
caagatctggtataaaatcacc

SEQ ID NO: 934539 - DNA, 22 bp, Artificial Sequence
  chemically synthesized
acaagatctggtataaaatcac

SEQ ID NO: 934540 - DNA, 22 bp, Artificial Sequence
  chemically synthesized
tttacaagatctggtataaaat

SEQ ID NO: 934541 - DNA, 22 bp, Artificial Sequence
  chemically synthesized
tatttacaagatctggtataaa

SEQ ID NO: 934542 - DNA, 22 bp, Artificial Sequence
  chemically synthesized
tataccagatcttgtaaataga

SEQ ID NO: 934543 - DNA, 22 bp, Artificial Sequence
  chemically synthesized
tagtagatcccctctatttaca

SEQ ID NO: 934544 - DNA, 22 bp, Artificial Sequence
  chemically synthesized
ataccagatcttgtaaatagag

SEQ ID NO: 934545 - DNA, 22 bp, Artificial Sequence
  chemically synthesized
taccagatcttgtaaatagagg

SEQ ID NO: 934546 - DNA, 22 bp, Artificial Sequence
  chemically synthesized
aaacctgtagtagatcccctct

SEQ ID NO: 934547 - DNA, 22 bp, Artificial Sequence
  chemically synthesized
aaaacctgtagtagatcccctc

SEQ ID NO: 934548 - DNA, 22 bp, Artificial Sequence
  chemically synthesized
cttaaaacctgtagtagatccc

SEQ ID NO: 934549 - DNA, 22 bp, Artificial Sequence
  chemically synthesized
gtaaatagaggggatctactac

SEQ ID NO: 934550 - DNA, 22 bp, Artificial Sequence
  chemically synthesized
taaatagaggggatctactaca

SEQ ID NO: 934551 - DNA, 22 bp, Artificial Sequence
  chemically synthesized
tctccttaaaacctgtagtaga

SEQ ID NO: 934552 - DNA, 22 bp, Artificial Sequence
  chemically synthesized
gtctccttaaaacctgtagtag

SEQ ID NO: 934553 - DNA, 22 bp, Artificial Sequence
  chemically synthesized
tcatatcgtttgtctccttaaa

SEQ ID NO: 934554 - DNA, 22 bp, Artificial Sequence
  chemically synthesized
atcatatcgtttgtctccttaa

SEQ ID NO: 934555 - DNA, 22 bp, Artificial Sequence
  chemically synthesized
ctacaggttttaaggagacaaa

SEQ ID NO: 934556 - DNA, 22 bp, Artificial Sequence
  chemically synthesized
caggttttaaggagacaaacga

SEQ ID NO: 934557 - DNA, 22 bp, Artificial Sequence
  chemically synthesized
taaggagacaaacgatatgata

SEQ ID NO: 934558 - DNA, 22 bp, Artificial Sequence
  chemically synthesized
aaggagacaaacgatatgataa

SEQ ID NO: 934559 - DNA, 22 bp, Artificial Sequence
  chemically synthesized
aggagacaaacgatatgataaa

SEQ ID NO: 934560 - DNA, 22 bp, Artificial Sequence
  chemically synthesized
tgatcagccataaaaataacat

SEQ ID NO: 934561 - DNA, 22 bp, Artificial Sequence
  chemically synthesized
taatactgtgatcagccataaa

SEQ ID NO: 934562 - DNA, 22 bp, Artificial Sequence
  chemically synthesized
ataatactgtgatcagccataa

SEQ ID NO: 934563 - DNA, 22 bp, Artificial Sequence
  chemically synthesized
tttttatggctgatcacagtat

SEQ ID NO: 934564 - DNA, 22 bp, Artificial Sequence
  chemically synthesized
caatccatttataatactgtga

SEQ ID NO: 934565 - DNA, 22 bp, Artificial Sequence
  chemically synthesized
ttatggctgatcacagtattat

SEQ ID NO: 934566 - DNA, 22 bp, Artificial Sequence
  chemically synthesized
tatggctgatcacagtattata

SEQ ID NO: 934567 - DNA, 22 bp, Artificial Sequence
  chemically synthesized
atggctgatcacagtattataa

SEQ ID NO: 934568 - DNA, 22 bp, Artificial Sequence
  chemically synthesized
tggctgatcacagtattataaa

SEQ ID NO: 934569 - DNA, 22 bp, Artificial Sequence
  chemically synthesized
tccattccaatccatttataat

SEQ ID NO: 934570 - DNA, 22 bp, Artificial Sequence
  chemically synthesized
atcacagtattataaatggatt

SEQ ID NO: 934571 - DNA, 22 bp, Artificial Sequence
  chemically synthesized
taatcacattatccattccaat

SEQ ID NO: 934572 - DNA, 22 bp, Artificial Sequence
  chemically synthesized
gtaatcacattatccattccaa

SEQ ID NO: 934573 - DNA, 22 bp, Artificial Sequence
  chemically synthesized
taaatggattggaatggataat

SEQ ID NO: 934574 - DNA, 22 bp, Artificial Sequence
  chemically synthesized
catttgtaatcacattatccat

SEQ ID NO: 934575 - DNA, 22 bp, Artificial Sequence
  chemically synthesized
ccatttgtaatcacattatcca

SEQ ID NO: 934576 - DNA, 22 bp, Artificial Sequence
  chemically synthesized
tccatttgtaatcacattatcc

SEQ ID NO: 934577 - DNA, 22 bp, Artificial Sequence
  chemically synthesized
ctttccatttgtaatcacatta

SEQ ID NO: 934578 - DNA, 22 bp, Artificial Sequence
  chemically synthesized
cctttccatttgtaatcacatt

SEQ ID NO: 934579 - DNA, 22 bp, Artificial Sequence
  chemically synthesized
tcctttccatttgtaatcacat

SEQ ID NO: 934580 - DNA, 22 bp, Artificial Sequence
  chemically synthesized
gaatggataatgtgattacaaa

SEQ ID NO: 934581 - DNA, 22 bp, Artificial Sequence
  chemically synthesized
ctttcctttccatttgtaatca

SEQ ID NO: 934582 - DNA, 22 bp, Artificial Sequence
  chemically synthesized
cctgctttcctttccatttgta

SEQ ID NO: 934583 - DNA, 22 bp, Artificial Sequence
  chemically synthesized
tgcctgctttcctttccatttg

SEQ ID NO: 934584 - DNA, 22 bp, Artificial Sequence
  chemically synthesized
ctgcctgctttcctttccattt

SEQ ID NO: 934585 - DNA, 22 bp, Artificial Sequence
  chemically synthesized
tctgcctgctttcctttccatt

SEQ ID NO: 934586 - DNA, 22 bp, Artificial Sequence
  chemically synthesized
gtctttctgcctgctttccttt

SEQ ID NO: 934587 - DNA, 22 bp, Artificial Sequence
  chemically synthesized
caaatggaaaggaaagcaggca

SEQ ID NO: 934588 - DNA, 22 bp, Artificial Sequence
  chemically synthesized
gtctggtctttctgcctgcttt

SEQ ID NO: 934589 - DNA, 22 bp, Artificial Sequence
  chemically synthesized
ccactggtctggtctttctgcc

SEQ ID NO: 934590 - DNA, 22 bp, Artificial Sequence
  chemically synthesized
taattgccactggtctggtctt

SEQ ID NO: 934591 - DNA, 22 bp, Artificial Sequence
  chemically synthesized
cgttgtaattgccactggtctg

SEQ ID NO: 934592 - DNA, 22 bp, Artificial Sequence
  chemically synthesized
acgttgtaattgccactggtct

SEQ ID NO: 934593 - DNA, 22 bp, Artificial Sequence
  chemically synthesized
gataaaagtcatagtaccttac

SEQ ID NO: 934594 - DNA, 22 bp, Artificial Sequence
  chemically synthesized
agataaaagtcatagtacctta

SEQ ID NO: 934595 - DNA, 22 bp, Artificial Sequence
  chemically synthesized
ttagataaaagtcatagtacct

SEQ ID NO: 934596 - DNA, 22 bp, Artificial Sequence
  chemically synthesized
caacgtaaggtactatgacttt

SEQ ID NO: 934597 - DNA, 22 bp, Artificial Sequence
  chemically synthesized
caagttcttagataaaagtcat

SEQ ID NO: 934598 - DNA, 22 bp, Artificial Sequence
  chemically synthesized
ccaagttcttagataaaagtca

SEQ ID NO: 934599 - DNA, 22 bp, Artificial Sequence
  chemically synthesized
tccaagttcttagataaaagtc

SEQ ID NO: 934600 - DNA, 22 bp, Artificial Sequence
  chemically synthesized
ttccaagttcttagataaaagt

SEQ ID NO: 934601 - DNA, 22 bp, Artificial Sequence
  chemically synthesized
tttccaagttcttagataaaag

SEQ ID NO: 934602 - DNA, 22 bp, Artificial Sequence
  chemically synthesized
ttttccaagttcttagataaaa

SEQ ID NO: 934603 - DNA, 22 bp, Artificial Sequence
  chemically synthesized
tttttccaagttcttagataaa

SEQ ID NO: 934604 - DNA, 22 bp, Artificial Sequence
  chemically synthesized
ttttttccaagttcttagataa

SEQ ID NO: 934605 - DNA, 22 bp, Artificial Sequence
  chemically synthesized
ttttttttccaagttcttagat

SEQ ID NO: 934606 - DNA, 22 bp, Artificial Sequence
  chemically synthesized
tgacttttatctaagaacttgg

SEQ ID NO: 934607 - DNA, 22 bp, Artificial Sequence
  chemically synthesized
agtacctcttttttttccaagt

SEQ ID NO: 934608 - DNA, 22 bp, Artificial Sequence
  chemically synthesized
ttatctaagaacttggaaaaaa

SEQ ID NO: 934609 - DNA, 22 bp, Artificial Sequence
  chemically synthesized
tcagtacctcttttttttccaa

SEQ ID NO: 934610 - DNA, 22 bp, Artificial Sequence
  chemically synthesized
tatctaagaacttggaaaaaaa

SEQ ID NO: 934611 - DNA, 22 bp, Artificial Sequence
  chemically synthesized
ctcagtacctcttttttttcca

SEQ ID NO: 934612 - DNA, 22 bp, Artificial Sequence
  chemically synthesized
atctaagaacttggaaaaaaaa

SEQ ID NO: 934613 - DNA, 22 bp, Artificial Sequence
  chemically synthesized
tctaagaacttggaaaaaaaag

SEQ ID NO: 934614 - DNA, 22 bp, Artificial Sequence
  chemically synthesized
cttctcagtacctctttttttt

SEQ ID NO: 934615 - DNA, 22 bp, Artificial Sequence
  chemically synthesized
ccttctcagtacctcttttttt

SEQ ID NO: 934616 - DNA, 22 bp, Artificial Sequence
  chemically synthesized
tccttctcagtacctctttttt

SEQ ID NO: 934617 - DNA, 22 bp, Artificial Sequence
  chemically synthesized
agaacttggaaaaaaaagaggt

SEQ ID NO: 934618 - DNA, 22 bp, Artificial Sequence
  chemically synthesized
ttccttctcagtacctcttttt

SEQ ID NO: 934619 - DNA, 22 bp, Artificial Sequence
  chemically synthesized
cacttttccttctcagtacctc

SEQ ID NO: 934620 - DNA, 22 bp, Artificial Sequence
  chemically synthesized
ggaaaaaaaagaggtactgaga

SEQ ID NO: 934621 - DNA, 22 bp, Artificial Sequence
  chemically synthesized
gaaaaaaaagaggtactgagaa

SEQ ID NO: 934622 - DNA, 22 bp, Artificial Sequence
  chemically synthesized
caggctacacttttccttctca

SEQ ID NO: 934623 - DNA, 22 bp, Artificial Sequence
  chemically synthesized
gcaggctacacttttccttctc

SEQ ID NO: 934624 - DNA, 22 bp, Artificial Sequence
  chemically synthesized
tgcaggctacacttttccttct

SEQ ID NO: 934625 - DNA, 22 bp, Artificial Sequence
  chemically synthesized
ctttgcaggctacacttttcct

SEQ ID NO: 934626 - DNA, 22 bp, Artificial Sequence
  chemically synthesized
ctcctttgcaggctacactttt

SEQ ID NO: 934627 - DNA, 22 bp, Artificial Sequence
  chemically synthesized
ctcctcctttgcaggctacact

SEQ ID NO: 934628 - DNA, 22 bp, Artificial Sequence
  chemically synthesized
gctcctcctttgcaggctacac

SEQ ID NO: 934629 - DNA, 22 bp, Artificial Sequence
  chemically synthesized
tgctcctcctttgcaggctaca

SEQ ID NO: 934630 - DNA, 22 bp, Artificial Sequence
  chemically synthesized
agaaggaaaagtgtagcctgca

SEQ ID NO: 934631 - DNA, 22 bp, Artificial Sequence
  chemically synthesized
ttgctcctcctttgcaggctac

SEQ ID NO: 934632 - DNA, 22 bp, Artificial Sequence
  chemically synthesized
aaacccacttttgctcctcctt

SEQ ID NO: 934633 - DNA, 22 bp, Artificial Sequence
  chemically synthesized
aggttcaaacccacttttgctc

SEQ ID NO: 934634 - DNA, 22 bp, Artificial Sequence
  chemically synthesized
ttaaggttcaaacccacttttg

SEQ ID NO: 934635 - DNA, 22 bp, Artificial Sequence
  chemically synthesized
caaaggaggagcaaaagtgggt

SEQ ID NO: 934636 - DNA, 22 bp, Artificial Sequence
  chemically synthesized
caacctattaaggttcaaaccc

SEQ ID NO: 934637 - DNA, 22 bp, Artificial Sequence
  chemically synthesized
ccaacctattaaggttcaaacc

SEQ ID NO: 934638 - DNA, 22 bp, Artificial Sequence
  chemically synthesized
cttccaacctattaaggttcaa

SEQ ID NO: 934639 - DNA, 22 bp, Artificial Sequence
  chemically synthesized
ttccttccaacctattaaggtt

SEQ ID NO: 934640 - DNA, 22 bp, Artificial Sequence
  chemically synthesized
ctgttccttccaacctattaag

SEQ ID NO: 934641 - DNA, 22 bp, Artificial Sequence
  chemically synthesized
cctgttccttccaacctattaa

SEQ ID NO: 934642 - DNA, 22 bp, Artificial Sequence
  chemically synthesized
acttcctgttccttccaaccta

SEQ ID NO: 934643 - DNA, 22 bp, Artificial Sequence
  chemically synthesized
gaaccttaataggttggaagga

SEQ ID NO: 934644 - DNA, 22 bp, Artificial Sequence
  chemically synthesized
aaccttaataggttggaaggaa

SEQ ID NO: 934645 - DNA, 22 bp, Artificial Sequence
  chemically synthesized
aataggttggaaggaacaggaa

SEQ ID NO: 934646 - DNA, 22 bp, Artificial Sequence
  chemically synthesized
ataggttggaaggaacaggaag

SEQ ID NO: 934647 - DNA, 22 bp, Artificial Sequence
  chemically synthesized
gaaggaacaggaagtcaattgt

SEQ ID NO: 934648 - DNA, 22 bp, Artificial Sequence
  chemically synthesized
caaagtcatccccacaattgac

SEQ ID NO: 934649 - DNA, 22 bp, Artificial Sequence
  chemically synthesized
ccctccaaagtcatccccacaa

SEQ ID NO: 934650 - DNA, 22 bp, Artificial Sequence
  chemically synthesized
tcccctccaaagtcatccccac

SEQ ID NO: 934651 - DNA, 22 bp, Artificial Sequence
  chemically synthesized
ctctcccctccaaagtcatccc

SEQ ID NO: 934652 - DNA, 22 bp, Artificial Sequence
  chemically synthesized
atccctgctctcccctccaaag

SEQ ID NO: 934653 - DNA, 22 bp, Artificial Sequence
  chemically synthesized
tggggatgactttggaggggag

SEQ ID NO: 934654 - DNA, 22 bp, Artificial Sequence
  chemically synthesized
caaattcatccctgctctcccc

SEQ ID NO: 934655 - DNA, 22 bp, Artificial Sequence
  chemically synthesized
gcaaattcatccctgctctccc

SEQ ID NO: 934656 - DNA, 22 bp, Artificial Sequence
  chemically synthesized
tgcaaattcatccctgctctcc

SEQ ID NO: 934657 - DNA, 22 bp, Artificial Sequence
  chemically synthesized
tggaggggagagcagggatgaa

SEQ ID NO: 934658 - DNA, 22 bp, Artificial Sequence
  chemically synthesized
ggaggggagagcagggatgaat

SEQ ID NO: 934659 - DNA, 22 bp, Artificial Sequence
  chemically synthesized
gaggggagagcagggatgaatt

SEQ ID NO: 934660 - DNA, 22 bp, Artificial Sequence
  chemically synthesized
catatgactttgcaaattcatc

SEQ ID NO: 934661 - DNA, 22 bp, Artificial Sequence
  chemically synthesized
ccatatgactttgcaaattcat

SEQ ID NO: 934662 - DNA, 22 bp, Artificial Sequence
  chemically synthesized
cgtatgaccgcagtttccatat

SEQ ID NO: 934663 - DNA, 22 bp, Artificial Sequence
  chemically synthesized
gcaaagtcatatggaaactgcg

SEQ ID NO: 934664 - DNA, 22 bp, Artificial Sequence
  chemically synthesized
caaagtcatatggaaactgcgg

SEQ ID NO: 934665 - DNA, 22 bp, Artificial Sequence
  chemically synthesized
gacatgacatgtggatatctcc

SEQ ID NO: 934666 - DNA, 22 bp, Artificial Sequence
  chemically synthesized
cggtcatacggagatatccaca

SEQ ID NO: 934667 - DNA, 22 bp, Artificial Sequence
  chemically synthesized
cctggacatgacatgtggatat

SEQ ID NO: 934668 - DNA, 22 bp, Artificial Sequence
  chemically synthesized
ctacctggacatgacatgtgga

SEQ ID NO: 934669 - DNA, 22 bp, Artificial Sequence
  chemically synthesized
gccctactacctggacatgaca

SEQ ID NO: 934670 - DNA, 22 bp, Artificial Sequence
  chemically synthesized
tagccctactacctggacatga

SEQ ID NO: 934671 - DNA, 22 bp, Artificial Sequence
  chemically synthesized
ctagccctactacctggacatg

SEQ ID NO: 934672 - DNA, 22 bp, Artificial Sequence
  chemically synthesized
tatttctagccctactacctgg

SEQ ID NO: 934673 - DNA, 22 bp, Artificial Sequence
  chemically synthesized
caacctgtatttctagccctac

SEQ ID NO: 934674 - DNA, 22 bp, Artificial Sequence
  chemically synthesized
ttccaacctgtatttctagccc

SEQ ID NO: 934675 - DNA, 22 bp, Artificial Sequence
  chemically synthesized
tgttccaacctgtatttctagc

SEQ ID NO: 934676 - DNA, 22 bp, Artificial Sequence
  chemically synthesized
tctctgttccaacctgtatttc

SEQ ID NO: 934677 - DNA, 22 bp, Artificial Sequence
  chemically synthesized
atctctgttccaacctgtattt

SEQ ID NO: 934678 - DNA, 22 bp, Artificial Sequence
  chemically synthesized
tatctctgttccaacctgtatt

SEQ ID NO: 934679 - DNA, 22 bp, Artificial Sequence
  chemically synthesized
ttatctctgttccaacctgtat

SEQ ID NO: 934680 - DNA, 22 bp, Artificial Sequence
  chemically synthesized
tttatctctgttccaacctgta

SEQ ID NO: 934681 - DNA, 22 bp, Artificial Sequence
  chemically synthesized
ttttttatctctgttccaacct

SEQ ID NO: 934682 - DNA, 22 bp, Artificial Sequence
  chemically synthesized
gaaatacaggttggaacagaga

SEQ ID NO: 934683 - DNA, 22 bp, Artificial Sequence
  chemically synthesized
tcctgttttttatctctgttcc

SEQ ID NO: 934684 - DNA, 22 bp, Artificial Sequence
  chemically synthesized
gctatcctgttttttatctctg

SEQ ID NO: 934685 - DNA, 22 bp, Artificial Sequence
  chemically synthesized
ggctatcctgttttttatctct

SEQ ID NO: 934686 - DNA, 22 bp, Artificial Sequence
  chemically synthesized
tggctatcctgttttttatctc

SEQ ID NO: 934687 - DNA, 22 bp, Artificial Sequence
  chemically synthesized
gctttggctatcctgtttttta

SEQ ID NO: 934688 - DNA, 22 bp, Artificial Sequence
  chemically synthesized
tggctttggctatcctgttttt

SEQ ID NO: 934689 - DNA, 22 bp, Artificial Sequence
  chemically synthesized
gaacagagataaaaaacaggat

SEQ ID NO: 934690 - DNA, 22 bp, Artificial Sequence
  chemically synthesized
ctggctttggctatcctgtttt

SEQ ID NO: 934691 - DNA, 22 bp, Artificial Sequence
  chemically synthesized
atcttctggctttggctatcct

SEQ ID NO: 934692 - DNA, 22 bp, Artificial Sequence
  chemically synthesized
catctcatcttctggctttggc

SEQ ID NO: 934693 - DNA, 22 bp, Artificial Sequence
  chemically synthesized
acatctcatcttctggctttgg

SEQ ID NO: 934694 - DNA, 22 bp, Artificial Sequence
  chemically synthesized
tttacatctcatcttctggctt

SEQ ID NO: 934695 - DNA, 22 bp, Artificial Sequence
  chemically synthesized
gtttacatctcatcttctggct

SEQ ID NO: 934696 - DNA, 22 bp, Artificial Sequence
  chemically synthesized
tgtttacatctcatcttctggc

SEQ ID NO: 934697 - DNA, 22 bp, Artificial Sequence
  chemically synthesized
acctttgtttacatctcatctt

SEQ ID NO: 934698 - DNA, 22 bp, Artificial Sequence
  chemically synthesized
acctcacctttgtttacatctc

SEQ ID NO: 934699 - DNA, 22 bp, Artificial Sequence
  chemically synthesized
tgacctcacctttgtttacatc

SEQ ID NO: 934700 - DNA, 22 bp, Artificial Sequence
  chemically synthesized
actctgacctcacctttgttta

SEQ ID NO: 934701 - DNA, 22 bp, Artificial Sequence
  chemically synthesized
tcactctgacctcacctttgtt

SEQ ID NO: 934702 - DNA, 22 bp, Artificial Sequence
  chemically synthesized
ctcactctgacctcacctttgt

SEQ ID NO: 934703 - DNA, 22 bp, Artificial Sequence
  chemically synthesized
tctcactctgacctcacctttg

SEQ ID NO: 934704 - DNA, 22 bp, Artificial Sequence
  chemically synthesized
tttctcactctgacctcacctt

SEQ ID NO: 934705 - DNA, 22 bp, Artificial Sequence
  chemically synthesized
tctttctcactctgacctcacc

SEQ ID NO: 934706 - DNA, 22 bp, Artificial Sequence
  chemically synthesized
ctctttctcactctgacctcac

SEQ ID NO: 934707 - DNA, 22 bp, Artificial Sequence
  chemically synthesized
tctctttctcactctgacctca

SEQ ID NO: 934708 - DNA, 22 bp, Artificial Sequence
  chemically synthesized
ttttctctttctcactctgacc

SEQ ID NO: 934709 - DNA, 22 bp, Artificial Sequence
  chemically synthesized
ttgttttctctttctcactctg

SEQ ID NO: 934710 - DNA, 22 bp, Artificial Sequence
  chemically synthesized
attgttttctctttctcactct

SEQ ID NO: 934711 - DNA, 22 bp, Artificial Sequence
  chemically synthesized
aggcttattgttttctctttct

SEQ ID NO: 934712 - DNA, 22 bp, Artificial Sequence
  chemically synthesized
atgtgtcaaaatcatcagttga

SEQ ID NO: 934713 - DNA, 22 bp, Artificial Sequence
  chemically synthesized
tcatgtgtcaaaatcatcagtt

SEQ ID NO: 934714 - DNA, 22 bp, Artificial Sequence
  chemically synthesized
ctctcatgtgtcaaaatcatca

SEQ ID NO: 934715 - DNA, 22 bp, Artificial Sequence
  chemically synthesized
ttcctctcatgtgtcaaaatca

SEQ ID NO: 934716 - DNA, 22 bp, Artificial Sequence
  chemically synthesized
attcctctcatgtgtcaaaatc

SEQ ID NO: 934717 - DNA, 22 bp, Artificial Sequence
  chemically synthesized
tattcctctcatgtgtcaaaat

SEQ ID NO: 934718 - DNA, 22 bp, Artificial Sequence
  chemically synthesized
ttattcctctcatgtgtcaaaa

SEQ ID NO: 934719 - DNA, 22 bp, Artificial Sequence
  chemically synthesized
tttattcctctcatgtgtcaaa

SEQ ID NO: 934720 - DNA, 22 bp, Artificial Sequence
  chemically synthesized
aactgatgattttgacacatga

SEQ ID NO: 934721 - DNA, 22 bp, Artificial Sequence
  chemically synthesized
gttttttattcctctcatgtgt

SEQ ID NO: 934722 - DNA, 22 bp, Artificial Sequence
  chemically synthesized
atgattttgacacatgagagga

SEQ ID NO: 934723 - DNA, 22 bp, Artificial Sequence
  chemically synthesized
ctagttttttattcctctcatg

SEQ ID NO: 934724 - DNA, 22 bp, Artificial Sequence
  chemically synthesized
tgacacatgagaggaataaaaa

SEQ ID NO: 934725 - DNA, 22 bp, Artificial Sequence
  chemically synthesized
gacacatgagaggaataaaaaa

SEQ ID NO: 934726 - DNA, 22 bp, Artificial Sequence
  chemically synthesized
taatattcctagttttttattc

SEQ ID NO: 934727 - DNA, 22 bp, Artificial Sequence
  chemically synthesized
acacatgagaggaataaaaaac

SEQ ID NO: 934728 - DNA, 22 bp, Artificial Sequence
  chemically synthesized
tgtaatattcctagttttttat

SEQ ID NO: 934729 - DNA, 22 bp, Artificial Sequence
  chemically synthesized
ctgtaatattcctagtttttta

SEQ ID NO: 934730 - DNA, 22 bp, Artificial Sequence
  chemically synthesized
gcttctgtaatattcctagttt

SEQ ID NO: 934731 - DNA, 22 bp, Artificial Sequence
  chemically synthesized
agcttctgtaatattcctagtt

SEQ ID NO: 934732 - DNA, 22 bp, Artificial Sequence
  chemically synthesized
tagcttctgtaatattcctagt

SEQ ID NO: 934733 - DNA, 22 bp, Artificial Sequence
  chemically synthesized
taaccctttagcttctgtaata

SEQ ID NO: 934734 - DNA, 22 bp, Artificial Sequence
  chemically synthesized
aagtctgtaaccctttagcttc

SEQ ID NO: 934735 - DNA, 22 bp, Artificial Sequence
  chemically synthesized
ggaatattacagaagctaaagg

SEQ ID NO: 934736 - DNA, 22 bp, Artificial Sequence
  chemically synthesized
aaagtctgtaaccctttagctt

SEQ ID NO: 934737 - DNA, 22 bp, Artificial Sequence
  chemically synthesized
taaagtctgtaaccctttagct

SEQ ID NO: 934738 - DNA, 22 bp, Artificial Sequence
  chemically synthesized
ttaaagtctgtaaccctttagc

SEQ ID NO: 934739 - DNA, 22 bp, Artificial Sequence
  chemically synthesized
tttaaagtctgtaaccctttag

SEQ ID NO: 934740 - DNA, 22 bp, Artificial Sequence
  chemically synthesized
ttttaaagtctgtaacccttta

SEQ ID NO: 934741 - DNA, 22 bp, Artificial Sequence
  chemically synthesized
tttttaaagtctgtaacccttt

SEQ ID NO: 934742 - DNA, 22 bp, Artificial Sequence
  chemically synthesized
ttttttaaagtctgtaaccctt

SEQ ID NO: 934743 - DNA, 22 bp, Artificial Sequence
  chemically synthesized
tttttttaaagtctgtaaccct

SEQ ID NO: 934744 - DNA, 22 bp, Artificial Sequence
  chemically synthesized
ttttttttaaagtctgtaaccc

SEQ ID NO: 934745 - DNA, 22 bp, Artificial Sequence
  chemically synthesized
cagaagctaaagggttacagac

SEQ ID NO: 934746 - DNA, 22 bp, Artificial Sequence
  chemically synthesized
tttttttttaaagtctgtaacc

SEQ ID NO: 934747 - DNA, 22 bp, Artificial Sequence
  chemically synthesized
ttttttttttaaagtctgtaac

SEQ ID NO: 934748 - DNA, 22 bp, Artificial Sequence
  chemically synthesized
tttttttttttaaagtctgtaa

SEQ ID NO: 934749 - DNA, 22 bp, Artificial Sequence
  chemically synthesized
ttttttttttttaaagtctgta

SEQ ID NO: 934750 - DNA, 22 bp, Artificial Sequence
  chemically synthesized
tttttttttttttaaagtctgt

SEQ ID NO: 934751 - DNA, 22 bp, Artificial Sequence
  chemically synthesized
ctttttttttttttttaaagtc

SEQ ID NO: 934752 - DNA, 22 bp, Artificial Sequence
  chemically synthesized
cctttttttttttttttaaagt

SEQ ID NO: 934753 - DNA, 22 bp, Artificial Sequence
  chemically synthesized
aagggttacagactttaaaaaa

SEQ ID NO: 934754 - DNA, 22 bp, Artificial Sequence
  chemically synthesized
cccttccttttttttttttttt

SEQ ID NO: 934755 - DNA, 22 bp, Artificial Sequence
  chemically synthesized
cagactttaaaaaaaaaaaaaa

SEQ ID NO: 934756 - DNA, 22 bp, Artificial Sequence
  chemically synthesized
cgatattccccttccttttttt

SEQ ID NO: 934757 - DNA, 22 bp, Artificial Sequence
  chemically synthesized
taaaaaaaaaaaaaaaggaagg

SEQ ID NO: 934758 - DNA, 22 bp, Artificial Sequence
  chemically synthesized
aaaaaaaaaaaaaaaggaaggg

SEQ ID NO: 934759 - DNA, 22 bp, Artificial Sequence
  chemically synthesized
aaaaaaaaaaaaaaggaagggg

SEQ ID NO: 934760 - DNA, 22 bp, Artificial Sequence
  chemically synthesized
aataccactgcgatattcccct

SEQ ID NO: 934761 - DNA, 22 bp, Artificial Sequence
  chemically synthesized
ttcaataccactgcgatattcc

SEQ ID NO: 934762 - DNA, 22 bp, Artificial Sequence
  chemically synthesized
gttcaataccactgcgatattc

SEQ ID NO: 934763 - DNA, 22 bp, Artificial Sequence
  chemically synthesized
tcttgttcaataccactgcgat

SEQ ID NO: 934764 - DNA, 22 bp, Artificial Sequence
  chemically synthesized
atcttgttcaataccactgcga

SEQ ID NO: 934765 - DNA, 22 bp, Artificial Sequence
  chemically synthesized
tatcttgttcaataccactgcg

SEQ ID NO: 934766 - DNA, 22 bp, Artificial Sequence
  chemically synthesized
ccattttatcttgttcaatacc

SEQ ID NO: 934767 - DNA, 22 bp, Artificial Sequence
  chemically synthesized
tgccattttatcttgttcaata

SEQ ID NO: 934768 - DNA, 22 bp, Artificial Sequence
  chemically synthesized
tctgccattttatcttgttcaa

SEQ ID NO: 934769 - DNA, 22 bp, Artificial Sequence
  chemically synthesized
ctctgccattttatcttgttca

SEQ ID NO: 934770 - DNA, 22 bp, Artificial Sequence
  chemically synthesized
gcttctctgccattttatcttg

SEQ ID NO: 934771 - DNA, 22 bp, Artificial Sequence
  chemically synthesized
aacaagataaaatggcagagaa

SEQ ID NO: 934772 - DNA, 22 bp, Artificial Sequence
  chemically synthesized
ccaaatccattggcttctctgc

SEQ ID NO: 934773 - DNA, 22 bp, Artificial Sequence
  chemically synthesized
gccaaatccattggcttctctg

SEQ ID NO: 934774 - DNA, 22 bp, Artificial Sequence
  chemically synthesized
aaaatcaacaataatgtatttg

SEQ ID NO: 934775 - DNA, 22 bp, Artificial Sequence
  chemically synthesized
caaaatcaacaataatgtattt

SEQ ID NO: 934776 - DNA, 22 bp, Artificial Sequence
  chemically synthesized
tcaaaatcaacaataatgtatt

SEQ ID NO: 934777 - DNA, 22 bp, Artificial Sequence
  chemically synthesized
ggcaaatacattattgttgatt

SEQ ID NO: 934778 - DNA, 22 bp, Artificial Sequence
  chemically synthesized
gcaaatacattattgttgattt

SEQ ID NO: 934779 - DNA, 22 bp, Artificial Sequence
  chemically synthesized
tagaataaactttcaaaatcaa

SEQ ID NO: 934780 - DNA, 22 bp, Artificial Sequence
  chemically synthesized
aatagctgtagaataaactttc

SEQ ID NO: 934781 - DNA, 22 bp, Artificial Sequence
  chemically synthesized
ttgttgattttgaaagtttatt

SEQ ID NO: 934782 - DNA, 22 bp, Artificial Sequence
  chemically synthesized
aaatagctgtagaataaacttt

SEQ ID NO: 934783 - DNA, 22 bp, Artificial Sequence
  chemically synthesized
ttgattttgaaagtttattcta

SEQ ID NO: 934784 - DNA, 22 bp, Artificial Sequence
  chemically synthesized
cttaaatagctgtagaataaac

SEQ ID NO: 934785 - DNA, 22 bp, Artificial Sequence
  chemically synthesized
attttgaaagtttattctacag

SEQ ID NO: 934786 - DNA, 22 bp, Artificial Sequence
  chemically synthesized
tgaaagtttattctacagctat

SEQ ID NO: 934787 - DNA, 22 bp, Artificial Sequence
  chemically synthesized
gaaagtttattctacagctatt

SEQ ID NO: 934788 - DNA, 22 bp, Artificial Sequence
  chemically synthesized
aaagtttattctacagctattt

SEQ ID NO: 934789 - DNA, 22 bp, Artificial Sequence
  chemically synthesized
attctacagctatttaaggaat

SEQ ID NO: 934790 - DNA, 22 bp, Artificial Sequence
  chemically synthesized
ttctacagctatttaaggaatg

SEQ ID NO: 934791 - DNA, 22 bp, Artificial Sequence
  chemically synthesized
gaacataatgggcattccttaa

SEQ ID NO: 934792 - DNA, 22 bp, Artificial Sequence
  chemically synthesized
ggaacataatgggcattcctta

SEQ ID NO: 934793 - DNA, 22 bp, Artificial Sequence
  chemically synthesized
tacagctatttaaggaatgccc

SEQ ID NO: 934794 - DNA, 22 bp, Artificial Sequence
  chemically synthesized
cagctatttaaggaatgcccat

SEQ ID NO: 934795 - DNA, 22 bp, Artificial Sequence
  chemically synthesized
tttaaggaatgcccattatgtt

SEQ ID NO: 934796 - DNA, 22 bp, Artificial Sequence
  chemically synthesized
aaggaatgcccattatgttcca

SEQ ID NO: 934797 - DNA, 22 bp, Artificial Sequence
  chemically synthesized
aggaatgcccattatgttccaa

SEQ ID NO: 934798 - DNA, 22 bp, Artificial Sequence
  chemically synthesized
gaacatggaacagtgcttggaa

SEQ ID NO: 934799 - DNA, 22 bp, Artificial Sequence
  chemically synthesized
agaacatggaacagtgcttgga

SEQ ID NO: 934800 - DNA, 22 bp, Artificial Sequence
  chemically synthesized
tagaacatggaacagtgcttgg

SEQ ID NO: 934801 - DNA, 22 bp, Artificial Sequence
  chemically synthesized
tgttccaagcactgttccatgt

SEQ ID NO: 934802 - DNA, 22 bp, Artificial Sequence
  chemically synthesized
ccgtatctttagaacatggaac

SEQ ID NO: 934803 - DNA, 22 bp, Artificial Sequence
  chemically synthesized
caagcactgttccatgttctaa

SEQ ID NO: 934804 - DNA, 22 bp, Artificial Sequence
  chemically synthesized
actgccgtatctttagaacatg

SEQ ID NO: 934805 - DNA, 22 bp, Artificial Sequence
  chemically synthesized
ttccatgttctaaagatacggc

SEQ ID NO: 934806 - DNA, 22 bp, Artificial Sequence
  chemically synthesized
catgagagctcactgccgtatc

SEQ ID NO: 934807 - DNA, 22 bp, Artificial Sequence
  chemically synthesized
catgttctaaagatacggcagt

SEQ ID NO: 934808 - DNA, 22 bp, Artificial Sequence
  chemically synthesized
taaagatacggcagtgagctct

SEQ ID NO: 934809 - DNA, 22 bp, Artificial Sequence
  chemically synthesized
ataaattccatgagagctcact

SEQ ID NO: 934810 - DNA, 22 bp, Artificial Sequence
  chemically synthesized
cataaattccatgagagctcac

SEQ ID NO: 934811 - DNA, 22 bp, Artificial Sequence
  chemically synthesized
aagatacggcagtgagctctca

SEQ ID NO: 934812 - DNA, 22 bp, Artificial Sequence
  chemically synthesized
ccttcataaattccatgagagc

SEQ ID NO: 934813 - DNA, 22 bp, Artificial Sequence
  chemically synthesized
tgttgccttcataaattccatg

SEQ ID NO: 934814 - DNA, 22 bp, Artificial Sequence
  chemically synthesized
atgttgccttcataaattccat

SEQ ID NO: 934815 - DNA, 22 bp, Artificial Sequence
  chemically synthesized
tatgttgccttcataaattcca

SEQ ID NO: 934816 - DNA, 22 bp, Artificial Sequence
  chemically synthesized
ttttatgttgccttcataaatt

SEQ ID NO: 934817 - DNA, 22 bp, Artificial Sequence
  chemically synthesized
attttatgttgccttcataaat

SEQ ID NO: 934818 - DNA, 22 bp, Artificial Sequence
  chemically synthesized
tttattttatgttgccttcata

SEQ ID NO: 934819 - DNA, 22 bp, Artificial Sequence
  chemically synthesized
tcatggaatttatgaaggcaac

SEQ ID NO: 934820 - DNA, 22 bp, Artificial Sequence
  chemically synthesized
atggaatttatgaaggcaacat

SEQ ID NO: 934821 - DNA, 22 bp, Artificial Sequence
  chemically synthesized
gttgtttattttatgttgcctt

SEQ ID NO: 934822 - DNA, 22 bp, Artificial Sequence
  chemically synthesized
agttgtttattttatgttgcct

SEQ ID NO: 934823 - DNA, 22 bp, Artificial Sequence
  chemically synthesized
ttagttgtttattttatgttgc

SEQ ID NO: 934824 - DNA, 22 bp, Artificial Sequence
  chemically synthesized
cttagttgtttattttatgttg

SEQ ID NO: 934825 - DNA, 22 bp, Artificial Sequence
  chemically synthesized
tcttagttgtttattttatgtt

SEQ ID NO: 934826 - DNA, 22 bp, Artificial Sequence
  chemically synthesized
atgaaggcaacataaaataaac

SEQ ID NO: 934827 - DNA, 22 bp, Artificial Sequence
  chemically synthesized
tgaaggcaacataaaataaaca

SEQ ID NO: 934828 - DNA, 22 bp, Artificial Sequence
  chemically synthesized
tatcatgcatcggttttcttag

SEQ ID NO: 934829 - DNA, 22 bp, Artificial Sequence
  chemically synthesized
gtatcatgcatcggttttctta

SEQ ID NO: 934830 - DNA, 22 bp, Artificial Sequence
  chemically synthesized
tcaccttgtatcatgcatcggt

SEQ ID NO: 934831 - DNA, 22 bp, Artificial Sequence
  chemically synthesized
atcaccttgtatcatgcatcgg

SEQ ID NO: 934832 - DNA, 22 bp, Artificial Sequence
  chemically synthesized
tatcaccttgtatcatgcatcg

SEQ ID NO: 934833 - DNA, 22 bp, Artificial Sequence
  chemically synthesized
tttatcaccttgtatcatgcat

SEQ ID NO: 934834 - DNA, 22 bp, Artificial Sequence
  chemically synthesized
agaaaaccgatgcatgatacaa

SEQ ID NO: 934835 - DNA, 22 bp, Artificial Sequence
  chemically synthesized
atattctttatcaccttgtatc

SEQ ID NO: 934836 - DNA, 22 bp, Artificial Sequence
  chemically synthesized
catattctttatcaccttgtat

SEQ ID NO: 934837 - DNA, 22 bp, Artificial Sequence
  chemically synthesized
ttcatattctttatcaccttgt

SEQ ID NO: 934838 - DNA, 22 bp, Artificial Sequence
  chemically synthesized
agtctcttcatattctttatca

SEQ ID NO: 934839 - DNA, 22 bp, Artificial Sequence
  chemically synthesized
aagtctcttcatattctttatc

SEQ ID NO: 934840 - DNA, 22 bp, Artificial Sequence
  chemically synthesized
taagtctcttcatattctttat

SEQ ID NO: 934841 - DNA, 22 bp, Artificial Sequence
  chemically synthesized
cgttttaagtctcttcatattc

SEQ ID NO: 934842 - DNA, 22 bp, Artificial Sequence
  chemically synthesized
cactgcgttttaagtctcttca

SEQ ID NO: 934843 - DNA, 22 bp, Artificial Sequence
  chemically synthesized
acactgcgttttaagtctcttc

SEQ ID NO: 934844 - DNA, 22 bp, Artificial Sequence
  chemically synthesized
cttacactgcgttttaagtctc

SEQ ID NO: 934845 - DNA, 22 bp, Artificial Sequence
  chemically synthesized
ccttacactgcgttttaagtct

SEQ ID NO: 934846 - DNA, 22 bp, Artificial Sequence
  chemically synthesized
cacttccttacactgcgtttta

SEQ ID NO: 934847 - DNA, 22 bp, Artificial Sequence
  chemically synthesized
tccacttccttacactgcgttt

SEQ ID NO: 934848 - DNA, 22 bp, Artificial Sequence
  chemically synthesized
actctccacttccttacactgc

SEQ ID NO: 934849 - DNA, 22 bp, Artificial Sequence
  chemically synthesized
tcactctccacttccttacact

SEQ ID NO: 934850 - DNA, 22 bp, Artificial Sequence
  chemically synthesized
ttctcactctccacttccttac

SEQ ID NO: 934851 - DNA, 22 bp, Artificial Sequence
  chemically synthesized
aaaacgcagtgtaaggaagtgg

SEQ ID NO: 934852 - DNA, 22 bp, Artificial Sequence
  chemically synthesized
aaacgcagtgtaaggaagtgga

SEQ ID NO: 934853 - DNA, 22 bp, Artificial Sequence
  chemically synthesized
ctgttctcactctccacttcct

SEQ ID NO: 934854 - DNA, 22 bp, Artificial Sequence
  chemically synthesized
cagtgaccacagtaatatagta

SEQ ID NO: 934855 - DNA, 22 bp, Artificial Sequence
  chemically synthesized
ccattacagtgaccacagtaat

SEQ ID NO: 934856 - DNA, 22 bp, Artificial Sequence
  chemically synthesized
gctcccattacagtgaccacag

SEQ ID NO: 934857 - DNA, 22 bp, Artificial Sequence
  chemically synthesized
ttagctcccattacagtgacca

SEQ ID NO: 934858 - DNA, 22 bp, Artificial Sequence
  chemically synthesized
ctatattactgtggtcactgta

SEQ ID NO: 934859 - DNA, 22 bp, Artificial Sequence
  chemically synthesized
tattactgtggtcactgtaatg

SEQ ID NO: 934860 - DNA, 22 bp, Artificial Sequence
  chemically synthesized
ctgtggtcactgtaatgggagc

SEQ ID NO: 934861 - DNA, 22 bp, Artificial Sequence
  chemically synthesized
aggagtgtctattagctcccat

SEQ ID NO: 934862 - DNA, 22 bp, Artificial Sequence
  chemically synthesized
tggtcactgtaatgggagctaa

SEQ ID NO: 934863 - DNA, 22 bp, Artificial Sequence
  chemically synthesized
cctcaggagtgtctattagctc

SEQ ID NO: 934864 - DNA, 22 bp, Artificial Sequence
  chemically synthesized
ccctcaggagtgtctattagct

SEQ ID NO: 934865 - DNA, 22 bp, Artificial Sequence
  chemically synthesized
acttccctcaggagtgtctatt

SEQ ID NO: 934866 - DNA, 22 bp, Artificial Sequence
  chemically synthesized
taatgggagctaatagacactc

SEQ ID NO: 934867 - DNA, 22 bp, Artificial Sequence
  chemically synthesized
taacttccctcaggagtgtcta

SEQ ID NO: 934868 - DNA, 22 bp, Artificial Sequence
  chemically synthesized
ccctctaacttccctcaggagt

SEQ ID NO: 934869 - DNA, 22 bp, Artificial Sequence
  chemically synthesized
accctctaacttccctcaggag

SEQ ID NO: 934870 - DNA, 22 bp, Artificial Sequence
  chemically synthesized
atagacactcctgagggaagtt

SEQ ID NO: 934871 - DNA, 22 bp, Artificial Sequence
  chemically synthesized
tccacacgtcttaccctctaac

SEQ ID NO: 934872 - DNA, 22 bp, Artificial Sequence
  chemically synthesized
ctgagggaagttagagggtaag

SEQ ID NO: 934873 - DNA, 22 bp, Artificial Sequence
  chemically synthesized
agctatccacacgtcttaccct

SEQ ID NO: 934874 - DNA, 22 bp, Artificial Sequence
  chemically synthesized
agggaagttagagggtaagacg

SEQ ID NO: 934875 - DNA, 22 bp, Artificial Sequence
  chemically synthesized
cagctatccacacgtcttaccc

SEQ ID NO: 934876 - DNA, 22 bp, Artificial Sequence
  chemically synthesized
ttcagctatccacacgtcttac

SEQ ID NO: 934877 - DNA, 22 bp, Artificial Sequence
  chemically synthesized
cttcagctatccacacgtctta

SEQ ID NO: 934878 - DNA, 22 bp, Artificial Sequence
  chemically synthesized
tcttcagctatccacacgtctt

SEQ ID NO: 934879 - DNA, 22 bp, Artificial Sequence
  chemically synthesized
tttcttcagctatccacacgtc

SEQ ID NO: 934880 - DNA, 22 bp, Artificial Sequence
  chemically synthesized
ctttcttcagctatccacacgt

SEQ ID NO: 934881 - DNA, 22 bp, Artificial Sequence
  chemically synthesized
gagggtaagacgtgtggatagc

SEQ ID NO: 934882 - DNA, 22 bp, Artificial Sequence
  chemically synthesized
aaccttctttcttcagctatcc

SEQ ID NO: 934883 - DNA, 22 bp, Artificial Sequence
  chemically synthesized
aaattcaaccttctttcttcag

SEQ ID NO: 934884 - DNA, 22 bp, Artificial Sequence
  chemically synthesized
ctgaaattcaaccttctttctt

SEQ ID NO: 934885 - DNA, 22 bp, Artificial Sequence
  chemically synthesized
ctgctgaaattcaaccttcttt

SEQ ID NO: 934886 - DNA, 22 bp, Artificial Sequence
  chemically synthesized
ctcctgctgaaattcaaccttc

SEQ ID NO: 934887 - DNA, 22 bp, Artificial Sequence
  chemically synthesized
attcctcctgctgaaattcaac

SEQ ID NO: 934888 - DNA, 22 bp, Artificial Sequence
  chemically synthesized
gattcctcctgctgaaattcaa

SEQ ID NO: 934889 - DNA, 22 bp, Artificial Sequence
  chemically synthesized
aagaaagaaggttgaatttcag

SEQ ID NO: 934890 - DNA, 22 bp, Artificial Sequence
  chemically synthesized
tgattcctcctgctgaaattca

SEQ ID NO: 934891 - DNA, 22 bp, Artificial Sequence
  chemically synthesized
gttttgattcctcctgctgaaa

SEQ ID NO: 934892 - DNA, 22 bp, Artificial Sequence
  chemically synthesized
ggttttgattcctcctgctgaa

SEQ ID NO: 934893 - DNA, 22 bp, Artificial Sequence
  chemically synthesized
tagatttggttttgattcctcc

SEQ ID NO: 934894 - DNA, 22 bp, Artificial Sequence
  chemically synthesized
aatttcagcaggaggaatcaaa

SEQ ID NO: 934895 - DNA, 22 bp, Artificial Sequence
  chemically synthesized
tatagatttggttttgattcct

SEQ ID NO: 934896 - DNA, 22 bp, Artificial Sequence
  chemically synthesized
tctatagatttggttttgattc

SEQ ID NO: 934897 - DNA, 22 bp, Artificial Sequence
  chemically synthesized
tctctatagatttggttttgat

SEQ ID NO: 934898 - DNA, 22 bp, Artificial Sequence
  chemically synthesized
cagcaggaggaatcaaaaccaa

SEQ ID NO: 934899 - DNA, 22 bp, Artificial Sequence
  chemically synthesized
agcaggaggaatcaaaaccaaa

SEQ ID NO: 934900 - DNA, 22 bp, Artificial Sequence
  chemically synthesized
tcctctctctatagatttggtt

SEQ ID NO: 934901 - DNA, 22 bp, Artificial Sequence
  chemically synthesized
actatcctctctctatagattt

SEQ ID NO: 934902 - DNA, 22 bp, Artificial Sequence
  chemically synthesized
cactatcctctctctatagatt

SEQ ID NO: 934903 - DNA, 22 bp, Artificial Sequence
  chemically synthesized
caacataaatccttcactatcc

SEQ ID NO: 934904 - DNA, 22 bp, Artificial Sequence
  chemically synthesized
tagagagaggatagtgaaggat

SEQ ID NO: 934905 - DNA, 22 bp, Artificial Sequence
  chemically synthesized
cacaaaaccgtaagtcattcca

SEQ ID NO: 934906 - DNA, 22 bp, Artificial Sequence
  chemically synthesized
gctacacaaaaccgtaagtcat

SEQ ID NO: 934907 - DNA, 22 bp, Artificial Sequence
  chemically synthesized
atgttggaatgacttacggttt

SEQ ID NO: 934908 - DNA, 22 bp, Artificial Sequence
  chemically synthesized
tgttggaatgacttacggtttt

SEQ ID NO: 934909 - DNA, 22 bp, Artificial Sequence
  chemically synthesized
gaatgacttacggttttgtgta

SEQ ID NO: 934910 - DNA, 22 bp, Artificial Sequence
  chemically synthesized
agaaaaactagctacacaaaac

SEQ ID NO: 934911 - DNA, 22 bp, Artificial Sequence
  chemically synthesized
aagaaaaactagctacacaaaa

SEQ ID NO: 934912 - DNA, 22 bp, Artificial Sequence
  chemically synthesized
taagaaaaactagctacacaaa

SEQ ID NO: 934913 - DNA, 22 bp, Artificial Sequence
  chemically synthesized
tttaagaaaaactagctacaca

SEQ ID NO: 934914 - DNA, 22 bp, Artificial Sequence
  chemically synthesized
ttctttaagaaaaactagctac

SEQ ID NO: 934915 - DNA, 22 bp, Artificial Sequence
  chemically synthesized
attctttaagaaaaactagcta

SEQ ID NO: 934916 - DNA, 22 bp, Artificial Sequence
  chemically synthesized
acggttttgtgtagctagtttt

SEQ ID NO: 934917 - DNA, 22 bp, Artificial Sequence
  chemically synthesized
cggttttgtgtagctagttttt

SEQ ID NO: 934918 - DNA, 22 bp, Artificial Sequence
  chemically synthesized
tgtgtagctagtttttcttaaa

SEQ ID NO: 934919 - DNA, 22 bp, Artificial Sequence
  chemically synthesized
gtgtagctagtttttcttaaag

SEQ ID NO: 934920 - DNA, 22 bp, Artificial Sequence
  chemically synthesized
tgtagctagtttttcttaaaga

SEQ ID NO: 934921 - DNA, 22 bp, Artificial Sequence
  chemically synthesized
gtttttcttaaagaataaactg

SEQ ID NO: 934922 - DNA, 22 bp, Artificial Sequence
  chemically synthesized
tcaagaggataagccagtttat

SEQ ID NO: 934923 - DNA, 22 bp, Artificial Sequence
  chemically synthesized
atcaagaggataagccagttta

SEQ ID NO: 934924 - DNA, 22 bp, Artificial Sequence
  chemically synthesized
ttcttaaagaataaactggctt

SEQ ID NO: 934925 - DNA, 22 bp, Artificial Sequence
  chemically synthesized
tcttaaagaataaactggctta

SEQ ID NO: 934926 - DNA, 22 bp, Artificial Sequence
  chemically synthesized
cttaaagaataaactggcttat

SEQ ID NO: 934927 - DNA, 22 bp, Artificial Sequence
  chemically synthesized
cttatcaagaggataagccagt

SEQ ID NO: 934928 - DNA, 22 bp, Artificial Sequence
  chemically synthesized
ttaaagaataaactggcttatc

SEQ ID NO: 934929 - DNA, 22 bp, Artificial Sequence
  chemically synthesized
aaagaataaactggcttatcct

SEQ ID NO: 934930 - DNA, 22 bp, Artificial Sequence
  chemically synthesized
aagaataaactggcttatcctc

SEQ ID NO: 934931 - DNA, 22 bp, Artificial Sequence
  chemically synthesized
attccttatcaagaggataagc

SEQ ID NO: 934932 - DNA, 22 bp, Artificial Sequence
  chemically synthesized
accactaattccttatcaagag

SEQ ID NO: 934933 - DNA, 22 bp, Artificial Sequence
  chemically synthesized
caccactaattccttatcaaga

SEQ ID NO: 934934 - DNA, 22 bp, Artificial Sequence
  chemically synthesized
tcaccactaattccttatcaag

SEQ ID NO: 934935 - DNA, 22 bp, Artificial Sequence
  chemically synthesized
tttcaccactaattccttatca

SEQ ID NO: 934936 - DNA, 22 bp, Artificial Sequence
  chemically synthesized
gcttatcctcttgataaggaat

SEQ ID NO: 934937 - DNA, 22 bp, Artificial Sequence
  chemically synthesized
ctttcaccactaattccttatc

SEQ ID NO: 934938 - DNA, 22 bp, Artificial Sequence
  chemically synthesized
atcctcttgataaggaattagt

SEQ ID NO: 934939 - DNA, 22 bp, Artificial Sequence
  chemically synthesized
tcctcttgataaggaattagtg

SEQ ID NO: 934940 - DNA, 22 bp, Artificial Sequence
  chemically synthesized
aaagcttctttcaccactaatt

SEQ ID NO: 934941 - DNA, 22 bp, Artificial Sequence
  chemically synthesized
caaagcttctttcaccactaat

SEQ ID NO: 934942 - DNA, 22 bp, Artificial Sequence
  chemically synthesized
ttgataaggaattagtggtgaa

SEQ ID NO: 934943 - DNA, 22 bp, Artificial Sequence
  chemically synthesized
gataaggaattagtggtgaaag

SEQ ID NO: 934944 - DNA, 22 bp, Artificial Sequence
  chemically synthesized
ataaggaattagtggtgaaaga

SEQ ID NO: 934945 - DNA, 22 bp, Artificial Sequence
  chemically synthesized
aatgtcttcaaagcttctttca

SEQ ID NO: 934946 - DNA, 22 bp, Artificial Sequence
  chemically synthesized
acattaaatgtcttcaaagctt

SEQ ID NO: 934947 - DNA, 22 bp, Artificial Sequence
  chemically synthesized
gtggtgaaagaagctttgaaga

SEQ ID NO: 934948 - DNA, 22 bp, Artificial Sequence
  chemically synthesized
ctaacattaaatgtcttcaaag

SEQ ID NO: 934949 - DNA, 22 bp, Artificial Sequence
  chemically synthesized
cctaacattaaatgtcttcaaa

SEQ ID NO: 934950 - DNA, 22 bp, Artificial Sequence
  chemically synthesized
cttcctaacattaaatgtcttc

SEQ ID NO: 934951 - DNA, 22 bp, Artificial Sequence
  chemically synthesized
gcttcctaacattaaatgtctt

SEQ ID NO: 934952 - DNA, 22 bp, Artificial Sequence
  chemically synthesized
ttgcttcctaacattaaatgtc

SEQ ID NO: 934953 - DNA, 22 bp, Artificial Sequence
  chemically synthesized
cttgcttcctaacattaaatgt

SEQ ID NO: 934954 - DNA, 22 bp, Artificial Sequence
  chemically synthesized
atttcttgcttcctaacattaa

SEQ ID NO: 934955 - DNA, 22 bp, Artificial Sequence
  chemically synthesized
tgatttcttgcttcctaacatt

SEQ ID NO: 934956 - DNA, 22 bp, Artificial Sequence
  chemically synthesized
tgaagacatttaatgttaggaa

SEQ ID NO: 934957 - DNA, 22 bp, Artificial Sequence
  chemically synthesized
gaagacatttaatgttaggaag

SEQ ID NO: 934958 - DNA, 22 bp, Artificial Sequence
  chemically synthesized
aagacatttaatgttaggaagc

SEQ ID NO: 934959 - DNA, 22 bp, Artificial Sequence
  chemically synthesized
acaactctgatttcttgcttcc

SEQ ID NO: 934960 - DNA, 22 bp, Artificial Sequence
  chemically synthesized
cacaactctgatttcttgcttc

SEQ ID NO: 934961 - DNA, 22 bp, Artificial Sequence
  chemically synthesized
ttcacaactctgatttcttgct

SEQ ID NO: 934962 - DNA, 22 bp, Artificial Sequence
  chemically synthesized
aatgttaggaagcaagaaatca

SEQ ID NO: 934963 - DNA, 22 bp, Artificial Sequence
  chemically synthesized
atgttaggaagcaagaaatcag

SEQ ID NO: 934964 - DNA, 22 bp, Artificial Sequence
  chemically synthesized
ggaagcaagaaatcagagttgt

SEQ ID NO: 934965 - DNA, 22 bp, Artificial Sequence
  chemically synthesized
acatatctcttcacaactctga

SEQ ID NO: 934966 - DNA, 22 bp, Artificial Sequence
  chemically synthesized
aacatatctcttcacaactctg

SEQ ID NO: 934967 - DNA, 22 bp, Artificial Sequence
  chemically synthesized
taacatatctcttcacaactct

SEQ ID NO: 934968 - DNA, 22 bp, Artificial Sequence
  chemically synthesized
attttaacatatctcttcacaa

SEQ ID NO: 934969 - DNA, 22 bp, Artificial Sequence
  chemically synthesized
tgaagagatatgttaaaattag

SEQ ID NO: 934970 - DNA, 22 bp, Artificial Sequence
  chemically synthesized
atggaggcaatgccctaatttt

SEQ ID NO: 934971 - DNA, 22 bp, Artificial Sequence
  chemically synthesized
ctcatggaggcaatgccctaat

SEQ ID NO: 934972 - DNA, 22 bp, Artificial Sequence
  chemically synthesized
atggcctgctcatggaggcaat

SEQ ID NO: 934973 - DNA, 22 bp, Artificial Sequence
  chemically synthesized
aatggcctgctcatggaggcaa

SEQ ID NO: 934974 - DNA, 22 bp, Artificial Sequence
  chemically synthesized
aaattagggcattgcctccatg

SEQ ID NO: 934975 - DNA, 22 bp, Artificial Sequence
  chemically synthesized
taatggcctgctcatggaggca

SEQ ID NO: 934976 - DNA, 22 bp, Artificial Sequence
  chemically synthesized
gggcattgcctccatgagcagg

SEQ ID NO: 934977 - DNA, 22 bp, Artificial Sequence
  chemically synthesized
cagatagttttaatggcctgct

SEQ ID NO: 934978 - DNA, 22 bp, Artificial Sequence
  chemically synthesized
ccagatagttttaatggcctgc

SEQ ID NO: 934979 - DNA, 22 bp, Artificial Sequence
  chemically synthesized
cctccatgagcaggccattaaa

SEQ ID NO: 934980 - DNA, 22 bp, Artificial Sequence
  chemically synthesized
catgagcaggccattaaaacta

SEQ ID NO: 934981 - DNA, 22 bp, Artificial Sequence
  chemically synthesized
aacatttccagatagttttaat

SEQ ID NO: 934982 - DNA, 22 bp, Artificial Sequence
  chemically synthesized
caacatttccagatagttttaa

SEQ ID NO: 934983 - DNA, 22 bp, Artificial Sequence
  chemically synthesized
tcaacatttccagatagtttta

SEQ ID NO: 934984 - DNA, 22 bp, Artificial Sequence
  chemically synthesized
atagtcctttcaacatttccag

SEQ ID NO: 934985 - DNA, 22 bp, Artificial Sequence
  chemically synthesized
catagtcctttcaacatttcca

SEQ ID NO: 934986 - DNA, 22 bp, Artificial Sequence
  chemically synthesized
tcatagtcctttcaacatttcc

SEQ ID NO: 934987 - DNA, 22 bp, Artificial Sequence
  chemically synthesized
aaactatctggaaatgttgaaa

SEQ ID NO: 934988 - DNA, 22 bp, Artificial Sequence
  chemically synthesized
gtgctttcatagtcctttcaac

SEQ ID NO: 934989 - DNA, 22 bp, Artificial Sequence
  chemically synthesized
tctggaaatgttgaaaggacta

SEQ ID NO: 934990 - DNA, 22 bp, Artificial Sequence
  chemically synthesized
gaaatgttgaaaggactatgaa

SEQ ID NO: 934991 - DNA, 22 bp, Artificial Sequence
  chemically synthesized
aaaggactatgaaagcactaga

SEQ ID NO: 934992 - DNA, 22 bp, Artificial Sequence
  chemically synthesized
agaaacgtagcatcatcatcta

SEQ ID NO: 934993 - DNA, 22 bp, Artificial Sequence
  chemically synthesized
cagaaacgtagcatcatcatct

SEQ ID NO: 934994 - DNA, 22 bp, Artificial Sequence
  chemically synthesized
tgaaagcactagatgatgatgc

SEQ ID NO: 934995 - DNA, 22 bp, Artificial Sequence
  chemically synthesized
gatgatgatgctacgtttctga

SEQ ID NO: 934996 - DNA, 22 bp, Artificial Sequence
  chemically synthesized
gagccaatgatgagggataact

SEQ ID NO: 934997 - DNA, 22 bp, Artificial Sequence
  chemically synthesized
ggagccaatgatgagggataac

SEQ ID NO: 934998 - DNA, 22 bp, Artificial Sequence
  chemically synthesized
cgtttctgaagttatccctcat

SEQ ID NO: 934999 - DNA, 22 bp, Artificial Sequence
  chemically synthesized
ctgaagttatccctcatcattg

SEQ ID NO: 935000 - DNA, 22 bp, Artificial Sequence
  chemically synthesized
tgaagttatccctcatcattgg

SEQ ID NO: 935001 - DNA, 22 bp, Artificial Sequence
  chemically synthesized
aagttatccctcatcattggct

SEQ ID NO: 935002 - DNA, 22 bp, Artificial Sequence
  chemically synthesized
tccctcatcattggctccaaat

SEQ ID NO: 935003 - DNA, 22 bp, Artificial Sequence
  chemically synthesized
agtgcaatgcatatttggagcc

SEQ ID NO: 935004 - DNA, 22 bp, Artificial Sequence
  chemically synthesized
aagtgcaatgcatatttggagc

SEQ ID NO: 935005 - DNA, 22 bp, Artificial Sequence
  chemically synthesized
taagtgcaatgcatatttggag

SEQ ID NO: 935006 - DNA, 22 bp, Artificial Sequence
  chemically synthesized
atcattggctccaaatatgcat

SEQ ID NO: 935007 - DNA, 22 bp, Artificial Sequence
  chemically synthesized
gctccaaatatgcattgcactt

SEQ ID NO: 935008 - DNA, 22 bp, Artificial Sequence
  chemically synthesized
taaaataaaattttaagtgcaa

SEQ ID NO: 935009 - DNA, 22 bp, Artificial Sequence
  chemically synthesized
caaatatgcattgcacttaaaa

SEQ ID NO: 935010 - DNA, 22 bp, Artificial Sequence
  chemically synthesized
aaatattataaaataaaatttt

SEQ ID NO: 935011 - DNA, 22 bp, Artificial Sequence
  chemically synthesized
aaaatattataaaataaaattt

SEQ ID NO: 935012 - DNA, 22 bp, Artificial Sequence
  chemically synthesized
taaaatattataaaataaaatt

SEQ ID NO: 935013 - DNA, 22 bp, Artificial Sequence
  chemically synthesized
cacttaaaattttattttataa

SEQ ID NO: 935014 - DNA, 22 bp, Artificial Sequence
  chemically synthesized
aaaattttattttataatattt

SEQ ID NO: 935015 - DNA, 22 bp, Artificial Sequence
  chemically synthesized
aaattttattttataatatttt

SEQ ID NO: 935016 - DNA, 22 bp, Artificial Sequence
  chemically synthesized
tgtatatactttaaaatattat

SEQ ID NO: 935017 - DNA, 22 bp, Artificial Sequence
  chemically synthesized
gtgtatatactttaaaatatta

SEQ ID NO: 935018 - DNA, 22 bp, Artificial Sequence
  chemically synthesized
tttgtgtatatactttaaaata

SEQ ID NO: 935019 - DNA, 22 bp, Artificial Sequence
  chemically synthesized
tattttataatattttaaagta

SEQ ID NO: 935020 - DNA, 22 bp, Artificial Sequence
  chemically synthesized
attttataatattttaaagtat

SEQ ID NO: 935021 - DNA, 22 bp, Artificial Sequence
  chemically synthesized
ttttataatattttaaagtata

SEQ ID NO: 935022 - DNA, 22 bp, Artificial Sequence
  chemically synthesized
aattgtttgtgtatatacttta

SEQ ID NO: 935023 - DNA, 22 bp, Artificial Sequence
  chemically synthesized
aaattgtttgtgtatatacttt

SEQ ID NO: 935024 - DNA, 22 bp, Artificial Sequence
  chemically synthesized
tataatattttaaagtatatac

SEQ ID NO: 935025 - DNA, 22 bp, Artificial Sequence
  chemically synthesized
taaattgtttgtgtatatactt

SEQ ID NO: 935026 - DNA, 22 bp, Artificial Sequence
  chemically synthesized
ataatattttaaagtatataca

SEQ ID NO: 935027 - DNA, 22 bp, Artificial Sequence
  chemically synthesized
taatattttaaagtatatacac

SEQ ID NO: 935028 - DNA, 22 bp, Artificial Sequence
  chemically synthesized
ttttaaattgtttgtgtatata

SEQ ID NO: 935029 - DNA, 22 bp, Artificial Sequence
  chemically synthesized
cagctattttaaattgtttgtg

SEQ ID NO: 935030 - DNA, 22 bp, Artificial Sequence
  chemically synthesized
taaagtatatacacaaacaatt

SEQ ID NO: 935031 - DNA, 22 bp, Artificial Sequence
  chemically synthesized
gcagctattttaaattgtttgt

SEQ ID NO: 935032 - DNA, 22 bp, Artificial Sequence
  chemically synthesized
aaagtatatacacaaacaattt

SEQ ID NO: 935033 - DNA, 22 bp, Artificial Sequence
  chemically synthesized
tgcagctattttaaattgtttg

SEQ ID NO: 935034 - DNA, 22 bp, Artificial Sequence
  chemically synthesized
aagtatatacacaaacaattta

SEQ ID NO: 935035 - DNA, 22 bp, Artificial Sequence
  chemically synthesized
ttgcagctattttaaattgttt

SEQ ID NO: 935036 - DNA, 22 bp, Artificial Sequence
  chemically synthesized
aaaatagctgcaaaaatatgat

SEQ ID NO: 935037 - DNA, 22 bp, Artificial Sequence
  chemically synthesized
aaatagctgcaaaaatatgatc

SEQ ID NO: 935038 - DNA, 22 bp, Artificial Sequence
  chemically synthesized
caaaaatatgatcacgtatggt

SEQ ID NO: 935039 - DNA, 22 bp, Artificial Sequence
  chemically synthesized
gtttttcttggctcactcctct

SEQ ID NO: 935040 - DNA, 22 bp, Artificial Sequence
  chemically synthesized
tgggtggaggaggagaggagtg

SEQ ID NO: 935041 - DNA, 22 bp, Artificial Sequence
  chemically synthesized
ttcttggctcactcctctcctc

SEQ ID NO: 935042 - DNA, 22 bp, Artificial Sequence
  chemically synthesized
ttgtgggtggaggaggagagga

SEQ ID NO: 935043 - DNA, 22 bp, Artificial Sequence
  chemically synthesized
tcttggctcactcctctcctcc

SEQ ID NO: 935044 - DNA, 22 bp, Artificial Sequence
  chemically synthesized
gttgtgggtggaggaggagagg

SEQ ID NO: 935045 - DNA, 22 bp, Artificial Sequence
  chemically synthesized
cttggctcactcctctcctcct

SEQ ID NO: 935046 - DNA, 22 bp, Artificial Sequence
  chemically synthesized
ttggctcactcctctcctcctc

SEQ ID NO: 935047 - DNA, 22 bp, Artificial Sequence
  chemically synthesized
ggctcactcctctcctcctcca

SEQ ID NO: 935048 - DNA, 22 bp, Artificial Sequence
  chemically synthesized
gctcactcctctcctcctccac

SEQ ID NO: 935049 - DNA, 22 bp, Artificial Sequence
  chemically synthesized
actcctctcctcctccacccac

SEQ ID NO: 935050 - DNA, 22 bp, Artificial Sequence
  chemically synthesized
ctctcctcctccacccacaaca

SEQ ID NO: 935051 - DNA, 22 bp, Artificial Sequence
  chemically synthesized
gtggaggaaggtttgttgtggg

SEQ ID NO: 935052 - DNA, 22 bp, Artificial Sequence
  chemically synthesized
agtggaggaaggtttgttgtgg

SEQ ID NO: 935053 - DNA, 22 bp, Artificial Sequence
  chemically synthesized
tcctcctccacccacaacaaac

SEQ ID NO: 935054 - DNA, 22 bp, Artificial Sequence
  chemically synthesized
tagtggaggaaggtttgttgtg

SEQ ID NO: 935055 - DNA, 22 bp, Artificial Sequence
  chemically synthesized
ctcctccacccacaacaaacct

SEQ ID NO: 935056 - DNA, 22 bp, Artificial Sequence
  chemically synthesized
ttttagtggaggaaggtttgtt

SEQ ID NO: 935057 - DNA, 22 bp, Artificial Sequence
  chemically synthesized
ctccacccacaacaaaccttcc

SEQ ID NO: 935058 - DNA, 22 bp, Artificial Sequence
  chemically synthesized
cacccacaacaaaccttcctcc

SEQ ID NO: 935059 - DNA, 22 bp, Artificial Sequence
  chemically synthesized
ggttattttagtggaggaaggt

SEQ ID NO: 935060 - DNA, 22 bp, Artificial Sequence
  chemically synthesized
cagaaataaataattaggttat

SEQ ID NO: 935061 - DNA, 22 bp, Artificial Sequence
  chemically synthesized
cctccactaaaataacctaatt

SEQ ID NO: 935062 - DNA, 22 bp, Artificial Sequence
  chemically synthesized
ctccactaaaataacctaatta

SEQ ID NO: 935063 - DNA, 22 bp, Artificial Sequence
  chemically synthesized
cactaaaataacctaattattt

SEQ ID NO: 935064 - DNA, 22 bp, Artificial Sequence
  chemically synthesized
aaataacctaattatttatttc

SEQ ID NO: 935065 - DNA, 22 bp, Artificial Sequence
  chemically synthesized
attatttatttctgtaattttg

SEQ ID NO: 935066 - DNA, 22 bp, Artificial Sequence
  chemically synthesized
tttatttctgtaattttgcact

SEQ ID NO: 935067 - DNA, 22 bp, Artificial Sequence
  chemically synthesized
aaaaaaatatcaagtgcaaaat

SEQ ID NO: 935068 - DNA, 22 bp, Artificial Sequence
  chemically synthesized
atttctgtaattttgcacttga

SEQ ID NO: 935069 - DNA, 22 bp, Artificial Sequence
  chemically synthesized
tttctgtaattttgcacttgat

SEQ ID NO: 935070 - DNA, 22 bp, Artificial Sequence
  chemically synthesized
ctgtaattttgcacttgatatt

SEQ ID NO: 935071 - DNA, 22 bp, Artificial Sequence
  chemically synthesized
tgtaattttgcacttgatattt

SEQ ID NO: 935072 - DNA, 22 bp, Artificial Sequence
  chemically synthesized
tataaattgaaaaaaatatcaa

SEQ ID NO: 935073 - DNA, 22 bp, Artificial Sequence
  chemically synthesized
taattttgcacttgatattttt

SEQ ID NO: 935074 - DNA, 22 bp, Artificial Sequence
  chemically synthesized
tgcacttgatatttttttcaat

SEQ ID NO: 935075 - DNA, 22 bp, Artificial Sequence
  chemically synthesized
gcacttgatatttttttcaatt

SEQ ID NO: 935076 - DNA, 22 bp, Artificial Sequence
  chemically synthesized
cacttgatatttttttcaattt

SEQ ID NO: 935077 - DNA, 22 bp, Artificial Sequence
  chemically synthesized
gatatttttttcaatttatata

SEQ ID NO: 935078 - DNA, 22 bp, Artificial Sequence
  chemically synthesized
atatttttttcaatttatatag

SEQ ID NO: 935079 - DNA, 22 bp, Artificial Sequence
  chemically synthesized
caaaagtatatatgactatata

SEQ ID NO: 935080 - DNA, 22 bp, Artificial Sequence
  chemically synthesized
tacaaaagtatatatgactata

SEQ ID NO: 935081 - DNA, 22 bp, Artificial Sequence
  chemically synthesized
ttttcaatttatatagtcatat

SEQ ID NO: 935082 - DNA, 22 bp, Artificial Sequence
  chemically synthesized
tttcaatttatatagtcatata

SEQ ID NO: 935083 - DNA, 22 bp, Artificial Sequence
  chemically synthesized
ttcaatttatatagtcatatat

SEQ ID NO: 935084 - DNA, 22 bp, Artificial Sequence
  chemically synthesized
ctctacaaaagtatatatgact

SEQ ID NO: 935085 - DNA, 22 bp, Artificial Sequence
  chemically synthesized
tcaatttatatagtcatatata

SEQ ID NO: 935086 - DNA, 22 bp, Artificial Sequence
  chemically synthesized
caatttatatagtcatatatac

SEQ ID NO: 935087 - DNA, 22 bp, Artificial Sequence
  chemically synthesized
tgctctacaaaagtatatatga

SEQ ID NO: 935088 - DNA, 22 bp, Artificial Sequence
  chemically synthesized
aatttatatagtcatatatact

SEQ ID NO: 935089 - DNA, 22 bp, Artificial Sequence
  chemically synthesized
atatagtcatatatacttttgt

SEQ ID NO: 935090 - DNA, 22 bp, Artificial Sequence
  chemically synthesized
accctctgctctacaaaagtat

SEQ ID NO: 935091 - DNA, 22 bp, Artificial Sequence
  chemically synthesized
tatagtcatatatacttttgta

SEQ ID NO: 935092 - DNA, 22 bp, Artificial Sequence
  chemically synthesized
tcaccctctgctctacaaaagt

SEQ ID NO: 935093 - DNA, 22 bp, Artificial Sequence
  chemically synthesized
ctcaccctctgctctacaaaag

SEQ ID NO: 935094 - DNA, 22 bp, Artificial Sequence
  chemically synthesized
ttctcaccctctgctctacaaa

SEQ ID NO: 935095 - DNA, 22 bp, Artificial Sequence
  chemically synthesized
tatccatctcttctcaccctct

SEQ ID NO: 935096 - DNA, 22 bp, Artificial Sequence
  chemically synthesized
atatccatctcttctcaccctc

SEQ ID NO: 935097 - DNA, 22 bp, Artificial Sequence
  chemically synthesized
ttgtagagcagagggtgagaag

SEQ ID NO: 935098 - DNA, 22 bp, Artificial Sequence
  chemically synthesized
tgtagagcagagggtgagaaga

SEQ ID NO: 935099 - DNA, 22 bp, Artificial Sequence
  chemically synthesized
gtagagcagagggtgagaagag

SEQ ID NO: 935100 - DNA, 22 bp, Artificial Sequence
  chemically synthesized
atttatatccatctcttctcac

SEQ ID NO: 935101 - DNA, 22 bp, Artificial Sequence
  chemically synthesized
tagagcagagggtgagaagaga

SEQ ID NO: 935102 - DNA, 22 bp, Artificial Sequence
  chemically synthesized
catttatatccatctcttctca

SEQ ID NO: 935103 - DNA, 22 bp, Artificial Sequence
  chemically synthesized
tcatttatatccatctcttctc

SEQ ID NO: 935104 - DNA, 22 bp, Artificial Sequence
  chemically synthesized
attttcatttatatccatctct

SEQ ID NO: 935105 - DNA, 22 bp, Artificial Sequence
  chemically synthesized
cattttcatttatatccatctc

SEQ ID NO: 935106 - DNA, 22 bp, Artificial Sequence
  chemically synthesized
gtttcattttcatttatatcca

SEQ ID NO: 935107 - DNA, 22 bp, Artificial Sequence
  chemically synthesized
tagtttcattttcatttatatc

SEQ ID NO: 935108 - DNA, 22 bp, Artificial Sequence
  chemically synthesized
ctagtttcattttcatttatat

SEQ ID NO: 935109 - DNA, 22 bp, Artificial Sequence
  chemically synthesized
tttctagtttcattttcattta

SEQ ID NO: 935110 - DNA, 22 bp, Artificial Sequence
  chemically synthesized
atttctagtttcattttcattt

SEQ ID NO: 935111 - DNA, 22 bp, Artificial Sequence
  chemically synthesized
atttatttctagtttcattttc

SEQ ID NO: 935112 - DNA, 22 bp, Artificial Sequence
  chemically synthesized
aatttatttctagtttcatttt

SEQ ID NO: 935113 - DNA, 22 bp, Artificial Sequence
  chemically synthesized
taatttatttctagtttcattt

SEQ ID NO: 935114 - DNA, 22 bp, Artificial Sequence
  chemically synthesized
gtaaagaattttaatttatttc

SEQ ID NO: 935115 - DNA, 22 bp, Artificial Sequence
  chemically synthesized
ggtaaagaattttaatttattt

SEQ ID NO: 935116 - DNA, 22 bp, Artificial Sequence
  chemically synthesized
ccttggtaaagaattttaattt

SEQ ID NO: 935117 - DNA, 22 bp, Artificial Sequence
  chemically synthesized
accttggtaaagaattttaatt

SEQ ID NO: 935118 - DNA, 22 bp, Artificial Sequence
  chemically synthesized
taccttggtaaagaattttaat

SEQ ID NO: 935119 - DNA, 22 bp, Artificial Sequence
  chemically synthesized
ttaccttggtaaagaattttaa

SEQ ID NO: 935120 - DNA, 22 bp, Artificial Sequence
  chemically synthesized
tttttaccttggtaaagaattt

SEQ ID NO: 935121 - DNA, 22 bp, Artificial Sequence
  chemically synthesized
gaaataaattaaaattctttac

SEQ ID NO: 935122 - DNA, 22 bp, Artificial Sequence
  chemically synthesized
atttttaccttggtaaagaatt

SEQ ID NO: 935123 - DNA, 22 bp, Artificial Sequence
  chemically synthesized
aaattctttaccaaggtaaaaa

SEQ ID NO: 935124 - DNA, 22 bp, Artificial Sequence
  chemically synthesized
tttaccaaggtaaaaataaatc

SEQ ID NO: 935125 - DNA, 22 bp, Artificial Sequence
  chemically synthesized
taccaaggtaaaaataaatctt

SEQ ID NO: 935126 - DNA, 22 bp, Artificial Sequence
  chemically synthesized
accaaggtaaaaataaatctta

SEQ ID NO: 935127 - DNA, 22 bp, Artificial Sequence
  chemically synthesized
tcataagaccaataagatttat

SEQ ID NO: 935128 - DNA, 22 bp, Artificial Sequence
  chemically synthesized
ccaaggtaaaaataaatcttat

SEQ ID NO: 935129 - DNA, 22 bp, Artificial Sequence
  chemically synthesized
attggtcttatgataatgcatt

SEQ ID NO: 935130 - DNA, 22 bp, Artificial Sequence
  chemically synthesized
ttggtcttatgataatgcattg

SEQ ID NO: 935131 - DNA, 22 bp, Artificial Sequence
  chemically synthesized
gtgatcacagaggacaatgcat

SEQ ID NO: 935132 - DNA, 22 bp, Artificial Sequence
  chemically synthesized
gtcttatgataatgcattgtcc

SEQ ID NO: 935133 - DNA, 22 bp, Artificial Sequence
  chemically synthesized
ggtgatcacagaggacaatgca

SEQ ID NO: 935134 - DNA, 22 bp, Artificial Sequence
  chemically synthesized
tggtgatcacagaggacaatgc

SEQ ID NO: 935135 - DNA, 22 bp, Artificial Sequence
  chemically synthesized
ttggtgatcacagaggacaatg

SEQ ID NO: 935136 - DNA, 22 bp, Artificial Sequence
  chemically synthesized
atgataatgcattgtcctctgt

SEQ ID NO: 935137 - DNA, 22 bp, Artificial Sequence
  chemically synthesized
tgataatgcattgtcctctgtg

SEQ ID NO: 935138 - DNA, 22 bp, Artificial Sequence
  chemically synthesized
tagatttttggtgatcacagag

SEQ ID NO: 935139 - DNA, 22 bp, Artificial Sequence
  chemically synthesized
tattgtagatttttggtgatca

SEQ ID NO: 935140 - DNA, 22 bp, Artificial Sequence
  chemically synthesized
gtattgtagatttttggtgatc

SEQ ID NO: 935141 - DNA, 22 bp, Artificial Sequence
  chemically synthesized
tgtattgtagatttttggtgat

SEQ ID NO: 935142 - DNA, 22 bp, Artificial Sequence
  chemically synthesized
tcctctgtgatcaccaaaaatc

SEQ ID NO: 935143 - DNA, 22 bp, Artificial Sequence
  chemically synthesized
gctttgtattgtagatttttgg

SEQ ID NO: 935144 - DNA, 22 bp, Artificial Sequence
  chemically synthesized
tgtgatcaccaaaaatctacaa

SEQ ID NO: 935145 - DNA, 22 bp, Artificial Sequence
  chemically synthesized
gctggctttgtattgtagattt

SEQ ID NO: 935146 - DNA, 22 bp, Artificial Sequence
  chemically synthesized
tgatcaccaaaaatctacaata

SEQ ID NO: 935147 - DNA, 22 bp, Artificial Sequence
  chemically synthesized
ccaagagattggctggctttgt

SEQ ID NO: 935148 - DNA, 22 bp, Artificial Sequence
  chemically synthesized
tcccaagagattggctggcttt

SEQ ID NO: 935149 - DNA, 22 bp, Artificial Sequence
  chemically synthesized
cactctcccaagagattggctg

SEQ ID NO: 935150 - DNA, 22 bp, Artificial Sequence
  chemically synthesized
caatacaaagccagccaatctc

SEQ ID NO: 935151 - DNA, 22 bp, Artificial Sequence
  chemically synthesized
tacactctcccaagagattggc

SEQ ID NO: 935152 - DNA, 22 bp, Artificial Sequence
  chemically synthesized
ctacactctcccaagagattgg

SEQ ID NO: 935153 - DNA, 22 bp, Artificial Sequence
  chemically synthesized
tctacactctcccaagagattg

SEQ ID NO: 935154 - DNA, 22 bp, Artificial Sequence
  chemically synthesized
aactttctacactctcccaaga

SEQ ID NO: 935155 - DNA, 22 bp, Artificial Sequence
  chemically synthesized
cctaaactttctacactctccc

SEQ ID NO: 935156 - DNA, 22 bp, Artificial Sequence
  chemically synthesized
ccctaaactttctacactctcc

SEQ ID NO: 935157 - DNA, 22 bp, Artificial Sequence
  chemically synthesized
catttccctaaactttctacac

SEQ ID NO: 935158 - DNA, 22 bp, Artificial Sequence
  chemically synthesized
ttgggagagtgtagaaagttta

SEQ ID NO: 935159 - DNA, 22 bp, Artificial Sequence
  chemically synthesized
gggagagtgtagaaagtttagg

SEQ ID NO: 935160 - DNA, 22 bp, Artificial Sequence
  chemically synthesized
ggagagtgtagaaagtttaggg

SEQ ID NO: 935161 - DNA, 22 bp, Artificial Sequence
  chemically synthesized
caaataaaatataattacattt

SEQ ID NO: 935162 - DNA, 22 bp, Artificial Sequence
  chemically synthesized
tgcaaataaaatataattacat

SEQ ID NO: 935163 - DNA, 22 bp, Artificial Sequence
  chemically synthesized
ctgcaaataaaatataattaca

SEQ ID NO: 935164 - DNA, 22 bp, Artificial Sequence
  chemically synthesized
cttctgcaaataaaatataatt

SEQ ID NO: 935165 - DNA, 22 bp, Artificial Sequence
  chemically synthesized
agggaaatgtaattatatttta

SEQ ID NO: 935166 - DNA, 22 bp, Artificial Sequence
  chemically synthesized
gggaaatgtaattatattttat

SEQ ID NO: 935167 - DNA, 22 bp, Artificial Sequence
  chemically synthesized
attccttctgcaaataaaatat

SEQ ID NO: 935168 - DNA, 22 bp, Artificial Sequence
  chemically synthesized
tattttatttgcagaaggaatc

SEQ ID NO: 935169 - DNA, 22 bp, Artificial Sequence
  chemically synthesized
tatttgcagaaggaatcaatat

SEQ ID NO: 935170 - DNA, 22 bp, Artificial Sequence
  chemically synthesized
aaaagtaccgccatattgattc

SEQ ID NO: 935171 - DNA, 22 bp, Artificial Sequence
  chemically synthesized
atttgcagaaggaatcaatatg

SEQ ID NO: 935172 - DNA, 22 bp, Artificial Sequence
  chemically synthesized
gaaaagtaccgccatattgatt

SEQ ID NO: 935173 - DNA, 22 bp, Artificial Sequence
  chemically synthesized
tttgcagaaggaatcaatatgg

SEQ ID NO: 935174 - DNA, 22 bp, Artificial Sequence
  chemically synthesized
gcagaaggaatcaatatggcgg

SEQ ID NO: 935175 - DNA, 22 bp, Artificial Sequence
  chemically synthesized
cagaaggaatcaatatggcggt

SEQ ID NO: 935176 - DNA, 22 bp, Artificial Sequence
  chemically synthesized
aacttgaaaagtaccgccatat

SEQ ID NO: 935177 - DNA, 22 bp, Artificial Sequence
  chemically synthesized
aattgaacttgaaaagtaccgc

SEQ ID NO: 935178 - DNA, 22 bp, Artificial Sequence
  chemically synthesized
tgattgaattgaacttgaaaag

SEQ ID NO: 935179 - DNA, 22 bp, Artificial Sequence
  chemically synthesized
gtgattgaattgaacttgaaaa

SEQ ID NO: 935180 - DNA, 22 bp, Artificial Sequence
  chemically synthesized
catttgtgattgaattgaactt

SEQ ID NO: 935181 - DNA, 22 bp, Artificial Sequence
  chemically synthesized
acatttgtgattgaattgaact

SEQ ID NO: 935182 - DNA, 22 bp, Artificial Sequence
  chemically synthesized
tacatttgtgattgaattgaac

SEQ ID NO: 935183 - DNA, 22 bp, Artificial Sequence
  chemically synthesized
tttacatttgtgattgaattga

SEQ ID NO: 935184 - DNA, 22 bp, Artificial Sequence
  chemically synthesized
ttctttacatttgtgattgaat

SEQ ID NO: 935185 - DNA, 22 bp, Artificial Sequence
  chemically synthesized
ttcaagttcaattcaatcacaa

SEQ ID NO: 935186 - DNA, 22 bp, Artificial Sequence
  chemically synthesized
tcaagttcaattcaatcacaaa

SEQ ID NO: 935187 - DNA, 22 bp, Artificial Sequence
  chemically synthesized
caagttcaattcaatcacaaat

SEQ ID NO: 935188 - DNA, 22 bp, Artificial Sequence
  chemically synthesized
aagttcaattcaatcacaaatg

SEQ ID NO: 935189 - DNA, 22 bp, Artificial Sequence
  chemically synthesized
aattcaatcacaaatgtaaaga

SEQ ID NO: 935190 - DNA, 22 bp, Artificial Sequence
  chemically synthesized
aatcacaaatgtaaagaacaga

SEQ ID NO: 935191 - DNA, 22 bp, Artificial Sequence
  chemically synthesized
gatgtaaatgcaaatctgttct

SEQ ID NO: 935192 - DNA, 22 bp, Artificial Sequence
  chemically synthesized
agatgtaaatgcaaatctgttc

SEQ ID NO: 935193 - DNA, 22 bp, Artificial Sequence
  chemically synthesized
cttagatgtaaatgcaaatctg

SEQ ID NO: 935194 - DNA, 22 bp, Artificial Sequence
  chemically synthesized
tgcttagatgtaaatgcaaatc

SEQ ID NO: 935195 - DNA, 22 bp, Artificial Sequence
  chemically synthesized
ctgcttagatgtaaatgcaaat

SEQ ID NO: 935196 - DNA, 22 bp, Artificial Sequence
  chemically synthesized
atccaccacgcttctgcttaga

SEQ ID NO: 935197 - DNA, 22 bp, Artificial Sequence
  chemically synthesized
aatccaccacgcttctgcttag

SEQ ID NO: 935198 - DNA, 22 bp, Artificial Sequence
  chemically synthesized
taatccaccacgcttctgctta

SEQ ID NO: 935199 - DNA, 22 bp, Artificial Sequence
  chemically synthesized
gcatttacatctaagcagaagc

SEQ ID NO: 935200 - DNA, 22 bp, Artificial Sequence
  chemically synthesized
ttaatccaccacgcttctgctt

SEQ ID NO: 935201 - DNA, 22 bp, Artificial Sequence
  chemically synthesized
catttacatctaagcagaagcg

SEQ ID NO: 935202 - DNA, 22 bp, Artificial Sequence
  chemically synthesized
tttaatccaccacgcttctgct

SEQ ID NO: 935203 - DNA, 22 bp, Artificial Sequence
  chemically synthesized
acatctaagcagaagcgtggtg

SEQ ID NO: 935204 - DNA, 22 bp, Artificial Sequence
  chemically synthesized
catctaagcagaagcgtggtgg

SEQ ID NO: 935205 - DNA, 22 bp, Artificial Sequence
  chemically synthesized
aaatctttttaatccaccacgc

SEQ ID NO: 935206 - DNA, 22 bp, Artificial Sequence
  chemically synthesized
ttgaaatctttttaatccacca

SEQ ID NO: 935207 - DNA, 22 bp, Artificial Sequence
  chemically synthesized
agcagaagcgtggtggattaaa

SEQ ID NO: 935208 - DNA, 22 bp, Artificial Sequence
  chemically synthesized
aatgttattgaaatctttttaa

SEQ ID NO: 935209 - DNA, 22 bp, Artificial Sequence
  chemically synthesized
aaaagatttcaataacatttag

SEQ ID NO: 935210 - DNA, 22 bp, Artificial Sequence
  chemically synthesized
acaaagagatgactaaatgtta

SEQ ID NO: 935211 - DNA, 22 bp, Artificial Sequence
  chemically synthesized
gacaaagagatgactaaatgtt

SEQ ID NO: 935212 - DNA, 22 bp, Artificial Sequence
  chemically synthesized
tgacaaagagatgactaaatgt

SEQ ID NO: 935213 - DNA, 22 bp, Artificial Sequence
  chemically synthesized
ttttgacaaagagatgactaaa

SEQ ID NO: 935214 - DNA, 22 bp, Artificial Sequence
  chemically synthesized
caataacatttagtcatctctt

SEQ ID NO: 935215 - DNA, 22 bp, Artificial Sequence
  chemically synthesized
aataacatttagtcatctcttt

SEQ ID NO: 935216 - DNA, 22 bp, Artificial Sequence
  chemically synthesized
aatgaatgccctattttgacaa

SEQ ID NO: 935217 - DNA, 22 bp, Artificial Sequence
  chemically synthesized
agtcatctctttgtcaaaatag

SEQ ID NO: 935218 - DNA, 22 bp, Artificial Sequence
  chemically synthesized
gtcatctctttgtcaaaatagg

SEQ ID NO: 935219 - DNA, 22 bp, Artificial Sequence
  chemically synthesized
tgttcaatgaatgccctatttt

SEQ ID NO: 935220 - DNA, 22 bp, Artificial Sequence
  chemically synthesized
tttgtcaaaatagggcattcat

SEQ ID NO: 935221 - DNA, 22 bp, Artificial Sequence
  chemically synthesized
tgtcaaaatagggcattcattg

SEQ ID NO: 935222 - DNA, 22 bp, Artificial Sequence
  chemically synthesized
gtcaaaatagggcattcattga

SEQ ID NO: 935223 - DNA, 22 bp, Artificial Sequence
  chemically synthesized
tcaaaatagggcattcattgaa

SEQ ID NO: 935224 - DNA, 22 bp, Artificial Sequence
  chemically synthesized
agtgtcattatgttcaatgaat

SEQ ID NO: 935225 - DNA, 22 bp, Artificial Sequence
  chemically synthesized
gagtgtcattatgttcaatgaa

SEQ ID NO: 935226 - DNA, 22 bp, Artificial Sequence
  chemically synthesized
gaaggatggccttgagtgtcat

SEQ ID NO: 935227 - DNA, 22 bp, Artificial Sequence
  chemically synthesized
attgaacataatgacactcaag

SEQ ID NO: 935228 - DNA, 22 bp, Artificial Sequence
  chemically synthesized
ttggaaggatggccttgagtgt

SEQ ID NO: 935229 - DNA, 22 bp, Artificial Sequence
  chemically synthesized
attggaaggatggccttgagtg

SEQ ID NO: 935230 - DNA, 22 bp, Artificial Sequence
  chemically synthesized
aacataatgacactcaaggcca

SEQ ID NO: 935231 - DNA, 22 bp, Artificial Sequence
  chemically synthesized
tagggtaatttattggaaggat

SEQ ID NO: 935232 - DNA, 22 bp, Artificial Sequence
  chemically synthesized
atagggtaatttattggaagga

SEQ ID NO: 935233 - DNA, 22 bp, Artificial Sequence
  chemically synthesized
tatagggtaatttattggaagg

SEQ ID NO: 935234 - DNA, 22 bp, Artificial Sequence
  chemically synthesized
aaggccatccttccaataaatt

SEQ ID NO: 935235 - DNA, 22 bp, Artificial Sequence
  chemically synthesized
aatggaagttttatagggtaat

SEQ ID NO: 935236 - DNA, 22 bp, Artificial Sequence
  chemically synthesized
gaatggaagttttatagggtaa

SEQ ID NO: 935237 - DNA, 22 bp, Artificial Sequence
  chemically synthesized
tgaatggaagttttatagggta

SEQ ID NO: 935238 - DNA, 22 bp, Artificial Sequence
  chemically synthesized
ccaataaattaccctataaaac

SEQ ID NO: 935239 - DNA, 22 bp, Artificial Sequence
  chemically synthesized
caataaattaccctataaaact

SEQ ID NO: 935240 - DNA, 22 bp, Artificial Sequence
  chemically synthesized
aattttgaatggaagttttata

SEQ ID NO: 935241 - DNA, 22 bp, Artificial Sequence
  chemically synthesized
ccctataaaacttccattcaaa

SEQ ID NO: 935242 - DNA, 22 bp, Artificial Sequence
  chemically synthesized
taccatattaaattttgaatgg

SEQ ID NO: 935243 - DNA, 22 bp, Artificial Sequence
  chemically synthesized
taaaacttccattcaaaattta

SEQ ID NO: 935244 - DNA, 22 bp, Artificial Sequence
  chemically synthesized
cccaacctgtaccatattaaat

SEQ ID NO: 935245 - DNA, 22 bp, Artificial Sequence
  chemically synthesized
ccattcaaaatttaatatggta

SEQ ID NO: 935246 - DNA, 22 bp, Artificial Sequence
  chemically synthesized
cattcaaaatttaatatggtac

SEQ ID NO: 935247 - DNA, 22 bp, Artificial Sequence
  chemically synthesized
tattccccaacctgtaccatat

SEQ ID NO: 935248 - DNA, 22 bp, Artificial Sequence
  chemically synthesized
aaaatttaatatggtacaggtt

SEQ ID NO: 935249 - DNA, 22 bp, Artificial Sequence
  chemically synthesized
cctatattccccaacctgtacc

SEQ ID NO: 935250 - DNA, 22 bp, Artificial Sequence
  chemically synthesized
attacctatattccccaacctg

SEQ ID NO: 935251 - DNA, 22 bp, Artificial Sequence
  chemically synthesized
aattacctatattccccaacct

SEQ ID NO: 935252 - DNA, 22 bp, Artificial Sequence
  chemically synthesized
aatatggtacaggttggggaat

SEQ ID NO: 935253 - DNA, 22 bp, Artificial Sequence
  chemically synthesized
atatggtacaggttggggaata

SEQ ID NO: 935254 - DNA, 22 bp, Artificial Sequence
  chemically synthesized
cgacacatttaattacctatat

SEQ ID NO: 935255 - DNA, 22 bp, Artificial Sequence
  chemically synthesized
tacgacacatttaattacctat

SEQ ID NO: 935256 - DNA, 22 bp, Artificial Sequence
  chemically synthesized
cctctacgacacatttaattac

SEQ ID NO: 935257 - DNA, 22 bp, Artificial Sequence
  chemically synthesized
gggaatataggtaattaaatgt

SEQ ID NO: 935258 - DNA, 22 bp, Artificial Sequence
  chemically synthesized
tacctctacgacacatttaatt

SEQ ID NO: 935259 - DNA, 22 bp, Artificial Sequence
  chemically synthesized
ctacctctacgacacatttaat

SEQ ID NO: 935260 - DNA, 22 bp, Artificial Sequence
  chemically synthesized
tctacctctacgacacatttaa

SEQ ID NO: 935261 - DNA, 22 bp, Artificial Sequence
  chemically synthesized
tttctacctctacgacacattt

SEQ ID NO: 935262 - DNA, 22 bp, Artificial Sequence
  chemically synthesized
ctttctacctctacgacacatt

SEQ ID NO: 935263 - DNA, 22 bp, Artificial Sequence
  chemically synthesized
cccagggtcttctttctacctc

SEQ ID NO: 935264 - DNA, 22 bp, Artificial Sequence
  chemically synthesized
aatgtgtcgtagaggtagaaag

SEQ ID NO: 935265 - DNA, 22 bp, Artificial Sequence
  chemically synthesized
acccagggtcttctttctacct

SEQ ID NO: 935266 - DNA, 22 bp, Artificial Sequence
  chemically synthesized
tacccagggtcttctttctacc

SEQ ID NO: 935267 - DNA, 22 bp, Artificial Sequence
  chemically synthesized
ctttacccagggtcttctttct

SEQ ID NO: 935268 - DNA, 22 bp, Artificial Sequence
  chemically synthesized
cctttacccagggtcttctttc

SEQ ID NO: 935269 - DNA, 22 bp, Artificial Sequence
  chemically synthesized
tcctttacccagggtcttcttt

SEQ ID NO: 935270 - DNA, 22 bp, Artificial Sequence
  chemically synthesized
ttcctttacccagggtcttctt

SEQ ID NO: 935271 - DNA, 22 bp, Artificial Sequence
  chemically synthesized
ccatcttttcctttacccaggg

SEQ ID NO: 935272 - DNA, 22 bp, Artificial Sequence
  chemically synthesized
attaccatcttttcctttaccc

SEQ ID NO: 935273 - DNA, 22 bp, Artificial Sequence
  chemically synthesized
aattaccatcttttcctttacc

SEQ ID NO: 935274 - DNA, 22 bp, Artificial Sequence
  chemically synthesized
aaatcttaattaccatcttttc

SEQ ID NO: 935275 - DNA, 22 bp, Artificial Sequence
  chemically synthesized
caaatcttaattaccatctttt

SEQ ID NO: 935276 - DNA, 22 bp, Artificial Sequence
  chemically synthesized
tcaaatcttaattaccatcttt

SEQ ID NO: 935277 - DNA, 22 bp, Artificial Sequence
  chemically synthesized
tttcaaatcttaattaccatct

SEQ ID NO: 935278 - DNA, 22 bp, Artificial Sequence
  chemically synthesized
ggtaaaggaaaagatggtaatt

SEQ ID NO: 935279 - DNA, 22 bp, Artificial Sequence
  chemically synthesized
ttctttcaaatcttaattacca

SEQ ID NO: 935280 - DNA, 22 bp, Artificial Sequence
  chemically synthesized
agtattattctttcaaatctta

SEQ ID NO: 935281 - DNA, 22 bp, Artificial Sequence
  chemically synthesized
cagtattattctttcaaatctt

SEQ ID NO: 935282 - DNA, 22 bp, Artificial Sequence
  chemically synthesized
tttcagtattattctttcaaat

SEQ ID NO: 935283 - DNA, 22 bp, Artificial Sequence
  chemically synthesized
atttcagtattattctttcaaa

SEQ ID NO: 935284 - DNA, 22 bp, Artificial Sequence
  chemically synthesized
tttatttcagtattattctttc

SEQ ID NO: 935285 - DNA, 22 bp, Artificial Sequence
  chemically synthesized
agatttgaaagaataatactga

SEQ ID NO: 935286 - DNA, 22 bp, Artificial Sequence
  chemically synthesized
gaataacctatttatttcagta

SEQ ID NO: 935287 - DNA, 22 bp, Artificial Sequence
  chemically synthesized
gaaagaataatactgaaataaa

SEQ ID NO: 935288 - DNA, 22 bp, Artificial Sequence
  chemically synthesized
aaagaataatactgaaataaat

SEQ ID NO: 935289 - DNA, 22 bp, Artificial Sequence
  chemically synthesized
ctagaataacctatttatttca

SEQ ID NO: 935290 - DNA, 22 bp, Artificial Sequence
  chemically synthesized
cctagaataacctatttatttc

SEQ ID NO: 935291 - DNA, 22 bp, Artificial Sequence
  chemically synthesized
tcctagaataacctatttattt

SEQ ID NO: 935292 - DNA, 22 bp, Artificial Sequence
  chemically synthesized
ataagattttcctagaataacc

SEQ ID NO: 935293 - DNA, 22 bp, Artificial Sequence
  chemically synthesized
aaataaataggttattctagga

SEQ ID NO: 935294 - DNA, 22 bp, Artificial Sequence
  chemically synthesized
gcatactgataagattttccta

SEQ ID NO: 935295 - DNA, 22 bp, Artificial Sequence
  chemically synthesized
ttctaggaaaatcttatcagta

SEQ ID NO: 935296 - DNA, 22 bp, Artificial Sequence
  chemically synthesized
aagtgattagcatactgataag

SEQ ID NO: 935297 - DNA, 22 bp, Artificial Sequence
  chemically synthesized
taggaaaatcttatcagtatgc

SEQ ID NO: 935298 - DNA, 22 bp, Artificial Sequence
  chemically synthesized
ggaaaatcttatcagtatgcta

SEQ ID NO: 935299 - DNA, 22 bp, Artificial Sequence
  chemically synthesized
tgataagggacctaaagtgatt

SEQ ID NO: 935300 - DNA, 22 bp, Artificial Sequence
  chemically synthesized
atcagtatgctaatcactttag

SEQ ID NO: 935301 - DNA, 22 bp, Artificial Sequence
  chemically synthesized
tcagtatgctaatcactttagg

SEQ ID NO: 935302 - DNA, 22 bp, Artificial Sequence
  chemically synthesized
ctatgataagggacctaaagtg

SEQ ID NO: 935303 - DNA, 22 bp, Artificial Sequence
  chemically synthesized
cctatgataagggacctaaagt

SEQ ID NO: 935304 - DNA, 22 bp, Artificial Sequence
  chemically synthesized
tcctatgataagggacctaaag

SEQ ID NO: 935305 - DNA, 22 bp, Artificial Sequence
  chemically synthesized
tttcctatgataagggacctaa

SEQ ID NO: 935306 - DNA, 22 bp, Artificial Sequence
  chemically synthesized
atcactttaggtcccttatcat

SEQ ID NO: 935307 - DNA, 22 bp, Artificial Sequence
  chemically synthesized
agattctttcctatgataaggg

SEQ ID NO: 935308 - DNA, 22 bp, Artificial Sequence
  chemically synthesized
aagattctttcctatgataagg

SEQ ID NO: 935309 - DNA, 22 bp, Artificial Sequence
  chemically synthesized
tttaagattctttcctatgata

SEQ ID NO: 935310 - DNA, 22 bp, Artificial Sequence
  chemically synthesized
taggtcccttatcataggaaag

SEQ ID NO: 935311 - DNA, 22 bp, Artificial Sequence
  chemically synthesized
aggtcccttatcataggaaaga

SEQ ID NO: 935312 - DNA, 22 bp, Artificial Sequence
  chemically synthesized
ggtcccttatcataggaaagaa

SEQ ID NO: 935313 - DNA, 22 bp, Artificial Sequence
  chemically synthesized
atcataggaaagaatcttaaac

SEQ ID NO: 935314 - DNA, 22 bp, Artificial Sequence
  chemically synthesized
tcccaagcacctgtttaagatt

SEQ ID NO: 935315 - DNA, 22 bp, Artificial Sequence
  chemically synthesized
tcataggaaagaatcttaaaca

SEQ ID NO: 935316 - DNA, 22 bp, Artificial Sequence
  chemically synthesized
accaccattgtcccaagcacct

SEQ ID NO: 935317 - DNA, 22 bp, Artificial Sequence
  chemically synthesized
aaacaggtgcttgggacaatgg

SEQ ID NO: 935318 - DNA, 22 bp, Artificial Sequence
  chemically synthesized
aggggttgaccaccattgtccc

SEQ ID NO: 935319 - DNA, 22 bp, Artificial Sequence
  chemically synthesized
aacaggtgcttgggacaatggt

SEQ ID NO: 935320 - DNA, 22 bp, Artificial Sequence
  chemically synthesized
aaaccgctaaggggttgaccac

SEQ ID NO: 935321 - DNA, 22 bp, Artificial Sequence
  chemically synthesized
gaaaccgctaaggggttgacca

SEQ ID NO: 935322 - DNA, 22 bp, Artificial Sequence
  chemically synthesized
gggacaatggtggtcaacccct

SEQ ID NO: 935323 - DNA, 22 bp, Artificial Sequence
  chemically synthesized
ggacaatggtggtcaacccctt

SEQ ID NO: 935324 - DNA, 22 bp, Artificial Sequence
  chemically synthesized
gcatttgaaaccgctaaggggt

SEQ ID NO: 935325 - DNA, 22 bp, Artificial Sequence
  chemically synthesized
ctagcatttgaaaccgctaagg

SEQ ID NO: 935326 - DNA, 22 bp, Artificial Sequence
  chemically synthesized
tgtgtcatgagactcctagcat

SEQ ID NO: 935327 - DNA, 22 bp, Artificial Sequence
  chemically synthesized
agcggtttcaaatgctaggagt

SEQ ID NO: 935328 - DNA, 22 bp, Artificial Sequence
  chemically synthesized
gcggtttcaaatgctaggagtc

SEQ ID NO: 935329 - DNA, 22 bp, Artificial Sequence
  chemically synthesized
gagcctgtgtgtcatgagactc

SEQ ID NO: 935330 - DNA, 22 bp, Artificial Sequence
  chemically synthesized
agagcctgtgtgtcatgagact

SEQ ID NO: 935331 - DNA, 22 bp, Artificial Sequence
  chemically synthesized
caaatgctaggagtctcatgac

SEQ ID NO: 935332 - DNA, 22 bp, Artificial Sequence
  chemically synthesized
aaatgctaggagtctcatgaca

SEQ ID NO: 935333 - DNA, 22 bp, Artificial Sequence
  chemically synthesized
ggagtctcatgacacacaggct

SEQ ID NO: 935334 - DNA, 22 bp, Artificial Sequence
  chemically synthesized
atgacacacaggctctaaacct

SEQ ID NO: 935335 - DNA, 22 bp, Artificial Sequence
  chemically synthesized
tagaaaggtaatcaaggtttag

SEQ ID NO: 935336 - DNA, 22 bp, Artificial Sequence
  chemically synthesized
gtagaaaggtaatcaaggttta

SEQ ID NO: 935337 - DNA, 22 bp, Artificial Sequence
  chemically synthesized
ttgtagaaaggtaatcaaggtt

SEQ ID NO: 935338 - DNA, 22 bp, Artificial Sequence
  chemically synthesized
taaaccttgattacctttctac

SEQ ID NO: 935339 - DNA, 22 bp, Artificial Sequence
  chemically synthesized
aaccttgattacctttctacaa

SEQ ID NO: 935340 - DNA, 22 bp, Artificial Sequence
  chemically synthesized
gattacctttctacaagaacat

SEQ ID NO: 935341 - DNA, 22 bp, Artificial Sequence
  chemically synthesized
attacctttctacaagaacatt

SEQ ID NO: 935342 - DNA, 22 bp, Artificial Sequence
  chemically synthesized
cctttctacaagaacattgttg

SEQ ID NO: 935343 - DNA, 22 bp, Artificial Sequence
  chemically synthesized
gagatcaacaagcaacaatgtt

SEQ ID NO: 935344 - DNA, 22 bp, Artificial Sequence
  chemically synthesized
tctacaagaacattgttgcttg

SEQ ID NO: 935345 - DNA, 22 bp, Artificial Sequence
  chemically synthesized
ctacaagaacattgttgcttgt

SEQ ID NO: 935346 - DNA, 22 bp, Artificial Sequence
  chemically synthesized
tacaagaacattgttgcttgtt

SEQ ID NO: 935347 - DNA, 22 bp, Artificial Sequence
  chemically synthesized
caagaacattgttgcttgttga

SEQ ID NO: 935348 - DNA, 22 bp, Artificial Sequence
  chemically synthesized
aaaagattggagatcaacaagc

SEQ ID NO: 935349 - DNA, 22 bp, Artificial Sequence
  chemically synthesized
gcgtattaaaaagattggagat

SEQ ID NO: 935350 - DNA, 22 bp, Artificial Sequence
  chemically synthesized
ttgcttgttgatctccaatctt

SEQ ID NO: 935351 - DNA, 22 bp, Artificial Sequence
  chemically synthesized
cttgttgatctccaatcttttt

SEQ ID NO: 935352 - DNA, 22 bp, Artificial Sequence
  chemically synthesized
acattagcgtattaaaaagatt

SEQ ID NO: 935353 - DNA, 22 bp, Artificial Sequence
  chemically synthesized
gttgatctccaatctttttaat

SEQ ID NO: 935354 - DNA, 22 bp, Artificial Sequence
  chemically synthesized
ttgatctccaatctttttaata

SEQ ID NO: 935355 - DNA, 22 bp, Artificial Sequence
  chemically synthesized
atctccaatctttttaatacgc

SEQ ID NO: 935356 - DNA, 22 bp, Artificial Sequence
  chemically synthesized
catctgacattagcgtattaaa

SEQ ID NO: 935357 - DNA, 22 bp, Artificial Sequence
  chemically synthesized
ccatctgacattagcgtattaa

SEQ ID NO: 935358 - DNA, 22 bp, Artificial Sequence
  chemically synthesized
tttccatctgacattagcgtat

SEQ ID NO: 935359 - DNA, 22 bp, Artificial Sequence
  chemically synthesized
caatctttttaatacgctaatg

SEQ ID NO: 935360 - DNA, 22 bp, Artificial Sequence
  chemically synthesized
gtttccatctgacattagcgta

SEQ ID NO: 935361 - DNA, 22 bp, Artificial Sequence
  chemically synthesized
tttaatacgctaatgtcagatg

SEQ ID NO: 935362 - DNA, 22 bp, Artificial Sequence
  chemically synthesized
ttaatacgctaatgtcagatgg

SEQ ID NO: 935363 - DNA, 22 bp, Artificial Sequence
  chemically synthesized
taatacgctaatgtcagatgga

SEQ ID NO: 935364 - DNA, 22 bp, Artificial Sequence
  chemically synthesized
aatacgctaatgtcagatggaa

SEQ ID NO: 935365 - DNA, 22 bp, Artificial Sequence
  chemically synthesized
atacgctaatgtcagatggaaa

SEQ ID NO: 935366 - DNA, 22 bp, Artificial Sequence
  chemically synthesized
atgtcagatggaaacaaattcg

SEQ ID NO: 935367 - DNA, 22 bp, Artificial Sequence
  chemically synthesized
ccatccaggagtcgaatttgtt

SEQ ID NO: 935368 - DNA, 22 bp, Artificial Sequence
  chemically synthesized
gccatccaggagtcgaatttgt

SEQ ID NO: 935369 - DNA, 22 bp, Artificial Sequence
  chemically synthesized
cttgccatccaggagtcgaatt

SEQ ID NO: 935370 - DNA, 22 bp, Artificial Sequence
  chemically synthesized
gcttgccatccaggagtcgaat

SEQ ID NO: 935371 - DNA, 22 bp, Artificial Sequence
  chemically synthesized
gactcctggatggcaagcaagc

SEQ ID NO: 935372 - DNA, 22 bp, Artificial Sequence
  chemically synthesized
cccaatcccagtgcagcttgct

SEQ ID NO: 935373 - DNA, 22 bp, Artificial Sequence
  chemically synthesized
acccaatcccagtgcagcttgc

SEQ ID NO: 935374 - DNA, 22 bp, Artificial Sequence
  chemically synthesized
ctggatggcaagcaagctgcac

SEQ ID NO: 935375 - DNA, 22 bp, Artificial Sequence
  chemically synthesized
gatggcaagcaagctgcactgg

SEQ ID NO: 935376 - DNA, 22 bp, Artificial Sequence
  chemically synthesized
gccttacccaatcccagtgcag

SEQ ID NO: 935377 - DNA, 22 bp, Artificial Sequence
  chemically synthesized
tagccttacccaatcccagtgc

SEQ ID NO: 935378 - DNA, 22 bp, Artificial Sequence
  chemically synthesized
ctagccttacccaatcccagtg

SEQ ID NO: 935379 - DNA, 22 bp, Artificial Sequence
  chemically synthesized
cactgggattgggtaaggctag

SEQ ID NO: 935380 - DNA, 22 bp, Artificial Sequence
  chemically synthesized
cagatgatggcttctagcctta

SEQ ID NO: 935381 - DNA, 22 bp, Artificial Sequence
  chemically synthesized
ggattgggtaaggctagaagcc

SEQ ID NO: 935382 - DNA, 22 bp, Artificial Sequence
  chemically synthesized
tgttgcagatgatggcttctag

SEQ ID NO: 935383 - DNA, 22 bp, Artificial Sequence
  chemically synthesized
tgtgttgcagatgatggcttct

SEQ ID NO: 935384 - DNA, 22 bp, Artificial Sequence
  chemically synthesized
ggtaaggctagaagccatcatc

SEQ ID NO: 935385 - DNA, 22 bp, Artificial Sequence
  chemically synthesized
tctctgtgttgcagatgatggc

SEQ ID NO: 935386 - DNA, 22 bp, Artificial Sequence
  chemically synthesized
atctctgtgttgcagatgatgg

SEQ ID NO: 935387 - DNA, 22 bp, Artificial Sequence
  chemically synthesized
gcttatctctgtgttgcagatg

SEQ ID NO: 935388 - DNA, 22 bp, Artificial Sequence
  chemically synthesized
gaagccatcatctgcaacacag

SEQ ID NO: 935389 - DNA, 22 bp, Artificial Sequence
  chemically synthesized
agcctcgcttatctctgtgttg

SEQ ID NO: 935390 - DNA, 22 bp, Artificial Sequence
  chemically synthesized
caacacagagataagcgaggct

SEQ ID NO: 935391 - DNA, 22 bp, Artificial Sequence
  chemically synthesized
aaaaggccacagagaattcagc

SEQ ID NO: 935392 - DNA, 22 bp, Artificial Sequence
  chemically synthesized
acataatacagtctcaaaaggc

SEQ ID NO: 935393 - DNA, 22 bp, Artificial Sequence
  chemically synthesized
aattctctgtggccttttgaga

SEQ ID NO: 935394 - DNA, 22 bp, Artificial Sequence
  chemically synthesized
cacataatacagtctcaaaagg

SEQ ID NO: 935395 - DNA, 22 bp, Artificial Sequence
  chemically synthesized
atttcacataatacagtctcaa

SEQ ID NO: 935396 - DNA, 22 bp, Artificial Sequence
  chemically synthesized
tctgtggccttttgagactgta

SEQ ID NO: 935397 - DNA, 22 bp, Artificial Sequence
  chemically synthesized
catttcacataatacagtctca

SEQ ID NO: 935398 - DNA, 22 bp, Artificial Sequence
  chemically synthesized
tgtggccttttgagactgtatt

SEQ ID NO: 935399 - DNA, 22 bp, Artificial Sequence
  chemically synthesized
ttcatttcacataatacagtct

SEQ ID NO: 935400 - DNA, 22 bp, Artificial Sequence
  chemically synthesized
tggccttttgagactgtattat

SEQ ID NO: 935401 - DNA, 22 bp, Artificial Sequence
  chemically synthesized
taaattcttcatttcacataat

SEQ ID NO: 935402 - DNA, 22 bp, Artificial Sequence
  chemically synthesized
gtaaattcttcatttcacataa

SEQ ID NO: 935403 - DNA, 22 bp, Artificial Sequence
  chemically synthesized
ttgagactgtattatgtgaaat

SEQ ID NO: 935404 - DNA, 22 bp, Artificial Sequence
  chemically synthesized
tgagactgtattatgtgaaatg

SEQ ID NO: 935405 - DNA, 22 bp, Artificial Sequence
  chemically synthesized
gagactgtattatgtgaaatga

SEQ ID NO: 935406 - DNA, 22 bp, Artificial Sequence
  chemically synthesized
cttgtaaattcttcatttcaca

SEQ ID NO: 935407 - DNA, 22 bp, Artificial Sequence
  chemically synthesized
agactgtattatgtgaaatgaa

SEQ ID NO: 935408 - DNA, 22 bp, Artificial Sequence
  chemically synthesized
tgcttgtaaattcttcatttca

SEQ ID NO: 935409 - DNA, 22 bp, Artificial Sequence
  chemically synthesized
ctgcttgtaaattcttcatttc

SEQ ID NO: 935410 - DNA, 22 bp, Artificial Sequence
  chemically synthesized
tttctgcttgtaaattcttcat

SEQ ID NO: 935411 - DNA, 22 bp, Artificial Sequence
  chemically synthesized
tattatgtgaaatgaagaattt

SEQ ID NO: 935412 - DNA, 22 bp, Artificial Sequence
  chemically synthesized
ctgtttctgcttgtaaattctt

SEQ ID NO: 935413 - DNA, 22 bp, Artificial Sequence
  chemically synthesized
tgtgaaatgaagaatttacaag

SEQ ID NO: 935414 - DNA, 22 bp, Artificial Sequence
  chemically synthesized
gctactgtttctgcttgtaaat

SEQ ID NO: 935415 - DNA, 22 bp, Artificial Sequence
  chemically synthesized
agctactgtttctgcttgtaaa

SEQ ID NO: 935416 - DNA, 22 bp, Artificial Sequence
  chemically synthesized
tagctactgtttctgcttgtaa

SEQ ID NO: 935417 - DNA, 22 bp, Artificial Sequence
  chemically synthesized
ttagctactgtttctgcttgta

SEQ ID NO: 935418 - DNA, 22 bp, Artificial Sequence
  chemically synthesized
ataatgagatttttagctactg

SEQ ID NO: 935419 - DNA, 22 bp, Artificial Sequence
  chemically synthesized
acaagcagaaacagtagctaaa

SEQ ID NO: 935420 - DNA, 22 bp, Artificial Sequence
  chemically synthesized
caagcagaaacagtagctaaaa

SEQ ID NO: 935421 - DNA, 22 bp, Artificial Sequence
  chemically synthesized
aaaagtcattaataatgagatt

SEQ ID NO: 935422 - DNA, 22 bp, Artificial Sequence
  chemically synthesized
ctcaaaagtcattaataatgag

SEQ ID NO: 935423 - DNA, 22 bp, Artificial Sequence
  chemically synthesized
aaaatctcattattaatgactt

SEQ ID NO: 935424 - DNA, 22 bp, Artificial Sequence
  chemically synthesized
attattaatgacttttgagcag

SEQ ID NO: 935425 - DNA, 22 bp, Artificial Sequence
  chemically synthesized
ttaatgacttttgagcagccac

SEQ ID NO: 935426 - DNA, 22 bp, Artificial Sequence
  chemically synthesized
atgacttttgagcagccacggt

SEQ ID NO: 935427 - DNA, 22 bp, Artificial Sequence
  chemically synthesized
acatgaaaaaccagaaaccgtg

SEQ ID NO: 935428 - DNA, 22 bp, Artificial Sequence
  chemically synthesized
ttgagcagccacggtttctggt

SEQ ID NO: 935429 - DNA, 22 bp, Artificial Sequence
  chemically synthesized
tgagcagccacggtttctggtt

SEQ ID NO: 935430 - DNA, 22 bp, Artificial Sequence
  chemically synthesized
gagcagccacggtttctggttt

SEQ ID NO: 935431 - DNA, 22 bp, Artificial Sequence
  chemically synthesized
agcagccacggtttctggtttt

SEQ ID NO: 935432 - DNA, 22 bp, Artificial Sequence
  chemically synthesized
cagattcacatgaaaaaccaga

SEQ ID NO: 935433 - DNA, 22 bp, Artificial Sequence
  chemically synthesized
acagattcacatgaaaaaccag

SEQ ID NO: 935434 - DNA, 22 bp, Artificial Sequence
  chemically synthesized
ttacagattcacatgaaaaacc

SEQ ID NO: 935435 - DNA, 22 bp, Artificial Sequence
  chemically synthesized
agtctcttacagattcacatga

SEQ ID NO: 935436 - DNA, 22 bp, Artificial Sequence
  chemically synthesized
ttaagtctcttacagattcaca

SEQ ID NO: 935437 - DNA, 22 bp, Artificial Sequence
  chemically synthesized
ctggtttttcatgtgaatctgt

SEQ ID NO: 935438 - DNA, 22 bp, Artificial Sequence
  chemically synthesized
gttaagtctcttacagattcac

SEQ ID NO: 935439 - DNA, 22 bp, Artificial Sequence
  chemically synthesized
tggtttttcatgtgaatctgta

SEQ ID NO: 935440 - DNA, 22 bp, Artificial Sequence
  chemically synthesized
tgttaagtctcttacagattca

SEQ ID NO: 935441 - DNA, 22 bp, Artificial Sequence
  chemically synthesized
gtttttcatgtgaatctgtaag

SEQ ID NO: 935442 - DNA, 22 bp, Artificial Sequence
  chemically synthesized
tctttgttaagtctcttacaga

SEQ ID NO: 935443 - DNA, 22 bp, Artificial Sequence
  chemically synthesized
gtctttgttaagtctcttacag

SEQ ID NO: 935444 - DNA, 22 bp, Artificial Sequence
  chemically synthesized
ttcatgtgaatctgtaagagac

SEQ ID NO: 935445 - DNA, 22 bp, Artificial Sequence
  chemically synthesized
tgtctttgttaagtctcttaca

SEQ ID NO: 935446 - DNA, 22 bp, Artificial Sequence
  chemically synthesized
tcatgtgaatctgtaagagact

SEQ ID NO: 935447 - DNA, 22 bp, Artificial Sequence
  chemically synthesized
ttgtctttgttaagtctcttac

SEQ ID NO: 935448 - DNA, 22 bp, Artificial Sequence
  chemically synthesized
catgtgaatctgtaagagactt

SEQ ID NO: 935449 - DNA, 22 bp, Artificial Sequence
  chemically synthesized
atgtgaatctgtaagagactta

SEQ ID NO: 935450 - DNA, 22 bp, Artificial Sequence
  chemically synthesized
tgcccacatttttgtctttgtt

SEQ ID NO: 935451 - DNA, 22 bp, Artificial Sequence
  chemically synthesized
gtgcccacatttttgtctttgt

SEQ ID NO: 935452 - DNA, 22 bp, Artificial Sequence
  chemically synthesized
taagagacttaacaaagacaaa

SEQ ID NO: 935453 - DNA, 22 bp, Artificial Sequence
  chemically synthesized
tgtgcccacatttttgtctttg

SEQ ID NO: 935454 - DNA, 22 bp, Artificial Sequence
  chemically synthesized
ttgtgcccacatttttgtcttt

SEQ ID NO: 935455 - DNA, 22 bp, Artificial Sequence
  chemically synthesized
tttgtgcccacatttttgtctt

SEQ ID NO: 935456 - DNA, 22 bp, Artificial Sequence
  chemically synthesized
cattttttgtgcccacattttt

SEQ ID NO: 935457 - DNA, 22 bp, Artificial Sequence
  chemically synthesized
aacaaagacaaaaatgtgggca

SEQ ID NO: 935458 - DNA, 22 bp, Artificial Sequence
  chemically synthesized
ctacattttttgtgcccacatt

SEQ ID NO: 935459 - DNA, 22 bp, Artificial Sequence
  chemically synthesized
acaaagacaaaaatgtgggcac

SEQ ID NO: 935460 - DNA, 22 bp, Artificial Sequence
  chemically synthesized
gctacattttttgtgcccacat

SEQ ID NO: 935461 - DNA, 22 bp, Artificial Sequence
  chemically synthesized
tttgctacattttttgtgccca

SEQ ID NO: 935462 - DNA, 22 bp, Artificial Sequence
  chemically synthesized
atttgctacattttttgtgccc

SEQ ID NO: 935463 - DNA, 22 bp, Artificial Sequence
  chemically synthesized
tttatttgctacattttttgtg

SEQ ID NO: 935464 - DNA, 22 bp, Artificial Sequence
  chemically synthesized
tgtttatttgctacattttttg

SEQ ID NO: 935465 - DNA, 22 bp, Artificial Sequence
  chemically synthesized
gtcccagattctgtttatttgc

SEQ ID NO: 935466 - DNA, 22 bp, Artificial Sequence
  chemically synthesized
agtcccagattctgtttatttg

SEQ ID NO: 935467 - DNA, 22 bp, Artificial Sequence
  chemically synthesized
tagtcccagattctgtttattt

SEQ ID NO: 935468 - DNA, 22 bp, Artificial Sequence
  chemically synthesized
ttttagtcccagattctgttta

SEQ ID NO: 935469 - DNA, 22 bp, Artificial Sequence
  chemically synthesized
tattttagtcccagattctgtt

SEQ ID NO: 935470 - DNA, 22 bp, Artificial Sequence
  chemically synthesized
ctattttagtcccagattctgt

SEQ ID NO: 935471 - DNA, 22 bp, Artificial Sequence
  chemically synthesized
tctattttagtcccagattctg

SEQ ID NO: 935472 - DNA, 22 bp, Artificial Sequence
  chemically synthesized
ttctattttagtcccagattct

SEQ ID NO: 935473 - DNA, 22 bp, Artificial Sequence
  chemically synthesized
catttttctattttagtcccag

SEQ ID NO: 935474 - DNA, 22 bp, Artificial Sequence
  chemically synthesized
agacacagttacatttttctat

SEQ ID NO: 935475 - DNA, 22 bp, Artificial Sequence
  chemically synthesized
gagacacagttacatttttcta

SEQ ID NO: 935476 - DNA, 22 bp, Artificial Sequence
  chemically synthesized
tgagacacagttacatttttct

SEQ ID NO: 935477 - DNA, 22 bp, Artificial Sequence
  chemically synthesized
ttgagacacagttacatttttc

SEQ ID NO: 935478 - DNA, 22 bp, Artificial Sequence
  chemically synthesized
ggactaaaatagaaaaatgtaa

SEQ ID NO: 935479 - DNA, 22 bp, Artificial Sequence
  chemically synthesized
aaatagaaaaatgtaactgtgt

SEQ ID NO: 935480 - DNA, 22 bp, Artificial Sequence
  chemically synthesized
agccagtatgtaaacacttttg

SEQ ID NO: 935481 - DNA, 22 bp, Artificial Sequence
  chemically synthesized
cagccagtatgtaaacactttt

SEQ ID NO: 935482 - DNA, 22 bp, Artificial Sequence
  chemically synthesized
tcagccagtatgtaaacacttt

SEQ ID NO: 935483 - DNA, 22 bp, Artificial Sequence
  chemically synthesized
tttcagccagtatgtaaacact

SEQ ID NO: 935484 - DNA, 22 bp, Artificial Sequence
  chemically synthesized
tgtctcaaaagtgtttacatac

SEQ ID NO: 935485 - DNA, 22 bp, Artificial Sequence
  chemically synthesized
actctttcagccagtatgtaaa

SEQ ID NO: 935486 - DNA, 22 bp, Artificial Sequence
  chemically synthesized
aaaagtgtttacatactggctg

SEQ ID NO: 935487 - DNA, 22 bp, Artificial Sequence
  chemically synthesized
tacagttcactctttcagccag

SEQ ID NO: 935488 - DNA, 22 bp, Artificial Sequence
  chemically synthesized
acatactggctgaaagagtgaa

SEQ ID NO: 935489 - DNA, 22 bp, Artificial Sequence
  chemically synthesized
catactggctgaaagagtgaac

SEQ ID NO: 935490 - DNA, 22 bp, Artificial Sequence
  chemically synthesized
aacaaaccctgtacagttcact

SEQ ID NO: 935491 - DNA, 22 bp, Artificial Sequence
  chemically synthesized
aaacaaaccctgtacagttcac

SEQ ID NO: 935492 - DNA, 22 bp, Artificial Sequence
  chemically synthesized
gctgaaagagtgaactgtacag

SEQ ID NO: 935493 - DNA, 22 bp, Artificial Sequence
  chemically synthesized
tttaaacaaaccctgtacagtt

SEQ ID NO: 935494 - DNA, 22 bp, Artificial Sequence
  chemically synthesized
gtttaaacaaaccctgtacagt

SEQ ID NO: 935495 - DNA, 22 bp, Artificial Sequence
  chemically synthesized
tgtttaaacaaaccctgtacag

SEQ ID NO: 935496 - DNA, 22 bp, Artificial Sequence
  chemically synthesized
ttgtttaaacaaaccctgtaca

SEQ ID NO: 935497 - DNA, 22 bp, Artificial Sequence
  chemically synthesized
aaagagtgaactgtacagggtt

SEQ ID NO: 935498 - DNA, 22 bp, Artificial Sequence
  chemically synthesized
cataacttttgtttaaacaaac

SEQ ID NO: 935499 - DNA, 22 bp, Artificial Sequence
  chemically synthesized
acataacttttgtttaaacaaa

SEQ ID NO: 935500 - DNA, 22 bp, Artificial Sequence
  chemically synthesized
tacagggtttgtttaaacaaaa

SEQ ID NO: 935501 - DNA, 22 bp, Artificial Sequence
  chemically synthesized
agcaaagatttacataactttt

SEQ ID NO: 935502 - DNA, 22 bp, Artificial Sequence
  chemically synthesized
gtttaaacaaaagttatgtaaa

SEQ ID NO: 935503 - DNA, 22 bp, Artificial Sequence
  chemically synthesized
tttaaacaaaagttatgtaaat

SEQ ID NO: 935504 - DNA, 22 bp, Artificial Sequence
  chemically synthesized
aaacaaaagttatgtaaatctt

SEQ ID NO: 935505 - DNA, 22 bp, Artificial Sequence
  chemically synthesized
aacaaaagttatgtaaatcttt

SEQ ID NO: 935506 - DNA, 22 bp, Artificial Sequence
  chemically synthesized
agcaaccagctgagcaaagatt

SEQ ID NO: 935507 - DNA, 22 bp, Artificial Sequence
  chemically synthesized
ctgagcaaccagctgagcaaag

SEQ ID NO: 935508 - DNA, 22 bp, Artificial Sequence
  chemically synthesized
cctgagcaaccagctgagcaaa

SEQ ID NO: 935509 - DNA, 22 bp, Artificial Sequence
  chemically synthesized
tcctgagcaaccagctgagcaa

SEQ ID NO: 935510 - DNA, 22 bp, Artificial Sequence
  chemically synthesized
tgtaaatctttgctcagctggt

SEQ ID NO: 935511 - DNA, 22 bp, Artificial Sequence
  chemically synthesized
ctttcctgagcaaccagctgag

SEQ ID NO: 935512 - DNA, 22 bp, Artificial Sequence
  chemically synthesized
actttcctgagcaaccagctga

SEQ ID NO: 935513 - DNA, 22 bp, Artificial Sequence
  chemically synthesized
catttactttcctgagcaacca

SEQ ID NO: 935514 - DNA, 22 bp, Artificial Sequence
  chemically synthesized
ccatttactttcctgagcaacc

SEQ ID NO: 935515 - DNA, 22 bp, Artificial Sequence
  chemically synthesized
tgctcagctggttgctcaggaa

SEQ ID NO: 935516 - DNA, 22 bp, Artificial Sequence
  chemically synthesized
cttccatttactttcctgagca

SEQ ID NO: 935517 - DNA, 22 bp, Artificial Sequence
  chemically synthesized
gctcagctggttgctcaggaaa

SEQ ID NO: 935518 - DNA, 22 bp, Artificial Sequence
  chemically synthesized
gcttccatttactttcctgagc

SEQ ID NO: 935519 - DNA, 22 bp, Artificial Sequence
  chemically synthesized
ctcagctggttgctcaggaaag

SEQ ID NO: 935520 - DNA, 22 bp, Artificial Sequence
  chemically synthesized
tttgcttccatttactttcctg

SEQ ID NO: 935521 - DNA, 22 bp, Artificial Sequence
  chemically synthesized
agctggttgctcaggaaagtaa

SEQ ID NO: 935522 - DNA, 22 bp, Artificial Sequence
  chemically synthesized
tgtttgcttccatttactttcc

SEQ ID NO: 935523 - DNA, 22 bp, Artificial Sequence
  chemically synthesized
ctctgtttgcttccatttactt

SEQ ID NO: 935524 - DNA, 22 bp, Artificial Sequence
  chemically synthesized
gttgctcaggaaagtaaatgga

SEQ ID NO: 935525 - DNA, 22 bp, Artificial Sequence
  chemically synthesized
cctctgtttgcttccatttact

SEQ ID NO: 935526 - DNA, 22 bp, Artificial Sequence
  chemically synthesized
tcctctgtttgcttccatttac

SEQ ID NO: 935527 - DNA, 22 bp, Artificial Sequence
  chemically synthesized
ctcaggaaagtaaatggaagca

SEQ ID NO: 935528 - DNA, 22 bp, Artificial Sequence
  chemically synthesized
ttttcctctgtttgcttccatt

SEQ ID NO: 935529 - DNA, 22 bp, Artificial Sequence
  chemically synthesized
aggaaagtaaatggaagcaaac

SEQ ID NO: 935530 - DNA, 22 bp, Artificial Sequence
  chemically synthesized
cagcccgtggtctgttttcctc

SEQ ID NO: 935531 - DNA, 22 bp, Artificial Sequence
  chemically synthesized
ccagcccgtggtctgttttcct

SEQ ID NO: 935532 - DNA, 22 bp, Artificial Sequence
  chemically synthesized
ttccagcccgtggtctgttttc

SEQ ID NO: 935533 - DNA, 22 bp, Artificial Sequence
  chemically synthesized
acaaactcttccagcccgtggt

SEQ ID NO: 935534 - DNA, 22 bp, Artificial Sequence
  chemically synthesized
gacaaactcttccagcccgtgg

SEQ ID NO: 935535 - DNA, 22 bp, Artificial Sequence
  chemically synthesized
ttgacaaactcttccagcccgt

SEQ ID NO: 935536 - DNA, 22 bp, Artificial Sequence
  chemically synthesized
tcattcttgacaaactcttcca

SEQ ID NO: 935537 - DNA, 22 bp, Artificial Sequence
  chemically synthesized
aatgcccgttatcattcttgac

SEQ ID NO: 935538 - DNA, 22 bp, Artificial Sequence
  chemically synthesized
caatgcccgttatcattcttga

SEQ ID NO: 935539 - DNA, 22 bp, Artificial Sequence
  chemically synthesized
gaagagtttgtcaagaatgata

SEQ ID NO: 935540 - DNA, 22 bp, Artificial Sequence
  chemically synthesized
atgcttcaatgcccgttatcat

SEQ ID NO: 935541 - DNA, 22 bp, Artificial Sequence
  chemically synthesized
gtcaagaatgataacgggcatt

SEQ ID NO: 935542 - DNA, 22 bp, Artificial Sequence
  chemically synthesized
tcaagaatgataacgggcattg

SEQ ID NO: 935543 - DNA, 22 bp, Artificial Sequence
  chemically synthesized
aatcctgatgcttcaatgcccg

SEQ ID NO: 935544 - DNA, 22 bp, Artificial Sequence
  chemically synthesized
aaatcctgatgcttcaatgccc

SEQ ID NO: 935545 - DNA, 22 bp, Artificial Sequence
  chemically synthesized
taaatcctgatgcttcaatgcc

SEQ ID NO: 935546 - DNA, 22 bp, Artificial Sequence
  chemically synthesized
tcattttaaatcctgatgcttc

SEQ ID NO: 935547 - DNA, 22 bp, Artificial Sequence
  chemically synthesized
ggctatcattttaaatcctgat

SEQ ID NO: 935548 - DNA, 22 bp, Artificial Sequence
  chemically synthesized
aagcatcaggatttaaaatgat

SEQ ID NO: 935549 - DNA, 22 bp, Artificial Sequence
  chemically synthesized
cagaggctgggctatcatttta

SEQ ID NO: 935550 - DNA, 22 bp, Artificial Sequence
  chemically synthesized
acagaggctgggctatcatttt

SEQ ID NO: 935551 - DNA, 22 bp, Artificial Sequence
  chemically synthesized
tttacagaggctgggctatcat

SEQ ID NO: 935552 - DNA, 22 bp, Artificial Sequence
  chemically synthesized
cattatttacagaggctgggct

SEQ ID NO: 935553 - DNA, 22 bp, Artificial Sequence
  chemically synthesized
gcattatttacagaggctgggc

SEQ ID NO: 935554 - DNA, 22 bp, Artificial Sequence
  chemically synthesized
aaaatgatagcccagcctctgt

SEQ ID NO: 935555 - DNA, 22 bp, Artificial Sequence
  chemically synthesized
aaatgatagcccagcctctgta

SEQ ID NO: 935556 - DNA, 22 bp, Artificial Sequence
  chemically synthesized
aagagcttgcattatttacaga

SEQ ID NO: 935557 - DNA, 22 bp, Artificial Sequence
  chemically synthesized
gtgcatcctgaagagcttgcat

SEQ ID NO: 935558 - DNA, 22 bp, Artificial Sequence
  chemically synthesized
tagtgcatcctgaagagcttgc

SEQ ID NO: 935559 - DNA, 22 bp, Artificial Sequence
  chemically synthesized
tgtaaataatgcaagctcttca

SEQ ID NO: 935560 - DNA, 22 bp, Artificial Sequence
  chemically synthesized
taaataatgcaagctcttcagg

SEQ ID NO: 935561 - DNA, 22 bp, Artificial Sequence
  chemically synthesized
ggtctctagtgcatcctgaaga

SEQ ID NO: 935562 - DNA, 22 bp, Artificial Sequence
  chemically synthesized
tcgagttgggtctctagtgcat

SEQ ID NO: 935563 - DNA, 22 bp, Artificial Sequence
  chemically synthesized
ttcaggatgcactagagaccca

SEQ ID NO: 935564 - DNA, 22 bp, Artificial Sequence
  chemically synthesized
caggatgcactagagacccaac

SEQ ID NO: 935565 - DNA, 22 bp, Artificial Sequence
  chemically synthesized
tcatgctgtcgagttgggtctc

SEQ ID NO: 935566 - DNA, 22 bp, Artificial Sequence
  chemically synthesized
aggatgcactagagacccaact

SEQ ID NO: 935567 - DNA, 22 bp, Artificial Sequence
  chemically synthesized
aaattatcatgctgtcgagttg

SEQ ID NO: 935568 - DNA, 22 bp, Artificial Sequence
  chemically synthesized
gctaaaattatcatgctgtcga

SEQ ID NO: 935569 - DNA, 22 bp, Artificial Sequence
  chemically synthesized
agctaaaattatcatgctgtcg

SEQ ID NO: 935570 - DNA, 22 bp, Artificial Sequence
  chemically synthesized
gagacccaactcgacagcatga

SEQ ID NO: 935571 - DNA, 22 bp, Artificial Sequence
  chemically synthesized
tagctaaaattatcatgctgtc

SEQ ID NO: 935572 - DNA, 22 bp, Artificial Sequence
  chemically synthesized
ttagctaaaattatcatgctgt

SEQ ID NO: 935573 - DNA, 22 bp, Artificial Sequence
  chemically synthesized
gacagcatgataattttagcta

SEQ ID NO: 935574 - DNA, 22 bp, Artificial Sequence
  chemically synthesized
tggagggaatagcaggttttta

SEQ ID NO: 935575 - DNA, 22 bp, Artificial Sequence
  chemically synthesized
gtggagggaatagcaggttttt

SEQ ID NO: 935576 - DNA, 22 bp, Artificial Sequence
  chemically synthesized
tagctaaaaacctgctattccc

SEQ ID NO: 935577 - DNA, 22 bp, Artificial Sequence
  chemically synthesized
agctaaaaacctgctattccct

SEQ ID NO: 935578 - DNA, 22 bp, Artificial Sequence
  chemically synthesized
gctaaaaacctgctattccctc

SEQ ID NO: 935579 - DNA, 22 bp, Artificial Sequence
  chemically synthesized
tggagtcttgtggagggaatag

SEQ ID NO: 935580 - DNA, 22 bp, Artificial Sequence
  chemically synthesized
atggagtcttgtggagggaata

SEQ ID NO: 935581 - DNA, 22 bp, Artificial Sequence
  chemically synthesized
aaaacctgctattccctccaca

SEQ ID NO: 935582 - DNA, 22 bp, Artificial Sequence
  chemically synthesized
gtttatggagtcttgtggaggg

SEQ ID NO: 935583 - DNA, 22 bp, Artificial Sequence
  chemically synthesized
agtttatggagtcttgtggagg

SEQ ID NO: 935584 - DNA, 22 bp, Artificial Sequence
  chemically synthesized
tagtttatggagtcttgtggag

SEQ ID NO: 935585 - DNA, 22 bp, Artificial Sequence
  chemically synthesized
tttagtttatggagtcttgtgg

SEQ ID NO: 935586 - DNA, 22 bp, Artificial Sequence
  chemically synthesized
ctttagtttatggagtcttgtg

SEQ ID NO: 935587 - DNA, 22 bp, Artificial Sequence
  chemically synthesized
ctattccctccacaagactcca

SEQ ID NO: 935588 - DNA, 22 bp, Artificial Sequence
  chemically synthesized
ttctttagtttatggagtcttg

SEQ ID NO: 935589 - DNA, 22 bp, Artificial Sequence
  chemically synthesized
cttctttagtttatggagtctt

SEQ ID NO: 935590 - DNA, 22 bp, Artificial Sequence
  chemically synthesized
tcttctttagtttatggagtct

SEQ ID NO: 935591 - DNA, 22 bp, Artificial Sequence
  chemically synthesized
ttccctccacaagactccataa

SEQ ID NO: 935592 - DNA, 22 bp, Artificial Sequence
  chemically synthesized
cctccacaagactccataaact

SEQ ID NO: 935593 - DNA, 22 bp, Artificial Sequence
  chemically synthesized
agctttcttctttagtttatgg

SEQ ID NO: 935594 - DNA, 22 bp, Artificial Sequence
  chemically synthesized
cacaagactccataaactaaag

SEQ ID NO: 935595 - DNA, 22 bp, Artificial Sequence
  chemically synthesized
cataaactaaagaagaaagctg

SEQ ID NO: 935596 - DNA, 22 bp, Artificial Sequence
  chemically synthesized
ggtgtatacaatccctcagctt

SEQ ID NO: 935597 - DNA, 22 bp, Artificial Sequence
  chemically synthesized
gggtgtatacaatccctcagct

SEQ ID NO: 935598 - DNA, 22 bp, Artificial Sequence
  chemically synthesized
tgggtgtatacaatccctcagc

SEQ ID NO: 935599 - DNA, 22 bp, Artificial Sequence
  chemically synthesized
aagaagaaagctgagggattgt

SEQ ID NO: 935600 - DNA, 22 bp, Artificial Sequence
  chemically synthesized
gcgttttgggtgtatacaatcc

SEQ ID NO: 935601 - DNA, 22 bp, Artificial Sequence
  chemically synthesized
acagttggcgttttgggtgtat

SEQ ID NO: 935602 - DNA, 22 bp, Artificial Sequence
  chemically synthesized
taacagttggcgttttgggtgt

SEQ ID NO: 935603 - DNA, 22 bp, Artificial Sequence
  chemically synthesized
agggattgtatacacccaaaac

SEQ ID NO: 935604 - DNA, 22 bp, Artificial Sequence
  chemically synthesized
ctaacagttggcgttttgggtg

SEQ ID NO: 935605 - DNA, 22 bp, Artificial Sequence
  chemically synthesized
tatacacccaaaacgccaactg

SEQ ID NO: 935606 - DNA, 22 bp, Artificial Sequence
  chemically synthesized
ccacgcttctaacagttggcgt

SEQ ID NO: 935607 - DNA, 22 bp, Artificial Sequence
  chemically synthesized
cccacgcttctaacagttggcg

SEQ ID NO: 935608 - DNA, 22 bp, Artificial Sequence
  chemically synthesized
aaggtgccaggtttcccacgct

SEQ ID NO: 935609 - DNA, 22 bp, Artificial Sequence
  chemically synthesized
aaaggtgccaggtttcccacgc

SEQ ID NO: 935610 - DNA, 22 bp, Artificial Sequence
  chemically synthesized
ttagaagcgtgggaaacctggc

SEQ ID NO: 935611 - DNA, 22 bp, Artificial Sequence
  chemically synthesized
gaagcgtgggaaacctggcacc

SEQ ID NO: 935612 - DNA, 22 bp, Artificial Sequence
  chemically synthesized
agggataaaatcagagatttaa

SEQ ID NO: 935613 - DNA, 22 bp, Artificial Sequence
  chemically synthesized
gcacctttaaatctctgatttt

SEQ ID NO: 935614 - DNA, 22 bp, Artificial Sequence
  chemically synthesized
taaatctctgattttatccctt

SEQ ID NO: 935615 - DNA, 22 bp, Artificial Sequence
  chemically synthesized
aaatctctgattttatccctta

SEQ ID NO: 935616 - DNA, 22 bp, Artificial Sequence
  chemically synthesized
aatctctgattttatcccttag

SEQ ID NO: 935617 - DNA, 22 bp, Artificial Sequence
  chemically synthesized
tgattttatcccttagttgccc

SEQ ID NO: 935618 - DNA, 22 bp, Artificial Sequence
  chemically synthesized
attttatcccttagttgcccat

SEQ ID NO: 935619 - DNA, 22 bp, Artificial Sequence
  chemically synthesized
ccaggcaatgtcatgggcaact

SEQ ID NO: 935620 - DNA, 22 bp, Artificial Sequence
  chemically synthesized
tatcccttagttgcccatgaca

SEQ ID NO: 935621 - DNA, 22 bp, Artificial Sequence
  chemically synthesized
atcccttagttgcccatgacat

SEQ ID NO: 935622 - DNA, 22 bp, Artificial Sequence
  chemically synthesized
tcccttagttgcccatgacatt

SEQ ID NO: 935623 - DNA, 22 bp, Artificial Sequence
  chemically synthesized
caaaatctcccaggcaatgtca

SEQ ID NO: 935624 - DNA, 22 bp, Artificial Sequence
  chemically synthesized
agttgcccatgacattgcctgg

SEQ ID NO: 935625 - DNA, 22 bp, Artificial Sequence
  chemically synthesized
gttgcccatgacattgcctggg

SEQ ID NO: 935626 - DNA, 22 bp, Artificial Sequence
  chemically synthesized
agtgctgcaaaatctcccaggc

SEQ ID NO: 935627 - DNA, 22 bp, Artificial Sequence
  chemically synthesized
cccatgacattgcctgggagat

SEQ ID NO: 935628 - DNA, 22 bp, Artificial Sequence
  chemically synthesized
aagtgctgcaaaatctcccagg

SEQ ID NO: 935629 - DNA, 22 bp, Artificial Sequence
  chemically synthesized
tcccagtttaagtgctgcaaaa

SEQ ID NO: 935630 - DNA, 22 bp, Artificial Sequence
  chemically synthesized
atcccagtttaagtgctgcaaa

SEQ ID NO: 935631 - DNA, 22 bp, Artificial Sequence
  chemically synthesized
cctgggagattttgcagcactt

SEQ ID NO: 935632 - DNA, 22 bp, Artificial Sequence
  chemically synthesized
acttatcccagtttaagtgctg

SEQ ID NO: 935633 - DNA, 22 bp, Artificial Sequence
  chemically synthesized
ggagattttgcagcacttaaac

SEQ ID NO: 935634 - DNA, 22 bp, Artificial Sequence
  chemically synthesized
tctaacttatcccagtttaagt

SEQ ID NO: 935635 - DNA, 22 bp, Artificial Sequence
  chemically synthesized
attgtctaacttatcccagttt

SEQ ID NO: 935636 - DNA, 22 bp, Artificial Sequence
  chemically synthesized
aattgtctaacttatcccagtt

SEQ ID NO: 935637 - DNA, 22 bp, Artificial Sequence
  chemically synthesized
tgcagcacttaaactgggataa

SEQ ID NO: 935638 - DNA, 22 bp, Artificial Sequence
  chemically synthesized
taattgtctaacttatcccagt

SEQ ID NO: 935639 - DNA, 22 bp, Artificial Sequence
  chemically synthesized
gcagcacttaaactgggataag

SEQ ID NO: 935640 - DNA, 22 bp, Artificial Sequence
  chemically synthesized
cagcacttaaactgggataagt

SEQ ID NO: 935641 - DNA, 22 bp, Artificial Sequence
  chemically synthesized
agatgctttaattgtctaactt

SEQ ID NO: 935642 - DNA, 22 bp, Artificial Sequence
  chemically synthesized
aaactgggataagttagacaat

SEQ ID NO: 935643 - DNA, 22 bp, Artificial Sequence
  chemically synthesized
aactgggataagttagacaatt

SEQ ID NO: 935644 - DNA, 22 bp, Artificial Sequence
  chemically synthesized
ggataagttagacaattaaagc

SEQ ID NO: 935645 - DNA, 22 bp, Artificial Sequence
  chemically synthesized
gacaaaaactgagatgctttaa

SEQ ID NO: 935646 - DNA, 22 bp, Artificial Sequence
  chemically synthesized
gacaattaaagcatctcagttt

SEQ ID NO: 935647 - DNA, 22 bp, Artificial Sequence
  chemically synthesized
gcatggttagacaaaaactgag

SEQ ID NO: 935648 - DNA, 22 bp, Artificial Sequence
  chemically synthesized
agcatggttagacaaaaactga

SEQ ID NO: 935649 - DNA, 22 bp, Artificial Sequence
  chemically synthesized
tagcatggttagacaaaaactg

SEQ ID NO: 935650 - DNA, 22 bp, Artificial Sequence
  chemically synthesized
ttagcatggttagacaaaaact

SEQ ID NO: 935651 - DNA, 22 bp, Artificial Sequence
  chemically synthesized
aagcatctcagtttttgtctaa

SEQ ID NO: 935652 - DNA, 22 bp, Artificial Sequence
  chemically synthesized
tttttagcatggttagacaaaa

SEQ ID NO: 935653 - DNA, 22 bp, Artificial Sequence
  chemically synthesized
atttttagcatggttagacaaa

SEQ ID NO: 935654 - DNA, 22 bp, Artificial Sequence
  chemically synthesized
ttatttttagcatggttagaca

SEQ ID NO: 935655 - DNA, 22 bp, Artificial Sequence
  chemically synthesized
agtttttgtctaaccatgctaa

SEQ ID NO: 935656 - DNA, 22 bp, Artificial Sequence
  chemically synthesized
tcactcttatttttagcatggt

SEQ ID NO: 935657 - DNA, 22 bp, Artificial Sequence
  chemically synthesized
ttgtctaaccatgctaaaaata

SEQ ID NO: 935658 - DNA, 22 bp, Artificial Sequence
  chemically synthesized
tgtctaaccatgctaaaaataa

SEQ ID NO: 935659 - DNA, 22 bp, Artificial Sequence
  chemically synthesized
gtctaaccatgctaaaaataag

SEQ ID NO: 935660 - DNA, 22 bp, Artificial Sequence
  chemically synthesized
agacctgtcactcttattttta

SEQ ID NO: 935661 - DNA, 22 bp, Artificial Sequence
  chemically synthesized
tctaaccatgctaaaaataaga

SEQ ID NO: 935662 - DNA, 22 bp, Artificial Sequence
  chemically synthesized
cagacctgtcactcttattttt

SEQ ID NO: 935663 - DNA, 22 bp, Artificial Sequence
  chemically synthesized
cttcagacctgtcactcttatt

SEQ ID NO: 935664 - DNA, 22 bp, Artificial Sequence
  chemically synthesized
accatgctaaaaataagagtga

SEQ ID NO: 935665 - DNA, 22 bp, Artificial Sequence
  chemically synthesized
gcttcagacctgtcactcttat

SEQ ID NO: 935666 - DNA, 22 bp, Artificial Sequence
  chemically synthesized
aaaataagagtgacaggtctga

SEQ ID NO: 935667 - DNA, 22 bp, Artificial Sequence
  chemically synthesized
catacaaaggcacaaaatgttt

SEQ ID NO: 935668 - DNA, 22 bp, Artificial Sequence
  chemically synthesized
gcatacaaaggcacaaaatgtt

SEQ ID NO: 935669 - DNA, 22 bp, Artificial Sequence
  chemically synthesized
tttgcatacaaaggcacaaaat

SEQ ID NO: 935670 - DNA, 22 bp, Artificial Sequence
  chemically synthesized
gtttgcatacaaaggcacaaaa

SEQ ID NO: 935671 - DNA, 22 bp, Artificial Sequence
  chemically synthesized
tgtttgcatacaaaggcacaaa

SEQ ID NO: 935672 - DNA, 22 bp, Artificial Sequence
  chemically synthesized
aagcaaacattttgtgcctttg

SEQ ID NO: 935673 - DNA, 22 bp, Artificial Sequence
  chemically synthesized
aattttgtttgcatacaaaggc

SEQ ID NO: 935674 - DNA, 22 bp, Artificial Sequence
  chemically synthesized
tcaactgaattttgtttgcata

SEQ ID NO: 935675 - DNA, 22 bp, Artificial Sequence
  chemically synthesized
gtcaactgaattttgtttgcat

SEQ ID NO: 935676 - DNA, 22 bp, Artificial Sequence
  chemically synthesized
tgtgcctttgtatgcaaacaaa

SEQ ID NO: 935677 - DNA, 22 bp, Artificial Sequence
  chemically synthesized
tgtcaactgaattttgtttgca

SEQ ID NO: 935678 - DNA, 22 bp, Artificial Sequence
  chemically synthesized
gtgcctttgtatgcaaacaaaa

SEQ ID NO: 935679 - DNA, 22 bp, Artificial Sequence
  chemically synthesized
tgcctttgtatgcaaacaaaat

SEQ ID NO: 935680 - DNA, 22 bp, Artificial Sequence
  chemically synthesized
tgttttgtcaactgaattttgt

SEQ ID NO: 935681 - DNA, 22 bp, Artificial Sequence
  chemically synthesized
gtgttttgtcaactgaattttg

SEQ ID NO: 935682 - DNA, 22 bp, Artificial Sequence
  chemically synthesized
tgtgttttgtcaactgaatttt

SEQ ID NO: 935683 - DNA, 22 bp, Artificial Sequence
  chemically synthesized
tgtatgcaaacaaaattcagtt

SEQ ID NO: 935684 - DNA, 22 bp, Artificial Sequence
  chemically synthesized
gtatgcaaacaaaattcagttg

SEQ ID NO: 935685 - DNA, 22 bp, Artificial Sequence
  chemically synthesized
tatgcaaacaaaattcagttga

SEQ ID NO: 935686 - DNA, 22 bp, Artificial Sequence
  chemically synthesized
tactttgtgttttgtcaactga

SEQ ID NO: 935687 - DNA, 22 bp, Artificial Sequence
  chemically synthesized
gtagtcattgtactttgtgttt

SEQ ID NO: 935688 - DNA, 22 bp, Artificial Sequence
  chemically synthesized
agttgacaaaacacaaagtaca

SEQ ID NO: 935689 - DNA, 22 bp, Artificial Sequence
  chemically synthesized
attcgtagtcattgtactttgt

SEQ ID NO: 935690 - DNA, 22 bp, Artificial Sequence
  chemically synthesized
gctcattcgtagtcattgtact

SEQ ID NO: 935691 - DNA, 22 bp, Artificial Sequence
  chemically synthesized
acaaaacacaaagtacaatgac

SEQ ID NO: 935692 - DNA, 22 bp, Artificial Sequence
  chemically synthesized
agctcattcgtagtcattgtac

SEQ ID NO: 935693 - DNA, 22 bp, Artificial Sequence
  chemically synthesized
tagctcattcgtagtcattgta

SEQ ID NO: 935694 - DNA, 22 bp, Artificial Sequence
  chemically synthesized
tatctttagctcattcgtagtc

SEQ ID NO: 935695 - DNA, 22 bp, Artificial Sequence
  chemically synthesized
gtatctttagctcattcgtagt

SEQ ID NO: 935696 - DNA, 22 bp, Artificial Sequence
  chemically synthesized
tgtatctttagctcattcgtag

SEQ ID NO: 935697 - DNA, 22 bp, Artificial Sequence
  chemically synthesized
attttgtatctttagctcattc

SEQ ID NO: 935698 - DNA, 22 bp, Artificial Sequence
  chemically synthesized
aattttgtatctttagctcatt

SEQ ID NO: 935699 - DNA, 22 bp, Artificial Sequence
  chemically synthesized
acttaattttgtatctttagct

SEQ ID NO: 935700 - DNA, 22 bp, Artificial Sequence
  chemically synthesized
cctaacttaattttgtatcttt

SEQ ID NO: 935701 - DNA, 22 bp, Artificial Sequence
  chemically synthesized
gcctaacttaattttgtatctt

SEQ ID NO: 935702 - DNA, 22 bp, Artificial Sequence
  chemically synthesized
cgaatgagctaaagatacaaaa

SEQ ID NO: 935703 - DNA, 22 bp, Artificial Sequence
  chemically synthesized
tgcctaacttaattttgtatct

SEQ ID NO: 935704 - DNA, 22 bp, Artificial Sequence
  chemically synthesized
atgggaattttgcctaacttaa

SEQ ID NO: 935705 - DNA, 22 bp, Artificial Sequence
  chemically synthesized
aagatacaaaattaagttaggc

SEQ ID NO: 935706 - DNA, 22 bp, Artificial Sequence
  chemically synthesized
agttaggcaaaattcccatgaa

SEQ ID NO: 935707 - DNA, 22 bp, Artificial Sequence
  chemically synthesized
ggcaaaattcccatgaacgctg

SEQ ID NO: 935708 - DNA, 22 bp, Artificial Sequence
  chemically synthesized
gcggggaagggacagcgttcat

SEQ ID NO: 935709 - DNA, 22 bp, Artificial Sequence
  chemically synthesized
agcggggaagggacagcgttca

SEQ ID NO: 935710 - DNA, 22 bp, Artificial Sequence
  chemically synthesized
ccatgaacgctgtcccttcccc

SEQ ID NO: 935711 - DNA, 22 bp, Artificial Sequence
  chemically synthesized
tcccttccccgctaaatatttt

SEQ ID NO: 935712 - DNA, 22 bp, Artificial Sequence
  chemically synthesized
agtggcggaagtaaaatattta

SEQ ID NO: 935713 - DNA, 22 bp, Artificial Sequence
  chemically synthesized
cagtggcggaagtaaaatattt

SEQ ID NO: 935714 - DNA, 22 bp, Artificial Sequence
  chemically synthesized
ccccgctaaatattttacttcc

SEQ ID NO: 935715 - DNA, 22 bp, Artificial Sequence
  chemically synthesized
cccgctaaatattttacttccg

SEQ ID NO: 935716 - DNA, 22 bp, Artificial Sequence
  chemically synthesized
gagggtttcagtggcggaagta

SEQ ID NO: 935717 - DNA, 22 bp, Artificial Sequence
  chemically synthesized
aatattttacttccgccactga

SEQ ID NO: 935718 - DNA, 22 bp, Artificial Sequence
  chemically synthesized
gtgttagagggtttcagtggcg

SEQ ID NO: 935719 - DNA, 22 bp, Artificial Sequence
  chemically synthesized
attggtgttagagggtttcagt

SEQ ID NO: 935720 - DNA, 22 bp, Artificial Sequence
  chemically synthesized
cattggtgttagagggtttcag

SEQ ID NO: 935721 - DNA, 22 bp, Artificial Sequence
  chemically synthesized
tacttccgccactgaaaccctc

SEQ ID NO: 935722 - DNA, 22 bp, Artificial Sequence
  chemically synthesized
acttccgccactgaaaccctct

SEQ ID NO: 935723 - DNA, 22 bp, Artificial Sequence
  chemically synthesized
cttccgccactgaaaccctcta

SEQ ID NO: 935724 - DNA, 22 bp, Artificial Sequence
  chemically synthesized
tttcattggtgttagagggttt

SEQ ID NO: 935725 - DNA, 22 bp, Artificial Sequence
  chemically synthesized
atttcattggtgttagagggtt

SEQ ID NO: 935726 - DNA, 22 bp, Artificial Sequence
  chemically synthesized
ccgccactgaaaccctctaaca

SEQ ID NO: 935727 - DNA, 22 bp, Artificial Sequence
  chemically synthesized
cgccactgaaaccctctaacac

SEQ ID NO: 935728 - DNA, 22 bp, Artificial Sequence
  chemically synthesized
tgtttatttcattggtgttaga

SEQ ID NO: 935729 - DNA, 22 bp, Artificial Sequence
  chemically synthesized
atgtttatttcattggtgttag

SEQ ID NO: 935730 - DNA, 22 bp, Artificial Sequence
  chemically synthesized
aaaccctctaacaccaatgaaa

SEQ ID NO: 935731 - DNA, 22 bp, Artificial Sequence
  chemically synthesized
ccaacttatgtttatttcattg

SEQ ID NO: 935732 - DNA, 22 bp, Artificial Sequence
  chemically synthesized
tcctaccaacttatgtttattt

SEQ ID NO: 935733 - DNA, 22 bp, Artificial Sequence
  chemically synthesized
taacaccaatgaaataaacata

SEQ ID NO: 935734 - DNA, 22 bp, Artificial Sequence
  chemically synthesized
acaccaatgaaataaacataag

SEQ ID NO: 935735 - DNA, 22 bp, Artificial Sequence
  chemically synthesized
acctgtcctaccaacttatgtt

SEQ ID NO: 935736 - DNA, 22 bp, Artificial Sequence
  chemically synthesized
tcacctgtcctaccaacttatg

SEQ ID NO: 935737 - DNA, 22 bp, Artificial Sequence
  chemically synthesized
ctcacctgtcctaccaacttat

SEQ ID NO: 935738 - DNA, 22 bp, Artificial Sequence
  chemically synthesized
tctcacctgtcctaccaactta

SEQ ID NO: 935739 - DNA, 22 bp, Artificial Sequence
  chemically synthesized
ttctcacctgtcctaccaactt

SEQ ID NO: 935740 - DNA, 22 bp, Artificial Sequence
  chemically synthesized
agaagatttttctcacctgtcc

SEQ ID NO: 935741 - DNA, 22 bp, Artificial Sequence
  chemically synthesized
aagaagatttttctcacctgtc

SEQ ID NO: 935742 - DNA, 22 bp, Artificial Sequence
  chemically synthesized
cttaagaagatttttctcacct

SEQ ID NO: 935743 - DNA, 22 bp, Artificial Sequence
  chemically synthesized
gtaggacaggtgagaaaaatct

SEQ ID NO: 935744 - DNA, 22 bp, Artificial Sequence
  chemically synthesized
agctccttaagaagatttttct

SEQ ID NO: 935745 - DNA, 22 bp, Artificial Sequence
  chemically synthesized
gagctccttaagaagatttttc

SEQ ID NO: 935746 - DNA, 22 bp, Artificial Sequence
  chemically synthesized
gtttgagctccttaagaagatt

SEQ ID NO: 935747 - DNA, 22 bp, Artificial Sequence
  chemically synthesized
ttagtttgagctccttaagaag

SEQ ID NO: 935748 - DNA, 22 bp, Artificial Sequence
  chemically synthesized
cttaaggagctcaaactaataa

SEQ ID NO: 935749 - DNA, 22 bp, Artificial Sequence
  chemically synthesized
ttaaggagctcaaactaataac

SEQ ID NO: 935750 - DNA, 22 bp, Artificial Sequence
  chemically synthesized
aaggagctcaaactaataaccc

SEQ ID NO: 935751 - DNA, 22 bp, Artificial Sequence
  chemically synthesized
aggagctcaaactaataaccct

SEQ ID NO: 935752 - DNA, 22 bp, Artificial Sequence
  chemically synthesized
cagatgatacgtagggttatta

SEQ ID NO: 935753 - DNA, 22 bp, Artificial Sequence
  chemically synthesized
ccagatgatacgtagggttatt

SEQ ID NO: 935754 - DNA, 22 bp, Artificial Sequence
  chemically synthesized
tccagatgatacgtagggttat

SEQ ID NO: 935755 - DNA, 22 bp, Artificial Sequence
  chemically synthesized
ttttccagatgatacgtagggt

SEQ ID NO: 935756 - DNA, 22 bp, Artificial Sequence
  chemically synthesized
aaactaataaccctacgtatca

SEQ ID NO: 935757 - DNA, 22 bp, Artificial Sequence
  chemically synthesized
ccagactgttttccagatgata

SEQ ID NO: 935758 - DNA, 22 bp, Artificial Sequence
  chemically synthesized
ataaccctacgtatcatctgga

SEQ ID NO: 935759 - DNA, 22 bp, Artificial Sequence
  chemically synthesized
gccagactgttttccagatgat

SEQ ID NO: 935760 - DNA, 22 bp, Artificial Sequence
  chemically synthesized
ttgccagactgttttccagatg

SEQ ID NO: 935761 - DNA, 22 bp, Artificial Sequence
  chemically synthesized
cgtatcatctggaaaacagtct

SEQ ID NO: 935762 - DNA, 22 bp, Artificial Sequence
  chemically synthesized
gaaaacagtctggcaagaggcc

SEQ ID NO: 935763 - DNA, 22 bp, Artificial Sequence
  chemically synthesized
atgcgaaaagaaggcctcttgc

SEQ ID NO: 935764 - DNA, 22 bp, Artificial Sequence
  chemically synthesized
gcaagaggccttcttttcgcat

SEQ ID NO: 935765 - DNA, 22 bp, Artificial Sequence
  chemically synthesized
cttttcgcattaaccttctgtg

SEQ ID NO: 935766 - DNA, 22 bp, Artificial Sequence
  chemically synthesized
ttttcgcattaaccttctgtgg

SEQ ID NO: 935767 - DNA, 22 bp, Artificial Sequence
  chemically synthesized
tcaggtgcggagcccacagaag

SEQ ID NO: 935768 - DNA, 22 bp, Artificial Sequence
  chemically synthesized
ttcgcattaaccttctgtgggc

SEQ ID NO: 935769 - DNA, 22 bp, Artificial Sequence
  chemically synthesized
gtcaggtgcggagcccacagaa

SEQ ID NO: 935770 - DNA, 22 bp, Artificial Sequence
  chemically synthesized
tcgcattaaccttctgtgggct

SEQ ID NO: 935771 - DNA, 22 bp, Artificial Sequence
  chemically synthesized
tgtcaggtgcggagcccacaga

SEQ ID NO: 935772 - DNA, 22 bp, Artificial Sequence
  chemically synthesized
cgcattaaccttctgtgggctc

SEQ ID NO: 935773 - DNA, 22 bp, Artificial Sequence
  chemically synthesized
gcattaaccttctgtgggctcc

SEQ ID NO: 935774 - DNA, 22 bp, Artificial Sequence
  chemically synthesized
accttctgtgggctccgcacct

SEQ ID NO: 935775 - DNA, 22 bp, Artificial Sequence
  chemically synthesized
ctgtgggctccgcacctgacaa

SEQ ID NO: 935776 - DNA, 22 bp, Artificial Sequence
  chemically synthesized
tgtgggctccgcacctgacaaa

SEQ ID NO: 935777 - DNA, 22 bp, Artificial Sequence
  chemically synthesized
tgggctccgcacctgacaaagc

SEQ ID NO: 935778 - DNA, 22 bp, Artificial Sequence
  chemically synthesized
ggggagcagccccatgctttgt

SEQ ID NO: 935779 - DNA, 22 bp, Artificial Sequence
  chemically synthesized
tcggggagcagccccatgcttt

SEQ ID NO: 935780 - DNA, 22 bp, Artificial Sequence
  chemically synthesized
ctcggggagcagccccatgctt

SEQ ID NO: 935781 - DNA, 22 bp, Artificial Sequence
  chemically synthesized
cgcacctgacaaagcatggggc

SEQ ID NO: 935782 - DNA, 22 bp, Artificial Sequence
  chemically synthesized
acaaagcatggggctgctcccc

SEQ ID NO: 935783 - DNA, 22 bp, Artificial Sequence
  chemically synthesized
ggagtcccatttctcggggagc

SEQ ID NO: 935784 - DNA, 22 bp, Artificial Sequence
  chemically synthesized
tgtcactgggagtcccatttct

SEQ ID NO: 935785 - DNA, 22 bp, Artificial Sequence
  chemically synthesized
ctccccgagaaatgggactccc

SEQ ID NO: 935786 - DNA, 22 bp, Artificial Sequence
  chemically synthesized
gtctgtgtcactgggagtccca

SEQ ID NO: 935787 - DNA, 22 bp, Artificial Sequence
  chemically synthesized
cccgagaaatgggactcccagt

SEQ ID NO: 935788 - DNA, 22 bp, Artificial Sequence
  chemically synthesized
cagttagtctgtgtcactggga

SEQ ID NO: 935789 - DNA, 22 bp, Artificial Sequence
  chemically synthesized
tccagttagtctgtgtcactgg

SEQ ID NO: 935790 - DNA, 22 bp, Artificial Sequence
  chemically synthesized
ctccagttagtctgtgtcactg

SEQ ID NO: 935791 - DNA, 22 bp, Artificial Sequence
  chemically synthesized
tctccagttagtctgtgtcact

SEQ ID NO: 935792 - DNA, 22 bp, Artificial Sequence
  chemically synthesized
ttctccagttagtctgtgtcac

SEQ ID NO: 935793 - DNA, 22 bp, Artificial Sequence
  chemically synthesized
ccagtgacacagactaactgga

SEQ ID NO: 935794 - DNA, 22 bp, Artificial Sequence
  chemically synthesized
aggccaatttttctccagttag

SEQ ID NO: 935795 - DNA, 22 bp, Artificial Sequence
  chemically synthesized
caggccaatttttctccagtta

SEQ ID NO: 935796 - DNA, 22 bp, Artificial Sequence
  chemically synthesized
atgtataacttcaggccaattt

SEQ ID NO: 935797 - DNA, 22 bp, Artificial Sequence
  chemically synthesized
actggagaaaaattggcctgaa

SEQ ID NO: 935798 - DNA, 22 bp, Artificial Sequence
  chemically synthesized
gagaaaaattggcctgaagtta

SEQ ID NO: 935799 - DNA, 22 bp, Artificial Sequence
  chemically synthesized
caaatgactgatgtataacttc

SEQ ID NO: 935800 - DNA, 22 bp, Artificial Sequence
  chemically synthesized
tgcaaatgactgatgtataact

SEQ ID NO: 935801 - DNA, 22 bp, Artificial Sequence
  chemically synthesized
ttctgcaaatgactgatgtata

SEQ ID NO: 935802 - DNA, 22 bp, Artificial Sequence
  chemically synthesized
gttctgcaaatgactgatgtat

SEQ ID NO: 935803 - DNA, 22 bp, Artificial Sequence
  chemically synthesized
gcctgaagttatacatcagtca

SEQ ID NO: 935804 - DNA, 22 bp, Artificial Sequence
  chemically synthesized
aagttatacatcagtcatttgc

SEQ ID NO: 935805 - DNA, 22 bp, Artificial Sequence
  chemically synthesized
aagtcttgttctgcaaatgact

SEQ ID NO: 935806 - DNA, 22 bp, Artificial Sequence
  chemically synthesized
tacatcagtcatttgcagaaca

SEQ ID NO: 935807 - DNA, 22 bp, Artificial Sequence
  chemically synthesized
atgatcctcaagtcttgttctg

SEQ ID NO: 935808 - DNA, 22 bp, Artificial Sequence
  chemically synthesized
caaaggctgatgatcctcaagt

SEQ ID NO: 935809 - DNA, 22 bp, Artificial Sequence
  chemically synthesized
ccaaaggctgatgatcctcaag

SEQ ID NO: 935810 - DNA, 22 bp, Artificial Sequence
  chemically synthesized
gcagaacaagacttgaggatca

SEQ ID NO: 935811 - DNA, 22 bp, Artificial Sequence
  chemically synthesized
cagaacaagacttgaggatcat

SEQ ID NO: 935812 - DNA, 22 bp, Artificial Sequence
  chemically synthesized
gaataaaaccatttccaaaggc

SEQ ID NO: 935813 - DNA, 22 bp, Artificial Sequence
  chemically synthesized
gaggatcatcagcctttggaaa

SEQ ID NO: 935814 - DNA, 22 bp, Artificial Sequence
  chemically synthesized
ggaataaaaccatttccaaagg

SEQ ID NO: 935815 - DNA, 22 bp, Artificial Sequence
  chemically synthesized
aggatcatcagcctttggaaat

SEQ ID NO: 935816 - DNA, 22 bp, Artificial Sequence
  chemically synthesized
tataacttggaataaaaccatt

SEQ ID NO: 935817 - DNA, 22 bp, Artificial Sequence
  chemically synthesized
ctgtataacttggaataaaacc

SEQ ID NO: 935818 - DNA, 22 bp, Artificial Sequence
  chemically synthesized
ctcctgtataacttggaataaa

SEQ ID NO: 935819 - DNA, 22 bp, Artificial Sequence
  chemically synthesized
tggaaatggttttattccaagt

SEQ ID NO: 935820 - DNA, 22 bp, Artificial Sequence
  chemically synthesized
ggaaatggttttattccaagtt

SEQ ID NO: 935821 - DNA, 22 bp, Artificial Sequence
  chemically synthesized
gaaatggttttattccaagtta

SEQ ID NO: 935822 - DNA, 22 bp, Artificial Sequence
  chemically synthesized
tattccaagttatacaggagta

SEQ ID NO: 935823 - DNA, 22 bp, Artificial Sequence
  chemically synthesized
attccaagttatacaggagtag

SEQ ID NO: 935824 - DNA, 22 bp, Artificial Sequence
  chemically synthesized
ttccaagttatacaggagtagg

SEQ ID NO: 935825 - DNA, 22 bp, Artificial Sequence
  chemically synthesized
caagttatacaggagtaggcac

SEQ ID NO: 935826 - DNA, 22 bp, Artificial Sequence
  chemically synthesized
agggcagatataaagcaggtgc

SEQ ID NO: 935827 - DNA, 22 bp, Artificial Sequence
  chemically synthesized
tacaggagtaggcacctgcttt

SEQ ID NO: 935828 - DNA, 22 bp, Artificial Sequence
  chemically synthesized
atccggagtgctaagggcagat

SEQ ID NO: 935829 - DNA, 22 bp, Artificial Sequence
  chemically synthesized
ctttatatctgcccttagcact

SEQ ID NO: 935830 - DNA, 22 bp, Artificial Sequence
  chemically synthesized
tatatctgcccttagcactccg

SEQ ID NO: 935831 - DNA, 22 bp, Artificial Sequence
  chemically synthesized
atatctgcccttagcactccgg

SEQ ID NO: 935832 - DNA, 22 bp, Artificial Sequence
  chemically synthesized
tatctgcccttagcactccgga

SEQ ID NO: 935833 - DNA, 22 bp, Artificial Sequence
  chemically synthesized
tatatgtgcgattaatccggag

SEQ ID NO: 935834 - DNA, 22 bp, Artificial Sequence
  chemically synthesized
cccttagcactccggattaatc

SEQ ID NO: 935835 - DNA, 22 bp, Artificial Sequence
  chemically synthesized
cctatatatgtgcgattaatcc

SEQ ID NO: 935836 - DNA, 22 bp, Artificial Sequence
  chemically synthesized
ccctatatatgtgcgattaatc

SEQ ID NO: 935837 - DNA, 22 bp, Artificial Sequence
  chemically synthesized
agcactccggattaatcgcaca

SEQ ID NO: 935838 - DNA, 22 bp, Artificial Sequence
  chemically synthesized
gcactccggattaatcgcacat

SEQ ID NO: 935839 - DNA, 22 bp, Artificial Sequence
  chemically synthesized
atttccctatatatgtgcgatt

SEQ ID NO: 935840 - DNA, 22 bp, Artificial Sequence
  chemically synthesized
cggattaatcgcacatatatag

SEQ ID NO: 935841 - DNA, 22 bp, Artificial Sequence
  chemically synthesized
atcgcacatatatagggaaatg

SEQ ID NO: 935842 - DNA, 22 bp, Artificial Sequence
  chemically synthesized
caatgaagagatcaacagggag

SEQ ID NO: 935843 - DNA, 22 bp, Artificial Sequence
  chemically synthesized
ctccctgttgatctcttcattg

SEQ ID NO: 935844 - DNA, 22 bp, Artificial Sequence
  chemically synthesized
tccctgttgatctcttcattgc

SEQ ID NO: 935845 - DNA, 22 bp, Artificial Sequence
  chemically synthesized
tgggcacaagattgcaatgaag

SEQ ID NO: 935846 - DNA, 22 bp, Artificial Sequence
  chemically synthesized
cctgttgatctcttcattgcaa

SEQ ID NO: 935847 - DNA, 22 bp, Artificial Sequence
  chemically synthesized
gtgggcacaagattgcaatgaa

SEQ ID NO: 935848 - DNA, 22 bp, Artificial Sequence
  chemically synthesized
tgtgggcacaagattgcaatga

SEQ ID NO: 935849 - DNA, 22 bp, Artificial Sequence
  chemically synthesized
ttgatctcttcattgcaatctt

SEQ ID NO: 935850 - DNA, 22 bp, Artificial Sequence
  chemically synthesized
atctcttcattgcaatcttgtg

SEQ ID NO: 935851 - DNA, 22 bp, Artificial Sequence
  chemically synthesized
agattttgtgggcacaagattg

SEQ ID NO: 935852 - DNA, 22 bp, Artificial Sequence
  chemically synthesized
ttcattgcaatcttgtgcccac

SEQ ID NO: 935853 - DNA, 22 bp, Artificial Sequence
  chemically synthesized
cattgagattttgtgggcacaa

SEQ ID NO: 935854 - DNA, 22 bp, Artificial Sequence
  chemically synthesized
cattgcaatcttgtgcccacaa

SEQ ID NO: 935855 - DNA, 22 bp, Artificial Sequence
  chemically synthesized
attgcaatcttgtgcccacaaa

SEQ ID NO: 935856 - DNA, 22 bp, Artificial Sequence
  chemically synthesized
caatcttgtgcccacaaaatct

SEQ ID NO: 935857 - DNA, 22 bp, Artificial Sequence
  chemically synthesized
gcgcagttccattgagattttg

SEQ ID NO: 935858 - DNA, 22 bp, Artificial Sequence
  chemically synthesized
ttagcgcagttccattgagatt

SEQ ID NO: 935859 - DNA, 22 bp, Artificial Sequence
  chemically synthesized
gtgcccacaaaatctcaatgga

SEQ ID NO: 935860 - DNA, 22 bp, Artificial Sequence
  chemically synthesized
tgcccacaaaatctcaatggaa

SEQ ID NO: 935861 - DNA, 22 bp, Artificial Sequence
  chemically synthesized
aacctgttagcgcagttccatt

SEQ ID NO: 935862 - DNA, 22 bp, Artificial Sequence
  chemically synthesized
aaacctgttagcgcagttccat

SEQ ID NO: 935863 - DNA, 22 bp, Artificial Sequence
  chemically synthesized
taaacctgttagcgcagttcca

SEQ ID NO: 935864 - DNA, 22 bp, Artificial Sequence
  chemically synthesized
ttaaacctgttagcgcagttcc

SEQ ID NO: 935865 - DNA, 22 bp, Artificial Sequence
  chemically synthesized
gtcttttaaacctgttagcgca

SEQ ID NO: 935866 - DNA, 22 bp, Artificial Sequence
  chemically synthesized
ggtcttttaaacctgttagcgc

SEQ ID NO: 935867 - DNA, 22 bp, Artificial Sequence
  chemically synthesized
aatggaactgcgctaacaggtt

SEQ ID NO: 935868 - DNA, 22 bp, Artificial Sequence
  chemically synthesized
acttggtcttttaaacctgtta

SEQ ID NO: 935869 - DNA, 22 bp, Artificial Sequence
  chemically synthesized
ctgacttggtcttttaaacctg

SEQ ID NO: 935870 - DNA, 22 bp, Artificial Sequence
  chemically synthesized
cctgacttggtcttttaaacct

SEQ ID NO: 935871 - DNA, 22 bp, Artificial Sequence
  chemically synthesized
cgctaacaggtttaaaagacca

SEQ ID NO: 935872 - DNA, 22 bp, Artificial Sequence
  chemically synthesized
acaggtttaaaagaccaagtca

SEQ ID NO: 935873 - DNA, 22 bp, Artificial Sequence
  chemically synthesized
aaaagaccaagtcaggaaattc

SEQ ID NO: 935874 - DNA, 22 bp, Artificial Sequence
  chemically synthesized
aaagaccaagtcaggaaattca

SEQ ID NO: 935875 - DNA, 22 bp, Artificial Sequence
  chemically synthesized
agaaccaagtgacaagtgaatt

SEQ ID NO: 935876 - DNA, 22 bp, Artificial Sequence
  chemically synthesized
gagaaccaagtgacaagtgaat

SEQ ID NO: 935877 - DNA, 22 bp, Artificial Sequence
  chemically synthesized
tgagaaccaagtgacaagtgaa

SEQ ID NO: 935878 - DNA, 22 bp, Artificial Sequence
  chemically synthesized
actttgagaaccaagtgacaag

SEQ ID NO: 935879 - DNA, 22 bp, Artificial Sequence
  chemically synthesized
gcgttcactttgagaaccaagt

SEQ ID NO: 935880 - DNA, 22 bp, Artificial Sequence
  chemically synthesized
cgcgttcactttgagaaccaag

SEQ ID NO: 935881 - DNA, 22 bp, Artificial Sequence
  chemically synthesized
tcgcgttcactttgagaaccaa

SEQ ID NO: 935882 - DNA, 22 bp, Artificial Sequence
  chemically synthesized
tttcgcgttcactttgagaacc

SEQ ID NO: 935883 - DNA, 22 bp, Artificial Sequence
  chemically synthesized
acttgtcacttggttctcaaag

SEQ ID NO: 935884 - DNA, 22 bp, Artificial Sequence
  chemically synthesized
ctttcgcgttcactttgagaac

SEQ ID NO: 935885 - DNA, 22 bp, Artificial Sequence
  chemically synthesized
gtcacttggttctcaaagtgaa

SEQ ID NO: 935886 - DNA, 22 bp, Artificial Sequence
  chemically synthesized
tcacttggttctcaaagtgaac

SEQ ID NO: 935887 - DNA, 22 bp, Artificial Sequence
  chemically synthesized
agtttctttcgcgttcactttg

SEQ ID NO: 935888 - DNA, 22 bp, Artificial Sequence
  chemically synthesized
cagtttctttcgcgttcacttt

SEQ ID NO: 935889 - DNA, 22 bp, Artificial Sequence
  chemically synthesized
ttcagtttctttcgcgttcact

SEQ ID NO: 935890 - DNA, 22 bp, Artificial Sequence
  chemically synthesized
ggttctcaaagtgaacgcgaaa

SEQ ID NO: 935891 - DNA, 22 bp, Artificial Sequence
  chemically synthesized
gttctcaaagtgaacgcgaaag

SEQ ID NO: 935892 - DNA, 22 bp, Artificial Sequence
  chemically synthesized
aattcttcagtttctttcgcgt

SEQ ID NO: 935893 - DNA, 22 bp, Artificial Sequence
  chemically synthesized
gaattcttcagtttctttcgcg

SEQ ID NO: 935894 - DNA, 22 bp, Artificial Sequence
  chemically synthesized
tgaattcttcagtttctttcgc

SEQ ID NO: 935895 - DNA, 22 bp, Artificial Sequence
  chemically synthesized
tcaaagtgaacgcgaaagaaac

SEQ ID NO: 935896 - DNA, 22 bp, Artificial Sequence
  chemically synthesized
aaagtgaacgcgaaagaaactg

SEQ ID NO: 935897 - DNA, 22 bp, Artificial Sequence
  chemically synthesized
aagaaatatccatgaccccttt

SEQ ID NO: 935898 - DNA, 22 bp, Artificial Sequence
  chemically synthesized
gaagaaatatccatgacccctt

SEQ ID NO: 935899 - DNA, 22 bp, Artificial Sequence
  chemically synthesized
tgaagaaatatccatgacccct

SEQ ID NO: 935900 - DNA, 22 bp, Artificial Sequence
  chemically synthesized
aagaattcaaaggggtcatgga

SEQ ID NO: 935901 - DNA, 22 bp, Artificial Sequence
  chemically synthesized
gagctttgaagaaatatccatg

SEQ ID NO: 935902 - DNA, 22 bp, Artificial Sequence
  chemically synthesized
ggagctttgaagaaatatccat

SEQ ID NO: 935903 - DNA, 22 bp, Artificial Sequence
  chemically synthesized
aaaggggtcatggatatttctt

SEQ ID NO: 935904 - DNA, 22 bp, Artificial Sequence
  chemically synthesized
tttggagctttgaagaaatatc

SEQ ID NO: 935905 - DNA, 22 bp, Artificial Sequence
  chemically synthesized
ccaaacaactatttggagcttt

SEQ ID NO: 935906 - DNA, 22 bp, Artificial Sequence
  chemically synthesized
taccaaacaactatttggagct

SEQ ID NO: 935907 - DNA, 22 bp, Artificial Sequence
  chemically synthesized
cttcaaagctccaaatagttgt

SEQ ID NO: 935908 - DNA, 22 bp, Artificial Sequence
  chemically synthesized
ttcaaagctccaaatagttgtt

SEQ ID NO: 935909 - DNA, 22 bp, Artificial Sequence
  chemically synthesized
gtcatctctaccaaacaactat

SEQ ID NO: 935910 - DNA, 22 bp, Artificial Sequence
  chemically synthesized
caaagctccaaatagttgtttg

SEQ ID NO: 935911 - DNA, 22 bp, Artificial Sequence
  chemically synthesized
aaagctccaaatagttgtttgg

SEQ ID NO: 935912 - DNA, 22 bp, Artificial Sequence
  chemically synthesized
aaaattcgtcatctctaccaaa

SEQ ID NO: 935913 - DNA, 22 bp, Artificial Sequence
  chemically synthesized
caaatagttgtttggtagagat

SEQ ID NO: 935914 - DNA, 22 bp, Artificial Sequence
  chemically synthesized
tttggtagagatgacgaatttt

SEQ ID NO: 935915 - DNA, 22 bp, Artificial Sequence
  chemically synthesized
cccagatggctcaaaattcgtc

SEQ ID NO: 935916 - DNA, 22 bp, Artificial Sequence
  chemically synthesized
ggtagagatgacgaattttgag

SEQ ID NO: 935917 - DNA, 22 bp, Artificial Sequence
  chemically synthesized
gtagagatgacgaattttgagc

SEQ ID NO: 935918 - DNA, 22 bp, Artificial Sequence
  chemically synthesized
gtattgcccagatggctcaaaa

SEQ ID NO: 935919 - DNA, 22 bp, Artificial Sequence
  chemically synthesized
tcgtattgcccagatggctcaa

SEQ ID NO: 935920 - DNA, 22 bp, Artificial Sequence
  chemically synthesized
ctcgtattgcccagatggctca

SEQ ID NO: 935921 - DNA, 22 bp, Artificial Sequence
  chemically synthesized
tgagccatctgggcaatacgag

SEQ ID NO: 935922 - DNA, 22 bp, Artificial Sequence
  chemically synthesized
gagccatctgggcaatacgaga

SEQ ID NO: 935923 - DNA, 22 bp, Artificial Sequence
  chemically synthesized
agccatctgggcaatacgagaa

SEQ ID NO: 935924 - DNA, 22 bp, Artificial Sequence
  chemically synthesized
ggcaatacgagaaggctcccct

SEQ ID NO: 935925 - DNA, 22 bp, Artificial Sequence
  chemically synthesized
ataagcacgtaaggaaggataa

SEQ ID NO: 935926 - DNA, 22 bp, Artificial Sequence
  chemically synthesized
ccctgattatccttccttacgt

SEQ ID NO: 935927 - DNA, 22 bp, Artificial Sequence
  chemically synthesized
attatccttccttacgtgctta

SEQ ID NO: 935928 - DNA, 22 bp, Artificial Sequence
  chemically synthesized
tccttccttacgtgcttatcaa

SEQ ID NO: 935929 - DNA, 22 bp, Artificial Sequence
  chemically synthesized
gggccgcaagtgagttgataag

SEQ ID NO: 935930 - DNA, 22 bp, Artificial Sequence
  chemically synthesized
ccttacgtgcttatcaactcac

SEQ ID NO: 935931 - DNA, 22 bp, Artificial Sequence
  chemically synthesized
cttacgtgcttatcaactcact

SEQ ID NO: 935932 - DNA, 22 bp, Artificial Sequence
  chemically synthesized
cctagggccgcaagtgagttga

SEQ ID NO: 935933 - DNA, 22 bp, Artificial Sequence
  chemically synthesized
tccctagggccgcaagtgagtt

SEQ ID NO: 935934 - DNA, 22 bp, Artificial Sequence
  chemically synthesized
acgtgcttatcaactcacttgc

SEQ ID NO: 935935 - DNA, 22 bp, Artificial Sequence
  chemically synthesized
cgtgcttatcaactcacttgcg

SEQ ID NO: 935936 - DNA, 22 bp, Artificial Sequence
  chemically synthesized
atcaactcacttgcggccctag

SEQ ID NO: 935937 - DNA, 22 bp, Artificial Sequence
  chemically synthesized
tcaactcacttgcggccctagg

SEQ ID NO: 935938 - DNA, 22 bp, Artificial Sequence
  chemically synthesized
ggaaatgccatcctctccctag

SEQ ID NO: 935939 - DNA, 22 bp, Artificial Sequence
  chemically synthesized
cggaaatgccatcctctcccta

SEQ ID NO: 935940 - DNA, 22 bp, Artificial Sequence
  chemically synthesized
acttgcggccctagggagagga

SEQ ID NO: 935941 - DNA, 22 bp, Artificial Sequence
  chemically synthesized
gcggccctagggagaggatggc

SEQ ID NO: 935942 - DNA, 22 bp, Artificial Sequence
  chemically synthesized
cggccctagggagaggatggca

SEQ ID NO: 935943 - DNA, 22 bp, Artificial Sequence
  chemically synthesized
gaacttcggaaatgccatcctc

SEQ ID NO: 935944 - DNA, 22 bp, Artificial Sequence
  chemically synthesized
ggaacttcggaaatgccatcct

SEQ ID NO: 935945 - DNA, 22 bp, Artificial Sequence
  chemically synthesized
gggagaggatggcatttccgaa

SEQ ID NO: 935946 - DNA, 22 bp, Artificial Sequence
  chemically synthesized
ccgaagttccaaattctctctg

SEQ ID NO: 935947 - DNA, 22 bp, Artificial Sequence
  chemically synthesized
cgaagttccaaattctctctgt

SEQ ID NO: 935948 - DNA, 22 bp, Artificial Sequence
  chemically synthesized
aagcacacagatacacacagag

SEQ ID NO: 935949 - DNA, 22 bp, Artificial Sequence
  chemically synthesized
caaattctctctgtgtgtatct

SEQ ID NO: 935950 - DNA, 22 bp, Artificial Sequence
  chemically synthesized
tgcgctcaagcacacagataca

SEQ ID NO: 935951 - DNA, 22 bp, Artificial Sequence
  chemically synthesized
atgcgctcaagcacacagatac

SEQ ID NO: 935952 - DNA, 22 bp, Artificial Sequence
  chemically synthesized
tctctgtgtgtatctgtgtgct

SEQ ID NO: 935953 - DNA, 22 bp, Artificial Sequence
  chemically synthesized
tctgtgtgtatctgtgtgcttg

SEQ ID NO: 935954 - DNA, 22 bp, Artificial Sequence
  chemically synthesized
tgtgtgtatctgtgtgcttgag

SEQ ID NO: 935955 - DNA, 22 bp, Artificial Sequence
  chemically synthesized
tgtgtatctgtgtgcttgagcg

SEQ ID NO: 935956 - DNA, 22 bp, Artificial Sequence
  chemically synthesized
tgtgcttgagcgcataagttat

SEQ ID NO: 935957 - DNA, 22 bp, Artificial Sequence
  chemically synthesized
gagcgcataagttattacattt

SEQ ID NO: 935958 - DNA, 22 bp, Artificial Sequence
  chemically synthesized
agcgcataagttattacatttg

SEQ ID NO: 935959 - DNA, 22 bp, Artificial Sequence
  chemically synthesized
agtaagtaaatacaaatgtaat

SEQ ID NO: 935960 - DNA, 22 bp, Artificial Sequence
  chemically synthesized
aagtaagtaaatacaaatgtaa

SEQ ID NO: 935961 - DNA, 22 bp, Artificial Sequence
  chemically synthesized
ttacatttgtatttacttactt

SEQ ID NO: 935962 - DNA, 22 bp, Artificial Sequence
  chemically synthesized
catttgtatttacttacttaaa

SEQ ID NO: 935963 - DNA, 22 bp, Artificial Sequence
  chemically synthesized
agtaaatgaataaatatttaag

SEQ ID NO: 935964 - DNA, 22 bp, Artificial Sequence
  chemically synthesized
gtatttacttacttaaatattt

SEQ ID NO: 935965 - DNA, 22 bp, Artificial Sequence
  chemically synthesized
cagtaaatgaataaatatttaa

SEQ ID NO: 935966 - DNA, 22 bp, Artificial Sequence
  chemically synthesized
tatttacttacttaaatattta

SEQ ID NO: 935967 - DNA, 22 bp, Artificial Sequence
  chemically synthesized
tcagtaaatgaataaatattta

SEQ ID NO: 935968 - DNA, 22 bp, Artificial Sequence
  chemically synthesized
ttcagtaaatgaataaatattt

SEQ ID NO: 935969 - DNA, 22 bp, Artificial Sequence
  chemically synthesized
tttcagtaaatgaataaatatt

SEQ ID NO: 935970 - DNA, 22 bp, Artificial Sequence
  chemically synthesized
acttacttaaatatttattcat

SEQ ID NO: 935971 - DNA, 22 bp, Artificial Sequence
  chemically synthesized
cttacttaaatatttattcatt

SEQ ID NO: 935972 - DNA, 22 bp, Artificial Sequence
  chemically synthesized
ccctttttcagtaaatgaataa

SEQ ID NO: 935973 - DNA, 22 bp, Artificial Sequence
  chemically synthesized
gccctttttcagtaaatgaata

SEQ ID NO: 935974 - DNA, 22 bp, Artificial Sequence
  chemically synthesized
acttaaatatttattcatttac

SEQ ID NO: 935975 - DNA, 22 bp, Artificial Sequence
  chemically synthesized
cttaaatatttattcatttact

SEQ ID NO: 935976 - DNA, 22 bp, Artificial Sequence
  chemically synthesized
ttgccctttttcagtaaatgaa

SEQ ID NO: 935977 - DNA, 22 bp, Artificial Sequence
  chemically synthesized
aaatatttattcatttactgaa

SEQ ID NO: 935978 - DNA, 22 bp, Artificial Sequence
  chemically synthesized
aatatttattcatttactgaaa

SEQ ID NO: 935979 - DNA, 22 bp, Artificial Sequence
  chemically synthesized
cctcttgccctttttcagtaaa

SEQ ID NO: 935980 - DNA, 22 bp, Artificial Sequence
  chemically synthesized
ctacctcttgccctttttcagt

SEQ ID NO: 935981 - DNA, 22 bp, Artificial Sequence
  chemically synthesized
actacctcttgccctttttcag

SEQ ID NO: 935982 - DNA, 22 bp, Artificial Sequence
  chemically synthesized
tactacctcttgccctttttca

SEQ ID NO: 935983 - DNA, 22 bp, Artificial Sequence
  chemically synthesized
attcatttactgaaaaagggca

SEQ ID NO: 935984 - DNA, 22 bp, Artificial Sequence
  chemically synthesized
ttcatttactgaaaaagggcaa

SEQ ID NO: 935985 - DNA, 22 bp, Artificial Sequence
  chemically synthesized
ctttactacctcttgccctttt

SEQ ID NO: 935986 - DNA, 22 bp, Artificial Sequence
  chemically synthesized
actttactacctcttgcccttt

SEQ ID NO: 935987 - DNA, 22 bp, Artificial Sequence
  chemically synthesized
atttactgaaaaagggcaagag

SEQ ID NO: 935988 - DNA, 22 bp, Artificial Sequence
  chemically synthesized
actgaaaaagggcaagaggtag

SEQ ID NO: 935989 - DNA, 22 bp, Artificial Sequence
  chemically synthesized
ctgaaaaagggcaagaggtagt

SEQ ID NO: 935990 - DNA, 22 bp, Artificial Sequence
  chemically synthesized
tggacttactttactacctctt

SEQ ID NO: 935991 - DNA, 22 bp, Artificial Sequence
  chemically synthesized
tgtggacttactttactacctc

SEQ ID NO: 935992 - DNA, 22 bp, Artificial Sequence
  chemically synthesized
aaaaagggcaagaggtagtaaa

SEQ ID NO: 935993 - DNA, 22 bp, Artificial Sequence
  chemically synthesized
actctgtggacttactttacta

SEQ ID NO: 935994 - DNA, 22 bp, Artificial Sequence
  chemically synthesized
cactctgtggacttactttact

SEQ ID NO: 935995 - DNA, 22 bp, Artificial Sequence
  chemically synthesized
tcactctgtggacttactttac

SEQ ID NO: 935996 - DNA, 22 bp, Artificial Sequence
  chemically synthesized
ttcactctgtggacttacttta

SEQ ID NO: 935997 - DNA, 22 bp, Artificial Sequence
  chemically synthesized
atttttcactctgtggacttac

SEQ ID NO: 935998 - DNA, 22 bp, Artificial Sequence
  chemically synthesized
ctcatttttcactctgtggact

SEQ ID NO: 935999 - DNA, 22 bp, Artificial Sequence
  chemically synthesized
cctactcatttttcactctgtg

SEQ ID NO: 936000 - DNA, 22 bp, Artificial Sequence
  chemically synthesized
gcctactcatttttcactctgt

SEQ ID NO: 936001 - DNA, 22 bp, Artificial Sequence
  chemically synthesized
aaatttgcctactcatttttca

SEQ ID NO: 936002 - DNA, 22 bp, Artificial Sequence
  chemically synthesized
caaatttgcctactcatttttc

SEQ ID NO: 936003 - DNA, 22 bp, Artificial Sequence
  chemically synthesized
tcaaatttgcctactcattttt

SEQ ID NO: 936004 - DNA, 22 bp, Artificial Sequence
  chemically synthesized
gtgactttcaaatttgcctact

SEQ ID NO: 936005 - DNA, 22 bp, Artificial Sequence
  chemically synthesized
aaccaatagagtaatcactggt

SEQ ID NO: 936006 - DNA, 22 bp, Artificial Sequence
  chemically synthesized
caaccaatagagtaatcactgg

SEQ ID NO: 936007 - DNA, 22 bp, Artificial Sequence
  chemically synthesized
tcaaccaatagagtaatcactg

SEQ ID NO: 936008 - DNA, 22 bp, Artificial Sequence
  chemically synthesized
ttcaaccaatagagtaatcact

SEQ ID NO: 936009 - DNA, 22 bp, Artificial Sequence
  chemically synthesized
gaaagtcaccagtgattactct

SEQ ID NO: 936010 - DNA, 22 bp, Artificial Sequence
  chemically synthesized
aaagtcaccagtgattactcta

SEQ ID NO: 936011 - DNA, 22 bp, Artificial Sequence
  chemically synthesized
tgataatgcatcttttcaacca

SEQ ID NO: 936012 - DNA, 22 bp, Artificial Sequence
  chemically synthesized
attatgataatgcatcttttca

SEQ ID NO: 936013 - DNA, 22 bp, Artificial Sequence
  chemically synthesized
ctctattggttgaaaagatgca

SEQ ID NO: 936014 - DNA, 22 bp, Artificial Sequence
  chemically synthesized
tattggttgaaaagatgcatta

SEQ ID NO: 936015 - DNA, 22 bp, Artificial Sequence
  chemically synthesized
ttggttgaaaagatgcattatc

SEQ ID NO: 936016 - DNA, 22 bp, Artificial Sequence
  chemically synthesized
atgcattcattatgataatgca

SEQ ID NO: 936017 - DNA, 22 bp, Artificial Sequence
  chemically synthesized
gttgaaaagatgcattatcata

SEQ ID NO: 936018 - DNA, 22 bp, Artificial Sequence
  chemically synthesized
taatgcattcattatgataatg

SEQ ID NO: 936019 - DNA, 22 bp, Artificial Sequence
  chemically synthesized
aaaagatgcattatcataatga

SEQ ID NO: 936020 - DNA, 22 bp, Artificial Sequence
  chemically synthesized
tctctaatgcattcattatgat

SEQ ID NO: 936021 - DNA, 22 bp, Artificial Sequence
  chemically synthesized
ttatctctaatgcattcattat

SEQ ID NO: 936022 - DNA, 22 bp, Artificial Sequence
  chemically synthesized
gttatctctaatgcattcatta

SEQ ID NO: 936023 - DNA, 22 bp, Artificial Sequence
  chemically synthesized
tcataatgaatgcattagagat

SEQ ID NO: 936024 - DNA, 22 bp, Artificial Sequence
  chemically synthesized
tacatatgtttgttatctctaa

SEQ ID NO: 936025 - DNA, 22 bp, Artificial Sequence
  chemically synthesized
gtacatatgtttgttatctcta

SEQ ID NO: 936026 - DNA, 22 bp, Artificial Sequence
  chemically synthesized
acacttgtacatatgtttgtta

SEQ ID NO: 936027 - DNA, 22 bp, Artificial Sequence
  chemically synthesized
ttgacacttgtacatatgtttg

SEQ ID NO: 936028 - DNA, 22 bp, Artificial Sequence
  chemically synthesized
gagataacaaacatatgtacaa

SEQ ID NO: 936029 - DNA, 22 bp, Artificial Sequence
  chemically synthesized
caaacctattgacacttgtaca

SEQ ID NO: 936030 - DNA, 22 bp, Artificial Sequence
  chemically synthesized
gtaggattatggctgattttat

SEQ ID NO: 936031 - DNA, 22 bp, Artificial Sequence
  chemically synthesized
cacggaagacgaataaaatcag

SEQ ID NO: 936032 - DNA, 22 bp, Artificial Sequence
  chemically synthesized
taggattatggctgattttatt

SEQ ID NO: 936033 - DNA, 22 bp, Artificial Sequence
  chemically synthesized
tggctgattttattcgtcttcc

SEQ ID NO: 936034 - DNA, 22 bp, Artificial Sequence
  chemically synthesized
attttattcgtcttccgtgcaa

SEQ ID NO: 936035 - DNA, 22 bp, Artificial Sequence
  chemically synthesized
aaaaatataggaagttgcacgg

SEQ ID NO: 936036 - DNA, 22 bp, Artificial Sequence
  chemically synthesized
gaaaaatataggaagttgcacg

SEQ ID NO: 936037 - DNA, 22 bp, Artificial Sequence
  chemically synthesized
tattcgtcttccgtgcaacttc

SEQ ID NO: 936038 - DNA, 22 bp, Artificial Sequence
  chemically synthesized
attcgtcttccgtgcaacttcc

SEQ ID NO: 936039 - DNA, 22 bp, Artificial Sequence
  chemically synthesized
ttcgtcttccgtgcaacttcct

SEQ ID NO: 936040 - DNA, 22 bp, Artificial Sequence
  chemically synthesized
gtcttccgtgcaacttcctata

SEQ ID NO: 936041 - DNA, 22 bp, Artificial Sequence
  chemically synthesized
tagaatttgaaaaatataggaa

SEQ ID NO: 936042 - DNA, 22 bp, Artificial Sequence
  chemically synthesized
ccgtgcaacttcctatattttt

SEQ ID NO: 936043 - DNA, 22 bp, Artificial Sequence
  chemically synthesized
cgtgcaacttcctatatttttc

SEQ ID NO: 936044 - DNA, 22 bp, Artificial Sequence
  chemically synthesized
attatagaatttgaaaaatata

SEQ ID NO: 936045 - DNA, 22 bp, Artificial Sequence
  chemically synthesized
cctatatttttcaaattctata

SEQ ID NO: 936046 - DNA, 22 bp, Artificial Sequence
  chemically synthesized
ctatatttttcaaattctataa

SEQ ID NO: 936047 - DNA, 22 bp, Artificial Sequence
  chemically synthesized
tatttttcaaattctataatga

SEQ ID NO: 936048 - DNA, 22 bp, Artificial Sequence
  chemically synthesized
taaaggtaataagtgctcatta

SEQ ID NO: 936049 - DNA, 22 bp, Artificial Sequence
  chemically synthesized
ttcaaattctataatgagcact

SEQ ID NO: 936050 - DNA, 22 bp, Artificial Sequence
  chemically synthesized
tcaaattctataatgagcactt

SEQ ID NO: 936051 - DNA, 22 bp, Artificial Sequence
  chemically synthesized
caaattctataatgagcactta

SEQ ID NO: 936052 - DNA, 22 bp, Artificial Sequence
  chemically synthesized
ttataaaggtaataagtgctca

SEQ ID NO: 936053 - DNA, 22 bp, Artificial Sequence
  chemically synthesized
aaattctataatgagcacttat

SEQ ID NO: 936054 - DNA, 22 bp, Artificial Sequence
  chemically synthesized
attataaaggtaataagtgctc

SEQ ID NO: 936055 - DNA, 22 bp, Artificial Sequence
  chemically synthesized
ttattataaaggtaataagtgc

SEQ ID NO: 936056 - DNA, 22 bp, Artificial Sequence
  chemically synthesized
cttattataaaggtaataagtg

SEQ ID NO: 936057 - DNA, 22 bp, Artificial Sequence
  chemically synthesized
tcttattataaaggtaataagt

SEQ ID NO: 936058 - DNA, 22 bp, Artificial Sequence
  chemically synthesized
ttcttattataaaggtaataag

SEQ ID NO: 936059 - DNA, 22 bp, Artificial Sequence
  chemically synthesized
tataatgagcacttattacctt

SEQ ID NO: 936060 - DNA, 22 bp, Artificial Sequence
  chemically synthesized
tttcttattataaaggtaataa

SEQ ID NO: 936061 - DNA, 22 bp, Artificial Sequence
  chemically synthesized
ttttcttattataaaggtaata

SEQ ID NO: 936062 - DNA, 22 bp, Artificial Sequence
  chemically synthesized
taatgagcacttattaccttta

SEQ ID NO: 936063 - DNA, 22 bp, Artificial Sequence
  chemically synthesized
ttttttcttattataaaggtaa

SEQ ID NO: 936064 - DNA, 22 bp, Artificial Sequence
  chemically synthesized
cttttttcttattataaaggta

SEQ ID NO: 936065 - DNA, 22 bp, Artificial Sequence
  chemically synthesized
tcttttttcttattataaaggt

SEQ ID NO: 936066 - DNA, 22 bp, Artificial Sequence
  chemically synthesized
cattttcttttttcttattata

SEQ ID NO: 936067 - DNA, 22 bp, Artificial Sequence
  chemically synthesized
gcattttcttttttcttattat

SEQ ID NO: 936068 - DNA, 22 bp, Artificial Sequence
  chemically synthesized
attacctttataataagaaaaa

SEQ ID NO: 936069 - DNA, 22 bp, Artificial Sequence
  chemically synthesized
ttacctttataataagaaaaaa

SEQ ID NO: 936070 - DNA, 22 bp, Artificial Sequence
  chemically synthesized
gtttgcattttcttttttctta

SEQ ID NO: 936071 - DNA, 22 bp, Artificial Sequence
  chemically synthesized
ggtttgcattttcttttttctt

SEQ ID NO: 936072 - DNA, 22 bp, Artificial Sequence
  chemically synthesized
tggtttgcattttcttttttct

SEQ ID NO: 936073 - DNA, 22 bp, Artificial Sequence
  chemically synthesized
cctttataataagaaaaaagaa

SEQ ID NO: 936074 - DNA, 22 bp, Artificial Sequence
  chemically synthesized
tataataagaaaaaagaaaatg

SEQ ID NO: 936075 - DNA, 22 bp, Artificial Sequence
  chemically synthesized
aattttggtttgcattttcttt

SEQ ID NO: 936076 - DNA, 22 bp, Artificial Sequence
  chemically synthesized
ataataagaaaaaagaaaatgc

SEQ ID NO: 936077 - DNA, 22 bp, Artificial Sequence
  chemically synthesized
caattttggtttgcattttctt

SEQ ID NO: 936078 - DNA, 22 bp, Artificial Sequence
  chemically synthesized
taataagaaaaaagaaaatgca

SEQ ID NO: 936079 - DNA, 22 bp, Artificial Sequence
  chemically synthesized
tcaattttggtttgcattttct

SEQ ID NO: 936080 - DNA, 22 bp, Artificial Sequence
  chemically synthesized
ttcaattttggtttgcattttc

SEQ ID NO: 936081 - DNA, 22 bp, Artificial Sequence
  chemically synthesized
tccacaaaatgtaaaacttttc

SEQ ID NO: 936082 - DNA, 22 bp, Artificial Sequence
  chemically synthesized
aaaagttttacattttgtggat

SEQ ID NO: 936083 - DNA, 22 bp, Artificial Sequence
  chemically synthesized
caaagatgtgccataaattatc

SEQ ID NO: 936084 - DNA, 22 bp, Artificial Sequence
  chemically synthesized
tacattttgtggataatttatg

SEQ ID NO: 936085 - DNA, 22 bp, Artificial Sequence
  chemically synthesized
ccaaagatgtgccataaattat

SEQ ID NO: 936086 - DNA, 22 bp, Artificial Sequence
  chemically synthesized
acattttgtggataatttatgg

SEQ ID NO: 936087 - DNA, 22 bp, Artificial Sequence
  chemically synthesized
cattttgtggataatttatggc

SEQ ID NO: 936088 - DNA, 22 bp, Artificial Sequence
  chemically synthesized
tgtggataatttatggcacatc

SEQ ID NO: 936089 - DNA, 22 bp, Artificial Sequence
  chemically synthesized
gtggataatttatggcacatct

SEQ ID NO: 936090 - DNA, 22 bp, Artificial Sequence
  chemically synthesized
tggataatttatggcacatctt

SEQ ID NO: 936091 - DNA, 22 bp, Artificial Sequence
  chemically synthesized
acataaaatttccaaagatgtg

SEQ ID NO: 936092 - DNA, 22 bp, Artificial Sequence
  chemically synthesized
taacataaaatttccaaagatg

SEQ ID NO: 936093 - DNA, 22 bp, Artificial Sequence
  chemically synthesized
atggcacatctttggaaatttt

SEQ ID NO: 936094 - DNA, 22 bp, Artificial Sequence
  chemically synthesized
tggcacatctttggaaatttta

SEQ ID NO: 936095 - DNA, 22 bp, Artificial Sequence
  chemically synthesized
gccagtgaaagcctctaacata

SEQ ID NO: 936096 - DNA, 22 bp, Artificial Sequence
  chemically synthesized
tggaaattttatgttagaggct

SEQ ID NO: 936097 - DNA, 22 bp, Artificial Sequence
  chemically synthesized
ggaaattttatgttagaggctt

SEQ ID NO: 936098 - DNA, 22 bp, Artificial Sequence
  chemically synthesized
attagccagtgaaagcctctaa

SEQ ID NO: 936099 - DNA, 22 bp, Artificial Sequence
  chemically synthesized
gaaattttatgttagaggcttt

SEQ ID NO: 936100 - DNA, 22 bp, Artificial Sequence
  chemically synthesized
tgattagccagtgaaagcctct

SEQ ID NO: 936101 - DNA, 22 bp, Artificial Sequence
  chemically synthesized
ctgattagccagtgaaagcctc

SEQ ID NO: 936102 - DNA, 22 bp, Artificial Sequence
  chemically synthesized
tatgttagaggctttcactggc

SEQ ID NO: 936103 - DNA, 22 bp, Artificial Sequence
  chemically synthesized
atgttagaggctttcactggct

SEQ ID NO: 936104 - DNA, 22 bp, Artificial Sequence
  chemically synthesized
tgttagaggctttcactggcta

SEQ ID NO: 936105 - DNA, 22 bp, Artificial Sequence
  chemically synthesized
gaggctttcactggctaatcag

SEQ ID NO: 936106 - DNA, 22 bp, Artificial Sequence
  chemically synthesized
tcactggctaatcagaaattgc

SEQ ID NO: 936107 - DNA, 22 bp, Artificial Sequence
  chemically synthesized
cactggctaatcagaaattgct

SEQ ID NO: 936108 - DNA, 22 bp, Artificial Sequence
  chemically synthesized
actggctaatcagaaattgctt

SEQ ID NO: 936109 - DNA, 22 bp, Artificial Sequence
  chemically synthesized
gctaatcagaaattgctttatc

SEQ ID NO: 936110 - DNA, 22 bp, Artificial Sequence
  chemically synthesized
aacaaagaaaaatagataaagc

SEQ ID NO: 936111 - DNA, 22 bp, Artificial Sequence
  chemically synthesized
atcagaaattgctttatctatt

SEQ ID NO: 936112 - DNA, 22 bp, Artificial Sequence
  chemically synthesized
cattcaacaaagaaaaatagat

SEQ ID NO: 936113 - DNA, 22 bp, Artificial Sequence
  chemically synthesized
ccattcaacaaagaaaaataga

SEQ ID NO: 936114 - DNA, 22 bp, Artificial Sequence
  chemically synthesized
tccattcaacaaagaaaaatag

SEQ ID NO: 936115 - DNA, 22 bp, Artificial Sequence
  chemically synthesized
cctttccattcaacaaagaaaa

SEQ ID NO: 936116 - DNA, 22 bp, Artificial Sequence
  chemically synthesized
ctttatctatttttctttgttg

SEQ ID NO: 936117 - DNA, 22 bp, Artificial Sequence
  chemically synthesized
ctccctttccattcaacaaaga

SEQ ID NO: 936118 - DNA, 22 bp, Artificial Sequence
  chemically synthesized
tatctatttttctttgttgaat

SEQ ID NO: 936119 - DNA, 22 bp, Artificial Sequence
  chemically synthesized
atctatttttctttgttgaatg

SEQ ID NO: 936120 - DNA, 22 bp, Artificial Sequence
  chemically synthesized
tctatttttctttgttgaatgg

SEQ ID NO: 936121 - DNA, 22 bp, Artificial Sequence
  chemically synthesized
cctcctccctttccattcaaca

SEQ ID NO: 936122 - DNA, 22 bp, Artificial Sequence
  chemically synthesized
tttttctttgttgaatggaaag

SEQ ID NO: 936123 - DNA, 22 bp, Artificial Sequence
  chemically synthesized
cctccctcctccctttccattc

SEQ ID NO: 936124 - DNA, 22 bp, Artificial Sequence
  chemically synthesized
tccctccctcctccctttccat

SEQ ID NO: 936125 - DNA, 22 bp, Artificial Sequence
  chemically synthesized
ttctttgttgaatggaaaggga

SEQ ID NO: 936126 - DNA, 22 bp, Artificial Sequence
  chemically synthesized
tctttgttgaatggaaagggag

SEQ ID NO: 936127 - DNA, 22 bp, Artificial Sequence
  chemically synthesized
ctttgttgaatggaaagggagg

SEQ ID NO: 936128 - DNA, 22 bp, Artificial Sequence
  chemically synthesized
tttgttgaatggaaagggagga

SEQ ID NO: 936129 - DNA, 22 bp, Artificial Sequence
  chemically synthesized
ccctctccctccctcctccctt

SEQ ID NO: 936130 - DNA, 22 bp, Artificial Sequence
  chemically synthesized
tgttgaatggaaagggaggagg

SEQ ID NO: 936131 - DNA, 22 bp, Artificial Sequence
  chemically synthesized
gttgaatggaaagggaggaggg

SEQ ID NO: 936132 - DNA, 22 bp, Artificial Sequence
  chemically synthesized
ttgaatggaaagggaggaggga

SEQ ID NO: 936133 - DNA, 22 bp, Artificial Sequence
  chemically synthesized
ttcccctctccctccctcctcc

SEQ ID NO: 936134 - DNA, 22 bp, Artificial Sequence
  chemically synthesized
attcccctctccctccctcctc

SEQ ID NO: 936135 - DNA, 22 bp, Artificial Sequence
  chemically synthesized
aatggaaagggaggagggaggg

SEQ ID NO: 936136 - DNA, 22 bp, Artificial Sequence
  chemically synthesized
cttattcccctctccctccctc

SEQ ID NO: 936137 - DNA, 22 bp, Artificial Sequence
  chemically synthesized
gcttattcccctctccctccct

SEQ ID NO: 936138 - DNA, 22 bp, Artificial Sequence
  chemically synthesized
ccttgcttattcccctctccct

SEQ ID NO: 936139 - DNA, 22 bp, Artificial Sequence
  chemically synthesized
tcccttgcttattcccctctcc

SEQ ID NO: 936140 - DNA, 22 bp, Artificial Sequence
  chemically synthesized
ctcccttgcttattcccctctc

SEQ ID NO: 936141 - DNA, 22 bp, Artificial Sequence
  chemically synthesized
tttctcccttgcttattcccct

SEQ ID NO: 936142 - DNA, 22 bp, Artificial Sequence
  chemically synthesized
ttatttctcccttgcttattcc

SEQ ID NO: 936143 - DNA, 22 bp, Artificial Sequence
  chemically synthesized
ccctattatttctcccttgctt

SEQ ID NO: 936144 - DNA, 22 bp, Artificial Sequence
  chemically synthesized
gccctattatttctcccttgct

SEQ ID NO: 936145 - DNA, 22 bp, Artificial Sequence
  chemically synthesized
tttgccctattatttctccctt

SEQ ID NO: 936146 - DNA, 22 bp, Artificial Sequence
  chemically synthesized
agtggaaccagttatttgccct

SEQ ID NO: 936147 - DNA, 22 bp, Artificial Sequence
  chemically synthesized
gagtggaaccagttatttgccc

SEQ ID NO: 936148 - DNA, 22 bp, Artificial Sequence
  chemically synthesized
ttgagtggaaccagttatttgc

SEQ ID NO: 936149 - DNA, 22 bp, Artificial Sequence
  chemically synthesized
ctcttgagtggaaccagttatt

SEQ ID NO: 936150 - DNA, 22 bp, Artificial Sequence
  chemically synthesized
gctcttgagtggaaccagttat

SEQ ID NO: 936151 - DNA, 22 bp, Artificial Sequence
  chemically synthesized
atttgctcttgagtggaaccag

SEQ ID NO: 936152 - DNA, 22 bp, Artificial Sequence
  chemically synthesized
gttccactcaagagcaaattaa

SEQ ID NO: 936153 - DNA, 22 bp, Artificial Sequence
  chemically synthesized
cccatgagggaaagttaatttg

SEQ ID NO: 936154 - DNA, 22 bp, Artificial Sequence
  chemically synthesized
cactcaagagcaaattaacttt

SEQ ID NO: 936155 - DNA, 22 bp, Artificial Sequence
  chemically synthesized
actacccatgagggaaagttaa

SEQ ID NO: 936156 - DNA, 22 bp, Artificial Sequence
  chemically synthesized
aagagcaaattaactttccctc

SEQ ID NO: 936157 - DNA, 22 bp, Artificial Sequence
  chemically synthesized
acatgtactgactacccatgag

SEQ ID NO: 936158 - DNA, 22 bp, Artificial Sequence
  chemically synthesized
actttccctcatgggtagtcag

SEQ ID NO: 936159 - DNA, 22 bp, Artificial Sequence
  chemically synthesized
tccctcatgggtagtcagtaca

SEQ ID NO: 936160 - DNA, 22 bp, Artificial Sequence
  chemically synthesized
ccctcatgggtagtcagtacat

SEQ ID NO: 936161 - DNA, 22 bp, Artificial Sequence
  chemically synthesized
tcatcaattaacatgtactgac

SEQ ID NO: 936162 - DNA, 22 bp, Artificial Sequence
  chemically synthesized
cctcatgggtagtcagtacatg

SEQ ID NO: 936163 - DNA, 22 bp, Artificial Sequence
  chemically synthesized
attatcatcaattaacatgtac

SEQ ID NO: 936164 - DNA, 22 bp, Artificial Sequence
  chemically synthesized
atgggtagtcagtacatgttaa

SEQ ID NO: 936165 - DNA, 22 bp, Artificial Sequence
  chemically synthesized
aattatcatcaattaacatgta

SEQ ID NO: 936166 - DNA, 22 bp, Artificial Sequence
  chemically synthesized
ttaattatcatcaattaacatg

SEQ ID NO: 936167 - DNA, 22 bp, Artificial Sequence
  chemically synthesized
cttaattatcatcaattaacat

SEQ ID NO: 936168 - DNA, 22 bp, Artificial Sequence
  chemically synthesized
tcttaattatcatcaattaaca

SEQ ID NO: 936169 - DNA, 22 bp, Artificial Sequence
  chemically synthesized
ttcttaattatcatcaattaac

SEQ ID NO: 936170 - DNA, 22 bp, Artificial Sequence
  chemically synthesized
atttttcttaattatcatcaat

SEQ ID NO: 936171 - DNA, 22 bp, Artificial Sequence
  chemically synthesized
attgatgataattaagaaaaat

SEQ ID NO: 936172 - DNA, 22 bp, Artificial Sequence
  chemically synthesized
atgataattaagaaaaatgagt

SEQ ID NO: 936173 - DNA, 22 bp, Artificial Sequence
  chemically synthesized
acaaaaaagaaaactcattttt

SEQ ID NO: 936174 - DNA, 22 bp, Artificial Sequence
  chemically synthesized
agaaaaatgagttttctttttt

SEQ ID NO: 936175 - DNA, 22 bp, Artificial Sequence
  chemically synthesized
tgtggtggtgctcacaaaaaag

SEQ ID NO: 936176 - DNA, 22 bp, Artificial Sequence
  chemically synthesized
tcttttttgtgagcaccaccac

SEQ ID NO: 936177 - DNA, 22 bp, Artificial Sequence
  chemically synthesized
cttttttgtgagcaccaccaca

SEQ ID NO: 936178 - DNA, 22 bp, Artificial Sequence
  chemically synthesized
ttttttgtgagcaccaccacac

SEQ ID NO: 936179 - DNA, 22 bp, Artificial Sequence
  chemically synthesized
ttttgtgagcaccaccacacaa

SEQ ID NO: 936180 - DNA, 22 bp, Artificial Sequence
  chemically synthesized
tttgtgagcaccaccacacaat

SEQ ID NO: 936181 - DNA, 22 bp, Artificial Sequence
  chemically synthesized
ttgtgagcaccaccacacaatt

SEQ ID NO: 936182 - DNA, 22 bp, Artificial Sequence
  chemically synthesized
tgtgagcaccaccacacaattc

SEQ ID NO: 936183 - DNA, 22 bp, Artificial Sequence
  chemically synthesized
gtgagcaccaccacacaattcc

SEQ ID NO: 936184 - DNA, 22 bp, Artificial Sequence
  chemically synthesized
atatgaaaatatggaattgtgt

SEQ ID NO: 936185 - DNA, 22 bp, Artificial Sequence
  chemically synthesized
tgagcaccaccacacaattcca

SEQ ID NO: 936186 - DNA, 22 bp, Artificial Sequence
  chemically synthesized
gctaatatgaaaatatggaatt

SEQ ID NO: 936187 - DNA, 22 bp, Artificial Sequence
  chemically synthesized
agctaatatgaaaatatggaat

SEQ ID NO: 936188 - DNA, 22 bp, Artificial Sequence
  chemically synthesized
tagctaatatgaaaatatggaa

SEQ ID NO: 936189 - DNA, 22 bp, Artificial Sequence
  chemically synthesized
acctttagctaatatgaaaata

SEQ ID NO: 936190 - DNA, 22 bp, Artificial Sequence
  chemically synthesized
aacctttagctaatatgaaaat

SEQ ID NO: 936191 - DNA, 22 bp, Artificial Sequence
  chemically synthesized
taacctttagctaatatgaaaa

SEQ ID NO: 936192 - DNA, 22 bp, Artificial Sequence
  chemically synthesized
actttaacctttagctaatatg

SEQ ID NO: 936193 - DNA, 22 bp, Artificial Sequence
  chemically synthesized
gactttaacctttagctaatat

SEQ ID NO: 936194 - DNA, 22 bp, Artificial Sequence
  chemically synthesized
catattttcatattagctaaag

SEQ ID NO: 936195 - DNA, 22 bp, Artificial Sequence
  chemically synthesized
gatcagtttgactttaaccttt

SEQ ID NO: 936196 - DNA, 22 bp, Artificial Sequence
  chemically synthesized
tcatattagctaaaggttaaag

SEQ ID NO: 936197 - DNA, 22 bp, Artificial Sequence
  chemically synthesized
catattagctaaaggttaaagt

SEQ ID NO: 936198 - DNA, 22 bp, Artificial Sequence
  chemically synthesized
atattagctaaaggttaaagtc

SEQ ID NO: 936199 - DNA, 22 bp, Artificial Sequence
  chemically synthesized
tactggatcagtttgactttaa

SEQ ID NO: 936200 - DNA, 22 bp, Artificial Sequence
  chemically synthesized
gctaaaggttaaagtcaaactg

SEQ ID NO: 936201 - DNA, 22 bp, Artificial Sequence
  chemically synthesized
aaggttaaagtcaaactgatcc

SEQ ID NO: 936202 - DNA, 22 bp, Artificial Sequence
  chemically synthesized
caaagttgtactggatcagttt

SEQ ID NO: 936203 - DNA, 22 bp, Artificial Sequence
  chemically synthesized
aagtcaaactgatccagtacaa

SEQ ID NO: 936204 - DNA, 22 bp, Artificial Sequence
  chemically synthesized
acatccaactgcaaagttgtac

SEQ ID NO: 936205 - DNA, 22 bp, Artificial Sequence
  chemically synthesized
atccagtacaactttgcagttg

SEQ ID NO: 936206 - DNA, 22 bp, Artificial Sequence
  chemically synthesized
tgaaaagtagttaacatccaac

SEQ ID NO: 936207 - DNA, 22 bp, Artificial Sequence
  chemically synthesized
tatgaaaagtagttaacatcca

SEQ ID NO: 936208 - DNA, 22 bp, Artificial Sequence
  chemically synthesized
ctatgaaaagtagttaacatcc

SEQ ID NO: 936209 - DNA, 22 bp, Artificial Sequence
  chemically synthesized
tgcagttggatgttaactactt

SEQ ID NO: 936210 - DNA, 22 bp, Artificial Sequence
  chemically synthesized
gcagttggatgttaactacttt

SEQ ID NO: 936211 - DNA, 22 bp, Artificial Sequence
  chemically synthesized
cagttggatgttaactactttt

SEQ ID NO: 936212 - DNA, 22 bp, Artificial Sequence
  chemically synthesized
gatgttaactacttttcataga

SEQ ID NO: 936213 - DNA, 22 bp, Artificial Sequence
  chemically synthesized
accatgaatgtggccccttcta

SEQ ID NO: 936214 - DNA, 22 bp, Artificial Sequence
  chemically synthesized
actacttttcatagaaggggcc

SEQ ID NO: 936215 - DNA, 22 bp, Artificial Sequence
  chemically synthesized
cttttcatagaaggggccacat

SEQ ID NO: 936216 - DNA, 22 bp, Artificial Sequence
  chemically synthesized
agattcaccatgaatgtggccc

SEQ ID NO: 936217 - DNA, 22 bp, Artificial Sequence
  chemically synthesized
gagattcaccatgaatgtggcc

SEQ ID NO: 936218 - DNA, 22 bp, Artificial Sequence
  chemically synthesized
ttcatagaaggggccacattca

SEQ ID NO: 936219 - DNA, 22 bp, Artificial Sequence
  chemically synthesized
tcatagaaggggccacattcat

SEQ ID NO: 936220 - DNA, 22 bp, Artificial Sequence
  chemically synthesized
catagaaggggccacattcatg

SEQ ID NO: 936221 - DNA, 22 bp, Artificial Sequence
  chemically synthesized
atagaaggggccacattcatgg

SEQ ID NO: 936222 - DNA, 22 bp, Artificial Sequence
  chemically synthesized
acaaataaacgaggtcttgaga

SEQ ID NO: 936223 - DNA, 22 bp, Artificial Sequence
  chemically synthesized
aacaaataaacgaggtcttgag

SEQ ID NO: 936224 - DNA, 22 bp, Artificial Sequence
  chemically synthesized
atggtgaatctcaagacctcgt

SEQ ID NO: 936225 - DNA, 22 bp, Artificial Sequence
  chemically synthesized
caaagatgcatttaacaaataa

SEQ ID NO: 936226 - DNA, 22 bp, Artificial Sequence
  chemically synthesized
aagacctcgtttatttgttaaa

SEQ ID NO: 936227 - DNA, 22 bp, Artificial Sequence
  chemically synthesized
gtttatttgttaaatgcatctt

SEQ ID NO: 936228 - DNA, 22 bp, Artificial Sequence
  chemically synthesized
atttgttaaatgcatctttgca

SEQ ID NO: 936229 - DNA, 22 bp, Artificial Sequence
  chemically synthesized
tttgttaaatgcatctttgcaa

SEQ ID NO: 936230 - DNA, 22 bp, Artificial Sequence
  chemically synthesized
gttaaatgcatctttgcaacta

SEQ ID NO: 936231 - DNA, 22 bp, Artificial Sequence
  chemically synthesized
ttaaatgcatctttgcaactat

SEQ ID NO: 936232 - DNA, 22 bp, Artificial Sequence
  chemically synthesized
aatgcatctttgcaactatttt

SEQ ID NO: 936233 - DNA, 22 bp, Artificial Sequence
  chemically synthesized
atggtatagggagaaatagaaa

SEQ ID NO: 936234 - DNA, 22 bp, Artificial Sequence
  chemically synthesized
tgcaactattttctatttctcc

SEQ ID NO: 936235 - DNA, 22 bp, Artificial Sequence
  chemically synthesized
gcaactattttctatttctccc

SEQ ID NO: 936236 - DNA, 22 bp, Artificial Sequence
  chemically synthesized
caactattttctatttctccct

SEQ ID NO: 936237 - DNA, 22 bp, Artificial Sequence
  chemically synthesized
ttttctatttctccctatacca

SEQ ID NO: 936238 - DNA, 22 bp, Artificial Sequence
  chemically synthesized
tgggtgtcattaatggtatagg

SEQ ID NO: 936239 - DNA, 22 bp, Artificial Sequence
  chemically synthesized
tctatttctccctataccatta

SEQ ID NO: 936240 - DNA, 22 bp, Artificial Sequence
  chemically synthesized
ctatttctccctataccattaa

SEQ ID NO: 936241 - DNA, 22 bp, Artificial Sequence
  chemically synthesized
ttgtgggtgtcattaatggtat

SEQ ID NO: 936242 - DNA, 22 bp, Artificial Sequence
  chemically synthesized
tatttctccctataccattaat

SEQ ID NO: 936243 - DNA, 22 bp, Artificial Sequence
  chemically synthesized
tttctccctataccattaatga

SEQ ID NO: 936244 - DNA, 22 bp, Artificial Sequence
  chemically synthesized
ctccctataccattaatgacac

SEQ ID NO: 936245 - DNA, 22 bp, Artificial Sequence
  chemically synthesized
tccctataccattaatgacacc

SEQ ID NO: 936246 - DNA, 22 bp, Artificial Sequence
  chemically synthesized
tgtactattgtgggtgtcatta

SEQ ID NO: 936247 - DNA, 22 bp, Artificial Sequence
  chemically synthesized
cctataccattaatgacaccca

SEQ ID NO: 936248 - DNA, 22 bp, Artificial Sequence
  chemically synthesized
taccattaatgacacccacaat

SEQ ID NO: 936249 - DNA, 22 bp, Artificial Sequence
  chemically synthesized
atgacacccacaatagtacaca

SEQ ID NO: 936250 - DNA, 22 bp, Artificial Sequence
  chemically synthesized
gatcactatttcttgcatgtct

SEQ ID NO: 936251 - DNA, 22 bp, Artificial Sequence
  chemically synthesized
atcactatttcttgcatgtctg

SEQ ID NO: 936252 - DNA, 22 bp, Artificial Sequence
  chemically synthesized
agcaaaggaaatgcagacatgc

SEQ ID NO: 936253 - DNA, 22 bp, Artificial Sequence
  chemically synthesized
tcagcaaaggaaatgcagacat

SEQ ID NO: 936254 - DNA, 22 bp, Artificial Sequence
  chemically synthesized
ctcagcaaaggaaatgcagaca

SEQ ID NO: 936255 - DNA, 22 bp, Artificial Sequence
  chemically synthesized
tttcttgcatgtctgcatttcc

SEQ ID NO: 936256 - DNA, 22 bp, Artificial Sequence
  chemically synthesized
tttctcagcaaaggaaatgcag

SEQ ID NO: 936257 - DNA, 22 bp, Artificial Sequence
  chemically synthesized
tatttctcagcaaaggaaatgc

SEQ ID NO: 936258 - DNA, 22 bp, Artificial Sequence
  chemically synthesized
cttgcatgtctgcatttccttt

SEQ ID NO: 936259 - DNA, 22 bp, Artificial Sequence
  chemically synthesized
ttgcatgtctgcatttcctttg

SEQ ID NO: 936260 - DNA, 22 bp, Artificial Sequence
  chemically synthesized
tctatttctcagcaaaggaaat

SEQ ID NO: 936261 - DNA, 22 bp, Artificial Sequence
  chemically synthesized
ctctatttctcagcaaaggaaa

SEQ ID NO: 936262 - DNA, 22 bp, Artificial Sequence
  chemically synthesized
gcatgtctgcatttcctttgct

SEQ ID NO: 936263 - DNA, 22 bp, Artificial Sequence
  chemically synthesized
catgtctgcatttcctttgctg

SEQ ID NO: 936264 - DNA, 22 bp, Artificial Sequence
  chemically synthesized
tgtatttctctatttctcagca

SEQ ID NO: 936265 - DNA, 22 bp, Artificial Sequence
  chemically synthesized
atgtatttctctatttctcagc

SEQ ID NO: 936266 - DNA, 22 bp, Artificial Sequence
  chemically synthesized
tatgtatttctctatttctcag

SEQ ID NO: 936267 - DNA, 22 bp, Artificial Sequence
  chemically synthesized
catttcctttgctgagaaatag

SEQ ID NO: 936268 - DNA, 22 bp, Artificial Sequence
  chemically synthesized
tttatgtatttctctatttctc

SEQ ID NO: 936269 - DNA, 22 bp, Artificial Sequence
  chemically synthesized
ttctttatgtatttctctattt

SEQ ID NO: 936270 - DNA, 22 bp, Artificial Sequence
  chemically synthesized
cctttgctgagaaatagagaaa

SEQ ID NO: 936271 - DNA, 22 bp, Artificial Sequence
  chemically synthesized
gttctttatgtatttctctatt

SEQ ID NO: 936272 - DNA, 22 bp, Artificial Sequence
  chemically synthesized
ctttgctgagaaatagagaaat

SEQ ID NO: 936273 - DNA, 22 bp, Artificial Sequence
  chemically synthesized
tgttctttatgtatttctctat

SEQ ID NO: 936274 - DNA, 22 bp, Artificial Sequence
  chemically synthesized
ttgttctttatgtatttctcta

SEQ ID NO: 936275 - DNA, 22 bp, Artificial Sequence
  chemically synthesized
tttgttctttatgtatttctct

SEQ ID NO: 936276 - DNA, 22 bp, Artificial Sequence
  chemically synthesized
tgctgagaaatagagaaataca

SEQ ID NO: 936277 - DNA, 22 bp, Artificial Sequence
  chemically synthesized
ttttgttctttatgtatttctc

SEQ ID NO: 936278 - DNA, 22 bp, Artificial Sequence
  chemically synthesized
gctgagaaatagagaaatacat

SEQ ID NO: 936279 - DNA, 22 bp, Artificial Sequence
  chemically synthesized
ctgagaaatagagaaatacata

SEQ ID NO: 936280 - DNA, 22 bp, Artificial Sequence
  chemically synthesized
agaaatagagaaatacataaag

SEQ ID NO: 936281 - DNA, 22 bp, Artificial Sequence
  chemically synthesized
gagcccttttttgttctttatg

SEQ ID NO: 936282 - DNA, 22 bp, Artificial Sequence
  chemically synthesized
agagcccttttttgttctttat

SEQ ID NO: 936283 - DNA, 22 bp, Artificial Sequence
  chemically synthesized
aatgggacttagagcccttttt

SEQ ID NO: 936284 - DNA, 22 bp, Artificial Sequence
  chemically synthesized
gaatgggacttagagccctttt

SEQ ID NO: 936285 - DNA, 22 bp, Artificial Sequence
  chemically synthesized
tgaatgggacttagagcccttt

SEQ ID NO: 936286 - DNA, 22 bp, Artificial Sequence
  chemically synthesized
ttgaatgggacttagagccctt

SEQ ID NO: 936287 - DNA, 22 bp, Artificial Sequence
  chemically synthesized
tagatttttgaatgggacttag

SEQ ID NO: 936288 - DNA, 22 bp, Artificial Sequence
  chemically synthesized
gtagatttttgaatgggactta

SEQ ID NO: 936289 - DNA, 22 bp, Artificial Sequence
  chemically synthesized
taagtcccattcaaaaatctac

SEQ ID NO: 936290 - DNA, 22 bp, Artificial Sequence
  chemically synthesized
agcagtcacgtttgtagatttt

SEQ ID NO: 936291 - DNA, 22 bp, Artificial Sequence
  chemically synthesized
agtcccattcaaaaatctacaa

SEQ ID NO: 936292 - DNA, 22 bp, Artificial Sequence
  chemically synthesized
aggcgttcagcagtcacgtttg

SEQ ID NO: 936293 - DNA, 22 bp, Artificial Sequence
  chemically synthesized
aaaaatctacaaacgtgactgc

SEQ ID NO: 936294 - DNA, 22 bp, Artificial Sequence
  chemically synthesized
ttaaggcgttcagcagtcacgt

SEQ ID NO: 936295 - DNA, 22 bp, Artificial Sequence
  chemically synthesized
gttaaggcgttcagcagtcacg

SEQ ID NO: 936296 - DNA, 22 bp, Artificial Sequence
  chemically synthesized
tgttaaggcgttcagcagtcac

SEQ ID NO: 936297 - DNA, 22 bp, Artificial Sequence
  chemically synthesized
ttgttaaggcgttcagcagtca

SEQ ID NO: 936298 - DNA, 22 bp, Artificial Sequence
  chemically synthesized
caaacgtgactgctgaacgcct

SEQ ID NO: 936299 - DNA, 22 bp, Artificial Sequence
  chemically synthesized
atgggtgcttttgttaaggcgt

SEQ ID NO: 936300 - DNA, 22 bp, Artificial Sequence
  chemically synthesized
ctgaacgccttaacaaaagcac

SEQ ID NO: 936301 - DNA, 22 bp, Artificial Sequence
  chemically synthesized
aacgccttaacaaaagcaccca

SEQ ID NO: 936302 - DNA, 22 bp, Artificial Sequence
  chemically synthesized
taaagccatggccgattcatgg

SEQ ID NO: 936303 - DNA, 22 bp, Artificial Sequence
  chemically synthesized
aacaaaagcacccatgaatcgg

SEQ ID NO: 936304 - DNA, 22 bp, Artificial Sequence
  chemically synthesized
acaaaagcacccatgaatcggc

SEQ ID NO: 936305 - DNA, 22 bp, Artificial Sequence
  chemically synthesized
gcagctataaagccatggccga

SEQ ID NO: 936306 - DNA, 22 bp, Artificial Sequence
  chemically synthesized
cgcagctataaagccatggccg

SEQ ID NO: 936307 - DNA, 22 bp, Artificial Sequence
  chemically synthesized
tcccttcgcagctataaagcca

SEQ ID NO: 936308 - DNA, 22 bp, Artificial Sequence
  chemically synthesized
tgtgttgtcccttcgcagctat

SEQ ID NO: 936309 - DNA, 22 bp, Artificial Sequence
  chemically synthesized
catgcctatgtgttgtcccttc

SEQ ID NO: 936310 - DNA, 22 bp, Artificial Sequence
  chemically synthesized
tccatgcctatgtgttgtccct

SEQ ID NO: 936311 - DNA, 22 bp, Artificial Sequence
  chemically synthesized
tatagctgcgaagggacaacac

SEQ ID NO: 936312 - DNA, 22 bp, Artificial Sequence
  chemically synthesized
atagctgcgaagggacaacaca

SEQ ID NO: 936313 - DNA, 22 bp, Artificial Sequence
  chemically synthesized
tctccatgcctatgtgttgtcc

SEQ ID NO: 936314 - DNA, 22 bp, Artificial Sequence
  chemically synthesized
tagctgcgaagggacaacacat

SEQ ID NO: 936315 - DNA, 22 bp, Artificial Sequence
  chemically synthesized
ctctccatgcctatgtgttgtc

SEQ ID NO: 936316 - DNA, 22 bp, Artificial Sequence
  chemically synthesized
cgaagggacaacacataggcat

SEQ ID NO: 936317 - DNA, 22 bp, Artificial Sequence
  chemically synthesized
caatttctctccatgcctatgt

SEQ ID NO: 936318 - DNA, 22 bp, Artificial Sequence
  chemically synthesized
ccaatttctctccatgcctatg

SEQ ID NO: 936319 - DNA, 22 bp, Artificial Sequence
  chemically synthesized
tccaatttctctccatgcctat

SEQ ID NO: 936320 - DNA, 22 bp, Artificial Sequence
  chemically synthesized
ttccaatttctctccatgccta

SEQ ID NO: 936321 - DNA, 22 bp, Artificial Sequence
  chemically synthesized
tttccaatttctctccatgcct

SEQ ID NO: 936322 - DNA, 22 bp, Artificial Sequence
  chemically synthesized
ttttccaatttctctccatgcc

SEQ ID NO: 936323 - DNA, 22 bp, Artificial Sequence
  chemically synthesized
tttttccaatttctctccatgc

SEQ ID NO: 936324 - DNA, 22 bp, Artificial Sequence
  chemically synthesized
tttttttccaatttctctccat

SEQ ID NO: 936325 - DNA, 22 bp, Artificial Sequence
  chemically synthesized
ctttttttccaatttctctcca

SEQ ID NO: 936326 - DNA, 22 bp, Artificial Sequence
  chemically synthesized
tctttttttccaatttctctcc

SEQ ID NO: 936327 - DNA, 22 bp, Artificial Sequence
  chemically synthesized
ttttctttttttccaatttctc

SEQ ID NO: 936328 - DNA, 22 bp, Artificial Sequence
  chemically synthesized
acgttattttctttttttccaa

SEQ ID NO: 936329 - DNA, 22 bp, Artificial Sequence
  chemically synthesized
attcacgttattttcttttttt

SEQ ID NO: 936330 - DNA, 22 bp, Artificial Sequence
  chemically synthesized
taattcacgttattttcttttt

SEQ ID NO: 936331 - DNA, 22 bp, Artificial Sequence
  chemically synthesized
gaaaaaaagaaaataacgtgaa

SEQ ID NO: 936332 - DNA, 22 bp, Artificial Sequence
  chemically synthesized
gcagaattctaattcacgttat

SEQ ID NO: 936333 - DNA, 22 bp, Artificial Sequence
  chemically synthesized
ttggcagaattctaattcacgt

SEQ ID NO: 936334 - DNA, 22 bp, Artificial Sequence
  chemically synthesized
atactattggcagaattctaat

SEQ ID NO: 936335 - DNA, 22 bp, Artificial Sequence
  chemically synthesized
gcactaatactattggcagaat

SEQ ID NO: 936336 - DNA, 22 bp, Artificial Sequence
  chemically synthesized
cattagcactaatactattggc

SEQ ID NO: 936337 - DNA, 22 bp, Artificial Sequence
  chemically synthesized
attacattagcactaatactat

SEQ ID NO: 936338 - DNA, 22 bp, Artificial Sequence
  chemically synthesized
gaattctgccaatagtattagt

SEQ ID NO: 936339 - DNA, 22 bp, Artificial Sequence
  chemically synthesized
tgccaatagtattagtgctaat

SEQ ID NO: 936340 - DNA, 22 bp, Artificial Sequence
  chemically synthesized
ccaatagtattagtgctaatgt

SEQ ID NO: 936341 - DNA, 22 bp, Artificial Sequence
  chemically synthesized
tgtcatgttgattacattagca

SEQ ID NO: 936342 - DNA, 22 bp, Artificial Sequence
  chemically synthesized
atgtcatgttgattacattagc

SEQ ID NO: 936343 - DNA, 22 bp, Artificial Sequence
  chemically synthesized
atacttatgtcatgttgattac

SEQ ID NO: 936344 - DNA, 22 bp, Artificial Sequence
  chemically synthesized
gtgctaatgtaatcaacatgac

SEQ ID NO: 936345 - DNA, 22 bp, Artificial Sequence
  chemically synthesized
aaagattcatacttatgtcatg

SEQ ID NO: 936346 - DNA, 22 bp, Artificial Sequence
  chemically synthesized
caaagattcatacttatgtcat

SEQ ID NO: 936347 - DNA, 22 bp, Artificial Sequence
  chemically synthesized
atgtaatcaacatgacataagt

SEQ ID NO: 936348 - DNA, 22 bp, Artificial Sequence
  chemically synthesized
gtatttcaaagattcatactta

SEQ ID NO: 936349 - DNA, 22 bp, Artificial Sequence
  chemically synthesized
ggtatttcaaagattcatactt

SEQ ID NO: 936350 - DNA, 22 bp, Artificial Sequence
  chemically synthesized
tggtatttcaaagattcatact

SEQ ID NO: 936351 - DNA, 22 bp, Artificial Sequence
  chemically synthesized
gaagttttggtatttcaaagat

SEQ ID NO: 936352 - DNA, 22 bp, Artificial Sequence
  chemically synthesized
ctcgaagttttggtatttcaaa

SEQ ID NO: 936353 - DNA, 22 bp, Artificial Sequence
  chemically synthesized
cctactcgaagttttggtattt

SEQ ID NO: 936354 - DNA, 22 bp, Artificial Sequence
  chemically synthesized
acctactcgaagttttggtatt

SEQ ID NO: 936355 - DNA, 22 bp, Artificial Sequence
  chemically synthesized
tacctactcgaagttttggtat

SEQ ID NO: 936356 - DNA, 22 bp, Artificial Sequence
  chemically synthesized
tgaaataccaaaacttcgagta

SEQ ID NO: 936357 - DNA, 22 bp, Artificial Sequence
  chemically synthesized
gaaataccaaaacttcgagtag

SEQ ID NO: 936358 - DNA, 22 bp, Artificial Sequence
  chemically synthesized
aaataccaaaacttcgagtagg

SEQ ID NO: 936359 - DNA, 22 bp, Artificial Sequence
  chemically synthesized
agaaccactttacctactcgaa

SEQ ID NO: 936360 - DNA, 22 bp, Artificial Sequence
  chemically synthesized
ttgagaaccactttacctactc

SEQ ID NO: 936361 - DNA, 22 bp, Artificial Sequence
  chemically synthesized
cgagtaggtaaagtggttctca

SEQ ID NO: 936362 - DNA, 22 bp, Artificial Sequence
  chemically synthesized
gagtaggtaaagtggttctcaa

SEQ ID NO: 936363 - DNA, 22 bp, Artificial Sequence
  chemically synthesized
agaagaaagatattgttgagaa

SEQ ID NO: 936364 - DNA, 22 bp, Artificial Sequence
  chemically synthesized
ccctgagaagaaagatattgtt

SEQ ID NO: 936365 - DNA, 22 bp, Artificial Sequence
  chemically synthesized
tgattaccctgagaagaaagat

SEQ ID NO: 936366 - DNA, 22 bp, Artificial Sequence
  chemically synthesized
tcaacaatatctttcttctcag

SEQ ID NO: 936367 - DNA, 22 bp, Artificial Sequence
  chemically synthesized
actatgattaccctgagaagaa

SEQ ID NO: 936368 - DNA, 22 bp, Artificial Sequence
  chemically synthesized
aacaatatctttcttctcaggg

SEQ ID NO: 936369 - DNA, 22 bp, Artificial Sequence
  chemically synthesized
atattcactatgattaccctga

SEQ ID NO: 936370 - DNA, 22 bp, Artificial Sequence
  chemically synthesized
tcttctcagggtaatcatagtg

SEQ ID NO: 936371 - DNA, 22 bp, Artificial Sequence
  chemically synthesized
cttctcagggtaatcatagtga

SEQ ID NO: 936372 - DNA, 22 bp, Artificial Sequence
  chemically synthesized
ttctcagggtaatcatagtgaa

SEQ ID NO: 936373 - DNA, 22 bp, Artificial Sequence
  chemically synthesized
ctcagggtaatcatagtgaata

SEQ ID NO: 936374 - DNA, 22 bp, Artificial Sequence
  chemically synthesized
tcagggtaatcatagtgaatat

SEQ ID NO: 936375 - DNA, 22 bp, Artificial Sequence
  chemically synthesized
tcgatgtatcctcatattcact

SEQ ID NO: 936376 - DNA, 22 bp, Artificial Sequence
  chemically synthesized
agggtaatcatagtgaatatga

SEQ ID NO: 936377 - DNA, 22 bp, Artificial Sequence
  chemically synthesized
cctgtcgatgtatcctcatatt

SEQ ID NO: 936378 - DNA, 22 bp, Artificial Sequence
  chemically synthesized
ccctgtcgatgtatcctcatat

SEQ ID NO: 936379 - DNA, 22 bp, Artificial Sequence
  chemically synthesized
tccctgtcgatgtatcctcata

SEQ ID NO: 936380 - DNA, 22 bp, Artificial Sequence
  chemically synthesized
ttccctgtcgatgtatcctcat

SEQ ID NO: 936381 - DNA, 22 bp, Artificial Sequence
  chemically synthesized
ttttccctgtcgatgtatcctc

SEQ ID NO: 936382 - DNA, 22 bp, Artificial Sequence
  chemically synthesized
ttcttttccctgtcgatgtatc

SEQ ID NO: 936383 - DNA, 22 bp, Artificial Sequence
  chemically synthesized
ctgttcttttccctgtcgatgt

SEQ ID NO: 936384 - DNA, 22 bp, Artificial Sequence
  chemically synthesized
cctactgttcttttccctgtcg

SEQ ID NO: 936385 - DNA, 22 bp, Artificial Sequence
  chemically synthesized
aaattacctactgttcttttcc

SEQ ID NO: 936386 - DNA, 22 bp, Artificial Sequence
  chemically synthesized
cctcaaattacctactgttctt

SEQ ID NO: 936387 - DNA, 22 bp, Artificial Sequence
  chemically synthesized
caaaattccctcaaattaccta

SEQ ID NO: 936388 - DNA, 22 bp, Artificial Sequence
  chemically synthesized
gtgctgcaaaattccctcaaat

SEQ ID NO: 936389 - DNA, 22 bp, Artificial Sequence
  chemically synthesized
aattagtgctgcaaaattccct

SEQ ID NO: 936390 - DNA, 22 bp, Artificial Sequence
  chemically synthesized
gagactaaattagtgctgcaaa

SEQ ID NO: 936391 - DNA, 22 bp, Artificial Sequence
  chemically synthesized
ggagactaaattagtgctgcaa

SEQ ID NO: 936392 - DNA, 22 bp, Artificial Sequence
  chemically synthesized
gagggaattttgcagcactaat

SEQ ID NO: 936393 - DNA, 22 bp, Artificial Sequence
  chemically synthesized
agggaattttgcagcactaatt

SEQ ID NO: 936394 - DNA, 22 bp, Artificial Sequence
  chemically synthesized
tgcagcactaatttagtctcca

SEQ ID NO: 936395 - DNA, 22 bp, Artificial Sequence
  chemically synthesized
gcagcactaatttagtctccaa

SEQ ID NO: 936396 - DNA, 22 bp, Artificial Sequence
  chemically synthesized
aataatcagtgtttggagacta

SEQ ID NO: 936397 - DNA, 22 bp, Artificial Sequence
  chemically synthesized
cagcactaatttagtctccaaa

SEQ ID NO: 936398 - DNA, 22 bp, Artificial Sequence
  chemically synthesized
atttagtctccaaacactgatt

SEQ ID NO: 936399 - DNA, 22 bp, Artificial Sequence
  chemically synthesized
agtctccaaacactgattattc

SEQ ID NO: 936400 - DNA, 22 bp, Artificial Sequence
  chemically synthesized
gtctccaaacactgattattca

SEQ ID NO: 936401 - DNA, 22 bp, Artificial Sequence
  chemically synthesized
gaataatgaccactgaataatc

SEQ ID NO: 936402 - DNA, 22 bp, Artificial Sequence
  chemically synthesized
ggaataatgaccactgaataat

SEQ ID NO: 936403 - DNA, 22 bp, Artificial Sequence
  chemically synthesized
caaacactgattattcagtggt

SEQ ID NO: 936404 - DNA, 22 bp, Artificial Sequence
  chemically synthesized
gcagtttggaataatgaccact

SEQ ID NO: 936405 - DNA, 22 bp, Artificial Sequence
  chemically synthesized
attattcagtggtcattattcc

SEQ ID NO: 936406 - DNA, 22 bp, Artificial Sequence
  chemically synthesized
tccctcgcagtttggaataatg

SEQ ID NO: 936407 - DNA, 22 bp, Artificial Sequence
  chemically synthesized
ttcagtggtcattattccaaac

SEQ ID NO: 936408 - DNA, 22 bp, Artificial Sequence
  chemically synthesized
ctgtccctcgcagtttggaata

SEQ ID NO: 936409 - DNA, 22 bp, Artificial Sequence
  chemically synthesized
agtggtcattattccaaactgc

SEQ ID NO: 936410 - DNA, 22 bp, Artificial Sequence
  chemically synthesized
attactgtccctcgcagtttgg

SEQ ID NO: 936411 - DNA, 22 bp, Artificial Sequence
  chemically synthesized
gattcattactgtccctcgcag

SEQ ID NO: 936412 - DNA, 22 bp, Artificial Sequence
  chemically synthesized
ggattcattactgtccctcgca

SEQ ID NO: 936413 - DNA, 22 bp, Artificial Sequence
  chemically synthesized
ttccaaactgcgagggacagta

SEQ ID NO: 936414 - DNA, 22 bp, Artificial Sequence
  chemically synthesized
caaactgcgagggacagtaatg

SEQ ID NO: 936415 - DNA, 22 bp, Artificial Sequence
  chemically synthesized
gaatagtgtttggattcattac

SEQ ID NO: 936416 - DNA, 22 bp, Artificial Sequence
  chemically synthesized
cgaatagtgtttggattcatta

SEQ ID NO: 936417 - DNA, 22 bp, Artificial Sequence
  chemically synthesized
tcgaatagtgtttggattcatt

SEQ ID NO: 936418 - DNA, 22 bp, Artificial Sequence
  chemically synthesized
cgagggacagtaatgaatccaa

SEQ ID NO: 936419 - DNA, 22 bp, Artificial Sequence
  chemically synthesized
cctttcgaatagtgtttggatt

SEQ ID NO: 936420 - DNA, 22 bp, Artificial Sequence
  chemically synthesized
gcctttcgaatagtgtttggat

SEQ ID NO: 936421 - DNA, 22 bp, Artificial Sequence
  chemically synthesized
taatagtttgcctttcgaatag

SEQ ID NO: 936422 - DNA, 22 bp, Artificial Sequence
  chemically synthesized
tgtaatagtttgcctttcgaat

SEQ ID NO: 936423 - DNA, 22 bp, Artificial Sequence
  chemically synthesized
tctgtaatagtttgcctttcga

SEQ ID NO: 936424 - DNA, 22 bp, Artificial Sequence
  chemically synthesized
ttcgaaaggcaaactattacag

SEQ ID NO: 936425 - DNA, 22 bp, Artificial Sequence
  chemically synthesized
gaaaggcaaactattacagaga

SEQ ID NO: 936426 - DNA, 22 bp, Artificial Sequence
  chemically synthesized
ggaagggtgtaacattctctgt

SEQ ID NO: 936427 - DNA, 22 bp, Artificial Sequence
  chemically synthesized
aggaagggtgtaacattctctg

SEQ ID NO: 936428 - DNA, 22 bp, Artificial Sequence
  chemically synthesized
acaacttaggaagggtgtaaca

SEQ ID NO: 936429 - DNA, 22 bp, Artificial Sequence
  chemically synthesized
ttacagagaatgttacaccctt

SEQ ID NO: 936430 - DNA, 22 bp, Artificial Sequence
  chemically synthesized
cagagaatgttacacccttcct

SEQ ID NO: 936431 - DNA, 22 bp, Artificial Sequence
  chemically synthesized
tgccactcacaacttaggaagg

SEQ ID NO: 936432 - DNA, 22 bp, Artificial Sequence
  chemically synthesized
cacccttcctaagttgtgagtg

SEQ ID NO: 936433 - DNA, 22 bp, Artificial Sequence
  chemically synthesized
cataaatctgtgccactcacaa

SEQ ID NO: 936434 - DNA, 22 bp, Artificial Sequence
  chemically synthesized
cctaagttgtgagtggcacaga

SEQ ID NO: 936435 - DNA, 22 bp, Artificial Sequence
  chemically synthesized
ccattacataaatctgtgccac

SEQ ID NO: 936436 - DNA, 22 bp, Artificial Sequence
  chemically synthesized
ctaagttgtgagtggcacagat

SEQ ID NO: 936437 - DNA, 22 bp, Artificial Sequence
  chemically synthesized
agttgtgagtggcacagattta

SEQ ID NO: 936438 - DNA, 22 bp, Artificial Sequence
  chemically synthesized
ccagttgccattacataaatct

SEQ ID NO: 936439 - DNA, 22 bp, Artificial Sequence
  chemically synthesized
tgagtggcacagatttatgtaa

SEQ ID NO: 936440 - DNA, 22 bp, Artificial Sequence
  chemically synthesized
ttcccagttgccattacataaa

SEQ ID NO: 936441 - DNA, 22 bp, Artificial Sequence
  chemically synthesized
gttcccagttgccattacataa

SEQ ID NO: 936442 - DNA, 22 bp, Artificial Sequence
  chemically synthesized
tgttcccagttgccattacata

SEQ ID NO: 936443 - DNA, 22 bp, Artificial Sequence
  chemically synthesized
ttgttcccagttgccattacat

SEQ ID NO: 936444 - DNA, 22 bp, Artificial Sequence
  chemically synthesized
tttttgttcccagttgccatta

SEQ ID NO: 936445 - DNA, 22 bp, Artificial Sequence
  chemically synthesized
gctgtttttgttcccagttgcc

SEQ ID NO: 936446 - DNA, 22 bp, Artificial Sequence
  chemically synthesized
ggctgtttttgttcccagttgc

SEQ ID NO: 936447 - DNA, 22 bp, Artificial Sequence
  chemically synthesized
atgtaatggcaactgggaacaa

SEQ ID NO: 936448 - DNA, 22 bp, Artificial Sequence
  chemically synthesized
tgtaatggcaactgggaacaaa

SEQ ID NO: 936449 - DNA, 22 bp, Artificial Sequence
  chemically synthesized
accttggctgtttttgttccca

SEQ ID NO: 936450 - DNA, 22 bp, Artificial Sequence
  chemically synthesized
cactgaccttggctgtttttgt

SEQ ID NO: 936451 - DNA, 22 bp, Artificial Sequence
  chemically synthesized
ccactgaccttggctgtttttg

SEQ ID NO: 936452 - DNA, 22 bp, Artificial Sequence
  chemically synthesized
ggtttccactgaccttggctgt

SEQ ID NO: 936453 - DNA, 22 bp, Artificial Sequence
  chemically synthesized
ggaacaaaaacagccaaggtca

SEQ ID NO: 936454 - DNA, 22 bp, Artificial Sequence
  chemically synthesized
caattaggtttccactgacctt

SEQ ID NO: 936455 - DNA, 22 bp, Artificial Sequence
  chemically synthesized
gataaagtactacaattaggtt

SEQ ID NO: 936456 - DNA, 22 bp, Artificial Sequence
  chemically synthesized
aactagataaagtactacaatt

SEQ ID NO: 936457 - DNA, 22 bp, Artificial Sequence
  chemically synthesized
ttcaactagataaagtactaca

SEQ ID NO: 936458 - DNA, 22 bp, Artificial Sequence
  chemically synthesized
attcaactagataaagtactac

SEQ ID NO: 936459 - DNA, 22 bp, Artificial Sequence
  chemically synthesized
tattcaactagataaagtacta

SEQ ID NO: 936460 - DNA, 22 bp, Artificial Sequence
  chemically synthesized
ttattcaactagataaagtact

SEQ ID NO: 936461 - DNA, 22 bp, Artificial Sequence
  chemically synthesized
attgtagtactttatctagttg

SEQ ID NO: 936462 - DNA, 22 bp, Artificial Sequence
  chemically synthesized
tagtactttatctagttgaata

SEQ ID NO: 936463 - DNA, 22 bp, Artificial Sequence
  chemically synthesized
aaaaaatgtggatttttattca

SEQ ID NO: 936464 - DNA, 22 bp, Artificial Sequence
  chemically synthesized
tatctagttgaataaaaatcca

SEQ ID NO: 936465 - DNA, 22 bp, Artificial Sequence
  chemically synthesized
atctagttgaataaaaatccac

SEQ ID NO: 936466 - DNA, 22 bp, Artificial Sequence
  chemically synthesized
tctagttgaataaaaatccaca

SEQ ID NO: 936467 - DNA, 22 bp, Artificial Sequence
  chemically synthesized
agtgctaaaaaaatgtggattt

SEQ ID NO: 936468 - DNA, 22 bp, Artificial Sequence
  chemically synthesized
gttgaataaaaatccacatttt

SEQ ID NO: 936469 - DNA, 22 bp, Artificial Sequence
  chemically synthesized
aataaaaatccacattttttta

SEQ ID NO: 936470 - DNA, 22 bp, Artificial Sequence
  chemically synthesized
aaaattcagtgctaaaaaaatg

SEQ ID NO: 936471 - DNA, 22 bp, Artificial Sequence
  chemically synthesized
ctgaaaattcagtgctaaaaaa

SEQ ID NO: 936472 - DNA, 22 bp, Artificial Sequence
  chemically synthesized
aattactgaaaattcagtgcta

SEQ ID NO: 936473 - DNA, 22 bp, Artificial Sequence
  chemically synthesized
caattactgaaaattcagtgct

SEQ ID NO: 936474 - DNA, 22 bp, Artificial Sequence
  chemically synthesized
tcaattactgaaaattcagtgc

SEQ ID NO: 936475 - DNA, 22 bp, Artificial Sequence
  chemically synthesized
ttttcaattactgaaaattcag

SEQ ID NO: 936476 - DNA, 22 bp, Artificial Sequence
  chemically synthesized
gttttcaattactgaaaattca

SEQ ID NO: 936477 - DNA, 22 bp, Artificial Sequence
  chemically synthesized
tgttttcaattactgaaaattc

SEQ ID NO: 936478 - DNA, 22 bp, Artificial Sequence
  chemically synthesized
ttgttttcaattactgaaaatt

SEQ ID NO: 936479 - DNA, 22 bp, Artificial Sequence
  chemically synthesized
ttttagcactgaattttcagta

SEQ ID NO: 936480 - DNA, 22 bp, Artificial Sequence
  chemically synthesized
tttgttttcaattactgaaaat

SEQ ID NO: 936481 - DNA, 22 bp, Artificial Sequence
  chemically synthesized
tttagcactgaattttcagtaa

SEQ ID NO: 936482 - DNA, 22 bp, Artificial Sequence
  chemically synthesized
ttttgttttcaattactgaaaa

SEQ ID NO: 936483 - DNA, 22 bp, Artificial Sequence
  chemically synthesized
ttagcactgaattttcagtaat

SEQ ID NO: 936484 - DNA, 22 bp, Artificial Sequence
  chemically synthesized
tttttgttttcaattactgaaa

SEQ ID NO: 936485 - DNA, 22 bp, Artificial Sequence
  chemically synthesized
tagcactgaattttcagtaatt

SEQ ID NO: 936486 - DNA, 22 bp, Artificial Sequence
  chemically synthesized
agcactgaattttcagtaattg

SEQ ID NO: 936487 - DNA, 22 bp, Artificial Sequence
  chemically synthesized
gcactgaattttcagtaattga

SEQ ID NO: 936488 - DNA, 22 bp, Artificial Sequence
  chemically synthesized
aattttcagtaattgaaaacaa

SEQ ID NO: 936489 - DNA, 22 bp, Artificial Sequence
  chemically synthesized
aagccccactttttttgttttc

SEQ ID NO: 936490 - DNA, 22 bp, Artificial Sequence
  chemically synthesized
tcagtaattgaaaacaaaaaaa

SEQ ID NO: 936491 - DNA, 22 bp, Artificial Sequence
  chemically synthesized
cagtaattgaaaacaaaaaaag

SEQ ID NO: 936492 - DNA, 22 bp, Artificial Sequence
  chemically synthesized
agtaattgaaaacaaaaaaagt

SEQ ID NO: 936493 - DNA, 22 bp, Artificial Sequence
  chemically synthesized
atataaaattgaagccccactt

SEQ ID NO: 936494 - DNA, 22 bp, Artificial Sequence
  chemically synthesized
aaaacaaaaaaagtggggcttc

SEQ ID NO: 936495 - DNA, 22 bp, Artificial Sequence
  chemically synthesized
tcatagctgatataaaattgaa

SEQ ID NO: 936496 - DNA, 22 bp, Artificial Sequence
  chemically synthesized
atcatagctgatataaaattga

SEQ ID NO: 936497 - DNA, 22 bp, Artificial Sequence
  chemically synthesized
tatcatagctgatataaaattg

SEQ ID NO: 936498 - DNA, 22 bp, Artificial Sequence
  chemically synthesized
ttatcatagctgatataaaatt

SEQ ID NO: 936499 - DNA, 22 bp, Artificial Sequence
  chemically synthesized
tcttttatcatagctgatataa

SEQ ID NO: 936500 - DNA, 22 bp, Artificial Sequence
  chemically synthesized
ctgtcttttatcatagctgata

SEQ ID NO: 936501 - DNA, 22 bp, Artificial Sequence
  chemically synthesized
caattttatatcagctatgata

SEQ ID NO: 936502 - DNA, 22 bp, Artificial Sequence
  chemically synthesized
aattttatatcagctatgataa

SEQ ID NO: 936503 - DNA, 22 bp, Artificial Sequence
  chemically synthesized
agttactgtcttttatcatagc

SEQ ID NO: 936504 - DNA, 22 bp, Artificial Sequence
  chemically synthesized
gagttactgtcttttatcatag

SEQ ID NO: 936505 - DNA, 22 bp, Artificial Sequence
  chemically synthesized
tgagttactgtcttttatcata

SEQ ID NO: 936506 - DNA, 22 bp, Artificial Sequence
  chemically synthesized
tatatcagctatgataaaagac

SEQ ID NO: 936507 - DNA, 22 bp, Artificial Sequence
  chemically synthesized
atatcagctatgataaaagaca

SEQ ID NO: 936508 - DNA, 22 bp, Artificial Sequence
  chemically synthesized
tatcagctatgataaaagacag

SEQ ID NO: 936509 - DNA, 22 bp, Artificial Sequence
  chemically synthesized
tgataaaagacagtaactcaaa

SEQ ID NO: 936510 - DNA, 22 bp, Artificial Sequence
  chemically synthesized
aggtatcaagcctttgagttac

SEQ ID NO: 936511 - DNA, 22 bp, Artificial Sequence
  chemically synthesized
aaggtatcaagcctttgagtta

SEQ ID NO: 936512 - DNA, 22 bp, Artificial Sequence
  chemically synthesized
aagtttaaggtatcaagccttt

SEQ ID NO: 936513 - DNA, 22 bp, Artificial Sequence
  chemically synthesized
aaaggcttgataccttaaactt

SEQ ID NO: 936514 - DNA, 22 bp, Artificial Sequence
  chemically synthesized
gataccttaaacttcagggttg

SEQ ID NO: 936515 - DNA, 22 bp, Artificial Sequence
  chemically synthesized
ataccttaaacttcagggttgt

SEQ ID NO: 936516 - DNA, 22 bp, Artificial Sequence
  chemically synthesized
caatgaacaggaaacaaccctg

SEQ ID NO: 936517 - DNA, 22 bp, Artificial Sequence
  chemically synthesized
aaacttcagggttgtttcctgt

SEQ ID NO: 936518 - DNA, 22 bp, Artificial Sequence
  chemically synthesized
aacttcagggttgtttcctgtt

SEQ ID NO: 936519 - DNA, 22 bp, Artificial Sequence
  chemically synthesized
aggatattacaatgaacaggaa

SEQ ID NO: 936520 - DNA, 22 bp, Artificial Sequence
  chemically synthesized
cagggttgtttcctgttcattg

SEQ ID NO: 936521 - DNA, 22 bp, Artificial Sequence
  chemically synthesized
agggttgtttcctgttcattgt

SEQ ID NO: 936522 - DNA, 22 bp, Artificial Sequence
  chemically synthesized
cgtaaggctgaggatattacaa

SEQ ID NO: 936523 - DNA, 22 bp, Artificial Sequence
  chemically synthesized
tttcctgttcattgtaatatcc

SEQ ID NO: 936524 - DNA, 22 bp, Artificial Sequence
  chemically synthesized
cctgttcattgtaatatcctca

SEQ ID NO: 936525 - DNA, 22 bp, Artificial Sequence
  chemically synthesized
ctgttcattgtaatatcctcag

SEQ ID NO: 936526 - DNA, 22 bp, Artificial Sequence
  chemically synthesized
ttcattgtaatatcctcagcct

SEQ ID NO: 936527 - DNA, 22 bp, Artificial Sequence
  chemically synthesized
caacgctacgtaaggctgagga

SEQ ID NO: 936528 - DNA, 22 bp, Artificial Sequence
  chemically synthesized
attgtaatatcctcagccttac

SEQ ID NO: 936529 - DNA, 22 bp, Artificial Sequence
  chemically synthesized
taatatcctcagccttacgtag

SEQ ID NO: 936530 - DNA, 22 bp, Artificial Sequence
  chemically synthesized
tatgcctgcaacgctacgtaag

SEQ ID NO: 936531 - DNA, 22 bp, Artificial Sequence
  chemically synthesized
agccttacgtagcgttgcaggc

SEQ ID NO: 936532 - DNA, 22 bp, Artificial Sequence
  chemically synthesized
gaccggttatatgcctgcaacg

SEQ ID NO: 936533 - DNA, 22 bp, Artificial Sequence
  chemically synthesized
ggaccggttatatgcctgcaac

SEQ ID NO: 936534 - DNA, 22 bp, Artificial Sequence
  chemically synthesized
tggaccggttatatgcctgcaa

SEQ ID NO: 936535 - DNA, 22 bp, Artificial Sequence
  chemically synthesized
ttttggaccggttatatgcctg

SEQ ID NO: 936536 - DNA, 22 bp, Artificial Sequence
  chemically synthesized
acgtagcgttgcaggcatataa

SEQ ID NO: 936537 - DNA, 22 bp, Artificial Sequence
  chemically synthesized
cgtagcgttgcaggcatataac

SEQ ID NO: 936538 - DNA, 22 bp, Artificial Sequence
  chemically synthesized
ttgttttggaccggttatatgc

SEQ ID NO: 936539 - DNA, 22 bp, Artificial Sequence
  chemically synthesized
attgttttggaccggttatatg

SEQ ID NO: 936540 - DNA, 22 bp, Artificial Sequence
  chemically synthesized
tattgttttggaccggttatat

SEQ ID NO: 936541 - DNA, 22 bp, Artificial Sequence
  chemically synthesized
ttattgttttggaccggttata

SEQ ID NO: 936542 - DNA, 22 bp, Artificial Sequence
  chemically synthesized
caggcatataaccggtccaaaa

SEQ ID NO: 936543 - DNA, 22 bp, Artificial Sequence
  chemically synthesized
aacatggtttttattgttttgg

SEQ ID NO: 936544 - DNA, 22 bp, Artificial Sequence
  chemically synthesized
attcaacatggtttttattgtt

SEQ ID NO: 936545 - DNA, 22 bp, Artificial Sequence
  chemically synthesized
attaattcaacatggtttttat

SEQ ID NO: 936546 - DNA, 22 bp, Artificial Sequence
  chemically synthesized
actaattaattcaacatggttt

SEQ ID NO: 936547 - DNA, 22 bp, Artificial Sequence
  chemically synthesized
actcactaattaattcaacatg

SEQ ID NO: 936548 - DNA, 22 bp, Artificial Sequence
  chemically synthesized
actcactcactaattaattcaa

SEQ ID NO: 936549 - DNA, 22 bp, Artificial Sequence
  chemically synthesized
ttcactcactcactaattaatt

SEQ ID NO: 936550 - DNA, 22 bp, Artificial Sequence
  chemically synthesized
attgttcactcactcactaatt

SEQ ID NO: 936551 - DNA, 22 bp, Artificial Sequence
  chemically synthesized
cattcattgttcactcactcac

SEQ ID NO: 936552 - DNA, 22 bp, Artificial Sequence
  chemically synthesized
tacattcattgttcactcactc

SEQ ID NO: 936553 - DNA, 22 bp, Artificial Sequence
  chemically synthesized
aattaattagtgagtgagtgaa

SEQ ID NO: 936554 - DNA, 22 bp, Artificial Sequence
  chemically synthesized
ctacattcattgttcactcact

SEQ ID NO: 936555 - DNA, 22 bp, Artificial Sequence
  chemically synthesized
cttctacattcattgttcactc

SEQ ID NO: 936556 - DNA, 22 bp, Artificial Sequence
  chemically synthesized
attagtgagtgagtgaacaatg

SEQ ID NO: 936557 - DNA, 22 bp, Artificial Sequence
  chemically synthesized
tctacttctacattcattgttc

SEQ ID NO: 936558 - DNA, 22 bp, Artificial Sequence
  chemically synthesized
gtgagtgagtgaacaatgaatg

SEQ ID NO: 936559 - DNA, 22 bp, Artificial Sequence
  chemically synthesized
ttatctacttctacattcattg

SEQ ID NO: 936560 - DNA, 22 bp, Artificial Sequence
  chemically synthesized
attatctacttctacattcatt

SEQ ID NO: 936561 - DNA, 22 bp, Artificial Sequence
  chemically synthesized
gcttattatctacttctacatt

SEQ ID NO: 936562 - DNA, 22 bp, Artificial Sequence
  chemically synthesized
tcctggcttattatctacttct

SEQ ID NO: 936563 - DNA, 22 bp, Artificial Sequence
  chemically synthesized
ttatcctggcttattatctact

SEQ ID NO: 936564 - DNA, 22 bp, Artificial Sequence
  chemically synthesized
attatcctggcttattatctac

SEQ ID NO: 936565 - DNA, 22 bp, Artificial Sequence
  chemically synthesized
atcacttattatcctggcttat

SEQ ID NO: 936566 - DNA, 22 bp, Artificial Sequence
  chemically synthesized
acacagttcatcacttattatc

SEQ ID NO: 936567 - DNA, 22 bp, Artificial Sequence
  chemically synthesized
tgacacagttcatcacttatta

SEQ ID NO: 936568 - DNA, 22 bp, Artificial Sequence
  chemically synthesized
gttctgacacagttcatcactt

SEQ ID NO: 936569 - DNA, 22 bp, Artificial Sequence
  chemically synthesized
ggttctgacacagttcatcact

SEQ ID NO: 936570 - DNA, 22 bp, Artificial Sequence
  chemically synthesized
atcttggttctgacacagttca

SEQ ID NO: 936571 - DNA, 22 bp, Artificial Sequence
  chemically synthesized
ttgatcttggttctgacacagt

SEQ ID NO: 936572 - DNA, 22 bp, Artificial Sequence
  chemically synthesized
ttgttgatcttggttctgacac

SEQ ID NO: 936573 - DNA, 22 bp, Artificial Sequence
  chemically synthesized
gttgttgatcttggttctgaca

SEQ ID NO: 936574 - DNA, 22 bp, Artificial Sequence
  chemically synthesized
ttgttgttgatcttggttctga

SEQ ID NO: 936575 - DNA, 22 bp, Artificial Sequence
  chemically synthesized
cttgttgttgatcttggttctg

SEQ ID NO: 936576 - DNA, 22 bp, Artificial Sequence
  chemically synthesized
gtggtttcttgttgttgatctt

SEQ ID NO: 936577 - DNA, 22 bp, Artificial Sequence
  chemically synthesized
tgtcagaaccaagatcaacaac

SEQ ID NO: 936578 - DNA, 22 bp, Artificial Sequence
  chemically synthesized
ggttggtggtttcttgttgttg

SEQ ID NO: 936579 - DNA, 22 bp, Artificial Sequence
  chemically synthesized
gtgtagttaggttggtggtttc

SEQ ID NO: 936580 - DNA, 22 bp, Artificial Sequence
  chemically synthesized
cattggtgtagttaggttggtg

SEQ ID NO: 936581 - DNA, 22 bp, Artificial Sequence
  chemically synthesized
ccatagatgacatcattgcatt

SEQ ID NO: 936582 - DNA, 22 bp, Artificial Sequence
  chemically synthesized
cccatagatgacatcattgcat

SEQ ID NO: 936583 - DNA, 22 bp, Artificial Sequence
  chemically synthesized
actacaccaatgcaatgatgtc

SEQ ID NO: 936584 - DNA, 22 bp, Artificial Sequence
  chemically synthesized
ccttcccatagatgacatcatt

SEQ ID NO: 936585 - DNA, 22 bp, Artificial Sequence
  chemically synthesized
cccttcccatagatgacatcat

SEQ ID NO: 936586 - DNA, 22 bp, Artificial Sequence
  chemically synthesized
caccaatgcaatgatgtcatct

SEQ ID NO: 936587 - DNA, 22 bp, Artificial Sequence
  chemically synthesized
ttcccttcccatagatgacatc

SEQ ID NO: 936588 - DNA, 22 bp, Artificial Sequence
  chemically synthesized
ctcttcccttcccatagatgac

SEQ ID NO: 936589 - DNA, 22 bp, Artificial Sequence
  chemically synthesized
cctcttcccttcccatagatga

SEQ ID NO: 936590 - DNA, 22 bp, Artificial Sequence
  chemically synthesized
tcctcttcccttcccatagatg

SEQ ID NO: 936591 - DNA, 22 bp, Artificial Sequence
  chemically synthesized
ccctttcctcttcccttcccat

SEQ ID NO: 936592 - DNA, 22 bp, Artificial Sequence
  chemically synthesized
tgggaagggaagaggaaagggc

SEQ ID NO: 936593 - DNA, 22 bp, Artificial Sequence
  chemically synthesized
atgaaagcatactgccctttcc

SEQ ID NO: 936594 - DNA, 22 bp, Artificial Sequence
  chemically synthesized
atattcatgaaagcatactgcc

SEQ ID NO: 936595 - DNA, 22 bp, Artificial Sequence
  chemically synthesized
taaatgattaatattcatgaaa

SEQ ID NO: 936596 - DNA, 22 bp, Artificial Sequence
  chemically synthesized
cacgttataaatgattaatatt

SEQ ID NO: 936597 - DNA, 22 bp, Artificial Sequence
  chemically synthesized
acacgttataaatgattaatat

SEQ ID NO: 936598 - DNA, 22 bp, Artificial Sequence
  chemically synthesized
tcatgaatattaatcatttata

SEQ ID NO: 936599 - DNA, 22 bp, Artificial Sequence
  chemically synthesized
catgaatattaatcatttataa

SEQ ID NO: 936600 - DNA, 22 bp, Artificial Sequence
  chemically synthesized
atgaatattaatcatttataac

SEQ ID NO: 936601 - DNA, 22 bp, Artificial Sequence
  chemically synthesized
atcatttataacgtgtaaactg

SEQ ID NO: 936602 - DNA, 22 bp, Artificial Sequence
  chemically synthesized
tggaatggaagatatacagttt

SEQ ID NO: 936603 - DNA, 22 bp, Artificial Sequence
  chemically synthesized
ataacgtgtaaactgtatatct

SEQ ID NO: 936604 - DNA, 22 bp, Artificial Sequence
  chemically synthesized
taacgtgtaaactgtatatctt

SEQ ID NO: 936605 - DNA, 22 bp, Artificial Sequence
  chemically synthesized
aacccacattgtggaatggaag

SEQ ID NO: 936606 - DNA, 22 bp, Artificial Sequence
  chemically synthesized
tatatcttccattccacaatgt

SEQ ID NO: 936607 - DNA, 22 bp, Artificial Sequence
  chemically synthesized
aaaagagctgaacccacattgt

SEQ ID NO: 936608 - DNA, 22 bp, Artificial Sequence
  chemically synthesized
attgaaaagagctgaacccaca

SEQ ID NO: 936609 - DNA, 22 bp, Artificial Sequence
  chemically synthesized
ccattccacaatgtgggttcag

SEQ ID NO: 936610 - DNA, 22 bp, Artificial Sequence
  chemically synthesized
aattgaaaagagctgaacccac

SEQ ID NO: 936611 - DNA, 22 bp, Artificial Sequence
  chemically synthesized
cattccacaatgtgggttcagc

SEQ ID NO: 936612 - DNA, 22 bp, Artificial Sequence
  chemically synthesized
cacaatgtgggttcagctcttt

SEQ ID NO: 936613 - DNA, 22 bp, Artificial Sequence
  chemically synthesized
agctcttttcaattaagctttt

SEQ ID NO: 936614 - DNA, 22 bp, Artificial Sequence
  chemically synthesized
tatgggcaaaaagaaaaagctt

SEQ ID NO: 936615 - DNA, 22 bp, Artificial Sequence
  chemically synthesized
ttttcaattaagctttttcttt

SEQ ID NO: 936616 - DNA, 22 bp, Artificial Sequence
  chemically synthesized
ttcaattaagctttttcttttt

SEQ ID NO: 936617 - DNA, 22 bp, Artificial Sequence
  chemically synthesized
tcaattaagctttttctttttg

SEQ ID NO: 936618 - DNA, 22 bp, Artificial Sequence
  chemically synthesized
caattaagctttttctttttgc

SEQ ID NO: 936619 - DNA, 22 bp, Artificial Sequence
  chemically synthesized
aattaagctttttctttttgcc

SEQ ID NO: 936620 - DNA, 22 bp, Artificial Sequence
  chemically synthesized
gatcattatatgggcaaaaaga

SEQ ID NO: 936621 - DNA, 22 bp, Artificial Sequence
  chemically synthesized
attggatcattatatgggcaaa

SEQ ID NO: 936622 - DNA, 22 bp, Artificial Sequence
  chemically synthesized
agctttttctttttgcccatat

SEQ ID NO: 936623 - DNA, 22 bp, Artificial Sequence
  chemically synthesized
tgattggatcattatatgggca

SEQ ID NO: 936624 - DNA, 22 bp, Artificial Sequence
  chemically synthesized
ctgattggatcattatatgggc

SEQ ID NO: 936625 - DNA, 22 bp, Artificial Sequence
  chemically synthesized
ttctgattggatcattatatgg

SEQ ID NO: 936626 - DNA, 22 bp, Artificial Sequence
  chemically synthesized
tttctttttgcccatataatga

SEQ ID NO: 936627 - DNA, 22 bp, Artificial Sequence
  chemically synthesized
ttctttttgcccatataatgat

SEQ ID NO: 936628 - DNA, 22 bp, Artificial Sequence
  chemically synthesized
tctttttgcccatataatgatc

SEQ ID NO: 936629 - DNA, 22 bp, Artificial Sequence
  chemically synthesized
ctttttgcccatataatgatcc

SEQ ID NO: 936630 - DNA, 22 bp, Artificial Sequence
  chemically synthesized
tttttgcccatataatgatcca

SEQ ID NO: 936631 - DNA, 22 bp, Artificial Sequence
  chemically synthesized
aggttcttctgattggatcatt

SEQ ID NO: 936632 - DNA, 22 bp, Artificial Sequence
  chemically synthesized
tttgcccatataatgatccaat

SEQ ID NO: 936633 - DNA, 22 bp, Artificial Sequence
  chemically synthesized
ttgcccatataatgatccaatc

SEQ ID NO: 936634 - DNA, 22 bp, Artificial Sequence
  chemically synthesized
tgcccatataatgatccaatca

SEQ ID NO: 936635 - DNA, 22 bp, Artificial Sequence
  chemically synthesized
gcccatataatgatccaatcag

SEQ ID NO: 936636 - DNA, 22 bp, Artificial Sequence
  chemically synthesized
actaaggttcttctgattggat

SEQ ID NO: 936637 - DNA, 22 bp, Artificial Sequence
  chemically synthesized
cccatataatgatccaatcaga

SEQ ID NO: 936638 - DNA, 22 bp, Artificial Sequence
  chemically synthesized
gactaaggttcttctgattgga

SEQ ID NO: 936639 - DNA, 22 bp, Artificial Sequence
  chemically synthesized
cagcagcacttgactaaggttc

SEQ ID NO: 936640 - DNA, 22 bp, Artificial Sequence
  chemically synthesized
gcagcagcacttgactaaggtt

SEQ ID NO: 936641 - DNA, 22 bp, Artificial Sequence
  chemically synthesized
tgcagcagcacttgactaaggt

SEQ ID NO: 936642 - DNA, 22 bp, Artificial Sequence
  chemically synthesized
tttgcagcagcacttgactaag

SEQ ID NO: 936643 - DNA, 22 bp, Artificial Sequence
  chemically synthesized
aggcacctctttgcagcagcac

SEQ ID NO: 936644 - DNA, 22 bp, Artificial Sequence
  chemically synthesized
agtcaagtgctgctgcaaagag

SEQ ID NO: 936645 - DNA, 22 bp, Artificial Sequence
  chemically synthesized
gtcaagtgctgctgcaaagagg

SEQ ID NO: 936646 - DNA, 22 bp, Artificial Sequence
  chemically synthesized
acccagttcaggcacctctttg

SEQ ID NO: 936647 - DNA, 22 bp, Artificial Sequence
  chemically synthesized
gggttcacccagttcaggcacc

SEQ ID NO: 936648 - DNA, 22 bp, Artificial Sequence
  chemically synthesized
agggttcacccagttcaggcac

SEQ ID NO: 936649 - DNA, 22 bp, Artificial Sequence
  chemically synthesized
tagggttcacccagttcaggca

SEQ ID NO: 936650 - DNA, 22 bp, Artificial Sequence
  chemically synthesized
ctgcaaagaggtgcctgaactg

SEQ ID NO: 936651 - DNA, 22 bp, Artificial Sequence
  chemically synthesized
tttagggttcacccagttcagg

SEQ ID NO: 936652 - DNA, 22 bp, Artificial Sequence
  chemically synthesized
ctttagggttcacccagttcag

SEQ ID NO: 936653 - DNA, 22 bp, Artificial Sequence
  chemically synthesized
caaagaggtgcctgaactgggt

SEQ ID NO: 936654 - DNA, 22 bp, Artificial Sequence
  chemically synthesized
tctttagggttcacccagttca

SEQ ID NO: 936655 - DNA, 22 bp, Artificial Sequence
  chemically synthesized
aactgggtgaaccctaaagaaa

SEQ ID NO: 936656 - DNA, 22 bp, Artificial Sequence
  chemically synthesized
ggtgaaccctaaagaaaattct

SEQ ID NO: 936657 - DNA, 22 bp, Artificial Sequence
  chemically synthesized
ccaatgcaggcagcagaatttt

SEQ ID NO: 936658 - DNA, 22 bp, Artificial Sequence
  chemically synthesized
gccaatgcaggcagcagaattt

SEQ ID NO: 936659 - DNA, 22 bp, Artificial Sequence
  chemically synthesized
ttgccaatgcaggcagcagaat

SEQ ID NO: 936660 - DNA, 22 bp, Artificial Sequence
  chemically synthesized
aagaaaattctgctgcctgcat

SEQ ID NO: 936661 - DNA, 22 bp, Artificial Sequence
  chemically synthesized
tggattcttgccaatgcaggca

SEQ ID NO: 936662 - DNA, 22 bp, Artificial Sequence
  chemically synthesized
gtggattcttgccaatgcaggc

SEQ ID NO: 936663 - DNA, 22 bp, Artificial Sequence
  chemically synthesized
tgctgcctgcattggcaagaat

SEQ ID NO: 936664 - DNA, 22 bp, Artificial Sequence
  chemically synthesized
ctgcctgcattggcaagaatcc

SEQ ID NO: 936665 - DNA, 22 bp, Artificial Sequence
  chemically synthesized
cctgcattggcaagaatccaca

SEQ ID NO: 936666 - DNA, 22 bp, Artificial Sequence
  chemically synthesized
cattggcaagaatccacaagcc

SEQ ID NO: 936667 - DNA, 22 bp, Artificial Sequence
  chemically synthesized
gcaagaatccacaagccactct

SEQ ID NO: 936668 - DNA, 22 bp, Artificial Sequence
  chemically synthesized
acataagatgcagtatacagag

SEQ ID NO: 936669 - DNA, 22 bp, Artificial Sequence
  chemically synthesized
tgtatactgcatcttatgtgaa

SEQ ID NO: 936670 - DNA, 22 bp, Artificial Sequence
  chemically synthesized
tatactgcatcttatgtgaatc

SEQ ID NO: 936671 - DNA, 22 bp, Artificial Sequence
  chemically synthesized
aatatacaaatgatagaagatt

SEQ ID NO: 936672 - DNA, 22 bp, Artificial Sequence
  chemically synthesized
catcttatgtgaatcttctatc

SEQ ID NO: 936673 - DNA, 22 bp, Artificial Sequence
  chemically synthesized
atgtgaatcttctatcatttgt

SEQ ID NO: 936674 - DNA, 22 bp, Artificial Sequence
  chemically synthesized
aagattgaatatacaaatgata

SEQ ID NO: 936675 - DNA, 22 bp, Artificial Sequence
  chemically synthesized
tgtgaatcttctatcatttgta

SEQ ID NO: 936676 - DNA, 22 bp, Artificial Sequence
  chemically synthesized
ttcaagattgaatatacaaatg

SEQ ID NO: 936677 - DNA, 22 bp, Artificial Sequence
  chemically synthesized
attcaagattgaatatacaaat

SEQ ID NO: 936678 - DNA, 22 bp, Artificial Sequence
  chemically synthesized
atttattcaagattgaatatac

SEQ ID NO: 936679 - DNA, 22 bp, Artificial Sequence
  chemically synthesized
ctatcatttgtatattcaatct

SEQ ID NO: 936680 - DNA, 22 bp, Artificial Sequence
  chemically synthesized
tatcatttgtatattcaatctt

SEQ ID NO: 936681 - DNA, 22 bp, Artificial Sequence
  chemically synthesized
tcatttgtatattcaatcttga

SEQ ID NO: 936682 - DNA, 22 bp, Artificial Sequence
  chemically synthesized
gtatattcaatcttgaataaat

SEQ ID NO: 936683 - DNA, 22 bp, Artificial Sequence
  chemically synthesized
tatattcaatcttgaataaatc

SEQ ID NO: 936684 - DNA, 22 bp, Artificial Sequence
  chemically synthesized
aatcttgaataaatcaatttgc

SEQ ID NO: 936685 - DNA, 22 bp, Artificial Sequence
  chemically synthesized
gaataaatcaatttgccctctt

SEQ ID NO: 936686 - DNA, 22 bp, Artificial Sequence
  chemically synthesized
aataaatcaatttgccctcttg

SEQ ID NO: 936687 - DNA, 22 bp, Artificial Sequence
  chemically synthesized
tagacgaagatcataagaccca

SEQ ID NO: 936688 - DNA, 22 bp, Artificial Sequence
  chemically synthesized
atagacgaagatcataagaccc

SEQ ID NO: 936689 - DNA, 22 bp, Artificial Sequence
  chemically synthesized
tatagacgaagatcataagacc

SEQ ID NO: 936690 - DNA, 22 bp, Artificial Sequence
  chemically synthesized
gccctcttgggtcttatgatct

SEQ ID NO: 936691 - DNA, 22 bp, Artificial Sequence
  chemically synthesized
ccctcttgggtcttatgatctt

SEQ ID NO: 936692 - DNA, 22 bp, Artificial Sequence
  chemically synthesized
attttatagacgaagatcataa

SEQ ID NO: 936693 - DNA, 22 bp, Artificial Sequence
  chemically synthesized
ttgggtcttatgatcttcgtct

SEQ ID NO: 936694 - DNA, 22 bp, Artificial Sequence
  chemically synthesized
tcctgattttatagacgaagat

SEQ ID NO: 936695 - DNA, 22 bp, Artificial Sequence
  chemically synthesized
gggtcttatgatcttcgtctat

SEQ ID NO: 936696 - DNA, 22 bp, Artificial Sequence
  chemically synthesized
ggtcttatgatcttcgtctata

SEQ ID NO: 936697 - DNA, 22 bp, Artificial Sequence
  chemically synthesized
atgatcttcgtctataaaatca

SEQ ID NO: 936698 - DNA, 22 bp, Artificial Sequence
  chemically synthesized
tgatcttcgtctataaaatcag

SEQ ID NO: 936699 - DNA, 22 bp, Artificial Sequence
  chemically synthesized
gcaatcacctatcctgatttta

SEQ ID NO: 936700 - DNA, 22 bp, Artificial Sequence
  chemically synthesized
cgtctataaaatcaggataggt

SEQ ID NO: 936701 - DNA, 22 bp, Artificial Sequence
  chemically synthesized
gtctataaaatcaggataggtg

SEQ ID NO: 936702 - DNA, 22 bp, Artificial Sequence
  chemically synthesized
tgcagaacctagcaatcaccta

SEQ ID NO: 936703 - DNA, 22 bp, Artificial Sequence
  chemically synthesized
taaaatcaggataggtgattgc

SEQ ID NO: 936704 - DNA, 22 bp, Artificial Sequence
  chemically synthesized
atattatgcagaacctagcaat

SEQ ID NO: 936705 - DNA, 22 bp, Artificial Sequence
  chemically synthesized
aggtaaacctcatattatgcag

SEQ ID NO: 936706 - DNA, 22 bp, Artificial Sequence
  chemically synthesized
aaggtaaacctcatattatgca

SEQ ID NO: 936707 - DNA, 22 bp, Artificial Sequence
  chemically synthesized
ctaggttctgcataatatgagg

SEQ ID NO: 936708 - DNA, 22 bp, Artificial Sequence
  chemically synthesized
ccttaaggtaaacctcatatta

SEQ ID NO: 936709 - DNA, 22 bp, Artificial Sequence
  chemically synthesized
ggttctgcataatatgaggttt

SEQ ID NO: 936710 - DNA, 22 bp, Artificial Sequence
  chemically synthesized
ggttgccttaaggtaaacctca

SEQ ID NO: 936711 - DNA, 22 bp, Artificial Sequence
  chemically synthesized
tgcataatatgaggtttacctt

SEQ ID NO: 936712 - DNA, 22 bp, Artificial Sequence
  chemically synthesized
cataatatgaggtttaccttaa

SEQ ID NO: 936713 - DNA, 22 bp, Artificial Sequence
  chemically synthesized
gtgtgccacctaggttgcctta

SEQ ID NO: 936714 - DNA, 22 bp, Artificial Sequence
  chemically synthesized
tagtgtgccacctaggttgcct

SEQ ID NO: 936715 - DNA, 22 bp, Artificial Sequence
  chemically synthesized
accttaaggcaacctaggtggc

SEQ ID NO: 936716 - DNA, 22 bp, Artificial Sequence
  chemically synthesized
ccttaaggcaacctaggtggca

SEQ ID NO: 936717 - DNA, 22 bp, Artificial Sequence
  chemically synthesized
gtgattctagtgtgccacctag

SEQ ID NO: 936718 - DNA, 22 bp, Artificial Sequence
  chemically synthesized
aaggcaacctaggtggcacact

SEQ ID NO: 936719 - DNA, 22 bp, Artificial Sequence
  chemically synthesized
cctagtgattctagtgtgccac

SEQ ID NO: 936720 - DNA, 22 bp, Artificial Sequence
  chemically synthesized
aggcaacctaggtggcacacta

SEQ ID NO: 936721 - DNA, 22 bp, Artificial Sequence
  chemically synthesized
ccctagtgattctagtgtgcca

SEQ ID NO: 936722 - DNA, 22 bp, Artificial Sequence
  chemically synthesized
aagcttccctagtgattctagt

SEQ ID NO: 936723 - DNA, 22 bp, Artificial Sequence
  chemically synthesized
aaagcttccctagtgattctag

SEQ ID NO: 936724 - DNA, 22 bp, Artificial Sequence
  chemically synthesized
taaagcttccctagtgattcta

SEQ ID NO: 936725 - DNA, 22 bp, Artificial Sequence
  chemically synthesized
ttaaagcttccctagtgattct

SEQ ID NO: 936726 - DNA, 22 bp, Artificial Sequence
  chemically synthesized
ggtggcacactagaatcactag

SEQ ID NO: 936727 - DNA, 22 bp, Artificial Sequence
  chemically synthesized
tttaaagcttccctagtgattc

SEQ ID NO: 936728 - DNA, 22 bp, Artificial Sequence
  chemically synthesized
ttttaaagcttccctagtgatt

SEQ ID NO: 936729 - DNA, 22 bp, Artificial Sequence
  chemically synthesized
gaatcactagggaagctttaaa

SEQ ID NO: 936730 - DNA, 22 bp, Artificial Sequence
  chemically synthesized
agaataggaatttttttaaagc

SEQ ID NO: 936731 - DNA, 22 bp, Artificial Sequence
  chemically synthesized
gggaagctttaaaaaaattcct

SEQ ID NO: 936732 - DNA, 22 bp, Artificial Sequence
  chemically synthesized
gtgcgagacctgagaataggaa

SEQ ID NO: 936733 - DNA, 22 bp, Artificial Sequence
  chemically synthesized
tggtgcgagacctgagaatagg

SEQ ID NO: 936734 - DNA, 22 bp, Artificial Sequence
  chemically synthesized
ctggtgcgagacctgagaatag

SEQ ID NO: 936735 - DNA, 22 bp, Artificial Sequence
  chemically synthesized
taaaaaaattcctattctcagg

SEQ ID NO: 936736 - DNA, 22 bp, Artificial Sequence
  chemically synthesized
tctggtgcgagacctgagaata

SEQ ID NO: 936737 - DNA, 22 bp, Artificial Sequence
  chemically synthesized
aaaaaaattcctattctcaggt

SEQ ID NO: 936738 - DNA, 22 bp, Artificial Sequence
  chemically synthesized
ttctggtgcgagacctgagaat

SEQ ID NO: 936739 - DNA, 22 bp, Artificial Sequence
  chemically synthesized
aaaaaattcctattctcaggtc

SEQ ID NO: 936740 - DNA, 22 bp, Artificial Sequence
  chemically synthesized
atttttctggtgcgagacctga

SEQ ID NO: 936741 - DNA, 22 bp, Artificial Sequence
  chemically synthesized
gatttttctggtgcgagacctg

SEQ ID NO: 936742 - DNA, 22 bp, Artificial Sequence
  chemically synthesized
atttgatttttctggtgcgaga

SEQ ID NO: 936743 - DNA, 22 bp, Artificial Sequence
  chemically synthesized
ctattctcaggtctcgcaccag

SEQ ID NO: 936744 - DNA, 22 bp, Artificial Sequence
  chemically synthesized
tgatttgatttttctggtgcga

SEQ ID NO: 936745 - DNA, 22 bp, Artificial Sequence
  chemically synthesized
ttctcaggtctcgcaccagaaa

SEQ ID NO: 936746 - DNA, 22 bp, Artificial Sequence
  chemically synthesized
tcaggtctcgcaccagaaaaat

SEQ ID NO: 936747 - DNA, 22 bp, Artificial Sequence
  chemically synthesized
aggtctcgcaccagaaaaatca

SEQ ID NO: 936748 - DNA, 22 bp, Artificial Sequence
  chemically synthesized
cagaaattctgatttgattttt

SEQ ID NO: 936749 - DNA, 22 bp, Artificial Sequence
  chemically synthesized
gcaccagaaaaatcaaatcaga

SEQ ID NO: 936750 - DNA, 22 bp, Artificial Sequence
  chemically synthesized
ccacctgcagaaattctgattt

SEQ ID NO: 936751 - DNA, 22 bp, Artificial Sequence
  chemically synthesized
gttcccacctgcagaaattctg

SEQ ID NO: 936752 - DNA, 22 bp, Artificial Sequence
  chemically synthesized
ctgcaggtgggaactaggcatc

SEQ ID NO: 936753 - DNA, 22 bp, Artificial Sequence
  chemically synthesized
tgcaggtgggaactaggcatct

SEQ ID NO: 936754 - DNA, 22 bp, Artificial Sequence
  chemically synthesized
caggtgggaactaggcatctct

SEQ ID NO: 936755 - DNA, 22 bp, Artificial Sequence
  chemically synthesized
aaaaaacaaaaaacaaaaaaaa

SEQ ID NO: 936756 - DNA, 22 bp, Artificial Sequence
  chemically synthesized
ggcatctctatttttttttgtt

SEQ ID NO: 936757 - DNA, 22 bp, Artificial Sequence
  chemically synthesized
taaaaaaacaaaaaacaaaaaa

SEQ ID NO: 936758 - DNA, 22 bp, Artificial Sequence
  chemically synthesized
tatttttttttgttttttgttt

SEQ ID NO: 936759 - DNA, 22 bp, Artificial Sequence
  chemically synthesized
gaagctctaaaaaaacaaaaaa

SEQ ID NO: 936760 - DNA, 22 bp, Artificial Sequence
  chemically synthesized
tttttttttgttttttgttttt

SEQ ID NO: 936761 - DNA, 22 bp, Artificial Sequence
  chemically synthesized
tggaagctctaaaaaaacaaaa

SEQ ID NO: 936762 - DNA, 22 bp, Artificial Sequence
  chemically synthesized
ttttttgttttttgttttttta

SEQ ID NO: 936763 - DNA, 22 bp, Artificial Sequence
  chemically synthesized
ctctggaagctctaaaaaaaca

SEQ ID NO: 936764 - DNA, 22 bp, Artificial Sequence
  chemically synthesized
tttttgttttttgtttttttag

SEQ ID NO: 936765 - DNA, 22 bp, Artificial Sequence
  chemically synthesized
ttttgttttttgtttttttaga

SEQ ID NO: 936766 - DNA, 22 bp, Artificial Sequence
  chemically synthesized
tttgttttttgtttttttagag

SEQ ID NO: 936767 - DNA, 22 bp, Artificial Sequence
  chemically synthesized
ttgttttttgtttttttagagc

SEQ ID NO: 936768 - DNA, 22 bp, Artificial Sequence
  chemically synthesized
tgttttttgtttttttagagct

SEQ ID NO: 936769 - DNA, 22 bp, Artificial Sequence
  chemically synthesized
gttttttgtttttttagagctt

SEQ ID NO: 936770 - DNA, 22 bp, Artificial Sequence
  chemically synthesized
gaattactctggaagctctaaa

SEQ ID NO: 936771 - DNA, 22 bp, Artificial Sequence
  chemically synthesized
ttttttgtttttttagagcttc

SEQ ID NO: 936772 - DNA, 22 bp, Artificial Sequence
  chemically synthesized
tttgtttttttagagcttccag

SEQ ID NO: 936773 - DNA, 22 bp, Artificial Sequence
  chemically synthesized
ttgtttttttagagcttccaga

SEQ ID NO: 936774 - DNA, 22 bp, Artificial Sequence
  chemically synthesized
tgtttttttagagcttccagag

SEQ ID NO: 936775 - DNA, 22 bp, Artificial Sequence
  chemically synthesized
gtttttttagagcttccagagt

SEQ ID NO: 936776 - DNA, 22 bp, Artificial Sequence
  chemically synthesized
caagttggaattactctggaag

SEQ ID NO: 936777 - DNA, 22 bp, Artificial Sequence
  chemically synthesized
tttttttagagcttccagagta

SEQ ID NO: 936778 - DNA, 22 bp, Artificial Sequence
  chemically synthesized
ttttagagcttccagagtaatt

SEQ ID NO: 936779 - DNA, 22 bp, Artificial Sequence
  chemically synthesized
gctacaagttggaattactctg

SEQ ID NO: 936780 - DNA, 22 bp, Artificial Sequence
  chemically synthesized
tttagagcttccagagtaattc

SEQ ID NO: 936781 - DNA, 22 bp, Artificial Sequence
  chemically synthesized
agctacaagttggaattactct

SEQ ID NO: 936782 - DNA, 22 bp, Artificial Sequence
  chemically synthesized
ttagagcttccagagtaattcc

SEQ ID NO: 936783 - DNA, 22 bp, Artificial Sequence
  chemically synthesized
tagagcttccagagtaattcca

SEQ ID NO: 936784 - DNA, 22 bp, Artificial Sequence
  chemically synthesized
agagcttccagagtaattccaa

SEQ ID NO: 936785 - DNA, 22 bp, Artificial Sequence
  chemically synthesized
gagcttccagagtaattccaac

SEQ ID NO: 936786 - DNA, 22 bp, Artificial Sequence
  chemically synthesized
aatcttagctacaagttggaat

SEQ ID NO: 936787 - DNA, 22 bp, Artificial Sequence
  chemically synthesized
caatcttagctacaagttggaa

SEQ ID NO: 936788 - DNA, 22 bp, Artificial Sequence
  chemically synthesized
tcaatcttagctacaagttgga

SEQ ID NO: 936789 - DNA, 22 bp, Artificial Sequence
  chemically synthesized
ccagagtaattccaacttgtag

SEQ ID NO: 936790 - DNA, 22 bp, Artificial Sequence
  chemically synthesized
cagagtaattccaacttgtagc

SEQ ID NO: 936791 - DNA, 22 bp, Artificial Sequence
  chemically synthesized
gttttcaatcttagctacaagt

SEQ ID NO: 936792 - DNA, 22 bp, Artificial Sequence
  chemically synthesized
aagagttagttttcaatcttag

SEQ ID NO: 936793 - DNA, 22 bp, Artificial Sequence
  chemically synthesized
aaagagttagttttcaatctta

SEQ ID NO: 936794 - DNA, 22 bp, Artificial Sequence
  chemically synthesized
caacttgtagctaagattgaaa

SEQ ID NO: 936795 - DNA, 22 bp, Artificial Sequence
  chemically synthesized
gtgtttaaagagttagttttca

SEQ ID NO: 936796 - DNA, 22 bp, Artificial Sequence
  chemically synthesized
gtagctaagattgaaaactaac

SEQ ID NO: 936797 - DNA, 22 bp, Artificial Sequence
  chemically synthesized
tagctaagattgaaaactaact

SEQ ID NO: 936798 - DNA, 22 bp, Artificial Sequence
  chemically synthesized
agattgaaaactaactctttaa

SEQ ID NO: 936799 - DNA, 22 bp, Artificial Sequence
  chemically synthesized
aaaactaactctttaaacacta

SEQ ID NO: 936800 - DNA, 22 bp, Artificial Sequence
  chemically synthesized
aggtgacaacaattagtgttta

SEQ ID NO: 936801 - DNA, 22 bp, Artificial Sequence
  chemically synthesized
ctcaggtgacaacaattagtgt

SEQ ID NO: 936802 - DNA, 22 bp, Artificial Sequence
  chemically synthesized
actcaggtgacaacaattagtg

SEQ ID NO: 936803 - DNA, 22 bp, Artificial Sequence
  chemically synthesized
actctttaaacactaattgttg

SEQ ID NO: 936804 - DNA, 22 bp, Artificial Sequence
  chemically synthesized
atttactcaggtgacaacaatt

SEQ ID NO: 936805 - DNA, 22 bp, Artificial Sequence
  chemically synthesized
aatttactcaggtgacaacaat

SEQ ID NO: 936806 - DNA, 22 bp, Artificial Sequence
  chemically synthesized
tttaaacactaattgttgtcac

SEQ ID NO: 936807 - DNA, 22 bp, Artificial Sequence
  chemically synthesized
taaacactaattgttgtcacct

SEQ ID NO: 936808 - DNA, 22 bp, Artificial Sequence
  chemically synthesized
aaacactaattgttgtcacctg

SEQ ID NO: 936809 - DNA, 22 bp, Artificial Sequence
  chemically synthesized
aacactaattgttgtcacctga

SEQ ID NO: 936810 - DNA, 22 bp, Artificial Sequence
  chemically synthesized
aaagtatccttaatttactcag

SEQ ID NO: 936811 - DNA, 22 bp, Artificial Sequence
  chemically synthesized
attgttgtcacctgagtaaatt

SEQ ID NO: 936812 - DNA, 22 bp, Artificial Sequence
  chemically synthesized
tgaaagtatccttaatttactc

SEQ ID NO: 936813 - DNA, 22 bp, Artificial Sequence
  chemically synthesized
ttgtcacctgagtaaattaagg

SEQ ID NO: 936814 - DNA, 22 bp, Artificial Sequence
  chemically synthesized
tcacctgagtaaattaaggata

SEQ ID NO: 936815 - DNA, 22 bp, Artificial Sequence
  chemically synthesized
tggctctgaaagtatccttaat

SEQ ID NO: 936816 - DNA, 22 bp, Artificial Sequence
  chemically synthesized
atggctctgaaagtatccttaa

SEQ ID NO: 936817 - DNA, 22 bp, Artificial Sequence
  chemically synthesized
tatggctctgaaagtatcctta

SEQ ID NO: 936818 - DNA, 22 bp, Artificial Sequence
  chemically synthesized
ttttatggctctgaaagtatcc

SEQ ID NO: 936819 - DNA, 22 bp, Artificial Sequence
  chemically synthesized
agtaaattaaggatactttcag

SEQ ID NO: 936820 - DNA, 22 bp, Artificial Sequence
  chemically synthesized
aggatactttcagagccataaa

SEQ ID NO: 936821 - DNA, 22 bp, Artificial Sequence
  chemically synthesized
tcagagccataaaataatttac

SEQ ID NO: 936822 - DNA, 22 bp, Artificial Sequence
  chemically synthesized
cagagccataaaataatttact

SEQ ID NO: 936823 - DNA, 22 bp, Artificial Sequence
  chemically synthesized
agagccataaaataatttactt

SEQ ID NO: 936824 - DNA, 22 bp, Artificial Sequence
  chemically synthesized
aaaaagtacaaaaagtaaatta

SEQ ID NO: 936825 - DNA, 22 bp, Artificial Sequence
  chemically synthesized
ggcctaaaaaagtacaaaaagt

SEQ ID NO: 936826 - DNA, 22 bp, Artificial Sequence
  chemically synthesized
aggcctaaaaaagtacaaaaag

SEQ ID NO: 936827 - DNA, 22 bp, Artificial Sequence
  chemically synthesized
taggcctaaaaaagtacaaaaa

SEQ ID NO: 936828 - DNA, 22 bp, Artificial Sequence
  chemically synthesized
actttttgtacttttttaggcc

SEQ ID NO: 936829 - DNA, 22 bp, Artificial Sequence
  chemically synthesized
ctttttgtacttttttaggcct

SEQ ID NO: 936830 - DNA, 22 bp, Artificial Sequence
  chemically synthesized
tttgtacttttttaggcctaaa

SEQ ID NO: 936831 - DNA, 22 bp, Artificial Sequence
  chemically synthesized
gaaatatataactttaggccta

SEQ ID NO: 936832 - DNA, 22 bp, Artificial Sequence
  chemically synthesized
ttgtacttttttaggcctaaag

SEQ ID NO: 936833 - DNA, 22 bp, Artificial Sequence
  chemically synthesized
tgtacttttttaggcctaaagt

SEQ ID NO: 936834 - DNA, 22 bp, Artificial Sequence
  chemically synthesized
tagaaatatataactttaggcc

SEQ ID NO: 936835 - DNA, 22 bp, Artificial Sequence
  chemically synthesized
gtacttttttaggcctaaagtt

SEQ ID NO: 936836 - DNA, 22 bp, Artificial Sequence
  chemically synthesized
tacttttttaggcctaaagtta

SEQ ID NO: 936837 - DNA, 22 bp, Artificial Sequence
  chemically synthesized
ttctagaaatatataactttag

SEQ ID NO: 936838 - DNA, 22 bp, Artificial Sequence
  chemically synthesized
attctagaaatatataacttta

SEQ ID NO: 936839 - DNA, 22 bp, Artificial Sequence
  chemically synthesized
tattctagaaatatataacttt

SEQ ID NO: 936840 - DNA, 22 bp, Artificial Sequence
  chemically synthesized
ttttaggcctaaagttatatat

SEQ ID NO: 936841 - DNA, 22 bp, Artificial Sequence
  chemically synthesized
tttaggcctaaagttatatatt

SEQ ID NO: 936842 - DNA, 22 bp, Artificial Sequence
  chemically synthesized
ttaggcctaaagttatatattt

SEQ ID NO: 936843 - DNA, 22 bp, Artificial Sequence
  chemically synthesized
taggcctaaagttatatatttc

SEQ ID NO: 936844 - DNA, 22 bp, Artificial Sequence
  chemically synthesized
aggcctaaagttatatatttct

SEQ ID NO: 936845 - DNA, 22 bp, Artificial Sequence
  chemically synthesized
ggcctaaagttatatatttcta

SEQ ID NO: 936846 - DNA, 22 bp, Artificial Sequence
  chemically synthesized
aagttatatatttctagaataa

SEQ ID NO: 936847 - DNA, 22 bp, Artificial Sequence
  chemically synthesized
tatatttctagaataaagattt

SEQ ID NO: 936848 - DNA, 22 bp, Artificial Sequence
  chemically synthesized
aaaatacgtgcacaaatcttta

SEQ ID NO: 936849 - DNA, 22 bp, Artificial Sequence
  chemically synthesized
aaaaatacgtgcacaaatcttt

SEQ ID NO: 936850 - DNA, 22 bp, Artificial Sequence
  chemically synthesized
taaaaatacgtgcacaaatctt

SEQ ID NO: 936851 - DNA, 22 bp, Artificial Sequence
  chemically synthesized
ctagaataaagatttgtgcacg

SEQ ID NO: 936852 - DNA, 22 bp, Artificial Sequence
  chemically synthesized
tagaataaagatttgtgcacgt

SEQ ID NO: 936853 - DNA, 22 bp, Artificial Sequence
  chemically synthesized
gaataaagatttgtgcacgtat

SEQ ID NO: 936854 - DNA, 22 bp, Artificial Sequence
  chemically synthesized
gtgcacgtatttttaaagggca

SEQ ID NO: 936855 - DNA, 22 bp, Artificial Sequence
  chemically synthesized
tgcacgtatttttaaagggcat

SEQ ID NO: 936856 - DNA, 22 bp, Artificial Sequence
  chemically synthesized
ttaaagggcatgtggcttgtat

SEQ ID NO: 936857 - DNA, 22 bp, Artificial Sequence
  chemically synthesized
taaagggcatgtggcttgtatt

SEQ ID NO: 936858 - DNA, 22 bp, Artificial Sequence
  chemically synthesized
caaagaaaaaaaaatacaagcc

SEQ ID NO: 936859 - DNA, 22 bp, Artificial Sequence
  chemically synthesized
aaagggcatgtggcttgtattt

SEQ ID NO: 936860 - DNA, 22 bp, Artificial Sequence
  chemically synthesized
aagggcatgtggcttgtatttt

SEQ ID NO: 936861 - DNA, 22 bp, Artificial Sequence
  chemically synthesized
agttgcaaagaaaaaaaaatac

SEQ ID NO: 936862 - DNA, 22 bp, Artificial Sequence
  chemically synthesized
gtatttttttttctttgcaact

SEQ ID NO: 936863 - DNA, 22 bp, Artificial Sequence
  chemically synthesized
atcatcacattaagttgcaaag

SEQ ID NO: 936864 - DNA, 22 bp, Artificial Sequence
  chemically synthesized
tatttttttttctttgcaactt

SEQ ID NO: 936865 - DNA, 22 bp, Artificial Sequence
  chemically synthesized
ttttttctttgcaacttaatgt

SEQ ID NO: 936866 - DNA, 22 bp, Artificial Sequence
  chemically synthesized
tttttctttgcaacttaatgtg

SEQ ID NO: 936867 - DNA, 22 bp, Artificial Sequence
  chemically synthesized
ttttctttgcaacttaatgtga

SEQ ID NO: 936868 - DNA, 22 bp, Artificial Sequence
  chemically synthesized
gaatattaatcatcacattaag

SEQ ID NO: 936869 - DNA, 22 bp, Artificial Sequence
  chemically synthesized
tttctttgcaacttaatgtgat

SEQ ID NO: 936870 - DNA, 22 bp, Artificial Sequence
  chemically synthesized
ggaatattaatcatcacattaa

SEQ ID NO: 936871 - DNA, 22 bp, Artificial Sequence
  chemically synthesized
ttctttgcaacttaatgtgatg

SEQ ID NO: 936872 - DNA, 22 bp, Artificial Sequence
  chemically synthesized
tctttgcaacttaatgtgatga

SEQ ID NO: 936873 - DNA, 22 bp, Artificial Sequence
  chemically synthesized
ctttgcaacttaatgtgatgat

SEQ ID NO: 936874 - DNA, 22 bp, Artificial Sequence
  chemically synthesized
tttgcaacttaatgtgatgatt

SEQ ID NO: 936875 - DNA, 22 bp, Artificial Sequence
  chemically synthesized
tgcaacttaatgtgatgattaa

SEQ ID NO: 936876 - DNA, 22 bp, Artificial Sequence
  chemically synthesized
gcaacttaatgtgatgattaat

SEQ ID NO: 936877 - DNA, 22 bp, Artificial Sequence
  chemically synthesized
caacttaatgtgatgattaata

SEQ ID NO: 936878 - DNA, 22 bp, Artificial Sequence
  chemically synthesized
gtagcaaatttggaatattaat

SEQ ID NO: 936879 - DNA, 22 bp, Artificial Sequence
  chemically synthesized
aatgtgatgattaatattccaa

SEQ ID NO: 936880 - DNA, 22 bp, Artificial Sequence
  chemically synthesized
atgtgatgattaatattccaaa

SEQ ID NO: 936881 - DNA, 22 bp, Artificial Sequence
  chemically synthesized
atattccaaatttgctaccagt

SEQ ID NO: 936882 - DNA, 22 bp, Artificial Sequence
  chemically synthesized
agtaataatgaaaactggtagc

SEQ ID NO: 936883 - DNA, 22 bp, Artificial Sequence
  chemically synthesized
caaatttgctaccagttttcat

SEQ ID NO: 936884 - DNA, 22 bp, Artificial Sequence
  chemically synthesized
aaaatactgagtaataatgaaa

SEQ ID NO: 936885 - DNA, 22 bp, Artificial Sequence
  chemically synthesized
gctaccagttttcattattact

SEQ ID NO: 936886 - DNA, 22 bp, Artificial Sequence
  chemically synthesized
ctaccagttttcattattactc

SEQ ID NO: 936887 - DNA, 22 bp, Artificial Sequence
  chemically synthesized
ccagttttcattattactcagt

SEQ ID NO: 936888 - DNA, 22 bp, Artificial Sequence
  chemically synthesized
tcattattactcagtattttca

SEQ ID NO: 936889 - DNA, 22 bp, Artificial Sequence
  chemically synthesized
cattattactcagtattttcag

SEQ ID NO: 936890 - DNA, 22 bp, Artificial Sequence
  chemically synthesized
attattactcagtattttcagg

SEQ ID NO: 936891 - DNA, 22 bp, Artificial Sequence
  chemically synthesized
tggagccatccatgcctgaaaa

SEQ ID NO: 936892 - DNA, 22 bp, Artificial Sequence
  chemically synthesized
ttactcagtattttcaggcatg

SEQ ID NO: 936893 - DNA, 22 bp, Artificial Sequence
  chemically synthesized
ctcagtattttcaggcatggat

SEQ ID NO: 936894 - DNA, 22 bp, Artificial Sequence
  chemically synthesized
aactatggagccatccatgcct

SEQ ID NO: 936895 - DNA, 22 bp, Artificial Sequence
  chemically synthesized
agtattttcaggcatggatggc

SEQ ID NO: 936896 - DNA, 22 bp, Artificial Sequence
  chemically synthesized
tcaggcatggatggctccatag

SEQ ID NO: 936897 - DNA, 22 bp, Artificial Sequence
  chemically synthesized
caggcatggatggctccatagt

SEQ ID NO: 936898 - DNA, 22 bp, Artificial Sequence
  chemically synthesized
aggcatggatggctccatagtt

SEQ ID NO: 936899 - DNA, 22 bp, Artificial Sequence
  chemically synthesized
aataggcagaaatcctgaacta

SEQ ID NO: 936900 - DNA, 22 bp, Artificial Sequence
  chemically synthesized
aaataggcagaaatcctgaact

SEQ ID NO: 936901 - DNA, 22 bp, Artificial Sequence
  chemically synthesized
taaataggcagaaatcctgaac

SEQ ID NO: 936902 - DNA, 22 bp, Artificial Sequence
  chemically synthesized
ttaaataggcagaaatcctgaa

SEQ ID NO: 936903 - DNA, 22 bp, Artificial Sequence
  chemically synthesized
cttttaaataggcagaaatcct

SEQ ID NO: 936904 - DNA, 22 bp, Artificial Sequence
  chemically synthesized
catagttcaggatttctgccta

SEQ ID NO: 936905 - DNA, 22 bp, Artificial Sequence
  chemically synthesized
aggcgactgcttttaaataggc

SEQ ID NO: 936906 - DNA, 22 bp, Artificial Sequence
  chemically synthesized
aaggcgactgcttttaaatagg

SEQ ID NO: 936907 - DNA, 22 bp, Artificial Sequence
  chemically synthesized
aggatttctgcctatttaaaag

SEQ ID NO: 936908 - DNA, 22 bp, Artificial Sequence
  chemically synthesized
ctgcctatttaaaagcagtcgc

SEQ ID NO: 936909 - DNA, 22 bp, Artificial Sequence
  chemically synthesized
tgcctatttaaaagcagtcgcc

SEQ ID NO: 936910 - DNA, 22 bp, Artificial Sequence
  chemically synthesized
cctatttaaaagcagtcgcctt

SEQ ID NO: 936911 - DNA, 22 bp, Artificial Sequence
  chemically synthesized
tttaaaagcagtcgccttaagc

SEQ ID NO: 936912 - DNA, 22 bp, Artificial Sequence
  chemically synthesized
acagacgaaaatgtgcttaagg

SEQ ID NO: 936913 - DNA, 22 bp, Artificial Sequence
  chemically synthesized
aaaagcagtcgccttaagcaca

SEQ ID NO: 936914 - DNA, 22 bp, Artificial Sequence
  chemically synthesized
aaagcagtcgccttaagcacat

SEQ ID NO: 936915 - DNA, 22 bp, Artificial Sequence
  chemically synthesized
ctgacagacgaaaatgtgctta

SEQ ID NO: 936916 - DNA, 22 bp, Artificial Sequence
  chemically synthesized
aagcacattttcgtctgtcagt

SEQ ID NO: 936917 - DNA, 22 bp, Artificial Sequence
  chemically synthesized
agcacattttcgtctgtcagta

SEQ ID NO: 936918 - DNA, 22 bp, Artificial Sequence
  chemically synthesized
tcgtctgtcagtagatgtatat

SEQ ID NO: 936919 - DNA, 22 bp, Artificial Sequence
  chemically synthesized
aaagcaggaagaatatacatct

SEQ ID NO: 936920 - DNA, 22 bp, Artificial Sequence
  chemically synthesized
cgtctgtcagtagatgtatatt

SEQ ID NO: 936921 - DNA, 22 bp, Artificial Sequence
  chemically synthesized
gtctgtcagtagatgtatattc

SEQ ID NO: 936922 - DNA, 22 bp, Artificial Sequence
  chemically synthesized
ttaaaagcaggaagaatataca

SEQ ID NO: 936923 - DNA, 22 bp, Artificial Sequence
  chemically synthesized
tcagtagatgtatattcttcct

SEQ ID NO: 936924 - DNA, 22 bp, Artificial Sequence
  chemically synthesized
attattaaaagcaggaagaata

SEQ ID NO: 936925 - DNA, 22 bp, Artificial Sequence
  chemically synthesized
cattattaaaagcaggaagaat

SEQ ID NO: 936926 - DNA, 22 bp, Artificial Sequence
  chemically synthesized
tcattattaaaagcaggaagaa

SEQ ID NO: 936927 - DNA, 22 bp, Artificial Sequence
  chemically synthesized
aaatgaaattttcattattaaa

SEQ ID NO: 936928 - DNA, 22 bp, Artificial Sequence
  chemically synthesized
aaaatgaaattttcattattaa

SEQ ID NO: 936929 - DNA, 22 bp, Artificial Sequence
  chemically synthesized
ttcctgcttttaataatgaaaa

SEQ ID NO: 936930 - DNA, 22 bp, Artificial Sequence
  chemically synthesized
cctgcttttaataatgaaaatt

SEQ ID NO: 936931 - DNA, 22 bp, Artificial Sequence
  chemically synthesized
ctgcttttaataatgaaaattt

SEQ ID NO: 936932 - DNA, 22 bp, Artificial Sequence
  chemically synthesized
tcacttaaaatgaaattttcat

SEQ ID NO: 936933 - DNA, 22 bp, Artificial Sequence
  chemically synthesized
cttttaataatgaaaatttcat

SEQ ID NO: 936934 - DNA, 22 bp, Artificial Sequence
  chemically synthesized
ttaataatgaaaatttcatttt

SEQ ID NO: 936935 - DNA, 22 bp, Artificial Sequence
  chemically synthesized
taataatgaaaatttcatttta

SEQ ID NO: 936936 - DNA, 22 bp, Artificial Sequence
  chemically synthesized
gggattatcacttaaaatgaaa

SEQ ID NO: 936937 - DNA, 22 bp, Artificial Sequence
  chemically synthesized
aataatgaaaatttcattttaa

SEQ ID NO: 936938 - DNA, 22 bp, Artificial Sequence
  chemically synthesized
agggattatcacttaaaatgaa

SEQ ID NO: 936939 - DNA, 22 bp, Artificial Sequence
  chemically synthesized
ataatgaaaatttcattttaag

SEQ ID NO: 936940 - DNA, 22 bp, Artificial Sequence
  chemically synthesized
tagggattatcacttaaaatga

SEQ ID NO: 936941 - DNA, 22 bp, Artificial Sequence
  chemically synthesized
ttagggattatcacttaaaatg

SEQ ID NO: 936942 - DNA, 22 bp, Artificial Sequence
  chemically synthesized
tttagggattatcacttaaaat

SEQ ID NO: 936943 - DNA, 22 bp, Artificial Sequence
  chemically synthesized
cattttaagtgataatccctaa

SEQ ID NO: 936944 - DNA, 22 bp, Artificial Sequence
  chemically synthesized
attttaagtgataatccctaaa

SEQ ID NO: 936945 - DNA, 22 bp, Artificial Sequence
  chemically synthesized
ccaggaaatcctttttagggat

SEQ ID NO: 936946 - DNA, 22 bp, Artificial Sequence
  chemically synthesized
tgccaggaaatcctttttaggg

SEQ ID NO: 936947 - DNA, 22 bp, Artificial Sequence
  chemically synthesized
taagtgataatccctaaaaagg

SEQ ID NO: 936948 - DNA, 22 bp, Artificial Sequence
  chemically synthesized
aagtgataatccctaaaaagga

SEQ ID NO: 936949 - DNA, 22 bp, Artificial Sequence
  chemically synthesized
agtgataatccctaaaaaggat

SEQ ID NO: 936950 - DNA, 22 bp, Artificial Sequence
  chemically synthesized
tgatataaaccattctgccagg

SEQ ID NO: 936951 - DNA, 22 bp, Artificial Sequence
  chemically synthesized
atgatataaaccattctgccag

SEQ ID NO: 936952 - DNA, 22 bp, Artificial Sequence
  chemically synthesized
aaaaggatttcctggcagaatg

SEQ ID NO: 936953 - DNA, 22 bp, Artificial Sequence
  chemically synthesized
ttatgatataaaccattctgcc

SEQ ID NO: 936954 - DNA, 22 bp, Artificial Sequence
  chemically synthesized
cctggcagaatggtttatatca

SEQ ID NO: 936955 - DNA, 22 bp, Artificial Sequence
  chemically synthesized
ctggcagaatggtttatatcat

SEQ ID NO: 936956 - DNA, 22 bp, Artificial Sequence
  chemically synthesized
ccatacgctcttatgatataaa

SEQ ID NO: 936957 - DNA, 22 bp, Artificial Sequence
  chemically synthesized
gcagaatggtttatatcataag

SEQ ID NO: 936958 - DNA, 22 bp, Artificial Sequence
  chemically synthesized
actcccatacgctcttatgata

SEQ ID NO: 936959 - DNA, 22 bp, Artificial Sequence
  chemically synthesized
aactcccatacgctcttatgat

SEQ ID NO: 936960 - DNA, 22 bp, Artificial Sequence
  chemically synthesized
ttaactcccatacgctcttatg

SEQ ID NO: 936961 - DNA, 22 bp, Artificial Sequence
  chemically synthesized
ttcttaactcccatacgctctt

SEQ ID NO: 936962 - DNA, 22 bp, Artificial Sequence
  chemically synthesized
atatcataagagcgtatgggag

SEQ ID NO: 936963 - DNA, 22 bp, Artificial Sequence
  chemically synthesized
tatcataagagcgtatgggagt

SEQ ID NO: 936964 - DNA, 22 bp, Artificial Sequence
  chemically synthesized
cataattattcttaactcccat

SEQ ID NO: 936965 - DNA, 22 bp, Artificial Sequence
  chemically synthesized
gctgcataattattcttaactc

SEQ ID NO: 936966 - DNA, 22 bp, Artificial Sequence
  chemically synthesized
gagaaagatactcgctgcataa

SEQ ID NO: 936967 - DNA, 22 bp, Artificial Sequence
  chemically synthesized
ggagaaagatactcgctgcata

SEQ ID NO: 936968 - DNA, 22 bp, Artificial Sequence
  chemically synthesized
tggagaaagatactcgctgcat

SEQ ID NO: 936969 - DNA, 22 bp, Artificial Sequence
  chemically synthesized
tttggagaaagatactcgctgc

SEQ ID NO: 936970 - DNA, 22 bp, Artificial Sequence
  chemically synthesized
agaataattatgcagcgagtat

SEQ ID NO: 936971 - DNA, 22 bp, Artificial Sequence
  chemically synthesized
agctctttggagaaagatactc

SEQ ID NO: 936972 - DNA, 22 bp, Artificial Sequence
  chemically synthesized
aagctctttggagaaagatact

SEQ ID NO: 936973 - DNA, 22 bp, Artificial Sequence
  chemically synthesized
taagctctttggagaaagatac

SEQ ID NO: 936974 - DNA, 22 bp, Artificial Sequence
  chemically synthesized
tgcagcgagtatctttctccaa

SEQ ID NO: 936975 - DNA, 22 bp, Artificial Sequence
  chemically synthesized
cataaagtgctttaagctcttt

SEQ ID NO: 936976 - DNA, 22 bp, Artificial Sequence
  chemically synthesized
tctccaaagagcttaaagcact

SEQ ID NO: 936977 - DNA, 22 bp, Artificial Sequence
  chemically synthesized
ctccaaagagcttaaagcactt

SEQ ID NO: 936978 - DNA, 22 bp, Artificial Sequence
  chemically synthesized
tccaaagagcttaaagcacttt

SEQ ID NO: 936979 - DNA, 22 bp, Artificial Sequence
  chemically synthesized
gatgaattccataaagtgcttt

SEQ ID NO: 936980 - DNA, 22 bp, Artificial Sequence
  chemically synthesized
caaagagcttaaagcactttat

SEQ ID NO: 936981 - DNA, 22 bp, Artificial Sequence
  chemically synthesized
attagatgaattccataaagtg

SEQ ID NO: 936982 - DNA, 22 bp, Artificial Sequence
  chemically synthesized
aaagcactttatggaattcatc

SEQ ID NO: 936983 - DNA, 22 bp, Artificial Sequence
  chemically synthesized
aagcactttatggaattcatct

SEQ ID NO: 936984 - DNA, 22 bp, Artificial Sequence
  chemically synthesized
tatggaattcatctaattaatg

SEQ ID NO: 936985 - DNA, 22 bp, Artificial Sequence
  chemically synthesized
atggaattcatctaattaatgt

SEQ ID NO: 936986 - DNA, 22 bp, Artificial Sequence
  chemically synthesized
tggaattcatctaattaatgtt

SEQ ID NO: 936987 - DNA, 22 bp, Artificial Sequence
  chemically synthesized
atggatatagtgtgaacattaa

SEQ ID NO: 936988 - DNA, 22 bp, Artificial Sequence
  chemically synthesized
tcatggatatagtgtgaacatt

SEQ ID NO: 936989 - DNA, 22 bp, Artificial Sequence
  chemically synthesized
ctcatggatatagtgtgaacat

SEQ ID NO: 936990 - DNA, 22 bp, Artificial Sequence
  chemically synthesized
atctaattaatgttcacactat

SEQ ID NO: 936991 - DNA, 22 bp, Artificial Sequence
  chemically synthesized
ccttctcatggatatagtgtga

SEQ ID NO: 936992 - DNA, 22 bp, Artificial Sequence
  chemically synthesized
attaatgttcacactatatcca

SEQ ID NO: 936993 - DNA, 22 bp, Artificial Sequence
  chemically synthesized
tccactgccttctcatggatat

SEQ ID NO: 936994 - DNA, 22 bp, Artificial Sequence
  chemically synthesized
atgttcacactatatccatgag

SEQ ID NO: 936995 - DNA, 22 bp, Artificial Sequence
  chemically synthesized
actgtccactgccttctcatgg

SEQ ID NO: 936996 - DNA, 22 bp, Artificial Sequence
  chemically synthesized
cactgtccactgccttctcatg

SEQ ID NO: 936997 - DNA, 22 bp, Artificial Sequence
  chemically synthesized
acactatatccatgagaaggca

SEQ ID NO: 936998 - DNA, 22 bp, Artificial Sequence
  chemically synthesized
tatccatgagaaggcagtggac

SEQ ID NO: 936999 - DNA, 22 bp, Artificial Sequence
  chemically synthesized
agacccagccatgcttcactgt

SEQ ID NO: 937000 - DNA, 22 bp, Artificial Sequence
  chemically synthesized
cagacccagccatgcttcactg

SEQ ID NO: 937001 - DNA, 22 bp, Artificial Sequence
  chemically synthesized
acttcagacccagccatgcttc

SEQ ID NO: 937002 - DNA, 22 bp, Artificial Sequence
  chemically synthesized
aaggcatggaatgggagctcac

SEQ ID NO: 937003 - DNA, 22 bp, Artificial Sequence
  chemically synthesized
tcaaggcatggaatgggagctc

SEQ ID NO: 937004 - DNA, 22 bp, Artificial Sequence
  chemically synthesized
ggtctgaagtgagctcccattc

SEQ ID NO: 937005 - DNA, 22 bp, Artificial Sequence
  chemically synthesized
ccctctcaaggcatggaatggg

SEQ ID NO: 937006 - DNA, 22 bp, Artificial Sequence
  chemically synthesized
accctctcaaggcatggaatgg

SEQ ID NO: 937007 - DNA, 22 bp, Artificial Sequence
  chemically synthesized
aagtgagctcccattccatgcc

SEQ ID NO: 937008 - DNA, 22 bp, Artificial Sequence
  chemically synthesized
atcttaccctctcaaggcatgg

SEQ ID NO: 937009 - DNA, 22 bp, Artificial Sequence
  chemically synthesized
aatcttaccctctcaaggcatg

SEQ ID NO: 937010 - DNA, 22 bp, Artificial Sequence
  chemically synthesized
ggtttaatcttaccctctcaag

SEQ ID NO: 937011 - DNA, 22 bp, Artificial Sequence
  chemically synthesized
ccattccatgccttgagagggt

SEQ ID NO: 937012 - DNA, 22 bp, Artificial Sequence
  chemically synthesized
ctgggtttaatcttaccctctc

SEQ ID NO: 937013 - DNA, 22 bp, Artificial Sequence
  chemically synthesized
gctgggtttaatcttaccctct

SEQ ID NO: 937014 - DNA, 22 bp, Artificial Sequence
  chemically synthesized
catgccttgagagggtaagatt

SEQ ID NO: 937015 - DNA, 22 bp, Artificial Sequence
  chemically synthesized
cgtttgctgggtttaatcttac

SEQ ID NO: 937016 - DNA, 22 bp, Artificial Sequence
  chemically synthesized
tgcgtttgctgggtttaatctt

SEQ ID NO: 937017 - DNA, 22 bp, Artificial Sequence
  chemically synthesized
gagagggtaagattaaacccag

SEQ ID NO: 937018 - DNA, 22 bp, Artificial Sequence
  chemically synthesized
actctgcgtttgctgggtttaa

SEQ ID NO: 937019 - DNA, 22 bp, Artificial Sequence
  chemically synthesized
agagggtaagattaaacccagc

SEQ ID NO: 937020 - DNA, 22 bp, Artificial Sequence
  chemically synthesized
cactaactctgcgtttgctggg

SEQ ID NO: 937021 - DNA, 22 bp, Artificial Sequence
  chemically synthesized
aacccagcaaacgcagagttag

SEQ ID NO: 937022 - DNA, 22 bp, Artificial Sequence
  chemically synthesized
acaaacagtggtagactacact

SEQ ID NO: 937023 - DNA, 22 bp, Artificial Sequence
  chemically synthesized
tcatgggctgacaaacagtggt

SEQ ID NO: 937024 - DNA, 22 bp, Artificial Sequence
  chemically synthesized
gtcatgggctgacaaacagtgg

SEQ ID NO: 937025 - DNA, 22 bp, Artificial Sequence
  chemically synthesized
tgtcatgggctgacaaacagtg

SEQ ID NO: 937026 - DNA, 22 bp, Artificial Sequence
  chemically synthesized
gtgtagtctaccactgtttgtc

SEQ ID NO: 937027 - DNA, 22 bp, Artificial Sequence
  chemically synthesized
ttgtcatgggctgacaaacagt

SEQ ID NO: 937028 - DNA, 22 bp, Artificial Sequence
  chemically synthesized
ccactgtttgtcagcccatgac

SEQ ID NO: 937029 - DNA, 22 bp, Artificial Sequence
  chemically synthesized
tttgtcagcccatgacaaaaac

SEQ ID NO: 937030 - DNA, 22 bp, Artificial Sequence
  chemically synthesized
gtcagcccatgacaaaaactac

SEQ ID NO: 937031 - DNA, 22 bp, Artificial Sequence
  chemically synthesized
atgtgataaaatgtagtttttg

SEQ ID NO: 937032 - DNA, 22 bp, Artificial Sequence
  chemically synthesized
tcagcccatgacaaaaactaca

SEQ ID NO: 937033 - DNA, 22 bp, Artificial Sequence
  chemically synthesized
aatgtgataaaatgtagttttt

SEQ ID NO: 937034 - DNA, 22 bp, Artificial Sequence
  chemically synthesized
taatgtgataaaatgtagtttt

SEQ ID NO: 937035 - DNA, 22 bp, Artificial Sequence
  chemically synthesized
ttttaatgtgataaaatgtagt

SEQ ID NO: 937036 - DNA, 22 bp, Artificial Sequence
  chemically synthesized
attttaatgtgataaaatgtag

SEQ ID NO: 937037 - DNA, 22 bp, Artificial Sequence
  chemically synthesized
tattttaatgtgataaaatgta

SEQ ID NO: 937038 - DNA, 22 bp, Artificial Sequence
  chemically synthesized
tttattttaatgtgataaaatg

SEQ ID NO: 937039 - DNA, 22 bp, Artificial Sequence
  chemically synthesized
ctctttattttaatgtgataaa

SEQ ID NO: 937040 - DNA, 22 bp, Artificial Sequence
  chemically synthesized
cctctttattttaatgtgataa

SEQ ID NO: 937041 - DNA, 22 bp, Artificial Sequence
  chemically synthesized
ttcctctttattttaatgtgat

SEQ ID NO: 937042 - DNA, 22 bp, Artificial Sequence
  chemically synthesized
cttcctctttattttaatgtga

SEQ ID NO: 937043 - DNA, 22 bp, Artificial Sequence
  chemically synthesized
cattttatcacattaaaataaa

SEQ ID NO: 937044 - DNA, 22 bp, Artificial Sequence
  chemically synthesized
tacgtttcttcctctttatttt

SEQ ID NO: 937045 - DNA, 22 bp, Artificial Sequence
  chemically synthesized
atacgtttcttcctctttattt

SEQ ID NO: 937046 - DNA, 22 bp, Artificial Sequence
  chemically synthesized
tatcacattaaaataaagagga

SEQ ID NO: 937047 - DNA, 22 bp, Artificial Sequence
  chemically synthesized
atcacattaaaataaagaggaa

SEQ ID NO: 937048 - DNA, 22 bp, Artificial Sequence
  chemically synthesized
tcacattaaaataaagaggaag

SEQ ID NO: 937049 - DNA, 22 bp, Artificial Sequence
  chemically synthesized
atttatacgtttcttcctcttt

SEQ ID NO: 937050 - DNA, 22 bp, Artificial Sequence
  chemically synthesized
agctgatttatacgtttcttcc

SEQ ID NO: 937051 - DNA, 22 bp, Artificial Sequence
  chemically synthesized
aaataaagaggaagaaacgtat

SEQ ID NO: 937052 - DNA, 22 bp, Artificial Sequence
  chemically synthesized
aaatccaaagggtaaagaaact

SEQ ID NO: 937053 - DNA, 22 bp, Artificial Sequence
  chemically synthesized
gaaatccaaagggtaaagaaac

SEQ ID NO: 937054 - DNA, 22 bp, Artificial Sequence
  chemically synthesized
ggatacttgaaatccaaagggt

SEQ ID NO: 937055 - DNA, 22 bp, Artificial Sequence
  chemically synthesized
agtttctttaccctttggattt

SEQ ID NO: 937056 - DNA, 22 bp, Artificial Sequence
  chemically synthesized
ttaggatacttgaaatccaaag

SEQ ID NO: 937057 - DNA, 22 bp, Artificial Sequence
  chemically synthesized
actgttaggatacttgaaatcc

SEQ ID NO: 937058 - DNA, 22 bp, Artificial Sequence
  chemically synthesized
ctttaccctttggatttcaagt

SEQ ID NO: 937059 - DNA, 22 bp, Artificial Sequence
  chemically synthesized
aactgttaggatacttgaaatc

SEQ ID NO: 937060 - DNA, 22 bp, Artificial Sequence
  chemically synthesized
tttaccctttggatttcaagta

SEQ ID NO: 937061 - DNA, 22 bp, Artificial Sequence
  chemically synthesized
taactgttaggatacttgaaat

SEQ ID NO: 937062 - DNA, 22 bp, Artificial Sequence
  chemically synthesized
ttaactgttaggatacttgaaa

SEQ ID NO: 937063 - DNA, 22 bp, Artificial Sequence
  chemically synthesized
taccctttggatttcaagtatc

SEQ ID NO: 937064 - DNA, 22 bp, Artificial Sequence
  chemically synthesized
accctttggatttcaagtatcc

SEQ ID NO: 937065 - DNA, 22 bp, Artificial Sequence
  chemically synthesized
ccctttggatttcaagtatcct

SEQ ID NO: 937066 - DNA, 22 bp, Artificial Sequence
  chemically synthesized
tgtttttaactgttaggatact

SEQ ID NO: 937067 - DNA, 22 bp, Artificial Sequence
  chemically synthesized
gtgtttttaactgttaggatac

SEQ ID NO: 937068 - DNA, 22 bp, Artificial Sequence
  chemically synthesized
tgtgtttttaactgttaggata

SEQ ID NO: 937069 - DNA, 22 bp, Artificial Sequence
  chemically synthesized
tggatttcaagtatcctaacag

SEQ ID NO: 937070 - DNA, 22 bp, Artificial Sequence
  chemically synthesized
ttgtgtttttaactgttaggat

SEQ ID NO: 937071 - DNA, 22 bp, Artificial Sequence
  chemically synthesized
ggatttcaagtatcctaacagt

SEQ ID NO: 937072 - DNA, 22 bp, Artificial Sequence
  chemically synthesized
gatttcaagtatcctaacagtt

SEQ ID NO: 937073 - DNA, 22 bp, Artificial Sequence
  chemically synthesized
caagtatcctaacagttaaaaa

SEQ ID NO: 937074 - DNA, 22 bp, Artificial Sequence
  chemically synthesized
atagtttttgtgtttttaactg

SEQ ID NO: 937075 - DNA, 22 bp, Artificial Sequence
  chemically synthesized
aagtatcctaacagttaaaaac

SEQ ID NO: 937076 - DNA, 22 bp, Artificial Sequence
  chemically synthesized
aaggaactgatagtttttgtgt

SEQ ID NO: 937077 - DNA, 22 bp, Artificial Sequence
  chemically synthesized
acagttaaaaacacaaaaacta

SEQ ID NO: 937078 - DNA, 22 bp, Artificial Sequence
  chemically synthesized
ttaaaggaactgatagtttttg

SEQ ID NO: 937079 - DNA, 22 bp, Artificial Sequence
  chemically synthesized
aaaacacaaaaactatcagttc

SEQ ID NO: 937080 - DNA, 22 bp, Artificial Sequence
  chemically synthesized
gaattgttaaaggaactgatag

SEQ ID NO: 937081 - DNA, 22 bp, Artificial Sequence
  chemically synthesized
tcagttcctttaacaattccag

SEQ ID NO: 937082 - DNA, 22 bp, Artificial Sequence
  chemically synthesized
aaatgccagagcatctggaatt

SEQ ID NO: 937083 - DNA, 22 bp, Artificial Sequence
  chemically synthesized
taaaatgccagagcatctggaa

SEQ ID NO: 937084 - DNA, 22 bp, Artificial Sequence
  chemically synthesized
ctaaaatgccagagcatctgga

SEQ ID NO: 937085 - DNA, 22 bp, Artificial Sequence
  chemically synthesized
ctttaacaattccagatgctct

SEQ ID NO: 937086 - DNA, 22 bp, Artificial Sequence
  chemically synthesized
taacaattccagatgctctggc

SEQ ID NO: 937087 - DNA, 22 bp, Artificial Sequence
  chemically synthesized
aacaattccagatgctctggca

SEQ ID NO: 937088 - DNA, 22 bp, Artificial Sequence
  chemically synthesized
acaattccagatgctctggcat

SEQ ID NO: 937089 - DNA, 22 bp, Artificial Sequence
  chemically synthesized
accgtatttctaaaatgccaga

SEQ ID NO: 937090 - DNA, 22 bp, Artificial Sequence
  chemically synthesized
gaccgtatttctaaaatgccag

SEQ ID NO: 937091 - DNA, 22 bp, Artificial Sequence
  chemically synthesized
tgaccgtatttctaaaatgcca

SEQ ID NO: 937092 - DNA, 22 bp, Artificial Sequence
  chemically synthesized
cagatgctctggcattttagaa

SEQ ID NO: 937093 - DNA, 22 bp, Artificial Sequence
  chemically synthesized
atcaaactttgaccgtatttct

SEQ ID NO: 937094 - DNA, 22 bp, Artificial Sequence
  chemically synthesized
aatcaaactttgaccgtatttc

SEQ ID NO: 937095 - DNA, 22 bp, Artificial Sequence
  chemically synthesized
taatcaaactttgaccgtattt

SEQ ID NO: 937096 - DNA, 22 bp, Artificial Sequence
  chemically synthesized
tggcattttagaaatacggtca

SEQ ID NO: 937097 - DNA, 22 bp, Artificial Sequence
  chemically synthesized
gcattttagaaatacggtcaaa

SEQ ID NO: 937098 - DNA, 22 bp, Artificial Sequence
  chemically synthesized
cacattttaatcaaactttgac

SEQ ID NO: 937099 - DNA, 22 bp, Artificial Sequence
  chemically synthesized
tagaaatacggtcaaagtttga

SEQ ID NO: 937100 - DNA, 22 bp, Artificial Sequence
  chemically synthesized
agaaatacggtcaaagtttgat

SEQ ID NO: 937101 - DNA, 22 bp, Artificial Sequence
  chemically synthesized
gaaatacggtcaaagtttgatt

SEQ ID NO: 937102 - DNA, 22 bp, Artificial Sequence
  chemically synthesized
gggaagctccacattttaatca

SEQ ID NO: 937103 - DNA, 22 bp, Artificial Sequence
  chemically synthesized
ctagggaagctccacattttaa

SEQ ID NO: 937104 - DNA, 22 bp, Artificial Sequence
  chemically synthesized
tactagggaagctccacatttt

SEQ ID NO: 937105 - DNA, 22 bp, Artificial Sequence
  chemically synthesized
ttctactagggaagctccacat

SEQ ID NO: 937106 - DNA, 22 bp, Artificial Sequence
  chemically synthesized
gttctactagggaagctccaca

SEQ ID NO: 937107 - DNA, 22 bp, Artificial Sequence
  chemically synthesized
tttgttctactagggaagctcc

SEQ ID NO: 937108 - DNA, 22 bp, Artificial Sequence
  chemically synthesized
gattaaaatgtggagcttccct

SEQ ID NO: 937109 - DNA, 22 bp, Artificial Sequence
  chemically synthesized
attaaaatgtggagcttcccta

SEQ ID NO: 937110 - DNA, 22 bp, Artificial Sequence
  chemically synthesized
aaatgtggagcttccctagtag

SEQ ID NO: 937111 - DNA, 22 bp, Artificial Sequence
  chemically synthesized
ccctagtagaacaaacaatatt

SEQ ID NO: 937112 - DNA, 22 bp, Artificial Sequence
  chemically synthesized
cctagtagaacaaacaatattt

SEQ ID NO: 937113 - DNA, 22 bp, Artificial Sequence
  chemically synthesized
gtagaacaaacaatatttacac

SEQ ID NO: 937114 - DNA, 22 bp, Artificial Sequence
  chemically synthesized
tgtgaatgaaaagcagtgtaaa

SEQ ID NO: 937115 - DNA, 22 bp, Artificial Sequence
  chemically synthesized
ttgtgtgaatgaaaagcagtgt

SEQ ID NO: 937116 - DNA, 22 bp, Artificial Sequence
  chemically synthesized
attgtgtgaatgaaaagcagtg

SEQ ID NO: 937117 - DNA, 22 bp, Artificial Sequence
  chemically synthesized
ccatttattgtgtgaatgaaaa

SEQ ID NO: 937118 - DNA, 22 bp, Artificial Sequence
  chemically synthesized
accatttattgtgtgaatgaaa

SEQ ID NO: 937119 - DNA, 22 bp, Artificial Sequence
  chemically synthesized
acactgcttttcattcacacaa

SEQ ID NO: 937120 - DNA, 22 bp, Artificial Sequence
  chemically synthesized
cactgcttttcattcacacaat

SEQ ID NO: 937121 - DNA, 22 bp, Artificial Sequence
  chemically synthesized
acaatgcttaccatttattgtg

SEQ ID NO: 937122 - DNA, 22 bp, Artificial Sequence
  chemically synthesized
cttttcattcacacaataaatg

SEQ ID NO: 937123 - DNA, 22 bp, Artificial Sequence
  chemically synthesized
ttcattcacacaataaatggta

SEQ ID NO: 937124 - DNA, 22 bp, Artificial Sequence
  chemically synthesized
tcattcacacaataaatggtaa

SEQ ID NO: 937125 - DNA, 22 bp, Artificial Sequence
  chemically synthesized
cattcacacaataaatggtaag

SEQ ID NO: 937126 - DNA, 22 bp, Artificial Sequence
  chemically synthesized
attcacacaataaatggtaagc

SEQ ID NO: 937127 - DNA, 22 bp, Artificial Sequence
  chemically synthesized
acacaataaatggtaagcattg

SEQ ID NO: 937128 - DNA, 22 bp, Artificial Sequence
  chemically synthesized
atgtaaatatgcccacacatac

SEQ ID NO: 937129 - DNA, 22 bp, Artificial Sequence
  chemically synthesized
agttgatgtaaatatgcccaca

SEQ ID NO: 937130 - DNA, 22 bp, Artificial Sequence
  chemically synthesized
gagttgatgtaaatatgcccac

SEQ ID NO: 937131 - DNA, 22 bp, Artificial Sequence
  chemically synthesized
tcagtatgtgtgggcatattta

SEQ ID NO: 937132 - DNA, 22 bp, Artificial Sequence
  chemically synthesized
ggtaacatttgagttgatgtaa

SEQ ID NO: 937133 - DNA, 22 bp, Artificial Sequence
  chemically synthesized
acatcaactcaaatgttaccca

SEQ ID NO: 937134 - DNA, 22 bp, Artificial Sequence
  chemically synthesized
catcaactcaaatgttacccag

SEQ ID NO: 937135 - DNA, 22 bp, Artificial Sequence
  chemically synthesized
aaagtacacagtcagatctggg

SEQ ID NO: 937136 - DNA, 22 bp, Artificial Sequence
  chemically synthesized
aaatgttacccagatctgactg

SEQ ID NO: 937137 - DNA, 22 bp, Artificial Sequence
  chemically synthesized
ggctaaaagtacacagtcagat

SEQ ID NO: 937138 - DNA, 22 bp, Artificial Sequence
  chemically synthesized
cccagatctgactgtgtacttt

SEQ ID NO: 937139 - DNA, 22 bp, Artificial Sequence
  chemically synthesized
tcaggccgtctgggctaaaagt

SEQ ID NO: 937140 - DNA, 22 bp, Artificial Sequence
  chemically synthesized
actgtgtacttttagcccagac

SEQ ID NO: 937141 - DNA, 22 bp, Artificial Sequence
  chemically synthesized
atctgtcaggccgtctgggcta

SEQ ID NO: 937142 - DNA, 22 bp, Artificial Sequence
  chemically synthesized
catctgtcaggccgtctgggct

SEQ ID NO: 937143 - DNA, 22 bp, Artificial Sequence
  chemically synthesized
tgtacttttagcccagacggcc

SEQ ID NO: 937144 - DNA, 22 bp, Artificial Sequence
  chemically synthesized
acttcatctgtcaggccgtctg

SEQ ID NO: 937145 - DNA, 22 bp, Artificial Sequence
  chemically synthesized
ttagcccagacggcctgacaga

SEQ ID NO: 937146 - DNA, 22 bp, Artificial Sequence
  chemically synthesized
aaattaacttcatctgtcaggc

SEQ ID NO: 937147 - DNA, 22 bp, Artificial Sequence
  chemically synthesized
tagcccagacggcctgacagat

SEQ ID NO: 937148 - DNA, 22 bp, Artificial Sequence
  chemically synthesized
agcccagacggcctgacagatg

SEQ ID NO: 937149 - DNA, 22 bp, Artificial Sequence
  chemically synthesized
gcccagacggcctgacagatga

SEQ ID NO: 937150 - DNA, 22 bp, Artificial Sequence
  chemically synthesized
agataatattaaaattaacttc

SEQ ID NO: 937151 - DNA, 22 bp, Artificial Sequence
  chemically synthesized
gagataatattaaaattaactt

SEQ ID NO: 937152 - DNA, 22 bp, Artificial Sequence
  chemically synthesized
ttgagataatattaaaattaac

SEQ ID NO: 937153 - DNA, 22 bp, Artificial Sequence
  chemically synthesized
cttgagataatattaaaattaa

SEQ ID NO: 937154 - DNA, 22 bp, Artificial Sequence
  chemically synthesized
tcttgagataatattaaaatta

SEQ ID NO: 937155 - DNA, 22 bp, Artificial Sequence
  chemically synthesized
acagatgaagttaattttaata

SEQ ID NO: 937156 - DNA, 22 bp, Artificial Sequence
  chemically synthesized
ttcttgagataatattaaaatt

SEQ ID NO: 937157 - DNA, 22 bp, Artificial Sequence
  chemically synthesized
atgcttttcttgagataatatt

SEQ ID NO: 937158 - DNA, 22 bp, Artificial Sequence
  chemically synthesized
attttaatattatctcaagaaa

SEQ ID NO: 937159 - DNA, 22 bp, Artificial Sequence
  chemically synthesized
taatattatctcaagaaaagca

SEQ ID NO: 937160 - DNA, 22 bp, Artificial Sequence
  chemically synthesized
aatattatctcaagaaaagcat

SEQ ID NO: 937161 - DNA, 22 bp, Artificial Sequence
  chemically synthesized
atattatctcaagaaaagcatt

SEQ ID NO: 937162 - DNA, 22 bp, Artificial Sequence
  chemically synthesized
tctcaagaaaagcattaattat

SEQ ID NO: 937163 - DNA, 22 bp, Artificial Sequence
  chemically synthesized
acaggcatgcatataattaatg

SEQ ID NO: 937164 - DNA, 22 bp, Artificial Sequence
  chemically synthesized
aagaaaagcattaattatatgc

SEQ ID NO: 937165 - DNA, 22 bp, Artificial Sequence
  chemically synthesized
caccagaacgtattaacaggca

SEQ ID NO: 937166 - DNA, 22 bp, Artificial Sequence
  chemically synthesized
attatatgcatgcctgttaata

SEQ ID NO: 937167 - DNA, 22 bp, Artificial Sequence
  chemically synthesized
tccaccagaacgtattaacagg

SEQ ID NO: 937168 - DNA, 22 bp, Artificial Sequence
  chemically synthesized
ctccaccagaacgtattaacag

SEQ ID NO: 937169 - DNA, 22 bp, Artificial Sequence
  chemically synthesized
tctccaccagaacgtattaaca

SEQ ID NO: 937170 - DNA, 22 bp, Artificial Sequence
  chemically synthesized
ttctccaccagaacgtattaac

SEQ ID NO: 937171 - DNA, 22 bp, Artificial Sequence
  chemically synthesized
tatgcatgcctgttaatacgtt

SEQ ID NO: 937172 - DNA, 22 bp, Artificial Sequence
  chemically synthesized
tttctccaccagaacgtattaa

SEQ ID NO: 937173 - DNA, 22 bp, Artificial Sequence
  chemically synthesized
tctttttctccaccagaacgta

SEQ ID NO: 937174 - DNA, 22 bp, Artificial Sequence
  chemically synthesized
tatctttttctccaccagaacg

SEQ ID NO: 937175 - DNA, 22 bp, Artificial Sequence
  chemically synthesized
ctatctttttctccaccagaac

SEQ ID NO: 937176 - DNA, 22 bp, Artificial Sequence
  chemically synthesized
ttaatacgttctggtggagaaa

SEQ ID NO: 937177 - DNA, 22 bp, Artificial Sequence
  chemically synthesized
atacgttctggtggagaaaaag

SEQ ID NO: 937178 - DNA, 22 bp, Artificial Sequence
  chemically synthesized
ccatccttctatctttttctcc

SEQ ID NO: 937179 - DNA, 22 bp, Artificial Sequence
  chemically synthesized
tgtactcccatccttctatctt

SEQ ID NO: 937180 - DNA, 22 bp, Artificial Sequence
  chemically synthesized
tggtggagaaaaagatagaagg

SEQ ID NO: 937181 - DNA, 22 bp, Artificial Sequence
  chemically synthesized
gtggagaaaaagatagaaggat

SEQ ID NO: 937182 - DNA, 22 bp, Artificial Sequence
  chemically synthesized
ttatgtactcccatccttctat

SEQ ID NO: 937183 - DNA, 22 bp, Artificial Sequence
  chemically synthesized
actattatgtactcccatcctt

SEQ ID NO: 937184 - DNA, 22 bp, Artificial Sequence
  chemically synthesized
taactattatgtactcccatcc

SEQ ID NO: 937185 - DNA, 22 bp, Artificial Sequence
  chemically synthesized
ctaactattatgtactcccatc

SEQ ID NO: 937186 - DNA, 22 bp, Artificial Sequence
  chemically synthesized
tctaactattatgtactcccat

SEQ ID NO: 937187 - DNA, 22 bp, Artificial Sequence
  chemically synthesized
caaatcagcctttctaactatt

SEQ ID NO: 937188 - DNA, 22 bp, Artificial Sequence
  chemically synthesized
acaaatcagcctttctaactat

SEQ ID NO: 937189 - DNA, 22 bp, Artificial Sequence
  chemically synthesized
tttacaaatcagcctttctaac

SEQ ID NO: 937190 - DNA, 22 bp, Artificial Sequence
  chemically synthesized
gtttacaaatcagcctttctaa

SEQ ID NO: 937191 - DNA, 22 bp, Artificial Sequence
  chemically synthesized
tgtttacaaatcagcctttcta

SEQ ID NO: 937192 - DNA, 22 bp, Artificial Sequence
  chemically synthesized
ttgtttacaaatcagcctttct

SEQ ID NO: 937193 - DNA, 22 bp, Artificial Sequence
  chemically synthesized
tttttgtttacaaatcagcctt

SEQ ID NO: 937194 - DNA, 22 bp, Artificial Sequence
  chemically synthesized
atttttgtttacaaatcagcct

SEQ ID NO: 937195 - DNA, 22 bp, Artificial Sequence
  chemically synthesized
tatttttgtttacaaatcagcc

SEQ ID NO: 937196 - DNA, 22 bp, Artificial Sequence
  chemically synthesized
ttatttttgtttacaaatcagc

SEQ ID NO: 937197 - DNA, 22 bp, Artificial Sequence
  chemically synthesized
tttttatttttgtttacaaatc

SEQ ID NO: 937198 - DNA, 22 bp, Artificial Sequence
  chemically synthesized
gaaaggctgatttgtaaacaaa

SEQ ID NO: 937199 - DNA, 22 bp, Artificial Sequence
  chemically synthesized
aagtgttgtttttatttttgtt

SEQ ID NO: 937200 - DNA, 22 bp, Artificial Sequence
  chemically synthesized
atttgtaaacaaaaataaaaac

SEQ ID NO: 937201 - DNA, 22 bp, Artificial Sequence
  chemically synthesized
gtaaacaaaaataaaaacaaca

SEQ ID NO: 937202 - DNA, 22 bp, Artificial Sequence
  chemically synthesized
taaacaaaaataaaaacaacac

SEQ ID NO: 937203 - DNA, 22 bp, Artificial Sequence
  chemically synthesized
aaatagggaagaggtactgaag

SEQ ID NO: 937204 - DNA, 22 bp, Artificial Sequence
  chemically synthesized
aaaatagggaagaggtactgaa

SEQ ID NO: 937205 - DNA, 22 bp, Artificial Sequence
  chemically synthesized
tgatttaaaatagggaagaggt

SEQ ID NO: 937206 - DNA, 22 bp, Artificial Sequence
  chemically synthesized
tggactgtgatttaaaataggg

SEQ ID NO: 937207 - DNA, 22 bp, Artificial Sequence
  chemically synthesized
cagtacctcttccctattttaa

SEQ ID NO: 937208 - DNA, 22 bp, Artificial Sequence
  chemically synthesized
agtacctcttccctattttaaa

SEQ ID NO: 937209 - DNA, 22 bp, Artificial Sequence
  chemically synthesized
aactgtggactgtgatttaaaa

SEQ ID NO: 937210 - DNA, 22 bp, Artificial Sequence
  chemically synthesized
ttccctattttaaatcacagtc

SEQ ID NO: 937211 - DNA, 22 bp, Artificial Sequence
  chemically synthesized
ccctattttaaatcacagtcca

SEQ ID NO: 937212 - DNA, 22 bp, Artificial Sequence
  chemically synthesized
cctattttaaatcacagtccac

SEQ ID NO: 937213 - DNA, 22 bp, Artificial Sequence
  chemically synthesized
ttttaaatcacagtccacagtt

SEQ ID NO: 937214 - DNA, 22 bp, Artificial Sequence
  chemically synthesized
taaatcacagtccacagttcag

SEQ ID NO: 937215 - DNA, 22 bp, Artificial Sequence
  chemically synthesized
aaatcacagtccacagttcagc

SEQ ID NO: 937216 - DNA, 22 bp, Artificial Sequence
  chemically synthesized
aatcacagtccacagttcagct

SEQ ID NO: 937217 - DNA, 22 bp, Artificial Sequence
  chemically synthesized
cgacgtgatcccagtggaaaag

SEQ ID NO: 937218 - DNA, 22 bp, Artificial Sequence
  chemically synthesized
agcttttccactgggatcacgt

SEQ ID NO: 937219 - DNA, 22 bp, Artificial Sequence
  chemically synthesized
ttccactgggatcacgtcgtaa

SEQ ID NO: 937220 - DNA, 22 bp, Artificial Sequence
  chemically synthesized
tccactgggatcacgtcgtaac

SEQ ID NO: 937221 - DNA, 22 bp, Artificial Sequence
  chemically synthesized
ccactgggatcacgtcgtaacc

SEQ ID NO: 937222 - DNA, 22 bp, Artificial Sequence
  chemically synthesized
cactgggatcacgtcgtaacct

SEQ ID NO: 937223 - DNA, 22 bp, Artificial Sequence
  chemically synthesized
gggaaatcaggtcaggttacga

SEQ ID NO: 937224 - DNA, 22 bp, Artificial Sequence
  chemically synthesized
ggatcacgtcgtaacctgacct

SEQ ID NO: 937225 - DNA, 22 bp, Artificial Sequence
  chemically synthesized
accaggttagggaaatcaggtc

SEQ ID NO: 937226 - DNA, 22 bp, Artificial Sequence
  chemically synthesized
aagaaaatctgaccaggttagg

SEQ ID NO: 937227 - DNA, 22 bp, Artificial Sequence
  chemically synthesized
acctgatttccctaacctggtc

SEQ ID NO: 937228 - DNA, 22 bp, Artificial Sequence
  chemically synthesized
tgaagaaaatctgaccaggtta

SEQ ID NO: 937229 - DNA, 22 bp, Artificial Sequence
  chemically synthesized
ttctgaagaaaatctgaccagg

SEQ ID NO: 937230 - DNA, 22 bp, Artificial Sequence
  chemically synthesized
attctgaagaaaatctgaccag

SEQ ID NO: 937231 - DNA, 22 bp, Artificial Sequence
  chemically synthesized
atttccctaacctggtcagatt

SEQ ID NO: 937232 - DNA, 22 bp, Artificial Sequence
  chemically synthesized
tattctgaagaaaatctgacca

SEQ ID NO: 937233 - DNA, 22 bp, Artificial Sequence
  chemically synthesized
ccctaacctggtcagattttct

SEQ ID NO: 937234 - DNA, 22 bp, Artificial Sequence
  chemically synthesized
attttattctgaagaaaatctg

SEQ ID NO: 937235 - DNA, 22 bp, Artificial Sequence
  chemically synthesized
cctaacctggtcagattttctt

SEQ ID NO: 937236 - DNA, 22 bp, Artificial Sequence
  chemically synthesized
ttaattttattctgaagaaaat

SEQ ID NO: 937237 - DNA, 22 bp, Artificial Sequence
  chemically synthesized
attaattttattctgaagaaaa

SEQ ID NO: 937238 - DNA, 22 bp, Artificial Sequence
  chemically synthesized
acctggtcagattttcttcaga

SEQ ID NO: 937239 - DNA, 22 bp, Artificial Sequence
  chemically synthesized
tattaattttattctgaagaaa

SEQ ID NO: 937240 - DNA, 22 bp, Artificial Sequence
  chemically synthesized
ttattaattttattctgaagaa

SEQ ID NO: 937241 - DNA, 22 bp, Artificial Sequence
  chemically synthesized
ttttattaattttattctgaag

SEQ ID NO: 937242 - DNA, 22 bp, Artificial Sequence
  chemically synthesized
gtcagattttcttcagaataaa

SEQ ID NO: 937243 - DNA, 22 bp, Artificial Sequence
  chemically synthesized
tgaattcttttattaattttat

SEQ ID NO: 937244 - DNA, 22 bp, Artificial Sequence
  chemically synthesized
tgtgaattcttttattaatttt

SEQ ID NO: 937245 - DNA, 22 bp, Artificial Sequence
  chemically synthesized
ctgtgaattcttttattaattt

SEQ ID NO: 937246 - DNA, 22 bp, Artificial Sequence
  chemically synthesized
tcttcagaataaaattaataaa

SEQ ID NO: 937247 - DNA, 22 bp, Artificial Sequence
  chemically synthesized
cttcagaataaaattaataaaa

SEQ ID NO: 937248 - DNA, 22 bp, Artificial Sequence
  chemically synthesized
ttcagaataaaattaataaaag

SEQ ID NO: 937249 - DNA, 22 bp, Artificial Sequence
  chemically synthesized
cagaataaaattaataaaagaa

SEQ ID NO: 937250 - DNA, 22 bp, Artificial Sequence
  chemically synthesized
agaataaaattaataaaagaat

SEQ ID NO: 937251 - DNA, 22 bp, Artificial Sequence
  chemically synthesized
taagccttctgtgaattctttt

SEQ ID NO: 937252 - DNA, 22 bp, Artificial Sequence
  chemically synthesized
atgaaattgtaagccttctgtg

SEQ ID NO: 937253 - DNA, 22 bp, Artificial Sequence
  chemically synthesized
ataaaagaattcacagaaggct

SEQ ID NO: 937254 - DNA, 22 bp, Artificial Sequence
  chemically synthesized
aatgaaattgtaagccttctgt

SEQ ID NO: 937255 - DNA, 22 bp, Artificial Sequence
  chemically synthesized
taatgaaattgtaagccttctg

SEQ ID NO: 937256 - DNA, 22 bp, Artificial Sequence
  chemically synthesized
ttttaatgaaattgtaagcctt

SEQ ID NO: 937257 - DNA, 22 bp, Artificial Sequence
  chemically synthesized
tctattttaatgaaattgtaag

SEQ ID NO: 937258 - DNA, 22 bp, Artificial Sequence
  chemically synthesized
atctattttaatgaaattgtaa

SEQ ID NO: 937259 - DNA, 22 bp, Artificial Sequence
  chemically synthesized
tatctattttaatgaaattgta

SEQ ID NO: 937260 - DNA, 22 bp, Artificial Sequence
  chemically synthesized
acagaaggcttacaatttcatt

SEQ ID NO: 937261 - DNA, 22 bp, Artificial Sequence
  chemically synthesized
ttttatctattttaatgaaatt

SEQ ID NO: 937262 - DNA, 22 bp, Artificial Sequence
  chemically synthesized
gaactattttatctattttaat

SEQ ID NO: 937263 - DNA, 22 bp, Artificial Sequence
  chemically synthesized
acaatttcattaaaatagataa

SEQ ID NO: 937264 - DNA, 22 bp, Artificial Sequence
  chemically synthesized
caatttcattaaaatagataaa

SEQ ID NO: 937265 - DNA, 22 bp, Artificial Sequence
  chemically synthesized
tgaagttggaactattttatct

SEQ ID NO: 937266 - DNA, 22 bp, Artificial Sequence
  chemically synthesized
atgaagttggaactattttatc

SEQ ID NO: 937267 - DNA, 22 bp, Artificial Sequence
  chemically synthesized
tatgaagttggaactattttat

SEQ ID NO: 937268 - DNA, 22 bp, Artificial Sequence
  chemically synthesized
cattaaaatagataaaatagtt

SEQ ID NO: 937269 - DNA, 22 bp, Artificial Sequence
  chemically synthesized
ttatgaagttggaactatttta

SEQ ID NO: 937270 - DNA, 22 bp, Artificial Sequence
  chemically synthesized
attaaaatagataaaatagttc

SEQ ID NO: 937271 - DNA, 22 bp, Artificial Sequence
  chemically synthesized
aaatagataaaatagttccaac

SEQ ID NO: 937272 - DNA, 22 bp, Artificial Sequence
  chemically synthesized
aatgtgccaatacaatttttat

SEQ ID NO: 937273 - DNA, 22 bp, Artificial Sequence
  chemically synthesized
gaatgtgccaatacaattttta

SEQ ID NO: 937274 - DNA, 22 bp, Artificial Sequence
  chemically synthesized
tgaatgtgccaatacaattttt

SEQ ID NO: 937275 - DNA, 22 bp, Artificial Sequence
  chemically synthesized
caacttcataaaaattgtattg

SEQ ID NO: 937276 - DNA, 22 bp, Artificial Sequence
  chemically synthesized
tgtctttgaatgtgccaataca

SEQ ID NO: 937277 - DNA, 22 bp, Artificial Sequence
  chemically synthesized
atgtctttgaatgtgccaatac

SEQ ID NO: 937278 - DNA, 22 bp, Artificial Sequence
  chemically synthesized
tatgtctttgaatgtgccaata

SEQ ID NO: 937279 - DNA, 22 bp, Artificial Sequence
  chemically synthesized
cataaaaattgtattggcacat

SEQ ID NO: 937280 - DNA, 22 bp, Artificial Sequence
  chemically synthesized
ttatgtctttgaatgtgccaat

SEQ ID NO: 937281 - DNA, 22 bp, Artificial Sequence
  chemically synthesized
ataaaaattgtattggcacatt

SEQ ID NO: 937282 - DNA, 22 bp, Artificial Sequence
  chemically synthesized
ttttatgtctttgaatgtgcca

SEQ ID NO: 937283 - DNA, 22 bp, Artificial Sequence
  chemically synthesized
tattggcacattcaaagacata

SEQ ID NO: 937284 - DNA, 22 bp, Artificial Sequence
  chemically synthesized
taagtattcttttatgtctttg

SEQ ID NO: 937285 - DNA, 22 bp, Artificial Sequence
  chemically synthesized
ataagtattcttttatgtcttt

SEQ ID NO: 937286 - DNA, 22 bp, Artificial Sequence
  chemically synthesized
gcacattcaaagacataaaaga

SEQ ID NO: 937287 - DNA, 22 bp, Artificial Sequence
  chemically synthesized
tagaatttataagtattctttt

SEQ ID NO: 937288 - DNA, 22 bp, Artificial Sequence
  chemically synthesized
aaagacataaaagaatacttat

SEQ ID NO: 937289 - DNA, 22 bp, Artificial Sequence
  chemically synthesized
tgcattgtagaatttataagta

SEQ ID NO: 937290 - DNA, 22 bp, Artificial Sequence
  chemically synthesized
acagattatgcattgtagaatt

SEQ ID NO: 937291 - DNA, 22 bp, Artificial Sequence
  chemically synthesized
cacagattatgcattgtagaat

SEQ ID NO: 937292 - DNA, 22 bp, Artificial Sequence
  chemically synthesized
ataaattctacaatgcataatc

SEQ ID NO: 937293 - DNA, 22 bp, Artificial Sequence
  chemically synthesized
taaattctacaatgcataatct

SEQ ID NO: 937294 - DNA, 22 bp, Artificial Sequence
  chemically synthesized
aaataaaaagatttcacagatt

SEQ ID NO: 937295 - DNA, 22 bp, Artificial Sequence
  chemically synthesized
caaataaaaagatttcacagat

SEQ ID NO: 937296 - DNA, 22 bp, Artificial Sequence
  chemically synthesized
tacaatgcataatctgtgaaat

SEQ ID NO: 937297 - DNA, 22 bp, Artificial Sequence
  chemically synthesized
tcaaataaaaagatttcacaga

SEQ ID NO: 937298 - DNA, 22 bp, Artificial Sequence
  chemically synthesized
ttcaaataaaaagatttcacag

SEQ ID NO: 937299 - DNA, 22 bp, Artificial Sequence
  chemically synthesized
caatgcataatctgtgaaatct

SEQ ID NO: 937300 - DNA, 22 bp, Artificial Sequence
  chemically synthesized
tttttcaaataaaaagatttca

SEQ ID NO: 937301 - DNA, 22 bp, Artificial Sequence
  chemically synthesized
gtttttcaaataaaaagatttc

SEQ ID NO: 937302 - DNA, 22 bp, Artificial Sequence
  chemically synthesized
tgtttttcaaataaaaagattt

SEQ ID NO: 937303 - DNA, 22 bp, Artificial Sequence
  chemically synthesized
aatactttgtttttcaaataaa

SEQ ID NO: 937304 - DNA, 22 bp, Artificial Sequence
  chemically synthesized
tgaaatctttttatttgaaaaa

SEQ ID NO: 937305 - DNA, 22 bp, Artificial Sequence
  chemically synthesized
ctaaatactttgtttttcaaat

SEQ ID NO: 937306 - DNA, 22 bp, Artificial Sequence
  chemically synthesized
gctaaatactttgtttttcaaa

SEQ ID NO: 937307 - DNA, 22 bp, Artificial Sequence
  chemically synthesized
tttgctaaatactttgtttttc

SEQ ID NO: 937308 - DNA, 22 bp, Artificial Sequence
  chemically synthesized
tttatttgaaaaacaaagtatt

SEQ ID NO: 937309 - DNA, 22 bp, Artificial Sequence
  chemically synthesized
ttatttgaaaaacaaagtattt

SEQ ID NO: 937310 - DNA, 22 bp, Artificial Sequence
  chemically synthesized
tatttgaaaaacaaagtattta

SEQ ID NO: 937311 - DNA, 22 bp, Artificial Sequence
  chemically synthesized
atttgaaaaacaaagtatttag

SEQ ID NO: 937312 - DNA, 22 bp, Artificial Sequence
  chemically synthesized
tttgaaaaacaaagtatttagc

SEQ ID NO: 937313 - DNA, 22 bp, Artificial Sequence
  chemically synthesized
gaaaaacaaagtatttagcaaa

SEQ ID NO: 937314 - DNA, 22 bp, Artificial Sequence
  chemically synthesized
aaaaacaaagtatttagcaaat

SEQ ID NO: 937315 - DNA, 22 bp, Artificial Sequence
  chemically synthesized
tgtggagagacagtgctatttg

SEQ ID NO: 937316 - DNA, 22 bp, Artificial Sequence
  chemically synthesized
agcaaatagcactgtctctcca

SEQ ID NO: 937317 - DNA, 22 bp, Artificial Sequence
  chemically synthesized
gcaaatagcactgtctctccac

SEQ ID NO: 937318 - DNA, 22 bp, Artificial Sequence
  chemically synthesized
tcagcatggtgtgactatgtgg

SEQ ID NO: 937319 - DNA, 22 bp, Artificial Sequence
  chemically synthesized
tgtcagcatggtgtgactatgt

SEQ ID NO: 937320 - DNA, 22 bp, Artificial Sequence
  chemically synthesized
ctgtcagcatggtgtgactatg

SEQ ID NO: 937321 - DNA, 22 bp, Artificial Sequence
  chemically synthesized
tctctccacatagtcacaccat

SEQ ID NO: 937322 - DNA, 22 bp, Artificial Sequence
  chemically synthesized
tcttctgtcagcatggtgtgac

SEQ ID NO: 937323 - DNA, 22 bp, Artificial Sequence
  chemically synthesized
atcttctgtcagcatggtgtga

SEQ ID NO: 937324 - DNA, 22 bp, Artificial Sequence
  chemically synthesized
tccacatagtcacaccatgctg

SEQ ID NO: 937325 - DNA, 22 bp, Artificial Sequence
  chemically synthesized
cacatagtcacaccatgctgac

SEQ ID NO: 937326 - DNA, 22 bp, Artificial Sequence
  chemically synthesized
tgtttatcttctgtcagcatgg

SEQ ID NO: 937327 - DNA, 22 bp, Artificial Sequence
  chemically synthesized
atgtttatcttctgtcagcatg

SEQ ID NO: 937328 - DNA, 22 bp, Artificial Sequence
  chemically synthesized
accttatgtttatcttctgtca

SEQ ID NO: 937329 - DNA, 22 bp, Artificial Sequence
  chemically synthesized
ctgaccttatgtttatcttctg

SEQ ID NO: 937330 - DNA, 22 bp, Artificial Sequence
  chemically synthesized
acagaagataaacataaggtca

SEQ ID NO: 937331 - DNA, 22 bp, Artificial Sequence
  chemically synthesized
aggaagacctactgaccttatg

SEQ ID NO: 937332 - DNA, 22 bp, Artificial Sequence
  chemically synthesized
gaggaagacctactgaccttat

SEQ ID NO: 937333 - DNA, 22 bp, Artificial Sequence
  chemically synthesized
tgaggaagacctactgacctta

SEQ ID NO: 937334 - DNA, 22 bp, Artificial Sequence
  chemically synthesized
cagtgtatggatggatgtcttt

SEQ ID NO: 937335 - DNA, 22 bp, Artificial Sequence
  chemically synthesized
cctcaaagacatccatccatac

SEQ ID NO: 937336 - DNA, 22 bp, Artificial Sequence
  chemically synthesized
ctcaaagacatccatccataca

SEQ ID NO: 937337 - DNA, 22 bp, Artificial Sequence
  chemically synthesized
atcatgtctccagtgtatggat

SEQ ID NO: 937338 - DNA, 22 bp, Artificial Sequence
  chemically synthesized
aaagacatccatccatacactg

SEQ ID NO: 937339 - DNA, 22 bp, Artificial Sequence
  chemically synthesized
tgaaagtgatgagatgaattga

SEQ ID NO: 937340 - DNA, 22 bp, Artificial Sequence
  chemically synthesized
gagacatgatcaattcatctca

SEQ ID NO: 937341 - DNA, 22 bp, Artificial Sequence
  chemically synthesized
ctatgaaagtgatgagatgaat

SEQ ID NO: 937342 - DNA, 22 bp, Artificial Sequence
  chemically synthesized
ccctactatgaaagtgatgaga

SEQ ID NO: 937343 - DNA, 22 bp, Artificial Sequence
  chemically synthesized
ttcccctactatgaaagtgatg

SEQ ID NO: 937344 - DNA, 22 bp, Artificial Sequence
  chemically synthesized
gttattcccctactatgaaagt

SEQ ID NO: 937345 - DNA, 22 bp, Artificial Sequence
  chemically synthesized
atctcatcactttcatagtagg

SEQ ID NO: 937346 - DNA, 22 bp, Artificial Sequence
  chemically synthesized
atcactttcatagtaggggaat

SEQ ID NO: 937347 - DNA, 22 bp, Artificial Sequence
  chemically synthesized
tcatagtaggggaataactagc

SEQ ID NO: 937348 - DNA, 22 bp, Artificial Sequence
  chemically synthesized
catagtaggggaataactagcg

SEQ ID NO: 937349 - DNA, 22 bp, Artificial Sequence
  chemically synthesized
atagtaggggaataactagcgg

SEQ ID NO: 937350 - DNA, 22 bp, Artificial Sequence
  chemically synthesized
ggcaaaaagtatccgctagtta

SEQ ID NO: 937351 - DNA, 22 bp, Artificial Sequence
  chemically synthesized
aggcaaaaagtatccgctagtt

SEQ ID NO: 937352 - DNA, 22 bp, Artificial Sequence
  chemically synthesized
taggcaaaaagtatccgctagt

SEQ ID NO: 937353 - DNA, 22 bp, Artificial Sequence
  chemically synthesized
ttaggcaaaaagtatccgctag

SEQ ID NO: 937354 - DNA, 22 bp, Artificial Sequence
  chemically synthesized
cttttaggcaaaaagtatccgc

SEQ ID NO: 937355 - DNA, 22 bp, Artificial Sequence
  chemically synthesized
gcggatactttttgcctaaaag

SEQ ID NO: 937356 - DNA, 22 bp, Artificial Sequence
  chemically synthesized
tttgcctaaaagcagatttgac

SEQ ID NO: 937357 - DNA, 22 bp, Artificial Sequence
  chemically synthesized
ataatcatcagagtcaaatctg

SEQ ID NO: 937358 - DNA, 22 bp, Artificial Sequence
  chemically synthesized
ttgcctaaaagcagatttgact

SEQ ID NO: 937359 - DNA, 22 bp, Artificial Sequence
  chemically synthesized
tgcctaaaagcagatttgactc

SEQ ID NO: 937360 - DNA, 22 bp, Artificial Sequence
  chemically synthesized
gcctaaaagcagatttgactct

SEQ ID NO: 937361 - DNA, 22 bp, Artificial Sequence
  chemically synthesized
cctaaaagcagatttgactctg

SEQ ID NO: 937362 - DNA, 22 bp, Artificial Sequence
  chemically synthesized
tactgataatcatcagagtcaa

SEQ ID NO: 937363 - DNA, 22 bp, Artificial Sequence
  chemically synthesized
gtactgataatcatcagagtca

SEQ ID NO: 937364 - DNA, 22 bp, Artificial Sequence
  chemically synthesized
aaagcagatttgactctgatga

SEQ ID NO: 937365 - DNA, 22 bp, Artificial Sequence
  chemically synthesized
aatttgtactgataatcatcag

SEQ ID NO: 937366 - DNA, 22 bp, Artificial Sequence
  chemically synthesized
aaatttgtactgataatcatca

SEQ ID NO: 937367 - DNA, 22 bp, Artificial Sequence
  chemically synthesized
taaatttgtactgataatcatc

SEQ ID NO: 937368 - DNA, 22 bp, Artificial Sequence
  chemically synthesized
gactctgatgattatcagtaca

SEQ ID NO: 937369 - DNA, 22 bp, Artificial Sequence
  chemically synthesized
acgttttaaatttgtactgata

SEQ ID NO: 937370 - DNA, 22 bp, Artificial Sequence
  chemically synthesized
actctgatgattatcagtacaa

SEQ ID NO: 937371 - DNA, 22 bp, Artificial Sequence
  chemically synthesized
gacgttttaaatttgtactgat

SEQ ID NO: 937372 - DNA, 22 bp, Artificial Sequence
  chemically synthesized
tgatgattatcagtacaaattt

SEQ ID NO: 937373 - DNA, 22 bp, Artificial Sequence
  chemically synthesized
acttgacgttttaaatttgtac

SEQ ID NO: 937374 - DNA, 22 bp, Artificial Sequence
  chemically synthesized
atgattatcagtacaaatttaa

SEQ ID NO: 937375 - DNA, 22 bp, Artificial Sequence
  chemically synthesized
caaattgacttgacgttttaaa

SEQ ID NO: 937376 - DNA, 22 bp, Artificial Sequence
  chemically synthesized
tcagtacaaatttaaaacgtca

SEQ ID NO: 937377 - DNA, 22 bp, Artificial Sequence
  chemically synthesized
tccaaattgacttgacgtttta

SEQ ID NO: 937378 - DNA, 22 bp, Artificial Sequence
  chemically synthesized
ctccaaattgacttgacgtttt

SEQ ID NO: 937379 - DNA, 22 bp, Artificial Sequence
  chemically synthesized
cacttctccaaattgacttgac

SEQ ID NO: 937380 - DNA, 22 bp, Artificial Sequence
  chemically synthesized
gcacttctccaaattgacttga

SEQ ID NO: 937381 - DNA, 22 bp, Artificial Sequence
  chemically synthesized
cttgcacttctccaaattgact

SEQ ID NO: 937382 - DNA, 22 bp, Artificial Sequence
  chemically synthesized
gcttgcacttctccaaattgac

SEQ ID NO: 937383 - DNA, 22 bp, Artificial Sequence
  chemically synthesized
tgcttgcacttctccaaattga

SEQ ID NO: 937384 - DNA, 22 bp, Artificial Sequence
  chemically synthesized
aaaacgtcaagtcaatttggag

SEQ ID NO: 937385 - DNA, 22 bp, Artificial Sequence
  chemically synthesized
aaacgtcaagtcaatttggaga

SEQ ID NO: 937386 - DNA, 22 bp, Artificial Sequence
  chemically synthesized
gtgcctttgcttgcacttctcc

SEQ ID NO: 937387 - DNA, 22 bp, Artificial Sequence
  chemically synthesized
ttggtgcctttgcttgcacttc

SEQ ID NO: 937388 - DNA, 22 bp, Artificial Sequence
  chemically synthesized
gttggtgcctttgcttgcactt

SEQ ID NO: 937389 - DNA, 22 bp, Artificial Sequence
  chemically synthesized
atttgttggtgcctttgcttgc

SEQ ID NO: 937390 - DNA, 22 bp, Artificial Sequence
  chemically synthesized
ttgatttgttggtgcctttgct

SEQ ID NO: 937391 - DNA, 22 bp, Artificial Sequence
  chemically synthesized
ggagaagtgcaagcaaaggcac

SEQ ID NO: 937392 - DNA, 22 bp, Artificial Sequence
  chemically synthesized
gagaagtgcaagcaaaggcacc

SEQ ID NO: 937393 - DNA, 22 bp, Artificial Sequence
  chemically synthesized
ctattgatttgttggtgccttt

SEQ ID NO: 937394 - DNA, 22 bp, Artificial Sequence
  chemically synthesized
actattgatttgttggtgcctt

SEQ ID NO: 937395 - DNA, 22 bp, Artificial Sequence
  chemically synthesized
aaagatgaacatcaaagaatct

SEQ ID NO: 937396 - DNA, 22 bp, Artificial Sequence
  chemically synthesized
aaaagatgaacatcaaagaatc

SEQ ID NO: 937397 - DNA, 22 bp, Artificial Sequence
  chemically synthesized
tttgatgttcatcttttaagat

SEQ ID NO: 937398 - DNA, 22 bp, Artificial Sequence
  chemically synthesized
gtacaaaggagaatcttaaaag

SEQ ID NO: 937399 - DNA, 22 bp, Artificial Sequence
  chemically synthesized
tgatgttcatcttttaagattc

SEQ ID NO: 937400 - DNA, 22 bp, Artificial Sequence
  chemically synthesized
gatgttcatcttttaagattct

SEQ ID NO: 937401 - DNA, 22 bp, Artificial Sequence
  chemically synthesized
atgttcatcttttaagattctc

SEQ ID NO: 937402 - DNA, 22 bp, Artificial Sequence
  chemically synthesized
atcttttaagattctcctttgt

SEQ ID NO: 937403 - DNA, 22 bp, Artificial Sequence
  chemically synthesized
ttaagattctcctttgtactaa

SEQ ID NO: 937404 - DNA, 22 bp, Artificial Sequence
  chemically synthesized
taagattctcctttgtactaac

SEQ ID NO: 937405 - DNA, 22 bp, Artificial Sequence
  chemically synthesized
aagattctcctttgtactaact

SEQ ID NO: 937406 - DNA, 22 bp, Artificial Sequence
  chemically synthesized
agattctcctttgtactaactc

SEQ ID NO: 937407 - DNA, 22 bp, Artificial Sequence
  chemically synthesized
tcctttgtactaactcttgact

SEQ ID NO: 937408 - DNA, 22 bp, Artificial Sequence
  chemically synthesized
ctttgtactaactcttgactca

SEQ ID NO: 937409 - DNA, 22 bp, Artificial Sequence
  chemically synthesized
aatgggaaagtatgagtcaaga

SEQ ID NO: 937410 - DNA, 22 bp, Artificial Sequence
  chemically synthesized
aaatgggaaagtatgagtcaag

SEQ ID NO: 937411 - DNA, 22 bp, Artificial Sequence
  chemically synthesized
taaatgggaaagtatgagtcaa

SEQ ID NO: 937412 - DNA, 22 bp, Artificial Sequence
  chemically synthesized
tgtactaactcttgactcatac

SEQ ID NO: 937413 - DNA, 22 bp, Artificial Sequence
  chemically synthesized
gtactaactcttgactcatact

SEQ ID NO: 937414 - DNA, 22 bp, Artificial Sequence
  chemically synthesized
tactaactcttgactcatactt

SEQ ID NO: 937415 - DNA, 22 bp, Artificial Sequence
  chemically synthesized
ctttaaatgggaaagtatgagt

SEQ ID NO: 937416 - DNA, 22 bp, Artificial Sequence
  chemically synthesized
actcttgactcatactttccca

SEQ ID NO: 937417 - DNA, 22 bp, Artificial Sequence
  chemically synthesized
ttgactcatactttcccattta

SEQ ID NO: 937418 - DNA, 22 bp, Artificial Sequence
  chemically synthesized
gactcatactttcccatttaaa

SEQ ID NO: 937419 - DNA, 22 bp, Artificial Sequence
  chemically synthesized
ataaacagttactttaaatggg

SEQ ID NO: 937420 - DNA, 22 bp, Artificial Sequence
  chemically synthesized
actcatactttcccatttaaag

SEQ ID NO: 937421 - DNA, 22 bp, Artificial Sequence
  chemically synthesized
atactttcccatttaaagtaac

SEQ ID NO: 937422 - DNA, 22 bp, Artificial Sequence
  chemically synthesized
aattaataaacagttactttaa

SEQ ID NO: 937423 - DNA, 22 bp, Artificial Sequence
  chemically synthesized
tcccatttaaagtaactgttta

SEQ ID NO: 937424 - DNA, 22 bp, Artificial Sequence
  chemically synthesized
cccatttaaagtaactgtttat

SEQ ID NO: 937425 - DNA, 22 bp, Artificial Sequence
  chemically synthesized
aatgttcaattaataaacagtt

SEQ ID NO: 937426 - DNA, 22 bp, Artificial Sequence
  chemically synthesized
ccatttaaagtaactgtttatt

SEQ ID NO: 937427 - DNA, 22 bp, Artificial Sequence
  chemically synthesized
aaagtaactgtttattaattga

SEQ ID NO: 937428 - DNA, 22 bp, Artificial Sequence
  chemically synthesized
aagtaactgtttattaattgaa

SEQ ID NO: 937429 - DNA, 22 bp, Artificial Sequence
  chemically synthesized
aagtaattcaatgttcaattaa

SEQ ID NO: 937430 - DNA, 22 bp, Artificial Sequence
  chemically synthesized
caagtaattcaatgttcaatta

SEQ ID NO: 937431 - DNA, 22 bp, Artificial Sequence
  chemically synthesized
tttattaattgaacattgaatt

SEQ ID NO: 937432 - DNA, 22 bp, Artificial Sequence
  chemically synthesized
taaatttcaagtaattcaatgt

SEQ ID NO: 937433 - DNA, 22 bp, Artificial Sequence
  chemically synthesized
attaattgaacattgaattact

SEQ ID NO: 937434 - DNA, 22 bp, Artificial Sequence
  chemically synthesized
ttaattgaacattgaattactt

SEQ ID NO: 937435 - DNA, 22 bp, Artificial Sequence
  chemically synthesized
gtattataaatttcaagtaatt

SEQ ID NO: 937436 - DNA, 22 bp, Artificial Sequence
  chemically synthesized
attgaacattgaattacttgaa

SEQ ID NO: 937437 - DNA, 22 bp, Artificial Sequence
  chemically synthesized
gctggtattataaatttcaagt

SEQ ID NO: 937438 - DNA, 22 bp, Artificial Sequence
  chemically synthesized
aacattgaattacttgaaattt

SEQ ID NO: 937439 - DNA, 22 bp, Artificial Sequence
  chemically synthesized
ttagctggtattataaatttca

SEQ ID NO: 937440 - DNA, 22 bp, Artificial Sequence
  chemically synthesized
aattacttgaaatttataatac

SEQ ID NO: 937441 - DNA, 22 bp, Artificial Sequence
  chemically synthesized
tccagttattagctggtattat

SEQ ID NO: 937442 - DNA, 22 bp, Artificial Sequence
  chemically synthesized
atccagttattagctggtatta

SEQ ID NO: 937443 - DNA, 22 bp, Artificial Sequence
  chemically synthesized
cttgaaatttataataccagct

SEQ ID NO: 937444 - DNA, 22 bp, Artificial Sequence
  chemically synthesized
gaaatttataataccagctaat

SEQ ID NO: 937445 - DNA, 22 bp, Artificial Sequence
  chemically synthesized
aaatttataataccagctaata

SEQ ID NO: 937446 - DNA, 22 bp, Artificial Sequence
  chemically synthesized
agagcttatccagttattagct

SEQ ID NO: 937447 - DNA, 22 bp, Artificial Sequence
  chemically synthesized
aagagcttatccagttattagc

SEQ ID NO: 937448 - DNA, 22 bp, Artificial Sequence
  chemically synthesized
ataataccagctaataactgga

SEQ ID NO: 937449 - DNA, 22 bp, Artificial Sequence
  chemically synthesized
taataccagctaataactggat

SEQ ID NO: 937450 - DNA, 22 bp, Artificial Sequence
  chemically synthesized
ataactggataagctcttaagg

SEQ ID NO: 937451 - DNA, 22 bp, Artificial Sequence
  chemically synthesized
gataagctcttaagggtgtttc

SEQ ID NO: 937452 - DNA, 22 bp, Artificial Sequence
  chemically synthesized
ggtacaggtaaggaaacaccct

SEQ ID NO: 937453 - DNA, 22 bp, Artificial Sequence
  chemically synthesized
tacgttgggtacaggtaaggaa

SEQ ID NO: 937454 - DNA, 22 bp, Artificial Sequence
  chemically synthesized
ttaagggtgtttccttacctgt

SEQ ID NO: 937455 - DNA, 22 bp, Artificial Sequence
  chemically synthesized
aagggtgtttccttacctgtac

SEQ ID NO: 937456 - DNA, 22 bp, Artificial Sequence
  chemically synthesized
agggtgtttccttacctgtacc

SEQ ID NO: 937457 - DNA, 22 bp, Artificial Sequence
  chemically synthesized
aactgtacgttgggtacaggta

SEQ ID NO: 937458 - DNA, 22 bp, Artificial Sequence
  chemically synthesized
caactgtacgttgggtacaggt

SEQ ID NO: 937459 - DNA, 22 bp, Artificial Sequence
  chemically synthesized
tcaactgtacgttgggtacagg

SEQ ID NO: 937460 - DNA, 22 bp, Artificial Sequence
  chemically synthesized
ccttacctgtacccaacgtaca

SEQ ID NO: 937461 - DNA, 22 bp, Artificial Sequence
  chemically synthesized
cttacctgtacccaacgtacag

SEQ ID NO: 937462 - DNA, 22 bp, Artificial Sequence
  chemically synthesized
acctgtacccaacgtacagttg

SEQ ID NO: 937463 - DNA, 22 bp, Artificial Sequence
  chemically synthesized
cctgtacccaacgtacagttga

SEQ ID NO: 937464 - DNA, 22 bp, Artificial Sequence
  chemically synthesized
tacccaacgtacagttgaaaat

SEQ ID NO: 937465 - DNA, 22 bp, Artificial Sequence
  chemically synthesized
ccgtgaaataatccacaatttt

SEQ ID NO: 937466 - DNA, 22 bp, Artificial Sequence
  chemically synthesized
cccgtgaaataatccacaattt

SEQ ID NO: 937467 - DNA, 22 bp, Artificial Sequence
  chemically synthesized
aaaattgtggattatttcacgg

SEQ ID NO: 937468 - DNA, 22 bp, Artificial Sequence
  chemically synthesized
agtcaggataaatttcccgtga

SEQ ID NO: 937469 - DNA, 22 bp, Artificial Sequence
  chemically synthesized
cagtcaggataaatttcccgtg

SEQ ID NO: 937470 - DNA, 22 bp, Artificial Sequence
  chemically synthesized
tggattatttcacgggaaattt

SEQ ID NO: 937471 - DNA, 22 bp, Artificial Sequence
  chemically synthesized
tcaatttcagtcaggataaatt

SEQ ID NO: 937472 - DNA, 22 bp, Artificial Sequence
  chemically synthesized
tttcacgggaaatttatcctga

SEQ ID NO: 937473 - DNA, 22 bp, Artificial Sequence
  chemically synthesized
ctatcaatttcagtcaggataa

SEQ ID NO: 937474 - DNA, 22 bp, Artificial Sequence
  chemically synthesized
cacgggaaatttatcctgactg

SEQ ID NO: 937475 - DNA, 22 bp, Artificial Sequence
  chemically synthesized
acgggaaatttatcctgactga

SEQ ID NO: 937476 - DNA, 22 bp, Artificial Sequence
  chemically synthesized
gtatggcattgctatcaatttc

SEQ ID NO: 937477 - DNA, 22 bp, Artificial Sequence
  chemically synthesized
cgtatggcattgctatcaattt

SEQ ID NO: 937478 - DNA, 22 bp, Artificial Sequence
  chemically synthesized
atcctgactgaaattgatagca

SEQ ID NO: 937479 - DNA, 22 bp, Artificial Sequence
  chemically synthesized
tcctgactgaaattgatagcaa

SEQ ID NO: 937480 - DNA, 22 bp, Artificial Sequence
  chemically synthesized
actgaaattgatagcaatgcca

SEQ ID NO: 937481 - DNA, 22 bp, Artificial Sequence
  chemically synthesized
atgaaagtttcgtatggcattg

SEQ ID NO: 937482 - DNA, 22 bp, Artificial Sequence
  chemically synthesized
catgaaagtttcgtatggcatt

SEQ ID NO: 937483 - DNA, 22 bp, Artificial Sequence
  chemically synthesized
aaattgatagcaatgccatacg

SEQ ID NO: 937484 - DNA, 22 bp, Artificial Sequence
  chemically synthesized
aatttcatgaaagtttcgtatg

SEQ ID NO: 937485 - DNA, 22 bp, Artificial Sequence
  chemically synthesized
aaatttcatgaaagtttcgtat

SEQ ID NO: 937486 - DNA, 22 bp, Artificial Sequence
  chemically synthesized
atagcaatgccatacgaaactt

SEQ ID NO: 937487 - DNA, 22 bp, Artificial Sequence
  chemically synthesized
tgtatttaaatttcatgaaagt

SEQ ID NO: 937488 - DNA, 22 bp, Artificial Sequence
  chemically synthesized
tgcaatgctatgtatttaaatt

SEQ ID NO: 937489 - DNA, 22 bp, Artificial Sequence
  chemically synthesized
atgcaatgctatgtatttaaat

SEQ ID NO: 937490 - DNA, 22 bp, Artificial Sequence
  chemically synthesized
tatgcaatgctatgtatttaaa

SEQ ID NO: 937491 - DNA, 22 bp, Artificial Sequence
  chemically synthesized
tcatgaaatttaaatacatagc

SEQ ID NO: 937492 - DNA, 22 bp, Artificial Sequence
  chemically synthesized
attttatgcaatgctatgtatt

SEQ ID NO: 937493 - DNA, 22 bp, Artificial Sequence
  chemically synthesized
catgaaatttaaatacatagca

SEQ ID NO: 937494 - DNA, 22 bp, Artificial Sequence
  chemically synthesized
aattttatgcaatgctatgtat

SEQ ID NO: 937495 - DNA, 22 bp, Artificial Sequence
  chemically synthesized
atgaaatttaaatacatagcat

SEQ ID NO: 937496 - DNA, 22 bp, Artificial Sequence
  chemically synthesized
taattttatgcaatgctatgta

SEQ ID NO: 937497 - DNA, 22 bp, Artificial Sequence
  chemically synthesized
ctttaattttatgcaatgctat

SEQ ID NO: 937498 - DNA, 22 bp, Artificial Sequence
  chemically synthesized
gctttaattttatgcaatgcta

SEQ ID NO: 937499 - DNA, 22 bp, Artificial Sequence
  chemically synthesized
tgctttaattttatgcaatgct

SEQ ID NO: 937500 - DNA, 22 bp, Artificial Sequence
  chemically synthesized
ttttgctttaattttatgcaat

SEQ ID NO: 937501 - DNA, 22 bp, Artificial Sequence
  chemically synthesized
aaatacatagcattgcataaaa

SEQ ID NO: 937502 - DNA, 22 bp, Artificial Sequence
  chemically synthesized
aatacatagcattgcataaaat

SEQ ID NO: 937503 - DNA, 22 bp, Artificial Sequence
  chemically synthesized
aaatggtattattttgctttaa

SEQ ID NO: 937504 - DNA, 22 bp, Artificial Sequence
  chemically synthesized
cataaaattaaagcaaaataat

SEQ ID NO: 937505 - DNA, 22 bp, Artificial Sequence
  chemically synthesized
aattcaaatggtattattttgc

SEQ ID NO: 937506 - DNA, 22 bp, Artificial Sequence
  chemically synthesized
aaactaaattcaaatggtatta

SEQ ID NO: 937507 - DNA, 22 bp, Artificial Sequence
  chemically synthesized
aagcaaaataataccatttgaa

SEQ ID NO: 937508 - DNA, 22 bp, Artificial Sequence
  chemically synthesized
aaaaggctaaaactaaattcaa

SEQ ID NO: 937509 - DNA, 22 bp, Artificial Sequence
  chemically synthesized
gccaaactcaaaaggctaaaac

SEQ ID NO: 937510 - DNA, 22 bp, Artificial Sequence
  chemically synthesized
gaatttagttttagccttttga

SEQ ID NO: 937511 - DNA, 22 bp, Artificial Sequence
  chemically synthesized
aatttagttttagccttttgag

SEQ ID NO: 937512 - DNA, 22 bp, Artificial Sequence
  chemically synthesized
agattagccaaactcaaaaggc

SEQ ID NO: 937513 - DNA, 22 bp, Artificial Sequence
  chemically synthesized
agttttagccttttgagtttgg

SEQ ID NO: 937514 - DNA, 22 bp, Artificial Sequence
  chemically synthesized
gttttagccttttgagtttggc

SEQ ID NO: 937515 - DNA, 22 bp, Artificial Sequence
  chemically synthesized
tagccttttgagtttggctaat

SEQ ID NO: 937516 - DNA, 22 bp, Artificial Sequence
  chemically synthesized
agccttttgagtttggctaatc

SEQ ID NO: 937517 - DNA, 22 bp, Artificial Sequence
  chemically synthesized
gccttttgagtttggctaatct

SEQ ID NO: 937518 - DNA, 22 bp, Artificial Sequence
  chemically synthesized
ttgagtttggctaatcttaatc

SEQ ID NO: 937519 - DNA, 22 bp, Artificial Sequence
  chemically synthesized
tgagtttggctaatcttaatca

SEQ ID NO: 937520 - DNA, 22 bp, Artificial Sequence
  chemically synthesized
gagtttggctaatcttaatcac

SEQ ID NO: 937521 - DNA, 22 bp, Artificial Sequence
  chemically synthesized
agtttggctaatcttaatcact

SEQ ID NO: 937522 - DNA, 22 bp, Artificial Sequence
  chemically synthesized
aagccagtggtcatccagtgat

SEQ ID NO: 937523 - DNA, 22 bp, Artificial Sequence
  chemically synthesized
ggctaatcttaatcactggatg

SEQ ID NO: 937524 - DNA, 22 bp, Artificial Sequence
  chemically synthesized
gctaatcttaatcactggatga

SEQ ID NO: 937525 - DNA, 22 bp, Artificial Sequence
  chemically synthesized
tgttgaagccagtggtcatcca

SEQ ID NO: 937526 - DNA, 22 bp, Artificial Sequence
  chemically synthesized
atcttaatcactggatgaccac

SEQ ID NO: 937527 - DNA, 22 bp, Artificial Sequence
  chemically synthesized
tatgttgaagccagtggtcatc

SEQ ID NO: 937528 - DNA, 22 bp, Artificial Sequence
  chemically synthesized
ctatgttgaagccagtggtcat

SEQ ID NO: 937529 - DNA, 22 bp, Artificial Sequence
  chemically synthesized
ttctatgttgaagccagtggtc

SEQ ID NO: 937530 - DNA, 22 bp, Artificial Sequence
  chemically synthesized
aatcactggatgaccactggct

SEQ ID NO: 937531 - DNA, 22 bp, Artificial Sequence
  chemically synthesized
atcactggatgaccactggctt

SEQ ID NO: 937532 - DNA, 22 bp, Artificial Sequence
  chemically synthesized
tatggttcttctatgttgaagc

SEQ ID NO: 937533 - DNA, 22 bp, Artificial Sequence
  chemically synthesized
gatgaccactggcttcaacata

SEQ ID NO: 937534 - DNA, 22 bp, Artificial Sequence
  chemically synthesized
atatggttcttctatgttgaag

SEQ ID NO: 937535 - DNA, 22 bp, Artificial Sequence
  chemically synthesized
tatatggttcttctatgttgaa

SEQ ID NO: 937536 - DNA, 22 bp, Artificial Sequence
  chemically synthesized
ttatatggttcttctatgttga

SEQ ID NO: 937537 - DNA, 22 bp, Artificial Sequence
  chemically synthesized
cttttatatggttcttctatgt

SEQ ID NO: 937538 - DNA, 22 bp, Artificial Sequence
  chemically synthesized
ccttttatatggttcttctatg

SEQ ID NO: 937539 - DNA, 22 bp, Artificial Sequence
  chemically synthesized
tccttttatatggttcttctat

SEQ ID NO: 937540 - DNA, 22 bp, Artificial Sequence
  chemically synthesized
ttccttttatatggttcttcta

SEQ ID NO: 937541 - DNA, 22 bp, Artificial Sequence
  chemically synthesized
gcttcaacatagaagaaccata

SEQ ID NO: 937542 - DNA, 22 bp, Artificial Sequence
  chemically synthesized
caacatagaagaaccatataaa

SEQ ID NO: 937543 - DNA, 22 bp, Artificial Sequence
  chemically synthesized
tacacttttccttttatatggt

SEQ ID NO: 937544 - DNA, 22 bp, Artificial Sequence
  chemically synthesized
aacatagaagaaccatataaaa

SEQ ID NO: 937545 - DNA, 22 bp, Artificial Sequence
  chemically synthesized
gtacacttttccttttatatgg

SEQ ID NO: 937546 - DNA, 22 bp, Artificial Sequence
  chemically synthesized
aaataatttgtacacttttcct

SEQ ID NO: 937547 - DNA, 22 bp, Artificial Sequence
  chemically synthesized
aaaataatttgtacacttttcc

SEQ ID NO: 937548 - DNA, 22 bp, Artificial Sequence
  chemically synthesized
taaaataatttgtacacttttc

SEQ ID NO: 937549 - DNA, 22 bp, Artificial Sequence
  chemically synthesized
ctttaaaataatttgtacactt

SEQ ID NO: 937550 - DNA, 22 bp, Artificial Sequence
  chemically synthesized
actttaaaataatttgtacact

SEQ ID NO: 937551 - DNA, 22 bp, Artificial Sequence
  chemically synthesized
tcagtcatttactttaaaataa

SEQ ID NO: 937552 - DNA, 22 bp, Artificial Sequence
  chemically synthesized
ttttaaagtaaatgactgataa

SEQ ID NO: 937553 - DNA, 22 bp, Artificial Sequence
  chemically synthesized
taaagtaaatgactgataattt

SEQ ID NO: 937554 - DNA, 22 bp, Artificial Sequence
  chemically synthesized
aaagtaaatgactgataatttc

SEQ ID NO: 937555 - DNA, 22 bp, Artificial Sequence
  chemically synthesized
taagatatgtaagaaattatca

SEQ ID NO: 937556 - DNA, 22 bp, Artificial Sequence
  chemically synthesized
aagtaaatgactgataatttct

SEQ ID NO: 937557 - DNA, 22 bp, Artificial Sequence
  chemically synthesized
ataagatatgtaagaaattatc

SEQ ID NO: 937558 - DNA, 22 bp, Artificial Sequence
  chemically synthesized
ataatttcttacatatcttata

SEQ ID NO: 937559 - DNA, 22 bp, Artificial Sequence
  chemically synthesized
cttacatatcttataaggacta

SEQ ID NO: 937560 - DNA, 22 bp, Artificial Sequence
  chemically synthesized
ttacatatcttataaggactat

SEQ ID NO: 937561 - DNA, 22 bp, Artificial Sequence
  chemically synthesized
acatatcttataaggactatta

SEQ ID NO: 937562 - DNA, 22 bp, Artificial Sequence
  chemically synthesized
catatcttataaggactattac

SEQ ID NO: 937563 - DNA, 22 bp, Artificial Sequence
  chemically synthesized
ataaggactattaccttactgt

SEQ ID NO: 937564 - DNA, 22 bp, Artificial Sequence
  chemically synthesized
taaggactattaccttactgtt

SEQ ID NO: 937565 - DNA, 22 bp, Artificial Sequence
  chemically synthesized
gaaaggtagagtcaacaacagt

SEQ ID NO: 937566 - DNA, 22 bp, Artificial Sequence
  chemically synthesized
ttaccttactgttgttgactct

SEQ ID NO: 937567 - DNA, 22 bp, Artificial Sequence
  chemically synthesized
ccttactgttgttgactctacc

SEQ ID NO: 937568 - DNA, 22 bp, Artificial Sequence
  chemically synthesized
ggcatgtctagaaaggtagagt

SEQ ID NO: 937569 - DNA, 22 bp, Artificial Sequence
  chemically synthesized
actgttgttgactctacctttc

SEQ ID NO: 937570 - DNA, 22 bp, Artificial Sequence
  chemically synthesized
ctgttgttgactctacctttct

SEQ ID NO: 937571 - DNA, 22 bp, Artificial Sequence
  chemically synthesized
ttgttgactctacctttctaga

SEQ ID NO: 937572 - DNA, 22 bp, Artificial Sequence
  chemically synthesized
gtccctaggcatgtctagaaag

SEQ ID NO: 937573 - DNA, 22 bp, Artificial Sequence
  chemically synthesized
ttgactctacctttctagacat

SEQ ID NO: 937574 - DNA, 22 bp, Artificial Sequence
  chemically synthesized
actctacctttctagacatgcc

SEQ ID NO: 937575 - DNA, 22 bp, Artificial Sequence
  chemically synthesized
tacctttctagacatgcctagg

SEQ ID NO: 937576 - DNA, 22 bp, Artificial Sequence
  chemically synthesized
cctttctagacatgcctaggga

SEQ ID NO: 937577 - DNA, 22 bp, Artificial Sequence
  chemically synthesized
tctagacatgcctagggactaa

SEQ ID NO: 937578 - DNA, 22 bp, Artificial Sequence
  chemically synthesized
aaagtaatccaattagtcccta

SEQ ID NO: 937579 - DNA, 22 bp, Artificial Sequence
  chemically synthesized
ctagacatgcctagggactaat

SEQ ID NO: 937580 - DNA, 22 bp, Artificial Sequence
  chemically synthesized
caaagtaatccaattagtccct

SEQ ID NO: 937581 - DNA, 22 bp, Artificial Sequence
  chemically synthesized
tagacatgcctagggactaatt

SEQ ID NO: 937582 - DNA, 22 bp, Artificial Sequence
  chemically synthesized
gacatgcctagggactaattgg

SEQ ID NO: 937583 - DNA, 22 bp, Artificial Sequence
  chemically synthesized
tttcaaagtaatccaattagtc

SEQ ID NO: 937584 - DNA, 22 bp, Artificial Sequence
  chemically synthesized
gggactaattggattactttga

SEQ ID NO: 937585 - DNA, 22 bp, Artificial Sequence
  chemically synthesized
cagtaaaagagattgtttcaaa

SEQ ID NO: 937586 - DNA, 22 bp, Artificial Sequence
  chemically synthesized
gcagtaaaagagattgtttcaa

SEQ ID NO: 937587 - DNA, 22 bp, Artificial Sequence
  chemically synthesized
attggattactttgaaacaatc

SEQ ID NO: 937588 - DNA, 22 bp, Artificial Sequence
  chemically synthesized
tgcagtaaaagagattgtttca

SEQ ID NO: 937589 - DNA, 22 bp, Artificial Sequence
  chemically synthesized
ttgcagtaaaagagattgtttc

SEQ ID NO: 937590 - DNA, 22 bp, Artificial Sequence
  chemically synthesized
gattactttgaaacaatctctt

SEQ ID NO: 937591 - DNA, 22 bp, Artificial Sequence
  chemically synthesized
cttttgcagtaaaagagattgt

SEQ ID NO: 937592 - DNA, 22 bp, Artificial Sequence
  chemically synthesized
ccttttgcagtaaaagagattg

SEQ ID NO: 937593 - DNA, 22 bp, Artificial Sequence
  chemically synthesized
tccttttgcagtaaaagagatt

SEQ ID NO: 937594 - DNA, 22 bp, Artificial Sequence
  chemically synthesized
tttccttttgcagtaaaagaga

SEQ ID NO: 937595 - DNA, 22 bp, Artificial Sequence
  chemically synthesized
ctttgaaacaatctcttttact

SEQ ID NO: 937596 - DNA, 22 bp, Artificial Sequence
  chemically synthesized
tgaaacaatctcttttactgca

SEQ ID NO: 937597 - DNA, 22 bp, Artificial Sequence
  chemically synthesized
gaaacaatctcttttactgcaa

SEQ ID NO: 937598 - DNA, 22 bp, Artificial Sequence
  chemically synthesized
aaacaatctcttttactgcaaa

SEQ ID NO: 937599 - DNA, 22 bp, Artificial Sequence
  chemically synthesized
taaattctttccttttgcagta

SEQ ID NO: 937600 - DNA, 22 bp, Artificial Sequence
  chemically synthesized
gtaaattctttccttttgcagt

SEQ ID NO: 937601 - DNA, 22 bp, Artificial Sequence
  chemically synthesized
tgtaaattctttccttttgcag

SEQ ID NO: 937602 - DNA, 22 bp, Artificial Sequence
  chemically synthesized
cctttgtaaattctttcctttt

SEQ ID NO: 937603 - DNA, 22 bp, Artificial Sequence
  chemically synthesized
gcctttgtaaattctttccttt

SEQ ID NO: 937604 - DNA, 22 bp, Artificial Sequence
  chemically synthesized
tgcctttgtaaattctttcctt

SEQ ID NO: 937605 - DNA, 22 bp, Artificial Sequence
  chemically synthesized
ttttactgcaaaaggaaagaat

SEQ ID NO: 937606 - DNA, 22 bp, Artificial Sequence
  chemically synthesized
ttactgcaaaaggaaagaattt

SEQ ID NO: 937607 - DNA, 22 bp, Artificial Sequence
  chemically synthesized
tactgcaaaaggaaagaattta

SEQ ID NO: 937608 - DNA, 22 bp, Artificial Sequence
  chemically synthesized
actgcaaaaggaaagaatttac

SEQ ID NO: 937609 - DNA, 22 bp, Artificial Sequence
  chemically synthesized
ctgcaaaaggaaagaatttaca

SEQ ID NO: 937610 - DNA, 22 bp, Artificial Sequence
  chemically synthesized
tagagctttgcctttgtaaatt

SEQ ID NO: 937611 - DNA, 22 bp, Artificial Sequence
  chemically synthesized
caaaaggaaagaatttacaaag

SEQ ID NO: 937612 - DNA, 22 bp, Artificial Sequence
  chemically synthesized
gctatagagctttgcctttgta

SEQ ID NO: 937613 - DNA, 22 bp, Artificial Sequence
  chemically synthesized
attggctatagagctttgcctt

SEQ ID NO: 937614 - DNA, 22 bp, Artificial Sequence
  chemically synthesized
actcattggctatagagctttg

SEQ ID NO: 937615 - DNA, 22 bp, Artificial Sequence
  chemically synthesized
aactcattggctatagagcttt

SEQ ID NO: 937616 - DNA, 22 bp, Artificial Sequence
  chemically synthesized
ttaactcattggctatagagct

SEQ ID NO: 937617 - DNA, 22 bp, Artificial Sequence
  chemically synthesized
cttaactcattggctatagagc

SEQ ID NO: 937618 - DNA, 22 bp, Artificial Sequence
  chemically synthesized
acaaaggcaaagctctatagcc

SEQ ID NO: 937619 - DNA, 22 bp, Artificial Sequence
  chemically synthesized
caaaggcaaagctctatagcca

SEQ ID NO: 937620 - DNA, 22 bp, Artificial Sequence
  chemically synthesized
agtaagtaacttcttaactcat

SEQ ID NO: 937621 - DNA, 22 bp, Artificial Sequence
  chemically synthesized
tatagccaatgagttaagaagt

SEQ ID NO: 937622 - DNA, 22 bp, Artificial Sequence
  chemically synthesized
tagccaatgagttaagaagtta

SEQ ID NO: 937623 - DNA, 22 bp, Artificial Sequence
  chemically synthesized
gaattcagtaagtaacttctta

SEQ ID NO: 937624 - DNA, 22 bp, Artificial Sequence
  chemically synthesized
tggaattcagtaagtaacttct

SEQ ID NO: 937625 - DNA, 22 bp, Artificial Sequence
  chemically synthesized
agaagttacttactgaattcca

SEQ ID NO: 937626 - DNA, 22 bp, Artificial Sequence
  chemically synthesized
cttactgaattccagagggtgt

SEQ ID NO: 937627 - DNA, 22 bp, Artificial Sequence
  chemically synthesized
actgaattccagagggtgttcc

SEQ ID NO: 937628 - DNA, 22 bp, Artificial Sequence
  chemically synthesized
ctgaattccagagggtgttcca

SEQ ID NO: 937629 - DNA, 22 bp, Artificial Sequence
  chemically synthesized
ccacagtataatatggaacacc

SEQ ID NO: 937630 - DNA, 22 bp, Artificial Sequence
  chemically synthesized
aattccagagggtgttccatat

SEQ ID NO: 937631 - DNA, 22 bp, Artificial Sequence
  chemically synthesized
actaccacagtataatatggaa

SEQ ID NO: 937632 - DNA, 22 bp, Artificial Sequence
  chemically synthesized
cagagggtgttccatattatac

SEQ ID NO: 937633 - DNA, 22 bp, Artificial Sequence
  chemically synthesized
ccacgttcactaccacagtata

SEQ ID NO: 937634 - DNA, 22 bp, Artificial Sequence
  chemically synthesized
catattatactgtggtagtgaa

SEQ ID NO: 937635 - DNA, 22 bp, Artificial Sequence
  chemically synthesized
aaccactgccacgttcactacc

SEQ ID NO: 937636 - DNA, 22 bp, Artificial Sequence
  chemically synthesized
caaccactgccacgttcactac

SEQ ID NO: 937637 - DNA, 22 bp, Artificial Sequence
  chemically synthesized
tactgtggtagtgaacgtggca

SEQ ID NO: 937638 - DNA, 22 bp, Artificial Sequence
  chemically synthesized
tggtagtgaacgtggcagtggt

SEQ ID NO: 937639 - DNA, 22 bp, Artificial Sequence
  chemically synthesized
agaacccacttcaaccactgcc

SEQ ID NO: 937640 - DNA, 22 bp, Artificial Sequence
  chemically synthesized
atccactaagaacccacttcaa

SEQ ID NO: 937641 - DNA, 22 bp, Artificial Sequence
  chemically synthesized
catccactaagaacccacttca

SEQ ID NO: 937642 - DNA, 22 bp, Artificial Sequence
  chemically synthesized
tcatccactaagaacccacttc

SEQ ID NO: 937643 - DNA, 22 bp, Artificial Sequence
  chemically synthesized
ttcatccactaagaacccactt

SEQ ID NO: 937644 - DNA, 22 bp, Artificial Sequence
  chemically synthesized
agaaccacttttcatccactaa

SEQ ID NO: 937645 - DNA, 22 bp, Artificial Sequence
  chemically synthesized
cagaaccacttttcatccacta

SEQ ID NO: 937646 - DNA, 22 bp, Artificial Sequence
  chemically synthesized
aagtgggttcttagtggatgaa

SEQ ID NO: 937647 - DNA, 22 bp, Artificial Sequence
  chemically synthesized
aacgacttcagaaccacttttc

SEQ ID NO: 937648 - DNA, 22 bp, Artificial Sequence
  chemically synthesized
ttagtggatgaaaagtggttct

SEQ ID NO: 937649 - DNA, 22 bp, Artificial Sequence
  chemically synthesized
agtggatgaaaagtggttctga

SEQ ID NO: 937650 - DNA, 22 bp, Artificial Sequence
  chemically synthesized
gtggatgaaaagtggttctgaa

SEQ ID NO: 937651 - DNA, 22 bp, Artificial Sequence
  chemically synthesized
gcccatatgatccctaaacgac

SEQ ID NO: 937652 - DNA, 22 bp, Artificial Sequence
  chemically synthesized
agcccatatgatccctaaacga

SEQ ID NO: 937653 - DNA, 22 bp, Artificial Sequence
  chemically synthesized
tagcccatatgatccctaaacg

SEQ ID NO: 937654 - DNA, 22 bp, Artificial Sequence
  chemically synthesized
tgaagtcgtttagggatcatat

SEQ ID NO: 937655 - DNA, 22 bp, Artificial Sequence
  chemically synthesized
aagtcgtttagggatcatatgg

SEQ ID NO: 937656 - DNA, 22 bp, Artificial Sequence
  chemically synthesized
tcatggtaattttagcccatat

SEQ ID NO: 937657 - DNA, 22 bp, Artificial Sequence
  chemically synthesized
agggatcatatgggctaaaatt

SEQ ID NO: 937658 - DNA, 22 bp, Artificial Sequence
  chemically synthesized
gggatcatatgggctaaaatta

SEQ ID NO: 937659 - DNA, 22 bp, Artificial Sequence
  chemically synthesized
atgaagctatcatggtaatttt

SEQ ID NO: 937660 - DNA, 22 bp, Artificial Sequence
  chemically synthesized
ctaatgaagctatcatggtaat

SEQ ID NO: 937661 - DNA, 22 bp, Artificial Sequence
  chemically synthesized
aaattaccatgatagcttcatt

SEQ ID NO: 937662 - DNA, 22 bp, Artificial Sequence
  chemically synthesized
aggtggtgttgctaatgaagct

SEQ ID NO: 937663 - DNA, 22 bp, Artificial Sequence
  chemically synthesized
caggtggtgttgctaatgaagc

SEQ ID NO: 937664 - DNA, 22 bp, Artificial Sequence
  chemically synthesized
cttcaggtggtgttgctaatga

SEQ ID NO: 937665 - DNA, 22 bp, Artificial Sequence
  chemically synthesized
ccatgatagcttcattagcaac

SEQ ID NO: 937666 - DNA, 22 bp, Artificial Sequence
  chemically synthesized
tacttcaggtggtgttgctaat

SEQ ID NO: 937667 - DNA, 22 bp, Artificial Sequence
  chemically synthesized
ctacttcaggtggtgttgctaa

SEQ ID NO: 937668 - DNA, 22 bp, Artificial Sequence
  chemically synthesized
cattagcaacaccacctgaagt

SEQ ID NO: 937669 - DNA, 22 bp, Artificial Sequence
  chemically synthesized
attagcaacaccacctgaagta

SEQ ID NO: 937670 - DNA, 22 bp, Artificial Sequence
  chemically synthesized
tacagagacagtttctacttca

SEQ ID NO: 937671 - DNA, 22 bp, Artificial Sequence
  chemically synthesized
gcaacaccacctgaagtagaaa

SEQ ID NO: 937672 - DNA, 22 bp, Artificial Sequence
  chemically synthesized
agtgaaattatacagagacagt

SEQ ID NO: 937673 - DNA, 22 bp, Artificial Sequence
  chemically synthesized
tgagtgaaattatacagagaca

SEQ ID NO: 937674 - DNA, 22 bp, Artificial Sequence
  chemically synthesized
aagtagaaactgtctctgtata

SEQ ID NO: 937675 - DNA, 22 bp, Artificial Sequence
  chemically synthesized
gttctgagtgaaattatacaga

SEQ ID NO: 937676 - DNA, 22 bp, Artificial Sequence
  chemically synthesized
ggttctgagtgaaattatacag

SEQ ID NO: 937677 - DNA, 22 bp, Artificial Sequence
  chemically synthesized
tctctgtataatttcactcaga

SEQ ID NO: 937678 - DNA, 22 bp, Artificial Sequence
  chemically synthesized
aaaagtaacttggttctgagtg

SEQ ID NO: 937679 - DNA, 22 bp, Artificial Sequence
  chemically synthesized
tgtataatttcactcagaacca

SEQ ID NO: 937680 - DNA, 22 bp, Artificial Sequence
  chemically synthesized
tataatttcactcagaaccaag

SEQ ID NO: 937681 - DNA, 22 bp, Artificial Sequence
  chemically synthesized
cactcagaaccaagttactttt

SEQ ID NO: 937682 - DNA, 22 bp, Artificial Sequence
  chemically synthesized
actcagaaccaagttacttttc

SEQ ID NO: 937683 - DNA, 22 bp, Artificial Sequence
  chemically synthesized
gggagagaccagttgaaaagta

SEQ ID NO: 937684 - DNA, 22 bp, Artificial Sequence
  chemically synthesized
agaaccaagttacttttcaact

SEQ ID NO: 937685 - DNA, 22 bp, Artificial Sequence
  chemically synthesized
cttttcaactggtctctcccca

SEQ ID NO: 937686 - DNA, 22 bp, Artificial Sequence
  chemically synthesized
ataggaacacatcctggggaga

SEQ ID NO: 937687 - DNA, 22 bp, Artificial Sequence
  chemically synthesized
ttcaactggtctctccccagga

SEQ ID NO: 937688 - DNA, 22 bp, Artificial Sequence
  chemically synthesized
tcaactggtctctccccaggat

SEQ ID NO: 937689 - DNA, 22 bp, Artificial Sequence
  chemically synthesized
caactggtctctccccaggatg

SEQ ID NO: 937690 - DNA, 22 bp, Artificial Sequence
  chemically synthesized
aactggtctctccccaggatgt

SEQ ID NO: 937691 - DNA, 22 bp, Artificial Sequence
  chemically synthesized
cagctaataggaacacatcctg

SEQ ID NO: 937692 - DNA, 22 bp, Artificial Sequence
  chemically synthesized
gcagctaataggaacacatcct

SEQ ID NO: 937693 - DNA, 22 bp, Artificial Sequence
  chemically synthesized
gtctctccccaggatgtgttcc

SEQ ID NO: 937694 - DNA, 22 bp, Artificial Sequence
  chemically synthesized
tccccaggatgtgttcctatta

SEQ ID NO: 937695 - DNA, 22 bp, Artificial Sequence
  chemically synthesized
cccaggatgtgttcctattagc

SEQ ID NO: 937696 - DNA, 22 bp, Artificial Sequence
  chemically synthesized
taagaatttgcagctaatagga

SEQ ID NO: 937697 - DNA, 22 bp, Artificial Sequence
  chemically synthesized
ttgtaagaatttgcagctaata

SEQ ID NO: 937698 - DNA, 22 bp, Artificial Sequence
  chemically synthesized
ctattagctgcaaattcttaca

SEQ ID NO: 937699 - DNA, 22 bp, Artificial Sequence
  chemically synthesized
gccataaggttgttgtaagaat

SEQ ID NO: 937700 - DNA, 22 bp, Artificial Sequence
  chemically synthesized
ttagctgcaaattcttacaaca

SEQ ID NO: 937701 - DNA, 22 bp, Artificial Sequence
  chemically synthesized
attagccataaggttgttgtaa

SEQ ID NO: 937702 - DNA, 22 bp, Artificial Sequence
  chemically synthesized
gctgcaaattcttacaacaacc

SEQ ID NO: 937703 - DNA, 22 bp, Artificial Sequence
  chemically synthesized
caaattcttacaacaaccttat

SEQ ID NO: 937704 - DNA, 22 bp, Artificial Sequence
  chemically synthesized
aatcctcattagccataaggtt

SEQ ID NO: 937705 - DNA, 22 bp, Artificial Sequence
  chemically synthesized
tgaatcctcattagccataagg

SEQ ID NO: 937706 - DNA, 22 bp, Artificial Sequence
  chemically synthesized
ttacaacaaccttatggctaat

SEQ ID NO: 937707 - DNA, 22 bp, Artificial Sequence
  chemically synthesized
acaacaaccttatggctaatga

SEQ ID NO: 937708 - DNA, 22 bp, Artificial Sequence
  chemically synthesized
gattctgaatcctcattagcca

SEQ ID NO: 937709 - DNA, 22 bp, Artificial Sequence
  chemically synthesized
caacaaccttatggctaatgag

SEQ ID NO: 937710 - DNA, 22 bp, Artificial Sequence
  chemically synthesized
tggattctgaatcctcattagc

SEQ ID NO: 937711 - DNA, 22 bp, Artificial Sequence
  chemically synthesized
ctggattctgaatcctcattag

SEQ ID NO: 937712 - DNA, 22 bp, Artificial Sequence
  chemically synthesized
catttctggattctgaatcctc

SEQ ID NO: 937713 - DNA, 22 bp, Artificial Sequence
  chemically synthesized
tccatttctggattctgaatcc

SEQ ID NO: 937714 - DNA, 22 bp, Artificial Sequence
  chemically synthesized
atggctaatgaggattcagaat

SEQ ID NO: 937715 - DNA, 22 bp, Artificial Sequence
  chemically synthesized
tggctaatgaggattcagaatc

SEQ ID NO: 937716 - DNA, 22 bp, Artificial Sequence
  chemically synthesized
atgaggattcagaatccagaaa

SEQ ID NO: 937717 - DNA, 22 bp, Artificial Sequence
  chemically synthesized
agaggaacaaattctccatttc

SEQ ID NO: 937718 - DNA, 22 bp, Artificial Sequence
  chemically synthesized
cagaggaacaaattctccattt

SEQ ID NO: 937719 - DNA, 22 bp, Artificial Sequence
  chemically synthesized
ttcagaggaacaaattctccat

SEQ ID NO: 937720 - DNA, 22 bp, Artificial Sequence
  chemically synthesized
agaatccagaaatggagaattt

SEQ ID NO: 937721 - DNA, 22 bp, Artificial Sequence
  chemically synthesized
cttcagaggaacaaattctcca

SEQ ID NO: 937722 - DNA, 22 bp, Artificial Sequence
  chemically synthesized
tcttcagaggaacaaattctcc

SEQ ID NO: 937723 - DNA, 22 bp, Artificial Sequence
  chemically synthesized
actttcttcagaggaacaaatt

SEQ ID NO: 937724 - DNA, 22 bp, Artificial Sequence
  chemically synthesized
taactttcttcagaggaacaaa

SEQ ID NO: 937725 - DNA, 22 bp, Artificial Sequence
  chemically synthesized
aaattctaactttcttcagagg

SEQ ID NO: 937726 - DNA, 22 bp, Artificial Sequence
  chemically synthesized
aaaattctaactttcttcagag

SEQ ID NO: 937727 - DNA, 22 bp, Artificial Sequence
  chemically synthesized
tttaaaattctaactttcttca

SEQ ID NO: 937728 - DNA, 22 bp, Artificial Sequence
  chemically synthesized
atttaaaattctaactttcttc

SEQ ID NO: 937729 - DNA, 22 bp, Artificial Sequence
  chemically synthesized
gttcctctgaagaaagttagaa

SEQ ID NO: 937730 - DNA, 22 bp, Artificial Sequence
  chemically synthesized
ttcctctgaagaaagttagaat

SEQ ID NO: 937731 - DNA, 22 bp, Artificial Sequence
  chemically synthesized
ctctgaagaaagttagaatttt

SEQ ID NO: 937732 - DNA, 22 bp, Artificial Sequence
  chemically synthesized
cagtatttatttaaaattctaa

SEQ ID NO: 937733 - DNA, 22 bp, Artificial Sequence
  chemically synthesized
tgaagaaagttagaattttaaa

SEQ ID NO: 937734 - DNA, 22 bp, Artificial Sequence
  chemically synthesized
aagaaagttagaattttaaata

SEQ ID NO: 937735 - DNA, 22 bp, Artificial Sequence
  chemically synthesized
cagaagttgcagtatttattta

SEQ ID NO: 937736 - DNA, 22 bp, Artificial Sequence
  chemically synthesized
gaattttaaataaatactgcaa

SEQ ID NO: 937737 - DNA, 22 bp, Artificial Sequence
  chemically synthesized
agaagtctccagaagttgcagt

SEQ ID NO: 937738 - DNA, 22 bp, Artificial Sequence
  chemically synthesized
taaataaatactgcaacttctg

SEQ ID NO: 937739 - DNA, 22 bp, Artificial Sequence
  chemically synthesized
aaataaatactgcaacttctgg

SEQ ID NO: 937740 - DNA, 22 bp, Artificial Sequence
  chemically synthesized
aataaatactgcaacttctgga

SEQ ID NO: 937741 - DNA, 22 bp, Artificial Sequence
  chemically synthesized
aattgagaagtctccagaagtt

SEQ ID NO: 937742 - DNA, 22 bp, Artificial Sequence
  chemically synthesized
caacttctggagacttctcaat

SEQ ID NO: 937743 - DNA, 22 bp, Artificial Sequence
  chemically synthesized
tggagtcacattaaattgagaa

SEQ ID NO: 937744 - DNA, 22 bp, Artificial Sequence
  chemically synthesized
ctggagacttctcaatttaatg

SEQ ID NO: 937745 - DNA, 22 bp, Artificial Sequence
  chemically synthesized
tggagacttctcaatttaatgt

SEQ ID NO: 937746 - DNA, 22 bp, Artificial Sequence
  chemically synthesized
gagacttctcaatttaatgtga

SEQ ID NO: 937747 - DNA, 22 bp, Artificial Sequence
  chemically synthesized
tgatcactatggagtcacatta

SEQ ID NO: 937748 - DNA, 22 bp, Artificial Sequence
  chemically synthesized
ctcaatttaatgtgactccata

SEQ ID NO: 937749 - DNA, 22 bp, Artificial Sequence
  chemically synthesized
tcaatttaatgtgactccatag

SEQ ID NO: 937750 - DNA, 22 bp, Artificial Sequence
  chemically synthesized
aatttaatgtgactccatagtg

SEQ ID NO: 937751 - DNA, 22 bp, Artificial Sequence
  chemically synthesized
aatgtgactccatagtgatcat

SEQ ID NO: 937752 - DNA, 22 bp, Artificial Sequence
  chemically synthesized
atgtgactccatagtgatcata

SEQ ID NO: 937753 - DNA, 22 bp, Artificial Sequence
  chemically synthesized
acccatgtggtcactatgatca

SEQ ID NO: 937754 - DNA, 22 bp, Artificial Sequence
  chemically synthesized
cacccatgtggtcactatgatc

SEQ ID NO: 937755 - DNA, 22 bp, Artificial Sequence
  chemically synthesized
catagtgatcatagtgaccaca

SEQ ID NO: 937756 - DNA, 22 bp, Artificial Sequence
  chemically synthesized
aagaggtttcacccatgtggtc

SEQ ID NO: 937757 - DNA, 22 bp, Artificial Sequence
  chemically synthesized
gaagaggtttcacccatgtggt

SEQ ID NO: 937758 - DNA, 22 bp, Artificial Sequence
  chemically synthesized
tcaatttgaagaggtttcaccc

SEQ ID NO: 937759 - DNA, 22 bp, Artificial Sequence
  chemically synthesized
atcaatttgaagaggtttcacc

SEQ ID NO: 937760 - DNA, 22 bp, Artificial Sequence
  chemically synthesized
tttatcaatttgaagaggtttc

SEQ ID NO: 937761 - DNA, 22 bp, Artificial Sequence
  chemically synthesized
atttatcaatttgaagaggttt

SEQ ID NO: 937762 - DNA, 22 bp, Artificial Sequence
  chemically synthesized
tatttatcaatttgaagaggtt

SEQ ID NO: 937763 - DNA, 22 bp, Artificial Sequence
  chemically synthesized
cattttatttatcaatttgaag

SEQ ID NO: 937764 - DNA, 22 bp, Artificial Sequence
  chemically synthesized
gaaattccattttatttatcaa

SEQ ID NO: 937765 - DNA, 22 bp, Artificial Sequence
  chemically synthesized
ttcaaattgataaataaaatgg

SEQ ID NO: 937766 - DNA, 22 bp, Artificial Sequence
  chemically synthesized
caaattgataaataaaatggaa

SEQ ID NO: 937767 - DNA, 22 bp, Artificial Sequence
  chemically synthesized
aaattgataaataaaatggaat

SEQ ID NO: 937768 - DNA, 22 bp, Artificial Sequence
  chemically synthesized
ataaataaaatggaatttccaa

SEQ ID NO: 937769 - DNA, 22 bp, Artificial Sequence
  chemically synthesized
tccaagatacacaattggaaat

SEQ ID NO: 937770 - DNA, 22 bp, Artificial Sequence
  chemically synthesized
tgcatggattgtccaagataca

SEQ ID NO: 937771 - DNA, 22 bp, Artificial Sequence
  chemically synthesized
attgtgcatggattgtccaaga

SEQ ID NO: 937772 - DNA, 22 bp, Artificial Sequence
  chemically synthesized
ccaattgtgtatcttggacaat

SEQ ID NO: 937773 - DNA, 22 bp, Artificial Sequence
  chemically synthesized
caattgtgtatcttggacaatc

SEQ ID NO: 937774 - DNA, 22 bp, Artificial Sequence
  chemically synthesized
taattgtgcatggattgtccaa

SEQ ID NO: 937775 - DNA, 22 bp, Artificial Sequence
  chemically synthesized
ctaattgtgcatggattgtcca

SEQ ID NO: 937776 - DNA, 22 bp, Artificial Sequence
  chemically synthesized
tttctaattgtgcatggattgt

SEQ ID NO: 937777 - DNA, 22 bp, Artificial Sequence
  chemically synthesized
tgtatcttggacaatccatgca

SEQ ID NO: 937778 - DNA, 22 bp, Artificial Sequence
  chemically synthesized
catctgtttctaattgtgcatg

SEQ ID NO: 937779 - DNA, 22 bp, Artificial Sequence
  chemically synthesized
ttacatctgtttctaattgtgc

SEQ ID NO: 937780 - DNA, 22 bp, Artificial Sequence
  chemically synthesized
ggacaatccatgcacaattaga

SEQ ID NO: 937781 - DNA, 22 bp, Artificial Sequence
  chemically synthesized
gacaatccatgcacaattagaa

SEQ ID NO: 937782 - DNA, 22 bp, Artificial Sequence
  chemically synthesized
aagccattgttacatctgtttc

SEQ ID NO: 937783 - DNA, 22 bp, Artificial Sequence
  chemically synthesized
gaaacagatgtaacaatggctt

SEQ ID NO: 937784 - DNA, 22 bp, Artificial Sequence
  chemically synthesized
tccgtcatgcatctaaagccat

SEQ ID NO: 937785 - DNA, 22 bp, Artificial Sequence
  chemically synthesized
atccgtcatgcatctaaagcca

SEQ ID NO: 937786 - DNA, 22 bp, Artificial Sequence
  chemically synthesized
tagtttatccgtcatgcatcta

SEQ ID NO: 937787 - DNA, 22 bp, Artificial Sequence
  chemically synthesized
atagtttatccgtcatgcatct

SEQ ID NO: 937788 - DNA, 22 bp, Artificial Sequence
  chemically synthesized
tggcccttatagtttatccgtc

SEQ ID NO: 937789 - DNA, 22 bp, Artificial Sequence
  chemically synthesized
tagatgcatgacggataaacta

SEQ ID NO: 937790 - DNA, 22 bp, Artificial Sequence
  chemically synthesized
agatgcatgacggataaactat

SEQ ID NO: 937791 - DNA, 22 bp, Artificial Sequence
  chemically synthesized
gatgcatgacggataaactata

SEQ ID NO: 937792 - DNA, 22 bp, Artificial Sequence
  chemically synthesized
tgcaactgtggcccttatagtt

SEQ ID NO: 937793 - DNA, 22 bp, Artificial Sequence
  chemically synthesized
tagagtcagagtactatgcaac

SEQ ID NO: 937794 - DNA, 22 bp, Artificial Sequence
  chemically synthesized
taagggccacagttgcatagta

SEQ ID NO: 937795 - DNA, 22 bp, Artificial Sequence
  chemically synthesized
atagagtcagagtactatgcaa

SEQ ID NO: 937796 - DNA, 22 bp, Artificial Sequence
  chemically synthesized
aaatgtacacttatagagtcag

SEQ ID NO: 937797 - DNA, 22 bp, Artificial Sequence
  chemically synthesized
aaaatgtacacttatagagtca

SEQ ID NO: 937798 - DNA, 22 bp, Artificial Sequence
  chemically synthesized
catagtactctgactctataag

SEQ ID NO: 937799 - DNA, 22 bp, Artificial Sequence
  chemically synthesized
aaggtgtttaaaatgtacactt

SEQ ID NO: 937800 - DNA, 22 bp, Artificial Sequence
  chemically synthesized
tgactctataagtgtacatttt

SEQ ID NO: 937801 - DNA, 22 bp, Artificial Sequence
  chemically synthesized
actctataagtgtacattttaa

SEQ ID NO: 937802 - DNA, 22 bp, Artificial Sequence
  chemically synthesized
tataagtgtacattttaaacac

SEQ ID NO: 937803 - DNA, 22 bp, Artificial Sequence
  chemically synthesized
gaaggcattgaaggtgtttaaa

SEQ ID NO: 937804 - DNA, 22 bp, Artificial Sequence
  chemically synthesized
taagtgtacattttaaacacct

SEQ ID NO: 937805 - DNA, 22 bp, Artificial Sequence
  chemically synthesized
agaaggcattgaaggtgtttaa

SEQ ID NO: 937806 - DNA, 22 bp, Artificial Sequence
  chemically synthesized
tagaaggcattgaaggtgttta

SEQ ID NO: 937807 - DNA, 22 bp, Artificial Sequence
  chemically synthesized
tgttttagaaggcattgaaggt

SEQ ID NO: 937808 - DNA, 22 bp, Artificial Sequence
  chemically synthesized
atgttttagaaggcattgaagg

SEQ ID NO: 937809 - DNA, 22 bp, Artificial Sequence
  chemically synthesized
ttatgttttagaaggcattgaa

SEQ ID NO: 937810 - DNA, 22 bp, Artificial Sequence
  chemically synthesized
ttcttatgttttagaaggcatt

SEQ ID NO: 937811 - DNA, 22 bp, Artificial Sequence
  chemically synthesized
taaacaccttcaatgccttcta

SEQ ID NO: 937812 - DNA, 22 bp, Artificial Sequence
  chemically synthesized
gttcttatgttttagaaggcat

SEQ ID NO: 937813 - DNA, 22 bp, Artificial Sequence
  chemically synthesized
aaacaccttcaatgccttctaa

SEQ ID NO: 937814 - DNA, 22 bp, Artificial Sequence
  chemically synthesized
tgttcttatgttttagaaggca

SEQ ID NO: 937815 - DNA, 22 bp, Artificial Sequence
  chemically synthesized
aacaccttcaatgccttctaaa

SEQ ID NO: 937816 - DNA, 22 bp, Artificial Sequence
  chemically synthesized
ttgttcttatgttttagaaggc

SEQ ID NO: 937817 - DNA, 22 bp, Artificial Sequence
  chemically synthesized
caatgccttctaaaacataaga

SEQ ID NO: 937818 - DNA, 22 bp, Artificial Sequence
  chemically synthesized
aatgccttctaaaacataagaa

SEQ ID NO: 937819 - DNA, 22 bp, Artificial Sequence
  chemically synthesized
ccagaacaatttttgttcttat

SEQ ID NO: 937820 - DNA, 22 bp, Artificial Sequence
  chemically synthesized
ctaaaacataagaacaaaaatt

SEQ ID NO: 937821 - DNA, 22 bp, Artificial Sequence
  chemically synthesized
taaaacataagaacaaaaattg

SEQ ID NO: 937822 - DNA, 22 bp, Artificial Sequence
  chemically synthesized
aaacataagaacaaaaattgtt

SEQ ID NO: 937823 - DNA, 22 bp, Artificial Sequence
  chemically synthesized
agtagaagtcatcaaagttacc

SEQ ID NO: 937824 - DNA, 22 bp, Artificial Sequence
  chemically synthesized
ttctggtaactttgatgacttc

SEQ ID NO: 937825 - DNA, 22 bp, Artificial Sequence
  chemically synthesized
tggtaactttgatgacttctac

SEQ ID NO: 937826 - DNA, 22 bp, Artificial Sequence
  chemically synthesized
gtaactttgatgacttctactt

SEQ ID NO: 937827 - DNA, 22 bp, Artificial Sequence
  chemically synthesized
agaaagacaacgattaagtaga

SEQ ID NO: 937828 - DNA, 22 bp, Artificial Sequence
  chemically synthesized
tgagaaagacaacgattaagta

SEQ ID NO: 937829 - DNA, 22 bp, Artificial Sequence
  chemically synthesized
tgatgacttctacttaatcgtt

SEQ ID NO: 937830 - DNA, 22 bp, Artificial Sequence
  chemically synthesized
gatgacttctacttaatcgttg

SEQ ID NO: 937831 - DNA, 22 bp, Artificial Sequence
  chemically synthesized
ttctgagaaagacaacgattaa

SEQ ID NO: 937832 - DNA, 22 bp, Artificial Sequence
  chemically synthesized
atgacttctacttaatcgttgt

SEQ ID NO: 937833 - DNA, 22 bp, Artificial Sequence
  chemically synthesized
gttctgagaaagacaacgatta

SEQ ID NO: 937834 - DNA, 22 bp, Artificial Sequence
  chemically synthesized
tttgttctgagaaagacaacga

SEQ ID NO: 937835 - DNA, 22 bp, Artificial Sequence
  chemically synthesized
ctacttaatcgttgtctttctc

SEQ ID NO: 937836 - DNA, 22 bp, Artificial Sequence
  chemically synthesized
tacttaatcgttgtctttctca

SEQ ID NO: 937837 - DNA, 22 bp, Artificial Sequence
  chemically synthesized
aacctatttgttctgagaaaga

SEQ ID NO: 937838 - DNA, 22 bp, Artificial Sequence
  chemically synthesized
cttaatcgttgtctttctcaga

SEQ ID NO: 937839 - DNA, 22 bp, Artificial Sequence
  chemically synthesized
aatcgttgtctttctcagaaca

SEQ ID NO: 937840 - DNA, 22 bp, Artificial Sequence
  chemically synthesized
atcgttgtctttctcagaacaa

SEQ ID NO: 937841 - DNA, 22 bp, Artificial Sequence
  chemically synthesized
tgttcaacctatttgttctgag

SEQ ID NO: 937842 - DNA, 22 bp, Artificial Sequence
  chemically synthesized
atgttcaacctatttgttctga

SEQ ID NO: 937843 - DNA, 22 bp, Artificial Sequence
  chemically synthesized
catttatgttcaacctatttgt

SEQ ID NO: 937844 - DNA, 22 bp, Artificial Sequence
  chemically synthesized
tctttctcagaacaaataggtt

SEQ ID NO: 937845 - DNA, 22 bp, Artificial Sequence
  chemically synthesized
tctcagaacaaataggttgaac

SEQ ID NO: 937846 - DNA, 22 bp, Artificial Sequence
  chemically synthesized
ctcagaacaaataggttgaaca

SEQ ID NO: 937847 - DNA, 22 bp, Artificial Sequence
  chemically synthesized
tcagaacaaataggttgaacat

SEQ ID NO: 937848 - DNA, 22 bp, Artificial Sequence
  chemically synthesized
agaacaaataggttgaacataa

SEQ ID NO: 937849 - DNA, 22 bp, Artificial Sequence
  chemically synthesized
tcaaacagcattgcatttatgt

SEQ ID NO: 937850 - DNA, 22 bp, Artificial Sequence
  chemically synthesized
acaaaattatcaaacagcattg

SEQ ID NO: 937851 - DNA, 22 bp, Artificial Sequence
  chemically synthesized
aacaaaattatcaaacagcatt

SEQ ID NO: 937852 - DNA, 22 bp, Artificial Sequence
  chemically synthesized
aacataaatgcaatgctgtttg

SEQ ID NO: 937853 - DNA, 22 bp, Artificial Sequence
  chemically synthesized
taacaaaattatcaaacagcat

SEQ ID NO: 937854 - DNA, 22 bp, Artificial Sequence
  chemically synthesized
aacattttaacaaaattatcaa

SEQ ID NO: 937855 - DNA, 22 bp, Artificial Sequence
  chemically synthesized
gaacattttaacaaaattatca

SEQ ID NO: 937856 - DNA, 22 bp, Artificial Sequence
  chemically synthesized
tttgaacattttaacaaaatta

SEQ ID NO: 937857 - DNA, 22 bp, Artificial Sequence
  chemically synthesized
atttgaacattttaacaaaatt

SEQ ID NO: 937858 - DNA, 22 bp, Artificial Sequence
  chemically synthesized
tatttgaacattttaacaaaat

SEQ ID NO: 937859 - DNA, 22 bp, Artificial Sequence
  chemically synthesized
ttatttgaacattttaacaaaa

SEQ ID NO: 937860 - DNA, 22 bp, Artificial Sequence
  chemically synthesized
tttatttgaacattttaacaaa

SEQ ID NO: 937861 - DNA, 22 bp, Artificial Sequence
  chemically synthesized
tttgataattttgttaaaatgt

SEQ ID NO: 937862 - DNA, 22 bp, Artificial Sequence
  chemically synthesized
ttttttatttgaacattttaac

SEQ ID NO: 937863 - DNA, 22 bp, Artificial Sequence
  chemically synthesized
gataattttgttaaaatgttca

SEQ ID NO: 937864 - DNA, 22 bp, Artificial Sequence
  chemically synthesized
ataattttgttaaaatgttcaa

SEQ ID NO: 937865 - DNA, 22 bp, Artificial Sequence
  chemically synthesized
tgttaaaatgttcaaataaaaa

SEQ ID NO: 937866 - DNA, 22 bp, Artificial Sequence
  chemically synthesized
ataaatcactgttttttatttg

SEQ ID NO: 937867 - DNA, 22 bp, Artificial Sequence
  chemically synthesized
gttaaaatgttcaaataaaaaa

SEQ ID NO: 937868 - DNA, 22 bp, Artificial Sequence
  chemically synthesized
ttaaaatgttcaaataaaaaac

SEQ ID NO: 937869 - DNA, 22 bp, Artificial Sequence
  chemically synthesized
aaatgttcaaataaaaaacagt

SEQ ID NO: 937870 - DNA, 22 bp, Artificial Sequence
  chemically synthesized
gatgggacctaataaatcactg

SEQ ID NO: 937871 - DNA, 22 bp, Artificial Sequence
  chemically synthesized
cgatgggacctaataaatcact

SEQ ID NO: 937872 - DNA, 22 bp, Artificial Sequence
  chemically synthesized
aaataaaaaacagtgatttatt

SEQ ID NO: 937873 - DNA, 22 bp, Artificial Sequence
  chemically synthesized
tcgatgggacctaataaatcac

SEQ ID NO: 937874 - DNA, 22 bp, Artificial Sequence
  chemically synthesized
attaggtcccatcgaaaattgc

SEQ ID NO: 937875 - DNA, 22 bp, Artificial Sequence
  chemically synthesized
ttaggtcccatcgaaaattgcc

SEQ ID NO: 937876 - DNA, 22 bp, Artificial Sequence
  chemically synthesized
tatacataaataggcaattttc

SEQ ID NO: 937877 - DNA, 22 bp, Artificial Sequence
  chemically synthesized
ggtcccatcgaaaattgcctat

SEQ ID NO: 937878 - DNA, 22 bp, Artificial Sequence
  chemically synthesized
ttgtatacataaataggcaatt

SEQ ID NO: 937879 - DNA, 22 bp, Artificial Sequence
  chemically synthesized
attgtatacataaataggcaat

SEQ ID NO: 937880 - DNA, 22 bp, Artificial Sequence
  chemically synthesized
atgcttattgtatacataaata

SEQ ID NO: 937881 - DNA, 22 bp, Artificial Sequence
  chemically synthesized
tcatgcttattgtatacataaa

SEQ ID NO: 937882 - DNA, 22 bp, Artificial Sequence
  chemically synthesized
ctcatgcttattgtatacataa

SEQ ID NO: 937883 - DNA, 22 bp, Artificial Sequence
  chemically synthesized
gatttctcatgcttattgtata

SEQ ID NO: 937884 - DNA, 22 bp, Artificial Sequence
  chemically synthesized
ggatttctcatgcttattgtat

SEQ ID NO: 937885 - DNA, 22 bp, Artificial Sequence
  chemically synthesized
cctatttatgtatacaataagc

SEQ ID NO: 937886 - DNA, 22 bp, Artificial Sequence
  chemically synthesized
tggatttctcatgcttattgta

SEQ ID NO: 937887 - DNA, 22 bp, Artificial Sequence
  chemically synthesized
ctttggatttctcatgcttatt

SEQ ID NO: 937888 - DNA, 22 bp, Artificial Sequence
  chemically synthesized
tttatgtatacaataagcatga

SEQ ID NO: 937889 - DNA, 22 bp, Artificial Sequence
  chemically synthesized
cctttggatttctcatgcttat

SEQ ID NO: 937890 - DNA, 22 bp, Artificial Sequence
  chemically synthesized
tcctttggatttctcatgctta

SEQ ID NO: 937891 - DNA, 22 bp, Artificial Sequence
  chemically synthesized
atgtatacaataagcatgagaa

SEQ ID NO: 937892 - DNA, 22 bp, Artificial Sequence
  chemically synthesized
tgtatacaataagcatgagaaa

SEQ ID NO: 937893 - DNA, 22 bp, Artificial Sequence
  chemically synthesized
atgaagctttcctttggatttc

SEQ ID NO: 937894 - DNA, 22 bp, Artificial Sequence
  chemically synthesized
catgaagctttcctttggattt

SEQ ID NO: 937895 - DNA, 22 bp, Artificial Sequence
  chemically synthesized
aggtaatttcatgaagctttcc

SEQ ID NO: 937896 - DNA, 22 bp, Artificial Sequence
  chemically synthesized
aaggtaatttcatgaagctttc

SEQ ID NO: 937897 - DNA, 22 bp, Artificial Sequence
  chemically synthesized
gcatttaaggtaatttcatgaa

SEQ ID NO: 937898 - DNA, 22 bp, Artificial Sequence
  chemically synthesized
aaaactagcatttaaggtaatt

SEQ ID NO: 937899 - DNA, 22 bp, Artificial Sequence
  chemically synthesized
catgaaattaccttaaatgcta

SEQ ID NO: 937900 - DNA, 22 bp, Artificial Sequence
  chemically synthesized
atgaaattaccttaaatgctag

SEQ ID NO: 937901 - DNA, 22 bp, Artificial Sequence
  chemically synthesized
aaaggaggttaaaaactagcat

SEQ ID NO: 937902 - DNA, 22 bp, Artificial Sequence
  chemically synthesized
attcaaaggaggttaaaaacta

SEQ ID NO: 937903 - DNA, 22 bp, Artificial Sequence
  chemically synthesized
ccttaaatgctagtttttaacc

SEQ ID NO: 937904 - DNA, 22 bp, Artificial Sequence
  chemically synthesized
gctcattcaaaggaggttaaaa

SEQ ID NO: 937905 - DNA, 22 bp, Artificial Sequence
  chemically synthesized
aaatgctagtttttaacctcct

SEQ ID NO: 937906 - DNA, 22 bp, Artificial Sequence
  chemically synthesized
aatgctagtttttaacctcctt

SEQ ID NO: 937907 - DNA, 22 bp, Artificial Sequence
  chemically synthesized
gtttttaacctcctttgaatga

SEQ ID NO: 937908 - DNA, 22 bp, Artificial Sequence
  chemically synthesized
ttaacctcctttgaatgagcca

SEQ ID NO: 937909 - DNA, 22 bp, Artificial Sequence
  chemically synthesized
taacctcctttgaatgagccaa

SEQ ID NO: 937910 - DNA, 22 bp, Artificial Sequence
  chemically synthesized
aacctcctttgaatgagccaat

SEQ ID NO: 937911 - DNA, 22 bp, Artificial Sequence
  chemically synthesized
aagggaacacacattggctcat

SEQ ID NO: 937912 - DNA, 22 bp, Artificial Sequence
  chemically synthesized
acctcctttgaatgagccaatg

SEQ ID NO: 937913 - DNA, 22 bp, Artificial Sequence
  chemically synthesized
tcaagggaacacacattggctc

SEQ ID NO: 937914 - DNA, 22 bp, Artificial Sequence
  chemically synthesized
ctcaagggaacacacattggct

SEQ ID NO: 937915 - DNA, 22 bp, Artificial Sequence
  chemically synthesized
ctttgaatgagccaatgtgtgt

SEQ ID NO: 937916 - DNA, 22 bp, Artificial Sequence
  chemically synthesized
cttctcaagggaacacacattg

SEQ ID NO: 937917 - DNA, 22 bp, Artificial Sequence
  chemically synthesized
ccttctcaagggaacacacatt

SEQ ID NO: 937918 - DNA, 22 bp, Artificial Sequence
  chemically synthesized
tgaatgagccaatgtgtgttcc

SEQ ID NO: 937919 - DNA, 22 bp, Artificial Sequence
  chemically synthesized
gaatgagccaatgtgtgttccc

SEQ ID NO: 937920 - DNA, 22 bp, Artificial Sequence
  chemically synthesized
aatgagccaatgtgtgttccct

SEQ ID NO: 937921 - DNA, 22 bp, Artificial Sequence
  chemically synthesized
agaaagtttccttctcaaggga

SEQ ID NO: 937922 - DNA, 22 bp, Artificial Sequence
  chemically synthesized
ccttgagaaggaaactttctca

SEQ ID NO: 937923 - DNA, 22 bp, Artificial Sequence
  chemically synthesized
aatagtcacagacctgagaaag

SEQ ID NO: 937924 - DNA, 22 bp, Artificial Sequence
  chemically synthesized
aaatagtcacagacctgagaaa

SEQ ID NO: 937925 - DNA, 22 bp, Artificial Sequence
  chemically synthesized
gagaaggaaactttctcaggtc

SEQ ID NO: 937926 - DNA, 22 bp, Artificial Sequence
  chemically synthesized
taaatagtcacagacctgagaa

SEQ ID NO: 937927 - DNA, 22 bp, Artificial Sequence
  chemically synthesized
agaaggaaactttctcaggtct

SEQ ID NO: 937928 - DNA, 22 bp, Artificial Sequence
  chemically synthesized
tctcaggtctgtgactatttaa

SEQ ID NO: 937929 - DNA, 22 bp, Artificial Sequence
  chemically synthesized
ctcaggtctgtgactatttaaa

SEQ ID NO: 937930 - DNA, 22 bp, Artificial Sequence
  chemically synthesized
tcaggtctgtgactatttaaag

SEQ ID NO: 937931 - DNA, 22 bp, Artificial Sequence
  chemically synthesized
aggtctgtgactatttaaagga

SEQ ID NO: 937932 - DNA, 22 bp, Artificial Sequence
  chemically synthesized
caatagaaaaataaatccttta

SEQ ID NO: 937933 - DNA, 22 bp, Artificial Sequence
  chemically synthesized
acaatagaaaaataaatccttt

SEQ ID NO: 937934 - DNA, 22 bp, Artificial Sequence
  chemically synthesized
tgactatttaaaggatttattt

SEQ ID NO: 937935 - DNA, 22 bp, Artificial Sequence
  chemically synthesized
tttaaaggatttatttttctat

SEQ ID NO: 937936 - DNA, 22 bp, Artificial Sequence
  chemically synthesized
aaaggatttatttttctattgt

SEQ ID NO: 937937 - DNA, 22 bp, Artificial Sequence
  chemically synthesized
aaggatttatttttctattgta

SEQ ID NO: 937938 - DNA, 22 bp, Artificial Sequence
  chemically synthesized
tgtgaaaagaaaacttacaata

SEQ ID NO: 937939 - DNA, 22 bp, Artificial Sequence
  chemically synthesized
atttttctattgtaagttttct

SEQ ID NO: 937940 - DNA, 22 bp, Artificial Sequence
  chemically synthesized
tttttctattgtaagttttctt

SEQ ID NO: 937941 - DNA, 22 bp, Artificial Sequence
  chemically synthesized
gtgttatgtgaaaagaaaactt

SEQ ID NO: 937942 - DNA, 22 bp, Artificial Sequence
  chemically synthesized
ttctattgtaagttttcttttc

SEQ ID NO: 937943 - DNA, 22 bp, Artificial Sequence
  chemically synthesized
tctattgtaagttttcttttca

SEQ ID NO: 937944 - DNA, 22 bp, Artificial Sequence
  chemically synthesized
ctattgtaagttttcttttcac

SEQ ID NO: 937945 - DNA, 22 bp, Artificial Sequence
  chemically synthesized
tattgtaagttttcttttcaca

SEQ ID NO: 937946 - DNA, 22 bp, Artificial Sequence
  chemically synthesized
ttgtaagttttcttttcacata

SEQ ID NO: 937947 - DNA, 22 bp, Artificial Sequence
  chemically synthesized
taagttttcttttcacataaca

SEQ ID NO: 937948 - DNA, 22 bp, Artificial Sequence
  chemically synthesized
tcaccagggtcactggtgttat

SEQ ID NO: 937949 - DNA, 22 bp, Artificial Sequence
  chemically synthesized
tcttttcacataacaccagtga

SEQ ID NO: 937950 - DNA, 22 bp, Artificial Sequence
  chemically synthesized
ctatcaccagggtcactggtgt

SEQ ID NO: 937951 - DNA, 22 bp, Artificial Sequence
  chemically synthesized
cttttcacataacaccagtgac

SEQ ID NO: 937952 - DNA, 22 bp, Artificial Sequence
  chemically synthesized
actatcaccagggtcactggtg

SEQ ID NO: 937953 - DNA, 22 bp, Artificial Sequence
  chemically synthesized
ttttcacataacaccagtgacc

SEQ ID NO: 937954 - DNA, 22 bp, Artificial Sequence
  chemically synthesized
tactatcaccagggtcactggt

SEQ ID NO: 937955 - DNA, 22 bp, Artificial Sequence
  chemically synthesized
ttcacataacaccagtgaccct

SEQ ID NO: 937956 - DNA, 22 bp, Artificial Sequence
  chemically synthesized
tcacataacaccagtgaccctg

SEQ ID NO: 937957 - DNA, 22 bp, Artificial Sequence
  chemically synthesized
cacataacaccagtgaccctgg

SEQ ID NO: 937958 - DNA, 22 bp, Artificial Sequence
  chemically synthesized
acataacaccagtgaccctggt

SEQ ID NO: 937959 - DNA, 22 bp, Artificial Sequence
  chemically synthesized
aagctttactatcaccagggtc

SEQ ID NO: 937960 - DNA, 22 bp, Artificial Sequence
  chemically synthesized
accaagtgctaaagctttacta

SEQ ID NO: 937961 - DNA, 22 bp, Artificial Sequence
  chemically synthesized
aaccaagtgctaaagctttact

SEQ ID NO: 937962 - DNA, 22 bp, Artificial Sequence
  chemically synthesized
gtgatagtaaagctttagcact

SEQ ID NO: 937963 - DNA, 22 bp, Artificial Sequence
  chemically synthesized
taacgcaggagtttaaccaagt

SEQ ID NO: 937964 - DNA, 22 bp, Artificial Sequence
  chemically synthesized
tagcacttggttaaactcctgc

SEQ ID NO: 937965 - DNA, 22 bp, Artificial Sequence
  chemically synthesized
agcacttggttaaactcctgcg

SEQ ID NO: 937966 - DNA, 22 bp, Artificial Sequence
  chemically synthesized
gcacttggttaaactcctgcgt

SEQ ID NO: 937967 - DNA, 22 bp, Artificial Sequence
  chemically synthesized
ggttaaactcctgcgttataat

SEQ ID NO: 937968 - DNA, 22 bp, Artificial Sequence
  chemically synthesized
gttaaactcctgcgttataatg

SEQ ID NO: 937969 - DNA, 22 bp, Artificial Sequence
  chemically synthesized
aactcctgcgttataatgtatc

SEQ ID NO: 937970 - DNA, 22 bp, Artificial Sequence
  chemically synthesized
tacaatatgataatatgataca

SEQ ID NO: 937971 - DNA, 22 bp, Artificial Sequence
  chemically synthesized
ctgcgttataatgtatcatatt

SEQ ID NO: 937972 - DNA, 22 bp, Artificial Sequence
  chemically synthesized
tatacaatatgataatatgata

SEQ ID NO: 937973 - DNA, 22 bp, Artificial Sequence
  chemically synthesized
ctatacaatatgataatatgat

SEQ ID NO: 937974 - DNA, 22 bp, Artificial Sequence
  chemically synthesized
cgttataatgtatcatattatc

SEQ ID NO: 937975 - DNA, 22 bp, Artificial Sequence
  chemically synthesized
taatgtatcatattatcatatt

SEQ ID NO: 937976 - DNA, 22 bp, Artificial Sequence
  chemically synthesized
gaaagtacagcttctatacaat

SEQ ID NO: 937977 - DNA, 22 bp, Artificial Sequence
  chemically synthesized
tcatattgtatagaagctgtac

SEQ ID NO: 937978 - DNA, 22 bp, Artificial Sequence
  chemically synthesized
tcccactggaaagtacagcttc

SEQ ID NO: 937979 - DNA, 22 bp, Artificial Sequence
  chemically synthesized
atgactatcccactggaaagta

SEQ ID NO: 937980 - DNA, 22 bp, Artificial Sequence
  chemically synthesized
tatagaagctgtactttccagt

SEQ ID NO: 937981 - DNA, 22 bp, Artificial Sequence
  chemically synthesized
tactttccagtgggatagtcat

SEQ ID NO: 937982 - DNA, 22 bp, Artificial Sequence
  chemically synthesized
tccagtgggatagtcattagcc

SEQ ID NO: 937983 - DNA, 22 bp, Artificial Sequence
  chemically synthesized
ccagtgggatagtcattagcca

SEQ ID NO: 937984 - DNA, 22 bp, Artificial Sequence
  chemically synthesized
tatagccacatgtggctaatga

SEQ ID NO: 937985 - DNA, 22 bp, Artificial Sequence
  chemically synthesized
cagtgggatagtcattagccac

SEQ ID NO: 937986 - DNA, 22 bp, Artificial Sequence
  chemically synthesized
atatagccacatgtggctaatg

SEQ ID NO: 937987 - DNA, 22 bp, Artificial Sequence
  chemically synthesized
aatttatatagccacatgtggc

SEQ ID NO: 937988 - DNA, 22 bp, Artificial Sequence
  chemically synthesized
aaatttatatagccacatgtgg

SEQ ID NO: 937989 - DNA, 22 bp, Artificial Sequence
  chemically synthesized
atttaaatttatatagccacat

SEQ ID NO: 937990 - DNA, 22 bp, Artificial Sequence
  chemically synthesized
aattaatttaaatttatatagc

SEQ ID NO: 937991 - DNA, 22 bp, Artificial Sequence
  chemically synthesized
caattaatttaaatttatatag

SEQ ID NO: 937992 - DNA, 22 bp, Artificial Sequence
  chemically synthesized
gccacatgtggctatataaatt

SEQ ID NO: 937993 - DNA, 22 bp, Artificial Sequence
  chemically synthesized
atttcaattaatttaaatttat

SEQ ID NO: 937994 - DNA, 22 bp, Artificial Sequence
  chemically synthesized
aatttcaattaatttaaattta

SEQ ID NO: 937995 - DNA, 22 bp, Artificial Sequence
  chemically synthesized
tttaatttcaattaatttaaat

SEQ ID NO: 937996 - DNA, 22 bp, Artificial Sequence
  chemically synthesized
atttaatttcaattaatttaaa

SEQ ID NO: 937997 - DNA, 22 bp, Artificial Sequence
  chemically synthesized
tatttaatttcaattaatttaa

SEQ ID NO: 937998 - DNA, 22 bp, Artificial Sequence
  chemically synthesized
actttatttaatttcaattaat

SEQ ID NO: 937999 - DNA, 22 bp, Artificial Sequence
  chemically synthesized
tataaatttaaattaattgaaa

SEQ ID NO: 938000 - DNA, 22 bp, Artificial Sequence
  chemically synthesized
aactttatttaatttcaattaa

SEQ ID NO: 938001 - DNA, 22 bp, Artificial Sequence
  chemically synthesized
taactttatttaatttcaatta

SEQ ID NO: 938002 - DNA, 22 bp, Artificial Sequence
  chemically synthesized
aagttttaactttatttaattt

SEQ ID NO: 938003 - DNA, 22 bp, Artificial Sequence
  chemically synthesized
aaattaattgaaattaaataaa

SEQ ID NO: 938004 - DNA, 22 bp, Artificial Sequence
  chemically synthesized
aattaattgaaattaaataaag

SEQ ID NO: 938005 - DNA, 22 bp, Artificial Sequence
  chemically synthesized
attgaaattaaataaagttaaa

SEQ ID NO: 938006 - DNA, 22 bp, Artificial Sequence
  chemically synthesized
aaattaaataaagttaaaactt

SEQ ID NO: 938007 - DNA, 22 bp, Artificial Sequence
  chemically synthesized
gtgggaatgaagaactgaagtt

SEQ ID NO: 938008 - DNA, 22 bp, Artificial Sequence
  chemically synthesized
aataaagttaaaacttcagttc

SEQ ID NO: 938009 - DNA, 22 bp, Artificial Sequence
  chemically synthesized
agtgggaatgaagaactgaagt

SEQ ID NO: 938010 - DNA, 22 bp, Artificial Sequence
  chemically synthesized
aaacttcagttcttcattccca

SEQ ID NO: 938011 - DNA, 22 bp, Artificial Sequence
  chemically synthesized
aaatgtgcttagtgggaatgaa

SEQ ID NO: 938012 - DNA, 22 bp, Artificial Sequence
  chemically synthesized
gaaatgtgcttagtgggaatga

SEQ ID NO: 938013 - DNA, 22 bp, Artificial Sequence
  chemically synthesized
cagttcttcattcccactaagc

SEQ ID NO: 938014 - DNA, 22 bp, Artificial Sequence
  chemically synthesized
agttcttcattcccactaagca

SEQ ID NO: 938015 - DNA, 22 bp, Artificial Sequence
  chemically synthesized
agaacttgaaatgtgcttagtg

SEQ ID NO: 938016 - DNA, 22 bp, Artificial Sequence
  chemically synthesized
ttcattcccactaagcacattt

SEQ ID NO: 938017 - DNA, 22 bp, Artificial Sequence
  chemically synthesized
cattcccactaagcacatttca

SEQ ID NO: 938018 - DNA, 22 bp, Artificial Sequence
  chemically synthesized
attcccactaagcacatttcaa

SEQ ID NO: 938019 - DNA, 22 bp, Artificial Sequence
  chemically synthesized
ccactaagcacatttcaagttc

SEQ ID NO: 938020 - DNA, 22 bp, Artificial Sequence
  chemically synthesized
agcacatttcaagttctcaatg

SEQ ID NO: 938021 - DNA, 22 bp, Artificial Sequence
  chemically synthesized
gaaatgcagtataatgtggcca

SEQ ID NO: 938022 - DNA, 22 bp, Artificial Sequence
  chemically synthesized
caagttctcaatggccacatta

SEQ ID NO: 938023 - DNA, 22 bp, Artificial Sequence
  chemically synthesized
aagttctcaatggccacattat

SEQ ID NO: 938024 - DNA, 22 bp, Artificial Sequence
  chemically synthesized
aatgttagaaatgcagtataat

SEQ ID NO: 938025 - DNA, 22 bp, Artificial Sequence
  chemically synthesized
tcaatggccacattatactgca

SEQ ID NO: 938026 - DNA, 22 bp, Artificial Sequence
  chemically synthesized
caatgttagaaatgcagtataa

SEQ ID NO: 938027 - DNA, 22 bp, Artificial Sequence
  chemically synthesized
aatggccacattatactgcatt

SEQ ID NO: 938028 - DNA, 22 bp, Artificial Sequence
  chemically synthesized
ttcaatgttagaaatgcagtat

SEQ ID NO: 938029 - DNA, 22 bp, Artificial Sequence
  chemically synthesized
tagaacattcttcaatgttaga

SEQ ID NO: 938030 - DNA, 22 bp, Artificial Sequence
  chemically synthesized
atagaacattcttcaatgttag

SEQ ID NO: 938031 - DNA, 22 bp, Artificial Sequence
  chemically synthesized
tactgcatttctaacattgaag

SEQ ID NO: 938032 - DNA, 22 bp, Artificial Sequence
  chemically synthesized
tcttatagaacattcttcaatg

SEQ ID NO: 938033 - DNA, 22 bp, Artificial Sequence
  chemically synthesized
catttctaacattgaagaatgt

SEQ ID NO: 938034 - DNA, 22 bp, Artificial Sequence
  chemically synthesized
ctaacattgaagaatgttctat

SEQ ID NO: 938035 - DNA, 22 bp, Artificial Sequence
  chemically synthesized
taacattgaagaatgttctata

SEQ ID NO: 938036 - DNA, 22 bp, Artificial Sequence
  chemically synthesized
tcacccctatcttatagaacat

SEQ ID NO: 938037 - DNA, 22 bp, Artificial Sequence
  chemically synthesized
acattgaagaatgttctataag

SEQ ID NO: 938038 - DNA, 22 bp, Artificial Sequence
  chemically synthesized
tatcacccctatcttatagaac

SEQ ID NO: 938039 - DNA, 22 bp, Artificial Sequence
  chemically synthesized
tctatcacccctatcttataga

SEQ ID NO: 938040 - DNA, 22 bp, Artificial Sequence
  chemically synthesized
aagaatgttctataagataggg

SEQ ID NO: 938041 - DNA, 22 bp, Artificial Sequence
  chemically synthesized
tataagataggggtgatagaga

SEQ ID NO: 938042 - DNA, 22 bp, Artificial Sequence
  chemically synthesized
taagataggggtgatagagaga

SEQ ID NO: 938043 - DNA, 22 bp, Artificial Sequence
  chemically synthesized
gtggcagagatagacaaagaag

SEQ ID NO: 938044 - DNA, 22 bp, Artificial Sequence
  chemically synthesized
ctttgtctatctctgccactag

SEQ ID NO: 938045 - DNA, 22 bp, Artificial Sequence
  chemically synthesized
accagggataaactagtggcag

SEQ ID NO: 938046 - DNA, 22 bp, Artificial Sequence
  chemically synthesized
tttgtctatctctgccactagt

SEQ ID NO: 938047 - DNA, 22 bp, Artificial Sequence
  chemically synthesized
tgtctatctctgccactagttt

SEQ ID NO: 938048 - DNA, 22 bp, Artificial Sequence
  chemically synthesized
ctcaccagggataaactagtgg

SEQ ID NO: 938049 - DNA, 22 bp, Artificial Sequence
  chemically synthesized
gtctatctctgccactagttta

SEQ ID NO: 938050 - DNA, 22 bp, Artificial Sequence
  chemically synthesized
tctatctctgccactagtttat

SEQ ID NO: 938051 - DNA, 22 bp, Artificial Sequence
  chemically synthesized
ccctcctcaccagggataaact

SEQ ID NO: 938052 - DNA, 22 bp, Artificial Sequence
  chemically synthesized
tctctgccactagtttatccct

SEQ ID NO: 938053 - DNA, 22 bp, Artificial Sequence
  chemically synthesized
tgccactagtttatccctggtg

SEQ ID NO: 938054 - DNA, 22 bp, Artificial Sequence
  chemically synthesized
ccactagtttatccctggtgag

SEQ ID NO: 938055 - DNA, 22 bp, Artificial Sequence
  chemically synthesized
aacccctgccctcctcaccagg

SEQ ID NO: 938056 - DNA, 22 bp, Artificial Sequence
  chemically synthesized
gtttatccctggtgaggagggc

SEQ ID NO: 938057 - DNA, 22 bp, Artificial Sequence
  chemically synthesized
tgctcaacccctgccctcctca

SEQ ID NO: 938058 - DNA, 22 bp, Artificial Sequence
  chemically synthesized
atccctggtgaggagggcaggg

SEQ ID NO: 938059 - DNA, 22 bp, Artificial Sequence
  chemically synthesized
tccctggtgaggagggcagggg

SEQ ID NO: 938060 - DNA, 22 bp, Artificial Sequence
  chemically synthesized
gtgaggagggcaggggttgagc

SEQ ID NO: 938061 - DNA, 22 bp, Artificial Sequence
  chemically synthesized
tatgcaacccattatgctcaac

SEQ ID NO: 938062 - DNA, 22 bp, Artificial Sequence
  chemically synthesized
tatgtgcccgttgtatgcaacc

SEQ ID NO: 938063 - DNA, 22 bp, Artificial Sequence
  chemically synthesized
atatgtgcccgttgtatgcaac

SEQ ID NO: 938064 - DNA, 22 bp, Artificial Sequence
  chemically synthesized
agcataatgggttgcatacaac

SEQ ID NO: 938065 - DNA, 22 bp, Artificial Sequence
  chemically synthesized
agcacttatatgtgcccgttgt

SEQ ID NO: 938066 - DNA, 22 bp, Artificial Sequence
  chemically synthesized
gagcacttatatgtgcccgttg

SEQ ID NO: 938067 - DNA, 22 bp, Artificial Sequence
  chemically synthesized
tgagcacttatatgtgcccgtt

SEQ ID NO: 938068 - DNA, 22 bp, Artificial Sequence
  chemically synthesized
ttgagcacttatatgtgcccgt

SEQ ID NO: 938069 - DNA, 22 bp, Artificial Sequence
  chemically synthesized
tatttttgagcacttatatgtg

SEQ ID NO: 938070 - DNA, 22 bp, Artificial Sequence
  chemically synthesized
catacaacgggcacatataagt

SEQ ID NO: 938071 - DNA, 22 bp, Artificial Sequence
  chemically synthesized
actgtatttttgagcacttata

SEQ ID NO: 938072 - DNA, 22 bp, Artificial Sequence
  chemically synthesized
gttcactgtatttttgagcact

SEQ ID NO: 938073 - DNA, 22 bp, Artificial Sequence
  chemically synthesized
attggttcactgtatttttgag

SEQ ID NO: 938074 - DNA, 22 bp, Artificial Sequence
  chemically synthesized
ttcattggttcactgtattttt

SEQ ID NO: 938075 - DNA, 22 bp, Artificial Sequence
  chemically synthesized
attcattggttcactgtatttt

SEQ ID NO: 938076 - DNA, 22 bp, Artificial Sequence
  chemically synthesized
aaaaatacagtgaaccaatgaa

SEQ ID NO: 938077 - DNA, 22 bp, Artificial Sequence
  chemically synthesized
atgtatggcagtgtcagtggta

SEQ ID NO: 938078 - DNA, 22 bp, Artificial Sequence
  chemically synthesized
aatgtatggcagtgtcagtggt

SEQ ID NO: 938079 - DNA, 22 bp, Artificial Sequence
  chemically synthesized
gttattattaccactgacactg

SEQ ID NO: 938080 - DNA, 22 bp, Artificial Sequence
  chemically synthesized
ttattattaccactgacactgc

SEQ ID NO: 938081 - DNA, 22 bp, Artificial Sequence
  chemically synthesized
ttattaccactgacactgccat

SEQ ID NO: 938082 - DNA, 22 bp, Artificial Sequence
  chemically synthesized
ttaccactgacactgccataca

SEQ ID NO: 938083 - DNA, 22 bp, Artificial Sequence
  chemically synthesized
aaaggtatttaatgtatggcag

SEQ ID NO: 938084 - DNA, 22 bp, Artificial Sequence
  chemically synthesized
ccactgacactgccatacatta

SEQ ID NO: 938085 - DNA, 22 bp, Artificial Sequence
  chemically synthesized
atctgaaaggtatttaatgtat

SEQ ID NO: 938086 - DNA, 22 bp, Artificial Sequence
  chemically synthesized
aatctgaaaggtatttaatgta

SEQ ID NO: 938087 - DNA, 22 bp, Artificial Sequence
  chemically synthesized
taatctgaaaggtatttaatgt

SEQ ID NO: 938088 - DNA, 22 bp, Artificial Sequence
  chemically synthesized
ttaatctgaaaggtatttaatg

SEQ ID NO: 938089 - DNA, 22 bp, Artificial Sequence
  chemically synthesized
acactgccatacattaaatacc

SEQ ID NO: 938090 - DNA, 22 bp, Artificial Sequence
  chemically synthesized
ccatacattaaatacctttcag

SEQ ID NO: 938091 - DNA, 22 bp, Artificial Sequence
  chemically synthesized
ataggtaaaagcacttttaatc

SEQ ID NO: 938092 - DNA, 22 bp, Artificial Sequence
  chemically synthesized
aatacctttcagattaaaagtg

SEQ ID NO: 938093 - DNA, 22 bp, Artificial Sequence
  chemically synthesized
tcagattaaaagtgcttttacc

SEQ ID NO: 938094 - DNA, 22 bp, Artificial Sequence
  chemically synthesized
cagattaaaagtgcttttacct

SEQ ID NO: 938095 - DNA, 22 bp, Artificial Sequence
  chemically synthesized
gaaaccactgataggtaaaagc

SEQ ID NO: 938096 - DNA, 22 bp, Artificial Sequence
  chemically synthesized
agattaaaagtgcttttaccta

SEQ ID NO: 938097 - DNA, 22 bp, Artificial Sequence
  chemically synthesized
aaagtgcttttacctatcagtg

SEQ ID NO: 938098 - DNA, 22 bp, Artificial Sequence
  chemically synthesized
ttacctatcagtggtttccagg

SEQ ID NO: 938099 - DNA, 22 bp, Artificial Sequence
  chemically synthesized
tacctatcagtggtttccaggg

SEQ ID NO: 938100 - DNA, 22 bp, Artificial Sequence
  chemically synthesized
ccccaccccagcccctggaaac

SEQ ID NO: 938101 - DNA, 22 bp, Artificial Sequence
  chemically synthesized
acctatcagtggtttccagggg

SEQ ID NO: 938102 - DNA, 22 bp, Artificial Sequence
  chemically synthesized
cctatcagtggtttccaggggc

SEQ ID NO: 938103 - DNA, 22 bp, Artificial Sequence
  chemically synthesized
ctgccccaccccagcccctgga

SEQ ID NO: 938104 - DNA, 22 bp, Artificial Sequence
  chemically synthesized
tcagtggtttccaggggctggg

SEQ ID NO: 938105 - DNA, 22 bp, Artificial Sequence
  chemically synthesized
cagtcagtctcctgccccaccc

SEQ ID NO: 938106 - DNA, 22 bp, Artificial Sequence
  chemically synthesized
ccaggggctggggtggggcagg

SEQ ID NO: 938107 - DNA, 22 bp, Artificial Sequence
  chemically synthesized
caggggctggggtggggcagga

SEQ ID NO: 938108 - DNA, 22 bp, Artificial Sequence
  chemically synthesized
ccgttgcagtcagtctcctgcc

SEQ ID NO: 938109 - DNA, 22 bp, Artificial Sequence
  chemically synthesized
tactcccgttgcagtcagtctc

SEQ ID NO: 938110 - DNA, 22 bp, Artificial Sequence
  chemically synthesized
gggtggggcaggagactgactg

SEQ ID NO: 938111 - DNA, 22 bp, Artificial Sequence
  chemically synthesized
gtactcccgttgcagtcagtct

SEQ ID NO: 938112 - DNA, 22 bp, Artificial Sequence
  chemically synthesized
cttgtactcccgttgcagtcag

SEQ ID NO: 938113 - DNA, 22 bp, Artificial Sequence
  chemically synthesized
ccttgtactcccgttgcagtca

SEQ ID NO: 938114 - DNA, 22 bp, Artificial Sequence
  chemically synthesized
aaaaagtttccttgtactcccg

SEQ ID NO: 938115 - DNA, 22 bp, Artificial Sequence
  chemically synthesized
caaaaagtttccttgtactccc

SEQ ID NO: 938116 - DNA, 22 bp, Artificial Sequence
  chemically synthesized
actgcaacgggagtacaaggaa

SEQ ID NO: 938117 - DNA, 22 bp, Artificial Sequence
  chemically synthesized
tcacttcaaaaagtttccttgt

SEQ ID NO: 938118 - DNA, 22 bp, Artificial Sequence
  chemically synthesized
atcacttcaaaaagtttccttg

SEQ ID NO: 938119 - DNA, 22 bp, Artificial Sequence
  chemically synthesized
caacgggagtacaaggaaactt

SEQ ID NO: 938120 - DNA, 22 bp, Artificial Sequence
  chemically synthesized
tatcacttcaaaaagtttcctt

SEQ ID NO: 938121 - DNA, 22 bp, Artificial Sequence
  chemically synthesized
ttatcacttcaaaaagtttcct

SEQ ID NO: 938122 - DNA, 22 bp, Artificial Sequence
  chemically synthesized
tttgaagtgataaaaatatttc

SEQ ID NO: 938123 - DNA, 22 bp, Artificial Sequence
  chemically synthesized
ttgaagtgataaaaatatttcc

SEQ ID NO: 938124 - DNA, 22 bp, Artificial Sequence
  chemically synthesized
tgaagtgataaaaatatttcct

SEQ ID NO: 938125 - DNA, 22 bp, Artificial Sequence
  chemically synthesized
gaagtgataaaaatatttccta

SEQ ID NO: 938126 - DNA, 22 bp, Artificial Sequence
  chemically synthesized
aagtgataaaaatatttcctat

SEQ ID NO: 938127 - DNA, 22 bp, Artificial Sequence
  chemically synthesized
caaccacgtccgtgatcagaat

SEQ ID NO: 938128 - DNA, 22 bp, Artificial Sequence
  chemically synthesized
cctattctgatcacggacgtgg

SEQ ID NO: 938129 - DNA, 22 bp, Artificial Sequence
  chemically synthesized
ctattctgatcacggacgtggt

SEQ ID NO: 938130 - DNA, 22 bp, Artificial Sequence
  chemically synthesized
ttctgatcacggacgtggttgt

SEQ ID NO: 938131 - DNA, 22 bp, Artificial Sequence
  chemically synthesized
tgatcacggacgtggttgtagg

SEQ ID NO: 938132 - DNA, 22 bp, Artificial Sequence
  chemically synthesized
atcacggacgtggttgtaggac

SEQ ID NO: 938133 - DNA, 22 bp, Artificial Sequence
  chemically synthesized
acaaacatatgcagtcctacaa

SEQ ID NO: 938134 - DNA, 22 bp, Artificial Sequence
  chemically synthesized
gacaaacatatgcagtcctaca

SEQ ID NO: 938135 - DNA, 22 bp, Artificial Sequence
  chemically synthesized
tgacaaacatatgcagtcctac

SEQ ID NO: 938136 - DNA, 22 bp, Artificial Sequence
  chemically synthesized
atgagttttgacaaacatatgc

SEQ ID NO: 938137 - DNA, 22 bp, Artificial Sequence
  chemically synthesized
gatgagttttgacaaacatatg

SEQ ID NO: 938138 - DNA, 22 bp, Artificial Sequence
  chemically synthesized
taggactgcatatgtttgtcaa

SEQ ID NO: 938139 - DNA, 22 bp, Artificial Sequence
  chemically synthesized
catatgtttgtcaaaactcatc

SEQ ID NO: 938140 - DNA, 22 bp, Artificial Sequence
  chemically synthesized
aagtgtacagtttgatgagttt

SEQ ID NO: 938141 - DNA, 22 bp, Artificial Sequence
  chemically synthesized
aaagtgtacagtttgatgagtt

SEQ ID NO: 938142 - DNA, 22 bp, Artificial Sequence
  chemically synthesized
taaagtgtacagtttgatgagt

SEQ ID NO: 938143 - DNA, 22 bp, Artificial Sequence
  chemically synthesized
ttaaagtgtacagtttgatgag

SEQ ID NO: 938144 - DNA, 22 bp, Artificial Sequence
  chemically synthesized
tttaaagtgtacagtttgatga

SEQ ID NO: 938145 - DNA, 22 bp, Artificial Sequence
  chemically synthesized
gtcaaaactcatcaaactgtac

SEQ ID NO: 938146 - DNA, 22 bp, Artificial Sequence
  chemically synthesized
tcaaaactcatcaaactgtaca

SEQ ID NO: 938147 - DNA, 22 bp, Artificial Sequence
  chemically synthesized
atcaaactgtacactttaaaaa

SEQ ID NO: 938148 - DNA, 22 bp, Artificial Sequence
  chemically synthesized
catgcacaaaaaaatcgccttt

SEQ ID NO: 938149 - DNA, 22 bp, Artificial Sequence
  chemically synthesized
acatgcacaaaaaaatcgcctt

SEQ ID NO: 938150 - DNA, 22 bp, Artificial Sequence
  chemically synthesized
tacactttaaaaaggcgatttt

SEQ ID NO: 938151 - DNA, 22 bp, Artificial Sequence
  chemically synthesized
taaaaaggcgatttttttgtgc

SEQ ID NO: 938152 - DNA, 22 bp, Artificial Sequence
  chemically synthesized
aaaaaggcgatttttttgtgca

SEQ ID NO: 938153 - DNA, 22 bp, Artificial Sequence
  chemically synthesized
aaaaggcgatttttttgtgcat

SEQ ID NO: 938154 - DNA, 22 bp, Artificial Sequence
  chemically synthesized
aggtataatttacatgcacaaa

SEQ ID NO: 938155 - DNA, 22 bp, Artificial Sequence
  chemically synthesized
ttgaggtataatttacatgcac

SEQ ID NO: 938156 - DNA, 22 bp, Artificial Sequence
  chemically synthesized
attgaggtataatttacatgca

SEQ ID NO: 938157 - DNA, 22 bp, Artificial Sequence
  chemically synthesized
tattgaggtataatttacatgc

SEQ ID NO: 938158 - DNA, 22 bp, Artificial Sequence
  chemically synthesized
ttttattgaggtataatttaca

SEQ ID NO: 938159 - DNA, 22 bp, Artificial Sequence
  chemically synthesized
gttttattgaggtataatttac

SEQ ID NO: 938160 - DNA, 22 bp, Artificial Sequence
  chemically synthesized
tgttttattgaggtataattta

SEQ ID NO: 938161 - DNA, 22 bp, Artificial Sequence
  chemically synthesized
ttttgtgcatgtaaattatacc

SEQ ID NO: 938162 - DNA, 22 bp, Artificial Sequence
  chemically synthesized
ttgttttattgaggtataattt

SEQ ID NO: 938163 - DNA, 22 bp, Artificial Sequence
  chemically synthesized
tttgtgcatgtaaattatacct

SEQ ID NO: 938164 - DNA, 22 bp, Artificial Sequence
  chemically synthesized
tttgttttattgaggtataatt

SEQ ID NO: 938165 - DNA, 22 bp, Artificial Sequence
  chemically synthesized
ttgtgcatgtaaattatacctc

SEQ ID NO: 938166 - DNA, 22 bp, Artificial Sequence
  chemically synthesized
tgtgcatgtaaattatacctca

SEQ ID NO: 938167 - DNA, 22 bp, Artificial Sequence
  chemically synthesized
gtgcatgtaaattatacctcaa

SEQ ID NO: 938168 - DNA, 22 bp, Artificial Sequence
  chemically synthesized
ctttttgttttattgaggtata

SEQ ID NO: 938169 - DNA, 22 bp, Artificial Sequence
  chemically synthesized
tgcatgtaaattatacctcaat

SEQ ID NO: 938170 - DNA, 22 bp, Artificial Sequence
  chemically synthesized
caattcctttttgttttattga

SEQ ID NO: 938171 - DNA, 22 bp, Artificial Sequence
  chemically synthesized
ccaattcctttttgttttattg

SEQ ID NO: 938172 - DNA, 22 bp, Artificial Sequence
  chemically synthesized
tccaattcctttttgttttatt

SEQ ID NO: 938173 - DNA, 22 bp, Artificial Sequence
  chemically synthesized
tttccaattcctttttgtttta

SEQ ID NO: 938174 - DNA, 22 bp, Artificial Sequence
  chemically synthesized
tctttccaattcctttttgttt

SEQ ID NO: 938175 - DNA, 22 bp, Artificial Sequence
  chemically synthesized
tacctcaataaaacaaaaagga

SEQ ID NO: 938176 - DNA, 22 bp, Artificial Sequence
  chemically synthesized
tctctttccaattcctttttgt

SEQ ID NO: 938177 - DNA, 22 bp, Artificial Sequence
  chemically synthesized
ctctctttccaattcctttttg

SEQ ID NO: 938178 - DNA, 22 bp, Artificial Sequence
  chemically synthesized
tctctctttccaattccttttt

SEQ ID NO: 938179 - DNA, 22 bp, Artificial Sequence
  chemically synthesized
ctttctctctttccaattcctt

SEQ ID NO: 938180 - DNA, 22 bp, Artificial Sequence
  chemically synthesized
aataaaacaaaaaggaattgga

SEQ ID NO: 938181 - DNA, 22 bp, Artificial Sequence
  chemically synthesized
gaaagagagaaagtaggcactt

SEQ ID NO: 938182 - DNA, 22 bp, Artificial Sequence
  chemically synthesized
aaatgcaaataaaagtgcctac

SEQ ID NO: 938183 - DNA, 22 bp, Artificial Sequence
  chemically synthesized
aaaatgcaaataaaagtgccta

SEQ ID NO: 938184 - DNA, 22 bp, Artificial Sequence
  chemically synthesized
taaaatgcaaataaaagtgcct

SEQ ID NO: 938185 - DNA, 22 bp, Artificial Sequence
  chemically synthesized
aaagtcaaggatgaaattttaa

SEQ ID NO: 938186 - DNA, 22 bp, Artificial Sequence
  chemically synthesized
ttatttgcattttaaaatttca

SEQ ID NO: 938187 - DNA, 22 bp, Artificial Sequence
  chemically synthesized
tatttgcattttaaaatttcat

SEQ ID NO: 938188 - DNA, 22 bp, Artificial Sequence
  chemically synthesized
taaaagtcaaggatgaaatttt

SEQ ID NO: 938189 - DNA, 22 bp, Artificial Sequence
  chemically synthesized
atttgcattttaaaatttcatc

SEQ ID NO: 938190 - DNA, 22 bp, Artificial Sequence
  chemically synthesized
tttgcattttaaaatttcatcc

SEQ ID NO: 938191 - DNA, 22 bp, Artificial Sequence
  chemically synthesized
gcattttaaaatttcatccttg

SEQ ID NO: 938192 - DNA, 22 bp, Artificial Sequence
  chemically synthesized
cattttaaaatttcatccttga

SEQ ID NO: 938193 - DNA, 22 bp, Artificial Sequence
  chemically synthesized
gtcactctaaaagtcaaggatg

SEQ ID NO: 938194 - DNA, 22 bp, Artificial Sequence
  chemically synthesized
agtcactctaaaagtcaaggat

SEQ ID NO: 938195 - DNA, 22 bp, Artificial Sequence
  chemically synthesized
taaaatttcatccttgactttt

SEQ ID NO: 938196 - DNA, 22 bp, Artificial Sequence
  chemically synthesized
aaaatttcatccttgactttta

SEQ ID NO: 938197 - DNA, 22 bp, Artificial Sequence
  chemically synthesized
gtttagtcactctaaaagtcaa

SEQ ID NO: 938198 - DNA, 22 bp, Artificial Sequence
  chemically synthesized
aaatttcatccttgacttttag

SEQ ID NO: 938199 - DNA, 22 bp, Artificial Sequence
  chemically synthesized
catccttgacttttagagtgac

SEQ ID NO: 938200 - DNA, 22 bp, Artificial Sequence
  chemically synthesized
atccttgacttttagagtgact

SEQ ID NO: 938201 - DNA, 22 bp, Artificial Sequence
  chemically synthesized
gacttttagagtgactaaacca

SEQ ID NO: 938202 - DNA, 22 bp, Artificial Sequence
  chemically synthesized
acttttagagtgactaaaccag

SEQ ID NO: 938203 - DNA, 22 bp, Artificial Sequence
  chemically synthesized
ggtagtaatcatctggtttagt

SEQ ID NO: 938204 - DNA, 22 bp, Artificial Sequence
  chemically synthesized
tcggtagtaatcatctggttta

SEQ ID NO: 938205 - DNA, 22 bp, Artificial Sequence
  chemically synthesized
ctcggtagtaatcatctggttt

SEQ ID NO: 938206 - DNA, 22 bp, Artificial Sequence
  chemically synthesized
ttagagtgactaaaccagatga

SEQ ID NO: 938207 - DNA, 22 bp, Artificial Sequence
  chemically synthesized
tagagtgactaaaccagatgat

SEQ ID NO: 938208 - DNA, 22 bp, Artificial Sequence
  chemically synthesized
agagtgactaaaccagatgatt

SEQ ID NO: 938209 - DNA, 22 bp, Artificial Sequence
  chemically synthesized
tttctcggtagtaatcatctgg

SEQ ID NO: 938210 - DNA, 22 bp, Artificial Sequence
  chemically synthesized
gagtgactaaaccagatgatta

SEQ ID NO: 938211 - DNA, 22 bp, Artificial Sequence
  chemically synthesized
ttgtttctcggtagtaatcatc

SEQ ID NO: 938212 - DNA, 22 bp, Artificial Sequence
  chemically synthesized
ttgttgtttctcggtagtaatc

SEQ ID NO: 938213 - DNA, 22 bp, Artificial Sequence
  chemically synthesized
attgttgtttctcggtagtaat

SEQ ID NO: 938214 - DNA, 22 bp, Artificial Sequence
  chemically synthesized
tattgttgtttctcggtagtaa

SEQ ID NO: 938215 - DNA, 22 bp, Artificial Sequence
  chemically synthesized
ttattgttgtttctcggtagta

SEQ ID NO: 938216 - DNA, 22 bp, Artificial Sequence
  chemically synthesized
aaccagatgattactaccgaga

SEQ ID NO: 938217 - DNA, 22 bp, Artificial Sequence
  chemically synthesized
aatatttttattgttgtttctc

SEQ ID NO: 938218 - DNA, 22 bp, Artificial Sequence
  chemically synthesized
taaatatttttattgttgtttc

SEQ ID NO: 938219 - DNA, 22 bp, Artificial Sequence
  chemically synthesized
ctaaatatttttattgttgttt

SEQ ID NO: 938220 - DNA, 22 bp, Artificial Sequence
  chemically synthesized
ctaccgagaaacaacaataaaa

SEQ ID NO: 938221 - DNA, 22 bp, Artificial Sequence
  chemically synthesized
catttctaaatatttttattgt

SEQ ID NO: 938222 - DNA, 22 bp, Artificial Sequence
  chemically synthesized
ccgagaaacaacaataaaaata

SEQ ID NO: 938223 - DNA, 22 bp, Artificial Sequence
  chemically synthesized
atgcatcctacatttctaaata

SEQ ID NO: 938224 - DNA, 22 bp, Artificial Sequence
  chemically synthesized
gatgcatcctacatttctaaat

SEQ ID NO: 938225 - DNA, 22 bp, Artificial Sequence
  chemically synthesized
agaaatgtaggatgcatcaagt

SEQ ID NO: 938226 - DNA, 22 bp, Artificial Sequence
  chemically synthesized
gaaatgtaggatgcatcaagtg

SEQ ID NO: 938227 - DNA, 22 bp, Artificial Sequence
  chemically synthesized
acatccaaagcacacttgatgc

SEQ ID NO: 938228 - DNA, 22 bp, Artificial Sequence
  chemically synthesized
gacatccaaagcacacttgatg

SEQ ID NO: 938229 - DNA, 22 bp, Artificial Sequence
  chemically synthesized
cttgacatccaaagcacacttg

SEQ ID NO: 938230 - DNA, 22 bp, Artificial Sequence
  chemically synthesized
agttgcttgacatccaaagcac

SEQ ID NO: 938231 - DNA, 22 bp, Artificial Sequence
  chemically synthesized
tgcccctaagttgcttgacatc

SEQ ID NO: 938232 - DNA, 22 bp, Artificial Sequence
  chemically synthesized
gaaatctgtgcccctaagttgc

SEQ ID NO: 938233 - DNA, 22 bp, Artificial Sequence
  chemically synthesized
agaaatctgtgcccctaagttg

SEQ ID NO: 938234 - DNA, 22 bp, Artificial Sequence
  chemically synthesized
tggatgtcaagcaacttagggg

SEQ ID NO: 938235 - DNA, 22 bp, Artificial Sequence
  chemically synthesized
tagaaatctgtgcccctaagtt

SEQ ID NO: 938236 - DNA, 22 bp, Artificial Sequence
  chemically synthesized
ggatgtcaagcaacttaggggc

SEQ ID NO: 938237 - DNA, 22 bp, Artificial Sequence
  chemically synthesized
gatgtcaagcaacttaggggca

SEQ ID NO: 938238 - DNA, 22 bp, Artificial Sequence
  chemically synthesized
acccaagacaattttagaaatc

SEQ ID NO: 938239 - DNA, 22 bp, Artificial Sequence
  chemically synthesized
aggggcacagatttctaaaatt

SEQ ID NO: 938240 - DNA, 22 bp, Artificial Sequence
  chemically synthesized
ggggcacagatttctaaaattg

SEQ ID NO: 938241 - DNA, 22 bp, Artificial Sequence
  chemically synthesized
agcagtatgttaacccaagaca

SEQ ID NO: 938242 - DNA, 22 bp, Artificial Sequence
  chemically synthesized
cctgagcagtatgttaacccaa

SEQ ID NO: 938243 - DNA, 22 bp, Artificial Sequence
  chemically synthesized
ctaaaattgtcttgggttaaca

SEQ ID NO: 938244 - DNA, 22 bp, Artificial Sequence
  chemically synthesized
ccctgagcagtatgttaaccca

SEQ ID NO: 938245 - DNA, 22 bp, Artificial Sequence
  chemically synthesized
taaaattgtcttgggttaacat

SEQ ID NO: 938246 - DNA, 22 bp, Artificial Sequence
  chemically synthesized
aaattgtcttgggttaacatac

SEQ ID NO: 938247 - DNA, 22 bp, Artificial Sequence
  chemically synthesized
gcgtcttccctgagcagtatgt

SEQ ID NO: 938248 - DNA, 22 bp, Artificial Sequence
  chemically synthesized
tcttgggttaacatactgctca

SEQ ID NO: 938249 - DNA, 22 bp, Artificial Sequence
  chemically synthesized
gggttaacatactgctcaggga

SEQ ID NO: 938250 - DNA, 22 bp, Artificial Sequence
  chemically synthesized
ggttaacatactgctcagggaa

SEQ ID NO: 938251 - DNA, 22 bp, Artificial Sequence
  chemically synthesized
acatactgctcagggaagacgc

SEQ ID NO: 938252 - DNA, 22 bp, Artificial Sequence
  chemically synthesized
ccagtgagacccgctagcgtct

SEQ ID NO: 938253 - DNA, 22 bp, Artificial Sequence
  chemically synthesized
cccagtgagacccgctagcgtc

SEQ ID NO: 938254 - DNA, 22 bp, Artificial Sequence
  chemically synthesized
ctcagggaagacgctagcgggt

SEQ ID NO: 938255 - DNA, 22 bp, Artificial Sequence
  chemically synthesized
agggaagacgctagcgggtctc

SEQ ID NO: 938256 - DNA, 22 bp, Artificial Sequence
  chemically synthesized
gaggggagaggtcttcccagtg

SEQ ID NO: 938257 - DNA, 22 bp, Artificial Sequence
  chemically synthesized
gcgggtctcactgggaagacct

SEQ ID NO: 938258 - DNA, 22 bp, Artificial Sequence
  chemically synthesized
actgggaagacctctcccctcc

SEQ ID NO: 938259 - DNA, 22 bp, Artificial Sequence
  chemically synthesized
ggaagacctctcccctccaatc

SEQ ID NO: 938260 - DNA, 22 bp, Artificial Sequence
  chemically synthesized
tcccctccaatctcacccccac

SEQ ID NO: 938261 - DNA, 22 bp, Artificial Sequence
  chemically synthesized
gagaatcagtggggtgggggtg

SEQ ID NO: 938262 - DNA, 22 bp, Artificial Sequence
  chemically synthesized
ccctccaatctcacccccaccc

SEQ ID NO: 938263 - DNA, 22 bp, Artificial Sequence
  chemically synthesized
caatctcacccccaccccactg

SEQ ID NO: 938264 - DNA, 22 bp, Artificial Sequence
  chemically synthesized
acccccaccccactgattctct

SEQ ID NO: 938265 - DNA, 22 bp, Artificial Sequence
  chemically synthesized
attctctaatcacttttgattt

SEQ ID NO: 938266 - DNA, 22 bp, Artificial Sequence
  chemically synthesized
tctaatcacttttgattttacc

SEQ ID NO: 938267 - DNA, 22 bp, Artificial Sequence
  chemically synthesized
taatcacttttgattttaccat

SEQ ID NO: 938268 - DNA, 22 bp, Artificial Sequence
  chemically synthesized
atcacttttgattttaccatct

SEQ ID NO: 938269 - DNA, 22 bp, Artificial Sequence
  chemically synthesized
tgccaggaggaacagatggtaa

SEQ ID NO: 938270 - DNA, 22 bp, Artificial Sequence
  chemically synthesized
ttgtgccaggaggaacagatgg

SEQ ID NO: 938271 - DNA, 22 bp, Artificial Sequence
  chemically synthesized
gttgtgccaggaggaacagatg

SEQ ID NO: 938272 - DNA, 22 bp, Artificial Sequence
  chemically synthesized
tgttgtgccaggaggaacagat

SEQ ID NO: 938273 - DNA, 22 bp, Artificial Sequence
  chemically synthesized
ttgattttaccatctgttcctc

SEQ ID NO: 938274 - DNA, 22 bp, Artificial Sequence
  chemically synthesized
tgattttaccatctgttcctcc

SEQ ID NO: 938275 - DNA, 22 bp, Artificial Sequence
  chemically synthesized
gattttaccatctgttcctcct

SEQ ID NO: 938276 - DNA, 22 bp, Artificial Sequence
  chemically synthesized
attttaccatctgttcctcctg

SEQ ID NO: 938277 - DNA, 22 bp, Artificial Sequence
  chemically synthesized
aacctttgttgtgccaggagga

SEQ ID NO: 938278 - DNA, 22 bp, Artificial Sequence
  chemically synthesized
taccatctgttcctcctggcac

SEQ ID NO: 938279 - DNA, 22 bp, Artificial Sequence
  chemically synthesized
accatctgttcctcctggcaca

SEQ ID NO: 938280 - DNA, 22 bp, Artificial Sequence
  chemically synthesized
ctgaacctttgttgtgccagga

SEQ ID NO: 938281 - DNA, 22 bp, Artificial Sequence
  chemically synthesized
ccatctgttcctcctggcacaa

SEQ ID NO: 938282 - DNA, 22 bp, Artificial Sequence
  chemically synthesized
gctgaacctttgttgtgccagg

SEQ ID NO: 938283 - DNA, 22 bp, Artificial Sequence
  chemically synthesized
ttgctgaacctttgttgtgcca

SEQ ID NO: 938284 - DNA, 22 bp, Artificial Sequence
  chemically synthesized
cttgctgaacctttgttgtgcc

SEQ ID NO: 938285 - DNA, 22 bp, Artificial Sequence
  chemically synthesized
tcttgctgaacctttgttgtgc

SEQ ID NO: 938286 - DNA, 22 bp, Artificial Sequence
  chemically synthesized
ttcttgctgaacctttgttgtg

SEQ ID NO: 938287 - DNA, 22 bp, Artificial Sequence
  chemically synthesized
ttcctcctggcacaacaaaggt

SEQ ID NO: 938288 - DNA, 22 bp, Artificial Sequence
  chemically synthesized
ctcctggcacaacaaaggttca

SEQ ID NO: 938289 - DNA, 22 bp, Artificial Sequence
  chemically synthesized
tcacttttcttgctgaaccttt

SEQ ID NO: 938290 - DNA, 22 bp, Artificial Sequence
  chemically synthesized
ctggcacaacaaaggttcagca

SEQ ID NO: 938291 - DNA, 22 bp, Artificial Sequence
  chemically synthesized
gcacaacaaaggttcagcaaga

SEQ ID NO: 938292 - DNA, 22 bp, Artificial Sequence
  chemically synthesized
aagctgtcacttttcttgctga

SEQ ID NO: 938293 - DNA, 22 bp, Artificial Sequence
  chemically synthesized
ttgaagctgtcacttttcttgc

SEQ ID NO: 938294 - DNA, 22 bp, Artificial Sequence
  chemically synthesized
agcaagaaaagtgacagcttca

SEQ ID NO: 938295 - DNA, 22 bp, Artificial Sequence
  chemically synthesized
aagacaaggttgttgaagctgt

SEQ ID NO: 938296 - DNA, 22 bp, Artificial Sequence
  chemically synthesized
aaaaatatcattgaagacaagg

SEQ ID NO: 938297 - DNA, 22 bp, Artificial Sequence
  chemically synthesized
caaaaatatcattgaagacaag

SEQ ID NO: 938298 - DNA, 22 bp, Artificial Sequence
  chemically synthesized
caacaaccttgtcttcaatgat

SEQ ID NO: 938299 - DNA, 22 bp, Artificial Sequence
  chemically synthesized
aacaaccttgtcttcaatgata

SEQ ID NO: 938300 - DNA, 22 bp, Artificial Sequence
  chemically synthesized
caataatttcaaaaatatcatt

SEQ ID NO: 938301 - DNA, 22 bp, Artificial Sequence
  chemically synthesized
cctccaataatttcaaaaatat

SEQ ID NO: 938302 - DNA, 22 bp, Artificial Sequence
  chemically synthesized
acctccaataatttcaaaaata

SEQ ID NO: 938303 - DNA, 22 bp, Artificial Sequence
  chemically synthesized
gtcttcaatgatatttttgaaa

SEQ ID NO: 938304 - DNA, 22 bp, Artificial Sequence
  chemically synthesized
tacctccaataatttcaaaaat

SEQ ID NO: 938305 - DNA, 22 bp, Artificial Sequence
  chemically synthesized
tcttcaatgatatttttgaaat

SEQ ID NO: 938306 - DNA, 22 bp, Artificial Sequence
  chemically synthesized
ttacctccaataatttcaaaaa

SEQ ID NO: 938307 - DNA, 22 bp, Artificial Sequence
  chemically synthesized
caatgatatttttgaaattatt

SEQ ID NO: 938308 - DNA, 22 bp, Artificial Sequence
  chemically synthesized
atttttacctccaataatttca

SEQ ID NO: 938309 - DNA, 22 bp, Artificial Sequence
  chemically synthesized
aatgatatttttgaaattattg

SEQ ID NO: 938310 - DNA, 22 bp, Artificial Sequence
  chemically synthesized
gatttttacctccaataatttc

SEQ ID NO: 938311 - DNA, 22 bp, Artificial Sequence
  chemically synthesized
ttgaaattattggaggtaaaaa

SEQ ID NO: 938312 - DNA, 22 bp, Artificial Sequence
  chemically synthesized
tgaaattattggaggtaaaaat

SEQ ID NO: 938313 - DNA, 22 bp, Artificial Sequence
  chemically synthesized
gaaattattggaggtaaaaatc

SEQ ID NO: 938314 - DNA, 22 bp, Artificial Sequence
  chemically synthesized
aaattattggaggtaaaaatca

SEQ ID NO: 938315 - DNA, 22 bp, Artificial Sequence
  chemically synthesized
aatcgaccgatttgatttttac

SEQ ID NO: 938316 - DNA, 22 bp, Artificial Sequence
  chemically synthesized
ttggaggtaaaaatcaaatcgg

SEQ ID NO: 938317 - DNA, 22 bp, Artificial Sequence
  chemically synthesized
gaggtaaaaatcaaatcggtcg

SEQ ID NO: 938318 - DNA, 22 bp, Artificial Sequence
  chemically synthesized
aataaatagtggattaaatcga

SEQ ID NO: 938319 - DNA, 22 bp, Artificial Sequence
  chemically synthesized
atgaataggcactcaataaata

SEQ ID NO: 938320 - DNA, 22 bp, Artificial Sequence
  chemically synthesized
catgaataggcactcaataaat

SEQ ID NO: 938321 - DNA, 22 bp, Artificial Sequence
  chemically synthesized
aatccactatttattgagtgcc

SEQ ID NO: 938322 - DNA, 22 bp, Artificial Sequence
  chemically synthesized
atccactatttattgagtgcct

SEQ ID NO: 938323 - DNA, 22 bp, Artificial Sequence
  chemically synthesized
tacttcatgaataggcactcaa

SEQ ID NO: 938324 - DNA, 22 bp, Artificial Sequence
  chemically synthesized
atacttcatgaataggcactca

SEQ ID NO: 938325 - DNA, 22 bp, Artificial Sequence
  chemically synthesized
tttattgagtgcctattcatga

SEQ ID NO: 938326 - DNA, 22 bp, Artificial Sequence
  chemically synthesized
attgagtgcctattcatgaagt

SEQ ID NO: 938327 - DNA, 22 bp, Artificial Sequence
  chemically synthesized
ttgagtgcctattcatgaagta

SEQ ID NO: 938328 - DNA, 22 bp, Artificial Sequence
  chemically synthesized
agtgcctattcatgaagtataa

SEQ ID NO: 938329 - DNA, 22 bp, Artificial Sequence
  chemically synthesized
gtatagccatgaatttatactt

SEQ ID NO: 938330 - DNA, 22 bp, Artificial Sequence
  chemically synthesized
ttcatgaagtataaattcatgg

SEQ ID NO: 938331 - DNA, 22 bp, Artificial Sequence
  chemically synthesized
atgaagtataaattcatggcta

SEQ ID NO: 938332 - DNA, 22 bp, Artificial Sequence
  chemically synthesized
gtgaaatcatgtcagactggta

SEQ ID NO: 938333 - DNA, 22 bp, Artificial Sequence
  chemically synthesized
atggctataccagtctgacatg

SEQ ID NO: 938334 - DNA, 22 bp, Artificial Sequence
  chemically synthesized
atataatattagtgaaatcatg

SEQ ID NO: 938335 - DNA, 22 bp, Artificial Sequence
  chemically synthesized
taccagtctgacatgatttcac

SEQ ID NO: 938336 - DNA, 22 bp, Artificial Sequence
  chemically synthesized
gattcatataatattagtgaaa

SEQ ID NO: 938337 - DNA, 22 bp, Artificial Sequence
  chemically synthesized
agattcatataatattagtgaa

SEQ ID NO: 938338 - DNA, 22 bp, Artificial Sequence
  chemically synthesized
tagattcatataatattagtga

SEQ ID NO: 938339 - DNA, 22 bp, Artificial Sequence
  chemically synthesized
ttttagattcatataatattag

SEQ ID NO: 938340 - DNA, 22 bp, Artificial Sequence
  chemically synthesized
acatgatttcactaatattata

SEQ ID NO: 938341 - DNA, 22 bp, Artificial Sequence
  chemically synthesized
cggccactgttttagattcata

SEQ ID NO: 938342 - DNA, 22 bp, Artificial Sequence
  chemically synthesized
cactaatattatatgaatctaa

SEQ ID NO: 938343 - DNA, 22 bp, Artificial Sequence
  chemically synthesized
ccggccactgttttagattcat

SEQ ID NO: 938344 - DNA, 22 bp, Artificial Sequence
  chemically synthesized
actaatattatatgaatctaaa

SEQ ID NO: 938345 - DNA, 22 bp, Artificial Sequence
  chemically synthesized
tccggccactgttttagattca

SEQ ID NO: 938346 - DNA, 22 bp, Artificial Sequence
  chemically synthesized
ttccggccactgttttagattc

SEQ ID NO: 938347 - DNA, 22 bp, Artificial Sequence
  chemically synthesized
atattatatgaatctaaaacag

SEQ ID NO: 938348 - DNA, 22 bp, Artificial Sequence
  chemically synthesized
tatgaatctaaaacagtggccg

SEQ ID NO: 938349 - DNA, 22 bp, Artificial Sequence
  chemically synthesized
gtcacacgtttttccggccact

SEQ ID NO: 938350 - DNA, 22 bp, Artificial Sequence
  chemically synthesized
aaacagtggccggaaaaacgtg

SEQ ID NO: 938351 - DNA, 22 bp, Artificial Sequence
  chemically synthesized
tgcaatgtggaaatcagaattg

SEQ ID NO: 938352 - DNA, 22 bp, Artificial Sequence
  chemically synthesized
gtgcaatgtggaaatcagaatt

SEQ ID NO: 938353 - DNA, 22 bp, Artificial Sequence
  chemically synthesized
tgtgcaatgtggaaatcagaat

SEQ ID NO: 938354 - DNA, 22 bp, Artificial Sequence
  chemically synthesized
ttgtgcaatgtggaaatcagaa

SEQ ID NO: 938355 - DNA, 22 bp, Artificial Sequence
  chemically synthesized
tcaacttttgtgcaatgtggaa

SEQ ID NO: 938356 - DNA, 22 bp, Artificial Sequence
  chemically synthesized
tgatttccacattgcacaaaag

SEQ ID NO: 938357 - DNA, 22 bp, Artificial Sequence
  chemically synthesized
atttccacattgcacaaaagtt

SEQ ID NO: 938358 - DNA, 22 bp, Artificial Sequence
  chemically synthesized
ccacattgcacaaaagttgaca

SEQ ID NO: 938359 - DNA, 22 bp, Artificial Sequence
  chemically synthesized
cacattgcacaaaagttgacag

SEQ ID NO: 938360 - DNA, 22 bp, Artificial Sequence
  chemically synthesized
agaacagtcagtgcatcactgt

SEQ ID NO: 938361 - DNA, 22 bp, Artificial Sequence
  chemically synthesized
cacaaaagttgacagtgatgca

SEQ ID NO: 938362 - DNA, 22 bp, Artificial Sequence
  chemically synthesized
tcagaacagtcagtgcatcact

SEQ ID NO: 938363 - DNA, 22 bp, Artificial Sequence
  chemically synthesized
ctcagaacagtcagtgcatcac

SEQ ID NO: 938364 - DNA, 22 bp, Artificial Sequence
  chemically synthesized
aaagtttctcagaacagtcagt

SEQ ID NO: 938365 - DNA, 22 bp, Artificial Sequence
  chemically synthesized
acagtgatgcactgactgttct

SEQ ID NO: 938366 - DNA, 22 bp, Artificial Sequence
  chemically synthesized
accctcaaagtttctcagaaca

SEQ ID NO: 938367 - DNA, 22 bp, Artificial Sequence
  chemically synthesized
gttaaccctcaaagtttctcag

SEQ ID NO: 938368 - DNA, 22 bp, Artificial Sequence
  chemically synthesized
ctagttaaccctcaaagtttct

SEQ ID NO: 938369 - DNA, 22 bp, Artificial Sequence
  chemically synthesized
actgttctgagaaactttgagg

SEQ ID NO: 938370 - DNA, 22 bp, Artificial Sequence
  chemically synthesized
attcctagttaaccctcaaagt

SEQ ID NO: 938371 - DNA, 22 bp, Artificial Sequence
  chemically synthesized
ttctgagaaactttgagggtta

SEQ ID NO: 938372 - DNA, 22 bp, Artificial Sequence
  chemically synthesized
tgagaaactttgagggttaact

SEQ ID NO: 938373 - DNA, 22 bp, Artificial Sequence
  chemically synthesized
agaaactttgagggttaactag

SEQ ID NO: 938374 - DNA, 22 bp, Artificial Sequence
  chemically synthesized
tgagggttaactaggaattagg

SEQ ID NO: 938375 - DNA, 22 bp, Artificial Sequence
  chemically synthesized
gagggttaactaggaattagga

SEQ ID NO: 938376 - DNA, 22 bp, Artificial Sequence
  chemically synthesized
agggttaactaggaattaggat

SEQ ID NO: 938377 - DNA, 22 bp, Artificial Sequence
  chemically synthesized
actaggaattaggatcatgatt

SEQ ID NO: 938378 - DNA, 22 bp, Artificial Sequence
  chemically synthesized
ggaattaggatcatgatttctt

SEQ ID NO: 938379 - DNA, 22 bp, Artificial Sequence
  chemically synthesized
cagggaatgtgatcaagaaatc

SEQ ID NO: 938380 - DNA, 22 bp, Artificial Sequence
  chemically synthesized
ccagggaatgtgatcaagaaat

SEQ ID NO: 938381 - DNA, 22 bp, Artificial Sequence
  chemically synthesized
tccagggaatgtgatcaagaaa

SEQ ID NO: 938382 - DNA, 22 bp, Artificial Sequence
  chemically synthesized
ggatcatgatttcttgatcaca

SEQ ID NO: 938383 - DNA, 22 bp, Artificial Sequence
  chemically synthesized
ctttccagggaatgtgatcaag

SEQ ID NO: 938384 - DNA, 22 bp, Artificial Sequence
  chemically synthesized
actttccagggaatgtgatcaa

SEQ ID NO: 938385 - DNA, 22 bp, Artificial Sequence
  chemically synthesized
cttgatcacattccctggaaag

SEQ ID NO: 938386 - DNA, 22 bp, Artificial Sequence
  chemically synthesized
tcacaaggtttactttccaggg

SEQ ID NO: 938387 - DNA, 22 bp, Artificial Sequence
  chemically synthesized
ttgatcacattccctggaaagt

SEQ ID NO: 938388 - DNA, 22 bp, Artificial Sequence
  chemically synthesized
tatcacaaggtttactttccag

SEQ ID NO: 938389 - DNA, 22 bp, Artificial Sequence
  chemically synthesized
gatcacattccctggaaagtaa

SEQ ID NO: 938390 - DNA, 22 bp, Artificial Sequence
  chemically synthesized
atcacattccctggaaagtaaa

SEQ ID NO: 938391 - DNA, 22 bp, Artificial Sequence
  chemically synthesized
gcatattctatcacaaggttta

SEQ ID NO: 938392 - DNA, 22 bp, Artificial Sequence
  chemically synthesized
ggcatattctatcacaaggttt

SEQ ID NO: 938393 - DNA, 22 bp, Artificial Sequence
  chemically synthesized
cctggaaagtaaaccttgtgat

SEQ ID NO: 938394 - DNA, 22 bp, Artificial Sequence
  chemically synthesized
cttggcatattctatcacaagg

SEQ ID NO: 938395 - DNA, 22 bp, Artificial Sequence
  chemically synthesized
gaaagtaaaccttgtgatagaa

SEQ ID NO: 938396 - DNA, 22 bp, Artificial Sequence
  chemically synthesized
cacataccaaattgcttggcat

SEQ ID NO: 938397 - DNA, 22 bp, Artificial Sequence
  chemically synthesized
gcacataccaaattgcttggca

SEQ ID NO: 938398 - DNA, 22 bp, Artificial Sequence
  chemically synthesized
gtgatagaatatgccaagcaat

SEQ ID NO: 938399 - DNA, 22 bp, Artificial Sequence
  chemically synthesized
tgcacataccaaattgcttggc

SEQ ID NO: 938400 - DNA, 22 bp, Artificial Sequence
  chemically synthesized
tgatagaatatgccaagcaatt

SEQ ID NO: 938401 - DNA, 22 bp, Artificial Sequence
  chemically synthesized
tttgcacataccaaattgcttg

SEQ ID NO: 938402 - DNA, 22 bp, Artificial Sequence
  chemically synthesized
ctttgcacataccaaattgctt

SEQ ID NO: 938403 - DNA, 22 bp, Artificial Sequence
  chemically synthesized
catttctttgcacataccaaat

SEQ ID NO: 938404 - DNA, 22 bp, Artificial Sequence
  chemically synthesized
acatttctttgcacataccaaa

SEQ ID NO: 938405 - DNA, 22 bp, Artificial Sequence
  chemically synthesized
cagaaatcttacatttctttgc

SEQ ID NO: 938406 - DNA, 22 bp, Artificial Sequence
  chemically synthesized
acagaaatcttacatttctttg

SEQ ID NO: 938407 - DNA, 22 bp, Artificial Sequence
  chemically synthesized
ggtatgtgcaaagaaatgtaag

SEQ ID NO: 938408 - DNA, 22 bp, Artificial Sequence
  chemically synthesized
gtatgtgcaaagaaatgtaaga

SEQ ID NO: 938409 - DNA, 22 bp, Artificial Sequence
  chemically synthesized
cacccagaaaggaacggcttac

SEQ ID NO: 938410 - DNA, 22 bp, Artificial Sequence
  chemically synthesized
ctgcacccagaaaggaacggct

SEQ ID NO: 938411 - DNA, 22 bp, Artificial Sequence
  chemically synthesized
ctgctgcacccagaaaggaacg

SEQ ID NO: 938412 - DNA, 22 bp, Artificial Sequence
  chemically synthesized
ctgtaagccgttcctttctggg

SEQ ID NO: 938413 - DNA, 22 bp, Artificial Sequence
  chemically synthesized
tgtaagccgttcctttctgggt

SEQ ID NO: 938414 - DNA, 22 bp, Artificial Sequence
  chemically synthesized
taagccgttcctttctgggtgc

SEQ ID NO: 938415 - DNA, 22 bp, Artificial Sequence
  chemically synthesized
ctttctgggtgcagcaggaact

SEQ ID NO: 938416 - DNA, 22 bp, Artificial Sequence
  chemically synthesized
tctgggtgcagcaggaacttga

SEQ ID NO: 938417 - DNA, 22 bp, Artificial Sequence
  chemically synthesized
ctgggtgcagcaggaacttgat

SEQ ID NO: 938418 - DNA, 22 bp, Artificial Sequence
  chemically synthesized
tgggtgcagcaggaacttgatt

SEQ ID NO: 938419 - DNA, 22 bp, Artificial Sequence
  chemically synthesized
atggaaatccccaatcaagttc

SEQ ID NO: 938420 - DNA, 22 bp, Artificial Sequence
  chemically synthesized
ggtgcagcaggaacttgattgg

SEQ ID NO: 938421 - DNA, 22 bp, Artificial Sequence
  chemically synthesized
taatggaaatccccaatcaagt

SEQ ID NO: 938422 - DNA, 22 bp, Artificial Sequence
  chemically synthesized
ctaatggaaatccccaatcaag

SEQ ID NO: 938423 - DNA, 22 bp, Artificial Sequence
  chemically synthesized
tctaatggaaatccccaatcaa

SEQ ID NO: 938424 - DNA, 22 bp, Artificial Sequence
  chemically synthesized
ttctaatggaaatccccaatca

SEQ ID NO: 938425 - DNA, 22 bp, Artificial Sequence
  chemically synthesized
gattggggatttccattagaaa

SEQ ID NO: 938426 - DNA, 22 bp, Artificial Sequence
  chemically synthesized
attggggatttccattagaaaa

SEQ ID NO: 938427 - DNA, 22 bp, Artificial Sequence
  chemically synthesized
gggatttccattagaaaaatct

SEQ ID NO: 938428 - DNA, 22 bp, Artificial Sequence
  chemically synthesized
accatcatgatgagcaggagat

SEQ ID NO: 938429 - DNA, 22 bp, Artificial Sequence
  chemically synthesized
ccattagaaaaatctcctgctc

SEQ ID NO: 938430 - DNA, 22 bp, Artificial Sequence
  chemically synthesized
gaccatcatgatgagcaggaga

SEQ ID NO: 938431 - DNA, 22 bp, Artificial Sequence
  chemically synthesized
cattagaaaaatctcctgctca

SEQ ID NO: 938432 - DNA, 22 bp, Artificial Sequence
  chemically synthesized
tgaccatcatgatgagcaggag

SEQ ID NO: 938433 - DNA, 22 bp, Artificial Sequence
  chemically synthesized
gaaaaatctcctgctcatcatg

SEQ ID NO: 938434 - DNA, 22 bp, Artificial Sequence
  chemically synthesized
ggtcaggctttgaccatcatga

SEQ ID NO: 938435 - DNA, 22 bp, Artificial Sequence
  chemically synthesized
ctgctcatcatgatggtcaaag

SEQ ID NO: 938436 - DNA, 22 bp, Artificial Sequence
  chemically synthesized
ctcatcatgatggtcaaagcct

SEQ ID NO: 938437 - DNA, 22 bp, Artificial Sequence
  chemically synthesized
acaagctgggtcaggctttgac

SEQ ID NO: 938438 - DNA, 22 bp, Artificial Sequence
  chemically synthesized
atcatgatggtcaaagcctgac

SEQ ID NO: 938439 - DNA, 22 bp, Artificial Sequence
  chemically synthesized
aagattaacaagctgggtcagg

SEQ ID NO: 938440 - DNA, 22 bp, Artificial Sequence
  chemically synthesized
tgaagattaacaagctgggtca

SEQ ID NO: 938441 - DNA, 22 bp, Artificial Sequence
  chemically synthesized
ctctgaagattaacaagctggg

SEQ ID NO: 938442 - DNA, 22 bp, Artificial Sequence
  chemically synthesized
tgctctgaagattaacaagctg

SEQ ID NO: 938443 - DNA, 22 bp, Artificial Sequence
  chemically synthesized
cattctgctctgaagattaaca

SEQ ID NO: 938444 - DNA, 22 bp, Artificial Sequence
  chemically synthesized
acccagcttgttaatcttcaga

SEQ ID NO: 938445 - DNA, 22 bp, Artificial Sequence
  chemically synthesized
tgcgttgcattctgctctgaag

SEQ ID NO: 938446 - DNA, 22 bp, Artificial Sequence
  chemically synthesized
gttaatcttcagagcagaatgc

SEQ ID NO: 938447 - DNA, 22 bp, Artificial Sequence
  chemically synthesized
ttaatcttcagagcagaatgca

SEQ ID NO: 938448 - DNA, 22 bp, Artificial Sequence
  chemically synthesized
atcttcagagcagaatgcaacg

SEQ ID NO: 938449 - DNA, 22 bp, Artificial Sequence
  chemically synthesized
cagagcagaatgcaacgcacaa

SEQ ID NO: 938450 - DNA, 22 bp, Artificial Sequence
  chemically synthesized
agagcagaatgcaacgcacaac

SEQ ID NO: 938451 - DNA, 22 bp, Artificial Sequence
  chemically synthesized
tgaaagtaaaaggatagtgcaa

SEQ ID NO: 938452 - DNA, 22 bp, Artificial Sequence
  chemically synthesized
gtgaaagtaaaaggatagtgca

SEQ ID NO: 938453 - DNA, 22 bp, Artificial Sequence
  chemically synthesized
gaatttgtgaaagtaaaaggat

SEQ ID NO: 938454 - DNA, 22 bp, Artificial Sequence
  chemically synthesized
tttgcactatccttttactttc

SEQ ID NO: 938455 - DNA, 22 bp, Artificial Sequence
  chemically synthesized
gcactatccttttactttcaca

SEQ ID NO: 938456 - DNA, 22 bp, Artificial Sequence
  chemically synthesized
cactatccttttactttcacaa

SEQ ID NO: 938457 - DNA, 22 bp, Artificial Sequence
  chemically synthesized
tccttttactttcacaaattcc

SEQ ID NO: 938458 - DNA, 22 bp, Artificial Sequence
  chemically synthesized
ttactttcacaaattccagtcg

SEQ ID NO: 938459 - DNA, 22 bp, Artificial Sequence
  chemically synthesized
tactttcacaaattccagtcgc

SEQ ID NO: 938460 - DNA, 22 bp, Artificial Sequence
  chemically synthesized
actttcacaaattccagtcgct

SEQ ID NO: 938461 - DNA, 22 bp, Artificial Sequence
  chemically synthesized
ctttcacaaattccagtcgctg

SEQ ID NO: 938462 - DNA, 22 bp, Artificial Sequence
  chemically synthesized
tcacaaattccagtcgctgttg

SEQ ID NO: 938463 - DNA, 22 bp, Artificial Sequence
  chemically synthesized
cacaaattccagtcgctgttgc

SEQ ID NO: 938464 - DNA, 22 bp, Artificial Sequence
  chemically synthesized
acaaattccagtcgctgttgcc

SEQ ID NO: 938465 - DNA, 22 bp, Artificial Sequence
  chemically synthesized
aaagacaccatagaggcaacag

SEQ ID NO: 938466 - DNA, 22 bp, Artificial Sequence
  chemically synthesized
aattaaaagacaccatagaggc

SEQ ID NO: 938467 - DNA, 22 bp, Artificial Sequence
  chemically synthesized
cagtcgctgttgcctctatggt

SEQ ID NO: 938468 - DNA, 22 bp, Artificial Sequence
  chemically synthesized
ttgcctctatggtgtcttttaa

SEQ ID NO: 938469 - DNA, 22 bp, Artificial Sequence
  chemically synthesized
cctctatggtgtcttttaattc

SEQ ID NO: 938470 - DNA, 22 bp, Artificial Sequence
  chemically synthesized
tatggtgtcttttaattcaatg

SEQ ID NO: 938471 - DNA, 22 bp, Artificial Sequence
  chemically synthesized
tggtgtcttttaattcaatgtc

SEQ ID NO: 938472 - DNA, 22 bp, Artificial Sequence
  chemically synthesized
ttaattcaatgtcattacttcg

SEQ ID NO: 938473 - DNA, 22 bp, Artificial Sequence
  chemically synthesized
taattcaatgtcattacttcgt

SEQ ID NO: 938474 - DNA, 22 bp, Artificial Sequence
  chemically synthesized
aattcaatgtcattacttcgtg

SEQ ID NO: 938475 - DNA, 22 bp, Artificial Sequence
  chemically synthesized
attcaatgtcattacttcgtgt

SEQ ID NO: 938476 - DNA, 22 bp, Artificial Sequence
  chemically synthesized
aatgtcattacttcgtgtttgt

SEQ ID NO: 938477 - DNA, 22 bp, Artificial Sequence
  chemically synthesized
taataaacatcaccatagagaa

SEQ ID NO: 938478 - DNA, 22 bp, Artificial Sequence
  chemically synthesized
cttcgtgtttgttctctatggt

SEQ ID NO: 938479 - DNA, 22 bp, Artificial Sequence
  chemically synthesized
gtaataaacatcaccatagaga

SEQ ID NO: 938480 - DNA, 22 bp, Artificial Sequence
  chemically synthesized
tgtaataaacatcaccatagag

SEQ ID NO: 938481 - DNA, 22 bp, Artificial Sequence
  chemically synthesized
cgtgtttgttctctatggtgat

SEQ ID NO: 938482 - DNA, 22 bp, Artificial Sequence
  chemically synthesized
tttgtaataaacatcaccatag

SEQ ID NO: 938483 - DNA, 22 bp, Artificial Sequence
  chemically synthesized
gtgtttgttctctatggtgatg

SEQ ID NO: 938484 - DNA, 22 bp, Artificial Sequence
  chemically synthesized
tgctctttgtaataaacatcac

SEQ ID NO: 938485 - DNA, 22 bp, Artificial Sequence
  chemically synthesized
gtgctctttgtaataaacatca

SEQ ID NO: 938486 - DNA, 22 bp, Artificial Sequence
  chemically synthesized
gttctctatggtgatgtttatt

SEQ ID NO: 938487 - DNA, 22 bp, Artificial Sequence
  chemically synthesized
tgtgctctttgtaataaacatc

SEQ ID NO: 938488 - DNA, 22 bp, Artificial Sequence
  chemically synthesized
ttctctatggtgatgtttatta

SEQ ID NO: 938489 - DNA, 22 bp, Artificial Sequence
  chemically synthesized
tctatggtgatgtttattacaa

SEQ ID NO: 938490 - DNA, 22 bp, Artificial Sequence
  chemically synthesized
cctttgtgctctttgtaataaa

SEQ ID NO: 938491 - DNA, 22 bp, Artificial Sequence
  chemically synthesized
tatggtgatgtttattacaaag

SEQ ID NO: 938492 - DNA, 22 bp, Artificial Sequence
  chemically synthesized
ttccctttgtgctctttgtaat

SEQ ID NO: 938493 - DNA, 22 bp, Artificial Sequence
  chemically synthesized
tggtgatgtttattacaaagag

SEQ ID NO: 938494 - DNA, 22 bp, Artificial Sequence
  chemically synthesized
attacaaagagcacaaagggaa

SEQ ID NO: 938495 - DNA, 22 bp, Artificial Sequence
  chemically synthesized
gtgcataaattgttccctttgt

SEQ ID NO: 938496 - DNA, 22 bp, Artificial Sequence
  chemically synthesized
ttacaaagagcacaaagggaac

SEQ ID NO: 938497 - DNA, 22 bp, Artificial Sequence
  chemically synthesized
agtgcataaattgttccctttg

SEQ ID NO: 938498 - DNA, 22 bp, Artificial Sequence
  chemically synthesized
tagtgcataaattgttcccttt

SEQ ID NO: 938499 - DNA, 22 bp, Artificial Sequence
  chemically synthesized
caaagagcacaaagggaacaat

SEQ ID NO: 938500 - DNA, 22 bp, Artificial Sequence
  chemically synthesized
ataagcagagacatacctttag

SEQ ID NO: 938501 - DNA, 22 bp, Artificial Sequence
  chemically synthesized
tgataagcagagacataccttt

SEQ ID NO: 938502 - DNA, 22 bp, Artificial Sequence
  chemically synthesized
ttctgataagcagagacatacc

SEQ ID NO: 938503 - DNA, 22 bp, Artificial Sequence
  chemically synthesized
attctgataagcagagacatac

SEQ ID NO: 938504 - DNA, 22 bp, Artificial Sequence
  chemically synthesized
atgcactaaaggtatgtctctg

SEQ ID NO: 938505 - DNA, 22 bp, Artificial Sequence
  chemically synthesized
tgcactaaaggtatgtctctgc

SEQ ID NO: 938506 - DNA, 22 bp, Artificial Sequence
  chemically synthesized
aaggtatgtctctgcttatcag

SEQ ID NO: 938507 - DNA, 22 bp, Artificial Sequence
  chemically synthesized
tacgggtaatttattctgataa

SEQ ID NO: 938508 - DNA, 22 bp, Artificial Sequence
  chemically synthesized
atacgggtaatttattctgata

SEQ ID NO: 938509 - DNA, 22 bp, Artificial Sequence
  chemically synthesized
tgcttatcagaataaattaccc

SEQ ID NO: 938510 - DNA, 22 bp, Artificial Sequence
  chemically synthesized
cagacacttatacgggtaattt

SEQ ID NO: 938511 - DNA, 22 bp, Artificial Sequence
  chemically synthesized
cttatcagaataaattacccgt

SEQ ID NO: 938512 - DNA, 22 bp, Artificial Sequence
  chemically synthesized
gcagacacttatacgggtaatt

SEQ ID NO: 938513 - DNA, 22 bp, Artificial Sequence
  chemically synthesized
tgcagacacttatacgggtaat

SEQ ID NO: 938514 - DNA, 22 bp, Artificial Sequence
  chemically synthesized
ttgcagacacttatacgggtaa

SEQ ID NO: 938515 - DNA, 22 bp, Artificial Sequence
  chemically synthesized
atcagaataaattacccgtata

SEQ ID NO: 938516 - DNA, 22 bp, Artificial Sequence
  chemically synthesized
tcagaataaattacccgtataa

SEQ ID NO: 938517 - DNA, 22 bp, Artificial Sequence
  chemically synthesized
tttttgcagacacttatacggg

SEQ ID NO: 938518 - DNA, 22 bp, Artificial Sequence
  chemically synthesized
cccgtataagtgtctgcaaaaa

SEQ ID NO: 938519 - DNA, 22 bp, Artificial Sequence
  chemically synthesized
accaagaaaagtagatgggatt

SEQ ID NO: 938520 - DNA, 22 bp, Artificial Sequence
  chemically synthesized
caaaaataatcccatctacttt

SEQ ID NO: 938521 - DNA, 22 bp, Artificial Sequence
  chemically synthesized
aatattcaccaagaaaagtaga

SEQ ID NO: 938522 - DNA, 22 bp, Artificial Sequence
  chemically synthesized
ctcaatattcaccaagaaaagt

SEQ ID NO: 938523 - DNA, 22 bp, Artificial Sequence
  chemically synthesized
actcaatattcaccaagaaaag

SEQ ID NO: 938524 - DNA, 22 bp, Artificial Sequence
  chemically synthesized
acggtttactcaatattcacca

SEQ ID NO: 938525 - DNA, 22 bp, Artificial Sequence
  chemically synthesized
ttaacggtttactcaatattca

SEQ ID NO: 938526 - DNA, 22 bp, Artificial Sequence
  chemically synthesized
cttttcttggtgaatattgagt

SEQ ID NO: 938527 - DNA, 22 bp, Artificial Sequence
  chemically synthesized
ttcttggtgaatattgagtaaa

SEQ ID NO: 938528 - DNA, 22 bp, Artificial Sequence
  chemically synthesized
ccctgttaacggtttactcaat

SEQ ID NO: 938529 - DNA, 22 bp, Artificial Sequence
  chemically synthesized
tcttggtgaatattgagtaaac

SEQ ID NO: 938530 - DNA, 22 bp, Artificial Sequence
  chemically synthesized
cttggtgaatattgagtaaacc

SEQ ID NO: 938531 - DNA, 22 bp, Artificial Sequence
  chemically synthesized
ttggtgaatattgagtaaaccg

SEQ ID NO: 938532 - DNA, 22 bp, Artificial Sequence
  chemically synthesized
actgccctgttaacggtttact

SEQ ID NO: 938533 - DNA, 22 bp, Artificial Sequence
  chemically synthesized
ggtgaatattgagtaaaccgtt

SEQ ID NO: 938534 - DNA, 22 bp, Artificial Sequence
  chemically synthesized
cactgccctgttaacggtttac

SEQ ID NO: 938535 - DNA, 22 bp, Artificial Sequence
  chemically synthesized
gtgaatattgagtaaaccgtta

SEQ ID NO: 938536 - DNA, 22 bp, Artificial Sequence
  chemically synthesized
agtaaaccgttaacagggcagt

SEQ ID NO: 938537 - DNA, 22 bp, Artificial Sequence
  chemically synthesized
agaagataatcaaatgcttcac

SEQ ID NO: 938538 - DNA, 22 bp, Artificial Sequence
  chemically synthesized
gagaagataatcaaatgcttca

SEQ ID NO: 938539 - DNA, 22 bp, Artificial Sequence
  chemically synthesized
ttgagaagataatcaaatgctt

SEQ ID NO: 938540 - DNA, 22 bp, Artificial Sequence
  chemically synthesized
acagggcagtgaagcatttgat

SEQ ID NO: 938541 - DNA, 22 bp, Artificial Sequence
  chemically synthesized
tcttgagaagataatcaaatgc

SEQ ID NO: 938542 - DNA, 22 bp, Artificial Sequence
  chemically synthesized
attctcttgagaagataatcaa

SEQ ID NO: 938543 - DNA, 22 bp, Artificial Sequence
  chemically synthesized
cattctcttgagaagataatca

SEQ ID NO: 938544 - DNA, 22 bp, Artificial Sequence
  chemically synthesized
gattatcttctcaagagaatga

SEQ ID NO: 938545 - DNA, 22 bp, Artificial Sequence
  chemically synthesized
attatcttctcaagagaatgaa

SEQ ID NO: 938546 - DNA, 22 bp, Artificial Sequence
  chemically synthesized
tcttctcaagagaatgaagacc

SEQ ID NO: 938547 - DNA, 22 bp, Artificial Sequence
  chemically synthesized
ctcaagagaatgaagaccttca

SEQ ID NO: 938548 - DNA, 22 bp, Artificial Sequence
  chemically synthesized
tcaagagaatgaagaccttcat

SEQ ID NO: 938549 - DNA, 22 bp, Artificial Sequence
  chemically synthesized
aagagaatgaagaccttcatgg

SEQ ID NO: 938550 - DNA, 22 bp, Artificial Sequence
  chemically synthesized
gaaggaggatgaccatgaaggt

SEQ ID NO: 938551 - DNA, 22 bp, Artificial Sequence
  chemically synthesized
agtcctagaaggaggatgacca

SEQ ID NO: 938552 - DNA, 22 bp, Artificial Sequence
  chemically synthesized
tcagtcctagaaggaggatgac

SEQ ID NO: 938553 - DNA, 22 bp, Artificial Sequence
  chemically synthesized
tctcagtcctagaaggaggatg

SEQ ID NO: 938554 - DNA, 22 bp, Artificial Sequence
  chemically synthesized
ctctcagtcctagaaggaggat

SEQ ID NO: 938555 - DNA, 22 bp, Artificial Sequence
  chemically synthesized
catggtcatcctccttctagga

SEQ ID NO: 938556 - DNA, 22 bp, Artificial Sequence
  chemically synthesized
atggtcatcctccttctaggac

SEQ ID NO: 938557 - DNA, 22 bp, Artificial Sequence
  chemically synthesized
gcatttctctcagtcctagaag

SEQ ID NO: 938558 - DNA, 22 bp, Artificial Sequence
  chemically synthesized
cttctaggactgagagaaatgc

SEQ ID NO: 938559 - DNA, 22 bp, Artificial Sequence
  chemically synthesized
gtgaggagaaattagcatttct

SEQ ID NO: 938560 - DNA, 22 bp, Artificial Sequence
  chemically synthesized
ctaggactgagagaaatgctaa

SEQ ID NO: 938561 - DNA, 22 bp, Artificial Sequence
  chemically synthesized
ggtgaggagaaattagcatttc

SEQ ID NO: 938562 - DNA, 22 bp, Artificial Sequence
  chemically synthesized
taggactgagagaaatgctaat

SEQ ID NO: 938563 - DNA, 22 bp, Artificial Sequence
  chemically synthesized
ggactgagagaaatgctaattt

SEQ ID NO: 938564 - DNA, 22 bp, Artificial Sequence
  chemically synthesized
ataaccttggtgaggagaaatt

SEQ ID NO: 938565 - DNA, 22 bp, Artificial Sequence
  chemically synthesized
agagaaatgctaatttctcctc

SEQ ID NO: 938566 - DNA, 22 bp, Artificial Sequence
  chemically synthesized
cataaccttggtgaggagaaat

SEQ ID NO: 938567 - DNA, 22 bp, Artificial Sequence
  chemically synthesized
ccttcataaccttggtgaggag

SEQ ID NO: 938568 - DNA, 22 bp, Artificial Sequence
  chemically synthesized
atttctcctcaccaaggttatg

SEQ ID NO: 938569 - DNA, 22 bp, Artificial Sequence
  chemically synthesized
ctcctcaccaaggttatgaagg

SEQ ID NO: 938570 - DNA, 22 bp, Artificial Sequence
  chemically synthesized
tcctcaccaaggttatgaaggt

SEQ ID NO: 938571 - DNA, 22 bp, Artificial Sequence
  chemically synthesized
ctcaccaaggttatgaaggtag

SEQ ID NO: 938572 - DNA, 22 bp, Artificial Sequence
  chemically synthesized
accaaggttatgaaggtagcat

SEQ ID NO: 938573 - DNA, 22 bp, Artificial Sequence
  chemically synthesized
ggtgtaaagatgatatgctacc

SEQ ID NO: 938574 - DNA, 22 bp, Artificial Sequence
  chemically synthesized
atgctaggtgtaaagatgatat

SEQ ID NO: 938575 - DNA, 22 bp, Artificial Sequence
  chemically synthesized
tgaaggtagcatatcatcttta

SEQ ID NO: 938576 - DNA, 22 bp, Artificial Sequence
  chemically synthesized
gctaatgctaggtgtaaagatg

SEQ ID NO: 938577 - DNA, 22 bp, Artificial Sequence
  chemically synthesized
agctaatgctaggtgtaaagat

SEQ ID NO: 938578 - DNA, 22 bp, Artificial Sequence
  chemically synthesized
agaaacttagctaatgctaggt

SEQ ID NO: 938579 - DNA, 22 bp, Artificial Sequence
  chemically synthesized
agattgagaaacttagctaatg

SEQ ID NO: 938580 - DNA, 22 bp, Artificial Sequence
  chemically synthesized
gagattgagaaacttagctaat

SEQ ID NO: 938581 - DNA, 22 bp, Artificial Sequence
  chemically synthesized
tgagattgagaaacttagctaa

SEQ ID NO: 938582 - DNA, 22 bp, Artificial Sequence
  chemically synthesized
tacacctagcattagctaagtt

SEQ ID NO: 938583 - DNA, 22 bp, Artificial Sequence
  chemically synthesized
acacctagcattagctaagttt

SEQ ID NO: 938584 - DNA, 22 bp, Artificial Sequence
  chemically synthesized
cacctagcattagctaagtttc

SEQ ID NO: 938585 - DNA, 22 bp, Artificial Sequence
  chemically synthesized
aattttgagattgagaaactta

SEQ ID NO: 938586 - DNA, 22 bp, Artificial Sequence
  chemically synthesized
caattttgagattgagaaactt

SEQ ID NO: 938587 - DNA, 22 bp, Artificial Sequence
  chemically synthesized
ttcaattttgagattgagaaac

SEQ ID NO: 938588 - DNA, 22 bp, Artificial Sequence
  chemically synthesized
gcattagctaagtttctcaatc

SEQ ID NO: 938589 - DNA, 22 bp, Artificial Sequence
  chemically synthesized
cttcaattttgagattgagaaa

SEQ ID NO: 938590 - DNA, 22 bp, Artificial Sequence
  chemically synthesized
gctaagtttctcaatctcaaaa

SEQ ID NO: 938591 - DNA, 22 bp, Artificial Sequence
  chemically synthesized
aaacacttcttcaattttgaga

SEQ ID NO: 938592 - DNA, 22 bp, Artificial Sequence
  chemically synthesized
agtttctcaatctcaaaattga

SEQ ID NO: 938593 - DNA, 22 bp, Artificial Sequence
  chemically synthesized
ctcaatctcaaaattgaagaag

SEQ ID NO: 938594 - DNA, 22 bp, Artificial Sequence
  chemically synthesized
tcaatctcaaaattgaagaagt

SEQ ID NO: 938595 - DNA, 22 bp, Artificial Sequence
  chemically synthesized
acaaactgaaacacttcttcaa

SEQ ID NO: 938596 - DNA, 22 bp, Artificial Sequence
  chemically synthesized
aacaaactgaaacacttcttca

SEQ ID NO: 938597 - DNA, 22 bp, Artificial Sequence
  chemically synthesized
aatctcaaaattgaagaagtgt

SEQ ID NO: 938598 - DNA, 22 bp, Artificial Sequence
  chemically synthesized
aaaattgaagaagtgtttcagt

SEQ ID NO: 938599 - DNA, 22 bp, Artificial Sequence
  chemically synthesized
atcatgggcttaacaaactgaa

SEQ ID NO: 938600 - DNA, 22 bp, Artificial Sequence
  chemically synthesized
catcatgggcttaacaaactga

SEQ ID NO: 938601 - DNA, 22 bp, Artificial Sequence
  chemically synthesized
tcatcatgggcttaacaaactg

SEQ ID NO: 938602 - DNA, 22 bp, Artificial Sequence
  chemically synthesized
aagaagtgtttcagtttgttaa

SEQ ID NO: 938603 - DNA, 22 bp, Artificial Sequence
  chemically synthesized
cagtttgttaagcccatgatga

SEQ ID NO: 938604 - DNA, 22 bp, Artificial Sequence
  chemically synthesized
agtttgttaagcccatgatgaa

SEQ ID NO: 938605 - DNA, 22 bp, Artificial Sequence
  chemically synthesized
gttaagcccatgatgaaagctt

SEQ ID NO: 938606 - DNA, 22 bp, Artificial Sequence
  chemically synthesized
ttaagcccatgatgaaagcttg

SEQ ID NO: 938607 - DNA, 22 bp, Artificial Sequence
  chemically synthesized
agcccatgatgaaagcttgtct

SEQ ID NO: 938608 - DNA, 22 bp, Artificial Sequence
  chemically synthesized
gaatgtgagagaaaaagacaag

SEQ ID NO: 938609 - DNA, 22 bp, Artificial Sequence
  chemically synthesized
tagactagaatgtgagagaaaa

SEQ ID NO: 938610 - DNA, 22 bp, Artificial Sequence
  chemically synthesized
atagactagaatgtgagagaaa

SEQ ID NO: 938611 - DNA, 22 bp, Artificial Sequence
  chemically synthesized
cttatagactagaatgtgagag

SEQ ID NO: 938612 - DNA, 22 bp, Artificial Sequence
  chemically synthesized
gtctttttctctcacattctag

SEQ ID NO: 938613 - DNA, 22 bp, Artificial Sequence
  chemically synthesized
tctttttctctcacattctagt

SEQ ID NO: 938614 - DNA, 22 bp, Artificial Sequence
  chemically synthesized
tgctacttatagactagaatgt

SEQ ID NO: 938615 - DNA, 22 bp, Artificial Sequence
  chemically synthesized
tttctctcacattctagtctat

SEQ ID NO: 938616 - DNA, 22 bp, Artificial Sequence
  chemically synthesized
ttctctcacattctagtctata

SEQ ID NO: 938617 - DNA, 22 bp, Artificial Sequence
  chemically synthesized
tctctcacattctagtctataa

SEQ ID NO: 938618 - DNA, 22 bp, Artificial Sequence
  chemically synthesized
ctctcacattctagtctataag

SEQ ID NO: 938619 - DNA, 22 bp, Artificial Sequence
  chemically synthesized
tctcacattctagtctataagt

SEQ ID NO: 938620 - DNA, 22 bp, Artificial Sequence
  chemically synthesized
tcacattctagtctataagtag

SEQ ID NO: 938621 - DNA, 22 bp, Artificial Sequence
  chemically synthesized
acattctagtctataagtagca

SEQ ID NO: 938622 - DNA, 22 bp, Artificial Sequence
  chemically synthesized
tagtctataagtagcacagcta

SEQ ID NO: 938623 - DNA, 22 bp, Artificial Sequence
  chemically synthesized
agaccccagacatagctgtgct

SEQ ID NO: 938624 - DNA, 22 bp, Artificial Sequence
  chemically synthesized
gtctataagtagcacagctatg

SEQ ID NO: 938625 - DNA, 22 bp, Artificial Sequence
  chemically synthesized
taagtagcacagctatgtctgg

SEQ ID NO: 938626 - DNA, 22 bp, Artificial Sequence
  chemically synthesized
aaaaaaaactaagaccccagac

SEQ ID NO: 938627 - DNA, 22 bp, Artificial Sequence
  chemically synthesized
taaaaaaaaactaagaccccag

SEQ ID NO: 938628 - DNA, 22 bp, Artificial Sequence
  chemically synthesized
ttctaaaaaaaaactaagaccc

SEQ ID NO: 938629 - DNA, 22 bp, Artificial Sequence
  chemically synthesized
attctaaaaaaaaactaagacc

SEQ ID NO: 938630 - DNA, 22 bp, Artificial Sequence
  chemically synthesized
tgtctggggtcttagttttttt

SEQ ID NO: 938631 - DNA, 22 bp, Artificial Sequence
  chemically synthesized
tcatccttattctaaaaaaaaa

SEQ ID NO: 938632 - DNA, 22 bp, Artificial Sequence
  chemically synthesized
gggtcttagtttttttttagaa

SEQ ID NO: 938633 - DNA, 22 bp, Artificial Sequence
  chemically synthesized
agtttttttttagaataaggat

SEQ ID NO: 938634 - DNA, 22 bp, Artificial Sequence
  chemically synthesized
gtttttttttagaataaggatg

SEQ ID NO: 938635 - DNA, 22 bp, Artificial Sequence
  chemically synthesized
ttttttagaataaggatgatag

SEQ ID NO: 938636 - DNA, 22 bp, Artificial Sequence
  chemically synthesized
tttttagaataaggatgatagc

SEQ ID NO: 938637 - DNA, 22 bp, Artificial Sequence
  chemically synthesized
ttttagaataaggatgatagct

SEQ ID NO: 938638 - DNA, 22 bp, Artificial Sequence
  chemically synthesized
tttagaataaggatgatagctc

SEQ ID NO: 938639 - DNA, 22 bp, Artificial Sequence
  chemically synthesized
ttagaataaggatgatagctct

SEQ ID NO: 938640 - DNA, 22 bp, Artificial Sequence
  chemically synthesized
tagaataaggatgatagctctg

SEQ ID NO: 938641 - DNA, 22 bp, Artificial Sequence
  chemically synthesized
atcgaagacagacagagctatc

SEQ ID NO: 938642 - DNA, 22 bp, Artificial Sequence
  chemically synthesized
agaataaggatgatagctctgt

SEQ ID NO: 938643 - DNA, 22 bp, Artificial Sequence
  chemically synthesized
gaataaggatgatagctctgtc

SEQ ID NO: 938644 - DNA, 22 bp, Artificial Sequence
  chemically synthesized
aggccctcatcgaagacagaca

SEQ ID NO: 938645 - DNA, 22 bp, Artificial Sequence
  chemically synthesized
gagctcaggccctcatcgaaga

SEQ ID NO: 938646 - DNA, 22 bp, Artificial Sequence
  chemically synthesized
tgtctgtcttcgatgagggcct

SEQ ID NO: 938647 - DNA, 22 bp, Artificial Sequence
  chemically synthesized
tctgtcttcgatgagggcctga

SEQ ID NO: 938648 - DNA, 22 bp, Artificial Sequence
  chemically synthesized
tcttcgatgagggcctgagctc

SEQ ID NO: 938649 - DNA, 22 bp, Artificial Sequence
  chemically synthesized
tccagaggcctagagctcaggc

SEQ ID NO: 938650 - DNA, 22 bp, Artificial Sequence
  chemically synthesized
tatccagaggcctagagctcag

SEQ ID NO: 938651 - DNA, 22 bp, Artificial Sequence
  chemically synthesized
ctatccagaggcctagagctca

SEQ ID NO: 938652 - DNA, 22 bp, Artificial Sequence
  chemically synthesized
cgatgagggcctgagctctagg

SEQ ID NO: 938653 - DNA, 22 bp, Artificial Sequence
  chemically synthesized
gatgagggcctgagctctaggc

SEQ ID NO: 938654 - DNA, 22 bp, Artificial Sequence
  chemically synthesized
tttctatccagaggcctagagc

SEQ ID NO: 938655 - DNA, 22 bp, Artificial Sequence
  chemically synthesized
tgtttctatccagaggcctaga

SEQ ID NO: 938656 - DNA, 22 bp, Artificial Sequence
  chemically synthesized
ctgtttctatccagaggcctag

SEQ ID NO: 938657 - DNA, 22 bp, Artificial Sequence
  chemically synthesized
ttctgtttctatccagaggcct

SEQ ID NO: 938658 - DNA, 22 bp, Artificial Sequence
  chemically synthesized
cctcttctgtttctatccagag

SEQ ID NO: 938659 - DNA, 22 bp, Artificial Sequence
  chemically synthesized
agctctaggcctctggatagaa

SEQ ID NO: 938660 - DNA, 22 bp, Artificial Sequence
  chemically synthesized
taggcctctggatagaaacaga

SEQ ID NO: 938661 - DNA, 22 bp, Artificial Sequence
  chemically synthesized
ggcctctggatagaaacagaag

SEQ ID NO: 938662 - DNA, 22 bp, Artificial Sequence
  chemically synthesized
tggatagaaacagaagaggtaa

SEQ ID NO: 938663 - DNA, 22 bp, Artificial Sequence
  chemically synthesized
gatagaaacagaagaggtaatc

SEQ ID NO: 938664 - DNA, 22 bp, Artificial Sequence
  chemically synthesized
acatgtaggacagattacctct

SEQ ID NO: 938665 - DNA, 22 bp, Artificial Sequence
  chemically synthesized
attcacatgtaggacagattac

SEQ ID NO: 938666 - DNA, 22 bp, Artificial Sequence
  chemically synthesized
acattaattcacatgtaggaca

SEQ ID NO: 938667 - DNA, 22 bp, Artificial Sequence
  chemically synthesized
ctcacattaattcacatgtagg

SEQ ID NO: 938668 - DNA, 22 bp, Artificial Sequence
  chemically synthesized
cctcacattaattcacatgtag

SEQ ID NO: 938669 - DNA, 22 bp, Artificial Sequence
  chemically synthesized
cttcctcacattaattcacatg

SEQ ID NO: 938670 - DNA, 22 bp, Artificial Sequence
  chemically synthesized
attccttcctcacattaattca

SEQ ID NO: 938671 - DNA, 22 bp, Artificial Sequence
  chemically synthesized
tcattccttcctcacattaatt

SEQ ID NO: 938672 - DNA, 22 bp, Artificial Sequence
  chemically synthesized
tcctacatgtgaattaatgtga

SEQ ID NO: 938673 - DNA, 22 bp, Artificial Sequence
  chemically synthesized
ctcattccttcctcacattaat

SEQ ID NO: 938674 - DNA, 22 bp, Artificial Sequence
  chemically synthesized
tctcattccttcctcacattaa

SEQ ID NO: 938675 - DNA, 22 bp, Artificial Sequence
  chemically synthesized
ctttctcattccttcctcacat

SEQ ID NO: 938676 - DNA, 22 bp, Artificial Sequence
  chemically synthesized
catgtgaattaatgtgaggaag

SEQ ID NO: 938677 - DNA, 22 bp, Artificial Sequence
  chemically synthesized
tatctgctttctcattccttcc

SEQ ID NO: 938678 - DNA, 22 bp, Artificial Sequence
  chemically synthesized
atatctgctttctcattccttc

SEQ ID NO: 938679 - DNA, 22 bp, Artificial Sequence
  chemically synthesized
tatatctgctttctcattcctt

SEQ ID NO: 938680 - DNA, 22 bp, Artificial Sequence
  chemically synthesized
atgtgaggaaggaatgagaaag

SEQ ID NO: 938681 - DNA, 22 bp, Artificial Sequence
  chemically synthesized
ggtactttatatctgctttctc

SEQ ID NO: 938682 - DNA, 22 bp, Artificial Sequence
  chemically synthesized
tgatcatagtgactaggtactt

SEQ ID NO: 938683 - DNA, 22 bp, Artificial Sequence
  chemically synthesized
tatattatgatcatagtgacta

SEQ ID NO: 938684 - DNA, 22 bp, Artificial Sequence
  chemically synthesized
taaattgtatattatgatcata

SEQ ID NO: 938685 - DNA, 22 bp, Artificial Sequence
  chemically synthesized
ataaattgtatattatgatcat

SEQ ID NO: 938686 - DNA, 22 bp, Artificial Sequence
  chemically synthesized
acttataaattgtatattatga

SEQ ID NO: 938687 - DNA, 22 bp, Artificial Sequence
  chemically synthesized
gtcactatgatcataatataca

SEQ ID NO: 938688 - DNA, 22 bp, Artificial Sequence
  chemically synthesized
tcacttataaattgtatattat

SEQ ID NO: 938689 - DNA, 22 bp, Artificial Sequence
  chemically synthesized
tgatcataatatacaatttata

SEQ ID NO: 938690 - DNA, 22 bp, Artificial Sequence
  chemically synthesized
atatcggagctctcacttataa

SEQ ID NO: 938691 - DNA, 22 bp, Artificial Sequence
  chemically synthesized
ctgatatcggagctctcactta

SEQ ID NO: 938692 - DNA, 22 bp, Artificial Sequence
  chemically synthesized
ataagtgagagctccgatatca

SEQ ID NO: 938693 - DNA, 22 bp, Artificial Sequence
  chemically synthesized
taagtgagagctccgatatcag

SEQ ID NO: 938694 - DNA, 22 bp, Artificial Sequence
  chemically synthesized
gtaacaatattactgatatcgg

SEQ ID NO: 938695 - DNA, 22 bp, Artificial Sequence
  chemically synthesized
tactagtaacaatattactgat

SEQ ID NO: 938696 - DNA, 22 bp, Artificial Sequence
  chemically synthesized
cgatatcagtaatattgttact

SEQ ID NO: 938697 - DNA, 22 bp, Artificial Sequence
  chemically synthesized
aaagacagcgagttatactagt

SEQ ID NO: 938698 - DNA, 22 bp, Artificial Sequence
  chemically synthesized
ttactagtataactcgctgtct

SEQ ID NO: 938699 - DNA, 22 bp, Artificial Sequence
  chemically synthesized
ctagtataactcgctgtctttc

SEQ ID NO: 938700 - DNA, 22 bp, Artificial Sequence
  chemically synthesized
gtataactcgctgtctttcaac

SEQ ID NO: 938701 - DNA, 22 bp, Artificial Sequence
  chemically synthesized
aatgaataaaccagttgaaaga

SEQ ID NO: 938702 - DNA, 22 bp, Artificial Sequence
  chemically synthesized
gctgtctttcaactggtttatt

SEQ ID NO: 938703 - DNA, 22 bp, Artificial Sequence
  chemically synthesized
tctttcaactggtttattcatt

SEQ ID NO: 938704 - DNA, 22 bp, Artificial Sequence
  chemically synthesized
tcaactggtttattcatttagc

SEQ ID NO: 938705 - DNA, 22 bp, Artificial Sequence
  chemically synthesized
caactggtttattcatttagct

SEQ ID NO: 938706 - DNA, 22 bp, Artificial Sequence
  chemically synthesized
aactggtttattcatttagctt

SEQ ID NO: 938707 - DNA, 22 bp, Artificial Sequence
  chemically synthesized
ccatatatatggagaaagctaa

SEQ ID NO: 938708 - DNA, 22 bp, Artificial Sequence
  chemically synthesized
accatatatatggagaaagcta

SEQ ID NO: 938709 - DNA, 22 bp, Artificial Sequence
  chemically synthesized
gtttattcatttagctttctcc

SEQ ID NO: 938710 - DNA, 22 bp, Artificial Sequence
  chemically synthesized
attcatttagctttctccatat

SEQ ID NO: 938711 - DNA, 22 bp, Artificial Sequence
  chemically synthesized
ttcatttagctttctccatata

SEQ ID NO: 938712 - DNA, 22 bp, Artificial Sequence
  chemically synthesized
gggcttaccatatatatggaga

SEQ ID NO: 938713 - DNA, 22 bp, Artificial Sequence
  chemically synthesized
ggggcttaccatatatatggag

SEQ ID NO: 938714 - DNA, 22 bp, Artificial Sequence
  chemically synthesized
tggggcttaccatatatatgga

SEQ ID NO: 938715 - DNA, 22 bp, Artificial Sequence
  chemically synthesized
atttagctttctccatatatat

SEQ ID NO: 938716 - DNA, 22 bp, Artificial Sequence
  chemically synthesized
agctttctccatatatatggta

SEQ ID NO: 938717 - DNA, 22 bp, Artificial Sequence
  chemically synthesized
gctttctccatatatatggtaa

SEQ ID NO: 938718 - DNA, 22 bp, Artificial Sequence
  chemically synthesized
tctccatatatatggtaagccc

SEQ ID NO: 938719 - DNA, 22 bp, Artificial Sequence
  chemically synthesized
ctccatatatatggtaagcccc

SEQ ID NO: 938720 - DNA, 22 bp, Artificial Sequence
  chemically synthesized
tccatatatatggtaagcccca

SEQ ID NO: 938721 - DNA, 22 bp, Artificial Sequence
  chemically synthesized
catatatatggtaagccccaaa

SEQ ID NO: 938722 - DNA, 22 bp, Artificial Sequence
  chemically synthesized
agaaagaggagaacaaaaaaat

SEQ ID NO: 938723 - DNA, 22 bp, Artificial Sequence
  chemically synthesized
gagaaagaggagaacaaaaaaa

SEQ ID NO: 938724 - DNA, 22 bp, Artificial Sequence
  chemically synthesized
ttttgttctcctctttctcaag

SEQ ID NO: 938725 - DNA, 22 bp, Artificial Sequence
  chemically synthesized
tttgttctcctctttctcaagc

SEQ ID NO: 938726 - DNA, 22 bp, Artificial Sequence
  chemically synthesized
ttgttctcctctttctcaagcc

SEQ ID NO: 938727 - DNA, 22 bp, Artificial Sequence
  chemically synthesized
tgttctcctctttctcaagcct

SEQ ID NO: 938728 - DNA, 22 bp, Artificial Sequence
  chemically synthesized
gttctcctctttctcaagcctt

SEQ ID NO: 938729 - DNA, 22 bp, Artificial Sequence
  chemically synthesized
cataggaccagaaaggcttgag

SEQ ID NO: 938730 - DNA, 22 bp, Artificial Sequence
  chemically synthesized
ttctcctctttctcaagccttt

SEQ ID NO: 938731 - DNA, 22 bp, Artificial Sequence
  chemically synthesized
ccataggaccagaaaggcttga

SEQ ID NO: 938732 - DNA, 22 bp, Artificial Sequence
  chemically synthesized
tccataggaccagaaaggcttg

SEQ ID NO: 938733 - DNA, 22 bp, Artificial Sequence
  chemically synthesized
tcctctttctcaagcctttctg

SEQ ID NO: 938734 - DNA, 22 bp, Artificial Sequence
  chemically synthesized
ctctttctcaagcctttctggt

SEQ ID NO: 938735 - DNA, 22 bp, Artificial Sequence
  chemically synthesized
tttctcaagcctttctggtcct

SEQ ID NO: 938736 - DNA, 22 bp, Artificial Sequence
  chemically synthesized
caacactttccataggaccaga

SEQ ID NO: 938737 - DNA, 22 bp, Artificial Sequence
  chemically synthesized
tctcaagcctttctggtcctat

SEQ ID NO: 938738 - DNA, 22 bp, Artificial Sequence
  chemically synthesized
ctcaagcctttctggtcctatg

SEQ ID NO: 938739 - DNA, 22 bp, Artificial Sequence
  chemically synthesized
tcaagcctttctggtcctatgg

SEQ ID NO: 938740 - DNA, 22 bp, Artificial Sequence
  chemically synthesized
aagcctttctggtcctatggaa

SEQ ID NO: 938741 - DNA, 22 bp, Artificial Sequence
  chemically synthesized
tctggtcctatggaaagtgttg

SEQ ID NO: 938742 - DNA, 22 bp, Artificial Sequence
  chemically synthesized
ctggtcctatggaaagtgttgg

SEQ ID NO: 938743 - DNA, 22 bp, Artificial Sequence
  chemically synthesized
tagcaataaactccaacacttt

SEQ ID NO: 938744 - DNA, 22 bp, Artificial Sequence
  chemically synthesized
tggtcctatggaaagtgttgga

SEQ ID NO: 938745 - DNA, 22 bp, Artificial Sequence
  chemically synthesized
tgtagcaataaactccaacact

SEQ ID NO: 938746 - DNA, 22 bp, Artificial Sequence
  chemically synthesized
gtcctatggaaagtgttggagt

SEQ ID NO: 938747 - DNA, 22 bp, Artificial Sequence
  chemically synthesized
ctgtagcaataaactccaacac

SEQ ID NO: 938748 - DNA, 22 bp, Artificial Sequence
  chemically synthesized
tggaaagtgttggagtttattg

SEQ ID NO: 938749 - DNA, 22 bp, Artificial Sequence
  chemically synthesized
aagaaataatttctgtagcaat

SEQ ID NO: 938750 - DNA, 22 bp, Artificial Sequence
  chemically synthesized
gagtttattgctacagaaatta

SEQ ID NO: 938751 - DNA, 22 bp, Artificial Sequence
  chemically synthesized
attgctacagaaattatttctt

SEQ ID NO: 938752 - DNA, 22 bp, Artificial Sequence
  chemically synthesized
ttgctacagaaattatttcttt

SEQ ID NO: 938753 - DNA, 22 bp, Artificial Sequence
  chemically synthesized
ctacagaaattatttctttagt

SEQ ID NO: 938754 - DNA, 22 bp, Artificial Sequence
  chemically synthesized
tggatcacaataaactaaagaa

SEQ ID NO: 938755 - DNA, 22 bp, Artificial Sequence
  chemically synthesized
cagaaattatttctttagttta

SEQ ID NO: 938756 - DNA, 22 bp, Artificial Sequence
  chemically synthesized
caaactatggatcacaataaac

SEQ ID NO: 938757 - DNA, 22 bp, Artificial Sequence
  chemically synthesized
ccaaactatggatcacaataaa

SEQ ID NO: 938758 - DNA, 22 bp, Artificial Sequence
  chemically synthesized
tttctttagtttattgtgatcc

SEQ ID NO: 938759 - DNA, 22 bp, Artificial Sequence
  chemically synthesized
acttccaaactatggatcacaa

SEQ ID NO: 938760 - DNA, 22 bp, Artificial Sequence
  chemically synthesized
aacttccaaactatggatcaca

SEQ ID NO: 938761 - DNA, 22 bp, Artificial Sequence
  chemically synthesized
ctttagtttattgtgatccata

SEQ ID NO: 938762 - DNA, 22 bp, Artificial Sequence
  chemically synthesized
tttagtttattgtgatccatag

SEQ ID NO: 938763 - DNA, 22 bp, Artificial Sequence
  chemically synthesized
tagtttattgtgatccatagtt

SEQ ID NO: 938764 - DNA, 22 bp, Artificial Sequence
  chemically synthesized
agtttattgtgatccatagttt

SEQ ID NO: 938765 - DNA, 22 bp, Artificial Sequence
  chemically synthesized
gtttattgtgatccatagtttg

SEQ ID NO: 938766 - DNA, 22 bp, Artificial Sequence
  chemically synthesized
attgtgatccatagtttggaag

SEQ ID NO: 938767 - DNA, 22 bp, Artificial Sequence
  chemically synthesized
ttgtgatccatagtttggaagt

SEQ ID NO: 938768 - DNA, 22 bp, Artificial Sequence
  chemically synthesized
taaaaatagacttaacttccaa

SEQ ID NO: 938769 - DNA, 22 bp, Artificial Sequence
  chemically synthesized
tgatccatagtttggaagttaa

SEQ ID NO: 938770 - DNA, 22 bp, Artificial Sequence
  chemically synthesized
ggaagttaagtctatttttata

SEQ ID NO: 938771 - DNA, 22 bp, Artificial Sequence
  chemically synthesized
gaagttaagtctatttttatag

SEQ ID NO: 938772 - DNA, 22 bp, Artificial Sequence
  chemically synthesized
aaggagaaaaacagctataaaa

SEQ ID NO: 938773 - DNA, 22 bp, Artificial Sequence
  chemically synthesized
tgaaggagaaaaacagctataa

SEQ ID NO: 938774 - DNA, 22 bp, Artificial Sequence
  chemically synthesized
agtctatttttatagctgtttt

SEQ ID NO: 938775 - DNA, 22 bp, Artificial Sequence
  chemically synthesized
tttttatagctgtttttctcct

SEQ ID NO: 938776 - DNA, 22 bp, Artificial Sequence
  chemically synthesized
aaaatatgctctgaaggagaaa

SEQ ID NO: 938777 - DNA, 22 bp, Artificial Sequence
  chemically synthesized
ttatagctgtttttctccttca

SEQ ID NO: 938778 - DNA, 22 bp, Artificial Sequence
  chemically synthesized
tatagctgtttttctccttcag

SEQ ID NO: 938779 - DNA, 22 bp, Artificial Sequence
  chemically synthesized
atagctgtttttctccttcaga

SEQ ID NO: 938780 - DNA, 22 bp, Artificial Sequence
  chemically synthesized
tagctgtttttctccttcagag

SEQ ID NO: 938781 - DNA, 22 bp, Artificial Sequence
  chemically synthesized
aattgaaaatatgctctgaagg

SEQ ID NO: 938782 - DNA, 22 bp, Artificial Sequence
  chemically synthesized
tttttctccttcagagcatatt

SEQ ID NO: 938783 - DNA, 22 bp, Artificial Sequence
  chemically synthesized
agttaaattgaaaatatgctct

SEQ ID NO: 938784 - DNA, 22 bp, Artificial Sequence
  chemically synthesized
ttctccttcagagcatattttc

SEQ ID NO: 938785 - DNA, 22 bp, Artificial Sequence
  chemically synthesized
ctaagttaaattgaaaatatgc

SEQ ID NO: 938786 - DNA, 22 bp, Artificial Sequence
  chemically synthesized
tctccttcagagcatattttca

SEQ ID NO: 938787 - DNA, 22 bp, Artificial Sequence
  chemically synthesized
gctaagttaaattgaaaatatg

SEQ ID NO: 938788 - DNA, 22 bp, Artificial Sequence
  chemically synthesized
ctccttcagagcatattttcaa

SEQ ID NO: 938789 - DNA, 22 bp, Artificial Sequence
  chemically synthesized
tccttcagagcatattttcaat

SEQ ID NO: 938790 - DNA, 22 bp, Artificial Sequence
  chemically synthesized
tttgctaagttaaattgaaaat

SEQ ID NO: 938791 - DNA, 22 bp, Artificial Sequence
  chemically synthesized
cttcagagcatattttcaattt

SEQ ID NO: 938792 - DNA, 22 bp, Artificial Sequence
  chemically synthesized
cagagcatattttcaatttaac

SEQ ID NO: 938793 - DNA, 22 bp, Artificial Sequence
  chemically synthesized
agagcatattttcaatttaact

SEQ ID NO: 938794 - DNA, 22 bp, Artificial Sequence
  chemically synthesized
aaaacagtgcctgtttgctaag

SEQ ID NO: 938795 - DNA, 22 bp, Artificial Sequence
  chemically synthesized
tcaatttaacttagcaaacagg

SEQ ID NO: 938796 - DNA, 22 bp, Artificial Sequence
  chemically synthesized
caatttaacttagcaaacaggc

SEQ ID NO: 938797 - DNA, 22 bp, Artificial Sequence
  chemically synthesized
aatttaacttagcaaacaggca

SEQ ID NO: 938798 - DNA, 22 bp, Artificial Sequence
  chemically synthesized
gaattaaaaacagtgcctgttt

SEQ ID NO: 938799 - DNA, 22 bp, Artificial Sequence
  chemically synthesized
ggaattaaaaacagtgcctgtt

SEQ ID NO: 938800 - DNA, 22 bp, Artificial Sequence
  chemically synthesized
tggaattaaaaacagtgcctgt

SEQ ID NO: 938801 - DNA, 22 bp, Artificial Sequence
  chemically synthesized
aacttagcaaacaggcactgtt

SEQ ID NO: 938802 - DNA, 22 bp, Artificial Sequence
  chemically synthesized
acttagcaaacaggcactgttt

SEQ ID NO: 938803 - DNA, 22 bp, Artificial Sequence
  chemically synthesized
ttttggaattaaaaacagtgcc

SEQ ID NO: 938804 - DNA, 22 bp, Artificial Sequence
  chemically synthesized
gttttggaattaaaaacagtgc

SEQ ID NO: 938805 - DNA, 22 bp, Artificial Sequence
  chemically synthesized
tgttttggaattaaaaacagtg

SEQ ID NO: 938806 - DNA, 22 bp, Artificial Sequence
  chemically synthesized
agcaaacaggcactgtttttaa

SEQ ID NO: 938807 - DNA, 22 bp, Artificial Sequence
  chemically synthesized
gcaaacaggcactgtttttaat

SEQ ID NO: 938808 - DNA, 22 bp, Artificial Sequence
  chemically synthesized
ctttgttttggaattaaaaaca

SEQ ID NO: 938809 - DNA, 22 bp, Artificial Sequence
  chemically synthesized
tgcattactttgttttggaatt

SEQ ID NO: 938810 - DNA, 22 bp, Artificial Sequence
  chemically synthesized
atgcattactttgttttggaat

SEQ ID NO: 938811 - DNA, 22 bp, Artificial Sequence
  chemically synthesized
tttatgcattactttgttttgg

SEQ ID NO: 938812 - DNA, 22 bp, Artificial Sequence
  chemically synthesized
gtttatgcattactttgttttg

SEQ ID NO: 938813 - DNA, 22 bp, Artificial Sequence
  chemically synthesized
tgtttatgcattactttgtttt

SEQ ID NO: 938814 - DNA, 22 bp, Artificial Sequence
  chemically synthesized
tttttaattccaaaacaaagta

SEQ ID NO: 938815 - DNA, 22 bp, Artificial Sequence
  chemically synthesized
ttgtttatgcattactttgttt

SEQ ID NO: 938816 - DNA, 22 bp, Artificial Sequence
  chemically synthesized
ttaattccaaaacaaagtaatg

SEQ ID NO: 938817 - DNA, 22 bp, Artificial Sequence
  chemically synthesized
taattccaaaacaaagtaatgc

SEQ ID NO: 938818 - DNA, 22 bp, Artificial Sequence
  chemically synthesized
aattccaaaacaaagtaatgca

SEQ ID NO: 938819 - DNA, 22 bp, Artificial Sequence
  chemically synthesized
attccaaaacaaagtaatgcat

SEQ ID NO: 938820 - DNA, 22 bp, Artificial Sequence
  chemically synthesized
gagtttttgtttatgcattact

SEQ ID NO: 938821 - DNA, 22 bp, Artificial Sequence
  chemically synthesized
caaaacaaagtaatgcataaac

SEQ ID NO: 938822 - DNA, 22 bp, Artificial Sequence
  chemically synthesized
gggttagagtttttgtttatgc

SEQ ID NO: 938823 - DNA, 22 bp, Artificial Sequence
  chemically synthesized
ggggttagagtttttgtttatg

SEQ ID NO: 938824 - DNA, 22 bp, Artificial Sequence
  chemically synthesized
ttggggttagagtttttgttta

SEQ ID NO: 938825 - DNA, 22 bp, Artificial Sequence
  chemically synthesized
aatcaagaacctcttggggtta

SEQ ID NO: 938826 - DNA, 22 bp, Artificial Sequence
  chemically synthesized
taaccccaagaggttcttgatt

SEQ ID NO: 938827 - DNA, 22 bp, Artificial Sequence
  chemically synthesized
accccaagaggttcttgattta

SEQ ID NO: 938828 - DNA, 22 bp, Artificial Sequence
  chemically synthesized
aggatacacagtagcagagcta

SEQ ID NO: 938829 - DNA, 22 bp, Artificial Sequence
  chemically synthesized
gttgaggatacacagtagcaga

SEQ ID NO: 938830 - DNA, 22 bp, Artificial Sequence
  chemically synthesized
ttgatttagctctgctactgtg

SEQ ID NO: 938831 - DNA, 22 bp, Artificial Sequence
  chemically synthesized
gatttagctctgctactgtgta

SEQ ID NO: 938832 - DNA, 22 bp, Artificial Sequence
  chemically synthesized
tctggttgaggatacacagtag

SEQ ID NO: 938833 - DNA, 22 bp, Artificial Sequence
  chemically synthesized
atttagctctgctactgtgtat

SEQ ID NO: 938834 - DNA, 22 bp, Artificial Sequence
  chemically synthesized
actatctggttgaggatacaca

SEQ ID NO: 938835 - DNA, 22 bp, Artificial Sequence
  chemically synthesized
agctctgctactgtgtatcctc

SEQ ID NO: 938836 - DNA, 22 bp, Artificial Sequence
  chemically synthesized
aactatctggttgaggatacac

SEQ ID NO: 938837 - DNA, 22 bp, Artificial Sequence
  chemically synthesized
gctctgctactgtgtatcctca

SEQ ID NO: 938838 - DNA, 22 bp, Artificial Sequence
  chemically synthesized
tgctactgtgtatcctcaacca

SEQ ID NO: 938839 - DNA, 22 bp, Artificial Sequence
  chemically synthesized
aatttaactatctggttgagga

SEQ ID NO: 938840 - DNA, 22 bp, Artificial Sequence
  chemically synthesized
aaatttaactatctggttgagg

SEQ ID NO: 938841 - DNA, 22 bp, Artificial Sequence
  chemically synthesized
ctactgtgtatcctcaaccaga

SEQ ID NO: 938842 - DNA, 22 bp, Artificial Sequence
  chemically synthesized
ttaaatttaactatctggttga

SEQ ID NO: 938843 - DNA, 22 bp, Artificial Sequence
  chemically synthesized
cttaaatttaactatctggttg

SEQ ID NO: 938844 - DNA, 22 bp, Artificial Sequence
  chemically synthesized
ctgtgtatcctcaaccagatag

SEQ ID NO: 938845 - DNA, 22 bp, Artificial Sequence
  chemically synthesized
tgtatcctcaaccagatagtta

SEQ ID NO: 938846 - DNA, 22 bp, Artificial Sequence
  chemically synthesized
catttcttaaatttaactatct

SEQ ID NO: 938847 - DNA, 22 bp, Artificial Sequence
  chemically synthesized
agttccatttcttaaatttaac

SEQ ID NO: 938848 - DNA, 22 bp, Artificial Sequence
  chemically synthesized
aaccagatagttaaatttaaga

SEQ ID NO: 938849 - DNA, 22 bp, Artificial Sequence
  chemically synthesized
aatttaagaaatggaacttaat

SEQ ID NO: 938850 - DNA, 22 bp, Artificial Sequence
  chemically synthesized
gcagacaaagacattaagttcc

SEQ ID NO: 938851 - DNA, 22 bp, Artificial Sequence
  chemically synthesized
aagaaatggaacttaatgtctt

SEQ ID NO: 938852 - DNA, 22 bp, Artificial Sequence
  chemically synthesized
acctagcagacaaagacattaa

SEQ ID NO: 938853 - DNA, 22 bp, Artificial Sequence
  chemically synthesized
agaaatggaacttaatgtcttt

SEQ ID NO: 938854 - DNA, 22 bp, Artificial Sequence
  chemically synthesized
cacctagcagacaaagacatta

SEQ ID NO: 938855 - DNA, 22 bp, Artificial Sequence
  chemically synthesized
cttcacctagcagacaaagaca

SEQ ID NO: 938856 - DNA, 22 bp, Artificial Sequence
  chemically synthesized
aactgcttcacctagcagacaa

SEQ ID NO: 938857 - DNA, 22 bp, Artificial Sequence
  chemically synthesized
aatgtctttgtctgctaggtga

SEQ ID NO: 938858 - DNA, 22 bp, Artificial Sequence
  chemically synthesized
atgtctttgtctgctaggtgaa

SEQ ID NO: 938859 - DNA, 22 bp, Artificial Sequence
  chemically synthesized
tgtctgctaggtgaagcagttg

SEQ ID NO: 938860 - DNA, 22 bp, Artificial Sequence
  chemically synthesized
gtctgctaggtgaagcagttga

SEQ ID NO: 938861 - DNA, 22 bp, Artificial Sequence
  chemically synthesized
tctgctaggtgaagcagttgaa

SEQ ID NO: 938862 - DNA, 22 bp, Artificial Sequence
  chemically synthesized
ggtgtcatgcagttcaactgct

SEQ ID NO: 938863 - DNA, 22 bp, Artificial Sequence
  chemically synthesized
ctaggtgaagcagttgaactgc

SEQ ID NO: 938864 - DNA, 22 bp, Artificial Sequence
  chemically synthesized
ggtgaagcagttgaactgcatg

SEQ ID NO: 938865 - DNA, 22 bp, Artificial Sequence
  chemically synthesized
gagatggcagagacattaggtg

SEQ ID NO: 938866 - DNA, 22 bp, Artificial Sequence
  chemically synthesized
aactgcatgacacctaatgtct

SEQ ID NO: 938867 - DNA, 22 bp, Artificial Sequence
  chemically synthesized
catgacacctaatgtctctgcc

SEQ ID NO: 938868 - DNA, 22 bp, Artificial Sequence
  chemically synthesized
atgtctctgccatctctaatgc

SEQ ID NO: 938869 - DNA, 22 bp, Artificial Sequence
  chemically synthesized
aatagtaaacagtagcattaga

SEQ ID NO: 938870 - DNA, 22 bp, Artificial Sequence
  chemically synthesized
tgccatctctaatgctactgtt

SEQ ID NO: 938871 - DNA, 22 bp, Artificial Sequence
  chemically synthesized
ccatctctaatgctactgttta

SEQ ID NO: 938872 - DNA, 22 bp, Artificial Sequence
  chemically synthesized
aaatcactgaatagtaaacagt

SEQ ID NO: 938873 - DNA, 22 bp, Artificial Sequence
  chemically synthesized
actaaaatcactgaatagtaaa

SEQ ID NO: 938874 - DNA, 22 bp, Artificial Sequence
  chemically synthesized
taatgctactgtttactattca

SEQ ID NO: 938875 - DNA, 22 bp, Artificial Sequence
  chemically synthesized
atgctactgtttactattcagt

SEQ ID NO: 938876 - DNA, 22 bp, Artificial Sequence
  chemically synthesized
gctaactaaaatcactgaatag

SEQ ID NO: 938877 - DNA, 22 bp, Artificial Sequence
  chemically synthesized
ggctaactaaaatcactgaata

SEQ ID NO: 938878 - DNA, 22 bp, Artificial Sequence
  chemically synthesized
tttggctaactaaaatcactga

SEQ ID NO: 938879 - DNA, 22 bp, Artificial Sequence
  chemically synthesized
ctgtttactattcagtgatttt

SEQ ID NO: 938880 - DNA, 22 bp, Artificial Sequence
  chemically synthesized
ttatttggctaactaaaatcac

SEQ ID NO: 938881 - DNA, 22 bp, Artificial Sequence
  chemically synthesized
tttactattcagtgattttagt

SEQ ID NO: 938882 - DNA, 22 bp, Artificial Sequence
  chemically synthesized
gttatttggctaactaaaatca

SEQ ID NO: 938883 - DNA, 22 bp, Artificial Sequence
  chemically synthesized
tgttatttggctaactaaaatc

SEQ ID NO: 938884 - DNA, 22 bp, Artificial Sequence
  chemically synthesized
actattcagtgattttagttag

SEQ ID NO: 938885 - DNA, 22 bp, Artificial Sequence
  chemically synthesized
ctattcagtgattttagttagc

SEQ ID NO: 938886 - DNA, 22 bp, Artificial Sequence
  chemically synthesized
ttcagtgattttagttagccaa

SEQ ID NO: 938887 - DNA, 22 bp, Artificial Sequence
  chemically synthesized
aaaactttgttatttggctaac

SEQ ID NO: 938888 - DNA, 22 bp, Artificial Sequence
  chemically synthesized
aaaaactttgttatttggctaa

SEQ ID NO: 938889 - DNA, 22 bp, Artificial Sequence
  chemically synthesized
agtgattttagttagccaaata

SEQ ID NO: 938890 - DNA, 22 bp, Artificial Sequence
  chemically synthesized
cttaaaaactttgttatttggc

SEQ ID NO: 938891 - DNA, 22 bp, Artificial Sequence
  chemically synthesized
tagttagccaaataacaaagtt

SEQ ID NO: 938892 - DNA, 22 bp, Artificial Sequence
  chemically synthesized
aaattgcttaaaaactttgtta

SEQ ID NO: 938893 - DNA, 22 bp, Artificial Sequence
  chemically synthesized
agttagccaaataacaaagttt

SEQ ID NO: 938894 - DNA, 22 bp, Artificial Sequence
  chemically synthesized
gttagccaaataacaaagtttt

SEQ ID NO: 938895 - DNA, 22 bp, Artificial Sequence
  chemically synthesized
gccaaataacaaagtttttaag

SEQ ID NO: 938896 - DNA, 22 bp, Artificial Sequence
  chemically synthesized
gggtgctaaaattgcttaaaaa

SEQ ID NO: 938897 - DNA, 22 bp, Artificial Sequence
  chemically synthesized
cctagggtgctaaaattgctta

SEQ ID NO: 938898 - DNA, 22 bp, Artificial Sequence
  chemically synthesized
gcctagggtgctaaaattgctt

SEQ ID NO: 938899 - DNA, 22 bp, Artificial Sequence
  chemically synthesized
ttaagcaattttagcaccctag

SEQ ID NO: 938900 - DNA, 22 bp, Artificial Sequence
  chemically synthesized
taagcaattttagcaccctagg

SEQ ID NO: 938901 - DNA, 22 bp, Artificial Sequence
  chemically synthesized
tgggtgtatttgcctagggtgc

SEQ ID NO: 938902 - DNA, 22 bp, Artificial Sequence
  chemically synthesized
aagcaattttagcaccctaggc

SEQ ID NO: 938903 - DNA, 22 bp, Artificial Sequence
  chemically synthesized
agcaattttagcaccctaggca

SEQ ID NO: 938904 - DNA, 22 bp, Artificial Sequence
  chemically synthesized
tgtgggtgtatttgcctagggt

SEQ ID NO: 938905 - DNA, 22 bp, Artificial Sequence
  chemically synthesized
actctgtgggtgtatttgccta

SEQ ID NO: 938906 - DNA, 22 bp, Artificial Sequence
  chemically synthesized
tagcaccctaggcaaatacacc

SEQ ID NO: 938907 - DNA, 22 bp, Artificial Sequence
  chemically synthesized
agcaccctaggcaaatacaccc

SEQ ID NO: 938908 - DNA, 22 bp, Artificial Sequence
  chemically synthesized
gcaccctaggcaaatacaccca

SEQ ID NO: 938909 - DNA, 22 bp, Artificial Sequence
  chemically synthesized
ccaaaatcctcactctgtgggt

SEQ ID NO: 938910 - DNA, 22 bp, Artificial Sequence
  chemically synthesized
gccaaaatcctcactctgtggg

SEQ ID NO: 938911 - DNA, 22 bp, Artificial Sequence
  chemically synthesized
ggcaaatacacccacagagtga

SEQ ID NO: 938912 - DNA, 22 bp, Artificial Sequence
  chemically synthesized
aaatagtttgccaaaatcctca

SEQ ID NO: 938913 - DNA, 22 bp, Artificial Sequence
  chemically synthesized
taacattaaaatagtttgccaa

SEQ ID NO: 938914 - DNA, 22 bp, Artificial Sequence
  chemically synthesized
tccattgtaacattaaaatagt

SEQ ID NO: 938915 - DNA, 22 bp, Artificial Sequence
  chemically synthesized
tggcaaactattttaatgttac

SEQ ID NO: 938916 - DNA, 22 bp, Artificial Sequence
  chemically synthesized
ggcaaactattttaatgttaca

SEQ ID NO: 938917 - DNA, 22 bp, Artificial Sequence
  chemically synthesized
gcaaactattttaatgttacaa

SEQ ID NO: 938918 - DNA, 22 bp, Artificial Sequence
  chemically synthesized
cagcactgtccattgtaacatt

SEQ ID NO: 938919 - DNA, 22 bp, Artificial Sequence
  chemically synthesized
ccagcactgtccattgtaacat

SEQ ID NO: 938920 - DNA, 22 bp, Artificial Sequence
  chemically synthesized
tccagcactgtccattgtaaca

SEQ ID NO: 938921 - DNA, 22 bp, Artificial Sequence
  chemically synthesized
ttttaatgttacaatggacagt

SEQ ID NO: 938922 - DNA, 22 bp, Artificial Sequence
  chemically synthesized
taatgttacaatggacagtgct

SEQ ID NO: 938923 - DNA, 22 bp, Artificial Sequence
  chemically synthesized
aatgttacaatggacagtgctg

SEQ ID NO: 938924 - DNA, 22 bp, Artificial Sequence
  chemically synthesized
atgttacaatggacagtgctgg

SEQ ID NO: 938925 - DNA, 22 bp, Artificial Sequence
  chemically synthesized
aggagcccgtattttccagcac

SEQ ID NO: 938926 - DNA, 22 bp, Artificial Sequence
  chemically synthesized
gaggagcccgtattttccagca

SEQ ID NO: 938927 - DNA, 22 bp, Artificial Sequence
  chemically synthesized
tgaggagcccgtattttccagc

SEQ ID NO: 938928 - DNA, 22 bp, Artificial Sequence
  chemically synthesized
caatggacagtgctggaaaata

SEQ ID NO: 938929 - DNA, 22 bp, Artificial Sequence
  chemically synthesized
ttttgaggagcccgtattttcc

SEQ ID NO: 938930 - DNA, 22 bp, Artificial Sequence
  chemically synthesized
gttttgaggagcccgtattttc

SEQ ID NO: 938931 - DNA, 22 bp, Artificial Sequence
  chemically synthesized
tgttttgaggagcccgtatttt

SEQ ID NO: 938932 - DNA, 22 bp, Artificial Sequence
  chemically synthesized
gaaaatacgggctcctcaaaac

SEQ ID NO: 938933 - DNA, 22 bp, Artificial Sequence
  chemically synthesized
aaataggcaaggtaagattttg

SEQ ID NO: 938934 - DNA, 22 bp, Artificial Sequence
  chemically synthesized
ctcaaaacaaaatcttaccttg

SEQ ID NO: 938935 - DNA, 22 bp, Artificial Sequence
  chemically synthesized
ggtctaaaataggcaaggtaag

SEQ ID NO: 938936 - DNA, 22 bp, Artificial Sequence
  chemically synthesized
aaaacaaaatcttaccttgcct

SEQ ID NO: 938937 - DNA, 22 bp, Artificial Sequence
  chemically synthesized
aaaaagctgggtctaaaatagg

SEQ ID NO: 938938 - DNA, 22 bp, Artificial Sequence
  chemically synthesized
tcaaaaagctgggtctaaaata

SEQ ID NO: 938939 - DNA, 22 bp, Artificial Sequence
  chemically synthesized
ctctcaaaaagctgggtctaaa

SEQ ID NO: 938940 - DNA, 22 bp, Artificial Sequence
  chemically synthesized
accttgcctattttagacccag

SEQ ID NO: 938941 - DNA, 22 bp, Artificial Sequence
  chemically synthesized
gctctcaaaaagctgggtctaa

SEQ ID NO: 938942 - DNA, 22 bp, Artificial Sequence
  chemically synthesized
ccttgcctattttagacccagc

SEQ ID NO: 938943 - DNA, 22 bp, Artificial Sequence
  chemically synthesized
tttgctctcaaaaagctgggtc

SEQ ID NO: 938944 - DNA, 22 bp, Artificial Sequence
  chemically synthesized
gcctattttagacccagctttt

SEQ ID NO: 938945 - DNA, 22 bp, Artificial Sequence
  chemically synthesized
cctattttagacccagcttttt

SEQ ID NO: 938946 - DNA, 22 bp, Artificial Sequence
  chemically synthesized
attgtttgctctcaaaaagctg

SEQ ID NO: 938947 - DNA, 22 bp, Artificial Sequence
  chemically synthesized
gattgtttgctctcaaaaagct

SEQ ID NO: 938948 - DNA, 22 bp, Artificial Sequence
  chemically synthesized
ttttagacccagctttttgaga

SEQ ID NO: 938949 - DNA, 22 bp, Artificial Sequence
  chemically synthesized
tagacccagctttttgagagca

SEQ ID NO: 938950 - DNA, 22 bp, Artificial Sequence
  chemically synthesized
agacccagctttttgagagcaa

SEQ ID NO: 938951 - DNA, 22 bp, Artificial Sequence
  chemically synthesized
gacccagctttttgagagcaaa

SEQ ID NO: 938952 - DNA, 22 bp, Artificial Sequence
  chemically synthesized
acaaaaacaaaacttgattgtt

SEQ ID NO: 938953 - DNA, 22 bp, Artificial Sequence
  chemically synthesized
tttgagagcaaacaatcaagtt

SEQ ID NO: 938954 - DNA, 22 bp, Artificial Sequence
  chemically synthesized
ttgagagcaaacaatcaagttt

SEQ ID NO: 938955 - DNA, 22 bp, Artificial Sequence
  chemically synthesized
tgagagcaaacaatcaagtttt

SEQ ID NO: 938956 - DNA, 22 bp, Artificial Sequence
  chemically synthesized
gagagcaaacaatcaagttttg

SEQ ID NO: 938957 - DNA, 22 bp, Artificial Sequence
  chemically synthesized
agagcaaacaatcaagttttgt

SEQ ID NO: 938958 - DNA, 22 bp, Artificial Sequence
  chemically synthesized
agaagaaactaacaaaaacaaa

SEQ ID NO: 938959 - DNA, 22 bp, Artificial Sequence
  chemically synthesized
gagaagaaactaacaaaaacaa

SEQ ID NO: 938960 - DNA, 22 bp, Artificial Sequence
  chemically synthesized
ggataagtcttgagaagaaact

SEQ ID NO: 938961 - DNA, 22 bp, Artificial Sequence
  chemically synthesized
tgtttttgttagtttcttctca

SEQ ID NO: 938962 - DNA, 22 bp, Artificial Sequence
  chemically synthesized
gtttttgttagtttcttctcaa

SEQ ID NO: 938963 - DNA, 22 bp, Artificial Sequence
  chemically synthesized
tttttgttagtttcttctcaag

SEQ ID NO: 938964 - DNA, 22 bp, Artificial Sequence
  chemically synthesized
ttgttagtttcttctcaagact

SEQ ID NO: 938965 - DNA, 22 bp, Artificial Sequence
  chemically synthesized
tgttagtttcttctcaagactt

SEQ ID NO: 938966 - DNA, 22 bp, Artificial Sequence
  chemically synthesized
gttagtttcttctcaagactta

SEQ ID NO: 938967 - DNA, 22 bp, Artificial Sequence
  chemically synthesized
ttagtttcttctcaagacttat

SEQ ID NO: 938968 - DNA, 22 bp, Artificial Sequence
  chemically synthesized
gtttcttctcaagacttatccc

SEQ ID NO: 938969 - DNA, 22 bp, Artificial Sequence
  chemically synthesized
taagaaaagccctgggataagt

SEQ ID NO: 938970 - DNA, 22 bp, Artificial Sequence
  chemically synthesized
cttctcaagacttatcccaggg

SEQ ID NO: 938971 - DNA, 22 bp, Artificial Sequence
  chemically synthesized
ttataagaaaagccctgggata

SEQ ID NO: 938972 - DNA, 22 bp, Artificial Sequence
  chemically synthesized
ttctcaagacttatcccagggc

SEQ ID NO: 938973 - DNA, 22 bp, Artificial Sequence
  chemically synthesized
attataagaaaagccctgggat

SEQ ID NO: 938974 - DNA, 22 bp, Artificial Sequence
  chemically synthesized
ctcaagacttatcccagggctt

SEQ ID NO: 938975 - DNA, 22 bp, Artificial Sequence
  chemically synthesized
tcaagacttatcccagggcttt

SEQ ID NO: 938976 - DNA, 22 bp, Artificial Sequence
  chemically synthesized
aagacttatcccagggcttttc

SEQ ID NO: 938977 - DNA, 22 bp, Artificial Sequence
  chemically synthesized
ccacccacttattataagaaaa

SEQ ID NO: 938978 - DNA, 22 bp, Artificial Sequence
  chemically synthesized
accacccacttattataagaaa

SEQ ID NO: 938979 - DNA, 22 bp, Artificial Sequence
  chemically synthesized
atcccagggcttttcttataat

SEQ ID NO: 938980 - DNA, 22 bp, Artificial Sequence
  chemically synthesized
tcccagggcttttcttataata

SEQ ID NO: 938981 - DNA, 22 bp, Artificial Sequence
  chemically synthesized
tttaccacccacttattataag

SEQ ID NO: 938982 - DNA, 22 bp, Artificial Sequence
  chemically synthesized
agcaattatttaccacccactt

SEQ ID NO: 938983 - DNA, 22 bp, Artificial Sequence
  chemically synthesized
ttcttataataagtgggtggta

SEQ ID NO: 938984 - DNA, 22 bp, Artificial Sequence
  chemically synthesized
tcttataataagtgggtggtaa

SEQ ID NO: 938985 - DNA, 22 bp, Artificial Sequence
  chemically synthesized
ttcagcaattatttaccaccca

SEQ ID NO: 938986 - DNA, 22 bp, Artificial Sequence
  chemically synthesized
cttataataagtgggtggtaaa

SEQ ID NO: 938987 - DNA, 22 bp, Artificial Sequence
  chemically synthesized
attcagcaattatttaccaccc

SEQ ID NO: 938988 - DNA, 22 bp, Artificial Sequence
  chemically synthesized
ttataataagtgggtggtaaat

SEQ ID NO: 938989 - DNA, 22 bp, Artificial Sequence
  chemically synthesized
ataataagtgggtggtaaataa

SEQ ID NO: 938990 - DNA, 22 bp, Artificial Sequence
  chemically synthesized
taataagtgggtggtaaataat

SEQ ID NO: 938991 - DNA, 22 bp, Artificial Sequence
  chemically synthesized
agagtccccataatttattcag

SEQ ID NO: 938992 - DNA, 22 bp, Artificial Sequence
  chemically synthesized
taagagtccccataatttattc

SEQ ID NO: 938993 - DNA, 22 bp, Artificial Sequence
  chemically synthesized
tagctctaagagtccccataat

SEQ ID NO: 938994 - DNA, 22 bp, Artificial Sequence
  chemically synthesized
atagctctaagagtccccataa

SEQ ID NO: 938995 - DNA, 22 bp, Artificial Sequence
  chemically synthesized
tatagctctaagagtccccata

SEQ ID NO: 938996 - DNA, 22 bp, Artificial Sequence
  chemically synthesized
ttatagctctaagagtccccat

SEQ ID NO: 938997 - DNA, 22 bp, Artificial Sequence
  chemically synthesized
ctgaataaattatggggactct

SEQ ID NO: 938998 - DNA, 22 bp, Artificial Sequence
  chemically synthesized
aataaattatggggactcttag

SEQ ID NO: 938999 - DNA, 22 bp, Artificial Sequence
  chemically synthesized
tcttttatagctctaagagtcc

SEQ ID NO: 939000 - DNA, 22 bp, Artificial Sequence
  chemically synthesized
tatcttttatagctctaagagt

SEQ ID NO: 939001 - DNA, 22 bp, Artificial Sequence
  chemically synthesized
tggggactcttagagctataaa

SEQ ID NO: 939002 - DNA, 22 bp, Artificial Sequence
  chemically synthesized
ttagagctataaaagatagaat

SEQ ID NO: 939003 - DNA, 22 bp, Artificial Sequence
  chemically synthesized
agagctataaaagatagaattt

SEQ ID NO: 939004 - DNA, 22 bp, Artificial Sequence
  chemically synthesized
gagctataaaagatagaatttg

SEQ ID NO: 939005 - DNA, 22 bp, Artificial Sequence
  chemically synthesized
taaaagatagaatttgggatta

SEQ ID NO: 939006 - DNA, 22 bp, Artificial Sequence
  chemically synthesized
ataagcaacacaggtaatccca

SEQ ID NO: 939007 - DNA, 22 bp, Artificial Sequence
  chemically synthesized
taataagcaacacaggtaatcc

SEQ ID NO: 939008 - DNA, 22 bp, Artificial Sequence
  chemically synthesized
ctaataagcaacacaggtaatc

SEQ ID NO: 939009 - DNA, 22 bp, Artificial Sequence
  chemically synthesized
tctaataagcaacacaggtaat

SEQ ID NO: 939010 - DNA, 22 bp, Artificial Sequence
  chemically synthesized
ttctaataagcaacacaggtaa

SEQ ID NO: 939011 - DNA, 22 bp, Artificial Sequence
  chemically synthesized
aaaacttttctaataagcaaca

SEQ ID NO: 939012 - DNA, 22 bp, Artificial Sequence
  chemically synthesized
gggattacctgtgttgcttatt

SEQ ID NO: 939013 - DNA, 22 bp, Artificial Sequence
  chemically synthesized
aaaaacttttctaataagcaac

SEQ ID NO: 939014 - DNA, 22 bp, Artificial Sequence
  chemically synthesized
ggattacctgtgttgcttatta

SEQ ID NO: 939015 - DNA, 22 bp, Artificial Sequence
  chemically synthesized
atttaaaaacttttctaataag

SEQ ID NO: 939016 - DNA, 22 bp, Artificial Sequence
  chemically synthesized
cctgtgttgcttattagaaaag

SEQ ID NO: 939017 - DNA, 22 bp, Artificial Sequence
  chemically synthesized
gttaatttaaaaacttttctaa

SEQ ID NO: 939018 - DNA, 22 bp, Artificial Sequence
  chemically synthesized
agttaatttaaaaacttttcta

SEQ ID NO: 939019 - DNA, 22 bp, Artificial Sequence
  chemically synthesized
tgttgcttattagaaaagtttt

SEQ ID NO: 939020 - DNA, 22 bp, Artificial Sequence
  chemically synthesized
cttattagaaaagtttttaaat

SEQ ID NO: 939021 - DNA, 22 bp, Artificial Sequence
  chemically synthesized
attagaaaagtttttaaattaa

SEQ ID NO: 939022 - DNA, 22 bp, Artificial Sequence
  chemically synthesized
ttagaaaagtttttaaattaac

SEQ ID NO: 939023 - DNA, 22 bp, Artificial Sequence
  chemically synthesized
acaaaatgatttagttaattta

SEQ ID NO: 939024 - DNA, 22 bp, Artificial Sequence
  chemically synthesized
gaaaagtttttaaattaactaa

SEQ ID NO: 939025 - DNA, 22 bp, Artificial Sequence
  chemically synthesized
ttaaattaactaaatcattttg

SEQ ID NO: 939026 - DNA, 22 bp, Artificial Sequence
  chemically synthesized
taaattaactaaatcattttgt

SEQ ID NO: 939027 - DNA, 22 bp, Artificial Sequence
  chemically synthesized
atatatatcctcacaaaatgat

SEQ ID NO: 939028 - DNA, 22 bp, Artificial Sequence
  chemically synthesized
aaattaactaaatcattttgtg

SEQ ID NO: 939029 - DNA, 22 bp, Artificial Sequence
  chemically synthesized
aattaactaaatcattttgtga

SEQ ID NO: 939030 - DNA, 22 bp, Artificial Sequence
  chemically synthesized
agttcatatatatcctcacaaa

SEQ ID NO: 939031 - DNA, 22 bp, Artificial Sequence
  chemically synthesized
actaaatcattttgtgaggata

SEQ ID NO: 939032 - DNA, 22 bp, Artificial Sequence
  chemically synthesized
aatcattttgtgaggatatata

SEQ ID NO: 939033 - DNA, 22 bp, Artificial Sequence
  chemically synthesized
tgtgaggatatatatgaactca

SEQ ID NO: 939034 - DNA, 22 bp, Artificial Sequence
  chemically synthesized
gtgaggatatatatgaactcag

SEQ ID NO: 939035 - DNA, 22 bp, Artificial Sequence
  chemically synthesized
tgaggatatatatgaactcagt

SEQ ID NO: 939036 - DNA, 22 bp, Artificial Sequence
  chemically synthesized
aaggcaaatgtgaggccaactg

SEQ ID NO: 939037 - DNA, 22 bp, Artificial Sequence
  chemically synthesized
caaggcaaatgtgaggccaact

SEQ ID NO: 939038 - DNA, 22 bp, Artificial Sequence
  chemically synthesized
agttggcctcacatttgccttg

SEQ ID NO: 939039 - DNA, 22 bp, Artificial Sequence
  chemically synthesized
gcctcacatttgccttgaagtt

SEQ ID NO: 939040 - DNA, 22 bp, Artificial Sequence
  chemically synthesized
agtgcaggaacataaaacttca

SEQ ID NO: 939041 - DNA, 22 bp, Artificial Sequence
  chemically synthesized
aagtgcaggaacataaaacttc

SEQ ID NO: 939042 - DNA, 22 bp, Artificial Sequence
  chemically synthesized
acatttgccttgaagttttatg

SEQ ID NO: 939043 - DNA, 22 bp, Artificial Sequence
  chemically synthesized
atttaagtgcaggaacataaaa

SEQ ID NO: 939044 - DNA, 22 bp, Artificial Sequence
  chemically synthesized
gccttgaagttttatgttcctg

SEQ ID NO: 939045 - DNA, 22 bp, Artificial Sequence
  chemically synthesized
ttgatttaagtgcaggaacata

SEQ ID NO: 939046 - DNA, 22 bp, Artificial Sequence
  chemically synthesized
ccttgaagttttatgttcctgc

SEQ ID NO: 939047 - DNA, 22 bp, Artificial Sequence
  chemically synthesized
gaagttttatgttcctgcactt

SEQ ID NO: 939048 - DNA, 22 bp, Artificial Sequence
  chemically synthesized
aagttttatgttcctgcactta

SEQ ID NO: 939049 - DNA, 22 bp, Artificial Sequence
  chemically synthesized
tatgttcctgcacttaaatcaa

SEQ ID NO: 939050 - DNA, 22 bp, Artificial Sequence
  chemically synthesized
atgttcctgcacttaaatcaac

SEQ ID NO: 939051 - DNA, 22 bp, Artificial Sequence
  chemically synthesized
tgttcctgcacttaaatcaaca

SEQ ID NO: 939052 - DNA, 22 bp, Artificial Sequence
  chemically synthesized
ctgcacttaaatcaacagtgct

SEQ ID NO: 939053 - DNA, 22 bp, Artificial Sequence
  chemically synthesized
cacttaaatcaacagtgctttt

SEQ ID NO: 939054 - DNA, 22 bp, Artificial Sequence
  chemically synthesized
aaatcaacagtgctttttctca

SEQ ID NO: 939055 - DNA, 22 bp, Artificial Sequence
  chemically synthesized
aatcaacagtgctttttctcat

SEQ ID NO: 939056 - DNA, 22 bp, Artificial Sequence
  chemically synthesized
aagaaatgaaaataatgagaaa

SEQ ID NO: 939057 - DNA, 22 bp, Artificial Sequence
  chemically synthesized
tttctcattattttcatttctt

SEQ ID NO: 939058 - DNA, 22 bp, Artificial Sequence
  chemically synthesized
ttctcattattttcatttcttc

SEQ ID NO: 939059 - DNA, 22 bp, Artificial Sequence
  chemically synthesized
tctcattattttcatttcttca

SEQ ID NO: 939060 - DNA, 22 bp, Artificial Sequence
  chemically synthesized
ctcattattttcatttcttcag

SEQ ID NO: 939061 - DNA, 22 bp, Artificial Sequence
  chemically synthesized
ggggaaaaaagtctgaagaaat

SEQ ID NO: 939062 - DNA, 22 bp, Artificial Sequence
  chemically synthesized
tcattattttcatttcttcaga

SEQ ID NO: 939063 - DNA, 22 bp, Artificial Sequence
  chemically synthesized
attattttcatttcttcagact

SEQ ID NO: 939064 - DNA, 22 bp, Artificial Sequence
  chemically synthesized
tgttaggggaaaaaagtctgaa

SEQ ID NO: 939065 - DNA, 22 bp, Artificial Sequence
  chemically synthesized
ttttcatttcttcagacttttt

SEQ ID NO: 939066 - DNA, 22 bp, Artificial Sequence
  chemically synthesized
tcatttcttcagacttttttcc

SEQ ID NO: 939067 - DNA, 22 bp, Artificial Sequence
  chemically synthesized
catttcttcagacttttttccc

SEQ ID NO: 939068 - DNA, 22 bp, Artificial Sequence
  chemically synthesized
atttcttcagacttttttcccc

SEQ ID NO: 939069 - DNA, 22 bp, Artificial Sequence
  chemically synthesized
tcaactatgttaggggaaaaaa

SEQ ID NO: 939070 - DNA, 22 bp, Artificial Sequence
  chemically synthesized
atcaactatgttaggggaaaaa

SEQ ID NO: 939071 - DNA, 22 bp, Artificial Sequence
  chemically synthesized
tatcaactatgttaggggaaaa

SEQ ID NO: 939072 - DNA, 22 bp, Artificial Sequence
  chemically synthesized
cttcagacttttttcccctaac

SEQ ID NO: 939073 - DNA, 22 bp, Artificial Sequence
  chemically synthesized
ttcagacttttttcccctaaca

SEQ ID NO: 939074 - DNA, 22 bp, Artificial Sequence
  chemically synthesized
cagacttttttcccctaacata

SEQ ID NO: 939075 - DNA, 22 bp, Artificial Sequence
  chemically synthesized
agacttttttcccctaacatag

SEQ ID NO: 939076 - DNA, 22 bp, Artificial Sequence
  chemically synthesized
ttttcccctaacatagttgata

SEQ ID NO: 939077 - DNA, 22 bp, Artificial Sequence
  chemically synthesized
tttcccctaacatagttgataa

SEQ ID NO: 939078 - DNA, 22 bp, Artificial Sequence
  chemically synthesized
ttcccctaacatagttgataaa

SEQ ID NO: 939079 - DNA, 22 bp, Artificial Sequence
  chemically synthesized
tcccctaacatagttgataaaa

SEQ ID NO: 939080 - DNA, 22 bp, Artificial Sequence
  chemically synthesized
cccctaacatagttgataaaat

SEQ ID NO: 939081 - DNA, 22 bp, Artificial Sequence
  chemically synthesized
ccctaacatagttgataaaatt

SEQ ID NO: 939082 - DNA, 22 bp, Artificial Sequence
  chemically synthesized
agtgtgggcagaaggaatttta

SEQ ID NO: 939083 - DNA, 22 bp, Artificial Sequence
  chemically synthesized
acatagttgataaaattccttc

SEQ ID NO: 939084 - DNA, 22 bp, Artificial Sequence
  chemically synthesized
aagattcagtgtgggcagaagg

SEQ ID NO: 939085 - DNA, 22 bp, Artificial Sequence
  chemically synthesized
aaagattcagtgtgggcagaag

SEQ ID NO: 939086 - DNA, 22 bp, Artificial Sequence
  chemically synthesized
taaagattcagtgtgggcagaa

SEQ ID NO: 939087 - DNA, 22 bp, Artificial Sequence
  chemically synthesized
ttaaagattcagtgtgggcaga

SEQ ID NO: 939088 - DNA, 22 bp, Artificial Sequence
  chemically synthesized
ataaaattccttctgcccacac

SEQ ID NO: 939089 - DNA, 22 bp, Artificial Sequence
  chemically synthesized
tgtttttaaagattcagtgtgg

SEQ ID NO: 939090 - DNA, 22 bp, Artificial Sequence
  chemically synthesized
tgtgtttttaaagattcagtgt

SEQ ID NO: 939091 - DNA, 22 bp, Artificial Sequence
  chemically synthesized
cttctgcccacactgaatcttt

SEQ ID NO: 939092 - DNA, 22 bp, Artificial Sequence
  chemically synthesized
ctctgtgtttttaaagattcag

SEQ ID NO: 939093 - DNA, 22 bp, Artificial Sequence
  chemically synthesized
ctgcccacactgaatctttaaa

SEQ ID NO: 939094 - DNA, 22 bp, Artificial Sequence
  chemically synthesized
tgcccacactgaatctttaaaa

SEQ ID NO: 939095 - DNA, 22 bp, Artificial Sequence
  chemically synthesized
cccacactgaatctttaaaaac

SEQ ID NO: 939096 - DNA, 22 bp, Artificial Sequence
  chemically synthesized
caactactctgtgtttttaaag

SEQ ID NO: 939097 - DNA, 22 bp, Artificial Sequence
  chemically synthesized
ccaactactctgtgtttttaaa

SEQ ID NO: 939098 - DNA, 22 bp, Artificial Sequence
  chemically synthesized
tccaactactctgtgtttttaa

SEQ ID NO: 939099 - DNA, 22 bp, Artificial Sequence
  chemically synthesized
ttccaactactctgtgttttta

SEQ ID NO: 939100 - DNA, 22 bp, Artificial Sequence
  chemically synthesized
tttccaactactctgtgttttt

SEQ ID NO: 939101 - DNA, 22 bp, Artificial Sequence
  chemically synthesized
aatctttaaaaacacagagtag

SEQ ID NO: 939102 - DNA, 22 bp, Artificial Sequence
  chemically synthesized
taaaaacacagagtagttggaa

SEQ ID NO: 939103 - DNA, 22 bp, Artificial Sequence
  chemically synthesized
aaaaacacagagtagttggaaa

SEQ ID NO: 939104 - DNA, 22 bp, Artificial Sequence
  chemically synthesized
aaaacacagagtagttggaaaa

SEQ ID NO: 939105 - DNA, 22 bp, Artificial Sequence
  chemically synthesized
tacacatatagcaaaacacaag

SEQ ID NO: 939106 - DNA, 22 bp, Artificial Sequence
  chemically synthesized
attatacacatatagcaaaaca

SEQ ID NO: 939107 - DNA, 22 bp, Artificial Sequence
  chemically synthesized
gaaaaaacttgtgttttgctat

SEQ ID NO: 939108 - DNA, 22 bp, Artificial Sequence
  chemically synthesized
gtgttttgctatatgtgtataa

SEQ ID NO: 939109 - DNA, 22 bp, Artificial Sequence
  chemically synthesized
tgttttgctatatgtgtataat

SEQ ID NO: 939110 - DNA, 22 bp, Artificial Sequence
  chemically synthesized
tacagaatactaattatacaca

SEQ ID NO: 939111 - DNA, 22 bp, Artificial Sequence
  chemically synthesized
atacagaatactaattatacac

SEQ ID NO: 939112 - DNA, 22 bp, Artificial Sequence
  chemically synthesized
tatacagaatactaattataca

SEQ ID NO: 939113 - DNA, 22 bp, Artificial Sequence
  chemically synthesized
tttatacagaatactaattata

SEQ ID NO: 939114 - DNA, 22 bp, Artificial Sequence
  chemically synthesized
tgctatatgtgtataattagta

SEQ ID NO: 939115 - DNA, 22 bp, Artificial Sequence
  chemically synthesized
ctttatacagaatactaattat

SEQ ID NO: 939116 - DNA, 22 bp, Artificial Sequence
  chemically synthesized
gctatatgtgtataattagtat

SEQ ID NO: 939117 - DNA, 22 bp, Artificial Sequence
  chemically synthesized
ctatatgtgtataattagtatt

SEQ ID NO: 939118 - DNA, 22 bp, Artificial Sequence
  chemically synthesized
tatgtgtataattagtattctg

SEQ ID NO: 939119 - DNA, 22 bp, Artificial Sequence
  chemically synthesized
cggtcatttctttatacagaat

SEQ ID NO: 939120 - DNA, 22 bp, Artificial Sequence
  chemically synthesized
gtattctgtataaagaaatgac

SEQ ID NO: 939121 - DNA, 22 bp, Artificial Sequence
  chemically synthesized
aagagaactacggtcatttctt

SEQ ID NO: 939122 - DNA, 22 bp, Artificial Sequence
  chemically synthesized
gattcaagagaactacggtcat

SEQ ID NO: 939123 - DNA, 22 bp, Artificial Sequence
  chemically synthesized
tgtataaagaaatgaccgtagt

SEQ ID NO: 939124 - DNA, 22 bp, Artificial Sequence
  chemically synthesized
tataaagaaatgaccgtagttc

SEQ ID NO: 939125 - DNA, 22 bp, Artificial Sequence
  chemically synthesized
acccccacgcagcatctggatt

SEQ ID NO: 939126 - DNA, 22 bp, Artificial Sequence
  chemically synthesized
aacccccacgcagcatctggat

SEQ ID NO: 939127 - DNA, 22 bp, Artificial Sequence
  chemically synthesized
tcttgaatccagatgctgcgtg

SEQ ID NO: 939128 - DNA, 22 bp, Artificial Sequence
  chemically synthesized
ttgaatccagatgctgcgtggg

SEQ ID NO: 939129 - DNA, 22 bp, Artificial Sequence
  chemically synthesized
taaaatttaacccccacgcagc

SEQ ID NO: 939130 - DNA, 22 bp, Artificial Sequence
  chemically synthesized
gaatccagatgctgcgtggggg

SEQ ID NO: 939131 - DNA, 22 bp, Artificial Sequence
  chemically synthesized
aatccagatgctgcgtgggggt

SEQ ID NO: 939132 - DNA, 22 bp, Artificial Sequence
  chemically synthesized
aatctgtaaaatttaaccccca

SEQ ID NO: 939133 - DNA, 22 bp, Artificial Sequence
  chemically synthesized
cgtgggggttaaattttacaga

SEQ ID NO: 939134 - DNA, 22 bp, Artificial Sequence
  chemically synthesized
gcaaatggctgaatctgtaaaa

SEQ ID NO: 939135 - DNA, 22 bp, Artificial Sequence
  chemically synthesized
agcaaatggctgaatctgtaaa

SEQ ID NO: 939136 - DNA, 22 bp, Artificial Sequence
  chemically synthesized
ttagcaaatggctgaatctgta

SEQ ID NO: 939137 - DNA, 22 bp, Artificial Sequence
  chemically synthesized
cttagcaaatggctgaatctgt

SEQ ID NO: 939138 - DNA, 22 bp, Artificial Sequence
  chemically synthesized
tcttagcaaatggctgaatctg

SEQ ID NO: 939139 - DNA, 22 bp, Artificial Sequence
  chemically synthesized
ttcttagcaaatggctgaatct

SEQ ID NO: 939140 - DNA, 22 bp, Artificial Sequence
  chemically synthesized
tttttcttagcaaatggctgaa

SEQ ID NO: 939141 - DNA, 22 bp, Artificial Sequence
  chemically synthesized
aattttacagattcagccattt

SEQ ID NO: 939142 - DNA, 22 bp, Artificial Sequence
  chemically synthesized
atttttcttagcaaatggctga

SEQ ID NO: 939143 - DNA, 22 bp, Artificial Sequence
  chemically synthesized
tacagattcagccatttgctaa

SEQ ID NO: 939144 - DNA, 22 bp, Artificial Sequence
  chemically synthesized
accttatttttcttagcaaatg

SEQ ID NO: 939145 - DNA, 22 bp, Artificial Sequence
  chemically synthesized
acagattcagccatttgctaag

SEQ ID NO: 939146 - DNA, 22 bp, Artificial Sequence
  chemically synthesized
gaccttatttttcttagcaaat

SEQ ID NO: 939147 - DNA, 22 bp, Artificial Sequence
  chemically synthesized
cagattcagccatttgctaaga

SEQ ID NO: 939148 - DNA, 22 bp, Artificial Sequence
  chemically synthesized
tgaccttatttttcttagcaaa

SEQ ID NO: 939149 - DNA, 22 bp, Artificial Sequence
  chemically synthesized
aaattttgaccttatttttctt

SEQ ID NO: 939150 - DNA, 22 bp, Artificial Sequence
  chemically synthesized
agccatttgctaagaaaaataa

SEQ ID NO: 939151 - DNA, 22 bp, Artificial Sequence
  chemically synthesized
ccctaaaattttgaccttattt

SEQ ID NO: 939152 - DNA, 22 bp, Artificial Sequence
  chemically synthesized
accctaaaattttgaccttatt

SEQ ID NO: 939153 - DNA, 22 bp, Artificial Sequence
  chemically synthesized
ttaccctaaaattttgacctta

SEQ ID NO: 939154 - DNA, 22 bp, Artificial Sequence
  chemically synthesized
gctaagaaaaataaggtcaaaa

SEQ ID NO: 939155 - DNA, 22 bp, Artificial Sequence
  chemically synthesized
cttaccctaaaattttgacctt

SEQ ID NO: 939156 - DNA, 22 bp, Artificial Sequence
  chemically synthesized
ctaagaaaaataaggtcaaaat

SEQ ID NO: 939157 - DNA, 22 bp, Artificial Sequence
  chemically synthesized
tcttaccctaaaattttgacct

SEQ ID NO: 939158 - DNA, 22 bp, Artificial Sequence
  chemically synthesized
agaaaaataaggtcaaaatttt

SEQ ID NO: 939159 - DNA, 22 bp, Artificial Sequence
  chemically synthesized
ttttcttaccctaaaattttga

SEQ ID NO: 939160 - DNA, 22 bp, Artificial Sequence
  chemically synthesized
attattttcttaccctaaaatt

SEQ ID NO: 939161 - DNA, 22 bp, Artificial Sequence
  chemically synthesized
tcattattttcttaccctaaaa

SEQ ID NO: 939162 - DNA, 22 bp, Artificial Sequence
  chemically synthesized
aatcattctcattattttctta

SEQ ID NO: 939163 - DNA, 22 bp, Artificial Sequence
  chemically synthesized
aaatcattctcattattttctt

SEQ ID NO: 939164 - DNA, 22 bp, Artificial Sequence
  chemically synthesized
tagggtaagaaaataatgagaa

SEQ ID NO: 939165 - DNA, 22 bp, Artificial Sequence
  chemically synthesized
agggtaagaaaataatgagaat

SEQ ID NO: 939166 - DNA, 22 bp, Artificial Sequence
  chemically synthesized
gggtaagaaaataatgagaatg

SEQ ID NO: 939167 - DNA, 22 bp, Artificial Sequence
  chemically synthesized
tacaagtttaaatcattctcat

SEQ ID NO: 939168 - DNA, 22 bp, Artificial Sequence
  chemically synthesized
aaatgtactatacaagtttaaa

SEQ ID NO: 939169 - DNA, 22 bp, Artificial Sequence
  chemically synthesized
taaactgaaatgtactatacaa

SEQ ID NO: 939170 - DNA, 22 bp, Artificial Sequence
  chemically synthesized
ataaactgaaatgtactataca

SEQ ID NO: 939171 - DNA, 22 bp, Artificial Sequence
  chemically synthesized
aaacttgtatagtacatttcag

SEQ ID NO: 939172 - DNA, 22 bp, Artificial Sequence
  chemically synthesized
aacttgtatagtacatttcagt

SEQ ID NO: 939173 - DNA, 22 bp, Artificial Sequence
  chemically synthesized
gaaagaaatttataaactgaaa

SEQ ID NO: 939174 - DNA, 22 bp, Artificial Sequence
  chemically synthesized
agaaagaaatttataaactgaa

SEQ ID NO: 939175 - DNA, 22 bp, Artificial Sequence
  chemically synthesized
gtatagtacatttcagtttata

SEQ ID NO: 939176 - DNA, 22 bp, Artificial Sequence
  chemically synthesized
tagaaagaaatttataaactga

SEQ ID NO: 939177 - DNA, 22 bp, Artificial Sequence
  chemically synthesized
tatagtacatttcagtttataa

SEQ ID NO: 939178 - DNA, 22 bp, Artificial Sequence
  chemically synthesized
ttagaaagaaatttataaactg

SEQ ID NO: 939179 - DNA, 22 bp, Artificial Sequence
  chemically synthesized
gaaagaaacttttagaaagaaa

SEQ ID NO: 939180 - DNA, 22 bp, Artificial Sequence
  chemically synthesized
cagtttataaatttctttctaa

SEQ ID NO: 939181 - DNA, 22 bp, Artificial Sequence
  chemically synthesized
agtttataaatttctttctaaa

SEQ ID NO: 939182 - DNA, 22 bp, Artificial Sequence
  chemically synthesized
tattagaaagaaacttttagaa

SEQ ID NO: 939183 - DNA, 22 bp, Artificial Sequence
  chemically synthesized
ataaatttctttctaaaagttt

SEQ ID NO: 939184 - DNA, 22 bp, Artificial Sequence
  chemically synthesized
taaatttctttctaaaagtttc

SEQ ID NO: 939185 - DNA, 22 bp, Artificial Sequence
  chemically synthesized
ctttctaaaagtttctttctaa

SEQ ID NO: 939186 - DNA, 22 bp, Artificial Sequence
  chemically synthesized
tttctaaaagtttctttctaat

SEQ ID NO: 939187 - DNA, 22 bp, Artificial Sequence
  chemically synthesized
aataaaatactatattagaaag

SEQ ID NO: 939188 - DNA, 22 bp, Artificial Sequence
  chemically synthesized
tctaaaagtttctttctaatat

SEQ ID NO: 939189 - DNA, 22 bp, Artificial Sequence
  chemically synthesized
ctaaaagtttctttctaatata

SEQ ID NO: 939190 - DNA, 22 bp, Artificial Sequence
  chemically synthesized
taaaagtttctttctaatatag

SEQ ID NO: 939191 - DNA, 22 bp, Artificial Sequence
  chemically synthesized
aaagtttctttctaatatagta

SEQ ID NO: 939192 - DNA, 22 bp, Artificial Sequence
  chemically synthesized
tcaaaattaaataaaatactat

SEQ ID NO: 939193 - DNA, 22 bp, Artificial Sequence
  chemically synthesized
ctttctaatatagtattttatt

SEQ ID NO: 939194 - DNA, 22 bp, Artificial Sequence
  chemically synthesized
ttgtcaaaattaaataaaatac

SEQ ID NO: 939195 - DNA, 22 bp, Artificial Sequence
  chemically synthesized
tttctaatatagtattttattt

SEQ ID NO: 939196 - DNA, 22 bp, Artificial Sequence
  chemically synthesized
gttgtcaaaattaaataaaata

SEQ ID NO: 939197 - DNA, 22 bp, Artificial Sequence
  chemically synthesized
tgttgtcaaaattaaataaaat

SEQ ID NO: 939198 - DNA, 22 bp, Artificial Sequence
  chemically synthesized
tctaatatagtattttatttaa

SEQ ID NO: 939199 - DNA, 22 bp, Artificial Sequence
  chemically synthesized
ctaatatagtattttatttaat

SEQ ID NO: 939200 - DNA, 22 bp, Artificial Sequence
  chemically synthesized
taatatagtattttatttaatt

SEQ ID NO: 939201 - DNA, 22 bp, Artificial Sequence
  chemically synthesized
atatagtattttatttaatttt

SEQ ID NO: 939202 - DNA, 22 bp, Artificial Sequence
  chemically synthesized
tccacatcacagttttgttgtc

SEQ ID NO: 939203 - DNA, 22 bp, Artificial Sequence
  chemically synthesized
tatttaattttgacaacaaaac

SEQ ID NO: 939204 - DNA, 22 bp, Artificial Sequence
  chemically synthesized
atttaattttgacaacaaaact

SEQ ID NO: 939205 - DNA, 22 bp, Artificial Sequence
  chemically synthesized
tttaattttgacaacaaaactg

SEQ ID NO: 939206 - DNA, 22 bp, Artificial Sequence
  chemically synthesized
aattttgacaacaaaactgtga

SEQ ID NO: 939207 - DNA, 22 bp, Artificial Sequence
  chemically synthesized
attttgacaacaaaactgtgat

SEQ ID NO: 939208 - DNA, 22 bp, Artificial Sequence
  chemically synthesized
tgacaacaaaactgtgatgtgg

SEQ ID NO: 939209 - DNA, 22 bp, Artificial Sequence
  chemically synthesized
gacaacaaaactgtgatgtgga

SEQ ID NO: 939210 - DNA, 22 bp, Artificial Sequence
  chemically synthesized
acaacaaaactgtgatgtggat

SEQ ID NO: 939211 - DNA, 22 bp, Artificial Sequence
  chemically synthesized
taaagtggcacacctatccaca

SEQ ID NO: 939212 - DNA, 22 bp, Artificial Sequence
  chemically synthesized
tataaagtggcacacctatcca

SEQ ID NO: 939213 - DNA, 22 bp, Artificial Sequence
  chemically synthesized
ctataaagtggcacacctatcc

SEQ ID NO: 939214 - DNA, 22 bp, Artificial Sequence
  chemically synthesized
tctataaagtggcacacctatc

SEQ ID NO: 939215 - DNA, 22 bp, Artificial Sequence
  chemically synthesized
ttctataaagtggcacacctat

SEQ ID NO: 939216 - DNA, 22 bp, Artificial Sequence
  chemically synthesized
tttctataaagtggcacaccta

SEQ ID NO: 939217 - DNA, 22 bp, Artificial Sequence
  chemically synthesized
ttttctataaagtggcacacct

SEQ ID NO: 939218 - DNA, 22 bp, Artificial Sequence
  chemically synthesized
tgatgtggataggtgtgccact

SEQ ID NO: 939219 - DNA, 22 bp, Artificial Sequence
  chemically synthesized
gcttttttctataaagtggcac

SEQ ID NO: 939220 - DNA, 22 bp, Artificial Sequence
  chemically synthesized
agcttttttctataaagtggca

SEQ ID NO: 939221 - DNA, 22 bp, Artificial Sequence
  chemically synthesized
tttagcttttttctataaagtg

SEQ ID NO: 939222 - DNA, 22 bp, Artificial Sequence
  chemically synthesized
gtttagcttttttctataaagt

SEQ ID NO: 939223 - DNA, 22 bp, Artificial Sequence
  chemically synthesized
gtttgtttagcttttttctata

SEQ ID NO: 939224 - DNA, 22 bp, Artificial Sequence
  chemically synthesized
agtttgtttagcttttttctat

SEQ ID NO: 939225 - DNA, 22 bp, Artificial Sequence
  chemically synthesized
aatcttagtttgtttagctttt

SEQ ID NO: 939226 - DNA, 22 bp, Artificial Sequence
  chemically synthesized
ctgaatcttagtttgtttagct

SEQ ID NO: 939227 - DNA, 22 bp, Artificial Sequence
  chemically synthesized
cctgaatcttagtttgtttagc

SEQ ID NO: 939228 - DNA, 22 bp, Artificial Sequence
  chemically synthesized
tatagaaaaaagctaaacaaac

SEQ ID NO: 939229 - DNA, 22 bp, Artificial Sequence
  chemically synthesized
atagaaaaaagctaaacaaact

SEQ ID NO: 939230 - DNA, 22 bp, Artificial Sequence
  chemically synthesized
tagaaaaaagctaaacaaacta

SEQ ID NO: 939231 - DNA, 22 bp, Artificial Sequence
  chemically synthesized
gcttcctgaatcttagtttgtt

SEQ ID NO: 939232 - DNA, 22 bp, Artificial Sequence
  chemically synthesized
agcttcctgaatcttagtttgt

SEQ ID NO: 939233 - DNA, 22 bp, Artificial Sequence
  chemically synthesized
cttagcttcctgaatcttagtt

SEQ ID NO: 939234 - DNA, 22 bp, Artificial Sequence
  chemically synthesized
aacaaactaagattcaggaagc

SEQ ID NO: 939235 - DNA, 22 bp, Artificial Sequence
  chemically synthesized
aataagttacttagcttcctga

SEQ ID NO: 939236 - DNA, 22 bp, Artificial Sequence
  chemically synthesized
aaataagttacttagcttcctg

SEQ ID NO: 939237 - DNA, 22 bp, Artificial Sequence
  chemically synthesized
agattcaggaagctaagtaact

SEQ ID NO: 939238 - DNA, 22 bp, Artificial Sequence
  chemically synthesized
aggaagctaagtaacttattta

SEQ ID NO: 939239 - DNA, 22 bp, Artificial Sequence
  chemically synthesized
ggtgtgtgaccttaaataagtt

SEQ ID NO: 939240 - DNA, 22 bp, Artificial Sequence
  chemically synthesized
agtaacttatttaaggtcacac

SEQ ID NO: 939241 - DNA, 22 bp, Artificial Sequence
  chemically synthesized
ccaaaaactaggtgtgtgacct

SEQ ID NO: 939242 - DNA, 22 bp, Artificial Sequence
  chemically synthesized
tgccaaaaactaggtgtgtgac

SEQ ID NO: 939243 - DNA, 22 bp, Artificial Sequence
  chemically synthesized
atttaaggtcacacacctagtt

SEQ ID NO: 939244 - DNA, 22 bp, Artificial Sequence
  chemically synthesized
tttaaggtcacacacctagttt

SEQ ID NO: 939245 - DNA, 22 bp, Artificial Sequence
  chemically synthesized
aaggtcacacacctagtttttg

SEQ ID NO: 939246 - DNA, 22 bp, Artificial Sequence
  chemically synthesized
aggtcacacacctagtttttgg

SEQ ID NO: 939247 - DNA, 22 bp, Artificial Sequence
  chemically synthesized
aagccagaacatatgtctctgc

SEQ ID NO: 939248 - DNA, 22 bp, Artificial Sequence
  chemically synthesized
gaagccagaacatatgtctctg

SEQ ID NO: 939249 - DNA, 22 bp, Artificial Sequence
  chemically synthesized
gtttttggcagagacatatgtt

SEQ ID NO: 939250 - DNA, 22 bp, Artificial Sequence
  chemically synthesized
aacttgaagccagaacatatgt

SEQ ID NO: 939251 - DNA, 22 bp, Artificial Sequence
  chemically synthesized
gaacttgaagccagaacatatg

SEQ ID NO: 939252 - DNA, 22 bp, Artificial Sequence
  chemically synthesized
tgaacttgaagccagaacatat

SEQ ID NO: 939253 - DNA, 22 bp, Artificial Sequence
  chemically synthesized
ttggcagagacatatgttctgg

SEQ ID NO: 939254 - DNA, 22 bp, Artificial Sequence
  chemically synthesized
tggcagagacatatgttctggc

SEQ ID NO: 939255 - DNA, 22 bp, Artificial Sequence
  chemically synthesized
ggcagagacatatgttctggct

SEQ ID NO: 939256 - DNA, 22 bp, Artificial Sequence
  chemically synthesized
gcagagacatatgttctggctt

SEQ ID NO: 939257 - DNA, 22 bp, Artificial Sequence
  chemically synthesized
tggcttcaagttcaaaatcctt

SEQ ID NO: 939258 - DNA, 22 bp, Artificial Sequence
  chemically synthesized
tagtatagtggaaaggattttg

SEQ ID NO: 939259 - DNA, 22 bp, Artificial Sequence
  chemically synthesized
gcttcaagttcaaaatcctttc

SEQ ID NO: 939260 - DNA, 22 bp, Artificial Sequence
  chemically synthesized
caagttcaaaatcctttccact

SEQ ID NO: 939261 - DNA, 22 bp, Artificial Sequence
  chemically synthesized
aagttcaaaatcctttccacta

SEQ ID NO: 939262 - DNA, 22 bp, Artificial Sequence
  chemically synthesized
aaaatcctttccactatactac

SEQ ID NO: 939263 - DNA, 22 bp, Artificial Sequence
  chemically synthesized
gatgtaaagtaggggtaattgt

SEQ ID NO: 939264 - DNA, 22 bp, Artificial Sequence
  chemically synthesized
tccactatactacaattacccc

SEQ ID NO: 939265 - DNA, 22 bp, Artificial Sequence
  chemically synthesized
agatgtaaagtaggggtaattg

SEQ ID NO: 939266 - DNA, 22 bp, Artificial Sequence
  chemically synthesized
ccactatactacaattacccct

SEQ ID NO: 939267 - DNA, 22 bp, Artificial Sequence
  chemically synthesized
tagatgtaaagtaggggtaatt

SEQ ID NO: 939268 - DNA, 22 bp, Artificial Sequence
  chemically synthesized
cactatactacaattaccccta

SEQ ID NO: 939269 - DNA, 22 bp, Artificial Sequence
  chemically synthesized
ttagatgtaaagtaggggtaat

SEQ ID NO: 939270 - DNA, 22 bp, Artificial Sequence
  chemically synthesized
tactacaattacccctacttta

SEQ ID NO: 939271 - DNA, 22 bp, Artificial Sequence
  chemically synthesized
caattacccctactttacatct

SEQ ID NO: 939272 - DNA, 22 bp, Artificial Sequence
  chemically synthesized
ggaagtgtttttagatgtaaag

SEQ ID NO: 939273 - DNA, 22 bp, Artificial Sequence
  chemically synthesized
taggaagtgtttttagatgtaa

SEQ ID NO: 939274 - DNA, 22 bp, Artificial Sequence
  chemically synthesized
ctaggaagtgtttttagatgta

SEQ ID NO: 939275 - DNA, 22 bp, Artificial Sequence
  chemically synthesized
cccctactttacatctaaaaac

SEQ ID NO: 939276 - DNA, 22 bp, Artificial Sequence
  chemically synthesized
cgcatttctaggaagtgttttt

SEQ ID NO: 939277 - DNA, 22 bp, Artificial Sequence
  chemically synthesized
acgcatttctaggaagtgtttt

SEQ ID NO: 939278 - DNA, 22 bp, Artificial Sequence
  chemically synthesized
ctttacatctaaaaacacttcc

SEQ ID NO: 939279 - DNA, 22 bp, Artificial Sequence
  chemically synthesized
tacatctaaaaacacttcctag

SEQ ID NO: 939280 - DNA, 22 bp, Artificial Sequence
  chemically synthesized
tcttacgcatttctaggaagtg

SEQ ID NO: 939281 - DNA, 22 bp, Artificial Sequence
  chemically synthesized
acatctaaaaacacttcctaga

SEQ ID NO: 939282 - DNA, 22 bp, Artificial Sequence
  chemically synthesized
atcttacgcatttctaggaagt

SEQ ID NO: 939283 - DNA, 22 bp, Artificial Sequence
  chemically synthesized
catctaaaaacacttcctagaa

SEQ ID NO: 939284 - DNA, 22 bp, Artificial Sequence
  chemically synthesized
tatcttacgcatttctaggaag

SEQ ID NO: 939285 - DNA, 22 bp, Artificial Sequence
  chemically synthesized
cctttatcttacgcatttctag

SEQ ID NO: 939286 - DNA, 22 bp, Artificial Sequence
  chemically synthesized
aaaacacttcctagaaatgcgt

SEQ ID NO: 939287 - DNA, 22 bp, Artificial Sequence
  chemically synthesized
cctagaaatgcgtaagataaag

SEQ ID NO: 939288 - DNA, 22 bp, Artificial Sequence
  chemically synthesized
ctagaaatgcgtaagataaagg

SEQ ID NO: 939289 - DNA, 22 bp, Artificial Sequence
  chemically synthesized
gaaatgcgtaagataaaggtag

SEQ ID NO: 939290 - DNA, 22 bp, Artificial Sequence
  chemically synthesized
ggaataaaacaaaaactacctt

SEQ ID NO: 939291 - DNA, 22 bp, Artificial Sequence
  chemically synthesized
aggaataaaacaaaaactacct

SEQ ID NO: 939292 - DNA, 22 bp, Artificial Sequence
  chemically synthesized
taggaataaaacaaaaactacc

SEQ ID NO: 939293 - DNA, 22 bp, Artificial Sequence
  chemically synthesized
ttttaggaataaaacaaaaact

SEQ ID NO: 939294 - DNA, 22 bp, Artificial Sequence
  chemically synthesized
atctattttaggaataaaacaa

SEQ ID NO: 939295 - DNA, 22 bp, Artificial Sequence
  chemically synthesized
ttgttttattcctaaaatagat

SEQ ID NO: 939296 - DNA, 22 bp, Artificial Sequence
  chemically synthesized
tgttttattcctaaaatagatt

SEQ ID NO: 939297 - DNA, 22 bp, Artificial Sequence
  chemically synthesized
atatacatgattaatctatttt

SEQ ID NO: 939298 - DNA, 22 bp, Artificial Sequence
  chemically synthesized
gttttattcctaaaatagatta

SEQ ID NO: 939299 - DNA, 22 bp, Artificial Sequence
  chemically synthesized
ttttattcctaaaatagattaa

SEQ ID NO: 939300 - DNA, 22 bp, Artificial Sequence
  chemically synthesized
tgatatacatgattaatctatt

SEQ ID NO: 939301 - DNA, 22 bp, Artificial Sequence
  chemically synthesized
tattcctaaaatagattaatca

SEQ ID NO: 939302 - DNA, 22 bp, Artificial Sequence
  chemically synthesized
attcctaaaatagattaatcat

SEQ ID NO: 939303 - DNA, 22 bp, Artificial Sequence
  chemically synthesized
ttcctaaaatagattaatcatg

SEQ ID NO: 939304 - DNA, 22 bp, Artificial Sequence
  chemically synthesized
ctaaaatagattaatcatgtat

SEQ ID NO: 939305 - DNA, 22 bp, Artificial Sequence
  chemically synthesized
taatatctctgatatacatgat

SEQ ID NO: 939306 - DNA, 22 bp, Artificial Sequence
  chemically synthesized
gtaatatctctgatatacatga

SEQ ID NO: 939307 - DNA, 22 bp, Artificial Sequence
  chemically synthesized
aaatagattaatcatgtatatc

SEQ ID NO: 939308 - DNA, 22 bp, Artificial Sequence
  chemically synthesized
aacttgtaatatctctgatata

SEQ ID NO: 939309 - DNA, 22 bp, Artificial Sequence
  chemically synthesized
tcaacttgtaatatctctgata

SEQ ID NO: 939310 - DNA, 22 bp, Artificial Sequence
  chemically synthesized
atcatgtatatcagagatatta

SEQ ID NO: 939311 - DNA, 22 bp, Artificial Sequence
  chemically synthesized
attctcaacttgtaatatctct

SEQ ID NO: 939312 - DNA, 22 bp, Artificial Sequence
  chemically synthesized
ctaattctcaacttgtaatatc

SEQ ID NO: 939313 - DNA, 22 bp, Artificial Sequence
  chemically synthesized
atcctgctaattctcaacttgt

SEQ ID NO: 939314 - DNA, 22 bp, Artificial Sequence
  chemically synthesized
catcctgctaattctcaacttg

SEQ ID NO: 939315 - DNA, 22 bp, Artificial Sequence
  chemically synthesized
tcaaaatttcatcctgctaatt

SEQ ID NO: 939316 - DNA, 22 bp, Artificial Sequence
  chemically synthesized
tgtcaaaatttcatcctgctaa

SEQ ID NO: 939317 - DNA, 22 bp, Artificial Sequence
  chemically synthesized
caagttgagaattagcaggatg

SEQ ID NO: 939318 - DNA, 22 bp, Artificial Sequence
  chemically synthesized
gttctgtcaaaatttcatcctg

SEQ ID NO: 939319 - DNA, 22 bp, Artificial Sequence
  chemically synthesized
ttggttctgtcaaaatttcatc

SEQ ID NO: 939320 - DNA, 22 bp, Artificial Sequence
  chemically synthesized
agaattagcaggatgaaatttt

SEQ ID NO: 939321 - DNA, 22 bp, Artificial Sequence
  chemically synthesized
gttggttctgtcaaaatttcat

SEQ ID NO: 939322 - DNA, 22 bp, Artificial Sequence
  chemically synthesized
catcttgttggttctgtcaaaa

SEQ ID NO: 939323 - DNA, 22 bp, Artificial Sequence
  chemically synthesized
gcaggatgaaattttgacagaa

SEQ ID NO: 939324 - DNA, 22 bp, Artificial Sequence
  chemically synthesized
gcatcttgttggttctgtcaaa

SEQ ID NO: 939325 - DNA, 22 bp, Artificial Sequence
  chemically synthesized
agtttgcatcttgttggttctg

SEQ ID NO: 939326 - DNA, 22 bp, Artificial Sequence
  chemically synthesized
tctcagtttgcatcttgttggt

SEQ ID NO: 939327 - DNA, 22 bp, Artificial Sequence
  chemically synthesized
tgacagaaccaacaagatgcaa

SEQ ID NO: 939328 - DNA, 22 bp, Artificial Sequence
  chemically synthesized
gacagaaccaacaagatgcaaa

SEQ ID NO: 939329 - DNA, 22 bp, Artificial Sequence
  chemically synthesized
acagaaccaacaagatgcaaac

SEQ ID NO: 939330 - DNA, 22 bp, Artificial Sequence
  chemically synthesized
taaaactatctcagtttgcatc

SEQ ID NO: 939331 - DNA, 22 bp, Artificial Sequence
  chemically synthesized
ttataaaactatctcagtttgc

SEQ ID NO: 939332 - DNA, 22 bp, Artificial Sequence
  chemically synthesized
ttattataaaactatctcagtt

SEQ ID NO: 939333 - DNA, 22 bp, Artificial Sequence
  chemically synthesized
aaagacatactgttattataaa

SEQ ID NO: 939334 - DNA, 22 bp, Artificial Sequence
  chemically synthesized
ttaaaagacatactgttattat

SEQ ID NO: 939335 - DNA, 22 bp, Artificial Sequence
  chemically synthesized
attaaaagacatactgttatta

SEQ ID NO: 939336 - DNA, 22 bp, Artificial Sequence
  chemically synthesized
agatagttttataataacagta

SEQ ID NO: 939337 - DNA, 22 bp, Artificial Sequence
  chemically synthesized
taatttattaaaagacatactg

SEQ ID NO: 939338 - DNA, 22 bp, Artificial Sequence
  chemically synthesized
tgtaatttattaaaagacatac

SEQ ID NO: 939339 - DNA, 22 bp, Artificial Sequence
  chemically synthesized
tataataacagtatgtctttta

SEQ ID NO: 939340 - DNA, 22 bp, Artificial Sequence
  chemically synthesized
ataataacagtatgtcttttaa

SEQ ID NO: 939341 - DNA, 22 bp, Artificial Sequence
  chemically synthesized
taataacagtatgtcttttaat

SEQ ID NO: 939342 - DNA, 22 bp, Artificial Sequence
  chemically synthesized
actctgtaatttattaaaagac

SEQ ID NO: 939343 - DNA, 22 bp, Artificial Sequence
  chemically synthesized
ttcactctgtaatttattaaaa

SEQ ID NO: 939344 - DNA, 22 bp, Artificial Sequence
  chemically synthesized
gtaaactattcactctgtaatt

SEQ ID NO: 939345 - DNA, 22 bp, Artificial Sequence
  chemically synthesized
ggtaaactattcactctgtaat

SEQ ID NO: 939346 - DNA, 22 bp, Artificial Sequence
  chemically synthesized
ttaataaattacagagtgaata

SEQ ID NO: 939347 - DNA, 22 bp, Artificial Sequence
  chemically synthesized
taataaattacagagtgaatag

SEQ ID NO: 939348 - DNA, 22 bp, Artificial Sequence
  chemically synthesized
aataaattacagagtgaatagt

SEQ ID NO: 939349 - DNA, 22 bp, Artificial Sequence
  chemically synthesized
ataaattacagagtgaatagtt

SEQ ID NO: 939350 - DNA, 22 bp, Artificial Sequence
  chemically synthesized
acccaacatttggtaaactatt

SEQ ID NO: 939351 - DNA, 22 bp, Artificial Sequence
  chemically synthesized
aacccaacatttggtaaactat

SEQ ID NO: 939352 - DNA, 22 bp, Artificial Sequence
  chemically synthesized
taacccaacatttggtaaacta

SEQ ID NO: 939353 - DNA, 22 bp, Artificial Sequence
  chemically synthesized
cagagtgaatagtttaccaaat

SEQ ID NO: 939354 - DNA, 22 bp, Artificial Sequence
  chemically synthesized
ctttaacccaacatttggtaaa

SEQ ID NO: 939355 - DNA, 22 bp, Artificial Sequence
  chemically synthesized
gctttaacccaacatttggtaa

SEQ ID NO: 939356 - DNA, 22 bp, Artificial Sequence
  chemically synthesized
aaagtttgctttaacccaacat

SEQ ID NO: 939357 - DNA, 22 bp, Artificial Sequence
  chemically synthesized
tggctgaaagtttgctttaacc

SEQ ID NO: 939358 - DNA, 22 bp, Artificial Sequence
  chemically synthesized
accaaatgttgggttaaagcaa

SEQ ID NO: 939359 - DNA, 22 bp, Artificial Sequence
  chemically synthesized
gtggctgaaagtttgctttaac

SEQ ID NO: 939360 - DNA, 22 bp, Artificial Sequence
  chemically synthesized
ccaaatgttgggttaaagcaaa

SEQ ID NO: 939361 - DNA, 22 bp, Artificial Sequence
  chemically synthesized
aatcttgtggctgaaagtttgc

SEQ ID NO: 939362 - DNA, 22 bp, Artificial Sequence
  chemically synthesized
ggttaaagcaaactttcagcca

SEQ ID NO: 939363 - DNA, 22 bp, Artificial Sequence
  chemically synthesized
aagcaaactttcagccacaaga

SEQ ID NO: 939364 - DNA, 22 bp, Artificial Sequence
  chemically synthesized
tggataaaacagcagattcaat

SEQ ID NO: 939365 - DNA, 22 bp, Artificial Sequence
  chemically synthesized
tcagccacaagattgaatctgc

SEQ ID NO: 939366 - DNA, 22 bp, Artificial Sequence
  chemically synthesized
cagccacaagattgaatctgct

SEQ ID NO: 939367 - DNA, 22 bp, Artificial Sequence
  chemically synthesized
agccacaagattgaatctgctg

SEQ ID NO: 939368 - DNA, 22 bp, Artificial Sequence
  chemically synthesized
aatctgctgttttatccacaga

SEQ ID NO: 939369 - DNA, 22 bp, Artificial Sequence
  chemically synthesized
ctgttttatccacagatatgtg

SEQ ID NO: 939370 - DNA, 22 bp, Artificial Sequence
  chemically synthesized
ttttatccacagatatgtggtt

SEQ ID NO: 939371 - DNA, 22 bp, Artificial Sequence
  chemically synthesized
tatccacagatatgtggttttt

SEQ ID NO: 939372 - DNA, 22 bp, Artificial Sequence
  chemically synthesized
atccacagatatgtggttttta

SEQ ID NO: 939373 - DNA, 22 bp, Artificial Sequence
  chemically synthesized
tccacagatatgtggtttttat

SEQ ID NO: 939374 - DNA, 22 bp, Artificial Sequence
  chemically synthesized
aaataaaatggaagtataagat

SEQ ID NO: 939375 - DNA, 22 bp, Artificial Sequence
  chemically synthesized
aaaataaaatggaagtataaga

SEQ ID NO: 939376 - DNA, 22 bp, Artificial Sequence
  chemically synthesized
taaaataaaatggaagtataag

SEQ ID NO: 939377 - DNA, 22 bp, Artificial Sequence
  chemically synthesized
ttattgatcttatacttccatt

SEQ ID NO: 939378 - DNA, 22 bp, Artificial Sequence
  chemically synthesized
tattgatcttatacttccattt

SEQ ID NO: 939379 - DNA, 22 bp, Artificial Sequence
  chemically synthesized
attgatcttatacttccatttt

SEQ ID NO: 939380 - DNA, 22 bp, Artificial Sequence
  chemically synthesized
ttgatcttatacttccatttta

SEQ ID NO: 939381 - DNA, 22 bp, Artificial Sequence
  chemically synthesized
atcttatacttccattttattt

SEQ ID NO: 939382 - DNA, 22 bp, Artificial Sequence
  chemically synthesized
atacttccattttattttaaaa

SEQ ID NO: 939383 - DNA, 22 bp, Artificial Sequence
  chemically synthesized
tacttccattttattttaaaat

SEQ ID NO: 939384 - DNA, 22 bp, Artificial Sequence
  chemically synthesized
ccattttattttaaaatgtaca

SEQ ID NO: 939385 - DNA, 22 bp, Artificial Sequence
  chemically synthesized
cattttattttaaaatgtacat

SEQ ID NO: 939386 - DNA, 22 bp, Artificial Sequence
  chemically synthesized
tattttaaaatgtacattttat

SEQ ID NO: 939387 - DNA, 22 bp, Artificial Sequence
  chemically synthesized
attttaaaatgtacattttatg

SEQ ID NO: 939388 - DNA, 22 bp, Artificial Sequence
  chemically synthesized
ttttaaaatgtacattttatgt

SEQ ID NO: 939389 - DNA, 22 bp, Artificial Sequence
  chemically synthesized
atcccaggatggtaacataaaa

SEQ ID NO: 939390 - DNA, 22 bp, Artificial Sequence
  chemically synthesized
taaaatgtacattttatgttac

SEQ ID NO: 939391 - DNA, 22 bp, Artificial Sequence
  chemically synthesized
gatcccaggatggtaacataaa

SEQ ID NO: 939392 - DNA, 22 bp, Artificial Sequence
  chemically synthesized
aaaatgtacattttatgttacc

SEQ ID NO: 939393 - DNA, 22 bp, Artificial Sequence
  chemically synthesized
tgatcccaggatggtaacataa

SEQ ID NO: 939394 - DNA, 22 bp, Artificial Sequence
  chemically synthesized
aaatgtacattttatgttacca

SEQ ID NO: 939395 - DNA, 22 bp, Artificial Sequence
  chemically synthesized
ctttgatcccaggatggtaaca

SEQ ID NO: 939396 - DNA, 22 bp, Artificial Sequence
  chemically synthesized
aagttactttgatcccaggatg

SEQ ID NO: 939397 - DNA, 22 bp, Artificial Sequence
  chemically synthesized
caagttactttgatcccaggat

SEQ ID NO: 939398 - DNA, 22 bp, Artificial Sequence
  chemically synthesized
tatgttaccatcctgggatcaa

SEQ ID NO: 939399 - DNA, 22 bp, Artificial Sequence
  chemically synthesized
tttcaagttactttgatcccag

SEQ ID NO: 939400 - DNA, 22 bp, Artificial Sequence
  chemically synthesized
atgttaccatcctgggatcaaa

SEQ ID NO: 939401 - DNA, 22 bp, Artificial Sequence
  chemically synthesized
tgttaccatcctgggatcaaag

SEQ ID NO: 939402 - DNA, 22 bp, Artificial Sequence
  chemically synthesized
ttatttcaagttactttgatcc

SEQ ID NO: 939403 - DNA, 22 bp, Artificial Sequence
  chemically synthesized
ccatcctgggatcaaagtaact

SEQ ID NO: 939404 - DNA, 22 bp, Artificial Sequence
  chemically synthesized
aggtcctattatttcaagttac

SEQ ID NO: 939405 - DNA, 22 bp, Artificial Sequence
  chemically synthesized
ggatcaaagtaacttgaaataa

SEQ ID NO: 939406 - DNA, 22 bp, Artificial Sequence
  chemically synthesized
cctaaggtcctattatttcaag

SEQ ID NO: 939407 - DNA, 22 bp, Artificial Sequence
  chemically synthesized
acctaaggtcctattatttcaa

SEQ ID NO: 939408 - DNA, 22 bp, Artificial Sequence
  chemically synthesized
tttacctaaggtcctattattt

SEQ ID NO: 939409 - DNA, 22 bp, Artificial Sequence
  chemically synthesized
atttacctaaggtcctattatt

SEQ ID NO: 939410 - DNA, 22 bp, Artificial Sequence
  chemically synthesized
gaaataataggaccttaggtaa

SEQ ID NO: 939411 - DNA, 22 bp, Artificial Sequence
  chemically synthesized
aaataataggaccttaggtaaa

SEQ ID NO: 939412 - DNA, 22 bp, Artificial Sequence
  chemically synthesized
tcccaacagaaggatttattta

SEQ ID NO: 939413 - DNA, 22 bp, Artificial Sequence
  chemically synthesized
atcccaacagaaggatttattt

SEQ ID NO: 939414 - DNA, 22 bp, Artificial Sequence
  chemically synthesized
atccttatcccaacagaaggat

SEQ ID NO: 939415 - DNA, 22 bp, Artificial Sequence
  chemically synthesized
aggtaaataaatccttctgttg

SEQ ID NO: 939416 - DNA, 22 bp, Artificial Sequence
  chemically synthesized
ggtaaataaatccttctgttgg

SEQ ID NO: 939417 - DNA, 22 bp, Artificial Sequence
  chemically synthesized
atggacatgttcatccttatcc

SEQ ID NO: 939418 - DNA, 22 bp, Artificial Sequence
  chemically synthesized
tgatggacatgttcatccttat

SEQ ID NO: 939419 - DNA, 22 bp, Artificial Sequence
  chemically synthesized
ctgttgggataaggatgaacat

SEQ ID NO: 939420 - DNA, 22 bp, Artificial Sequence
  chemically synthesized
tgttgggataaggatgaacatg

SEQ ID NO: 939421 - DNA, 22 bp, Artificial Sequence
  chemically synthesized
ttgggataaggatgaacatgtc

SEQ ID NO: 939422 - DNA, 22 bp, Artificial Sequence
  chemically synthesized
ggataaggatgaacatgtccat

SEQ ID NO: 939423 - DNA, 22 bp, Artificial Sequence
  chemically synthesized
aaaagcaaaggaaaaagagaca

SEQ ID NO: 939424 - DNA, 22 bp, Artificial Sequence
  chemically synthesized
acacaagttaaaaagcaaagga

SEQ ID NO: 939425 - DNA, 22 bp, Artificial Sequence
  chemically synthesized
tctctttttcctttgcttttta

SEQ ID NO: 939426 - DNA, 22 bp, Artificial Sequence
  chemically synthesized
cctaacacaagttaaaaagcaa

SEQ ID NO: 939427 - DNA, 22 bp, Artificial Sequence
  chemically synthesized
gcctaacacaagttaaaaagca

SEQ ID NO: 939428 - DNA, 22 bp, Artificial Sequence
  chemically synthesized
tttttcctttgctttttaactt

SEQ ID NO: 939429 - DNA, 22 bp, Artificial Sequence
  chemically synthesized
tttcctttgctttttaacttgt

SEQ ID NO: 939430 - DNA, 22 bp, Artificial Sequence
  chemically synthesized
ttcctttgctttttaacttgtg

SEQ ID NO: 939431 - DNA, 22 bp, Artificial Sequence
  chemically synthesized
tcacttgcctaacacaagttaa

SEQ ID NO: 939432 - DNA, 22 bp, Artificial Sequence
  chemically synthesized
tcctttgctttttaacttgtgt

SEQ ID NO: 939433 - DNA, 22 bp, Artificial Sequence
  chemically synthesized
cctttgctttttaacttgtgtt

SEQ ID NO: 939434 - DNA, 22 bp, Artificial Sequence
  chemically synthesized
tgtcacttgcctaacacaagtt

SEQ ID NO: 939435 - DNA, 22 bp, Artificial Sequence
  chemically synthesized
ctttgctttttaacttgtgtta

SEQ ID NO: 939436 - DNA, 22 bp, Artificial Sequence
  chemically synthesized
tgctttttaacttgtgttaggc

SEQ ID NO: 939437 - DNA, 22 bp, Artificial Sequence
  chemically synthesized
gctttttaacttgtgttaggca

SEQ ID NO: 939438 - DNA, 22 bp, Artificial Sequence
  chemically synthesized
ctttttaacttgtgttaggcaa

SEQ ID NO: 939439 - DNA, 22 bp, Artificial Sequence
  chemically synthesized
tttaacttgtgttaggcaagtg

SEQ ID NO: 939440 - DNA, 22 bp, Artificial Sequence
  chemically synthesized
ttaacttgtgttaggcaagtga

SEQ ID NO: 939441 - DNA, 22 bp, Artificial Sequence
  chemically synthesized
taacttgtgttaggcaagtgac

SEQ ID NO: 939442 - DNA, 22 bp, Artificial Sequence
  chemically synthesized
aacttgtgttaggcaagtgaca

SEQ ID NO: 939443 - DNA, 22 bp, Artificial Sequence
  chemically synthesized
acttgtgttaggcaagtgacag

SEQ ID NO: 939444 - DNA, 22 bp, Artificial Sequence
  chemically synthesized
gtgttaggcaagtgacagaata

SEQ ID NO: 939445 - DNA, 22 bp, Artificial Sequence
  chemically synthesized
tgttaggcaagtgacagaatat

SEQ ID NO: 939446 - DNA, 22 bp, Artificial Sequence
  chemically synthesized
ggcaagtgacagaatatgtttt

SEQ ID NO: 939447 - DNA, 22 bp, Artificial Sequence
  chemically synthesized
ggatcagagaacaacaaaaaca

SEQ ID NO: 939448 - DNA, 22 bp, Artificial Sequence
  chemically synthesized
ttgttgttctctgatcccagtt

SEQ ID NO: 939449 - DNA, 22 bp, Artificial Sequence
  chemically synthesized
tgttgttctctgatcccagttt

SEQ ID NO: 939450 - DNA, 22 bp, Artificial Sequence
  chemically synthesized
gttgttctctgatcccagtttt

SEQ ID NO: 939451 - DNA, 22 bp, Artificial Sequence
  chemically synthesized
ttgttctctgatcccagtttta

SEQ ID NO: 939452 - DNA, 22 bp, Artificial Sequence
  chemically synthesized
ttctctgatcccagttttattc

SEQ ID NO: 939453 - DNA, 22 bp, Artificial Sequence
  chemically synthesized
tctgatcccagttttattcttt

SEQ ID NO: 939454 - DNA, 22 bp, Artificial Sequence
  chemically synthesized
tgatcccagttttattctttgt

SEQ ID NO: 939455 - DNA, 22 bp, Artificial Sequence
  chemically synthesized
atcccagttttattctttgtca

SEQ ID NO: 939456 - DNA, 22 bp, Artificial Sequence
  chemically synthesized
gcagaaaaaaaaagtgacaaag

SEQ ID NO: 939457 - DNA, 22 bp, Artificial Sequence
  chemically synthesized
ggcagaaaaaaaaagtgacaaa

SEQ ID NO: 939458 - DNA, 22 bp, Artificial Sequence
  chemically synthesized
tttggcagaaaaaaaaagtgac

SEQ ID NO: 939459 - DNA, 22 bp, Artificial Sequence
  chemically synthesized
tattctttgtcacttttttttt

SEQ ID NO: 939460 - DNA, 22 bp, Artificial Sequence
  chemically synthesized
attctttgtcactttttttttc

SEQ ID NO: 939461 - DNA, 22 bp, Artificial Sequence
  chemically synthesized
ttctttgtcactttttttttct

SEQ ID NO: 939462 - DNA, 22 bp, Artificial Sequence
  chemically synthesized
catctgtttggcagaaaaaaaa

SEQ ID NO: 939463 - DNA, 22 bp, Artificial Sequence
  chemically synthesized
tttgtcactttttttttctgcc

SEQ ID NO: 939464 - DNA, 22 bp, Artificial Sequence
  chemically synthesized
tgtcactttttttttctgccaa

SEQ ID NO: 939465 - DNA, 22 bp, Artificial Sequence
  chemically synthesized
gtcactttttttttctgccaaa

SEQ ID NO: 939466 - DNA, 22 bp, Artificial Sequence
  chemically synthesized
tcactttttttttctgccaaac

SEQ ID NO: 939467 - DNA, 22 bp, Artificial Sequence
  chemically synthesized
aaacatactgcatctgtttggc

SEQ ID NO: 939468 - DNA, 22 bp, Artificial Sequence
  chemically synthesized
tttttttctgccaaacagatgc

SEQ ID NO: 939469 - DNA, 22 bp, Artificial Sequence
  chemically synthesized
ttgaaacatactgcatctgttt

SEQ ID NO: 939470 - DNA, 22 bp, Artificial Sequence
  chemically synthesized
ttttttctgccaaacagatgca

SEQ ID NO: 939471 - DNA, 22 bp, Artificial Sequence
  chemically synthesized
tttttctgccaaacagatgcag

SEQ ID NO: 939472 - DNA, 22 bp, Artificial Sequence
  chemically synthesized
tgttgaaacatactgcatctgt

SEQ ID NO: 939473 - DNA, 22 bp, Artificial Sequence
  chemically synthesized
ttttctgccaaacagatgcagt

SEQ ID NO: 939474 - DNA, 22 bp, Artificial Sequence
  chemically synthesized
ctgttgaaacatactgcatctg

SEQ ID NO: 939475 - DNA, 22 bp, Artificial Sequence
  chemically synthesized
tttctgccaaacagatgcagta

SEQ ID NO: 939476 - DNA, 22 bp, Artificial Sequence
  chemically synthesized
tctgttgaaacatactgcatct

SEQ ID NO: 939477 - DNA, 22 bp, Artificial Sequence
  chemically synthesized
ttctgccaaacagatgcagtat

SEQ ID NO: 939478 - DNA, 22 bp, Artificial Sequence
  chemically synthesized
tctgccaaacagatgcagtatg

SEQ ID NO: 939479 - DNA, 22 bp, Artificial Sequence
  chemically synthesized
tttctgttgaaacatactgcat

SEQ ID NO: 939480 - DNA, 22 bp, Artificial Sequence
  chemically synthesized
ctgccaaacagatgcagtatgt

SEQ ID NO: 939481 - DNA, 22 bp, Artificial Sequence
  chemically synthesized
tgccaaacagatgcagtatgtt

SEQ ID NO: 939482 - DNA, 22 bp, Artificial Sequence
  chemically synthesized
ccaaacagatgcagtatgtttc

SEQ ID NO: 939483 - DNA, 22 bp, Artificial Sequence
  chemically synthesized
gagcactctttctgttgaaaca

SEQ ID NO: 939484 - DNA, 22 bp, Artificial Sequence
  chemically synthesized
ggagcactctttctgttgaaac

SEQ ID NO: 939485 - DNA, 22 bp, Artificial Sequence
  chemically synthesized
aagatttggagcactctttctg

SEQ ID NO: 939486 - DNA, 22 bp, Artificial Sequence
  chemically synthesized
caacagaaagagtgctccaaat

SEQ ID NO: 939487 - DNA, 22 bp, Artificial Sequence
  chemically synthesized
aacagaaagagtgctccaaatc

SEQ ID NO: 939488 - DNA, 22 bp, Artificial Sequence
  chemically synthesized
ataatgattaaagatttggagc

SEQ ID NO: 939489 - DNA, 22 bp, Artificial Sequence
  chemically synthesized
cataatgattaaagatttggag

SEQ ID NO: 939490 - DNA, 22 bp, Artificial Sequence
  chemically synthesized
tcataatgattaaagatttgga

SEQ ID NO: 939491 - DNA, 22 bp, Artificial Sequence
  chemically synthesized
ttcataatgattaaagatttgg

SEQ ID NO: 939492 - DNA, 22 bp, Artificial Sequence
  chemically synthesized
tgtttttcataatgattaaaga

SEQ ID NO: 939493 - DNA, 22 bp, Artificial Sequence
  chemically synthesized
caaatctttaatcattatgaaa

SEQ ID NO: 939494 - DNA, 22 bp, Artificial Sequence
  chemically synthesized
taatcattatgaaaaacacagt

SEQ ID NO: 939495 - DNA, 22 bp, Artificial Sequence
  chemically synthesized
aatcattatgaaaaacacagta

SEQ ID NO: 939496 - DNA, 22 bp, Artificial Sequence
  chemically synthesized
atcattatgaaaaacacagtac

SEQ ID NO: 939497 - DNA, 22 bp, Artificial Sequence
  chemically synthesized
aaatacaaggtcaaggtactgt

SEQ ID NO: 939498 - DNA, 22 bp, Artificial Sequence
  chemically synthesized
aaaatacaaggtcaaggtactg

SEQ ID NO: 939499 - DNA, 22 bp, Artificial Sequence
  chemically synthesized
taaaatacaaggtcaaggtact

SEQ ID NO: 939500 - DNA, 22 bp, Artificial Sequence
  chemically synthesized
tgaaaaacacagtaccttgacc

SEQ ID NO: 939501 - DNA, 22 bp, Artificial Sequence
  chemically synthesized
actttaaaatacaaggtcaagg

SEQ ID NO: 939502 - DNA, 22 bp, Artificial Sequence
  chemically synthesized
aactttaaaatacaaggtcaag

SEQ ID NO: 939503 - DNA, 22 bp, Artificial Sequence
  chemically synthesized
catttaactttaaaatacaagg

SEQ ID NO: 939504 - DNA, 22 bp, Artificial Sequence
  chemically synthesized
gaccttgtattttaaagttaaa

SEQ ID NO: 939505 - DNA, 22 bp, Artificial Sequence
  chemically synthesized
accttgtattttaaagttaaat

SEQ ID NO: 939506 - DNA, 22 bp, Artificial Sequence
  chemically synthesized
taatgccactccatttaacttt

SEQ ID NO: 939507 - DNA, 22 bp, Artificial Sequence
  chemically synthesized
ataatgccactccatttaactt

SEQ ID NO: 939508 - DNA, 22 bp, Artificial Sequence
  chemically synthesized
tataatgccactccatttaact

SEQ ID NO: 939509 - DNA, 22 bp, Artificial Sequence
  chemically synthesized
ttataatgccactccatttaac

SEQ ID NO: 939510 - DNA, 22 bp, Artificial Sequence
  chemically synthesized
gtattttaaagttaaatggagt

SEQ ID NO: 939511 - DNA, 22 bp, Artificial Sequence
  chemically synthesized
tattttaaagttaaatggagtg

SEQ ID NO: 939512 - DNA, 22 bp, Artificial Sequence
  chemically synthesized
atttttataatgccactccatt

SEQ ID NO: 939513 - DNA, 22 bp, Artificial Sequence
  chemically synthesized
aatttttataatgccactccat

SEQ ID NO: 939514 - DNA, 22 bp, Artificial Sequence
  chemically synthesized
taaagttaaatggagtggcatt

SEQ ID NO: 939515 - DNA, 22 bp, Artificial Sequence
  chemically synthesized
aaagttaaatggagtggcatta

SEQ ID NO: 939516 - DNA, 22 bp, Artificial Sequence
  chemically synthesized
aagttaaatggagtggcattat

SEQ ID NO: 939517 - DNA, 22 bp, Artificial Sequence
  chemically synthesized
aatggagtggcattataaaaat

SEQ ID NO: 939518 - DNA, 22 bp, Artificial Sequence
  chemically synthesized
tggaaatgagcaagaaccaatt

SEQ ID NO: 939519 - DNA, 22 bp, Artificial Sequence
  chemically synthesized
taaaaattaaattggttcttgc

SEQ ID NO: 939520 - DNA, 22 bp, Artificial Sequence
  chemically synthesized
gaggatattatggaaatgagca

SEQ ID NO: 939521 - DNA, 22 bp, Artificial Sequence
  chemically synthesized
agaggatattatggaaatgagc

SEQ ID NO: 939522 - DNA, 22 bp, Artificial Sequence
  chemically synthesized
aattggttcttgctcatttcca

SEQ ID NO: 939523 - DNA, 22 bp, Artificial Sequence
  chemically synthesized
tagaggatattatggaaatgag

SEQ ID NO: 939524 - DNA, 22 bp, Artificial Sequence
  chemically synthesized
ttagaggatattatggaaatga

SEQ ID NO: 939525 - DNA, 22 bp, Artificial Sequence
  chemically synthesized
tttagaggatattatggaaatg

SEQ ID NO: 939526 - DNA, 22 bp, Artificial Sequence
  chemically synthesized
gttcttgctcatttccataata

SEQ ID NO: 939527 - DNA, 22 bp, Artificial Sequence
  chemically synthesized
ttgctcatttccataatatcct

SEQ ID NO: 939528 - DNA, 22 bp, Artificial Sequence
  chemically synthesized
gctcatttccataatatcctct

SEQ ID NO: 939529 - DNA, 22 bp, Artificial Sequence
  chemically synthesized
ctcatttccataatatcctcta

SEQ ID NO: 939530 - DNA, 22 bp, Artificial Sequence
  chemically synthesized
ggcaaggctttttagaggatat

SEQ ID NO: 939531 - DNA, 22 bp, Artificial Sequence
  chemically synthesized
atttccataatatcctctaaaa

SEQ ID NO: 939532 - DNA, 22 bp, Artificial Sequence
  chemically synthesized
ggttaggcaaggctttttagag

SEQ ID NO: 939533 - DNA, 22 bp, Artificial Sequence
  chemically synthesized
ccataatatcctctaaaaagcc

SEQ ID NO: 939534 - DNA, 22 bp, Artificial Sequence
  chemically synthesized
taggttaggcaaggctttttag

SEQ ID NO: 939535 - DNA, 22 bp, Artificial Sequence
  chemically synthesized
cataatatcctctaaaaagcct

SEQ ID NO: 939536 - DNA, 22 bp, Artificial Sequence
  chemically synthesized
taaaaagccttgcctaacctag

SEQ ID NO: 939537 - DNA, 22 bp, Artificial Sequence
  chemically synthesized
aaaagccttgcctaacctagag

SEQ ID NO: 939538 - DNA, 22 bp, Artificial Sequence
  chemically synthesized
gcctaacctagagtggatgtcc

SEQ ID NO: 939539 - DNA, 22 bp, Artificial Sequence
  chemically synthesized
cctaacctagagtggatgtcct

SEQ ID NO: 939540 - DNA, 22 bp, Artificial Sequence
  chemically synthesized
acctagagtggatgtcctattt

SEQ ID NO: 939541 - DNA, 22 bp, Artificial Sequence
  chemically synthesized
gagtggatgtcctatttcttta

SEQ ID NO: 939542 - DNA, 22 bp, Artificial Sequence
  chemically synthesized
tttctttatctttcttgatgat

SEQ ID NO: 939543 - DNA, 22 bp, Artificial Sequence
  chemically synthesized
caggcatgagagatcatcaaga

SEQ ID NO: 939544 - DNA, 22 bp, Artificial Sequence
  chemically synthesized
gcaggcatgagagatcatcaag

SEQ ID NO: 939545 - DNA, 22 bp, Artificial Sequence
  chemically synthesized
ctttatctttcttgatgatctc

SEQ ID NO: 939546 - DNA, 22 bp, Artificial Sequence
  chemically synthesized
tttatctttcttgatgatctct

SEQ ID NO: 939547 - DNA, 22 bp, Artificial Sequence
  chemically synthesized
acttgcaggcatgagagatcat

SEQ ID NO: 939548 - DNA, 22 bp, Artificial Sequence
  chemically synthesized
tatctttcttgatgatctctca

SEQ ID NO: 939549 - DNA, 22 bp, Artificial Sequence
  chemically synthesized
atctttcttgatgatctctcat

SEQ ID NO: 939550 - DNA, 22 bp, Artificial Sequence
  chemically synthesized
tctttcttgatgatctctcatg

SEQ ID NO: 939551 - DNA, 22 bp, Artificial Sequence
  chemically synthesized
tcttgatgatctctcatgcctg

SEQ ID NO: 939552 - DNA, 22 bp, Artificial Sequence
  chemically synthesized
cttgatgatctctcatgcctgc

SEQ ID NO: 939553 - DNA, 22 bp, Artificial Sequence
  chemically synthesized
ttgatgatctctcatgcctgca

SEQ ID NO: 939554 - DNA, 22 bp, Artificial Sequence
  chemically synthesized
gatgatctctcatgcctgcaag

SEQ ID NO: 939555 - DNA, 22 bp, Artificial Sequence
  chemically synthesized
atgatctctcatgcctgcaagt

SEQ ID NO: 939556 - DNA, 22 bp, Artificial Sequence
  chemically synthesized
agcaaagaaaaacgagctgact

SEQ ID NO: 939557 - DNA, 22 bp, Artificial Sequence
  chemically synthesized
tcatgcctgcaagtcagctcgt

SEQ ID NO: 939558 - DNA, 22 bp, Artificial Sequence
  chemically synthesized
cagcaaagaaaaacgagctgac

SEQ ID NO: 939559 - DNA, 22 bp, Artificial Sequence
  chemically synthesized
atgcctgcaagtcagctcgttt

SEQ ID NO: 939560 - DNA, 22 bp, Artificial Sequence
  chemically synthesized
caagtcagctcgtttttctttg

SEQ ID NO: 939561 - DNA, 22 bp, Artificial Sequence
  chemically synthesized
gtttttctttgctgaagactgc

SEQ ID NO: 939562 - DNA, 22 bp, Artificial Sequence
  chemically synthesized
ttctttgctgaagactgcaccc

SEQ ID NO: 939563 - DNA, 22 bp, Artificial Sequence
  chemically synthesized
tctttgctgaagactgcacccc

SEQ ID NO: 939564 - DNA, 22 bp, Artificial Sequence
  chemically synthesized
ctttgctgaagactgcacccca

SEQ ID NO: 939565 - DNA, 22 bp, Artificial Sequence
  chemically synthesized
tttgctgaagactgcaccccac

SEQ ID NO: 939566 - DNA, 22 bp, Artificial Sequence
  chemically synthesized
tgctgaagactgcaccccactg

SEQ ID NO: 939567 - DNA, 22 bp, Artificial Sequence
  chemically synthesized
gagtgcatgcagcagtggggtg

SEQ ID NO: 939568 - DNA, 22 bp, Artificial Sequence
  chemically synthesized
gctgaagactgcaccccactgc

SEQ ID NO: 939569 - DNA, 22 bp, Artificial Sequence
  chemically synthesized
agagtgcatgcagcagtggggt

SEQ ID NO: 939570 - DNA, 22 bp, Artificial Sequence
  chemically synthesized
ctgaagactgcaccccactgct

SEQ ID NO: 939571 - DNA, 22 bp, Artificial Sequence
  chemically synthesized
tagagtgcatgcagcagtgggg

SEQ ID NO: 939572 - DNA, 22 bp, Artificial Sequence
  chemically synthesized
ttagagtgcatgcagcagtggg

SEQ ID NO: 939573 - DNA, 22 bp, Artificial Sequence
  chemically synthesized
aagactgcaccccactgctgca

SEQ ID NO: 939574 - DNA, 22 bp, Artificial Sequence
  chemically synthesized
caccccactgctgcatgcactc

SEQ ID NO: 939575 - DNA, 22 bp, Artificial Sequence
  chemically synthesized
atggaacttttagagtgcatgc

SEQ ID NO: 939576 - DNA, 22 bp, Artificial Sequence
  chemically synthesized
aatggaacttttagagtgcatg

SEQ ID NO: 939577 - DNA, 22 bp, Artificial Sequence
  chemically synthesized
taatggaacttttagagtgcat

SEQ ID NO: 939578 - DNA, 22 bp, Artificial Sequence
  chemically synthesized
gattttaatggaacttttagag

SEQ ID NO: 939579 - DNA, 22 bp, Artificial Sequence
  chemically synthesized
ctgcatgcactctaaaagttcc

SEQ ID NO: 939580 - DNA, 22 bp, Artificial Sequence
  chemically synthesized
catgcactctaaaagttccatt

SEQ ID NO: 939581 - DNA, 22 bp, Artificial Sequence
  chemically synthesized
taaaagttccattaaaatctag

SEQ ID NO: 939582 - DNA, 22 bp, Artificial Sequence
  chemically synthesized
aaagttccattaaaatctaggg

SEQ ID NO: 939583 - DNA, 22 bp, Artificial Sequence
  chemically synthesized
cattaaaatctagggcatcatc

SEQ ID NO: 939584 - DNA, 22 bp, Artificial Sequence
  chemically synthesized
cagataagaatgagtgatgatg

SEQ ID NO: 939585 - DNA, 22 bp, Artificial Sequence
  chemically synthesized
aaatctagggcatcatcactca

SEQ ID NO: 939586 - DNA, 22 bp, Artificial Sequence
  chemically synthesized
ctgcagataagaatgagtgatg

SEQ ID NO: 939587 - DNA, 22 bp, Artificial Sequence
  chemically synthesized
gggcatcatcactcattcttat

SEQ ID NO: 939588 - DNA, 22 bp, Artificial Sequence
  chemically synthesized
agcagcctgctgcagataagaa

SEQ ID NO: 939589 - DNA, 22 bp, Artificial Sequence
  chemically synthesized
ctcagcagcctgctgcagataa

SEQ ID NO: 939590 - DNA, 22 bp, Artificial Sequence
  chemically synthesized
attcttatctgcagcaggctgc

SEQ ID NO: 939591 - DNA, 22 bp, Artificial Sequence
  chemically synthesized
gtatggcactgctcagcagcct

SEQ ID NO: 939592 - DNA, 22 bp, Artificial Sequence
  chemically synthesized
ttatctgcagcaggctgctgag

SEQ ID NO: 939593 - DNA, 22 bp, Artificial Sequence
  chemically synthesized
atctgcagcaggctgctgagca

SEQ ID NO: 939594 - DNA, 22 bp, Artificial Sequence
  chemically synthesized
ctggtatggcactgctcagcag

SEQ ID NO: 939595 - DNA, 22 bp, Artificial Sequence
  chemically synthesized
tctgcagcaggctgctgagcag

SEQ ID NO: 939596 - DNA, 22 bp, Artificial Sequence
  chemically synthesized
cagcaggctgctgagcagtgcc

SEQ ID NO: 939597 - DNA, 22 bp, Artificial Sequence
  chemically synthesized
catgcagttgctggtatggcac

SEQ ID NO: 939598 - DNA, 22 bp, Artificial Sequence
  chemically synthesized
gcatgcagttgctggtatggca

SEQ ID NO: 939599 - DNA, 22 bp, Artificial Sequence
  chemically synthesized
ctgagcagtgccataccagcaa

SEQ ID NO: 939600 - DNA, 22 bp, Artificial Sequence
  chemically synthesized
gtttgcatgcagttgctggtat

SEQ ID NO: 939601 - DNA, 22 bp, Artificial Sequence
  chemically synthesized
agcagtgccataccagcaactg

SEQ ID NO: 939602 - DNA, 22 bp, Artificial Sequence
  chemically synthesized
aggctagtttgcatgcagttgc

SEQ ID NO: 939603 - DNA, 22 bp, Artificial Sequence
  chemically synthesized
gaggctagtttgcatgcagttg

SEQ ID NO: 939604 - DNA, 22 bp, Artificial Sequence
  chemically synthesized
tgaggctagtttgcatgcagtt

SEQ ID NO: 939605 - DNA, 22 bp, Artificial Sequence
  chemically synthesized
tcctttgaggctagtttgcatg

SEQ ID NO: 939606 - DNA, 22 bp, Artificial Sequence
  chemically synthesized
atattgtcctttgaggctagtt

SEQ ID NO: 939607 - DNA, 22 bp, Artificial Sequence
  chemically synthesized
catgcaaactagcctcaaagga

SEQ ID NO: 939608 - DNA, 22 bp, Artificial Sequence
  chemically synthesized
gcctcaaaggacaatattagct

SEQ ID NO: 939609 - DNA, 22 bp, Artificial Sequence
  chemically synthesized
aaaggacaatattagctatata

SEQ ID NO: 939610 - DNA, 22 bp, Artificial Sequence
  chemically synthesized
cagaatgacaatgtatatagct

SEQ ID NO: 939611 - DNA, 22 bp, Artificial Sequence
  chemically synthesized
acagaatgacaatgtatatagc

SEQ ID NO: 939612 - DNA, 22 bp, Artificial Sequence
  chemically synthesized
tacagaatgacaatgtatatag

SEQ ID NO: 939613 - DNA, 22 bp, Artificial Sequence
  chemically synthesized
tttacagaatgacaatgtatat

SEQ ID NO: 939614 - DNA, 22 bp, Artificial Sequence
  chemically synthesized
tctttacagaatgacaatgtat

SEQ ID NO: 939615 - DNA, 22 bp, Artificial Sequence
  chemically synthesized
ctctttacagaatgacaatgta

SEQ ID NO: 939616 - DNA, 22 bp, Artificial Sequence
  chemically synthesized
gctatatacattgtcattctgt

SEQ ID NO: 939617 - DNA, 22 bp, Artificial Sequence
  chemically synthesized
tatacattgtcattctgtaaag

SEQ ID NO: 939618 - DNA, 22 bp, Artificial Sequence
  chemically synthesized
tcattctgtaaagagaagattc

SEQ ID NO: 939619 - DNA, 22 bp, Artificial Sequence
  chemically synthesized
tgtaaagagaagattccacctg

SEQ ID NO: 939620 - DNA, 22 bp, Artificial Sequence
  chemically synthesized
taaagagaagattccacctgga

SEQ ID NO: 939621 - DNA, 22 bp, Artificial Sequence
  chemically synthesized
ggagataaggtaagatccaggt

SEQ ID NO: 939622 - DNA, 22 bp, Artificial Sequence
  chemically synthesized
tgggagataaggtaagatccag

SEQ ID NO: 939623 - DNA, 22 bp, Artificial Sequence
  chemically synthesized
cacctggatcttaccttatctc

SEQ ID NO: 939624 - DNA, 22 bp, Artificial Sequence
  chemically synthesized
gatatgctctgggagataaggt

SEQ ID NO: 939625 - DNA, 22 bp, Artificial Sequence
  chemically synthesized
gatcttaccttatctcccagag

SEQ ID NO: 939626 - DNA, 22 bp, Artificial Sequence
  chemically synthesized
gaaaggctagatatgctctggg

SEQ ID NO: 939627 - DNA, 22 bp, Artificial Sequence
  chemically synthesized
accttatctcccagagcatatc

SEQ ID NO: 939628 - DNA, 22 bp, Artificial Sequence
  chemically synthesized
ccttatctcccagagcatatct

SEQ ID NO: 939629 - DNA, 22 bp, Artificial Sequence
  chemically synthesized
atctcccagagcatatctagcc

SEQ ID NO: 939630 - DNA, 22 bp, Artificial Sequence
  chemically synthesized
tctcccagagcatatctagcct

SEQ ID NO: 939631 - DNA, 22 bp, Artificial Sequence
  chemically synthesized
ggagccatgttggaaaggctag

SEQ ID NO: 939632 - DNA, 22 bp, Artificial Sequence
  chemically synthesized
ccagagcatatctagcctttcc

SEQ ID NO: 939633 - DNA, 22 bp, Artificial Sequence
  chemically synthesized
acactgggagccatgttggaaa

SEQ ID NO: 939634 - DNA, 22 bp, Artificial Sequence
  chemically synthesized
gcctttccaacatggctcccag

SEQ ID NO: 939635 - DNA, 22 bp, Artificial Sequence
  chemically synthesized
atagcgctgacactgggagcca

SEQ ID NO: 939636 - DNA, 22 bp, Artificial Sequence
  chemically synthesized
tccaacatggctcccagtgtca

SEQ ID NO: 939637 - DNA, 22 bp, Artificial Sequence
  chemically synthesized
ccaacatggctcccagtgtcag

SEQ ID NO: 939638 - DNA, 22 bp, Artificial Sequence
  chemically synthesized
caacatggctcccagtgtcagc

SEQ ID NO: 939639 - DNA, 22 bp, Artificial Sequence
  chemically synthesized
caagagacccattcatagcgct

SEQ ID NO: 939640 - DNA, 22 bp, Artificial Sequence
  chemically synthesized
ttgcaagagacccattcatagc

SEQ ID NO: 939641 - DNA, 22 bp, Artificial Sequence
  chemically synthesized
ccagtgtcagcgctatgaatgg

SEQ ID NO: 939642 - DNA, 22 bp, Artificial Sequence
  chemically synthesized
ctgttgcaagagacccattcat

SEQ ID NO: 939643 - DNA, 22 bp, Artificial Sequence
  chemically synthesized
gctgttgcaagagacccattca

SEQ ID NO: 939644 - DNA, 22 bp, Artificial Sequence
  chemically synthesized
agtaatccttgctgttgcaaga

SEQ ID NO: 939645 - DNA, 22 bp, Artificial Sequence
  chemically synthesized
aagtaatccttgctgttgcaag

SEQ ID NO: 939646 - DNA, 22 bp, Artificial Sequence
  chemically synthesized
tgaatgggtctcttgcaacagc

SEQ ID NO: 939647 - DNA, 22 bp, Artificial Sequence
  chemically synthesized
taagtaatccttgctgttgcaa

SEQ ID NO: 939648 - DNA, 22 bp, Artificial Sequence
  chemically synthesized
ttaagtaatccttgctgttgca

SEQ ID NO: 939649 - DNA, 22 bp, Artificial Sequence
  chemically synthesized
tttaagtaatccttgctgttgc

SEQ ID NO: 939650 - DNA, 22 bp, Artificial Sequence
  chemically synthesized
ctttttaagtaatccttgctgt

SEQ ID NO: 939651 - DNA, 22 bp, Artificial Sequence
  chemically synthesized
ttgcaacagcaaggattactta

SEQ ID NO: 939652 - DNA, 22 bp, Artificial Sequence
  chemically synthesized
gtaaattgctttttaagtaatc

SEQ ID NO: 939653 - DNA, 22 bp, Artificial Sequence
  chemically synthesized
gcaacagcaaggattacttaaa

SEQ ID NO: 939654 - DNA, 22 bp, Artificial Sequence
  chemically synthesized
caacagcaaggattacttaaaa

SEQ ID NO: 939655 - DNA, 22 bp, Artificial Sequence
  chemically synthesized
ctggtaaattgctttttaagta

SEQ ID NO: 939656 - DNA, 22 bp, Artificial Sequence
  chemically synthesized
gctggtaaattgctttttaagt

SEQ ID NO: 939657 - DNA, 22 bp, Artificial Sequence
  chemically synthesized
ttgctggtaaattgctttttaa

SEQ ID NO: 939658 - DNA, 22 bp, Artificial Sequence
  chemically synthesized
cttgctggtaaattgcttttta

SEQ ID NO: 939659 - DNA, 22 bp, Artificial Sequence
  chemically synthesized
atttcttgctggtaaattgctt

SEQ ID NO: 939660 - DNA, 22 bp, Artificial Sequence
  chemically synthesized
cttaaaaagcaatttaccagca

SEQ ID NO: 939661 - DNA, 22 bp, Artificial Sequence
  chemically synthesized
aaaaagcaatttaccagcaaga

SEQ ID NO: 939662 - DNA, 22 bp, Artificial Sequence
  chemically synthesized
aaaagcaatttaccagcaagaa

SEQ ID NO: 939663 - DNA, 22 bp, Artificial Sequence
  chemically synthesized
taaaaagctaatttcttgctgg

SEQ ID NO: 939664 - DNA, 22 bp, Artificial Sequence
  chemically synthesized
accagcaagaaattagcttttt

SEQ ID NO: 939665 - DNA, 22 bp, Artificial Sequence
  chemically synthesized
ccagcaagaaattagcttttta

SEQ ID NO: 939666 - DNA, 22 bp, Artificial Sequence
  chemically synthesized
ataaagggtgtcctataaaaag

SEQ ID NO: 939667 - DNA, 22 bp, Artificial Sequence
  chemically synthesized
aataaagggtgtcctataaaaa

SEQ ID NO: 939668 - DNA, 22 bp, Artificial Sequence
  chemically synthesized
gctttttataggacacccttta

SEQ ID NO: 939669 - DNA, 22 bp, Artificial Sequence
  chemically synthesized
acaccaagtttaataaagggtg

SEQ ID NO: 939670 - DNA, 22 bp, Artificial Sequence
  chemically synthesized
tttataggacaccctttattaa

SEQ ID NO: 939671 - DNA, 22 bp, Artificial Sequence
  chemically synthesized
ttataggacaccctttattaaa

SEQ ID NO: 939672 - DNA, 22 bp, Artificial Sequence
  chemically synthesized
tataggacaccctttattaaac

SEQ ID NO: 939673 - DNA, 22 bp, Artificial Sequence
  chemically synthesized
atctcacaccaagtttaataaa

SEQ ID NO: 939674 - DNA, 22 bp, Artificial Sequence
  chemically synthesized
ataggacaccctttattaaact

SEQ ID NO: 939675 - DNA, 22 bp, Artificial Sequence
  chemically synthesized
taggacaccctttattaaactt

SEQ ID NO: 939676 - DNA, 22 bp, Artificial Sequence
  chemically synthesized
gctcatctcacaccaagtttaa

SEQ ID NO: 939677 - DNA, 22 bp, Artificial Sequence
  chemically synthesized
aggatgctagctcatctcacac

SEQ ID NO: 939678 - DNA, 22 bp, Artificial Sequence
  chemically synthesized
tattaaacttggtgtgagatga

SEQ ID NO: 939679 - DNA, 22 bp, Artificial Sequence
  chemically synthesized
attaaacttggtgtgagatgag

SEQ ID NO: 939680 - DNA, 22 bp, Artificial Sequence
  chemically synthesized
ttaaacttggtgtgagatgagc

SEQ ID NO: 939681 - DNA, 22 bp, Artificial Sequence
  chemically synthesized
aacttggtgtgagatgagctag

SEQ ID NO: 939682 - DNA, 22 bp, Artificial Sequence
  chemically synthesized
ggtgtgagatgagctagcatcc

SEQ ID NO: 939683 - DNA, 22 bp, Artificial Sequence
  chemically synthesized
gtgtgagatgagctagcatcct

SEQ ID NO: 939684 - DNA, 22 bp, Artificial Sequence
  chemically synthesized
aagggggaaattcaggatgcta

SEQ ID NO: 939685 - DNA, 22 bp, Artificial Sequence
  chemically synthesized
agtgggctcaagggggaaattc

SEQ ID NO: 939686 - DNA, 22 bp, Artificial Sequence
  chemically synthesized
gcatcctgaatttcccccttga

SEQ ID NO: 939687 - DNA, 22 bp, Artificial Sequence
  chemically synthesized
aatttcccccttgagcccactg

SEQ ID NO: 939688 - DNA, 22 bp, Artificial Sequence
  chemically synthesized
gcccgcgtggtctcagtgggct

SEQ ID NO: 939689 - DNA, 22 bp, Artificial Sequence
  chemically synthesized
ggcccgcgtggtctcagtgggc

SEQ ID NO: 939690 - DNA, 22 bp, Artificial Sequence
  chemically synthesized
tggcccgcgtggtctcagtggg

SEQ ID NO: 939691 - DNA, 22 bp, Artificial Sequence
  chemically synthesized
ttggcccgcgtggtctcagtgg

SEQ ID NO: 939692 - DNA, 22 bp, Artificial Sequence
  chemically synthesized
cccccttgagcccactgagacc

SEQ ID NO: 939693 - DNA, 22 bp, Artificial Sequence
  chemically synthesized
ccccttgagcccactgagacca

SEQ ID NO: 939694 - DNA, 22 bp, Artificial Sequence
  chemically synthesized
gagcccactgagaccacgcggg

SEQ ID NO: 939695 - DNA, 22 bp, Artificial Sequence
  chemically synthesized
agcccactgagaccacgcgggc

SEQ ID NO: 939696 - DNA, 22 bp, Artificial Sequence
  chemically synthesized
aaatgaaacagcttttggcccg

SEQ ID NO: 939697 - DNA, 22 bp, Artificial Sequence
  chemically synthesized
aaaatgaaacagcttttggccc

SEQ ID NO: 939698 - DNA, 22 bp, Artificial Sequence
  chemically synthesized
agaccacgcgggccaaaagctg

SEQ ID NO: 939699 - DNA, 22 bp, Artificial Sequence
  chemically synthesized
tagtacagtatttaaaatgaaa

SEQ ID NO: 939700 - DNA, 22 bp, Artificial Sequence
  chemically synthesized
atagtacagtatttaaaatgaa

SEQ ID NO: 939701 - DNA, 22 bp, Artificial Sequence
  chemically synthesized
tatagtacagtatttaaaatga

SEQ ID NO: 939702 - DNA, 22 bp, Artificial Sequence
  chemically synthesized
ttatagtacagtatttaaaatg

SEQ ID NO: 939703 - DNA, 22 bp, Artificial Sequence
  chemically synthesized
tttatagtacagtatttaaaat

SEQ ID NO: 939704 - DNA, 22 bp, Artificial Sequence
  chemically synthesized
tttcattttaaatactgtacta

SEQ ID NO: 939705 - DNA, 22 bp, Artificial Sequence
  chemically synthesized
cattttaaatactgtactataa

SEQ ID NO: 939706 - DNA, 22 bp, Artificial Sequence
  chemically synthesized
attttaaatactgtactataaa

SEQ ID NO: 939707 - DNA, 22 bp, Artificial Sequence
  chemically synthesized
taaatactgtactataaaaaat

SEQ ID NO: 939708 - DNA, 22 bp, Artificial Sequence
  chemically synthesized
aaatactgtactataaaaaatt

SEQ ID NO: 939709 - DNA, 22 bp, Artificial Sequence
  chemically synthesized
aatactgtactataaaaaatta

SEQ ID NO: 939710 - DNA, 22 bp, Artificial Sequence
  chemically synthesized
tactataaaaaattatacgtat

SEQ ID NO: 939711 - DNA, 22 bp, Artificial Sequence
  chemically synthesized
taaaaaattatacgtattcctc

SEQ ID NO: 939712 - DNA, 22 bp, Artificial Sequence
  chemically synthesized
atcaagatcagagaggaatacg

SEQ ID NO: 939713 - DNA, 22 bp, Artificial Sequence
  chemically synthesized
tacgtattcctctctgatcttg

SEQ ID NO: 939714 - DNA, 22 bp, Artificial Sequence
  chemically synthesized
ctctctgatcttgatgaattct

SEQ ID NO: 939715 - DNA, 22 bp, Artificial Sequence
  chemically synthesized
tctgatcttgatgaattctttc

SEQ ID NO: 939716 - DNA, 22 bp, Artificial Sequence
  chemically synthesized
tgatcttgatgaattctttctt

SEQ ID NO: 939717 - DNA, 22 bp, Artificial Sequence
  chemically synthesized
atcttgatgaattctttcttgg

SEQ ID NO: 939718 - DNA, 22 bp, Artificial Sequence
  chemically synthesized
ataacacatccatcccaagaaa

SEQ ID NO: 939719 - DNA, 22 bp, Artificial Sequence
  chemically synthesized
gatgaattctttcttgggatgg

SEQ ID NO: 939720 - DNA, 22 bp, Artificial Sequence
  chemically synthesized
atgaattctttcttgggatgga

SEQ ID NO: 939721 - DNA, 22 bp, Artificial Sequence
  chemically synthesized
tcctaataacacatccatccca

SEQ ID NO: 939722 - DNA, 22 bp, Artificial Sequence
  chemically synthesized
ttatcctaataacacatccatc

SEQ ID NO: 939723 - DNA, 22 bp, Artificial Sequence
  chemically synthesized
attatcctaataacacatccat

SEQ ID NO: 939724 - DNA, 22 bp, Artificial Sequence
  chemically synthesized
tttcttgggatggatgtgttat

SEQ ID NO: 939725 - DNA, 22 bp, Artificial Sequence
  chemically synthesized
tcttgggatggatgtgttatta

SEQ ID NO: 939726 - DNA, 22 bp, Artificial Sequence
  chemically synthesized
cttgggatggatgtgttattag

SEQ ID NO: 939727 - DNA, 22 bp, Artificial Sequence
  chemically synthesized
ttgggatggatgtgttattagg

SEQ ID NO: 939728 - DNA, 22 bp, Artificial Sequence
  chemically synthesized
aagccttattatcctaataaca

SEQ ID NO: 939729 - DNA, 22 bp, Artificial Sequence
  chemically synthesized
gggatggatgtgttattaggat

SEQ ID NO: 939730 - DNA, 22 bp, Artificial Sequence
  chemically synthesized
tcaagccttattatcctaataa

SEQ ID NO: 939731 - DNA, 22 bp, Artificial Sequence
  chemically synthesized
ggatggatgtgttattaggata

SEQ ID NO: 939732 - DNA, 22 bp, Artificial Sequence
  chemically synthesized
aactctcaagccttattatcct

SEQ ID NO: 939733 - DNA, 22 bp, Artificial Sequence
  chemically synthesized
ttcaactctcaagccttattat

SEQ ID NO: 939734 - DNA, 22 bp, Artificial Sequence
  chemically synthesized
ttaggataataaggcttgagag

SEQ ID NO: 939735 - DNA, 22 bp, Artificial Sequence
  chemically synthesized
gcccattgttcaactctcaagc

SEQ ID NO: 939736 - DNA, 22 bp, Artificial Sequence
  chemically synthesized
ggataataaggcttgagagttg

SEQ ID NO: 939737 - DNA, 22 bp, Artificial Sequence
  chemically synthesized
gagagttgaacaatgggctagg

SEQ ID NO: 939738 - DNA, 22 bp, Artificial Sequence
  chemically synthesized
agagttgaacaatgggctagga

SEQ ID NO: 939739 - DNA, 22 bp, Artificial Sequence
  chemically synthesized
aacaatgggctaggatttggca

SEQ ID NO: 939740 - DNA, 22 bp, Artificial Sequence
  chemically synthesized
aggacaacaggaacagtgccaa

SEQ ID NO: 939741 - DNA, 22 bp, Artificial Sequence
  chemically synthesized
caggacaacaggaacagtgcca

SEQ ID NO: 939742 - DNA, 22 bp, Artificial Sequence
  chemically synthesized
acatttcaggacaacaggaaca

SEQ ID NO: 939743 - DNA, 22 bp, Artificial Sequence
  chemically synthesized
ggatttggcactgttcctgttg

SEQ ID NO: 939744 - DNA, 22 bp, Artificial Sequence
  chemically synthesized
cacatttcaggacaacaggaac

SEQ ID NO: 939745 - DNA, 22 bp, Artificial Sequence
  chemically synthesized
ttcacatttcaggacaacagga

SEQ ID NO: 939746 - DNA, 22 bp, Artificial Sequence
  chemically synthesized
cttcacatttcaggacaacagg

SEQ ID NO: 939747 - DNA, 22 bp, Artificial Sequence
  chemically synthesized
ggcactgttcctgttgtcctga

SEQ ID NO: 939748 - DNA, 22 bp, Artificial Sequence
  chemically synthesized
gcactgttcctgttgtcctgaa

SEQ ID NO: 939749 - DNA, 22 bp, Artificial Sequence
  chemically synthesized
ttcctgttgtcctgaaatgtga

SEQ ID NO: 939750 - DNA, 22 bp, Artificial Sequence
  chemically synthesized
catcaacatttcttcacatttc

SEQ ID NO: 939751 - DNA, 22 bp, Artificial Sequence
  chemically synthesized
ctgttgtcctgaaatgtgaaga

SEQ ID NO: 939752 - DNA, 22 bp, Artificial Sequence
  chemically synthesized
ttgtcctgaaatgtgaagaaat

SEQ ID NO: 939753 - DNA, 22 bp, Artificial Sequence
  chemically synthesized
tcctgaaatgtgaagaaatgtt

SEQ ID NO: 939754 - DNA, 22 bp, Artificial Sequence
  chemically synthesized
agtaagttacatcaacatttct

SEQ ID NO: 939755 - DNA, 22 bp, Artificial Sequence
  chemically synthesized
aaatgtgaagaaatgttgatgt

SEQ ID NO: 939756 - DNA, 22 bp, Artificial Sequence
  chemically synthesized
attgagtaagttacatcaacat

SEQ ID NO: 939757 - DNA, 22 bp, Artificial Sequence
  chemically synthesized
gggaacatctcattgagtaagt

SEQ ID NO: 939758 - DNA, 22 bp, Artificial Sequence
  chemically synthesized
atgtaacttactcaatgagatg

SEQ ID NO: 939759 - DNA, 22 bp, Artificial Sequence
  chemically synthesized
ccagtggttagggaacatctca

SEQ ID NO: 939760 - DNA, 22 bp, Artificial Sequence
  chemically synthesized
ttcccagtggttagggaacatc

SEQ ID NO: 939761 - DNA, 22 bp, Artificial Sequence
  chemically synthesized
actcaatgagatgttccctaac

SEQ ID NO: 939762 - DNA, 22 bp, Artificial Sequence
  chemically synthesized
ctcaatgagatgttccctaacc

SEQ ID NO: 939763 - DNA, 22 bp, Artificial Sequence
  chemically synthesized
aatgagatgttccctaaccact

SEQ ID NO: 939764 - DNA, 22 bp, Artificial Sequence
  chemically synthesized
cctaaccactgggaatagttca

SEQ ID NO: 939765 - DNA, 22 bp, Artificial Sequence
  chemically synthesized
gtgtccccaggcagtgaactat

SEQ ID NO: 939766 - DNA, 22 bp, Artificial Sequence
  chemically synthesized
accactgggaatagttcactgc

SEQ ID NO: 939767 - DNA, 22 bp, Artificial Sequence
  chemically synthesized
tggtgtccccaggcagtgaact

SEQ ID NO: 939768 - DNA, 22 bp, Artificial Sequence
  chemically synthesized
ctctggtgtccccaggcagtga

SEQ ID NO: 939769 - DNA, 22 bp, Artificial Sequence
  chemically synthesized
tcctctggtgtccccaggcagt

SEQ ID NO: 939770 - DNA, 22 bp, Artificial Sequence
  chemically synthesized
ggaatagttcactgcctgggga

SEQ ID NO: 939771 - DNA, 22 bp, Artificial Sequence
  chemically synthesized
tagttctcctctggtgtcccca

SEQ ID NO: 939772 - DNA, 22 bp, Artificial Sequence
  chemically synthesized
tgtagttctcctctggtgtccc

SEQ ID NO: 939773 - DNA, 22 bp, Artificial Sequence
  chemically synthesized
actgcctggggacaccagagga

SEQ ID NO: 939774 - DNA, 22 bp, Artificial Sequence
  chemically synthesized
cctggggacaccagaggagaac

SEQ ID NO: 939775 - DNA, 22 bp, Artificial Sequence
  chemically synthesized
ccccatctctgtagttctcctc

SEQ ID NO: 939776 - DNA, 22 bp, Artificial Sequence
  chemically synthesized
gggacaccagaggagaactaca

SEQ ID NO: 939777 - DNA, 22 bp, Artificial Sequence
  chemically synthesized
accaatctcccccatctctgta

SEQ ID NO: 939778 - DNA, 22 bp, Artificial Sequence
  chemically synthesized
caccaatctcccccatctctgt

SEQ ID NO: 939779 - DNA, 22 bp, Artificial Sequence
  chemically synthesized
tcaccaatctcccccatctctg

SEQ ID NO: 939780 - DNA, 22 bp, Artificial Sequence
  chemically synthesized
tttcaccaatctcccccatctc

SEQ ID NO: 939781 - DNA, 22 bp, Artificial Sequence
  chemically synthesized
cagagatgggggagattggtga

SEQ ID NO: 939782 - DNA, 22 bp, Artificial Sequence
  chemically synthesized
taccccagctctttcaccaatc

SEQ ID NO: 939783 - DNA, 22 bp, Artificial Sequence
  chemically synthesized
ataccccagctctttcaccaat

SEQ ID NO: 939784 - DNA, 22 bp, Artificial Sequence
  chemically synthesized
tataccccagctctttcaccaa

SEQ ID NO: 939785 - DNA, 22 bp, Artificial Sequence
  chemically synthesized
tatctttataccccagctcttt

SEQ ID NO: 939786 - DNA, 22 bp, Artificial Sequence
  chemically synthesized
gtatctttataccccagctctt

SEQ ID NO: 939787 - DNA, 22 bp, Artificial Sequence
  chemically synthesized
tgtatctttataccccagctct

SEQ ID NO: 939788 - DNA, 22 bp, Artificial Sequence
  chemically synthesized
ttgtatctttataccccagctc

SEQ ID NO: 939789 - DNA, 22 bp, Artificial Sequence
  chemically synthesized
tttgtatctttataccccagct

SEQ ID NO: 939790 - DNA, 22 bp, Artificial Sequence
  chemically synthesized
ttttttgtatctttatacccca

SEQ ID NO: 939791 - DNA, 22 bp, Artificial Sequence
  chemically synthesized
attttttgtatctttatacccc

SEQ ID NO: 939792 - DNA, 22 bp, Artificial Sequence
  chemically synthesized
gtgaaagagctggggtataaag

SEQ ID NO: 939793 - DNA, 22 bp, Artificial Sequence
  chemically synthesized
tattttttgtatctttataccc

SEQ ID NO: 939794 - DNA, 22 bp, Artificial Sequence
  chemically synthesized
tttattttttgtatctttatac

SEQ ID NO: 939795 - DNA, 22 bp, Artificial Sequence
  chemically synthesized
gggtataaagatacaaaaaata

SEQ ID NO: 939796 - DNA, 22 bp, Artificial Sequence
  chemically synthesized
atataataaagaaggaaaaggt

SEQ ID NO: 939797 - DNA, 22 bp, Artificial Sequence
  chemically synthesized
gatataataaagaaggaaaagg

SEQ ID NO: 939798 - DNA, 22 bp, Artificial Sequence
  chemically synthesized
ccaccttttccttctttattat

SEQ ID NO: 939799 - DNA, 22 bp, Artificial Sequence
  chemically synthesized
gaaaaatgatatttgatataat

SEQ ID NO: 939800 - DNA, 22 bp, Artificial Sequence
  chemically synthesized
agaaaaatgatatttgatataa

SEQ ID NO: 939801 - DNA, 22 bp, Artificial Sequence
  chemically synthesized
ttccttctttattatatcaaat

SEQ ID NO: 939802 - DNA, 22 bp, Artificial Sequence
  chemically synthesized
tccttctttattatatcaaata

SEQ ID NO: 939803 - DNA, 22 bp, Artificial Sequence
  chemically synthesized
ccttctttattatatcaaatat

SEQ ID NO: 939804 - DNA, 22 bp, Artificial Sequence
  chemically synthesized
cttctttattatatcaaatatc

SEQ ID NO: 939805 - DNA, 22 bp, Artificial Sequence
  chemically synthesized
gtttagaaaaatgatatttgat

SEQ ID NO: 939806 - DNA, 22 bp, Artificial Sequence
  chemically synthesized
ctttattatatcaaatatcatt

SEQ ID NO: 939807 - DNA, 22 bp, Artificial Sequence
  chemically synthesized
ttggtttagaaaaatgatattt

SEQ ID NO: 939808 - DNA, 22 bp, Artificial Sequence
  chemically synthesized
tttattatatcaaatatcattt

SEQ ID NO: 939809 - DNA, 22 bp, Artificial Sequence
  chemically synthesized
tattatatcaaatatcattttt

SEQ ID NO: 939810 - DNA, 22 bp, Artificial Sequence
  chemically synthesized
ttattggtttagaaaaatgata

SEQ ID NO: 939811 - DNA, 22 bp, Artificial Sequence
  chemically synthesized
attatatcaaatatcatttttc

SEQ ID NO: 939812 - DNA, 22 bp, Artificial Sequence
  chemically synthesized
ttatatcaaatatcatttttct

SEQ ID NO: 939813 - DNA, 22 bp, Artificial Sequence
  chemically synthesized
tgttattggtttagaaaaatga

SEQ ID NO: 939814 - DNA, 22 bp, Artificial Sequence
  chemically synthesized
tatcaaatatcatttttctaaa

SEQ ID NO: 939815 - DNA, 22 bp, Artificial Sequence
  chemically synthesized
ccacagaagtactctgttattg

SEQ ID NO: 939816 - DNA, 22 bp, Artificial Sequence
  chemically synthesized
ttctaaaccaataacagagtac

SEQ ID NO: 939817 - DNA, 22 bp, Artificial Sequence
  chemically synthesized
gttcccacagaagtactctgtt

SEQ ID NO: 939818 - DNA, 22 bp, Artificial Sequence
  chemically synthesized
tctaaaccaataacagagtact

SEQ ID NO: 939819 - DNA, 22 bp, Artificial Sequence
  chemically synthesized
ctaaaccaataacagagtactt

SEQ ID NO: 939820 - DNA, 22 bp, Artificial Sequence
  chemically synthesized
taaaccaataacagagtacttc

SEQ ID NO: 939821 - DNA, 22 bp, Artificial Sequence
  chemically synthesized
ttcgttcccacagaagtactct

SEQ ID NO: 939822 - DNA, 22 bp, Artificial Sequence
  chemically synthesized
attcgttcccacagaagtactc

SEQ ID NO: 939823 - DNA, 22 bp, Artificial Sequence
  chemically synthesized
aaccaataacagagtacttctg

SEQ ID NO: 939824 - DNA, 22 bp, Artificial Sequence
  chemically synthesized
tattcgttcccacagaagtact

SEQ ID NO: 939825 - DNA, 22 bp, Artificial Sequence
  chemically synthesized
ttattcgttcccacagaagtac

SEQ ID NO: 939826 - DNA, 22 bp, Artificial Sequence
  chemically synthesized
tttattcgttcccacagaagta

SEQ ID NO: 939827 - DNA, 22 bp, Artificial Sequence
  chemically synthesized
ttttattcgttcccacagaagt

SEQ ID NO: 939828 - DNA, 22 bp, Artificial Sequence
  chemically synthesized
tcttttttattcgttcccacag

SEQ ID NO: 939829 - DNA, 22 bp, Artificial Sequence
  chemically synthesized
tcattatcttttttattcgttc

SEQ ID NO: 939830 - DNA, 22 bp, Artificial Sequence
  chemically synthesized
ctgtgggaacgaataaaaaaga

SEQ ID NO: 939831 - DNA, 22 bp, Artificial Sequence
  chemically synthesized
atattatcattatcttttttat

SEQ ID NO: 939832 - DNA, 22 bp, Artificial Sequence
  chemically synthesized
tgtgggaacgaataaaaaagat

SEQ ID NO: 939833 - DNA, 22 bp, Artificial Sequence
  chemically synthesized
gatattatcattatctttttta

SEQ ID NO: 939834 - DNA, 22 bp, Artificial Sequence
  chemically synthesized
tgggaacgaataaaaaagataa

SEQ ID NO: 939835 - DNA, 22 bp, Artificial Sequence
  chemically synthesized
acaataatgatatttgatatta

SEQ ID NO: 939836 - DNA, 22 bp, Artificial Sequence
  chemically synthesized
gacaataatgatatttgatatt

SEQ ID NO: 939837 - DNA, 22 bp, Artificial Sequence
  chemically synthesized
ttgtcaaacttgatgacttatt

SEQ ID NO: 939838 - DNA, 22 bp, Artificial Sequence
  chemically synthesized
tataaaatggagaaataagtca

SEQ ID NO: 939839 - DNA, 22 bp, Artificial Sequence
  chemically synthesized
tcaaacttgatgacttatttct

SEQ ID NO: 939840 - DNA, 22 bp, Artificial Sequence
  chemically synthesized
caagttatataaaatggagaaa

SEQ ID NO: 939841 - DNA, 22 bp, Artificial Sequence
  chemically synthesized
gatgacttatttctccatttta

SEQ ID NO: 939842 - DNA, 22 bp, Artificial Sequence
  chemically synthesized
atgacttatttctccattttat

SEQ ID NO: 939843 - DNA, 22 bp, Artificial Sequence
  chemically synthesized
atttctccattttatataactt

SEQ ID NO: 939844 - DNA, 22 bp, Artificial Sequence
  chemically synthesized
tttctccattttatataacttg

SEQ ID NO: 939845 - DNA, 22 bp, Artificial Sequence
  chemically synthesized
atgatggtactacaagttatat

SEQ ID NO: 939846 - DNA, 22 bp, Artificial Sequence
  chemically synthesized
aatgatggtactacaagttata

SEQ ID NO: 939847 - DNA, 22 bp, Artificial Sequence
  chemically synthesized
ctccattttatataacttgtag

SEQ ID NO: 939848 - DNA, 22 bp, Artificial Sequence
  chemically synthesized
tccattttatataacttgtagt

SEQ ID NO: 939849 - DNA, 22 bp, Artificial Sequence
  chemically synthesized
cttaatgatggtactacaagtt

SEQ ID NO: 939850 - DNA, 22 bp, Artificial Sequence
  chemically synthesized
cattttatataacttgtagtac

SEQ ID NO: 939851 - DNA, 22 bp, Artificial Sequence
  chemically synthesized
atactacttaatgatggtacta

SEQ ID NO: 939852 - DNA, 22 bp, Artificial Sequence
  chemically synthesized
tatataacttgtagtaccatca

SEQ ID NO: 939853 - DNA, 22 bp, Artificial Sequence
  chemically synthesized
aatactacttaatgatggtact

SEQ ID NO: 939854 - DNA, 22 bp, Artificial Sequence
  chemically synthesized
atataacttgtagtaccatcat

SEQ ID NO: 939855 - DNA, 22 bp, Artificial Sequence
  chemically synthesized
tataacttgtagtaccatcatt

SEQ ID NO: 939856 - DNA, 22 bp, Artificial Sequence
  chemically synthesized
tttaatactacttaatgatggt

SEQ ID NO: 939857 - DNA, 22 bp, Artificial Sequence
  chemically synthesized
atttaatactacttaatgatgg

SEQ ID NO: 939858 - DNA, 22 bp, Artificial Sequence
  chemically synthesized
gtagtaccatcattaagtagta

SEQ ID NO: 939859 - DNA, 22 bp, Artificial Sequence
  chemically synthesized
tagtaccatcattaagtagtat

SEQ ID NO: 939860 - DNA, 22 bp, Artificial Sequence
  chemically synthesized
agtagtattaaataagataccc

SEQ ID NO: 939861 - DNA, 22 bp, Artificial Sequence
  chemically synthesized
tagtaccatgtatatgggtatc

SEQ ID NO: 939862 - DNA, 22 bp, Artificial Sequence
  chemically synthesized
atagtaccatgtatatgggtat

SEQ ID NO: 939863 - DNA, 22 bp, Artificial Sequence
  chemically synthesized
tttatagtaccatgtatatggg

SEQ ID NO: 939864 - DNA, 22 bp, Artificial Sequence
  chemically synthesized
aataagatacccatatacatgg

SEQ ID NO: 939865 - DNA, 22 bp, Artificial Sequence
  chemically synthesized
tcaggaaattatttatagtacc

SEQ ID NO: 939866 - DNA, 22 bp, Artificial Sequence
  chemically synthesized
gtcaggaaattatttatagtac

SEQ ID NO: 939867 - DNA, 22 bp, Artificial Sequence
  chemically synthesized
taaataatttcctgacaagtat

SEQ ID NO: 939868 - DNA, 22 bp, Artificial Sequence
  chemically synthesized
gacaagaagtaaaatacttgtc

SEQ ID NO: 939869 - DNA, 22 bp, Artificial Sequence
  chemically synthesized
attagacaagaagtaaaatact

SEQ ID NO: 939870 - DNA, 22 bp, Artificial Sequence
  chemically synthesized
cattagacaagaagtaaaatac

SEQ ID NO: 939871 - DNA, 22 bp, Artificial Sequence
  chemically synthesized
cctgacaagtattttacttctt

SEQ ID NO: 939872 - DNA, 22 bp, Artificial Sequence
  chemically synthesized
acttcattagacaagaagtaaa

SEQ ID NO: 939873 - DNA, 22 bp, Artificial Sequence
  chemically synthesized
ctgacaagtattttacttcttg

SEQ ID NO: 939874 - DNA, 22 bp, Artificial Sequence
  chemically synthesized
cacttcattagacaagaagtaa

SEQ ID NO: 939875 - DNA, 22 bp, Artificial Sequence
  chemically synthesized
acaagtattttacttcttgtct

SEQ ID NO: 939876 - DNA, 22 bp, Artificial Sequence
  chemically synthesized
acttcacttcattagacaagaa

SEQ ID NO: 939877 - DNA, 22 bp, Artificial Sequence
  chemically synthesized
cacttcacttcattagacaaga

SEQ ID NO: 939878 - DNA, 22 bp, Artificial Sequence
  chemically synthesized
tacttcttgtctaatgaagtga

SEQ ID NO: 939879 - DNA, 22 bp, Artificial Sequence
  chemically synthesized
aagtgcttcacttcacttcatt

SEQ ID NO: 939880 - DNA, 22 bp, Artificial Sequence
  chemically synthesized
acttcttgtctaatgaagtgaa

SEQ ID NO: 939881 - DNA, 22 bp, Artificial Sequence
  chemically synthesized
cttcttgtctaatgaagtgaag

SEQ ID NO: 939882 - DNA, 22 bp, Artificial Sequence
  chemically synthesized
attaaagtgcttcacttcactt

SEQ ID NO: 939883 - DNA, 22 bp, Artificial Sequence
  chemically synthesized
cttgtctaatgaagtgaagtga

SEQ ID NO: 939884 - DNA, 22 bp, Artificial Sequence
  chemically synthesized
cattaaagtgcttcacttcact

SEQ ID NO: 939885 - DNA, 22 bp, Artificial Sequence
  chemically synthesized
ttgtctaatgaagtgaagtgaa

SEQ ID NO: 939886 - DNA, 22 bp, Artificial Sequence
  chemically synthesized
gtctaatgaagtgaagtgaagc

SEQ ID NO: 939887 - DNA, 22 bp, Artificial Sequence
  chemically synthesized
tctaatgaagtgaagtgaagca

SEQ ID NO: 939888 - DNA, 22 bp, Artificial Sequence
  chemically synthesized
atgaagtgaagtgaagcacttt

SEQ ID NO: 939889 - DNA, 22 bp, Artificial Sequence
  chemically synthesized
gtacacccaccacttcattaaa

SEQ ID NO: 939890 - DNA, 22 bp, Artificial Sequence
  chemically synthesized
agactggtacacccaccacttc

SEQ ID NO: 939891 - DNA, 22 bp, Artificial Sequence
  chemically synthesized
tgagactggtacacccaccact

SEQ ID NO: 939892 - DNA, 22 bp, Artificial Sequence
  chemically synthesized
ctgagactggtacacccaccac

SEQ ID NO: 939893 - DNA, 22 bp, Artificial Sequence
  chemically synthesized
taatgaagtggtgggtgtacca

SEQ ID NO: 939894 - DNA, 22 bp, Artificial Sequence
  chemically synthesized
aatgaagtggtgggtgtaccag

SEQ ID NO: 939895 - DNA, 22 bp, Artificial Sequence
  chemically synthesized
atgaagtggtgggtgtaccagt

SEQ ID NO: 939896 - DNA, 22 bp, Artificial Sequence
  chemically synthesized
ggaatgtttctgagactggtac

SEQ ID NO: 939897 - DNA, 22 bp, Artificial Sequence
  chemically synthesized
cggaatgtttctgagactggta

SEQ ID NO: 939898 - DNA, 22 bp, Artificial Sequence
  chemically synthesized
ggaaatcagtcttcggaatgtt

SEQ ID NO: 939899 - DNA, 22 bp, Artificial Sequence
  chemically synthesized
aggaaatcagtcttcggaatgt

SEQ ID NO: 939900 - DNA, 22 bp, Artificial Sequence
  chemically synthesized
agaaacattccgaagactgatt

SEQ ID NO: 939901 - DNA, 22 bp, Artificial Sequence
  chemically synthesized
gaagacttaggaaatcagtctt

SEQ ID NO: 939902 - DNA, 22 bp, Artificial Sequence
  chemically synthesized
ttggaagacttaggaaatcagt

SEQ ID NO: 939903 - DNA, 22 bp, Artificial Sequence
  chemically synthesized
attggaagacttaggaaatcag

SEQ ID NO: 939904 - DNA, 22 bp, Artificial Sequence
  chemically synthesized
cgaagactgatttcctaagtct

SEQ ID NO: 939905 - DNA, 22 bp, Artificial Sequence
  chemically synthesized
aagtttattggaagacttagga

SEQ ID NO: 939906 - DNA, 22 bp, Artificial Sequence
  chemically synthesized
aagctaaagtttattggaagac

SEQ ID NO: 939907 - DNA, 22 bp, Artificial Sequence
  chemically synthesized
atttcctaagtcttccaataaa

SEQ ID NO: 939908 - DNA, 22 bp, Artificial Sequence
  chemically synthesized
cctaagtcttccaataaacttt

SEQ ID NO: 939909 - DNA, 22 bp, Artificial Sequence
  chemically synthesized
ctaagtcttccaataaacttta

SEQ ID NO: 939910 - DNA, 22 bp, Artificial Sequence
  chemically synthesized
agtcttccaataaactttagct

SEQ ID NO: 939911 - DNA, 22 bp, Artificial Sequence
  chemically synthesized
ccaataaactttagctttagac

SEQ ID NO: 939912 - DNA, 22 bp, Artificial Sequence
  chemically synthesized
caataaactttagctttagacg

SEQ ID NO: 939913 - DNA, 22 bp, Artificial Sequence
  chemically synthesized
caccccacccaccgtctaaagc

SEQ ID NO: 939914 - DNA, 22 bp, Artificial Sequence
  chemically synthesized
accacctgcaccccacccaccg

SEQ ID NO: 939915 - DNA, 22 bp, Artificial Sequence
  chemically synthesized
tagctttagacggtgggtgggg

SEQ ID NO: 939916 - DNA, 22 bp, Artificial Sequence
  chemically synthesized
agctttagacggtgggtggggt

SEQ ID NO: 939917 - DNA, 22 bp, Artificial Sequence
  chemically synthesized
gctttagacggtgggtggggtg

SEQ ID NO: 939918 - DNA, 22 bp, Artificial Sequence
  chemically synthesized
tagacggtgggtggggtgcagg

SEQ ID NO: 939919 - DNA, 22 bp, Artificial Sequence
  chemically synthesized
acaatctaaccacctgcacccc

SEQ ID NO: 939920 - DNA, 22 bp, Artificial Sequence
  chemically synthesized
agacggtgggtggggtgcaggt

SEQ ID NO: 939921 - DNA, 22 bp, Artificial Sequence
  chemically synthesized
gacggtgggtggggtgcaggtg

SEQ ID NO: 939922 - DNA, 22 bp, Artificial Sequence
  chemically synthesized
ctgacaatctaaccacctgcac

SEQ ID NO: 939923 - DNA, 22 bp, Artificial Sequence
  chemically synthesized
actgacaatctaaccacctgca

SEQ ID NO: 939924 - DNA, 22 bp, Artificial Sequence
  chemically synthesized
tactgacaatctaaccacctgc

SEQ ID NO: 939925 - DNA, 22 bp, Artificial Sequence
  chemically synthesized
ttactgacaatctaaccacctg

SEQ ID NO: 939926 - DNA, 22 bp, Artificial Sequence
  chemically synthesized
ggtgcttttactgacaatctaa

SEQ ID NO: 939927 - DNA, 22 bp, Artificial Sequence
  chemically synthesized
aggtgcttttactgacaatcta

SEQ ID NO: 939928 - DNA, 22 bp, Artificial Sequence
  chemically synthesized
cccagggcttaggtgcttttac

SEQ ID NO: 939929 - DNA, 22 bp, Artificial Sequence
  chemically synthesized
acccagggcttaggtgctttta

SEQ ID NO: 939930 - DNA, 22 bp, Artificial Sequence
  chemically synthesized
gattgtcagtaaaagcacctaa

SEQ ID NO: 939931 - DNA, 22 bp, Artificial Sequence
  chemically synthesized
tcagtaaaagcacctaagccct

SEQ ID NO: 939932 - DNA, 22 bp, Artificial Sequence
  chemically synthesized
gagaatttacccagggcttagg

SEQ ID NO: 939933 - DNA, 22 bp, Artificial Sequence
  chemically synthesized
tgtctggagaatttacccaggg

SEQ ID NO: 939934 - DNA, 22 bp, Artificial Sequence
  chemically synthesized
ttatgtctggagaatttaccca

SEQ ID NO: 939935 - DNA, 22 bp, Artificial Sequence
  chemically synthesized
attatgtctggagaatttaccc

SEQ ID NO: 939936 - DNA, 22 bp, Artificial Sequence
  chemically synthesized
agccctgggtaaattctccaga

SEQ ID NO: 939937 - DNA, 22 bp, Artificial Sequence
  chemically synthesized
agagtcagtcttattatgtctg

SEQ ID NO: 939938 - DNA, 22 bp, Artificial Sequence
  chemically synthesized
ggtaaattctccagacataata

SEQ ID NO: 939939 - DNA, 22 bp, Artificial Sequence
  chemically synthesized
cagagtcagtcttattatgtct

SEQ ID NO: 939940 - DNA, 22 bp, Artificial Sequence
  chemically synthesized
tcagagtcagtcttattatgtc

SEQ ID NO: 939941 - DNA, 22 bp, Artificial Sequence
  chemically synthesized
tccagacataataagactgact

SEQ ID NO: 939942 - DNA, 22 bp, Artificial Sequence
  chemically synthesized
cagacataataagactgactct

SEQ ID NO: 939943 - DNA, 22 bp, Artificial Sequence
  chemically synthesized
aacaaagatctttcagagtcag

SEQ ID NO: 939944 - DNA, 22 bp, Artificial Sequence
  chemically synthesized
caacaaagatctttcagagtca

SEQ ID NO: 939945 - DNA, 22 bp, Artificial Sequence
  chemically synthesized
tcaacaaagatctttcagagtc

SEQ ID NO: 939946 - DNA, 22 bp, Artificial Sequence
  chemically synthesized
actctgaaagatctttgttgaa

SEQ ID NO: 939947 - DNA, 22 bp, Artificial Sequence
  chemically synthesized
tgaaagatctttgttgaaaggt

SEQ ID NO: 939948 - DNA, 22 bp, Artificial Sequence
  chemically synthesized
aaagatctttgttgaaaggtgc

SEQ ID NO: 939949 - DNA, 22 bp, Artificial Sequence
  chemically synthesized
tgttgaaaggtgctggatacca

SEQ ID NO: 939950 - DNA, 22 bp, Artificial Sequence
  chemically synthesized
gttgaaaggtgctggataccac

SEQ ID NO: 939951 - DNA, 22 bp, Artificial Sequence
  chemically synthesized
ttgaaaggtgctggataccact

SEQ ID NO: 939952 - DNA, 22 bp, Artificial Sequence
  chemically synthesized
catagatatggcagagtggtat

SEQ ID NO: 939953 - DNA, 22 bp, Artificial Sequence
  chemically synthesized
aaaggtgctggataccactctg

SEQ ID NO: 939954 - DNA, 22 bp, Artificial Sequence
  chemically synthesized
ttacatagatatggcagagtgg

SEQ ID NO: 939955 - DNA, 22 bp, Artificial Sequence
  chemically synthesized
gataccactctgccatatctat

SEQ ID NO: 939956 - DNA, 22 bp, Artificial Sequence
  chemically synthesized
gaagaatggatactattacata

SEQ ID NO: 939957 - DNA, 22 bp, Artificial Sequence
  chemically synthesized
tgccatatctatgtaatagtat

SEQ ID NO: 939958 - DNA, 22 bp, Artificial Sequence
  chemically synthesized
ttggaagaatggatactattac

SEQ ID NO: 939959 - DNA, 22 bp, Artificial Sequence
  chemically synthesized
ccatatctatgtaatagtatcc

SEQ ID NO: 939960 - DNA, 22 bp, Artificial Sequence
  chemically synthesized
tgtaatagtatccattcttcca

SEQ ID NO: 939961 - DNA, 22 bp, Artificial Sequence
  chemically synthesized
gatatatagctgttggaagaat

SEQ ID NO: 939962 - DNA, 22 bp, Artificial Sequence
  chemically synthesized
tagatatatagctgttggaaga

SEQ ID NO: 939963 - DNA, 22 bp, Artificial Sequence
  chemically synthesized
attctagatatatagctgttgg

SEQ ID NO: 939964 - DNA, 22 bp, Artificial Sequence
  chemically synthesized
cagagttgattctagatatata

SEQ ID NO: 939965 - DNA, 22 bp, Artificial Sequence
  chemically synthesized
ttccaacagctatatatctaga

SEQ ID NO: 939966 - DNA, 22 bp, Artificial Sequence
  chemically synthesized
ccaacagctatatatctagaat

SEQ ID NO: 939967 - DNA, 22 bp, Artificial Sequence
  chemically synthesized
caacagctatatatctagaatc

SEQ ID NO: 939968 - DNA, 22 bp, Artificial Sequence
  chemically synthesized
atgtgaaatattgcagagttga

SEQ ID NO: 939969 - DNA, 22 bp, Artificial Sequence
  chemically synthesized
tatatctagaatcaactctgca

SEQ ID NO: 939970 - DNA, 22 bp, Artificial Sequence
  chemically synthesized
catgtgaaatattgcagagttg

SEQ ID NO: 939971 - DNA, 22 bp, Artificial Sequence
  chemically synthesized
tcatgtgaaatattgcagagtt

SEQ ID NO: 939972 - DNA, 22 bp, Artificial Sequence
  chemically synthesized
gaatcaactctgcaatatttca

SEQ ID NO: 939973 - DNA, 22 bp, Artificial Sequence
  chemically synthesized
agaaaaagagtctttcatgtga

SEQ ID NO: 939974 - DNA, 22 bp, Artificial Sequence
  chemically synthesized
taagaaaaagagtctttcatgt

SEQ ID NO: 939975 - DNA, 22 bp, Artificial Sequence
  chemically synthesized
tgcaatatttcacatgaaagac

SEQ ID NO: 939976 - DNA, 22 bp, Artificial Sequence
  chemically synthesized
caatatttcacatgaaagactc

SEQ ID NO: 939977 - DNA, 22 bp, Artificial Sequence
  chemically synthesized
aatctctaagaaaaagagtctt

SEQ ID NO: 939978 - DNA, 22 bp, Artificial Sequence
  chemically synthesized
cacatgaaagactctttttctt

SEQ ID NO: 939979 - DNA, 22 bp, Artificial Sequence
  chemically synthesized
acatgaaagactctttttctta

SEQ ID NO: 939980 - DNA, 22 bp, Artificial Sequence
  chemically synthesized
tttttcttagagatttagtttc

SEQ ID NO: 939981 - DNA, 22 bp, Artificial Sequence
  chemically synthesized
tttcttagagatttagtttcca

SEQ ID NO: 939982 - DNA, 22 bp, Artificial Sequence
  chemically synthesized
ttcttagagatttagtttccat

SEQ ID NO: 939983 - DNA, 22 bp, Artificial Sequence
  chemically synthesized
caggaaataacaatggaaacta

SEQ ID NO: 939984 - DNA, 22 bp, Artificial Sequence
  chemically synthesized
tcttagagatttagtttccatt

SEQ ID NO: 939985 - DNA, 22 bp, Artificial Sequence
  chemically synthesized
cttagagatttagtttccattg

SEQ ID NO: 939986 - DNA, 22 bp, Artificial Sequence
  chemically synthesized
ttagagatttagtttccattgt

SEQ ID NO: 939987 - DNA, 22 bp, Artificial Sequence
  chemically synthesized
agagatttagtttccattgtta

SEQ ID NO: 939988 - DNA, 22 bp, Artificial Sequence
  chemically synthesized
gagatttagtttccattgttat

SEQ ID NO: 939989 - DNA, 22 bp, Artificial Sequence
  chemically synthesized
agtttccattgttatttcctgt

SEQ ID NO: 939990 - DNA, 22 bp, Artificial Sequence
  chemically synthesized
gtttccattgttatttcctgta

SEQ ID NO: 939991 - DNA, 22 bp, Artificial Sequence
  chemically synthesized
ccattgttatttcctgtagctg

SEQ ID NO: 939992 - DNA, 22 bp, Artificial Sequence
  chemically synthesized
acaccatccagacagctacagg

SEQ ID NO: 939993 - DNA, 22 bp, Artificial Sequence
  chemically synthesized
cattgttatttcctgtagctgt

SEQ ID NO: 939994 - DNA, 22 bp, Artificial Sequence
  chemically synthesized
gttgacaccatccagacagcta

SEQ ID NO: 939995 - DNA, 22 bp, Artificial Sequence
  chemically synthesized
ggttgacaccatccagacagct

SEQ ID NO: 939996 - DNA, 22 bp, Artificial Sequence
  chemically synthesized
ttatttcctgtagctgtctgga

SEQ ID NO: 939997 - DNA, 22 bp, Artificial Sequence
  chemically synthesized
tttcctgtagctgtctggatgg

SEQ ID NO: 939998 - DNA, 22 bp, Artificial Sequence
  chemically synthesized
accttggttgacaccatccaga

SEQ ID NO: 939999 - DNA, 22 bp, Artificial Sequence
  chemically synthesized
cctgtagctgtctggatggtgt

SEQ ID NO: 940000 - DNA, 22 bp, Artificial Sequence
  chemically synthesized
ctgtagctgtctggatggtgtc

SEQ ID NO: 940001 - DNA, 22 bp, Artificial Sequence
  chemically synthesized
tagctgtctggatggtgtcaac

SEQ ID NO: 940002 - DNA, 22 bp, Artificial Sequence
  chemically synthesized
gaccaaagttcaccttggttga

SEQ ID NO: 940003 - DNA, 22 bp, Artificial Sequence
  chemically synthesized
tctggatggtgtcaaccaaggt

SEQ ID NO: 940004 - DNA, 22 bp, Artificial Sequence
  chemically synthesized
agaccaaagttcaccttggttg

SEQ ID NO: 940005 - DNA, 22 bp, Artificial Sequence
  chemically synthesized
gatggtgtcaaccaaggtgaac

SEQ ID NO: 940006 - DNA, 22 bp, Artificial Sequence
  chemically synthesized
aggaaaaatcatttagaccaaa

SEQ ID NO: 940007 - DNA, 22 bp, Artificial Sequence
  chemically synthesized
ataactgaggaaaaatcattta

SEQ ID NO: 940008 - DNA, 22 bp, Artificial Sequence
  chemically synthesized
aataactgaggaaaaatcattt

SEQ ID NO: 940009 - DNA, 22 bp, Artificial Sequence
  chemically synthesized
cttaataactgaggaaaaatca

SEQ ID NO: 940010 - DNA, 22 bp, Artificial Sequence
  chemically synthesized
tggtctaaatgatttttcctca

SEQ ID NO: 940011 - DNA, 22 bp, Artificial Sequence
  chemically synthesized
ggtctaaatgatttttcctcag

SEQ ID NO: 940012 - DNA, 22 bp, Artificial Sequence
  chemically synthesized
gtctaaatgatttttcctcagt

SEQ ID NO: 940013 - DNA, 22 bp, Artificial Sequence
  chemically synthesized
acactacttaataactgaggaa

SEQ ID NO: 940014 - DNA, 22 bp, Artificial Sequence
  chemically synthesized
cacactacttaataactgagga

SEQ ID NO: 940015 - DNA, 22 bp, Artificial Sequence
  chemically synthesized
aatgatttttcctcagttatta

SEQ ID NO: 940016 - DNA, 22 bp, Artificial Sequence
  chemically synthesized
tcttcacactacttaataactg

SEQ ID NO: 940017 - DNA, 22 bp, Artificial Sequence
  chemically synthesized
gtcttcacactacttaataact

SEQ ID NO: 940018 - DNA, 22 bp, Artificial Sequence
  chemically synthesized
tgtcttcacactacttaataac

SEQ ID NO: 940019 - DNA, 22 bp, Artificial Sequence
  chemically synthesized
ttgtcttcacactacttaataa

SEQ ID NO: 940020 - DNA, 22 bp, Artificial Sequence
  chemically synthesized
tttgtcttcacactacttaata

SEQ ID NO: 940021 - DNA, 22 bp, Artificial Sequence
  chemically synthesized
ttcctcagttattaagtagtgt

SEQ ID NO: 940022 - DNA, 22 bp, Artificial Sequence
  chemically synthesized
ttttttgtcttcacactactta

SEQ ID NO: 940023 - DNA, 22 bp, Artificial Sequence
  chemically synthesized
tcctcagttattaagtagtgtg

SEQ ID NO: 940024 - DNA, 22 bp, Artificial Sequence
  chemically synthesized
cctcagttattaagtagtgtga

SEQ ID NO: 940025 - DNA, 22 bp, Artificial Sequence
  chemically synthesized
ctcagttattaagtagtgtgaa

SEQ ID NO: 940026 - DNA, 22 bp, Artificial Sequence
  chemically synthesized
ttattttttgtcttcacactac

SEQ ID NO: 940027 - DNA, 22 bp, Artificial Sequence
  chemically synthesized
attattttttgtcttcacacta

SEQ ID NO: 940028 - DNA, 22 bp, Artificial Sequence
  chemically synthesized
tattattttttgtcttcacact

SEQ ID NO: 940029 - DNA, 22 bp, Artificial Sequence
  chemically synthesized
agttattaagtagtgtgaagac

SEQ ID NO: 940030 - DNA, 22 bp, Artificial Sequence
  chemically synthesized
ttttattattttttgtcttcac

SEQ ID NO: 940031 - DNA, 22 bp, Artificial Sequence
  chemically synthesized
attttattattttttgtcttca

SEQ ID NO: 940032 - DNA, 22 bp, Artificial Sequence
  chemically synthesized
ttaagtagtgtgaagacaaaaa

SEQ ID NO: 940033 - DNA, 22 bp, Artificial Sequence
  chemically synthesized
agtagtgtgaagacaaaaaata

SEQ ID NO: 940034 - DNA, 22 bp, Artificial Sequence
  chemically synthesized
ccaacatttattttattatttt

SEQ ID NO: 940035 - DNA, 22 bp, Artificial Sequence
  chemically synthesized
cccaacatttattttattattt

SEQ ID NO: 940036 - DNA, 22 bp, Artificial Sequence
  chemically synthesized
aatttcccaacatttattttat

SEQ ID NO: 940037 - DNA, 22 bp, Artificial Sequence
  chemically synthesized
tcaatttcccaacatttatttt

SEQ ID NO: 940038 - DNA, 22 bp, Artificial Sequence
  chemically synthesized
aagcagcatacctctcaatttc

SEQ ID NO: 940039 - DNA, 22 bp, Artificial Sequence
  chemically synthesized
cataactgaagcagcatacctc

SEQ ID NO: 940040 - DNA, 22 bp, Artificial Sequence
  chemically synthesized
ggaaattgagaggtatgctgct

SEQ ID NO: 940041 - DNA, 22 bp, Artificial Sequence
  chemically synthesized
agaggtatgctgcttcagttat

SEQ ID NO: 940042 - DNA, 22 bp, Artificial Sequence
  chemically synthesized
tgtgaaatagattccataactg

SEQ ID NO: 940043 - DNA, 22 bp, Artificial Sequence
  chemically synthesized
atgtgaaatagattccataact

SEQ ID NO: 940044 - DNA, 22 bp, Artificial Sequence
  chemically synthesized
tatgtgaaatagattccataac

SEQ ID NO: 940045 - DNA, 22 bp, Artificial Sequence
  chemically synthesized
ttttatgtgaaatagattccat

SEQ ID NO: 940046 - DNA, 22 bp, Artificial Sequence
  chemically synthesized
cttcagttatggaatctatttc

SEQ ID NO: 940047 - DNA, 22 bp, Artificial Sequence
  chemically synthesized
cagttatggaatctatttcaca

SEQ ID NO: 940048 - DNA, 22 bp, Artificial Sequence
  chemically synthesized
agttatggaatctatttcacat

SEQ ID NO: 940049 - DNA, 22 bp, Artificial Sequence
  chemically synthesized
gaataactattttatgtgaaat

SEQ ID NO: 940050 - DNA, 22 bp, Artificial Sequence
  chemically synthesized
ggaataactattttatgtgaaa

SEQ ID NO: 940051 - DNA, 22 bp, Artificial Sequence
  chemically synthesized
tggaatctatttcacataaaat

SEQ ID NO: 940052 - DNA, 22 bp, Artificial Sequence
  chemically synthesized
gacttggaataactattttatg

SEQ ID NO: 940053 - DNA, 22 bp, Artificial Sequence
  chemically synthesized
agacttggaataactattttat

SEQ ID NO: 940054 - DNA, 22 bp, Artificial Sequence
  chemically synthesized
tagacttggaataactatttta

SEQ ID NO: 940055 - DNA, 22 bp, Artificial Sequence
  chemically synthesized
ttagacttggaataactatttt

SEQ ID NO: 940056 - DNA, 22 bp, Artificial Sequence
  chemically synthesized
tttttagacttggaataactat

SEQ ID NO: 940057 - DNA, 22 bp, Artificial Sequence
  chemically synthesized
tttcacataaaatagttattcc

SEQ ID NO: 940058 - DNA, 22 bp, Artificial Sequence
  chemically synthesized
ttatttttagacttggaataac

SEQ ID NO: 940059 - DNA, 22 bp, Artificial Sequence
  chemically synthesized
cacataaaatagttattccaag

SEQ ID NO: 940060 - DNA, 22 bp, Artificial Sequence
  chemically synthesized
acataaaatagttattccaagt

SEQ ID NO: 940061 - DNA, 22 bp, Artificial Sequence
  chemically synthesized
ttattatttttagacttggaat

SEQ ID NO: 940062 - DNA, 22 bp, Artificial Sequence
  chemically synthesized
attattatttttagacttggaa

SEQ ID NO: 940063 - DNA, 22 bp, Artificial Sequence
  chemically synthesized
gatttattattatttttagact

SEQ ID NO: 940064 - DNA, 22 bp, Artificial Sequence
  chemically synthesized
ggatttattattatttttagac

SEQ ID NO: 940065 - DNA, 22 bp, Artificial Sequence
  chemically synthesized
tggatttattattatttttaga

SEQ ID NO: 940066 - DNA, 22 bp, Artificial Sequence
  chemically synthesized
gttttggatttattattatttt

SEQ ID NO: 940067 - DNA, 22 bp, Artificial Sequence
  chemically synthesized
ttccaagtctaaaaataataat

SEQ ID NO: 940068 - DNA, 22 bp, Artificial Sequence
  chemically synthesized
ggttttggatttattattattt

SEQ ID NO: 940069 - DNA, 22 bp, Artificial Sequence
  chemically synthesized
tggttttggatttattattatt

SEQ ID NO: 940070 - DNA, 22 bp, Artificial Sequence
  chemically synthesized
caagtctaaaaataataataaa

SEQ ID NO: 940071 - DNA, 22 bp, Artificial Sequence
  chemically synthesized
aaaataataataaatccaaaac

SEQ ID NO: 940072 - DNA, 22 bp, Artificial Sequence
  chemically synthesized
cacatccgatattttggttttg

SEQ ID NO: 940073 - DNA, 22 bp, Artificial Sequence
  chemically synthesized
aaactacacatccgatattttg

SEQ ID NO: 940074 - DNA, 22 bp, Artificial Sequence
  chemically synthesized
attaaaactacacatccgatat

SEQ ID NO: 940075 - DNA, 22 bp, Artificial Sequence
  chemically synthesized
gattaaaactacacatccgata

SEQ ID NO: 940076 - DNA, 22 bp, Artificial Sequence
  chemically synthesized
cttgattaaaactacacatccg

SEQ ID NO: 940077 - DNA, 22 bp, Artificial Sequence
  chemically synthesized
gcttgattaaaactacacatcc

SEQ ID NO: 940078 - DNA, 22 bp, Artificial Sequence
  chemically synthesized
tttgcttgattaaaactacaca

SEQ ID NO: 940079 - DNA, 22 bp, Artificial Sequence
  chemically synthesized
atttgcttgattaaaactacac

SEQ ID NO: 940080 - DNA, 22 bp, Artificial Sequence
  chemically synthesized
taaaacatttatttgcttgatt

SEQ ID NO: 940081 - DNA, 22 bp, Artificial Sequence
  chemically synthesized
taatcaagcaaataaatgtttt

SEQ ID NO: 940082 - DNA, 22 bp, Artificial Sequence
  chemically synthesized
aatcaagcaaataaatgtttta

SEQ ID NO: 940083 - DNA, 22 bp, Artificial Sequence
  chemically synthesized
atcaagcaaataaatgttttat

SEQ ID NO: 940084 - DNA, 22 bp, Artificial Sequence
  chemically synthesized
atcaaaaggccctataaaacat

SEQ ID NO: 940085 - DNA, 22 bp, Artificial Sequence
  chemically synthesized
aatcaaaaggccctataaaaca

SEQ ID NO: 940086 - DNA, 22 bp, Artificial Sequence
  chemically synthesized
ttaatcaaaaggccctataaaa

SEQ ID NO: 940087 - DNA, 22 bp, Artificial Sequence
  chemically synthesized
tgagctcttaatcaaaaggccc

SEQ ID NO: 940088 - DNA, 22 bp, Artificial Sequence
  chemically synthesized
actgtgagctcttaatcaaaag

SEQ ID NO: 940089 - DNA, 22 bp, Artificial Sequence
  chemically synthesized
tatagggccttttgattaagag

SEQ ID NO: 940090 - DNA, 22 bp, Artificial Sequence
  chemically synthesized
atagggccttttgattaagagc

SEQ ID NO: 940091 - DNA, 22 bp, Artificial Sequence
  chemically synthesized
tagggccttttgattaagagct

SEQ ID NO: 940092 - DNA, 22 bp, Artificial Sequence
  chemically synthesized
aaaagtctcactgtgagctctt

SEQ ID NO: 940093 - DNA, 22 bp, Artificial Sequence
  chemically synthesized
ctaaaaagtctcactgtgagct

SEQ ID NO: 940094 - DNA, 22 bp, Artificial Sequence
  chemically synthesized
ttgattaagagctcacagtgag

SEQ ID NO: 940095 - DNA, 22 bp, Artificial Sequence
  chemically synthesized
tgattaagagctcacagtgaga

SEQ ID NO: 940096 - DNA, 22 bp, Artificial Sequence
  chemically synthesized
gattaagagctcacagtgagac

SEQ ID NO: 940097 - DNA, 22 bp, Artificial Sequence
  chemically synthesized
attaagagctcacagtgagact

SEQ ID NO: 940098 - DNA, 22 bp, Artificial Sequence
  chemically synthesized
taaattactaaaaagtctcact

SEQ ID NO: 940099 - DNA, 22 bp, Artificial Sequence
  chemically synthesized
agagctcacagtgagacttttt

SEQ ID NO: 940100 - DNA, 22 bp, Artificial Sequence
  chemically synthesized
acggttataaattactaaaaag

SEQ ID NO: 940101 - DNA, 22 bp, Artificial Sequence
  chemically synthesized
acagtgagactttttagtaatt

SEQ ID NO: 940102 - DNA, 22 bp, Artificial Sequence
  chemically synthesized
tttagtaatttataaccgtgaa

SEQ ID NO: 940103 - DNA, 22 bp, Artificial Sequence
  chemically synthesized
gtgtggaaagtattcacggtta

SEQ ID NO: 940104 - DNA, 22 bp, Artificial Sequence
  chemically synthesized
ttagtaatttataaccgtgaat

SEQ ID NO: 940105 - DNA, 22 bp, Artificial Sequence
  chemically synthesized
tagtaatttataaccgtgaata

SEQ ID NO: 940106 - DNA, 22 bp, Artificial Sequence
  chemically synthesized
agtaatttataaccgtgaatac

SEQ ID NO: 940107 - DNA, 22 bp, Artificial Sequence
  chemically synthesized
gtaatttataaccgtgaatact

SEQ ID NO: 940108 - DNA, 22 bp, Artificial Sequence
  chemically synthesized
ataaattagtgtggaaagtatt

SEQ ID NO: 940109 - DNA, 22 bp, Artificial Sequence
  chemically synthesized
tgataaattagtgtggaaagta

SEQ ID NO: 940110 - DNA, 22 bp, Artificial Sequence
  chemically synthesized
ataaccgtgaatactttccaca

SEQ ID NO: 940111 - DNA, 22 bp, Artificial Sequence
  chemically synthesized
ctgataaattagtgtggaaagt

SEQ ID NO: 940112 - DNA, 22 bp, Artificial Sequence
  chemically synthesized
taaccgtgaatactttccacac

SEQ ID NO: 940113 - DNA, 22 bp, Artificial Sequence
  chemically synthesized
tccacactaatttatcagaagc

SEQ ID NO: 940114 - DNA, 22 bp, Artificial Sequence
  chemically synthesized
ccacactaatttatcagaagcc

SEQ ID NO: 940115 - DNA, 22 bp, Artificial Sequence
  chemically synthesized
cacactaatttatcagaagcct

SEQ ID NO: 940116 - DNA, 22 bp, Artificial Sequence
  chemically synthesized
gaaaatgtagtaataaaggctt

SEQ ID NO: 940117 - DNA, 22 bp, Artificial Sequence
  chemically synthesized
tggaaaatgtagtaataaaggc

SEQ ID NO: 940118 - DNA, 22 bp, Artificial Sequence
  chemically synthesized
atttatcagaagcctttattac

SEQ ID NO: 940119 - DNA, 22 bp, Artificial Sequence
  chemically synthesized
atcagaagcctttattactaca

SEQ ID NO: 940120 - DNA, 22 bp, Artificial Sequence
  chemically synthesized
tcagaagcctttattactacat

SEQ ID NO: 940121 - DNA, 22 bp, Artificial Sequence
  chemically synthesized
aaaattctggaaaatgtagtaa

SEQ ID NO: 940122 - DNA, 22 bp, Artificial Sequence
  chemically synthesized
gaaaattctggaaaatgtagta

SEQ ID NO: 940123 - DNA, 22 bp, Artificial Sequence
  chemically synthesized
tattactacattttccagaatt

SEQ ID NO: 940124 - DNA, 22 bp, Artificial Sequence
  chemically synthesized
attactacattttccagaattt

SEQ ID NO: 940125 - DNA, 22 bp, Artificial Sequence
  chemically synthesized
ttactacattttccagaatttt

SEQ ID NO: 940126 - DNA, 22 bp, Artificial Sequence
  chemically synthesized
ctacattttccagaattttcaa

SEQ ID NO: 940127 - DNA, 22 bp, Artificial Sequence
  chemically synthesized
cattttccagaattttcaaggg

SEQ ID NO: 940128 - DNA, 22 bp, Artificial Sequence
  chemically synthesized
atcccaccacatcccccttgaa

SEQ ID NO: 940129 - DNA, 22 bp, Artificial Sequence
  chemically synthesized
tccagaattttcaagggggatg

SEQ ID NO: 940130 - DNA, 22 bp, Artificial Sequence
  chemically synthesized
ttcatcccaccacatccccctt

SEQ ID NO: 940131 - DNA, 22 bp, Artificial Sequence
  chemically synthesized
ccagaattttcaagggggatgt

SEQ ID NO: 940132 - DNA, 22 bp, Artificial Sequence
  chemically synthesized
cagaattttcaagggggatgtg

SEQ ID NO: 940133 - DNA, 22 bp, Artificial Sequence
  chemically synthesized
tcaagggggatgtggtgggatg

SEQ ID NO: 940134 - DNA, 22 bp, Artificial Sequence
  chemically synthesized
caagggggatgtggtgggatga

SEQ ID NO: 940135 - DNA, 22 bp, Artificial Sequence
  chemically synthesized
aggggaaactattcatcccacc

SEQ ID NO: 940136 - DNA, 22 bp, Artificial Sequence
  chemically synthesized
aagggggatgtggtgggatgaa

SEQ ID NO: 940137 - DNA, 22 bp, Artificial Sequence
  chemically synthesized
ttcaggggaaactattcatccc

SEQ ID NO: 940138 - DNA, 22 bp, Artificial Sequence
  chemically synthesized
agggacatgtgactattcaggg

SEQ ID NO: 940139 - DNA, 22 bp, Artificial Sequence
  chemically synthesized
cagggacatgtgactattcagg

SEQ ID NO: 940140 - DNA, 22 bp, Artificial Sequence
  chemically synthesized
aaggtttcagggacatgtgact

SEQ ID NO: 940141 - DNA, 22 bp, Artificial Sequence
  chemically synthesized
cccctgaatagtcacatgtccc

SEQ ID NO: 940142 - DNA, 22 bp, Artificial Sequence
  chemically synthesized
ccctgaatagtcacatgtccct

SEQ ID NO: 940143 - DNA, 22 bp, Artificial Sequence
  chemically synthesized
aatagtcacatgtccctgaaac

SEQ ID NO: 940144 - DNA, 22 bp, Artificial Sequence
  chemically synthesized
gtgacattcaaggtttcaggga

SEQ ID NO: 940145 - DNA, 22 bp, Artificial Sequence
  chemically synthesized
caaatctggtgacattcaaggt

SEQ ID NO: 940146 - DNA, 22 bp, Artificial Sequence
  chemically synthesized
ccaaatctggtgacattcaagg

SEQ ID NO: 940147 - DNA, 22 bp, Artificial Sequence
  chemically synthesized
tttccaaatctggtgacattca

SEQ ID NO: 940148 - DNA, 22 bp, Artificial Sequence
  chemically synthesized
aaaccttgaatgtcaccagatt

SEQ ID NO: 940149 - DNA, 22 bp, Artificial Sequence
  chemically synthesized
aaagaccctatttccaaatctg

SEQ ID NO: 940150 - DNA, 22 bp, Artificial Sequence
  chemically synthesized
caaagaccctatttccaaatct

SEQ ID NO: 940151 - DNA, 22 bp, Artificial Sequence
  chemically synthesized
gaatgtcaccagatttggaaat

SEQ ID NO: 940152 - DNA, 22 bp, Artificial Sequence
  chemically synthesized
aatgtcaccagatttggaaata

SEQ ID NO: 940153 - DNA, 22 bp, Artificial Sequence
  chemically synthesized
catcttcaaagaccctatttcc

SEQ ID NO: 940154 - DNA, 22 bp, Artificial Sequence
  chemically synthesized
attacatcttcaaagaccctat

SEQ ID NO: 940155 - DNA, 22 bp, Artificial Sequence
  chemically synthesized
actaattacatcttcaaagacc

SEQ ID NO: 940156 - DNA, 22 bp, Artificial Sequence
  chemically synthesized
aactaattacatcttcaaagac

SEQ ID NO: 940157 - DNA, 22 bp, Artificial Sequence
  chemically synthesized
ttaactaattacatcttcaaag

SEQ ID NO: 940158 - DNA, 22 bp, Artificial Sequence
  chemically synthesized
ggaaatagggtctttgaagatg

SEQ ID NO: 940159 - DNA, 22 bp, Artificial Sequence
  chemically synthesized
gaaatagggtctttgaagatgt

SEQ ID NO: 940160 - DNA, 22 bp, Artificial Sequence
  chemically synthesized
aaattcttaactaattacatct

SEQ ID NO: 940161 - DNA, 22 bp, Artificial Sequence
  chemically synthesized
gaaattcttaactaattacatc

SEQ ID NO: 940162 - DNA, 22 bp, Artificial Sequence
  chemically synthesized
tgaaattcttaactaattacat

SEQ ID NO: 940163 - DNA, 22 bp, Artificial Sequence
  chemically synthesized
tgaagatgtaattagttaagaa

SEQ ID NO: 940164 - DNA, 22 bp, Artificial Sequence
  chemically synthesized
gaagatgtaattagttaagaat

SEQ ID NO: 940165 - DNA, 22 bp, Artificial Sequence
  chemically synthesized
aagatgtaattagttaagaatt

SEQ ID NO: 940166 - DNA, 22 bp, Artificial Sequence
  chemically synthesized
atggtgatgtcattttgaaatt

SEQ ID NO: 940167 - DNA, 22 bp, Artificial Sequence
  chemically synthesized
aattcatggtgatgtcattttg

SEQ ID NO: 940168 - DNA, 22 bp, Artificial Sequence
  chemically synthesized
gttaagaatttcaaaatgacat

SEQ ID NO: 940169 - DNA, 22 bp, Artificial Sequence
  chemically synthesized
agaatttcaaaatgacatcacc

SEQ ID NO: 940170 - DNA, 22 bp, Artificial Sequence
  chemically synthesized
caaaatgacatcaccatgaatt

SEQ ID NO: 940171 - DNA, 22 bp, Artificial Sequence
  chemically synthesized
gagcccaccctaaattcatggt

SEQ ID NO: 940172 - DNA, 22 bp, Artificial Sequence
  chemically synthesized
aaaatgacatcaccatgaattt

SEQ ID NO: 940173 - DNA, 22 bp, Artificial Sequence
  chemically synthesized
agagcccaccctaaattcatgg

SEQ ID NO: 940174 - DNA, 22 bp, Artificial Sequence
  chemically synthesized
gatttagagcccaccctaaatt

SEQ ID NO: 940175 - DNA, 22 bp, Artificial Sequence
  chemically synthesized
ggatttagagcccaccctaaat

SEQ ID NO: 940176 - DNA, 22 bp, Artificial Sequence
  chemically synthesized
tggatttagagcccaccctaaa

SEQ ID NO: 940177 - DNA, 22 bp, Artificial Sequence
  chemically synthesized
agggtgggctctaaatccaaag

SEQ ID NO: 940178 - DNA, 22 bp, Artificial Sequence
  chemically synthesized
gggtgggctctaaatccaaaga

SEQ ID NO: 940179 - DNA, 22 bp, Artificial Sequence
  chemically synthesized
taaatccaaagactggtgtcct

SEQ ID NO: 940180 - DNA, 22 bp, Artificial Sequence
  chemically synthesized
aatccaaagactggtgtccttt

SEQ ID NO: 940181 - DNA, 22 bp, Artificial Sequence
  chemically synthesized
tgaatagtgccgcaaaaggaca

SEQ ID NO: 940182 - DNA, 22 bp, Artificial Sequence
  chemically synthesized
ttgtgaatagtgccgcaaaagg

SEQ ID NO: 940183 - DNA, 22 bp, Artificial Sequence
  chemically synthesized
ctattgtgaatagtgccgcaaa

SEQ ID NO: 940184 - DNA, 22 bp, Artificial Sequence
  chemically synthesized
gctattgtgaatagtgccgcaa

SEQ ID NO: 940185 - DNA, 22 bp, Artificial Sequence
  chemically synthesized
tgctattgtgaatagtgccgca

SEQ ID NO: 940186 - DNA, 22 bp, Artificial Sequence
  chemically synthesized
gtgtccttttgcggcactattc

SEQ ID NO: 940187 - DNA, 22 bp, Artificial Sequence
  chemically synthesized
caagtctttgctattgtgaata

SEQ ID NO: 940188 - DNA, 22 bp, Artificial Sequence
  chemically synthesized
ttgcggcactattcacaatagc

SEQ ID NO: 940189 - DNA, 22 bp, Artificial Sequence
  chemically synthesized
tgcggcactattcacaatagca

SEQ ID NO: 940190 - DNA, 22 bp, Artificial Sequence
  chemically synthesized
gttccaagtctttgctattgtg

SEQ ID NO: 940191 - DNA, 22 bp, Artificial Sequence
  chemically synthesized
gcggcactattcacaatagcaa

SEQ ID NO: 940192 - DNA, 22 bp, Artificial Sequence
  chemically synthesized
cggcactattcacaatagcaaa

SEQ ID NO: 940193 - DNA, 22 bp, Artificial Sequence
  chemically synthesized
ggttggttccaagtctttgcta

SEQ ID NO: 940194 - DNA, 22 bp, Artificial Sequence
  chemically synthesized
gggttggttccaagtctttgct

SEQ ID NO: 940195 - DNA, 22 bp, Artificial Sequence
  chemically synthesized
ttcacaatagcaaagacttgga

SEQ ID NO: 940196 - DNA, 22 bp, Artificial Sequence
  chemically synthesized
acaatagcaaagacttggaacc

SEQ ID NO: 940197 - DNA, 22 bp, Artificial Sequence
  chemically synthesized
gacatttgggttggttccaagt

SEQ ID NO: 940198 - DNA, 22 bp, Artificial Sequence
  chemically synthesized
ttggacatttgggttggttcca

SEQ ID NO: 940199 - DNA, 22 bp, Artificial Sequence
  chemically synthesized
tcattgttggacatttgggttg

SEQ ID NO: 940200 - DNA, 22 bp, Artificial Sequence
  chemically synthesized
ggaaccaacccaaatgtccaac

SEQ ID NO: 940201 - DNA, 22 bp, Artificial Sequence
  chemically synthesized
gaaccaacccaaatgtccaaca

SEQ ID NO: 940202 - DNA, 22 bp, Artificial Sequence
  chemically synthesized
atccagtctatcattgttggac

SEQ ID NO: 940203 - DNA, 22 bp, Artificial Sequence
  chemically synthesized
aatccagtctatcattgttgga

SEQ ID NO: 940204 - DNA, 22 bp, Artificial Sequence
  chemically synthesized
ttaatccagtctatcattgttg

SEQ ID NO: 940205 - DNA, 22 bp, Artificial Sequence
  chemically synthesized
cttaatccagtctatcattgtt

SEQ ID NO: 940206 - DNA, 22 bp, Artificial Sequence
  chemically synthesized
tcttaatccagtctatcattgt

SEQ ID NO: 940207 - DNA, 22 bp, Artificial Sequence
  chemically synthesized
catggtgtatatgtgccacatt

SEQ ID NO: 940208 - DNA, 22 bp, Artificial Sequence
  chemically synthesized
gattaagaaaatgtggcacata

SEQ ID NO: 940209 - DNA, 22 bp, Artificial Sequence
  chemically synthesized
agaaaatgtggcacatatacac

SEQ ID NO: 940210 - DNA, 22 bp, Artificial Sequence
  chemically synthesized
catagtattccatggtgtatat

SEQ ID NO: 940211 - DNA, 22 bp, Artificial Sequence
  chemically synthesized
tggctgcatagtattccatggt

SEQ ID NO: 940212 - DNA, 22 bp, Artificial Sequence
  chemically synthesized
atggctgcatagtattccatgg

SEQ ID NO: 940213 - DNA, 22 bp, Artificial Sequence
  chemically synthesized
tatggctgcatagtattccatg

SEQ ID NO: 940214 - DNA, 22 bp, Artificial Sequence
  chemically synthesized
ttatggctgcatagtattccat

SEQ ID NO: 940215 - DNA, 22 bp, Artificial Sequence
  chemically synthesized
tttatggctgcatagtattcca

SEQ ID NO: 940216 - DNA, 22 bp, Artificial Sequence
  chemically synthesized
ttttatggctgcatagtattcc

SEQ ID NO: 940217 - DNA, 22 bp, Artificial Sequence
  chemically synthesized
atcatttttttatggctgcata

SEQ ID NO: 940218 - DNA, 22 bp, Artificial Sequence
  chemically synthesized
tgcagccataaaaaaatgatga

SEQ ID NO: 940219 - DNA, 22 bp, Artificial Sequence
  chemically synthesized
caaagaacatgaactcatcatt

SEQ ID NO: 940220 - DNA, 22 bp, Artificial Sequence
  chemically synthesized
tacaaagaacatgaactcatca

SEQ ID NO: 940221 - DNA, 22 bp, Artificial Sequence
  chemically synthesized
atccatgtctctacaaagaaca

SEQ ID NO: 940222 - DNA, 22 bp, Artificial Sequence
  chemically synthesized
catccatgtctctacaaagaac

SEQ ID NO: 940223 - DNA, 22 bp, Artificial Sequence
  chemically synthesized
caatttcatccatgtctctaca

SEQ ID NO: 940224 - DNA, 22 bp, Artificial Sequence
  chemically synthesized
ccaatttcatccatgtctctac

SEQ ID NO: 940225 - DNA, 22 bp, Artificial Sequence
  chemically synthesized
atgttctttgtagagacatgga

SEQ ID NO: 940226 - DNA, 22 bp, Artificial Sequence
  chemically synthesized
tttgtagagacatggatgaaat

SEQ ID NO: 940227 - DNA, 22 bp, Artificial Sequence
  chemically synthesized
tgtagagacatggatgaaattg

SEQ ID NO: 940228 - DNA, 22 bp, Artificial Sequence
  chemically synthesized
gtagagacatggatgaaattgg

SEQ ID NO: 940229 - DNA, 22 bp, Artificial Sequence
  chemically synthesized
tagagacatggatgaaattgga

SEQ ID NO: 940230 - DNA, 22 bp, Artificial Sequence
  chemically synthesized
agaatgatgatttccaatttca

SEQ ID NO: 940231 - DNA, 22 bp, Artificial Sequence
  chemically synthesized
ctgagaatgatgatttccaatt

SEQ ID NO: 940232 - DNA, 22 bp, Artificial Sequence
  chemically synthesized
actgagaatgatgatttccaat

SEQ ID NO: 940233 - DNA, 22 bp, Artificial Sequence
  chemically synthesized
cgatagtttactgagaatgatg

SEQ ID NO: 940234 - DNA, 22 bp, Artificial Sequence
  chemically synthesized
gcgatagtttactgagaatgat

SEQ ID NO: 940235 - DNA, 22 bp, Artificial Sequence
  chemically synthesized
ttgcgatagtttactgagaatg

SEQ ID NO: 940236 - DNA, 22 bp, Artificial Sequence
  chemically synthesized
ttcttgcgatagtttactgaga

SEQ ID NO: 940237 - DNA, 22 bp, Artificial Sequence
  chemically synthesized
gaaatcatcattctcagtaaac

SEQ ID NO: 940238 - DNA, 22 bp, Artificial Sequence
  chemically synthesized
gttcttgcgatagtttactgag

SEQ ID NO: 940239 - DNA, 22 bp, Artificial Sequence
  chemically synthesized
tgttcttgcgatagtttactga

SEQ ID NO: 940240 - DNA, 22 bp, Artificial Sequence
  chemically synthesized
ttgttcttgcgatagtttactg

SEQ ID NO: 940241 - DNA, 22 bp, Artificial Sequence
  chemically synthesized
tttgttcttgcgatagtttact

SEQ ID NO: 940242 - DNA, 22 bp, Artificial Sequence
  chemically synthesized
gttttttgttcttgcgatagtt

SEQ ID NO: 940243 - DNA, 22 bp, Artificial Sequence
  chemically synthesized
ggttttttgttcttgcgatagt

SEQ ID NO: 940244 - DNA, 22 bp, Artificial Sequence
  chemically synthesized
tcagtaaactatcgcaagaaca

SEQ ID NO: 940245 - DNA, 22 bp, Artificial Sequence
  chemically synthesized
agtaaactatcgcaagaacaaa

SEQ ID NO: 940246 - DNA, 22 bp, Artificial Sequence
  chemically synthesized
tcgcaagaacaaaaaaccaaac

SEQ ID NO: 940247 - DNA, 22 bp, Artificial Sequence
  chemically synthesized
tgagtgagagtatgcagtgttt

SEQ ID NO: 940248 - DNA, 22 bp, Artificial Sequence
  chemically synthesized
ccacctgtgagtgagagtatgc

SEQ ID NO: 940249 - DNA, 22 bp, Artificial Sequence
  chemically synthesized
aattcccacctgtgagtgagag

SEQ ID NO: 940250 - DNA, 22 bp, Artificial Sequence
  chemically synthesized
ttcaattcccacctgtgagtga

SEQ ID NO: 940251 - DNA, 22 bp, Artificial Sequence
  chemically synthesized
attgttcaattcccacctgtga

SEQ ID NO: 940252 - DNA, 22 bp, Artificial Sequence
  chemically synthesized
catactctcactcacaggtggg

SEQ ID NO: 940253 - DNA, 22 bp, Artificial Sequence
  chemically synthesized
tcattgttcaattcccacctgt

SEQ ID NO: 940254 - DNA, 22 bp, Artificial Sequence
  chemically synthesized
tcactcacaggtgggaattgaa

SEQ ID NO: 940255 - DNA, 22 bp, Artificial Sequence
  chemically synthesized
actcacaggtgggaattgaaca

SEQ ID NO: 940256 - DNA, 22 bp, Artificial Sequence
  chemically synthesized
acaggtgggaattgaacaatga

SEQ ID NO: 940257 - DNA, 22 bp, Artificial Sequence
  chemically synthesized
tgtccatgtgttctcattgttc

SEQ ID NO: 940258 - DNA, 22 bp, Artificial Sequence
  chemically synthesized
ctgtgtccatgtgttctcattg

SEQ ID NO: 940259 - DNA, 22 bp, Artificial Sequence
  chemically synthesized
ccattcctgtgtccatgtgttc

SEQ ID NO: 940260 - DNA, 22 bp, Artificial Sequence
  chemically synthesized
aacaatgagaacacatggacac

SEQ ID NO: 940261 - DNA, 22 bp, Artificial Sequence
  chemically synthesized
cccccaccccacaacagtcccc

SEQ ID NO: 940262 - DNA, 22 bp, Artificial Sequence
  chemically synthesized
cccccctccccccaccccacaa

SEQ ID NO: 940263 - DNA, 22 bp, Artificial Sequence
  chemically synthesized
tggggactgttgtggggtgggg

SEQ ID NO: 940264 - DNA, 22 bp, Artificial Sequence
  chemically synthesized
gggactgttgtggggtgggggg

SEQ ID NO: 940265 - DNA, 22 bp, Artificial Sequence
  chemically synthesized
tccctccccccctccccccacc

SEQ ID NO: 940266 - DNA, 22 bp, Artificial Sequence
  chemically synthesized
ttgtggggtggggggagggggg

SEQ ID NO: 940267 - DNA, 22 bp, Artificial Sequence
  chemically synthesized
atgctatccctccccccctccc

SEQ ID NO: 940268 - DNA, 22 bp, Artificial Sequence
  chemically synthesized
tggggtggggggagggggggag

SEQ ID NO: 940269 - DNA, 22 bp, Artificial Sequence
  chemically synthesized
ctaatgctatccctccccccct

SEQ ID NO: 940270 - DNA, 22 bp, Artificial Sequence
  chemically synthesized
ggtatatctcctaatgctatcc

SEQ ID NO: 940271 - DNA, 22 bp, Artificial Sequence
  chemically synthesized
gcattaggtatatctcctaatg

SEQ ID NO: 940272 - DNA, 22 bp, Artificial Sequence
  chemically synthesized
agcattaggtatatctcctaat

SEQ ID NO: 940273 - DNA, 22 bp, Artificial Sequence
  chemically synthesized
atcatttagcattaggtatatc

SEQ ID NO: 940274 - DNA, 22 bp, Artificial Sequence
  chemically synthesized
gctcatcatttagcattaggta

SEQ ID NO: 940275 - DNA, 22 bp, Artificial Sequence
  chemically synthesized
ggagatatacctaatgctaaat

SEQ ID NO: 940276 - DNA, 22 bp, Artificial Sequence
  chemically synthesized
cacccattagctcatcatttag

SEQ ID NO: 940277 - DNA, 22 bp, Artificial Sequence
  chemically synthesized
gtgtgctgcacccattagctca

SEQ ID NO: 940278 - DNA, 22 bp, Artificial Sequence
  chemically synthesized
atgctaaatgatgagctaatgg

SEQ ID NO: 940279 - DNA, 22 bp, Artificial Sequence
  chemically synthesized
aatgatgagctaatgggtgcag

SEQ ID NO: 940280 - DNA, 22 bp, Artificial Sequence
  chemically synthesized
atgggtgcagcacaccagcatg

SEQ ID NO: 940281 - DNA, 22 bp, Artificial Sequence
  chemically synthesized
catatgtatgcatgtgccatgc

SEQ ID NO: 940282 - DNA, 22 bp, Artificial Sequence
  chemically synthesized
gttacatatgtatgcatgtgcc

SEQ ID NO: 940283 - DNA, 22 bp, Artificial Sequence
  chemically synthesized
gggtacatgtgcacaatgtgca

SEQ ID NO: 940284 - DNA, 22 bp, Artificial Sequence
  chemically synthesized
agggtacatgtgcacaatgtgc

SEQ ID NO: 940285 - DNA, 22 bp, Artificial Sequence
  chemically synthesized
tagggtacatgtgcacaatgtg

SEQ ID NO: 940286 - DNA, 22 bp, Artificial Sequence
  chemically synthesized
agttttagggtacatgtgcaca

SEQ ID NO: 940287 - DNA, 22 bp, Artificial Sequence
  chemically synthesized
aagttttagggtacatgtgcac

SEQ ID NO: 940288 - DNA, 22 bp, Artificial Sequence
  chemically synthesized
acctgcacattgtgcacatgta

SEQ ID NO: 940289 - DNA, 22 bp, Artificial Sequence
  chemically synthesized
taagttttagggtacatgtgca

SEQ ID NO: 940290 - DNA, 22 bp, Artificial Sequence
  chemically synthesized
cacattgtgcacatgtacccta

SEQ ID NO: 940291 - DNA, 22 bp, Artificial Sequence
  chemically synthesized
tactttaagttttagggtacat

SEQ ID NO: 940292 - DNA, 22 bp, Artificial Sequence
  chemically synthesized
ttatactttaagttttagggta

SEQ ID NO: 940293 - DNA, 22 bp, Artificial Sequence
  chemically synthesized
ttattatactttaagttttagg

SEQ ID NO: 940294 - DNA, 22 bp, Artificial Sequence
  chemically synthesized
tgcacatgtaccctaaaactta

SEQ ID NO: 940295 - DNA, 22 bp, Artificial Sequence
  chemically synthesized
ttattattatactttaagtttt

SEQ ID NO: 940296 - DNA, 22 bp, Artificial Sequence
  chemically synthesized
ttattattattatactttaagt

SEQ ID NO: 940297 - DNA, 22 bp, Artificial Sequence
  chemically synthesized
ttattattattattatacttta

SEQ ID NO: 940298 - DNA, 22 bp, Artificial Sequence
  chemically synthesized
ttattattattattattatact

SEQ ID NO: 940299 - DNA, 22 bp, Artificial Sequence
  chemically synthesized
ttattattattattattattat

SEQ ID NO: 940300 - DNA, 22 bp, Artificial Sequence
  chemically synthesized
aaacttaaagtataataataat

SEQ ID NO: 940301 - DNA, 22 bp, Artificial Sequence
  chemically synthesized
ttattattattattattattat

SEQ ID NO: 940302 - DNA, 22 bp, Artificial Sequence
  chemically synthesized
ttattattattattattattat

SEQ ID NO: 940303 - DNA, 22 bp, Artificial Sequence
  chemically synthesized
aaagtataataataataataat

SEQ ID NO: 940304 - DNA, 22 bp, Artificial Sequence
  chemically synthesized
aagtataataataataataata

SEQ ID NO: 940305 - DNA, 22 bp, Artificial Sequence
  chemically synthesized
ttattattattattattattat

SEQ ID NO: 940306 - DNA, 22 bp, Artificial Sequence
  chemically synthesized
ttattattattattattattat

SEQ ID NO: 940307 - DNA, 22 bp, Artificial Sequence
  chemically synthesized
attattattattattattatta

SEQ ID NO: 940308 - DNA, 22 bp, Artificial Sequence
  chemically synthesized
tattattattattattattatt

SEQ ID NO: 940309 - DNA, 22 bp, Artificial Sequence
  chemically synthesized
tttattattattattattatta

SEQ ID NO: 940310 - DNA, 22 bp, Artificial Sequence
  chemically synthesized
ctttattattattattattatt

SEQ ID NO: 940311 - DNA, 22 bp, Artificial Sequence
  chemically synthesized
tctttattattattattattat

SEQ ID NO: 940312 - DNA, 22 bp, Artificial Sequence
  chemically synthesized
ttctttattattattattatta

SEQ ID NO: 940313 - DNA, 22 bp, Artificial Sequence
  chemically synthesized
ttttctttattattattattat

SEQ ID NO: 940314 - DNA, 22 bp, Artificial Sequence
  chemically synthesized
tgtccactcttttctttattat

SEQ ID NO: 940315 - DNA, 22 bp, Artificial Sequence
  chemically synthesized
tgtgtccactcttttctttatt

SEQ ID NO: 940316 - DNA, 22 bp, Artificial Sequence
  chemically synthesized
ctgtgtccactcttttctttat

SEQ ID NO: 940317 - DNA, 22 bp, Artificial Sequence
  chemically synthesized
tctgtgtccactcttttcttta

SEQ ID NO: 940318 - DNA, 22 bp, Artificial Sequence
  chemically synthesized
tgtgtctttctgtgtccactct

SEQ ID NO: 940319 - DNA, 22 bp, Artificial Sequence
  chemically synthesized
gtgtgtctttctgtgtccactc

SEQ ID NO: 940320 - DNA, 22 bp, Artificial Sequence
  chemically synthesized
tgtgtgtctttctgtgtccact

SEQ ID NO: 940321 - DNA, 22 bp, Artificial Sequence
  chemically synthesized
tttgtgtgtctttctgtgtcca

SEQ ID NO: 940322 - DNA, 22 bp, Artificial Sequence
  chemically synthesized
ctttgtgtgtctttctgtgtcc

SEQ ID NO: 940323 - DNA, 22 bp, Artificial Sequence
  chemically synthesized
ttctttgtgtgtctttctgtgt

SEQ ID NO: 940324 - DNA, 22 bp, Artificial Sequence
  chemically synthesized
acataaccctcttctttgtgtg

SEQ ID NO: 940325 - DNA, 22 bp, Artificial Sequence
  chemically synthesized
acctcacataaccctcttcttt

SEQ ID NO: 940326 - DNA, 22 bp, Artificial Sequence
  chemically synthesized
ctgacctcacataaccctcttc

SEQ ID NO: 940327 - DNA, 22 bp, Artificial Sequence
  chemically synthesized
ctcctgacctcacataaccctc

SEQ ID NO: 940328 - DNA, 22 bp, Artificial Sequence
  chemically synthesized
aacatctgctcctgacctcaca

SEQ ID NO: 940329 - DNA, 22 bp, Artificial Sequence
  chemically synthesized
tgtgaggtcaggagcagatgtt

SEQ ID NO: 940330 - DNA, 22 bp, Artificial Sequence
  chemically synthesized
aagcagcacaagttcaacatct

SEQ ID NO: 940331 - DNA, 22 bp, Artificial Sequence
  chemically synthesized
caagcagcacaagttcaacatc

SEQ ID NO: 940332 - DNA, 22 bp, Artificial Sequence
  chemically synthesized
atttcaagcagcacaagttcaa

SEQ ID NO: 940333 - DNA, 22 bp, Artificial Sequence
  chemically synthesized
gatttcaagcagcacaagttca

SEQ ID NO: 940334 - DNA, 22 bp, Artificial Sequence
  chemically synthesized
cttgatttcaagcagcacaagt

SEQ ID NO: 940335 - DNA, 22 bp, Artificial Sequence
  chemically synthesized
aacttgtgctgcttgaaatcaa

SEQ ID NO: 940336 - DNA, 22 bp, Artificial Sequence
  chemically synthesized
gtgctgcttgaaatcaaggaac

SEQ ID NO: 940337 - DNA, 22 bp, Artificial Sequence
  chemically synthesized
gtagccccaggtgttccttgat

SEQ ID NO: 940338 - DNA, 22 bp, Artificial Sequence
  chemically synthesized
tgctgcttgaaatcaaggaaca

SEQ ID NO: 940339 - DNA, 22 bp, Artificial Sequence
  chemically synthesized
tggtagccccaggtgttccttg

SEQ ID NO: 940340 - DNA, 22 bp, Artificial Sequence
  chemically synthesized
ctggtagccccaggtgttcctt

SEQ ID NO: 940341 - DNA, 22 bp, Artificial Sequence
  chemically synthesized
cttgaaatcaaggaacacctgg

SEQ ID NO: 940342 - DNA, 22 bp, Artificial Sequence
  chemically synthesized
gaaatcaaggaacacctggggc

SEQ ID NO: 940343 - DNA, 22 bp, Artificial Sequence
  chemically synthesized
cagcttctggtagccccaggtg

SEQ ID NO: 940344 - DNA, 22 bp, Artificial Sequence
  chemically synthesized
aaatcaaggaacacctggggct

SEQ ID NO: 940345 - DNA, 22 bp, Artificial Sequence
  chemically synthesized
ccagcttctggtagccccaggt

SEQ ID NO: 940346 - DNA, 22 bp, Artificial Sequence
  chemically synthesized
ttccagcttctggtagccccag

SEQ ID NO: 940347 - DNA, 22 bp, Artificial Sequence
  chemically synthesized
cctcttccagcttctggtagcc

SEQ ID NO: 940348 - DNA, 22 bp, Artificial Sequence
  chemically synthesized
gcctcttccagcttctggtagc

SEQ ID NO: 940349 - DNA, 22 bp, Artificial Sequence
  chemically synthesized
cttgcctcttccagcttctggt

SEQ ID NO: 940350 - DNA, 22 bp, Artificial Sequence
  chemically synthesized
ccttgcctcttccagcttctgg

SEQ ID NO: 940351 - DNA, 22 bp, Artificial Sequence
  chemically synthesized
ttccttgcctcttccagcttct

SEQ ID NO: 940352 - DNA, 22 bp, Artificial Sequence
  chemically synthesized
gggctaccagaagctggaagag

SEQ ID NO: 940353 - DNA, 22 bp, Artificial Sequence
  chemically synthesized
ccagaagctggaagaggcaagg

SEQ ID NO: 940354 - DNA, 22 bp, Artificial Sequence
  chemically synthesized
gggaagaattcttccttgcctc

SEQ ID NO: 940355 - DNA, 22 bp, Artificial Sequence
  chemically synthesized
tggggaagaattcttccttgcc

SEQ ID NO: 940356 - DNA, 22 bp, Artificial Sequence
  chemically synthesized
gaagaggcaaggaagaattctt

SEQ ID NO: 940357 - DNA, 22 bp, Artificial Sequence
  chemically synthesized
aaggctctggggaagaattctt

SEQ ID NO: 940358 - DNA, 22 bp, Artificial Sequence
  chemically synthesized
tgaaggctctggggaagaattc

SEQ ID NO: 940359 - DNA, 22 bp, Artificial Sequence
  chemically synthesized
tccctctgaaggctctggggaa

SEQ ID NO: 940360 - DNA, 22 bp, Artificial Sequence
  chemically synthesized
ttccccagagccttcagaggga

SEQ ID NO: 940361 - DNA, 22 bp, Artificial Sequence
  chemically synthesized
ccccagagccttcagagggata

SEQ ID NO: 940362 - DNA, 22 bp, Artificial Sequence
  chemically synthesized
cccagagccttcagagggataa

SEQ ID NO: 940363 - DNA, 22 bp, Artificial Sequence
  chemically synthesized
ggtgtccaaaatcaaggtcaat

SEQ ID NO: 940364 - DNA, 22 bp, Artificial Sequence
  chemically synthesized
cagagggataattgaccttgat

SEQ ID NO: 940365 - DNA, 22 bp, Artificial Sequence
  chemically synthesized
agagggataattgaccttgatt

SEQ ID NO: 940366 - DNA, 22 bp, Artificial Sequence
  chemically synthesized
gaagctaggtgtccaaaatcaa

SEQ ID NO: 940367 - DNA, 22 bp, Artificial Sequence
  chemically synthesized
accttgattttggacacctagc

SEQ ID NO: 940368 - DNA, 22 bp, Artificial Sequence
  chemically synthesized
acaaatctggaagctaggtgtc

SEQ ID NO: 940369 - DNA, 22 bp, Artificial Sequence
  chemically synthesized
tcacaaatctggaagctaggtg

SEQ ID NO: 940370 - DNA, 22 bp, Artificial Sequence
  chemically synthesized
tctcacaaatctggaagctagg

SEQ ID NO: 940371 - DNA, 22 bp, Artificial Sequence
  chemically synthesized
gattttggacacctagcttcca

SEQ ID NO: 940372 - DNA, 22 bp, Artificial Sequence
  chemically synthesized
attttggacacctagcttccag

SEQ ID NO: 940373 - DNA, 22 bp, Artificial Sequence
  chemically synthesized
ttctctcacaaatctggaagct

SEQ ID NO: 940374 - DNA, 22 bp, Artificial Sequence
  chemically synthesized
attctctcacaaatctggaagc

SEQ ID NO: 940375 - DNA, 22 bp, Artificial Sequence
  chemically synthesized
tggacacctagcttccagattt

SEQ ID NO: 940376 - DNA, 22 bp, Artificial Sequence
  chemically synthesized
ggacacctagcttccagatttg

SEQ ID NO: 940377 - DNA, 22 bp, Artificial Sequence
  chemically synthesized
gacacctagcttccagatttgt

SEQ ID NO: 940378 - DNA, 22 bp, Artificial Sequence
  chemically synthesized
atagacatttattctctcacaa

SEQ ID NO: 940379 - DNA, 22 bp, Artificial Sequence
  chemically synthesized
aatagacatttattctctcaca

SEQ ID NO: 940380 - DNA, 22 bp, Artificial Sequence
  chemically synthesized
gcttccagatttgtgagagaat

SEQ ID NO: 940381 - DNA, 22 bp, Artificial Sequence
  chemically synthesized
ccagatttgtgagagaataaat

SEQ ID NO: 940382 - DNA, 22 bp, Artificial Sequence
  chemically synthesized
cagatttgtgagagaataaatg

SEQ ID NO: 940383 - DNA, 22 bp, Artificial Sequence
  chemically synthesized
ggtggcttaatagacatttatt

SEQ ID NO: 940384 - DNA, 22 bp, Artificial Sequence
  chemically synthesized
gtgagagaataaatgtctatta

SEQ ID NO: 940385 - DNA, 22 bp, Artificial Sequence
  chemically synthesized
tgagagaataaatgtctattaa

SEQ ID NO: 940386 - DNA, 22 bp, Artificial Sequence
  chemically synthesized
ccacaagctgggtggcttaata

SEQ ID NO: 940387 - DNA, 22 bp, Artificial Sequence
  chemically synthesized
ttaagccacccagcttgtggta

SEQ ID NO: 940388 - DNA, 22 bp, Artificial Sequence
  chemically synthesized
agccacccagcttgtggtaatt

SEQ ID NO: 940389 - DNA, 22 bp, Artificial Sequence
  chemically synthesized
acacagatgtaacaaattacca

SEQ ID NO: 940390 - DNA, 22 bp, Artificial Sequence
  chemically synthesized
ctaacacagatgtaacaaatta

SEQ ID NO: 940391 - DNA, 22 bp, Artificial Sequence
  chemically synthesized
cctaacacagatgtaacaaatt

SEQ ID NO: 940392 - DNA, 22 bp, Artificial Sequence
  chemically synthesized
tttcctaacacagatgtaacaa

SEQ ID NO: 940393 - DNA, 22 bp, Artificial Sequence
  chemically synthesized
gtggtaatttgttacatctgtg

SEQ ID NO: 940394 - DNA, 22 bp, Artificial Sequence
  chemically synthesized
tggtaatttgttacatctgtgt

SEQ ID NO: 940395 - DNA, 22 bp, Artificial Sequence
  chemically synthesized
caattgtttcctaacacagatg

SEQ ID NO: 940396 - DNA, 22 bp, Artificial Sequence
  chemically synthesized
cctgcaattgtttcctaacaca

SEQ ID NO: 940397 - DNA, 22 bp, Artificial Sequence
  chemically synthesized
gttacatctgtgttaggaaaca

SEQ ID NO: 940398 - DNA, 22 bp, Artificial Sequence
  chemically synthesized
ttacatctgtgttaggaaacaa

SEQ ID NO: 940399 - DNA, 22 bp, Artificial Sequence
  chemically synthesized
catctgtgttaggaaacaattg

SEQ ID NO: 940400 - DNA, 22 bp, Artificial Sequence
  chemically synthesized
tgttaggaaacaattgcaggga

SEQ ID NO: 940401 - DNA, 22 bp, Artificial Sequence
  chemically synthesized
ggaaacaattgcagggagtatg

SEQ ID NO: 940402 - DNA, 22 bp, Artificial Sequence
  chemically synthesized
gcaatataggataataacaacc

SEQ ID NO: 940403 - DNA, 22 bp, Artificial Sequence
  chemically synthesized
ggcaatataggataataacaac

SEQ ID NO: 940404 - DNA, 22 bp, Artificial Sequence
  chemically synthesized
cagggagtatggttgttattat

SEQ ID NO: 940405 - DNA, 22 bp, Artificial Sequence
  chemically synthesized
gtatgcacttggcaatatagga

SEQ ID NO: 940406 - DNA, 22 bp, Artificial Sequence
  chemically synthesized
cgtatgcacttggcaatatagg

SEQ ID NO: 940407 - DNA, 22 bp, Artificial Sequence
  chemically synthesized
ttattatcctatattgccaagt

SEQ ID NO: 940408 - DNA, 22 bp, Artificial Sequence
  chemically synthesized
ttatcctatattgccaagtgca

SEQ ID NO: 940409 - DNA, 22 bp, Artificial Sequence
  chemically synthesized
aaccaaatttcgtatgcacttg

SEQ ID NO: 940410 - DNA, 22 bp, Artificial Sequence
  chemically synthesized
tcctatattgccaagtgcatac

SEQ ID NO: 940411 - DNA, 22 bp, Artificial Sequence
  chemically synthesized
tattgccaagtgcatacgaaat

SEQ ID NO: 940412 - DNA, 22 bp, Artificial Sequence
  chemically synthesized
ccaagtgcatacgaaatttggt

SEQ ID NO: 940413 - DNA, 22 bp, Artificial Sequence
  chemically synthesized
ggagaccaatagatgctaaacc

SEQ ID NO: 940414 - DNA, 22 bp, Artificial Sequence
  chemically synthesized
tgggagaccaatagatgctaaa

SEQ ID NO: 940415 - DNA, 22 bp, Artificial Sequence
  chemically synthesized
acgtgtctctgggagaccaata

SEQ ID NO: 940416 - DNA, 22 bp, Artificial Sequence
  chemically synthesized
ggtttagcatctattggtctcc

SEQ ID NO: 940417 - DNA, 22 bp, Artificial Sequence
  chemically synthesized
gtttagcatctattggtctccc

SEQ ID NO: 940418 - DNA, 22 bp, Artificial Sequence
  chemically synthesized
agcatctattggtctcccagag

SEQ ID NO: 940419 - DNA, 22 bp, Artificial Sequence
  chemically synthesized
agattgacgtgtctctgggaga

SEQ ID NO: 940420 - DNA, 22 bp, Artificial Sequence
  chemically synthesized
gcatctattggtctcccagaga

SEQ ID NO: 940421 - DNA, 22 bp, Artificial Sequence
  chemically synthesized
aagattgacgtgtctctgggag

SEQ ID NO: 940422 - DNA, 22 bp, Artificial Sequence
  chemically synthesized
taagattgacgtgtctctggga

SEQ ID NO: 940423 - DNA, 22 bp, Artificial Sequence
  chemically synthesized
ttggtctcccagagacacgtca

SEQ ID NO: 940424 - DNA, 22 bp, Artificial Sequence
  chemically synthesized
gcatcctttaagattgacgtgt

SEQ ID NO: 940425 - DNA, 22 bp, Artificial Sequence
  chemically synthesized
gtctcccagagacacgtcaatc

SEQ ID NO: 940426 - DNA, 22 bp, Artificial Sequence
  chemically synthesized
agcatcctttaagattgacgtg

SEQ ID NO: 940427 - DNA, 22 bp, Artificial Sequence
  chemically synthesized
tagcatcctttaagattgacgt

SEQ ID NO: 940428 - DNA, 22 bp, Artificial Sequence
  chemically synthesized
ttagcatcctttaagattgacg

SEQ ID NO: 940429 - DNA, 22 bp, Artificial Sequence
  chemically synthesized
ccagagacacgtcaatcttaaa

SEQ ID NO: 940430 - DNA, 22 bp, Artificial Sequence
  chemically synthesized
ccagcttttagcatcctttaag

SEQ ID NO: 940431 - DNA, 22 bp, Artificial Sequence
  chemically synthesized
aagcctaccagcttttagcatc

SEQ ID NO: 940432 - DNA, 22 bp, Artificial Sequence
  chemically synthesized
gacctaaagcctaccagctttt

SEQ ID NO: 940433 - DNA, 22 bp, Artificial Sequence
  chemically synthesized
ggacctaaagcctaccagcttt

SEQ ID NO: 940434 - DNA, 22 bp, Artificial Sequence
  chemically synthesized
aaaggatgctaaaagctggtag

SEQ ID NO: 940435 - DNA, 22 bp, Artificial Sequence
  chemically synthesized
tggacctaaagcctaccagctt

SEQ ID NO: 940436 - DNA, 22 bp, Artificial Sequence
  chemically synthesized
aaggatgctaaaagctggtagg

SEQ ID NO: 940437 - DNA, 22 bp, Artificial Sequence
  chemically synthesized
gtcaatctttggacctaaagcc

SEQ ID NO: 940438 - DNA, 22 bp, Artificial Sequence
  chemically synthesized
aaagctggtaggctttaggtcc

SEQ ID NO: 940439 - DNA, 22 bp, Artificial Sequence
  chemically synthesized
tagtcaatctttggacctaaag

SEQ ID NO: 940440 - DNA, 22 bp, Artificial Sequence
  chemically synthesized
ctagtcaatctttggacctaaa

SEQ ID NO: 940441 - DNA, 22 bp, Artificial Sequence
  chemically synthesized
cttctagtcaatctttggacct

SEQ ID NO: 940442 - DNA, 22 bp, Artificial Sequence
  chemically synthesized
acttctagtcaatctttggacc

SEQ ID NO: 940443 - DNA, 22 bp, Artificial Sequence
  chemically synthesized
tacttctagtcaatctttggac

SEQ ID NO: 940444 - DNA, 22 bp, Artificial Sequence
  chemically synthesized
gtaggctttaggtccaaagatt

SEQ ID NO: 940445 - DNA, 22 bp, Artificial Sequence
  chemically synthesized
aaatctttacttctagtcaatc

SEQ ID NO: 940446 - DNA, 22 bp, Artificial Sequence
  chemically synthesized
taggtccaaagattgactagaa

SEQ ID NO: 940447 - DNA, 22 bp, Artificial Sequence
  chemically synthesized
aggtccaaagattgactagaag

SEQ ID NO: 940448 - DNA, 22 bp, Artificial Sequence
  chemically synthesized
ggtccaaagattgactagaagt

SEQ ID NO: 940449 - DNA, 22 bp, Artificial Sequence
  chemically synthesized
gcctgaaatctttacttctagt

SEQ ID NO: 940450 - DNA, 22 bp, Artificial Sequence
  chemically synthesized
ggcctgaaatctttacttctag

SEQ ID NO: 940451 - DNA, 22 bp, Artificial Sequence
  chemically synthesized
tgtatttggcctgaaatcttta

SEQ ID NO: 940452 - DNA, 22 bp, Artificial Sequence
  chemically synthesized
ctgtgtatttggcctgaaatct

SEQ ID NO: 940453 - DNA, 22 bp, Artificial Sequence
  chemically synthesized
actagaagtaaagatttcaggc

SEQ ID NO: 940454 - DNA, 22 bp, Artificial Sequence
  chemically synthesized
gaagtaaagatttcaggccaaa

SEQ ID NO: 940455 - DNA, 22 bp, Artificial Sequence
  chemically synthesized
tgctgctgtgtatttggcctga

SEQ ID NO: 940456 - DNA, 22 bp, Artificial Sequence
  chemically synthesized
caggccaaatacacagcagcac

SEQ ID NO: 940457 - DNA, 22 bp, Artificial Sequence
  chemically synthesized
aggccaaatacacagcagcaca

SEQ ID NO: 940458 - DNA, 22 bp, Artificial Sequence
  chemically synthesized
cccaccacgtccccccaaacct

SEQ ID NO: 940459 - DNA, 22 bp, Artificial Sequence
  chemically synthesized
tccccaccacgtccccccaaac

SEQ ID NO: 940460 - DNA, 22 bp, Artificial Sequence
  chemically synthesized
ctccccaccacgtccccccaaa

SEQ ID NO: 940461 - DNA, 22 bp, Artificial Sequence
  chemically synthesized
caagatttctccccaccacgtc

SEQ ID NO: 940462 - DNA, 22 bp, Artificial Sequence
  chemically synthesized
acaagatttctccccaccacgt

SEQ ID NO: 940463 - DNA, 22 bp, Artificial Sequence
  chemically synthesized
tacaagatttctccccaccacg

SEQ ID NO: 940464 - DNA, 22 bp, Artificial Sequence
  chemically synthesized
actttacaagatttctccccac

SEQ ID NO: 940465 - DNA, 22 bp, Artificial Sequence
  chemically synthesized
ggggggacgtggtggggagaaa

SEQ ID NO: 940466 - DNA, 22 bp, Artificial Sequence
  chemically synthesized
gggggacgtggtggggagaaat

SEQ ID NO: 940467 - DNA, 22 bp, Artificial Sequence
  chemically synthesized
ttgactttacaagatttctccc

SEQ ID NO: 940468 - DNA, 22 bp, Artificial Sequence
  chemically synthesized
gaaaatggattgttgactttac

SEQ ID NO: 940469 - DNA, 22 bp, Artificial Sequence
  chemically synthesized
gacagtaactagaaaatggatt

SEQ ID NO: 940470 - DNA, 22 bp, Artificial Sequence
  chemically synthesized
gtaaagtcaacaatccattttc

SEQ ID NO: 940471 - DNA, 22 bp, Artificial Sequence
  chemically synthesized
taaagtcaacaatccattttct

SEQ ID NO: 940472 - DNA, 22 bp, Artificial Sequence
  chemically synthesized
taatgcgtgactagacagtaac

SEQ ID NO: 940473 - DNA, 22 bp, Artificial Sequence
  chemically synthesized
ataatgcgtgactagacagtaa

SEQ ID NO: 940474 - DNA, 22 bp, Artificial Sequence
  chemically synthesized
tctagttactgtctagtcacgc

SEQ ID NO: 940475 - DNA, 22 bp, Artificial Sequence
  chemically synthesized
ctagttactgtctagtcacgca

SEQ ID NO: 940476 - DNA, 22 bp, Artificial Sequence
  chemically synthesized
tgtcatttataatgcgtgacta

SEQ ID NO: 940477 - DNA, 22 bp, Artificial Sequence
  chemically synthesized
tagttactgtctagtcacgcat

SEQ ID NO: 940478 - DNA, 22 bp, Artificial Sequence
  chemically synthesized
gtgtcatttataatgcgtgact

SEQ ID NO: 940479 - DNA, 22 bp, Artificial Sequence
  chemically synthesized
gttactgtctagtcacgcatta

SEQ ID NO: 940480 - DNA, 22 bp, Artificial Sequence
  chemically synthesized
tttgtgtcatttataatgcgtg

SEQ ID NO: 940481 - DNA, 22 bp, Artificial Sequence
  chemically synthesized
ctgtctagtcacgcattataaa

SEQ ID NO: 940482 - DNA, 22 bp, Artificial Sequence
  chemically synthesized
tctagtcacgcattataaatga

SEQ ID NO: 940483 - DNA, 22 bp, Artificial Sequence
  chemically synthesized
gtcacgcattataaatgacaca

SEQ ID NO: 940484 - DNA, 22 bp, Artificial Sequence
  chemically synthesized
aagggtgagctgtttgtgtcat

SEQ ID NO: 940485 - DNA, 22 bp, Artificial Sequence
  chemically synthesized
caagggtgagctgtttgtgtca

SEQ ID NO: 940486 - DNA, 22 bp, Artificial Sequence
  chemically synthesized
agacttcaagggtgagctgttt

SEQ ID NO: 940487 - DNA, 22 bp, Artificial Sequence
  chemically synthesized
taaatgacacaaacagctcacc

SEQ ID NO: 940488 - DNA, 22 bp, Artificial Sequence
  chemically synthesized
ataatgttaagacttcaagggt

SEQ ID NO: 940489 - DNA, 22 bp, Artificial Sequence
  chemically synthesized
tgaggttcataatgttaagact

SEQ ID NO: 940490 - DNA, 22 bp, Artificial Sequence
  chemically synthesized
atgaggttcataatgttaagac

SEQ ID NO: 940491 - DNA, 22 bp, Artificial Sequence
  chemically synthesized
acccttgaagtcttaacattat

SEQ ID NO: 940492 - DNA, 22 bp, Artificial Sequence
  chemically synthesized
aaatttatgaggttcataatgt

SEQ ID NO: 940493 - DNA, 22 bp, Artificial Sequence
  chemically synthesized
aaaatttatgaggttcataatg

SEQ ID NO: 940494 - DNA, 22 bp, Artificial Sequence
  chemically synthesized
taaaatttatgaggttcataat

SEQ ID NO: 940495 - DNA, 22 bp, Artificial Sequence
  chemically synthesized
gaagtcttaacattatgaacct

SEQ ID NO: 940496 - DNA, 22 bp, Artificial Sequence
  chemically synthesized
ttaaaatttatgaggttcataa

SEQ ID NO: 940497 - DNA, 22 bp, Artificial Sequence
  chemically synthesized
aagtcttaacattatgaacctc

SEQ ID NO: 940498 - DNA, 22 bp, Artificial Sequence
  chemically synthesized
atttttaaaatttatgaggttc

SEQ ID NO: 940499 - DNA, 22 bp, Artificial Sequence
  chemically synthesized
tgatttttaaaatttatgaggt

SEQ ID NO: 940500 - DNA, 22 bp, Artificial Sequence
  chemically synthesized
aacattatgaacctcataaatt

SEQ ID NO: 940501 - DNA, 22 bp, Artificial Sequence
  chemically synthesized
acattatgaacctcataaattt

SEQ ID NO: 940502 - DNA, 22 bp, Artificial Sequence
  chemically synthesized
ttctgatttttaaaatttatga

SEQ ID NO: 940503 - DNA, 22 bp, Artificial Sequence
  chemically synthesized
attctgatttttaaaatttatg

SEQ ID NO: 940504 - DNA, 22 bp, Artificial Sequence
  chemically synthesized
tattctgatttttaaaatttat

SEQ ID NO: 940505 - DNA, 22 bp, Artificial Sequence
  chemically synthesized
tgaacctcataaattttaaaaa

SEQ ID NO: 940506 - DNA, 22 bp, Artificial Sequence
  chemically synthesized
agagactttattctgattttta

SEQ ID NO: 940507 - DNA, 22 bp, Artificial Sequence
  chemically synthesized
ataaattttaaaaatcagaata

SEQ ID NO: 940508 - DNA, 22 bp, Artificial Sequence
  chemically synthesized
aatattcagagactttattctg

SEQ ID NO: 940509 - DNA, 22 bp, Artificial Sequence
  chemically synthesized
gctgaatattcagagactttat

SEQ ID NO: 940510 - DNA, 22 bp, Artificial Sequence
  chemically synthesized
taaaaatcagaataaagtctct

SEQ ID NO: 940511 - DNA, 22 bp, Artificial Sequence
  chemically synthesized
aaaaatcagaataaagtctctg

SEQ ID NO: 940512 - DNA, 22 bp, Artificial Sequence
  chemically synthesized
aaaatcagaataaagtctctga

SEQ ID NO: 940513 - DNA, 22 bp, Artificial Sequence
  chemically synthesized
ttagctgaatattcagagactt

SEQ ID NO: 940514 - DNA, 22 bp, Artificial Sequence
  chemically synthesized
ctgttagctgaatattcagaga

SEQ ID NO: 940515 - DNA, 22 bp, Artificial Sequence
  chemically synthesized
actgttagctgaatattcagag

SEQ ID NO: 940516 - DNA, 22 bp, Artificial Sequence
  chemically synthesized
tactgttagctgaatattcaga

SEQ ID NO: 940517 - DNA, 22 bp, Artificial Sequence
  chemically synthesized
aagactttactgttagctgaat

SEQ ID NO: 940518 - DNA, 22 bp, Artificial Sequence
  chemically synthesized
gattaaagactttactgttagc

SEQ ID NO: 940519 - DNA, 22 bp, Artificial Sequence
  chemically synthesized
agattaaagactttactgttag

SEQ ID NO: 940520 - DNA, 22 bp, Artificial Sequence
  chemically synthesized
tgaatattcagctaacagtaaa

SEQ ID NO: 940521 - DNA, 22 bp, Artificial Sequence
  chemically synthesized
aatattcagctaacagtaaagt

SEQ ID NO: 940522 - DNA, 22 bp, Artificial Sequence
  chemically synthesized
agctaacagtaaagtctttaat

SEQ ID NO: 940523 - DNA, 22 bp, Artificial Sequence
  chemically synthesized
atcatccatttagattaaagac

SEQ ID NO: 940524 - DNA, 22 bp, Artificial Sequence
  chemically synthesized
catcatccatttagattaaaga

SEQ ID NO: 940525 - DNA, 22 bp, Artificial Sequence
  chemically synthesized
tcatcatccatttagattaaag

SEQ ID NO: 940526 - DNA, 22 bp, Artificial Sequence
  chemically synthesized
acagtaaagtctttaatctaaa

SEQ ID NO: 940527 - DNA, 22 bp, Artificial Sequence
  chemically synthesized
cattttcatcatccatttagat

SEQ ID NO: 940528 - DNA, 22 bp, Artificial Sequence
  chemically synthesized
tccattttcatcatccatttag

SEQ ID NO: 940529 - DNA, 22 bp, Artificial Sequence
  chemically synthesized
tctccattttcatcatccattt

SEQ ID NO: 940530 - DNA, 22 bp, Artificial Sequence
  chemically synthesized
taatctaaatggatgatgaaaa

SEQ ID NO: 940531 - DNA, 22 bp, Artificial Sequence
  chemically synthesized
aatctaaatggatgatgaaaat

SEQ ID NO: 940532 - DNA, 22 bp, Artificial Sequence
  chemically synthesized
atctaaatggatgatgaaaatg

SEQ ID NO: 940533 - DNA, 22 bp, Artificial Sequence
  chemically synthesized
acataaattctctccattttca

SEQ ID NO: 940534 - DNA, 22 bp, Artificial Sequence
  chemically synthesized
aatggatgatgaaaatggagag

SEQ ID NO: 940535 - DNA, 22 bp, Artificial Sequence
  chemically synthesized
gctaacataaattctctccatt

SEQ ID NO: 940536 - DNA, 22 bp, Artificial Sequence
  chemically synthesized
tagctaacataaattctctcca

SEQ ID NO: 940537 - DNA, 22 bp, Artificial Sequence
  chemically synthesized
ctagctaacataaattctctcc

SEQ ID NO: 940538 - DNA, 22 bp, Artificial Sequence
  chemically synthesized
tctagctaacataaattctctc

SEQ ID NO: 940539 - DNA, 22 bp, Artificial Sequence
  chemically synthesized
attttctagctaacataaattc

SEQ ID NO: 940540 - DNA, 22 bp, Artificial Sequence
  chemically synthesized
aattttctagctaacataaatt

SEQ ID NO: 940541 - DNA, 22 bp, Artificial Sequence
  chemically synthesized
agtagtcttaattttctagcta

SEQ ID NO: 940542 - DNA, 22 bp, Artificial Sequence
  chemically synthesized
ttcagtagtcttaattttctag

SEQ ID NO: 940543 - DNA, 22 bp, Artificial Sequence
  chemically synthesized
atgttagctagaaaattaagac

SEQ ID NO: 940544 - DNA, 22 bp, Artificial Sequence
  chemically synthesized
tgttagctagaaaattaagact

SEQ ID NO: 940545 - DNA, 22 bp, Artificial Sequence
  chemically synthesized
gctagaaaattaagactactga

SEQ ID NO: 940546 - DNA, 22 bp, Artificial Sequence
  chemically synthesized
aaagaaaaattattcagtagtc

SEQ ID NO: 940547 - DNA, 22 bp, Artificial Sequence
  chemically synthesized
gaaaattaagactactgaataa

SEQ ID NO: 940548 - DNA, 22 bp, Artificial Sequence
  chemically synthesized
gctgaaagaaaaattattcagt

SEQ ID NO: 940549 - DNA, 22 bp, Artificial Sequence
  chemically synthesized
agactactgaataatttttctt

SEQ ID NO: 940550 - DNA, 22 bp, Artificial Sequence
  chemically synthesized
tatggaacactagctgaaagaa

SEQ ID NO: 940551 - DNA, 22 bp, Artificial Sequence
  chemically synthesized
ctgaataatttttctttcagct

SEQ ID NO: 940552 - DNA, 22 bp, Artificial Sequence
  chemically synthesized
aataatttttctttcagctagt

SEQ ID NO: 940553 - DNA, 22 bp, Artificial Sequence
  chemically synthesized
ttctttcagctagtgttccata

SEQ ID NO: 940554 - DNA, 22 bp, Artificial Sequence
  chemically synthesized
tctttcagctagtgttccatat

SEQ ID NO: 940555 - DNA, 22 bp, Artificial Sequence
  chemically synthesized
ctttcagctagtgttccatata

SEQ ID NO: 940556 - DNA, 22 bp, Artificial Sequence
  chemically synthesized
tttcagctagtgttccatataa

SEQ ID NO: 940557 - DNA, 22 bp, Artificial Sequence
  chemically synthesized
tcagctagtgttccatataatg

SEQ ID NO: 940558 - DNA, 22 bp, Artificial Sequence
  chemically synthesized
cagctagtgttccatataatgg

SEQ ID NO: 940559 - DNA, 22 bp, Artificial Sequence
  chemically synthesized
agctagtgttccatataatggt

SEQ ID NO: 940560 - DNA, 22 bp, Artificial Sequence
  chemically synthesized
gtgttccatataatggtgatat

SEQ ID NO: 940561 - DNA, 22 bp, Artificial Sequence
  chemically synthesized
catatatgccaaaatatcacca

SEQ ID NO: 940562 - DNA, 22 bp, Artificial Sequence
  chemically synthesized
acatatatgccaaaatatcacc

SEQ ID NO: 940563 - DNA, 22 bp, Artificial Sequence
  chemically synthesized
catataatggtgatattttggc

SEQ ID NO: 940564 - DNA, 22 bp, Artificial Sequence
  chemically synthesized
tcttacatatatgccaaaatat

SEQ ID NO: 940565 - DNA, 22 bp, Artificial Sequence
  chemically synthesized
gtaagtgttatcttacatatat

SEQ ID NO: 940566 - DNA, 22 bp, Artificial Sequence
  chemically synthesized
agtaagtgttatcttacatata

SEQ ID NO: 940567 - DNA, 22 bp, Artificial Sequence
  chemically synthesized
tagtaagtgttatcttacatat

SEQ ID NO: 940568 - DNA, 22 bp, Artificial Sequence
  chemically synthesized
ttagtaagtgttatcttacata

SEQ ID NO: 940569 - DNA, 22 bp, Artificial Sequence
  chemically synthesized
tttagtaagtgttatcttacat

SEQ ID NO: 940570 - DNA, 22 bp, Artificial Sequence
  chemically synthesized
ttttagtaagtgttatcttaca

SEQ ID NO: 940571 - DNA, 22 bp, Artificial Sequence
  chemically synthesized
ttttttagtaagtgttatctta

SEQ ID NO: 940572 - DNA, 22 bp, Artificial Sequence
  chemically synthesized
tggcatatatgtaagataacac

SEQ ID NO: 940573 - DNA, 22 bp, Artificial Sequence
  chemically synthesized
cttttttagtaagtgttatctt

SEQ ID NO: 940574 - DNA, 22 bp, Artificial Sequence
  chemically synthesized
ggcatatatgtaagataacact

SEQ ID NO: 940575 - DNA, 22 bp, Artificial Sequence
  chemically synthesized
gcatatatgtaagataacactt

SEQ ID NO: 940576 - DNA, 22 bp, Artificial Sequence
  chemically synthesized
acatgcatcagataatttcttt

SEQ ID NO: 940577 - DNA, 22 bp, Artificial Sequence
  chemically synthesized
cacatgcatcagataatttctt

SEQ ID NO: 940578 - DNA, 22 bp, Artificial Sequence
  chemically synthesized
tcacatgcatcagataatttct

SEQ ID NO: 940579 - DNA, 22 bp, Artificial Sequence
  chemically synthesized
actaaaaaagaaattatctgat

SEQ ID NO: 940580 - DNA, 22 bp, Artificial Sequence
  chemically synthesized
ctaaaaaagaaattatctgatg

SEQ ID NO: 940581 - DNA, 22 bp, Artificial Sequence
  chemically synthesized
aattttcacatgcatcagataa

SEQ ID NO: 940582 - DNA, 22 bp, Artificial Sequence
  chemically synthesized
taaattttcacatgcatcagat

SEQ ID NO: 940583 - DNA, 22 bp, Artificial Sequence
  chemically synthesized
aaaaagaaattatctgatgcat

SEQ ID NO: 940584 - DNA, 22 bp, Artificial Sequence
  chemically synthesized
tctctaaattttcacatgcatc

SEQ ID NO: 940585 - DNA, 22 bp, Artificial Sequence
  chemically synthesized
tctgatgcatgtgaaaatttag

SEQ ID NO: 940586 - DNA, 22 bp, Artificial Sequence
  chemically synthesized
atgcatgtgaaaatttagagac

SEQ ID NO: 940587 - DNA, 22 bp, Artificial Sequence
  chemically synthesized
atcggtagtaatgacctgtctc

SEQ ID NO: 940588 - DNA, 22 bp, Artificial Sequence
  chemically synthesized
gatcggtagtaatgacctgtct

SEQ ID NO: 940589 - DNA, 22 bp, Artificial Sequence
  chemically synthesized
agagacaggtcattactaccga

SEQ ID NO: 940590 - DNA, 22 bp, Artificial Sequence
  chemically synthesized
gagacaggtcattactaccgat

SEQ ID NO: 940591 - DNA, 22 bp, Artificial Sequence
  chemically synthesized
aaatgggcagtagcaaatcatc

SEQ ID NO: 940592 - DNA, 22 bp, Artificial Sequence
  chemically synthesized
ctaccgatcaagatgatttgct

SEQ ID NO: 940593 - DNA, 22 bp, Artificial Sequence
  chemically synthesized
tcaaatgggcagtagcaaatca

SEQ ID NO: 940594 - DNA, 22 bp, Artificial Sequence
  chemically synthesized
ccgatcaagatgatttgctact

SEQ ID NO: 940595 - DNA, 22 bp, Artificial Sequence
  chemically synthesized
tactctcaaatgggcagtagca

SEQ ID NO: 940596 - DNA, 22 bp, Artificial Sequence
  chemically synthesized
atactctcaaatgggcagtagc

SEQ ID NO: 940597 - DNA, 22 bp, Artificial Sequence
  chemically synthesized
tccccttatactctcaaatggg

SEQ ID NO: 940598 - DNA, 22 bp, Artificial Sequence
  chemically synthesized
gctactgcccatttgagagtat

SEQ ID NO: 940599 - DNA, 22 bp, Artificial Sequence
  chemically synthesized
ctactgcccatttgagagtata

SEQ ID NO: 940600 - DNA, 22 bp, Artificial Sequence
  chemically synthesized
ctgcccatttgagagtataagg

SEQ ID NO: 940601 - DNA, 22 bp, Artificial Sequence
  chemically synthesized
cccatttgagagtataagggga

SEQ ID NO: 940602 - DNA, 22 bp, Artificial Sequence
  chemically synthesized
gagagtataaggggacagtggg

SEQ ID NO: 940603 - DNA, 22 bp, Artificial Sequence
  chemically synthesized
agagtataaggggacagtgggc

SEQ ID NO: 940604 - DNA, 22 bp, Artificial Sequence
  chemically synthesized
atagtcacaccggagcccactg

SEQ ID NO: 940605 - DNA, 22 bp, Artificial Sequence
  chemically synthesized
agggcatatgttcatagtcaca

SEQ ID NO: 940606 - DNA, 22 bp, Artificial Sequence
  chemically synthesized
ctgagggcatatgttcatagtc

SEQ ID NO: 940607 - DNA, 22 bp, Artificial Sequence
  chemically synthesized
actgagggcatatgttcatagt

SEQ ID NO: 940608 - DNA, 22 bp, Artificial Sequence
  chemically synthesized
cttactgagggcatatgttcat

SEQ ID NO: 940609 - DNA, 22 bp, Artificial Sequence
  chemically synthesized
cggtgtgactatgaacatatgc

SEQ ID NO: 940610 - DNA, 22 bp, Artificial Sequence
  chemically synthesized
ccctgcttactgagggcatatg

SEQ ID NO: 940611 - DNA, 22 bp, Artificial Sequence
  chemically synthesized
tgaacatatgccctcagtaagc

SEQ ID NO: 940612 - DNA, 22 bp, Artificial Sequence
  chemically synthesized
agggatgcaagctgccctgctt

SEQ ID NO: 940613 - DNA, 22 bp, Artificial Sequence
  chemically synthesized
tcagggatgcaagctgccctgc

SEQ ID NO: 940614 - DNA, 22 bp, Artificial Sequence
  chemically synthesized
ctcagggatgcaagctgccctg

SEQ ID NO: 940615 - DNA, 22 bp, Artificial Sequence
  chemically synthesized
cttctcagggatgcaagctgcc

SEQ ID NO: 940616 - DNA, 22 bp, Artificial Sequence
  chemically synthesized
acttctcagggatgcaagctgc

SEQ ID NO: 940617 - DNA, 22 bp, Artificial Sequence
  chemically synthesized
agtaagcagggcagcttgcatc

SEQ ID NO: 940618 - DNA, 22 bp, Artificial Sequence
  chemically synthesized
atttacttctcagggatgcaag

SEQ ID NO: 940619 - DNA, 22 bp, Artificial Sequence
  chemically synthesized
tactcatttacttctcagggat

SEQ ID NO: 940620 - DNA, 22 bp, Artificial Sequence
  chemically synthesized
gcatccctgagaagtaaatgag

SEQ ID NO: 940621 - DNA, 22 bp, Artificial Sequence
  chemically synthesized
catccctgagaagtaaatgagt

SEQ ID NO: 940622 - DNA, 22 bp, Artificial Sequence
  chemically synthesized
aggagagcacatctatactcat

SEQ ID NO: 940623 - DNA, 22 bp, Artificial Sequence
  chemically synthesized
gaggagagcacatctatactca

SEQ ID NO: 940624 - DNA, 22 bp, Artificial Sequence
  chemically synthesized
tgaggagagcacatctatactc

SEQ ID NO: 940625 - DNA, 22 bp, Artificial Sequence
  chemically synthesized
ttgaggagagcacatctatact

SEQ ID NO: 940626 - DNA, 22 bp, Artificial Sequence
  chemically synthesized
agaagtaaatgagtatagatgt

SEQ ID NO: 940627 - DNA, 22 bp, Artificial Sequence
  chemically synthesized
gtgggaagggaaagcttttgag

SEQ ID NO: 940628 - DNA, 22 bp, Artificial Sequence
  chemically synthesized
ctggtgggaagggaaagctttt

SEQ ID NO: 940629 - DNA, 22 bp, Artificial Sequence
  chemically synthesized
tcctcaaaagctttcccttccc

SEQ ID NO: 940630 - DNA, 22 bp, Artificial Sequence
  chemically synthesized
ctcaaaagctttcccttcccac

SEQ ID NO: 940631 - DNA, 22 bp, Artificial Sequence
  chemically synthesized
caaacactcctggtgggaaggg

SEQ ID NO: 940632 - DNA, 22 bp, Artificial Sequence
  chemically synthesized
acaaacactcctggtgggaagg

SEQ ID NO: 940633 - DNA, 22 bp, Artificial Sequence
  chemically synthesized
aaaagctttcccttcccaccag

SEQ ID NO: 940634 - DNA, 22 bp, Artificial Sequence
  chemically synthesized
aacatttacaaacactcctggt

SEQ ID NO: 940635 - DNA, 22 bp, Artificial Sequence
  chemically synthesized
tcccttcccaccaggagtgttt

SEQ ID NO: 940636 - DNA, 22 bp, Artificial Sequence
  chemically synthesized
cccttcccaccaggagtgtttg

SEQ ID NO: 940637 - DNA, 22 bp, Artificial Sequence
  chemically synthesized
ccttcccaccaggagtgtttgt

SEQ ID NO: 940638 - DNA, 22 bp, Artificial Sequence
  chemically synthesized
gcctcaacatttacaaacactc

SEQ ID NO: 940639 - DNA, 22 bp, Artificial Sequence
  chemically synthesized
cccaccaggagtgtttgtaaat

SEQ ID NO: 940640 - DNA, 22 bp, Artificial Sequence
  chemically synthesized
ccaccaggagtgtttgtaaatg

SEQ ID NO: 940641 - DNA, 22 bp, Artificial Sequence
  chemically synthesized
cacctagcctcaacatttacaa

SEQ ID NO: 940642 - DNA, 22 bp, Artificial Sequence
  chemically synthesized
ccacctagcctcaacatttaca

SEQ ID NO: 940643 - DNA, 22 bp, Artificial Sequence
  chemically synthesized
tccacctagcctcaacatttac

SEQ ID NO: 940644 - DNA, 22 bp, Artificial Sequence
  chemically synthesized
tttccacctagcctcaacattt

SEQ ID NO: 940645 - DNA, 22 bp, Artificial Sequence
  chemically synthesized
caactctttccacctagcctca

SEQ ID NO: 940646 - DNA, 22 bp, Artificial Sequence
  chemically synthesized
ttccaactctttccacctagcc

SEQ ID NO: 940647 - DNA, 22 bp, Artificial Sequence
  chemically synthesized
gtaaatgttgaggctaggtgga

SEQ ID NO: 940648 - DNA, 22 bp, Artificial Sequence
  chemically synthesized
taaatgttgaggctaggtggaa

SEQ ID NO: 940649 - DNA, 22 bp, Artificial Sequence
  chemically synthesized
aggctaggtggaaagagttgga

SEQ ID NO: 940650 - DNA, 22 bp, Artificial Sequence
  chemically synthesized
caaaaatgtatcctattccaac

SEQ ID NO: 940651 - DNA, 22 bp, Artificial Sequence
  chemically synthesized
gcaaaaatgtatcctattccaa

SEQ ID NO: 940652 - DNA, 22 bp, Artificial Sequence
  chemically synthesized
ggtggaaagagttggaatagga

SEQ ID NO: 940653 - DNA, 22 bp, Artificial Sequence
  chemically synthesized
tatcatttgcaaaaatgtatcc

SEQ ID NO: 940654 - DNA, 22 bp, Artificial Sequence
  chemically synthesized
atatcatttgcaaaaatgtatc

SEQ ID NO: 940655 - DNA, 22 bp, Artificial Sequence
  chemically synthesized
tatatcatttgcaaaaatgtat

SEQ ID NO: 940656 - DNA, 22 bp, Artificial Sequence
  chemically synthesized
tttatatcatttgcaaaaatgt

SEQ ID NO: 940657 - DNA, 22 bp, Artificial Sequence
  chemically synthesized
gaataggatacatttttgcaaa

SEQ ID NO: 940658 - DNA, 22 bp, Artificial Sequence
  chemically synthesized
atatcaccctctttatatcatt

SEQ ID NO: 940659 - DNA, 22 bp, Artificial Sequence
  chemically synthesized
tattcatatcaccctctttata

SEQ ID NO: 940660 - DNA, 22 bp, Artificial Sequence
  chemically synthesized
ttgcaaatgatataaagagggt

SEQ ID NO: 940661 - DNA, 22 bp, Artificial Sequence
  chemically synthesized
tgtattcatatcaccctcttta

SEQ ID NO: 940662 - DNA, 22 bp, Artificial Sequence
  chemically synthesized
tgcaaatgatataaagagggtg

SEQ ID NO: 940663 - DNA, 22 bp, Artificial Sequence
  chemically synthesized
gcaaatgatataaagagggtga

SEQ ID NO: 940664 - DNA, 22 bp, Artificial Sequence
  chemically synthesized
caaatgatataaagagggtgat

SEQ ID NO: 940665 - DNA, 22 bp, Artificial Sequence
  chemically synthesized
cacaattctgtattcatatcac

SEQ ID NO: 940666 - DNA, 22 bp, Artificial Sequence
  chemically synthesized
aaagctccacaattctgtattc

SEQ ID NO: 940667 - DNA, 22 bp, Artificial Sequence
  chemically synthesized
caaagctccacaattctgtatt

SEQ ID NO: 940668 - DNA, 22 bp, Artificial Sequence
  chemically synthesized
ttcaaagctccacaattctgta

SEQ ID NO: 940669 - DNA, 22 bp, Artificial Sequence
  chemically synthesized
tcttcaaagctccacaattctg

SEQ ID NO: 940670 - DNA, 22 bp, Artificial Sequence
  chemically synthesized
ctcttcaaagctccacaattct

SEQ ID NO: 940671 - DNA, 22 bp, Artificial Sequence
  chemically synthesized
tctcttcaaagctccacaattc

SEQ ID NO: 940672 - DNA, 22 bp, Artificial Sequence
  chemically synthesized
cctttctcttcaaagctccaca

SEQ ID NO: 940673 - DNA, 22 bp, Artificial Sequence
  chemically synthesized
ttccctttctcttcaaagctcc

SEQ ID NO: 940674 - DNA, 22 bp, Artificial Sequence
  chemically synthesized
atcattattccctttctcttca

SEQ ID NO: 940675 - DNA, 22 bp, Artificial Sequence
  chemically synthesized
tggagctttgaagagaaaggga

SEQ ID NO: 940676 - DNA, 22 bp, Artificial Sequence
  chemically synthesized
agtaaatgctaatcattattcc

SEQ ID NO: 940677 - DNA, 22 bp, Artificial Sequence
  chemically synthesized
tgaagagaaagggaataatgat

SEQ ID NO: 940678 - DNA, 22 bp, Artificial Sequence
  chemically synthesized
gaagagaaagggaataatgatt

SEQ ID NO: 940679 - DNA, 22 bp, Artificial Sequence
  chemically synthesized
aagagaaagggaataatgatta

SEQ ID NO: 940680 - DNA, 22 bp, Artificial Sequence
  chemically synthesized
gcacaaaatcggtactcagtaa

SEQ ID NO: 940681 - DNA, 22 bp, Artificial Sequence
  chemically synthesized
ggcacaaaatcggtactcagta

SEQ ID NO: 940682 - DNA, 22 bp, Artificial Sequence
  chemically synthesized
gcatttactgagtaccgatttt

SEQ ID NO: 940683 - DNA, 22 bp, Artificial Sequence
  chemically synthesized
aacaagatttggcacaaaatcg

SEQ ID NO: 940684 - DNA, 22 bp, Artificial Sequence
  chemically synthesized
actgagtaccgattttgtgcca

SEQ ID NO: 940685 - DNA, 22 bp, Artificial Sequence
  chemically synthesized
ctgagtaccgattttgtgccaa

SEQ ID NO: 940686 - DNA, 22 bp, Artificial Sequence
  chemically synthesized
agtaccgattttgtgccaaatc

SEQ ID NO: 940687 - DNA, 22 bp, Artificial Sequence
  chemically synthesized
aaaatgctcaacaagatttggc

SEQ ID NO: 940688 - DNA, 22 bp, Artificial Sequence
  chemically synthesized
tgtgccaaatcttgttgagcat

SEQ ID NO: 940689 - DNA, 22 bp, Artificial Sequence
  chemically synthesized
gtgccaaatcttgttgagcatt

SEQ ID NO: 940690 - DNA, 22 bp, Artificial Sequence
  chemically synthesized
tgccaaatcttgttgagcattt

SEQ ID NO: 940691 - DNA, 22 bp, Artificial Sequence
  chemically synthesized
aataaatgagtgtattaaaaat

SEQ ID NO: 940692 - DNA, 22 bp, Artificial Sequence
  chemically synthesized
gttgagcatttttaatacactc

SEQ ID NO: 940693 - DNA, 22 bp, Artificial Sequence
  chemically synthesized
ttgagcatttttaatacactca

SEQ ID NO: 940694 - DNA, 22 bp, Artificial Sequence
  chemically synthesized
gaattaaataaatgagtgtatt

SEQ ID NO: 940695 - DNA, 22 bp, Artificial Sequence
  chemically synthesized
agcatttttaatacactcattt

SEQ ID NO: 940696 - DNA, 22 bp, Artificial Sequence
  chemically synthesized
ttggaattaaataaatgagtgt

SEQ ID NO: 940697 - DNA, 22 bp, Artificial Sequence
  chemically synthesized
gttggaattaaataaatgagtg

SEQ ID NO: 940698 - DNA, 22 bp, Artificial Sequence
  chemically synthesized
ttgttggaattaaataaatgag

SEQ ID NO: 940699 - DNA, 22 bp, Artificial Sequence
  chemically synthesized
ttaatacactcatttatttaat

SEQ ID NO: 940700 - DNA, 22 bp, Artificial Sequence
  chemically synthesized
taatacactcatttatttaatt

SEQ ID NO: 940701 - DNA, 22 bp, Artificial Sequence
  chemically synthesized
aatacactcatttatttaattc

SEQ ID NO: 940702 - DNA, 22 bp, Artificial Sequence
  chemically synthesized
atacactcatttatttaattcc

SEQ ID NO: 940703 - DNA, 22 bp, Artificial Sequence
  chemically synthesized
cagaactcttgttggaattaaa

SEQ ID NO: 940704 - DNA, 22 bp, Artificial Sequence
  chemically synthesized
atactgcagaactcttgttgga

SEQ ID NO: 940705 - DNA, 22 bp, Artificial Sequence
  chemically synthesized
atttatttaattccaacaagag

SEQ ID NO: 940706 - DNA, 22 bp, Artificial Sequence
  chemically synthesized
ctcatactgcagaactcttgtt

SEQ ID NO: 940707 - DNA, 22 bp, Artificial Sequence
  chemically synthesized
atttaattccaacaagagttct

SEQ ID NO: 940708 - DNA, 22 bp, Artificial Sequence
  chemically synthesized
tttaattccaacaagagttctg

SEQ ID NO: 940709 - DNA, 22 bp, Artificial Sequence
  chemically synthesized
aattccaacaagagttctgcag

SEQ ID NO: 940710 - DNA, 22 bp, Artificial Sequence
  chemically synthesized
attccaacaagagttctgcagt

SEQ ID NO: 940711 - DNA, 22 bp, Artificial Sequence
  chemically synthesized
caacaagagttctgcagtatga

SEQ ID NO: 940712 - DNA, 22 bp, Artificial Sequence
  chemically synthesized
taaaataggtactactcatact

SEQ ID NO: 940713 - DNA, 22 bp, Artificial Sequence
  chemically synthesized
acctgtaaaataggtactactc

SEQ ID NO: 940714 - DNA, 22 bp, Artificial Sequence
  chemically synthesized
tgcagtatgagtagtacctatt

SEQ ID NO: 940715 - DNA, 22 bp, Artificial Sequence
  chemically synthesized
cctcacctgtaaaataggtact

SEQ ID NO: 940716 - DNA, 22 bp, Artificial Sequence
  chemically synthesized
cagtatgagtagtacctatttt

SEQ ID NO: 940717 - DNA, 22 bp, Artificial Sequence
  chemically synthesized
aattacctcacctgtaaaatag

SEQ ID NO: 940718 - DNA, 22 bp, Artificial Sequence
  chemically synthesized
tgatcctcaattacctcacctg

SEQ ID NO: 940719 - DNA, 22 bp, Artificial Sequence
  chemically synthesized
atcctatgatcctcaattacct

SEQ ID NO: 940720 - DNA, 22 bp, Artificial Sequence
  chemically synthesized
ttttacaggtgaggtaattgag

SEQ ID NO: 940721 - DNA, 22 bp, Artificial Sequence
  chemically synthesized
aatcctatgatcctcaattacc

SEQ ID NO: 940722 - DNA, 22 bp, Artificial Sequence
  chemically synthesized
taatcctatgatcctcaattac

SEQ ID NO: 940723 - DNA, 22 bp, Artificial Sequence
  chemically synthesized
ttaatcctatgatcctcaatta

SEQ ID NO: 940724 - DNA, 22 bp, Artificial Sequence
  chemically synthesized
tacaggtgaggtaattgaggat

SEQ ID NO: 940725 - DNA, 22 bp, Artificial Sequence
  chemically synthesized
tttaatcctatgatcctcaatt

SEQ ID NO: 940726 - DNA, 22 bp, Artificial Sequence
  chemically synthesized
acaggtgaggtaattgaggatc

SEQ ID NO: 940727 - DNA, 22 bp, Artificial Sequence
  chemically synthesized
ttttaatcctatgatcctcaat

SEQ ID NO: 940728 - DNA, 22 bp, Artificial Sequence
  chemically synthesized
caggtgaggtaattgaggatca

SEQ ID NO: 940729 - DNA, 22 bp, Artificial Sequence
  chemically synthesized
tttttaatcctatgatcctcaa

SEQ ID NO: 940730 - DNA, 22 bp, Artificial Sequence
  chemically synthesized
aggtaattttttttaatcctat

SEQ ID NO: 940731 - DNA, 22 bp, Artificial Sequence
  chemically synthesized
aggatcataggattaaaaaaaa

SEQ ID NO: 940732 - DNA, 22 bp, Artificial Sequence
  chemically synthesized
tgtaaattcaggtaattttttt

SEQ ID NO: 940733 - DNA, 22 bp, Artificial Sequence
  chemically synthesized
aaaaaaattacctgaatttaca

SEQ ID NO: 940734 - DNA, 22 bp, Artificial Sequence
  chemically synthesized
catccacacatactgtgtaaat

SEQ ID NO: 940735 - DNA, 22 bp, Artificial Sequence
  chemically synthesized
acatccacacatactgtgtaaa

SEQ ID NO: 940736 - DNA, 22 bp, Artificial Sequence
  chemically synthesized
tttacatccacacatactgtgt

SEQ ID NO: 940737 - DNA, 22 bp, Artificial Sequence
  chemically synthesized
cctgaatttacacagtatgtgt

SEQ ID NO: 940738 - DNA, 22 bp, Artificial Sequence
  chemically synthesized
aatttacacagtatgtgtggat

SEQ ID NO: 940739 - DNA, 22 bp, Artificial Sequence
  chemically synthesized
acacagtatgtgtggatgtaaa

SEQ ID NO: 940740 - DNA, 22 bp, Artificial Sequence
  chemically synthesized
cacagtatgtgtggatgtaaac

SEQ ID NO: 940741 - DNA, 22 bp, Artificial Sequence
  chemically synthesized
ggtccaagaatacaagagaatg

SEQ ID NO: 940742 - DNA, 22 bp, Artificial Sequence
  chemically synthesized
aggtccaagaatacaagagaat

SEQ ID NO: 940743 - DNA, 22 bp, Artificial Sequence
  chemically synthesized
taggtccaagaatacaagagaa

SEQ ID NO: 940744 - DNA, 22 bp, Artificial Sequence
  chemically synthesized
ttaggtccaagaatacaagaga

SEQ ID NO: 940745 - DNA, 22 bp, Artificial Sequence
  chemically synthesized
tgccattctcttgtattcttgg

SEQ ID NO: 940746 - DNA, 22 bp, Artificial Sequence
  chemically synthesized
ggtcttttaggtccaagaatac

SEQ ID NO: 940747 - DNA, 22 bp, Artificial Sequence
  chemically synthesized
gccattctcttgtattcttgga

SEQ ID NO: 940748 - DNA, 22 bp, Artificial Sequence
  chemically synthesized
ccattctcttgtattcttggac

SEQ ID NO: 940749 - DNA, 22 bp, Artificial Sequence
  chemically synthesized
tcttgtattcttggacctaaaa

SEQ ID NO: 940750 - DNA, 22 bp, Artificial Sequence
  chemically synthesized
ttgtattcttggacctaaaaga

SEQ ID NO: 940751 - DNA, 22 bp, Artificial Sequence
  chemically synthesized
gtattcttggacctaaaagacc

SEQ ID NO: 940752 - DNA, 22 bp, Artificial Sequence
  chemically synthesized
tattcttggacctaaaagacct

SEQ ID NO: 940753 - DNA, 22 bp, Artificial Sequence
  chemically synthesized
tacaaccacaccgttaggtctt

SEQ ID NO: 940754 - DNA, 22 bp, Artificial Sequence
  chemically synthesized
atacaaccacaccgttaggtct

SEQ ID NO: 940755 - DNA, 22 bp, Artificial Sequence
  chemically synthesized
ttggacctaaaagacctaacgg

SEQ ID NO: 940756 - DNA, 22 bp, Artificial Sequence
  chemically synthesized
ggacctaaaagacctaacggtg

SEQ ID NO: 940757 - DNA, 22 bp, Artificial Sequence
  chemically synthesized
cttatacaaccacaccgttagg

SEQ ID NO: 940758 - DNA, 22 bp, Artificial Sequence
  chemically synthesized
gacctaaaagacctaacggtgt

SEQ ID NO: 940759 - DNA, 22 bp, Artificial Sequence
  chemically synthesized
gcttatacaaccacaccgttag

SEQ ID NO: 940760 - DNA, 22 bp, Artificial Sequence
  chemically synthesized
tgcttatacaaccacaccgtta

SEQ ID NO: 940761 - DNA, 22 bp, Artificial Sequence
  chemically synthesized
aaagacctaacggtgtggttgt

SEQ ID NO: 940762 - DNA, 22 bp, Artificial Sequence
  chemically synthesized
tccattttgcttatacaaccac

SEQ ID NO: 940763 - DNA, 22 bp, Artificial Sequence
  chemically synthesized
acggtgtggttgtataagcaaa

SEQ ID NO: 940764 - DNA, 22 bp, Artificial Sequence
  chemically synthesized
aagtctatccattttgcttata

SEQ ID NO: 940765 - DNA, 22 bp, Artificial Sequence
  chemically synthesized
caagtctatccattttgcttat

SEQ ID NO: 940766 - DNA, 22 bp, Artificial Sequence
  chemically synthesized
tcaagtctatccattttgctta

SEQ ID NO: 940767 - DNA, 22 bp, Artificial Sequence
  chemically synthesized
aaactttcaagtctatccattt

SEQ ID NO: 940768 - DNA, 22 bp, Artificial Sequence
  chemically synthesized
tataagcaaaatggatagactt

SEQ ID NO: 940769 - DNA, 22 bp, Artificial Sequence
  chemically synthesized
atactaaaactttcaagtctat

SEQ ID NO: 940770 - DNA, 22 bp, Artificial Sequence
  chemically synthesized
ttcatactaaaactttcaagtc

SEQ ID NO: 940771 - DNA, 22 bp, Artificial Sequence
  chemically synthesized
attcatactaaaactttcaagt

SEQ ID NO: 940772 - DNA, 22 bp, Artificial Sequence
  chemically synthesized
ttattcatactaaaactttcaa

SEQ ID NO: 940773 - DNA, 22 bp, Artificial Sequence
  chemically synthesized
ccacagtctcttattcatacta

SEQ ID NO: 940774 - DNA, 22 bp, Artificial Sequence
  chemically synthesized
taccacagtctcttattcatac

SEQ ID NO: 940775 - DNA, 22 bp, Artificial Sequence
  chemically synthesized
ctaccacagtctcttattcata

SEQ ID NO: 940776 - DNA, 22 bp, Artificial Sequence
  chemically synthesized
gaaagttttagtatgaataaga

SEQ ID NO: 940777 - DNA, 22 bp, Artificial Sequence
  chemically synthesized
tctaccacagtctcttattcat

SEQ ID NO: 940778 - DNA, 22 bp, Artificial Sequence
  chemically synthesized
aaagttttagtatgaataagag

SEQ ID NO: 940779 - DNA, 22 bp, Artificial Sequence
  chemically synthesized
ttctaccacagtctcttattca

SEQ ID NO: 940780 - DNA, 22 bp, Artificial Sequence
  chemically synthesized
tagtatgaataagagactgtgg

SEQ ID NO: 940781 - DNA, 22 bp, Artificial Sequence
  chemically synthesized
agtatgaataagagactgtggt

SEQ ID NO: 940782 - DNA, 22 bp, Artificial Sequence
  chemically synthesized
gtatgaataagagactgtggta

SEQ ID NO: 940783 - DNA, 22 bp, Artificial Sequence
  chemically synthesized
aaaaatgtttttctaccacagt

SEQ ID NO: 940784 - DNA, 22 bp, Artificial Sequence
  chemically synthesized
aaaaaatgtttttctaccacag

SEQ ID NO: 940785 - DNA, 22 bp, Artificial Sequence
  chemically synthesized
taaaaaatgtttttctaccaca

SEQ ID NO: 940786 - DNA, 22 bp, Artificial Sequence
  chemically synthesized
cagttttaaaaaatgtttttct

SEQ ID NO: 940787 - DNA, 22 bp, Artificial Sequence
  chemically synthesized
aatctacagttttaaaaaatgt

SEQ ID NO: 940788 - DNA, 22 bp, Artificial Sequence
  chemically synthesized
tggtagaaaaacattttttaaa

SEQ ID NO: 940789 - DNA, 22 bp, Artificial Sequence
  chemically synthesized
attaaatctacagttttaaaaa

SEQ ID NO: 940790 - DNA, 22 bp, Artificial Sequence
  chemically synthesized
aattaaatctacagttttaaaa

SEQ ID NO: 940791 - DNA, 22 bp, Artificial Sequence
  chemically synthesized
agacttaattaaatctacagtt

SEQ ID NO: 940792 - DNA, 22 bp, Artificial Sequence
  chemically synthesized
gagacttaattaaatctacagt

SEQ ID NO: 940793 - DNA, 22 bp, Artificial Sequence
  chemically synthesized
tgagacttaattaaatctacag

SEQ ID NO: 940794 - DNA, 22 bp, Artificial Sequence
  chemically synthesized
ttgagacttaattaaatctaca

SEQ ID NO: 940795 - DNA, 22 bp, Artificial Sequence
  chemically synthesized
tttaaaactgtagatttaatta

SEQ ID NO: 940796 - DNA, 22 bp, Artificial Sequence
  chemically synthesized
ttaaaactgtagatttaattaa

SEQ ID NO: 940797 - DNA, 22 bp, Artificial Sequence
  chemically synthesized
taaaactgtagatttaattaag

SEQ ID NO: 940798 - DNA, 22 bp, Artificial Sequence
  chemically synthesized
aaaactgtagatttaattaagt

SEQ ID NO: 940799 - DNA, 22 bp, Artificial Sequence
  chemically synthesized
aaactgtagatttaattaagtc

SEQ ID NO: 940800 - DNA, 22 bp, Artificial Sequence
  chemically synthesized
atgcagcatttttgagacttaa

SEQ ID NO: 940801 - DNA, 22 bp, Artificial Sequence
  chemically synthesized
catgcagcatttttgagactta

SEQ ID NO: 940802 - DNA, 22 bp, Artificial Sequence
  chemically synthesized
tcatgcagcatttttgagactt

SEQ ID NO: 940803 - DNA, 22 bp, Artificial Sequence
  chemically synthesized
tagatttaattaagtctcaaaa

SEQ ID NO: 940804 - DNA, 22 bp, Artificial Sequence
  chemically synthesized
ttcatgcagcatttttgagact

SEQ ID NO: 940805 - DNA, 22 bp, Artificial Sequence
  chemically synthesized
tttttcatgcagcatttttgag

SEQ ID NO: 940806 - DNA, 22 bp, Artificial Sequence
  chemically synthesized
atttttcatgcagcatttttga

SEQ ID NO: 940807 - DNA, 22 bp, Artificial Sequence
  chemically synthesized
aattaagtctcaaaaatgctgc

SEQ ID NO: 940808 - DNA, 22 bp, Artificial Sequence
  chemically synthesized
attaagtctcaaaaatgctgca

SEQ ID NO: 940809 - DNA, 22 bp, Artificial Sequence
  chemically synthesized
agtctcaaaaatgctgcatgaa

SEQ ID NO: 940810 - DNA, 22 bp, Artificial Sequence
  chemically synthesized
tagcacttatttttcatgcagc

SEQ ID NO: 940811 - DNA, 22 bp, Artificial Sequence
  chemically synthesized
ctatagcacttatttttcatgc

SEQ ID NO: 940812 - DNA, 22 bp, Artificial Sequence
  chemically synthesized
aaaaatgctgcatgaaaaataa

SEQ ID NO: 940813 - DNA, 22 bp, Artificial Sequence
  chemically synthesized
cctcctatagcacttatttttc

SEQ ID NO: 940814 - DNA, 22 bp, Artificial Sequence
  chemically synthesized
acctcctatagcacttattttt

SEQ ID NO: 940815 - DNA, 22 bp, Artificial Sequence
  chemically synthesized
ttacctcctatagcacttattt

SEQ ID NO: 940816 - DNA, 22 bp, Artificial Sequence
  chemically synthesized
catgaaaaataagtgctatagg

SEQ ID NO: 940817 - DNA, 22 bp, Artificial Sequence
  chemically synthesized
ccacctcttacctcctatagca

SEQ ID NO: 940818 - DNA, 22 bp, Artificial Sequence
  chemically synthesized
tcccacctcttacctcctatag

SEQ ID NO: 940819 - DNA, 22 bp, Artificial Sequence
  chemically synthesized
aatgattctcccacctcttacc

SEQ ID NO: 940820 - DNA, 22 bp, Artificial Sequence
  chemically synthesized
taggaggtaagaggtgggagaa

SEQ ID NO: 940821 - DNA, 22 bp, Artificial Sequence
  chemically synthesized
tgaacagttaaatgattctccc

SEQ ID NO: 940822 - DNA, 22 bp, Artificial Sequence
  chemically synthesized
tgtgaacagttaaatgattctc

SEQ ID NO: 940823 - DNA, 22 bp, Artificial Sequence
  chemically synthesized
ctctgtgaacagttaaatgatt

SEQ ID NO: 940824 - DNA, 22 bp, Artificial Sequence
  chemically synthesized
acagccacactcctctgtgaac

SEQ ID NO: 940825 - DNA, 22 bp, Artificial Sequence
  chemically synthesized
agctcacagccacactcctctg

SEQ ID NO: 940826 - DNA, 22 bp, Artificial Sequence
  chemically synthesized
cagctcacagccacactcctct

SEQ ID NO: 940827 - DNA, 22 bp, Artificial Sequence
  chemically synthesized
aactgttcacagaggagtgtgg

SEQ ID NO: 940828 - DNA, 22 bp, Artificial Sequence
  chemically synthesized
actgttcacagaggagtgtggc

SEQ ID NO: 940829 - DNA, 22 bp, Artificial Sequence
  chemically synthesized
catcttcagctcacagccacac

SEQ ID NO: 940830 - DNA, 22 bp, Artificial Sequence
  chemically synthesized
ttcacagaggagtgtggctgtg

SEQ ID NO: 940831 - DNA, 22 bp, Artificial Sequence
  chemically synthesized
acagaggagtgtggctgtgagc

SEQ ID NO: 940832 - DNA, 22 bp, Artificial Sequence
  chemically synthesized
atcctccatcttcagctcacag

SEQ ID NO: 940833 - DNA, 22 bp, Artificial Sequence
  chemically synthesized
aatcctccatcttcagctcaca

SEQ ID NO: 940834 - DNA, 22 bp, Artificial Sequence
  chemically synthesized
taatcctccatcttcagctcac

SEQ ID NO: 940835 - DNA, 22 bp, Artificial Sequence
  chemically synthesized
ttaatcctccatcttcagctca

SEQ ID NO: 940836 - DNA, 22 bp, Artificial Sequence
  chemically synthesized
ttttaatcctccatcttcagct

SEQ ID NO: 940837 - DNA, 22 bp, Artificial Sequence
  chemically synthesized
tcttttaatcctccatcttcag

SEQ ID NO: 940838 - DNA, 22 bp, Artificial Sequence
  chemically synthesized
ctcttttaatcctccatcttca

SEQ ID NO: 940839 - DNA, 22 bp, Artificial Sequence
  chemically synthesized
cttctcttttaatcctccatct

SEQ ID NO: 940840 - DNA, 22 bp, Artificial Sequence
  chemically synthesized
tgagctgaagatggaggattaa

SEQ ID NO: 940841 - DNA, 22 bp, Artificial Sequence
  chemically synthesized
tgatatcctgcttctcttttaa

SEQ ID NO: 940842 - DNA, 22 bp, Artificial Sequence
  chemically synthesized
aagatggaggattaaaagagaa

SEQ ID NO: 940843 - DNA, 22 bp, Artificial Sequence
  chemically synthesized
cacatagactatgatatcctgc

SEQ ID NO: 940844 - DNA, 22 bp, Artificial Sequence
  chemically synthesized
aaagagaagcaggatatcatag

SEQ ID NO: 940845 - DNA, 22 bp, Artificial Sequence
  chemically synthesized
tgtagactccacatagactatg

SEQ ID NO: 940846 - DNA, 22 bp, Artificial Sequence
  chemically synthesized
tatgtagactccacatagacta

SEQ ID NO: 940847 - DNA, 22 bp, Artificial Sequence
  chemically synthesized
ctctatgtagactccacataga

SEQ ID NO: 940848 - DNA, 22 bp, Artificial Sequence
  chemically synthesized
cctctatgtagactccacatag

SEQ ID NO: 940849 - DNA, 22 bp, Artificial Sequence
  chemically synthesized
ttcctctatgtagactccacat

SEQ ID NO: 940850 - DNA, 22 bp, Artificial Sequence
  chemically synthesized
cctcttcctctatgtagactcc

SEQ ID NO: 940851 - DNA, 22 bp, Artificial Sequence
  chemically synthesized
ctgcctcttcctctatgtagac

SEQ ID NO: 940852 - DNA, 22 bp, Artificial Sequence
  chemically synthesized
tcctgcctcttcctctatgtag

SEQ ID NO: 940853 - DNA, 22 bp, Artificial Sequence
  chemically synthesized
tgtggagtctacatagaggaag

SEQ ID NO: 940854 - DNA, 22 bp, Artificial Sequence
  chemically synthesized
aagccagaagttctcctgcctc

SEQ ID NO: 940855 - DNA, 22 bp, Artificial Sequence
  chemically synthesized
caagccagaagttctcctgcct

SEQ ID NO: 940856 - DNA, 22 bp, Artificial Sequence
  chemically synthesized
catagaggaagaggcaggagaa

SEQ ID NO: 940857 - DNA, 22 bp, Artificial Sequence
  chemically synthesized
atgtttcaagccagaagttctc

SEQ ID NO: 940858 - DNA, 22 bp, Artificial Sequence
  chemically synthesized
catcatgctcatgtttcaagcc

SEQ ID NO: 940859 - DNA, 22 bp, Artificial Sequence
  chemically synthesized
aggttccatcatgctcatgttt

SEQ ID NO: 940860 - DNA, 22 bp, Artificial Sequence
  chemically synthesized
ctggcttgaaacatgagcatga

SEQ ID NO: 940861 - DNA, 22 bp, Artificial Sequence
  chemically synthesized
tggcttgaaacatgagcatgat

SEQ ID NO: 940862 - DNA, 22 bp, Artificial Sequence
  chemically synthesized
gcttgaaacatgagcatgatgg

SEQ ID NO: 940863 - DNA, 22 bp, Artificial Sequence
  chemically synthesized
gaaacatgagcatgatggaacc

SEQ ID NO: 940864 - DNA, 22 bp, Artificial Sequence
  chemically synthesized
ggaggaccctcaggttccatca

SEQ ID NO: 940865 - DNA, 22 bp, Artificial Sequence
  chemically synthesized
aaacatgagcatgatggaacct

SEQ ID NO: 940866 - DNA, 22 bp, Artificial Sequence
  chemically synthesized
aggaggaccctcaggttccatc

SEQ ID NO: 940867 - DNA, 22 bp, Artificial Sequence
  chemically synthesized
cttaggaggaccctcaggttcc

SEQ ID NO: 940868 - DNA, 22 bp, Artificial Sequence
  chemically synthesized
tacctacttaggaggaccctca

SEQ ID NO: 940869 - DNA, 22 bp, Artificial Sequence
  chemically synthesized
atacctacttaggaggaccctc

SEQ ID NO: 940870 - DNA, 22 bp, Artificial Sequence
  chemically synthesized
ttatacctacttaggaggaccc

SEQ ID NO: 940871 - DNA, 22 bp, Artificial Sequence
  chemically synthesized
cctcttatacctacttaggagg

SEQ ID NO: 940872 - DNA, 22 bp, Artificial Sequence
  chemically synthesized
ccctcttatacctacttaggag

SEQ ID NO: 940873 - DNA, 22 bp, Artificial Sequence
  chemically synthesized
tccctcttatacctacttagga

SEQ ID NO: 940874 - DNA, 22 bp, Artificial Sequence
  chemically synthesized
agggtcctcctaagtaggtata

SEQ ID NO: 940875 - DNA, 22 bp, Artificial Sequence
  chemically synthesized
aactttccctcttatacctact

SEQ ID NO: 940876 - DNA, 22 bp, Artificial Sequence
  chemically synthesized
caactttccctcttatacctac

SEQ ID NO: 940877 - DNA, 22 bp, Artificial Sequence
  chemically synthesized
tcaactttccctcttataccta

SEQ ID NO: 940878 - DNA, 22 bp, Artificial Sequence
  chemically synthesized
ttcaactttccctcttatacct

SEQ ID NO: 940879 - DNA, 22 bp, Artificial Sequence
  chemically synthesized
ctaagtaggtataagagggaaa

SEQ ID NO: 940880 - DNA, 22 bp, Artificial Sequence
  chemically synthesized
agtaggtataagagggaaagtt

SEQ ID NO: 940881 - DNA, 22 bp, Artificial Sequence
  chemically synthesized
atgcaaacttttcaactttccc

SEQ ID NO: 940882 - DNA, 22 bp, Artificial Sequence
  chemically synthesized
ggttcatgcaaacttttcaact

SEQ ID NO: 940883 - DNA, 22 bp, Artificial Sequence
  chemically synthesized
tgggttcatgcaaacttttcaa

SEQ ID NO: 940884 - DNA, 22 bp, Artificial Sequence
  chemically synthesized
atattctgggttcatgcaaact

SEQ ID NO: 940885 - DNA, 22 bp, Artificial Sequence
  chemically synthesized
catattctgggttcatgcaaac

SEQ ID NO: 940886 - DNA, 22 bp, Artificial Sequence
  chemically synthesized
tcatattctgggttcatgcaaa

SEQ ID NO: 940887 - DNA, 22 bp, Artificial Sequence
  chemically synthesized
actttcatattctgggttcatg

SEQ ID NO: 940888 - DNA, 22 bp, Artificial Sequence
  chemically synthesized
tgactttcatattctgggttca

SEQ ID NO: 940889 - DNA, 22 bp, Artificial Sequence
  chemically synthesized
aaaagtttgcatgaacccagaa

SEQ ID NO: 940890 - DNA, 22 bp, Artificial Sequence
  chemically synthesized
catattctgactttcatattct

SEQ ID NO: 940891 - DNA, 22 bp, Artificial Sequence
  chemically synthesized
gcatgaacccagaatatgaaag

SEQ ID NO: 940892 - DNA, 22 bp, Artificial Sequence
  chemically synthesized
catgaacccagaatatgaaagt

SEQ ID NO: 940893 - DNA, 22 bp, Artificial Sequence
  chemically synthesized
atctgcatattctgactttcat

SEQ ID NO: 940894 - DNA, 22 bp, Artificial Sequence
  chemically synthesized
aagttaatctgcatattctgac

SEQ ID NO: 940895 - DNA, 22 bp, Artificial Sequence
  chemically synthesized
acaggctcaagttaatctgcat

SEQ ID NO: 940896 - DNA, 22 bp, Artificial Sequence
  chemically synthesized
gtcctcacaggctcaagttaat

SEQ ID NO: 940897 - DNA, 22 bp, Artificial Sequence
  chemically synthesized
tagtcctcacaggctcaagtta

SEQ ID NO: 940898 - DNA, 22 bp, Artificial Sequence
  chemically synthesized
ctagtcctcacaggctcaagtt

SEQ ID NO: 940899 - DNA, 22 bp, Artificial Sequence
  chemically synthesized
tctagtcctcacaggctcaagt

SEQ ID NO: 940900 - DNA, 22 bp, Artificial Sequence
  chemically synthesized
acttgagcctgtgaggactaga

SEQ ID NO: 940901 - DNA, 22 bp, Artificial Sequence
  chemically synthesized
gagcctgtgaggactagaaagc

SEQ ID NO: 940902 - DNA, 22 bp, Artificial Sequence
  chemically synthesized
agcctgtgaggactagaaagcc

SEQ ID NO: 940903 - DNA, 22 bp, Artificial Sequence
  chemically synthesized
aaaacgtatcagtggctttcta

SEQ ID NO: 940904 - DNA, 22 bp, Artificial Sequence
  chemically synthesized
tgaggactagaaagccactgat

SEQ ID NO: 940905 - DNA, 22 bp, Artificial Sequence
  chemically synthesized
ccagctcaaaacgtatcagtgg

SEQ ID NO: 940906 - DNA, 22 bp, Artificial Sequence
  chemically synthesized
gttaccagctcaaaacgtatca

SEQ ID NO: 940907 - DNA, 22 bp, Artificial Sequence
  chemically synthesized
gaaagccactgatacgttttga

SEQ ID NO: 940908 - DNA, 22 bp, Artificial Sequence
  chemically synthesized
cattagttaccagctcaaaacg

SEQ ID NO: 940909 - DNA, 22 bp, Artificial Sequence
  chemically synthesized
attacattagttaccagctcaa

SEQ ID NO: 940910 - DNA, 22 bp, Artificial Sequence
  chemically synthesized
atacgttttgagctggtaacta

SEQ ID NO: 940911 - DNA, 22 bp, Artificial Sequence
  chemically synthesized
tgagctggtaactaatgtaatg

SEQ ID NO: 940912 - DNA, 22 bp, Artificial Sequence
  chemically synthesized
gagctggtaactaatgtaatga

SEQ ID NO: 940913 - DNA, 22 bp, Artificial Sequence
  chemically synthesized
agctggtaactaatgtaatgaa

SEQ ID NO: 940914 - DNA, 22 bp, Artificial Sequence
  chemically synthesized
agaaatatatcaggttcattac

SEQ ID NO: 940915 - DNA, 22 bp, Artificial Sequence
  chemically synthesized
gtaactaatgtaatgaacctga

SEQ ID NO: 940916 - DNA, 22 bp, Artificial Sequence
  chemically synthesized
ctgagaaatatatcaggttcat

SEQ ID NO: 940917 - DNA, 22 bp, Artificial Sequence
  chemically synthesized
cctgagaaatatatcaggttca

SEQ ID NO: 940918 - DNA, 22 bp, Artificial Sequence
  chemically synthesized
atcttcctgagaaatatatcag

SEQ ID NO: 940919 - DNA, 22 bp, Artificial Sequence
  chemically synthesized
atgtaatgaacctgatatattt

SEQ ID NO: 940920 - DNA, 22 bp, Artificial Sequence
  chemically synthesized
ttaatcttcctgagaaatatat

SEQ ID NO: 940921 - DNA, 22 bp, Artificial Sequence
  chemically synthesized
tgttattaatcttcctgagaaa

SEQ ID NO: 940922 - DNA, 22 bp, Artificial Sequence
  chemically synthesized
atatatttctcaggaagattaa

SEQ ID NO: 940923 - DNA, 22 bp, Artificial Sequence
  chemically synthesized
taccgctatgttattaatcttc

SEQ ID NO: 940924 - DNA, 22 bp, Artificial Sequence
  chemically synthesized
actataccgctatgttattaat

SEQ ID NO: 940925 - DNA, 22 bp, Artificial Sequence
  chemically synthesized
tcactataccgctatgttatta

SEQ ID NO: 940926 - DNA, 22 bp, Artificial Sequence
  chemically synthesized
ctcaggaagattaataacatag

SEQ ID NO: 940927 - DNA, 22 bp, Artificial Sequence
  chemically synthesized
tcaggaagattaataacatagc

SEQ ID NO: 940928 - DNA, 22 bp, Artificial Sequence
  chemically synthesized
aggaagattaataacatagcgg

SEQ ID NO: 940929 - DNA, 22 bp, Artificial Sequence
  chemically synthesized
ccaatctctcactataccgcta

SEQ ID NO: 940930 - DNA, 22 bp, Artificial Sequence
  chemically synthesized
ataacatagcggtatagtgaga

SEQ ID NO: 940931 - DNA, 22 bp, Artificial Sequence
  chemically synthesized
cccattaccaatctctcactat

SEQ ID NO: 940932 - DNA, 22 bp, Artificial Sequence
  chemically synthesized
ccatctccccattaccaatctc

SEQ ID NO: 940933 - DNA, 22 bp, Artificial Sequence
  chemically synthesized
cccatctccccattaccaatct

SEQ ID NO: 940934 - DNA, 22 bp, Artificial Sequence
  chemically synthesized
cttcccatctccccattaccaa

SEQ ID NO: 940935 - DNA, 22 bp, Artificial Sequence
  chemically synthesized
ccttcccatctccccattacca

SEQ ID NO: 940936 - DNA, 22 bp, Artificial Sequence
  chemically synthesized
gcttccttcccatctccccatt

SEQ ID NO: 940937 - DNA, 22 bp, Artificial Sequence
  chemically synthesized
gtaatggggagatgggaaggaa

SEQ ID NO: 940938 - DNA, 22 bp, Artificial Sequence
  chemically synthesized
aatataggattagcttccttcc

SEQ ID NO: 940939 - DNA, 22 bp, Artificial Sequence
  chemically synthesized
gaatataggattagcttccttc

SEQ ID NO: 940940 - DNA, 22 bp, Artificial Sequence
  chemically synthesized
aaaataatcatgtttgaatata

SEQ ID NO: 940941 - DNA, 22 bp, Artificial Sequence
  chemically synthesized
taaaaataatcatgtttgaata

SEQ ID NO: 940942 - DNA, 22 bp, Artificial Sequence
  chemically synthesized
ctaaaaataatcatgtttgaat

SEQ ID NO: 940943 - DNA, 22 bp, Artificial Sequence
  chemically synthesized
tttctaaaaataatcatgtttg

SEQ ID NO: 940944 - DNA, 22 bp, Artificial Sequence
  chemically synthesized
gtttctaaaaataatcatgttt

SEQ ID NO: 940945 - DNA, 22 bp, Artificial Sequence
  chemically synthesized
atcctatattcaaacatgatta

SEQ ID NO: 940946 - DNA, 22 bp, Artificial Sequence
  chemically synthesized
tttgtttctaaaaataatcatg

SEQ ID NO: 940947 - DNA, 22 bp, Artificial Sequence
  chemically synthesized
tatttgtttctaaaaataatca

SEQ ID NO: 940948 - DNA, 22 bp, Artificial Sequence
  chemically synthesized
ctatttgtttctaaaaataatc

SEQ ID NO: 940949 - DNA, 22 bp, Artificial Sequence
  chemically synthesized
tattcaaacatgattattttta

SEQ ID NO: 940950 - DNA, 22 bp, Artificial Sequence
  chemically synthesized
tttctatttgtttctaaaaata

SEQ ID NO: 940951 - DNA, 22 bp, Artificial Sequence
  chemically synthesized
tgtttctatttgtttctaaaaa

SEQ ID NO: 940952 - DNA, 22 bp, Artificial Sequence
  chemically synthesized
aaacatgattatttttagaaac

SEQ ID NO: 940953 - DNA, 22 bp, Artificial Sequence
  chemically synthesized
ctctgtttctatttgtttctaa

SEQ ID NO: 940954 - DNA, 22 bp, Artificial Sequence
  chemically synthesized
cctctgtttctatttgtttcta

SEQ ID NO: 940955 - DNA, 22 bp, Artificial Sequence
  chemically synthesized
tttcctctgtttctatttgttt

SEQ ID NO: 940956 - DNA, 22 bp, Artificial Sequence
  chemically synthesized
tatttcctctgtttctatttgt

SEQ ID NO: 940957 - DNA, 22 bp, Artificial Sequence
  chemically synthesized
ctatttcctctgtttctatttg

SEQ ID NO: 940958 - DNA, 22 bp, Artificial Sequence
  chemically synthesized
tctatttcctctgtttctattt

SEQ ID NO: 940959 - DNA, 22 bp, Artificial Sequence
  chemically synthesized
tttttagaaacaaatagaaaca

SEQ ID NO: 940960 - DNA, 22 bp, Artificial Sequence
  chemically synthesized
ttttctatttcctctgtttcta

SEQ ID NO: 940961 - DNA, 22 bp, Artificial Sequence
  chemically synthesized
ttagaaacaaatagaaacagag

SEQ ID NO: 940962 - DNA, 22 bp, Artificial Sequence
  chemically synthesized
tagaaacaaatagaaacagagg

SEQ ID NO: 940963 - DNA, 22 bp, Artificial Sequence
  chemically synthesized
agaaacaaatagaaacagagga

SEQ ID NO: 940964 - DNA, 22 bp, Artificial Sequence
  chemically synthesized
ttattttctatttcctctgttt

SEQ ID NO: 940965 - DNA, 22 bp, Artificial Sequence
  chemically synthesized
gaaacaaatagaaacagaggaa

SEQ ID NO: 940966 - DNA, 22 bp, Artificial Sequence
  chemically synthesized
gttattttctatttcctctgtt

SEQ ID NO: 940967 - DNA, 22 bp, Artificial Sequence
  chemically synthesized
ttgttattttctatttcctctg

SEQ ID NO: 940968 - DNA, 22 bp, Artificial Sequence
  chemically synthesized
ctcttgttattttctatttcct

SEQ ID NO: 940969 - DNA, 22 bp, Artificial Sequence
  chemically synthesized
cctcttgttattttctatttcc

SEQ ID NO: 940970 - DNA, 22 bp, Artificial Sequence
  chemically synthesized
cttcctcttgttattttctatt

SEQ ID NO: 940971 - DNA, 22 bp, Artificial Sequence
  chemically synthesized
ccttcctcttgttattttctat

SEQ ID NO: 940972 - DNA, 22 bp, Artificial Sequence
  chemically synthesized
ttccttcctcttgttattttct

SEQ ID NO: 940973 - DNA, 22 bp, Artificial Sequence
  chemically synthesized
tggatatctcttccttcctctt

SEQ ID NO: 940974 - DNA, 22 bp, Artificial Sequence
  chemically synthesized
gtggatatctcttccttcctct

SEQ ID NO: 940975 - DNA, 22 bp, Artificial Sequence
  chemically synthesized
gtcatgtgcaatcttgtggata

SEQ ID NO: 940976 - DNA, 22 bp, Artificial Sequence
  chemically synthesized
tagtcatgtgcaatcttgtgga

SEQ ID NO: 940977 - DNA, 22 bp, Artificial Sequence
  chemically synthesized
ctagtcatgtgcaatcttgtgg

SEQ ID NO: 940978 - DNA, 22 bp, Artificial Sequence
  chemically synthesized
tctagtcatgtgcaatcttgtg

SEQ ID NO: 940979 - DNA, 22 bp, Artificial Sequence
  chemically synthesized
tgcctttctagtcatgtgcaat

SEQ ID NO: 940980 - DNA, 22 bp, Artificial Sequence
  chemically synthesized
ctgtgcctttctagtcatgtgc

SEQ ID NO: 940981 - DNA, 22 bp, Artificial Sequence
  chemically synthesized
cctgtgcctttctagtcatgtg

SEQ ID NO: 940982 - DNA, 22 bp, Artificial Sequence
  chemically synthesized
ttcctgtgcctttctagtcatg

SEQ ID NO: 940983 - DNA, 22 bp, Artificial Sequence
  chemically synthesized
acctcttcctgtgcctttctag

SEQ ID NO: 940984 - DNA, 22 bp, Artificial Sequence
  chemically synthesized
gacctcttcctgtgcctttcta

SEQ ID NO: 940985 - DNA, 22 bp, Artificial Sequence
  chemically synthesized
tgacctcttcctgtgcctttct

SEQ ID NO: 940986 - DNA, 22 bp, Artificial Sequence
  chemically synthesized
ttgacctcttcctgtgcctttc

SEQ ID NO: 940987 - DNA, 22 bp, Artificial Sequence
  chemically synthesized
cacatgactagaaaggcacagg

SEQ ID NO: 940988 - DNA, 22 bp, Artificial Sequence
  chemically synthesized
agacacttttgacctcttcctg

SEQ ID NO: 940989 - DNA, 22 bp, Artificial Sequence
  chemically synthesized
cagacacttttgacctcttcct

SEQ ID NO: 940990 - DNA, 22 bp, Artificial Sequence
  chemically synthesized
gaaaggcacaggaagaggtcaa

SEQ ID NO: 940991 - DNA, 22 bp, Artificial Sequence
  chemically synthesized
tccttcagacacttttgacctc

SEQ ID NO: 940992 - DNA, 22 bp, Artificial Sequence
  chemically synthesized
agttatccttcagacacttttg

SEQ ID NO: 940993 - DNA, 22 bp, Artificial Sequence
  chemically synthesized
cagttatccttcagacactttt

SEQ ID NO: 940994 - DNA, 22 bp, Artificial Sequence
  chemically synthesized
tcagttatccttcagacacttt

SEQ ID NO: 940995 - DNA, 22 bp, Artificial Sequence
  chemically synthesized
ttttcagttatccttcagacac

SEQ ID NO: 940996 - DNA, 22 bp, Artificial Sequence
  chemically synthesized
attttcagttatccttcagaca

SEQ ID NO: 940997 - DNA, 22 bp, Artificial Sequence
  chemically synthesized
tattttcagttatccttcagac

SEQ ID NO: 940998 - DNA, 22 bp, Artificial Sequence
  chemically synthesized
cctttattttcagttatccttc

SEQ ID NO: 940999 - DNA, 22 bp, Artificial Sequence
  chemically synthesized
actccctttattttcagttatc

SEQ ID NO: 941000 - DNA, 22 bp, Artificial Sequence
  chemically synthesized
actgactccctttattttcagt

SEQ ID NO: 941001 - DNA, 22 bp, Artificial Sequence
  chemically synthesized
aaggataactgaaaataaaggg

SEQ ID NO: 941002 - DNA, 22 bp, Artificial Sequence
  chemically synthesized
aaagattgactgactcccttta

SEQ ID NO: 941003 - DNA, 22 bp, Artificial Sequence
  chemically synthesized
aaaataaagggagtcagtcaat

SEQ ID NO: 941004 - DNA, 22 bp, Artificial Sequence
  chemically synthesized
cagagacccccagcaatagcag

SEQ ID NO: 941005 - DNA, 22 bp, Artificial Sequence
  chemically synthesized
acagagacccccagcaatagca

SEQ ID NO: 941006 - DNA, 22 bp, Artificial Sequence
  chemically synthesized
tttacagagacccccagcaata

SEQ ID NO: 941007 - DNA, 22 bp, Artificial Sequence
  chemically synthesized
atttacagagacccccagcaat

SEQ ID NO: 941008 - DNA, 22 bp, Artificial Sequence
  chemically synthesized
ttagctgctattgctgggggtc

SEQ ID NO: 941009 - DNA, 22 bp, Artificial Sequence
  chemically synthesized
tagctgctattgctgggggtct

SEQ ID NO: 941010 - DNA, 22 bp, Artificial Sequence
  chemically synthesized
agctgctattgctgggggtctc

SEQ ID NO: 941011 - DNA, 22 bp, Artificial Sequence
  chemically synthesized
gctgctattgctgggggtctct

SEQ ID NO: 941012 - DNA, 22 bp, Artificial Sequence
  chemically synthesized
ctattgctgggggtctctgtaa

SEQ ID NO: 941013 - DNA, 22 bp, Artificial Sequence
  chemically synthesized
gaaagcaacttatttacagaga

SEQ ID NO: 941014 - DNA, 22 bp, Artificial Sequence
  chemically synthesized
ggaaagcaacttatttacagag

SEQ ID NO: 941015 - DNA, 22 bp, Artificial Sequence
  chemically synthesized
ttgctgggggtctctgtaaata

SEQ ID NO: 941016 - DNA, 22 bp, Artificial Sequence
  chemically synthesized
ctgggggtctctgtaaataagt

SEQ ID NO: 941017 - DNA, 22 bp, Artificial Sequence
  chemically synthesized
ggggtctctgtaaataagttgc

SEQ ID NO: 941018 - DNA, 22 bp, Artificial Sequence
  chemically synthesized
tgtaaataagttgctttccaag

SEQ ID NO: 941019 - DNA, 22 bp, Artificial Sequence
  chemically synthesized
aaaggccatgaacttggaaagc

SEQ ID NO: 941020 - DNA, 22 bp, Artificial Sequence
  chemically synthesized
caaaggccatgaacttggaaag

SEQ ID NO: 941021 - DNA, 22 bp, Artificial Sequence
  chemically synthesized
taaataagttgctttccaagtt

SEQ ID NO: 941022 - DNA, 22 bp, Artificial Sequence
  chemically synthesized
ctttccaagttcatggcctttg

SEQ ID NO: 941023 - DNA, 22 bp, Artificial Sequence
  chemically synthesized
tccaagttcatggcctttgaag

SEQ ID NO: 941024 - DNA, 22 bp, Artificial Sequence
  chemically synthesized
taatgaagggtgcttcaaaggc

SEQ ID NO: 941025 - DNA, 22 bp, Artificial Sequence
  chemically synthesized
ccaagttcatggcctttgaagc

SEQ ID NO: 941026 - DNA, 22 bp, Artificial Sequence
  chemically synthesized
caagttcatggcctttgaagca

SEQ ID NO: 941027 - DNA, 22 bp, Artificial Sequence
  chemically synthesized
attgtaatgaagggtgcttcaa

SEQ ID NO: 941028 - DNA, 22 bp, Artificial Sequence
  chemically synthesized
atggcctttgaagcacccttca

SEQ ID NO: 941029 - DNA, 22 bp, Artificial Sequence
  chemically synthesized
tgaagcacccttcattacaatc

SEQ ID NO: 941030 - DNA, 22 bp, Artificial Sequence
  chemically synthesized
gaagcacccttcattacaatca

SEQ ID NO: 941031 - DNA, 22 bp, Artificial Sequence
  chemically synthesized
aagcacccttcattacaatcag

SEQ ID NO: 941032 - DNA, 22 bp, Artificial Sequence
  chemically synthesized
cagaaaaacgcactgattgtaa

SEQ ID NO: 941033 - DNA, 22 bp, Artificial Sequence
  chemically synthesized
tgtgttacagaaaaacgcactg

SEQ ID NO: 941034 - DNA, 22 bp, Artificial Sequence
  chemically synthesized
cattacaatcagtgcgtttttc

SEQ ID NO: 941035 - DNA, 22 bp, Artificial Sequence
  chemically synthesized
attacaatcagtgcgtttttct

SEQ ID NO: 941036 - DNA, 22 bp, Artificial Sequence
  chemically synthesized
caatcagtgcgtttttctgtaa

SEQ ID NO: 941037 - DNA, 22 bp, Artificial Sequence
  chemically synthesized
tgataacgttgtgtgttacaga

SEQ ID NO: 941038 - DNA, 22 bp, Artificial Sequence
  chemically synthesized
ttctgtaacacacaacgttatc

SEQ ID NO: 941039 - DNA, 22 bp, Artificial Sequence
  chemically synthesized
tctgtaacacacaacgttatca

SEQ ID NO: 941040 - DNA, 22 bp, Artificial Sequence
  chemically synthesized
ctgtaacacacaacgttatcat

SEQ ID NO: 941041 - DNA, 22 bp, Artificial Sequence
  chemically synthesized
tgtaacacacaacgttatcata

SEQ ID NO: 941042 - DNA, 22 bp, Artificial Sequence
  chemically synthesized
ataaaacaaaattatgataacg

SEQ ID NO: 941043 - DNA, 22 bp, Artificial Sequence
  chemically synthesized
taacacacaacgttatcataat

SEQ ID NO: 941044 - DNA, 22 bp, Artificial Sequence
  chemically synthesized
tgcctcataaaacaaaattatg

SEQ ID NO: 941045 - DNA, 22 bp, Artificial Sequence
  chemically synthesized
ccctatgcctcataaaacaaaa

SEQ ID NO: 941046 - DNA, 22 bp, Artificial Sequence
  chemically synthesized
gccctatgcctcataaaacaaa

SEQ ID NO: 941047 - DNA, 22 bp, Artificial Sequence
  chemically synthesized
tgccctatgcctcataaaacaa

SEQ ID NO: 941048 - DNA, 22 bp, Artificial Sequence
  chemically synthesized
tttgccctatgcctcataaaac

SEQ ID NO: 941049 - DNA, 22 bp, Artificial Sequence
  chemically synthesized
tcataattttgttttatgaggc

SEQ ID NO: 941050 - DNA, 22 bp, Artificial Sequence
  chemically synthesized
cctctttgccctatgcctcata

SEQ ID NO: 941051 - DNA, 22 bp, Artificial Sequence
  chemically synthesized
tgttttatgaggcatagggcaa

SEQ ID NO: 941052 - DNA, 22 bp, Artificial Sequence
  chemically synthesized
gttttatgaggcatagggcaaa

SEQ ID NO: 941053 - DNA, 22 bp, Artificial Sequence
  chemically synthesized
ttttatgaggcatagggcaaag

SEQ ID NO: 941054 - DNA, 22 bp, Artificial Sequence
  chemically synthesized
tatgaggcatagggcaaagagg

SEQ ID NO: 941055 - DNA, 22 bp, Artificial Sequence
  chemically synthesized
atgaggcatagggcaaagaggc

SEQ ID NO: 941056 - DNA, 22 bp, Artificial Sequence
  chemically synthesized
aaaatgcatattgcctctttgc

SEQ ID NO: 941057 - DNA, 22 bp, Artificial Sequence
  chemically synthesized
tgaggcatagggcaaagaggca

SEQ ID NO: 941058 - DNA, 22 bp, Artificial Sequence
  chemically synthesized
aaaaatgcatattgcctctttg

SEQ ID NO: 941059 - DNA, 22 bp, Artificial Sequence
  chemically synthesized
aagaacttaaaaatgcatattg

SEQ ID NO: 941060 - DNA, 22 bp, Artificial Sequence
  chemically synthesized
caagaacttaaaaatgcatatt

SEQ ID NO: 941061 - DNA, 22 bp, Artificial Sequence
  chemically synthesized
aagacatgcatagatttcaaga

SEQ ID NO: 941062 - DNA, 22 bp, Artificial Sequence
  chemically synthesized
aaagacatgcatagatttcaag

SEQ ID NO: 941063 - DNA, 22 bp, Artificial Sequence
  chemically synthesized
acttaaagacatgcatagattt

SEQ ID NO: 941064 - DNA, 22 bp, Artificial Sequence
  chemically synthesized
ttaagttcttgaaatctatgca

SEQ ID NO: 941065 - DNA, 22 bp, Artificial Sequence
  chemically synthesized
taagttcttgaaatctatgcat

SEQ ID NO: 941066 - DNA, 22 bp, Artificial Sequence
  chemically synthesized
aagttcttgaaatctatgcatg

SEQ ID NO: 941067 - DNA, 22 bp, Artificial Sequence
  chemically synthesized
ctaacttaaagacatgcataga

SEQ ID NO: 941068 - DNA, 22 bp, Artificial Sequence
  chemically synthesized
agttcttgaaatctatgcatgt

SEQ ID NO: 941069 - DNA, 22 bp, Artificial Sequence
  chemically synthesized
ttgaaatctatgcatgtcttta

SEQ ID NO: 941070 - DNA, 22 bp, Artificial Sequence
  chemically synthesized
tgtctactaacttaaagacatg

SEQ ID NO: 941071 - DNA, 22 bp, Artificial Sequence
  chemically synthesized
atgtctactaacttaaagacat

SEQ ID NO: 941072 - DNA, 22 bp, Artificial Sequence
  chemically synthesized
gaaatctatgcatgtctttaag

SEQ ID NO: 941073 - DNA, 22 bp, Artificial Sequence
  chemically synthesized
aaatctatgcatgtctttaagt

SEQ ID NO: 941074 - DNA, 22 bp, Artificial Sequence
  chemically synthesized
tttatgtctactaacttaaaga

SEQ ID NO: 941075 - DNA, 22 bp, Artificial Sequence
  chemically synthesized
tgcatgtctttaagttagtaga

SEQ ID NO: 941076 - DNA, 22 bp, Artificial Sequence
  chemically synthesized
aaaattatttatgtctactaac

SEQ ID NO: 941077 - DNA, 22 bp, Artificial Sequence
  chemically synthesized
aaaaattatttatgtctactaa

SEQ ID NO: 941078 - DNA, 22 bp, Artificial Sequence
  chemically synthesized
taaaaattatttatgtctacta

SEQ ID NO: 941079 - DNA, 22 bp, Artificial Sequence
  chemically synthesized
taagttagtagacataaataat

SEQ ID NO: 941080 - DNA, 22 bp, Artificial Sequence
  chemically synthesized
aagttagtagacataaataatt

SEQ ID NO: 941081 - DNA, 22 bp, Artificial Sequence
  chemically synthesized
agttagtagacataaataattt

SEQ ID NO: 941082 - DNA, 22 bp, Artificial Sequence
  chemically synthesized
gtagacataaataatttttaaa

SEQ ID NO: 941083 - DNA, 22 bp, Artificial Sequence
  chemically synthesized
aatcgtgaaggattttaaaaat

SEQ ID NO: 941084 - DNA, 22 bp, Artificial Sequence
  chemically synthesized
aattcaatcgtgaaggatttta

SEQ ID NO: 941085 - DNA, 22 bp, Artificial Sequence
  chemically synthesized
caattcaatcgtgaaggatttt

SEQ ID NO: 941086 - DNA, 22 bp, Artificial Sequence
  chemically synthesized
cttcaattcaatcgtgaaggat

SEQ ID NO: 941087 - DNA, 22 bp, Artificial Sequence
  chemically synthesized
ttaaaatccttcacgattgaat

SEQ ID NO: 941088 - DNA, 22 bp, Artificial Sequence
  chemically synthesized
taaaatccttcacgattgaatt

SEQ ID NO: 941089 - DNA, 22 bp, Artificial Sequence
  chemically synthesized
aaaatccttcacgattgaattg

SEQ ID NO: 941090 - DNA, 22 bp, Artificial Sequence
  chemically synthesized
aaatccttcacgattgaattga

SEQ ID NO: 941091 - DNA, 22 bp, Artificial Sequence
  chemically synthesized
cacgattgaattgaagtaatta

SEQ ID NO: 941092 - DNA, 22 bp, Artificial Sequence
  chemically synthesized
acgattgaattgaagtaattat

SEQ ID NO: 941093 - DNA, 22 bp, Artificial Sequence
  chemically synthesized
aatatgtagtcaacataattac

SEQ ID NO: 941094 - DNA, 22 bp, Artificial Sequence
  chemically synthesized
attgaatatgtagtcaacataa

SEQ ID NO: 941095 - DNA, 22 bp, Artificial Sequence
  chemically synthesized
aattgaagtaattatgttgact

SEQ ID NO: 941096 - DNA, 22 bp, Artificial Sequence
  chemically synthesized
cattgaatatgtagtcaacata

SEQ ID NO: 941097 - DNA, 22 bp, Artificial Sequence
  chemically synthesized
tcattgaatatgtagtcaacat

SEQ ID NO: 941098 - DNA, 22 bp, Artificial Sequence
  chemically synthesized
aagtaattatgttgactacata

SEQ ID NO: 941099 - DNA, 22 bp, Artificial Sequence
  chemically synthesized
tgttgactacatattcaatgaa

SEQ ID NO: 941100 - DNA, 22 bp, Artificial Sequence
  chemically synthesized
actacatattcaatgaaaatta

SEQ ID NO: 941101 - DNA, 22 bp, Artificial Sequence
  chemically synthesized
gagaataatgaagtaattttca

SEQ ID NO: 941102 - DNA, 22 bp, Artificial Sequence
  chemically synthesized
agagaataatgaagtaattttc

SEQ ID NO: 941103 - DNA, 22 bp, Artificial Sequence
  chemically synthesized
tagagaataatgaagtaatttt

SEQ ID NO: 941104 - DNA, 22 bp, Artificial Sequence
  chemically synthesized
catattcaatgaaaattacttc

SEQ ID NO: 941105 - DNA, 22 bp, Artificial Sequence
  chemically synthesized
tttagagaataatgaagtaatt

SEQ ID NO: 941106 - DNA, 22 bp, Artificial Sequence
  chemically synthesized
ctttagagaataatgaagtaat

SEQ ID NO: 941107 - DNA, 22 bp, Artificial Sequence
  chemically synthesized
tctttagagaataatgaagtaa

SEQ ID NO: 941108 - DNA, 22 bp, Artificial Sequence
  chemically synthesized
aatgaaaattacttcattattc

SEQ ID NO: 941109 - DNA, 22 bp, Artificial Sequence
  chemically synthesized
tccattttctttagagaataat

SEQ ID NO: 941110 - DNA, 22 bp, Artificial Sequence
  chemically synthesized
tgtccattttctttagagaata

SEQ ID NO: 941111 - DNA, 22 bp, Artificial Sequence
  chemically synthesized
cttcattattctctaaagaaaa

SEQ ID NO: 941112 - DNA, 22 bp, Artificial Sequence
  chemically synthesized
cattattctctaaagaaaatgg

SEQ ID NO: 941113 - DNA, 22 bp, Artificial Sequence
  chemically synthesized
attattctctaaagaaaatgga

SEQ ID NO: 941114 - DNA, 22 bp, Artificial Sequence
  chemically synthesized
ttctctaaagaaaatggacaga

SEQ ID NO: 941115 - DNA, 22 bp, Artificial Sequence
  chemically synthesized
tctaaagaaaatggacagagat

SEQ ID NO: 941116 - DNA, 22 bp, Artificial Sequence
  chemically synthesized
taaagaaaatggacagagatta

SEQ ID NO: 941117 - DNA, 22 bp, Artificial Sequence
  chemically synthesized
caaataaaaatagtaatctctg

SEQ ID NO: 941118 - DNA, 22 bp, Artificial Sequence
  chemically synthesized
aagaaaatggacagagattact

SEQ ID NO: 941119 - DNA, 22 bp, Artificial Sequence
  chemically synthesized
tccaaataaaaatagtaatctc

SEQ ID NO: 941120 - DNA, 22 bp, Artificial Sequence
  chemically synthesized
ctccaaataaaaatagtaatct

SEQ ID NO: 941121 - DNA, 22 bp, Artificial Sequence
  chemically synthesized
tctccaaataaaaatagtaatc

SEQ ID NO: 941122 - DNA, 22 bp, Artificial Sequence
  chemically synthesized
tttctccaaataaaaatagtaa

SEQ ID NO: 941123 - DNA, 22 bp, Artificial Sequence
  chemically synthesized
ctttctccaaataaaaatagta

SEQ ID NO: 941124 - DNA, 22 bp, Artificial Sequence
  chemically synthesized
agtgtttctttctccaaataaa

SEQ ID NO: 941125 - DNA, 22 bp, Artificial Sequence
  chemically synthesized
aagtgtttctttctccaaataa

SEQ ID NO: 941126 - DNA, 22 bp, Artificial Sequence
  chemically synthesized
ctatttttatttggagaaagaa

SEQ ID NO: 941127 - DNA, 22 bp, Artificial Sequence
  chemically synthesized
tttttatttggagaaagaaaca

SEQ ID NO: 941128 - DNA, 22 bp, Artificial Sequence
  chemically synthesized
ttatttggagaaagaaacactt

SEQ ID NO: 941129 - DNA, 22 bp, Artificial Sequence
  chemically synthesized
tatttggagaaagaaacactta

SEQ ID NO: 941130 - DNA, 22 bp, Artificial Sequence
  chemically synthesized
atttggagaaagaaacacttaa

SEQ ID NO: 941131 - DNA, 22 bp, Artificial Sequence
  chemically synthesized
aggcccatagacttaagtgttt

SEQ ID NO: 941132 - DNA, 22 bp, Artificial Sequence
  chemically synthesized
tttggagaaagaaacacttaag

SEQ ID NO: 941133 - DNA, 22 bp, Artificial Sequence
  chemically synthesized
caggcccatagacttaagtgtt

SEQ ID NO: 941134 - DNA, 22 bp, Artificial Sequence
  chemically synthesized
tcaggcccatagacttaagtgt

SEQ ID NO: 941135 - DNA, 22 bp, Artificial Sequence
  chemically synthesized
ggagaaagaaacacttaagtct

SEQ ID NO: 941136 - DNA, 22 bp, Artificial Sequence
  chemically synthesized
gagaaagaaacacttaagtcta

SEQ ID NO: 941137 - DNA, 22 bp, Artificial Sequence
  chemically synthesized
accctttcaggcccatagactt

SEQ ID NO: 941138 - DNA, 22 bp, Artificial Sequence
  chemically synthesized
tattaaccctttcaggcccata

SEQ ID NO: 941139 - DNA, 22 bp, Artificial Sequence
  chemically synthesized
attgtattaaccctttcaggcc

SEQ ID NO: 941140 - DNA, 22 bp, Artificial Sequence
  chemically synthesized
aagtctatgggcctgaaagggt

SEQ ID NO: 941141 - DNA, 22 bp, Artificial Sequence
  chemically synthesized
agtctatgggcctgaaagggtt

SEQ ID NO: 941142 - DNA, 22 bp, Artificial Sequence
  chemically synthesized
tgggcctgaaagggttaataca

SEQ ID NO: 941143 - DNA, 22 bp, Artificial Sequence
  chemically synthesized
aaaatgcattaattgtattaac

SEQ ID NO: 941144 - DNA, 22 bp, Artificial Sequence
  chemically synthesized
aaaaatgcattaattgtattaa

SEQ ID NO: 941145 - DNA, 22 bp, Artificial Sequence
  chemically synthesized
taaaaatgcattaattgtatta

SEQ ID NO: 941146 - DNA, 22 bp, Artificial Sequence
  chemically synthesized
ttaaaaatgcattaattgtatt

SEQ ID NO: 941147 - DNA, 22 bp, Artificial Sequence
  chemically synthesized
aaagggttaatacaattaatgc

SEQ ID NO: 941148 - DNA, 22 bp, Artificial Sequence
  chemically synthesized
atacaattaatgcatttttaaa

SEQ ID NO: 941149 - DNA, 22 bp, Artificial Sequence
  chemically synthesized
agagtaatatagacttttaaaa

SEQ ID NO: 941150 - DNA, 22 bp, Artificial Sequence
  chemically synthesized
atgcatttttaaaagtctatat

SEQ ID NO: 941151 - DNA, 22 bp, Artificial Sequence
  chemically synthesized
tcatctgagagtaatatagact

SEQ ID NO: 941152 - DNA, 22 bp, Artificial Sequence
  chemically synthesized
gttatcatctgagagtaatata

SEQ ID NO: 941153 - DNA, 22 bp, Artificial Sequence
  chemically synthesized
ttaaaagtctatattactctca

SEQ ID NO: 941154 - DNA, 22 bp, Artificial Sequence
  chemically synthesized
taaaagtctatattactctcag

SEQ ID NO: 941155 - DNA, 22 bp, Artificial Sequence
  chemically synthesized
aaaagtctatattactctcaga

SEQ ID NO: 941156 - DNA, 22 bp, Artificial Sequence
  chemically synthesized
aaagtctatattactctcagat

SEQ ID NO: 941157 - DNA, 22 bp, Artificial Sequence
  chemically synthesized
aagtgaattagttatcatctga

SEQ ID NO: 941158 - DNA, 22 bp, Artificial Sequence
  chemically synthesized
caagtgaattagttatcatctg

SEQ ID NO: 941159 - DNA, 22 bp, Artificial Sequence
  chemically synthesized
ttcaagtgaattagttatcatc

SEQ ID NO: 941160 - DNA, 22 bp, Artificial Sequence
  chemically synthesized
tattactctcagatgataacta

SEQ ID NO: 941161 - DNA, 22 bp, Artificial Sequence
  chemically synthesized
agttcttcaagtgaattagtta

SEQ ID NO: 941162 - DNA, 22 bp, Artificial Sequence
  chemically synthesized
ctctcagatgataactaattca

SEQ ID NO: 941163 - DNA, 22 bp, Artificial Sequence
  chemically synthesized
tcagatgataactaattcactt

SEQ ID NO: 941164 - DNA, 22 bp, Artificial Sequence
  chemically synthesized
agatgataactaattcacttga

SEQ ID NO: 941165 - DNA, 22 bp, Artificial Sequence
  chemically synthesized
aatgtatcaaactaagttcttc

SEQ ID NO: 941166 - DNA, 22 bp, Artificial Sequence
  chemically synthesized
taaatgtatcaaactaagttct

SEQ ID NO: 941167 - DNA, 22 bp, Artificial Sequence
  chemically synthesized
attcacttgaagaacttagttt

SEQ ID NO: 941168 - DNA, 22 bp, Artificial Sequence
  chemically synthesized
acttgaagaacttagtttgata

SEQ ID NO: 941169 - DNA, 22 bp, Artificial Sequence
  chemically synthesized
gaagaacttagtttgatacatt

SEQ ID NO: 941170 - DNA, 22 bp, Artificial Sequence
  chemically synthesized
aagaacttagtttgatacattt

SEQ ID NO: 941171 - DNA, 22 bp, Artificial Sequence
  chemically synthesized
caaggagcctctaaatgtatca

SEQ ID NO: 941172 - DNA, 22 bp, Artificial Sequence
  chemically synthesized
agtttgatacatttagaggctc

SEQ ID NO: 941173 - DNA, 22 bp, Artificial Sequence
  chemically synthesized
aagaactccaaggagcctctaa

SEQ ID NO: 941174 - DNA, 22 bp, Artificial Sequence
  chemically synthesized
gtttgatacatttagaggctcc

SEQ ID NO: 941175 - DNA, 22 bp, Artificial Sequence
  chemically synthesized
gaagaactccaaggagcctcta

SEQ ID NO: 941176 - DNA, 22 bp, Artificial Sequence
  chemically synthesized
tgaagaactccaaggagcctct

SEQ ID NO: 941177 - DNA, 22 bp, Artificial Sequence
  chemically synthesized
ttgaagaactccaaggagcctc

SEQ ID NO: 941178 - DNA, 22 bp, Artificial Sequence
  chemically synthesized
gatacatttagaggctccttgg

SEQ ID NO: 941179 - DNA, 22 bp, Artificial Sequence
  chemically synthesized
ttttgaagaactccaaggagcc

SEQ ID NO: 941180 - DNA, 22 bp, Artificial Sequence
  chemically synthesized
atacatttagaggctccttgga

SEQ ID NO: 941181 - DNA, 22 bp, Artificial Sequence
  chemically synthesized
agaggctccttggagttcttca

SEQ ID NO: 941182 - DNA, 22 bp, Artificial Sequence
  chemically synthesized
gaggctccttggagttcttcaa

SEQ ID NO: 941183 - DNA, 22 bp, Artificial Sequence
  chemically synthesized
tagcaacctcttttgaagaact

SEQ ID NO: 941184 - DNA, 22 bp, Artificial Sequence
  chemically synthesized
tgtagcaacctcttttgaagaa

SEQ ID NO: 941185 - DNA, 22 bp, Artificial Sequence
  chemically synthesized
cttggagttcttcaaaagaggt

SEQ ID NO: 941186 - DNA, 22 bp, Artificial Sequence
  chemically synthesized
gaactctgtagcaacctctttt

SEQ ID NO: 941187 - DNA, 22 bp, Artificial Sequence
  chemically synthesized
ggagttcttcaaaagaggttgc

SEQ ID NO: 941188 - DNA, 22 bp, Artificial Sequence
  chemically synthesized
gagttcttcaaaagaggttgct

SEQ ID NO: 941189 - DNA, 22 bp, Artificial Sequence
  chemically synthesized
ttcaaaagaggttgctacagag

SEQ ID NO: 941190 - DNA, 22 bp, Artificial Sequence
  chemically synthesized
taataccctggaactctgtagc

SEQ ID NO: 941191 - DNA, 22 bp, Artificial Sequence
  chemically synthesized
caaaagaggttgctacagagtt

SEQ ID NO: 941192 - DNA, 22 bp, Artificial Sequence
  chemically synthesized
aaaagaggttgctacagagttc

SEQ ID NO: 941193 - DNA, 22 bp, Artificial Sequence
  chemically synthesized
ataatgattataataccctgga

SEQ ID NO: 941194 - DNA, 22 bp, Artificial Sequence
  chemically synthesized
ctacagagttccagggtattat

SEQ ID NO: 941195 - DNA, 22 bp, Artificial Sequence
  chemically synthesized
cagagttccagggtattataat

SEQ ID NO: 941196 - DNA, 22 bp, Artificial Sequence
  chemically synthesized
caattaataatgattataatac

SEQ ID NO: 941197 - DNA, 22 bp, Artificial Sequence
  chemically synthesized
cagggtattataatcattatta

SEQ ID NO: 941198 - DNA, 22 bp, Artificial Sequence
  chemically synthesized
aaatactgcaattaataatgat

SEQ ID NO: 941199 - DNA, 22 bp, Artificial Sequence
  chemically synthesized
aaaatactgcaattaataatga

SEQ ID NO: 941200 - DNA, 22 bp, Artificial Sequence
  chemically synthesized
taaaatactgcaattaataatg

SEQ ID NO: 941201 - DNA, 22 bp, Artificial Sequence
  chemically synthesized
taatcattattaattgcagtat

SEQ ID NO: 941202 - DNA, 22 bp, Artificial Sequence
  chemically synthesized
gtgtgaactttaaaatactgca

SEQ ID NO: 941203 - DNA, 22 bp, Artificial Sequence
  chemically synthesized
atctggtgtgaactttaaaata

SEQ ID NO: 941204 - DNA, 22 bp, Artificial Sequence
  chemically synthesized
ttaattgcagtattttaaagtt

SEQ ID NO: 941205 - DNA, 22 bp, Artificial Sequence
  chemically synthesized
attgcagtattttaaagttcac

SEQ ID NO: 941206 - DNA, 22 bp, Artificial Sequence
  chemically synthesized
gaagctcatctggtgtgaactt

SEQ ID NO: 941207 - DNA, 22 bp, Artificial Sequence
  chemically synthesized
ggaagctcatctggtgtgaact

SEQ ID NO: 941208 - DNA, 22 bp, Artificial Sequence
  chemically synthesized
cagtattttaaagttcacacca

SEQ ID NO: 941209 - DNA, 22 bp, Artificial Sequence
  chemically synthesized
ttggaagctcatctggtgtgaa

SEQ ID NO: 941210 - DNA, 22 bp, Artificial Sequence
  chemically synthesized
cttggaagctcatctggtgtga

SEQ ID NO: 941211 - DNA, 22 bp, Artificial Sequence
  chemically synthesized
tcttggaagctcatctggtgtg

SEQ ID NO: 941212 - DNA, 22 bp, Artificial Sequence
  chemically synthesized
ttcttggaagctcatctggtgt

SEQ ID NO: 941213 - DNA, 22 bp, Artificial Sequence
  chemically synthesized
taaagttcacaccagatgagct

SEQ ID NO: 941214 - DNA, 22 bp, Artificial Sequence
  chemically synthesized
aaagttcacaccagatgagctt

SEQ ID NO: 941215 - DNA, 22 bp, Artificial Sequence
  chemically synthesized
aagttcacaccagatgagcttc

SEQ ID NO: 941216 - DNA, 22 bp, Artificial Sequence
  chemically synthesized
ggtcatttttcttggaagctca

SEQ ID NO: 941217 - DNA, 22 bp, Artificial Sequence
  chemically synthesized
gggtcatttttcttggaagctc

SEQ ID NO: 941218 - DNA, 22 bp, Artificial Sequence
  chemically synthesized
acaccagatgagcttccaagaa

SEQ ID NO: 941219 - DNA, 22 bp, Artificial Sequence
  chemically synthesized
aaataaatttgggtcatttttc

SEQ ID NO: 941220 - DNA, 22 bp, Artificial Sequence
  chemically synthesized
caaataaatttgggtcattttt

SEQ ID NO: 941221 - DNA, 22 bp, Artificial Sequence
  chemically synthesized
tcaaataaatttgggtcatttt

SEQ ID NO: 941222 - DNA, 22 bp, Artificial Sequence
  chemically synthesized
ccaagaaaaatgacccaaattt

SEQ ID NO: 941223 - DNA, 22 bp, Artificial Sequence
  chemically synthesized
caagaaaaatgacccaaattta

SEQ ID NO: 941224 - DNA, 22 bp, Artificial Sequence
  chemically synthesized
atttgaaaggtcacatatattt

SEQ ID NO: 941225 - DNA, 22 bp, Artificial Sequence
  chemically synthesized
gataagtaaaataaatatatgt

SEQ ID NO: 941226 - DNA, 22 bp, Artificial Sequence
  chemically synthesized
tttgaaaggtcacatatattta

SEQ ID NO: 941227 - DNA, 22 bp, Artificial Sequence
  chemically synthesized
gaaaggtcacatatatttattt

SEQ ID NO: 941228 - DNA, 22 bp, Artificial Sequence
  chemically synthesized
aaaggtcacatatatttatttt

SEQ ID NO: 941229 - DNA, 22 bp, Artificial Sequence
  chemically synthesized
tcaccatgtggttggataagta

SEQ ID NO: 941230 - DNA, 22 bp, Artificial Sequence
  chemically synthesized
atcaccatgtggttggataagt

SEQ ID NO: 941231 - DNA, 22 bp, Artificial Sequence
  chemically synthesized
tatcaccatgtggttggataag

SEQ ID NO: 941232 - DNA, 22 bp, Artificial Sequence
  chemically synthesized
ttatcaccatgtggttggataa

SEQ ID NO: 941233 - DNA, 22 bp, Artificial Sequence
  chemically synthesized
tttttatcaccatgtggttgga

SEQ ID NO: 941234 - DNA, 22 bp, Artificial Sequence
  chemically synthesized
attttacttatccaaccacatg

SEQ ID NO: 941235 - DNA, 22 bp, Artificial Sequence
  chemically synthesized
ttttacttatccaaccacatgg

SEQ ID NO: 941236 - DNA, 22 bp, Artificial Sequence
  chemically synthesized
cctatttttatcaccatgtggt

SEQ ID NO: 941237 - DNA, 22 bp, Artificial Sequence
  chemically synthesized
ccctatttttatcaccatgtgg

SEQ ID NO: 941238 - DNA, 22 bp, Artificial Sequence
  chemically synthesized
tacttatccaaccacatggtga

SEQ ID NO: 941239 - DNA, 22 bp, Artificial Sequence
  chemically synthesized
acttatccaaccacatggtgat

SEQ ID NO: 941240 - DNA, 22 bp, Artificial Sequence
  chemically synthesized
cttatccaaccacatggtgata

SEQ ID NO: 941241 - DNA, 22 bp, Artificial Sequence
  chemically synthesized
atccaaccacatggtgataaaa

SEQ ID NO: 941242 - DNA, 22 bp, Artificial Sequence
  chemically synthesized
tccaaccacatggtgataaaaa

SEQ ID NO: 941243 - DNA, 22 bp, Artificial Sequence
  chemically synthesized
tcatggtttccctatttttatc

SEQ ID NO: 941244 - DNA, 22 bp, Artificial Sequence
  chemically synthesized
atcatggtttccctatttttat

SEQ ID NO: 941245 - DNA, 22 bp, Artificial Sequence
  chemically synthesized
tatcatggtttccctattttta

SEQ ID NO: 941246 - DNA, 22 bp, Artificial Sequence
  chemically synthesized
gattttatcatggtttccctat

SEQ ID NO: 941247 - DNA, 22 bp, Artificial Sequence
  chemically synthesized
agctggattttatcatggtttc

SEQ ID NO: 941248 - DNA, 22 bp, Artificial Sequence
  chemically synthesized
gttgagctggattttatcatgg

SEQ ID NO: 941249 - DNA, 22 bp, Artificial Sequence
  chemically synthesized
cctagttgagctggattttatc

SEQ ID NO: 941250 - DNA, 22 bp, Artificial Sequence
  chemically synthesized
cctacctagttgagctggattt

SEQ ID NO: 941251 - DNA, 22 bp, Artificial Sequence
  chemically synthesized
taccatactacctacctagttg

SEQ ID NO: 941252 - DNA, 22 bp, Artificial Sequence
  chemically synthesized
ctataccatactacctacctag

SEQ ID NO: 941253 - DNA, 22 bp, Artificial Sequence
  chemically synthesized
tgctataccatactacctacct

SEQ ID NO: 941254 - DNA, 22 bp, Artificial Sequence
  chemically synthesized
ctgctataccatactacctacc

SEQ ID NO: 941255 - DNA, 22 bp, Artificial Sequence
  chemically synthesized
gtttctgctataccatactacc

SEQ ID NO: 941256 - DNA, 22 bp, Artificial Sequence
  chemically synthesized
aactaggtaggtagtatggtat

SEQ ID NO: 941257 - DNA, 22 bp, Artificial Sequence
  chemically synthesized
ggtaggtagtatggtatagcag

SEQ ID NO: 941258 - DNA, 22 bp, Artificial Sequence
  chemically synthesized
aatccagggactcgtttctgct

SEQ ID NO: 941259 - DNA, 22 bp, Artificial Sequence
  chemically synthesized
aaatccagggactcgtttctgc

SEQ ID NO: 941260 - DNA, 22 bp, Artificial Sequence
  chemically synthesized
taaatccagggactcgtttctg

SEQ ID NO: 941261 - DNA, 22 bp, Artificial Sequence
  chemically synthesized
agattttaaatccagggactcg

SEQ ID NO: 941262 - DNA, 22 bp, Artificial Sequence
  chemically synthesized
tcagattttaaatccagggact

SEQ ID NO: 941263 - DNA, 22 bp, Artificial Sequence
  chemically synthesized
gatttaaaatctgagagctgat

SEQ ID NO: 941264 - DNA, 22 bp, Artificial Sequence
  chemically synthesized
aaaatctgagagctgatttcct

SEQ ID NO: 941265 - DNA, 22 bp, Artificial Sequence
  chemically synthesized
aaatctgagagctgatttcctc

SEQ ID NO: 941266 - DNA, 22 bp, Artificial Sequence
  chemically synthesized
gtacatgaaggaatcaaagagg

SEQ ID NO: 941267 - DNA, 22 bp, Artificial Sequence
  chemically synthesized
agagctgatttcctctttgatt

SEQ ID NO: 941268 - DNA, 22 bp, Artificial Sequence
  chemically synthesized
atttcctctttgattccttcat

SEQ ID NO: 941269 - DNA, 22 bp, Artificial Sequence
  chemically synthesized
cctctttgattccttcatgtac

SEQ ID NO: 941270 - DNA, 22 bp, Artificial Sequence
  chemically synthesized
ctctttgattccttcatgtacc

SEQ ID NO: 941271 - DNA, 22 bp, Artificial Sequence
  chemically synthesized
aaatcacacaattggtacatga

SEQ ID NO: 941272 - DNA, 22 bp, Artificial Sequence
  chemically synthesized
tttgattccttcatgtaccaat

SEQ ID NO: 941273 - DNA, 22 bp, Artificial Sequence
  chemically synthesized
tgattccttcatgtaccaattg

SEQ ID NO: 941274 - DNA, 22 bp, Artificial Sequence
  chemically synthesized
gattccttcatgtaccaattgt

SEQ ID NO: 941275 - DNA, 22 bp, Artificial Sequence
  chemically synthesized
attccttcatgtaccaattgtg

SEQ ID NO: 941276 - DNA, 22 bp, Artificial Sequence
  chemically synthesized
cttcatgtaccaattgtgtgat

SEQ ID NO: 941277 - DNA, 22 bp, Artificial Sequence
  chemically synthesized
catgtaccaattgtgtgatttt

SEQ ID NO: 941278 - DNA, 22 bp, Artificial Sequence
  chemically synthesized
agcagtatagttaaaatcacac

SEQ ID NO: 941279 - DNA, 22 bp, Artificial Sequence
  chemically synthesized
atgtaccaattgtgtgatttta

SEQ ID NO: 941280 - DNA, 22 bp, Artificial Sequence
  chemically synthesized
tgtgattttaactatactgctt

SEQ ID NO: 941281 - DNA, 22 bp, Artificial Sequence
  chemically synthesized
agacatatgaggattaagcagt

SEQ ID NO: 941282 - DNA, 22 bp, Artificial Sequence
  chemically synthesized
taactatactgcttaatcctca

SEQ ID NO: 941283 - DNA, 22 bp, Artificial Sequence
  chemically synthesized
aactatactgcttaatcctcat

SEQ ID NO: 941284 - DNA, 22 bp, Artificial Sequence
  chemically synthesized
actatactgcttaatcctcata

SEQ ID NO: 941285 - DNA, 22 bp, Artificial Sequence
  chemically synthesized
agaaattaagacatatgaggat

SEQ ID NO: 941286 - DNA, 22 bp, Artificial Sequence
  chemically synthesized
tactgcttaatcctcatatgtc

SEQ ID NO: 941287 - DNA, 22 bp, Artificial Sequence
  chemically synthesized
cagctgagaaattaagacatat

SEQ ID NO: 941288 - DNA, 22 bp, Artificial Sequence
  chemically synthesized
acagctgagaaattaagacata

SEQ ID NO: 941289 - DNA, 22 bp, Artificial Sequence
  chemically synthesized
cttaatcctcatatgtcttaat

SEQ ID NO: 941290 - DNA, 22 bp, Artificial Sequence
  chemically synthesized
tacagctgagaaattaagacat

SEQ ID NO: 941291 - DNA, 22 bp, Artificial Sequence
  chemically synthesized
aatcctcatatgtcttaatttc

SEQ ID NO: 941292 - DNA, 22 bp, Artificial Sequence
  chemically synthesized
atcctcatatgtcttaatttct

SEQ ID NO: 941293 - DNA, 22 bp, Artificial Sequence
  chemically synthesized
tgcccattttacagctgagaaa

SEQ ID NO: 941294 - DNA, 22 bp, Artificial Sequence
  chemically synthesized
atatgtcttaatttctcagctg

SEQ ID NO: 941295 - DNA, 22 bp, Artificial Sequence
  chemically synthesized
ttatgcccattttacagctgag

SEQ ID NO: 941296 - DNA, 22 bp, Artificial Sequence
  chemically synthesized
aatttctcagctgtaaaatggg

SEQ ID NO: 941297 - DNA, 22 bp, Artificial Sequence
  chemically synthesized
atttctcagctgtaaaatgggc

SEQ ID NO: 941298 - DNA, 22 bp, Artificial Sequence
  chemically synthesized
ctcagctgtaaaatgggcataa

SEQ ID NO: 941299 - DNA, 22 bp, Artificial Sequence
  chemically synthesized
tcagctgtaaaatgggcataat

SEQ ID NO: 941300 - DNA, 22 bp, Artificial Sequence
  chemically synthesized
agctgtaaaatgggcataataa

SEQ ID NO: 941301 - DNA, 22 bp, Artificial Sequence
  chemically synthesized
aggtaagacaaacattattatg

SEQ ID NO: 941302 - DNA, 22 bp, Artificial Sequence
  chemically synthesized
taaaatgggcataataatgttt

SEQ ID NO: 941303 - DNA, 22 bp, Artificial Sequence
  chemically synthesized
actgaggtaagacaaacattat

SEQ ID NO: 941304 - DNA, 22 bp, Artificial Sequence
  chemically synthesized
tcctcactgaggtaagacaaac

SEQ ID NO: 941305 - DNA, 22 bp, Artificial Sequence
  chemically synthesized
gtcctcactgaggtaagacaaa

SEQ ID NO: 941306 - DNA, 22 bp, Artificial Sequence
  chemically synthesized
aaaaaaaaaatttgtcctcact

SEQ ID NO: 941307 - DNA, 22 bp, Artificial Sequence
  chemically synthesized
gtcttacctcagtgaggacaaa

SEQ ID NO: 941308 - DNA, 22 bp, Artificial Sequence
  chemically synthesized
tcttacctcagtgaggacaaat

SEQ ID NO: 941309 - DNA, 22 bp, Artificial Sequence
  chemically synthesized
acctcagtgaggacaaattttt

SEQ ID NO: 941310 - DNA, 22 bp, Artificial Sequence
  chemically synthesized
cctcagtgaggacaaatttttt

SEQ ID NO: 941311 - DNA, 22 bp, Artificial Sequence
  chemically synthesized
cagcactgaaaaaaaaaatttg

SEQ ID NO: 941312 - DNA, 22 bp, Artificial Sequence
  chemically synthesized
agtgaggacaaatttttttttt

SEQ ID NO: 941313 - DNA, 22 bp, Artificial Sequence
  chemically synthesized
gaattacagcactgaaaaaaaa

SEQ ID NO: 941314 - DNA, 22 bp, Artificial Sequence
  chemically synthesized
ctggaattacagcactgaaaaa

SEQ ID NO: 941315 - DNA, 22 bp, Artificial Sequence
  chemically synthesized
gctgctggaattacagcactga

SEQ ID NO: 941316 - DNA, 22 bp, Artificial Sequence
  chemically synthesized
tagctgctggaattacagcact

SEQ ID NO: 941317 - DNA, 22 bp, Artificial Sequence
  chemically synthesized
tttttttcagtgctgtaattcc

SEQ ID NO: 941318 - DNA, 22 bp, Artificial Sequence
  chemically synthesized
ttttttcagtgctgtaattcca

SEQ ID NO: 941319 - DNA, 22 bp, Artificial Sequence
  chemically synthesized
tttttcagtgctgtaattccag

SEQ ID NO: 941320 - DNA, 22 bp, Artificial Sequence
  chemically synthesized
ttttcagtgctgtaattccagc

SEQ ID NO: 941321 - DNA, 22 bp, Artificial Sequence
  chemically synthesized
tttcagtgctgtaattccagca

SEQ ID NO: 941322 - DNA, 22 bp, Artificial Sequence
  chemically synthesized
ttcagtgctgtaattccagcag

SEQ ID NO: 941323 - DNA, 22 bp, Artificial Sequence
  chemically synthesized
tcagtgctgtaattccagcagc

SEQ ID NO: 941324 - DNA, 22 bp, Artificial Sequence
  chemically synthesized
cagtgctgtaattccagcagct

SEQ ID NO: 941325 - DNA, 22 bp, Artificial Sequence
  chemically synthesized
agtgctgtaattccagcagcta

SEQ ID NO: 941326 - DNA, 22 bp, Artificial Sequence
  chemically synthesized
tgccaaacgcagttctagctgc

SEQ ID NO: 941327 - DNA, 22 bp, Artificial Sequence
  chemically synthesized
tgtgccaaacgcagttctagct

SEQ ID NO: 941328 - DNA, 22 bp, Artificial Sequence
  chemically synthesized
taattccagcagctagaactgc

SEQ ID NO: 941329 - DNA, 22 bp, Artificial Sequence
  chemically synthesized
ctctgtgccaaacgcagttcta

SEQ ID NO: 941330 - DNA, 22 bp, Artificial Sequence
  chemically synthesized
tgctctgtgccaaacgcagttc

SEQ ID NO: 941331 - DNA, 22 bp, Artificial Sequence
  chemically synthesized
cagcagctagaactgcgtttgg

SEQ ID NO: 941332 - DNA, 22 bp, Artificial Sequence
  chemically synthesized
agcctctgctctgtgccaaacg

SEQ ID NO: 941333 - DNA, 22 bp, Artificial Sequence
  chemically synthesized
tgagcctctgctctgtgccaaa

SEQ ID NO: 941334 - DNA, 22 bp, Artificial Sequence
  chemically synthesized
ctgagcctctgctctgtgccaa

SEQ ID NO: 941335 - DNA, 22 bp, Artificial Sequence
  chemically synthesized
gaactgcgtttggcacagagca

SEQ ID NO: 941336 - DNA, 22 bp, Artificial Sequence
  chemically synthesized
cgtttggcacagagcagaggct

SEQ ID NO: 941337 - DNA, 22 bp, Artificial Sequence
  chemically synthesized
acaaacatttctgagcctctgc

SEQ ID NO: 941338 - DNA, 22 bp, Artificial Sequence
  chemically synthesized
aacaaacatttctgagcctctg

SEQ ID NO: 941339 - DNA, 22 bp, Artificial Sequence
  chemically synthesized
ggcacagagcagaggctcagaa

SEQ ID NO: 941340 - DNA, 22 bp, Artificial Sequence
  chemically synthesized
gcacagagcagaggctcagaaa

SEQ ID NO: 941341 - DNA, 22 bp, Artificial Sequence
  chemically synthesized
atttaacaaacatttctgagcc

SEQ ID NO: 941342 - DNA, 22 bp, Artificial Sequence
  chemically synthesized
acgtgttaatttaacaaacatt

SEQ ID NO: 941343 - DNA, 22 bp, Artificial Sequence
  chemically synthesized
attcacgtgttaatttaacaaa

SEQ ID NO: 941344 - DNA, 22 bp, Artificial Sequence
  chemically synthesized
agaaatgtttgttaaattaaca

SEQ ID NO: 941345 - DNA, 22 bp, Artificial Sequence
  chemically synthesized
tccattcattcacgtgttaatt

SEQ ID NO: 941346 - DNA, 22 bp, Artificial Sequence
  chemically synthesized
attatccattcattcacgtgtt

SEQ ID NO: 941347 - DNA, 22 bp, Artificial Sequence
  chemically synthesized
gttaaattaacacgtgaatgaa

SEQ ID NO: 941348 - DNA, 22 bp, Artificial Sequence
  chemically synthesized
ttaaattaacacgtgaatgaat

SEQ ID NO: 941349 - DNA, 22 bp, Artificial Sequence
  chemically synthesized
aattaacacgtgaatgaatgga

SEQ ID NO: 941350 - DNA, 22 bp, Artificial Sequence
  chemically synthesized
acacgtgaatgaatggataatg

SEQ ID NO: 941351 - DNA, 22 bp, Artificial Sequence
  chemically synthesized
aatgcgcacaacattcattatc

SEQ ID NO: 941352 - DNA, 22 bp, Artificial Sequence
  chemically synthesized
ctgaatgcgcacaacattcatt

SEQ ID NO: 941353 - DNA, 22 bp, Artificial Sequence
  chemically synthesized
atgttactgaatgcgcacaaca

SEQ ID NO: 941354 - DNA, 22 bp, Artificial Sequence
  chemically synthesized
catgttactgaatgcgcacaac

SEQ ID NO: 941355 - DNA, 22 bp, Artificial Sequence
  chemically synthesized
atgtgcttcatgttactgaatg

SEQ ID NO: 941356 - DNA, 22 bp, Artificial Sequence
  chemically synthesized
tgcgcattcagtaacatgaagc

SEQ ID NO: 941357 - DNA, 22 bp, Artificial Sequence
  chemically synthesized
aatatatgtacattcatgtgct

SEQ ID NO: 941358 - DNA, 22 bp, Artificial Sequence
  chemically synthesized
aaatatatgtacattcatgtgc

SEQ ID NO: 941359 - DNA, 22 bp, Artificial Sequence
  chemically synthesized
agtaacatgaagcacatgaatg

SEQ ID NO: 941360 - DNA, 22 bp, Artificial Sequence
  chemically synthesized
atagatatggatgcaaaattta

SEQ ID NO: 941361 - DNA, 22 bp, Artificial Sequence
  chemically synthesized
aatagatatggatgcaaaattt

SEQ ID NO: 941362 - DNA, 22 bp, Artificial Sequence
  chemically synthesized
aaattttgcatccatatctatt

SEQ ID NO: 941363 - DNA, 22 bp, Artificial Sequence
  chemically synthesized
aattttgcatccatatctatta

SEQ ID NO: 941364 - DNA, 22 bp, Artificial Sequence
  chemically synthesized
tgcatccatatctattaaatac

SEQ ID NO: 941365 - DNA, 22 bp, Artificial Sequence
  chemically synthesized
gcatccatatctattaaatacc

SEQ ID NO: 941366 - DNA, 22 bp, Artificial Sequence
  chemically synthesized
catccatatctattaaatacca

SEQ ID NO: 941367 - DNA, 22 bp, Artificial Sequence
  chemically synthesized
ttaaataccatctggatatttt

SEQ ID NO: 941368 - DNA, 22 bp, Artificial Sequence
  chemically synthesized
aataccatctggatattttatc

SEQ ID NO: 941369 - DNA, 22 bp, Artificial Sequence
  chemically synthesized
cccagatataatagataaaata

SEQ ID NO: 941370 - DNA, 22 bp, Artificial Sequence
  chemically synthesized
attacccagatataatagataa

SEQ ID NO: 941371 - DNA, 22 bp, Artificial Sequence
  chemically synthesized
cattacccagatataatagata

SEQ ID NO: 941372 - DNA, 22 bp, Artificial Sequence
  chemically synthesized
tcattacccagatataatagat

SEQ ID NO: 941373 - DNA, 22 bp, Artificial Sequence
  chemically synthesized
ttttcattacccagatataata

SEQ ID NO: 941374 - DNA, 22 bp, Artificial Sequence
  chemically synthesized
gatattttatctattatatctg

SEQ ID NO: 941375 - DNA, 22 bp, Artificial Sequence
  chemically synthesized
tatctattatatctgggtaatg

SEQ ID NO: 941376 - DNA, 22 bp, Artificial Sequence
  chemically synthesized
tatagttattttcattacccag

SEQ ID NO: 941377 - DNA, 22 bp, Artificial Sequence
  chemically synthesized
atctattatatctgggtaatga

SEQ ID NO: 941378 - DNA, 22 bp, Artificial Sequence
  chemically synthesized
tctattatatctgggtaatgaa

SEQ ID NO: 941379 - DNA, 22 bp, Artificial Sequence
  chemically synthesized
ttatatctgggtaatgaaaata

SEQ ID NO: 941380 - DNA, 22 bp, Artificial Sequence
  chemically synthesized
tatctgggtaatgaaaataact

SEQ ID NO: 941381 - DNA, 22 bp, Artificial Sequence
  chemically synthesized
ggtaatgaaaataactatacaa

SEQ ID NO: 941382 - DNA, 22 bp, Artificial Sequence
  chemically synthesized
gaaagaaacgggcagtagcaca

SEQ ID NO: 941383 - DNA, 22 bp, Artificial Sequence
  chemically synthesized
tacaatgctgtgctactgcccg

SEQ ID NO: 941384 - DNA, 22 bp, Artificial Sequence
  chemically synthesized
aatgcagaattggaaagaaacg

SEQ ID NO: 941385 - DNA, 22 bp, Artificial Sequence
  chemically synthesized
tgctactgcccgtttctttcca

SEQ ID NO: 941386 - DNA, 22 bp, Artificial Sequence
  chemically synthesized
ctgcccgtttctttccaattct

SEQ ID NO: 941387 - DNA, 22 bp, Artificial Sequence
  chemically synthesized
cccgtttctttccaattctgca

SEQ ID NO: 941388 - DNA, 22 bp, Artificial Sequence
  chemically synthesized
ctttccaattctgcattcaatg

SEQ ID NO: 941389 - DNA, 22 bp, Artificial Sequence
  chemically synthesized
ccagtgtgacgtcattgaatgc

SEQ ID NO: 941390 - DNA, 22 bp, Artificial Sequence
  chemically synthesized
tttccaattctgcattcaatga

SEQ ID NO: 941391 - DNA, 22 bp, Artificial Sequence
  chemically synthesized
tccaattctgcattcaatgacg

SEQ ID NO: 941392 - DNA, 22 bp, Artificial Sequence
  chemically synthesized
ccaattctgcattcaatgacgt

SEQ ID NO: 941393 - DNA, 22 bp, Artificial Sequence
  chemically synthesized
caattctgcattcaatgacgtc

SEQ ID NO: 941394 - DNA, 22 bp, Artificial Sequence
  chemically synthesized
aagctaccagtgtgacgtcatt

SEQ ID NO: 941395 - DNA, 22 bp, Artificial Sequence
  chemically synthesized
caagctaccagtgtgacgtcat

SEQ ID NO: 941396 - DNA, 22 bp, Artificial Sequence
  chemically synthesized
tgcattcaatgacgtcacactg

SEQ ID NO: 941397 - DNA, 22 bp, Artificial Sequence
  chemically synthesized
cattcaatgacgtcacactggt

SEQ ID NO: 941398 - DNA, 22 bp, Artificial Sequence
  chemically synthesized
aatgacgtcacactggtagctt

SEQ ID NO: 941399 - DNA, 22 bp, Artificial Sequence
  chemically synthesized
cagcatagccaatttcaagcta

SEQ ID NO: 941400 - DNA, 22 bp, Artificial Sequence
  chemically synthesized
gtagcttgaaattggctatgct

SEQ ID NO: 941401 - DNA, 22 bp, Artificial Sequence
  chemically synthesized
cacaaatgctccagcatagcca

SEQ ID NO: 941402 - DNA, 22 bp, Artificial Sequence
  chemically synthesized
ttgcacaaatgctccagcatag

SEQ ID NO: 941403 - DNA, 22 bp, Artificial Sequence
  chemically synthesized
gttgcacaaatgctccagcata

SEQ ID NO: 941404 - DNA, 22 bp, Artificial Sequence
  chemically synthesized
tgttgcacaaatgctccagcat

SEQ ID NO: 941405 - DNA, 22 bp, Artificial Sequence
  chemically synthesized
gaaattggctatgctggagcat

SEQ ID NO: 941406 - DNA, 22 bp, Artificial Sequence
  chemically synthesized
aaattggctatgctggagcatt

SEQ ID NO: 941407 - DNA, 22 bp, Artificial Sequence
  chemically synthesized
gcaaattttgttgcacaaatgc

SEQ ID NO: 941408 - DNA, 22 bp, Artificial Sequence
  chemically synthesized
gctatgctggagcatttgtgca

SEQ ID NO: 941409 - DNA, 22 bp, Artificial Sequence
  chemically synthesized
ggcaaattttgttgcacaaatg

SEQ ID NO: 941410 - DNA, 22 bp, Artificial Sequence
  chemically synthesized
tgctggagcatttgtgcaacaa

SEQ ID NO: 941411 - DNA, 22 bp, Artificial Sequence
  chemically synthesized
cagcatttggcaaattttgttg

SEQ ID NO: 941412 - DNA, 22 bp, Artificial Sequence
  chemically synthesized
gagcatttgtgcaacaaaattt

SEQ ID NO: 941413 - DNA, 22 bp, Artificial Sequence
  chemically synthesized
gcagcatttggcaaattttgtt

SEQ ID NO: 941414 - DNA, 22 bp, Artificial Sequence
  chemically synthesized
atttgcagcatttggcaaattt

SEQ ID NO: 941415 - DNA, 22 bp, Artificial Sequence
  chemically synthesized
gtgcaacaaaatttgccaaatg

SEQ ID NO: 941416 - DNA, 22 bp, Artificial Sequence
  chemically synthesized
tgcaacaaaatttgccaaatgc

SEQ ID NO: 941417 - DNA, 22 bp, Artificial Sequence
  chemically synthesized
gccaaatgctgcaaatcagaca

SEQ ID NO: 941418 - DNA, 22 bp, Artificial Sequence
  chemically synthesized
ccaaatgctgcaaatcagacac

SEQ ID NO: 941419 - DNA, 22 bp, Artificial Sequence
  chemically synthesized
gcggggagagagagtgtctgat

SEQ ID NO: 941420 - DNA, 22 bp, Artificial Sequence
  chemically synthesized
ggcggggagagagagtgtctga

SEQ ID NO: 941421 - DNA, 22 bp, Artificial Sequence
  chemically synthesized
ttggcggggagagagagtgtct

SEQ ID NO: 941422 - DNA, 22 bp, Artificial Sequence
  chemically synthesized
caaatcagacactctctctccc

SEQ ID NO: 941423 - DNA, 22 bp, Artificial Sequence
  chemically synthesized
acaagaggctcttggcggggag

SEQ ID NO: 941424 - DNA, 22 bp, Artificial Sequence
  chemically synthesized
aacaagaggctcttggcgggga

SEQ ID NO: 941425 - DNA, 22 bp, Artificial Sequence
  chemically synthesized
tctctccccgccaagagcctct

SEQ ID NO: 941426 - DNA, 22 bp, Artificial Sequence
  chemically synthesized
tctccccgccaagagcctcttg

SEQ ID NO: 941427 - DNA, 22 bp, Artificial Sequence
  chemically synthesized
gtaaatgtttaacaagaggctc

SEQ ID NO: 941428 - DNA, 22 bp, Artificial Sequence
  chemically synthesized
tccccgccaagagcctcttgtt

SEQ ID NO: 941429 - DNA, 22 bp, Artificial Sequence
  chemically synthesized
ctggtaaatgtttaacaagagg

SEQ ID NO: 941430 - DNA, 22 bp, Artificial Sequence
  chemically synthesized
cccgccaagagcctcttgttaa

SEQ ID NO: 941431 - DNA, 22 bp, Artificial Sequence
  chemically synthesized
gctggtaaatgtttaacaagag

SEQ ID NO: 941432 - DNA, 22 bp, Artificial Sequence
  chemically synthesized
gaacagtggtttgctggtaaat

SEQ ID NO: 941433 - DNA, 22 bp, Artificial Sequence
  chemically synthesized
ttgttaaacatttaccagcaaa

SEQ ID NO: 941434 - DNA, 22 bp, Artificial Sequence
  chemically synthesized
gttaaacatttaccagcaaacc

SEQ ID NO: 941435 - DNA, 22 bp, Artificial Sequence
  chemically synthesized
ttaaacatttaccagcaaacca

SEQ ID NO: 941436 - DNA, 22 bp, Artificial Sequence
  chemically synthesized
aacatttaccagcaaaccactg

SEQ ID NO: 941437 - DNA, 22 bp, Artificial Sequence
  chemically synthesized
accagcaaaccactgttccagg

SEQ ID NO: 941438 - DNA, 22 bp, Artificial Sequence
  chemically synthesized
ccagcaaaccactgttccaggt

SEQ ID NO: 941439 - DNA, 22 bp, Artificial Sequence
  chemically synthesized
ttccaggtcctcattatctggc

SEQ ID NO: 941440 - DNA, 22 bp, Artificial Sequence
  chemically synthesized
caggtcctcattatctggcctc

SEQ ID NO: 941441 - DNA, 22 bp, Artificial Sequence
  chemically synthesized
attatctggcctctgcttatac

SEQ ID NO: 941442 - DNA, 22 bp, Artificial Sequence
  chemically synthesized
tctggcctctgcttatactttg

SEQ ID NO: 941443 - DNA, 22 bp, Artificial Sequence
  chemically synthesized
gcctctgcttatactttgttgt

SEQ ID NO: 941444 - DNA, 22 bp, Artificial Sequence
  chemically synthesized
tagagaagatagaagacaacaa

SEQ ID NO: 941445 - DNA, 22 bp, Artificial Sequence
  chemically synthesized
tgcttatactttgttgtcttct

SEQ ID NO: 941446 - DNA, 22 bp, Artificial Sequence
  chemically synthesized
cttatactttgttgtcttctat

SEQ ID NO: 941447 - DNA, 22 bp, Artificial Sequence
  chemically synthesized
atactttgttgtcttctatctt

SEQ ID NO: 941448 - DNA, 22 bp, Artificial Sequence
  chemically synthesized
tactttgttgtcttctatcttc

SEQ ID NO: 941449 - DNA, 22 bp, Artificial Sequence
  chemically synthesized
agcaaaagttgtagagaagata

SEQ ID NO: 941450 - DNA, 22 bp, Artificial Sequence
  chemically synthesized
cagcaaaagttgtagagaagat

SEQ ID NO: 941451 - DNA, 22 bp, Artificial Sequence
  chemically synthesized
tgttgtcttctatcttctctac

SEQ ID NO: 941452 - DNA, 22 bp, Artificial Sequence
  chemically synthesized
gttgtcttctatcttctctaca

SEQ ID NO: 941453 - DNA, 22 bp, Artificial Sequence
  chemically synthesized
ttgtcttctatcttctctacaa

SEQ ID NO: 941454 - DNA, 22 bp, Artificial Sequence
  chemically synthesized
tcttctatcttctctacaactt

SEQ ID NO: 941455 - DNA, 22 bp, Artificial Sequence
  chemically synthesized
ctatcttctctacaacttttgc

SEQ ID NO: 941456 - DNA, 22 bp, Artificial Sequence
  chemically synthesized
agaatgacttcagcaaaagttg

SEQ ID NO: 941457 - DNA, 22 bp, Artificial Sequence
  chemically synthesized
tatcttctctacaacttttgct

SEQ ID NO: 941458 - DNA, 22 bp, Artificial Sequence
  chemically synthesized
cagaatgacttcagcaaaagtt

SEQ ID NO: 941459 - DNA, 22 bp, Artificial Sequence
  chemically synthesized
tcttctctacaacttttgctga

SEQ ID NO: 941460 - DNA, 22 bp, Artificial Sequence
  chemically synthesized
ctctacaacttttgctgaagtc

SEQ ID NO: 941461 - DNA, 22 bp, Artificial Sequence
  chemically synthesized
gtatttcagaatgacttcagca

SEQ ID NO: 941462 - DNA, 22 bp, Artificial Sequence
  chemically synthesized
tctacaacttttgctgaagtca

SEQ ID NO: 941463 - DNA, 22 bp, Artificial Sequence
  chemically synthesized
tacaacttttgctgaagtcatt

SEQ ID NO: 941464 - DNA, 22 bp, Artificial Sequence
  chemically synthesized
ctagtatttcagaatgacttca

SEQ ID NO: 941465 - DNA, 22 bp, Artificial Sequence
  chemically synthesized
caacttttgctgaagtcattct

SEQ ID NO: 941466 - DNA, 22 bp, Artificial Sequence
  chemically synthesized
gtgactgctagtatttcagaat

SEQ ID NO: 941467 - DNA, 22 bp, Artificial Sequence
  chemically synthesized
ttgctgaagtcattctgaaata

SEQ ID NO: 941468 - DNA, 22 bp, Artificial Sequence
  chemically synthesized
ggtgactgctagtatttcagaa

SEQ ID NO: 941469 - DNA, 22 bp, Artificial Sequence
  chemically synthesized
tgctgaagtcattctgaaatac

SEQ ID NO: 941470 - DNA, 22 bp, Artificial Sequence
  chemically synthesized
tggtgactgctagtatttcaga

SEQ ID NO: 941471 - DNA, 22 bp, Artificial Sequence
  chemically synthesized
gctgaagtcattctgaaatact

SEQ ID NO: 941472 - DNA, 22 bp, Artificial Sequence
  chemically synthesized
ctgaagtcattctgaaatacta

SEQ ID NO: 941473 - DNA, 22 bp, Artificial Sequence
  chemically synthesized
ttttggtgactgctagtatttc

SEQ ID NO: 941474 - DNA, 22 bp, Artificial Sequence
  chemically synthesized
aagtcattctgaaatactagca

SEQ ID NO: 941475 - DNA, 22 bp, Artificial Sequence
  chemically synthesized
gattattttggtgactgctagt

SEQ ID NO: 941476 - DNA, 22 bp, Artificial Sequence
  chemically synthesized
tgaaatactagcagtcaccaaa

SEQ ID NO: 941477 - DNA, 22 bp, Artificial Sequence
  chemically synthesized
aaatactagcagtcaccaaaat

SEQ ID NO: 941478 - DNA, 22 bp, Artificial Sequence
  chemically synthesized
gcagtcaccaaaataatccagg

SEQ ID NO: 941479 - DNA, 22 bp, Artificial Sequence
  chemically synthesized
tgcagtgacgcccagagcctgg

SEQ ID NO: 941480 - DNA, 22 bp, Artificial Sequence
  chemically synthesized
aaggcaaggtggagattgtgca

SEQ ID NO: 941481 - DNA, 22 bp, Artificial Sequence
  chemically synthesized
caaggcaaggtggagattgtgc

SEQ ID NO: 941482 - DNA, 22 bp, Artificial Sequence
  chemically synthesized
tgggcgtcactgcacaatctcc

SEQ ID NO: 941483 - DNA, 22 bp, Artificial Sequence
  chemically synthesized
tcaaggcaaggtggagattgtg

SEQ ID NO: 941484 - DNA, 22 bp, Artificial Sequence
  chemically synthesized
ggcgtcactgcacaatctccac

SEQ ID NO: 941485 - DNA, 22 bp, Artificial Sequence
  chemically synthesized
cacaatctccaccttgccttga

SEQ ID NO: 941486 - DNA, 22 bp, Artificial Sequence
  chemically synthesized
ggagggaaattttcaaggcaag

SEQ ID NO: 941487 - DNA, 22 bp, Artificial Sequence
  chemically synthesized
taggagggaaattttcaaggca

SEQ ID NO: 941488 - DNA, 22 bp, Artificial Sequence
  chemically synthesized
ctaggagggaaattttcaaggc

SEQ ID NO: 941489 - DNA, 22 bp, Artificial Sequence
  chemically synthesized
caccttgccttgaaaatttccc

SEQ ID NO: 941490 - DNA, 22 bp, Artificial Sequence
  chemically synthesized
gccttgaaaatttccctcctag

SEQ ID NO: 941491 - DNA, 22 bp, Artificial Sequence
  chemically synthesized
ccttgaaaatttccctcctaga

SEQ ID NO: 941492 - DNA, 22 bp, Artificial Sequence
  chemically synthesized
gaaaatttccctcctagaaata

SEQ ID NO: 941493 - DNA, 22 bp, Artificial Sequence
  chemically synthesized
agacatgatacgtatttctagg

SEQ ID NO: 941494 - DNA, 22 bp, Artificial Sequence
  chemically synthesized
aaaatttccctcctagaaatac

SEQ ID NO: 941495 - DNA, 22 bp, Artificial Sequence
  chemically synthesized
gctaagacatgatacgtatttc

SEQ ID NO: 941496 - DNA, 22 bp, Artificial Sequence
  chemically synthesized
ccctcctagaaatacgtatcat

SEQ ID NO: 941497 - DNA, 22 bp, Artificial Sequence
  chemically synthesized
cctcctagaaatacgtatcatg

SEQ ID NO: 941498 - DNA, 22 bp, Artificial Sequence
  chemically synthesized
ctagaaatacgtatcatgtctt

SEQ ID NO: 941499 - DNA, 22 bp, Artificial Sequence
  chemically synthesized
gaaatacgtatcatgtcttagc

SEQ ID NO: 941500 - DNA, 22 bp, Artificial Sequence
  chemically synthesized
aaggatatccgagtaagtgtta

SEQ ID NO: 941501 - DNA, 22 bp, Artificial Sequence
  chemically synthesized
caaggatatccgagtaagtgtt

SEQ ID NO: 941502 - DNA, 22 bp, Artificial Sequence
  chemically synthesized
tcaaggatatccgagtaagtgt

SEQ ID NO: 941503 - DNA, 22 bp, Artificial Sequence
  chemically synthesized
ctttcaaggatatccgagtaag

SEQ ID NO: 941504 - DNA, 22 bp, Artificial Sequence
  chemically synthesized
agctaacacttactcggatatc

SEQ ID NO: 941505 - DNA, 22 bp, Artificial Sequence
  chemically synthesized
gctaacacttactcggatatcc

SEQ ID NO: 941506 - DNA, 22 bp, Artificial Sequence
  chemically synthesized
acacttactcggatatccttga

SEQ ID NO: 941507 - DNA, 22 bp, Artificial Sequence
  chemically synthesized
actcggatatccttgaaagcag

SEQ ID NO: 941508 - DNA, 22 bp, Artificial Sequence
  chemically synthesized
ctcggatatccttgaaagcagt

SEQ ID NO: 941509 - DNA, 22 bp, Artificial Sequence
  chemically synthesized
gggtagtcagagactgctttca

SEQ ID NO: 941510 - DNA, 22 bp, Artificial Sequence
  chemically synthesized
ggggtagtcagagactgctttc

SEQ ID NO: 941511 - DNA, 22 bp, Artificial Sequence
  chemically synthesized
ggatatccttgaaagcagtctc

SEQ ID NO: 941512 - DNA, 22 bp, Artificial Sequence
  chemically synthesized
acttggggtagtcagagactgc

SEQ ID NO: 941513 - DNA, 22 bp, Artificial Sequence
  chemically synthesized
gaaagcagtctctgactacccc

SEQ ID NO: 941514 - DNA, 22 bp, Artificial Sequence
  chemically synthesized
aaagcagtctctgactacccca

SEQ ID NO: 941515 - DNA, 22 bp, Artificial Sequence
  chemically synthesized
tgactaccccaagttagacttg

SEQ ID NO: 941516 - DNA, 22 bp, Artificial Sequence
  chemically synthesized
actaccccaagttagacttggg

SEQ ID NO: 941517 - DNA, 22 bp, Artificial Sequence
  chemically synthesized
ccccaagttagacttgggtacc

SEQ ID NO: 941518 - DNA, 22 bp, Artificial Sequence
  chemically synthesized
gacttgggtacctcttccatgt

SEQ ID NO: 941519 - DNA, 22 bp, Artificial Sequence
  chemically synthesized
agtgatagccaaacacatggaa

SEQ ID NO: 941520 - DNA, 22 bp, Artificial Sequence
  chemically synthesized
gggtacctcttccatgtgtttg

SEQ ID NO: 941521 - DNA, 22 bp, Artificial Sequence
  chemically synthesized
ggtacctcttccatgtgtttgg

SEQ ID NO: 941522 - DNA, 22 bp, Artificial Sequence
  chemically synthesized
ttccatgtgtttggctatcact

SEQ ID NO: 941523 - DNA, 22 bp, Artificial Sequence
  chemically synthesized
ccatgtgtttggctatcactca

SEQ ID NO: 941524 - DNA, 22 bp, Artificial Sequence
  chemically synthesized
catgtgtttggctatcactcag

SEQ ID NO: 941525 - DNA, 22 bp, Artificial Sequence
  chemically synthesized
ggctatcactcagtggttatca

SEQ ID NO: 941526 - DNA, 22 bp, Artificial Sequence
  chemically synthesized
gctatcactcagtggttatcac

SEQ ID NO: 941527 - DNA, 22 bp, Artificial Sequence
  chemically synthesized
tcactcagtggttatcaccatg

SEQ ID NO: 941528 - DNA, 22 bp, Artificial Sequence
  chemically synthesized
ggataataccgtcatggtgata

SEQ ID NO: 941529 - DNA, 22 bp, Artificial Sequence
  chemically synthesized
agtggttatcaccatgacggta

SEQ ID NO: 941530 - DNA, 22 bp, Artificial Sequence
  chemically synthesized
tcatacgttaggataataccgt

SEQ ID NO: 941531 - DNA, 22 bp, Artificial Sequence
  chemically synthesized
ttatcatacgttaggataatac

SEQ ID NO: 941532 - DNA, 22 bp, Artificial Sequence
  chemically synthesized
tcaccatgacggtattatccta

SEQ ID NO: 941533 - DNA, 22 bp, Artificial Sequence
  chemically synthesized
tcctaacgtatgataataattg

SEQ ID NO: 941534 - DNA, 22 bp, Artificial Sequence
  chemically synthesized
acgtatgataataattgcttgt

SEQ ID NO: 941535 - DNA, 22 bp, Artificial Sequence
  chemically synthesized
aggggaggcacacaagtaaaca

SEQ ID NO: 941536 - DNA, 22 bp, Artificial Sequence
  chemically synthesized
tcaggggaggcacacaagtaaa

SEQ ID NO: 941537 - DNA, 22 bp, Artificial Sequence
  chemically synthesized
cttgtttacttgtgtgcctccc

SEQ ID NO: 941538 - DNA, 22 bp, Artificial Sequence
  chemically synthesized
aaagagctctcaggggaggcac

SEQ ID NO: 941539 - DNA, 22 bp, Artificial Sequence
  chemically synthesized
caaagagctctcaggggaggca

SEQ ID NO: 941540 - DNA, 22 bp, Artificial Sequence
  chemically synthesized
gtttacttgtgtgcctcccctg

SEQ ID NO: 941541 - DNA, 22 bp, Artificial Sequence
  chemically synthesized
tttacttgtgtgcctcccctga

SEQ ID NO: 941542 - DNA, 22 bp, Artificial Sequence
  chemically synthesized
acttgtgtgcctcccctgagag

SEQ ID NO: 941543 - DNA, 22 bp, Artificial Sequence
  chemically synthesized
tacttcaaagagctctcagggg

SEQ ID NO: 941544 - DNA, 22 bp, Artificial Sequence
  chemically synthesized
cttgtgtgcctcccctgagagc

SEQ ID NO: 941545 - DNA, 22 bp, Artificial Sequence
  chemically synthesized
gtgtgcctcccctgagagctct

SEQ ID NO: 941546 - DNA, 22 bp, Artificial Sequence
  chemically synthesized
tgtgcctcccctgagagctctt

SEQ ID NO: 941547 - DNA, 22 bp, Artificial Sequence
  chemically synthesized
ccctgagagctctttgaagtac

SEQ ID NO: 941548 - DNA, 22 bp, Artificial Sequence
  chemically synthesized
agagctctttgaagtacaggga

SEQ ID NO: 941549 - DNA, 22 bp, Artificial Sequence
  chemically synthesized
ggaataagacagtccctgtact

SEQ ID NO: 941550 - DNA, 22 bp, Artificial Sequence
  chemically synthesized
attaggaataagacagtccctg

SEQ ID NO: 941551 - DNA, 22 bp, Artificial Sequence
  chemically synthesized
taattaggaataagacagtccc

SEQ ID NO: 941552 - DNA, 22 bp, Artificial Sequence
  chemically synthesized
tttgaagtacagggactgtctt

SEQ ID NO: 941553 - DNA, 22 bp, Artificial Sequence
  chemically synthesized
tgaagtacagggactgtcttat

SEQ ID NO: 941554 - DNA, 22 bp, Artificial Sequence
  chemically synthesized
gaagtacagggactgtcttatt

SEQ ID NO: 941555 - DNA, 22 bp, Artificial Sequence
  chemically synthesized
aagtacagggactgtcttattc

SEQ ID NO: 941556 - DNA, 22 bp, Artificial Sequence
  chemically synthesized
tcttattcctaattagagtttc

SEQ ID NO: 941557 - DNA, 22 bp, Artificial Sequence
  chemically synthesized
tagaagcaagatacagaaactc

SEQ ID NO: 941558 - DNA, 22 bp, Artificial Sequence
  chemically synthesized
attcctaattagagtttctgta

SEQ ID NO: 941559 - DNA, 22 bp, Artificial Sequence
  chemically synthesized
ttcctaattagagtttctgtat

SEQ ID NO: 941560 - DNA, 22 bp, Artificial Sequence
  chemically synthesized
ctgtagaagcaagatacagaaa

SEQ ID NO: 941561 - DNA, 22 bp, Artificial Sequence
  chemically synthesized
ctaattagagtttctgtatctt

SEQ ID NO: 941562 - DNA, 22 bp, Artificial Sequence
  chemically synthesized
attagagtttctgtatcttgct

SEQ ID NO: 941563 - DNA, 22 bp, Artificial Sequence
  chemically synthesized
ggtagctcctgtagaagcaaga

SEQ ID NO: 941564 - DNA, 22 bp, Artificial Sequence
  chemically synthesized
gagtttctgtatcttgcttcta

SEQ ID NO: 941565 - DNA, 22 bp, Artificial Sequence
  chemically synthesized
ttgggtagctcctgtagaagca

SEQ ID NO: 941566 - DNA, 22 bp, Artificial Sequence
  chemically synthesized
attgggtagctcctgtagaagc

SEQ ID NO: 941567 - DNA, 22 bp, Artificial Sequence
  chemically synthesized
ctgtatcttgcttctacaggag

SEQ ID NO: 941568 - DNA, 22 bp, Artificial Sequence
  chemically synthesized
tgtatcttgcttctacaggagc

SEQ ID NO: 941569 - DNA, 22 bp, Artificial Sequence
  chemically synthesized
tatcttgcttctacaggagcta

SEQ ID NO: 941570 - DNA, 22 bp, Artificial Sequence
  chemically synthesized
tcatttattgggtagctcctgt

SEQ ID NO: 941571 - DNA, 22 bp, Artificial Sequence
  chemically synthesized
gcttctacaggagctacccaat

SEQ ID NO: 941572 - DNA, 22 bp, Artificial Sequence
  chemically synthesized
cttctacaggagctacccaata

SEQ ID NO: 941573 - DNA, 22 bp, Artificial Sequence
  chemically synthesized
atggaactatcatttattgggt

SEQ ID NO: 941574 - DNA, 22 bp, Artificial Sequence
  chemically synthesized
ctacaggagctacccaataaat

SEQ ID NO: 941575 - DNA, 22 bp, Artificial Sequence
  chemically synthesized
tacaggagctacccaataaatg

SEQ ID NO: 941576 - DNA, 22 bp, Artificial Sequence
  chemically synthesized
ttcatggaactatcatttattg

SEQ ID NO: 941577 - DNA, 22 bp, Artificial Sequence
  chemically synthesized
caggagctacccaataaatgat

SEQ ID NO: 941578 - DNA, 22 bp, Artificial Sequence
  chemically synthesized
gttgttcatggaactatcattt

SEQ ID NO: 941579 - DNA, 22 bp, Artificial Sequence
  chemically synthesized
agttgttcatggaactatcatt

SEQ ID NO: 941580 - DNA, 22 bp, Artificial Sequence
  chemically synthesized
tagttgttcatggaactatcat

SEQ ID NO: 941581 - DNA, 22 bp, Artificial Sequence
  chemically synthesized
ttagttgttcatggaactatca

SEQ ID NO: 941582 - DNA, 22 bp, Artificial Sequence
  chemically synthesized
tttagttgttcatggaactatc

SEQ ID NO: 941583 - DNA, 22 bp, Artificial Sequence
  chemically synthesized
cccaataaatgatagttccatg

SEQ ID NO: 941584 - DNA, 22 bp, Artificial Sequence
  chemically synthesized
gggttttttagttgttcatgga

SEQ ID NO: 941585 - DNA, 22 bp, Artificial Sequence
  chemically synthesized
catgaacaactaaaaaacccca

SEQ ID NO: 941586 - DNA, 22 bp, Artificial Sequence
  chemically synthesized
ccaacatgtacaaaaccagatt

SEQ ID NO: 941587 - DNA, 22 bp, Artificial Sequence
  chemically synthesized
aaaaaccccaatctggttttgt

SEQ ID NO: 941588 - DNA, 22 bp, Artificial Sequence
  chemically synthesized
aattgccaacatgtacaaaacc

SEQ ID NO: 941589 - DNA, 22 bp, Artificial Sequence
  chemically synthesized
ctgaattgccaacatgtacaaa

SEQ ID NO: 941590 - DNA, 22 bp, Artificial Sequence
  chemically synthesized
cctgaattgccaacatgtacaa

SEQ ID NO: 941591 - DNA, 22 bp, Artificial Sequence
  chemically synthesized
gccttcctgaattgccaacatg

SEQ ID NO: 941592 - DNA, 22 bp, Artificial Sequence
  chemically synthesized
agccttcctgaattgccaacat

SEQ ID NO: 941593 - DNA, 22 bp, Artificial Sequence
  chemically synthesized
gttttgtacatgttggcaattc

SEQ ID NO: 941594 - DNA, 22 bp, Artificial Sequence
  chemically synthesized
tgtacatgttggcaattcagga

SEQ ID NO: 941595 - DNA, 22 bp, Artificial Sequence
  chemically synthesized
gtacatgttggcaattcaggaa

SEQ ID NO: 941596 - DNA, 22 bp, Artificial Sequence
  chemically synthesized
tacatgttggcaattcaggaag

SEQ ID NO: 941597 - DNA, 22 bp, Artificial Sequence
  chemically synthesized
ataacacacttagccttcctga

SEQ ID NO: 941598 - DNA, 22 bp, Artificial Sequence
  chemically synthesized
gactaataacacacttagcctt

SEQ ID NO: 941599 - DNA, 22 bp, Artificial Sequence
  chemically synthesized
ggactaataacacacttagcct

SEQ ID NO: 941600 - DNA, 22 bp, Artificial Sequence
  chemically synthesized
gcaattcaggaaggctaagtgt

SEQ ID NO: 941601 - DNA, 22 bp, Artificial Sequence
  chemically synthesized
ttggactaataacacacttagc

SEQ ID NO: 941602 - DNA, 22 bp, Artificial Sequence
  chemically synthesized
cttggactaataacacacttag

SEQ ID NO: 941603 - DNA, 22 bp, Artificial Sequence
  chemically synthesized
aggaaggctaagtgtgttatta

SEQ ID NO: 941604 - DNA, 22 bp, Artificial Sequence
  chemically synthesized
catttcttggactaataacaca

SEQ ID NO: 941605 - DNA, 22 bp, Artificial Sequence
  chemically synthesized
actacatttcttggactaataa

SEQ ID NO: 941606 - DNA, 22 bp, Artificial Sequence
  chemically synthesized
ttcactacatttcttggactaa

SEQ ID NO: 941607 - DNA, 22 bp, Artificial Sequence
  chemically synthesized
agtgtgttattagtccaagaaa

SEQ ID NO: 941608 - DNA, 22 bp, Artificial Sequence
  chemically synthesized
tgtctattcactacatttcttg

SEQ ID NO: 941609 - DNA, 22 bp, Artificial Sequence
  chemically synthesized
ttagtccaagaaatgtagtgaa

SEQ ID NO: 941610 - DNA, 22 bp, Artificial Sequence
  chemically synthesized
gtccaagaaatgtagtgaatag

SEQ ID NO: 941611 - DNA, 22 bp, Artificial Sequence
  chemically synthesized
tgtaagagtggttgtgtctatt

SEQ ID NO: 941612 - DNA, 22 bp, Artificial Sequence
  chemically synthesized
ttacataggcactctgtgcttg

SEQ ID NO: 941613 - DNA, 22 bp, Artificial Sequence
  chemically synthesized
aggaaatcatgtcaagcacaga

SEQ ID NO: 941614 - DNA, 22 bp, Artificial Sequence
  chemically synthesized
acataggcactctgtgcttgac

SEQ ID NO: 941615 - DNA, 22 bp, Artificial Sequence
  chemically synthesized
cataggcactctgtgcttgaca

SEQ ID NO: 941616 - DNA, 22 bp, Artificial Sequence
  chemically synthesized
acattcaggaaatcatgtcaag

SEQ ID NO: 941617 - DNA, 22 bp, Artificial Sequence
  chemically synthesized
tgtgcttgacatgatttcctga

SEQ ID NO: 941618 - DNA, 22 bp, Artificial Sequence
  chemically synthesized
ccccactaacattcaggaaatc

SEQ ID NO: 941619 - DNA, 22 bp, Artificial Sequence
  chemically synthesized
tgcttgacatgatttcctgaat

SEQ ID NO: 941620 - DNA, 22 bp, Artificial Sequence
  chemically synthesized
gacatgatttcctgaatgttag

SEQ ID NO: 941621 - DNA, 22 bp, Artificial Sequence
  chemically synthesized
acatgatttcctgaatgttagt

SEQ ID NO: 941622 - DNA, 22 bp, Artificial Sequence
  chemically synthesized
gtgtaacggattcccccactaa

SEQ ID NO: 941623 - DNA, 22 bp, Artificial Sequence
  chemically synthesized
cctgaatgttagtgggggaatc

SEQ ID NO: 941624 - DNA, 22 bp, Artificial Sequence
  chemically synthesized
ctgaatgttagtgggggaatcc

SEQ ID NO: 941625 - DNA, 22 bp, Artificial Sequence
  chemically synthesized
aatgttagtgggggaatccgtt

SEQ ID NO: 941626 - DNA, 22 bp, Artificial Sequence
  chemically synthesized
tgtggattagtgtaacggattc

SEQ ID NO: 941627 - DNA, 22 bp, Artificial Sequence
  chemically synthesized
gtgtggattagtgtaacggatt

SEQ ID NO: 941628 - DNA, 22 bp, Artificial Sequence
  chemically synthesized
cttgtgtggattagtgtaacgg

SEQ ID NO: 941629 - DNA, 22 bp, Artificial Sequence
  chemically synthesized
gtgggggaatccgttacactaa

SEQ ID NO: 941630 - DNA, 22 bp, Artificial Sequence
  chemically synthesized
cgactacttgtgtggattagtg

SEQ ID NO: 941631 - DNA, 22 bp, Artificial Sequence
  chemically synthesized
cactaatccacacaagtagtcg

SEQ ID NO: 941632 - DNA, 22 bp, Artificial Sequence
  chemically synthesized
ccagcagcattacgactacttg

SEQ ID NO: 941633 - DNA, 22 bp, Artificial Sequence
  chemically synthesized
atccacacaagtagtcgtaatg

SEQ ID NO: 941634 - DNA, 22 bp, Artificial Sequence
  chemically synthesized
ggaaattgccagcagcattacg

SEQ ID NO: 941635 - DNA, 22 bp, Artificial Sequence
  chemically synthesized
atgtctgggaaattgccagcag

SEQ ID NO: 941636 - DNA, 22 bp, Artificial Sequence
  chemically synthesized
ttaatgtctgggaaattgccag

SEQ ID NO: 941637 - DNA, 22 bp, Artificial Sequence
  chemically synthesized
attgttaatgtctgggaaattg

SEQ ID NO: 941638 - DNA, 22 bp, Artificial Sequence
  chemically synthesized
cattgttaatgtctgggaaatt

SEQ ID NO: 941639 - DNA, 22 bp, Artificial Sequence
  chemically synthesized
ctggcaatttcccagacattaa

SEQ ID NO: 941640 - DNA, 22 bp, Artificial Sequence
  chemically synthesized
gcaatttcccagacattaacaa

SEQ ID NO: 941641 - DNA, 22 bp, Artificial Sequence
  chemically synthesized
agccaacgatcttcattgttaa

SEQ ID NO: 941642 - DNA, 22 bp, Artificial Sequence
  chemically synthesized
cccagacattaacaatgaagat

SEQ ID NO: 941643 - DNA, 22 bp, Artificial Sequence
  chemically synthesized
ccagacattaacaatgaagatc

SEQ ID NO: 941644 - DNA, 22 bp, Artificial Sequence
  chemically synthesized
cattaagccaacgatcttcatt

SEQ ID NO: 941645 - DNA, 22 bp, Artificial Sequence
  chemically synthesized
gcattaagccaacgatcttcat

SEQ ID NO: 941646 - DNA, 22 bp, Artificial Sequence
  chemically synthesized
acaatgaagatcgttggcttaa

SEQ ID NO: 941647 - DNA, 22 bp, Artificial Sequence
  chemically synthesized
tcacaggcgtcaatgatttgca

SEQ ID NO: 941648 - DNA, 22 bp, Artificial Sequence
  chemically synthesized
atctgtcacaggcgtcaatgat

SEQ ID NO: 941649 - DNA, 22 bp, Artificial Sequence
  chemically synthesized
gcttaatgcaaatcattgacgc

SEQ ID NO: 941650 - DNA, 22 bp, Artificial Sequence
  chemically synthesized
gatctgtcacaggcgtcaatga

SEQ ID NO: 941651 - DNA, 22 bp, Artificial Sequence
  chemically synthesized
aatgcaaatcattgacgcctgt

SEQ ID NO: 941652 - DNA, 22 bp, Artificial Sequence
  chemically synthesized
acttgatctgtcacaggcgtca

SEQ ID NO: 941653 - DNA, 22 bp, Artificial Sequence
  chemically synthesized
atgcaaatcattgacgcctgtg

SEQ ID NO: 941654 - DNA, 22 bp, Artificial Sequence
  chemically synthesized
atattgacttgatctgtcacag

SEQ ID NO: 941655 - DNA, 22 bp, Artificial Sequence
  chemically synthesized
acgcctgtgacagatcaagtca

SEQ ID NO: 941656 - DNA, 22 bp, Artificial Sequence
  chemically synthesized
tgacagatcaagtcaatattaa

SEQ ID NO: 941657 - DNA, 22 bp, Artificial Sequence
  chemically synthesized
aaatgtcacaagaaaagtatca

SEQ ID NO: 941658 - DNA, 22 bp, Artificial Sequence
  chemically synthesized
caaatgtcacaagaaaagtatc

SEQ ID NO: 941659 - DNA, 22 bp, Artificial Sequence
  chemically synthesized
attcctgtctgatacttttctt

SEQ ID NO: 941660 - DNA, 22 bp, Artificial Sequence
  chemically synthesized
ctgtctgatacttttcttgtga

SEQ ID NO: 941661 - DNA, 22 bp, Artificial Sequence
  chemically synthesized
tctgatacttttcttgtgacat

SEQ ID NO: 941662 - DNA, 22 bp, Artificial Sequence
  chemically synthesized
atacttttcttgtgacatttga

SEQ ID NO: 941663 - DNA, 22 bp, Artificial Sequence
  chemically synthesized
ttcttgtgacatttgaagtcat

SEQ ID NO: 941664 - DNA, 22 bp, Artificial Sequence
  chemically synthesized
gacaaaacagagatgacttcaa

SEQ ID NO: 941665 - DNA, 22 bp, Artificial Sequence
  chemically synthesized
tcttgtgacatttgaagtcatc

SEQ ID NO: 941666 - DNA, 22 bp, Artificial Sequence
  chemically synthesized
agacaaaacagagatgacttca

SEQ ID NO: 941667 - DNA, 22 bp, Artificial Sequence
  chemically synthesized
cttgtgacatttgaagtcatct

SEQ ID NO: 941668 - DNA, 22 bp, Artificial Sequence
  chemically synthesized
tagacaaaacagagatgacttc

SEQ ID NO: 941669 - DNA, 22 bp, Artificial Sequence
  chemically synthesized
ttgtgacatttgaagtcatctc

SEQ ID NO: 941670 - DNA, 22 bp, Artificial Sequence
  chemically synthesized
ttagacaaaacagagatgactt

SEQ ID NO: 941671 - DNA, 22 bp, Artificial Sequence
  chemically synthesized
gtgacatttgaagtcatctctg

SEQ ID NO: 941672 - DNA, 22 bp, Artificial Sequence
  chemically synthesized
tgacatttgaagtcatctctgt

SEQ ID NO: 941673 - DNA, 22 bp, Artificial Sequence
  chemically synthesized
gaagtcatctctgttttgtcta

SEQ ID NO: 941674 - DNA, 22 bp, Artificial Sequence
  chemically synthesized
aagtcatctctgttttgtctaa

SEQ ID NO: 941675 - DNA, 22 bp, Artificial Sequence
  chemically synthesized
cgaataagatttttagacaaaa

SEQ ID NO: 941676 - DNA, 22 bp, Artificial Sequence
  chemically synthesized
tcctacgaataagatttttaga

SEQ ID NO: 941677 - DNA, 22 bp, Artificial Sequence
  chemically synthesized
tgttttgtctaaaaatcttatt

SEQ ID NO: 941678 - DNA, 22 bp, Artificial Sequence
  chemically synthesized
ttttgtctaaaaatcttattcg

SEQ ID NO: 941679 - DNA, 22 bp, Artificial Sequence
  chemically synthesized
tgtctaaaaatcttattcgtag

SEQ ID NO: 941680 - DNA, 22 bp, Artificial Sequence
  chemically synthesized
taggtggctgtcctacgaataa

SEQ ID NO: 941681 - DNA, 22 bp, Artificial Sequence
  chemically synthesized
gtctaaaaatcttattcgtagg

SEQ ID NO: 941682 - DNA, 22 bp, Artificial Sequence
  chemically synthesized
tctaaaaatcttattcgtagga

SEQ ID NO: 941683 - DNA, 22 bp, Artificial Sequence
  chemically synthesized
aaaatcttattcgtaggacagc

SEQ ID NO: 941684 - DNA, 22 bp, Artificial Sequence
  chemically synthesized
ggtggccctgtaggtggctgtc

SEQ ID NO: 941685 - DNA, 22 bp, Artificial Sequence
  chemically synthesized
tgggtggccctgtaggtggctg

SEQ ID NO: 941686 - DNA, 22 bp, Artificial Sequence
  chemically synthesized
attcgtaggacagccacctaca

SEQ ID NO: 941687 - DNA, 22 bp, Artificial Sequence
  chemically synthesized
ttcgtaggacagccacctacag

SEQ ID NO: 941688 - DNA, 22 bp, Artificial Sequence
  chemically synthesized
gtaggacagccacctacagggc

SEQ ID NO: 941689 - DNA, 22 bp, Artificial Sequence
  chemically synthesized
atgagccattctgggtggccct

SEQ ID NO: 941690 - DNA, 22 bp, Artificial Sequence
  chemically synthesized
aatgagccattctgggtggccc

SEQ ID NO: 941691 - DNA, 22 bp, Artificial Sequence
  chemically synthesized
gcttaatgagccattctgggtg

SEQ ID NO: 941692 - DNA, 22 bp, Artificial Sequence
  chemically synthesized
cagggccacccagaatggctca

SEQ ID NO: 941693 - DNA, 22 bp, Artificial Sequence
  chemically synthesized
attaagccaacacatttctttt

SEQ ID NO: 941694 - DNA, 22 bp, Artificial Sequence
  chemically synthesized
atgcacaaagatgcaaaagaaa

SEQ ID NO: 941695 - DNA, 22 bp, Artificial Sequence
  chemically synthesized
catgcacaaagatgcaaaagaa

SEQ ID NO: 941696 - DNA, 22 bp, Artificial Sequence
  chemically synthesized
agccaacacatttcttttgcat

SEQ ID NO: 941697 - DNA, 22 bp, Artificial Sequence
  chemically synthesized
gatcccttcatgcacaaagatg

SEQ ID NO: 941698 - DNA, 22 bp, Artificial Sequence
  chemically synthesized
tagatcccttcatgcacaaaga

SEQ ID NO: 941699 - DNA, 22 bp, Artificial Sequence
  chemically synthesized
tctagatcccttcatgcacaaa

SEQ ID NO: 941700 - DNA, 22 bp, Artificial Sequence
  chemically synthesized
ctctagatcccttcatgcacaa

SEQ ID NO: 941701 - DNA, 22 bp, Artificial Sequence
  chemically synthesized
cttttgcatctttgtgcatgaa

SEQ ID NO: 941702 - DNA, 22 bp, Artificial Sequence
  chemically synthesized
tctctagatcccttcatgcaca

SEQ ID NO: 941703 - DNA, 22 bp, Artificial Sequence
  chemically synthesized
ttttgcatctttgtgcatgaag

SEQ ID NO: 941704 - DNA, 22 bp, Artificial Sequence
  chemically synthesized
ttctctagatcccttcatgcac

SEQ ID NO: 941705 - DNA, 22 bp, Artificial Sequence
  chemically synthesized
ttgcatctttgtgcatgaaggg

SEQ ID NO: 941706 - DNA, 22 bp, Artificial Sequence
  chemically synthesized
tgcatctttgtgcatgaaggga

SEQ ID NO: 941707 - DNA, 22 bp, Artificial Sequence
  chemically synthesized
gcatctttgtgcatgaagggat

SEQ ID NO: 941708 - DNA, 22 bp, Artificial Sequence
  chemically synthesized
catctttgtgcatgaagggatc

SEQ ID NO: 941709 - DNA, 22 bp, Artificial Sequence
  chemically synthesized
tgtgcatgaagggatctagaga

SEQ ID NO: 941710 - DNA, 22 bp, Artificial Sequence
  chemically synthesized
gtgcatgaagggatctagagaa

SEQ ID NO: 941711 - DNA, 22 bp, Artificial Sequence
  chemically synthesized
tgcatgaagggatctagagaaa

SEQ ID NO: 941712 - DNA, 22 bp, Artificial Sequence
  chemically synthesized
gagaaaaactatattattcctg

SEQ ID NO: 941713 - DNA, 22 bp, Artificial Sequence
  chemically synthesized
tgtgaggcaggagggaaaaaac

SEQ ID NO: 941714 - DNA, 22 bp, Artificial Sequence
  chemically synthesized
tattattcctgttttttccctc

SEQ ID NO: 941715 - DNA, 22 bp, Artificial Sequence
  chemically synthesized
acctgtgtgaggcaggagggaa

SEQ ID NO: 941716 - DNA, 22 bp, Artificial Sequence
  chemically synthesized
ttcctgttttttccctcctgcc

SEQ ID NO: 941717 - DNA, 22 bp, Artificial Sequence
  chemically synthesized
ctgttttttccctcctgcctca

SEQ ID NO: 941718 - DNA, 22 bp, Artificial Sequence
  chemically synthesized
ttttttccctcctgcctcacac

SEQ ID NO: 941719 - DNA, 22 bp, Artificial Sequence
  chemically synthesized
tttccctcctgcctcacacagg

SEQ ID NO: 941720 - DNA, 22 bp, Artificial Sequence
  chemically synthesized
ttccctcctgcctcacacaggt

SEQ ID NO: 941721 - DNA, 22 bp, Artificial Sequence
  chemically synthesized
gtgcaacaactgacctgtgtga

SEQ ID NO: 941722 - DNA, 22 bp, Artificial Sequence
  chemically synthesized
tccctcctgcctcacacaggtc

SEQ ID NO: 941723 - DNA, 22 bp, Artificial Sequence
  chemically synthesized
ccctcctgcctcacacaggtca

SEQ ID NO: 941724 - DNA, 22 bp, Artificial Sequence
  chemically synthesized
cctcctgcctcacacaggtcag

SEQ ID NO: 941725 - DNA, 22 bp, Artificial Sequence
  chemically synthesized
ctgcctcacacaggtcagttgt

SEQ ID NO: 941726 - DNA, 22 bp, Artificial Sequence
  chemically synthesized
cctcacacaggtcagttgttgc

SEQ ID NO: 941727 - DNA, 22 bp, Artificial Sequence
  chemically synthesized
acacaggtcagttgttgcacca

SEQ ID NO: 941728 - DNA, 22 bp, Artificial Sequence
  chemically synthesized
agggaaatagacaatgactggt

SEQ ID NO: 941729 - DNA, 22 bp, Artificial Sequence
  chemically synthesized
aagggaaatagacaatgactgg

SEQ ID NO: 941730 - DNA, 22 bp, Artificial Sequence
  chemically synthesized
ttgcaccagtcattgtctattt

SEQ ID NO: 941731 - DNA, 22 bp, Artificial Sequence
  chemically synthesized
caccagtcattgtctatttccc

SEQ ID NO: 941732 - DNA, 22 bp, Artificial Sequence
  chemically synthesized
ccagggggacatgatcttaagg

SEQ ID NO: 941733 - DNA, 22 bp, Artificial Sequence
  chemically synthesized
tctatttcccttaagatcatgt

SEQ ID NO: 941734 - DNA, 22 bp, Artificial Sequence
  chemically synthesized
tttcccttaagatcatgtcccc

SEQ ID NO: 941735 - DNA, 22 bp, Artificial Sequence
  chemically synthesized
cccttaagatcatgtccccctg

SEQ ID NO: 941736 - DNA, 22 bp, Artificial Sequence
  chemically synthesized
ccttaagatcatgtccccctgg

SEQ ID NO: 941737 - DNA, 22 bp, Artificial Sequence
  chemically synthesized
ggaaatgtagttcccaggggga

SEQ ID NO: 941738 - DNA, 22 bp, Artificial Sequence
  chemically synthesized
aagatcatgtccccctgggaac

SEQ ID NO: 941739 - DNA, 22 bp, Artificial Sequence
  chemically synthesized
agatcatgtccccctgggaact

SEQ ID NO: 941740 - DNA, 22 bp, Artificial Sequence
  chemically synthesized
gcatatgagtctgggaaatgta

SEQ ID NO: 941741 - DNA, 22 bp, Artificial Sequence
  chemically synthesized
ggaactacatttcccagactca

SEQ ID NO: 941742 - DNA, 22 bp, Artificial Sequence
  chemically synthesized
catttcccagactcatatgcca

SEQ ID NO: 941743 - DNA, 22 bp, Artificial Sequence
  chemically synthesized
cccagactcatatgccaatgga

SEQ ID NO: 941744 - DNA, 22 bp, Artificial Sequence
  chemically synthesized
catccagagaagtccattggca

SEQ ID NO: 941745 - DNA, 22 bp, Artificial Sequence
  chemically synthesized
ccagactcatatgccaatggac

SEQ ID NO: 941746 - DNA, 22 bp, Artificial Sequence
  chemically synthesized
acgtattccatccagagaagtc

SEQ ID NO: 941747 - DNA, 22 bp, Artificial Sequence
  chemically synthesized
atatgccaatggacttctctgg

SEQ ID NO: 941748 - DNA, 22 bp, Artificial Sequence
  chemically synthesized
ccacacattgacgtattccatc

SEQ ID NO: 941749 - DNA, 22 bp, Artificial Sequence
  chemically synthesized
ttgccacacattgacgtattcc

SEQ ID NO: 941750 - DNA, 22 bp, Artificial Sequence
  chemically synthesized
ctattgccacacattgacgtat

SEQ ID NO: 941751 - DNA, 22 bp, Artificial Sequence
  chemically synthesized
ctctggatggaatacgtcaatg

SEQ ID NO: 941752 - DNA, 22 bp, Artificial Sequence
  chemically synthesized
tctggatggaatacgtcaatgt

SEQ ID NO: 941753 - DNA, 22 bp, Artificial Sequence
  chemically synthesized
tggatggaatacgtcaatgtgt

SEQ ID NO: 941754 - DNA, 22 bp, Artificial Sequence
  chemically synthesized
cctgctattgccacacattgac

SEQ ID NO: 941755 - DNA, 22 bp, Artificial Sequence
  chemically synthesized
gatggaatacgtcaatgtgtgg

SEQ ID NO: 941756 - DNA, 22 bp, Artificial Sequence
  chemically synthesized
gttccctgctattgccacacat

SEQ ID NO: 941757 - DNA, 22 bp, Artificial Sequence
  chemically synthesized
agttccctgctattgccacaca

SEQ ID NO: 941758 - DNA, 22 bp, Artificial Sequence
  chemically synthesized
ccatttagttccctgctattgc

SEQ ID NO: 941759 - DNA, 22 bp, Artificial Sequence
  chemically synthesized
cctgccatttagttccctgcta

SEQ ID NO: 941760 - DNA, 22 bp, Artificial Sequence
  chemically synthesized
ccctgccatttagttccctgct

SEQ ID NO: 941761 - DNA, 22 bp, Artificial Sequence
  chemically synthesized
tccctgccatttagttccctgc

SEQ ID NO: 941762 - DNA, 22 bp, Artificial Sequence
  chemically synthesized
cgtattttccctgccatttagt

SEQ ID NO: 941763 - DNA, 22 bp, Artificial Sequence
  chemically synthesized
aattccgtattttccctgccat

SEQ ID NO: 941764 - DNA, 22 bp, Artificial Sequence
  chemically synthesized
aatggcagggaaaatacggaat

SEQ ID NO: 941765 - DNA, 22 bp, Artificial Sequence
  chemically synthesized
cagagcagagagaaggagaaat

SEQ ID NO: 941766 - DNA, 22 bp, Artificial Sequence
  chemically synthesized
ccagagcagagagaaggagaaa

SEQ ID NO: 941767 - DNA, 22 bp, Artificial Sequence
  chemically synthesized
agggtatttctccttctctctg

SEQ ID NO: 941768 - DNA, 22 bp, Artificial Sequence
  chemically synthesized
ctccttctctctgctctggaag

SEQ ID NO: 941769 - DNA, 22 bp, Artificial Sequence
  chemically synthesized
tccttctctctgctctggaagg

SEQ ID NO: 941770 - DNA, 22 bp, Artificial Sequence
  chemically synthesized
cttctctctgctctggaaggta

SEQ ID NO: 941771 - DNA, 22 bp, Artificial Sequence
  chemically synthesized
ctctctgctctggaaggtattt

SEQ ID NO: 941772 - DNA, 22 bp, Artificial Sequence
  chemically synthesized
tctctgctctggaaggtatttt

SEQ ID NO: 941773 - DNA, 22 bp, Artificial Sequence
  chemically synthesized
agccataagccacaaaatacct

SEQ ID NO: 941774 - DNA, 22 bp, Artificial Sequence
  chemically synthesized
tctgctctggaaggtattttgt

SEQ ID NO: 941775 - DNA, 22 bp, Artificial Sequence
  chemically synthesized
tgctctggaaggtattttgtgg

SEQ ID NO: 941776 - DNA, 22 bp, Artificial Sequence
  chemically synthesized
ctctggaaggtattttgtggct

SEQ ID NO: 941777 - DNA, 22 bp, Artificial Sequence
  chemically synthesized
tggaaggtattttgtggcttat

SEQ ID NO: 941778 - DNA, 22 bp, Artificial Sequence
  chemically synthesized
gaaggtattttgtggcttatgg

SEQ ID NO: 941779 - DNA, 22 bp, Artificial Sequence
  chemically synthesized
gaacacaagaggggattcagcc

SEQ ID NO: 941780 - DNA, 22 bp, Artificial Sequence
  chemically synthesized
tgtggcttatggctgaatcccc

SEQ ID NO: 941781 - DNA, 22 bp, Artificial Sequence
  chemically synthesized
gtggcttatggctgaatcccct

SEQ ID NO: 941782 - DNA, 22 bp, Artificial Sequence
  chemically synthesized
tggcttatggctgaatcccctc

SEQ ID NO: 941783 - DNA, 22 bp, Artificial Sequence
  chemically synthesized
atggctgaatcccctcttgtgt

SEQ ID NO: 941784 - DNA, 22 bp, Artificial Sequence
  chemically synthesized
tggctgaatcccctcttgtgtt

SEQ ID NO: 941785 - DNA, 22 bp, Artificial Sequence
  chemically synthesized
aatcccctcttgtgttccaact

SEQ ID NO: 941786 - DNA, 22 bp, Artificial Sequence
  chemically synthesized
ttgtgttccaactttctgcttg

SEQ ID NO: 941787 - DNA, 22 bp, Artificial Sequence
  chemically synthesized
gtgttccaactttctgcttgac

SEQ ID NO: 941788 - DNA, 22 bp, Artificial Sequence
  chemically synthesized
tgttccaactttctgcttgacg

SEQ ID NO: 941789 - DNA, 22 bp, Artificial Sequence
  chemically synthesized
caactttctgcttgacgcatcc

SEQ ID NO: 941790 - DNA, 22 bp, Artificial Sequence
  chemically synthesized
caaccacaggaggaggatgcgt

SEQ ID NO: 941791 - DNA, 22 bp, Artificial Sequence
  chemically synthesized
tctgcttgacgcatcctcctcc

SEQ ID NO: 941792 - DNA, 22 bp, Artificial Sequence
  chemically synthesized
ctgcttgacgcatcctcctcct

SEQ ID NO: 941793 - DNA, 22 bp, Artificial Sequence
  chemically synthesized
tgcttgacgcatcctcctcctg

SEQ ID NO: 941794 - DNA, 22 bp, Artificial Sequence
  chemically synthesized
cttgacgcatcctcctcctgtg

SEQ ID NO: 941795 - DNA, 22 bp, Artificial Sequence
  chemically synthesized
gacgcatcctcctcctgtggtt

SEQ ID NO: 941796 - DNA, 22 bp, Artificial Sequence
  chemically synthesized
ggcaggacctgcaaccacagga

SEQ ID NO: 941797 - DNA, 22 bp, Artificial Sequence
  chemically synthesized
acgcatcctcctcctgtggttg

SEQ ID NO: 941798 - DNA, 22 bp, Artificial Sequence
  chemically synthesized
ttcggcaggacctgcaaccaca

SEQ ID NO: 941799 - DNA, 22 bp, Artificial Sequence
  chemically synthesized
tcctgttcggcaggacctgcaa

SEQ ID NO: 941800 - DNA, 22 bp, Artificial Sequence
  chemically synthesized
ctcctgtggttgcaggtcctgc

SEQ ID NO: 941801 - DNA, 22 bp, Artificial Sequence
  chemically synthesized
ctgtggttgcaggtcctgccga

SEQ ID NO: 941802 - DNA, 22 bp, Artificial Sequence
  chemically synthesized
tggttgcaggtcctgccgaaca

SEQ ID NO: 941803 - DNA, 22 bp, Artificial Sequence
  chemically synthesized
caggtcctgccgaacaggacag

SEQ ID NO: 941804 - DNA, 22 bp, Artificial Sequence
  chemically synthesized
ggatcaggtggggcctgtcctg

SEQ ID NO: 941805 - DNA, 22 bp, Artificial Sequence
  chemically synthesized
ccgaacaggacaggccccacct

SEQ ID NO: 941806 - DNA, 22 bp, Artificial Sequence
  chemically synthesized
gaggcagctaggatcaggtggg

SEQ ID NO: 941807 - DNA, 22 bp, Artificial Sequence
  chemically synthesized
aagtcgtctggaggcagctagg

SEQ ID NO: 941808 - DNA, 22 bp, Artificial Sequence
  chemically synthesized
gaagtcgtctggaggcagctag

SEQ ID NO: 941809 - DNA, 22 bp, Artificial Sequence
  chemically synthesized
agaatttgaagtcgtctggagg

SEQ ID NO: 941810 - DNA, 22 bp, Artificial Sequence
  chemically synthesized
cagaatttgaagtcgtctggag

SEQ ID NO: 941811 - DNA, 22 bp, Artificial Sequence
  chemically synthesized
atcctagctgcctccagacgac

SEQ ID NO: 941812 - DNA, 22 bp, Artificial Sequence
  chemically synthesized
gctgcctccagacgacttcaaa

SEQ ID NO: 941813 - DNA, 22 bp, Artificial Sequence
  chemically synthesized
cctccagacgacttcaaattct

SEQ ID NO: 941814 - DNA, 22 bp, Artificial Sequence
  chemically synthesized
cagacgacttcaaattctgaaa

SEQ ID NO: 941815 - DNA, 22 bp, Artificial Sequence
  chemically synthesized
agcacaaggtgacatgagattt

SEQ ID NO: 941816 - DNA, 22 bp, Artificial Sequence
  chemically synthesized
aagcacaaggtgacatgagatt

SEQ ID NO: 941817 - DNA, 22 bp, Artificial Sequence
  chemically synthesized
taagcacaaggtgacatgagat

SEQ ID NO: 941818 - DNA, 22 bp, Artificial Sequence
  chemically synthesized
caaattctgaaatctcatgtca

SEQ ID NO: 941819 - DNA, 22 bp, Artificial Sequence
  chemically synthesized
aaattctgaaatctcatgtcac

SEQ ID NO: 941820 - DNA, 22 bp, Artificial Sequence
  chemically synthesized
gggctttaagcacaaggtgaca

SEQ ID NO: 941821 - DNA, 22 bp, Artificial Sequence
  chemically synthesized
tgaaatctcatgtcaccttgtg

SEQ ID NO: 941822 - DNA, 22 bp, Artificial Sequence
  chemically synthesized
aaatctcatgtcaccttgtgct

SEQ ID NO: 941823 - DNA, 22 bp, Artificial Sequence
  chemically synthesized
tggctggggctttaagcacaag

SEQ ID NO: 941824 - DNA, 22 bp, Artificial Sequence
  chemically synthesized
atggctggggctttaagcacaa

SEQ ID NO: 941825 - DNA, 22 bp, Artificial Sequence
  chemically synthesized
atgtcaccttgtgcttaaagcc

SEQ ID NO: 941826 - DNA, 22 bp, Artificial Sequence
  chemically synthesized
acttatggctggggctttaagc

SEQ ID NO: 941827 - DNA, 22 bp, Artificial Sequence
  chemically synthesized
tcacttatggctggggctttaa

SEQ ID NO: 941828 - DNA, 22 bp, Artificial Sequence
  chemically synthesized
ttctcacttatggctggggctt

SEQ ID NO: 941829 - DNA, 22 bp, Artificial Sequence
  chemically synthesized
gtgcttaaagccccagccataa

SEQ ID NO: 941830 - DNA, 22 bp, Artificial Sequence
  chemically synthesized
tgcttaaagccccagccataag

SEQ ID NO: 941831 - DNA, 22 bp, Artificial Sequence
  chemically synthesized
aaagccccagccataagtgaga

SEQ ID NO: 941832 - DNA, 22 bp, Artificial Sequence
  chemically synthesized
aagccccagccataagtgagaa

SEQ ID NO: 941833 - DNA, 22 bp, Artificial Sequence
  chemically synthesized
gcagtcgcaggaagctgttctc

SEQ ID NO: 941834 - DNA, 22 bp, Artificial Sequence
  chemically synthesized
cctgcgactgccaatccctggg

SEQ ID NO: 941835 - DNA, 22 bp, Artificial Sequence
  chemically synthesized
ctgcgactgccaatccctgggt

SEQ ID NO: 941836 - DNA, 22 bp, Artificial Sequence
  chemically synthesized
cgactgccaatccctgggttgt

SEQ ID NO: 941837 - DNA, 22 bp, Artificial Sequence
  chemically synthesized
ccaatccctgggttgttttgat

SEQ ID NO: 941838 - DNA, 22 bp, Artificial Sequence
  chemically synthesized
agaagccaaacgagaaaagatc

SEQ ID NO: 941839 - DNA, 22 bp, Artificial Sequence
  chemically synthesized
ggttgttttgatcttttctcgt

SEQ ID NO: 941840 - DNA, 22 bp, Artificial Sequence
  chemically synthesized
ttttgatcttttctcgtttggc

SEQ ID NO: 941841 - DNA, 22 bp, Artificial Sequence
  chemically synthesized
tgatcttttctcgtttggcttc

SEQ ID NO: 941842 - DNA, 22 bp, Artificial Sequence
  chemically synthesized
gatcttttctcgtttggcttct

SEQ ID NO: 941843 - DNA, 22 bp, Artificial Sequence
  chemically synthesized
atcttttctcgtttggcttctc

SEQ ID NO: 941844 - DNA, 22 bp, Artificial Sequence
  chemically synthesized
ttctcgtttggcttctcaggac

SEQ ID NO: 941845 - DNA, 22 bp, Artificial Sequence
  chemically synthesized
tctcgtttggcttctcaggact

SEQ ID NO: 941846 - DNA, 22 bp, Artificial Sequence
  chemically synthesized
ctcgtttggcttctcaggactc

SEQ ID NO: 941847 - DNA, 22 bp, Artificial Sequence
  chemically synthesized
cgtaggtgatgagagtcctgag

SEQ ID NO: 941848 - DNA, 22 bp, Artificial Sequence
  chemically synthesized
tcgtttggcttctcaggactct

SEQ ID NO: 941849 - DNA, 22 bp, Artificial Sequence
  chemically synthesized
gtttggcttctcaggactctca

SEQ ID NO: 941850 - DNA, 22 bp, Artificial Sequence
  chemically synthesized
attccgtaggtgatgagagtcc

SEQ ID NO: 941851 - DNA, 22 bp, Artificial Sequence
  chemically synthesized
ggcttctcaggactctcatcac

SEQ ID NO: 941852 - DNA, 22 bp, Artificial Sequence
  chemically synthesized
gcttctcaggactctcatcacc

SEQ ID NO: 941853 - DNA, 22 bp, Artificial Sequence
  chemically synthesized
ctcaggactctcatcacctacg

SEQ ID NO: 941854 - DNA, 22 bp, Artificial Sequence
  chemically synthesized
tcaggactctcatcacctacgg

SEQ ID NO: 941855 - DNA, 22 bp, Artificial Sequence
  chemically synthesized
aggactctcatcacctacggaa

SEQ ID NO: 941856 - DNA, 22 bp, Artificial Sequence
  chemically synthesized
atagaggaaattaattccgtag

SEQ ID NO: 941857 - DNA, 22 bp, Artificial Sequence
  chemically synthesized
aatagaggaaattaattccgta

SEQ ID NO: 941858 - DNA, 22 bp, Artificial Sequence
  chemically synthesized
tcatcacctacggaattaattt

SEQ ID NO: 941859 - DNA, 22 bp, Artificial Sequence
  chemically synthesized
atcacctacggaattaatttcc

SEQ ID NO: 941860 - DNA, 22 bp, Artificial Sequence
  chemically synthesized
cggaattaatttcctctattaa

SEQ ID NO: 941861 - DNA, 22 bp, Artificial Sequence
  chemically synthesized
atttcctctattaaactccctc

SEQ ID NO: 941862 - DNA, 22 bp, Artificial Sequence
  chemically synthesized
caaatagtaccaagggagggag

SEQ ID NO: 941863 - DNA, 22 bp, Artificial Sequence
  chemically synthesized
cctctattaaactccctccctt

SEQ ID NO: 941864 - DNA, 22 bp, Artificial Sequence
  chemically synthesized
ctctattaaactccctcccttg

SEQ ID NO: 941865 - DNA, 22 bp, Artificial Sequence
  chemically synthesized
ctccaaatagtaccaagggagg

SEQ ID NO: 941866 - DNA, 22 bp, Artificial Sequence
  chemically synthesized
tattaaactccctcccttggta

SEQ ID NO: 941867 - DNA, 22 bp, Artificial Sequence
  chemically synthesized
ttaaactccctcccttggtact

SEQ ID NO: 941868 - DNA, 22 bp, Artificial Sequence
  chemically synthesized
aactccctcccttggtactatt

SEQ ID NO: 941869 - DNA, 22 bp, Artificial Sequence
  chemically synthesized
cctcccttggtactatttggag

SEQ ID NO: 941870 - DNA, 22 bp, Artificial Sequence
  chemically synthesized
ccttggtactatttggaggagt

SEQ ID NO: 941871 - DNA, 22 bp, Artificial Sequence
  chemically synthesized
ggtactatttggaggagttctc

SEQ ID NO: 941872 - DNA, 22 bp, Artificial Sequence
  chemically synthesized
gtactatttggaggagttctct

SEQ ID NO: 941873 - DNA, 22 bp, Artificial Sequence
  chemically synthesized
aaaaacaataataataaagaga

SEQ ID NO: 941874 - DNA, 22 bp, Artificial Sequence
  chemically synthesized
tttggaggagttctctttatta

SEQ ID NO: 941875 - DNA, 22 bp, Artificial Sequence
  chemically synthesized
ggaggagttctctttattatta

SEQ ID NO: 941876 - DNA, 22 bp, Artificial Sequence
  chemically synthesized
gaggagttctctttattattat

SEQ ID NO: 941877 - DNA, 22 bp, Artificial Sequence
  chemically synthesized
tctttattattattgtttttta

SEQ ID NO: 941878 - DNA, 22 bp, Artificial Sequence
  chemically synthesized
tttattattattgttttttaac

SEQ ID NO: 941879 - DNA, 22 bp, Artificial Sequence
  chemically synthesized
tgaagaaaaaatggttaaaaaa

SEQ ID NO: 941880 - DNA, 22 bp, Artificial Sequence
  chemically synthesized
tattattattgttttttaacca

SEQ ID NO: 941881 - DNA, 22 bp, Artificial Sequence
  chemically synthesized
attattattgttttttaaccat

SEQ ID NO: 941882 - DNA, 22 bp, Artificial Sequence
  chemically synthesized
ttattattgttttttaaccatt

SEQ ID NO: 941883 - DNA, 22 bp, Artificial Sequence
  chemically synthesized
ttattgttttttaaccattttt

SEQ ID NO: 941884 - DNA, 22 bp, Artificial Sequence
  chemically synthesized
ttgttttttaaccattttttct

SEQ ID NO: 941885 - DNA, 22 bp, Artificial Sequence
  chemically synthesized
ttttttaaccattttttcttca

SEQ ID NO: 941886 - DNA, 22 bp, Artificial Sequence
  chemically synthesized
tttaaccattttttcttcatag

SEQ ID NO: 941887 - DNA, 22 bp, Artificial Sequence
  chemically synthesized
ttaaccattttttcttcatagt

SEQ ID NO: 941888 - DNA, 22 bp, Artificial Sequence
  chemically synthesized
taaccattttttcttcatagta

SEQ ID NO: 941889 - DNA, 22 bp, Artificial Sequence
  chemically synthesized
aaccattttttcttcatagtac

SEQ ID NO: 941890 - DNA, 22 bp, Artificial Sequence
  chemically synthesized
accattttttcttcatagtact

SEQ ID NO: 941891 - DNA, 22 bp, Artificial Sequence
  chemically synthesized
atcaccaaataagatagtagta

SEQ ID NO: 941892 - DNA, 22 bp, Artificial Sequence
  chemically synthesized
tttcttcatagtactactatct

SEQ ID NO: 941893 - DNA, 22 bp, Artificial Sequence
  chemically synthesized
catcaccaaataagatagtagt

SEQ ID NO: 941894 - DNA, 22 bp, Artificial Sequence
  chemically synthesized
ttcttcatagtactactatctt

SEQ ID NO: 941895 - DNA, 22 bp, Artificial Sequence
  chemically synthesized
tcatcaccaaataagatagtag

SEQ ID NO: 941896 - DNA, 22 bp, Artificial Sequence
  chemically synthesized
tcttcatagtactactatctta

SEQ ID NO: 941897 - DNA, 22 bp, Artificial Sequence
  chemically synthesized
cttcatagtactactatcttat

SEQ ID NO: 941898 - DNA, 22 bp, Artificial Sequence
  chemically synthesized
ttcatagtactactatcttatt

SEQ ID NO: 941899 - DNA, 22 bp, Artificial Sequence
  chemically synthesized
attttcatcaccaaataagata

SEQ ID NO: 941900 - DNA, 22 bp, Artificial Sequence
  chemically synthesized
catagtactactatcttatttg

SEQ ID NO: 941901 - DNA, 22 bp, Artificial Sequence
  chemically synthesized
gattttcatcaccaaataagat

SEQ ID NO: 941902 - DNA, 22 bp, Artificial Sequence
  chemically synthesized
atagtactactatcttatttgg

SEQ ID NO: 941903 - DNA, 22 bp, Artificial Sequence
  chemically synthesized
tgattttcatcaccaaataaga

SEQ ID NO: 941904 - DNA, 22 bp, Artificial Sequence
  chemically synthesized
attttgattttcatcaccaaat

SEQ ID NO: 941905 - DNA, 22 bp, Artificial Sequence
  chemically synthesized
gattttgattttcatcaccaaa

SEQ ID NO: 941906 - DNA, 22 bp, Artificial Sequence
  chemically synthesized
tgattttgattttcatcaccaa

SEQ ID NO: 941907 - DNA, 22 bp, Artificial Sequence
  chemically synthesized
ctatcttatttggtgatgaaaa

SEQ ID NO: 941908 - DNA, 22 bp, Artificial Sequence
  chemically synthesized
tcttatttggtgatgaaaatca

SEQ ID NO: 941909 - DNA, 22 bp, Artificial Sequence
  chemically synthesized
agaatattttgattttgatttt

SEQ ID NO: 941910 - DNA, 22 bp, Artificial Sequence
  chemically synthesized
atttggtgatgaaaatcaaaat

SEQ ID NO: 941911 - DNA, 22 bp, Artificial Sequence
  chemically synthesized
tttggtgatgaaaatcaaaatc

SEQ ID NO: 941912 - DNA, 22 bp, Artificial Sequence
  chemically synthesized
ggtgatgaaaatcaaaatcaaa

SEQ ID NO: 941913 - DNA, 22 bp, Artificial Sequence
  chemically synthesized
gtgatgaaaatcaaaatcaaaa

SEQ ID NO: 941914 - DNA, 22 bp, Artificial Sequence
  chemically synthesized
tgaattatctttggcttcctat

SEQ ID NO: 941915 - DNA, 22 bp, Artificial Sequence
  chemically synthesized
aattatctttggcttcctattt

SEQ ID NO: 941916 - DNA, 22 bp, Artificial Sequence
  chemically synthesized
aggagtcagataaaataggaag

SEQ ID NO: 941917 - DNA, 22 bp, Artificial Sequence
  chemically synthesized
gaggagtcagataaaataggaa

SEQ ID NO: 941918 - DNA, 22 bp, Artificial Sequence
  chemically synthesized
tctttggcttcctattttatct

SEQ ID NO: 941919 - DNA, 22 bp, Artificial Sequence
  chemically synthesized
gacttgaggagtcagataaaat

SEQ ID NO: 941920 - DNA, 22 bp, Artificial Sequence
  chemically synthesized
agacttgaggagtcagataaaa

SEQ ID NO: 941921 - DNA, 22 bp, Artificial Sequence
  chemically synthesized
tggcttcctattttatctgact

SEQ ID NO: 941922 - DNA, 22 bp, Artificial Sequence
  chemically synthesized
ggcttcctattttatctgactc

SEQ ID NO: 941923 - DNA, 22 bp, Artificial Sequence
  chemically synthesized
tttagacttgaggagtcagata

SEQ ID NO: 941924 - DNA, 22 bp, Artificial Sequence
  chemically synthesized
gcttcctattttatctgactcc

SEQ ID NO: 941925 - DNA, 22 bp, Artificial Sequence
  chemically synthesized
cctattttatctgactcctcaa

SEQ ID NO: 941926 - DNA, 22 bp, Artificial Sequence
  chemically synthesized
ctattttatctgactcctcaag

SEQ ID NO: 941927 - DNA, 22 bp, Artificial Sequence
  chemically synthesized
acaactgtttagacttgaggag

SEQ ID NO: 941928 - DNA, 22 bp, Artificial Sequence
  chemically synthesized
gacaactgtttagacttgagga

SEQ ID NO: 941929 - DNA, 22 bp, Artificial Sequence
  chemically synthesized
ttttatctgactcctcaagtct

SEQ ID NO: 941930 - DNA, 22 bp, Artificial Sequence
  chemically synthesized
tatctgactcctcaagtctaaa

SEQ ID NO: 941931 - DNA, 22 bp, Artificial Sequence
  chemically synthesized
atctgactcctcaagtctaaac

SEQ ID NO: 941932 - DNA, 22 bp, Artificial Sequence
  chemically synthesized
tctgactcctcaagtctaaaca

SEQ ID NO: 941933 - DNA, 22 bp, Artificial Sequence
  chemically synthesized
ggggggcttgacaactgtttag

SEQ ID NO: 941934 - DNA, 22 bp, Artificial Sequence
  chemically synthesized
actcctcaagtctaaacagttg

SEQ ID NO: 941935 - DNA, 22 bp, Artificial Sequence
  chemically synthesized
ctcaagtctaaacagttgtcaa

SEQ ID NO: 941936 - DNA, 22 bp, Artificial Sequence
  chemically synthesized
aagtctaaacagttgtcaagcc

SEQ ID NO: 941937 - DNA, 22 bp, Artificial Sequence
  chemically synthesized
aaaggactgggggggcttgaca

SEQ ID NO: 941938 - DNA, 22 bp, Artificial Sequence
  chemically synthesized
aacagttgtcaagcccccccag

SEQ ID NO: 941939 - DNA, 22 bp, Artificial Sequence
  chemically synthesized
tcaagcccccccagtcctttca

SEQ ID NO: 941940 - DNA, 22 bp, Artificial Sequence
  chemically synthesized
tcaactttcattatcttctttc

SEQ ID NO: 941941 - DNA, 22 bp, Artificial Sequence
  chemically synthesized
caactttcattatcttctttca

SEQ ID NO: 941942 - DNA, 22 bp, Artificial Sequence
  chemically synthesized
aactttcattatcttctttcat

SEQ ID NO: 941943 - DNA, 22 bp, Artificial Sequence
  chemically synthesized
tcattatcttctttcatttcta

SEQ ID NO: 941944 - DNA, 22 bp, Artificial Sequence
  chemically synthesized
cattatcttctttcatttctat

SEQ ID NO: 941945 - DNA, 22 bp, Artificial Sequence
  chemically synthesized
attatcttctttcatttctatt

SEQ ID NO: 941946 - DNA, 22 bp, Artificial Sequence
  chemically synthesized
tcccaggaatgagaatagaaat

SEQ ID NO: 941947 - DNA, 22 bp, Artificial Sequence
  chemically synthesized
tcttctttcatttctattctca

SEQ ID NO: 941948 - DNA, 22 bp, Artificial Sequence
  chemically synthesized
ttgtcccaggaatgagaataga

SEQ ID NO: 941949 - DNA, 22 bp, Artificial Sequence
  chemically synthesized
ctttcatttctattctcattcc

SEQ ID NO: 941950 - DNA, 22 bp, Artificial Sequence
  chemically synthesized
tttcatttctattctcattcct

SEQ ID NO: 941951 - DNA, 22 bp, Artificial Sequence
  chemically synthesized
tcatttctattctcattcctgg

SEQ ID NO: 941952 - DNA, 22 bp, Artificial Sequence
  chemically synthesized
catttctattctcattcctggg

SEQ ID NO: 941953 - DNA, 22 bp, Artificial Sequence
  chemically synthesized
atttctattctcattcctggga

SEQ ID NO: 941954 - DNA, 22 bp, Artificial Sequence
  chemically synthesized
ctattctcattcctgggacaac

SEQ ID NO: 941955 - DNA, 22 bp, Artificial Sequence
  chemically synthesized
tattctcattcctgggacaaca

SEQ ID NO: 941956 - DNA, 22 bp, Artificial Sequence
  chemically synthesized
ttctcattcctgggacaacaat

SEQ ID NO: 941957 - DNA, 22 bp, Artificial Sequence
  chemically synthesized
tcattcctgggacaacaatgtg

SEQ ID NO: 941958 - DNA, 22 bp, Artificial Sequence
  chemically synthesized
attcctgggacaacaatgtgat

SEQ ID NO: 941959 - DNA, 22 bp, Artificial Sequence
  chemically synthesized
ctgggacaacaatgtgatggcc

SEQ ID NO: 941960 - DNA, 22 bp, Artificial Sequence
  chemically synthesized
agggaaaaggcaatggccatca

SEQ ID NO: 941961 - DNA, 22 bp, Artificial Sequence
  chemically synthesized
ggacaacaatgtgatggccatt

SEQ ID NO: 941962 - DNA, 22 bp, Artificial Sequence
  chemically synthesized
cagggaaaaggcaatggccatc

SEQ ID NO: 941963 - DNA, 22 bp, Artificial Sequence
  chemically synthesized
caatatttcagggaaaaggcaa

SEQ ID NO: 941964 - DNA, 22 bp, Artificial Sequence
  chemically synthesized
ttgcaatatttcagggaaaagg

SEQ ID NO: 941965 - DNA, 22 bp, Artificial Sequence
  chemically synthesized
gtaggctattgcaatatttcag

SEQ ID NO: 941966 - DNA, 22 bp, Artificial Sequence
  chemically synthesized
ccttttccctgaaatattgcaa

SEQ ID NO: 941967 - DNA, 22 bp, Artificial Sequence
  chemically synthesized
ttccctgaaatattgcaatagc

SEQ ID NO: 941968 - DNA, 22 bp, Artificial Sequence
  chemically synthesized
tccctgaaatattgcaatagcc

SEQ ID NO: 941969 - DNA, 22 bp, Artificial Sequence
  chemically synthesized
ccctgaaatattgcaatagcct

SEQ ID NO: 941970 - DNA, 22 bp, Artificial Sequence
  chemically synthesized
cctgaaatattgcaatagccta

SEQ ID NO: 941971 - DNA, 22 bp, Artificial Sequence
  chemically synthesized
aaatattgcaatagcctactaa

SEQ ID NO: 941972 - DNA, 22 bp, Artificial Sequence
  chemically synthesized
aaggcaaaggccccaattagta

SEQ ID NO: 941973 - DNA, 22 bp, Artificial Sequence
  chemically synthesized
caatagcctactaattggggcc

SEQ ID NO: 941974 - DNA, 22 bp, Artificial Sequence
  chemically synthesized
ctaattggggcctttgccttca

SEQ ID NO: 941975 - DNA, 22 bp, Artificial Sequence
  chemically synthesized
attggggcctttgccttcagtc

SEQ ID NO: 941976 - DNA, 22 bp, Artificial Sequence
  chemically synthesized
gggcctttgccttcagtctctt

SEQ ID NO: 941977 - DNA, 22 bp, Artificial Sequence
  chemically synthesized
gtaaacagagaagggaaagaga

SEQ ID NO: 941978 - DNA, 22 bp, Artificial Sequence
  chemically synthesized
tgccttcagtctctttcccttc

SEQ ID NO: 941979 - DNA, 22 bp, Artificial Sequence
  chemically synthesized
ctagtaaacagagaagggaaag

SEQ ID NO: 941980 - DNA, 22 bp, Artificial Sequence
  chemically synthesized
gccttcagtctctttcccttct

SEQ ID NO: 941981 - DNA, 22 bp, Artificial Sequence
  chemically synthesized
ccttcagtctctttcccttctc

SEQ ID NO: 941982 - DNA, 22 bp, Artificial Sequence
  chemically synthesized
cagtctctttcccttctctgtt

SEQ ID NO: 941983 - DNA, 22 bp, Artificial Sequence
  chemically synthesized
agtctctttcccttctctgttt

SEQ ID NO: 941984 - DNA, 22 bp, Artificial Sequence
  chemically synthesized
tgatccatattcctagtaaaca

SEQ ID NO: 941985 - DNA, 22 bp, Artificial Sequence
  chemically synthesized
tttcccttctctgtttactagg

SEQ ID NO: 941986 - DNA, 22 bp, Artificial Sequence
  chemically synthesized
tcccttctctgtttactaggaa

SEQ ID NO: 941987 - DNA, 22 bp, Artificial Sequence
  chemically synthesized
cccttctctgtttactaggaat

SEQ ID NO: 941988 - DNA, 22 bp, Artificial Sequence
  chemically synthesized
ccttctctgtttactaggaata

SEQ ID NO: 941989 - DNA, 22 bp, Artificial Sequence
  chemically synthesized
ctctgtttactaggaatatgga

SEQ ID NO: 941990 - DNA, 22 bp, Artificial Sequence
  chemically synthesized
tctgtttactaggaatatggat

SEQ ID NO: 941991 - DNA, 22 bp, Artificial Sequence
  chemically synthesized
agtaaagtctatgatccatatt

SEQ ID NO: 941992 - DNA, 22 bp, Artificial Sequence
  chemically synthesized
tgtttactaggaatatggatca

SEQ ID NO: 941993 - DNA, 22 bp, Artificial Sequence
  chemically synthesized
aagtaaagtctatgatccatat

SEQ ID NO: 941994 - DNA, 22 bp, Artificial Sequence
  chemically synthesized
tttactaggaatatggatcata

SEQ ID NO: 941995 - DNA, 22 bp, Artificial Sequence
  chemically synthesized
gcttaagtaaagtctatgatcc

SEQ ID NO: 941996 - DNA, 22 bp, Artificial Sequence
  chemically synthesized
actaggaatatggatcatagac

SEQ ID NO: 941997 - DNA, 22 bp, Artificial Sequence
  chemically synthesized
ctaggaatatggatcatagact

SEQ ID NO: 941998 - DNA, 22 bp, Artificial Sequence
  chemically synthesized
ggaatatggatcatagacttta

SEQ ID NO: 941999 - DNA, 22 bp, Artificial Sequence
  chemically synthesized
tccatccaagctggcttaagta

SEQ ID NO: 942000 - DNA, 22 bp, Artificial Sequence
  chemically synthesized
tatccatccaagctggcttaag

SEQ ID NO: 942001 - DNA, 22 bp, Artificial Sequence
  chemically synthesized
ctatccatccaagctggcttaa

SEQ ID NO: 942002 - DNA, 22 bp, Artificial Sequence
  chemically synthesized
tctatccatccaagctggctta

SEQ ID NO: 942003 - DNA, 22 bp, Artificial Sequence
  chemically synthesized
tctttctatccatccaagctgg

SEQ ID NO: 942004 - DNA, 22 bp, Artificial Sequence
  chemically synthesized
tatctttctatccatccaagct

SEQ ID NO: 942005 - DNA, 22 bp, Artificial Sequence
  chemically synthesized
ctatctttctatccatccaagc

SEQ ID NO: 942006 - DNA, 22 bp, Artificial Sequence
  chemically synthesized
tacttaagccagcttggatgga

SEQ ID NO: 942007 - DNA, 22 bp, Artificial Sequence
  chemically synthesized
acttaagccagcttggatggat

SEQ ID NO: 942008 - DNA, 22 bp, Artificial Sequence
  chemically synthesized
cttaagccagcttggatggata

SEQ ID NO: 942009 - DNA, 22 bp, Artificial Sequence
  chemically synthesized
aagccagcttggatggatagaa

SEQ ID NO: 942010 - DNA, 22 bp, Artificial Sequence
  chemically synthesized
agccagcttggatggatagaaa

SEQ ID NO: 942011 - DNA, 22 bp, Artificial Sequence
  chemically synthesized
caataatcccttctatctttct

SEQ ID NO: 942012 - DNA, 22 bp, Artificial Sequence
  chemically synthesized
acaataatcccttctatctttc

SEQ ID NO: 942013 - DNA, 22 bp, Artificial Sequence
  chemically synthesized
ggatggatagaaagatagaagg

SEQ ID NO: 942014 - DNA, 22 bp, Artificial Sequence
  chemically synthesized
gatggatagaaagatagaaggg

SEQ ID NO: 942015 - DNA, 22 bp, Artificial Sequence
  chemically synthesized
aaaccttacaataatcccttct

SEQ ID NO: 942016 - DNA, 22 bp, Artificial Sequence
  chemically synthesized
acctcaaaccttacaataatcc

SEQ ID NO: 942017 - DNA, 22 bp, Artificial Sequence
  chemically synthesized
tcgtctcacctcaaaccttaca

SEQ ID NO: 942018 - DNA, 22 bp, Artificial Sequence
  chemically synthesized
atcgtctcacctcaaaccttac

SEQ ID NO: 942019 - DNA, 22 bp, Artificial Sequence
  chemically synthesized
ccttatcgtctcacctcaaacc

SEQ ID NO: 942020 - DNA, 22 bp, Artificial Sequence
  chemically synthesized
ttgtaaggtttgaggtgagacg

SEQ ID NO: 942021 - DNA, 22 bp, Artificial Sequence
  chemically synthesized
taaggtttgaggtgagacgata

SEQ ID NO: 942022 - DNA, 22 bp, Artificial Sequence
  chemically synthesized
cccagagactcccttatcgtct

SEQ ID NO: 942023 - DNA, 22 bp, Artificial Sequence
  chemically synthesized
aattccccagagactcccttat

SEQ ID NO: 942024 - DNA, 22 bp, Artificial Sequence
  chemically synthesized
gaggtgagacgataagggagtc

SEQ ID NO: 942025 - DNA, 22 bp, Artificial Sequence
  chemically synthesized
aggtgagacgataagggagtct

SEQ ID NO: 942026 - DNA, 22 bp, Artificial Sequence
  chemically synthesized
ttgaattccccagagactccct

SEQ ID NO: 942027 - DNA, 22 bp, Artificial Sequence
  chemically synthesized
ttattgaattccccagagactc

SEQ ID NO: 942028 - DNA, 22 bp, Artificial Sequence
  chemically synthesized
tgacagatgctgttattgaatt

SEQ ID NO: 942029 - DNA, 22 bp, Artificial Sequence
  chemically synthesized
tggggaattcaataacagcatc

SEQ ID NO: 942030 - DNA, 22 bp, Artificial Sequence
  chemically synthesized
agagttatgacagatgctgtta

SEQ ID NO: 942031 - DNA, 22 bp, Artificial Sequence
  chemically synthesized
gggaattcaataacagcatctg

SEQ ID NO: 942032 - DNA, 22 bp, Artificial Sequence
  chemically synthesized
tcatgctcagagttatgacaga

SEQ ID NO: 942033 - DNA, 22 bp, Artificial Sequence
  chemically synthesized
gtcatgctcagagttatgacag

SEQ ID NO: 942034 - DNA, 22 bp, Artificial Sequence
  chemically synthesized
aataacagcatctgtcataact

SEQ ID NO: 942035 - DNA, 22 bp, Artificial Sequence
  chemically synthesized
tgtcatgctcagagttatgaca

SEQ ID NO: 942036 - DNA, 22 bp, Artificial Sequence
  chemically synthesized
tttgtcatgctcagagttatga

SEQ ID NO: 942037 - DNA, 22 bp, Artificial Sequence
  chemically synthesized
attctttgtcatgctcagagtt

SEQ ID NO: 942038 - DNA, 22 bp, Artificial Sequence
  chemically synthesized
tatgttcattctttgtcatgct

SEQ ID NO: 942039 - DNA, 22 bp, Artificial Sequence
  chemically synthesized
tcataactctgagcatgacaaa

SEQ ID NO: 942040 - DNA, 22 bp, Artificial Sequence
  chemically synthesized
tgagcatgacaaagaatgaaca

SEQ ID NO: 942041 - DNA, 22 bp, Artificial Sequence
  chemically synthesized
agcatgacaaagaatgaacata

SEQ ID NO: 942042 - DNA, 22 bp, Artificial Sequence
  chemically synthesized
aatccaggaccacctatatgtt

SEQ ID NO: 942043 - DNA, 22 bp, Artificial Sequence
  chemically synthesized
gaatccaggaccacctatatgt

SEQ ID NO: 942044 - DNA, 22 bp, Artificial Sequence
  chemically synthesized
ccttgaatccaggaccacctat

SEQ ID NO: 942045 - DNA, 22 bp, Artificial Sequence
  chemically synthesized
ttgccttgaatccaggaccacc

SEQ ID NO: 942046 - DNA, 22 bp, Artificial Sequence
  chemically synthesized
ctgttgccttgaatccaggacc

SEQ ID NO: 942047 - DNA, 22 bp, Artificial Sequence
  chemically synthesized
tactgttgccttgaatccagga

SEQ ID NO: 942048 - DNA, 22 bp, Artificial Sequence
  chemically synthesized
ctactgttgccttgaatccagg

SEQ ID NO: 942049 - DNA, 22 bp, Artificial Sequence
  chemically synthesized
atgagatttctactgttgcctt

SEQ ID NO: 942050 - DNA, 22 bp, Artificial Sequence
  chemically synthesized
ctgatgagatttctactgttgc

SEQ ID NO: 942051 - DNA, 22 bp, Artificial Sequence
  chemically synthesized
actgatgagatttctactgttg

SEQ ID NO: 942052 - DNA, 22 bp, Artificial Sequence
  chemically synthesized
ttactgatgagatttctactgt

SEQ ID NO: 942053 - DNA, 22 bp, Artificial Sequence
  chemically synthesized
gattcaaggcaacagtagaaat

SEQ ID NO: 942054 - DNA, 22 bp, Artificial Sequence
  chemically synthesized
aactcttactgatgagatttct

SEQ ID NO: 942055 - DNA, 22 bp, Artificial Sequence
  chemically synthesized
aaggcaacagtagaaatctcat

SEQ ID NO: 942056 - DNA, 22 bp, Artificial Sequence
  chemically synthesized
gaactcttactgatgagatttc

SEQ ID NO: 942057 - DNA, 22 bp, Artificial Sequence
  chemically synthesized
cttgaactcttactgatgagat

SEQ ID NO: 942058 - DNA, 22 bp, Artificial Sequence
  chemically synthesized
atcagtaagagttcaagcaatt

SEQ ID NO: 942059 - DNA, 22 bp, Artificial Sequence
  chemically synthesized
aagcaatttcactgcacttctc

SEQ ID NO: 942060 - DNA, 22 bp, Artificial Sequence
  chemically synthesized
aggcacaataatggaagagaag

SEQ ID NO: 942061 - DNA, 22 bp, Artificial Sequence
  chemically synthesized
cactgcacttctcttccattat

SEQ ID NO: 942062 - DNA, 22 bp, Artificial Sequence
  chemically synthesized
actgcacttctcttccattatt

SEQ ID NO: 942063 - DNA, 22 bp, Artificial Sequence
  chemically synthesized
cacttctcttccattattgtgc

SEQ ID NO: 942064 - DNA, 22 bp, Artificial Sequence
  chemically synthesized
gggggtgactgaggcacaataa

SEQ ID NO: 942065 - DNA, 22 bp, Artificial Sequence
  chemically synthesized
ctcttccattattgtgcctcag

SEQ ID NO: 942066 - DNA, 22 bp, Artificial Sequence
  chemically synthesized
tcttccattattgtgcctcagt

SEQ ID NO: 942067 - DNA, 22 bp, Artificial Sequence
  chemically synthesized
ttccattattgtgcctcagtca

SEQ ID NO: 942068 - DNA, 22 bp, Artificial Sequence
  chemically synthesized
ccattattgtgcctcagtcacc

SEQ ID NO: 942069 - DNA, 22 bp, Artificial Sequence
  chemically synthesized
cattattgtgcctcagtcaccc

SEQ ID NO: 942070 - DNA, 22 bp, Artificial Sequence
  chemically synthesized
ttgtgcctcagtcaccccctag

SEQ ID NO: 942071 - DNA, 22 bp, Artificial Sequence
  chemically synthesized
tgcctcagtcaccccctaggtg

SEQ ID NO: 942072 - DNA, 22 bp, Artificial Sequence
  chemically synthesized
agtcaccccctaggtgtctccc

SEQ ID NO: 942073 - DNA, 22 bp, Artificial Sequence
  chemically synthesized
ggtgtctccctcatttgtttct

SEQ ID NO: 942074 - DNA, 22 bp, Artificial Sequence
  chemically synthesized
cctcatttgtttctgcatttac

SEQ ID NO: 942075 - DNA, 22 bp, Artificial Sequence
  chemically synthesized
atttgtttctgcatttacccgg

SEQ ID NO: 942076 - DNA, 22 bp, Artificial Sequence
  chemically synthesized
aagaaacagtagcagccgggta

SEQ ID NO: 942077 - DNA, 22 bp, Artificial Sequence
  chemically synthesized
gtttctgcatttacccggctgc

SEQ ID NO: 942078 - DNA, 22 bp, Artificial Sequence
  chemically synthesized
tttctgcatttacccggctgct

SEQ ID NO: 942079 - DNA, 22 bp, Artificial Sequence
  chemically synthesized
ctgcatttacccggctgctact

SEQ ID NO: 942080 - DNA, 22 bp, Artificial Sequence
  chemically synthesized
tgcatttacccggctgctactg

SEQ ID NO: 942081 - DNA, 22 bp, Artificial Sequence
  chemically synthesized
catttacccggctgctactgtt

SEQ ID NO: 942082 - DNA, 22 bp, Artificial Sequence
  chemically synthesized
acccggctgctactgtttcttc

SEQ ID NO: 942083 - DNA, 22 bp, Artificial Sequence
  chemically synthesized
cccggctgctactgtttcttca

SEQ ID NO: 942084 - DNA, 22 bp, Artificial Sequence
  chemically synthesized
tgagggagaagaaattgaagaa

SEQ ID NO: 942085 - DNA, 22 bp, Artificial Sequence
  chemically synthesized
ctactgtttcttcaatttcttc

SEQ ID NO: 942086 - DNA, 22 bp, Artificial Sequence
  chemically synthesized
agaattatgagggagaagaaat

SEQ ID NO: 942087 - DNA, 22 bp, Artificial Sequence
  chemically synthesized
ctgtttcttcaatttcttctcc

SEQ ID NO: 942088 - DNA, 22 bp, Artificial Sequence
  chemically synthesized
tttcttcaatttcttctccctc

SEQ ID NO: 942089 - DNA, 22 bp, Artificial Sequence
  chemically synthesized
cttcaatttcttctccctcata

SEQ ID NO: 942090 - DNA, 22 bp, Artificial Sequence
  chemically synthesized
ttcaatttcttctccctcataa

SEQ ID NO: 942091 - DNA, 22 bp, Artificial Sequence
  chemically synthesized
caatttcttctccctcataatt

SEQ ID NO: 942092 - DNA, 22 bp, Artificial Sequence
  chemically synthesized
tgtacaattcagaattatgagg

SEQ ID NO: 942093 - DNA, 22 bp, Artificial Sequence
  chemically synthesized
aatttcttctccctcataattc

SEQ ID NO: 942094 - DNA, 22 bp, Artificial Sequence
  chemically synthesized
cttctccctcataattctgaat

SEQ ID NO: 942095 - DNA, 22 bp, Artificial Sequence
  chemically synthesized
ttctccctcataattctgaatt

SEQ ID NO: 942096 - DNA, 22 bp, Artificial Sequence
  chemically synthesized
aaagctatgtacaattcagaat

SEQ ID NO: 942097 - DNA, 22 bp, Artificial Sequence
  chemically synthesized
gaaagctatgtacaattcagaa

SEQ ID NO: 942098 - DNA, 22 bp, Artificial Sequence
  chemically synthesized
ctccctcataattctgaattgt

SEQ ID NO: 942099 - DNA, 22 bp, Artificial Sequence
  chemically synthesized
tccctcataattctgaattgta

SEQ ID NO: 942100 - DNA, 22 bp, Artificial Sequence
  chemically synthesized
cctcataattctgaattgtaca

SEQ ID NO: 942101 - DNA, 22 bp, Artificial Sequence
  chemically synthesized
tagccttgaaagctatgtacaa

SEQ ID NO: 942102 - DNA, 22 bp, Artificial Sequence
  chemically synthesized
ataattctgaattgtacatagc

SEQ ID NO: 942103 - DNA, 22 bp, Artificial Sequence
  chemically synthesized
tgaattgtacatagctttcaag

SEQ ID NO: 942104 - DNA, 22 bp, Artificial Sequence
  chemically synthesized
aattgtacatagctttcaaggc

SEQ ID NO: 942105 - DNA, 22 bp, Artificial Sequence
  chemically synthesized
tacatagctttcaaggctacaa

SEQ ID NO: 942106 - DNA, 22 bp, Artificial Sequence
  chemically synthesized
ataacatgacagagttgtagcc

SEQ ID NO: 942107 - DNA, 22 bp, Artificial Sequence
  chemically synthesized
aataacatgacagagttgtagc

SEQ ID NO: 942108 - DNA, 22 bp, Artificial Sequence
  chemically synthesized
taataacatgacagagttgtag

SEQ ID NO: 942109 - DNA, 22 bp, Artificial Sequence
  chemically synthesized
tcaaggctacaactctgtcatg

SEQ ID NO: 942110 - DNA, 22 bp, Artificial Sequence
  chemically synthesized
caaggctacaactctgtcatgt

SEQ ID NO: 942111 - DNA, 22 bp, Artificial Sequence
  chemically synthesized
aaggctacaactctgtcatgtt

SEQ ID NO: 942112 - DNA, 22 bp, Artificial Sequence
  chemically synthesized
tatagctttaataacatgacag

SEQ ID NO: 942113 - DNA, 22 bp, Artificial Sequence
  chemically synthesized
caactctgtcatgttattaaag

SEQ ID NO: 942114 - DNA, 22 bp, Artificial Sequence
  chemically synthesized
tgtcatgttattaaagctatac

SEQ ID NO: 942115 - DNA, 22 bp, Artificial Sequence
  chemically synthesized
tcatgttattaaagctatacag

SEQ ID NO: 942116 - DNA, 22 bp, Artificial Sequence
  chemically synthesized
agaatagatacagaagctgtat

SEQ ID NO: 942117 - DNA, 22 bp, Artificial Sequence
  chemically synthesized
cagaatagatacagaagctgta

SEQ ID NO: 942118 - DNA, 22 bp, Artificial Sequence
  chemically synthesized
ttaaagctatacagcttctgta

SEQ ID NO: 942119 - DNA, 22 bp, Artificial Sequence
  chemically synthesized
aagctatacagcttctgtatct

SEQ ID NO: 942120 - DNA, 22 bp, Artificial Sequence
  chemically synthesized
tacagcttctgtatctattctg

SEQ ID NO: 942121 - DNA, 22 bp, Artificial Sequence
  chemically synthesized
gaaaacccaagaatttcagaat

SEQ ID NO: 942122 - DNA, 22 bp, Artificial Sequence
  chemically synthesized
ggaaaacccaagaatttcagaa

SEQ ID NO: 942123 - DNA, 22 bp, Artificial Sequence
  chemically synthesized
ttggaaaacccaagaatttcag

SEQ ID NO: 942124 - DNA, 22 bp, Artificial Sequence
  chemically synthesized
ctgtatctattctgaaattctt

SEQ ID NO: 942125 - DNA, 22 bp, Artificial Sequence
  chemically synthesized
tgtatctattctgaaattcttg

SEQ ID NO: 942126 - DNA, 22 bp, Artificial Sequence
  chemically synthesized
ttcttggaaaacccaagaattt

SEQ ID NO: 942127 - DNA, 22 bp, Artificial Sequence
  chemically synthesized
tatctattctgaaattcttggg

SEQ ID NO: 942128 - DNA, 22 bp, Artificial Sequence
  chemically synthesized
tattcttggaaaacccaagaat

SEQ ID NO: 942129 - DNA, 22 bp, Artificial Sequence
  chemically synthesized
ctattcttggaaaacccaagaa

SEQ ID NO: 942130 - DNA, 22 bp, Artificial Sequence
  chemically synthesized
ttctgaaattcttgggttttcc

SEQ ID NO: 942131 - DNA, 22 bp, Artificial Sequence
  chemically synthesized
tgaaattcttgggttttccaag

SEQ ID NO: 942132 - DNA, 22 bp, Artificial Sequence
  chemically synthesized
aaattcttgggttttccaagaa

SEQ ID NO: 942133 - DNA, 22 bp, Artificial Sequence
  chemically synthesized
aacaatcagatttctattcttg

SEQ ID NO: 942134 - DNA, 22 bp, Artificial Sequence
  chemically synthesized
ttgggttttccaagaatagaaa

SEQ ID NO: 942135 - DNA, 22 bp, Artificial Sequence
  chemically synthesized
gggttttccaagaatagaaatc

SEQ ID NO: 942136 - DNA, 22 bp, Artificial Sequence
  chemically synthesized
gctgaacaatcagatttctatt

SEQ ID NO: 942137 - DNA, 22 bp, Artificial Sequence
  chemically synthesized
ggttttccaagaatagaaatct

SEQ ID NO: 942138 - DNA, 22 bp, Artificial Sequence
  chemically synthesized
tccaagaatagaaatctgattg

SEQ ID NO: 942139 - DNA, 22 bp, Artificial Sequence
  chemically synthesized
ccaagaatagaaatctgattgt

SEQ ID NO: 942140 - DNA, 22 bp, Artificial Sequence
  chemically synthesized
caagaatagaaatctgattgtt

SEQ ID NO: 942141 - DNA, 22 bp, Artificial Sequence
  chemically synthesized
agaagttagctgaacaatcaga

SEQ ID NO: 942142 - DNA, 22 bp, Artificial Sequence
  chemically synthesized
gcattaagaagttagctgaaca

SEQ ID NO: 942143 - DNA, 22 bp, Artificial Sequence
  chemically synthesized
ggcattaagaagttagctgaac

SEQ ID NO: 942144 - DNA, 22 bp, Artificial Sequence
  chemically synthesized
attgttcagctaacttcttaat

SEQ ID NO: 942145 - DNA, 22 bp, Artificial Sequence
  chemically synthesized
aaaccagagcttggcattaaga

SEQ ID NO: 942146 - DNA, 22 bp, Artificial Sequence
  chemically synthesized
ttcagctaacttcttaatgcca

SEQ ID NO: 942147 - DNA, 22 bp, Artificial Sequence
  chemically synthesized
agctaacttcttaatgccaagc

SEQ ID NO: 942148 - DNA, 22 bp, Artificial Sequence
  chemically synthesized
attgaaaccagagcttggcatt

SEQ ID NO: 942149 - DNA, 22 bp, Artificial Sequence
  chemically synthesized
acttcttaatgccaagctctgg

SEQ ID NO: 942150 - DNA, 22 bp, Artificial Sequence
  chemically synthesized
catggttgattgaaaccagagc

SEQ ID NO: 942151 - DNA, 22 bp, Artificial Sequence
  chemically synthesized
cttaatgccaagctctggtttc

SEQ ID NO: 942152 - DNA, 22 bp, Artificial Sequence
  chemically synthesized
ttaatgccaagctctggtttca

SEQ ID NO: 942153 - DNA, 22 bp, Artificial Sequence
  chemically synthesized
aatgccaagctctggtttcaat

SEQ ID NO: 942154 - DNA, 22 bp, Artificial Sequence
  chemically synthesized
atgccaagctctggtttcaatc

SEQ ID NO: 942155 - DNA, 22 bp, Artificial Sequence
  chemically synthesized
cactacatggttgattgaaacc

SEQ ID NO: 942156 - DNA, 22 bp, Artificial Sequence
  chemically synthesized
cctccactacatggttgattga

SEQ ID NO: 942157 - DNA, 22 bp, Artificial Sequence
  chemically synthesized
tggtttcaatcaaccatgtagt

SEQ ID NO: 942158 - DNA, 22 bp, Artificial Sequence
  chemically synthesized
gtaactgcctccactacatggt

SEQ ID NO: 942159 - DNA, 22 bp, Artificial Sequence
  chemically synthesized
cgtaactgcctccactacatgg

SEQ ID NO: 942160 - DNA, 22 bp, Artificial Sequence
  chemically synthesized
gtttcaatcaaccatgtagtgg

SEQ ID NO: 942161 - DNA, 22 bp, Artificial Sequence
  chemically synthesized
caatcaaccatgtagtggaggc

SEQ ID NO: 942162 - DNA, 22 bp, Artificial Sequence
  chemically synthesized
aatcaaccatgtagtggaggca

SEQ ID NO: 942163 - DNA, 22 bp, Artificial Sequence
  chemically synthesized
gggcccttcgtaactgcctcca

SEQ ID NO: 942164 - DNA, 22 bp, Artificial Sequence
  chemically synthesized
tcccagtaaaagggtgcattcg

SEQ ID NO: 942165 - DNA, 22 bp, Artificial Sequence
  chemically synthesized
cgaagggcccgaatgcaccctt

SEQ ID NO: 942166 - DNA, 22 bp, Artificial Sequence
  chemically synthesized
tgtcctatcccagtaaaagggt

SEQ ID NO: 942167 - DNA, 22 bp, Artificial Sequence
  chemically synthesized
ccctgtgtcctatcccagtaaa

SEQ ID NO: 942168 - DNA, 22 bp, Artificial Sequence
  chemically synthesized
aatgaactgccctgtgtcctat

SEQ ID NO: 942169 - DNA, 22 bp, Artificial Sequence
  chemically synthesized
ctaaatgaactgccctgtgtcc

SEQ ID NO: 942170 - DNA, 22 bp, Artificial Sequence
  chemically synthesized
ttactgggataggacacagggc

SEQ ID NO: 942171 - DNA, 22 bp, Artificial Sequence
  chemically synthesized
tactgggataggacacagggca

SEQ ID NO: 942172 - DNA, 22 bp, Artificial Sequence
  chemically synthesized
actgggataggacacagggcag

SEQ ID NO: 942173 - DNA, 22 bp, Artificial Sequence
  chemically synthesized
ttcctaaatgaactgccctgtg

SEQ ID NO: 942174 - DNA, 22 bp, Artificial Sequence
  chemically synthesized
ctgggataggacacagggcagt

SEQ ID NO: 942175 - DNA, 22 bp, Artificial Sequence
  chemically synthesized
tgttcctaaatgaactgccctg

SEQ ID NO: 942176 - DNA, 22 bp, Artificial Sequence
  chemically synthesized
ggataggacacagggcagttca

SEQ ID NO: 942177 - DNA, 22 bp, Artificial Sequence
  chemically synthesized
tcactctgttcctaaatgaact

SEQ ID NO: 942178 - DNA, 22 bp, Artificial Sequence
  chemically synthesized
gataatagattatcactctgtt

SEQ ID NO: 942179 - DNA, 22 bp, Artificial Sequence
  chemically synthesized
ggataatagattatcactctgt

SEQ ID NO: 942180 - DNA, 22 bp, Artificial Sequence
  chemically synthesized
tttggataatagattatcactc

SEQ ID NO: 942181 - DNA, 22 bp, Artificial Sequence
  chemically synthesized
atttaggaacagagtgataatc

SEQ ID NO: 942182 - DNA, 22 bp, Artificial Sequence
  chemically synthesized
gtttggataatagattatcact

SEQ ID NO: 942183 - DNA, 22 bp, Artificial Sequence
  chemically synthesized
aggaacagagtgataatctatt

SEQ ID NO: 942184 - DNA, 22 bp, Artificial Sequence
  chemically synthesized
ggaacagagtgataatctatta

SEQ ID NO: 942185 - DNA, 22 bp, Artificial Sequence
  chemically synthesized
aaaaatatccttgtttggataa

SEQ ID NO: 942186 - DNA, 22 bp, Artificial Sequence
  chemically synthesized
tcaaaaatatccttgtttggat

SEQ ID NO: 942187 - DNA, 22 bp, Artificial Sequence
  chemically synthesized
ctctcaaaaatatccttgtttg

SEQ ID NO: 942188 - DNA, 22 bp, Artificial Sequence
  chemically synthesized
gctctcaaaaatatccttgttt

SEQ ID NO: 942189 - DNA, 22 bp, Artificial Sequence
  chemically synthesized
tgctctcaaaaatatccttgtt

SEQ ID NO: 942190 - DNA, 22 bp, Artificial Sequence
  chemically synthesized
ttgctctcaaaaatatccttgt

SEQ ID NO: 942191 - DNA, 22 bp, Artificial Sequence
  chemically synthesized
cttttgctctcaaaaatatcct

SEQ ID NO: 942192 - DNA, 22 bp, Artificial Sequence
  chemically synthesized
ttatccaaacaaggatattttt

SEQ ID NO: 942193 - DNA, 22 bp, Artificial Sequence
  chemically synthesized
tccaaacaaggatatttttgag

SEQ ID NO: 942194 - DNA, 22 bp, Artificial Sequence
  chemically synthesized
ggcctccttttgctctcaaaaa

SEQ ID NO: 942195 - DNA, 22 bp, Artificial Sequence
  chemically synthesized
ttgggcctccttttgctctcaa

SEQ ID NO: 942196 - DNA, 22 bp, Artificial Sequence
  chemically synthesized
attgggcctccttttgctctca

SEQ ID NO: 942197 - DNA, 22 bp, Artificial Sequence
  chemically synthesized
ttgagagcaaaaggaggcccaa

SEQ ID NO: 942198 - DNA, 22 bp, Artificial Sequence
  chemically synthesized
tgtaatcatttattgggcctcc

SEQ ID NO: 942199 - DNA, 22 bp, Artificial Sequence
  chemically synthesized
tgagagcaaaaggaggcccaat

SEQ ID NO: 942200 - DNA, 22 bp, Artificial Sequence
  chemically synthesized
gagagcaaaaggaggcccaata

SEQ ID NO: 942201 - DNA, 22 bp, Artificial Sequence
  chemically synthesized
agagcaaaaggaggcccaataa

SEQ ID NO: 942202 - DNA, 22 bp, Artificial Sequence
  chemically synthesized
tcctatgtaatcatttattggg

SEQ ID NO: 942203 - DNA, 22 bp, Artificial Sequence
  chemically synthesized
atcctatgtaatcatttattgg

SEQ ID NO: 942204 - DNA, 22 bp, Artificial Sequence
  chemically synthesized
tttatcctatgtaatcatttat

SEQ ID NO: 942205 - DNA, 22 bp, Artificial Sequence
  chemically synthesized
gtttatcctatgtaatcattta

SEQ ID NO: 942206 - DNA, 22 bp, Artificial Sequence
  chemically synthesized
cttgtttatcctatgtaatcat

SEQ ID NO: 942207 - DNA, 22 bp, Artificial Sequence
  chemically synthesized
tacttgtttatcctatgtaatc

SEQ ID NO: 942208 - DNA, 22 bp, Artificial Sequence
  chemically synthesized
ctacttgtttatcctatgtaat

SEQ ID NO: 942209 - DNA, 22 bp, Artificial Sequence
  chemically synthesized
tctacttgtttatcctatgtaa

SEQ ID NO: 942210 - DNA, 22 bp, Artificial Sequence
  chemically synthesized
cataggataaacaagtagaaag

SEQ ID NO: 942211 - DNA, 22 bp, Artificial Sequence
  chemically synthesized
agaacaatcccactttctactt

SEQ ID NO: 942212 - DNA, 22 bp, Artificial Sequence
  chemically synthesized
ctcagaacaatcccactttcta

SEQ ID NO: 942213 - DNA, 22 bp, Artificial Sequence
  chemically synthesized
actcagaacaatcccactttct

SEQ ID NO: 942214 - DNA, 22 bp, Artificial Sequence
  chemically synthesized
cagtttactcagaacaatccca

SEQ ID NO: 942215 - DNA, 22 bp, Artificial Sequence
  chemically synthesized
taagttgcagtttactcagaac

SEQ ID NO: 942216 - DNA, 22 bp, Artificial Sequence
  chemically synthesized
actgtaagttgcagtttactca

SEQ ID NO: 942217 - DNA, 22 bp, Artificial Sequence
  chemically synthesized
tacgttgactgtaagttgcagt

SEQ ID NO: 942218 - DNA, 22 bp, Artificial Sequence
  chemically synthesized
ttctgagtaaactgcaacttac

SEQ ID NO: 942219 - DNA, 22 bp, Artificial Sequence
  chemically synthesized
tatacgttgactgtaagttgca

SEQ ID NO: 942220 - DNA, 22 bp, Artificial Sequence
  chemically synthesized
tgagtaaactgcaacttacagt

SEQ ID NO: 942221 - DNA, 22 bp, Artificial Sequence
  chemically synthesized
agtaaactgcaacttacagtca

SEQ ID NO: 942222 - DNA, 22 bp, Artificial Sequence
  chemically synthesized
gagtactctatacgttgactgt

SEQ ID NO: 942223 - DNA, 22 bp, Artificial Sequence
  chemically synthesized
cctggagtactctatacgttga

SEQ ID NO: 942224 - DNA, 22 bp, Artificial Sequence
  chemically synthesized
caacttacagtcaacgtataga

SEQ ID NO: 942225 - DNA, 22 bp, Artificial Sequence
  chemically synthesized
cctgcctggagtactctatacg

SEQ ID NO: 942226 - DNA, 22 bp, Artificial Sequence
  chemically synthesized
gcctgcctggagtactctatac

SEQ ID NO: 942227 - DNA, 22 bp, Artificial Sequence
  chemically synthesized
acagtcaacgtatagagtactc

SEQ ID NO: 942228 - DNA, 22 bp, Artificial Sequence
  chemically synthesized
cagtcaacgtatagagtactcc

SEQ ID NO: 942229 - DNA, 22 bp, Artificial Sequence
  chemically synthesized
caatacttgcctgcctggagta

SEQ ID NO: 942230 - DNA, 22 bp, Artificial Sequence
  chemically synthesized
acaatacttgcctgcctggagt

SEQ ID NO: 942231 - DNA, 22 bp, Artificial Sequence
  chemically synthesized
aatttacaatacttgcctgcct

SEQ ID NO: 942232 - DNA, 22 bp, Artificial Sequence
  chemically synthesized
caggcaggcaagtattgtaaat

SEQ ID NO: 942233 - DNA, 22 bp, Artificial Sequence
  chemically synthesized
acaagtggaaatagactcaatt

SEQ ID NO: 942234 - DNA, 22 bp, Artificial Sequence
  chemically synthesized
taaattgagtctatttccactt

SEQ ID NO: 942235 - DNA, 22 bp, Artificial Sequence
  chemically synthesized
agtctatttccacttgttagtt

SEQ ID NO: 942236 - DNA, 22 bp, Artificial Sequence
  chemically synthesized
tttccacttgttagtttctcta

SEQ ID NO: 942237 - DNA, 22 bp, Artificial Sequence
  chemically synthesized
ccacttgttagtttctctactg

SEQ ID NO: 942238 - DNA, 22 bp, Artificial Sequence
  chemically synthesized
cacttgttagtttctctactgc

SEQ ID NO: 942239 - DNA, 22 bp, Artificial Sequence
  chemically synthesized
agtatatatatgaagagcagta

SEQ ID NO: 942240 - DNA, 22 bp, Artificial Sequence
  chemically synthesized
gttagtttctctactgctcttc

SEQ ID NO: 942241 - DNA, 22 bp, Artificial Sequence
  chemically synthesized
ttagtttctctactgctcttca

SEQ ID NO: 942242 - DNA, 22 bp, Artificial Sequence
  chemically synthesized
gtttctctactgctcttcatat

SEQ ID NO: 942243 - DNA, 22 bp, Artificial Sequence
  chemically synthesized
ctctactgctcttcatatatat

SEQ ID NO: 942244 - DNA, 22 bp, Artificial Sequence
  chemically synthesized
tctactgctcttcatatatata

SEQ ID NO: 942245 - DNA, 22 bp, Artificial Sequence
  chemically synthesized
tactgctcttcatatatatact

SEQ ID NO: 942246 - DNA, 22 bp, Artificial Sequence
  chemically synthesized
ctgctcttcatatatatactga

SEQ ID NO: 942247 - DNA, 22 bp, Artificial Sequence
  chemically synthesized
agaaagagatattcagtatata

SEQ ID NO: 942248 - DNA, 22 bp, Artificial Sequence
  chemically synthesized
ctcttcatatatatactgaata

SEQ ID NO: 942249 - DNA, 22 bp, Artificial Sequence
  chemically synthesized
cactgagaaagagatattcagt

SEQ ID NO: 942250 - DNA, 22 bp, Artificial Sequence
  chemically synthesized
ttcatatatatactgaatatct

SEQ ID NO: 942251 - DNA, 22 bp, Artificial Sequence
  chemically synthesized
tacactgagaaagagatattca

SEQ ID NO: 942252 - DNA, 22 bp, Artificial Sequence
  chemically synthesized
catatatatactgaatatctct

SEQ ID NO: 942253 - DNA, 22 bp, Artificial Sequence
  chemically synthesized
atatatatactgaatatctctt

SEQ ID NO: 942254 - DNA, 22 bp, Artificial Sequence
  chemically synthesized
aatatctctttctcagtgtaga

SEQ ID NO: 942255 - DNA, 22 bp, Artificial Sequence
  chemically synthesized
gggaagaatgaatgacattcta

SEQ ID NO: 942256 - DNA, 22 bp, Artificial Sequence
  chemically synthesized
tttctcagtgtagaatgtcatt

SEQ ID NO: 942257 - DNA, 22 bp, Artificial Sequence
  chemically synthesized
tctcagtgtagaatgtcattca

SEQ ID NO: 942258 - DNA, 22 bp, Artificial Sequence
  chemically synthesized
ctcagtgtagaatgtcattcat

SEQ ID NO: 942259 - DNA, 22 bp, Artificial Sequence
  chemically synthesized
tcagtgtagaatgtcattcatt

SEQ ID NO: 942260 - DNA, 22 bp, Artificial Sequence
  chemically synthesized
atgttagggaagaatgaatgac

SEQ ID NO: 942261 - DNA, 22 bp, Artificial Sequence
  chemically synthesized
agtgtagaatgtcattcattct

SEQ ID NO: 942262 - DNA, 22 bp, Artificial Sequence
  chemically synthesized
attcttccctaacatcagcctg

SEQ ID NO: 942263 - DNA, 22 bp, Artificial Sequence
  chemically synthesized
acgtagcagtgggatcaggctg

SEQ ID NO: 942264 - DNA, 22 bp, Artificial Sequence
  chemically synthesized
ttccctaacatcagcctgatcc

SEQ ID NO: 942265 - DNA, 22 bp, Artificial Sequence
  chemically synthesized
gacgtagcagtgggatcaggct

SEQ ID NO: 942266 - DNA, 22 bp, Artificial Sequence
  chemically synthesized
ccctaacatcagcctgatccca

SEQ ID NO: 942267 - DNA, 22 bp, Artificial Sequence
  chemically synthesized
cctaacatcagcctgatcccac

SEQ ID NO: 942268 - DNA, 22 bp, Artificial Sequence
  chemically synthesized
acatcagcctgatcccactgct

SEQ ID NO: 942269 - DNA, 22 bp, Artificial Sequence
  chemically synthesized
aacacacacttgacgtagcagt

SEQ ID NO: 942270 - DNA, 22 bp, Artificial Sequence
  chemically synthesized
caacacacacttgacgtagcag

SEQ ID NO: 942271 - DNA, 22 bp, Artificial Sequence
  chemically synthesized
atcccactgctacgtcaagtgt

SEQ ID NO: 942272 - DNA, 22 bp, Artificial Sequence
  chemically synthesized
ctacgtcaagtgtgtgttgaaa

SEQ ID NO: 942273 - DNA, 22 bp, Artificial Sequence
  chemically synthesized
cgtcaagtgtgtgttgaaatat

SEQ ID NO: 942274 - DNA, 22 bp, Artificial Sequence
  chemically synthesized
atggagaaaaaaatatttcaac

SEQ ID NO: 942275 - DNA, 22 bp, Artificial Sequence
  chemically synthesized
catggagaaaaaaatatttcaa

SEQ ID NO: 942276 - DNA, 22 bp, Artificial Sequence
  chemically synthesized
aaatatttttttctccatgaag

SEQ ID NO: 942277 - DNA, 22 bp, Artificial Sequence
  chemically synthesized
aatcaaggaaggcttcatggag

SEQ ID NO: 942278 - DNA, 22 bp, Artificial Sequence
  chemically synthesized
gctaaatcaaggaaggcttcat

SEQ ID NO: 942279 - DNA, 22 bp, Artificial Sequence
  chemically synthesized
ttagctaaatcaaggaaggctt

SEQ ID NO: 942280 - DNA, 22 bp, Artificial Sequence
  chemically synthesized
ttttctccatgaagccttcctt

SEQ ID NO: 942281 - DNA, 22 bp, Artificial Sequence
  chemically synthesized
tttctccatgaagccttccttg

SEQ ID NO: 942282 - DNA, 22 bp, Artificial Sequence
  chemically synthesized
ttctccatgaagccttccttga

SEQ ID NO: 942283 - DNA, 22 bp, Artificial Sequence
  chemically synthesized
ctgttagctaaatcaaggaagg

SEQ ID NO: 942284 - DNA, 22 bp, Artificial Sequence
  chemically synthesized
tctccatgaagccttccttgat

SEQ ID NO: 942285 - DNA, 22 bp, Artificial Sequence
  chemically synthesized
cctgttagctaaatcaaggaag

SEQ ID NO: 942286 - DNA, 22 bp, Artificial Sequence
  chemically synthesized
ctccatgaagccttccttgatt

SEQ ID NO: 942287 - DNA, 22 bp, Artificial Sequence
  chemically synthesized
tccatgaagccttccttgattt

SEQ ID NO: 942288 - DNA, 22 bp, Artificial Sequence
  chemically synthesized
catgaagccttccttgatttag

SEQ ID NO: 942289 - DNA, 22 bp, Artificial Sequence
  chemically synthesized
atttcctgttagctaaatcaag

SEQ ID NO: 942290 - DNA, 22 bp, Artificial Sequence
  chemically synthesized
ccttgatttagctaacaggaaa

SEQ ID NO: 942291 - DNA, 22 bp, Artificial Sequence
  chemically synthesized
cttgatttagctaacaggaaat

SEQ ID NO: 942292 - DNA, 22 bp, Artificial Sequence
  chemically synthesized
gatttagctaacaggaaattaa

SEQ ID NO: 942293 - DNA, 22 bp, Artificial Sequence
  chemically synthesized
atttagctaacaggaaattaat

SEQ ID NO: 942294 - DNA, 22 bp, Artificial Sequence
  chemically synthesized
agctaacaggaaattaatcttt

SEQ ID NO: 942295 - DNA, 22 bp, Artificial Sequence
  chemically synthesized
gctaacaggaaattaatctttt

SEQ ID NO: 942296 - DNA, 22 bp, Artificial Sequence
  chemically synthesized
acaggaaattaatcttttcttt

SEQ ID NO: 942297 - DNA, 22 bp, Artificial Sequence
  chemically synthesized
aaaaaaaaaaaaaggaaagaaa

SEQ ID NO: 942298 - DNA, 22 bp, Artificial Sequence
  chemically synthesized
atcttttcttttctttcctttt

SEQ ID NO: 942299 - DNA, 22 bp, Artificial Sequence
  chemically synthesized
catctcaaaaaaaaaaaaagga

SEQ ID NO: 942300 - DNA, 22 bp, Artificial Sequence
  chemically synthesized
ttcttttctttccttttttttt

SEQ ID NO: 942301 - DNA, 22 bp, Artificial Sequence
  chemically synthesized
tcttttctttcctttttttttt

SEQ ID NO: 942302 - DNA, 22 bp, Artificial Sequence
  chemically synthesized
cttttctttccttttttttttt

SEQ ID NO: 942303 - DNA, 22 bp, Artificial Sequence
  chemically synthesized
ttttctttcctttttttttttt

SEQ ID NO: 942304 - DNA, 22 bp, Artificial Sequence
  chemically synthesized
ttctttcctttttttttttttg

SEQ ID NO: 942305 - DNA, 22 bp, Artificial Sequence
  chemically synthesized
tctttcctttttttttttttga

SEQ ID NO: 942306 - DNA, 22 bp, Artificial Sequence
  chemically synthesized
ctttcctttttttttttttgag

SEQ ID NO: 942307 - DNA, 22 bp, Artificial Sequence
  chemically synthesized
tttcctttttttttttttgaga

SEQ ID NO: 942308 - DNA, 22 bp, Artificial Sequence
  chemically synthesized
tcctttttttttttttgagatg

SEQ ID NO: 942309 - DNA, 22 bp, Artificial Sequence
  chemically synthesized
cctttttttttttttgagatgg

SEQ ID NO: 942310 - DNA, 22 bp, Artificial Sequence
  chemically synthesized
ctttttttttttttgagatgga

SEQ ID NO: 942311 - DNA, 22 bp, Artificial Sequence
  chemically synthesized
ggcaacagcaagattccatctc

SEQ ID NO: 942312 - DNA, 22 bp, Artificial Sequence
  chemically synthesized
tttttttttttgagatggaatc

SEQ ID NO: 942313 - DNA, 22 bp, Artificial Sequence
  chemically synthesized
ttttttttttgagatggaatct

SEQ ID NO: 942314 - DNA, 22 bp, Artificial Sequence
  chemically synthesized
tttttttttgagatggaatctt

SEQ ID NO: 942315 - DNA, 22 bp, Artificial Sequence
  chemically synthesized
ttttttttgagatggaatcttg

SEQ ID NO: 942316 - DNA, 22 bp, Artificial Sequence
  chemically synthesized
tttttttgagatggaatcttgc

SEQ ID NO: 942317 - DNA, 22 bp, Artificial Sequence
  chemically synthesized
ttttttgagatggaatcttgct

SEQ ID NO: 942318 - DNA, 22 bp, Artificial Sequence
  chemically synthesized
tttttgagatggaatcttgctg

SEQ ID NO: 942319 - DNA, 22 bp, Artificial Sequence
  chemically synthesized
cagcctgggcaacagcaagatt

SEQ ID NO: 942320 - DNA, 22 bp, Artificial Sequence
  chemically synthesized
ttttgagatggaatcttgctgt

SEQ ID NO: 942321 - DNA, 22 bp, Artificial Sequence
  chemically synthesized
tttgagatggaatcttgctgtt

SEQ ID NO: 942322 - DNA, 22 bp, Artificial Sequence
  chemically synthesized
ttgagatggaatcttgctgttg

SEQ ID NO: 942323 - DNA, 22 bp, Artificial Sequence
  chemically synthesized
tgagatggaatcttgctgttgc

SEQ ID NO: 942324 - DNA, 22 bp, Artificial Sequence
  chemically synthesized
gagatggaatcttgctgttgcc

SEQ ID NO: 942325 - DNA, 22 bp, Artificial Sequence
  chemically synthesized
cactccagcctgggcaacagca

SEQ ID NO: 942326 - DNA, 22 bp, Artificial Sequence
  chemically synthesized
agatggaatcttgctgttgccc

SEQ ID NO: 942327 - DNA, 22 bp, Artificial Sequence
  chemically synthesized
gccattgcactccagcctgggc

SEQ ID NO: 942328 - DNA, 22 bp, Artificial Sequence
  chemically synthesized
gctgttgcccaggctggagtgc

SEQ ID NO: 942329 - DNA, 22 bp, Artificial Sequence
  chemically synthesized
ctgttgcccaggctggagtgca

SEQ ID NO: 942330 - DNA, 22 bp, Artificial Sequence
  chemically synthesized
ttgcccaggctggagtgcaatg

SEQ ID NO: 942331 - DNA, 22 bp, Artificial Sequence
  chemically synthesized
cccaggctggagtgcaatggcc

SEQ ID NO: 942332 - DNA, 22 bp, Artificial Sequence
  chemically synthesized
cagtgagccaagatctggccat

SEQ ID NO: 942333 - DNA, 22 bp, Artificial Sequence
  chemically synthesized
gagtgcaatggccagatcttgg

SEQ ID NO: 942334 - DNA, 22 bp, Artificial Sequence
  chemically synthesized
ggaggtggaggttgcagtgagc

SEQ ID NO: 942335 - DNA, 22 bp, Artificial Sequence
  chemically synthesized
aacctgggaggtggaggttgca

SEQ ID NO: 942336 - DNA, 22 bp, Artificial Sequence
  chemically synthesized
gaacctgggaggtggaggttgc

SEQ ID NO: 942337 - DNA, 22 bp, Artificial Sequence
  chemically synthesized
tttgaacctgggaggtggaggt

SEQ ID NO: 942338 - DNA, 22 bp, Artificial Sequence
  chemically synthesized
ggctcactgcaacctccacctc

SEQ ID NO: 942339 - DNA, 22 bp, Artificial Sequence
  chemically synthesized
gctcactgcaacctccacctcc

SEQ ID NO: 942340 - DNA, 22 bp, Artificial Sequence
  chemically synthesized
actgcaacctccacctcccagg

SEQ ID NO: 942341 - DNA, 22 bp, Artificial Sequence
  chemically synthesized
caacctccacctcccaggttca

SEQ ID NO: 942342 - DNA, 22 bp, Artificial Sequence
  chemically synthesized
aggcaggagaattgtttgaacc

SEQ ID NO: 942343 - DNA, 22 bp, Artificial Sequence
  chemically synthesized
cacctcccaggttcaaacaatt

SEQ ID NO: 942344 - DNA, 22 bp, Artificial Sequence
  chemically synthesized
gcaggctgaggcaggagaattg

SEQ ID NO: 942345 - DNA, 22 bp, Artificial Sequence
  chemically synthesized
ccaggttcaaacaattctcctg

SEQ ID NO: 942346 - DNA, 22 bp, Artificial Sequence
  chemically synthesized
agcaggctgaggcaggagaatt

SEQ ID NO: 942347 - DNA, 22 bp, Artificial Sequence
  chemically synthesized
cttagcaggctgaggcaggaga

SEQ ID NO: 942348 - DNA, 22 bp, Artificial Sequence
  chemically synthesized
aaacaattctcctgcctcagcc

SEQ ID NO: 942349 - DNA, 22 bp, Artificial Sequence
  chemically synthesized
taatcccagctacttagcaggc

SEQ ID NO: 942350 - DNA, 22 bp, Artificial Sequence
  chemically synthesized
tcctgcctcagcctgctaagta

SEQ ID NO: 942351 - DNA, 22 bp, Artificial Sequence
  chemically synthesized
ctgcctcagcctgctaagtagc

SEQ ID NO: 942352 - DNA, 22 bp, Artificial Sequence
  chemically synthesized
cctcagcctgctaagtagctgg

SEQ ID NO: 942353 - DNA, 22 bp, Artificial Sequence
  chemically synthesized
agcctgctaagtagctgggatt

SEQ ID NO: 942354 - DNA, 22 bp, Artificial Sequence
  chemically synthesized
gtggtatgcacctgtaatccca

SEQ ID NO: 942355 - DNA, 22 bp, Artificial Sequence
  chemically synthesized
ggtggtatgcacctgtaatccc

SEQ ID NO: 942356 - DNA, 22 bp, Artificial Sequence
  chemically synthesized
ctaagtagctgggattacaggt

SEQ ID NO: 942357 - DNA, 22 bp, Artificial Sequence
  chemically synthesized
agtagctgggattacaggtgca

SEQ ID NO: 942358 - DNA, 22 bp, Artificial Sequence
  chemically synthesized
gccgggtttggtggtatgcacc

SEQ ID NO: 942359 - DNA, 22 bp, Artificial Sequence
  chemically synthesized
ggattacaggtgcataccacca

SEQ ID NO: 942360 - DNA, 22 bp, Artificial Sequence
  chemically synthesized
caggtgcataccaccaaacccg

SEQ ID NO: 942361 - DNA, 22 bp, Artificial Sequence
  chemically synthesized
aatatacaaaaattagccgggt

SEQ ID NO: 942362 - DNA, 22 bp, Artificial Sequence
  chemically synthesized
ctaaatatacaaaaattagccg

SEQ ID NO: 942363 - DNA, 22 bp, Artificial Sequence
  chemically synthesized
tactaaatatacaaaaattagc

SEQ ID NO: 942364 - DNA, 22 bp, Artificial Sequence
  chemically synthesized
tctctactaaatatacaaaaat

SEQ ID NO: 942365 - DNA, 22 bp, Artificial Sequence
  chemically synthesized
tatctctactaaatatacaaaa

SEQ ID NO: 942366 - DNA, 22 bp, Artificial Sequence
  chemically synthesized
atttttgtatatttagtagaga

SEQ ID NO: 942367 - DNA, 22 bp, Artificial Sequence
  chemically synthesized
ttgtatatttagtagagataga

SEQ ID NO: 942368 - DNA, 22 bp, Artificial Sequence
  chemically synthesized
tgtatatttagtagagatagag

SEQ ID NO: 942369 - DNA, 22 bp, Artificial Sequence
  chemically synthesized
gtatatttagtagagatagagt

SEQ ID NO: 942370 - DNA, 22 bp, Artificial Sequence
  chemically synthesized
tatatttagtagagatagagtt

SEQ ID NO: 942371 - DNA, 22 bp, Artificial Sequence
  chemically synthesized
gccaacatggtgaaactctatc

SEQ ID NO: 942372 - DNA, 22 bp, Artificial Sequence
  chemically synthesized
agtagagatagagtttcaccat

SEQ ID NO: 942373 - DNA, 22 bp, Artificial Sequence
  chemically synthesized
gtagagatagagtttcaccatg

SEQ ID NO: 942374 - DNA, 22 bp, Artificial Sequence
  chemically synthesized
gagaccatcctggccaacatgg

SEQ ID NO: 942375 - DNA, 22 bp, Artificial Sequence
  chemically synthesized
caccatgttggccaggatggtc

SEQ ID NO: 942376 - DNA, 22 bp, Artificial Sequence
  chemically synthesized
accatgttggccaggatggtct

SEQ ID NO: 942377 - DNA, 22 bp, Artificial Sequence
  chemically synthesized
gccaggatggtctcgaactcct

SEQ ID NO: 942378 - DNA, 22 bp, Artificial Sequence
  chemically synthesized
gaactcctgacctcgtgatctg

SEQ ID NO: 942379 - DNA, 22 bp, Artificial Sequence
  chemically synthesized
ggaggccaaggtgggcagatca

SEQ ID NO: 942380 - DNA, 22 bp, Artificial Sequence
  chemically synthesized
gggaggccaaggtgggcagatc

SEQ ID NO: 942381 - DNA, 22 bp, Artificial Sequence
  chemically synthesized
tgggaggccaaggtgggcagat

SEQ ID NO: 942382 - DNA, 22 bp, Artificial Sequence
  chemically synthesized
ctgacctcgtgatctgcccacc

SEQ ID NO: 942383 - DNA, 22 bp, Artificial Sequence
  chemically synthesized
acctcgtgatctgcccaccttg

SEQ ID NO: 942384 - DNA, 22 bp, Artificial Sequence
  chemically synthesized
gtgatctgcccaccttggcctc

SEQ ID NO: 942385 - DNA, 22 bp, Artificial Sequence
  chemically synthesized
taatcccagcactttgggaggc

SEQ ID NO: 942386 - DNA, 22 bp, Artificial Sequence
  chemically synthesized
cccaccttggcctcccaaagtg

SEQ ID NO: 942387 - DNA, 22 bp, Artificial Sequence
  chemically synthesized
acgcctgtaatcccagcacttt

SEQ ID NO: 942388 - DNA, 22 bp, Artificial Sequence
  chemically synthesized
ggcctcccaaagtgctgggatt

SEQ ID NO: 942389 - DNA, 22 bp, Artificial Sequence
  chemically synthesized
gcctcccaaagtgctgggatta

SEQ ID NO: 942390 - DNA, 22 bp, Artificial Sequence
  chemically synthesized
ccaaagtgctgggattacaggc

SEQ ID NO: 942391 - DNA, 22 bp, Artificial Sequence
  chemically synthesized
ggcacggtggctcacgcctgta

SEQ ID NO: 942392 - DNA, 22 bp, Artificial Sequence
  chemically synthesized
gctgggcacggtggctcacgcc

SEQ ID NO: 942393 - DNA, 22 bp, Artificial Sequence
  chemically synthesized
ggattacaggcgtgagccaccg

SEQ ID NO: 942394 - DNA, 22 bp, Artificial Sequence
  chemically synthesized
caggcgtgagccaccgtgccca

SEQ ID NO: 942395 - DNA, 22 bp, Artificial Sequence
  chemically synthesized
taaaaagaaagatgaattggct

SEQ ID NO: 942396 - DNA, 22 bp, Artificial Sequence
  chemically synthesized
ttataaaaagaaagatgaattg

SEQ ID NO: 942397 - DNA, 22 bp, Artificial Sequence
  chemically synthesized
attataaaaagaaagatgaatt

SEQ ID NO: 942398 - DNA, 22 bp, Artificial Sequence
  chemically synthesized
catttattataaaaagaaagat

SEQ ID NO: 942399 - DNA, 22 bp, Artificial Sequence
  chemically synthesized
gcatttattataaaaagaaaga

SEQ ID NO: 942400 - DNA, 22 bp, Artificial Sequence
  chemically synthesized
atctttctttttataataaatg

SEQ ID NO: 942401 - DNA, 22 bp, Artificial Sequence
  chemically synthesized
aagtacgatttgcatttattat

SEQ ID NO: 942402 - DNA, 22 bp, Artificial Sequence
  chemically synthesized
tctttttataataaatgcaaat

SEQ ID NO: 942403 - DNA, 22 bp, Artificial Sequence
  chemically synthesized
ctttttataataaatgcaaatc

SEQ ID NO: 942404 - DNA, 22 bp, Artificial Sequence
  chemically synthesized
tttttataataaatgcaaatcg

SEQ ID NO: 942405 - DNA, 22 bp, Artificial Sequence
  chemically synthesized
tttataataaatgcaaatcgta

SEQ ID NO: 942406 - DNA, 22 bp, Artificial Sequence
  chemically synthesized
ttataataaatgcaaatcgtac

SEQ ID NO: 942407 - DNA, 22 bp, Artificial Sequence
  chemically synthesized
tataataaatgcaaatcgtact

SEQ ID NO: 942408 - DNA, 22 bp, Artificial Sequence
  chemically synthesized
ataataaatgcaaatcgtactt

SEQ ID NO: 942409 - DNA, 22 bp, Artificial Sequence
  chemically synthesized
taataaatgcaaatcgtacttc

SEQ ID NO: 942410 - DNA, 22 bp, Artificial Sequence
  chemically synthesized
gaatgcacagttgaagtacgat

SEQ ID NO: 942411 - DNA, 22 bp, Artificial Sequence
  chemically synthesized
caactgtgcattctagggcttg

SEQ ID NO: 942412 - DNA, 22 bp, Artificial Sequence
  chemically synthesized
aactgtgcattctagggcttgt

SEQ ID NO: 942413 - DNA, 22 bp, Artificial Sequence
  chemically synthesized
tgcattctagggcttgtattta

SEQ ID NO: 942414 - DNA, 22 bp, Artificial Sequence
  chemically synthesized
taatgtataatagaaaataaat

SEQ ID NO: 942415 - DNA, 22 bp, Artificial Sequence
  chemically synthesized
tagggcttgtatttattttcta

SEQ ID NO: 942416 - DNA, 22 bp, Artificial Sequence
  chemically synthesized
gggcttgtatttattttctatt

SEQ ID NO: 942417 - DNA, 22 bp, Artificial Sequence
  chemically synthesized
gtatttattttctattatacat

SEQ ID NO: 942418 - DNA, 22 bp, Artificial Sequence
  chemically synthesized
tatttattttctattatacatt

SEQ ID NO: 942419 - DNA, 22 bp, Artificial Sequence
  chemically synthesized
attttctattatacattataat

SEQ ID NO: 942420 - DNA, 22 bp, Artificial Sequence
  chemically synthesized
ttttctattatacattataatt

SEQ ID NO: 942421 - DNA, 22 bp, Artificial Sequence
  chemically synthesized
tctattatacattataattttt

SEQ ID NO: 942422 - DNA, 22 bp, Artificial Sequence
  chemically synthesized
ctattatacattataattttta

SEQ ID NO: 942423 - DNA, 22 bp, Artificial Sequence
  chemically synthesized
tattatacattataatttttat

SEQ ID NO: 942424 - DNA, 22 bp, Artificial Sequence
  chemically synthesized
ttatacattataatttttatgc

SEQ ID NO: 942425 - DNA, 22 bp, Artificial Sequence
  chemically synthesized
gacaaagtacatgcataaaaat

SEQ ID NO: 942426 - DNA, 22 bp, Artificial Sequence
  chemically synthesized
tacattataatttttatgcatg

SEQ ID NO: 942427 - DNA, 22 bp, Artificial Sequence
  chemically synthesized
ttagacaaagtacatgcataaa

SEQ ID NO: 942428 - DNA, 22 bp, Artificial Sequence
  chemically synthesized
cacctattagacaaagtacatg

SEQ ID NO: 942429 - DNA, 22 bp, Artificial Sequence
  chemically synthesized
taatttttatgcatgtactttg

SEQ ID NO: 942430 - DNA, 22 bp, Artificial Sequence
  chemically synthesized
acacctattagacaaagtacat

SEQ ID NO: 942431 - DNA, 22 bp, Artificial Sequence
  chemically synthesized
ttatgcatgtactttgtctaat

SEQ ID NO: 942432 - DNA, 22 bp, Artificial Sequence
  chemically synthesized
tatgcatgtactttgtctaata

SEQ ID NO: 942433 - DNA, 22 bp, Artificial Sequence
  chemically synthesized
agaacttacacctattagacaa

SEQ ID NO: 942434 - DNA, 22 bp, Artificial Sequence
  chemically synthesized
atgcatgtactttgtctaatag

SEQ ID NO: 942435 - DNA, 22 bp, Artificial Sequence
  chemically synthesized
tgcatgtactttgtctaatagg

SEQ ID NO: 942436 - DNA, 22 bp, Artificial Sequence
  chemically synthesized
cctaagaacttacacctattag

SEQ ID NO: 942437 - DNA, 22 bp, Artificial Sequence
  chemically synthesized
tccctaagaacttacacctatt

SEQ ID NO: 942438 - DNA, 22 bp, Artificial Sequence
  chemically synthesized
attctccctaagaacttacacc

SEQ ID NO: 942439 - DNA, 22 bp, Artificial Sequence
  chemically synthesized
tgtctaataggtgtaagttctt

SEQ ID NO: 942440 - DNA, 22 bp, Artificial Sequence
  chemically synthesized
gtctaataggtgtaagttctta

SEQ ID NO: 942441 - DNA, 22 bp, Artificial Sequence
  chemically synthesized
tctaataggtgtaagttcttag

SEQ ID NO: 942442 - DNA, 22 bp, Artificial Sequence
  chemically synthesized
ataggtgtaagttcttagggag

SEQ ID NO: 942443 - DNA, 22 bp, Artificial Sequence
  chemically synthesized
aatatggctcattctccctaag

SEQ ID NO: 942444 - DNA, 22 bp, Artificial Sequence
  chemically synthesized
ttagggagaatgagccatattt

SEQ ID NO: 942445 - DNA, 22 bp, Artificial Sequence
  chemically synthesized
agggagaatgagccatatttaa

SEQ ID NO: 942446 - DNA, 22 bp, Artificial Sequence
  chemically synthesized
gggagaatgagccatatttaat

SEQ ID NO: 942447 - DNA, 22 bp, Artificial Sequence
  chemically synthesized
ggccatgtggggtatacaaaaa

SEQ ID NO: 942448 - DNA, 22 bp, Artificial Sequence
  chemically synthesized
gctaggccatgtggggtataca

SEQ ID NO: 942449 - DNA, 22 bp, Artificial Sequence
  chemically synthesized
aatacatttttgtataccccac

SEQ ID NO: 942450 - DNA, 22 bp, Artificial Sequence
  chemically synthesized
atacatttttgtataccccaca

SEQ ID NO: 942451 - DNA, 22 bp, Artificial Sequence
  chemically synthesized
ttgtataccccacatggcctag

SEQ ID NO: 942452 - DNA, 22 bp, Artificial Sequence
  chemically synthesized
tgtataccccacatggcctagc

SEQ ID NO: 942453 - DNA, 22 bp, Artificial Sequence
  chemically synthesized
gtataccccacatggcctagcc

SEQ ID NO: 942454 - DNA, 22 bp, Artificial Sequence
  chemically synthesized
tataccccacatggcctagcca

SEQ ID NO: 942455 - DNA, 22 bp, Artificial Sequence
  chemically synthesized
taagcaaagtattggctaggcc

SEQ ID NO: 942456 - DNA, 22 bp, Artificial Sequence
  chemically synthesized
ccaactataagcaaagtattgg

SEQ ID NO: 942457 - DNA, 22 bp, Artificial Sequence
  chemically synthesized
cctaccaactataagcaaagta

SEQ ID NO: 942458 - DNA, 22 bp, Artificial Sequence
  chemically synthesized
attgcctaccaactataagcaa

SEQ ID NO: 942459 - DNA, 22 bp, Artificial Sequence
  chemically synthesized
gccaatactttgcttatagttg

SEQ ID NO: 942460 - DNA, 22 bp, Artificial Sequence
  chemically synthesized
ataaatattcattgcctaccaa

SEQ ID NO: 942461 - DNA, 22 bp, Artificial Sequence
  chemically synthesized
aataaatattcattgcctacca

SEQ ID NO: 942462 - DNA, 22 bp, Artificial Sequence
  chemically synthesized
tgcttatagttggtaggcaatg

SEQ ID NO: 942463 - DNA, 22 bp, Artificial Sequence
  chemically synthesized
gcttatagttggtaggcaatga

SEQ ID NO: 942464 - DNA, 22 bp, Artificial Sequence
  chemically synthesized
cttatagttggtaggcaatgaa

SEQ ID NO: 942465 - DNA, 22 bp, Artificial Sequence
  chemically synthesized
gtttaataaatattcattgcct

SEQ ID NO: 942466 - DNA, 22 bp, Artificial Sequence
  chemically synthesized
atagttggtaggcaatgaatat

SEQ ID NO: 942467 - DNA, 22 bp, Artificial Sequence
  chemically synthesized
tagttggtaggcaatgaatatt

SEQ ID NO: 942468 - DNA, 22 bp, Artificial Sequence
  chemically synthesized
gtaggcaatgaatatttattaa

SEQ ID NO: 942469 - DNA, 22 bp, Artificial Sequence
  chemically synthesized
agcaatcattcgtttaataaat

SEQ ID NO: 942470 - DNA, 22 bp, Artificial Sequence
  chemically synthesized
agaaaactcagcaatcattcgt

SEQ ID NO: 942471 - DNA, 22 bp, Artificial Sequence
  chemically synthesized
cagaaaactcagcaatcattcg

SEQ ID NO: 942472 - DNA, 22 bp, Artificial Sequence
  chemically synthesized
tcagaaaactcagcaatcattc

SEQ ID NO: 942473 - DNA, 22 bp, Artificial Sequence
  chemically synthesized
attaaacgaatgattgctgagt

SEQ ID NO: 942474 - DNA, 22 bp, Artificial Sequence
  chemically synthesized
ttaaacgaatgattgctgagtt

SEQ ID NO: 942475 - DNA, 22 bp, Artificial Sequence
  chemically synthesized
aacgaatgattgctgagttttc

SEQ ID NO: 942476 - DNA, 22 bp, Artificial Sequence
  chemically synthesized
ctgagttttctgaaaacatcat

SEQ ID NO: 942477 - DNA, 22 bp, Artificial Sequence
  chemically synthesized
agttttctgaaaacatcattct

SEQ ID NO: 942478 - DNA, 22 bp, Artificial Sequence
  chemically synthesized
aaaacaacaatggcaagaatga

SEQ ID NO: 942479 - DNA, 22 bp, Artificial Sequence
  chemically synthesized
tctgaaaacatcattcttgcca

SEQ ID NO: 942480 - DNA, 22 bp, Artificial Sequence
  chemically synthesized
ctgaaaacatcattcttgccat

SEQ ID NO: 942481 - DNA, 22 bp, Artificial Sequence
  chemically synthesized
tgaaaacatcattcttgccatt

SEQ ID NO: 942482 - DNA, 22 bp, Artificial Sequence
  chemically synthesized
aaaacatcattcttgccattgt

SEQ ID NO: 942483 - DNA, 22 bp, Artificial Sequence
  chemically synthesized
agtgagctcaaaacaacaatgg

SEQ ID NO: 942484 - DNA, 22 bp, Artificial Sequence
  chemically synthesized
ttgccattgttgttttgagctc

SEQ ID NO: 942485 - DNA, 22 bp, Artificial Sequence
  chemically synthesized
gccattgttgttttgagctcac

SEQ ID NO: 942486 - DNA, 22 bp, Artificial Sequence
  chemically synthesized
ccattgttgttttgagctcact

SEQ ID NO: 942487 - DNA, 22 bp, Artificial Sequence
  chemically synthesized
ttgttttgagctcactcaatta

SEQ ID NO: 942488 - DNA, 22 bp, Artificial Sequence
  chemically synthesized
ttttgagctcactcaattattc

SEQ ID NO: 942489 - DNA, 22 bp, Artificial Sequence
  chemically synthesized
tgagctcactcaattattctgg

SEQ ID NO: 942490 - DNA, 22 bp, Artificial Sequence
  chemically synthesized
gagctcactcaattattctgga

SEQ ID NO: 942491 - DNA, 22 bp, Artificial Sequence
  chemically synthesized
agctcactcaattattctggat

SEQ ID NO: 942492 - DNA, 22 bp, Artificial Sequence
  chemically synthesized
atagacatcaggatccagaata

SEQ ID NO: 942493 - DNA, 22 bp, Artificial Sequence
  chemically synthesized
catagacatcaggatccagaat

SEQ ID NO: 942494 - DNA, 22 bp, Artificial Sequence
  chemically synthesized
actcaattattctggatcctga

SEQ ID NO: 942495 - DNA, 22 bp, Artificial Sequence
  chemically synthesized
catttcatagacatcaggatcc

SEQ ID NO: 942496 - DNA, 22 bp, Artificial Sequence
  chemically synthesized
gcatttcatagacatcaggatc

SEQ ID NO: 942497 - DNA, 22 bp, Artificial Sequence
  chemically synthesized
tgcatttcatagacatcaggat

SEQ ID NO: 942498 - DNA, 22 bp, Artificial Sequence
  chemically synthesized
aattattctggatcctgatgtc

SEQ ID NO: 942499 - DNA, 22 bp, Artificial Sequence
  chemically synthesized
ttgcatttcatagacatcagga

SEQ ID NO: 942500 - DNA, 22 bp, Artificial Sequence
  chemically synthesized
tttgcatttcatagacatcagg

SEQ ID NO: 942501 - DNA, 22 bp, Artificial Sequence
  chemically synthesized
ttctggatcctgatgtctatga

SEQ ID NO: 942502 - DNA, 22 bp, Artificial Sequence
  chemically synthesized
tctttttgcatttcatagacat

SEQ ID NO: 942503 - DNA, 22 bp, Artificial Sequence
  chemically synthesized
atctttttgcatttcatagaca

SEQ ID NO: 942504 - DNA, 22 bp, Artificial Sequence
  chemically synthesized
tggatcctgatgtctatgaaat

SEQ ID NO: 942505 - DNA, 22 bp, Artificial Sequence
  chemically synthesized
gatcctgatgtctatgaaatgc

SEQ ID NO: 942506 - DNA, 22 bp, Artificial Sequence
  chemically synthesized
atgtctatgaaatgcaaaaaga

SEQ ID NO: 942507 - DNA, 22 bp, Artificial Sequence
  chemically synthesized
gacgtgatcaatatcttatctt

SEQ ID NO: 942508 - DNA, 22 bp, Artificial Sequence
  chemically synthesized
tgaaatgcaaaaagataagata

SEQ ID NO: 942509 - DNA, 22 bp, Artificial Sequence
  chemically synthesized
agacgtgatcaatatcttatct

SEQ ID NO: 942510 - DNA, 22 bp, Artificial Sequence
  chemically synthesized
atttagacgtgatcaatatctt

SEQ ID NO: 942511 - DNA, 22 bp, Artificial Sequence
  chemically synthesized
taatttagacgtgatcaatatc

SEQ ID NO: 942512 - DNA, 22 bp, Artificial Sequence
  chemically synthesized
ctaatttagacgtgatcaatat

SEQ ID NO: 942513 - DNA, 22 bp, Artificial Sequence
  chemically synthesized
ttctaatttagacgtgatcaat

SEQ ID NO: 942514 - DNA, 22 bp, Artificial Sequence
  chemically synthesized
accactcttctaatttagacgt

SEQ ID NO: 942515 - DNA, 22 bp, Artificial Sequence
  chemically synthesized
tctcaccactcttctaatttag

SEQ ID NO: 942516 - DNA, 22 bp, Artificial Sequence
  chemically synthesized
atctcaccactcttctaattta

SEQ ID NO: 942517 - DNA, 22 bp, Artificial Sequence
  chemically synthesized
tttatctcaccactcttctaat

SEQ ID NO: 942518 - DNA, 22 bp, Artificial Sequence
  chemically synthesized
atcacgtctaaattagaagagt

SEQ ID NO: 942519 - DNA, 22 bp, Artificial Sequence
  chemically synthesized
tgtttatctcaccactcttcta

SEQ ID NO: 942520 - DNA, 22 bp, Artificial Sequence
  chemically synthesized
ctgtttatctcaccactcttct

SEQ ID NO: 942521 - DNA, 22 bp, Artificial Sequence
  chemically synthesized
tttctgtttatctcaccactct

SEQ ID NO: 942522 - DNA, 22 bp, Artificial Sequence
  chemically synthesized
atttctgtttatctcaccactc

SEQ ID NO: 942523 - DNA, 22 bp, Artificial Sequence
  chemically synthesized
ttatttctgtttatctcaccac

SEQ ID NO: 942524 - DNA, 22 bp, Artificial Sequence
  chemically synthesized
aattagaagagtggtgagataa

SEQ ID NO: 942525 - DNA, 22 bp, Artificial Sequence
  chemically synthesized
gaagagtggtgagataaacaga

SEQ ID NO: 942526 - DNA, 22 bp, Artificial Sequence
  chemically synthesized
caatcctcttatttctgtttat

SEQ ID NO: 942527 - DNA, 22 bp, Artificial Sequence
  chemically synthesized
ccaatcctcttatttctgttta

SEQ ID NO: 942528 - DNA, 22 bp, Artificial Sequence
  chemically synthesized
acttccaatcctcttatttctg

SEQ ID NO: 942529 - DNA, 22 bp, Artificial Sequence
  chemically synthesized
tgtaaataagttaacttccaat

SEQ ID NO: 942530 - DNA, 22 bp, Artificial Sequence
  chemically synthesized
agattatgtaaataagttaact

SEQ ID NO: 942531 - DNA, 22 bp, Artificial Sequence
  chemically synthesized
cagattatgtaaataagttaac

SEQ ID NO: 942532 - DNA, 22 bp, Artificial Sequence
  chemically synthesized
ttcagattatgtaaataagtta

SEQ ID NO: 942533 - DNA, 22 bp, Artificial Sequence
  chemically synthesized
gaagttaacttatttacataat

SEQ ID NO: 942534 - DNA, 22 bp, Artificial Sequence
  chemically synthesized
aacattcttcagattatgtaaa

SEQ ID NO: 942535 - DNA, 22 bp, Artificial Sequence
  chemically synthesized
cagttaaacattcttcagatta

SEQ ID NO: 942536 - DNA, 22 bp, Artificial Sequence
  chemically synthesized
acttatttacataatctgaaga

SEQ ID NO: 942537 - DNA, 22 bp, Artificial Sequence
  chemically synthesized
ccagttaaacattcttcagatt

SEQ ID NO: 942538 - DNA, 22 bp, Artificial Sequence
  chemically synthesized
tttccagttaaacattcttcag

SEQ ID NO: 942539 - DNA, 22 bp, Artificial Sequence
  chemically synthesized
atttacataatctgaagaatgt

SEQ ID NO: 942540 - DNA, 22 bp, Artificial Sequence
  chemically synthesized
atttccagttaaacattcttca

SEQ ID NO: 942541 - DNA, 22 bp, Artificial Sequence
  chemically synthesized
tttacataatctgaagaatgtt

SEQ ID NO: 942542 - DNA, 22 bp, Artificial Sequence
  chemically synthesized
tatttccagttaaacattcttc

SEQ ID NO: 942543 - DNA, 22 bp, Artificial Sequence
  chemically synthesized
acataatctgaagaatgtttaa

SEQ ID NO: 942544 - DNA, 22 bp, Artificial Sequence
  chemically synthesized
cataatctgaagaatgtttaac

SEQ ID NO: 942545 - DNA, 22 bp, Artificial Sequence
  chemically synthesized
tccgttttatttccagttaaac

SEQ ID NO: 942546 - DNA, 22 bp, Artificial Sequence
  chemically synthesized
tgtccgttttatttccagttaa

SEQ ID NO: 942547 - DNA, 22 bp, Artificial Sequence
  chemically synthesized
ctgtccgttttatttccagtta

SEQ ID NO: 942548 - DNA, 22 bp, Artificial Sequence
  chemically synthesized
aagaatgtttaactggaaataa

SEQ ID NO: 942549 - DNA, 22 bp, Artificial Sequence
  chemically synthesized
aactggaaataaaacggacaga

SEQ ID NO: 942550 - DNA, 22 bp, Artificial Sequence
  chemically synthesized
actggaaataaaacggacagaa

SEQ ID NO: 942551 - DNA, 22 bp, Artificial Sequence
  chemically synthesized
agaagcaaaatgtcttctgtcc

SEQ ID NO: 942552 - DNA, 22 bp, Artificial Sequence
  chemically synthesized
cagaagcaaaatgtcttctgtc

SEQ ID NO: 942553 - DNA, 22 bp, Artificial Sequence
  chemically synthesized
gaaataaaacggacagaagaca

SEQ ID NO: 942554 - DNA, 22 bp, Artificial Sequence
  chemically synthesized
ttcagaagcaaaatgtcttctg

SEQ ID NO: 942555 - DNA, 22 bp, Artificial Sequence
  chemically synthesized
tctcttcagaagcaaaatgtct

SEQ ID NO: 942556 - DNA, 22 bp, Artificial Sequence
  chemically synthesized
atctcttcagaagcaaaatgtc

SEQ ID NO: 942557 - DNA, 22 bp, Artificial Sequence
  chemically synthesized
tttatctcttcagaagcaaaat

SEQ ID NO: 942558 - DNA, 22 bp, Artificial Sequence
  chemically synthesized
gtttatctcttcagaagcaaaa

SEQ ID NO: 942559 - DNA, 22 bp, Artificial Sequence
  chemically synthesized
cttgtttatctcttcagaagca

SEQ ID NO: 942560 - DNA, 22 bp, Artificial Sequence
  chemically synthesized
ggattccttgtttatctcttca

SEQ ID NO: 942561 - DNA, 22 bp, Artificial Sequence
  chemically synthesized
tctaggattccttgtttatctc

SEQ ID NO: 942562 - DNA, 22 bp, Artificial Sequence
  chemically synthesized
tgcttctgaagagataaacaag

SEQ ID NO: 942563 - DNA, 22 bp, Artificial Sequence
  chemically synthesized
gcttctgaagagataaacaagg

SEQ ID NO: 942564 - DNA, 22 bp, Artificial Sequence
  chemically synthesized
cttctgaagagataaacaagga

SEQ ID NO: 942565 - DNA, 22 bp, Artificial Sequence
  chemically synthesized
aattatctaggattccttgttt

SEQ ID NO: 942566 - DNA, 22 bp, Artificial Sequence
  chemically synthesized
caattatctaggattccttgtt

SEQ ID NO: 942567 - DNA, 22 bp, Artificial Sequence
  chemically synthesized
ctgaagagataaacaaggaatc

SEQ ID NO: 942568 - DNA, 22 bp, Artificial Sequence
  chemically synthesized
tcaattatctaggattccttgt

SEQ ID NO: 942569 - DNA, 22 bp, Artificial Sequence
  chemically synthesized
tgaagagataaacaaggaatcc

SEQ ID NO: 942570 - DNA, 22 bp, Artificial Sequence
  chemically synthesized
tttcaattatctaggattcctt

SEQ ID NO: 942571 - DNA, 22 bp, Artificial Sequence
  chemically synthesized
aagagataaacaaggaatccta

SEQ ID NO: 942572 - DNA, 22 bp, Artificial Sequence
  chemically synthesized
ctttcaattatctaggattcct

SEQ ID NO: 942573 - DNA, 22 bp, Artificial Sequence
  chemically synthesized
tctttcaattatctaggattcc

SEQ ID NO: 942574 - DNA, 22 bp, Artificial Sequence
  chemically synthesized
ttctttcaattatctaggattc

SEQ ID NO: 942575 - DNA, 22 bp, Artificial Sequence
  chemically synthesized
cttttctttcaattatctagga

SEQ ID NO: 942576 - DNA, 22 bp, Artificial Sequence
  chemically synthesized
agaaataaatgtattccttttc

SEQ ID NO: 942577 - DNA, 22 bp, Artificial Sequence
  chemically synthesized
gataattgaaagaaaaggaata

SEQ ID NO: 942578 - DNA, 22 bp, Artificial Sequence
  chemically synthesized
attgagaaataaatgtattcct

SEQ ID NO: 942579 - DNA, 22 bp, Artificial Sequence
  chemically synthesized
aaagaaaaggaatacatttatt

SEQ ID NO: 942580 - DNA, 22 bp, Artificial Sequence
  chemically synthesized
aacaaatactcattgagaaata

SEQ ID NO: 942581 - DNA, 22 bp, Artificial Sequence
  chemically synthesized
atttctcaatgagtatttgttc

SEQ ID NO: 942582 - DNA, 22 bp, Artificial Sequence
  chemically synthesized
tttctcaatgagtatttgttca

SEQ ID NO: 942583 - DNA, 22 bp, Artificial Sequence
  chemically synthesized
ctcaatgagtatttgttcaatc

SEQ ID NO: 942584 - DNA, 22 bp, Artificial Sequence
  chemically synthesized
tcaatgagtatttgttcaatcc

SEQ ID NO: 942585 - DNA, 22 bp, Artificial Sequence
  chemically synthesized
aatgagtatttgttcaatccat

SEQ ID NO: 942586 - DNA, 22 bp, Artificial Sequence
  chemically synthesized
aataaatcatgtatggattgaa

SEQ ID NO: 942587 - DNA, 22 bp, Artificial Sequence
  chemically synthesized
tctaaataaatcatgtatggat

SEQ ID NO: 942588 - DNA, 22 bp, Artificial Sequence
  chemically synthesized
gtctaaataaatcatgtatgga

SEQ ID NO: 942589 - DNA, 22 bp, Artificial Sequence
  chemically synthesized
gttcaatccatacatgatttat

SEQ ID NO: 942590 - DNA, 22 bp, Artificial Sequence
  chemically synthesized
ttcaatccatacatgatttatt

SEQ ID NO: 942591 - DNA, 22 bp, Artificial Sequence
  chemically synthesized
gatatttgtctaaataaatcat

SEQ ID NO: 942592 - DNA, 22 bp, Artificial Sequence
  chemically synthesized
aatccatacatgatttatttag

SEQ ID NO: 942593 - DNA, 22 bp, Artificial Sequence
  chemically synthesized
aaattagatatttgtctaaata

SEQ ID NO: 942594 - DNA, 22 bp, Artificial Sequence
  chemically synthesized
atttagacaaatatctaatttg

SEQ ID NO: 942595 - DNA, 22 bp, Artificial Sequence
  chemically synthesized
tttagacaaatatctaatttga

SEQ ID NO: 942596 - DNA, 22 bp, Artificial Sequence
  chemically synthesized
agacaaatatctaatttgaaca

SEQ ID NO: 942597 - DNA, 22 bp, Artificial Sequence
  chemically synthesized
gacaaatatctaatttgaacat

SEQ ID NO: 942598 - DNA, 22 bp, Artificial Sequence
  chemically synthesized
tagaaaccaaggggatgttcaa

SEQ ID NO: 942599 - DNA, 22 bp, Artificial Sequence
  chemically synthesized
taaattatagaaaccaagggga

SEQ ID NO: 942600 - DNA, 22 bp, Artificial Sequence
  chemically synthesized
atttgaacatccccttggtttc

SEQ ID NO: 942601 - DNA, 22 bp, Artificial Sequence
  chemically synthesized
gaacatccccttggtttctata

SEQ ID NO: 942602 - DNA, 22 bp, Artificial Sequence
  chemically synthesized
aacatccccttggtttctataa

SEQ ID NO: 942603 - DNA, 22 bp, Artificial Sequence
  chemically synthesized
taaatgatgttataaattatag

SEQ ID NO: 942604 - DNA, 22 bp, Artificial Sequence
  chemically synthesized
gtaaatgatgttataaattata

SEQ ID NO: 942605 - DNA, 22 bp, Artificial Sequence
  chemically synthesized
aacttgtaaatgatgttataaa

SEQ ID NO: 942606 - DNA, 22 bp, Artificial Sequence
  chemically synthesized
ggtttctataatttataacatc

SEQ ID NO: 942607 - DNA, 22 bp, Artificial Sequence
  chemically synthesized
gtttctataatttataacatca

SEQ ID NO: 942608 - DNA, 22 bp, Artificial Sequence
  chemically synthesized
aattgaacttgtaaatgatgtt

SEQ ID NO: 942609 - DNA, 22 bp, Artificial Sequence
  chemically synthesized
ctataatttataacatcattta

SEQ ID NO: 942610 - DNA, 22 bp, Artificial Sequence
  chemically synthesized
tataatttataacatcatttac

SEQ ID NO: 942611 - DNA, 22 bp, Artificial Sequence
  chemically synthesized
taatttataacatcatttacaa

SEQ ID NO: 942612 - DNA, 22 bp, Artificial Sequence
  chemically synthesized
ataacatcatttacaagttcaa

SEQ ID NO: 942613 - DNA, 22 bp, Artificial Sequence
  chemically synthesized
taacatcatttacaagttcaat

SEQ ID NO: 942614 - DNA, 22 bp, Artificial Sequence
  chemically synthesized
catatacattaaattgaacttg

SEQ ID NO: 942615 - DNA, 22 bp, Artificial Sequence
  chemically synthesized
ccatatacattaaattgaactt

SEQ ID NO: 942616 - DNA, 22 bp, Artificial Sequence
  chemically synthesized
tgatttccatatacattaaatt

SEQ ID NO: 942617 - DNA, 22 bp, Artificial Sequence
  chemically synthesized
acaagttcaatttaatgtatat

SEQ ID NO: 942618 - DNA, 22 bp, Artificial Sequence
  chemically synthesized
caagttcaatttaatgtatatg

SEQ ID NO: 942619 - DNA, 22 bp, Artificial Sequence
  chemically synthesized
atatgcactatgatttccatat

SEQ ID NO: 942620 - DNA, 22 bp, Artificial Sequence
  chemically synthesized
aatttaatgtatatggaaatca

SEQ ID NO: 942621 - DNA, 22 bp, Artificial Sequence
  chemically synthesized
aatgtatatggaaatcatagtg

SEQ ID NO: 942622 - DNA, 22 bp, Artificial Sequence
  chemically synthesized
atgtatatggaaatcatagtgc

SEQ ID NO: 942623 - DNA, 22 bp, Artificial Sequence
  chemically synthesized
aaaatagcaaaactgatatgca

SEQ ID NO: 942624 - DNA, 22 bp, Artificial Sequence
  chemically synthesized
aaaaatagcaaaactgatatgc

SEQ ID NO: 942625 - DNA, 22 bp, Artificial Sequence
  chemically synthesized
taaaaatagcaaaactgatatg

SEQ ID NO: 942626 - DNA, 22 bp, Artificial Sequence
  chemically synthesized
ttaaaaatagcaaaactgatat

SEQ ID NO: 942627 - DNA, 22 bp, Artificial Sequence
  chemically synthesized
ggaagcacttttaaaaatagca

SEQ ID NO: 942628 - DNA, 22 bp, Artificial Sequence
  chemically synthesized
attaggaagcacttttaaaaat

SEQ ID NO: 942629 - DNA, 22 bp, Artificial Sequence
  chemically synthesized
cattaggaagcacttttaaaaa

SEQ ID NO: 942630 - DNA, 22 bp, Artificial Sequence
  chemically synthesized
tcattaggaagcacttttaaaa

SEQ ID NO: 942631 - DNA, 22 bp, Artificial Sequence
  chemically synthesized
ttcattaggaagcacttttaaa

SEQ ID NO: 942632 - DNA, 22 bp, Artificial Sequence
  chemically synthesized
tgctatttttaaaagtgcttcc

SEQ ID NO: 942633 - DNA, 22 bp, Artificial Sequence
  chemically synthesized
gctatttttaaaagtgcttcct

SEQ ID NO: 942634 - DNA, 22 bp, Artificial Sequence
  chemically synthesized
ctatttttaaaagtgcttccta

SEQ ID NO: 942635 - DNA, 22 bp, Artificial Sequence
  chemically synthesized
tttttaaaagtgcttcctaatg

SEQ ID NO: 942636 - DNA, 22 bp, Artificial Sequence
  chemically synthesized
ttaaaagtgcttcctaatgaaa

SEQ ID NO: 942637 - DNA, 22 bp, Artificial Sequence
  chemically synthesized
taaaagtgcttcctaatgaaaa

SEQ ID NO: 942638 - DNA, 22 bp, Artificial Sequence
  chemically synthesized
aaatatcagaacttttcattag

SEQ ID NO: 942639 - DNA, 22 bp, Artificial Sequence
  chemically synthesized
aaaagtgcttcctaatgaaaag

SEQ ID NO: 942640 - DNA, 22 bp, Artificial Sequence
  chemically synthesized
aaagtgcttcctaatgaaaagt

SEQ ID NO: 942641 - DNA, 22 bp, Artificial Sequence
  chemically synthesized
tgaaatatcagaacttttcatt

SEQ ID NO: 942642 - DNA, 22 bp, Artificial Sequence
  chemically synthesized
ctgaaatatcagaacttttcat

SEQ ID NO: 942643 - DNA, 22 bp, Artificial Sequence
  chemically synthesized
tctgaaatatcagaacttttca

SEQ ID NO: 942644 - DNA, 22 bp, Artificial Sequence
  chemically synthesized
cctaatgaaaagttctgatatt

SEQ ID NO: 942645 - DNA, 22 bp, Artificial Sequence
  chemically synthesized
ctaatgaaaagttctgatattt

SEQ ID NO: 942646 - DNA, 22 bp, Artificial Sequence
  chemically synthesized
atgaaaagttctgatatttcag

SEQ ID NO: 942647 - DNA, 22 bp, Artificial Sequence
  chemically synthesized
tgtaagaatgtaaatgttttct

SEQ ID NO: 942648 - DNA, 22 bp, Artificial Sequence
  chemically synthesized
atgtaagaatgtaaatgttttc

SEQ ID NO: 942649 - DNA, 22 bp, Artificial Sequence
  chemically synthesized
tgatatttcagaaaacatttac

SEQ ID NO: 942650 - DNA, 22 bp, Artificial Sequence
  chemically synthesized
ttatgtaagaatgtaaatgttt

SEQ ID NO: 942651 - DNA, 22 bp, Artificial Sequence
  chemically synthesized
cttatgtaagaatgtaaatgtt

SEQ ID NO: 942652 - DNA, 22 bp, Artificial Sequence
  chemically synthesized
atatttcagaaaacatttacat

SEQ ID NO: 942653 - DNA, 22 bp, Artificial Sequence
  chemically synthesized
cttcttatgtaagaatgtaaat

SEQ ID NO: 942654 - DNA, 22 bp, Artificial Sequence
  chemically synthesized
cagaaaacatttacattcttac

SEQ ID NO: 942655 - DNA, 22 bp, Artificial Sequence
  chemically synthesized
actgcttcttatgtaagaatgt

SEQ ID NO: 942656 - DNA, 22 bp, Artificial Sequence
  chemically synthesized
agaaaacatttacattcttaca

SEQ ID NO: 942657 - DNA, 22 bp, Artificial Sequence
  chemically synthesized
aactgcttcttatgtaagaatg

SEQ ID NO: 942658 - DNA, 22 bp, Artificial Sequence
  chemically synthesized
tttaactgcttcttatgtaaga

SEQ ID NO: 942659 - DNA, 22 bp, Artificial Sequence
  chemically synthesized
ctatttaactgcttcttatgta

SEQ ID NO: 942660 - DNA, 22 bp, Artificial Sequence
  chemically synthesized
actatttaactgcttcttatgt

SEQ ID NO: 942661 - DNA, 22 bp, Artificial Sequence
  chemically synthesized
acattcttacataagaagcagt

SEQ ID NO: 942662 - DNA, 22 bp, Artificial Sequence
  chemically synthesized
cattcttacataagaagcagtt

SEQ ID NO: 942663 - DNA, 22 bp, Artificial Sequence
  chemically synthesized
ttacataagaagcagttaaata

SEQ ID NO: 942664 - DNA, 22 bp, Artificial Sequence
  chemically synthesized
atggaagtttactatttaactg

SEQ ID NO: 942665 - DNA, 22 bp, Artificial Sequence
  chemically synthesized
acataagaagcagttaaatagt

SEQ ID NO: 942666 - DNA, 22 bp, Artificial Sequence
  chemically synthesized
cataagaagcagttaaatagta

SEQ ID NO: 942667 - DNA, 22 bp, Artificial Sequence
  chemically synthesized
ctaatggaagtttactatttaa

SEQ ID NO: 942668 - DNA, 22 bp, Artificial Sequence
  chemically synthesized
actactaatggaagtttactat

SEQ ID NO: 942669 - DNA, 22 bp, Artificial Sequence
  chemically synthesized
attaactactaatggaagttta

SEQ ID NO: 942670 - DNA, 22 bp, Artificial Sequence
  chemically synthesized
aattaactactaatggaagttt

SEQ ID NO: 942671 - DNA, 22 bp, Artificial Sequence
  chemically synthesized
ttaattaactactaatggaagt

SEQ ID NO: 942672 - DNA, 22 bp, Artificial Sequence
  chemically synthesized
cttaattaactactaatggaag

SEQ ID NO: 942673 - DNA, 22 bp, Artificial Sequence
  chemically synthesized
aatagtaaacttccattagtag

SEQ ID NO: 942674 - DNA, 22 bp, Artificial Sequence
  chemically synthesized
ccattagtagttaattaagaag

SEQ ID NO: 942675 - DNA, 22 bp, Artificial Sequence
  chemically synthesized
cattagtagttaattaagaagc

SEQ ID NO: 942676 - DNA, 22 bp, Artificial Sequence
  chemically synthesized
gtagttaattaagaagcattat

SEQ ID NO: 942677 - DNA, 22 bp, Artificial Sequence
  chemically synthesized
attaagaagcattatatcactc

SEQ ID NO: 942678 - DNA, 22 bp, Artificial Sequence
  chemically synthesized
acaaatatagaagagtgatata

SEQ ID NO: 942679 - DNA, 22 bp, Artificial Sequence
  chemically synthesized
agaagcattatatcactcttct

SEQ ID NO: 942680 - DNA, 22 bp, Artificial Sequence
  chemically synthesized
catacactaacaaatatagaag

SEQ ID NO: 942681 - DNA, 22 bp, Artificial Sequence
  chemically synthesized
tatcactcttctatatttgtta

SEQ ID NO: 942682 - DNA, 22 bp, Artificial Sequence
  chemically synthesized
atgttacatacactaacaaata

SEQ ID NO: 942683 - DNA, 22 bp, Artificial Sequence
  chemically synthesized
attcatgttacatacactaaca

SEQ ID NO: 942684 - DNA, 22 bp, Artificial Sequence
  chemically synthesized
gattcatgttacatacactaac

SEQ ID NO: 942685 - DNA, 22 bp, Artificial Sequence
  chemically synthesized
tgattcatgttacatacactaa

SEQ ID NO: 942686 - DNA, 22 bp, Artificial Sequence
  chemically synthesized
ttctatatttgttagtgtatgt

SEQ ID NO: 942687 - DNA, 22 bp, Artificial Sequence
  chemically synthesized
ctatatttgttagtgtatgtaa

SEQ ID NO: 942688 - DNA, 22 bp, Artificial Sequence
  chemically synthesized
tatatttgttagtgtatgtaac

SEQ ID NO: 942689 - DNA, 22 bp, Artificial Sequence
  chemically synthesized
tatttgttagtgtatgtaacat

SEQ ID NO: 942690 - DNA, 22 bp, Artificial Sequence
  chemically synthesized
aggtggctttgattcatgttac

SEQ ID NO: 942691 - DNA, 22 bp, Artificial Sequence
  chemically synthesized
caggtggctttgattcatgtta

SEQ ID NO: 942692 - DNA, 22 bp, Artificial Sequence
  chemically synthesized
gttagtgtatgtaacatgaatc

SEQ ID NO: 942693 - DNA, 22 bp, Artificial Sequence
  chemically synthesized
ttagtgtatgtaacatgaatca

SEQ ID NO: 942694 - DNA, 22 bp, Artificial Sequence
  chemically synthesized
cttcaggtggctttgattcatg

SEQ ID NO: 942695 - DNA, 22 bp, Artificial Sequence
  chemically synthesized
gtgtatgtaacatgaatcaaag

SEQ ID NO: 942696 - DNA, 22 bp, Artificial Sequence
  chemically synthesized
tgaccccatgaattacttcagg

SEQ ID NO: 942697 - DNA, 22 bp, Artificial Sequence
  chemically synthesized
aaagtgcacgttatgaccccat

SEQ ID NO: 942698 - DNA, 22 bp, Artificial Sequence
  chemically synthesized
aagtaattcatggggtcataac

SEQ ID NO: 942699 - DNA, 22 bp, Artificial Sequence
  chemically synthesized
atggggtcataacgtgcacttt

SEQ ID NO: 942700 - DNA, 22 bp, Artificial Sequence
  chemically synthesized
aataacatgcatcatacactaa

SEQ ID NO: 942701 - DNA, 22 bp, Artificial Sequence
  chemically synthesized
aaattaaataacatgcatcata

SEQ ID NO: 942702 - DNA, 22 bp, Artificial Sequence
  chemically synthesized
attgaaattaaataacatgcat

SEQ ID NO: 942703 - DNA, 22 bp, Artificial Sequence
  chemically synthesized
aattgaaattaaataacatgca

SEQ ID NO: 942704 - DNA, 22 bp, Artificial Sequence
  chemically synthesized
ttagtgtatgatgcatgttatt

SEQ ID NO: 942705 - DNA, 22 bp, Artificial Sequence
  chemically synthesized
taattgaaattaaataacatgc

SEQ ID NO: 942706 - DNA, 22 bp, Artificial Sequence
  chemically synthesized
tagtgtatgatgcatgttattt

SEQ ID NO: 942707 - DNA, 22 bp, Artificial Sequence
  chemically synthesized
agtgtatgatgcatgttattta

SEQ ID NO: 942708 - DNA, 22 bp, Artificial Sequence
  chemically synthesized
gtgtatgatgcatgttatttaa

SEQ ID NO: 942709 - DNA, 22 bp, Artificial Sequence
  chemically synthesized
attttaattgaaattaaataac

SEQ ID NO: 942710 - DNA, 22 bp, Artificial Sequence
  chemically synthesized
cattttaattgaaattaaataa

SEQ ID NO: 942711 - DNA, 22 bp, Artificial Sequence
  chemically synthesized
aaacttcattttaattgaaatt

SEQ ID NO: 942712 - DNA, 22 bp, Artificial Sequence
  chemically synthesized
tttaatttcaattaaaatgaag

SEQ ID NO: 942713 - DNA, 22 bp, Artificial Sequence
  chemically synthesized
aatttcaattaaaatgaagttt

SEQ ID NO: 942714 - DNA, 22 bp, Artificial Sequence
  chemically synthesized
atttcaattaaaatgaagtttc

SEQ ID NO: 942715 - DNA, 22 bp, Artificial Sequence
  chemically synthesized
tgtgaagaacaactgaaacttc

SEQ ID NO: 942716 - DNA, 22 bp, Artificial Sequence
  chemically synthesized
caattaaaatgaagtttcagtt

SEQ ID NO: 942717 - DNA, 22 bp, Artificial Sequence
  chemically synthesized
aattaaaatgaagtttcagttg

SEQ ID NO: 942718 - DNA, 22 bp, Artificial Sequence
  chemically synthesized
aaatgaagtttcagttgttctt

SEQ ID NO: 942719 - DNA, 22 bp, Artificial Sequence
  chemically synthesized
agggaaaaaggcctgtgtgaag

SEQ ID NO: 942720 - DNA, 22 bp, Artificial Sequence
  chemically synthesized
ttaagggaaaaaggcctgtgtg

SEQ ID NO: 942721 - DNA, 22 bp, Artificial Sequence
  chemically synthesized
cagttgttcttcacacaggcct

SEQ ID NO: 942722 - DNA, 22 bp, Artificial Sequence
  chemically synthesized
agttgttcttcacacaggcctt

SEQ ID NO: 942723 - DNA, 22 bp, Artificial Sequence
  chemically synthesized
tattattaagggaaaaaggcct

SEQ ID NO: 942724 - DNA, 22 bp, Artificial Sequence
  chemically synthesized
ttcttcacacaggcctttttcc

SEQ ID NO: 942725 - DNA, 22 bp, Artificial Sequence
  chemically synthesized
ttcacacaggcctttttccctt

SEQ ID NO: 942726 - DNA, 22 bp, Artificial Sequence
  chemically synthesized
cacacaggcctttttcccttaa

SEQ ID NO: 942727 - DNA, 22 bp, Artificial Sequence
  chemically synthesized
acacaggcctttttcccttaat

SEQ ID NO: 942728 - DNA, 22 bp, Artificial Sequence
  chemically synthesized
tggaaatgaatctgtattatta

SEQ ID NO: 942729 - DNA, 22 bp, Artificial Sequence
  chemically synthesized
tttcccttaataatacagattc

SEQ ID NO: 942730 - DNA, 22 bp, Artificial Sequence
  chemically synthesized
ttcccttaataatacagattca

SEQ ID NO: 942731 - DNA, 22 bp, Artificial Sequence
  chemically synthesized
tcccttaataatacagattcat

SEQ ID NO: 942732 - DNA, 22 bp, Artificial Sequence
  chemically synthesized
cccttaataatacagattcatt

SEQ ID NO: 942733 - DNA, 22 bp, Artificial Sequence
  chemically synthesized
aagtattatggaaatgaatctg

SEQ ID NO: 942734 - DNA, 22 bp, Artificial Sequence
  chemically synthesized
ccttaataatacagattcattt

SEQ ID NO: 942735 - DNA, 22 bp, Artificial Sequence
  chemically synthesized
aataatacagattcatttccat

SEQ ID NO: 942736 - DNA, 22 bp, Artificial Sequence
  chemically synthesized
ataatacagattcatttccata

SEQ ID NO: 942737 - DNA, 22 bp, Artificial Sequence
  chemically synthesized
atttccataatactttaggtga

SEQ ID NO: 942738 - DNA, 22 bp, Artificial Sequence
  chemically synthesized
ccataatactttaggtgatatg

SEQ ID NO: 942739 - DNA, 22 bp, Artificial Sequence
  chemically synthesized
cataatactttaggtgatatgt

SEQ ID NO: 942740 - DNA, 22 bp, Artificial Sequence
  chemically synthesized
tgtatcatacaatcatacatat

SEQ ID NO: 942741 - DNA, 22 bp, Artificial Sequence
  chemically synthesized
ttatgtatcatacaatcataca

SEQ ID NO: 942742 - DNA, 22 bp, Artificial Sequence
  chemically synthesized
taggtgatatgtatgattgtat

SEQ ID NO: 942743 - DNA, 22 bp, Artificial Sequence
  chemically synthesized
aggtgatatgtatgattgtatg

SEQ ID NO: 942744 - DNA, 22 bp, Artificial Sequence
  chemically synthesized
ggtgatatgtatgattgtatga

SEQ ID NO: 942745 - DNA, 22 bp, Artificial Sequence
  chemically synthesized
aaaacctattatgtatcataca

SEQ ID NO: 942746 - DNA, 22 bp, Artificial Sequence
  chemically synthesized
aaaatgctaaaaacctattatg

SEQ ID NO: 942747 - DNA, 22 bp, Artificial Sequence
  chemically synthesized
tatgatacataataggttttta

SEQ ID NO: 942748 - DNA, 22 bp, Artificial Sequence
  chemically synthesized
tattaaaaatgctaaaaaccta

SEQ ID NO: 942749 - DNA, 22 bp, Artificial Sequence
  chemically synthesized
gatatgtagagttgtattaaaa

SEQ ID NO: 942750 - DNA, 22 bp, Artificial Sequence
  chemically synthesized
ctggatatgtagagttgtatta

SEQ ID NO: 942751 - DNA, 22 bp, Artificial Sequence
  chemically synthesized
ttagcatttttaatacaactct

SEQ ID NO: 942752 - DNA, 22 bp, Artificial Sequence
  chemically synthesized
tagcatttttaatacaactcta

SEQ ID NO: 942753 - DNA, 22 bp, Artificial Sequence
  chemically synthesized
agcatttttaatacaactctac

SEQ ID NO: 942754 - DNA, 22 bp, Artificial Sequence
  chemically synthesized
gcatttttaatacaactctaca

SEQ ID NO: 942755 - DNA, 22 bp, Artificial Sequence
  chemically synthesized
gattcctggatatgtagagttg

SEQ ID NO: 942756 - DNA, 22 bp, Artificial Sequence
  chemically synthesized
ggattcctggatatgtagagtt

SEQ ID NO: 942757 - DNA, 22 bp, Artificial Sequence
  chemically synthesized
ttaatacaactctacatatcca

SEQ ID NO: 942758 - DNA, 22 bp, Artificial Sequence
  chemically synthesized
taatacaactctacatatccag

SEQ ID NO: 942759 - DNA, 22 bp, Artificial Sequence
  chemically synthesized
aatacaactctacatatccagg

SEQ ID NO: 942760 - DNA, 22 bp, Artificial Sequence
  chemically synthesized
atacaactctacatatccagga

SEQ ID NO: 942761 - DNA, 22 bp, Artificial Sequence
  chemically synthesized
caatgcttggattcctggatat

SEQ ID NO: 942762 - DNA, 22 bp, Artificial Sequence
  chemically synthesized
ccaatgcttggattcctggata

SEQ ID NO: 942763 - DNA, 22 bp, Artificial Sequence
  chemically synthesized
tacatatccaggaatccaagca

SEQ ID NO: 942764 - DNA, 22 bp, Artificial Sequence
  chemically synthesized
catatccaggaatccaagcatt

SEQ ID NO: 942765 - DNA, 22 bp, Artificial Sequence
  chemically synthesized
gtcgaggcccaaggggtcaatt

SEQ ID NO: 942766 - DNA, 22 bp, Artificial Sequence
  chemically synthesized
ggtcgaggcccaaggggtcaat

SEQ ID NO: 942767 - DNA, 22 bp, Artificial Sequence
  chemically synthesized
atttggtcgaggcccaaggggt

SEQ ID NO: 942768 - DNA, 22 bp, Artificial Sequence
  chemically synthesized
gatttggtcgaggcccaagggg

SEQ ID NO: 942769 - DNA, 22 bp, Artificial Sequence
  chemically synthesized
gaaattgaccccttgggcctcg

SEQ ID NO: 942770 - DNA, 22 bp, Artificial Sequence
  chemically synthesized
acgtacttgatttggtcgaggc

SEQ ID NO: 942771 - DNA, 22 bp, Artificial Sequence
  chemically synthesized
accccttgggcctcgaccaaat

SEQ ID NO: 942772 - DNA, 22 bp, Artificial Sequence
  chemically synthesized
tctcacgtacttgatttggtcg

SEQ ID NO: 942773 - DNA, 22 bp, Artificial Sequence
  chemically synthesized
gtctcacgtacttgatttggtc

SEQ ID NO: 942774 - DNA, 22 bp, Artificial Sequence
  chemically synthesized
gggcctcgaccaaatcaagtac

SEQ ID NO: 942775 - DNA, 22 bp, Artificial Sequence
  chemically synthesized
ggcctcgaccaaatcaagtacg

SEQ ID NO: 942776 - DNA, 22 bp, Artificial Sequence
  chemically synthesized
atatttgtctcacgtacttgat

SEQ ID NO: 942777 - DNA, 22 bp, Artificial Sequence
  chemically synthesized
gaccaaatcaagtacgtgagac

SEQ ID NO: 942778 - DNA, 22 bp, Artificial Sequence
  chemically synthesized
taccgaaggctcatatttgtct

SEQ ID NO: 942779 - DNA, 22 bp, Artificial Sequence
  chemically synthesized
gttgtaccgaaggctcatattt

SEQ ID NO: 942780 - DNA, 22 bp, Artificial Sequence
  chemically synthesized
tagttgtaccgaaggctcatat

SEQ ID NO: 942781 - DNA, 22 bp, Artificial Sequence
  chemically synthesized
ctctagttgtaccgaaggctca

SEQ ID NO: 942782 - DNA, 22 bp, Artificial Sequence
  chemically synthesized
gaataaaataaatctactctag

SEQ ID NO: 942783 - DNA, 22 bp, Artificial Sequence
  chemically synthesized
cggtacaactagagtagattta

SEQ ID NO: 942784 - DNA, 22 bp, Artificial Sequence
  chemically synthesized
ggtacaactagagtagatttat

SEQ ID NO: 942785 - DNA, 22 bp, Artificial Sequence
  chemically synthesized
gagtagatttattttattccaa

SEQ ID NO: 942786 - DNA, 22 bp, Artificial Sequence
  chemically synthesized
aagggagcataatggttggaat

SEQ ID NO: 942787 - DNA, 22 bp, Artificial Sequence
  chemically synthesized
attttattccaaccattatgct

SEQ ID NO: 942788 - DNA, 22 bp, Artificial Sequence
  chemically synthesized
ttttattccaaccattatgctc

SEQ ID NO: 942789 - DNA, 22 bp, Artificial Sequence
  chemically synthesized
tattccaaccattatgctccct

SEQ ID NO: 942790 - DNA, 22 bp, Artificial Sequence
  chemically synthesized
attccaaccattatgctccctt

SEQ ID NO: 942791 - DNA, 22 bp, Artificial Sequence
  chemically synthesized
ttccaaccattatgctcccttt

SEQ ID NO: 942792 - DNA, 22 bp, Artificial Sequence
  chemically synthesized
caaccattatgctccctttagc

SEQ ID NO: 942793 - DNA, 22 bp, Artificial Sequence
  chemically synthesized
ccaggtcataatatgtgacagc

SEQ ID NO: 942794 - DNA, 22 bp, Artificial Sequence
  chemically synthesized
tgctccctttagctgtcacata

SEQ ID NO: 942795 - DNA, 22 bp, Artificial Sequence
  chemically synthesized
cccaggtcataatatgtgacag

SEQ ID NO: 942796 - DNA, 22 bp, Artificial Sequence
  chemically synthesized
tcccaggtcataatatgtgaca

SEQ ID NO: 942797 - DNA, 22 bp, Artificial Sequence
  chemically synthesized
ttcccaggtcataatatgtgac

SEQ ID NO: 942798 - DNA, 22 bp, Artificial Sequence
  chemically synthesized
cctttagctgtcacatattatg

SEQ ID NO: 942799 - DNA, 22 bp, Artificial Sequence
  chemically synthesized
tagctgtcacatattatgacct

SEQ ID NO: 942800 - DNA, 22 bp, Artificial Sequence
  chemically synthesized
gcaacttttcccaggtcataat

SEQ ID NO: 942801 - DNA, 22 bp, Artificial Sequence
  chemically synthesized
agctgtcacatattatgacctg

SEQ ID NO: 942802 - DNA, 22 bp, Artificial Sequence
  chemically synthesized
gctgtcacatattatgacctgg

SEQ ID NO: 942803 - DNA, 22 bp, Artificial Sequence
  chemically synthesized
tcacatattatgacctgggaaa

SEQ ID NO: 942804 - DNA, 22 bp, Artificial Sequence
  chemically synthesized
tagagaagttagcaacttttcc

SEQ ID NO: 942805 - DNA, 22 bp, Artificial Sequence
  chemically synthesized
tgacctgggaaaagttgctaac

SEQ ID NO: 942806 - DNA, 22 bp, Artificial Sequence
  chemically synthesized
tactatagagaagttagcaact

SEQ ID NO: 942807 - DNA, 22 bp, Artificial Sequence
  chemically synthesized
ggaaaagttgctaacttctcta

SEQ ID NO: 942808 - DNA, 22 bp, Artificial Sequence
  chemically synthesized
tcaggtgagaaaactgtactat

SEQ ID NO: 942809 - DNA, 22 bp, Artificial Sequence
  chemically synthesized
ctaacttctctatagtacagtt

SEQ ID NO: 942810 - DNA, 22 bp, Artificial Sequence
  chemically synthesized
atcaggtgagaaaactgtacta

SEQ ID NO: 942811 - DNA, 22 bp, Artificial Sequence
  chemically synthesized
acttctctatagtacagttttc

SEQ ID NO: 942812 - DNA, 22 bp, Artificial Sequence
  chemically synthesized
cttatcaggtgagaaaactgta

SEQ ID NO: 942813 - DNA, 22 bp, Artificial Sequence
  chemically synthesized
gcttatcaggtgagaaaactgt

SEQ ID NO: 942814 - DNA, 22 bp, Artificial Sequence
  chemically synthesized
ctctatagtacagttttctcac

SEQ ID NO: 942815 - DNA, 22 bp, Artificial Sequence
  chemically synthesized
cttgcttatcaggtgagaaaac

SEQ ID NO: 942816 - DNA, 22 bp, Artificial Sequence
  chemically synthesized
tctatagtacagttttctcacc

SEQ ID NO: 942817 - DNA, 22 bp, Artificial Sequence
  chemically synthesized
tatagtacagttttctcacctg

SEQ ID NO: 942818 - DNA, 22 bp, Artificial Sequence
  chemically synthesized
tagtacagttttctcacctgat

SEQ ID NO: 942819 - DNA, 22 bp, Artificial Sequence
  chemically synthesized
tctcacctgataagcaaggagg

SEQ ID NO: 942820 - DNA, 22 bp, Artificial Sequence
  chemically synthesized
ctcacctgataagcaaggagga

SEQ ID NO: 942821 - DNA, 22 bp, Artificial Sequence
  chemically synthesized
tcacctgataagcaaggaggat

SEQ ID NO: 942822 - DNA, 22 bp, Artificial Sequence
  chemically synthesized
acctgataagcaaggaggatcc

SEQ ID NO: 942823 - DNA, 22 bp, Artificial Sequence
  chemically synthesized
ggaggtagaaggtagggatcct

SEQ ID NO: 942824 - DNA, 22 bp, Artificial Sequence
  chemically synthesized
ataagcaaggaggatccctacc

SEQ ID NO: 942825 - DNA, 22 bp, Artificial Sequence
  chemically synthesized
tgggaggtagaaggtagggatc

SEQ ID NO: 942826 - DNA, 22 bp, Artificial Sequence
  chemically synthesized
ataatcacatcagctctgggag

SEQ ID NO: 942827 - DNA, 22 bp, Artificial Sequence
  chemically synthesized
aataatcacatcagctctggga

SEQ ID NO: 942828 - DNA, 22 bp, Artificial Sequence
  chemically synthesized
taataatcacatcagctctggg

SEQ ID NO: 942829 - DNA, 22 bp, Artificial Sequence
  chemically synthesized
ttaataatcacatcagctctgg

SEQ ID NO: 942830 - DNA, 22 bp, Artificial Sequence
  chemically synthesized
ccttctacctcccagagctgat

SEQ ID NO: 942831 - DNA, 22 bp, Artificial Sequence
  chemically synthesized
gcttttaataatcacatcagct

SEQ ID NO: 942832 - DNA, 22 bp, Artificial Sequence
  chemically synthesized
ctacctcccagagctgatgtga

SEQ ID NO: 942833 - DNA, 22 bp, Artificial Sequence
  chemically synthesized
tacctcccagagctgatgtgat

SEQ ID NO: 942834 - DNA, 22 bp, Artificial Sequence
  chemically synthesized
cctcccagagctgatgtgatta

SEQ ID NO: 942835 - DNA, 22 bp, Artificial Sequence
  chemically synthesized
actggcttttaataatcacatc

SEQ ID NO: 942836 - DNA, 22 bp, Artificial Sequence
  chemically synthesized
taactggcttttaataatcaca

SEQ ID NO: 942837 - DNA, 22 bp, Artificial Sequence
  chemically synthesized
ccagagctgatgtgattattaa

SEQ ID NO: 942838 - DNA, 22 bp, Artificial Sequence
  chemically synthesized
atgtgattattaaaagccagtt

SEQ ID NO: 942839 - DNA, 22 bp, Artificial Sequence
  chemically synthesized
tgtgaagattctaactggcttt

SEQ ID NO: 942840 - DNA, 22 bp, Artificial Sequence
  chemically synthesized
ctatgtgaagattctaactggc

SEQ ID NO: 942841 - DNA, 22 bp, Artificial Sequence
  chemically synthesized
actatgtgaagattctaactgg

SEQ ID NO: 942842 - DNA, 22 bp, Artificial Sequence
  chemically synthesized
ttaaaagccagttagaatcttc

SEQ ID NO: 942843 - DNA, 22 bp, Artificial Sequence
  chemically synthesized
aacacttactatgtgaagattc

SEQ ID NO: 942844 - DNA, 22 bp, Artificial Sequence
  chemically synthesized
aaagccagttagaatcttcaca

SEQ ID NO: 942845 - DNA, 22 bp, Artificial Sequence
  chemically synthesized
ttgaacacttactatgtgaaga

SEQ ID NO: 942846 - DNA, 22 bp, Artificial Sequence
  chemically synthesized
attgaacacttactatgtgaag

SEQ ID NO: 942847 - DNA, 22 bp, Artificial Sequence
  chemically synthesized
gaatcttcacatagtaagtgtt

SEQ ID NO: 942848 - DNA, 22 bp, Artificial Sequence
  chemically synthesized
cacatagtaagtgttcaataaa

SEQ ID NO: 942849 - DNA, 22 bp, Artificial Sequence
  chemically synthesized
acatagtaagtgttcaataaac

SEQ ID NO: 942850 - DNA, 22 bp, Artificial Sequence
  chemically synthesized
gtaatagtaatggcaagtgttt

SEQ ID NO: 942851 - DNA, 22 bp, Artificial Sequence
  chemically synthesized
ctagtaatagtaatggcaagtg

SEQ ID NO: 942852 - DNA, 22 bp, Artificial Sequence
  chemically synthesized
aataaacacttgccattactat

SEQ ID NO: 942853 - DNA, 22 bp, Artificial Sequence
  chemically synthesized
gtgtgttactagtaatagtaat

SEQ ID NO: 942854 - DNA, 22 bp, Artificial Sequence
  chemically synthesized
cgtgtgttactagtaatagtaa

SEQ ID NO: 942855 - DNA, 22 bp, Artificial Sequence
  chemically synthesized
ttcgtgtgttactagtaatagt

SEQ ID NO: 942856 - DNA, 22 bp, Artificial Sequence
  chemically synthesized
gccattactattactagtaaca

SEQ ID NO: 942857 - DNA, 22 bp, Artificial Sequence
  chemically synthesized
ccattactattactagtaacac

SEQ ID NO: 942858 - DNA, 22 bp, Artificial Sequence
  chemically synthesized
agggttcttcgtgtgttactag

SEQ ID NO: 942859 - DNA, 22 bp, Artificial Sequence
  chemically synthesized
cagggttcttcgtgtgttacta

SEQ ID NO: 942860 - DNA, 22 bp, Artificial Sequence
  chemically synthesized
tcagggttcttcgtgtgttact

SEQ ID NO: 942861 - DNA, 22 bp, Artificial Sequence
  chemically synthesized
tttcagggttcttcgtgtgtta

SEQ ID NO: 942862 - DNA, 22 bp, Artificial Sequence
  chemically synthesized
ctattactagtaacacacgaag

SEQ ID NO: 942863 - DNA, 22 bp, Artificial Sequence
  chemically synthesized
ttactagtaacacacgaagaac

SEQ ID NO: 942864 - DNA, 22 bp, Artificial Sequence
  chemically synthesized
tgttctttcagggttcttcgtg

SEQ ID NO: 942865 - DNA, 22 bp, Artificial Sequence
  chemically synthesized
atgttctttcagggttcttcgt

SEQ ID NO: 942866 - DNA, 22 bp, Artificial Sequence
  chemically synthesized
ctagtaacacacgaagaaccct

SEQ ID NO: 942867 - DNA, 22 bp, Artificial Sequence
  chemically synthesized
acttatgttctttcagggttct

SEQ ID NO: 942868 - DNA, 22 bp, Artificial Sequence
  chemically synthesized
gtaacacacgaagaaccctgaa

SEQ ID NO: 942869 - DNA, 22 bp, Artificial Sequence
  chemically synthesized
cacttatgttctttcagggttc

SEQ ID NO: 942870 - DNA, 22 bp, Artificial Sequence
  chemically synthesized
accttcacttatgttctttcag

SEQ ID NO: 942871 - DNA, 22 bp, Artificial Sequence
  chemically synthesized
tgaccttcacttatgttctttc

SEQ ID NO: 942872 - DNA, 22 bp, Artificial Sequence
  chemically synthesized
ctgaccttcacttatgttcttt

SEQ ID NO: 942873 - DNA, 22 bp, Artificial Sequence
  chemically synthesized
tcttctgaccttcacttatgtt

SEQ ID NO: 942874 - DNA, 22 bp, Artificial Sequence
  chemically synthesized
gtcttctgaccttcacttatgt

SEQ ID NO: 942875 - DNA, 22 bp, Artificial Sequence
  chemically synthesized
caccttgtcttctgaccttcac

SEQ ID NO: 942876 - DNA, 22 bp, Artificial Sequence
  chemically synthesized
aaagaacataagtgaaggtcag

SEQ ID NO: 942877 - DNA, 22 bp, Artificial Sequence
  chemically synthesized
ataatagtctccaccttgtctt

SEQ ID NO: 942878 - DNA, 22 bp, Artificial Sequence
  chemically synthesized
cataatagtctccaccttgtct

SEQ ID NO: 942879 - DNA, 22 bp, Artificial Sequence
  chemically synthesized
tcataatagtctccaccttgtc

SEQ ID NO: 942880 - DNA, 22 bp, Artificial Sequence
  chemically synthesized
aacattttcataatagtctcca

SEQ ID NO: 942881 - DNA, 22 bp, Artificial Sequence
  chemically synthesized
taaacattttcataatagtctc

SEQ ID NO: 942882 - DNA, 22 bp, Artificial Sequence
  chemically synthesized
ctaaacattttcataatagtct

SEQ ID NO: 942883 - DNA, 22 bp, Artificial Sequence
  chemically synthesized
tctaaacattttcataatagtc

SEQ ID NO: 942884 - DNA, 22 bp, Artificial Sequence
  chemically synthesized
ttctaaacattttcataatagt

SEQ ID NO: 942885 - DNA, 22 bp, Artificial Sequence
  chemically synthesized
gaacttttctaaacattttcat

SEQ ID NO: 942886 - DNA, 22 bp, Artificial Sequence
  chemically synthesized
acccaactagaacttttctaaa

SEQ ID NO: 942887 - DNA, 22 bp, Artificial Sequence
  chemically synthesized
ttatgaaaatgtttagaaaagt

SEQ ID NO: 942888 - DNA, 22 bp, Artificial Sequence
  chemically synthesized
tgacccaactagaacttttcta

SEQ ID NO: 942889 - DNA, 22 bp, Artificial Sequence
  chemically synthesized
tgaaaatgtttagaaaagttct

SEQ ID NO: 942890 - DNA, 22 bp, Artificial Sequence
  chemically synthesized
atctctgacccaactagaactt

SEQ ID NO: 942891 - DNA, 22 bp, Artificial Sequence
  chemically synthesized
aatctctgacccaactagaact

SEQ ID NO: 942892 - DNA, 22 bp, Artificial Sequence
  chemically synthesized
taatctctgacccaactagaac

SEQ ID NO: 942893 - DNA, 22 bp, Artificial Sequence
  chemically synthesized
atctttaatctctgacccaact

SEQ ID NO: 942894 - DNA, 22 bp, Artificial Sequence
  chemically synthesized
agaaaagttctagttgggtcag

SEQ ID NO: 942895 - DNA, 22 bp, Artificial Sequence
  chemically synthesized
aatctttaatctctgacccaac

SEQ ID NO: 942896 - DNA, 22 bp, Artificial Sequence
  chemically synthesized
gaaaagttctagttgggtcaga

SEQ ID NO: 942897 - DNA, 22 bp, Artificial Sequence
  chemically synthesized
taatctttaatctctgacccaa

SEQ ID NO: 942898 - DNA, 22 bp, Artificial Sequence
  chemically synthesized
aacgttttaatctttaatctct

SEQ ID NO: 942899 - DNA, 22 bp, Artificial Sequence
  chemically synthesized
tagttgggtcagagattaaaga

SEQ ID NO: 942900 - DNA, 22 bp, Artificial Sequence
  chemically synthesized
gttgggtcagagattaaagatt

SEQ ID NO: 942901 - DNA, 22 bp, Artificial Sequence
  chemically synthesized
ggtcagagattaaagattaaaa

SEQ ID NO: 942902 - DNA, 22 bp, Artificial Sequence
  chemically synthesized
agtgggtctaaacgttttaatc

SEQ ID NO: 942903 - DNA, 22 bp, Artificial Sequence
  chemically synthesized
attaagtgggtctaaacgtttt

SEQ ID NO: 942904 - DNA, 22 bp, Artificial Sequence
  chemically synthesized
aattaagtgggtctaaacgttt

SEQ ID NO: 942905 - DNA, 22 bp, Artificial Sequence
  chemically synthesized
taattaagtgggtctaaacgtt

SEQ ID NO: 942906 - DNA, 22 bp, Artificial Sequence
  chemically synthesized
ttaattaagtgggtctaaacgt

SEQ ID NO: 942907 - DNA, 22 bp, Artificial Sequence
  chemically synthesized
aagattaaaacgtttagaccca

SEQ ID NO: 942908 - DNA, 22 bp, Artificial Sequence
  chemically synthesized
tcttttaattaagtgggtctaa

SEQ ID NO: 942909 - DNA, 22 bp, Artificial Sequence
  chemically synthesized
gtcttttaattaagtgggtcta

SEQ ID NO: 942910 - DNA, 22 bp, Artificial Sequence
  chemically synthesized
aaacgtttagacccacttaatt

SEQ ID NO: 942911 - DNA, 22 bp, Artificial Sequence
  chemically synthesized
aaatttgtcttttaattaagtg

SEQ ID NO: 942912 - DNA, 22 bp, Artificial Sequence
  chemically synthesized
agacccacttaattaaaagaca

SEQ ID NO: 942913 - DNA, 22 bp, Artificial Sequence
  chemically synthesized
gacccacttaattaaaagacaa

SEQ ID NO: 942914 - DNA, 22 bp, Artificial Sequence
  chemically synthesized
atatgttaaaatttgtctttta

SEQ ID NO: 942915 - DNA, 22 bp, Artificial Sequence
  chemically synthesized
ctaatatgttaaaatttgtctt

SEQ ID NO: 942916 - DNA, 22 bp, Artificial Sequence
  chemically synthesized
ttactaatatgttaaaatttgt

SEQ ID NO: 942917 - DNA, 22 bp, Artificial Sequence
  chemically synthesized
attactaatatgttaaaatttg

SEQ ID NO: 942918 - DNA, 22 bp, Artificial Sequence
  chemically synthesized
aattaaaagacaaattttaaca

SEQ ID NO: 942919 - DNA, 22 bp, Artificial Sequence
  chemically synthesized
attaaaagacaaattttaacat

SEQ ID NO: 942920 - DNA, 22 bp, Artificial Sequence
  chemically synthesized
aaagacaaattttaacatatta

SEQ ID NO: 942921 - DNA, 22 bp, Artificial Sequence
  chemically synthesized
atatgaggcttattactaatat

SEQ ID NO: 942922 - DNA, 22 bp, Artificial Sequence
  chemically synthesized
taacatattagtaataagcctc

SEQ ID NO: 942923 - DNA, 22 bp, Artificial Sequence
  chemically synthesized
aacatattagtaataagcctca

SEQ ID NO: 942924 - DNA, 22 bp, Artificial Sequence
  chemically synthesized
gtagtactaatatgaggcttat

SEQ ID NO: 942925 - DNA, 22 bp, Artificial Sequence
  chemically synthesized
acatattagtaataagcctcat

SEQ ID NO: 942926 - DNA, 22 bp, Artificial Sequence
  chemically synthesized
agtagtactaatatgaggctta

SEQ ID NO: 942927 - DNA, 22 bp, Artificial Sequence
  chemically synthesized
gtaataagcctcatattagtac

SEQ ID NO: 942928 - DNA, 22 bp, Artificial Sequence
  chemically synthesized
agtatgcttagtagtactaata

SEQ ID NO: 942929 - DNA, 22 bp, Artificial Sequence
  chemically synthesized
gagtatgcttagtagtactaat

SEQ ID NO: 942930 - DNA, 22 bp, Artificial Sequence
  chemically synthesized
tgagtatgcttagtagtactaa

SEQ ID NO: 942931 - DNA, 22 bp, Artificial Sequence
  chemically synthesized
ttttgagtatgcttagtagtac

SEQ ID NO: 942932 - DNA, 22 bp, Artificial Sequence
  chemically synthesized
cctattttgagtatgcttagta

SEQ ID NO: 942933 - DNA, 22 bp, Artificial Sequence
  chemically synthesized
acctattttgagtatgcttagt

SEQ ID NO: 942934 - DNA, 22 bp, Artificial Sequence
  chemically synthesized
atattagtactactaagcatac

SEQ ID NO: 942935 - DNA, 22 bp, Artificial Sequence
  chemically synthesized
gtactactaagcatactcaaaa

SEQ ID NO: 942936 - DNA, 22 bp, Artificial Sequence
  chemically synthesized
agtagtcttacctattttgagt

SEQ ID NO: 942937 - DNA, 22 bp, Artificial Sequence
  chemically synthesized
cagtagtcttacctattttgag

SEQ ID NO: 942938 - DNA, 22 bp, Artificial Sequence
  chemically synthesized
ctaagcatactcaaaataggta

SEQ ID NO: 942939 - DNA, 22 bp, Artificial Sequence
  chemically synthesized
ccttcagtagtcttacctattt

SEQ ID NO: 942940 - DNA, 22 bp, Artificial Sequence
  chemically synthesized
accttcagtagtcttacctatt

SEQ ID NO: 942941 - DNA, 22 bp, Artificial Sequence
  chemically synthesized
agcatactcaaaataggtaaga

SEQ ID NO: 942942 - DNA, 22 bp, Artificial Sequence
  chemically synthesized
taccttcagtagtcttacctat

SEQ ID NO: 942943 - DNA, 22 bp, Artificial Sequence
  chemically synthesized
attttaccttcagtagtcttac

SEQ ID NO: 942944 - DNA, 22 bp, Artificial Sequence
  chemically synthesized
gattttaccttcagtagtctta

SEQ ID NO: 942945 - DNA, 22 bp, Artificial Sequence
  chemically synthesized
tgattttaccttcagtagtctt

SEQ ID NO: 942946 - DNA, 22 bp, Artificial Sequence
  chemically synthesized
aaaataggtaagactactgaag

SEQ ID NO: 942947 - DNA, 22 bp, Artificial Sequence
  chemically synthesized
ctttgattttaccttcagtagt

SEQ ID NO: 942948 - DNA, 22 bp, Artificial Sequence
  chemically synthesized
gtactgctttgattttaccttc

SEQ ID NO: 942949 - DNA, 22 bp, Artificial Sequence
  chemically synthesized
tggtactgctttgattttacct

SEQ ID NO: 942950 - DNA, 22 bp, Artificial Sequence
  chemically synthesized
ctgaaggtaaaatcaaagcagt

SEQ ID NO: 942951 - DNA, 22 bp, Artificial Sequence
  chemically synthesized
agatattctggtactgctttga

SEQ ID NO: 942952 - DNA, 22 bp, Artificial Sequence
  chemically synthesized
aaggtaaaatcaaagcagtacc

SEQ ID NO: 942953 - DNA, 22 bp, Artificial Sequence
  chemically synthesized
gcaaaaggagaatgtgcctcag

SEQ ID NO: 942954 - DNA, 22 bp, Artificial Sequence
  chemically synthesized
cgcaaaaggagaatgtgcctca

SEQ ID NO: 942955 - DNA, 22 bp, Artificial Sequence
  chemically synthesized
ccatcttcgcaaaaggagaatg

SEQ ID NO: 942956 - DNA, 22 bp, Artificial Sequence
  chemically synthesized
aggcacattctccttttgcgaa

SEQ ID NO: 942957 - DNA, 22 bp, Artificial Sequence
  chemically synthesized
agaactaccatcttcgcaaaag

SEQ ID NO: 942958 - DNA, 22 bp, Artificial Sequence
  chemically synthesized
tccttttgcgaagatggtagtt

SEQ ID NO: 942959 - DNA, 22 bp, Artificial Sequence
  chemically synthesized
cttttgcgaagatggtagttct

SEQ ID NO: 942960 - DNA, 22 bp, Artificial Sequence
  chemically synthesized
ttgcgaagatggtagttcttaa

SEQ ID NO: 942961 - DNA, 22 bp, Artificial Sequence
  chemically synthesized
tgcgaagatggtagttcttaac

SEQ ID NO: 942962 - DNA, 22 bp, Artificial Sequence
  chemically synthesized
gcgaagatggtagttcttaaca

SEQ ID NO: 942963 - DNA, 22 bp, Artificial Sequence
  chemically synthesized
cgaagatggtagttcttaacac

SEQ ID NO: 942964 - DNA, 22 bp, Artificial Sequence
  chemically synthesized
ggcaaatcacaagggtgttaag

SEQ ID NO: 942965 - DNA, 22 bp, Artificial Sequence
  chemically synthesized
aggcaaatcacaagggtgttaa

SEQ ID NO: 942966 - DNA, 22 bp, Artificial Sequence
  chemically synthesized
agatcttaggcaaatcacaagg

SEQ ID NO: 942967 - DNA, 22 bp, Artificial Sequence
  chemically synthesized
ttaacacccttgtgatttgcct

SEQ ID NO: 942968 - DNA, 22 bp, Artificial Sequence
  chemically synthesized
aacacccttgtgatttgcctaa

SEQ ID NO: 942969 - DNA, 22 bp, Artificial Sequence
  chemically synthesized
acacccttgtgatttgcctaag

SEQ ID NO: 942970 - DNA, 22 bp, Artificial Sequence
  chemically synthesized
agagtatgttaagatcttaggc

SEQ ID NO: 942971 - DNA, 22 bp, Artificial Sequence
  chemically synthesized
gagagtatgttaagatcttagg

SEQ ID NO: 942972 - DNA, 22 bp, Artificial Sequence
  chemically synthesized
gtgatttgcctaagatcttaac

SEQ ID NO: 942973 - DNA, 22 bp, Artificial Sequence
  chemically synthesized
tgatttgcctaagatcttaaca

SEQ ID NO: 942974 - DNA, 22 bp, Artificial Sequence
  chemically synthesized
atgtgtttgagagtatgttaag

SEQ ID NO: 942975 - DNA, 22 bp, Artificial Sequence
  chemically synthesized
gcctaagatcttaacatactct

SEQ ID NO: 942976 - DNA, 22 bp, Artificial Sequence
  chemically synthesized
cctaagatcttaacatactctc

SEQ ID NO: 942977 - DNA, 22 bp, Artificial Sequence
  chemically synthesized
agatcttaacatactctcaaac

SEQ ID NO: 942978 - DNA, 22 bp, Artificial Sequence
  chemically synthesized
aaggattaatgtgtttgagagt

SEQ ID NO: 942979 - DNA, 22 bp, Artificial Sequence
  chemically synthesized
ggattaaaggattaatgtgttt

SEQ ID NO: 942980 - DNA, 22 bp, Artificial Sequence
  chemically synthesized
aacatactctcaaacacattaa

SEQ ID NO: 942981 - DNA, 22 bp, Artificial Sequence
  chemically synthesized
acatactctcaaacacattaat

SEQ ID NO: 942982 - DNA, 22 bp, Artificial Sequence
  chemically synthesized
taggattaaaggattaatgtgt

SEQ ID NO: 942983 - DNA, 22 bp, Artificial Sequence
  chemically synthesized
ttctaggattaaaggattaatg

SEQ ID NO: 942984 - DNA, 22 bp, Artificial Sequence
  chemically synthesized
tcaaacacattaatcctttaat

SEQ ID NO: 942985 - DNA, 22 bp, Artificial Sequence
  chemically synthesized
aaacacattaatcctttaatcc

SEQ ID NO: 942986 - DNA, 22 bp, Artificial Sequence
  chemically synthesized
agaaacactgttctaggattaa

SEQ ID NO: 942987 - DNA, 22 bp, Artificial Sequence
  chemically synthesized
aggttgagaaacactgttctag

SEQ ID NO: 942988 - DNA, 22 bp, Artificial Sequence
  chemically synthesized
atcctttaatcctagaacagtg

SEQ ID NO: 942989 - DNA, 22 bp, Artificial Sequence
  chemically synthesized
taatcctagaacagtgtttctc

SEQ ID NO: 942990 - DNA, 22 bp, Artificial Sequence
  chemically synthesized
aatcctagaacagtgtttctca

SEQ ID NO: 942991 - DNA, 22 bp, Artificial Sequence
  chemically synthesized
atcctagaacagtgtttctcaa

SEQ ID NO: 942992 - DNA, 22 bp, Artificial Sequence
  chemically synthesized
gaacagtgtttctcaaccttag

SEQ ID NO: 942993 - DNA, 22 bp, Artificial Sequence
  chemically synthesized
aatgatcccagagtgtagctaa

SEQ ID NO: 942994 - DNA, 22 bp, Artificial Sequence
  chemically synthesized
gaatgatcccagagtgtagcta

SEQ ID NO: 942995 - DNA, 22 bp, Artificial Sequence
  chemically synthesized
ttgaatgatcccagagtgtagc

SEQ ID NO: 942996 - DNA, 22 bp, Artificial Sequence
  chemically synthesized
cttgaatgatcccagagtgtag

SEQ ID NO: 942997 - DNA, 22 bp, Artificial Sequence
  chemically synthesized
ctcaaccttagctacactctgg

SEQ ID NO: 942998 - DNA, 22 bp, Artificial Sequence
  chemically synthesized
tcaaccttagctacactctggg

SEQ ID NO: 942999 - DNA, 22 bp, Artificial Sequence
  chemically synthesized
aaccttagctacactctgggat

SEQ ID NO: 943000 - DNA, 22 bp, Artificial Sequence
  chemically synthesized
aaatatttcttgaatgatccca

SEQ ID NO: 943001 - DNA, 22 bp, Artificial Sequence
  chemically synthesized
aaaatatttcttgaatgatccc

SEQ ID NO: 943002 - DNA, 22 bp, Artificial Sequence
  chemically synthesized
agctacactctgggatcattca

SEQ ID NO: 943003 - DNA, 22 bp, Artificial Sequence
  chemically synthesized
taaaatatttcttgaatgatcc

SEQ ID NO: 943004 - DNA, 22 bp, Artificial Sequence
  chemically synthesized
gctacactctgggatcattcaa

SEQ ID NO: 943005 - DNA, 22 bp, Artificial Sequence
  chemically synthesized
cactctgggatcattcaagaaa

SEQ ID NO: 943006 - DNA, 22 bp, Artificial Sequence
  chemically synthesized
tgggatcattcaagaaatattt

SEQ ID NO: 943007 - DNA, 22 bp, Artificial Sequence
  chemically synthesized
ggatcattcaagaaatatttta

SEQ ID NO: 943008 - DNA, 22 bp, Artificial Sequence
  chemically synthesized
aagaaatattttaaaatactga

SEQ ID NO: 943009 - DNA, 22 bp, Artificial Sequence
  chemically synthesized
tggaggcaggacccagacatca

SEQ ID NO: 943010 - DNA, 22 bp, Artificial Sequence
  chemically synthesized
taaaatactgatgtctgggtcc

SEQ ID NO: 943011 - DNA, 22 bp, Artificial Sequence
  chemically synthesized
aaaatactgatgtctgggtcct

SEQ ID NO: 943012 - DNA, 22 bp, Artificial Sequence
  chemically synthesized
aaatactgatgtctgggtcctg

SEQ ID NO: 943013 - DNA, 22 bp, Artificial Sequence
  chemically synthesized
aatcagaatctatggaggcagg

SEQ ID NO: 943014 - DNA, 22 bp, Artificial Sequence
  chemically synthesized
atgtctgggtcctgcctccata

SEQ ID NO: 943015 - DNA, 22 bp, Artificial Sequence
  chemically synthesized
ggtcctgcctccatagattctg

SEQ ID NO: 943016 - DNA, 22 bp, Artificial Sequence
  chemically synthesized
gaccaattgaatcagaatctat

SEQ ID NO: 943017 - DNA, 22 bp, Artificial Sequence
  chemically synthesized
cctccatagattctgattcaat

SEQ ID NO: 943018 - DNA, 22 bp, Artificial Sequence
  chemically synthesized
catagattctgattcaattggt

SEQ ID NO: 943019 - DNA, 22 bp, Artificial Sequence
  chemically synthesized
cgggcccagatcacatctagac

SEQ ID NO: 943020 - DNA, 22 bp, Artificial Sequence
  chemically synthesized
tgattcaattggtctagatgtg

SEQ ID NO: 943021 - DNA, 22 bp, Artificial Sequence
  chemically synthesized
attcaattggtctagatgtgat

SEQ ID NO: 943022 - DNA, 22 bp, Artificial Sequence
  chemically synthesized
ttccgggcccagatcacatcta

SEQ ID NO: 943023 - DNA, 22 bp, Artificial Sequence
  chemically synthesized
aattggtctagatgtgatctgg

SEQ ID NO: 943024 - DNA, 22 bp, Artificial Sequence
  chemically synthesized
agctattccgggcccagatcac

SEQ ID NO: 943025 - DNA, 22 bp, Artificial Sequence
  chemically synthesized
gtctagatgtgatctgggcccg

SEQ ID NO: 943026 - DNA, 22 bp, Artificial Sequence
  chemically synthesized
gatgtgatctgggcccggaata

SEQ ID NO: 943027 - DNA, 22 bp, Artificial Sequence
  chemically synthesized
gggagacagttgagctattccg

SEQ ID NO: 943028 - DNA, 22 bp, Artificial Sequence
  chemically synthesized
ggcccggaatagctcaactgtc

SEQ ID NO: 943029 - DNA, 22 bp, Artificial Sequence
  chemically synthesized
aatcacctggggagacagttga

SEQ ID NO: 943030 - DNA, 22 bp, Artificial Sequence
  chemically synthesized
cgtatctgaatcacctggggag

SEQ ID NO: 943031 - DNA, 22 bp, Artificial Sequence
  chemically synthesized
attgcgtatctgaatcacctgg

SEQ ID NO: 943032 - DNA, 22 bp, Artificial Sequence
  chemically synthesized
gattgcgtatctgaatcacctg

SEQ ID NO: 943033 - DNA, 22 bp, Artificial Sequence
  chemically synthesized
aactgtctccccaggtgattca

SEQ ID NO: 943034 - DNA, 22 bp, Artificial Sequence
  chemically synthesized
tgattgcgtatctgaatcacct

SEQ ID NO: 943035 - DNA, 22 bp, Artificial Sequence
  chemically synthesized
tctccccaggtgattcagatac

SEQ ID NO: 943036 - DNA, 22 bp, Artificial Sequence
  chemically synthesized
agctttgattgcgtatctgaat

SEQ ID NO: 943037 - DNA, 22 bp, Artificial Sequence
  chemically synthesized
tcagctttgattgcgtatctga

SEQ ID NO: 943038 - DNA, 22 bp, Artificial Sequence
  chemically synthesized
cccaggtgattcagatacgcaa

SEQ ID NO: 943039 - DNA, 22 bp, Artificial Sequence
  chemically synthesized
gttctcagctttgattgcgtat

SEQ ID NO: 943040 - DNA, 22 bp, Artificial Sequence
  chemically synthesized
ttggttctcagctttgattgcg

SEQ ID NO: 943041 - DNA, 22 bp, Artificial Sequence
  chemically synthesized
agatacgcaatcaaagctgaga

SEQ ID NO: 943042 - DNA, 22 bp, Artificial Sequence
  chemically synthesized
aaaagcgtcgatcgaactgttg

SEQ ID NO: 943043 - DNA, 22 bp, Artificial Sequence
  chemically synthesized
gaaaagcgtcgatcgaactgtt

SEQ ID NO: 943044 - DNA, 22 bp, Artificial Sequence
  chemically synthesized
agaaccaacagttcgatcgacg

SEQ ID NO: 943045 - DNA, 22 bp, Artificial Sequence
  chemically synthesized
atgtcaaaatttgaaaagcgtc

SEQ ID NO: 943046 - DNA, 22 bp, Artificial Sequence
  chemically synthesized
ttcatgtcaaaatttgaaaagc

SEQ ID NO: 943047 - DNA, 22 bp, Artificial Sequence
  chemically synthesized
attcatgtcaaaatttgaaaag

SEQ ID NO: 943048 - DNA, 22 bp, Artificial Sequence
  chemically synthesized
ttattcatgtcaaaatttgaaa

SEQ ID NO: 943049 - DNA, 22 bp, Artificial Sequence
  chemically synthesized
gatcgacgcttttcaaattttg

SEQ ID NO: 943050 - DNA, 22 bp, Artificial Sequence
  chemically synthesized
caagtgattcttattcatgtca

SEQ ID NO: 943051 - DNA, 22 bp, Artificial Sequence
  chemically synthesized
ttcaaattttgacatgaataag

SEQ ID NO: 943052 - DNA, 22 bp, Artificial Sequence
  chemically synthesized
tcaaattttgacatgaataaga

SEQ ID NO: 943053 - DNA, 22 bp, Artificial Sequence
  chemically synthesized
caaattttgacatgaataagaa

SEQ ID NO: 943054 - DNA, 22 bp, Artificial Sequence
  chemically synthesized
aaattttgacatgaataagaat

SEQ ID NO: 943055 - DNA, 22 bp, Artificial Sequence
  chemically synthesized
acaaggtctccaagtgattctt

SEQ ID NO: 943056 - DNA, 22 bp, Artificial Sequence
  chemically synthesized
tgacatgaataagaatcacttg

SEQ ID NO: 943057 - DNA, 22 bp, Artificial Sequence
  chemically synthesized
gacatgaataagaatcacttgg

SEQ ID NO: 943058 - DNA, 22 bp, Artificial Sequence
  chemically synthesized
acatgaataagaatcacttgga

SEQ ID NO: 943059 - DNA, 22 bp, Artificial Sequence
  chemically synthesized
tgggttaacaaggtctccaagt

SEQ ID NO: 943060 - DNA, 22 bp, Artificial Sequence
  chemically synthesized
ggagaccttgttaacccacagt

SEQ ID NO: 943061 - DNA, 22 bp, Artificial Sequence
  chemically synthesized
gagaccttgttaacccacagtt

SEQ ID NO: 943062 - DNA, 22 bp, Artificial Sequence
  chemically synthesized
ggagtagggccaagaaaactgt

SEQ ID NO: 943063 - DNA, 22 bp, Artificial Sequence
  chemically synthesized
gggagtagggccaagaaaactg

SEQ ID NO: 943064 - DNA, 22 bp, Artificial Sequence
  chemically synthesized
tgggagtagggccaagaaaact

SEQ ID NO: 943065 - DNA, 22 bp, Artificial Sequence
  chemically synthesized
ttgggagtagggccaagaaaac

SEQ ID NO: 943066 - DNA, 22 bp, Artificial Sequence
  chemically synthesized
gttaacccacagttttcttggc

SEQ ID NO: 943067 - DNA, 22 bp, Artificial Sequence
  chemically synthesized
ttaacccacagttttcttggcc

SEQ ID NO: 943068 - DNA, 22 bp, Artificial Sequence
  chemically synthesized
acccacagttttcttggcccta

SEQ ID NO: 943069 - DNA, 22 bp, Artificial Sequence
  chemically synthesized
aatcagagtttttgggagtagg

SEQ ID NO: 943070 - DNA, 22 bp, Artificial Sequence
  chemically synthesized
ctaaatcagagtttttgggagt

SEQ ID NO: 943071 - DNA, 22 bp, Artificial Sequence
  chemically synthesized
tcttggccctactcccaaaaac

SEQ ID NO: 943072 - DNA, 22 bp, Artificial Sequence
  chemically synthesized
cttggccctactcccaaaaact

SEQ ID NO: 943073 - DNA, 22 bp, Artificial Sequence
  chemically synthesized
ttggccctactcccaaaaactc

SEQ ID NO: 943074 - DNA, 22 bp, Artificial Sequence
  chemically synthesized
ggccctactcccaaaaactctg

SEQ ID NO: 943075 - DNA, 22 bp, Artificial Sequence
  chemically synthesized
gccctactcccaaaaactctga

SEQ ID NO: 943076 - DNA, 22 bp, Artificial Sequence
  chemically synthesized
ctcccaaaaactctgatttagt

SEQ ID NO: 943077 - DNA, 22 bp, Artificial Sequence
  chemically synthesized
ccaaaaactctgatttagtagg

SEQ ID NO: 943078 - DNA, 22 bp, Artificial Sequence
  chemically synthesized
gccccaccccaagcctactaaa

SEQ ID NO: 943079 - DNA, 22 bp, Artificial Sequence
  chemically synthesized
ggccccaccccaagcctactaa

SEQ ID NO: 943080 - DNA, 22 bp, Artificial Sequence
  chemically synthesized
tgatttagtaggcttggggtgg

SEQ ID NO: 943081 - DNA, 22 bp, Artificial Sequence
  chemically synthesized
gaaagtcttggccccaccccaa

SEQ ID NO: 943082 - DNA, 22 bp, Artificial Sequence
  chemically synthesized
atttagtaggcttggggtgggg

SEQ ID NO: 943083 - DNA, 22 bp, Artificial Sequence
  chemically synthesized
agtaggcttggggtggggccaa

SEQ ID NO: 943084 - DNA, 22 bp, Artificial Sequence
  chemically synthesized
gtaggcttggggtggggccaag

SEQ ID NO: 943085 - DNA, 22 bp, Artificial Sequence
  chemically synthesized
gaactagaaagtcttggcccca

SEQ ID NO: 943086 - DNA, 22 bp, Artificial Sequence
  chemically synthesized
ttagaactagaaagtcttggcc

SEQ ID NO: 943087 - DNA, 22 bp, Artificial Sequence
  chemically synthesized
gttagaactagaaagtcttggc

SEQ ID NO: 943088 - DNA, 22 bp, Artificial Sequence
  chemically synthesized
ggggtggggccaagactttcta

SEQ ID NO: 943089 - DNA, 22 bp, Artificial Sequence
  chemically synthesized
gggtggggccaagactttctag

SEQ ID NO: 943090 - DNA, 22 bp, Artificial Sequence
  chemically synthesized
aaagcttgttagaactagaaag

SEQ ID NO: 943091 - DNA, 22 bp, Artificial Sequence
  chemically synthesized
ggcatcacctgaaagcttgtta

SEQ ID NO: 943092 - DNA, 22 bp, Artificial Sequence
  chemically synthesized
tctagttctaacaagctttcag

SEQ ID NO: 943093 - DNA, 22 bp, Artificial Sequence
  chemically synthesized
ctagttctaacaagctttcagg

SEQ ID NO: 943094 - DNA, 22 bp, Artificial Sequence
  chemically synthesized
tagttctaacaagctttcaggt

SEQ ID NO: 943095 - DNA, 22 bp, Artificial Sequence
  chemically synthesized
gttctaacaagctttcaggtga

SEQ ID NO: 943096 - DNA, 22 bp, Artificial Sequence
  chemically synthesized
taacaagctttcaggtgatgcc

SEQ ID NO: 943097 - DNA, 22 bp, Artificial Sequence
  chemically synthesized
acaagctttcaggtgatgccga

SEQ ID NO: 943098 - DNA, 22 bp, Artificial Sequence
  chemically synthesized
acaggccatcatgctcggcatc

SEQ ID NO: 943099 - DNA, 22 bp, Artificial Sequence
  chemically synthesized
ctcacaggccatcatgctcggc

SEQ ID NO: 943100 - DNA, 22 bp, Artificial Sequence
  chemically synthesized
tcaggtgatgccgagcatgatg

SEQ ID NO: 943101 - DNA, 22 bp, Artificial Sequence
  chemically synthesized
caggtgatgccgagcatgatgg

SEQ ID NO: 943102 - DNA, 22 bp, Artificial Sequence
  chemically synthesized
aggtgatgccgagcatgatggc

SEQ ID NO: 943103 - DNA, 22 bp, Artificial Sequence
  chemically synthesized
agaacgctactcacaggccatc

SEQ ID NO: 943104 - DNA, 22 bp, Artificial Sequence
  chemically synthesized
cagaacgctactcacaggccat

SEQ ID NO: 943105 - DNA, 22 bp, Artificial Sequence
  chemically synthesized
aagtttcagaacgctactcaca

SEQ ID NO: 943106 - DNA, 22 bp, Artificial Sequence
  chemically synthesized
caaatgttcaagtttcagaacg

SEQ ID NO: 943107 - DNA, 22 bp, Artificial Sequence
  chemically synthesized
tgagtagcgttctgaaacttga

SEQ ID NO: 943108 - DNA, 22 bp, Artificial Sequence
  chemically synthesized
acactccaaatgttcaagtttc

SEQ ID NO: 943109 - DNA, 22 bp, Artificial Sequence
  chemically synthesized
tgacactccaaatgttcaagtt

SEQ ID NO: 943110 - DNA, 22 bp, Artificial Sequence
  chemically synthesized
tgaaacttgaacatttggagtg

SEQ ID NO: 943111 - DNA, 22 bp, Artificial Sequence
  chemically synthesized
cagggggttctgacactccaaa

SEQ ID NO: 943112 - DNA, 22 bp, Artificial Sequence
  chemically synthesized
aaacttgaacatttggagtgtc

SEQ ID NO: 943113 - DNA, 22 bp, Artificial Sequence
  chemically synthesized
tccagggggttctgacactcca

SEQ ID NO: 943114 - DNA, 22 bp, Artificial Sequence
  chemically synthesized
gaacatttggagtgtcagaacc

SEQ ID NO: 943115 - DNA, 22 bp, Artificial Sequence
  chemically synthesized
aacatttggagtgtcagaaccc

SEQ ID NO: 943116 - DNA, 22 bp, Artificial Sequence
  chemically synthesized
tgaccagctctccagggggttc

SEQ ID NO: 943117 - DNA, 22 bp, Artificial Sequence
  chemically synthesized
ggagtgtcagaaccccctggag

SEQ ID NO: 943118 - DNA, 22 bp, Artificial Sequence
  chemically synthesized
ttgtgaccagctctccaggggg

SEQ ID NO: 943119 - DNA, 22 bp, Artificial Sequence
  chemically synthesized
gagtgtcagaaccccctggaga

SEQ ID NO: 943120 - DNA, 22 bp, Artificial Sequence
  chemically synthesized
gttgtgaccagctctccagggg

SEQ ID NO: 943121 - DNA, 22 bp, Artificial Sequence
  chemically synthesized
tgttgtgaccagctctccaggg

SEQ ID NO: 943122 - DNA, 22 bp, Artificial Sequence
  chemically synthesized
gagagctggtcacaacaaagac

SEQ ID NO: 943123 - DNA, 22 bp, Artificial Sequence
  chemically synthesized
gggggtgtagcccggcagtctt

SEQ ID NO: 943124 - DNA, 22 bp, Artificial Sequence
  chemically synthesized
tagggggtgtagcccggcagtc

SEQ ID NO: 943125 - DNA, 22 bp, Artificial Sequence
  chemically synthesized
gtcacaacaaagactgccgggc

SEQ ID NO: 943126 - DNA, 22 bp, Artificial Sequence
  chemically synthesized
aaaactctagggggtgtagccc

SEQ ID NO: 943127 - DNA, 22 bp, Artificial Sequence
  chemically synthesized
gaaaactctagggggtgtagcc

SEQ ID NO: 943128 - DNA, 22 bp, Artificial Sequence
  chemically synthesized
acttgaaaactctagggggtgt

SEQ ID NO: 943129 - DNA, 22 bp, Artificial Sequence
  chemically synthesized
ccgggctacaccccctagagtt

SEQ ID NO: 943130 - DNA, 22 bp, Artificial Sequence
  chemically synthesized
cagatctcacttgaaaactcta

SEQ ID NO: 943131 - DNA, 22 bp, Artificial Sequence
  chemically synthesized
caccccctagagttttcaagtg

SEQ ID NO: 943132 - DNA, 22 bp, Artificial Sequence
  chemically synthesized
gagttttcaagtgagatctgga

SEQ ID NO: 943133 - DNA, 22 bp, Artificial Sequence
  chemically synthesized
catgggccccattccagatctc

SEQ ID NO: 943134 - DNA, 22 bp, Artificial Sequence
  chemically synthesized
tcaagtgagatctggaatgggg

SEQ ID NO: 943135 - DNA, 22 bp, Artificial Sequence
  chemically synthesized
gacctgcatgggccccattcca

SEQ ID NO: 943136 - DNA, 22 bp, Artificial Sequence
  chemically synthesized
caagtgagatctggaatggggc

SEQ ID NO: 943137 - DNA, 22 bp, Artificial Sequence
  chemically synthesized
agacctgcatgggccccattcc

SEQ ID NO: 943138 - DNA, 22 bp, Artificial Sequence
  chemically synthesized
aagtgagatctggaatggggcc

SEQ ID NO: 943139 - DNA, 22 bp, Artificial Sequence
  chemically synthesized
ggaacttagacctgcatgggcc

SEQ ID NO: 943140 - DNA, 22 bp, Artificial Sequence
  chemically synthesized
gggaacttagacctgcatgggc

SEQ ID NO: 943141 - DNA, 22 bp, Artificial Sequence
  chemically synthesized
gaatggggcccatgcaggtcta

SEQ ID NO: 943142 - DNA, 22 bp, Artificial Sequence
  chemically synthesized
gcatcacttgggaacttagacc

SEQ ID NO: 943143 - DNA, 22 bp, Artificial Sequence
  chemically synthesized
agttcccaagtgatgctaacgc

SEQ ID NO: 943144 - DNA, 22 bp, Artificial Sequence
  chemically synthesized
ccaagtgatgctaacgctgctg

SEQ ID NO: 943145 - DNA, 22 bp, Artificial Sequence
  chemically synthesized
aaagggaggtcccgggatcagc

SEQ ID NO: 943146 - DNA, 22 bp, Artificial Sequence
  chemically synthesized
tcaaagggaggtcccgggatca

SEQ ID NO: 943147 - DNA, 22 bp, Artificial Sequence
  chemically synthesized
acgctgctgatcccgggacctc

SEQ ID NO: 943148 - DNA, 22 bp, Artificial Sequence
  chemically synthesized
ctgatcccgggacctccctttg

SEQ ID NO: 943149 - DNA, 22 bp, Artificial Sequence
  chemically synthesized
gagtagtagttctcaaagggag

SEQ ID NO: 943150 - DNA, 22 bp, Artificial Sequence
  chemically synthesized
atcccgggacctccctttgaga

SEQ ID NO: 943151 - DNA, 22 bp, Artificial Sequence
  chemically synthesized
tctagagtagtagttctcaaag

SEQ ID NO: 943152 - DNA, 22 bp, Artificial Sequence
  chemically synthesized
atctagagtagtagttctcaaa

SEQ ID NO: 943153 - DNA, 22 bp, Artificial Sequence
  chemically synthesized
tatctagagtagtagttctcaa

SEQ ID NO: 943154 - DNA, 22 bp, Artificial Sequence
  chemically synthesized
ttatctagagtagtagttctca

SEQ ID NO: 943155 - DNA, 22 bp, Artificial Sequence
  chemically synthesized
tttatctagagtagtagttctc

SEQ ID NO: 943156 - DNA, 22 bp, Artificial Sequence
  chemically synthesized
cctttgagaactactactctag

SEQ ID NO: 943157 - DNA, 22 bp, Artificial Sequence
  chemically synthesized
tgagaactactactctagataa

SEQ ID NO: 943158 - DNA, 22 bp, Artificial Sequence
  chemically synthesized
gagaactactactctagataaa

SEQ ID NO: 943159 - DNA, 22 bp, Artificial Sequence
  chemically synthesized
agaactactactctagataaaa

SEQ ID NO: 943160 - DNA, 22 bp, Artificial Sequence
  chemically synthesized
ctactctagataaaaagtactt

SEQ ID NO: 943161 - DNA, 22 bp, Artificial Sequence
  chemically synthesized
ctctagataaaaagtacttact

SEQ ID NO: 943162 - DNA, 22 bp, Artificial Sequence
  chemically synthesized
tagataaaaagtacttactctc

SEQ ID NO: 943163 - DNA, 22 bp, Artificial Sequence
  chemically synthesized
aaaatgcagatggagagtaagt

SEQ ID NO: 943164 - DNA, 22 bp, Artificial Sequence
  chemically synthesized
aaaaatgcagatggagagtaag

SEQ ID NO: 943165 - DNA, 22 bp, Artificial Sequence
  chemically synthesized
gataaaaagtacttactctcca

SEQ ID NO: 943166 - DNA, 22 bp, Artificial Sequence
  chemically synthesized
taaaaatgcagatggagagtaa

SEQ ID NO: 943167 - DNA, 22 bp, Artificial Sequence
  chemically synthesized
ttaaaaatgcagatggagagta

SEQ ID NO: 943168 - DNA, 22 bp, Artificial Sequence
  chemically synthesized
aagtgatgtttttaaaaatgca

SEQ ID NO: 943169 - DNA, 22 bp, Artificial Sequence
  chemically synthesized
actctccatctgcatttttaaa

SEQ ID NO: 943170 - DNA, 22 bp, Artificial Sequence
  chemically synthesized
ctctccatctgcatttttaaaa

SEQ ID NO: 943171 - DNA, 22 bp, Artificial Sequence
  chemically synthesized
ttaaagtgatgtttttaaaaat

SEQ ID NO: 943172 - DNA, 22 bp, Artificial Sequence
  chemically synthesized
tccatctgcatttttaaaaaca

SEQ ID NO: 943173 - DNA, 22 bp, Artificial Sequence
  chemically synthesized
catctgcatttttaaaaacatc

SEQ ID NO: 943174 - DNA, 22 bp, Artificial Sequence
  chemically synthesized
catttttaaaaacatcacttta

SEQ ID NO: 943175 - DNA, 22 bp, Artificial Sequence
  chemically synthesized
aaagccagtagattattaaagt

SEQ ID NO: 943176 - DNA, 22 bp, Artificial Sequence
  chemically synthesized
ttaaaaacatcactttaataat

SEQ ID NO: 943177 - DNA, 22 bp, Artificial Sequence
  chemically synthesized
gaaagccagtagattattaaag

SEQ ID NO: 943178 - DNA, 22 bp, Artificial Sequence
  chemically synthesized
taaaaacatcactttaataatc

SEQ ID NO: 943179 - DNA, 22 bp, Artificial Sequence
  chemically synthesized
aaaaacatcactttaataatct

SEQ ID NO: 943180 - DNA, 22 bp, Artificial Sequence
  chemically synthesized
aaaacatcactttaataatcta

SEQ ID NO: 943181 - DNA, 22 bp, Artificial Sequence
  chemically synthesized
taataatctactggctttcaag

SEQ ID NO: 943182 - DNA, 22 bp, Artificial Sequence
  chemically synthesized
aataatctactggctttcaaga

SEQ ID NO: 943183 - DNA, 22 bp, Artificial Sequence
  chemically synthesized
gtggtgaaaatgtcttgaaagc

SEQ ID NO: 943184 - DNA, 22 bp, Artificial Sequence
  chemically synthesized
ataatctactggctttcaagac

SEQ ID NO: 943185 - DNA, 22 bp, Artificial Sequence
  chemically synthesized
agtggtgaaaatgtcttgaaag

SEQ ID NO: 943186 - DNA, 22 bp, Artificial Sequence
  chemically synthesized
ctggctttcaagacattttcac

SEQ ID NO: 943187 - DNA, 22 bp, Artificial Sequence
  chemically synthesized
gctttcaagacattttcaccac

SEQ ID NO: 943188 - DNA, 22 bp, Artificial Sequence
  chemically synthesized
tgataaggtgtttagtggtgaa

SEQ ID NO: 943189 - DNA, 22 bp, Artificial Sequence
  chemically synthesized
tcaagacattttcaccactaaa

SEQ ID NO: 943190 - DNA, 22 bp, Artificial Sequence
  chemically synthesized
caagacattttcaccactaaac

SEQ ID NO: 943191 - DNA, 22 bp, Artificial Sequence
  chemically synthesized
ctatgataaggtgtttagtggt

SEQ ID NO: 943192 - DNA, 22 bp, Artificial Sequence
  chemically synthesized
aagacattttcaccactaaaca

SEQ ID NO: 943193 - DNA, 22 bp, Artificial Sequence
  chemically synthesized
tcaccactaaacaccttatcat

SEQ ID NO: 943194 - DNA, 22 bp, Artificial Sequence
  chemically synthesized
caccactaaacaccttatcata

SEQ ID NO: 943195 - DNA, 22 bp, Artificial Sequence
  chemically synthesized
accactaaacaccttatcatag

SEQ ID NO: 943196 - DNA, 22 bp, Artificial Sequence
  chemically synthesized
aacaccttatcatagcagcttc

SEQ ID NO: 943197 - DNA, 22 bp, Artificial Sequence
  chemically synthesized
atcatagcagcttccacggatt

SEQ ID NO: 943198 - DNA, 22 bp, Artificial Sequence
  chemically synthesized
tcatagcagcttccacggattg

SEQ ID NO: 943199 - DNA, 22 bp, Artificial Sequence
  chemically synthesized
atccaaaggcacagcaatccgt

SEQ ID NO: 943200 - DNA, 22 bp, Artificial Sequence
  chemically synthesized
taatccaaaggcacagcaatcc

SEQ ID NO: 943201 - DNA, 22 bp, Artificial Sequence
  chemically synthesized
tctaatccaaaggcacagcaat

SEQ ID NO: 943202 - DNA, 22 bp, Artificial Sequence
  chemically synthesized
ctctaatccaaaggcacagcaa

SEQ ID NO: 943203 - DNA, 22 bp, Artificial Sequence
  chemically synthesized
tttctctaatccaaaggcacag

SEQ ID NO: 943204 - DNA, 22 bp, Artificial Sequence
  chemically synthesized
gtttctctaatccaaaggcaca

SEQ ID NO: 943205 - DNA, 22 bp, Artificial Sequence
  chemically synthesized
ccacggattgctgtgcctttgg

SEQ ID NO: 943206 - DNA, 22 bp, Artificial Sequence
  chemically synthesized
cacggattgctgtgcctttgga

SEQ ID NO: 943207 - DNA, 22 bp, Artificial Sequence
  chemically synthesized
tgtacttgtttctctaatccaa

SEQ ID NO: 943208 - DNA, 22 bp, Artificial Sequence
  chemically synthesized
atgtacttgtttctctaatcca

SEQ ID NO: 943209 - DNA, 22 bp, Artificial Sequence
  chemically synthesized
ctgtgcctttggattagagaaa

SEQ ID NO: 943210 - DNA, 22 bp, Artificial Sequence
  chemically synthesized
ccttatgtacttgtttctctaa

SEQ ID NO: 943211 - DNA, 22 bp, Artificial Sequence
  chemically synthesized
gccttatgtacttgtttctcta

SEQ ID NO: 943212 - DNA, 22 bp, Artificial Sequence
  chemically synthesized
tgcctttggattagagaaacaa

SEQ ID NO: 943213 - DNA, 22 bp, Artificial Sequence
  chemically synthesized
tgccttatgtacttgtttctct

SEQ ID NO: 943214 - DNA, 22 bp, Artificial Sequence
  chemically synthesized
tggattagagaaacaagtacat

SEQ ID NO: 943215 - DNA, 22 bp, Artificial Sequence
  chemically synthesized
ggattagagaaacaagtacata

SEQ ID NO: 943216 - DNA, 22 bp, Artificial Sequence
  chemically synthesized
gattagagaaacaagtacataa

SEQ ID NO: 943217 - DNA, 22 bp, Artificial Sequence
  chemically synthesized
gagaaacaagtacataaggcaa

SEQ ID NO: 943218 - DNA, 22 bp, Artificial Sequence
  chemically synthesized
tgcatccaagtagacagggaga

SEQ ID NO: 943219 - DNA, 22 bp, Artificial Sequence
  chemically synthesized
ggcagctgtgcatccaagtaga

SEQ ID NO: 943220 - DNA, 22 bp, Artificial Sequence
  chemically synthesized
tccctgtctacttggatgcaca

SEQ ID NO: 943221 - DNA, 22 bp, Artificial Sequence
  chemically synthesized
ggtgctgggcagctgtgcatcc

SEQ ID NO: 943222 - DNA, 22 bp, Artificial Sequence
  chemically synthesized
cctgtctacttggatgcacagc

SEQ ID NO: 943223 - DNA, 22 bp, Artificial Sequence
  chemically synthesized
tgggtgctgggcagctgtgcat

SEQ ID NO: 943224 - DNA, 22 bp, Artificial Sequence
  chemically synthesized
ctgggtgctgggcagctgtgca

SEQ ID NO: 943225 - DNA, 22 bp, Artificial Sequence
  chemically synthesized
tctacttggatgcacagctgcc

SEQ ID NO: 943226 - DNA, 22 bp, Artificial Sequence
  chemically synthesized
cttggatgcacagctgcccagc

SEQ ID NO: 943227 - DNA, 22 bp, Artificial Sequence
  chemically synthesized
ggatgcacagctgcccagcacc

SEQ ID NO: 943228 - DNA, 22 bp, Artificial Sequence
  chemically synthesized
gatgcacagctgcccagcaccc

SEQ ID NO: 943229 - DNA, 22 bp, Artificial Sequence
  chemically synthesized
gtgaatggtatcagatggtttc

SEQ ID NO: 943230 - DNA, 22 bp, Artificial Sequence
  chemically synthesized
cccagcacccagaaaccatctg

SEQ ID NO: 943231 - DNA, 22 bp, Artificial Sequence
  chemically synthesized
ggtgaatggtatcagatggttt

SEQ ID NO: 943232 - DNA, 22 bp, Artificial Sequence
  chemically synthesized
ataccattcaccaagctgatgg

SEQ ID NO: 943233 - DNA, 22 bp, Artificial Sequence
  chemically synthesized
accaagctgatggattgtgtgt

SEQ ID NO: 943234 - DNA, 22 bp, Artificial Sequence
  chemically synthesized
gataaggagcagaatgaacaac

SEQ ID NO: 943235 - DNA, 22 bp, Artificial Sequence
  chemically synthesized
atggattgtgtgttgttcattc

SEQ ID NO: 943236 - DNA, 22 bp, Artificial Sequence
  chemically synthesized
ttagataaggagcagaatgaac

SEQ ID NO: 943237 - DNA, 22 bp, Artificial Sequence
  chemically synthesized
tgtgttgttcattctgctcctt

SEQ ID NO: 943238 - DNA, 22 bp, Artificial Sequence
  chemically synthesized
ttcattctgctccttatctaat

SEQ ID NO: 943239 - DNA, 22 bp, Artificial Sequence
  chemically synthesized
aataaaagaactattagataag

SEQ ID NO: 943240 - DNA, 22 bp, Artificial Sequence
  chemically synthesized
attctgctccttatctaatagt

SEQ ID NO: 943241 - DNA, 22 bp, Artificial Sequence
  chemically synthesized
gttaaataaaagaactattaga

SEQ ID NO: 943242 - DNA, 22 bp, Artificial Sequence
  chemically synthesized
tgctccttatctaatagttctt

SEQ ID NO: 943243 - DNA, 22 bp, Artificial Sequence
  chemically synthesized
ctccttatctaatagttctttt

SEQ ID NO: 943244 - DNA, 22 bp, Artificial Sequence
  chemically synthesized
cttatctaatagttcttttatt

SEQ ID NO: 943245 - DNA, 22 bp, Artificial Sequence
  chemically synthesized
cagtcattagttaaataaaaga

SEQ ID NO: 943246 - DNA, 22 bp, Artificial Sequence
  chemically synthesized
atctaatagttcttttatttaa

SEQ ID NO: 943247 - DNA, 22 bp, Artificial Sequence
  chemically synthesized
tctaatagttcttttatttaac

SEQ ID NO: 943248 - DNA, 22 bp, Artificial Sequence
  chemically synthesized
atagttcttttatttaactaat

SEQ ID NO: 943249 - DNA, 22 bp, Artificial Sequence
  chemically synthesized
atgagaattacagtcattagtt

SEQ ID NO: 943250 - DNA, 22 bp, Artificial Sequence
  chemically synthesized
ttttatttaactaatgactgta

SEQ ID NO: 943251 - DNA, 22 bp, Artificial Sequence
  chemically synthesized
ttatttaactaatgactgtaat

SEQ ID NO: 943252 - DNA, 22 bp, Artificial Sequence
  chemically synthesized
tatttaactaatgactgtaatt

SEQ ID NO: 943253 - DNA, 22 bp, Artificial Sequence
  chemically synthesized
atttaactaatgactgtaattc

SEQ ID NO: 943254 - DNA, 22 bp, Artificial Sequence
  chemically synthesized
tttaactaatgactgtaattct

SEQ ID NO: 943255 - DNA, 22 bp, Artificial Sequence
  chemically synthesized
tcagcatctaatgagaattaca

SEQ ID NO: 943256 - DNA, 22 bp, Artificial Sequence
  chemically synthesized
aactaatgactgtaattctcat

SEQ ID NO: 943257 - DNA, 22 bp, Artificial Sequence
  chemically synthesized
tatcagcatctaatgagaatta

SEQ ID NO: 943258 - DNA, 22 bp, Artificial Sequence
  chemically synthesized
actaatgactgtaattctcatt

SEQ ID NO: 943259 - DNA, 22 bp, Artificial Sequence
  chemically synthesized
atgactgtaattctcattagat

SEQ ID NO: 943260 - DNA, 22 bp, Artificial Sequence
  chemically synthesized
gtgttctatcagcatctaatga

SEQ ID NO: 943261 - DNA, 22 bp, Artificial Sequence
  chemically synthesized
agtgttctatcagcatctaatg

SEQ ID NO: 943262 - DNA, 22 bp, Artificial Sequence
  chemically synthesized
taattctcattagatgctgata

SEQ ID NO: 943263 - DNA, 22 bp, Artificial Sequence
  chemically synthesized
tcattagatgctgatagaacac

SEQ ID NO: 943264 - DNA, 22 bp, Artificial Sequence
  chemically synthesized
attagatgctgatagaacacta

SEQ ID NO: 943265 - DNA, 22 bp, Artificial Sequence
  chemically synthesized
cacaaaaaaaacttagtgttct

SEQ ID NO: 943266 - DNA, 22 bp, Artificial Sequence
  chemically synthesized
gatgctgatagaacactaagtt

SEQ ID NO: 943267 - DNA, 22 bp, Artificial Sequence
  chemically synthesized
ccaagttccacaaaaaaaactt

SEQ ID NO: 943268 - DNA, 22 bp, Artificial Sequence
  chemically synthesized
gccaagttccacaaaaaaaact

SEQ ID NO: 943269 - DNA, 22 bp, Artificial Sequence
  chemically synthesized
atagaacactaagttttttttg

SEQ ID NO: 943270 - DNA, 22 bp, Artificial Sequence
  chemically synthesized
tgccaagttccacaaaaaaaac

SEQ ID NO: 943271 - DNA, 22 bp, Artificial Sequence
  chemically synthesized
agttttttttgtggaacttggc

SEQ ID NO: 943272 - DNA, 22 bp, Artificial Sequence
  chemically synthesized
ccatgagtagttttgccaagtt

SEQ ID NO: 943273 - DNA, 22 bp, Artificial Sequence
  chemically synthesized
tttttgtggaacttggcaaaac

SEQ ID NO: 943274 - DNA, 22 bp, Artificial Sequence
  chemically synthesized
ttttgtggaacttggcaaaact

SEQ ID NO: 943275 - DNA, 22 bp, Artificial Sequence
  chemically synthesized
tttgtggaacttggcaaaacta

SEQ ID NO: 943276 - DNA, 22 bp, Artificial Sequence
  chemically synthesized
ttgtggaacttggcaaaactac

SEQ ID NO: 943277 - DNA, 22 bp, Artificial Sequence
  chemically synthesized
tgtggaacttggcaaaactact

SEQ ID NO: 943278 - DNA, 22 bp, Artificial Sequence
  chemically synthesized
gtggaacttggcaaaactactc

SEQ ID NO: 943279 - DNA, 22 bp, Artificial Sequence
  chemically synthesized
atgtcctgccatgagtagtttt

SEQ ID NO: 943280 - DNA, 22 bp, Artificial Sequence
  chemically synthesized
tggaacttggcaaaactactca

SEQ ID NO: 943281 - DNA, 22 bp, Artificial Sequence
  chemically synthesized
accaactgatgtcctgccatga

SEQ ID NO: 943282 - DNA, 22 bp, Artificial Sequence
  chemically synthesized
ggcaaaactactcatggcagga

SEQ ID NO: 943283 - DNA, 22 bp, Artificial Sequence
  chemically synthesized
gcaaaactactcatggcaggac

SEQ ID NO: 943284 - DNA, 22 bp, Artificial Sequence
  chemically synthesized
ggtaatgctcaccaactgatgt

SEQ ID NO: 943285 - DNA, 22 bp, Artificial Sequence
  chemically synthesized
ctcatggcaggacatcagttgg

SEQ ID NO: 943286 - DNA, 22 bp, Artificial Sequence
  chemically synthesized
atggcaggacatcagttggtga

SEQ ID NO: 943287 - DNA, 22 bp, Artificial Sequence
  chemically synthesized
cctaggtaatgctcaccaactg

SEQ ID NO: 943288 - DNA, 22 bp, Artificial Sequence
  chemically synthesized
ctgcctaggtaatgctcaccaa

SEQ ID NO: 943289 - DNA, 22 bp, Artificial Sequence
  chemically synthesized
ggtgttgctgcctaggtaatgc

SEQ ID NO: 943290 - DNA, 22 bp, Artificial Sequence
  chemically synthesized
gtgagcattacctaggcagcaa

SEQ ID NO: 943291 - DNA, 22 bp, Artificial Sequence
  chemically synthesized
cctaggcagcaacacccaaccc

SEQ ID NO: 943292 - DNA, 22 bp, Artificial Sequence
  chemically synthesized
aggccagcgggagggttgggtg

SEQ ID NO: 943293 - DNA, 22 bp, Artificial Sequence
  chemically synthesized
ctcaggccagcgggagggttgg

SEQ ID NO: 943294 - DNA, 22 bp, Artificial Sequence
  chemically synthesized
ggcagcaacacccaaccctccc

SEQ ID NO: 943295 - DNA, 22 bp, Artificial Sequence
  chemically synthesized
ctgctcaggccagcgggagggt

SEQ ID NO: 943296 - DNA, 22 bp, Artificial Sequence
  chemically synthesized
acagcaccagcacctgctgctc

SEQ ID NO: 943297 - DNA, 22 bp, Artificial Sequence
  chemically synthesized
ccgctggcctgagcagcaggtg

SEQ ID NO: 943298 - DNA, 22 bp, Artificial Sequence
  chemically synthesized
ctaacagcaccagcacctgctg

SEQ ID NO: 943299 - DNA, 22 bp, Artificial Sequence
  chemically synthesized
gcctgagcagcaggtgctggtg

SEQ ID NO: 943300 - DNA, 22 bp, Artificial Sequence
  chemically synthesized
agcagcaggtgctggtgctgtt

SEQ ID NO: 943301 - DNA, 22 bp, Artificial Sequence
  chemically synthesized
tgtcgacattactaacagcacc

SEQ ID NO: 943302 - DNA, 22 bp, Artificial Sequence
  chemically synthesized
atgtcgacattactaacagcac

SEQ ID NO: 943303 - DNA, 22 bp, Artificial Sequence
  chemically synthesized
cttatgtcgacattactaacag

SEQ ID NO: 943304 - DNA, 22 bp, Artificial Sequence
  chemically synthesized
cctccttatgtcgacattacta

SEQ ID NO: 943305 - DNA, 22 bp, Artificial Sequence
  chemically synthesized
gtgctgttagtaatgtcgacat

SEQ ID NO: 943306 - DNA, 22 bp, Artificial Sequence
  chemically synthesized
ttagtaatgtcgacataaggag

SEQ ID NO: 943307 - DNA, 22 bp, Artificial Sequence
  chemically synthesized
gtaatgtcgacataaggaggca

SEQ ID NO: 943308 - DNA, 22 bp, Artificial Sequence
  chemically synthesized
catggccagagaaaccattgcc

SEQ ID NO: 943309 - DNA, 22 bp, Artificial Sequence
  chemically synthesized
ccatggccagagaaaccattgc

SEQ ID NO: 943310 - DNA, 22 bp, Artificial Sequence
  chemically synthesized
aatcacaacatatcttccatgg

SEQ ID NO: 943311 - DNA, 22 bp, Artificial Sequence
  chemically synthesized
aattaaatcacaacatatcttc

SEQ ID NO: 943312 - DNA, 22 bp, Artificial Sequence
  chemically synthesized
ctctggccatggaagatatgtt

SEQ ID NO: 943313 - DNA, 22 bp, Artificial Sequence
  chemically synthesized
gaattaaatcacaacatatctt

SEQ ID NO: 943314 - DNA, 22 bp, Artificial Sequence
  chemically synthesized
tctggccatggaagatatgttg

SEQ ID NO: 943315 - DNA, 22 bp, Artificial Sequence
  chemically synthesized
ttgaattaaatcacaacatatc

SEQ ID NO: 943316 - DNA, 22 bp, Artificial Sequence
  chemically synthesized
tggccatggaagatatgttgtg

SEQ ID NO: 943317 - DNA, 22 bp, Artificial Sequence
  chemically synthesized
gccatggaagatatgttgtgat

SEQ ID NO: 943318 - DNA, 22 bp, Artificial Sequence
  chemically synthesized
aaggaattcttgaattaaatca

SEQ ID NO: 943319 - DNA, 22 bp, Artificial Sequence
  chemically synthesized
aactgaaggaattcttgaatta

SEQ ID NO: 943320 - DNA, 22 bp, Artificial Sequence
  chemically synthesized
taaactgaaggaattcttgaat

SEQ ID NO: 943321 - DNA, 22 bp, Artificial Sequence
  chemically synthesized
tgatttaattcaagaattcctt

SEQ ID NO: 943322 - DNA, 22 bp, Artificial Sequence
  chemically synthesized
atagacctctaaactgaaggaa

SEQ ID NO: 943323 - DNA, 22 bp, Artificial Sequence
  chemically synthesized
aatagacctctaaactgaagga

SEQ ID NO: 943324 - DNA, 22 bp, Artificial Sequence
  chemically synthesized
aattcaagaattccttcagttt

SEQ ID NO: 943325 - DNA, 22 bp, Artificial Sequence
  chemically synthesized
attcaagaattccttcagttta

SEQ ID NO: 943326 - DNA, 22 bp, Artificial Sequence
  chemically synthesized
aagaattccttcagtttagagg

SEQ ID NO: 943327 - DNA, 22 bp, Artificial Sequence
  chemically synthesized
cttcagtttagaggtctattaa

SEQ ID NO: 943328 - DNA, 22 bp, Artificial Sequence
  chemically synthesized
cagtttagaggtctattaaatg

SEQ ID NO: 943329 - DNA, 22 bp, Artificial Sequence
  chemically synthesized
agtttagaggtctattaaatga

SEQ ID NO: 943330 - DNA, 22 bp, Artificial Sequence
  chemically synthesized
cataacagaaggtcatttaata

SEQ ID NO: 943331 - DNA, 22 bp, Artificial Sequence
  chemically synthesized
agaggtctattaaatgaccttc

SEQ ID NO: 943332 - DNA, 22 bp, Artificial Sequence
  chemically synthesized
gaggtctattaaatgaccttct

SEQ ID NO: 943333 - DNA, 22 bp, Artificial Sequence
  chemically synthesized
cagattgcataacagaaggtca

SEQ ID NO: 943334 - DNA, 22 bp, Artificial Sequence
  chemically synthesized
ttaaatgaccttctgttatgca

SEQ ID NO: 943335 - DNA, 22 bp, Artificial Sequence
  chemically synthesized
atgactgcagattgcataacag

SEQ ID NO: 943336 - DNA, 22 bp, Artificial Sequence
  chemically synthesized
catgactgcagattgcataaca

SEQ ID NO: 943337 - DNA, 22 bp, Artificial Sequence
  chemically synthesized
aatgaccttctgttatgcaatc

SEQ ID NO: 943338 - DNA, 22 bp, Artificial Sequence
  chemically synthesized
agatttcatgactgcagattgc

SEQ ID NO: 943339 - DNA, 22 bp, Artificial Sequence
  chemically synthesized
aagatttcatgactgcagattg

SEQ ID NO: 943340 - DNA, 22 bp, Artificial Sequence
  chemically synthesized
taagatttcatgactgcagatt

SEQ ID NO: 943341 - DNA, 22 bp, Artificial Sequence
  chemically synthesized
tttaagatttcatgactgcaga

SEQ ID NO: 943342 - DNA, 22 bp, Artificial Sequence
  chemically synthesized
ctgttatgcaatctgcagtcat

SEQ ID NO: 943343 - DNA, 22 bp, Artificial Sequence
  chemically synthesized
ctttaagatttcatgactgcag

SEQ ID NO: 943344 - DNA, 22 bp, Artificial Sequence
  chemically synthesized
tgttatgcaatctgcagtcatg

SEQ ID NO: 943345 - DNA, 22 bp, Artificial Sequence
  chemically synthesized
ttctttaagatttcatgactgc

SEQ ID NO: 943346 - DNA, 22 bp, Artificial Sequence
  chemically synthesized
ttatgcaatctgcagtcatgaa

SEQ ID NO: 943347 - DNA, 22 bp, Artificial Sequence
  chemically synthesized
tcttctttaagatttcatgact

SEQ ID NO: 943348 - DNA, 22 bp, Artificial Sequence
  chemically synthesized
ctcttctttaagatttcatgac

SEQ ID NO: 943349 - DNA, 22 bp, Artificial Sequence
  chemically synthesized
tgcaatctgcagtcatgaaatc

SEQ ID NO: 943350 - DNA, 22 bp, Artificial Sequence
  chemically synthesized
tctcttctttaagatttcatga

SEQ ID NO: 943351 - DNA, 22 bp, Artificial Sequence
  chemically synthesized
cagtcatgaaatcttaaagaag

SEQ ID NO: 943352 - DNA, 22 bp, Artificial Sequence
  chemically synthesized
aaacaaaggtgttttctcttct

SEQ ID NO: 943353 - DNA, 22 bp, Artificial Sequence
  chemically synthesized
ggctaaaacaaaggtgttttct

SEQ ID NO: 943354 - DNA, 22 bp, Artificial Sequence
  chemically synthesized
aaagaagagaaaacacctttgt

SEQ ID NO: 943355 - DNA, 22 bp, Artificial Sequence
  chemically synthesized
cattaggctaaaacaaaggtgt

SEQ ID NO: 943356 - DNA, 22 bp, Artificial Sequence
  chemically synthesized
aagaagagaaaacacctttgtt

SEQ ID NO: 943357 - DNA, 22 bp, Artificial Sequence
  chemically synthesized
tccattaggctaaaacaaaggt

SEQ ID NO: 943358 - DNA, 22 bp, Artificial Sequence
  chemically synthesized
ttctccattaggctaaaacaaa

SEQ ID NO: 943359 - DNA, 22 bp, Artificial Sequence
  chemically synthesized
ggattgttctccattaggctaa

SEQ ID NO: 943360 - DNA, 22 bp, Artificial Sequence
  chemically synthesized
gggattgttctccattaggcta

SEQ ID NO: 943361 - DNA, 22 bp, Artificial Sequence
  chemically synthesized
tgttttagcctaatggagaaca

SEQ ID NO: 943362 - DNA, 22 bp, Artificial Sequence
  chemically synthesized
gttttagcctaatggagaacaa

SEQ ID NO: 943363 - DNA, 22 bp, Artificial Sequence
  chemically synthesized
ttttagcctaatggagaacaat

SEQ ID NO: 943364 - DNA, 22 bp, Artificial Sequence
  chemically synthesized
ccagatccttgggattgttctc

SEQ ID NO: 943365 - DNA, 22 bp, Artificial Sequence
  chemically synthesized
tagcctaatggagaacaatccc

SEQ ID NO: 943366 - DNA, 22 bp, Artificial Sequence
  chemically synthesized
agcctaatggagaacaatccca

SEQ ID NO: 943367 - DNA, 22 bp, Artificial Sequence
  chemically synthesized
gcctaatggagaacaatcccaa

SEQ ID NO: 943368 - DNA, 22 bp, Artificial Sequence
  chemically synthesized
atggagaacaatcccaaggatc

SEQ ID NO: 943369 - DNA, 22 bp, Artificial Sequence
  chemically synthesized
aggtgaaatagagtataatagt

SEQ ID NO: 943370 - DNA, 22 bp, Artificial Sequence
  chemically synthesized
ggaatactattatactctattt

SEQ ID NO: 943371 - DNA, 22 bp, Artificial Sequence
  chemically synthesized
ttatactctatttcaccttaat

SEQ ID NO: 943372 - DNA, 22 bp, Artificial Sequence
  chemically synthesized
tactctatttcaccttaatgtc

SEQ ID NO: 943373 - DNA, 22 bp, Artificial Sequence
  chemically synthesized
tatttcaccttaatgtcctcgc

SEQ ID NO: 943374 - DNA, 22 bp, Artificial Sequence
  chemically synthesized
agaacaacaagtgcgaggacat

SEQ ID NO: 943375 - DNA, 22 bp, Artificial Sequence
  chemically synthesized
cagaacaacaagtgcgaggaca

SEQ ID NO: 943376 - DNA, 22 bp, Artificial Sequence
  chemically synthesized
tttcaccttaatgtcctcgcac

SEQ ID NO: 943377 - DNA, 22 bp, Artificial Sequence
  chemically synthesized
tcagaacaacaagtgcgaggac

SEQ ID NO: 943378 - DNA, 22 bp, Artificial Sequence
  chemically synthesized
caccttaatgtcctcgcacttg

SEQ ID NO: 943379 - DNA, 22 bp, Artificial Sequence
  chemically synthesized
accttaatgtcctcgcacttgt

SEQ ID NO: 943380 - DNA, 22 bp, Artificial Sequence
  chemically synthesized
aatgtcctcgcacttgttgttc

SEQ ID NO: 943381 - DNA, 22 bp, Artificial Sequence
  chemically synthesized
atgtcctcgcacttgttgttct

SEQ ID NO: 943382 - DNA, 22 bp, Artificial Sequence
  chemically synthesized
gcacttgttgttctgaaagccc

SEQ ID NO: 943383 - DNA, 22 bp, Artificial Sequence
  chemically synthesized
gttgttctgaaagcccctccct

SEQ ID NO: 943384 - DNA, 22 bp, Artificial Sequence
  chemically synthesized
ttgttctgaaagcccctccctt

SEQ ID NO: 943385 - DNA, 22 bp, Artificial Sequence
  chemically synthesized
ttctgaaagcccctccctttcc

SEQ ID NO: 943386 - DNA, 22 bp, Artificial Sequence
  chemically synthesized
tgaaagcccctccctttccctc

SEQ ID NO: 943387 - DNA, 22 bp, Artificial Sequence
  chemically synthesized
aaagcccctccctttccctcct

SEQ ID NO: 943388 - DNA, 22 bp, Artificial Sequence
  chemically synthesized
cctttccctcctgcttccgggt

SEQ ID NO: 943389 - DNA, 22 bp, Artificial Sequence
  chemically synthesized
tccctcctgcttccgggtcacc

SEQ ID NO: 943390 - DNA, 22 bp, Artificial Sequence
  chemically synthesized
ccctcctgcttccgggtcaccc

SEQ ID NO: 943391 - DNA, 22 bp, Artificial Sequence
  chemically synthesized
cctcctgcttccgggtcaccct

SEQ ID NO: 943392 - DNA, 22 bp, Artificial Sequence
  chemically synthesized
ctgcttccgggtcacccttact

SEQ ID NO: 943393 - DNA, 22 bp, Artificial Sequence
  chemically synthesized
cttccgggtcacccttactcat

SEQ ID NO: 943394 - DNA, 22 bp, Artificial Sequence
  chemically synthesized
ccgggtcacccttactcatcta

SEQ ID NO: 943395 - DNA, 22 bp, Artificial Sequence
  chemically synthesized
aaatagatgtgatagatgagta

SEQ ID NO: 943396 - DNA, 22 bp, Artificial Sequence
  chemically synthesized
cgggtcacccttactcatctat

SEQ ID NO: 943397 - DNA, 22 bp, Artificial Sequence
  chemically synthesized
ggtgctaaaatagatgtgatag

SEQ ID NO: 943398 - DNA, 22 bp, Artificial Sequence
  chemically synthesized
gtctgggtgctaaaatagatgt

SEQ ID NO: 943399 - DNA, 22 bp, Artificial Sequence
  chemically synthesized
actcatctatcacatctatttt

SEQ ID NO: 943400 - DNA, 22 bp, Artificial Sequence
  chemically synthesized
agtctgggtgctaaaatagatg

SEQ ID NO: 943401 - DNA, 22 bp, Artificial Sequence
  chemically synthesized
ctcatctatcacatctatttta

SEQ ID NO: 943402 - DNA, 22 bp, Artificial Sequence
  chemically synthesized
atctatcacatctattttagca

SEQ ID NO: 943403 - DNA, 22 bp, Artificial Sequence
  chemically synthesized
tcttagtctgggtgctaaaata

SEQ ID NO: 943404 - DNA, 22 bp, Artificial Sequence
  chemically synthesized
tcacatctattttagcacccag

SEQ ID NO: 943405 - DNA, 22 bp, Artificial Sequence
  chemically synthesized
gggtggtactatcttagtctgg

SEQ ID NO: 943406 - DNA, 22 bp, Artificial Sequence
  chemically synthesized
ttttagcacccagactaagata

SEQ ID NO: 943407 - DNA, 22 bp, Artificial Sequence
  chemically synthesized
actcgggtggtactatcttagt

SEQ ID NO: 943408 - DNA, 22 bp, Artificial Sequence
  chemically synthesized
cactcgggtggtactatcttag

SEQ ID NO: 943409 - DNA, 22 bp, Artificial Sequence
  chemically synthesized
tagcacccagactaagatagta

SEQ ID NO: 943410 - DNA, 22 bp, Artificial Sequence
  chemically synthesized
agcacccagactaagatagtac

SEQ ID NO: 943411 - DNA, 22 bp, Artificial Sequence
  chemically synthesized
gcacccagactaagatagtacc

SEQ ID NO: 943412 - DNA, 22 bp, Artificial Sequence
  chemically synthesized
agaaagacttcactcgggtggt

SEQ ID NO: 943413 - DNA, 22 bp, Artificial Sequence
  chemically synthesized
gagaaagacttcactcgggtgg

SEQ ID NO: 943414 - DNA, 22 bp, Artificial Sequence
  chemically synthesized
agatagtaccacccgagtgaag

SEQ ID NO: 943415 - DNA, 22 bp, Artificial Sequence
  chemically synthesized
ggcagcatgaccagagatagga

SEQ ID NO: 943416 - DNA, 22 bp, Artificial Sequence
  chemically synthesized
tctcaaatgtcctatctctggt

SEQ ID NO: 943417 - DNA, 22 bp, Artificial Sequence
  chemically synthesized
ctcaaatgtcctatctctggtc

SEQ ID NO: 943418 - DNA, 22 bp, Artificial Sequence
  chemically synthesized
tcaaatgtcctatctctggtca

SEQ ID NO: 943419 - DNA, 22 bp, Artificial Sequence
  chemically synthesized
aaatgtcctatctctggtcatg

SEQ ID NO: 943420 - DNA, 22 bp, Artificial Sequence
  chemically synthesized
caagaactaggcagcatgacca

SEQ ID NO: 943421 - DNA, 22 bp, Artificial Sequence
  chemically synthesized
tctctggtcatgctgcctagtt

SEQ ID NO: 943422 - DNA, 22 bp, Artificial Sequence
  chemically synthesized
tggtcatgctgcctagttcttg

SEQ ID NO: 943423 - DNA, 22 bp, Artificial Sequence
  chemically synthesized
gtcatgctgcctagttcttgga

SEQ ID NO: 943424 - DNA, 22 bp, Artificial Sequence
  chemically synthesized
cctagttcttggagtgcatttc

SEQ ID NO: 943425 - DNA, 22 bp, Artificial Sequence
  chemically synthesized
gttcttggagtgcatttccgtc

SEQ ID NO: 943426 - DNA, 22 bp, Artificial Sequence
  chemically synthesized
ttggagtgcatttccgtcatgg

SEQ ID NO: 943427 - DNA, 22 bp, Artificial Sequence
  chemically synthesized
ggagtgcatttccgtcatggta

SEQ ID NO: 943428 - DNA, 22 bp, Artificial Sequence
  chemically synthesized
gagtgcatttccgtcatggtac

SEQ ID NO: 943429 - DNA, 22 bp, Artificial Sequence
  chemically synthesized
atgcagtgtaatgagtaccatg

SEQ ID NO: 943430 - DNA, 22 bp, Artificial Sequence
  chemically synthesized
tcatgcagtgtaatgagtacca

SEQ ID NO: 943431 - DNA, 22 bp, Artificial Sequence
  chemically synthesized
ccgtcatggtactcattacact

SEQ ID NO: 943432 - DNA, 22 bp, Artificial Sequence
  chemically synthesized
cgtcatggtactcattacactg

SEQ ID NO: 943433 - DNA, 22 bp, Artificial Sequence
  chemically synthesized
attacactgcatgagaactggg

SEQ ID NO: 943434 - DNA, 22 bp, Artificial Sequence
  chemically synthesized
cactgcatgagaactgggatta

SEQ ID NO: 943435 - DNA, 22 bp, Artificial Sequence
  chemically synthesized
catgagaactgggattatccta

SEQ ID NO: 943436 - DNA, 22 bp, Artificial Sequence
  chemically synthesized
tggggaggtgagtaggataatc

SEQ ID NO: 943437 - DNA, 22 bp, Artificial Sequence
  chemically synthesized
gtggggaggtgagtaggataat

SEQ ID NO: 943438 - DNA, 22 bp, Artificial Sequence
  chemically synthesized
tgtggggaggtgagtaggataa

SEQ ID NO: 943439 - DNA, 22 bp, Artificial Sequence
  chemically synthesized
tgctttgtggggaggtgagtag

SEQ ID NO: 943440 - DNA, 22 bp, Artificial Sequence
  chemically synthesized
gtgctttgtggggaggtgagta

SEQ ID NO: 943441 - DNA, 22 bp, Artificial Sequence
  chemically synthesized
ggattatcctactcacctcccc

SEQ ID NO: 943442 - DNA, 22 bp, Artificial Sequence
  chemically synthesized
tgtgcttgtgctttgtggggag

SEQ ID NO: 943443 - DNA, 22 bp, Artificial Sequence
  chemically synthesized
tcctactcacctccccacaaag

SEQ ID NO: 943444 - DNA, 22 bp, Artificial Sequence
  chemically synthesized
tcctatgtgcttgtgctttgtg

SEQ ID NO: 943445 - DNA, 22 bp, Artificial Sequence
  chemically synthesized
ctcacctccccacaaagcacaa

SEQ ID NO: 943446 - DNA, 22 bp, Artificial Sequence
  chemically synthesized
tgtcctatgtgcttgtgctttg

SEQ ID NO: 943447 - DNA, 22 bp, Artificial Sequence
  chemically synthesized
acctccccacaaagcacaagca

SEQ ID NO: 943448 - DNA, 22 bp, Artificial Sequence
  chemically synthesized
cccacaaagcacaagcacatag

SEQ ID NO: 943449 - DNA, 22 bp, Artificial Sequence
  chemically synthesized
gataccgcctctgtcctatgtg

SEQ ID NO: 943450 - DNA, 22 bp, Artificial Sequence
  chemically synthesized
gagagaaaaagatgtgctagat

SEQ ID NO: 943451 - DNA, 22 bp, Artificial Sequence
  chemically synthesized
ggaagtgctggagagaaaaaga

SEQ ID NO: 943452 - DNA, 22 bp, Artificial Sequence
  chemically synthesized
ctaggaagtgctggagagaaaa

SEQ ID NO: 943453 - DNA, 22 bp, Artificial Sequence
  chemically synthesized
gcacatctttttctctccagca

SEQ ID NO: 943454 - DNA, 22 bp, Artificial Sequence
  chemically synthesized
tgccaggcactgctaggaagtg

SEQ ID NO: 943455 - DNA, 22 bp, Artificial Sequence
  chemically synthesized
tttctctccagcacttcctagc

SEQ ID NO: 943456 - DNA, 22 bp, Artificial Sequence
  chemically synthesized
ttctctccagcacttcctagca

SEQ ID NO: 943457 - DNA, 22 bp, Artificial Sequence
  chemically synthesized
tgtgccaggcactgctaggaag

SEQ ID NO: 943458 - DNA, 22 bp, Artificial Sequence
  chemically synthesized
tctctccagcacttcctagcag

SEQ ID NO: 943459 - DNA, 22 bp, Artificial Sequence
  chemically synthesized
ctctccagcacttcctagcagt

SEQ ID NO: 943460 - DNA, 22 bp, Artificial Sequence
  chemically synthesized
tctgtgccaggcactgctagga

SEQ ID NO: 943461 - DNA, 22 bp, Artificial Sequence
  chemically synthesized
tctccagcacttcctagcagtg

SEQ ID NO: 943462 - DNA, 22 bp, Artificial Sequence
  chemically synthesized
ctctgtgccaggcactgctagg

SEQ ID NO: 943463 - DNA, 22 bp, Artificial Sequence
  chemically synthesized
tccagcacttcctagcagtgcc

SEQ ID NO: 943464 - DNA, 22 bp, Artificial Sequence
  chemically synthesized
cagcacttcctagcagtgcctg

SEQ ID NO: 943465 - DNA, 22 bp, Artificial Sequence
  chemically synthesized
cctagcagtgcctggcacagag

SEQ ID NO: 943466 - DNA, 22 bp, Artificial Sequence
  chemically synthesized
cgtatgtaccttctctgtgcca

SEQ ID NO: 943467 - DNA, 22 bp, Artificial Sequence
  chemically synthesized
ctagcagtgcctggcacagaga

SEQ ID NO: 943468 - DNA, 22 bp, Artificial Sequence
  chemically synthesized
gcagtgcctggcacagagaagg

SEQ ID NO: 943469 - DNA, 22 bp, Artificial Sequence
  chemically synthesized
tggaagatgttacgtatgtacc

SEQ ID NO: 943470 - DNA, 22 bp, Artificial Sequence
  chemically synthesized
gtggaagatgttacgtatgtac

SEQ ID NO: 943471 - DNA, 22 bp, Artificial Sequence
  chemically synthesized
gcacagagaaggtacatacgta

SEQ ID NO: 943472 - DNA, 22 bp, Artificial Sequence
  chemically synthesized
ttgtggaagatgttacgtatgt

SEQ ID NO: 943473 - DNA, 22 bp, Artificial Sequence
  chemically synthesized
cttgtggaagatgttacgtatg

SEQ ID NO: 943474 - DNA, 22 bp, Artificial Sequence
  chemically synthesized
aaagaacttcttgtggaagatg

SEQ ID NO: 943475 - DNA, 22 bp, Artificial Sequence
  chemically synthesized
caaagaacttcttgtggaagat

SEQ ID NO: 943476 - DNA, 22 bp, Artificial Sequence
  chemically synthesized
gtgcttcaaagaacttcttgtg

SEQ ID NO: 943477 - DNA, 22 bp, Artificial Sequence
  chemically synthesized
ccacaagaagttctttgaagca

SEQ ID NO: 943478 - DNA, 22 bp, Artificial Sequence
  chemically synthesized
cacaagaagttctttgaagcac

SEQ ID NO: 943479 - DNA, 22 bp, Artificial Sequence
  chemically synthesized
tttgaagcaccaatcccaccat

SEQ ID NO: 943480 - DNA, 22 bp, Artificial Sequence
  chemically synthesized
gcaagtatagcagatggtggga

SEQ ID NO: 943481 - DNA, 22 bp, Artificial Sequence
  chemically synthesized
tgaagcaccaatcccaccatct

SEQ ID NO: 943482 - DNA, 22 bp, Artificial Sequence
  chemically synthesized
gaagcaccaatcccaccatctg

SEQ ID NO: 943483 - DNA, 22 bp, Artificial Sequence
  chemically synthesized
aagcaccaatcccaccatctgc

SEQ ID NO: 943484 - DNA, 22 bp, Artificial Sequence
  chemically synthesized
gaaacactagcaagtatagcag

SEQ ID NO: 943485 - DNA, 22 bp, Artificial Sequence
  chemically synthesized
ggaaacactagcaagtatagca

SEQ ID NO: 943486 - DNA, 22 bp, Artificial Sequence
  chemically synthesized
ctatacttgctagtgtttccaa

SEQ ID NO: 943487 - DNA, 22 bp, Artificial Sequence
  chemically synthesized
tacttgctagtgtttccaagat

SEQ ID NO: 943488 - DNA, 22 bp, Artificial Sequence
  chemically synthesized
gctagtgtttccaagatacttc

SEQ ID NO: 943489 - DNA, 22 bp, Artificial Sequence
  chemically synthesized
ctagtgtttccaagatacttct

SEQ ID NO: 943490 - DNA, 22 bp, Artificial Sequence
  chemically synthesized
gtgtttccaagatacttctgga

SEQ ID NO: 943491 - DNA, 22 bp, Artificial Sequence
  chemically synthesized
gaagaaataccgagggatccag

SEQ ID NO: 943492 - DNA, 22 bp, Artificial Sequence
  chemically synthesized
ccaagatacttctggatccctc

SEQ ID NO: 943493 - DNA, 22 bp, Artificial Sequence
  chemically synthesized
ggaagaaataccgagggatcca

SEQ ID NO: 943494 - DNA, 22 bp, Artificial Sequence
  chemically synthesized
caagatacttctggatccctcg

SEQ ID NO: 943495 - DNA, 22 bp, Artificial Sequence
  chemically synthesized
catttggaagaaataccgaggg

SEQ ID NO: 943496 - DNA, 22 bp, Artificial Sequence
  chemically synthesized
ctggatccctcggtatttcttc

SEQ ID NO: 943497 - DNA, 22 bp, Artificial Sequence
  chemically synthesized
tggatccctcggtatttcttcc

SEQ ID NO: 943498 - DNA, 22 bp, Artificial Sequence
  chemically synthesized
gatccctcggtatttcttccaa

SEQ ID NO: 943499 - DNA, 22 bp, Artificial Sequence
  chemically synthesized
ggtatttcttccaaatgtagtg

SEQ ID NO: 943500 - DNA, 22 bp, Artificial Sequence
  chemically synthesized
atgatcaaaggcataaacacta

SEQ ID NO: 943501 - DNA, 22 bp, Artificial Sequence
  chemically synthesized
cttccaaatgtagtgtttatgc

SEQ ID NO: 943502 - DNA, 22 bp, Artificial Sequence
  chemically synthesized
ttccaaatgtagtgtttatgcc

SEQ ID NO: 943503 - DNA, 22 bp, Artificial Sequence
  chemically synthesized
ccaaatgtagtgtttatgcctt

SEQ ID NO: 943504 - DNA, 22 bp, Artificial Sequence
  chemically synthesized
caaatgtagtgtttatgccttt

SEQ ID NO: 943505 - DNA, 22 bp, Artificial Sequence
  chemically synthesized
tgaaatgatcactgatgatcaa

SEQ ID NO: 943506 - DNA, 22 bp, Artificial Sequence
  chemically synthesized
gtgaaatgatcactgatgatca

SEQ ID NO: 943507 - DNA, 22 bp, Artificial Sequence
  chemically synthesized
atgcctttgatcatcagtgatc

SEQ ID NO: 943508 - DNA, 22 bp, Artificial Sequence
  chemically synthesized
tgcctttgatcatcagtgatca

SEQ ID NO: 943509 - DNA, 22 bp, Artificial Sequence
  chemically synthesized
tgatcatcagtgatcatttcac

SEQ ID NO: 943510 - DNA, 22 bp, Artificial Sequence
  chemically synthesized
gcacacacacttgtgaaatgat

SEQ ID NO: 943511 - DNA, 22 bp, Artificial Sequence
  chemically synthesized
gatcatcagtgatcatttcaca

SEQ ID NO: 943512 - DNA, 22 bp, Artificial Sequence
  chemically synthesized
atcatcagtgatcatttcacaa

SEQ ID NO: 943513 - DNA, 22 bp, Artificial Sequence
  chemically synthesized
tggtcagggctagcacacacac

SEQ ID NO: 943514 - DNA, 22 bp, Artificial Sequence
  chemically synthesized
atggtcagggctagcacacaca

SEQ ID NO: 943515 - DNA, 22 bp, Artificial Sequence
  chemically synthesized
cacaagtgtgtgtgctagccct

SEQ ID NO: 943516 - DNA, 22 bp, Artificial Sequence
  chemically synthesized
acaagtgtgtgtgctagccctg

SEQ ID NO: 943517 - DNA, 22 bp, Artificial Sequence
  chemically synthesized
atggtgcttatggtcagggcta

SEQ ID NO: 943518 - DNA, 22 bp, Artificial Sequence
  chemically synthesized
tcatggtgcttatggtcagggc

SEQ ID NO: 943519 - DNA, 22 bp, Artificial Sequence
  chemically synthesized
gccctgaccataagcaccatga

SEQ ID NO: 943520 - DNA, 22 bp, Artificial Sequence
  chemically synthesized
tgaacacaatagattctcatgg

SEQ ID NO: 943521 - DNA, 22 bp, Artificial Sequence
  chemically synthesized
accataagcaccatgagaatct

SEQ ID NO: 943522 - DNA, 22 bp, Artificial Sequence
  chemically synthesized
atgataaaactgtgaacacaat

SEQ ID NO: 943523 - DNA, 22 bp, Artificial Sequence
  chemically synthesized
aaaatgctgatgataaaactgt

SEQ ID NO: 943524 - DNA, 22 bp, Artificial Sequence
  chemically synthesized
taaaaatgctgatgataaaact

SEQ ID NO: 943525 - DNA, 22 bp, Artificial Sequence
  chemically synthesized
ttgtgttcacagttttatcatc

SEQ ID NO: 943526 - DNA, 22 bp, Artificial Sequence
  chemically synthesized
tgttcacagttttatcatcagc

SEQ ID NO: 943527 - DNA, 22 bp, Artificial Sequence
  chemically synthesized
acagttttatcatcagcatttt

SEQ ID NO: 943528 - DNA, 22 bp, Artificial Sequence
  chemically synthesized
caagtgccatatattctaaaaa

SEQ ID NO: 943529 - DNA, 22 bp, Artificial Sequence
  chemically synthesized
tatcatcagcatttttagaata

SEQ ID NO: 943530 - DNA, 22 bp, Artificial Sequence
  chemically synthesized
gcaagtgccatatattctaaaa

SEQ ID NO: 943531 - DNA, 22 bp, Artificial Sequence
  chemically synthesized
atcatcagcatttttagaatat

SEQ ID NO: 943532 - DNA, 22 bp, Artificial Sequence
  chemically synthesized
tcatcagcatttttagaatata

SEQ ID NO: 943533 - DNA, 22 bp, Artificial Sequence
  chemically synthesized
agaacttgcaagtgccatatat

SEQ ID NO: 943534 - DNA, 22 bp, Artificial Sequence
  chemically synthesized
ctgagaacttgcaagtgccata

SEQ ID NO: 943535 - DNA, 22 bp, Artificial Sequence
  chemically synthesized
actgagaacttgcaagtgccat

SEQ ID NO: 943536 - DNA, 22 bp, Artificial Sequence
  chemically synthesized
ttagaatatatggcacttgcaa

SEQ ID NO: 943537 - DNA, 22 bp, Artificial Sequence
  chemically synthesized
tagaatatatggcacttgcaag

SEQ ID NO: 943538 - DNA, 22 bp, Artificial Sequence
  chemically synthesized
agaatatatggcacttgcaagt

SEQ ID NO: 943539 - DNA, 22 bp, Artificial Sequence
  chemically synthesized
gaatatatggcacttgcaagtt

SEQ ID NO: 943540 - DNA, 22 bp, Artificial Sequence
  chemically synthesized
atcaggcagatatttactgaga

SEQ ID NO: 943541 - DNA, 22 bp, Artificial Sequence
  chemically synthesized
catcaggcagatatttactgag

SEQ ID NO: 943542 - DNA, 22 bp, Artificial Sequence
  chemically synthesized
tttcatcaggcagatatttact

SEQ ID NO: 943543 - DNA, 22 bp, Artificial Sequence
  chemically synthesized
gtttcatcaggcagatatttac

SEQ ID NO: 943544 - DNA, 22 bp, Artificial Sequence
  chemically synthesized
gcaagttctcagtaaatatctg

SEQ ID NO: 943545 - DNA, 22 bp, Artificial Sequence
  chemically synthesized
caagttctcagtaaatatctgc

SEQ ID NO: 943546 - DNA, 22 bp, Artificial Sequence
  chemically synthesized
tttgtttcatcaggcagatatt

SEQ ID NO: 943547 - DNA, 22 bp, Artificial Sequence
  chemically synthesized
atttgtttcatcaggcagatat

SEQ ID NO: 943548 - DNA, 22 bp, Artificial Sequence
  chemically synthesized
tcagtaaatatctgcctgatga

SEQ ID NO: 943549 - DNA, 22 bp, Artificial Sequence
  chemically synthesized
agtaaatatctgcctgatgaaa

SEQ ID NO: 943550 - DNA, 22 bp, Artificial Sequence
  chemically synthesized
cagaaacttatttgtttcatca

SEQ ID NO: 943551 - DNA, 22 bp, Artificial Sequence
  chemically synthesized
acagaaacttatttgtttcatc

SEQ ID NO: 943552 - DNA, 22 bp, Artificial Sequence
  chemically synthesized
tacagaaacttatttgtttcat

SEQ ID NO: 943553 - DNA, 22 bp, Artificial Sequence
  chemically synthesized
cctgatgaaacaaataagtttc

SEQ ID NO: 943554 - DNA, 22 bp, Artificial Sequence
  chemically synthesized
acagcccattttacagaaactt

SEQ ID NO: 943555 - DNA, 22 bp, Artificial Sequence
  chemically synthesized
atgaaacaaataagtttctgta

SEQ ID NO: 943556 - DNA, 22 bp, Artificial Sequence
  chemically synthesized
aacagcccattttacagaaact

SEQ ID NO: 943557 - DNA, 22 bp, Artificial Sequence
  chemically synthesized
tgtttaacagcccattttacag

SEQ ID NO: 943558 - DNA, 22 bp, Artificial Sequence
  chemically synthesized
atctgtgtttaacagcccattt

SEQ ID NO: 943559 - DNA, 22 bp, Artificial Sequence
  chemically synthesized
catctgtgtttaacagcccatt

SEQ ID NO: 943560 - DNA, 22 bp, Artificial Sequence
  chemically synthesized
tcatctgtgtttaacagcccat

SEQ ID NO: 943561 - DNA, 22 bp, Artificial Sequence
  chemically synthesized
ttcatctgtgtttaacagccca

SEQ ID NO: 943562 - DNA, 22 bp, Artificial Sequence
  chemically synthesized
ctgtaaaatgggctgttaaaca

SEQ ID NO: 943563 - DNA, 22 bp, Artificial Sequence
  chemically synthesized
tgtaaaatgggctgttaaacac

SEQ ID NO: 943564 - DNA, 22 bp, Artificial Sequence
  chemically synthesized
taaaatgggctgttaaacacag

SEQ ID NO: 943565 - DNA, 22 bp, Artificial Sequence
  chemically synthesized
aaaacttttcatctgtgtttaa

SEQ ID NO: 943566 - DNA, 22 bp, Artificial Sequence
  chemically synthesized
aaaaacttttcatctgtgttta

SEQ ID NO: 943567 - DNA, 22 bp, Artificial Sequence
  chemically synthesized
taaaaacttttcatctgtgttt

SEQ ID NO: 943568 - DNA, 22 bp, Artificial Sequence
  chemically synthesized
ttaaaaacttttcatctgtgtt

SEQ ID NO: 943569 - DNA, 22 bp, Artificial Sequence
  chemically synthesized
atgtttttaaaaacttttcatc

SEQ ID NO: 943570 - DNA, 22 bp, Artificial Sequence
  chemically synthesized
ttaaacacagatgaaaagtttt

SEQ ID NO: 943571 - DNA, 22 bp, Artificial Sequence
  chemically synthesized
aacacagatgaaaagtttttaa

SEQ ID NO: 943572 - DNA, 22 bp, Artificial Sequence
  chemically synthesized
aagccctgatgtttttaaaaac

SEQ ID NO: 943573 - DNA, 22 bp, Artificial Sequence
  chemically synthesized
actgaagccctgatgtttttaa

SEQ ID NO: 943574 - DNA, 22 bp, Artificial Sequence
  chemically synthesized
aactgaagccctgatgttttta

SEQ ID NO: 943575 - DNA, 22 bp, Artificial Sequence
  chemically synthesized
cttaactgaagccctgatgttt

SEQ ID NO: 943576 - DNA, 22 bp, Artificial Sequence
  chemically synthesized
acttaactgaagccctgatgtt

SEQ ID NO: 943577 - DNA, 22 bp, Artificial Sequence
  chemically synthesized
ttaaaaacatcagggcttcagt

SEQ ID NO: 943578 - DNA, 22 bp, Artificial Sequence
  chemically synthesized
taaaaacatcagggcttcagtt

SEQ ID NO: 943579 - DNA, 22 bp, Artificial Sequence
  chemically synthesized
aaaaacatcagggcttcagtta

SEQ ID NO: 943580 - DNA, 22 bp, Artificial Sequence
  chemically synthesized
aaaacatcagggcttcagttaa

SEQ ID NO: 943581 - DNA, 22 bp, Artificial Sequence
  chemically synthesized
tcccaaatatttacttaactga

SEQ ID NO: 943582 - DNA, 22 bp, Artificial Sequence
  chemically synthesized
atcccaaatatttacttaactg

SEQ ID NO: 943583 - DNA, 22 bp, Artificial Sequence
  chemically synthesized
ttatcccaaatatttacttaac

SEQ ID NO: 943584 - DNA, 22 bp, Artificial Sequence
  chemically synthesized
cttatcccaaatatttacttaa

SEQ ID NO: 943585 - DNA, 22 bp, Artificial Sequence
  chemically synthesized
cagcttcttatcccaaatattt

SEQ ID NO: 943586 - DNA, 22 bp, Artificial Sequence
  chemically synthesized
acagcttcttatcccaaatatt

SEQ ID NO: 943587 - DNA, 22 bp, Artificial Sequence
  chemically synthesized
cagttaagtaaatatttgggat

SEQ ID NO: 943588 - DNA, 22 bp, Artificial Sequence
  chemically synthesized
agttaagtaaatatttgggata

SEQ ID NO: 943589 - DNA, 22 bp, Artificial Sequence
  chemically synthesized
gtatttacagcttcttatccca

SEQ ID NO: 943590 - DNA, 22 bp, Artificial Sequence
  chemically synthesized
agtaaatatttgggataagaag

SEQ ID NO: 943591 - DNA, 22 bp, Artificial Sequence
  chemically synthesized
gacgttagtatttacagcttct

SEQ ID NO: 943592 - DNA, 22 bp, Artificial Sequence
  chemically synthesized
cactcgacgttagtatttacag

SEQ ID NO: 943593 - DNA, 22 bp, Artificial Sequence
  chemically synthesized
gggataagaagctgtaaatact

SEQ ID NO: 943594 - DNA, 22 bp, Artificial Sequence
  chemically synthesized
ggataagaagctgtaaatacta

SEQ ID NO: 943595 - DNA, 22 bp, Artificial Sequence
  chemically synthesized
ttgcactcgacgttagtattta

SEQ ID NO: 943596 - DNA, 22 bp, Artificial Sequence
  chemically synthesized
gttgcactcgacgttagtattt

SEQ ID NO: 943597 - DNA, 22 bp, Artificial Sequence
  chemically synthesized
acatatttgttgcactcgacgt

SEQ ID NO: 943598 - DNA, 22 bp, Artificial Sequence
  chemically synthesized
taaatactaacgtcgagtgcaa

SEQ ID NO: 943599 - DNA, 22 bp, Artificial Sequence
  chemically synthesized
tgttgacatatttgttgcactc

SEQ ID NO: 943600 - DNA, 22 bp, Artificial Sequence
  chemically synthesized
gtgttgacatatttgttgcact

SEQ ID NO: 943601 - DNA, 22 bp, Artificial Sequence
  chemically synthesized
ttgtgttgacatatttgttgca

SEQ ID NO: 943602 - DNA, 22 bp, Artificial Sequence
  chemically synthesized
cttgtgttgacatatttgttgc

SEQ ID NO: 943603 - DNA, 22 bp, Artificial Sequence
  chemically synthesized
acgtcgagtgcaacaaatatgt

SEQ ID NO: 943604 - DNA, 22 bp, Artificial Sequence
  chemically synthesized
aatgacttcttgtgttgacata

SEQ ID NO: 943605 - DNA, 22 bp, Artificial Sequence
  chemically synthesized
ctcaatgacttcttgtgttgac

SEQ ID NO: 943606 - DNA, 22 bp, Artificial Sequence
  chemically synthesized
tactcaatgacttcttgtgttg

SEQ ID NO: 943607 - DNA, 22 bp, Artificial Sequence
  chemically synthesized
ctactcaatgacttcttgtgtt

SEQ ID NO: 943608 - DNA, 22 bp, Artificial Sequence
  chemically synthesized
tgacaatacttctactcaatga

SEQ ID NO: 943609 - DNA, 22 bp, Artificial Sequence
  chemically synthesized
atgacaatacttctactcaatg

SEQ ID NO: 943610 - DNA, 22 bp, Artificial Sequence
  chemically synthesized
tatgacaatacttctactcaat

SEQ ID NO: 943611 - DNA, 22 bp, Artificial Sequence
  chemically synthesized
ccaacacattttatgacaatac

SEQ ID NO: 943612 - DNA, 22 bp, Artificial Sequence
  chemically synthesized
agtagaagtattgtcataaaat

SEQ ID NO: 943613 - DNA, 22 bp, Artificial Sequence
  chemically synthesized
tcataaaatgtgttgggagctt

SEQ ID NO: 943614 - DNA, 22 bp, Artificial Sequence
  chemically synthesized
tgggagcataaaaagctcccaa

SEQ ID NO: 943615 - DNA, 22 bp, Artificial Sequence
  chemically synthesized
atgggagcataaaaagctccca

SEQ ID NO: 943616 - DNA, 22 bp, Artificial Sequence
  chemically synthesized
tatgggagcataaaaagctccc

SEQ ID NO: 943617 - DNA, 22 bp, Artificial Sequence
  chemically synthesized
cccaagcattttatgggagcat

SEQ ID NO: 943618 - DNA, 22 bp, Artificial Sequence
  chemically synthesized
ggagctttttatgctcccataa

SEQ ID NO: 943619 - DNA, 22 bp, Artificial Sequence
  chemically synthesized
ctccccaagcattttatgggag

SEQ ID NO: 943620 - DNA, 22 bp, Artificial Sequence
  chemically synthesized
tttatgctcccataaaatgctt

SEQ ID NO: 943621 - DNA, 22 bp, Artificial Sequence
  chemically synthesized
ttatgctcccataaaatgcttg

SEQ ID NO: 943622 - DNA, 22 bp, Artificial Sequence
  chemically synthesized
tatgctcccataaaatgcttgg

SEQ ID NO: 943623 - DNA, 22 bp, Artificial Sequence
  chemically synthesized
atgctcccataaaatgcttggg

SEQ ID NO: 943624 - DNA, 22 bp, Artificial Sequence
  chemically synthesized
tgctcccataaaatgcttgggg

SEQ ID NO: 943625 - DNA, 22 bp, Artificial Sequence
  chemically synthesized
ccataaaatgcttggggagcaa

SEQ ID NO: 943626 - DNA, 22 bp, Artificial Sequence
  chemically synthesized
aatgcaaaaggattgctcccca

SEQ ID NO: 943627 - DNA, 22 bp, Artificial Sequence
  chemically synthesized
taaatgcaaaaggattgctccc

SEQ ID NO: 943628 - DNA, 22 bp, Artificial Sequence
  chemically synthesized
aatggtctctaaatgcaaaagg

SEQ ID NO: 943629 - DNA, 22 bp, Artificial Sequence
  chemically synthesized
ggggagcaatccttttgcattt

SEQ ID NO: 943630 - DNA, 22 bp, Artificial Sequence
  chemically synthesized
gggagcaatccttttgcattta

SEQ ID NO: 943631 - DNA, 22 bp, Artificial Sequence
  chemically synthesized
caaaagaaatactaaatggtct

SEQ ID NO: 943632 - DNA, 22 bp, Artificial Sequence
  chemically synthesized
ccaaaagaaatactaaatggtc

SEQ ID NO: 943633 - DNA, 22 bp, Artificial Sequence
  chemically synthesized
ttgcatttagagaccatttagt

SEQ ID NO: 943634 - DNA, 22 bp, Artificial Sequence
  chemically synthesized
tgcatttagagaccatttagta

SEQ ID NO: 943635 - DNA, 22 bp, Artificial Sequence
  chemically synthesized
gcatttagagaccatttagtat

SEQ ID NO: 943636 - DNA, 22 bp, Artificial Sequence
  chemically synthesized
catttagagaccatttagtatt

SEQ ID NO: 943637 - DNA, 22 bp, Artificial Sequence
  chemically synthesized
agagaccatttagtatttcttt

SEQ ID NO: 943638 - DNA, 22 bp, Artificial Sequence
  chemically synthesized
gagaccatttagtatttctttt

SEQ ID NO: 943639 - DNA, 22 bp, Artificial Sequence
  chemically synthesized
aaacaaagccgtttccaaaaga

SEQ ID NO: 943640 - DNA, 22 bp, Artificial Sequence
  chemically synthesized
agtatttcttttggaaacggct

SEQ ID NO: 943641 - DNA, 22 bp, Artificial Sequence
  chemically synthesized
gtatttcttttggaaacggctt

SEQ ID NO: 943642 - DNA, 22 bp, Artificial Sequence
  chemically synthesized
cttttggaaacggctttgtttg

SEQ ID NO: 943643 - DNA, 22 bp, Artificial Sequence
  chemically synthesized
ttttggaaacggctttgtttga

SEQ ID NO: 943644 - DNA, 22 bp, Artificial Sequence
  chemically synthesized
ttggaaacggctttgtttgaat

SEQ ID NO: 943645 - DNA, 22 bp, Artificial Sequence
  chemically synthesized
tggaaacggctttgtttgaatt

SEQ ID NO: 943646 - DNA, 22 bp, Artificial Sequence
  chemically synthesized
ggaaacggctttgtttgaattc

SEQ ID NO: 943647 - DNA, 22 bp, Artificial Sequence
  chemically synthesized
gaaacggctttgtttgaattcc

SEQ ID NO: 943648 - DNA, 22 bp, Artificial Sequence
  chemically synthesized
tgtttgaattcccattccattt

SEQ ID NO: 943649 - DNA, 22 bp, Artificial Sequence
  chemically synthesized
gaagaagcccgtaaatggaatg

SEQ ID NO: 943650 - DNA, 22 bp, Artificial Sequence
  chemically synthesized
gtttgaattcccattccattta

SEQ ID NO: 943651 - DNA, 22 bp, Artificial Sequence
  chemically synthesized
ggaagaagcccgtaaatggaat

SEQ ID NO: 943652 - DNA, 22 bp, Artificial Sequence
  chemically synthesized
tttgaattcccattccatttac

SEQ ID NO: 943653 - DNA, 22 bp, Artificial Sequence
  chemically synthesized
tggaagaagcccgtaaatggaa

SEQ ID NO: 943654 - DNA, 22 bp, Artificial Sequence
  chemically synthesized
tttggaagaagcccgtaaatgg

SEQ ID NO: 943655 - DNA, 22 bp, Artificial Sequence
  chemically synthesized
gaattcccattccatttacggg

SEQ ID NO: 943656 - DNA, 22 bp, Artificial Sequence
  chemically synthesized
aattcccattccatttacgggc

SEQ ID NO: 943657 - DNA, 22 bp, Artificial Sequence
  chemically synthesized
ccattccatttacgggcttctt

SEQ ID NO: 943658 - DNA, 22 bp, Artificial Sequence
  chemically synthesized
agaagaaattctttggaagaag

SEQ ID NO: 943659 - DNA, 22 bp, Artificial Sequence
  chemically synthesized
catttacgggcttcttccaaag

SEQ ID NO: 943660 - DNA, 22 bp, Artificial Sequence
  chemically synthesized
acgggcttcttccaaagaattt

SEQ ID NO: 943661 - DNA, 22 bp, Artificial Sequence
  chemically synthesized
cgggcttcttccaaagaatttc

SEQ ID NO: 943662 - DNA, 22 bp, Artificial Sequence
  chemically synthesized
cagacatatctgagaagaaatt

SEQ ID NO: 943663 - DNA, 22 bp, Artificial Sequence
  chemically synthesized
cttccaaagaatttcttctcag

SEQ ID NO: 943664 - DNA, 22 bp, Artificial Sequence
  chemically synthesized
ttccaaagaatttcttctcaga

SEQ ID NO: 943665 - DNA, 22 bp, Artificial Sequence
  chemically synthesized
ccaaagaatttcttctcagata

SEQ ID NO: 943666 - DNA, 22 bp, Artificial Sequence
  chemically synthesized
caaagaatttcttctcagatat

SEQ ID NO: 943667 - DNA, 22 bp, Artificial Sequence
  chemically synthesized
cttctcagatatgtctggaatc

SEQ ID NO: 943668 - DNA, 22 bp, Artificial Sequence
  chemically synthesized
ttctcagatatgtctggaatct

SEQ ID NO: 943669 - DNA, 22 bp, Artificial Sequence
  chemically synthesized
ctcagatatgtctggaatctcc

SEQ ID NO: 943670 - DNA, 22 bp, Artificial Sequence
  chemically synthesized
tcagatatgtctggaatctcct

SEQ ID NO: 943671 - DNA, 22 bp, Artificial Sequence
  chemically synthesized
agatatgtctggaatctccttt

SEQ ID NO: 943672 - DNA, 22 bp, Artificial Sequence
  chemically synthesized
gaatctcctttttaccttttga

SEQ ID NO: 943673 - DNA, 22 bp, Artificial Sequence
  chemically synthesized
cccaaacaataaccaatcaaaa

SEQ ID NO: 943674 - DNA, 22 bp, Artificial Sequence
  chemically synthesized
gcccaaacaataaccaatcaaa

SEQ ID NO: 943675 - DNA, 22 bp, Artificial Sequence
  chemically synthesized
ctttttaccttttgattggtta

SEQ ID NO: 943676 - DNA, 22 bp, Artificial Sequence
  chemically synthesized
tttaccttttgattggttattg

SEQ ID NO: 943677 - DNA, 22 bp, Artificial Sequence
  chemically synthesized
ttaccttttgattggttattgt

SEQ ID NO: 943678 - DNA, 22 bp, Artificial Sequence
  chemically synthesized
taccttttgattggttattgtt

SEQ ID NO: 943679 - DNA, 22 bp, Artificial Sequence
  chemically synthesized
accttttgattggttattgttt

SEQ ID NO: 943680 - DNA, 22 bp, Artificial Sequence
  chemically synthesized
ccttttgattggttattgtttg

SEQ ID NO: 943681 - DNA, 22 bp, Artificial Sequence
  chemically synthesized
ttgattggttattgtttgggca

SEQ ID NO: 943682 - DNA, 22 bp, Artificial Sequence
  chemically synthesized
acaatgagtgtttgcccaaaca

SEQ ID NO: 943683 - DNA, 22 bp, Artificial Sequence
  chemically synthesized
tgattggttattgtttgggcaa

SEQ ID NO: 943684 - DNA, 22 bp, Artificial Sequence
  chemically synthesized
gattggttattgtttgggcaaa

SEQ ID NO: 943685 - DNA, 22 bp, Artificial Sequence
  chemically synthesized
attggttattgtttgggcaaac

SEQ ID NO: 943686 - DNA, 22 bp, Artificial Sequence
  chemically synthesized
gttgacaatgagtgtttgccca

SEQ ID NO: 943687 - DNA, 22 bp, Artificial Sequence
  chemically synthesized
gttattgtttgggcaaacactc

SEQ ID NO: 943688 - DNA, 22 bp, Artificial Sequence
  chemically synthesized
ctagttgacaatgagtgtttgc

SEQ ID NO: 943689 - DNA, 22 bp, Artificial Sequence
  chemically synthesized
ttgtttgggcaaacactcattg

SEQ ID NO: 943690 - DNA, 22 bp, Artificial Sequence
  chemically synthesized
tttgggcaaacactcattgtca

SEQ ID NO: 943691 - DNA, 22 bp, Artificial Sequence
  chemically synthesized
tcagttgctagttgacaatgag

SEQ ID NO: 943692 - DNA, 22 bp, Artificial Sequence
  chemically synthesized
atcagttgctagttgacaatga

SEQ ID NO: 943693 - DNA, 22 bp, Artificial Sequence
  chemically synthesized
gggcaaacactcattgtcaact

SEQ ID NO: 943694 - DNA, 22 bp, Artificial Sequence
  chemically synthesized
ggcaaacactcattgtcaacta

SEQ ID NO: 943695 - DNA, 22 bp, Artificial Sequence
  chemically synthesized
cttatcagttgctagttgacaa

SEQ ID NO: 943696 - DNA, 22 bp, Artificial Sequence
  chemically synthesized
acttatcagttgctagttgaca

SEQ ID NO: 943697 - DNA, 22 bp, Artificial Sequence
  chemically synthesized
tacttatcagttgctagttgac

SEQ ID NO: 943698 - DNA, 22 bp, Artificial Sequence
  chemically synthesized
cctttacttatcagttgctagt

SEQ ID NO: 943699 - DNA, 22 bp, Artificial Sequence
  chemically synthesized
ccctttacttatcagttgctag

SEQ ID NO: 943700 - DNA, 22 bp, Artificial Sequence
  chemically synthesized
tccctttacttatcagttgcta

SEQ ID NO: 943701 - DNA, 22 bp, Artificial Sequence
  chemically synthesized
ttccctttacttatcagttgct

SEQ ID NO: 943702 - DNA, 22 bp, Artificial Sequence
  chemically synthesized
attgtcaactagcaactgataa

SEQ ID NO: 943703 - DNA, 22 bp, Artificial Sequence
  chemically synthesized
tatttttccctttacttatcag

SEQ ID NO: 943704 - DNA, 22 bp, Artificial Sequence
  chemically synthesized
tcaactagcaactgataagtaa

SEQ ID NO: 943705 - DNA, 22 bp, Artificial Sequence
  chemically synthesized
gtaattgtatttttccctttac

SEQ ID NO: 943706 - DNA, 22 bp, Artificial Sequence
  chemically synthesized
gcaactgataagtaaagggaaa

SEQ ID NO: 943707 - DNA, 22 bp, Artificial Sequence
  chemically synthesized
ataagtaaagggaaaaatacaa

SEQ ID NO: 943708 - DNA, 22 bp, Artificial Sequence
  chemically synthesized
aaaaactggtaattgtattttt

SEQ ID NO: 943709 - DNA, 22 bp, Artificial Sequence
  chemically synthesized
ttgaaaaactggtaattgtatt

SEQ ID NO: 943710 - DNA, 22 bp, Artificial Sequence
  chemically synthesized
aaaattattgaaaaactggtaa

SEQ ID NO: 943711 - DNA, 22 bp, Artificial Sequence
  chemically synthesized
caaaattattgaaaaactggta

SEQ ID NO: 943712 - DNA, 22 bp, Artificial Sequence
  chemically synthesized
atgcttcaaaattattgaaaaa

SEQ ID NO: 943713 - DNA, 22 bp, Artificial Sequence
  chemically synthesized
ttgatgcttcaaaattattgaa

SEQ ID NO: 943714 - DNA, 22 bp, Artificial Sequence
  chemically synthesized
tattgatgcttcaaaattattg

SEQ ID NO: 943715 - DNA, 22 bp, Artificial Sequence
  chemically synthesized
ctattgatgcttcaaaattatt

SEQ ID NO: 943716 - DNA, 22 bp, Artificial Sequence
  chemically synthesized
ccagtttttcaataattttgaa

SEQ ID NO: 943717 - DNA, 22 bp, Artificial Sequence
  chemically synthesized
atccgtttctattgatgcttca

SEQ ID NO: 943718 - DNA, 22 bp, Artificial Sequence
  chemically synthesized
ttcaataattttgaagcatcaa

SEQ ID NO: 943719 - DNA, 22 bp, Artificial Sequence
  chemically synthesized
aatccgtttctattgatgcttc

SEQ ID NO: 943720 - DNA, 22 bp, Artificial Sequence
  chemically synthesized
tcaataattttgaagcatcaat

SEQ ID NO: 943721 - DNA, 22 bp, Artificial Sequence
  chemically synthesized
caataattttgaagcatcaata

SEQ ID NO: 943722 - DNA, 22 bp, Artificial Sequence
  chemically synthesized
aataattttgaagcatcaatag

SEQ ID NO: 943723 - DNA, 22 bp, Artificial Sequence
  chemically synthesized
tgaagcatcaatagaaacggat

SEQ ID NO: 943724 - DNA, 22 bp, Artificial Sequence
  chemically synthesized
gaagcatcaatagaaacggatt

SEQ ID NO: 943725 - DNA, 22 bp, Artificial Sequence
  chemically synthesized
aagcatcaatagaaacggatta

SEQ ID NO: 943726 - DNA, 22 bp, Artificial Sequence
  chemically synthesized
aaggcaatgtgatatttaatcc

SEQ ID NO: 943727 - DNA, 22 bp, Artificial Sequence
  chemically synthesized
gaaggcaatgtgatatttaatc

SEQ ID NO: 943728 - DNA, 22 bp, Artificial Sequence
  chemically synthesized
tgaaggcaatgtgatatttaat

SEQ ID NO: 943729 - DNA, 22 bp, Artificial Sequence
  chemically synthesized
ttgaaggcaatgtgatatttaa

SEQ ID NO: 943730 - DNA, 22 bp, Artificial Sequence
  chemically synthesized
tttgaaggcaatgtgatattta

SEQ ID NO: 943731 - DNA, 22 bp, Artificial Sequence
  chemically synthesized
gcccctttttgaaggcaatgtg

SEQ ID NO: 943732 - DNA, 22 bp, Artificial Sequence
  chemically synthesized
ggcccctttttgaaggcaatgt

SEQ ID NO: 943733 - DNA, 22 bp, Artificial Sequence
  chemically synthesized
ccttggcccctttttgaaggca

SEQ ID NO: 943734 - DNA, 22 bp, Artificial Sequence
  chemically synthesized
accttggcccctttttgaaggc

SEQ ID NO: 943735 - DNA, 22 bp, Artificial Sequence
  chemically synthesized
aatatcacattgccttcaaaaa

SEQ ID NO: 943736 - DNA, 22 bp, Artificial Sequence
  chemically synthesized
ccttaccttggcccctttttga

SEQ ID NO: 943737 - DNA, 22 bp, Artificial Sequence
  chemically synthesized
tctcccttaccttggccccttt

SEQ ID NO: 943738 - DNA, 22 bp, Artificial Sequence
  chemically synthesized
atctcccttaccttggcccctt

SEQ ID NO: 943739 - DNA, 22 bp, Artificial Sequence
  chemically synthesized
tatctcccttaccttggcccct

SEQ ID NO: 943740 - DNA, 22 bp, Artificial Sequence
  chemically synthesized
ttatctcccttaccttggcccc

SEQ ID NO: 943741 - DNA, 22 bp, Artificial Sequence
  chemically synthesized
ccttcaaaaaggggccaaggta

SEQ ID NO: 943742 - DNA, 22 bp, Artificial Sequence
  chemically synthesized
ttttatctcccttaccttggcc

SEQ ID NO: 943743 - DNA, 22 bp, Artificial Sequence
  chemically synthesized
caaaaaggggccaaggtaaggg

SEQ ID NO: 943744 - DNA, 22 bp, Artificial Sequence
  chemically synthesized
cctcttttatctcccttacctt

SEQ ID NO: 943745 - DNA, 22 bp, Artificial Sequence
  chemically synthesized
aaaaaggggccaaggtaaggga

SEQ ID NO: 943746 - DNA, 22 bp, Artificial Sequence
  chemically synthesized
gcctcttttatctcccttacct

SEQ ID NO: 943747 - DNA, 22 bp, Artificial Sequence
  chemically synthesized
ccatttgcctcttttatctccc

SEQ ID NO: 943748 - DNA, 22 bp, Artificial Sequence
  chemically synthesized
caaactcccatttgcctctttt

SEQ ID NO: 943749 - DNA, 22 bp, Artificial Sequence
  chemically synthesized
ccaaactcccatttgcctcttt

SEQ ID NO: 943750 - DNA, 22 bp, Artificial Sequence
  chemically synthesized
agcagagcttccaaactcccat

SEQ ID NO: 943751 - DNA, 22 bp, Artificial Sequence
  chemically synthesized
gagcagagcttccaaactccca

SEQ ID NO: 943752 - DNA, 22 bp, Artificial Sequence
  chemically synthesized
tgagcagagcttccaaactccc

SEQ ID NO: 943753 - DNA, 22 bp, Artificial Sequence
  chemically synthesized
ataatactttgagcagagcttc

SEQ ID NO: 943754 - DNA, 22 bp, Artificial Sequence
  chemically synthesized
taaaacattcataatactttga

SEQ ID NO: 943755 - DNA, 22 bp, Artificial Sequence
  chemically synthesized
ggaagctctgctcaaagtatta

SEQ ID NO: 943756 - DNA, 22 bp, Artificial Sequence
  chemically synthesized
gaagctctgctcaaagtattat

SEQ ID NO: 943757 - DNA, 22 bp, Artificial Sequence
  chemically synthesized
tgctcaaagtattatgaatgtt

SEQ ID NO: 943758 - DNA, 22 bp, Artificial Sequence
  chemically synthesized
aaatacattgtaaaacattcat

SEQ ID NO: 943759 - DNA, 22 bp, Artificial Sequence
  chemically synthesized
ctcaaagtattatgaatgtttt

SEQ ID NO: 943760 - DNA, 22 bp, Artificial Sequence
  chemically synthesized
aaagtattatgaatgttttaca

SEQ ID NO: 943761 - DNA, 22 bp, Artificial Sequence
  chemically synthesized
acctgaaatacattgtaaaaca

SEQ ID NO: 943762 - DNA, 22 bp, Artificial Sequence
  chemically synthesized
ttgacctgaaatacattgtaaa

SEQ ID NO: 943763 - DNA, 22 bp, Artificial Sequence
  chemically synthesized
gttgacctgaaatacattgtaa

SEQ ID NO: 943764 - DNA, 22 bp, Artificial Sequence
  chemically synthesized
tgaatgttttacaatgtatttc

SEQ ID NO: 943765 - DNA, 22 bp, Artificial Sequence
  chemically synthesized
tacaatgtatttcaggtcaaca

SEQ ID NO: 943766 - DNA, 22 bp, Artificial Sequence
  chemically synthesized
acaatgtatttcaggtcaacaa

SEQ ID NO: 943767 - DNA, 22 bp, Artificial Sequence
  chemically synthesized
caatgtatttcaggtcaacaaa

SEQ ID NO: 943768 - DNA, 22 bp, Artificial Sequence
  chemically synthesized
caggtcaacaaacattggcatc

SEQ ID NO: 943769 - DNA, 22 bp, Artificial Sequence
  chemically synthesized
aggtcaacaaacattggcatcg

SEQ ID NO: 943770 - DNA, 22 bp, Artificial Sequence
  chemically synthesized
aaaaatgcaacgacgatgccaa

SEQ ID NO: 943771 - DNA, 22 bp, Artificial Sequence
  chemically synthesized
tgaaaaatgcaacgacgatgcc

SEQ ID NO: 943772 - DNA, 22 bp, Artificial Sequence
  chemically synthesized
ctgaaaaatgcaacgacgatgc

SEQ ID NO: 943773 - DNA, 22 bp, Artificial Sequence
  chemically synthesized
tctgaaaaatgcaacgacgatg

SEQ ID NO: 943774 - DNA, 22 bp, Artificial Sequence
  chemically synthesized
ttctgaaaaatgcaacgacgat

SEQ ID NO: 943775 - DNA, 22 bp, Artificial Sequence
  chemically synthesized
ttttctgaaaaatgcaacgacg

SEQ ID NO: 943776 - DNA, 22 bp, Artificial Sequence
  chemically synthesized
cattcttttctgaaaaatgcaa

SEQ ID NO: 943777 - DNA, 22 bp, Artificial Sequence
  chemically synthesized
acattcttttctgaaaaatgca

SEQ ID NO: 943778 - DNA, 22 bp, Artificial Sequence
  chemically synthesized
gcatcgtcgttgcatttttcag

SEQ ID NO: 943779 - DNA, 22 bp, Artificial Sequence
  chemically synthesized
ccagcttacattcttttctgaa

SEQ ID NO: 943780 - DNA, 22 bp, Artificial Sequence
  chemically synthesized
cccagcttacattcttttctga

SEQ ID NO: 943781 - DNA, 22 bp, Artificial Sequence
  chemically synthesized
tcccagcttacattcttttctg

SEQ ID NO: 943782 - DNA, 22 bp, Artificial Sequence
  chemically synthesized
ttcccagcttacattcttttct

SEQ ID NO: 943783 - DNA, 22 bp, Artificial Sequence
  chemically synthesized
tttcccagcttacattcttttc

SEQ ID NO: 943784 - DNA, 22 bp, Artificial Sequence
  chemically synthesized
ttttcccagcttacattctttt

SEQ ID NO: 943785 - DNA, 22 bp, Artificial Sequence
  chemically synthesized
catttttcagaaaagaatgtaa

SEQ ID NO: 943786 - DNA, 22 bp, Artificial Sequence
  chemically synthesized
aacttttttcccagcttacatt

SEQ ID NO: 943787 - DNA, 22 bp, Artificial Sequence
  chemically synthesized
ttcagaaaagaatgtaagctgg

SEQ ID NO: 943788 - DNA, 22 bp, Artificial Sequence
  chemically synthesized
taaacttttttcccagcttaca

SEQ ID NO: 943789 - DNA, 22 bp, Artificial Sequence
  chemically synthesized
tcagaaaagaatgtaagctggg

SEQ ID NO: 943790 - DNA, 22 bp, Artificial Sequence
  chemically synthesized
cagaaaagaatgtaagctggga

SEQ ID NO: 943791 - DNA, 22 bp, Artificial Sequence
  chemically synthesized
agaaaagaatgtaagctgggaa

SEQ ID NO: 943792 - DNA, 22 bp, Artificial Sequence
  chemically synthesized
cctctaaacttttttcccagct

SEQ ID NO: 943793 - DNA, 22 bp, Artificial Sequence
  chemically synthesized
gcctctaaacttttttcccagc

SEQ ID NO: 943794 - DNA, 22 bp, Artificial Sequence
  chemically synthesized
atttgcctctaaacttttttcc

SEQ ID NO: 943795 - DNA, 22 bp, Artificial Sequence
  chemically synthesized
aatttgcctctaaacttttttc

SEQ ID NO: 943796 - DNA, 22 bp, Artificial Sequence
  chemically synthesized
aagtcttaatttgcctctaaac

SEQ ID NO: 943797 - DNA, 22 bp, Artificial Sequence
  chemically synthesized
tcaagtcttaatttgcctctaa

SEQ ID NO: 943798 - DNA, 22 bp, Artificial Sequence
  chemically synthesized
ggaaaaaagtttagaggcaaat

SEQ ID NO: 943799 - DNA, 22 bp, Artificial Sequence
  chemically synthesized
tctctcaagtcttaatttgcct

SEQ ID NO: 943800 - DNA, 22 bp, Artificial Sequence
  chemically synthesized
gaactgtctctcaagtcttaat

SEQ ID NO: 943801 - DNA, 22 bp, Artificial Sequence
  chemically synthesized
agaactgtctctcaagtcttaa

SEQ ID NO: 943802 - DNA, 22 bp, Artificial Sequence
  chemically synthesized
agaggcaaattaagacttgaga

SEQ ID NO: 943803 - DNA, 22 bp, Artificial Sequence
  chemically synthesized
gaggcaaattaagacttgagag

SEQ ID NO: 943804 - DNA, 22 bp, Artificial Sequence
  chemically synthesized
cacttagaactgtctctcaagt

SEQ ID NO: 943805 - DNA, 22 bp, Artificial Sequence
  chemically synthesized
ccacttagaactgtctctcaag

SEQ ID NO: 943806 - DNA, 22 bp, Artificial Sequence
  chemically synthesized
tttccacttagaactgtctctc

SEQ ID NO: 943807 - DNA, 22 bp, Artificial Sequence
  chemically synthesized
atttccacttagaactgtctct

SEQ ID NO: 943808 - DNA, 22 bp, Artificial Sequence
  chemically synthesized
agacttgagagacagttctaag

SEQ ID NO: 943809 - DNA, 22 bp, Artificial Sequence
  chemically synthesized
gagagacagttctaagtggaaa

SEQ ID NO: 943810 - DNA, 22 bp, Artificial Sequence
  chemically synthesized
ccatcccccttatttccactta

SEQ ID NO: 943811 - DNA, 22 bp, Artificial Sequence
  chemically synthesized
agagacagttctaagtggaaat

SEQ ID NO: 943812 - DNA, 22 bp, Artificial Sequence
  chemically synthesized
cccatcccccttatttccactt

SEQ ID NO: 943813 - DNA, 22 bp, Artificial Sequence
  chemically synthesized
tcccatcccccttatttccact

SEQ ID NO: 943814 - DNA, 22 bp, Artificial Sequence
  chemically synthesized
ttcccatcccccttatttccac

SEQ ID NO: 943815 - DNA, 22 bp, Artificial Sequence
  chemically synthesized
ttttcccatcccccttatttcc

SEQ ID NO: 943816 - DNA, 22 bp, Artificial Sequence
  chemically synthesized
taagtggaaataagggggatgg

SEQ ID NO: 943817 - DNA, 22 bp, Artificial Sequence
  chemically synthesized
agtggaaataagggggatggga

SEQ ID NO: 943818 - DNA, 22 bp, Artificial Sequence
  chemically synthesized
aatacagggttcttttcccatc

SEQ ID NO: 943819 - DNA, 22 bp, Artificial Sequence
  chemically synthesized
caatacagggttcttttcccat

SEQ ID NO: 943820 - DNA, 22 bp, Artificial Sequence
  chemically synthesized
tgggtgagaaggaaatcaatga

SEQ ID NO: 943821 - DNA, 22 bp, Artificial Sequence
  chemically synthesized
atgggtgagaaggaaatcaatg

SEQ ID NO: 943822 - DNA, 22 bp, Artificial Sequence
  chemically synthesized
tattgaaacatcattgatttcc

SEQ ID NO: 943823 - DNA, 22 bp, Artificial Sequence
  chemically synthesized
aaacatcattgatttccttctc

SEQ ID NO: 943824 - DNA, 22 bp, Artificial Sequence
  chemically synthesized
gcagagtgtaggtttatgggtg

SEQ ID NO: 943825 - DNA, 22 bp, Artificial Sequence
  chemically synthesized
agcagagtgtaggtttatgggt

SEQ ID NO: 943826 - DNA, 22 bp, Artificial Sequence
  chemically synthesized
atttccttctcacccataaacc

SEQ ID NO: 943827 - DNA, 22 bp, Artificial Sequence
  chemically synthesized
tagcagagtgtaggtttatggg

SEQ ID NO: 943828 - DNA, 22 bp, Artificial Sequence
  chemically synthesized
ccttctcacccataaacctaca

SEQ ID NO: 943829 - DNA, 22 bp, Artificial Sequence
  chemically synthesized
cttctcacccataaacctacac

SEQ ID NO: 943830 - DNA, 22 bp, Artificial Sequence
  chemically synthesized
ctcacccataaacctacactct

SEQ ID NO: 943831 - DNA, 22 bp, Artificial Sequence
  chemically synthesized
acacattttagcagagtgtagg

SEQ ID NO: 943832 - DNA, 22 bp, Artificial Sequence
  chemically synthesized
tcacccataaacctacactctg

SEQ ID NO: 943833 - DNA, 22 bp, Artificial Sequence
  chemically synthesized
acccataaacctacactctgct

SEQ ID NO: 943834 - DNA, 22 bp, Artificial Sequence
  chemically synthesized
cagttaacacattttagcagag

SEQ ID NO: 943835 - DNA, 22 bp, Artificial Sequence
  chemically synthesized
ctgcagttaacacattttagca

SEQ ID NO: 943836 - DNA, 22 bp, Artificial Sequence
  chemically synthesized
gctgcagttaacacattttagc

SEQ ID NO: 943837 - DNA, 22 bp, Artificial Sequence
  chemically synthesized
tgctgcagttaacacattttag

SEQ ID NO: 943838 - DNA, 22 bp, Artificial Sequence
  chemically synthesized
cactctgctaaaatgtgttaac

SEQ ID NO: 943839 - DNA, 22 bp, Artificial Sequence
  chemically synthesized
atcattttgctgcagttaacac

SEQ ID NO: 943840 - DNA, 22 bp, Artificial Sequence
  chemically synthesized
tgctaaaatgtgttaactgcag

SEQ ID NO: 943841 - DNA, 22 bp, Artificial Sequence
  chemically synthesized
ctaaaatgtgttaactgcagca

SEQ ID NO: 943842 - DNA, 22 bp, Artificial Sequence
  chemically synthesized
aaatgtgttaactgcagcaaaa

SEQ ID NO: 943843 - DNA, 22 bp, Artificial Sequence
  chemically synthesized
accgagttaatcattttgctgc

SEQ ID NO: 943844 - DNA, 22 bp, Artificial Sequence
  chemically synthesized
gactcaccgagttaatcatttt

SEQ ID NO: 943845 - DNA, 22 bp, Artificial Sequence
  chemically synthesized
actgcagcaaaatgattaactc

SEQ ID NO: 943846 - DNA, 22 bp, Artificial Sequence
  chemically synthesized
cagcaaaatgattaactcggtg

SEQ ID NO: 943847 - DNA, 22 bp, Artificial Sequence
  chemically synthesized
ccacatgctagactcaccgagt

SEQ ID NO: 943848 - DNA, 22 bp, Artificial Sequence
  chemically synthesized
cccacatgctagactcaccgag

SEQ ID NO: 943849 - DNA, 22 bp, Artificial Sequence
  chemically synthesized
cttcccacatgctagactcacc

SEQ ID NO: 943850 - DNA, 22 bp, Artificial Sequence
  chemically synthesized
acttcccacatgctagactcac

SEQ ID NO: 943851 - DNA, 22 bp, Artificial Sequence
  chemically synthesized
actcggtgagtctagcatgtgg

SEQ ID NO: 943852 - DNA, 22 bp, Artificial Sequence
  chemically synthesized
ggtgagtctagcatgtgggaag

SEQ ID NO: 943853 - DNA, 22 bp, Artificial Sequence
  chemically synthesized
catatgtcatttacttcccaca

SEQ ID NO: 943854 - DNA, 22 bp, Artificial Sequence
  chemically synthesized
gttacatatgtcatttacttcc

SEQ ID NO: 943855 - DNA, 22 bp, Artificial Sequence
  chemically synthesized
ctcgttacatatgtcatttact

SEQ ID NO: 943856 - DNA, 22 bp, Artificial Sequence
  chemically synthesized
gcatgtgggaagtaaatgacat

SEQ ID NO: 943857 - DNA, 22 bp, Artificial Sequence
  chemically synthesized
caggccagttcctcgttacata

SEQ ID NO: 943858 - DNA, 22 bp, Artificial Sequence
  chemically synthesized
cctccaggccagttcctcgtta

SEQ ID NO: 943859 - DNA, 22 bp, Artificial Sequence
  chemically synthesized
gcgctacctccaggccagttcc

SEQ ID NO: 943860 - DNA, 22 bp, Artificial Sequence
  chemically synthesized
tggcgctacctccaggccagtt

SEQ ID NO: 943861 - DNA, 22 bp, Artificial Sequence
  chemically synthesized
ctggcgctacctccaggccagt

SEQ ID NO: 943862 - DNA, 22 bp, Artificial Sequence
  chemically synthesized
gatatacttctggcgctacctc

SEQ ID NO: 943863 - DNA, 22 bp, Artificial Sequence
  chemically synthesized
ggatatacttctggcgctacct

SEQ ID NO: 943864 - DNA, 22 bp, Artificial Sequence
  chemically synthesized
gcctggaggtagcgccagaagt

SEQ ID NO: 943865 - DNA, 22 bp, Artificial Sequence
  chemically synthesized
ccatcttggatatacttctggc

SEQ ID NO: 943866 - DNA, 22 bp, Artificial Sequence
  chemically synthesized
gccatcttggatatacttctgg

SEQ ID NO: 943867 - DNA, 22 bp, Artificial Sequence
  chemically synthesized
gaggtagcgccagaagtatatc

SEQ ID NO: 943868 - DNA, 22 bp, Artificial Sequence
  chemically synthesized
atcttgccatcttggatatact

SEQ ID NO: 943869 - DNA, 22 bp, Artificial Sequence
  chemically synthesized
catcttgccatcttggatatac

SEQ ID NO: 943870 - DNA, 22 bp, Artificial Sequence
  chemically synthesized
cttcatcttgccatcttggata

SEQ ID NO: 943871 - DNA, 22 bp, Artificial Sequence
  chemically synthesized
gcttcatcttgccatcttggat

SEQ ID NO: 943872 - DNA, 22 bp, Artificial Sequence
  chemically synthesized
ttgcttcatcttgccatcttgg

SEQ ID NO: 943873 - DNA, 22 bp, Artificial Sequence
  chemically synthesized
tactcttgcttcatcttgccat

SEQ ID NO: 943874 - DNA, 22 bp, Artificial Sequence
  chemically synthesized
ttgtactcttgcttcatcttgc

SEQ ID NO: 943875 - DNA, 22 bp, Artificial Sequence
  chemically synthesized
caccaggaagttgttgtactct

SEQ ID NO: 943876 - DNA, 22 bp, Artificial Sequence
  chemically synthesized
aaaggcactacaccaggaagtt

SEQ ID NO: 943877 - DNA, 22 bp, Artificial Sequence
  chemically synthesized
tgaaaggcactacaccaggaag

SEQ ID NO: 943878 - DNA, 22 bp, Artificial Sequence
  chemically synthesized
ctgaaaggcactacaccaggaa

SEQ ID NO: 943879 - DNA, 22 bp, Artificial Sequence
  chemically synthesized
tctgaaaggcactacaccagga

SEQ ID NO: 943880 - DNA, 22 bp, Artificial Sequence
  chemically synthesized
cctggtgtagtgcctttcagaa

SEQ ID NO: 943881 - DNA, 22 bp, Artificial Sequence
  chemically synthesized
ctggtgtagtgcctttcagaaa

SEQ ID NO: 943882 - DNA, 22 bp, Artificial Sequence
  chemically synthesized
gtgtagtgcctttcagaaaatc

SEQ ID NO: 943883 - DNA, 22 bp, Artificial Sequence
  chemically synthesized
tcagaaaatctccctctgtttt

SEQ ID NO: 943884 - DNA, 22 bp, Artificial Sequence
  chemically synthesized
cagaaaatctccctctgttttg

SEQ ID NO: 943885 - DNA, 22 bp, Artificial Sequence
  chemically synthesized
agaaaatctccctctgttttgt

SEQ ID NO: 943886 - DNA, 22 bp, Artificial Sequence
  chemically synthesized
cctctgttttgttgcacatgac

SEQ ID NO: 943887 - DNA, 22 bp, Artificial Sequence
  chemically synthesized
agtaagataaagaagtcatgtg

SEQ ID NO: 943888 - DNA, 22 bp, Artificial Sequence
  chemically synthesized
tgttttgttgcacatgacttct

SEQ ID NO: 943889 - DNA, 22 bp, Artificial Sequence
  chemically synthesized
ttttgttgcacatgacttcttt

SEQ ID NO: 943890 - DNA, 22 bp, Artificial Sequence
  chemically synthesized
tgttgcacatgacttctttatc

SEQ ID NO: 943891 - DNA, 22 bp, Artificial Sequence
  chemically synthesized
gttgcacatgacttctttatct

SEQ ID NO: 943892 - DNA, 22 bp, Artificial Sequence
  chemically synthesized
ttgcacatgacttctttatctt

SEQ ID NO: 943893 - DNA, 22 bp, Artificial Sequence
  chemically synthesized
cacatgacttctttatcttact

SEQ ID NO: 943894 - DNA, 22 bp, Artificial Sequence
  chemically synthesized
cacaatgagttgagtaagataa

SEQ ID NO: 943895 - DNA, 22 bp, Artificial Sequence
  chemically synthesized
ttacacaatgagttgagtaaga

SEQ ID NO: 943896 - DNA, 22 bp, Artificial Sequence
  chemically synthesized
attacacaatgagttgagtaag

SEQ ID NO: 943897 - DNA, 22 bp, Artificial Sequence
  chemically synthesized
ccttattacacaatgagttgag

SEQ ID NO: 943898 - DNA, 22 bp, Artificial Sequence
  chemically synthesized
ctttatcttactcaactcattg

SEQ ID NO: 943899 - DNA, 22 bp, Artificial Sequence
  chemically synthesized
taccttattacacaatgagttg

SEQ ID NO: 943900 - DNA, 22 bp, Artificial Sequence
  chemically synthesized
tttatcttactcaactcattgt

SEQ ID NO: 943901 - DNA, 22 bp, Artificial Sequence
  chemically synthesized
ctaccttattacacaatgagtt

SEQ ID NO: 943902 - DNA, 22 bp, Artificial Sequence
  chemically synthesized
tatcttactcaactcattgtgt

SEQ ID NO: 943903 - DNA, 22 bp, Artificial Sequence
  chemically synthesized
atcttactcaactcattgtgta

SEQ ID NO: 943904 - DNA, 22 bp, Artificial Sequence
  chemically synthesized
cttctaccttattacacaatga

SEQ ID NO: 943905 - DNA, 22 bp, Artificial Sequence
  chemically synthesized
tcttactcaactcattgtgtaa

SEQ ID NO: 943906 - DNA, 22 bp, Artificial Sequence
  chemically synthesized
tacttctaccttattacacaat

SEQ ID NO: 943907 - DNA, 22 bp, Artificial Sequence
  chemically synthesized
ctacttctaccttattacacaa

SEQ ID NO: 943908 - DNA, 22 bp, Artificial Sequence
  chemically synthesized
tctacttctaccttattacaca

SEQ ID NO: 943909 - DNA, 22 bp, Artificial Sequence
  chemically synthesized
actcaactcattgtgtaataag

SEQ ID NO: 943910 - DNA, 22 bp, Artificial Sequence
  chemically synthesized
ctcaactcattgtgtaataagg

SEQ ID NO: 943911 - DNA, 22 bp, Artificial Sequence
  chemically synthesized
tttctacttctaccttattaca

SEQ ID NO: 943912 - DNA, 22 bp, Artificial Sequence
  chemically synthesized
aactcattgtgtaataaggtag

SEQ ID NO: 943913 - DNA, 22 bp, Artificial Sequence
  chemically synthesized
attgtgtaataaggtagaagta

SEQ ID NO: 943914 - DNA, 22 bp, Artificial Sequence
  chemically synthesized
aaggatgttctttctacttcta

SEQ ID NO: 943915 - DNA, 22 bp, Artificial Sequence
  chemically synthesized
gaaggatgttctttctacttct

SEQ ID NO: 943916 - DNA, 22 bp, Artificial Sequence
  chemically synthesized
tgtaataaggtagaagtagaaa

SEQ ID NO: 943917 - DNA, 22 bp, Artificial Sequence
  chemically synthesized
tgaaggatgttctttctacttc

SEQ ID NO: 943918 - DNA, 22 bp, Artificial Sequence
  chemically synthesized
caataattttgaaggatgttct

SEQ ID NO: 943919 - DNA, 22 bp, Artificial Sequence
  chemically synthesized
ccaataattttgaaggatgttc

SEQ ID NO: 943920 - DNA, 22 bp, Artificial Sequence
  chemically synthesized
tccaataattttgaaggatgtt

SEQ ID NO: 943921 - DNA, 22 bp, Artificial Sequence
  chemically synthesized
tcactttccaataattttgaag

SEQ ID NO: 943922 - DNA, 22 bp, Artificial Sequence
  chemically synthesized
tgtcactttccaataattttga

SEQ ID NO: 943923 - DNA, 22 bp, Artificial Sequence
  chemically synthesized
aaacattctgtcactttccaat

SEQ ID NO: 943924 - DNA, 22 bp, Artificial Sequence
  chemically synthesized
caaaattattggaaagtgacag

SEQ ID NO: 943925 - DNA, 22 bp, Artificial Sequence
  chemically synthesized
aaaattattggaaagtgacaga

SEQ ID NO: 943926 - DNA, 22 bp, Artificial Sequence
  chemically synthesized
ttggaaagtgacagaatgtttg

SEQ ID NO: 943927 - DNA, 22 bp, Artificial Sequence
  chemically synthesized
caaagccatccactcaaacatt

SEQ ID NO: 943928 - DNA, 22 bp, Artificial Sequence
  chemically synthesized
gaaagtgacagaatgtttgagt

SEQ ID NO: 943929 - DNA, 22 bp, Artificial Sequence
  chemically synthesized
gcaaagccatccactcaaacat

SEQ ID NO: 943930 - DNA, 22 bp, Artificial Sequence
  chemically synthesized
aacagtttgcaaagccatccac

SEQ ID NO: 943931 - DNA, 22 bp, Artificial Sequence
  chemically synthesized
caacagtttgcaaagccatcca

SEQ ID NO: 943932 - DNA, 22 bp, Artificial Sequence
  chemically synthesized
tcaacagtttgcaaagccatcc

SEQ ID NO: 943933 - DNA, 22 bp, Artificial Sequence
  chemically synthesized
gagtggatggctttgcaaactg

SEQ ID NO: 943934 - DNA, 22 bp, Artificial Sequence
  chemically synthesized
agtggatggctttgcaaactgt

SEQ ID NO: 943935 - DNA, 22 bp, Artificial Sequence
  chemically synthesized
aggatgaaacattttcaacagt

SEQ ID NO: 943936 - DNA, 22 bp, Artificial Sequence
  chemically synthesized
gtattgaggatgaaacattttc

SEQ ID NO: 943937 - DNA, 22 bp, Artificial Sequence
  chemically synthesized
tgcaaactgttgaaaatgtttc

SEQ ID NO: 943938 - DNA, 22 bp, Artificial Sequence
  chemically synthesized
ggtattgaggatgaaacatttt

SEQ ID NO: 943939 - DNA, 22 bp, Artificial Sequence
  chemically synthesized
gcaaactgttgaaaatgtttca

SEQ ID NO: 943940 - DNA, 22 bp, Artificial Sequence
  chemically synthesized
caaactgttgaaaatgtttcat

SEQ ID NO: 943941 - DNA, 22 bp, Artificial Sequence
  chemically synthesized
ttgaaaatgtttcatcctcaat

SEQ ID NO: 943942 - DNA, 22 bp, Artificial Sequence
  chemically synthesized
aaaatgtttcatcctcaatacc

SEQ ID NO: 943943 - DNA, 22 bp, Artificial Sequence
  chemically synthesized
gcagaaatgtcatttggtattg

SEQ ID NO: 943944 - DNA, 22 bp, Artificial Sequence
  chemically synthesized
tgctagcagaaatgtcatttgg

SEQ ID NO: 943945 - DNA, 22 bp, Artificial Sequence
  chemically synthesized
catcctcaataccaaatgacat

SEQ ID NO: 943946 - DNA, 22 bp, Artificial Sequence
  chemically synthesized
atcctcaataccaaatgacatt

SEQ ID NO: 943947 - DNA, 22 bp, Artificial Sequence
  chemically synthesized
aataccaaatgacatttctgct

SEQ ID NO: 943948 - DNA, 22 bp, Artificial Sequence
  chemically synthesized
ctgctagcataatgccatgctt

SEQ ID NO: 943949 - DNA, 22 bp, Artificial Sequence
  chemically synthesized
gaagggggaaaaaagcatggca

SEQ ID NO: 943950 - DNA, 22 bp, Artificial Sequence
  chemically synthesized
tgctagcataatgccatgcttt

SEQ ID NO: 943951 - DNA, 22 bp, Artificial Sequence
  chemically synthesized
ctagcataatgccatgcttttt

SEQ ID NO: 943952 - DNA, 22 bp, Artificial Sequence
  chemically synthesized
gcataatgccatgcttttttcc

SEQ ID NO: 943953 - DNA, 22 bp, Artificial Sequence
  chemically synthesized
tatagtattagaagggggaaaa

SEQ ID NO: 943954 - DNA, 22 bp, Artificial Sequence
  chemically synthesized
atattgtatagtattagaaggg

SEQ ID NO: 943955 - DNA, 22 bp, Artificial Sequence
  chemically synthesized
ttttcccccttctaatactata

SEQ ID NO: 943956 - DNA, 22 bp, Artificial Sequence
  chemically synthesized
tttcccccttctaatactatac

SEQ ID NO: 943957 - DNA, 22 bp, Artificial Sequence
  chemically synthesized
ttcccccttctaatactataca

SEQ ID NO: 943958 - DNA, 22 bp, Artificial Sequence
  chemically synthesized
tcccccttctaatactatacaa

SEQ ID NO: 943959 - DNA, 22 bp, Artificial Sequence
  chemically synthesized
cccccttctaatactatacaat

SEQ ID NO: 943960 - DNA, 22 bp, Artificial Sequence
  chemically synthesized
ccccttctaatactatacaata

SEQ ID NO: 943961 - DNA, 22 bp, Artificial Sequence
  chemically synthesized
catgcaaaatctaatattgtat

SEQ ID NO: 943962 - DNA, 22 bp, Artificial Sequence
  chemically synthesized
ccatgcaaaatctaatattgta

SEQ ID NO: 943963 - DNA, 22 bp, Artificial Sequence
  chemically synthesized
ctaatactatacaatattagat

SEQ ID NO: 943964 - DNA, 22 bp, Artificial Sequence
  chemically synthesized
taatactatacaatattagatt

SEQ ID NO: 943965 - DNA, 22 bp, Artificial Sequence
  chemically synthesized
atactatacaatattagatttt

SEQ ID NO: 943966 - DNA, 22 bp, Artificial Sequence
  chemically synthesized
tacaatattagattttgcatgg

SEQ ID NO: 943967 - DNA, 22 bp, Artificial Sequence
  chemically synthesized
gattttgcatggaaatcactcc

SEQ ID NO: 943968 - DNA, 22 bp, Artificial Sequence
  chemically synthesized
tcaaatggatgcatggagtgat

SEQ ID NO: 943969 - DNA, 22 bp, Artificial Sequence
  chemically synthesized
tgcatggaaatcactccatgca

SEQ ID NO: 943970 - DNA, 22 bp, Artificial Sequence
  chemically synthesized
gcatggaaatcactccatgcat

SEQ ID NO: 943971 - DNA, 22 bp, Artificial Sequence
  chemically synthesized
catggaaatcactccatgcatc

SEQ ID NO: 943972 - DNA, 22 bp, Artificial Sequence
  chemically synthesized
gataaattgtcaaatggatgca

SEQ ID NO: 943973 - DNA, 22 bp, Artificial Sequence
  chemically synthesized
catgcatccatttgacaattta

SEQ ID NO: 943974 - DNA, 22 bp, Artificial Sequence
  chemically synthesized
aaacaggtactcgataaattgt

SEQ ID NO: 943975 - DNA, 22 bp, Artificial Sequence
  chemically synthesized
gaaacaggtactcgataaattg

SEQ ID NO: 943976 - DNA, 22 bp, Artificial Sequence
  chemically synthesized
gacaatttatcgagtacctgtt

SEQ ID NO: 943977 - DNA, 22 bp, Artificial Sequence
  chemically synthesized
acaatttatcgagtacctgttt

SEQ ID NO: 943978 - DNA, 22 bp, Artificial Sequence
  chemically synthesized
agtacatagcacttgaaacagg

SEQ ID NO: 943979 - DNA, 22 bp, Artificial Sequence
  chemically synthesized
tcagtacatagcacttgaaaca

SEQ ID NO: 943980 - DNA, 22 bp, Artificial Sequence
  chemically synthesized
atcgagtacctgtttcaagtgc

SEQ ID NO: 943981 - DNA, 22 bp, Artificial Sequence
  chemically synthesized
tcgagtacctgtttcaagtgct

SEQ ID NO: 943982 - DNA, 22 bp, Artificial Sequence
  chemically synthesized
gtgggcgcattctcagtacata

SEQ ID NO: 943983 - DNA, 22 bp, Artificial Sequence
  chemically synthesized
tttcaagtgctatgtactgaga

SEQ ID NO: 943984 - DNA, 22 bp, Artificial Sequence
  chemically synthesized
caagtgctatgtactgagaatg

SEQ ID NO: 943985 - DNA, 22 bp, Artificial Sequence
  chemically synthesized
aagtgctatgtactgagaatgc

SEQ ID NO: 943986 - DNA, 22 bp, Artificial Sequence
  chemically synthesized
tcatgttcgtgggcgcattctc

SEQ ID NO: 943987 - DNA, 22 bp, Artificial Sequence
  chemically synthesized
tctgtcatgttcgtgggcgcat

SEQ ID NO: 943988 - DNA, 22 bp, Artificial Sequence
  chemically synthesized
tgtactgagaatgcgcccacga

SEQ ID NO: 943989 - DNA, 22 bp, Artificial Sequence
  chemically synthesized
agaatgcgcccacgaacatgac

SEQ ID NO: 943990 - DNA, 22 bp, Artificial Sequence
  chemically synthesized
tgtgcagatatattatctgtca

SEQ ID NO: 943991 - DNA, 22 bp, Artificial Sequence
  chemically synthesized
taaattatgtgcagatatatta

SEQ ID NO: 943992 - DNA, 22 bp, Artificial Sequence
  chemically synthesized
gactgtaaattatgtgcagata

SEQ ID NO: 943993 - DNA, 22 bp, Artificial Sequence
  chemically synthesized
ctggactgtaaattatgtgcag

SEQ ID NO: 943994 - DNA, 22 bp, Artificial Sequence
  chemically synthesized
actggactgtaaattatgtgca

SEQ ID NO: 943995 - DNA, 22 bp, Artificial Sequence
  chemically synthesized
ttactggactgtaaattatgtg

SEQ ID NO: 943996 - DNA, 22 bp, Artificial Sequence
  chemically synthesized
taattcttactggactgtaaat

SEQ ID NO: 943997 - DNA, 22 bp, Artificial Sequence
  chemically synthesized
agctgtaattcttactggactg

SEQ ID NO: 943998 - DNA, 22 bp, Artificial Sequence
  chemically synthesized
cacataatttacagtccagtaa

SEQ ID NO: 943999 - DNA, 22 bp, Artificial Sequence
  chemically synthesized
acagtccagtaagaattacagc

SEQ ID NO: 944000 - DNA, 22 bp, Artificial Sequence
  chemically synthesized
cagtccagtaagaattacagct

SEQ ID NO: 944001 - DNA, 22 bp, Artificial Sequence
  chemically synthesized
gagtaagacaggaagaagctaa

SEQ ID NO: 944002 - DNA, 22 bp, Artificial Sequence
  chemically synthesized
tctggagtaagacaggaagaag

SEQ ID NO: 944003 - DNA, 22 bp, Artificial Sequence
  chemically synthesized
atctggagtaagacaggaagaa

SEQ ID NO: 944004 - DNA, 22 bp, Artificial Sequence
  chemically synthesized
tatctggagtaagacaggaaga

SEQ ID NO: 944005 - DNA, 22 bp, Artificial Sequence
  chemically synthesized
cagcttagcttcttcctgtctt

SEQ ID NO: 944006 - DNA, 22 bp, Artificial Sequence
  chemically synthesized
agcttcttcctgtcttactcca

SEQ ID NO: 944007 - DNA, 22 bp, Artificial Sequence
  chemically synthesized
gcttcttcctgtcttactccag

SEQ ID NO: 944008 - DNA, 22 bp, Artificial Sequence
  chemically synthesized
cttcctgtcttactccagataa

SEQ ID NO: 944009 - DNA, 22 bp, Artificial Sequence
  chemically synthesized
ttcctgtcttactccagataaa

SEQ ID NO: 944010 - DNA, 22 bp, Artificial Sequence
  chemically synthesized
cctgtcttactccagataaaga

SEQ ID NO: 944011 - DNA, 22 bp, Artificial Sequence
  chemically synthesized
ctgtcttactccagataaagac

SEQ ID NO: 944012 - DNA, 22 bp, Artificial Sequence
  chemically synthesized
tcttactccagataaagaccct

SEQ ID NO: 944013 - DNA, 22 bp, Artificial Sequence
  chemically synthesized
actccagataaagacccttttc

SEQ ID NO: 944014 - DNA, 22 bp, Artificial Sequence
  chemically synthesized
ctccagataaagacccttttcc

SEQ ID NO: 944015 - DNA, 22 bp, Artificial Sequence
  chemically synthesized
cagataaagacccttttccctc

SEQ ID NO: 944016 - DNA, 22 bp, Artificial Sequence
  chemically synthesized
agagggtggaatgagggaaaag

SEQ ID NO: 944017 - DNA, 22 bp, Artificial Sequence
  chemically synthesized
gagagggtggaatgagggaaaa

SEQ ID NO: 944018 - DNA, 22 bp, Artificial Sequence
  chemically synthesized
tgcaccttgagagggtggaatg

SEQ ID NO: 944019 - DNA, 22 bp, Artificial Sequence
  chemically synthesized
agttatgcaccttgagagggtg

SEQ ID NO: 944020 - DNA, 22 bp, Artificial Sequence
  chemically synthesized
ttccctcattccaccctctcaa

SEQ ID NO: 944021 - DNA, 22 bp, Artificial Sequence
  chemically synthesized
tccctcattccaccctctcaag

SEQ ID NO: 944022 - DNA, 22 bp, Artificial Sequence
  chemically synthesized
ccctcattccaccctctcaagg

SEQ ID NO: 944023 - DNA, 22 bp, Artificial Sequence
  chemically synthesized
ttaagttatgcaccttgagagg

SEQ ID NO: 944024 - DNA, 22 bp, Artificial Sequence
  chemically synthesized
cctcattccaccctctcaaggt

SEQ ID NO: 944025 - DNA, 22 bp, Artificial Sequence
  chemically synthesized
attaagttatgcaccttgagag

SEQ ID NO: 944026 - DNA, 22 bp, Artificial Sequence
  chemically synthesized
attccaccctctcaaggtgcat

SEQ ID NO: 944027 - DNA, 22 bp, Artificial Sequence
  chemically synthesized
acttattaagttatgcaccttg

SEQ ID NO: 944028 - DNA, 22 bp, Artificial Sequence
  chemically synthesized
caccctctcaaggtgcataact

SEQ ID NO: 944029 - DNA, 22 bp, Artificial Sequence
  chemically synthesized
agcatgctgacttattaagtta

SEQ ID NO: 944030 - DNA, 22 bp, Artificial Sequence
  chemically synthesized
tcaaggtgcataacttaataag

SEQ ID NO: 944031 - DNA, 22 bp, Artificial Sequence
  chemically synthesized
aaggtgcataacttaataagtc

SEQ ID NO: 944032 - DNA, 22 bp, Artificial Sequence
  chemically synthesized
gatcgaacagtattaagcatgc

SEQ ID NO: 944033 - DNA, 22 bp, Artificial Sequence
  chemically synthesized
aataagtcagcatgcttaatac

SEQ ID NO: 944034 - DNA, 22 bp, Artificial Sequence
  chemically synthesized
ataagtcagcatgcttaatact

SEQ ID NO: 944035 - DNA, 22 bp, Artificial Sequence
  chemically synthesized
aagacaattagatcgaacagta

SEQ ID NO: 944036 - DNA, 22 bp, Artificial Sequence
  chemically synthesized
tcaagacaattagatcgaacag

SEQ ID NO: 944037 - DNA, 22 bp, Artificial Sequence
  chemically synthesized
aatactgttcgatctaattgtc

SEQ ID NO: 944038 - DNA, 22 bp, Artificial Sequence
  chemically synthesized
atactgttcgatctaattgtct

SEQ ID NO: 944039 - DNA, 22 bp, Artificial Sequence
  chemically synthesized
ttcgatctaattgtcttgagaa

SEQ ID NO: 944040 - DNA, 22 bp, Artificial Sequence
  chemically synthesized
gatctaattgtcttgagaatgt

SEQ ID NO: 944041 - DNA, 22 bp, Artificial Sequence
  chemically synthesized
attgtcttgagaatgtcatttt

SEQ ID NO: 944042 - DNA, 22 bp, Artificial Sequence
  chemically synthesized
tcttgagaatgtcattttcttc

SEQ ID NO: 944043 - DNA, 22 bp, Artificial Sequence
  chemically synthesized
aaaaaggtgggatgggaagaaa

SEQ ID NO: 944044 - DNA, 22 bp, Artificial Sequence
  chemically synthesized
gagaatgtcattttcttcccat

SEQ ID NO: 944045 - DNA, 22 bp, Artificial Sequence
  chemically synthesized
gaaaaaggtgggatgggaagaa

SEQ ID NO: 944046 - DNA, 22 bp, Artificial Sequence
  chemically synthesized
agaatgtcattttcttcccatc

SEQ ID NO: 944047 - DNA, 22 bp, Artificial Sequence
  chemically synthesized
tgaaaaaggtgggatgggaaga

SEQ ID NO: 944048 - DNA, 22 bp, Artificial Sequence
  chemically synthesized
ttgaaaaaggtgggatgggaag

SEQ ID NO: 944049 - DNA, 22 bp, Artificial Sequence
  chemically synthesized
aatacttttgaaaaaggtggga

SEQ ID NO: 944050 - DNA, 22 bp, Artificial Sequence
  chemically synthesized
tcttcccatcccacctttttca

SEQ ID NO: 944051 - DNA, 22 bp, Artificial Sequence
  chemically synthesized
cttcccatcccacctttttcaa

SEQ ID NO: 944052 - DNA, 22 bp, Artificial Sequence
  chemically synthesized
ttcccatcccacctttttcaaa

SEQ ID NO: 944053 - DNA, 22 bp, Artificial Sequence
  chemically synthesized
cccatcccacctttttcaaaag

SEQ ID NO: 944054 - DNA, 22 bp, Artificial Sequence
  chemically synthesized
ccatcccacctttttcaaaagt

SEQ ID NO: 944055 - DNA, 22 bp, Artificial Sequence
  chemically synthesized
tgcaaaaaggagtcattaaata

SEQ ID NO: 944056 - DNA, 22 bp, Artificial Sequence
  chemically synthesized
tgtgcaaaaaggagtcattaaa

SEQ ID NO: 944057 - DNA, 22 bp, Artificial Sequence
  chemically synthesized
tttcaaaagtatttaatgactc

SEQ ID NO: 944058 - DNA, 22 bp, Artificial Sequence
  chemically synthesized
ttcaaaagtatttaatgactcc

SEQ ID NO: 944059 - DNA, 22 bp, Artificial Sequence
  chemically synthesized
tcaaaagtatttaatgactcct

SEQ ID NO: 944060 - DNA, 22 bp, Artificial Sequence
  chemically synthesized
caaaagtatttaatgactcctt

SEQ ID NO: 944061 - DNA, 22 bp, Artificial Sequence
  chemically synthesized
aaaagtatttaatgactccttt

SEQ ID NO: 944062 - DNA, 22 bp, Artificial Sequence
  chemically synthesized
aatgtgaacctctgtgcaaaaa

SEQ ID NO: 944063 - DNA, 22 bp, Artificial Sequence
  chemically synthesized
gaatgtgaacctctgtgcaaaa

SEQ ID NO: 944064 - DNA, 22 bp, Artificial Sequence
  chemically synthesized
aatgactcctttttgcacagag

SEQ ID NO: 944065 - DNA, 22 bp, Artificial Sequence
  chemically synthesized
atgactcctttttgcacagagg

SEQ ID NO: 944066 - DNA, 22 bp, Artificial Sequence
  chemically synthesized
aggagcttgaatgtgaacctct

SEQ ID NO: 944067 - DNA, 22 bp, Artificial Sequence
  chemically synthesized
ctttttgcacagaggttcacat

SEQ ID NO: 944068 - DNA, 22 bp, Artificial Sequence
  chemically synthesized
tttgcacagaggttcacattca

SEQ ID NO: 944069 - DNA, 22 bp, Artificial Sequence
  chemically synthesized
gcctgaggagcttgaatgtgaa

SEQ ID NO: 944070 - DNA, 22 bp, Artificial Sequence
  chemically synthesized
ttgcacagaggttcacattcaa

SEQ ID NO: 944071 - DNA, 22 bp, Artificial Sequence
  chemically synthesized
tgcacagaggttcacattcaag

SEQ ID NO: 944072 - DNA, 22 bp, Artificial Sequence
  chemically synthesized
gcacagaggttcacattcaagc

SEQ ID NO: 944073 - DNA, 22 bp, Artificial Sequence
  chemically synthesized
ttagcctgaggagcttgaatgt

SEQ ID NO: 944074 - DNA, 22 bp, Artificial Sequence
  chemically synthesized
cacagaggttcacattcaagct

SEQ ID NO: 944075 - DNA, 22 bp, Artificial Sequence
  chemically synthesized
acattcaagctcctcaggctaa

SEQ ID NO: 944076 - DNA, 22 bp, Artificial Sequence
  chemically synthesized
cagtgggatgagttgttagcct

SEQ ID NO: 944077 - DNA, 22 bp, Artificial Sequence
  chemically synthesized
acagtgggatgagttgttagcc

SEQ ID NO: 944078 - DNA, 22 bp, Artificial Sequence
  chemically synthesized
aagctcctcaggctaacaactc

SEQ ID NO: 944079 - DNA, 22 bp, Artificial Sequence
  chemically synthesized
ctcaggctaacaactcatccca

SEQ ID NO: 944080 - DNA, 22 bp, Artificial Sequence
  chemically synthesized
atacaaatttacagtgggatga

SEQ ID NO: 944081 - DNA, 22 bp, Artificial Sequence
  chemically synthesized
aggctaacaactcatcccactg

SEQ ID NO: 944082 - DNA, 22 bp, Artificial Sequence
  chemically synthesized
acaactcatcccactgtaaatt

SEQ ID NO: 944083 - DNA, 22 bp, Artificial Sequence
  chemically synthesized
gaatatgattaatacaaattta

SEQ ID NO: 944084 - DNA, 22 bp, Artificial Sequence
  chemically synthesized
atcccactgtaaatttgtatta

SEQ ID NO: 944085 - DNA, 22 bp, Artificial Sequence
  chemically synthesized
taaatttgtattaatcatattc

SEQ ID NO: 944086 - DNA, 22 bp, Artificial Sequence
  chemically synthesized
gtattaatcatattctaattgt

SEQ ID NO: 944087 - DNA, 22 bp, Artificial Sequence
  chemically synthesized
tattaatcatattctaattgtc

SEQ ID NO: 944088 - DNA, 22 bp, Artificial Sequence
  chemically synthesized
agggacaaaagaggacaattag

SEQ ID NO: 944089 - DNA, 22 bp, Artificial Sequence
  chemically synthesized
atcatattctaattgtcctctt

SEQ ID NO: 944090 - DNA, 22 bp, Artificial Sequence
  chemically synthesized
taattgtcctcttttgtccctc

SEQ ID NO: 944091 - DNA, 22 bp, Artificial Sequence
  chemically synthesized
attgtcctcttttgtccctcaa

SEQ ID NO: 944092 - DNA, 22 bp, Artificial Sequence
  chemically synthesized
tcctcttttgtccctcaacatg

SEQ ID NO: 944093 - DNA, 22 bp, Artificial Sequence
  chemically synthesized
ttttgtccctcaacatgggcct

SEQ ID NO: 944094 - DNA, 22 bp, Artificial Sequence
  chemically synthesized
ttgtccctcaacatgggcctgc

SEQ ID NO: 944095 - DNA, 22 bp, Artificial Sequence
  chemically synthesized
tgtccctcaacatgggcctgcc

SEQ ID NO: 944096 - DNA, 22 bp, Artificial Sequence
  chemically synthesized
gtccctcaacatgggcctgcca

SEQ ID NO: 944097 - DNA, 22 bp, Artificial Sequence
  chemically synthesized
tccctcaacatgggcctgccac

SEQ ID NO: 944098 - DNA, 22 bp, Artificial Sequence
  chemically synthesized
aacatgggcctgccactctggt

SEQ ID NO: 944099 - DNA, 22 bp, Artificial Sequence
  chemically synthesized
agcagccaaggagtgaccagag

SEQ ID NO: 944100 - DNA, 22 bp, Artificial Sequence
  chemically synthesized
ccactctggtcactccttggct

SEQ ID NO: 944101 - DNA, 22 bp, Artificial Sequence
  chemically synthesized
tggtcactccttggctgctcaa

SEQ ID NO: 944102 - DNA, 22 bp, Artificial Sequence
  chemically synthesized
gtcactccttggctgctcaata

SEQ ID NO: 944103 - DNA, 22 bp, Artificial Sequence
  chemically synthesized
cttggctgctcaatataccacc

SEQ ID NO: 944104 - DNA, 22 bp, Artificial Sequence
  chemically synthesized
ggctgctcaatataccacccgt

SEQ ID NO: 944105 - DNA, 22 bp, Artificial Sequence
  chemically synthesized
gctgctcaatataccacccgtg

SEQ ID NO: 944106 - DNA, 22 bp, Artificial Sequence
  chemically synthesized
ccccgcaaagaacacgggtggt

SEQ ID NO: 944107 - DNA, 22 bp, Artificial Sequence
  chemically synthesized
ctcaatataccacccgtgttct

SEQ ID NO: 944108 - DNA, 22 bp, Artificial Sequence
  chemically synthesized
agctcccccgcaaagaacacgg

SEQ ID NO: 944109 - DNA, 22 bp, Artificial Sequence
  chemically synthesized
gagctcccccgcaaagaacacg

SEQ ID NO: 944110 - DNA, 22 bp, Artificial Sequence
  chemically synthesized
aatataccacccgtgttctttg

SEQ ID NO: 944111 - DNA, 22 bp, Artificial Sequence
  chemically synthesized
tttgcgggggagctcaagtcat

SEQ ID NO: 944112 - DNA, 22 bp, Artificial Sequence
  chemically synthesized
tgcgggggagctcaagtcattt

SEQ ID NO: 944113 - DNA, 22 bp, Artificial Sequence
  chemically synthesized
gcgggggagctcaagtcatttg

SEQ ID NO: 944114 - DNA, 22 bp, Artificial Sequence
  chemically synthesized
cgggggagctcaagtcatttgt

SEQ ID NO: 944115 - DNA, 22 bp, Artificial Sequence
  chemically synthesized
agatgaaaggaaaaaacaaatg

SEQ ID NO: 944116 - DNA, 22 bp, Artificial Sequence
  chemically synthesized
cagatgaaaggaaaaaacaaat

SEQ ID NO: 944117 - DNA, 22 bp, Artificial Sequence
  chemically synthesized
aagtcatttgttttttcctttc

SEQ ID NO: 944118 - DNA, 22 bp, Artificial Sequence
  chemically synthesized
acccaaatgtgtcttcagatga

SEQ ID NO: 944119 - DNA, 22 bp, Artificial Sequence
  chemically synthesized
gttttttcctttcatctgaaga

SEQ ID NO: 944120 - DNA, 22 bp, Artificial Sequence
  chemically synthesized
ttttttcctttcatctgaagac

SEQ ID NO: 944121 - DNA, 22 bp, Artificial Sequence
  chemically synthesized
tttcctttcatctgaagacaca

SEQ ID NO: 944122 - DNA, 22 bp, Artificial Sequence
  chemically synthesized
ttcctttcatctgaagacacat

SEQ ID NO: 944123 - DNA, 22 bp, Artificial Sequence
  chemically synthesized
tcctttcatctgaagacacatt

SEQ ID NO: 944124 - DNA, 22 bp, Artificial Sequence
  chemically synthesized
cctttcatctgaagacacattt

SEQ ID NO: 944125 - DNA, 22 bp, Artificial Sequence
  chemically synthesized
ctttcatctgaagacacatttg

SEQ ID NO: 944126 - DNA, 22 bp, Artificial Sequence
  chemically synthesized
tcatctgaagacacatttgggt

SEQ ID NO: 944127 - DNA, 22 bp, Artificial Sequence
  chemically synthesized
catctgaagacacatttgggtg

SEQ ID NO: 944128 - DNA, 22 bp, Artificial Sequence
  chemically synthesized
atctgaagacacatttgggtga

SEQ ID NO: 944129 - DNA, 22 bp, Artificial Sequence
  chemically synthesized
aagacacatttgggtgagactt

SEQ ID NO: 944130 - DNA, 22 bp, Artificial Sequence
  chemically synthesized
aacatacaaatccccaagtctc

SEQ ID NO: 944131 - DNA, 22 bp, Artificial Sequence
  chemically synthesized
aaacatacaaatccccaagtct

SEQ ID NO: 944132 - DNA, 22 bp, Artificial Sequence
  chemically synthesized
gggtgagacttggggatttgta

SEQ ID NO: 944133 - DNA, 22 bp, Artificial Sequence
  chemically synthesized
ggtgcttaaacatacaaatccc

SEQ ID NO: 944134 - DNA, 22 bp, Artificial Sequence
  chemically synthesized
ggtgagacttggggatttgtat

SEQ ID NO: 944135 - DNA, 22 bp, Artificial Sequence
  chemically synthesized
tgggtgcttaaacatacaaatc

SEQ ID NO: 944136 - DNA, 22 bp, Artificial Sequence
  chemically synthesized
ggggatttgtatgtttaagcac

SEQ ID NO: 944137 - DNA, 22 bp, Artificial Sequence
  chemically synthesized
gggatttgtatgtttaagcacc

SEQ ID NO: 944138 - DNA, 22 bp, Artificial Sequence
  chemically synthesized
gtatgtttaagcacccagagtg

SEQ ID NO: 944139 - DNA, 22 bp, Artificial Sequence
  chemically synthesized
tatgtttaagcacccagagtga

SEQ ID NO: 944140 - DNA, 22 bp, Artificial Sequence
  chemically synthesized
aagcacccagagtgactctgac

SEQ ID NO: 944141 - DNA, 22 bp, Artificial Sequence
  chemically synthesized
agcacccagagtgactctgaca

SEQ ID NO: 944142 - DNA, 22 bp, Artificial Sequence
  chemically synthesized
tagatagagtagtggtatgtca

SEQ ID NO: 944143 - DNA, 22 bp, Artificial Sequence
  chemically synthesized
atagatagagtagtggtatgtc

SEQ ID NO: 944144 - DNA, 22 bp, Artificial Sequence
  chemically synthesized
tgacataccactactctatcta

SEQ ID NO: 944145 - DNA, 22 bp, Artificial Sequence
  chemically synthesized
taagcagagtttatagatagag

SEQ ID NO: 944146 - DNA, 22 bp, Artificial Sequence
  chemically synthesized
acataccactactctatctata

SEQ ID NO: 944147 - DNA, 22 bp, Artificial Sequence
  chemically synthesized
ggttgtaagcagagtttataga

SEQ ID NO: 944148 - DNA, 22 bp, Artificial Sequence
  chemically synthesized
aggttgtaagcagagtttatag

SEQ ID NO: 944149 - DNA, 22 bp, Artificial Sequence
  chemically synthesized
gccttaggttgtaagcagagtt

SEQ ID NO: 944150 - DNA, 22 bp, Artificial Sequence
  chemically synthesized
ctctatctataaactctgctta

SEQ ID NO: 944151 - DNA, 22 bp, Artificial Sequence
  chemically synthesized
tatctataaactctgcttacaa

SEQ ID NO: 944152 - DNA, 22 bp, Artificial Sequence
  chemically synthesized
aattggccttaggttgtaagca

SEQ ID NO: 944153 - DNA, 22 bp, Artificial Sequence
  chemically synthesized
tctataaactctgcttacaacc

SEQ ID NO: 944154 - DNA, 22 bp, Artificial Sequence
  chemically synthesized
taaactctgcttacaacctaag

SEQ ID NO: 944155 - DNA, 22 bp, Artificial Sequence
  chemically synthesized
tgcttacaacctaaggccaatt

SEQ ID NO: 944156 - DNA, 22 bp, Artificial Sequence
  chemically synthesized
cttacaacctaaggccaattca

SEQ ID NO: 944157 - DNA, 22 bp, Artificial Sequence
  chemically synthesized
gaaagagtaggatctgaattgg

SEQ ID NO: 944158 - DNA, 22 bp, Artificial Sequence
  chemically synthesized
acaacctaaggccaattcagat

SEQ ID NO: 944159 - DNA, 22 bp, Artificial Sequence
  chemically synthesized
caacctaaggccaattcagatc

SEQ ID NO: 944160 - DNA, 22 bp, Artificial Sequence
  chemically synthesized
tagaaagagtaggatctgaatt

SEQ ID NO: 944161 - DNA, 22 bp, Artificial Sequence
  chemically synthesized
ctagaaagagtaggatctgaat

SEQ ID NO: 944162 - DNA, 22 bp, Artificial Sequence
  chemically synthesized
tctagaaagagtaggatctgaa

SEQ ID NO: 944163 - DNA, 22 bp, Artificial Sequence
  chemically synthesized
aggccaattcagatcctactct

SEQ ID NO: 944164 - DNA, 22 bp, Artificial Sequence
  chemically synthesized
atgaatgttttctagaaagagt

SEQ ID NO: 944165 - DNA, 22 bp, Artificial Sequence
  chemically synthesized
agatcctactctttctagaaaa

SEQ ID NO: 944166 - DNA, 22 bp, Artificial Sequence
  chemically synthesized
ctctttctagaaaacattcatt

SEQ ID NO: 944167 - DNA, 22 bp, Artificial Sequence
  chemically synthesized
tttctagaaaacattcattaac

SEQ ID NO: 944168 - DNA, 22 bp, Artificial Sequence
  chemically synthesized
tctagaaaacattcattaactg

SEQ ID NO: 944169 - DNA, 22 bp, Artificial Sequence
  chemically synthesized
ctagaaaacattcattaactgt

SEQ ID NO: 944170 - DNA, 22 bp, Artificial Sequence
  chemically synthesized
tagaaaacattcattaactgtt

SEQ ID NO: 944171 - DNA, 22 bp, Artificial Sequence
  chemically synthesized
gaaaacattcattaactgttac

SEQ ID NO: 944172 - DNA, 22 bp, Artificial Sequence
  chemically synthesized
attaactgttacttctcatcat

SEQ ID NO: 944173 - DNA, 22 bp, Artificial Sequence
  chemically synthesized
actgttacttctcatcatgatt

SEQ ID NO: 944174 - DNA, 22 bp, Artificial Sequence
  chemically synthesized
taaagaatgaagaaatcatgat

SEQ ID NO: 944175 - DNA, 22 bp, Artificial Sequence
  chemically synthesized
ttacttctcatcatgatttctt

SEQ ID NO: 944176 - DNA, 22 bp, Artificial Sequence
  chemically synthesized
tactataaagaatgaagaaatc

SEQ ID NO: 944177 - DNA, 22 bp, Artificial Sequence
  chemically synthesized
cttctcatcatgatttcttcat

SEQ ID NO: 944178 - DNA, 22 bp, Artificial Sequence
  chemically synthesized
ttgtactataaagaatgaagaa

SEQ ID NO: 944179 - DNA, 22 bp, Artificial Sequence
  chemically synthesized
ctcatcatgatttcttcattct

SEQ ID NO: 944180 - DNA, 22 bp, Artificial Sequence
  chemically synthesized
tcatcatgatttcttcattctt

SEQ ID NO: 944181 - DNA, 22 bp, Artificial Sequence
  chemically synthesized
atcatgatttcttcattcttta

SEQ ID NO: 944182 - DNA, 22 bp, Artificial Sequence
  chemically synthesized
cttcattctttatagtacaata

SEQ ID NO: 944183 - DNA, 22 bp, Artificial Sequence
  chemically synthesized
ttcattctttatagtacaataa

SEQ ID NO: 944184 - DNA, 22 bp, Artificial Sequence
  chemically synthesized
cattctttatagtacaataaca

SEQ ID NO: 944185 - DNA, 22 bp, Artificial Sequence
  chemically synthesized
attctttatagtacaataacac

SEQ ID NO: 944186 - DNA, 22 bp, Artificial Sequence
  chemically synthesized
tttatagtacaataacacttac

SEQ ID NO: 944187 - DNA, 22 bp, Artificial Sequence
  chemically synthesized
tatagtacaataacacttactg

SEQ ID NO: 944188 - DNA, 22 bp, Artificial Sequence
  chemically synthesized
atagtacaataacacttactgt

SEQ ID NO: 944189 - DNA, 22 bp, Artificial Sequence
  chemically synthesized
tagtacaataacacttactgtc

SEQ ID NO: 944190 - DNA, 22 bp, Artificial Sequence
  chemically synthesized
tatatgccgaaataaatgagac

SEQ ID NO: 944191 - DNA, 22 bp, Artificial Sequence
  chemically synthesized
gaactatatatgccgaaataaa

SEQ ID NO: 944192 - DNA, 22 bp, Artificial Sequence
  chemically synthesized
tggaactatatatgccgaaata

SEQ ID NO: 944193 - DNA, 22 bp, Artificial Sequence
  chemically synthesized
actgtctcatttatttcggcat

SEQ ID NO: 944194 - DNA, 22 bp, Artificial Sequence
  chemically synthesized
ctgtctcatttatttcggcata

SEQ ID NO: 944195 - DNA, 22 bp, Artificial Sequence
  chemically synthesized
tctcatttatttcggcatatat

SEQ ID NO: 944196 - DNA, 22 bp, Artificial Sequence
  chemically synthesized
catagctctggaactatatatg

SEQ ID NO: 944197 - DNA, 22 bp, Artificial Sequence
  chemically synthesized
atttatttcggcatatatagtt

SEQ ID NO: 944198 - DNA, 22 bp, Artificial Sequence
  chemically synthesized
atttcggcatatatagttccag

SEQ ID NO: 944199 - DNA, 22 bp, Artificial Sequence
  chemically synthesized
tttcggcatatatagttccaga

SEQ ID NO: 944200 - DNA, 22 bp, Artificial Sequence
  chemically synthesized
cggcatatatagttccagagct

SEQ ID NO: 944201 - DNA, 22 bp, Artificial Sequence
  chemically synthesized
ggcatatatagttccagagcta

SEQ ID NO: 944202 - DNA, 22 bp, Artificial Sequence
  chemically synthesized
tgaaacaggcgtaattacatag

SEQ ID NO: 944203 - DNA, 22 bp, Artificial Sequence
  chemically synthesized
tgtctatgaaacaggcgtaatt

SEQ ID NO: 944204 - DNA, 22 bp, Artificial Sequence
  chemically synthesized
cagagctatgtaattacgcctg

SEQ ID NO: 944205 - DNA, 22 bp, Artificial Sequence
  chemically synthesized
tgtaattacgcctgtttcatag

SEQ ID NO: 944206 - DNA, 22 bp, Artificial Sequence
  chemically synthesized
gagggataagacctgtgtctat

SEQ ID NO: 944207 - DNA, 22 bp, Artificial Sequence
  chemically synthesized
cgcctgtttcatagacacaggt

SEQ ID NO: 944208 - DNA, 22 bp, Artificial Sequence
  chemically synthesized
attggagggataagacctgtgt

SEQ ID NO: 944209 - DNA, 22 bp, Artificial Sequence
  chemically synthesized
tcattggagggataagacctgt

SEQ ID NO: 944210 - DNA, 22 bp, Artificial Sequence
  chemically synthesized
ctcattggagggataagacctg

SEQ ID NO: 944211 - DNA, 22 bp, Artificial Sequence
  chemically synthesized
tttcatagacacaggtcttatc

SEQ ID NO: 944212 - DNA, 22 bp, Artificial Sequence
  chemically synthesized
catagacacaggtcttatccct

SEQ ID NO: 944213 - DNA, 22 bp, Artificial Sequence
  chemically synthesized
atagacacaggtcttatccctc

SEQ ID NO: 944214 - DNA, 22 bp, Artificial Sequence
  chemically synthesized
tagaacatgtcttctcattgga

SEQ ID NO: 944215 - DNA, 22 bp, Artificial Sequence
  chemically synthesized
ctatagaacatgtcttctcatt

SEQ ID NO: 944216 - DNA, 22 bp, Artificial Sequence
  chemically synthesized
tcctatagaacatgtcttctca

SEQ ID NO: 944217 - DNA, 22 bp, Artificial Sequence
  chemically synthesized
ctcctatagaacatgtcttctc

SEQ ID NO: 944218 - DNA, 22 bp, Artificial Sequence
  chemically synthesized
atccctccaatgagaagacatg

SEQ ID NO: 944219 - DNA, 22 bp, Artificial Sequence
  chemically synthesized
tccctccaatgagaagacatgt

SEQ ID NO: 944220 - DNA, 22 bp, Artificial Sequence
  chemically synthesized
cttctcctatagaacatgtctt

SEQ ID NO: 944221 - DNA, 22 bp, Artificial Sequence
  chemically synthesized
caatgagaagacatgttctata

SEQ ID NO: 944222 - DNA, 22 bp, Artificial Sequence
  chemically synthesized
tataggagaagcagctattatc

SEQ ID NO: 944223 - DNA, 22 bp, Artificial Sequence
  chemically synthesized
aatacaggtccaagataatagc

SEQ ID NO: 944224 - DNA, 22 bp, Artificial Sequence
  chemically synthesized
taggagaagcagctattatctt

SEQ ID NO: 944225 - DNA, 22 bp, Artificial Sequence
  chemically synthesized
agaagttcaatacaggtccaag

SEQ ID NO: 944226 - DNA, 22 bp, Artificial Sequence
  chemically synthesized
ttatcttggacctgtattgaac

SEQ ID NO: 944227 - DNA, 22 bp, Artificial Sequence
  chemically synthesized
ggtgcggttgagaagttcaata

SEQ ID NO: 944228 - DNA, 22 bp, Artificial Sequence
  chemically synthesized
tcttggacctgtattgaacttc

SEQ ID NO: 944229 - DNA, 22 bp, Artificial Sequence
  chemically synthesized
ggacctgtattgaacttctcaa

SEQ ID NO: 944230 - DNA, 22 bp, Artificial Sequence
  chemically synthesized
gacctgtattgaacttctcaac

SEQ ID NO: 944231 - DNA, 22 bp, Artificial Sequence
  chemically synthesized
gagccatgctaggtgcggttga

SEQ ID NO: 944232 - DNA, 22 bp, Artificial Sequence
  chemically synthesized
tattgaacttctcaaccgcacc

SEQ ID NO: 944233 - DNA, 22 bp, Artificial Sequence
  chemically synthesized
agagccatgctaggtgcggttg

SEQ ID NO: 944234 - DNA, 22 bp, Artificial Sequence
  chemically synthesized
aacttctcaaccgcacctagca

SEQ ID NO: 944235 - DNA, 22 bp, Artificial Sequence
  chemically synthesized
ctcaaccgcacctagcatggct

SEQ ID NO: 944236 - DNA, 22 bp, Artificial Sequence
  chemically synthesized
tcaaccgcacctagcatggctc

SEQ ID NO: 944237 - DNA, 22 bp, Artificial Sequence
  chemically synthesized
caagtatacttagagccatgct

SEQ ID NO: 944238 - DNA, 22 bp, Artificial Sequence
  chemically synthesized
aaccgcacctagcatggctcta

SEQ ID NO: 944239 - DNA, 22 bp, Artificial Sequence
  chemically synthesized
gcatggctctaagtatacttgc

SEQ ID NO: 944240 - DNA, 22 bp, Artificial Sequence
  chemically synthesized
taagtatacttgcagcatacat

SEQ ID NO: 944241 - DNA, 22 bp, Artificial Sequence
  chemically synthesized
agtatacttgcagcatacattg

SEQ ID NO: 944242 - DNA, 22 bp, Artificial Sequence
  chemically synthesized
aaataaaataagtacacaatgt

SEQ ID NO: 944243 - DNA, 22 bp, Artificial Sequence
  chemically synthesized
gcagcatacattgtgtacttat

SEQ ID NO: 944244 - DNA, 22 bp, Artificial Sequence
  chemically synthesized
cagcatacattgtgtacttatt

SEQ ID NO: 944245 - DNA, 22 bp, Artificial Sequence
  chemically synthesized
gaagagtcatgatgttaaaata

SEQ ID NO: 944246 - DNA, 22 bp, Artificial Sequence
  chemically synthesized
tgtacttattttattttaacat

SEQ ID NO: 944247 - DNA, 22 bp, Artificial Sequence
  chemically synthesized
ctagaagagtcatgatgttaaa

SEQ ID NO: 944248 - DNA, 22 bp, Artificial Sequence
  chemically synthesized
attttattttaacatcatgact

SEQ ID NO: 944249 - DNA, 22 bp, Artificial Sequence
  chemically synthesized
ttttattttaacatcatgactc

SEQ ID NO: 944250 - DNA, 22 bp, Artificial Sequence
  chemically synthesized
tattttaacatcatgactcttc

SEQ ID NO: 944251 - DNA, 22 bp, Artificial Sequence
  chemically synthesized
attttaacatcatgactcttct

SEQ ID NO: 944252 - DNA, 22 bp, Artificial Sequence
  chemically synthesized
acaaaagttgctagaagagtca

SEQ ID NO: 944253 - DNA, 22 bp, Artificial Sequence
  chemically synthesized
ttttaacatcatgactcttcta

SEQ ID NO: 944254 - DNA, 22 bp, Artificial Sequence
  chemically synthesized
taacatcatgactcttctagca

SEQ ID NO: 944255 - DNA, 22 bp, Artificial Sequence
  chemically synthesized
aacatcatgactcttctagcaa

SEQ ID NO: 944256 - DNA, 22 bp, Artificial Sequence
  chemically synthesized
acatcatgactcttctagcaac

SEQ ID NO: 944257 - DNA, 22 bp, Artificial Sequence
  chemically synthesized
aatgcaactcacaaaagttgct

SEQ ID NO: 944258 - DNA, 22 bp, Artificial Sequence
  chemically synthesized
ttctagcaacttttgtgagttg

SEQ ID NO: 944259 - DNA, 22 bp, Artificial Sequence
  chemically synthesized
aaaaagttaaatgcaactcaca

SEQ ID NO: 944260 - DNA, 22 bp, Artificial Sequence
  chemically synthesized
ctagcaacttttgtgagttgca

SEQ ID NO: 944261 - DNA, 22 bp, Artificial Sequence
  chemically synthesized
tagcaacttttgtgagttgcat

SEQ ID NO: 944262 - DNA, 22 bp, Artificial Sequence
  chemically synthesized
gcaacttttgtgagttgcattt

SEQ ID NO: 944263 - DNA, 22 bp, Artificial Sequence
  chemically synthesized
cagagactgaaaaagttaaatg

SEQ ID NO: 944264 - DNA, 22 bp, Artificial Sequence
  chemically synthesized
ttgtgagttgcatttaactttt

SEQ ID NO: 944265 - DNA, 22 bp, Artificial Sequence
  chemically synthesized
tgtgagttgcatttaacttttt

SEQ ID NO: 944266 - DNA, 22 bp, Artificial Sequence
  chemically synthesized
gtgagttgcatttaactttttc

SEQ ID NO: 944267 - DNA, 22 bp, Artificial Sequence
  chemically synthesized
tgagttgcatttaactttttca

SEQ ID NO: 944268 - DNA, 22 bp, Artificial Sequence
  chemically synthesized
catttaactttttcagtctctg

SEQ ID NO: 944269 - DNA, 22 bp, Artificial Sequence
  chemically synthesized
tgaagtaagccctacagagact

SEQ ID NO: 944270 - DNA, 22 bp, Artificial Sequence
  chemically synthesized
aactttttcagtctctgtaggg

SEQ ID NO: 944271 - DNA, 22 bp, Artificial Sequence
  chemically synthesized
ttgtgaagtaagccctacagag

SEQ ID NO: 944272 - DNA, 22 bp, Artificial Sequence
  chemically synthesized
actttttcagtctctgtagggc

SEQ ID NO: 944273 - DNA, 22 bp, Artificial Sequence
  chemically synthesized
tttcagtctctgtagggcttac

SEQ ID NO: 944274 - DNA, 22 bp, Artificial Sequence
  chemically synthesized
ttcagtctctgtagggcttact

SEQ ID NO: 944275 - DNA, 22 bp, Artificial Sequence
  chemically synthesized
tcagtctctgtagggcttactt

SEQ ID NO: 944276 - DNA, 22 bp, Artificial Sequence
  chemically synthesized
agacctattgtgaagtaagccc

SEQ ID NO: 944277 - DNA, 22 bp, Artificial Sequence
  chemically synthesized
cagtctctgtagggcttacttc

SEQ ID NO: 944278 - DNA, 22 bp, Artificial Sequence
  chemically synthesized
agtctctgtagggcttacttca

SEQ ID NO: 944279 - DNA, 22 bp, Artificial Sequence
  chemically synthesized
actgagacctattgtgaagtaa

SEQ ID NO: 944280 - DNA, 22 bp, Artificial Sequence
  chemically synthesized
tgtagggcttacttcacaatag

SEQ ID NO: 944281 - DNA, 22 bp, Artificial Sequence
  chemically synthesized
attcactgagacctattgtgaa

SEQ ID NO: 944282 - DNA, 22 bp, Artificial Sequence
  chemically synthesized
tagggcttacttcacaataggt

SEQ ID NO: 944283 - DNA, 22 bp, Artificial Sequence
  chemically synthesized
attcattcactgagacctattg

SEQ ID NO: 944284 - DNA, 22 bp, Artificial Sequence
  chemically synthesized
acttcacaataggtctcagtga

SEQ ID NO: 944285 - DNA, 22 bp, Artificial Sequence
  chemically synthesized
cttcacaataggtctcagtgaa

SEQ ID NO: 944286 - DNA, 22 bp, Artificial Sequence
  chemically synthesized
agggttaattcattcactgaga

SEQ ID NO: 944287 - DNA, 22 bp, Artificial Sequence
  chemically synthesized
taagggttaattcattcactga

SEQ ID NO: 944288 - DNA, 22 bp, Artificial Sequence
  chemically synthesized
cacaataggtctcagtgaatga

SEQ ID NO: 944289 - DNA, 22 bp, Artificial Sequence
  chemically synthesized
acaataggtctcagtgaatgaa

SEQ ID NO: 944290 - DNA, 22 bp, Artificial Sequence
  chemically synthesized
agtgaatgaattaacccttaga

SEQ ID NO: 944291 - DNA, 22 bp, Artificial Sequence
  chemically synthesized
gatgaaacggacactctaaggg

SEQ ID NO: 944292 - DNA, 22 bp, Artificial Sequence
  chemically synthesized
agatgaaacggacactctaagg

SEQ ID NO: 944293 - DNA, 22 bp, Artificial Sequence
  chemically synthesized
tagatgaaacggacactctaag

SEQ ID NO: 944294 - DNA, 22 bp, Artificial Sequence
  chemically synthesized
ctttagatgaaacggacactct

SEQ ID NO: 944295 - DNA, 22 bp, Artificial Sequence
  chemically synthesized
acccttagagtgtccgtttcat

SEQ ID NO: 944296 - DNA, 22 bp, Artificial Sequence
  chemically synthesized
agagtgtccgtttcatctaaag

SEQ ID NO: 944297 - DNA, 22 bp, Artificial Sequence
  chemically synthesized
gagtgtccgtttcatctaaagg

SEQ ID NO: 944298 - DNA, 22 bp, Artificial Sequence
  chemically synthesized
caaaaacaggcaatcctccttt

SEQ ID NO: 944299 - DNA, 22 bp, Artificial Sequence
  chemically synthesized
gcaaaaacaggcaatcctcctt

SEQ ID NO: 944300 - DNA, 22 bp, Artificial Sequence
  chemically synthesized
catctaaaggaggattgcctgt

SEQ ID NO: 944301 - DNA, 22 bp, Artificial Sequence
  chemically synthesized
gaacttgcaaaaacaggcaatc

SEQ ID NO: 944302 - DNA, 22 bp, Artificial Sequence
  chemically synthesized
atctaaaggaggattgcctgtt

SEQ ID NO: 944303 - DNA, 22 bp, Artificial Sequence
  chemically synthesized
aaggaggattgcctgtttttgc

SEQ ID NO: 944304 - DNA, 22 bp, Artificial Sequence
  chemically synthesized
gatgctggaacttgcaaaaaca

SEQ ID NO: 944305 - DNA, 22 bp, Artificial Sequence
  chemically synthesized
cctgtttttgcaagttccagca

SEQ ID NO: 944306 - DNA, 22 bp, Artificial Sequence
  chemically synthesized
tttttgcaagttccagcatcta

SEQ ID NO: 944307 - DNA, 22 bp, Artificial Sequence
  chemically synthesized
aaggtgaaacattagatgctgg

SEQ ID NO: 944308 - DNA, 22 bp, Artificial Sequence
  chemically synthesized
caaggtgaaacattagatgctg

SEQ ID NO: 944309 - DNA, 22 bp, Artificial Sequence
  chemically synthesized
tcaaggtgaaacattagatgct

SEQ ID NO: 944310 - DNA, 22 bp, Artificial Sequence
  chemically synthesized
ttgcaagttccagcatctaatg

SEQ ID NO: 944311 - DNA, 22 bp, Artificial Sequence
  chemically synthesized
ttcaaggtgaaacattagatgc

SEQ ID NO: 944312 - DNA, 22 bp, Artificial Sequence
  chemically synthesized
tgcaagttccagcatctaatgt

SEQ ID NO: 944313 - DNA, 22 bp, Artificial Sequence
  chemically synthesized
gcaagttccagcatctaatgtt

SEQ ID NO: 944314 - DNA, 22 bp, Artificial Sequence
  chemically synthesized
caagttccagcatctaatgttt

SEQ ID NO: 944315 - DNA, 22 bp, Artificial Sequence
  chemically synthesized
atatttttcaaggtgaaacatt

SEQ ID NO: 944316 - DNA, 22 bp, Artificial Sequence
  chemically synthesized
cagcatctaatgtttcaccttg

SEQ ID NO: 944317 - DNA, 22 bp, Artificial Sequence
  chemically synthesized
catcagggttaatatttttcaa

SEQ ID NO: 944318 - DNA, 22 bp, Artificial Sequence
  chemically synthesized
atgtttcaccttgaaaaatatt

SEQ ID NO: 944319 - DNA, 22 bp, Artificial Sequence
  chemically synthesized
acctacatcagggttaatattt

SEQ ID NO: 944320 - DNA, 22 bp, Artificial Sequence
  chemically synthesized
gacctacatcagggttaatatt

SEQ ID NO: 944321 - DNA, 22 bp, Artificial Sequence
  chemically synthesized
caccttgaaaaatattaaccct

SEQ ID NO: 944322 - DNA, 22 bp, Artificial Sequence
  chemically synthesized
accttgaaaaatattaaccctg

SEQ ID NO: 944323 - DNA, 22 bp, Artificial Sequence
  chemically synthesized
gaaaaatattaaccctgatgta

SEQ ID NO: 944324 - DNA, 22 bp, Artificial Sequence
  chemically synthesized
aaaaatattaaccctgatgtag

SEQ ID NO: 944325 - DNA, 22 bp, Artificial Sequence
  chemically synthesized
catatatttgacctacatcagg

SEQ ID NO: 944326 - DNA, 22 bp, Artificial Sequence
  chemically synthesized
acatatatttgacctacatcag

SEQ ID NO: 944327 - DNA, 22 bp, Artificial Sequence
  chemically synthesized
tacatatatttgacctacatca

SEQ ID NO: 944328 - DNA, 22 bp, Artificial Sequence
  chemically synthesized
accctgatgtaggtcaaatata

SEQ ID NO: 944329 - DNA, 22 bp, Artificial Sequence
  chemically synthesized
atacagctttacatatatttga

SEQ ID NO: 944330 - DNA, 22 bp, Artificial Sequence
  chemically synthesized
atgtaggtcaaatatatgtaaa

SEQ ID NO: 944331 - DNA, 22 bp, Artificial Sequence
  chemically synthesized
aaaaacaaagttaatacagctt

SEQ ID NO: 944332 - DNA, 22 bp, Artificial Sequence
  chemically synthesized
gaaaaacaaagttaatacagct

SEQ ID NO: 944333 - DNA, 22 bp, Artificial Sequence
  chemically synthesized
tgaaaaacaaagttaatacagc

SEQ ID NO: 944334 - DNA, 22 bp, Artificial Sequence
  chemically synthesized
tattaactttgtttttcaaaga

SEQ ID NO: 944335 - DNA, 22 bp, Artificial Sequence
  chemically synthesized
actttgtttttcaaagacatca

SEQ ID NO: 944336 - DNA, 22 bp, Artificial Sequence
  chemically synthesized
tgtttttcaaagacatcatcat

SEQ ID NO: 944337 - DNA, 22 bp, Artificial Sequence
  chemically synthesized
gtttttcaaagacatcatcatt

SEQ ID NO: 944338 - DNA, 22 bp, Artificial Sequence
  chemically synthesized
tttttcaaagacatcatcattt

SEQ ID NO: 944339 - DNA, 22 bp, Artificial Sequence
  chemically synthesized
ttcaaagacatcatcatttttt

SEQ ID NO: 944340 - DNA, 22 bp, Artificial Sequence
  chemically synthesized
tcaaagacatcatcattttttt

SEQ ID NO: 944341 - DNA, 22 bp, Artificial Sequence
  chemically synthesized
caaagacatcatcatttttttc

SEQ ID NO: 944342 - DNA, 22 bp, Artificial Sequence
  chemically synthesized
acagagaaaaaagaaaaaaatg

SEQ ID NO: 944343 - DNA, 22 bp, Artificial Sequence
  chemically synthesized
aaagacatcatcatttttttct

SEQ ID NO: 944344 - DNA, 22 bp, Artificial Sequence
  chemically synthesized
ttttcttttttctctgtgaggg

SEQ ID NO: 944345 - DNA, 22 bp, Artificial Sequence
  chemically synthesized
tttcttttttctctgtgagggc

SEQ ID NO: 944346 - DNA, 22 bp, Artificial Sequence
  chemically synthesized
ttcttttttctctgtgagggct

SEQ ID NO: 944347 - DNA, 22 bp, Artificial Sequence
  chemically synthesized
tcttttttctctgtgagggctt

SEQ ID NO: 944348 - DNA, 22 bp, Artificial Sequence
  chemically synthesized
cttttttctctgtgagggcttt

SEQ ID NO: 944349 - DNA, 22 bp, Artificial Sequence
  chemically synthesized
ttttttctctgtgagggctttt

SEQ ID NO: 944350 - DNA, 22 bp, Artificial Sequence
  chemically synthesized
taaaagaaaaaaaaaagccctc

SEQ ID NO: 944351 - DNA, 22 bp, Artificial Sequence
  chemically synthesized
ataaaagaaaaaaaaaagccct

SEQ ID NO: 944352 - DNA, 22 bp, Artificial Sequence
  chemically synthesized
ttttctctgtgagggctttttt

SEQ ID NO: 944353 - DNA, 22 bp, Artificial Sequence
  chemically synthesized
tataaaagaaaaaaaaaagccc

SEQ ID NO: 944354 - DNA, 22 bp, Artificial Sequence
  chemically synthesized
tttctctgtgagggcttttttt

SEQ ID NO: 944355 - DNA, 22 bp, Artificial Sequence
  chemically synthesized
ttctctgtgagggctttttttt

SEQ ID NO: 944356 - DNA, 22 bp, Artificial Sequence
  chemically synthesized
tctctgtgagggcttttttttt

SEQ ID NO: 944357 - DNA, 22 bp, Artificial Sequence
  chemically synthesized
ctttataaaagaaaaaaaaaag

SEQ ID NO: 944358 - DNA, 22 bp, Artificial Sequence
  chemically synthesized
ctctgtgagggctttttttttt

SEQ ID NO: 944359 - DNA, 22 bp, Artificial Sequence
  chemically synthesized
actttataaaagaaaaaaaaaa

SEQ ID NO: 944360 - DNA, 22 bp, Artificial Sequence
  chemically synthesized
tctgtgagggcttttttttttc

SEQ ID NO: 944361 - DNA, 22 bp, Artificial Sequence
  chemically synthesized
tactttataaaagaaaaaaaaa

SEQ ID NO: 944362 - DNA, 22 bp, Artificial Sequence
  chemically synthesized
ttactttataaaagaaaaaaaa

SEQ ID NO: 944363 - DNA, 22 bp, Artificial Sequence
  chemically synthesized
tgtgagggcttttttttttctt

SEQ ID NO: 944364 - DNA, 22 bp, Artificial Sequence
  chemically synthesized
tgagggcttttttttttctttt

SEQ ID NO: 944365 - DNA, 22 bp, Artificial Sequence
  chemically synthesized
tttttactttataaaagaaaaa

SEQ ID NO: 944366 - DNA, 22 bp, Artificial Sequence
  chemically synthesized
aaattatttttactttataaaa

SEQ ID NO: 944367 - DNA, 22 bp, Artificial Sequence
  chemically synthesized
gaaattatttttactttataaa

SEQ ID NO: 944368 - DNA, 22 bp, Artificial Sequence
  chemically synthesized
tgaaattatttttactttataa

SEQ ID NO: 944369 - DNA, 22 bp, Artificial Sequence
  chemically synthesized
ttttttttcttttataaagtaa

SEQ ID NO: 944370 - DNA, 22 bp, Artificial Sequence
  chemically synthesized
ttgaaattatttttactttata

SEQ ID NO: 944371 - DNA, 22 bp, Artificial Sequence
  chemically synthesized
tttttttcttttataaagtaaa

SEQ ID NO: 944372 - DNA, 22 bp, Artificial Sequence
  chemically synthesized
ttttttcttttataaagtaaaa

SEQ ID NO: 944373 - DNA, 22 bp, Artificial Sequence
  chemically synthesized
tttttcttttataaagtaaaaa

SEQ ID NO: 944374 - DNA, 22 bp, Artificial Sequence
  chemically synthesized
ttttcttttataaagtaaaaat

SEQ ID NO: 944375 - DNA, 22 bp, Artificial Sequence
  chemically synthesized
tttcttttataaagtaaaaata

SEQ ID NO: 944376 - DNA, 22 bp, Artificial Sequence
  chemically synthesized
ttcttttataaagtaaaaataa

SEQ ID NO: 944377 - DNA, 22 bp, Artificial Sequence
  chemically synthesized
tcttttataaagtaaaaataat

SEQ ID NO: 944378 - DNA, 22 bp, Artificial Sequence
  chemically synthesized
cttttataaagtaaaaataatt

SEQ ID NO: 944379 - DNA, 22 bp, Artificial Sequence
  chemically synthesized
ttttataaagtaaaaataattt

SEQ ID NO: 944380 - DNA, 22 bp, Artificial Sequence
  chemically synthesized
ttataaagtaaaaataatttca

SEQ ID NO: 944381 - DNA, 22 bp, Artificial Sequence
  chemically synthesized
tataaagtaaaaataatttcaa

SEQ ID NO: 944382 - DNA, 22 bp, Artificial Sequence
  chemically synthesized
ataaagtaaaaataatttcaaa

SEQ ID NO: 944383 - DNA, 22 bp, Artificial Sequence
  chemically synthesized
taaagtaaaaataatttcaaaa

SEQ ID NO: 944384 - DNA, 22 bp, Artificial Sequence
  chemically synthesized
atcacaagagaacaatatgatt

SEQ ID NO: 944385 - DNA, 22 bp, Artificial Sequence
  chemically synthesized
tcatcacaagagaacaatatga

SEQ ID NO: 944386 - DNA, 22 bp, Artificial Sequence
  chemically synthesized
ctcatcacaagagaacaatatg

SEQ ID NO: 944387 - DNA, 22 bp, Artificial Sequence
  chemically synthesized
tctcatcacaagagaacaatat

SEQ ID NO: 944388 - DNA, 22 bp, Artificial Sequence
  chemically synthesized
caaaaatcatattgttctcttg

SEQ ID NO: 944389 - DNA, 22 bp, Artificial Sequence
  chemically synthesized
aaaaatcatattgttctcttgt

SEQ ID NO: 944390 - DNA, 22 bp, Artificial Sequence
  chemically synthesized
tatgtgctttctcatcacaaga

SEQ ID NO: 944391 - DNA, 22 bp, Artificial Sequence
  chemically synthesized
gtatgtgctttctcatcacaag

SEQ ID NO: 944392 - DNA, 22 bp, Artificial Sequence
  chemically synthesized
tgtatgtgctttctcatcacaa

SEQ ID NO: 944393 - DNA, 22 bp, Artificial Sequence
  chemically synthesized
ttctcttgtgatgagaaagcac

SEQ ID NO: 944394 - DNA, 22 bp, Artificial Sequence
  chemically synthesized
tcttgtgatgagaaagcacata

SEQ ID NO: 944395 - DNA, 22 bp, Artificial Sequence
  chemically synthesized
aataaaattttgtatgtgcttt

SEQ ID NO: 944396 - DNA, 22 bp, Artificial Sequence
  chemically synthesized
aaataaaattttgtatgtgctt

SEQ ID NO: 944397 - DNA, 22 bp, Artificial Sequence
  chemically synthesized
ttgtgatgagaaagcacataca

SEQ ID NO: 944398 - DNA, 22 bp, Artificial Sequence
  chemically synthesized
gtgatgagaaagcacatacaaa

SEQ ID NO: 944399 - DNA, 22 bp, Artificial Sequence
  chemically synthesized
cttaaataaaattttgtatgtg

SEQ ID NO: 944400 - DNA, 22 bp, Artificial Sequence
  chemically synthesized
tgatgagaaagcacatacaaaa

SEQ ID NO: 944401 - DNA, 22 bp, Artificial Sequence
  chemically synthesized
aagttgcttaaataaaattttg

SEQ ID NO: 944402 - DNA, 22 bp, Artificial Sequence
  chemically synthesized
atgcgtgttcaagttgcttaaa

SEQ ID NO: 944403 - DNA, 22 bp, Artificial Sequence
  chemically synthesized
gatgcgtgttcaagttgcttaa

SEQ ID NO: 944404 - DNA, 22 bp, Artificial Sequence
  chemically synthesized
tatttaagcaacttgaacacgc

SEQ ID NO: 944405 - DNA, 22 bp, Artificial Sequence
  chemically synthesized
atttaagcaacttgaacacgca

SEQ ID NO: 944406 - DNA, 22 bp, Artificial Sequence
  chemically synthesized
tttaagcaacttgaacacgcat

SEQ ID NO: 944407 - DNA, 22 bp, Artificial Sequence
  chemically synthesized
aagcaacttgaacacgcatcaa

SEQ ID NO: 944408 - DNA, 22 bp, Artificial Sequence
  chemically synthesized
agcaacttgaacacgcatcaaa

SEQ ID NO: 944409 - DNA, 22 bp, Artificial Sequence
  chemically synthesized
tcaaagggaacaatttgatgcg

SEQ ID NO: 944410 - DNA, 22 bp, Artificial Sequence
  chemically synthesized
gtcaaagggaacaatttgatgc

SEQ ID NO: 944411 - DNA, 22 bp, Artificial Sequence
  chemically synthesized
tgtcaaagggaacaatttgatg

SEQ ID NO: 944412 - DNA, 22 bp, Artificial Sequence
  chemically synthesized
ttgtcaaagggaacaatttgat

SEQ ID NO: 944413 - DNA, 22 bp, Artificial Sequence
  chemically synthesized
tttgtcaaagggaacaatttga

SEQ ID NO: 944414 - DNA, 22 bp, Artificial Sequence
  chemically synthesized
tttttgtcaaagggaacaattt

SEQ ID NO: 944415 - DNA, 22 bp, Artificial Sequence
  chemically synthesized
gaacacgcatcaaattgttccc

SEQ ID NO: 944416 - DNA, 22 bp, Artificial Sequence
  chemically synthesized
aacacgcatcaaattgttccct

SEQ ID NO: 944417 - DNA, 22 bp, Artificial Sequence
  chemically synthesized
tctttttgtcaaagggaacaat

SEQ ID NO: 944418 - DNA, 22 bp, Artificial Sequence
  chemically synthesized
ctctttttgtcaaagggaacaa

SEQ ID NO: 944419 - DNA, 22 bp, Artificial Sequence
  chemically synthesized
tctctttttgtcaaagggaaca

SEQ ID NO: 944420 - DNA, 22 bp, Artificial Sequence
  chemically synthesized
ttccctttgacaaaaagagaaa

SEQ ID NO: 944421 - DNA, 22 bp, Artificial Sequence
  chemically synthesized
cctttgacaaaaagagaaaact

SEQ ID NO: 944422 - DNA, 22 bp, Artificial Sequence
  chemically synthesized
tgacaaaaagagaaaactactt

SEQ ID NO: 944423 - DNA, 22 bp, Artificial Sequence
  chemically synthesized
gtgagcccagacaagtagtttt

SEQ ID NO: 944424 - DNA, 22 bp, Artificial Sequence
  chemically synthesized
gacaaaaagagaaaactacttg

SEQ ID NO: 944425 - DNA, 22 bp, Artificial Sequence
  chemically synthesized
acaaaaagagaaaactacttgt

SEQ ID NO: 944426 - DNA, 22 bp, Artificial Sequence
  chemically synthesized
cttgtctgggctcactagatta

SEQ ID NO: 944427 - DNA, 22 bp, Artificial Sequence
  chemically synthesized
gtctgggctcactagattacca

SEQ ID NO: 944428 - DNA, 22 bp, Artificial Sequence
  chemically synthesized
tctgggctcactagattaccat

SEQ ID NO: 944429 - DNA, 22 bp, Artificial Sequence
  chemically synthesized
gtcgtgacatagtacatggtaa

SEQ ID NO: 944430 - DNA, 22 bp, Artificial Sequence
  chemically synthesized
ggctcactagattaccatgtac

SEQ ID NO: 944431 - DNA, 22 bp, Artificial Sequence
  chemically synthesized
actagattaccatgtactatgt

SEQ ID NO: 944432 - DNA, 22 bp, Artificial Sequence
  chemically synthesized
gattaccatgtactatgtcacg

SEQ ID NO: 944433 - DNA, 22 bp, Artificial Sequence
  chemically synthesized
gaaatatattcgtcgtgacata

SEQ ID NO: 944434 - DNA, 22 bp, Artificial Sequence
  chemically synthesized
agaaatatattcgtcgtgacat

SEQ ID NO: 944435 - DNA, 22 bp, Artificial Sequence
  chemically synthesized
tagaaatatattcgtcgtgaca

SEQ ID NO: 944436 - DNA, 22 bp, Artificial Sequence
  chemically synthesized
ccatgtactatgtcacgacgaa

SEQ ID NO: 944437 - DNA, 22 bp, Artificial Sequence
  chemically synthesized
gctttagaaatatattcgtcgt

SEQ ID NO: 944438 - DNA, 22 bp, Artificial Sequence
  chemically synthesized
ggctttagaaatatattcgtcg

SEQ ID NO: 944439 - DNA, 22 bp, Artificial Sequence
  chemically synthesized
atgtttggctttagaaatatat

SEQ ID NO: 944440 - DNA, 22 bp, Artificial Sequence
  chemically synthesized
tgtcacgacgaatatatttcta

SEQ ID NO: 944441 - DNA, 22 bp, Artificial Sequence
  chemically synthesized
catgtttggctttagaaatata

SEQ ID NO: 944442 - DNA, 22 bp, Artificial Sequence
  chemically synthesized
tcatgtttggctttagaaatat

SEQ ID NO: 944443 - DNA, 22 bp, Artificial Sequence
  chemically synthesized
aattttcatgtttggctttaga

SEQ ID NO: 944444 - DNA, 22 bp, Artificial Sequence
  chemically synthesized
aagataattaaattttcatgtt

SEQ ID NO: 944445 - DNA, 22 bp, Artificial Sequence
  chemically synthesized
ctaaagccaaacatgaaaattt

SEQ ID NO: 944446 - DNA, 22 bp, Artificial Sequence
  chemically synthesized
taaagccaaacatgaaaattta

SEQ ID NO: 944447 - DNA, 22 bp, Artificial Sequence
  chemically synthesized
aagccaaacatgaaaatttaat

SEQ ID NO: 944448 - DNA, 22 bp, Artificial Sequence
  chemically synthesized
tgtagctcaagataattaaatt

SEQ ID NO: 944449 - DNA, 22 bp, Artificial Sequence
  chemically synthesized
aattatcttgagctacataatt

SEQ ID NO: 944450 - DNA, 22 bp, Artificial Sequence
  chemically synthesized
attatcttgagctacataattg

SEQ ID NO: 944451 - DNA, 22 bp, Artificial Sequence
  chemically synthesized
tcttgagctacataattgttct

SEQ ID NO: 944452 - DNA, 22 bp, Artificial Sequence
  chemically synthesized
gagctacataattgttcttctt

SEQ ID NO: 944453 - DNA, 22 bp, Artificial Sequence
  chemically synthesized
ggcaagaagccaaagaagaaca

SEQ ID NO: 944454 - DNA, 22 bp, Artificial Sequence
  chemically synthesized
agctacataattgttcttcttt

SEQ ID NO: 944455 - DNA, 22 bp, Artificial Sequence
  chemically synthesized
cataattgttcttctttggctt

SEQ ID NO: 944456 - DNA, 22 bp, Artificial Sequence
  chemically synthesized
taaaattcggcaagaagccaaa

SEQ ID NO: 944457 - DNA, 22 bp, Artificial Sequence
  chemically synthesized
ttcttctttggcttcttgccga

SEQ ID NO: 944458 - DNA, 22 bp, Artificial Sequence
  chemically synthesized
ttctttggcttcttgccgaatt

SEQ ID NO: 944459 - DNA, 22 bp, Artificial Sequence
  chemically synthesized
aaaaaattataaaattcggcaa

SEQ ID NO: 944460 - DNA, 22 bp, Artificial Sequence
  chemically synthesized
ctttggcttcttgccgaatttt

SEQ ID NO: 944461 - DNA, 22 bp, Artificial Sequence
  chemically synthesized
tttggcttcttgccgaatttta

SEQ ID NO: 944462 - DNA, 22 bp, Artificial Sequence
  chemically synthesized
ttgaaaaaattataaaattcgg

SEQ ID NO: 944463 - DNA, 22 bp, Artificial Sequence
  chemically synthesized
tggcttcttgccgaattttata

SEQ ID NO: 944464 - DNA, 22 bp, Artificial Sequence
  chemically synthesized
ggcttcttgccgaattttataa

SEQ ID NO: 944465 - DNA, 22 bp, Artificial Sequence
  chemically synthesized
gcttcttgccgaattttataat

SEQ ID NO: 944466 - DNA, 22 bp, Artificial Sequence
  chemically synthesized
gatctattgaaaaaattataaa

SEQ ID NO: 944467 - DNA, 22 bp, Artificial Sequence
  chemically synthesized
cttgccgaattttataattttt

SEQ ID NO: 944468 - DNA, 22 bp, Artificial Sequence
  chemically synthesized
ttgccgaattttataatttttt

SEQ ID NO: 944469 - DNA, 22 bp, Artificial Sequence
  chemically synthesized
gccgaattttataattttttca

SEQ ID NO: 944470 - DNA, 22 bp, Artificial Sequence
  chemically synthesized
agttcgatctattgaaaaaatt

SEQ ID NO: 944471 - DNA, 22 bp, Artificial Sequence
  chemically synthesized
ccgaattttataattttttcaa

SEQ ID NO: 944472 - DNA, 22 bp, Artificial Sequence
  chemically synthesized
taaattcagttcgatctattga

SEQ ID NO: 944473 - DNA, 22 bp, Artificial Sequence
  chemically synthesized
gtaaattcagttcgatctattg

SEQ ID NO: 944474 - DNA, 22 bp, Artificial Sequence
  chemically synthesized
tataattttttcaatagatcga

SEQ ID NO: 944475 - DNA, 22 bp, Artificial Sequence
  chemically synthesized
ataattttttcaatagatcgaa

SEQ ID NO: 944476 - DNA, 22 bp, Artificial Sequence
  chemically synthesized
taattttttcaatagatcgaac

SEQ ID NO: 944477 - DNA, 22 bp, Artificial Sequence
  chemically synthesized
tcttgtaaattcagttcgatct

SEQ ID NO: 944478 - DNA, 22 bp, Artificial Sequence
  chemically synthesized
tttcaatagatcgaactgaatt

SEQ ID NO: 944479 - DNA, 22 bp, Artificial Sequence
  chemically synthesized
ttcaatagatcgaactgaattt

SEQ ID NO: 944480 - DNA, 22 bp, Artificial Sequence
  chemically synthesized
tcaatagatcgaactgaattta

SEQ ID NO: 944481 - DNA, 22 bp, Artificial Sequence
  chemically synthesized
caatagatcgaactgaatttac

SEQ ID NO: 944482 - DNA, 22 bp, Artificial Sequence
  chemically synthesized
aaagattatcttgtaaattcag

SEQ ID NO: 944483 - DNA, 22 bp, Artificial Sequence
  chemically synthesized
aatagatcgaactgaatttaca

SEQ ID NO: 944484 - DNA, 22 bp, Artificial Sequence
  chemically synthesized
aattcaaagattatcttgtaaa

SEQ ID NO: 944485 - DNA, 22 bp, Artificial Sequence
  chemically synthesized
aaattcaaagattatcttgtaa

SEQ ID NO: 944486 - DNA, 22 bp, Artificial Sequence
  chemically synthesized
taaattcaaagattatcttgta

SEQ ID NO: 944487 - DNA, 22 bp, Artificial Sequence
  chemically synthesized
ttttaaattcaaagattatctt

SEQ ID NO: 944488 - DNA, 22 bp, Artificial Sequence
  chemically synthesized
gttttaaattcaaagattatct

SEQ ID NO: 944489 - DNA, 22 bp, Artificial Sequence
  chemically synthesized
tgttttaaattcaaagattatc

SEQ ID NO: 944490 - DNA, 22 bp, Artificial Sequence
  chemically synthesized
aatttacaagataatctttgaa

SEQ ID NO: 944491 - DNA, 22 bp, Artificial Sequence
  chemically synthesized
acaagataatctttgaatttaa

SEQ ID NO: 944492 - DNA, 22 bp, Artificial Sequence
  chemically synthesized
caagataatctttgaatttaaa

SEQ ID NO: 944493 - DNA, 22 bp, Artificial Sequence
  chemically synthesized
aaaagtaatgtactttgtttta

SEQ ID NO: 944494 - DNA, 22 bp, Artificial Sequence
  chemically synthesized
aaaaagtaatgtactttgtttt

SEQ ID NO: 944495 - DNA, 22 bp, Artificial Sequence
  chemically synthesized
gcttaaaaagtaatgtactttg

SEQ ID NO: 944496 - DNA, 22 bp, Artificial Sequence
  chemically synthesized
tgaatttaaaacaaagtacatt

SEQ ID NO: 944497 - DNA, 22 bp, Artificial Sequence
  chemically synthesized
gaatttaaaacaaagtacatta

SEQ ID NO: 944498 - DNA, 22 bp, Artificial Sequence
  chemically synthesized
aatttaaaacaaagtacattac

SEQ ID NO: 944499 - DNA, 22 bp, Artificial Sequence
  chemically synthesized
ctggcttaaaaagtaatgtact

SEQ ID NO: 944500 - DNA, 22 bp, Artificial Sequence
  chemically synthesized
actggcttaaaaagtaatgtac

SEQ ID NO: 944501 - DNA, 22 bp, Artificial Sequence
  chemically synthesized
aaaacaaagtacattacttttt

SEQ ID NO: 944502 - DNA, 22 bp, Artificial Sequence
  chemically synthesized
acttactggcttaaaaagtaat

SEQ ID NO: 944503 - DNA, 22 bp, Artificial Sequence
  chemically synthesized
aaacaaagtacattacttttta

SEQ ID NO: 944504 - DNA, 22 bp, Artificial Sequence
  chemically synthesized
aacttactggcttaaaaagtaa

SEQ ID NO: 944505 - DNA, 22 bp, Artificial Sequence
  chemically synthesized
taacttactggcttaaaaagta

SEQ ID NO: 944506 - DNA, 22 bp, Artificial Sequence
  chemically synthesized
gaattttaacttactggcttaa

SEQ ID NO: 944507 - DNA, 22 bp, Artificial Sequence
  chemically synthesized
gaattggaattttaacttactg

SEQ ID NO: 944508 - DNA, 22 bp, Artificial Sequence
  chemically synthesized
agaattggaattttaacttact

SEQ ID NO: 944509 - DNA, 22 bp, Artificial Sequence
  chemically synthesized
ctttttaagccagtaagttaaa

SEQ ID NO: 944510 - DNA, 22 bp, Artificial Sequence
  chemically synthesized
tagaattggaattttaacttac

SEQ ID NO: 944511 - DNA, 22 bp, Artificial Sequence
  chemically synthesized
tttaagccagtaagttaaaatt

SEQ ID NO: 944512 - DNA, 22 bp, Artificial Sequence
  chemically synthesized
ttaagccagtaagttaaaattc

SEQ ID NO: 944513 - DNA, 22 bp, Artificial Sequence
  chemically synthesized
taagccagtaagttaaaattcc

SEQ ID NO: 944514 - DNA, 22 bp, Artificial Sequence
  chemically synthesized
aagccagtaagttaaaattcca

SEQ ID NO: 944515 - DNA, 22 bp, Artificial Sequence
  chemically synthesized
agccagtaagttaaaattccaa

SEQ ID NO: 944516 - DNA, 22 bp, Artificial Sequence
  chemically synthesized
taatattttagaattggaattt

SEQ ID NO: 944517 - DNA, 22 bp, Artificial Sequence
  chemically synthesized
ggagtgcactgtaatattttag

SEQ ID NO: 944518 - DNA, 22 bp, Artificial Sequence
  chemically synthesized
aaattccaattctaaaatatta

SEQ ID NO: 944519 - DNA, 22 bp, Artificial Sequence
  chemically synthesized
gggagtgcactgtaatatttta

SEQ ID NO: 944520 - DNA, 22 bp, Artificial Sequence
  chemically synthesized
tgggagtgcactgtaatatttt

SEQ ID NO: 944521 - DNA, 22 bp, Artificial Sequence
  chemically synthesized
caattctaaaatattacagtgc

SEQ ID NO: 944522 - DNA, 22 bp, Artificial Sequence
  chemically synthesized
taaaatattacagtgcactccc

SEQ ID NO: 944523 - DNA, 22 bp, Artificial Sequence
  chemically synthesized
aaatattacagtgcactcccaa

SEQ ID NO: 944524 - DNA, 22 bp, Artificial Sequence
  chemically synthesized
aaccacaatgctttgggagtgc

SEQ ID NO: 944525 - DNA, 22 bp, Artificial Sequence
  chemically synthesized
aaaccacaatgctttgggagtg

SEQ ID NO: 944526 - DNA, 22 bp, Artificial Sequence
  chemically synthesized
taaaccacaatgctttgggagt

SEQ ID NO: 944527 - DNA, 22 bp, Artificial Sequence
  chemically synthesized
cagtgcactcccaaagcattgt

SEQ ID NO: 944528 - DNA, 22 bp, Artificial Sequence
  chemically synthesized
aatattttaaaccacaatgctt

SEQ ID NO: 944529 - DNA, 22 bp, Artificial Sequence
  chemically synthesized
gaatattttaaaccacaatgct

SEQ ID NO: 944530 - DNA, 22 bp, Artificial Sequence
  chemically synthesized
tgaatattttaaaccacaatgc

SEQ ID NO: 944531 - DNA, 22 bp, Artificial Sequence
  chemically synthesized
ccaaagcattgtggtttaaaat

SEQ ID NO: 944532 - DNA, 22 bp, Artificial Sequence
  chemically synthesized
tataattttgaatattttaaac

SEQ ID NO: 944533 - DNA, 22 bp, Artificial Sequence
  chemically synthesized
tcattatataattttgaatatt

SEQ ID NO: 944534 - DNA, 22 bp, Artificial Sequence
  chemically synthesized
tggtttaaaatattcaaaatta

SEQ ID NO: 944535 - DNA, 22 bp, Artificial Sequence
  chemically synthesized
agattatcattatataattttg

SEQ ID NO: 944536 - DNA, 22 bp, Artificial Sequence
  chemically synthesized
aaaatattcaaaattatataat

SEQ ID NO: 944537 - DNA, 22 bp, Artificial Sequence
  chemically synthesized
aaatattcaaaattatataatg

SEQ ID NO: 944538 - DNA, 22 bp, Artificial Sequence
  chemically synthesized
aaaagcactgagattatcatta

SEQ ID NO: 944539 - DNA, 22 bp, Artificial Sequence
  chemically synthesized
aaaattatataatgataatctc

SEQ ID NO: 944540 - DNA, 22 bp, Artificial Sequence
  chemically synthesized
aaactgaaaagcactgagatta

SEQ ID NO: 944541 - DNA, 22 bp, Artificial Sequence
  chemically synthesized
aaaactgaaaagcactgagatt

SEQ ID NO: 944542 - DNA, 22 bp, Artificial Sequence
  chemically synthesized
tataatgataatctcagtgctt

SEQ ID NO: 944543 - DNA, 22 bp, Artificial Sequence
  chemically synthesized
aaacatgaataccttaaaactg

SEQ ID NO: 944544 - DNA, 22 bp, Artificial Sequence
  chemically synthesized
agtgcttttcagttttaaggta

SEQ ID NO: 944545 - DNA, 22 bp, Artificial Sequence
  chemically synthesized
actaaaacatgaataccttaaa

SEQ ID NO: 944546 - DNA, 22 bp, Artificial Sequence
  chemically synthesized
gactaaaacatgaataccttaa

SEQ ID NO: 944547 - DNA, 22 bp, Artificial Sequence
  chemically synthesized
ttcagttttaaggtattcatgt

SEQ ID NO: 944548 - DNA, 22 bp, Artificial Sequence
  chemically synthesized
tcagttttaaggtattcatgtt

SEQ ID NO: 944549 - DNA, 22 bp, Artificial Sequence
  chemically synthesized
cagttttaaggtattcatgttt

SEQ ID NO: 944550 - DNA, 22 bp, Artificial Sequence
  chemically synthesized
agttttaaggtattcatgtttt

SEQ ID NO: 944551 - DNA, 22 bp, Artificial Sequence
  chemically synthesized
taaggtattcatgttttagtca

SEQ ID NO: 944552 - DNA, 22 bp, Artificial Sequence
  chemically synthesized
aaggtattcatgttttagtcaa

SEQ ID NO: 944553 - DNA, 22 bp, Artificial Sequence
  chemically synthesized
aggtattcatgttttagtcaaa

SEQ ID NO: 944554 - DNA, 22 bp, Artificial Sequence
  chemically synthesized
atgttttagtcaaatgtgatta

SEQ ID NO: 944555 - DNA, 22 bp, Artificial Sequence
  chemically synthesized
tagtcaaatgtgattatacttt

SEQ ID NO: 944556 - DNA, 22 bp, Artificial Sequence
  chemically synthesized
agtcaaatgtgattatactttt

SEQ ID NO: 944557 - DNA, 22 bp, Artificial Sequence
  chemically synthesized
gtcaaatgtgattatactttta

SEQ ID NO: 944558 - DNA, 22 bp, Artificial Sequence
  chemically synthesized
aaacatgtgtaagaaagatacg

SEQ ID NO: 944559 - DNA, 22 bp, Artificial Sequence
  chemically synthesized
gaaacatgtgtaagaaagatac

SEQ ID NO: 944560 - DNA, 22 bp, Artificial Sequence
  chemically synthesized
tacttttattcgtatctttctt

SEQ ID NO: 944561 - DNA, 22 bp, Artificial Sequence
  chemically synthesized
tgaaacatgtgtaagaaagata

SEQ ID NO: 944562 - DNA, 22 bp, Artificial Sequence
  chemically synthesized
ttattcgtatctttcttacaca

SEQ ID NO: 944563 - DNA, 22 bp, Artificial Sequence
  chemically synthesized
tattcgtatctttcttacacat

SEQ ID NO: 944564 - DNA, 22 bp, Artificial Sequence
  chemically synthesized
attcgtatctttcttacacatg

SEQ ID NO: 944565 - DNA, 22 bp, Artificial Sequence
  chemically synthesized
cgagctttgaaacatgtgtaag

SEQ ID NO: 944566 - DNA, 22 bp, Artificial Sequence
  chemically synthesized
ttcgtatctttcttacacatgt

SEQ ID NO: 944567 - DNA, 22 bp, Artificial Sequence
  chemically synthesized
acgagctttgaaacatgtgtaa

SEQ ID NO: 944568 - DNA, 22 bp, Artificial Sequence
  chemically synthesized
tacgagctttgaaacatgtgta

SEQ ID NO: 944569 - DNA, 22 bp, Artificial Sequence
  chemically synthesized
gtatctttcttacacatgtttc

SEQ ID NO: 944570 - DNA, 22 bp, Artificial Sequence
  chemically synthesized
ttttacgagctttgaaacatgt

SEQ ID NO: 944571 - DNA, 22 bp, Artificial Sequence
  chemically synthesized
tcttacacatgtttcaaagctc

SEQ ID NO: 944572 - DNA, 22 bp, Artificial Sequence
  chemically synthesized
cttacacatgtttcaaagctcg

SEQ ID NO: 944573 - DNA, 22 bp, Artificial Sequence
  chemically synthesized
ttacacatgtttcaaagctcgt

SEQ ID NO: 944574 - DNA, 22 bp, Artificial Sequence
  chemically synthesized
acacatgtttcaaagctcgtaa

SEQ ID NO: 944575 - DNA, 22 bp, Artificial Sequence
  chemically synthesized
cacatgtttcaaagctcgtaaa

SEQ ID NO: 944576 - DNA, 22 bp, Artificial Sequence
  chemically synthesized
gaacaaataagataattatttt

SEQ ID NO: 944577 - DNA, 22 bp, Artificial Sequence
  chemically synthesized
agaacaaataagataattattt

SEQ ID NO: 944578 - DNA, 22 bp, Artificial Sequence
  chemically synthesized
caaagctcgtaaaataattatc

SEQ ID NO: 944579 - DNA, 22 bp, Artificial Sequence
  chemically synthesized
tagaacaaataagataattatt

SEQ ID NO: 944580 - DNA, 22 bp, Artificial Sequence
  chemically synthesized
aaagctcgtaaaataattatct

SEQ ID NO: 944581 - DNA, 22 bp, Artificial Sequence
  chemically synthesized
gtaaaataattatcttatttgt

SEQ ID NO: 944582 - DNA, 22 bp, Artificial Sequence
  chemically synthesized
tcttatttgttctaaaacttcc

SEQ ID NO: 944583 - DNA, 22 bp, Artificial Sequence
  chemically synthesized
atttgttctaaaacttccttac

SEQ ID NO: 944584 - DNA, 22 bp, Artificial Sequence
  chemically synthesized
tttgttctaaaacttccttacg

SEQ ID NO: 944585 - DNA, 22 bp, Artificial Sequence
  chemically synthesized
gttctaaaacttccttacgtat

SEQ ID NO: 944586 - DNA, 22 bp, Artificial Sequence
  chemically synthesized
ttctaaaacttccttacgtatg

SEQ ID NO: 944587 - DNA, 22 bp, Artificial Sequence
  chemically synthesized
taaaacttccttacgtatgctg

SEQ ID NO: 944588 - DNA, 22 bp, Artificial Sequence
  chemically synthesized
aaacttccttacgtatgctgta

SEQ ID NO: 944589 - DNA, 22 bp, Artificial Sequence
  chemically synthesized
agatgggacaaagtacagcata

SEQ ID NO: 944590 - DNA, 22 bp, Artificial Sequence
  chemically synthesized
attgagatgggacaaagtacag

SEQ ID NO: 944591 - DNA, 22 bp, Artificial Sequence
  chemically synthesized
ccttacgtatgctgtactttgt

SEQ ID NO: 944592 - DNA, 22 bp, Artificial Sequence
  chemically synthesized
cattgagatgggacaaagtaca

SEQ ID NO: 944593 - DNA, 22 bp, Artificial Sequence
  chemically synthesized
cttacgtatgctgtactttgtc

SEQ ID NO: 944594 - DNA, 22 bp, Artificial Sequence
  chemically synthesized
acgtatgctgtactttgtccca

SEQ ID NO: 944595 - DNA, 22 bp, Artificial Sequence
  chemically synthesized
cgtatgctgtactttgtcccat

SEQ ID NO: 944596 - DNA, 22 bp, Artificial Sequence
  chemically synthesized
catgtaatttcattgagatggg

SEQ ID NO: 944597 - DNA, 22 bp, Artificial Sequence
  chemically synthesized
ctgcatgtaatttcattgagat

SEQ ID NO: 944598 - DNA, 22 bp, Artificial Sequence
  chemically synthesized
tactttgtcccatctcaatgaa

SEQ ID NO: 944599 - DNA, 22 bp, Artificial Sequence
  chemically synthesized
gctgcatgtaatttcattgaga

SEQ ID NO: 944600 - DNA, 22 bp, Artificial Sequence
  chemically synthesized
tgtcccatctcaatgaaattac

SEQ ID NO: 944601 - DNA, 22 bp, Artificial Sequence
  chemically synthesized
gtcccatctcaatgaaattaca

SEQ ID NO: 944602 - DNA, 22 bp, Artificial Sequence
  chemically synthesized
tcccatctcaatgaaattacat

SEQ ID NO: 944603 - DNA, 22 bp, Artificial Sequence
  chemically synthesized
ggaacaaatttgctgcatgtaa

SEQ ID NO: 944604 - DNA, 22 bp, Artificial Sequence
  chemically synthesized
aggaacaaatttgctgcatgta

SEQ ID NO: 944605 - DNA, 22 bp, Artificial Sequence
  chemically synthesized
aatgaaattacatgcagcaaat

SEQ ID NO: 944606 - DNA, 22 bp, Artificial Sequence
  chemically synthesized
aacacaagacttaggaacaaat

SEQ ID NO: 944607 - DNA, 22 bp, Artificial Sequence
  chemically synthesized
catgcagcaaatttgttcctaa

SEQ ID NO: 944608 - DNA, 22 bp, Artificial Sequence
  chemically synthesized
agtgttgaacacaagacttagg

SEQ ID NO: 944609 - DNA, 22 bp, Artificial Sequence
  chemically synthesized
cagtctcagtgttgaacacaag

SEQ ID NO: 944610 - DNA, 22 bp, Artificial Sequence
  chemically synthesized
gttcctaagtcttgtgttcaac

SEQ ID NO: 944611 - DNA, 22 bp, Artificial Sequence
  chemically synthesized
ttcctaagtcttgtgttcaaca

SEQ ID NO: 944612 - DNA, 22 bp, Artificial Sequence
  chemically synthesized
ctaagtcttgtgttcaacactg

SEQ ID NO: 944613 - DNA, 22 bp, Artificial Sequence
  chemically synthesized
agtcttgtgttcaacactgaga

SEQ ID NO: 944614 - DNA, 22 bp, Artificial Sequence
  chemically synthesized
gtgttcaacactgagactgtaa

SEQ ID NO: 944615 - DNA, 22 bp, Artificial Sequence
  chemically synthesized
tgttcaacactgagactgtaat

SEQ ID NO: 944616 - DNA, 22 bp, Artificial Sequence
  chemically synthesized
aacactgagactgtaattcctg

SEQ ID NO: 944617 - DNA, 22 bp, Artificial Sequence
  chemically synthesized
agactgtaattcctgacgctgt

SEQ ID NO: 944618 - DNA, 22 bp, Artificial Sequence
  chemically synthesized
aaaaagtagaatgacagcgtca

SEQ ID NO: 944619 - DNA, 22 bp, Artificial Sequence
  chemically synthesized
caaaaagtagaatgacagcgtc

SEQ ID NO: 944620 - DNA, 22 bp, Artificial Sequence
  chemically synthesized
tcaaaaagtagaatgacagcgt

SEQ ID NO: 944621 - DNA, 22 bp, Artificial Sequence
  chemically synthesized
taattcctgacgctgtcattct

SEQ ID NO: 944622 - DNA, 22 bp, Artificial Sequence
  chemically synthesized
ctgacgctgtcattctactttt

SEQ ID NO: 944623 - DNA, 22 bp, Artificial Sequence
  chemically synthesized
acgctgtcattctactttttga

SEQ ID NO: 944624 - DNA, 22 bp, Artificial Sequence
  chemically synthesized
aatgtaaaattttcaaaaagta

SEQ ID NO: 944625 - DNA, 22 bp, Artificial Sequence
  chemically synthesized
gaatgtaaaattttcaaaaagt

SEQ ID NO: 944626 - DNA, 22 bp, Artificial Sequence
  chemically synthesized
tttgaatgtaaaattttcaaaa

SEQ ID NO: 944627 - DNA, 22 bp, Artificial Sequence
  chemically synthesized
tcattctactttttgaaaattt

SEQ ID NO: 944628 - DNA, 22 bp, Artificial Sequence
  chemically synthesized
tatttgaatgtaaaattttcaa

SEQ ID NO: 944629 - DNA, 22 bp, Artificial Sequence
  chemically synthesized
tactttttgaaaattttacatt

SEQ ID NO: 944630 - DNA, 22 bp, Artificial Sequence
  chemically synthesized
ctttttgaaaattttacattca

SEQ ID NO: 944631 - DNA, 22 bp, Artificial Sequence
  chemically synthesized
agatattctatttgaatgtaaa

SEQ ID NO: 944632 - DNA, 22 bp, Artificial Sequence
  chemically synthesized
tttgaaaattttacattcaaat

SEQ ID NO: 944633 - DNA, 22 bp, Artificial Sequence
  chemically synthesized
ttgaaaattttacattcaaata

SEQ ID NO: 944634 - DNA, 22 bp, Artificial Sequence
  chemically synthesized
tgaaaattttacattcaaatag

SEQ ID NO: 944635 - DNA, 22 bp, Artificial Sequence
  chemically synthesized
gaaaattttacattcaaataga

SEQ ID NO: 944636 - DNA, 22 bp, Artificial Sequence
  chemically synthesized
aaaattttacattcaaatagaa

SEQ ID NO: 944637 - DNA, 22 bp, Artificial Sequence
  chemically synthesized
tacattcaaatagaatatctca

SEQ ID NO: 944638 - DNA, 22 bp, Artificial Sequence
  chemically synthesized
acattcaaatagaatatctcaa

SEQ ID NO: 944639 - DNA, 22 bp, Artificial Sequence
  chemically synthesized
cattcaaatagaatatctcaac

SEQ ID NO: 944640 - DNA, 22 bp, Artificial Sequence
  chemically synthesized
aaatagaatatctcaactcttt

SEQ ID NO: 944641 - DNA, 22 bp, Artificial Sequence
  chemically synthesized
aagacagacaaatagaaagagt

SEQ ID NO: 944642 - DNA, 22 bp, Artificial Sequence
  chemically synthesized
tctgaagacagacaaatagaaa

SEQ ID NO: 944643 - DNA, 22 bp, Artificial Sequence
  chemically synthesized
aactctttctatttgtctgtct

SEQ ID NO: 944644 - DNA, 22 bp, Artificial Sequence
  chemically synthesized
aaataagttatctgaagacaga

SEQ ID NO: 944645 - DNA, 22 bp, Artificial Sequence
  chemically synthesized
tttctatttgtctgtcttcaga

SEQ ID NO: 944646 - DNA, 22 bp, Artificial Sequence
  chemically synthesized
tctatttgtctgtcttcagata

SEQ ID NO: 944647 - DNA, 22 bp, Artificial Sequence
  chemically synthesized
ctatttgtctgtcttcagataa

SEQ ID NO: 944648 - DNA, 22 bp, Artificial Sequence
  chemically synthesized
tatttgtctgtcttcagataac

SEQ ID NO: 944649 - DNA, 22 bp, Artificial Sequence
  chemically synthesized
tttgtctgtcttcagataactt

SEQ ID NO: 944650 - DNA, 22 bp, Artificial Sequence
  chemically synthesized
acaaactaaaataagttatctg

SEQ ID NO: 944651 - DNA, 22 bp, Artificial Sequence
  chemically synthesized
aacaaactaaaataagttatct

SEQ ID NO: 944652 - DNA, 22 bp, Artificial Sequence
  chemically synthesized
gtctgtcttcagataacttatt

SEQ ID NO: 944653 - DNA, 22 bp, Artificial Sequence
  chemically synthesized
tctgtcttcagataacttattt

SEQ ID NO: 944654 - DNA, 22 bp, Artificial Sequence
  chemically synthesized
agatttaacaaactaaaataag

SEQ ID NO: 944655 - DNA, 22 bp, Artificial Sequence
  chemically synthesized
tcttcagataacttattttagt

SEQ ID NO: 944656 - DNA, 22 bp, Artificial Sequence
  chemically synthesized
tgagatttaacaaactaaaata

SEQ ID NO: 944657 - DNA, 22 bp, Artificial Sequence
  chemically synthesized
cagataacttattttagtttgt

SEQ ID NO: 944658 - DNA, 22 bp, Artificial Sequence
  chemically synthesized
agataacttattttagtttgtt

SEQ ID NO: 944659 - DNA, 22 bp, Artificial Sequence
  chemically synthesized
attttagtttgttaaatctcag

SEQ ID NO: 944660 - DNA, 22 bp, Artificial Sequence
  chemically synthesized
ttttagtttgttaaatctcaga

SEQ ID NO: 944661 - DNA, 22 bp, Artificial Sequence
  chemically synthesized
tagtttgttaaatctcagaatt

SEQ ID NO: 944662 - DNA, 22 bp, Artificial Sequence
  chemically synthesized
agtttgttaaatctcagaattt

SEQ ID NO: 944663 - DNA, 22 bp, Artificial Sequence
  chemically synthesized
gtttgttaaatctcagaatttt

SEQ ID NO: 944664 - DNA, 22 bp, Artificial Sequence
  chemically synthesized
gttaaatctcagaattttcacc

SEQ ID NO: 944665 - DNA, 22 bp, Artificial Sequence
  chemically synthesized
ttaaatctcagaattttcaccc

SEQ ID NO: 944666 - DNA, 22 bp, Artificial Sequence
  chemically synthesized
gccccatgaatagggtgaaaat

SEQ ID NO: 944667 - DNA, 22 bp, Artificial Sequence
  chemically synthesized
agccccatgaatagggtgaaaa

SEQ ID NO: 944668 - DNA, 22 bp, Artificial Sequence
  chemically synthesized
aatctcagaattttcaccctat

SEQ ID NO: 944669 - DNA, 22 bp, Artificial Sequence
  chemically synthesized
aacttagccccatgaatagggt

SEQ ID NO: 944670 - DNA, 22 bp, Artificial Sequence
  chemically synthesized
agaattttcaccctattcatgg

SEQ ID NO: 944671 - DNA, 22 bp, Artificial Sequence
  chemically synthesized
attcaacttagccccatgaata

SEQ ID NO: 944672 - DNA, 22 bp, Artificial Sequence
  chemically synthesized
tcaccctattcatggggctaag

SEQ ID NO: 944673 - DNA, 22 bp, Artificial Sequence
  chemically synthesized
caccctattcatggggctaagt

SEQ ID NO: 944674 - DNA, 22 bp, Artificial Sequence
  chemically synthesized
agaattaattcaacttagcccc

SEQ ID NO: 944675 - DNA, 22 bp, Artificial Sequence
  chemically synthesized
accctattcatggggctaagtt

SEQ ID NO: 944676 - DNA, 22 bp, Artificial Sequence
  chemically synthesized
aagaattaattcaacttagccc

SEQ ID NO: 944677 - DNA, 22 bp, Artificial Sequence
  chemically synthesized
ttcatggggctaagttgaatta

SEQ ID NO: 944678 - DNA, 22 bp, Artificial Sequence
  chemically synthesized
acaatttaagaattaattcaac

SEQ ID NO: 944679 - DNA, 22 bp, Artificial Sequence
  chemically synthesized
atggggctaagttgaattaatt

SEQ ID NO: 944680 - DNA, 22 bp, Artificial Sequence
  chemically synthesized
caaatcctcacaatttaagaat

SEQ ID NO: 944681 - DNA, 22 bp, Artificial Sequence
  chemically synthesized
agttgaattaattcttaaattg

SEQ ID NO: 944682 - DNA, 22 bp, Artificial Sequence
  chemically synthesized
tccaaatcctcacaatttaaga

SEQ ID NO: 944683 - DNA, 22 bp, Artificial Sequence
  chemically synthesized
ctccaaatcctcacaatttaag

SEQ ID NO: 944684 - DNA, 22 bp, Artificial Sequence
  chemically synthesized
aattaattcttaaattgtgagg

SEQ ID NO: 944685 - DNA, 22 bp, Artificial Sequence
  chemically synthesized
taatttctccaaatcctcacaa

SEQ ID NO: 944686 - DNA, 22 bp, Artificial Sequence
  chemically synthesized
attcttaaattgtgaggatttg

SEQ ID NO: 944687 - DNA, 22 bp, Artificial Sequence
  chemically synthesized
ttaaattgtgaggatttggaga

SEQ ID NO: 944688 - DNA, 22 bp, Artificial Sequence
  chemically synthesized
atatctataatttctccaaatc

SEQ ID NO: 944689 - DNA, 22 bp, Artificial Sequence
  chemically synthesized
aatatctataatttctccaaat

SEQ ID NO: 944690 - DNA, 22 bp, Artificial Sequence
  chemically synthesized
aaattgtgaggatttggagaaa

SEQ ID NO: 944691 - DNA, 22 bp, Artificial Sequence
  chemically synthesized
taatatctataatttctccaaa

SEQ ID NO: 944692 - DNA, 22 bp, Artificial Sequence
  chemically synthesized
aattgtgaggatttggagaaat

SEQ ID NO: 944693 - DNA, 22 bp, Artificial Sequence
  chemically synthesized
tgaggatttggagaaattatag

SEQ ID NO: 944694 - DNA, 22 bp, Artificial Sequence
  chemically synthesized
gggctttaatatctataatttc

SEQ ID NO: 944695 - DNA, 22 bp, Artificial Sequence
  chemically synthesized
tgctagggctttaatatctata

SEQ ID NO: 944696 - DNA, 22 bp, Artificial Sequence
  chemically synthesized
gtgctagggctttaatatctat

SEQ ID NO: 944697 - DNA, 22 bp, Artificial Sequence
  chemically synthesized
ggagaaattatagatattaaag

SEQ ID NO: 944698 - DNA, 22 bp, Artificial Sequence
  chemically synthesized
gagaaattatagatattaaagc

SEQ ID NO: 944699 - DNA, 22 bp, Artificial Sequence
  chemically synthesized
agaatttgtgctagggctttaa

SEQ ID NO: 944700 - DNA, 22 bp, Artificial Sequence
  chemically synthesized
cagaatttgtgctagggcttta

SEQ ID NO: 944701 - DNA, 22 bp, Artificial Sequence
  chemically synthesized
tagatattaaagccctagcaca

SEQ ID NO: 944702 - DNA, 22 bp, Artificial Sequence
  chemically synthesized
tgtttcagaatttgtgctaggg

SEQ ID NO: 944703 - DNA, 22 bp, Artificial Sequence
  chemically synthesized
aagccctagcacaaattctgaa

SEQ ID NO: 944704 - DNA, 22 bp, Artificial Sequence
  chemically synthesized
caaaaaagccgctatgtttcag

SEQ ID NO: 944705 - DNA, 22 bp, Artificial Sequence
  chemically synthesized
gcaaaaaagccgctatgtttca

SEQ ID NO: 944706 - DNA, 22 bp, Artificial Sequence
  chemically synthesized
gcacaaattctgaaacatagcg

SEQ ID NO: 944707 - DNA, 22 bp, Artificial Sequence
  chemically synthesized
tgaaacatagcggcttttttgc

SEQ ID NO: 944708 - DNA, 22 bp, Artificial Sequence
  chemically synthesized
aaacatagcggcttttttgcaa

SEQ ID NO: 944709 - DNA, 22 bp, Artificial Sequence
  chemically synthesized
ttttgcaaatgttcattttgcc

SEQ ID NO: 944710 - DNA, 22 bp, Artificial Sequence
  chemically synthesized
tttgcaaatgttcattttgcct

SEQ ID NO: 944711 - DNA, 22 bp, Artificial Sequence
  chemically synthesized
ttgcaaatgttcattttgccta

SEQ ID NO: 944712 - DNA, 22 bp, Artificial Sequence
  chemically synthesized
caggtggatccataggcaaaat

SEQ ID NO: 944713 - DNA, 22 bp, Artificial Sequence
  chemically synthesized
tgcaaatgttcattttgcctat

SEQ ID NO: 944714 - DNA, 22 bp, Artificial Sequence
  chemically synthesized
gcaggtggatccataggcaaaa

SEQ ID NO: 944715 - DNA, 22 bp, Artificial Sequence
  chemically synthesized
gcaaatgttcattttgcctatg

SEQ ID NO: 944716 - DNA, 22 bp, Artificial Sequence
  chemically synthesized
caaatgttcattttgcctatgg

SEQ ID NO: 944717 - DNA, 22 bp, Artificial Sequence
  chemically synthesized
cccaccttgcaggtggatccat

SEQ ID NO: 944718 - DNA, 22 bp, Artificial Sequence
  chemically synthesized
gcccaccttgcaggtggatcca

SEQ ID NO: 944719 - DNA, 22 bp, Artificial Sequence
  chemically synthesized
attttgcctatggatccacctg

SEQ ID NO: 944720 - DNA, 22 bp, Artificial Sequence
  chemically synthesized
cttgcccaccttgcaggtggat

SEQ ID NO: 944721 - DNA, 22 bp, Artificial Sequence
  chemically synthesized
ccttgcccaccttgcaggtgga

SEQ ID NO: 944722 - DNA, 22 bp, Artificial Sequence
  chemically synthesized
tccttgcccaccttgcaggtgg

SEQ ID NO: 944723 - DNA, 22 bp, Artificial Sequence
  chemically synthesized
tgcctatggatccacctgcaag

SEQ ID NO: 944724 - DNA, 22 bp, Artificial Sequence
  chemically synthesized
gcctatggatccacctgcaagg

SEQ ID NO: 944725 - DNA, 22 bp, Artificial Sequence
  chemically synthesized
cctatggatccacctgcaaggt

SEQ ID NO: 944726 - DNA, 22 bp, Artificial Sequence
  chemically synthesized
tggatccacctgcaaggtgggc

SEQ ID NO: 944727 - DNA, 22 bp, Artificial Sequence
  chemically synthesized
caaaccctttccttgcccacct

SEQ ID NO: 944728 - DNA, 22 bp, Artificial Sequence
  chemically synthesized
caaggtgggcaaggaaagggtt

SEQ ID NO: 944729 - DNA, 22 bp, Artificial Sequence
  chemically synthesized
tgcaatagaactacaaaccctt

SEQ ID NO: 944730 - DNA, 22 bp, Artificial Sequence
  chemically synthesized
atgcaatagaactacaaaccct

SEQ ID NO: 944731 - DNA, 22 bp, Artificial Sequence
  chemically synthesized
aaagccttatgcaatagaacta

SEQ ID NO: 944732 - DNA, 22 bp, Artificial Sequence
  chemically synthesized
caaagccttatgcaatagaact

SEQ ID NO: 944733 - DNA, 22 bp, Artificial Sequence
  chemically synthesized
gtgaatttcaaagccttatgca

SEQ ID NO: 944734 - DNA, 22 bp, Artificial Sequence
  chemically synthesized
gtagttctattgcataaggctt

SEQ ID NO: 944735 - DNA, 22 bp, Artificial Sequence
  chemically synthesized
tagttctattgcataaggcttt

SEQ ID NO: 944736 - DNA, 22 bp, Artificial Sequence
  chemically synthesized
ctagtgaatttcaaagccttat

SEQ ID NO: 944737 - DNA, 22 bp, Artificial Sequence
  chemically synthesized
tattgcataaggctttgaaatt

SEQ ID NO: 944738 - DNA, 22 bp, Artificial Sequence
  chemically synthesized
ttgcataaggctttgaaattca

SEQ ID NO: 944739 - DNA, 22 bp, Artificial Sequence
  chemically synthesized
cataaggctttgaaattcacta

SEQ ID NO: 944740 - DNA, 22 bp, Artificial Sequence
  chemically synthesized
atcgtgatctactagtgaattt

SEQ ID NO: 944741 - DNA, 22 bp, Artificial Sequence
  chemically synthesized
aatccactgatcgtgatctact

SEQ ID NO: 944742 - DNA, 22 bp, Artificial Sequence
  chemically synthesized
tgaaattcactagtagatcacg

SEQ ID NO: 944743 - DNA, 22 bp, Artificial Sequence
  chemically synthesized
gaaattcactagtagatcacga

SEQ ID NO: 944744 - DNA, 22 bp, Artificial Sequence
  chemically synthesized
aaattcactagtagatcacgat

SEQ ID NO: 944745 - DNA, 22 bp, Artificial Sequence
  chemically synthesized
actagtagatcacgatcagtgg

SEQ ID NO: 944746 - DNA, 22 bp, Artificial Sequence
  chemically synthesized
gtagatcacgatcagtggattg

SEQ ID NO: 944747 - DNA, 22 bp, Artificial Sequence
  chemically synthesized
acgtagatagtaaggcagcaga

SEQ ID NO: 944748 - DNA, 22 bp, Artificial Sequence
  chemically synthesized
aacgtagatagtaaggcagcag

SEQ ID NO: 944749 - DNA, 22 bp, Artificial Sequence
  chemically synthesized
taacgtagatagtaaggcagca

SEQ ID NO: 944750 - DNA, 22 bp, Artificial Sequence
  chemically synthesized
gctttaacgtagatagtaaggc

SEQ ID NO: 944751 - DNA, 22 bp, Artificial Sequence
  chemically synthesized
aatctgctgccttactatctac

SEQ ID NO: 944752 - DNA, 22 bp, Artificial Sequence
  chemically synthesized
ataactggctttaacgtagata

SEQ ID NO: 944753 - DNA, 22 bp, Artificial Sequence
  chemically synthesized
ctgccttactatctacgttaaa

SEQ ID NO: 944754 - DNA, 22 bp, Artificial Sequence
  chemically synthesized
ccttactatctacgttaaagcc

SEQ ID NO: 944755 - DNA, 22 bp, Artificial Sequence
  chemically synthesized
actatctacgttaaagccagtt

SEQ ID NO: 944756 - DNA, 22 bp, Artificial Sequence
  chemically synthesized
ctatctacgttaaagccagtta

SEQ ID NO: 944757 - DNA, 22 bp, Artificial Sequence
  chemically synthesized
tctacgttaaagccagttatca

SEQ ID NO: 944758 - DNA, 22 bp, Artificial Sequence
  chemically synthesized
atgtgccagcaagactgataac

SEQ ID NO: 944759 - DNA, 22 bp, Artificial Sequence
  chemically synthesized
cgttaaagccagttatcagtct

SEQ ID NO: 944760 - DNA, 22 bp, Artificial Sequence
  chemically synthesized
ttgatgtgccagcaagactgat

SEQ ID NO: 944761 - DNA, 22 bp, Artificial Sequence
  chemically synthesized
gttgatgtgccagcaagactga

SEQ ID NO: 944762 - DNA, 22 bp, Artificial Sequence
  chemically synthesized
tgttgatgtgccagcaagactg

SEQ ID NO: 944763 - DNA, 22 bp, Artificial Sequence
  chemically synthesized
aagccagttatcagtcttgctg

SEQ ID NO: 944764 - DNA, 22 bp, Artificial Sequence
  chemically synthesized
tcagtcttgctggcacatcaac

SEQ ID NO: 944765 - DNA, 22 bp, Artificial Sequence
  chemically synthesized
aaagaaagacaggctttgttga

SEQ ID NO: 944766 - DNA, 22 bp, Artificial Sequence
  chemically synthesized
gctggcacatcaacaaagcctg

SEQ ID NO: 944767 - DNA, 22 bp, Artificial Sequence
  chemically synthesized
ctggcacatcaacaaagcctgt

SEQ ID NO: 944768 - DNA, 22 bp, Artificial Sequence
  chemically synthesized
attgaaagaaagacaggctttg

SEQ ID NO: 944769 - DNA, 22 bp, Artificial Sequence
  chemically synthesized
aattgaaagaaagacaggcttt

SEQ ID NO: 944770 - DNA, 22 bp, Artificial Sequence
  chemically synthesized
taattgaaagaaagacaggctt

SEQ ID NO: 944771 - DNA, 22 bp, Artificial Sequence
  chemically synthesized
gcacatcaacaaagcctgtctt

SEQ ID NO: 944772 - DNA, 22 bp, Artificial Sequence
  chemically synthesized
ttaattgaaagaaagacaggct

SEQ ID NO: 944773 - DNA, 22 bp, Artificial Sequence
  chemically synthesized
caacttttaattgaaagaaaga

SEQ ID NO: 944774 - DNA, 22 bp, Artificial Sequence
  chemically synthesized
taattgcaacttttaattgaaa

SEQ ID NO: 944775 - DNA, 22 bp, Artificial Sequence
  chemically synthesized
tctttctttcaattaaaagttg

SEQ ID NO: 944776 - DNA, 22 bp, Artificial Sequence
  chemically synthesized
tctttcaattaaaagttgcaat

SEQ ID NO: 944777 - DNA, 22 bp, Artificial Sequence
  chemically synthesized
ctttcaattaaaagttgcaatt

SEQ ID NO: 944778 - DNA, 22 bp, Artificial Sequence
  chemically synthesized
tttcaattaaaagttgcaatta

SEQ ID NO: 944779 - DNA, 22 bp, Artificial Sequence
  chemically synthesized
tcaattaaaagttgcaattaca

SEQ ID NO: 944780 - DNA, 22 bp, Artificial Sequence
  chemically synthesized
caattaaaagttgcaattacaa

SEQ ID NO: 944781 - DNA, 22 bp, Artificial Sequence
  chemically synthesized
aaagaaagcaagttgtaattgc

SEQ ID NO: 944782 - DNA, 22 bp, Artificial Sequence
  chemically synthesized
aattaaaagttgcaattacaac

SEQ ID NO: 944783 - DNA, 22 bp, Artificial Sequence
  chemically synthesized
aaaagaaagcaagttgtaattg

SEQ ID NO: 944784 - DNA, 22 bp, Artificial Sequence
  chemically synthesized
aaagttgcaattacaacttgct

SEQ ID NO: 944785 - DNA, 22 bp, Artificial Sequence
  chemically synthesized
cgagaggtttaaaagaaagcaa

SEQ ID NO: 944786 - DNA, 22 bp, Artificial Sequence
  chemically synthesized
caattacaacttgctttctttt

SEQ ID NO: 944787 - DNA, 22 bp, Artificial Sequence
  chemically synthesized
caacttgctttcttttaaacct

SEQ ID NO: 944788 - DNA, 22 bp, Artificial Sequence
  chemically synthesized
aatcactacgagaggtttaaaa

SEQ ID NO: 944789 - DNA, 22 bp, Artificial Sequence
  chemically synthesized
gctttcttttaaacctctcgta

SEQ ID NO: 944790 - DNA, 22 bp, Artificial Sequence
  chemically synthesized
ctttcttttaaacctctcgtag

SEQ ID NO: 944791 - DNA, 22 bp, Artificial Sequence
  chemically synthesized
tcttttaaacctctcgtagtga

SEQ ID NO: 944792 - DNA, 22 bp, Artificial Sequence
  chemically synthesized
cttttaaacctctcgtagtgat

SEQ ID NO: 944793 - DNA, 22 bp, Artificial Sequence
  chemically synthesized
ttttaaacctctcgtagtgatt

SEQ ID NO: 944794 - DNA, 22 bp, Artificial Sequence
  chemically synthesized
ttaaacctctcgtagtgattca

SEQ ID NO: 944795 - DNA, 22 bp, Artificial Sequence
  chemically synthesized
taaacctctcgtagtgattcaa

SEQ ID NO: 944796 - DNA, 22 bp, Artificial Sequence
  chemically synthesized
gggacaagtaggttgaatcact

SEQ ID NO: 944797 - DNA, 22 bp, Artificial Sequence
  chemically synthesized
aaacctctcgtagtgattcaac

SEQ ID NO: 944798 - DNA, 22 bp, Artificial Sequence
  chemically synthesized
ggggacaagtaggttgaatcac

SEQ ID NO: 944799 - DNA, 22 bp, Artificial Sequence
  chemically synthesized
aacctctcgtagtgattcaacc

SEQ ID NO: 944800 - DNA, 22 bp, Artificial Sequence
  chemically synthesized
tggggacaagtaggttgaatca

SEQ ID NO: 944801 - DNA, 22 bp, Artificial Sequence
  chemically synthesized
tcgtagtgattcaacctacttg

SEQ ID NO: 944802 - DNA, 22 bp, Artificial Sequence
  chemically synthesized
gtagtgattcaacctacttgtc

SEQ ID NO: 944803 - DNA, 22 bp, Artificial Sequence
  chemically synthesized
aatcaaatacgctttggggaca

SEQ ID NO: 944804 - DNA, 22 bp, Artificial Sequence
  chemically synthesized
caatcaaatacgctttggggac

SEQ ID NO: 944805 - DNA, 22 bp, Artificial Sequence
  chemically synthesized
tcaatcaaatacgctttgggga

SEQ ID NO: 944806 - DNA, 22 bp, Artificial Sequence
  chemically synthesized
aacctacttgtccccaaagcgt

SEQ ID NO: 944807 - DNA, 22 bp, Artificial Sequence
  chemically synthesized
cttgtccccaaagcgtatttga

SEQ ID NO: 944808 - DNA, 22 bp, Artificial Sequence
  chemically synthesized
gtccccaaagcgtatttgattg

SEQ ID NO: 944809 - DNA, 22 bp, Artificial Sequence
  chemically synthesized
tccccaaagcgtatttgattga

SEQ ID NO: 944810 - DNA, 22 bp, Artificial Sequence
  chemically synthesized
ggccggcccagcatgattttca

SEQ ID NO: 944811 - DNA, 22 bp, Artificial Sequence
  chemically synthesized
ttgggccggcccagcatgattt

SEQ ID NO: 944812 - DNA, 22 bp, Artificial Sequence
  chemically synthesized
gttgggccggcccagcatgatt

SEQ ID NO: 944813 - DNA, 22 bp, Artificial Sequence
  chemically synthesized
gattgaaaatcatgctgggccg

SEQ ID NO: 944814 - DNA, 22 bp, Artificial Sequence
  chemically synthesized
attgaaaatcatgctgggccgg

SEQ ID NO: 944815 - DNA, 22 bp, Artificial Sequence
  chemically synthesized
aaaatcatgctgggccggccca

SEQ ID NO: 944816 - DNA, 22 bp, Artificial Sequence
  chemically synthesized
ataagtgtgaaatttgttgggc

SEQ ID NO: 944817 - DNA, 22 bp, Artificial Sequence
  chemically synthesized
tcataagtgtgaaatttgttgg

SEQ ID NO: 944818 - DNA, 22 bp, Artificial Sequence
  chemically synthesized
ctcataagtgtgaaatttgttg

SEQ ID NO: 944819 - DNA, 22 bp, Artificial Sequence
  chemically synthesized
ggccggcccaacaaatttcaca

SEQ ID NO: 944820 - DNA, 22 bp, Artificial Sequence
  chemically synthesized
gtgaatttctcataagtgtgaa

SEQ ID NO: 944821 - DNA, 22 bp, Artificial Sequence
  chemically synthesized
cacacttatgagaaattcacca

SEQ ID NO: 944822 - DNA, 22 bp, Artificial Sequence
  chemically synthesized
acacttatgagaaattcaccaa

SEQ ID NO: 944823 - DNA, 22 bp, Artificial Sequence
  chemically synthesized
atgatatgagaagggttggtga

SEQ ID NO: 944824 - DNA, 22 bp, Artificial Sequence
  chemically synthesized
atgagaaattcaccaacccttc

SEQ ID NO: 944825 - DNA, 22 bp, Artificial Sequence
  chemically synthesized
tgagaaattcaccaacccttct

SEQ ID NO: 944826 - DNA, 22 bp, Artificial Sequence
  chemically synthesized
accaacccttctcatatcatca

SEQ ID NO: 944827 - DNA, 22 bp, Artificial Sequence
  chemically synthesized
gatgggggaataagctgatgat

SEQ ID NO: 944828 - DNA, 22 bp, Artificial Sequence
  chemically synthesized
ggatgggggaataagctgatga

SEQ ID NO: 944829 - DNA, 22 bp, Artificial Sequence
  chemically synthesized
tggatgggggaataagctgatg

SEQ ID NO: 944830 - DNA, 22 bp, Artificial Sequence
  chemically synthesized
ttggatgggggaataagctgat

SEQ ID NO: 944831 - DNA, 22 bp, Artificial Sequence
  chemically synthesized
ctcatatcatcagcttattccc

SEQ ID NO: 944832 - DNA, 22 bp, Artificial Sequence
  chemically synthesized
tcatatcatcagcttattcccc

SEQ ID NO: 944833 - DNA, 22 bp, Artificial Sequence
  chemically synthesized
atatcatcagcttattccccca

SEQ ID NO: 944834 - DNA, 22 bp, Artificial Sequence
  chemically synthesized
ggaatgtcttttggatggggga

SEQ ID NO: 944835 - DNA, 22 bp, Artificial Sequence
  chemically synthesized
ctgggaatgtcttttggatggg

SEQ ID NO: 944836 - DNA, 22 bp, Artificial Sequence
  chemically synthesized
actgggaatgtcttttggatgg

SEQ ID NO: 944837 - DNA, 22 bp, Artificial Sequence
  chemically synthesized
tactgggaatgtcttttggatg

SEQ ID NO: 944838 - DNA, 22 bp, Artificial Sequence
  chemically synthesized
ctttactgggaatgtcttttgg

SEQ ID NO: 944839 - DNA, 22 bp, Artificial Sequence
  chemically synthesized
attcccccatccaaaagacatt

SEQ ID NO: 944840 - DNA, 22 bp, Artificial Sequence
  chemically synthesized
ttcccccatccaaaagacattc

SEQ ID NO: 944841 - DNA, 22 bp, Artificial Sequence
  chemically synthesized
ccccatccaaaagacattccca

SEQ ID NO: 944842 - DNA, 22 bp, Artificial Sequence
  chemically synthesized
atgttactttactgggaatgtc

SEQ ID NO: 944843 - DNA, 22 bp, Artificial Sequence
  chemically synthesized
aacagttaatgttactttactg

SEQ ID NO: 944844 - DNA, 22 bp, Artificial Sequence
  chemically synthesized
actaaacagttaatgttacttt

SEQ ID NO: 944845 - DNA, 22 bp, Artificial Sequence
  chemically synthesized
attaactaaacagttaatgtta

SEQ ID NO: 944846 - DNA, 22 bp, Artificial Sequence
  chemically synthesized
aattaactaaacagttaatgtt

SEQ ID NO: 944847 - DNA, 22 bp, Artificial Sequence
  chemically synthesized
taattaactaaacagttaatgt

SEQ ID NO: 944848 - DNA, 22 bp, Artificial Sequence
  chemically synthesized
ccagtaaagtaacattaactgt

SEQ ID NO: 944849 - DNA, 22 bp, Artificial Sequence
  chemically synthesized
aagatggtctttaattaactaa

SEQ ID NO: 944850 - DNA, 22 bp, Artificial Sequence
  chemically synthesized
tgaagatggtctttaattaact

SEQ ID NO: 944851 - DNA, 22 bp, Artificial Sequence
  chemically synthesized
actgtttagttaattaaagacc

SEQ ID NO: 944852 - DNA, 22 bp, Artificial Sequence
  chemically synthesized
tattctgaagatggtctttaat

SEQ ID NO: 944853 - DNA, 22 bp, Artificial Sequence
  chemically synthesized
tatattctgaagatggtcttta

SEQ ID NO: 944854 - DNA, 22 bp, Artificial Sequence
  chemically synthesized
ctatattctgaagatggtcttt

SEQ ID NO: 944855 - DNA, 22 bp, Artificial Sequence
  chemically synthesized
tttagttaattaaagaccatct

SEQ ID NO: 944856 - DNA, 22 bp, Artificial Sequence
  chemically synthesized
agttaattaaagaccatcttca

SEQ ID NO: 944857 - DNA, 22 bp, Artificial Sequence
  chemically synthesized
gttaattaaagaccatcttcag

SEQ ID NO: 944858 - DNA, 22 bp, Artificial Sequence
  chemically synthesized
attaaagaccatcttcagaata

SEQ ID NO: 944859 - DNA, 22 bp, Artificial Sequence
  chemically synthesized
aagaccatcttcagaatataga

SEQ ID NO: 944860 - DNA, 22 bp, Artificial Sequence
  chemically synthesized
agtccataacagtttctatatt

SEQ ID NO: 944861 - DNA, 22 bp, Artificial Sequence
  chemically synthesized
cagtccataacagtttctatat

SEQ ID NO: 944862 - DNA, 22 bp, Artificial Sequence
  chemically synthesized
cttcagtccataacagtttcta

SEQ ID NO: 944863 - DNA, 22 bp, Artificial Sequence
  chemically synthesized
cagaatatagaaactgttatgg

SEQ ID NO: 944864 - DNA, 22 bp, Artificial Sequence
  chemically synthesized
agaatatagaaactgttatgga

SEQ ID NO: 944865 - DNA, 22 bp, Artificial Sequence
  chemically synthesized
aggagacctacttcagtccata

SEQ ID NO: 944866 - DNA, 22 bp, Artificial Sequence
  chemically synthesized
ttatggactgaagtaggtctcc

SEQ ID NO: 944867 - DNA, 22 bp, Artificial Sequence
  chemically synthesized
tggactgaagtaggtctcctca

SEQ ID NO: 944868 - DNA, 22 bp, Artificial Sequence
  chemically synthesized
aacatatgaatggggttgagga

SEQ ID NO: 944869 - DNA, 22 bp, Artificial Sequence
  chemically synthesized
caacatatgaatggggttgagg

SEQ ID NO: 944870 - DNA, 22 bp, Artificial Sequence
  chemically synthesized
aagtaggtctcctcaaccccat

SEQ ID NO: 944871 - DNA, 22 bp, Artificial Sequence
  chemically synthesized
aaacttcaacatatgaatgggg

SEQ ID NO: 944872 - DNA, 22 bp, Artificial Sequence
  chemically synthesized
ctcaaccccattcatatgttga

SEQ ID NO: 944873 - DNA, 22 bp, Artificial Sequence
  chemically synthesized
caggggttaaaacttcaacata

SEQ ID NO: 944874 - DNA, 22 bp, Artificial Sequence
  chemically synthesized
aaccccattcatatgttgaagt

SEQ ID NO: 944875 - DNA, 22 bp, Artificial Sequence
  chemically synthesized
gcaggggttaaaacttcaacat

SEQ ID NO: 944876 - DNA, 22 bp, Artificial Sequence
  chemically synthesized
cacttgcaggggttaaaacttc

SEQ ID NO: 944877 - DNA, 22 bp, Artificial Sequence
  chemically synthesized
cctccacttgcaggggttaaaa

SEQ ID NO: 944878 - DNA, 22 bp, Artificial Sequence
  chemically synthesized
atatgttgaagttttaacccct

SEQ ID NO: 944879 - DNA, 22 bp, Artificial Sequence
  chemically synthesized
aagttttaacccctgcaagtgg

SEQ ID NO: 944880 - DNA, 22 bp, Artificial Sequence
  chemically synthesized
aaggccctacctccacttgcag

SEQ ID NO: 944881 - DNA, 22 bp, Artificial Sequence
  chemically synthesized
aaaggccctacctccacttgca

SEQ ID NO: 944882 - DNA, 22 bp, Artificial Sequence
  chemically synthesized
taaaggccctacctccacttgc

SEQ ID NO: 944883 - DNA, 22 bp, Artificial Sequence
  chemically synthesized
taacccctgcaagtggaggtag

SEQ ID NO: 944884 - DNA, 22 bp, Artificial Sequence
  chemically synthesized
aacccctgcaagtggaggtagg

SEQ ID NO: 944885 - DNA, 22 bp, Artificial Sequence
  chemically synthesized
acccctgcaagtggaggtaggg

SEQ ID NO: 944886 - DNA, 22 bp, Artificial Sequence
  chemically synthesized
cccctttaaaggccctacctcc

SEQ ID NO: 944887 - DNA, 22 bp, Artificial Sequence
  chemically synthesized
attacccctttaaaggccctac

SEQ ID NO: 944888 - DNA, 22 bp, Artificial Sequence
  chemically synthesized
aattacccctttaaaggcccta

SEQ ID NO: 944889 - DNA, 22 bp, Artificial Sequence
  chemically synthesized
caagtggaggtagggcctttaa

SEQ ID NO: 944890 - DNA, 22 bp, Artificial Sequence
  chemically synthesized
accttaattacccctttaaagg

SEQ ID NO: 944891 - DNA, 22 bp, Artificial Sequence
  chemically synthesized
aaccttaattacccctttaaag

SEQ ID NO: 944892 - DNA, 22 bp, Artificial Sequence
  chemically synthesized
atttaaccttaattaccccttt

SEQ ID NO: 944893 - DNA, 22 bp, Artificial Sequence
  chemically synthesized
taaaggggtaattaaggttaaa

SEQ ID NO: 944894 - DNA, 22 bp, Artificial Sequence
  chemically synthesized
aaaggggtaattaaggttaaat

SEQ ID NO: 944895 - DNA, 22 bp, Artificial Sequence
  chemically synthesized
aaggggtaattaaggttaaatg

SEQ ID NO: 944896 - DNA, 22 bp, Artificial Sequence
  chemically synthesized
cccatatgaactcatttaacct

SEQ ID NO: 944897 - DNA, 22 bp, Artificial Sequence
  chemically synthesized
aggtcctacccatatgaactca

SEQ ID NO: 944898 - DNA, 22 bp, Artificial Sequence
  chemically synthesized
aggttaaatgagttcatatggg

SEQ ID NO: 944899 - DNA, 22 bp, Artificial Sequence
  chemically synthesized
gattaaggtcctacccatatga

SEQ ID NO: 944900 - DNA, 22 bp, Artificial Sequence
  chemically synthesized
ttggattaaggtcctacccata

SEQ ID NO: 944901 - DNA, 22 bp, Artificial Sequence
  chemically synthesized
attggattaaggtcctacccat

SEQ ID NO: 944902 - DNA, 22 bp, Artificial Sequence
  chemically synthesized
aatgagttcatatgggtaggac

SEQ ID NO: 944903 - DNA, 22 bp, Artificial Sequence
  chemically synthesized
gacttattggattaaggtccta

SEQ ID NO: 944904 - DNA, 22 bp, Artificial Sequence
  chemically synthesized
atatgggtaggaccttaatcca

SEQ ID NO: 944905 - DNA, 22 bp, Artificial Sequence
  chemically synthesized
tgaggacattagacttattgga

SEQ ID NO: 944906 - DNA, 22 bp, Artificial Sequence
  chemically synthesized
atgaggacattagacttattgg

SEQ ID NO: 944907 - DNA, 22 bp, Artificial Sequence
  chemically synthesized
tatgaggacattagacttattg

SEQ ID NO: 944908 - DNA, 22 bp, Artificial Sequence
  chemically synthesized
ttatgaggacattagacttatt

SEQ ID NO: 944909 - DNA, 22 bp, Artificial Sequence
  chemically synthesized
cttttatgaggacattagactt

SEQ ID NO: 944910 - DNA, 22 bp, Artificial Sequence
  chemically synthesized
ccttttatgaggacattagact

SEQ ID NO: 944911 - DNA, 22 bp, Artificial Sequence
  chemically synthesized
ttccttttatgaggacattaga

SEQ ID NO: 944912 - DNA, 22 bp, Artificial Sequence
  chemically synthesized
aatccaataagtctaatgtcct

SEQ ID NO: 944913 - DNA, 22 bp, Artificial Sequence
  chemically synthesized
atccaataagtctaatgtcctc

SEQ ID NO: 944914 - DNA, 22 bp, Artificial Sequence
  chemically synthesized
ttcttccttttatgaggacatt

SEQ ID NO: 944915 - DNA, 22 bp, Artificial Sequence
  chemically synthesized
tagctgttcttccttttatgag

SEQ ID NO: 944916 - DNA, 22 bp, Artificial Sequence
  chemically synthesized
gtagctgttcttccttttatga

SEQ ID NO: 944917 - DNA, 22 bp, Artificial Sequence
  chemically synthesized
atgtcctcataaaaggaagaac

SEQ ID NO: 944918 - DNA, 22 bp, Artificial Sequence
  chemically synthesized
ataaaaggaagaacagctacaa

SEQ ID NO: 944919 - DNA, 22 bp, Artificial Sequence
  chemically synthesized
tgtatgtgcatcccttgtagct

SEQ ID NO: 944920 - DNA, 22 bp, Artificial Sequence
  chemically synthesized
tgtgtatgtgcatcccttgtag

SEQ ID NO: 944921 - DNA, 22 bp, Artificial Sequence
  chemically synthesized
ctctgtgtatgtgcatcccttg

SEQ ID NO: 944922 - DNA, 22 bp, Artificial Sequence
  chemically synthesized
cctctgtgtatgtgcatccctt

SEQ ID NO: 944923 - DNA, 22 bp, Artificial Sequence
  chemically synthesized
tcctctgtgtatgtgcatccct

SEQ ID NO: 944924 - DNA, 22 bp, Artificial Sequence
  chemically synthesized
atgacctttcctctgtgtatgt

SEQ ID NO: 944925 - DNA, 22 bp, Artificial Sequence
  chemically synthesized
catgacctttcctctgtgtatg

SEQ ID NO: 944926 - DNA, 22 bp, Artificial Sequence
  chemically synthesized
caagggatgcacatacacagag

SEQ ID NO: 944927 - DNA, 22 bp, Artificial Sequence
  chemically synthesized
cttcatgacctttcctctgtgt

SEQ ID NO: 944928 - DNA, 22 bp, Artificial Sequence
  chemically synthesized
tccttcatgacctttcctctgt

SEQ ID NO: 944929 - DNA, 22 bp, Artificial Sequence
  chemically synthesized
ctccttcatgacctttcctctg

SEQ ID NO: 944930 - DNA, 22 bp, Artificial Sequence
  chemically synthesized
cagatagccgccttctccttca

SEQ ID NO: 944931 - DNA, 22 bp, Artificial Sequence
  chemically synthesized
gcagatagccgccttctccttc

SEQ ID NO: 944932 - DNA, 22 bp, Artificial Sequence
  chemically synthesized
gcttgcagatagccgccttctc

SEQ ID NO: 944933 - DNA, 22 bp, Artificial Sequence
  chemically synthesized
ccccattggcttgcagatagcc

SEQ ID NO: 944934 - DNA, 22 bp, Artificial Sequence
  chemically synthesized
gtgagtcctcccccattggctt

SEQ ID NO: 944935 - DNA, 22 bp, Artificial Sequence
  chemically synthesized
tggtgagtcctcccccattggc

SEQ ID NO: 944936 - DNA, 22 bp, Artificial Sequence
  chemically synthesized
ctggtgagtcctcccccattgg

SEQ ID NO: 944937 - DNA, 22 bp, Artificial Sequence
  chemically synthesized
tctgcaagccaatgggggagga

SEQ ID NO: 944938 - DNA, 22 bp, Artificial Sequence
  chemically synthesized
gtttctggtgagtcctccccca

SEQ ID NO: 944939 - DNA, 22 bp, Artificial Sequence
  chemically synthesized
caagccaatgggggaggactca

SEQ ID NO: 944940 - DNA, 22 bp, Artificial Sequence
  chemically synthesized
aggtgatgacagggttggtttc

SEQ ID NO: 944941 - DNA, 22 bp, Artificial Sequence
  chemically synthesized
agattaaggtgatgacagggtt

SEQ ID NO: 944942 - DNA, 22 bp, Artificial Sequence
  chemically synthesized
accagaaaccaaccctgtcatc

SEQ ID NO: 944943 - DNA, 22 bp, Artificial Sequence
  chemically synthesized
aacgtctaagattaaggtgatg

SEQ ID NO: 944944 - DNA, 22 bp, Artificial Sequence
  chemically synthesized
cggaagttgaacgtctaagatt

SEQ ID NO: 944945 - DNA, 22 bp, Artificial Sequence
  chemically synthesized
tcatcaccttaatcttagacgt

SEQ ID NO: 944946 - DNA, 22 bp, Artificial Sequence
  chemically synthesized
cagttccggaagttgaacgtct

SEQ ID NO: 944947 - DNA, 22 bp, Artificial Sequence
  chemically synthesized
gcagttccggaagttgaacgtc

SEQ ID NO: 944948 - DNA, 22 bp, Artificial Sequence
  chemically synthesized
ttgcagttccggaagttgaacg

SEQ ID NO: 944949 - DNA, 22 bp, Artificial Sequence
  chemically synthesized
cttgcagttccggaagttgaac

SEQ ID NO: 944950 - DNA, 22 bp, Artificial Sequence
  chemically synthesized
aatcttagacgttcaacttccg

SEQ ID NO: 944951 - DNA, 22 bp, Artificial Sequence
  chemically synthesized
atcttagacgttcaacttccgg

SEQ ID NO: 944952 - DNA, 22 bp, Artificial Sequence
  chemically synthesized
agacgttcaacttccggaactg

SEQ ID NO: 944953 - DNA, 22 bp, Artificial Sequence
  chemically synthesized
gacgttcaacttccggaactgc

SEQ ID NO: 944954 - DNA, 22 bp, Artificial Sequence
  chemically synthesized
aacttccggaactgcaagaaat

SEQ ID NO: 944955 - DNA, 22 bp, Artificial Sequence
  chemically synthesized
agcaacagaaatgtatttcttg

SEQ ID NO: 944956 - DNA, 22 bp, Artificial Sequence
  chemically synthesized
aagcaacagaaatgtatttctt

SEQ ID NO: 944957 - DNA, 22 bp, Artificial Sequence
  chemically synthesized
ccggaactgcaagaaatacatt

SEQ ID NO: 944958 - DNA, 22 bp, Artificial Sequence
  chemically synthesized
cggaactgcaagaaatacattt

SEQ ID NO: 944959 - DNA, 22 bp, Artificial Sequence
  chemically synthesized
ggtggcttaagcaacagaaatg

SEQ ID NO: 944960 - DNA, 22 bp, Artificial Sequence
  chemically synthesized
caagaaatacatttctgttgct

SEQ ID NO: 944961 - DNA, 22 bp, Artificial Sequence
  chemically synthesized
ctgttgcttaagccacccagtg

SEQ ID NO: 944962 - DNA, 22 bp, Artificial Sequence
  chemically synthesized
tgttgcttaagccacccagtgg

SEQ ID NO: 944963 - DNA, 22 bp, Artificial Sequence
  chemically synthesized
ttgcttaagccacccagtgggt

SEQ ID NO: 944964 - DNA, 22 bp, Artificial Sequence
  chemically synthesized
agcaaggtaaacacccactggg

SEQ ID NO: 944965 - DNA, 22 bp, Artificial Sequence
  chemically synthesized
aagcaaggtaaacacccactgg

SEQ ID NO: 944966 - DNA, 22 bp, Artificial Sequence
  chemically synthesized
cttaagccacccagtgggtgtt

SEQ ID NO: 944967 - DNA, 22 bp, Artificial Sequence
  chemically synthesized
aagccacccagtgggtgtttac

SEQ ID NO: 944968 - DNA, 22 bp, Artificial Sequence
  chemically synthesized
agccacccagtgggtgtttacc

SEQ ID NO: 944969 - DNA, 22 bp, Artificial Sequence
  chemically synthesized
aaaatatccatgacttaagcaa

SEQ ID NO: 944970 - DNA, 22 bp, Artificial Sequence
  chemically synthesized
caaaatatccatgacttaagca

SEQ ID NO: 944971 - DNA, 22 bp, Artificial Sequence
  chemically synthesized
accttgcttaagtcatggatat

SEQ ID NO: 944972 - DNA, 22 bp, Artificial Sequence
  chemically synthesized
ccttgcttaagtcatggatatt

SEQ ID NO: 944973 - DNA, 22 bp, Artificial Sequence
  chemically synthesized
gcttaagtcatggatattttga

SEQ ID NO: 944974 - DNA, 22 bp, Artificial Sequence
  chemically synthesized
tatataaaaatttcaaaatatc

SEQ ID NO: 944975 - DNA, 22 bp, Artificial Sequence
  chemically synthesized
cttaagtcatggatattttgaa

SEQ ID NO: 944976 - DNA, 22 bp, Artificial Sequence
  chemically synthesized
gtatataaaaatttcaaaatat

SEQ ID NO: 944977 - DNA, 22 bp, Artificial Sequence
  chemically synthesized
aagtcatggatattttgaaatt

SEQ ID NO: 944978 - DNA, 22 bp, Artificial Sequence
  chemically synthesized
tttgtatataaaaatttcaaaa

SEQ ID NO: 944979 - DNA, 22 bp, Artificial Sequence
  chemically synthesized
agtcatggatattttgaaattt

SEQ ID NO: 944980 - DNA, 22 bp, Artificial Sequence
  chemically synthesized
gtttgtatataaaaatttcaaa

SEQ ID NO: 944981 - DNA, 22 bp, Artificial Sequence
  chemically synthesized
tgtttgtatataaaaatttcaa

SEQ ID NO: 944982 - DNA, 22 bp, Artificial Sequence
  chemically synthesized
ttgtttgtatataaaaatttca

SEQ ID NO: 944983 - DNA, 22 bp, Artificial Sequence
  chemically synthesized
cttttgtttgtatataaaaatt

SEQ ID NO: 944984 - DNA, 22 bp, Artificial Sequence
  chemically synthesized
gcattacttttgtttgtatata

SEQ ID NO: 944985 - DNA, 22 bp, Artificial Sequence
  chemically synthesized
tgaaatttttatatacaaacaa

SEQ ID NO: 944986 - DNA, 22 bp, Artificial Sequence
  chemically synthesized
gaaatttttatatacaaacaaa

SEQ ID NO: 944987 - DNA, 22 bp, Artificial Sequence
  chemically synthesized
attggcattacttttgtttgta

SEQ ID NO: 944988 - DNA, 22 bp, Artificial Sequence
  chemically synthesized
aaatttttatatacaaacaaaa

SEQ ID NO: 944989 - DNA, 22 bp, Artificial Sequence
  chemically synthesized
ttaattggcattacttttgttt

SEQ ID NO: 944990 - DNA, 22 bp, Artificial Sequence
  chemically synthesized
ttatatacaaacaaaagtaatg

SEQ ID NO: 944991 - DNA, 22 bp, Artificial Sequence
  chemically synthesized
tatatacaaacaaaagtaatgc

SEQ ID NO: 944992 - DNA, 22 bp, Artificial Sequence
  chemically synthesized
atatacaaacaaaagtaatgcc

SEQ ID NO: 944993 - DNA, 22 bp, Artificial Sequence
  chemically synthesized
tatacaaacaaaagtaatgcca

SEQ ID NO: 944994 - DNA, 22 bp, Artificial Sequence
  chemically synthesized
aatagatataattattaattgg

SEQ ID NO: 944995 - DNA, 22 bp, Artificial Sequence
  chemically synthesized
ttaaatagatataattattaat

SEQ ID NO: 944996 - DNA, 22 bp, Artificial Sequence
  chemically synthesized
gttgttaaatagatataattat

SEQ ID NO: 944997 - DNA, 22 bp, Artificial Sequence
  chemically synthesized
ataattatatctatttaacaac

SEQ ID NO: 944998 - DNA, 22 bp, Artificial Sequence
  chemically synthesized
tatctatttaacaactagctat

SEQ ID NO: 944999 - DNA, 22 bp, Artificial Sequence
  chemically synthesized
gatatataaaatatatagctag

SEQ ID NO: 945000 - DNA, 22 bp, Artificial Sequence
  chemically synthesized
ggatatataaaatatatagcta

SEQ ID NO: 945001 - DNA, 22 bp, Artificial Sequence
  chemically synthesized
tggatatataaaatatatagct

SEQ ID NO: 945002 - DNA, 22 bp, Artificial Sequence
  chemically synthesized
tttaacaactagctatatattt

SEQ ID NO: 945003 - DNA, 22 bp, Artificial Sequence
  chemically synthesized
actttggatatataaaatatat

SEQ ID NO: 945004 - DNA, 22 bp, Artificial Sequence
  chemically synthesized
aacaactagctatatattttat

SEQ ID NO: 945005 - DNA, 22 bp, Artificial Sequence
  chemically synthesized
acaactagctatatattttata

SEQ ID NO: 945006 - DNA, 22 bp, Artificial Sequence
  chemically synthesized
attaactttggatatataaaat

SEQ ID NO: 945007 - DNA, 22 bp, Artificial Sequence
  chemically synthesized
gctatatattttatatatccaa

SEQ ID NO: 945008 - DNA, 22 bp, Artificial Sequence
  chemically synthesized
ggttgattaactttggatatat

SEQ ID NO: 945009 - DNA, 22 bp, Artificial Sequence
  chemically synthesized
tatattttatatatccaaagtt

SEQ ID NO: 945010 - DNA, 22 bp, Artificial Sequence
  chemically synthesized
ggtcaattcggttgattaactt

SEQ ID NO: 945011 - DNA, 22 bp, Artificial Sequence
  chemically synthesized
tatatatccaaagttaatcaac

SEQ ID NO: 945012 - DNA, 22 bp, Artificial Sequence
  chemically synthesized
atatatccaaagttaatcaacc

SEQ ID NO: 945013 - DNA, 22 bp, Artificial Sequence
  chemically synthesized
ctgggtcaattcggttgattaa

SEQ ID NO: 945014 - DNA, 22 bp, Artificial Sequence
  chemically synthesized
tatatccaaagttaatcaaccg

SEQ ID NO: 945015 - DNA, 22 bp, Artificial Sequence
  chemically synthesized
actgggtcaattcggttgatta

SEQ ID NO: 945016 - DNA, 22 bp, Artificial Sequence
  chemically synthesized
cacttactgggtcaattcggtt

SEQ ID NO: 945017 - DNA, 22 bp, Artificial Sequence
  chemically synthesized
atcaaccgaattgacccagtaa

SEQ ID NO: 945018 - DNA, 22 bp, Artificial Sequence
  chemically synthesized
cataagcaaagattacacttac

SEQ ID NO: 945019 - DNA, 22 bp, Artificial Sequence
  chemically synthesized
acataagcaaagattacactta

SEQ ID NO: 945020 - DNA, 22 bp, Artificial Sequence
  chemically synthesized
tttacataagcaaagattacac

SEQ ID NO: 945021 - DNA, 22 bp, Artificial Sequence
  chemically synthesized
acccagtaagtgtaatctttgc

SEQ ID NO: 945022 - DNA, 22 bp, Artificial Sequence
  chemically synthesized
tattgtttacataagcaaagat

SEQ ID NO: 945023 - DNA, 22 bp, Artificial Sequence
  chemically synthesized
gtattgtttacataagcaaaga

SEQ ID NO: 945024 - DNA, 22 bp, Artificial Sequence
  chemically synthesized
agggtttgtattgtttacataa

SEQ ID NO: 945025 - DNA, 22 bp, Artificial Sequence
  chemically synthesized
tgcttatgtaaacaatacaaac

SEQ ID NO: 945026 - DNA, 22 bp, Artificial Sequence
  chemically synthesized
aatgagctaagggtttgtattg

SEQ ID NO: 945027 - DNA, 22 bp, Artificial Sequence
  chemically synthesized
gcttatgtaaacaatacaaacc

SEQ ID NO: 945028 - DNA, 22 bp, Artificial Sequence
  chemically synthesized
cttatgtaaacaatacaaaccc

SEQ ID NO: 945029 - DNA, 22 bp, Artificial Sequence
  chemically synthesized
atgtaaacaatacaaaccctta

SEQ ID NO: 945030 - DNA, 22 bp, Artificial Sequence
  chemically synthesized
tgtaaacaatacaaacccttag

SEQ ID NO: 945031 - DNA, 22 bp, Artificial Sequence
  chemically synthesized
gagccaatctaaatgagctaag

SEQ ID NO: 945032 - DNA, 22 bp, Artificial Sequence
  chemically synthesized
ttggagccaatctaaatgagct

SEQ ID NO: 945033 - DNA, 22 bp, Artificial Sequence
  chemically synthesized
attggagccaatctaaatgagc

SEQ ID NO: 945034 - DNA, 22 bp, Artificial Sequence
  chemically synthesized
tattggagccaatctaaatgag

SEQ ID NO: 945035 - DNA, 22 bp, Artificial Sequence
  chemically synthesized
agctcatttagattggctccaa

SEQ ID NO: 945036 - DNA, 22 bp, Artificial Sequence
  chemically synthesized
aaaaatattttattggagccaa

SEQ ID NO: 945037 - DNA, 22 bp, Artificial Sequence
  chemically synthesized
gctcatttagattggctccaat

SEQ ID NO: 945038 - DNA, 22 bp, Artificial Sequence
  chemically synthesized
aaaaaatattttattggagcca

SEQ ID NO: 945039 - DNA, 22 bp, Artificial Sequence
  chemically synthesized
atttagattggctccaataaaa

SEQ ID NO: 945040 - DNA, 22 bp, Artificial Sequence
  chemically synthesized
aatttaaaaaatattttattgg

SEQ ID NO: 945041 - DNA, 22 bp, Artificial Sequence
  chemically synthesized
agattggctccaataaaatatt

SEQ ID NO: 945042 - DNA, 22 bp, Artificial Sequence
  chemically synthesized
gattggctccaataaaatattt

SEQ ID NO: 945043 - DNA, 22 bp, Artificial Sequence
  chemically synthesized
actgaatttaaaaaatatttta

SEQ ID NO: 945044 - DNA, 22 bp, Artificial Sequence
  chemically synthesized
aactgaatttaaaaaatatttt

SEQ ID NO: 945045 - DNA, 22 bp, Artificial Sequence
  chemically synthesized
taactgaatttaaaaaatattt

SEQ ID NO: 945046 - DNA, 22 bp, Artificial Sequence
  chemically synthesized
gctccaataaaatattttttaa

SEQ ID NO: 945047 - DNA, 22 bp, Artificial Sequence
  chemically synthesized
agactttaactgaatttaaaaa

SEQ ID NO: 945048 - DNA, 22 bp, Artificial Sequence
  chemically synthesized
caataaaatattttttaaattc

SEQ ID NO: 945049 - DNA, 22 bp, Artificial Sequence
  chemically synthesized
aagactttaactgaatttaaaa

SEQ ID NO: 945050 - DNA, 22 bp, Artificial Sequence
  chemically synthesized
tttaaattcagttaaagtctta

SEQ ID NO: 945051 - DNA, 22 bp, Artificial Sequence
  chemically synthesized
ttaaattcagttaaagtcttaa

SEQ ID NO: 945052 - DNA, 22 bp, Artificial Sequence
  chemically synthesized
taaattcagttaaagtcttaaa

SEQ ID NO: 945053 - DNA, 22 bp, Artificial Sequence
  chemically synthesized
aaattcagttaaagtcttaaac

SEQ ID NO: 945054 - DNA, 22 bp, Artificial Sequence
  chemically synthesized
aattcagttaaagtcttaaaca

SEQ ID NO: 945055 - DNA, 22 bp, Artificial Sequence
  chemically synthesized
tgtaagtgatccatgtttaaga

SEQ ID NO: 945056 - DNA, 22 bp, Artificial Sequence
  chemically synthesized
ctatgtaagtgatccatgttta

SEQ ID NO: 945057 - DNA, 22 bp, Artificial Sequence
  chemically synthesized
agttaaagtcttaaacatggat

SEQ ID NO: 945058 - DNA, 22 bp, Artificial Sequence
  chemically synthesized
gctatgtaagtgatccatgttt

SEQ ID NO: 945059 - DNA, 22 bp, Artificial Sequence
  chemically synthesized
aagtcttaaacatggatcactt

SEQ ID NO: 945060 - DNA, 22 bp, Artificial Sequence
  chemically synthesized
aaacatggatcacttacatagc

SEQ ID NO: 945061 - DNA, 22 bp, Artificial Sequence
  chemically synthesized
aacatggatcacttacatagca

SEQ ID NO: 945062 - DNA, 22 bp, Artificial Sequence
  chemically synthesized
tagtgcacacatatttgctatg

SEQ ID NO: 945063 - DNA, 22 bp, Artificial Sequence
  chemically synthesized
gtagtgcacacatatttgctat

SEQ ID NO: 945064 - DNA, 22 bp, Artificial Sequence
  chemically synthesized
caatttgtagtgcacacatatt

SEQ ID NO: 945065 - DNA, 22 bp, Artificial Sequence
  chemically synthesized
acatagcaaatatgtgtgcact

SEQ ID NO: 945066 - DNA, 22 bp, Artificial Sequence
  chemically synthesized
gctgcaatttgtagtgcacaca

SEQ ID NO: 945067 - DNA, 22 bp, Artificial Sequence
  chemically synthesized
catagcaaatatgtgtgcacta

SEQ ID NO: 945068 - DNA, 22 bp, Artificial Sequence
  chemically synthesized
attagctgcaatttgtagtgca

SEQ ID NO: 945069 - DNA, 22 bp, Artificial Sequence
  chemically synthesized
caaattgcagctaatcaatcat

SEQ ID NO: 945070 - DNA, 22 bp, Artificial Sequence
  chemically synthesized
cagctaatcaatcatttctatt

SEQ ID NO: 945071 - DNA, 22 bp, Artificial Sequence
  chemically synthesized
atcaatcatttctatttatgtg

SEQ ID NO: 945072 - DNA, 22 bp, Artificial Sequence
  chemically synthesized
tcaggtcatagggtatgcacac

SEQ ID NO: 945073 - DNA, 22 bp, Artificial Sequence
  chemically synthesized
ctatttatgtgtgcatacccta

SEQ ID NO: 945074 - DNA, 22 bp, Artificial Sequence
  chemically synthesized
tatttatgtgtgcataccctat

SEQ ID NO: 945075 - DNA, 22 bp, Artificial Sequence
  chemically synthesized
tttatgtgtgcataccctatga

SEQ ID NO: 945076 - DNA, 22 bp, Artificial Sequence
  chemically synthesized
gtagtattgtcaggtcataggg

SEQ ID NO: 945077 - DNA, 22 bp, Artificial Sequence
  chemically synthesized
atgtgtgcataccctatgacct

SEQ ID NO: 945078 - DNA, 22 bp, Artificial Sequence
  chemically synthesized
tgtgtgcataccctatgacctg

SEQ ID NO: 945079 - DNA, 22 bp, Artificial Sequence
  chemically synthesized
gctagtagtattgtcaggtcat

SEQ ID NO: 945080 - DNA, 22 bp, Artificial Sequence
  chemically synthesized
aacagtattcgctagtagtatt

SEQ ID NO: 945081 - DNA, 22 bp, Artificial Sequence
  chemically synthesized
tcaacagtattcgctagtagta

SEQ ID NO: 945082 - DNA, 22 bp, Artificial Sequence
  chemically synthesized
tgacctgacaatactactagcg

SEQ ID NO: 945083 - DNA, 22 bp, Artificial Sequence
  chemically synthesized
ctcaacagtattcgctagtagt

SEQ ID NO: 945084 - DNA, 22 bp, Artificial Sequence
  chemically synthesized
acaatactactagcgaatactg

SEQ ID NO: 945085 - DNA, 22 bp, Artificial Sequence
  chemically synthesized
aaaatttctcaacagtattcgc

SEQ ID NO: 945086 - DNA, 22 bp, Artificial Sequence
  chemically synthesized
aaaaatttctcaacagtattcg

SEQ ID NO: 945087 - DNA, 22 bp, Artificial Sequence
  chemically synthesized
ctagcgaatactgttgagaaat

SEQ ID NO: 945088 - DNA, 22 bp, Artificial Sequence
  chemically synthesized
gcgaatactgttgagaaatttt

SEQ ID NO: 945089 - DNA, 22 bp, Artificial Sequence
  chemically synthesized
tagtgcatgtttaaaaatttct

SEQ ID NO: 945090 - DNA, 22 bp, Artificial Sequence
  chemically synthesized
atagtgcatgtttaaaaatttc

SEQ ID NO: 945091 - DNA, 22 bp, Artificial Sequence
  chemically synthesized
tatagtgcatgtttaaaaattt

SEQ ID NO: 945092 - DNA, 22 bp, Artificial Sequence
  chemically synthesized
ttgagaaatttttaaacatgca

SEQ ID NO: 945093 - DNA, 22 bp, Artificial Sequence
  chemically synthesized
tatatgttttatagtgcatgtt

SEQ ID NO: 945094 - DNA, 22 bp, Artificial Sequence
  chemically synthesized
agaaatttttaaacatgcacta

SEQ ID NO: 945095 - DNA, 22 bp, Artificial Sequence
  chemically synthesized
gtatatgttttatagtgcatgt

SEQ ID NO: 945096 - DNA, 22 bp, Artificial Sequence
  chemically synthesized
ttgtatatgttttatagtgcat

SEQ ID NO: 945097 - DNA, 22 bp, Artificial Sequence
  chemically synthesized
ttaaacatgcactataaaacat

SEQ ID NO: 945098 - DNA, 22 bp, Artificial Sequence
  chemically synthesized
taaacatgcactataaaacata

SEQ ID NO: 945099 - DNA, 22 bp, Artificial Sequence
  chemically synthesized
aaacatgcactataaaacatat

SEQ ID NO: 945100 - DNA, 22 bp, Artificial Sequence
  chemically synthesized
aacatgcactataaaacatata

SEQ ID NO: 945101 - DNA, 22 bp, Artificial Sequence
  chemically synthesized
taaaacatatacaagaacacat

SEQ ID NO: 945102 - DNA, 22 bp, Artificial Sequence
  chemically synthesized
atcacaaaccacaacacacatg

SEQ ID NO: 945103 - DNA, 22 bp, Artificial Sequence
  chemically synthesized
ttcatcacaaaccacaacacac

SEQ ID NO: 945104 - DNA, 22 bp, Artificial Sequence
  chemically synthesized
gttcatcacaaaccacaacaca

SEQ ID NO: 945105 - DNA, 22 bp, Artificial Sequence
  chemically synthesized
tgttcatcacaaaccacaacac

SEQ ID NO: 945106 - DNA, 22 bp, Artificial Sequence
  chemically synthesized
ttgttcatcacaaaccacaaca

SEQ ID NO: 945107 - DNA, 22 bp, Artificial Sequence
  chemically synthesized
tgtttttgttcatcacaaacca

SEQ ID NO: 945108 - DNA, 22 bp, Artificial Sequence
  chemically synthesized
atgtttttgttcatcacaaacc

SEQ ID NO: 945109 - DNA, 22 bp, Artificial Sequence
  chemically synthesized
tatgtttttgttcatcacaaac

SEQ ID NO: 945110 - DNA, 22 bp, Artificial Sequence
  chemically synthesized
ttatgtttttgttcatcacaaa

SEQ ID NO: 945111 - DNA, 22 bp, Artificial Sequence
  chemically synthesized
tttttatgtttttgttcatcac

SEQ ID NO: 945112 - DNA, 22 bp, Artificial Sequence
  chemically synthesized
ggttgtttttatgtttttgttc

SEQ ID NO: 945113 - DNA, 22 bp, Artificial Sequence
  chemically synthesized
tggtttgtgatgaacaaaaaca

SEQ ID NO: 945114 - DNA, 22 bp, Artificial Sequence
  chemically synthesized
gggttgtttttatgtttttgtt

SEQ ID NO: 945115 - DNA, 22 bp, Artificial Sequence
  chemically synthesized
gtgatgaacaaaaacataaaaa

SEQ ID NO: 945116 - DNA, 22 bp, Artificial Sequence
  chemically synthesized
tgatgaacaaaaacataaaaac

SEQ ID NO: 945117 - DNA, 22 bp, Artificial Sequence
  chemically synthesized
catgcgtatggacatttgggtt

SEQ ID NO: 945118 - DNA, 22 bp, Artificial Sequence
  chemically synthesized
acatgcgtatggacatttgggt

SEQ ID NO: 945119 - DNA, 22 bp, Artificial Sequence
  chemically synthesized
tacatgcgtatggacatttggg

SEQ ID NO: 945120 - DNA, 22 bp, Artificial Sequence
  chemically synthesized
tatgtatataacacaatgtata

SEQ ID NO: 945121 - DNA, 22 bp, Artificial Sequence
  chemically synthesized
attgtatgtatataacacaatg

SEQ ID NO: 945122 - DNA, 22 bp, Artificial Sequence
  chemically synthesized
atcaatgtgcaactcattgtat

SEQ ID NO: 945123 - DNA, 22 bp, Artificial Sequence
  chemically synthesized
tgttatatacatacaatgagtt

SEQ ID NO: 945124 - DNA, 22 bp, Artificial Sequence
  chemically synthesized
cgttcatcaatgtgcaactcat

SEQ ID NO: 945125 - DNA, 22 bp, Artificial Sequence
  chemically synthesized
acgttcatcaatgtgcaactca

SEQ ID NO: 945126 - DNA, 22 bp, Artificial Sequence
  chemically synthesized
tatacatacaatgagttgcaca

SEQ ID NO: 945127 - DNA, 22 bp, Artificial Sequence
  chemically synthesized
catatttacgttcatcaatgtg

SEQ ID NO: 945128 - DNA, 22 bp, Artificial Sequence
  chemically synthesized
acatatttacgttcatcaatgt

SEQ ID NO: 945129 - DNA, 22 bp, Artificial Sequence
  chemically synthesized
tacatatttacgttcatcaatg

SEQ ID NO: 945130 - DNA, 22 bp, Artificial Sequence
  chemically synthesized
tgttttacatatttacgttcat

SEQ ID NO: 945131 - DNA, 22 bp, Artificial Sequence
  chemically synthesized
cacattgatgaacgtaaatatg

SEQ ID NO: 945132 - DNA, 22 bp, Artificial Sequence
  chemically synthesized
aatactatgttttacatattta

SEQ ID NO: 945133 - DNA, 22 bp, Artificial Sequence
  chemically synthesized
tcaatactatgttttacatatt

SEQ ID NO: 945134 - DNA, 22 bp, Artificial Sequence
  chemically synthesized
tctcaatactatgttttacata

SEQ ID NO: 945135 - DNA, 22 bp, Artificial Sequence
  chemically synthesized
atgaacgtaaatatgtaaaaca

SEQ ID NO: 945136 - DNA, 22 bp, Artificial Sequence
  chemically synthesized
ctctcaatactatgttttacat

SEQ ID NO: 945137 - DNA, 22 bp, Artificial Sequence
  chemically synthesized
tctctcaatactatgttttaca

SEQ ID NO: 945138 - DNA, 22 bp, Artificial Sequence
  chemically synthesized
ttctctcaatactatgttttac

SEQ ID NO: 945139 - DNA, 22 bp, Artificial Sequence
  chemically synthesized
ttttctctcaatactatgtttt

SEQ ID NO: 945140 - DNA, 22 bp, Artificial Sequence
  chemically synthesized
tgaattcttttctctcaatact

SEQ ID NO: 945141 - DNA, 22 bp, Artificial Sequence
  chemically synthesized
tgtgaattcttttctctcaata

SEQ ID NO: 945142 - DNA, 22 bp, Artificial Sequence
  chemically synthesized
tctgtgaattcttttctctcaa

SEQ ID NO: 945143 - DNA, 22 bp, Artificial Sequence
  chemically synthesized
ctctgtgaattcttttctctca

SEQ ID NO: 945144 - DNA, 22 bp, Artificial Sequence
  chemically synthesized
atcttctctgtgaattcttttc

SEQ ID NO: 945145 - DNA, 22 bp, Artificial Sequence
  chemically synthesized
taatcttctctgtgaattcttt

SEQ ID NO: 945146 - DNA, 22 bp, Artificial Sequence
  chemically synthesized
agagaaaagaattcacagagaa

SEQ ID NO: 945147 - DNA, 22 bp, Artificial Sequence
  chemically synthesized
agggaaccaccccatctctaat

SEQ ID NO: 945148 - DNA, 22 bp, Artificial Sequence
  chemically synthesized
acagagaagattagagatgggg

SEQ ID NO: 945149 - DNA, 22 bp, Artificial Sequence
  chemically synthesized
tattaagggaaccaccccatct

SEQ ID NO: 945150 - DNA, 22 bp, Artificial Sequence
  chemically synthesized
atattaagggaaccaccccatc

SEQ ID NO: 945151 - DNA, 22 bp, Artificial Sequence
  chemically synthesized
tatattaagggaaccaccccat

SEQ ID NO: 945152 - DNA, 22 bp, Artificial Sequence
  chemically synthesized
aactttatattaagggaaccac

SEQ ID NO: 945153 - DNA, 22 bp, Artificial Sequence
  chemically synthesized
gaactttatattaagggaacca

SEQ ID NO: 945154 - DNA, 22 bp, Artificial Sequence
  chemically synthesized
gagatggggtggttcccttaat

SEQ ID NO: 945155 - DNA, 22 bp, Artificial Sequence
  chemically synthesized
gatttgaactttatattaaggg

SEQ ID NO: 945156 - DNA, 22 bp, Artificial Sequence
  chemically synthesized
cctggatttgaactttatatta

SEQ ID NO: 945157 - DNA, 22 bp, Artificial Sequence
  chemically synthesized
gcctggatttgaactttatatt

SEQ ID NO: 945158 - DNA, 22 bp, Artificial Sequence
  chemically synthesized
gtttgcctggatttgaacttta

SEQ ID NO: 945159 - DNA, 22 bp, Artificial Sequence
  chemically synthesized
agtttgcctggatttgaacttt

SEQ ID NO: 945160 - DNA, 22 bp, Artificial Sequence
  chemically synthesized
tagtttgcctggatttgaactt

SEQ ID NO: 945161 - DNA, 22 bp, Artificial Sequence
  chemically synthesized
ccttaatataaagttcaaatcc

SEQ ID NO: 945162 - DNA, 22 bp, Artificial Sequence
  chemically synthesized
gttttagtttgcctggatttga

SEQ ID NO: 945163 - DNA, 22 bp, Artificial Sequence
  chemically synthesized
aatataaagttcaaatccaggc

SEQ ID NO: 945164 - DNA, 22 bp, Artificial Sequence
  chemically synthesized
atataaagttcaaatccaggca

SEQ ID NO: 945165 - DNA, 22 bp, Artificial Sequence
  chemically synthesized
aagagtagctagttttagtttg

SEQ ID NO: 945166 - DNA, 22 bp, Artificial Sequence
  chemically synthesized
aaagagtagctagttttagttt

SEQ ID NO: 945167 - DNA, 22 bp, Artificial Sequence
  chemically synthesized
taaagagtagctagttttagtt

SEQ ID NO: 945168 - DNA, 22 bp, Artificial Sequence
  chemically synthesized
aaatccaggcaaactaaaacta

SEQ ID NO: 945169 - DNA, 22 bp, Artificial Sequence
  chemically synthesized
tatctttaaagagtagctagtt

SEQ ID NO: 945170 - DNA, 22 bp, Artificial Sequence
  chemically synthesized
gtatctttaaagagtagctagt

SEQ ID NO: 945171 - DNA, 22 bp, Artificial Sequence
  chemically synthesized
tatttgtatctttaaagagtag

SEQ ID NO: 945172 - DNA, 22 bp, Artificial Sequence
  chemically synthesized
aaactagctactctttaaagat

SEQ ID NO: 945173 - DNA, 22 bp, Artificial Sequence
  chemically synthesized
aacacctgtatttgtatcttta

SEQ ID NO: 945174 - DNA, 22 bp, Artificial Sequence
  chemically synthesized
gctactctttaaagatacaaat

SEQ ID NO: 945175 - DNA, 22 bp, Artificial Sequence
  chemically synthesized
ctctttaaagatacaaatacag

SEQ ID NO: 945176 - DNA, 22 bp, Artificial Sequence
  chemically synthesized
tttaaagatacaaatacaggtg

SEQ ID NO: 945177 - DNA, 22 bp, Artificial Sequence
  chemically synthesized
taaagatacaaatacaggtgtt

SEQ ID NO: 945178 - DNA, 22 bp, Artificial Sequence
  chemically synthesized
aaagatacaaatacaggtgttg

SEQ ID NO: 945179 - DNA, 22 bp, Artificial Sequence
  chemically synthesized
aagatacaaatacaggtgttga

SEQ ID NO: 945180 - DNA, 22 bp, Artificial Sequence
  chemically synthesized
aaaaacgtatgttcaacacctg

SEQ ID NO: 945181 - DNA, 22 bp, Artificial Sequence
  chemically synthesized
aaaaaacgtatgttcaacacct

SEQ ID NO: 945182 - DNA, 22 bp, Artificial Sequence
  chemically synthesized
taaaaaacgtatgttcaacacc

SEQ ID NO: 945183 - DNA, 22 bp, Artificial Sequence
  chemically synthesized
ttaaaaaacgtatgttcaacac

SEQ ID NO: 945184 - DNA, 22 bp, Artificial Sequence
  chemically synthesized
tttaaaaaacgtatgttcaaca

SEQ ID NO: 945185 - DNA, 22 bp, Artificial Sequence
  chemically synthesized
attttttaaaaaacgtatgttc

SEQ ID NO: 945186 - DNA, 22 bp, Artificial Sequence
  chemically synthesized
aacatacgttttttaaaaaatg

SEQ ID NO: 945187 - DNA, 22 bp, Artificial Sequence
  chemically synthesized
gtaaacaatgctcattttttaa

SEQ ID NO: 945188 - DNA, 22 bp, Artificial Sequence
  chemically synthesized
tagtaaacaatgctcatttttt

SEQ ID NO: 945189 - DNA, 22 bp, Artificial Sequence
  chemically synthesized
ctagtaaacaatgctcattttt

SEQ ID NO: 945190 - DNA, 22 bp, Artificial Sequence
  chemically synthesized
aatttctagtaaacaatgctca

SEQ ID NO: 945191 - DNA, 22 bp, Artificial Sequence
  chemically synthesized
gaatttctagtaaacaatgctc

SEQ ID NO: 945192 - DNA, 22 bp, Artificial Sequence
  chemically synthesized
tttaaaaaatgagcattgttta

SEQ ID NO: 945193 - DNA, 22 bp, Artificial Sequence
  chemically synthesized
ttaaaaaatgagcattgtttac

SEQ ID NO: 945194 - DNA, 22 bp, Artificial Sequence
  chemically synthesized
taaaaaatgagcattgtttact

SEQ ID NO: 945195 - DNA, 22 bp, Artificial Sequence
  chemically synthesized
tcttgaatttctagtaaacaat

SEQ ID NO: 945196 - DNA, 22 bp, Artificial Sequence
  chemically synthesized
aaaaaatgagcattgtttacta

SEQ ID NO: 945197 - DNA, 22 bp, Artificial Sequence
  chemically synthesized
aaaaatgagcattgtttactag

SEQ ID NO: 945198 - DNA, 22 bp, Artificial Sequence
  chemically synthesized
tttactagaaattcaagataat

SEQ ID NO: 945199 - DNA, 22 bp, Artificial Sequence
  chemically synthesized
actagaaattcaagataatggt

SEQ ID NO: 945200 - DNA, 22 bp, Artificial Sequence
  chemically synthesized
ctagaaattcaagataatggtt

SEQ ID NO: 945201 - DNA, 22 bp, Artificial Sequence
  chemically synthesized
gaaattcaagataatggttact

SEQ ID NO: 945202 - DNA, 22 bp, Artificial Sequence
  chemically synthesized
cccccagagccaaaagtaacca

SEQ ID NO: 945203 - DNA, 22 bp, Artificial Sequence
  chemically synthesized
ccccccagagccaaaagtaacc

SEQ ID NO: 945204 - DNA, 22 bp, Artificial Sequence
  chemically synthesized
cttccccccagagccaaaagta

SEQ ID NO: 945205 - DNA, 22 bp, Artificial Sequence
  chemically synthesized
aagataatggttacttttggct

SEQ ID NO: 945206 - DNA, 22 bp, Artificial Sequence
  chemically synthesized
ccttccccccagagccaaaagt

SEQ ID NO: 945207 - DNA, 22 bp, Artificial Sequence
  chemically synthesized
atcaccttccttccccccagag

SEQ ID NO: 945208 - DNA, 22 bp, Artificial Sequence
  chemically synthesized
ctaatcaccttccttcccccca

SEQ ID NO: 945209 - DNA, 22 bp, Artificial Sequence
  chemically synthesized
gctaatcaccttccttcccccc

SEQ ID NO: 945210 - DNA, 22 bp, Artificial Sequence
  chemically synthesized
cttttggctctggggggaagga

SEQ ID NO: 945211 - DNA, 22 bp, Artificial Sequence
  chemically synthesized
ttggctctggggggaaggaagg

SEQ ID NO: 945212 - DNA, 22 bp, Artificial Sequence
  chemically synthesized
tggctctggggggaaggaaggt

SEQ ID NO: 945213 - DNA, 22 bp, Artificial Sequence
  chemically synthesized
ggctctggggggaaggaaggtg

SEQ ID NO: 945214 - DNA, 22 bp, Artificial Sequence
  chemically synthesized
ccccttgctaatcaccttcctt

SEQ ID NO: 945215 - DNA, 22 bp, Artificial Sequence
  chemically synthesized
gctctggggggaaggaaggtga

SEQ ID NO: 945216 - DNA, 22 bp, Artificial Sequence
  chemically synthesized
tggggggaaggaaggtgattag

SEQ ID NO: 945217 - DNA, 22 bp, Artificial Sequence
  chemically synthesized
tgttaccccttgctaatcacct

SEQ ID NO: 945218 - DNA, 22 bp, Artificial Sequence
  chemically synthesized
gggggaaggaaggtgattagca

SEQ ID NO: 945219 - DNA, 22 bp, Artificial Sequence
  chemically synthesized
cctatgttaccccttgctaatc

SEQ ID NO: 945220 - DNA, 22 bp, Artificial Sequence
  chemically synthesized
ggagaagctccctatgttaccc

SEQ ID NO: 945221 - DNA, 22 bp, Artificial Sequence
  chemically synthesized
gggagaagctccctatgttacc

SEQ ID NO: 945222 - DNA, 22 bp, Artificial Sequence
  chemically synthesized
tgggagaagctccctatgttac

SEQ ID NO: 945223 - DNA, 22 bp, Artificial Sequence
  chemically synthesized
gcaaggggtaacatagggagct

SEQ ID NO: 945224 - DNA, 22 bp, Artificial Sequence
  chemically synthesized
aaataagaagaacaccatcagt

SEQ ID NO: 945225 - DNA, 22 bp, Artificial Sequence
  chemically synthesized
caaataagaagaacaccatcag

SEQ ID NO: 945226 - DNA, 22 bp, Artificial Sequence
  chemically synthesized
ctcccaaaatactgatggtgtt

SEQ ID NO: 945227 - DNA, 22 bp, Artificial Sequence
  chemically synthesized
tcccaaaatactgatggtgttc

SEQ ID NO: 945228 - DNA, 22 bp, Artificial Sequence
  chemically synthesized
ccaaaatactgatggtgttctt

SEQ ID NO: 945229 - DNA, 22 bp, Artificial Sequence
  chemically synthesized
agtttcaaataagaagaacacc

SEQ ID NO: 945230 - DNA, 22 bp, Artificial Sequence
  chemically synthesized
tgagtttcaaataagaagaaca

SEQ ID NO: 945231 - DNA, 22 bp, Artificial Sequence
  chemically synthesized
atggtgttcttcttatttgaaa

SEQ ID NO: 945232 - DNA, 22 bp, Artificial Sequence
  chemically synthesized
caacattctgagtttcaaataa

SEQ ID NO: 945233 - DNA, 22 bp, Artificial Sequence
  chemically synthesized
tgttccaacattctgagtttca

SEQ ID NO: 945234 - DNA, 22 bp, Artificial Sequence
  chemically synthesized
ttcttatttgaaactcagaatg

SEQ ID NO: 945235 - DNA, 22 bp, Artificial Sequence
  chemically synthesized
cttatttgaaactcagaatgtt

SEQ ID NO: 945236 - DNA, 22 bp, Artificial Sequence
  chemically synthesized
ttatttgaaactcagaatgttg

SEQ ID NO: 945237 - DNA, 22 bp, Artificial Sequence
  chemically synthesized
atttgaaactcagaatgttgga

SEQ ID NO: 945238 - DNA, 22 bp, Artificial Sequence
  chemically synthesized
tttgaaactcagaatgttggaa

SEQ ID NO: 945239 - DNA, 22 bp, Artificial Sequence
  chemically synthesized
gaaactcagaatgttggaacac

SEQ ID NO: 945240 - DNA, 22 bp, Artificial Sequence
  chemically synthesized
aaactcagaatgttggaacaca

SEQ ID NO: 945241 - DNA, 22 bp, Artificial Sequence
  chemically synthesized
agaatgttggaacacagatgtt

SEQ ID NO: 945242 - DNA, 22 bp, Artificial Sequence
  chemically synthesized
aagaataatatgaacatctgtg

SEQ ID NO: 945243 - DNA, 22 bp, Artificial Sequence
  chemically synthesized
aaagaataatatgaacatctgt

SEQ ID NO: 945244 - DNA, 22 bp, Artificial Sequence
  chemically synthesized
gaacacagatgttcatattatt

SEQ ID NO: 945245 - DNA, 22 bp, Artificial Sequence
  chemically synthesized
gacagcacaggtttaaagaata

SEQ ID NO: 945246 - DNA, 22 bp, Artificial Sequence
  chemically synthesized
atattattctttaaacctgtgc

SEQ ID NO: 945247 - DNA, 22 bp, Artificial Sequence
  chemically synthesized
ccgtgttggacagcacaggttt

SEQ ID NO: 945248 - DNA, 22 bp, Artificial Sequence
  chemically synthesized
ttctttaaacctgtgctgtcca

SEQ ID NO: 945249 - DNA, 22 bp, Artificial Sequence
  chemically synthesized
atggctaccgtgttggacagca

SEQ ID NO: 945250 - DNA, 22 bp, Artificial Sequence
  chemically synthesized
tttaaacctgtgctgtccaaca

SEQ ID NO: 945251 - DNA, 22 bp, Artificial Sequence
  chemically synthesized
taaacctgtgctgtccaacacg

SEQ ID NO: 945252 - DNA, 22 bp, Artificial Sequence
  chemically synthesized
aaacctgtgctgtccaacacgg

SEQ ID NO: 945253 - DNA, 22 bp, Artificial Sequence
  chemically synthesized
aacctgtgctgtccaacacggt

SEQ ID NO: 945254 - DNA, 22 bp, Artificial Sequence
  chemically synthesized
tgctgtccaacacggtagccat

SEQ ID NO: 945255 - DNA, 22 bp, Artificial Sequence
  chemically synthesized
tccaacacggtagccattagcc

SEQ ID NO: 945256 - DNA, 22 bp, Artificial Sequence
  chemically synthesized
aatagccacaggtggctaatgg

SEQ ID NO: 945257 - DNA, 22 bp, Artificial Sequence
  chemically synthesized
ttcaatagccacaggtggctaa

SEQ ID NO: 945258 - DNA, 22 bp, Artificial Sequence
  chemically synthesized
aattgttcaatagccacaggtg

SEQ ID NO: 945259 - DNA, 22 bp, Artificial Sequence
  chemically synthesized
gaattgttcaatagccacaggt

SEQ ID NO: 945260 - DNA, 22 bp, Artificial Sequence
  chemically synthesized
gccacctgtggctattgaacaa

SEQ ID NO: 945261 - DNA, 22 bp, Artificial Sequence
  chemically synthesized
gtcacatttgaattgttcaata

SEQ ID NO: 945262 - DNA, 22 bp, Artificial Sequence
  chemically synthesized
cattagtcacatttgaattgtt

SEQ ID NO: 945263 - DNA, 22 bp, Artificial Sequence
  chemically synthesized
gcattagtcacatttgaattgt

SEQ ID NO: 945264 - DNA, 22 bp, Artificial Sequence
  chemically synthesized
tggctattgaacaattcaaatg

SEQ ID NO: 945265 - DNA, 22 bp, Artificial Sequence
  chemically synthesized
caatttgcattagtcacatttg

SEQ ID NO: 945266 - DNA, 22 bp, Artificial Sequence
  chemically synthesized
ttgaacaattcaaatgtgacta

SEQ ID NO: 945267 - DNA, 22 bp, Artificial Sequence
  chemically synthesized
aacaattcaaatgtgactaatg

SEQ ID NO: 945268 - DNA, 22 bp, Artificial Sequence
  chemically synthesized
tggcacattgcaatttgcatta

SEQ ID NO: 945269 - DNA, 22 bp, Artificial Sequence
  chemically synthesized
atggcacattgcaatttgcatt

SEQ ID NO: 945270 - DNA, 22 bp, Artificial Sequence
  chemically synthesized
aaatgtgactaatgcaaattgc

SEQ ID NO: 945271 - DNA, 22 bp, Artificial Sequence
  chemically synthesized
catttatggcacattgcaattt

SEQ ID NO: 945272 - DNA, 22 bp, Artificial Sequence
  chemically synthesized
acatttatggcacattgcaatt

SEQ ID NO: 945273 - DNA, 22 bp, Artificial Sequence
  chemically synthesized
tacatttatggcacattgcaat

SEQ ID NO: 945274 - DNA, 22 bp, Artificial Sequence
  chemically synthesized
atgcaaattgcaatgtgccata

SEQ ID NO: 945275 - DNA, 22 bp, Artificial Sequence
  chemically synthesized
gtgtatattttacatttatggc

SEQ ID NO: 945276 - DNA, 22 bp, Artificial Sequence
  chemically synthesized
caatgtgccataaatgtaaaat

SEQ ID NO: 945277 - DNA, 22 bp, Artificial Sequence
  chemically synthesized
aaatctagtgtatattttacat

SEQ ID NO: 945278 - DNA, 22 bp, Artificial Sequence
  chemically synthesized
tgaaatctagtgtatattttac

SEQ ID NO: 945279 - DNA, 22 bp, Artificial Sequence
  chemically synthesized
gtaagtctctgaaatctagtgt

SEQ ID NO: 945280 - DNA, 22 bp, Artificial Sequence
  chemically synthesized
agtaagtctctgaaatctagtg

SEQ ID NO: 945281 - DNA, 22 bp, Artificial Sequence
  chemically synthesized
tagtaagtctctgaaatctagt

SEQ ID NO: 945282 - DNA, 22 bp, Artificial Sequence
  chemically synthesized
tttagtaagtctctgaaatcta

SEQ ID NO: 945283 - DNA, 22 bp, Artificial Sequence
  chemically synthesized
ctttagtaagtctctgaaatct

SEQ ID NO: 945284 - DNA, 22 bp, Artificial Sequence
  chemically synthesized
tctttagtaagtctctgaaatc

SEQ ID NO: 945285 - DNA, 22 bp, Artificial Sequence
  chemically synthesized
ttctttagtaagtctctgaaat

SEQ ID NO: 945286 - DNA, 22 bp, Artificial Sequence
  chemically synthesized
tttctttagtaagtctctgaaa

SEQ ID NO: 945287 - DNA, 22 bp, Artificial Sequence
  chemically synthesized
acctttttctttagtaagtctc

SEQ ID NO: 945288 - DNA, 22 bp, Artificial Sequence
  chemically synthesized
aacctttttctttagtaagtct

SEQ ID NO: 945289 - DNA, 22 bp, Artificial Sequence
  chemically synthesized
gatttcagagacttactaaaga

SEQ ID NO: 945290 - DNA, 22 bp, Artificial Sequence
  chemically synthesized
tgtatttaacctttttctttag

SEQ ID NO: 945291 - DNA, 22 bp, Artificial Sequence
  chemically synthesized
cagagacttactaaagaaaaag

SEQ ID NO: 945292 - DNA, 22 bp, Artificial Sequence
  chemically synthesized
agagacttactaaagaaaaagg

SEQ ID NO: 945293 - DNA, 22 bp, Artificial Sequence
  chemically synthesized
attatgtatttaacctttttct

SEQ ID NO: 945294 - DNA, 22 bp, Artificial Sequence
  chemically synthesized
ctaattatgtatttaacctttt

SEQ ID NO: 945295 - DNA, 22 bp, Artificial Sequence
  chemically synthesized
actaaagaaaaaggttaaatac

SEQ ID NO: 945296 - DNA, 22 bp, Artificial Sequence
  chemically synthesized
ctaaagaaaaaggttaaataca

SEQ ID NO: 945297 - DNA, 22 bp, Artificial Sequence
  chemically synthesized
aagaaaaaggttaaatacataa

SEQ ID NO: 945298 - DNA, 22 bp, Artificial Sequence
  chemically synthesized
aatacataattagtaattttta

SEQ ID NO: 945299 - DNA, 22 bp, Artificial Sequence
  chemically synthesized
aatatgtaatcaatataaaaat

SEQ ID NO: 945300 - DNA, 22 bp, Artificial Sequence
  chemically synthesized
aaatatgtaatcaatataaaaa

SEQ ID NO: 945301 - DNA, 22 bp, Artificial Sequence
  chemically synthesized
tttaaatatgtaatcaatataa

SEQ ID NO: 945302 - DNA, 22 bp, Artificial Sequence
  chemically synthesized
gtaatttttatattgattacat

SEQ ID NO: 945303 - DNA, 22 bp, Artificial Sequence
  chemically synthesized
ttatattgattacatatttaaa

SEQ ID NO: 945304 - DNA, 22 bp, Artificial Sequence
  chemically synthesized
tatattgattacatatttaaat

SEQ ID NO: 945305 - DNA, 22 bp, Artificial Sequence
  chemically synthesized
atattgattacatatttaaata

SEQ ID NO: 945306 - DNA, 22 bp, Artificial Sequence
  chemically synthesized
tattgattacatatttaaataa

SEQ ID NO: 945307 - DNA, 22 bp, Artificial Sequence
  chemically synthesized
attacatatttaaataattgtg

SEQ ID NO: 945308 - DNA, 22 bp, Artificial Sequence
  chemically synthesized
gtatatccaaatcacaattatt

SEQ ID NO: 945309 - DNA, 22 bp, Artificial Sequence
  chemically synthesized
catatttaaataattgtgattt

SEQ ID NO: 945310 - DNA, 22 bp, Artificial Sequence
  chemically synthesized
gcctagtatatccaaatcacaa

SEQ ID NO: 945311 - DNA, 22 bp, Artificial Sequence
  chemically synthesized
agcctagtatatccaaatcaca

SEQ ID NO: 945312 - DNA, 22 bp, Artificial Sequence
  chemically synthesized
tttagcctagtatatccaaatc

SEQ ID NO: 945313 - DNA, 22 bp, Artificial Sequence
  chemically synthesized
atttagcctagtatatccaaat

SEQ ID NO: 945314 - DNA, 22 bp, Artificial Sequence
  chemically synthesized
aaataattgtgatttggatata

SEQ ID NO: 945315 - DNA, 22 bp, Artificial Sequence
  chemically synthesized
tatttagcctagtatatccaaa

SEQ ID NO: 945316 - DNA, 22 bp, Artificial Sequence
  chemically synthesized
aataattgtgatttggatatac

SEQ ID NO: 945317 - DNA, 22 bp, Artificial Sequence
  chemically synthesized
tgatttggatatactaggctaa

SEQ ID NO: 945318 - DNA, 22 bp, Artificial Sequence
  chemically synthesized
ggatatactaggctaaataaag

SEQ ID NO: 945319 - DNA, 22 bp, Artificial Sequence
  chemically synthesized
gatatactaggctaaataaagt

SEQ ID NO: 945320 - DNA, 22 bp, Artificial Sequence
  chemically synthesized
atgtaataggatactttattta

SEQ ID NO: 945321 - DNA, 22 bp, Artificial Sequence
  chemically synthesized
ggctaaataaagtatcctatta

SEQ ID NO: 945322 - DNA, 22 bp, Artificial Sequence
  chemically synthesized
aataaagtatcctattacatta

SEQ ID NO: 945323 - DNA, 22 bp, Artificial Sequence
  chemically synthesized
gaaaaagaaacagagaaattaa

SEQ ID NO: 945324 - DNA, 22 bp, Artificial Sequence
  chemically synthesized
ttacattaatttctctgtttct

SEQ ID NO: 945325 - DNA, 22 bp, Artificial Sequence
  chemically synthesized
gccatattagaaaaagaaacag

SEQ ID NO: 945326 - DNA, 22 bp, Artificial Sequence
  chemically synthesized
cattaatttctctgtttctttt

SEQ ID NO: 945327 - DNA, 22 bp, Artificial Sequence
  chemically synthesized
ctagccatattagaaaaagaaa

SEQ ID NO: 945328 - DNA, 22 bp, Artificial Sequence
  chemically synthesized
tactagccatattagaaaaaga

SEQ ID NO: 945329 - DNA, 22 bp, Artificial Sequence
  chemically synthesized
atttctctgtttctttttctaa

SEQ ID NO: 945330 - DNA, 22 bp, Artificial Sequence
  chemically synthesized
ctactagccatattagaaaaag

SEQ ID NO: 945331 - DNA, 22 bp, Artificial Sequence
  chemically synthesized
tctactagccatattagaaaaa

SEQ ID NO: 945332 - DNA, 22 bp, Artificial Sequence
  chemically synthesized
ctctgtttctttttctaatatg

SEQ ID NO: 945333 - DNA, 22 bp, Artificial Sequence
  chemically synthesized
tctgtttctttttctaatatgg

SEQ ID NO: 945334 - DNA, 22 bp, Artificial Sequence
  chemically synthesized
aattttctactagccatattag

SEQ ID NO: 945335 - DNA, 22 bp, Artificial Sequence
  chemically synthesized
tgtttctttttctaatatggct

SEQ ID NO: 945336 - DNA, 22 bp, Artificial Sequence
  chemically synthesized
caattttctactagccatatta

SEQ ID NO: 945337 - DNA, 22 bp, Artificial Sequence
  chemically synthesized
tcaattttctactagccatatt

SEQ ID NO: 945338 - DNA, 22 bp, Artificial Sequence
  chemically synthesized
tttctttttctaatatggctag

SEQ ID NO: 945339 - DNA, 22 bp, Artificial Sequence
  chemically synthesized
ctttttctaatatggctagtag

SEQ ID NO: 945340 - DNA, 22 bp, Artificial Sequence
  chemically synthesized
tttttctaatatggctagtaga

SEQ ID NO: 945341 - DNA, 22 bp, Artificial Sequence
  chemically synthesized
tttctaatatggctagtagaaa

SEQ ID NO: 945342 - DNA, 22 bp, Artificial Sequence
  chemically synthesized
ttctaatatggctagtagaaaa

SEQ ID NO: 945343 - DNA, 22 bp, Artificial Sequence
  chemically synthesized
tctaatatggctagtagaaaat

SEQ ID NO: 945344 - DNA, 22 bp, Artificial Sequence
  chemically synthesized
ctaatatggctagtagaaaatt

SEQ ID NO: 945345 - DNA, 22 bp, Artificial Sequence
  chemically synthesized
taatatggctagtagaaaattg

SEQ ID NO: 945346 - DNA, 22 bp, Artificial Sequence
  chemically synthesized
atatggctagtagaaaattgaa

SEQ ID NO: 945347 - DNA, 22 bp, Artificial Sequence
  chemically synthesized
gtagaaaattgaaaactacgta

SEQ ID NO: 945348 - DNA, 22 bp, Artificial Sequence
  chemically synthesized
aaaactacgtatttgactcaca

SEQ ID NO: 945349 - DNA, 22 bp, Artificial Sequence
  chemically synthesized
tccaatggaaatataatgtgag

SEQ ID NO: 945350 - DNA, 22 bp, Artificial Sequence
  chemically synthesized
cgtatttgactcacattatatt

SEQ ID NO: 945351 - DNA, 22 bp, Artificial Sequence
  chemically synthesized
gactcacattatatttccattg

SEQ ID NO: 945352 - DNA, 22 bp, Artificial Sequence
  chemically synthesized
actcacattatatttccattgg

SEQ ID NO: 945353 - DNA, 22 bp, Artificial Sequence
  chemically synthesized
aagtggtgttgtccaatggaaa

SEQ ID NO: 945354 - DNA, 22 bp, Artificial Sequence
  chemically synthesized
aaagtggtgttgtccaatggaa

SEQ ID NO: 945355 - DNA, 22 bp, Artificial Sequence
  chemically synthesized
acattatatttccattggacaa

SEQ ID NO: 945356 - DNA, 22 bp, Artificial Sequence
  chemically synthesized
tatttccattggacaacaccac

SEQ ID NO: 945357 - DNA, 22 bp, Artificial Sequence
  chemically synthesized
cagggagtgtttaaagtggtgt

SEQ ID NO: 945358 - DNA, 22 bp, Artificial Sequence
  chemically synthesized
acagggagtgtttaaagtggtg

SEQ ID NO: 945359 - DNA, 22 bp, Artificial Sequence
  chemically synthesized
ccattggacaacaccactttaa

SEQ ID NO: 945360 - DNA, 22 bp, Artificial Sequence
  chemically synthesized
cattggacaacaccactttaaa

SEQ ID NO: 945361 - DNA, 22 bp, Artificial Sequence
  chemically synthesized
gacaacaccactttaaacactc

SEQ ID NO: 945362 - DNA, 22 bp, Artificial Sequence
  chemically synthesized
taaacactccctgtaaacgttt

SEQ ID NO: 945363 - DNA, 22 bp, Artificial Sequence
  chemically synthesized
aaacactccctgtaaacgttta

SEQ ID NO: 945364 - DNA, 22 bp, Artificial Sequence
  chemically synthesized
aacactccctgtaaacgtttat

SEQ ID NO: 945365 - DNA, 22 bp, Artificial Sequence
  chemically synthesized
tgaaatatatcacaatataaac

SEQ ID NO: 945366 - DNA, 22 bp, Artificial Sequence
  chemically synthesized
cctgtaaacgtttatattgtga

SEQ ID NO: 945367 - DNA, 22 bp, Artificial Sequence
  chemically synthesized
ttatgaaatatatcacaatata

SEQ ID NO: 945368 - DNA, 22 bp, Artificial Sequence
  chemically synthesized
attatgaaatatatcacaatat

SEQ ID NO: 945369 - DNA, 22 bp, Artificial Sequence
  chemically synthesized
tattatgaaatatatcacaata

SEQ ID NO: 945370 - DNA, 22 bp, Artificial Sequence
  chemically synthesized
ttattatgaaatatatcacaat

SEQ ID NO: 945371 - DNA, 22 bp, Artificial Sequence
  chemically synthesized
taaacgtttatattgtgatata

SEQ ID NO: 945372 - DNA, 22 bp, Artificial Sequence
  chemically synthesized
tttattatgaaatatatcacaa

SEQ ID NO: 945373 - DNA, 22 bp, Artificial Sequence
  chemically synthesized
ttttttattatgaaatatatca

SEQ ID NO: 945374 - DNA, 22 bp, Artificial Sequence
  chemically synthesized
attttttattatgaaatatatc

SEQ ID NO: 945375 - DNA, 22 bp, Artificial Sequence
  chemically synthesized
atattgtgatatatttcataat

SEQ ID NO: 945376 - DNA, 22 bp, Artificial Sequence
  chemically synthesized
tattgtgatatatttcataata

SEQ ID NO: 945377 - DNA, 22 bp, Artificial Sequence
  chemically synthesized
acacatatttattttttattat

SEQ ID NO: 945378 - DNA, 22 bp, Artificial Sequence
  chemically synthesized
tgatatatttcataataaaaaa

SEQ ID NO: 945379 - DNA, 22 bp, Artificial Sequence
  chemically synthesized
tacaattaacacatatttattt

SEQ ID NO: 945380 - DNA, 22 bp, Artificial Sequence
  chemically synthesized
cataataaaaaataaatatgtg

SEQ ID NO: 945381 - DNA, 22 bp, Artificial Sequence
  chemically synthesized
ttatacaattaacacatattta

SEQ ID NO: 945382 - DNA, 22 bp, Artificial Sequence
  chemically synthesized
ataataaaaaataaatatgtgt

SEQ ID NO: 945383 - DNA, 22 bp, Artificial Sequence
  chemically synthesized
attatacaattaacacatattt

SEQ ID NO: 945384 - DNA, 22 bp, Artificial Sequence
  chemically synthesized
tattatacaattaacacatatt

SEQ ID NO: 945385 - DNA, 22 bp, Artificial Sequence
  chemically synthesized
gattttattatacaattaacac

SEQ ID NO: 945386 - DNA, 22 bp, Artificial Sequence
  chemically synthesized
agggtgaaaacctggattttat

SEQ ID NO: 945387 - DNA, 22 bp, Artificial Sequence
  chemically synthesized
aagggtgaaaacctggatttta

SEQ ID NO: 945388 - DNA, 22 bp, Artificial Sequence
  chemically synthesized
attgtataataaaatccaggtt

SEQ ID NO: 945389 - DNA, 22 bp, Artificial Sequence
  chemically synthesized
tccttaagggtgaaaacctgga

SEQ ID NO: 945390 - DNA, 22 bp, Artificial Sequence
  chemically synthesized
atccttaagggtgaaaacctgg

SEQ ID NO: 945391 - DNA, 22 bp, Artificial Sequence
  chemically synthesized
tataataaaatccaggttttca

SEQ ID NO: 945392 - DNA, 22 bp, Artificial Sequence
  chemically synthesized
tatccttaagggtgaaaacctg

SEQ ID NO: 945393 - DNA, 22 bp, Artificial Sequence
  chemically synthesized
ttatccttaagggtgaaaacct

SEQ ID NO: 945394 - DNA, 22 bp, Artificial Sequence
  chemically synthesized
cttttatccttaagggtgaaaa

SEQ ID NO: 945395 - DNA, 22 bp, Artificial Sequence
  chemically synthesized
ctccttttatccttaagggtga

SEQ ID NO: 945396 - DNA, 22 bp, Artificial Sequence
  chemically synthesized
tcacccttaaggataaaaggag

SEQ ID NO: 945397 - DNA, 22 bp, Artificial Sequence
  chemically synthesized
cacccttaaggataaaaggagt

SEQ ID NO: 945398 - DNA, 22 bp, Artificial Sequence
  chemically synthesized
gaaaggaaaactactcctttta

SEQ ID NO: 945399 - DNA, 22 bp, Artificial Sequence
  chemically synthesized
acccttaaggataaaaggagta

SEQ ID NO: 945400 - DNA, 22 bp, Artificial Sequence
  chemically synthesized
agaaaggaaaactactcctttt

SEQ ID NO: 945401 - DNA, 22 bp, Artificial Sequence
  chemically synthesized
tatttagaaaggaaaactactc

SEQ ID NO: 945402 - DNA, 22 bp, Artificial Sequence
  chemically synthesized
aaggataaaaggagtagttttc

SEQ ID NO: 945403 - DNA, 22 bp, Artificial Sequence
  chemically synthesized
aggataaaaggagtagttttcc

SEQ ID NO: 945404 - DNA, 22 bp, Artificial Sequence
  chemically synthesized
tattgtatttagaaaggaaaac

SEQ ID NO: 945405 - DNA, 22 bp, Artificial Sequence
  chemically synthesized
atattgtatttagaaaggaaaa

SEQ ID NO: 945406 - DNA, 22 bp, Artificial Sequence
  chemically synthesized
gtttatattgtatttagaaagg

SEQ ID NO: 945407 - DNA, 22 bp, Artificial Sequence
  chemically synthesized
aactggtttatattgtatttag

SEQ ID NO: 945408 - DNA, 22 bp, Artificial Sequence
  chemically synthesized
cattgaactggtttatattgta

SEQ ID NO: 945409 - DNA, 22 bp, Artificial Sequence
  chemically synthesized
tcctttctaaatacaatataaa

SEQ ID NO: 945410 - DNA, 22 bp, Artificial Sequence
  chemically synthesized
cctttctaaatacaatataaac

SEQ ID NO: 945411 - DNA, 22 bp, Artificial Sequence
  chemically synthesized
ctttctaaatacaatataaacc

SEQ ID NO: 945412 - DNA, 22 bp, Artificial Sequence
  chemically synthesized
tctaaatacaatataaaccagt

SEQ ID NO: 945413 - DNA, 22 bp, Artificial Sequence
  chemically synthesized
ctaaatacaatataaaccagtt

SEQ ID NO: 945414 - DNA, 22 bp, Artificial Sequence
  chemically synthesized
taagttccattgaactggttta

SEQ ID NO: 945415 - DNA, 22 bp, Artificial Sequence
  chemically synthesized
taaatacaatataaaccagttc

SEQ ID NO: 945416 - DNA, 22 bp, Artificial Sequence
  chemically synthesized
ataagttccattgaactggttt

SEQ ID NO: 945417 - DNA, 22 bp, Artificial Sequence
  chemically synthesized
tataagttccattgaactggtt

SEQ ID NO: 945418 - DNA, 22 bp, Artificial Sequence
  chemically synthesized
aatacaatataaaccagttcaa

SEQ ID NO: 945419 - DNA, 22 bp, Artificial Sequence
  chemically synthesized
gaaggtgtccatagttttataa

SEQ ID NO: 945420 - DNA, 22 bp, Artificial Sequence
  chemically synthesized
agaaggtgtccatagttttata

SEQ ID NO: 945421 - DNA, 22 bp, Artificial Sequence
  chemically synthesized
aatggaacttataaaactatgg

SEQ ID NO: 945422 - DNA, 22 bp, Artificial Sequence
  chemically synthesized
cttagaaggtgtccatagtttt

SEQ ID NO: 945423 - DNA, 22 bp, Artificial Sequence
  chemically synthesized
acttagaaggtgtccatagttt

SEQ ID NO: 945424 - DNA, 22 bp, Artificial Sequence
  chemically synthesized
ataaaactatggacaccttcta

SEQ ID NO: 945425 - DNA, 22 bp, Artificial Sequence
  chemically synthesized
taaaactatggacaccttctaa

SEQ ID NO: 945426 - DNA, 22 bp, Artificial Sequence
  chemically synthesized
aaaaaaatgacttacttagaag

SEQ ID NO: 945427 - DNA, 22 bp, Artificial Sequence
  chemically synthesized
aaaaaaaatgacttacttagaa

SEQ ID NO: 945428 - DNA, 22 bp, Artificial Sequence
  chemically synthesized
taaaaaaaatgacttacttaga

SEQ ID NO: 945429 - DNA, 22 bp, Artificial Sequence
  chemically synthesized
tggacaccttctaagtaagtca

SEQ ID NO: 945430 - DNA, 22 bp, Artificial Sequence
  chemically synthesized
ctttaaaaaaaatgacttactt

SEQ ID NO: 945431 - DNA, 22 bp, Artificial Sequence
  chemically synthesized
ctactttaaaaaaaatgactta

SEQ ID NO: 945432 - DNA, 22 bp, Artificial Sequence
  chemically synthesized
ctaagtaagtcattttttttaa

SEQ ID NO: 945433 - DNA, 22 bp, Artificial Sequence
  chemically synthesized
taagtaagtcattttttttaaa

SEQ ID NO: 945434 - DNA, 22 bp, Artificial Sequence
  chemically synthesized
agtaagtcattttttttaaagt

SEQ ID NO: 945435 - DNA, 22 bp, Artificial Sequence
  chemically synthesized
aggtaatgtatacctactactt

SEQ ID NO: 945436 - DNA, 22 bp, Artificial Sequence
  chemically synthesized
tttttaaagtagtaggtataca

SEQ ID NO: 945437 - DNA, 22 bp, Artificial Sequence
  chemically synthesized
ttttaaagtagtaggtatacat

SEQ ID NO: 945438 - DNA, 22 bp, Artificial Sequence
  chemically synthesized
tttaaagtagtaggtatacatt

SEQ ID NO: 945439 - DNA, 22 bp, Artificial Sequence
  chemically synthesized
aatgattgaggtaatgtatacc

SEQ ID NO: 945440 - DNA, 22 bp, Artificial Sequence
  chemically synthesized
ttaaagtagtaggtatacatta

SEQ ID NO: 945441 - DNA, 22 bp, Artificial Sequence
  chemically synthesized
gaatgattgaggtaatgtatac

SEQ ID NO: 945442 - DNA, 22 bp, Artificial Sequence
  chemically synthesized
taaagtagtaggtatacattac

SEQ ID NO: 945443 - DNA, 22 bp, Artificial Sequence
  chemically synthesized
tgaatgattgaggtaatgtata

SEQ ID NO: 945444 - DNA, 22 bp, Artificial Sequence
  chemically synthesized
aaagtagtaggtatacattacc

SEQ ID NO: 945445 - DNA, 22 bp, Artificial Sequence
  chemically synthesized
ttgaatgattgaggtaatgtat

SEQ ID NO: 945446 - DNA, 22 bp, Artificial Sequence
  chemically synthesized
aagtagtaggtatacattacct

SEQ ID NO: 945447 - DNA, 22 bp, Artificial Sequence
  chemically synthesized
cttttgaatgattgaggtaatg

SEQ ID NO: 945448 - DNA, 22 bp, Artificial Sequence
  chemically synthesized
attgcttttgaatgattgaggt

SEQ ID NO: 945449 - DNA, 22 bp, Artificial Sequence
  chemically synthesized
accacatctcattgcttttgaa

SEQ ID NO: 945450 - DNA, 22 bp, Artificial Sequence
  chemically synthesized
cctcaatcattcaaaagcaatg

SEQ ID NO: 945451 - DNA, 22 bp, Artificial Sequence
  chemically synthesized
aaattaaccacatctcattgct

SEQ ID NO: 945452 - DNA, 22 bp, Artificial Sequence
  chemically synthesized
aatcattcaaaagcaatgagat

SEQ ID NO: 945453 - DNA, 22 bp, Artificial Sequence
  chemically synthesized
aaaagcaatgagatgtggttaa

SEQ ID NO: 945454 - DNA, 22 bp, Artificial Sequence
  chemically synthesized
tatatgtgttgaaattaaccac

SEQ ID NO: 945455 - DNA, 22 bp, Artificial Sequence
  chemically synthesized
tgtatatgtgttgaaattaacc

SEQ ID NO: 945456 - DNA, 22 bp, Artificial Sequence
  chemically synthesized
aaaaagtgattctgtatatgtg

SEQ ID NO: 945457 - DNA, 22 bp, Artificial Sequence
  chemically synthesized
aaaaaagtgattctgtatatgt

SEQ ID NO: 945458 - DNA, 22 bp, Artificial Sequence
  chemically synthesized
taaaaaagtgattctgtatatg

SEQ ID NO: 945459 - DNA, 22 bp, Artificial Sequence
  chemically synthesized
atttcaacacatatacagaatc

SEQ ID NO: 945460 - DNA, 22 bp, Artificial Sequence
  chemically synthesized
caacacatatacagaatcactt

SEQ ID NO: 945461 - DNA, 22 bp, Artificial Sequence
  chemically synthesized
aacacatatacagaatcacttt

SEQ ID NO: 945462 - DNA, 22 bp, Artificial Sequence
  chemically synthesized
gagcagattttaaaaaagtgat

SEQ ID NO: 945463 - DNA, 22 bp, Artificial Sequence
  chemically synthesized
agagcagattttaaaaaagtga

SEQ ID NO: 945464 - DNA, 22 bp, Artificial Sequence
  chemically synthesized
tagagcagattttaaaaaagtg

SEQ ID NO: 945465 - DNA, 22 bp, Artificial Sequence
  chemically synthesized
ttagagcagattttaaaaaagt

SEQ ID NO: 945466 - DNA, 22 bp, Artificial Sequence
  chemically synthesized
gatttttagagcagattttaaa

SEQ ID NO: 945467 - DNA, 22 bp, Artificial Sequence
  chemically synthesized
tggatttttagagcagatttta

SEQ ID NO: 945468 - DNA, 22 bp, Artificial Sequence
  chemically synthesized
ctggatttttagagcagatttt

SEQ ID NO: 945469 - DNA, 22 bp, Artificial Sequence
  chemically synthesized
tctggatttttagagcagattt

SEQ ID NO: 945470 - DNA, 22 bp, Artificial Sequence
  chemically synthesized
ttctggatttttagagcagatt

SEQ ID NO: 945471 - DNA, 22 bp, Artificial Sequence
  chemically synthesized
ttttaaaatctgctctaaaaat

SEQ ID NO: 945472 - DNA, 22 bp, Artificial Sequence
  chemically synthesized
tttaaaatctgctctaaaaatc

SEQ ID NO: 945473 - DNA, 22 bp, Artificial Sequence
  chemically synthesized
ttaaaatctgctctaaaaatcc

SEQ ID NO: 945474 - DNA, 22 bp, Artificial Sequence
  chemically synthesized
taaaatctgctctaaaaatcca

SEQ ID NO: 945475 - DNA, 22 bp, Artificial Sequence
  chemically synthesized
aaaatctgctctaaaaatccag

SEQ ID NO: 945476 - DNA, 22 bp, Artificial Sequence
  chemically synthesized
aaatctgctctaaaaatccaga

SEQ ID NO: 945477 - DNA, 22 bp, Artificial Sequence
  chemically synthesized
ctctaaaaatccagaaaagggg

SEQ ID NO: 945478 - DNA, 22 bp, Artificial Sequence
  chemically synthesized
ggaaaatccaggccccttttct

SEQ ID NO: 945479 - DNA, 22 bp, Artificial Sequence
  chemically synthesized
gggaaaatccaggccccttttc

SEQ ID NO: 945480 - DNA, 22 bp, Artificial Sequence
  chemically synthesized
tgggaaaatccaggcccctttt

SEQ ID NO: 945481 - DNA, 22 bp, Artificial Sequence
  chemically synthesized
taaaaatccagaaaaggggcct

SEQ ID NO: 945482 - DNA, 22 bp, Artificial Sequence
  chemically synthesized
aaaatccagaaaaggggcctgg

SEQ ID NO: 945483 - DNA, 22 bp, Artificial Sequence
  chemically synthesized
cctttgggaaaatccaggcccc

SEQ ID NO: 945484 - DNA, 22 bp, Artificial Sequence
  chemically synthesized
gcctttgggaaaatccaggccc

SEQ ID NO: 945485 - DNA, 22 bp, Artificial Sequence
  chemically synthesized
agatttgcctttgggaaaatcc

SEQ ID NO: 945486 - DNA, 22 bp, Artificial Sequence
  chemically synthesized
accactcagatttgcctttggg

SEQ ID NO: 945487 - DNA, 22 bp, Artificial Sequence
  chemically synthesized
gattttcccaaaggcaaatctg

SEQ ID NO: 945488 - DNA, 22 bp, Artificial Sequence
  chemically synthesized
tcccaaaggcaaatctgagtgg

SEQ ID NO: 945489 - DNA, 22 bp, Artificial Sequence
  chemically synthesized
cccaaaggcaaatctgagtggt

SEQ ID NO: 945490 - DNA, 22 bp, Artificial Sequence
  chemically synthesized
ccaaaggcaaatctgagtggtg

SEQ ID NO: 945491 - DNA, 22 bp, Artificial Sequence
  chemically synthesized
aatatatcaactcaccactcag

SEQ ID NO: 945492 - DNA, 22 bp, Artificial Sequence
  chemically synthesized
agtgataattcaatatatcaac

SEQ ID NO: 945493 - DNA, 22 bp, Artificial Sequence
  chemically synthesized
tcagtgataattcaatatatca

SEQ ID NO: 945494 - DNA, 22 bp, Artificial Sequence
  chemically synthesized
ctcagtgataattcaatatatc

SEQ ID NO: 945495 - DNA, 22 bp, Artificial Sequence
  chemically synthesized
agtggtgagttgatatattgaa

SEQ ID NO: 945496 - DNA, 22 bp, Artificial Sequence
  chemically synthesized
tctcagtgataattcaatatat

SEQ ID NO: 945497 - DNA, 22 bp, Artificial Sequence
  chemically synthesized
tttctcagtgataattcaatat

SEQ ID NO: 945498 - DNA, 22 bp, Artificial Sequence
  chemically synthesized
ctttctcagtgataattcaata

SEQ ID NO: 945499 - DNA, 22 bp, Artificial Sequence
  chemically synthesized
gtttctttctcagtgataattc

SEQ ID NO: 945500 - DNA, 22 bp, Artificial Sequence
  chemically synthesized
ggtttctttctcagtgataatt

SEQ ID NO: 945501 - DNA, 22 bp, Artificial Sequence
  chemically synthesized
tggtttctttctcagtgataat

SEQ ID NO: 945502 - DNA, 22 bp, Artificial Sequence
  chemically synthesized
atatattgaattatcactgaga

SEQ ID NO: 945503 - DNA, 22 bp, Artificial Sequence
  chemically synthesized
aattttggtttctttctcagtg

SEQ ID NO: 945504 - DNA, 22 bp, Artificial Sequence
  chemically synthesized
attgaattttggtttctttctc

SEQ ID NO: 945505 - DNA, 22 bp, Artificial Sequence
  chemically synthesized
cattgaattttggtttctttct

SEQ ID NO: 945506 - DNA, 22 bp, Artificial Sequence
  chemically synthesized
aattatcactgagaaagaaacc

SEQ ID NO: 945507 - DNA, 22 bp, Artificial Sequence
  chemically synthesized
tcactgagaaagaaaccaaaat

SEQ ID NO: 945508 - DNA, 22 bp, Artificial Sequence
  chemically synthesized
agatttcattgaattttggttt

SEQ ID NO: 945509 - DNA, 22 bp, Artificial Sequence
  chemically synthesized
tattaagatttcattgaatttt

SEQ ID NO: 945510 - DNA, 22 bp, Artificial Sequence
  chemically synthesized
agaaagaaaccaaaattcaatg

SEQ ID NO: 945511 - DNA, 22 bp, Artificial Sequence
  chemically synthesized
tccacgtaggctatattaagat

SEQ ID NO: 945512 - DNA, 22 bp, Artificial Sequence
  chemically synthesized
gtccacgtaggctatattaaga

SEQ ID NO: 945513 - DNA, 22 bp, Artificial Sequence
  chemically synthesized
aatgaaatcttaatatagccta

SEQ ID NO: 945514 - DNA, 22 bp, Artificial Sequence
  chemically synthesized
tatacttgtccacgtaggctat

SEQ ID NO: 945515 - DNA, 22 bp, Artificial Sequence
  chemically synthesized
gtatacttgtccacgtaggcta

SEQ ID NO: 945516 - DNA, 22 bp, Artificial Sequence
  chemically synthesized
tgtatacttgtccacgtaggct

SEQ ID NO: 945517 - DNA, 22 bp, Artificial Sequence
  chemically synthesized
aaattttgtatacttgtccacg

SEQ ID NO: 945518 - DNA, 22 bp, Artificial Sequence
  chemically synthesized
aatatagcctacgtggacaagt

SEQ ID NO: 945519 - DNA, 22 bp, Artificial Sequence
  chemically synthesized
atatagcctacgtggacaagta

SEQ ID NO: 945520 - DNA, 22 bp, Artificial Sequence
  chemically synthesized
tgctcaaattttgtatacttgt

SEQ ID NO: 945521 - DNA, 22 bp, Artificial Sequence
  chemically synthesized
ctatgctcaaattttgtatact

SEQ ID NO: 945522 - DNA, 22 bp, Artificial Sequence
  chemically synthesized
cgtggacaagtatacaaaattt

SEQ ID NO: 945523 - DNA, 22 bp, Artificial Sequence
  chemically synthesized
tatcgttgctatgctcaaattt

SEQ ID NO: 945524 - DNA, 22 bp, Artificial Sequence
  chemically synthesized
aattgtatcgttgctatgctca

SEQ ID NO: 945525 - DNA, 22 bp, Artificial Sequence
  chemically synthesized
aaattgtatcgttgctatgctc

SEQ ID NO: 945526 - DNA, 22 bp, Artificial Sequence
  chemically synthesized
gagcatagcaacgatacaattt

SEQ ID NO: 945527 - DNA, 22 bp, Artificial Sequence
  chemically synthesized
agcatagcaacgatacaattta

SEQ ID NO: 945528 - DNA, 22 bp, Artificial Sequence
  chemically synthesized
gagcaaaatccttaaattgtat

SEQ ID NO: 945529 - DNA, 22 bp, Artificial Sequence
  chemically synthesized
agagcaaaatccttaaattgta

SEQ ID NO: 945530 - DNA, 22 bp, Artificial Sequence
  chemically synthesized
gtttagagcaaaatccttaaat

SEQ ID NO: 945531 - DNA, 22 bp, Artificial Sequence
  chemically synthesized
aattagtttagagcaaaatcct

SEQ ID NO: 945532 - DNA, 22 bp, Artificial Sequence
  chemically synthesized
ttgaattagtttagagcaaaat

SEQ ID NO: 945533 - DNA, 22 bp, Artificial Sequence
  chemically synthesized
attattgaattagtttagagca

SEQ ID NO: 945534 - DNA, 22 bp, Artificial Sequence
  chemically synthesized
aaggattttgctctaaactaat

SEQ ID NO: 945535 - DNA, 22 bp, Artificial Sequence
  chemically synthesized
cctaattattgaattagtttag

SEQ ID NO: 945536 - DNA, 22 bp, Artificial Sequence
  chemically synthesized
aggattttgctctaaactaatt

SEQ ID NO: 945537 - DNA, 22 bp, Artificial Sequence
  chemically synthesized
ccctaattattgaattagttta

SEQ ID NO: 945538 - DNA, 22 bp, Artificial Sequence
  chemically synthesized
tagcttccctaattattgaatt

SEQ ID NO: 945539 - DNA, 22 bp, Artificial Sequence
  chemically synthesized
tgctctaaactaattcaataat

SEQ ID NO: 945540 - DNA, 22 bp, Artificial Sequence
  chemically synthesized
gctctaaactaattcaataatt

SEQ ID NO: 945541 - DNA, 22 bp, Artificial Sequence
  chemically synthesized
tgtagcttccctaattattgaa

SEQ ID NO: 945542 - DNA, 22 bp, Artificial Sequence
  chemically synthesized
ctctaaactaattcaataatta

SEQ ID NO: 945543 - DNA, 22 bp, Artificial Sequence
  chemically synthesized
taaactaattcaataattaggg

SEQ ID NO: 945544 - DNA, 22 bp, Artificial Sequence
  chemically synthesized
aactaattcaataattagggaa

SEQ ID NO: 945545 - DNA, 22 bp, Artificial Sequence
  chemically synthesized
attcaataattagggaagctac

SEQ ID NO: 945546 - DNA, 22 bp, Artificial Sequence
  chemically synthesized
atataggcattctgtagcttcc

SEQ ID NO: 945547 - DNA, 22 bp, Artificial Sequence
  chemically synthesized
aatataggcattctgtagcttc

SEQ ID NO: 945548 - DNA, 22 bp, Artificial Sequence
  chemically synthesized
taatataggcattctgtagctt

SEQ ID NO: 945549 - DNA, 22 bp, Artificial Sequence
  chemically synthesized
aataattagggaagctacagaa

SEQ ID NO: 945550 - DNA, 22 bp, Artificial Sequence
  chemically synthesized
ttaatataggcattctgtagct

SEQ ID NO: 945551 - DNA, 22 bp, Artificial Sequence
  chemically synthesized
gggaagctacagaatgcctata

SEQ ID NO: 945552 - DNA, 22 bp, Artificial Sequence
  chemically synthesized
cagaatgcctatattaaaaatt

SEQ ID NO: 945553 - DNA, 22 bp, Artificial Sequence
  chemically synthesized
cacaaaggagagataattttta

SEQ ID NO: 945554 - DNA, 22 bp, Artificial Sequence
  chemically synthesized
agttccacaaaggagagataat

SEQ ID NO: 945555 - DNA, 22 bp, Artificial Sequence
  chemically synthesized
tattaaaaattatctctccttt

SEQ ID NO: 945556 - DNA, 22 bp, Artificial Sequence
  chemically synthesized
aaaattatctctcctttgtgga

SEQ ID NO: 945557 - DNA, 22 bp, Artificial Sequence
  chemically synthesized
tatggtcagattgagttccaca

SEQ ID NO: 945558 - DNA, 22 bp, Artificial Sequence
  chemically synthesized
tctctcctttgtggaactcaat

SEQ ID NO: 945559 - DNA, 22 bp, Artificial Sequence
  chemically synthesized
tcctttgtggaactcaatctga

SEQ ID NO: 945560 - DNA, 22 bp, Artificial Sequence
  chemically synthesized
caaattgtatggtcagattgag

SEQ ID NO: 945561 - DNA, 22 bp, Artificial Sequence
  chemically synthesized
gcaaattgtatggtcagattga

SEQ ID NO: 945562 - DNA, 22 bp, Artificial Sequence
  chemically synthesized
ctttgtggaactcaatctgacc

SEQ ID NO: 945563 - DNA, 22 bp, Artificial Sequence
  chemically synthesized
tgcaaattgtatggtcagattg

SEQ ID NO: 945564 - DNA, 22 bp, Artificial Sequence
  chemically synthesized
tgtggaactcaatctgaccata

SEQ ID NO: 945565 - DNA, 22 bp, Artificial Sequence
  chemically synthesized
ctttgcaaattgtatggtcaga

SEQ ID NO: 945566 - DNA, 22 bp, Artificial Sequence
  chemically synthesized
gtggaactcaatctgaccatac

SEQ ID NO: 945567 - DNA, 22 bp, Artificial Sequence
  chemically synthesized
tggaactcaatctgaccataca

SEQ ID NO: 945568 - DNA, 22 bp, Artificial Sequence
  chemically synthesized
tctgctttgcaaattgtatggt

SEQ ID NO: 945569 - DNA, 22 bp, Artificial Sequence
  chemically synthesized
atctgctttgcaaattgtatgg

SEQ ID NO: 945570 - DNA, 22 bp, Artificial Sequence
  chemically synthesized
aatctgaccatacaatttgcaa

SEQ ID NO: 945571 - DNA, 22 bp, Artificial Sequence
  chemically synthesized
tgtaatttatctgctttgcaaa

SEQ ID NO: 945572 - DNA, 22 bp, Artificial Sequence
  chemically synthesized
accatacaatttgcaaagcaga

SEQ ID NO: 945573 - DNA, 22 bp, Artificial Sequence
  chemically synthesized
aattatgtaatttatctgcttt

SEQ ID NO: 945574 - DNA, 22 bp, Artificial Sequence
  chemically synthesized
aatgctaaattatgtaatttat

SEQ ID NO: 945575 - DNA, 22 bp, Artificial Sequence
  chemically synthesized
gcaaagcagataaattacataa

SEQ ID NO: 945576 - DNA, 22 bp, Artificial Sequence
  chemically synthesized
caaagcagataaattacataat

SEQ ID NO: 945577 - DNA, 22 bp, Artificial Sequence
  chemically synthesized
agatgaagtattcaatgctaaa

SEQ ID NO: 945578 - DNA, 22 bp, Artificial Sequence
  chemically synthesized
ttcagatgaagtattcaatgct

SEQ ID NO: 945579 - DNA, 22 bp, Artificial Sequence
  chemically synthesized
ctattcagatgaagtattcaat

SEQ ID NO: 945580 - DNA, 22 bp, Artificial Sequence
  chemically synthesized
cataatttagcattgaatactt

SEQ ID NO: 945581 - DNA, 22 bp, Artificial Sequence
  chemically synthesized
actattcagatgaagtattcaa

SEQ ID NO: 945582 - DNA, 22 bp, Artificial Sequence
  chemically synthesized
ataccttactattcagatgaag

SEQ ID NO: 945583 - DNA, 22 bp, Artificial Sequence
  chemically synthesized
agcattgaatacttcatctgaa

SEQ ID NO: 945584 - DNA, 22 bp, Artificial Sequence
  chemically synthesized
gcattgaatacttcatctgaat

SEQ ID NO: 945585 - DNA, 22 bp, Artificial Sequence
  chemically synthesized
gatattcataccttactattca

SEQ ID NO: 945586 - DNA, 22 bp, Artificial Sequence
  chemically synthesized
aatacttcatctgaatagtaag

SEQ ID NO: 945587 - DNA, 22 bp, Artificial Sequence
  chemically synthesized
catctgaatagtaaggtatgaa

SEQ ID NO: 945588 - DNA, 22 bp, Artificial Sequence
  chemically synthesized
atctgaatagtaaggtatgaat

SEQ ID NO: 945589 - DNA, 22 bp, Artificial Sequence
  chemically synthesized
aatagtaaggtatgaatatcta

SEQ ID NO: 945590 - DNA, 22 bp, Artificial Sequence
  chemically synthesized
gaaaacagagaggccattagat

SEQ ID NO: 945591 - DNA, 22 bp, Artificial Sequence
  chemically synthesized
agaaaacagagaggccattaga

SEQ ID NO: 945592 - DNA, 22 bp, Artificial Sequence
  chemically synthesized
tagaaaacagagaggccattag

SEQ ID NO: 945593 - DNA, 22 bp, Artificial Sequence
  chemically synthesized
gcagattttagaaaacagagag

SEQ ID NO: 945594 - DNA, 22 bp, Artificial Sequence
  chemically synthesized
tagcagattttagaaaacagag

SEQ ID NO: 945595 - DNA, 22 bp, Artificial Sequence
  chemically synthesized
actctagcagattttagaaaac

SEQ ID NO: 945596 - DNA, 22 bp, Artificial Sequence
  chemically synthesized
atggcctctctgttttctaaaa

SEQ ID NO: 945597 - DNA, 22 bp, Artificial Sequence
  chemically synthesized
tgactctagcagattttagaaa

SEQ ID NO: 945598 - DNA, 22 bp, Artificial Sequence
  chemically synthesized
tctgttttctaaaatctgctag

SEQ ID NO: 945599 - DNA, 22 bp, Artificial Sequence
  chemically synthesized
tgttttctaaaatctgctagag

SEQ ID NO: 945600 - DNA, 22 bp, Artificial Sequence
  chemically synthesized
ttttctaaaatctgctagagtc

SEQ ID NO: 945601 - DNA, 22 bp, Artificial Sequence
  chemically synthesized
tacatgacattctgactctagc

SEQ ID NO: 945602 - DNA, 22 bp, Artificial Sequence
  chemically synthesized
gtacatgacattctgactctag

SEQ ID NO: 945603 - DNA, 22 bp, Artificial Sequence
  chemically synthesized
tctaaaatctgctagagtcaga

SEQ ID NO: 945604 - DNA, 22 bp, Artificial Sequence
  chemically synthesized
ctaaaatctgctagagtcagaa

SEQ ID NO: 945605 - DNA, 22 bp, Artificial Sequence
  chemically synthesized
taaaatctgctagagtcagaat

SEQ ID NO: 945606 - DNA, 22 bp, Artificial Sequence
  chemically synthesized
aaatctgctagagtcagaatgt

SEQ ID NO: 945607 - DNA, 22 bp, Artificial Sequence
  chemically synthesized
gaacttgtacatgacattctga

SEQ ID NO: 945608 - DNA, 22 bp, Artificial Sequence
  chemically synthesized
agaacttgtacatgacattctg

SEQ ID NO: 945609 - DNA, 22 bp, Artificial Sequence
  chemically synthesized
tagaacttgtacatgacattct

SEQ ID NO: 945610 - DNA, 22 bp, Artificial Sequence
  chemically synthesized
tttagaacttgtacatgacatt

SEQ ID NO: 945611 - DNA, 22 bp, Artificial Sequence
  chemically synthesized
ctagagtcagaatgtcatgtac

SEQ ID NO: 945612 - DNA, 22 bp, Artificial Sequence
  chemically synthesized
gagtcagaatgtcatgtacaag

SEQ ID NO: 945613 - DNA, 22 bp, Artificial Sequence
  chemically synthesized
aaaattctttagaacttgtaca

SEQ ID NO: 945614 - DNA, 22 bp, Artificial Sequence
  chemically synthesized
aaaaattctttagaacttgtac

SEQ ID NO: 945615 - DNA, 22 bp, Artificial Sequence
  chemically synthesized
ttaaaaattctttagaacttgt

SEQ ID NO: 945616 - DNA, 22 bp, Artificial Sequence
  chemically synthesized
tcttaaaaattctttagaactt

SEQ ID NO: 945617 - DNA, 22 bp, Artificial Sequence
  chemically synthesized
ctcttaaaaattctttagaact

SEQ ID NO: 945618 - DNA, 22 bp, Artificial Sequence
  chemically synthesized
tctcttaaaaattctttagaac

SEQ ID NO: 945619 - DNA, 22 bp, Artificial Sequence
  chemically synthesized
ttctcttaaaaattctttagaa

SEQ ID NO: 945620 - DNA, 22 bp, Artificial Sequence
  chemically synthesized
tttctcttaaaaattctttaga

SEQ ID NO: 945621 - DNA, 22 bp, Artificial Sequence
  chemically synthesized
cctttttctcttaaaaattctt

SEQ ID NO: 945622 - DNA, 22 bp, Artificial Sequence
  chemically synthesized
attccctttttctcttaaaaat

SEQ ID NO: 945623 - DNA, 22 bp, Artificial Sequence
  chemically synthesized
aattccctttttctcttaaaaa

SEQ ID NO: 945624 - DNA, 22 bp, Artificial Sequence
  chemically synthesized
taattccctttttctcttaaaa

SEQ ID NO: 945625 - DNA, 22 bp, Artificial Sequence
  chemically synthesized
taaagaatttttaagagaaaaa

SEQ ID NO: 945626 - DNA, 22 bp, Artificial Sequence
  chemically synthesized
aagaatttttaagagaaaaagg

SEQ ID NO: 945627 - DNA, 22 bp, Artificial Sequence
  chemically synthesized
aataacctttaattcccttttt

SEQ ID NO: 945628 - DNA, 22 bp, Artificial Sequence
  chemically synthesized
ttaagagaaaaagggaattaaa

SEQ ID NO: 945629 - DNA, 22 bp, Artificial Sequence
  chemically synthesized
taagagaaaaagggaattaaag

SEQ ID NO: 945630 - DNA, 22 bp, Artificial Sequence
  chemically synthesized
aagagaaaaagggaattaaagg

SEQ ID NO: 945631 - DNA, 22 bp, Artificial Sequence
  chemically synthesized
agagaaaaagggaattaaaggt

SEQ ID NO: 945632 - DNA, 22 bp, Artificial Sequence
  chemically synthesized
aaagtctcaataacctttaatt

SEQ ID NO: 945633 - DNA, 22 bp, Artificial Sequence
  chemically synthesized
caaagtctcaataacctttaat

SEQ ID NO: 945634 - DNA, 22 bp, Artificial Sequence
  chemically synthesized
ataaaaatagatttcaaagtct

SEQ ID NO: 945635 - DNA, 22 bp, Artificial Sequence
  chemically synthesized
aaggttattgagactttgaaat

SEQ ID NO: 945636 - DNA, 22 bp, Artificial Sequence
  chemically synthesized
ttgagactttgaaatctatttt

SEQ ID NO: 945637 - DNA, 22 bp, Artificial Sequence
  chemically synthesized
agactttgaaatctatttttat

SEQ ID NO: 945638 - DNA, 22 bp, Artificial Sequence
  chemically synthesized
cagtgtcaactgataaaaatag

SEQ ID NO: 945639 - DNA, 22 bp, Artificial Sequence
  chemically synthesized
ccagtgtcaactgataaaaata

SEQ ID NO: 945640 - DNA, 22 bp, Artificial Sequence
  chemically synthesized
ttccagtgtcaactgataaaaa

SEQ ID NO: 945641 - DNA, 22 bp, Artificial Sequence
  chemically synthesized
tcttccagtgtcaactgataaa

SEQ ID NO: 945642 - DNA, 22 bp, Artificial Sequence
  chemically synthesized
tgaaatctatttttatcagttg

SEQ ID NO: 945643 - DNA, 22 bp, Artificial Sequence
  chemically synthesized
ctcttccagtgtcaactgataa

SEQ ID NO: 945644 - DNA, 22 bp, Artificial Sequence
  chemically synthesized
gaaatctatttttatcagttga

SEQ ID NO: 945645 - DNA, 22 bp, Artificial Sequence
  chemically synthesized
aaatctatttttatcagttgac

SEQ ID NO: 945646 - DNA, 22 bp, Artificial Sequence
  chemically synthesized
tttttatcagttgacactggaa

SEQ ID NO: 945647 - DNA, 22 bp, Artificial Sequence
  chemically synthesized
ttatcagttgacactggaagag

SEQ ID NO: 945648 - DNA, 22 bp, Artificial Sequence
  chemically synthesized
tatcagttgacactggaagaga

SEQ ID NO: 945649 - DNA, 22 bp, Artificial Sequence
  chemically synthesized
atcagttgacactggaagagaa

SEQ ID NO: 945650 - DNA, 22 bp, Artificial Sequence
  chemically synthesized
tcagttgacactggaagagaaa

SEQ ID NO: 945651 - DNA, 22 bp, Artificial Sequence
  chemically synthesized
acactggaagagaaacgtgggt

SEQ ID NO: 945652 - DNA, 22 bp, Artificial Sequence
  chemically synthesized
gaagagaaacgtgggtatacac

SEQ ID NO: 945653 - DNA, 22 bp, Artificial Sequence
  chemically synthesized
taaagacagaagatatatgtat

SEQ ID NO: 945654 - DNA, 22 bp, Artificial Sequence
  chemically synthesized
tataaactataaagacagaaga

SEQ ID NO: 945655 - DNA, 22 bp, Artificial Sequence
  chemically synthesized
aatctatataaactataaagac

SEQ ID NO: 945656 - DNA, 22 bp, Artificial Sequence
  chemically synthesized
cattgaatctatataaactata

SEQ ID NO: 945657 - DNA, 22 bp, Artificial Sequence
  chemically synthesized
ccattgaatctatataaactat

SEQ ID NO: 945658 - DNA, 22 bp, Artificial Sequence
  chemically synthesized
tccattgaatctatataaacta

SEQ ID NO: 945659 - DNA, 22 bp, Artificial Sequence
  chemically synthesized
ctgtctttatagtttatataga

SEQ ID NO: 945660 - DNA, 22 bp, Artificial Sequence
  chemically synthesized
ttttccattgaatctatataaa

SEQ ID NO: 945661 - DNA, 22 bp, Artificial Sequence
  chemically synthesized
tgtctttatagtttatatagat

SEQ ID NO: 945662 - DNA, 22 bp, Artificial Sequence
  chemically synthesized
attttccattgaatctatataa

SEQ ID NO: 945663 - DNA, 22 bp, Artificial Sequence
  chemically synthesized
tctttatagtttatatagattc

SEQ ID NO: 945664 - DNA, 22 bp, Artificial Sequence
  chemically synthesized
aatttattttccattgaatcta

SEQ ID NO: 945665 - DNA, 22 bp, Artificial Sequence
  chemically synthesized
tatagtttatatagattcaatg

SEQ ID NO: 945666 - DNA, 22 bp, Artificial Sequence
  chemically synthesized
atagtttatatagattcaatgg

SEQ ID NO: 945667 - DNA, 22 bp, Artificial Sequence
  chemically synthesized
tgaatttattttccattgaatc

SEQ ID NO: 945668 - DNA, 22 bp, Artificial Sequence
  chemically synthesized
tagtttatatagattcaatgga

SEQ ID NO: 945669 - DNA, 22 bp, Artificial Sequence
  chemically synthesized
agattctgaatttattttccat

SEQ ID NO: 945670 - DNA, 22 bp, Artificial Sequence
  chemically synthesized
atatagattcaatggaaaataa

SEQ ID NO: 945671 - DNA, 22 bp, Artificial Sequence
  chemically synthesized
cagattctgaatttattttcca

SEQ ID NO: 945672 - DNA, 22 bp, Artificial Sequence
  chemically synthesized
tatagattcaatggaaaataaa

SEQ ID NO: 945673 - DNA, 22 bp, Artificial Sequence
  chemically synthesized
tcagattctgaatttattttcc

SEQ ID NO: 945674 - DNA, 22 bp, Artificial Sequence
  chemically synthesized
attttcagattctgaatttatt

SEQ ID NO: 945675 - DNA, 22 bp, Artificial Sequence
  chemically synthesized
aatggaaaataaattcagaatc

SEQ ID NO: 945676 - DNA, 22 bp, Artificial Sequence
  chemically synthesized
atcaaaattcattttcagattc

SEQ ID NO: 945677 - DNA, 22 bp, Artificial Sequence
  chemically synthesized
tggcctgatcaaaattcatttt

SEQ ID NO: 945678 - DNA, 22 bp, Artificial Sequence
  chemically synthesized
agaatctgaaaatgaattttga

SEQ ID NO: 945679 - DNA, 22 bp, Artificial Sequence
  chemically synthesized
aaaatgaattttgatcaggcca

SEQ ID NO: 945680 - DNA, 22 bp, Artificial Sequence
  chemically synthesized
tgtatcacacatcctgtggcct

SEQ ID NO: 945681 - DNA, 22 bp, Artificial Sequence
  chemically synthesized
tgtgtatcacacatcctgtggc

SEQ ID NO: 945682 - DNA, 22 bp, Artificial Sequence
  chemically synthesized
tgatcaggccacaggatgtgtg

SEQ ID NO: 945683 - DNA, 22 bp, Artificial Sequence
  chemically synthesized
gatcaggccacaggatgtgtga

SEQ ID NO: 945684 - DNA, 22 bp, Artificial Sequence
  chemically synthesized
atcaggccacaggatgtgtgat

SEQ ID NO: 945685 - DNA, 22 bp, Artificial Sequence
  chemically synthesized
cccattctgtgtatcacacatc

SEQ ID NO: 945686 - DNA, 22 bp, Artificial Sequence
  chemically synthesized
cattccccattctgtgtatcac

SEQ ID NO: 945687 - DNA, 22 bp, Artificial Sequence
  chemically synthesized
gcattccccattctgtgtatca

SEQ ID NO: 945688 - DNA, 22 bp, Artificial Sequence
  chemically synthesized
tttgcattccccattctgtgta

SEQ ID NO: 945689 - DNA, 22 bp, Artificial Sequence
  chemically synthesized
cctgtttgcattccccattctg

SEQ ID NO: 945690 - DNA, 22 bp, Artificial Sequence
  chemically synthesized
ccctgtttgcattccccattct

SEQ ID NO: 945691 - DNA, 22 bp, Artificial Sequence
  chemically synthesized
tttccctgtttgcattccccat

SEQ ID NO: 945692 - DNA, 22 bp, Artificial Sequence
  chemically synthesized
caatatatgacattgtttccct

SEQ ID NO: 945693 - DNA, 22 bp, Artificial Sequence
  chemically synthesized
gcaatatatgacattgtttccc

SEQ ID NO: 945694 - DNA, 22 bp, Artificial Sequence
  chemically synthesized
tgcaatatatgacattgtttcc

SEQ ID NO: 945695 - DNA, 22 bp, Artificial Sequence
  chemically synthesized
ttgcaatatatgacattgtttc

SEQ ID NO: 945696 - DNA, 22 bp, Artificial Sequence
  chemically synthesized
tttgcaatatatgacattgttt

SEQ ID NO: 945697 - DNA, 22 bp, Artificial Sequence
  chemically synthesized
ttttgcaatatatgacattgtt

SEQ ID NO: 945698 - DNA, 22 bp, Artificial Sequence
  chemically synthesized
caagcccaaacaaatccttttt

SEQ ID NO: 945699 - DNA, 22 bp, Artificial Sequence
  chemically synthesized
attccaagcccaaacaaatcct

SEQ ID NO: 945700 - DNA, 22 bp, Artificial Sequence
  chemically synthesized
gattccaagcccaaacaaatcc

SEQ ID NO: 945701 - DNA, 22 bp, Artificial Sequence
  chemically synthesized
tgattccaagcccaaacaaatc

SEQ ID NO: 945702 - DNA, 22 bp, Artificial Sequence
  chemically synthesized
tttgattccaagcccaaacaaa

SEQ ID NO: 945703 - DNA, 22 bp, Artificial Sequence
  chemically synthesized
caaaaaaggatttgtttgggct

SEQ ID NO: 945704 - DNA, 22 bp, Artificial Sequence
  chemically synthesized
tctttgattccaagcccaaaca

SEQ ID NO: 945705 - DNA, 22 bp, Artificial Sequence
  chemically synthesized
taccgagttctctttgattcca

SEQ ID NO: 945706 - DNA, 22 bp, Artificial Sequence
  chemically synthesized
gtttgggcttggaatcaaagag

SEQ ID NO: 945707 - DNA, 22 bp, Artificial Sequence
  chemically synthesized
tttgggcttggaatcaaagaga

SEQ ID NO: 945708 - DNA, 22 bp, Artificial Sequence
  chemically synthesized
gggcttggaatcaaagagaact

SEQ ID NO: 945709 - DNA, 22 bp, Artificial Sequence
  chemically synthesized
ggcttggaatcaaagagaactc

SEQ ID NO: 945710 - DNA, 22 bp, Artificial Sequence
  chemically synthesized
ggaatcaaagagaactcggtat

SEQ ID NO: 945711 - DNA, 22 bp, Artificial Sequence
  chemically synthesized
gaatcaaagagaactcggtata

SEQ ID NO: 945712 - DNA, 22 bp, Artificial Sequence
  chemically synthesized
ggtataatcctctttttttttt

SEQ ID NO: 945713 - DNA, 22 bp, Artificial Sequence
  chemically synthesized
agaagaaaaaaaaaaaaaaaaa

SEQ ID NO: 945714 - DNA, 22 bp, Artificial Sequence
  chemically synthesized
cgtctcagaagaaaaaaaaaaa

SEQ ID NO: 945715 - DNA, 22 bp, Artificial Sequence
  chemically synthesized
tttttttttttttttttttctt

SEQ ID NO: 945716 - DNA, 22 bp, Artificial Sequence
  chemically synthesized
tttttttttttttttttcttct

SEQ ID NO: 945717 - DNA, 22 bp, Artificial Sequence
  chemically synthesized
ttttttttttttttttcttctg

SEQ ID NO: 945718 - DNA, 22 bp, Artificial Sequence
  chemically synthesized
tttttttttttttttcttctga

SEQ ID NO: 945719 - DNA, 22 bp, Artificial Sequence
  chemically synthesized
ttttttttttttttcttctgag

SEQ ID NO: 945720 - DNA, 22 bp, Artificial Sequence
  chemically synthesized
tttttttttttttcttctgaga

SEQ ID NO: 945721 - DNA, 22 bp, Artificial Sequence
  chemically synthesized
ttttttttttttcttctgagac

SEQ ID NO: 945722 - DNA, 22 bp, Artificial Sequence
  chemically synthesized
tttttttttttcttctgagacg

SEQ ID NO: 945723 - DNA, 22 bp, Artificial Sequence
  chemically synthesized
ttttttttttcttctgagacgg

SEQ ID NO: 945724 - DNA, 22 bp, Artificial Sequence
  chemically synthesized
tttttttttcttctgagacgga

SEQ ID NO: 945725 - DNA, 22 bp, Artificial Sequence
  chemically synthesized
ttttttttcttctgagacggag

SEQ ID NO: 945726 - DNA, 22 bp, Artificial Sequence
  chemically synthesized
tttttttcttctgagacggagt

SEQ ID NO: 945727 - DNA, 22 bp, Artificial Sequence
  chemically synthesized
ttttttcttctgagacggagtt

SEQ ID NO: 945728 - DNA, 22 bp, Artificial Sequence
  chemically synthesized
tttttcttctgagacggagttt

SEQ ID NO: 945729 - DNA, 22 bp, Artificial Sequence
  chemically synthesized
ttttcttctgagacggagtttt

SEQ ID NO: 945730 - DNA, 22 bp, Artificial Sequence
  chemically synthesized
ggcgacaagagcaaaactccgt

SEQ ID NO: 945731 - DNA, 22 bp, Artificial Sequence
  chemically synthesized
tttcttctgagacggagttttg

SEQ ID NO: 945732 - DNA, 22 bp, Artificial Sequence
  chemically synthesized
ttcttctgagacggagttttgc

SEQ ID NO: 945733 - DNA, 22 bp, Artificial Sequence
  chemically synthesized
tcttctgagacggagttttgct

SEQ ID NO: 945734 - DNA, 22 bp, Artificial Sequence
  chemically synthesized
cttctgagacggagttttgctc

SEQ ID NO: 945735 - DNA, 22 bp, Artificial Sequence
  chemically synthesized
ttctgagacggagttttgctct

SEQ ID NO: 945736 - DNA, 22 bp, Artificial Sequence
  chemically synthesized
ctgagacggagttttgctcttg

SEQ ID NO: 945737 - DNA, 22 bp, Artificial Sequence
  chemically synthesized
cagcctgggcgacaagagcaaa

SEQ ID NO: 945738 - DNA, 22 bp, Artificial Sequence
  chemically synthesized
tgagacggagttttgctcttgt

SEQ ID NO: 945739 - DNA, 22 bp, Artificial Sequence
  chemically synthesized
agacggagttttgctcttgtcg

SEQ ID NO: 945740 - DNA, 22 bp, Artificial Sequence
  chemically synthesized
cactccagcctgggcgacaaga

SEQ ID NO: 945741 - DNA, 22 bp, Artificial Sequence
  chemically synthesized
tgctcttgtcgcccaggctgga

SEQ ID NO: 945742 - DNA, 22 bp, Artificial Sequence
  chemically synthesized
gctcttgtcgcccaggctggag

SEQ ID NO: 945743 - DNA, 22 bp, Artificial Sequence
  chemically synthesized
ctcttgtcgcccaggctggagt

SEQ ID NO: 945744 - DNA, 22 bp, Artificial Sequence
  chemically synthesized
ttgtcgcccaggctggagtgca

SEQ ID NO: 945745 - DNA, 22 bp, Artificial Sequence
  chemically synthesized
gtcgcccaggctggagtgcaat

SEQ ID NO: 945746 - DNA, 22 bp, Artificial Sequence
  chemically synthesized
tcgcccaggctggagtgcaatg

SEQ ID NO: 945747 - DNA, 22 bp, Artificial Sequence
  chemically synthesized
cagtgagccgagatcgtgccat

SEQ ID NO: 945748 - DNA, 22 bp, Artificial Sequence
  chemically synthesized
gcagtgagccgagatcgtgcca

SEQ ID NO: 945749 - DNA, 22 bp, Artificial Sequence
  chemically synthesized
gagtgcaatggcacgatctcgg

SEQ ID NO: 945750 - DNA, 22 bp, Artificial Sequence
  chemically synthesized
aacccgggaggcggagtttgca

SEQ ID NO: 945751 - DNA, 22 bp, Artificial Sequence
  chemically synthesized
gaacccgggaggcggagtttgc

SEQ ID NO: 945752 - DNA, 22 bp, Artificial Sequence
  chemically synthesized
ggctcactgcaaactccgcctc

SEQ ID NO: 945753 - DNA, 22 bp, Artificial Sequence
  chemically synthesized
actgcaaactccgcctcccggg

SEQ ID NO: 945754 - DNA, 22 bp, Artificial Sequence
  chemically synthesized
caaactccgcctcccgggttca

SEQ ID NO: 945755 - DNA, 22 bp, Artificial Sequence
  chemically synthesized
aggtaggagaatcacttgaacc

SEQ ID NO: 945756 - DNA, 22 bp, Artificial Sequence
  chemically synthesized
cgcctcccgggttcaagtgatt

SEQ ID NO: 945757 - DNA, 22 bp, Artificial Sequence
  chemically synthesized
ccgggttcaagtgattctccta

SEQ ID NO: 945758 - DNA, 22 bp, Artificial Sequence
  chemically synthesized
gggaggctgaggtaggagaatc

SEQ ID NO: 945759 - DNA, 22 bp, Artificial Sequence
  chemically synthesized
ctcgggaggctgaggtaggaga

SEQ ID NO: 945760 - DNA, 22 bp, Artificial Sequence
  chemically synthesized
aagtgattctcctacctcagcc

SEQ ID NO: 945761 - DNA, 22 bp, Artificial Sequence
  chemically synthesized
agctactcgggaggctgaggta

SEQ ID NO: 945762 - DNA, 22 bp, Artificial Sequence
  chemically synthesized
taatctcagctactcgggaggc

SEQ ID NO: 945763 - DNA, 22 bp, Artificial Sequence
  chemically synthesized
tcctacctcagcctcccgagta

SEQ ID NO: 945764 - DNA, 22 bp, Artificial Sequence
  chemically synthesized
ctacctcagcctcccgagtagc

SEQ ID NO: 945765 - DNA, 22 bp, Artificial Sequence
  chemically synthesized
cctcagcctcccgagtagctga

SEQ ID NO: 945766 - DNA, 22 bp, Artificial Sequence
  chemically synthesized
agcctcccgagtagctgagatt

SEQ ID NO: 945767 - DNA, 22 bp, Artificial Sequence
  chemically synthesized
ccgagtagctgagattacaggt

SEQ ID NO: 945768 - DNA, 22 bp, Artificial Sequence
  chemically synthesized
ggcgtggtggcacgcacctgta

SEQ ID NO: 945769 - DNA, 22 bp, Artificial Sequence
  chemically synthesized
gctgggcgtggtggcacgcacc

SEQ ID NO: 945770 - DNA, 22 bp, Artificial Sequence
  chemically synthesized
agattacaggtgcgtgccacca

SEQ ID NO: 945771 - DNA, 22 bp, Artificial Sequence
  chemically synthesized
caggtgcgtgccaccacgccca

SEQ ID NO: 945772 - DNA, 22 bp, Artificial Sequence
  chemically synthesized
aaaatagtaaaattagctgggc

SEQ ID NO: 945773 - DNA, 22 bp, Artificial Sequence
  chemically synthesized
ctaaaaatagtaaaattagctg

SEQ ID NO: 945774 - DNA, 22 bp, Artificial Sequence
  chemically synthesized
actaaaaatagtaaaattagct

SEQ ID NO: 945775 - DNA, 22 bp, Artificial Sequence
  chemically synthesized
tactaaaaatagtaaaattagc

SEQ ID NO: 945776 - DNA, 22 bp, Artificial Sequence
  chemically synthesized
attttactatttttagtaaaga

SEQ ID NO: 945777 - DNA, 22 bp, Artificial Sequence
  chemically synthesized
tactatttttagtaaagacggg

SEQ ID NO: 945778 - DNA, 22 bp, Artificial Sequence
  chemically synthesized
actatttttagtaaagacgggg

SEQ ID NO: 945779 - DNA, 22 bp, Artificial Sequence
  chemically synthesized
ctatttttagtaaagacggggt

SEQ ID NO: 945780 - DNA, 22 bp, Artificial Sequence
  chemically synthesized
gccaacatggtgagaccccgtc

SEQ ID NO: 945781 - DNA, 22 bp, Artificial Sequence
  chemically synthesized
tttttagtaaagacggggtctc

SEQ ID NO: 945782 - DNA, 22 bp, Artificial Sequence
  chemically synthesized
ttagtaaagacggggtctcacc

SEQ ID NO: 945783 - DNA, 22 bp, Artificial Sequence
  chemically synthesized
tagtaaagacggggtctcacca

SEQ ID NO: 945784 - DNA, 22 bp, Artificial Sequence
  chemically synthesized
agtaaagacggggtctcaccat

SEQ ID NO: 945785 - DNA, 22 bp, Artificial Sequence
  chemically synthesized
gtaaagacggggtctcaccatg

SEQ ID NO: 945786 - DNA, 22 bp, Artificial Sequence
  chemically synthesized
agaccatcctggccaacatggt

SEQ ID NO: 945787 - DNA, 22 bp, Artificial Sequence
  chemically synthesized
accatgttggccaggatggtct

SEQ ID NO: 945788 - DNA, 22 bp, Artificial Sequence
  chemically synthesized
gccaggatggtctcaatctctt

SEQ ID NO: 945789 - DNA, 22 bp, Artificial Sequence
  chemically synthesized
aatctcttgacctcatgatccg

SEQ ID NO: 945790 - DNA, 22 bp, Artificial Sequence
  chemically synthesized
aggaggccgaggcgggcggatc

SEQ ID NO: 945791 - DNA, 22 bp, Artificial Sequence
  chemically synthesized
caggaggccgaggcgggcggat

SEQ ID NO: 945792 - DNA, 22 bp, Artificial Sequence
  chemically synthesized
ttgacctcatgatccgcccgcc

SEQ ID NO: 945793 - DNA, 22 bp, Artificial Sequence
  chemically synthesized
gacctcatgatccgcccgcctc

SEQ ID NO: 945794 - DNA, 22 bp, Artificial Sequence
  chemically synthesized
acctcatgatccgcccgcctcg

SEQ ID NO: 945795 - DNA, 22 bp, Artificial Sequence
  chemically synthesized
agcgcttcaggaggccgaggcg

SEQ ID NO: 945796 - DNA, 22 bp, Artificial Sequence
  chemically synthesized
atgatccgcccgcctcggcctc

SEQ ID NO: 945797 - DNA, 22 bp, Artificial Sequence
  chemically synthesized
taatctcagcgcttcaggaggc

SEQ ID NO: 945798 - DNA, 22 bp, Artificial Sequence
  chemically synthesized
atgcctgtaatctcagcgcttc

SEQ ID NO: 945799 - DNA, 22 bp, Artificial Sequence
  chemically synthesized
ggcctcctgaagcgctgagatt

SEQ ID NO: 945800 - DNA, 22 bp, Artificial Sequence
  chemically synthesized
ctgaagcgctgagattacaggc

SEQ ID NO: 945801 - DNA, 22 bp, Artificial Sequence
  chemically synthesized
aagcgctgagattacaggcatg

SEQ ID NO: 945802 - DNA, 22 bp, Artificial Sequence
  chemically synthesized
gccgggcgcagtagctcatgcc

SEQ ID NO: 945803 - DNA, 22 bp, Artificial Sequence
  chemically synthesized
tggccgggcgcagtagctcatg

SEQ ID NO: 945804 - DNA, 22 bp, Artificial Sequence
  chemically synthesized
agattacaggcatgagctactg

SEQ ID NO: 945805 - DNA, 22 bp, Artificial Sequence
  chemically synthesized
caggcatgagctactgcgcccg

SEQ ID NO: 945806 - DNA, 22 bp, Artificial Sequence
  chemically synthesized
taccaagttctggccgggcgca

SEQ ID NO: 945807 - DNA, 22 bp, Artificial Sequence
  chemically synthesized
ctgcgcccggccagaacttggt

SEQ ID NO: 945808 - DNA, 22 bp, Artificial Sequence
  chemically synthesized
cgcccggccagaacttggtata

SEQ ID NO: 945809 - DNA, 22 bp, Artificial Sequence
  chemically synthesized
caaagaaagtgaatggaagaat

SEQ ID NO: 945810 - DNA, 22 bp, Artificial Sequence
  chemically synthesized
ggtataattcttccattcactt

SEQ ID NO: 945811 - DNA, 22 bp, Artificial Sequence
  chemically synthesized
gtataattcttccattcacttt

SEQ ID NO: 945812 - DNA, 22 bp, Artificial Sequence
  chemically synthesized
cgaagttgcaaagaaagtgaat

SEQ ID NO: 945813 - DNA, 22 bp, Artificial Sequence
  chemically synthesized
ccgaagttgcaaagaaagtgaa

SEQ ID NO: 945814 - DNA, 22 bp, Artificial Sequence
  chemically synthesized
tccgaagttgcaaagaaagtga

SEQ ID NO: 945815 - DNA, 22 bp, Artificial Sequence
  chemically synthesized
ttccgaagttgcaaagaaagtg

SEQ ID NO: 945816 - DNA, 22 bp, Artificial Sequence
  chemically synthesized
ttccattcactttctttgcaac

SEQ ID NO: 945817 - DNA, 22 bp, Artificial Sequence
  chemically synthesized
ccattcactttctttgcaactt

SEQ ID NO: 945818 - DNA, 22 bp, Artificial Sequence
  chemically synthesized
gaaatttttccgaagttgcaaa

SEQ ID NO: 945819 - DNA, 22 bp, Artificial Sequence
  chemically synthesized
cattcactttctttgcaacttc

SEQ ID NO: 945820 - DNA, 22 bp, Artificial Sequence
  chemically synthesized
actttctttgcaacttcggaaa

SEQ ID NO: 945821 - DNA, 22 bp, Artificial Sequence
  chemically synthesized
ataagttagaaatttttccgaa

SEQ ID NO: 945822 - DNA, 22 bp, Artificial Sequence
  chemically synthesized
tctttgcaacttcggaaaaatt

SEQ ID NO: 945823 - DNA, 22 bp, Artificial Sequence
  chemically synthesized
ctttgcaacttcggaaaaattt

SEQ ID NO: 945824 - DNA, 22 bp, Artificial Sequence
  chemically synthesized
tttgcaacttcggaaaaatttc

SEQ ID NO: 945825 - DNA, 22 bp, Artificial Sequence
  chemically synthesized
tgcaacttcggaaaaatttcta

SEQ ID NO: 945826 - DNA, 22 bp, Artificial Sequence
  chemically synthesized
atgttcataagttagaaatttt

SEQ ID NO: 945827 - DNA, 22 bp, Artificial Sequence
  chemically synthesized
gcaacttcggaaaaatttctaa

SEQ ID NO: 945828 - DNA, 22 bp, Artificial Sequence
  chemically synthesized
caacttcggaaaaatttctaac

SEQ ID NO: 945829 - DNA, 22 bp, Artificial Sequence
  chemically synthesized
cggaaaaatttctaacttatga

SEQ ID NO: 945830 - DNA, 22 bp, Artificial Sequence
  chemically synthesized
ggaaaaatttctaacttatgaa

SEQ ID NO: 945831 - DNA, 22 bp, Artificial Sequence
  chemically synthesized
agaaaactgatgttcataagtt

SEQ ID NO: 945832 - DNA, 22 bp, Artificial Sequence
  chemically synthesized
ctaacttatgaacatcagtttt

SEQ ID NO: 945833 - DNA, 22 bp, Artificial Sequence
  chemically synthesized
taacttatgaacatcagttttc

SEQ ID NO: 945834 - DNA, 22 bp, Artificial Sequence
  chemically synthesized
tacagtaattgagaaaactgat

SEQ ID NO: 945835 - DNA, 22 bp, Artificial Sequence
  chemically synthesized
acttatgaacatcagttttctc

SEQ ID NO: 945836 - DNA, 22 bp, Artificial Sequence
  chemically synthesized
ttatacagtaattgagaaaact

SEQ ID NO: 945837 - DNA, 22 bp, Artificial Sequence
  chemically synthesized
atgaacatcagttttctcaatt

SEQ ID NO: 945838 - DNA, 22 bp, Artificial Sequence
  chemically synthesized
tgaacatcagttttctcaatta

SEQ ID NO: 945839 - DNA, 22 bp, Artificial Sequence
  chemically synthesized
tctcaattactgtataataact

SEQ ID NO: 945840 - DNA, 22 bp, Artificial Sequence
  chemically synthesized
ctcaattactgtataataacta

SEQ ID NO: 945841 - DNA, 22 bp, Artificial Sequence
  chemically synthesized
aaagtgatagcatagttattat

SEQ ID NO: 945842 - DNA, 22 bp, Artificial Sequence
  chemically synthesized
tcaattactgtataataactat

SEQ ID NO: 945843 - DNA, 22 bp, Artificial Sequence
  chemically synthesized
caaagtgatagcatagttatta

SEQ ID NO: 945844 - DNA, 22 bp, Artificial Sequence
  chemically synthesized
aattactgtataataactatgc

SEQ ID NO: 945845 - DNA, 22 bp, Artificial Sequence
  chemically synthesized
ctgtataataactatgctatca

SEQ ID NO: 945846 - DNA, 22 bp, Artificial Sequence
  chemically synthesized
ggaatccttcaaagtgatagca

SEQ ID NO: 945847 - DNA, 22 bp, Artificial Sequence
  chemically synthesized
tataataactatgctatcactt

SEQ ID NO: 945848 - DNA, 22 bp, Artificial Sequence
  chemically synthesized
ctaggaatccttcaaagtgata

SEQ ID NO: 945849 - DNA, 22 bp, Artificial Sequence
  chemically synthesized
atgctcctaggaatccttcaaa

SEQ ID NO: 945850 - DNA, 22 bp, Artificial Sequence
  chemically synthesized
aatgctcctaggaatccttcaa

SEQ ID NO: 945851 - DNA, 22 bp, Artificial Sequence
  chemically synthesized
tgctatcactttgaaggattcc

SEQ ID NO: 945852 - DNA, 22 bp, Artificial Sequence
  chemically synthesized
catttaatgctcctaggaatcc

SEQ ID NO: 945853 - DNA, 22 bp, Artificial Sequence
  chemically synthesized
tcactttgaaggattcctagga

SEQ ID NO: 945854 - DNA, 22 bp, Artificial Sequence
  chemically synthesized
tgaaggattcctaggagcatta

SEQ ID NO: 945855 - DNA, 22 bp, Artificial Sequence
  chemically synthesized
gaaggattcctaggagcattaa

SEQ ID NO: 945856 - DNA, 22 bp, Artificial Sequence
  chemically synthesized
aaggattcctaggagcattaaa

SEQ ID NO: 945857 - DNA, 22 bp, Artificial Sequence
  chemically synthesized
ctaggagcattaaatgtagggt

SEQ ID NO: 945858 - DNA, 22 bp, Artificial Sequence
  chemically synthesized
cagtaggacaggcaccctacat

SEQ ID NO: 945859 - DNA, 22 bp, Artificial Sequence
  chemically synthesized
ggagcattaaatgtagggtgcc

SEQ ID NO: 945860 - DNA, 22 bp, Artificial Sequence
  chemically synthesized
gatacctgcagtaggacaggca

SEQ ID NO: 945861 - DNA, 22 bp, Artificial Sequence
  chemically synthesized
agatacctgcagtaggacaggc

SEQ ID NO: 945862 - DNA, 22 bp, Artificial Sequence
  chemically synthesized
aatgtagggtgcctgtcctact

SEQ ID NO: 945863 - DNA, 22 bp, Artificial Sequence
  chemically synthesized
tcctactgcaggtatctaagac

SEQ ID NO: 945864 - DNA, 22 bp, Artificial Sequence
  chemically synthesized
ctgcaggtatctaagacctggg

SEQ ID NO: 945865 - DNA, 22 bp, Artificial Sequence
  chemically synthesized
agatgataataccccccaggtc

SEQ ID NO: 945866 - DNA, 22 bp, Artificial Sequence
  chemically synthesized
caggtatctaagacctgggggg

SEQ ID NO: 945867 - DNA, 22 bp, Artificial Sequence
  chemically synthesized
agacctggggggtattatcatc

SEQ ID NO: 945868 - DNA, 22 bp, Artificial Sequence
  chemically synthesized
atgataaactaagatgataata

SEQ ID NO: 945869 - DNA, 22 bp, Artificial Sequence
  chemically synthesized
gatgataaactaagatgataat

SEQ ID NO: 945870 - DNA, 22 bp, Artificial Sequence
  chemically synthesized
tttgatgataaactaagatgat

SEQ ID NO: 945871 - DNA, 22 bp, Artificial Sequence
  chemically synthesized
gggggtattatcatcttagttt

SEQ ID NO: 945872 - DNA, 22 bp, Artificial Sequence
  chemically synthesized
gcattatttgatgataaactaa

SEQ ID NO: 945873 - DNA, 22 bp, Artificial Sequence
  chemically synthesized
tagcattatttgatgataaact

SEQ ID NO: 945874 - DNA, 22 bp, Artificial Sequence
  chemically synthesized
tctagcattatttgatgataaa

SEQ ID NO: 945875 - DNA, 22 bp, Artificial Sequence
  chemically synthesized
ctctagcattatttgatgataa

SEQ ID NO: 945876 - DNA, 22 bp, Artificial Sequence
  chemically synthesized
tcatcttagtttatcatcaaat

SEQ ID NO: 945877 - DNA, 22 bp, Artificial Sequence
  chemically synthesized
cttctctagcattatttgatga

SEQ ID NO: 945878 - DNA, 22 bp, Artificial Sequence
  chemically synthesized
ccttctctagcattatttgatg

SEQ ID NO: 945879 - DNA, 22 bp, Artificial Sequence
  chemically synthesized
gtttccttctctagcattattt

SEQ ID NO: 945880 - DNA, 22 bp, Artificial Sequence
  chemically synthesized
agtttatcatcaaataatgcta

SEQ ID NO: 945881 - DNA, 22 bp, Artificial Sequence
  chemically synthesized
gtttatcatcaaataatgctag

SEQ ID NO: 945882 - DNA, 22 bp, Artificial Sequence
  chemically synthesized
atcatcaaataatgctagagaa

SEQ ID NO: 945883 - DNA, 22 bp, Artificial Sequence
  chemically synthesized
atgctggtttccttctctagca

SEQ ID NO: 945884 - DNA, 22 bp, Artificial Sequence
  chemically synthesized
tcatcaaataatgctagagaag

SEQ ID NO: 945885 - DNA, 22 bp, Artificial Sequence
  chemically synthesized
gagaaggaaaccagcattagtt

SEQ ID NO: 945886 - DNA, 22 bp, Artificial Sequence
  chemically synthesized
gtgaagagggtagaacagcaga

SEQ ID NO: 945887 - DNA, 22 bp, Artificial Sequence
  chemically synthesized
ttagtgaagagggtagaacagc

SEQ ID NO: 945888 - DNA, 22 bp, Artificial Sequence
  chemically synthesized
tgttagtgaagagggtagaaca

SEQ ID NO: 945889 - DNA, 22 bp, Artificial Sequence
  chemically synthesized
gttctgctgttctaccctcttc

SEQ ID NO: 945890 - DNA, 22 bp, Artificial Sequence
  chemically synthesized
tcaaattctgttagtgaagagg

SEQ ID NO: 945891 - DNA, 22 bp, Artificial Sequence
  chemically synthesized
tgctgttctaccctcttcacta

SEQ ID NO: 945892 - DNA, 22 bp, Artificial Sequence
  chemically synthesized
ctgttctaccctcttcactaac

SEQ ID NO: 945893 - DNA, 22 bp, Artificial Sequence
  chemically synthesized
ttctaccctcttcactaacaga

SEQ ID NO: 945894 - DNA, 22 bp, Artificial Sequence
  chemically synthesized
taccctcttcactaacagaatt

SEQ ID NO: 945895 - DNA, 22 bp, Artificial Sequence
  chemically synthesized
ccctcttcactaacagaatttg

SEQ ID NO: 945896 - DNA, 22 bp, Artificial Sequence
  chemically synthesized
aaatgtagattatcaaattctg

SEQ ID NO: 945897 - DNA, 22 bp, Artificial Sequence
  chemically synthesized
ttcactaacagaatttgataat

SEQ ID NO: 945898 - DNA, 22 bp, Artificial Sequence
  chemically synthesized
actcaaatgtagattatcaaat

SEQ ID NO: 945899 - DNA, 22 bp, Artificial Sequence
  chemically synthesized
cactaacagaatttgataatct

SEQ ID NO: 945900 - DNA, 22 bp, Artificial Sequence
  chemically synthesized
actaacagaatttgataatcta

SEQ ID NO: 945901 - DNA, 22 bp, Artificial Sequence
  chemically synthesized
acagaatttgataatctacatt

SEQ ID NO: 945902 - DNA, 22 bp, Artificial Sequence
  chemically synthesized
gaggtctcactcaaatgtagat

SEQ ID NO: 945903 - DNA, 22 bp, Artificial Sequence
  chemically synthesized
agaggtctcactcaaatgtaga

SEQ ID NO: 945904 - DNA, 22 bp, Artificial Sequence
  chemically synthesized
tttagaggtctcactcaaatgt

SEQ ID NO: 945905 - DNA, 22 bp, Artificial Sequence
  chemically synthesized
ttatttagaggtctcactcaaa

SEQ ID NO: 945906 - DNA, 22 bp, Artificial Sequence
  chemically synthesized
gataatctacatttgagtgaga

SEQ ID NO: 945907 - DNA, 22 bp, Artificial Sequence
  chemically synthesized
ataatctacatttgagtgagac

SEQ ID NO: 945908 - DNA, 22 bp, Artificial Sequence
  chemically synthesized
tattatttagaggtctcactca

SEQ ID NO: 945909 - DNA, 22 bp, Artificial Sequence
  chemically synthesized
ctattatttagaggtctcactc

SEQ ID NO: 945910 - DNA, 22 bp, Artificial Sequence
  chemically synthesized
catttgagtgagacctctaaat

SEQ ID NO: 945911 - DNA, 22 bp, Artificial Sequence
  chemically synthesized
catgtcttctattatttagagg

SEQ ID NO: 945912 - DNA, 22 bp, Artificial Sequence
  chemically synthesized
gagtgagacctctaaataatag

SEQ ID NO: 945913 - DNA, 22 bp, Artificial Sequence
  chemically synthesized
gctgcatgtcttctattattta

SEQ ID NO: 945914 - DNA, 22 bp, Artificial Sequence
  chemically synthesized
agtgagacctctaaataataga

SEQ ID NO: 945915 - DNA, 22 bp, Artificial Sequence
  chemically synthesized
tgactagctgcatgtcttctat

SEQ ID NO: 945916 - DNA, 22 bp, Artificial Sequence
  chemically synthesized
taaataatagaagacatgcagc

SEQ ID NO: 945917 - DNA, 22 bp, Artificial Sequence
  chemically synthesized
aataatagaagacatgcagcta

SEQ ID NO: 945918 - DNA, 22 bp, Artificial Sequence
  chemically synthesized
acagagtgagacatacacgtcg

SEQ ID NO: 945919 - DNA, 22 bp, Artificial Sequence
  chemically synthesized
gtcacaatatcgacgtgtatgt

SEQ ID NO: 945920 - DNA, 22 bp, Artificial Sequence
  chemically synthesized
ttgacagagtgagacatacacg

SEQ ID NO: 945921 - DNA, 22 bp, Artificial Sequence
  chemically synthesized
attgacagagtgagacatacac

SEQ ID NO: 945922 - DNA, 22 bp, Artificial Sequence
  chemically synthesized
tattgacagagtgagacataca

SEQ ID NO: 945923 - DNA, 22 bp, Artificial Sequence
  chemically synthesized
taagtgcagttttattgacaga

SEQ ID NO: 945924 - DNA, 22 bp, Artificial Sequence
  chemically synthesized
gtaagtgcagttttattgacag

SEQ ID NO: 945925 - DNA, 22 bp, Artificial Sequence
  chemically synthesized
tgtaagtgcagttttattgaca

SEQ ID NO: 945926 - DNA, 22 bp, Artificial Sequence
  chemically synthesized
ttgtaagtgcagttttattgac

SEQ ID NO: 945927 - DNA, 22 bp, Artificial Sequence
  chemically synthesized
tttttgtaagtgcagttttatt

SEQ ID NO: 945928 - DNA, 22 bp, Artificial Sequence
  chemically synthesized
tgtttttgtaagtgcagtttta

SEQ ID NO: 945929 - DNA, 22 bp, Artificial Sequence
  chemically synthesized
ctgtttttgtaagtgcagtttt

SEQ ID NO: 945930 - DNA, 22 bp, Artificial Sequence
  chemically synthesized
actctgtcaataaaactgcact

SEQ ID NO: 945931 - DNA, 22 bp, Artificial Sequence
  chemically synthesized
tctgtttttgtaagtgcagttt

SEQ ID NO: 945932 - DNA, 22 bp, Artificial Sequence
  chemically synthesized
ttctgtttttgtaagtgcagtt

SEQ ID NO: 945933 - DNA, 22 bp, Artificial Sequence
  chemically synthesized
tgtcaataaaactgcacttaca

SEQ ID NO: 945934 - DNA, 22 bp, Artificial Sequence
  chemically synthesized
cttttctgtttttgtaagtgca

SEQ ID NO: 945935 - DNA, 22 bp, Artificial Sequence
  chemically synthesized
gcttttctgtttttgtaagtgc

SEQ ID NO: 945936 - DNA, 22 bp, Artificial Sequence
  chemically synthesized
tcaataaaactgcacttacaaa

SEQ ID NO: 945937 - DNA, 22 bp, Artificial Sequence
  chemically synthesized
tgcttttctgtttttgtaagtg

SEQ ID NO: 945938 - DNA, 22 bp, Artificial Sequence
  chemically synthesized
ttgcttttctgtttttgtaagt

SEQ ID NO: 945939 - DNA, 22 bp, Artificial Sequence
  chemically synthesized
tttgcttttctgtttttgtaag

SEQ ID NO: 945940 - DNA, 22 bp, Artificial Sequence
  chemically synthesized
cacttacaaaaacagaaaagca

SEQ ID NO: 945941 - DNA, 22 bp, Artificial Sequence
  chemically synthesized
taaataaaatattttttgcttt

SEQ ID NO: 945942 - DNA, 22 bp, Artificial Sequence
  chemically synthesized
acaaaaacagaaaagcaaaaaa

SEQ ID NO: 945943 - DNA, 22 bp, Artificial Sequence
  chemically synthesized
caaaaacagaaaagcaaaaaat

SEQ ID NO: 945944 - DNA, 22 bp, Artificial Sequence
  chemically synthesized
acattataaataaaatattttt

SEQ ID NO: 945945 - DNA, 22 bp, Artificial Sequence
  chemically synthesized
aacattataaataaaatatttt

SEQ ID NO: 945946 - DNA, 22 bp, Artificial Sequence
  chemically synthesized
taacattataaataaaatattt

SEQ ID NO: 945947 - DNA, 22 bp, Artificial Sequence
  chemically synthesized
ctttaacattataaataaaata

SEQ ID NO: 945948 - DNA, 22 bp, Artificial Sequence
  chemically synthesized
cctttaacattataaataaaat

SEQ ID NO: 945949 - DNA, 22 bp, Artificial Sequence
  chemically synthesized
ttcctttaacattataaataaa

SEQ ID NO: 945950 - DNA, 22 bp, Artificial Sequence
  chemically synthesized
tcttcctttaacattataaata

SEQ ID NO: 945951 - DNA, 22 bp, Artificial Sequence
  chemically synthesized
tatttataatgttaaaggaaga

SEQ ID NO: 945952 - DNA, 22 bp, Artificial Sequence
  chemically synthesized
ggagcaccattctcttccttta

SEQ ID NO: 945953 - DNA, 22 bp, Artificial Sequence
  chemically synthesized
atttataatgttaaaggaagag

SEQ ID NO: 945954 - DNA, 22 bp, Artificial Sequence
  chemically synthesized
aggagcaccattctcttccttt

SEQ ID NO: 945955 - DNA, 22 bp, Artificial Sequence
  chemically synthesized
tttataatgttaaaggaagaga

SEQ ID NO: 945956 - DNA, 22 bp, Artificial Sequence
  chemically synthesized
taggagcaccattctcttcctt

SEQ ID NO: 945957 - DNA, 22 bp, Artificial Sequence
  chemically synthesized
ttaggagcaccattctcttcct

SEQ ID NO: 945958 - DNA, 22 bp, Artificial Sequence
  chemically synthesized
tttaggagcaccattctcttcc

SEQ ID NO: 945959 - DNA, 22 bp, Artificial Sequence
  chemically synthesized
ataatgttaaaggaagagaatg

SEQ ID NO: 945960 - DNA, 22 bp, Artificial Sequence
  chemically synthesized
taatgttaaaggaagagaatgg

SEQ ID NO: 945961 - DNA, 22 bp, Artificial Sequence
  chemically synthesized
tttttaggagcaccattctctt

SEQ ID NO: 945962 - DNA, 22 bp, Artificial Sequence
  chemically synthesized
ctttttaggagcaccattctct

SEQ ID NO: 945963 - DNA, 22 bp, Artificial Sequence
  chemically synthesized
tctttttaggagcaccattctc

SEQ ID NO: 945964 - DNA, 22 bp, Artificial Sequence
  chemically synthesized
ttctttttaggagcaccattct

SEQ ID NO: 945965 - DNA, 22 bp, Artificial Sequence
  chemically synthesized
aaggaagagaatggtgctccta

SEQ ID NO: 945966 - DNA, 22 bp, Artificial Sequence
  chemically synthesized
tgtcccttttctttttaggagc

SEQ ID NO: 945967 - DNA, 22 bp, Artificial Sequence
  chemically synthesized
atgtcccttttctttttaggag

SEQ ID NO: 945968 - DNA, 22 bp, Artificial Sequence
  chemically synthesized
acatatttatgtcccttttctt

SEQ ID NO: 945969 - DNA, 22 bp, Artificial Sequence
  chemically synthesized
aacatatttatgtcccttttct

SEQ ID NO: 945970 - DNA, 22 bp, Artificial Sequence
  chemically synthesized
ctaaaaagaaaagggacataaa

SEQ ID NO: 945971 - DNA, 22 bp, Artificial Sequence
  chemically synthesized
aaaagaaaagggacataaatat

SEQ ID NO: 945972 - DNA, 22 bp, Artificial Sequence
  chemically synthesized
tgtcaatttaacatatttatgt

SEQ ID NO: 945973 - DNA, 22 bp, Artificial Sequence
  chemically synthesized
atgtcaatttaacatatttatg

SEQ ID NO: 945974 - DNA, 22 bp, Artificial Sequence
  chemically synthesized
acatatttatgtcaatttaaca

SEQ ID NO: 945975 - DNA, 22 bp, Artificial Sequence
  chemically synthesized
gacatatttatgtcaatttaac

SEQ ID NO: 945976 - DNA, 22 bp, Artificial Sequence
  chemically synthesized
ttgacatatttatgtcaattta

SEQ ID NO: 945977 - DNA, 22 bp, Artificial Sequence
  chemically synthesized
ctcttgacatatttatgtcaat

SEQ ID NO: 945978 - DNA, 22 bp, Artificial Sequence
  chemically synthesized
cctcttgacatatttatgtcaa

SEQ ID NO: 945979 - DNA, 22 bp, Artificial Sequence
  chemically synthesized
tcctcttgacatatttatgtca

SEQ ID NO: 945980 - DNA, 22 bp, Artificial Sequence
  chemically synthesized
ttttcctcttgacatatttatg

SEQ ID NO: 945981 - DNA, 22 bp, Artificial Sequence
  chemically synthesized
aattgacataaatatgtcaaga

SEQ ID NO: 945982 - DNA, 22 bp, Artificial Sequence
  chemically synthesized
acataaatatgtcaagaggaaa

SEQ ID NO: 945983 - DNA, 22 bp, Artificial Sequence
  chemically synthesized
aaagagaaatgctattttcctc

SEQ ID NO: 945984 - DNA, 22 bp, Artificial Sequence
  chemically synthesized
gtatattcaaagagaaatgcta

SEQ ID NO: 945985 - DNA, 22 bp, Artificial Sequence
  chemically synthesized
ggtatattcaaagagaaatgct

SEQ ID NO: 945986 - DNA, 22 bp, Artificial Sequence
  chemically synthesized
tggtatattcaaagagaaatgc

SEQ ID NO: 945987 - DNA, 22 bp, Artificial Sequence
  chemically synthesized
ttggtatattcaaagagaaatg

SEQ ID NO: 945988 - DNA, 22 bp, Artificial Sequence
  chemically synthesized
tttggtatattcaaagagaaat

SEQ ID NO: 945989 - DNA, 22 bp, Artificial Sequence
  chemically synthesized
tatgtactttttggtatattca

SEQ ID NO: 945990 - DNA, 22 bp, Artificial Sequence
  chemically synthesized
ctctttgaatataccaaaaagt

SEQ ID NO: 945991 - DNA, 22 bp, Artificial Sequence
  chemically synthesized
tctttgaatataccaaaaagta

SEQ ID NO: 945992 - DNA, 22 bp, Artificial Sequence
  chemically synthesized
tgatgttatatgtactttttgg

SEQ ID NO: 945993 - DNA, 22 bp, Artificial Sequence
  chemically synthesized
tttgaatataccaaaaagtaca

SEQ ID NO: 945994 - DNA, 22 bp, Artificial Sequence
  chemically synthesized
tgaatataccaaaaagtacata

SEQ ID NO: 945995 - DNA, 22 bp, Artificial Sequence
  chemically synthesized
gaatataccaaaaagtacatat

SEQ ID NO: 945996 - DNA, 22 bp, Artificial Sequence
  chemically synthesized
aatataccaaaaagtacatata

SEQ ID NO: 945997 - DNA, 22 bp, Artificial Sequence
  chemically synthesized
tgaatagtgctgtgatgttata

SEQ ID NO: 945998 - DNA, 22 bp, Artificial Sequence
  chemically synthesized
ccattgtgaatagtgctgtgat

SEQ ID NO: 945999 - DNA, 22 bp, Artificial Sequence
  chemically synthesized
gccattgtgaatagtgctgtga

SEQ ID NO: 946000 - DNA, 22 bp, Artificial Sequence
  chemically synthesized
tgccattgtgaatagtgctgtg

SEQ ID NO: 946001 - DNA, 22 bp, Artificial Sequence
  chemically synthesized
catgtctttgccattgtgaata

SEQ ID NO: 946002 - DNA, 22 bp, Artificial Sequence
  chemically synthesized
attgcatgtctttgccattgtg

SEQ ID NO: 946003 - DNA, 22 bp, Artificial Sequence
  chemically synthesized
ggttgattgcatgtctttgcca

SEQ ID NO: 946004 - DNA, 22 bp, Artificial Sequence
  chemically synthesized
ttcacaatggcaaagacatgca

SEQ ID NO: 946005 - DNA, 22 bp, Artificial Sequence
  chemically synthesized
acaatggcaaagacatgcaatc

SEQ ID NO: 946006 - DNA, 22 bp, Artificial Sequence
  chemically synthesized
atgggcacctaggttgattgca

SEQ ID NO: 946007 - DNA, 22 bp, Artificial Sequence
  chemically synthesized
tccaccattaatgggcacctag

SEQ ID NO: 946008 - DNA, 22 bp, Artificial Sequence
  chemically synthesized
tcctgtccaccattaatgggca

SEQ ID NO: 946009 - DNA, 22 bp, Artificial Sequence
  chemically synthesized
atcctgtccaccattaatgggc

SEQ ID NO: 946010 - DNA, 22 bp, Artificial Sequence
  chemically synthesized
tatcctgtccaccattaatggg

SEQ ID NO: 946011 - DNA, 22 bp, Artificial Sequence
  chemically synthesized
tttatcctgtccaccattaatg

SEQ ID NO: 946012 - DNA, 22 bp, Artificial Sequence
  chemically synthesized
ggtgcccattaatggtggacag

SEQ ID NO: 946013 - DNA, 22 bp, Artificial Sequence
  chemically synthesized
atggtggacaggataaagaatg

SEQ ID NO: 946014 - DNA, 22 bp, Artificial Sequence
  chemically synthesized
catggtgtatacgcgccacatt

SEQ ID NO: 946015 - DNA, 22 bp, Artificial Sequence
  chemically synthesized
tgtagtattccatggtgtatac

SEQ ID NO: 946016 - DNA, 22 bp, Artificial Sequence
  chemically synthesized
tggctgtgtagtattccatggt

SEQ ID NO: 946017 - DNA, 22 bp, Artificial Sequence
  chemically synthesized
atggctgtgtagtattccatgg

SEQ ID NO: 946018 - DNA, 22 bp, Artificial Sequence
  chemically synthesized
tatggctgtgtagtattccatg

SEQ ID NO: 946019 - DNA, 22 bp, Artificial Sequence
  chemically synthesized
ttatggctgtgtagtattccat

SEQ ID NO: 946020 - DNA, 22 bp, Artificial Sequence
  chemically synthesized
gtttttatggctgtgtagtatt

SEQ ID NO: 946021 - DNA, 22 bp, Artificial Sequence
  chemically synthesized
ttagtttttatggctgtgtagt

SEQ ID NO: 946022 - DNA, 22 bp, Artificial Sequence
  chemically synthesized
gttagtttttatggctgtgtag

SEQ ID NO: 946023 - DNA, 22 bp, Artificial Sequence
  chemically synthesized
tgttagtttttatggctgtgta

SEQ ID NO: 946024 - DNA, 22 bp, Artificial Sequence
  chemically synthesized
cacagccataaaaactaacaaa

SEQ ID NO: 946025 - DNA, 22 bp, Artificial Sequence
  chemically synthesized
cacaggccatgattttgttagt

SEQ ID NO: 946026 - DNA, 22 bp, Artificial Sequence
  chemically synthesized
ttgcacaggccatgattttgtt

SEQ ID NO: 946027 - DNA, 22 bp, Artificial Sequence
  chemically synthesized
catccatgttgttgcacaggcc

SEQ ID NO: 946028 - DNA, 22 bp, Artificial Sequence
  chemically synthesized
acaaaatcatggcctgtgcaac

SEQ ID NO: 946029 - DNA, 22 bp, Artificial Sequence
  chemically synthesized
caattgcatccatgttgttgca

SEQ ID NO: 946030 - DNA, 22 bp, Artificial Sequence
  chemically synthesized
tgcaacaacatggatgcaattg

SEQ ID NO: 946031 - DNA, 22 bp, Artificial Sequence
  chemically synthesized
ggatagtggcctccaattgcat

SEQ ID NO: 946032 - DNA, 22 bp, Artificial Sequence
  chemically synthesized
aggatagtggcctccaattgca

SEQ ID NO: 946033 - DNA, 22 bp, Artificial Sequence
  chemically synthesized
acgtgcttaggatagtggcctc

SEQ ID NO: 946034 - DNA, 22 bp, Artificial Sequence
  chemically synthesized
cgttaacgtgcttaggatagtg

SEQ ID NO: 946035 - DNA, 22 bp, Artificial Sequence
  chemically synthesized
ctgcgttaacgtgcttaggata

SEQ ID NO: 946036 - DNA, 22 bp, Artificial Sequence
  chemically synthesized
ttcctgcgttaacgtgcttagg

SEQ ID NO: 946037 - DNA, 22 bp, Artificial Sequence
  chemically synthesized
gaggccactatcctaagcacgt

SEQ ID NO: 946038 - DNA, 22 bp, Artificial Sequence
  chemically synthesized
tctgttcctgcgttaacgtgct

SEQ ID NO: 946039 - DNA, 22 bp, Artificial Sequence
  chemically synthesized
gttgtctgttcctgcgttaacg

SEQ ID NO: 946040 - DNA, 22 bp, Artificial Sequence
  chemically synthesized
tcctaagcacgttaacgcagga

SEQ ID NO: 946041 - DNA, 22 bp, Artificial Sequence
  chemically synthesized
agcacgttaacgcaggaacaga

SEQ ID NO: 946042 - DNA, 22 bp, Artificial Sequence
  chemically synthesized
acgcaggaacagacaacgagta

SEQ ID NO: 946043 - DNA, 22 bp, Artificial Sequence
  chemically synthesized
agcgagaacatgcagtactcgt

SEQ ID NO: 946044 - DNA, 22 bp, Artificial Sequence
  chemically synthesized
aagcgagaacatgcagtactcg

SEQ ID NO: 946045 - DNA, 22 bp, Artificial Sequence
  chemically synthesized
taagcgagaacatgcagtactc

SEQ ID NO: 946046 - DNA, 22 bp, Artificial Sequence
  chemically synthesized
ttaagcgagaacatgcagtact

SEQ ID NO: 946047 - DNA, 22 bp, Artificial Sequence
  chemically synthesized
ccacttttaagcgagaacatgc

SEQ ID NO: 946048 - DNA, 22 bp, Artificial Sequence
  chemically synthesized
gctcccacttttaagcgagaac

SEQ ID NO: 946049 - DNA, 22 bp, Artificial Sequence
  chemically synthesized
agctcccacttttaagcgagaa

SEQ ID NO: 946050 - DNA, 22 bp, Artificial Sequence
  chemically synthesized
aatgtttagctcccacttttaa

SEQ ID NO: 946051 - DNA, 22 bp, Artificial Sequence
  chemically synthesized
catgttctcgcttaaaagtggg

SEQ ID NO: 946052 - DNA, 22 bp, Artificial Sequence
  chemically synthesized
tcgcttaaaagtgggagctaaa

SEQ ID NO: 946053 - DNA, 22 bp, Artificial Sequence
  chemically synthesized
gcttaaaagtgggagctaaaca

SEQ ID NO: 946054 - DNA, 22 bp, Artificial Sequence
  chemically synthesized
aaaagtgggagctaaacattga

SEQ ID NO: 946055 - DNA, 22 bp, Artificial Sequence
  chemically synthesized
aaagtgggagctaaacattgag

SEQ ID NO: 946056 - DNA, 22 bp, Artificial Sequence
  chemically synthesized
tgtccatgtgcactcaatgttt

SEQ ID NO: 946057 - DNA, 22 bp, Artificial Sequence
  chemically synthesized
atgtccatgtgcactcaatgtt

SEQ ID NO: 946058 - DNA, 22 bp, Artificial Sequence
  chemically synthesized
tatgtccatgtgcactcaatgt

SEQ ID NO: 946059 - DNA, 22 bp, Artificial Sequence
  chemically synthesized
tctttatgtccatgtgcactca

SEQ ID NO: 946060 - DNA, 22 bp, Artificial Sequence
  chemically synthesized
ctgtctttatgtccatgtgcac

SEQ ID NO: 946061 - DNA, 22 bp, Artificial Sequence
  chemically synthesized
ttcctgtctttatgtccatgtg

SEQ ID NO: 946062 - DNA, 22 bp, Artificial Sequence
  chemically synthesized
aacattgagtgcacatggacat

SEQ ID NO: 946063 - DNA, 22 bp, Artificial Sequence
  chemically synthesized
ttgttcctgtctttatgtccat

SEQ ID NO: 946064 - DNA, 22 bp, Artificial Sequence
  chemically synthesized
agtgcacatggacataaagaca

SEQ ID NO: 946065 - DNA, 22 bp, Artificial Sequence
  chemically synthesized
tagtccccagtgtctattgttc

SEQ ID NO: 946066 - DNA, 22 bp, Artificial Sequence
  chemically synthesized
tgtagtccccagtgtctattgt

SEQ ID NO: 946067 - DNA, 22 bp, Artificial Sequence
  chemically synthesized
ctctgtagtccccagtgtctat

SEQ ID NO: 946068 - DNA, 22 bp, Artificial Sequence
  chemically synthesized
cctctgtagtccccagtgtcta

SEQ ID NO: 946069 - DNA, 22 bp, Artificial Sequence
  chemically synthesized
cttcctctgtagtccccagtgt

SEQ ID NO: 946070 - DNA, 22 bp, Artificial Sequence
  chemically synthesized
cctccttcctctgtagtcccca

SEQ ID NO: 946071 - DNA, 22 bp, Artificial Sequence
  chemically synthesized
ctccctccttcctctgtagtcc

SEQ ID NO: 946072 - DNA, 22 bp, Artificial Sequence
  chemically synthesized
cctccctccttcctctgtagtc

SEQ ID NO: 946073 - DNA, 22 bp, Artificial Sequence
  chemically synthesized
ccttcctccctccttcctctgt

SEQ ID NO: 946074 - DNA, 22 bp, Artificial Sequence
  chemically synthesized
ttcccttcctccctccttcctc

SEQ ID NO: 946075 - DNA, 22 bp, Artificial Sequence
  chemically synthesized
gggactacagaggaaggaggga

SEQ ID NO: 946076 - DNA, 22 bp, Artificial Sequence
  chemically synthesized
cctgttcccttcctccctcctt

SEQ ID NO: 946077 - DNA, 22 bp, Artificial Sequence
  chemically synthesized
gcctgttcccttcctccctcct

SEQ ID NO: 946078 - DNA, 22 bp, Artificial Sequence
  chemically synthesized
cagaggaaggagggaggaaggg

SEQ ID NO: 946079 - DNA, 22 bp, Artificial Sequence
  chemically synthesized
aacccttgcctgttcccttcct

SEQ ID NO: 946080 - DNA, 22 bp, Artificial Sequence
  chemically synthesized
caacccttgcctgttcccttcc

SEQ ID NO: 946081 - DNA, 22 bp, Artificial Sequence
  chemically synthesized
ttcaacccttgcctgttccctt

SEQ ID NO: 946082 - DNA, 22 bp, Artificial Sequence
  chemically synthesized
gttcttcaacccttgcctgttc

SEQ ID NO: 946083 - DNA, 22 bp, Artificial Sequence
  chemically synthesized
aagaactagtggttaccatgct

SEQ ID NO: 946084 - DNA, 22 bp, Artificial Sequence
  chemically synthesized
gtggttaccatgctcgctacct

SEQ ID NO: 946085 - DNA, 22 bp, Artificial Sequence
  chemically synthesized
ccatgctcgctacctgggtggt

SEQ ID NO: 946086 - DNA, 22 bp, Artificial Sequence
  chemically synthesized
tatgaatgatcccaccacccag

SEQ ID NO: 946087 - DNA, 22 bp, Artificial Sequence
  chemically synthesized
ctatatgaatgatcccaccacc

SEQ ID NO: 946088 - DNA, 22 bp, Artificial Sequence
  chemically synthesized
gctatatgaatgatcccaccac

SEQ ID NO: 946089 - DNA, 22 bp, Artificial Sequence
  chemically synthesized
gctacctgggtggtgggatcat

SEQ ID NO: 946090 - DNA, 22 bp, Artificial Sequence
  chemically synthesized
cctgggtggtgggatcattcat

SEQ ID NO: 946091 - DNA, 22 bp, Artificial Sequence
  chemically synthesized
ggtggtgggatcattcatatag

SEQ ID NO: 946092 - DNA, 22 bp, Artificial Sequence
  chemically synthesized
gatatagtgcatgatgatgagg

SEQ ID NO: 946093 - DNA, 22 bp, Artificial Sequence
  chemically synthesized
atatagcaaacctcatcatcat

SEQ ID NO: 946094 - DNA, 22 bp, Artificial Sequence
  chemically synthesized
cctggatatagtgcatgatgat

SEQ ID NO: 946095 - DNA, 22 bp, Artificial Sequence
  chemically synthesized
atcatcatgcactatatccagg

SEQ ID NO: 946096 - DNA, 22 bp, Artificial Sequence
  chemically synthesized
agcgggtacatgttccctggat

SEQ ID NO: 946097 - DNA, 22 bp, Artificial Sequence
  chemically synthesized
gattcagcgggtacatgttccc

SEQ ID NO: 946098 - DNA, 22 bp, Artificial Sequence
  chemically synthesized
agattcagcgggtacatgttcc

SEQ ID NO: 946099 - DNA, 22 bp, Artificial Sequence
  chemically synthesized
tagattcagcgggtacatgttc

SEQ ID NO: 946100 - DNA, 22 bp, Artificial Sequence
  chemically synthesized
ttttagattcagcgggtacatg

SEQ ID NO: 946101 - DNA, 22 bp, Artificial Sequence
  chemically synthesized
tatccagggaacatgtacccgc

SEQ ID NO: 946102 - DNA, 22 bp, Artificial Sequence
  chemically synthesized
attttagattcagcgggtacat

SEQ ID NO: 946103 - DNA, 22 bp, Artificial Sequence
  chemically synthesized
tattttagattcagcgggtaca

SEQ ID NO: 946104 - DNA, 22 bp, Artificial Sequence
  chemically synthesized
ttattttagattcagcgggtac

SEQ ID NO: 946105 - DNA, 22 bp, Artificial Sequence
  chemically synthesized
aacttttattttagattcagcg

SEQ ID NO: 946106 - DNA, 22 bp, Artificial Sequence
  chemically synthesized
caacttttattttagattcagc

SEQ ID NO: 946107 - DNA, 22 bp, Artificial Sequence
  chemically synthesized
taatttcaacttttattttaga

SEQ ID NO: 946108 - DNA, 22 bp, Artificial Sequence
  chemically synthesized
ataatttcaacttttattttag

SEQ ID NO: 946109 - DNA, 22 bp, Artificial Sequence
  chemically synthesized
tataatttcaacttttatttta

SEQ ID NO: 946110 - DNA, 22 bp, Artificial Sequence
  chemically synthesized
ttataatttcaacttttatttt

SEQ ID NO: 946111 - DNA, 22 bp, Artificial Sequence
  chemically synthesized
tttataatttcaacttttattt

SEQ ID NO: 946112 - DNA, 22 bp, Artificial Sequence
  chemically synthesized
tttttataatttcaacttttat

SEQ ID NO: 946113 - DNA, 22 bp, Artificial Sequence
  chemically synthesized
ctttttataatttcaactttta

SEQ ID NO: 946114 - DNA, 22 bp, Artificial Sequence
  chemically synthesized
tctttttataatttcaactttt

SEQ ID NO: 946115 - DNA, 22 bp, Artificial Sequence
  chemically synthesized
ttctttttataatttcaacttt

SEQ ID NO: 946116 - DNA, 22 bp, Artificial Sequence
  chemically synthesized
aatctaaaataaaagttgaaat

SEQ ID NO: 946117 - DNA, 22 bp, Artificial Sequence
  chemically synthesized
tttctttttataatttcaactt

SEQ ID NO: 946118 - DNA, 22 bp, Artificial Sequence
  chemically synthesized
ttttctttttataatttcaact

SEQ ID NO: 946119 - DNA, 22 bp, Artificial Sequence
  chemically synthesized
tttttctttttataatttcaac

SEQ ID NO: 946120 - DNA, 22 bp, Artificial Sequence
  chemically synthesized
tttttttctttttataatttca

SEQ ID NO: 946121 - DNA, 22 bp, Artificial Sequence
  chemically synthesized
ctttttttctttttataatttc

SEQ ID NO: 946122 - DNA, 22 bp, Artificial Sequence
  chemically synthesized
aaataaaagttgaaattataaa

SEQ ID NO: 946123 - DNA, 22 bp, Artificial Sequence
  chemically synthesized
tctttttttctttttataattt

SEQ ID NO: 946124 - DNA, 22 bp, Artificial Sequence
  chemically synthesized
gtatgaggttttctttttttct

SEQ ID NO: 946125 - DNA, 22 bp, Artificial Sequence
  chemically synthesized
aaattataaaaagaaaaaaaga

SEQ ID NO: 946126 - DNA, 22 bp, Artificial Sequence
  chemically synthesized
taaaaagaaaaaaagaaaacct

SEQ ID NO: 946127 - DNA, 22 bp, Artificial Sequence
  chemically synthesized
caaagaatgttagtatgaggtt

SEQ ID NO: 946128 - DNA, 22 bp, Artificial Sequence
  chemically synthesized
ccaaagaatgttagtatgaggt

SEQ ID NO: 946129 - DNA, 22 bp, Artificial Sequence
  chemically synthesized
tttccaaagaatgttagtatga

SEQ ID NO: 946130 - DNA, 22 bp, Artificial Sequence
  chemically synthesized
actgtttccaaagaatgttagt

SEQ ID NO: 946131 - DNA, 22 bp, Artificial Sequence
  chemically synthesized
aactgtttccaaagaatgttag

SEQ ID NO: 946132 - DNA, 22 bp, Artificial Sequence
  chemically synthesized
atttaactgtttccaaagaatg

SEQ ID NO: 946133 - DNA, 22 bp, Artificial Sequence
  chemically synthesized
catttaactgtttccaaagaat

SEQ ID NO: 946134 - DNA, 22 bp, Artificial Sequence
  chemically synthesized
atactaacattctttggaaaca

SEQ ID NO: 946135 - DNA, 22 bp, Artificial Sequence
  chemically synthesized
ataatttcatttaactgtttcc

SEQ ID NO: 946136 - DNA, 22 bp, Artificial Sequence
  chemically synthesized
aataatttcatttaactgtttc

SEQ ID NO: 946137 - DNA, 22 bp, Artificial Sequence
  chemically synthesized
taataatttcatttaactgttt

SEQ ID NO: 946138 - DNA, 22 bp, Artificial Sequence
  chemically synthesized
acattctttggaaacagttaaa

SEQ ID NO: 946139 - DNA, 22 bp, Artificial Sequence
  chemically synthesized
ttaataatttcatttaactgtt

SEQ ID NO: 946140 - DNA, 22 bp, Artificial Sequence
  chemically synthesized
tttggaaacagttaaatgaaat

SEQ ID NO: 946141 - DNA, 22 bp, Artificial Sequence
  chemically synthesized
tggaaacagttaaatgaaatta

SEQ ID NO: 946142 - DNA, 22 bp, Artificial Sequence
  chemically synthesized
ggaaacagttaaatgaaattat

SEQ ID NO: 946143 - DNA, 22 bp, Artificial Sequence
  chemically synthesized
gaaacagttaaatgaaattatt

SEQ ID NO: 946144 - DNA, 22 bp, Artificial Sequence
  chemically synthesized
aatgaaattattaaaagtatga

SEQ ID NO: 946145 - DNA, 22 bp, Artificial Sequence
  chemically synthesized
ttaaaagtatgatgatcatgca

SEQ ID NO: 946146 - DNA, 22 bp, Artificial Sequence
  chemically synthesized
agcgaagtacacatgcatgatc

SEQ ID NO: 946147 - DNA, 22 bp, Artificial Sequence
  chemically synthesized
aagcgaagtacacatgcatgat

SEQ ID NO: 946148 - DNA, 22 bp, Artificial Sequence
  chemically synthesized
aaagtatgatgatcatgcatgt

SEQ ID NO: 946149 - DNA, 22 bp, Artificial Sequence
  chemically synthesized
taagcgaagtacacatgcatga

SEQ ID NO: 946150 - DNA, 22 bp, Artificial Sequence
  chemically synthesized
cacccggcccatacataaatat

SEQ ID NO: 946151 - DNA, 22 bp, Artificial Sequence
  chemically synthesized
cgcttaaaatatttatgtatgg

SEQ ID NO: 946152 - DNA, 22 bp, Artificial Sequence
  chemically synthesized
gcttaaaatatttatgtatggg

SEQ ID NO: 946153 - DNA, 22 bp, Artificial Sequence
  chemically synthesized
aaaatatttatgtatgggccgg

SEQ ID NO: 946154 - DNA, 22 bp, Artificial Sequence
  chemically synthesized
aaatatttatgtatgggccggg

SEQ ID NO: 946155 - DNA, 22 bp, Artificial Sequence
  chemically synthesized
catgcatgagccactacacccg

SEQ ID NO: 946156 - DNA, 22 bp, Artificial Sequence
  chemically synthesized
atgtatgggccgggtgtagtgg

SEQ ID NO: 946157 - DNA, 22 bp, Artificial Sequence
  chemically synthesized
tgtatgggccgggtgtagtggc

SEQ ID NO: 946158 - DNA, 22 bp, Artificial Sequence
  chemically synthesized
ggattacatgcatgagccacta

SEQ ID NO: 946159 - DNA, 22 bp, Artificial Sequence
  chemically synthesized
ccacagtgctgggattacatgc

SEQ ID NO: 946160 - DNA, 22 bp, Artificial Sequence
  chemically synthesized
gcctcccacagtgctgggatta

SEQ ID NO: 946161 - DNA, 22 bp, Artificial Sequence
  chemically synthesized
ggcctcccacagtgctgggatt

SEQ ID NO: 946162 - DNA, 22 bp, Artificial Sequence
  chemically synthesized
atgcatgtaatcccagcactgt

SEQ ID NO: 946163 - DNA, 22 bp, Artificial Sequence
  chemically synthesized
gcagtccgcccgccttggcctc

SEQ ID NO: 946164 - DNA, 22 bp, Artificial Sequence
  chemically synthesized
tggcagtccgcccgccttggcc

SEQ ID NO: 946165 - DNA, 22 bp, Artificial Sequence
  chemically synthesized
agctctggcagtccgcccgcct

SEQ ID NO: 946166 - DNA, 22 bp, Artificial Sequence
  chemically synthesized
tgggaggccaaggcgggcggac

SEQ ID NO: 946167 - DNA, 22 bp, Artificial Sequence
  chemically synthesized
ctcagctctggcagtccgcccg

SEQ ID NO: 946168 - DNA, 22 bp, Artificial Sequence
  chemically synthesized
gagttcctcagctctggcagtc

SEQ ID NO: 946169 - DNA, 22 bp, Artificial Sequence
  chemically synthesized
gtctcgagttcctcagctctgg

SEQ ID NO: 946170 - DNA, 22 bp, Artificial Sequence
  chemically synthesized
accaggctggtctcgagttcct

SEQ ID NO: 946171 - DNA, 22 bp, Artificial Sequence
  chemically synthesized
ccagagctgaggaactcgagac

SEQ ID NO: 946172 - DNA, 22 bp, Artificial Sequence
  chemically synthesized
accatgttgaccaggctggtct

SEQ ID NO: 946173 - DNA, 22 bp, Artificial Sequence
  chemically synthesized
caccatgttgaccaggctggtc

SEQ ID NO: 946174 - DNA, 22 bp, Artificial Sequence
  chemically synthesized
aggaactcgagaccagcctggt

SEQ ID NO: 946175 - DNA, 22 bp, Artificial Sequence
  chemically synthesized
gagaccagcctggtcaacatgg

SEQ ID NO: 946176 - DNA, 22 bp, Artificial Sequence
  chemically synthesized
agtagagacagggcttcaccat

SEQ ID NO: 946177 - DNA, 22 bp, Artificial Sequence
  chemically synthesized
cagtagagacagggcttcacca

SEQ ID NO: 946178 - DNA, 22 bp, Artificial Sequence
  chemically synthesized
tcagtagagacagggcttcacc

SEQ ID NO: 946179 - DNA, 22 bp, Artificial Sequence
  chemically synthesized
gtcaacatggtgaagccctgtc

SEQ ID NO: 946180 - DNA, 22 bp, Artificial Sequence
  chemically synthesized
tgttttcagtagagacagggct

SEQ ID NO: 946181 - DNA, 22 bp, Artificial Sequence
  chemically synthesized
gtgttttcagtagagacagggc

SEQ ID NO: 946182 - DNA, 22 bp, Artificial Sequence
  chemically synthesized
tgtgttttcagtagagacaggg

SEQ ID NO: 946183 - DNA, 22 bp, Artificial Sequence
  chemically synthesized
ttgtgttttcagtagagacagg

SEQ ID NO: 946184 - DNA, 22 bp, Artificial Sequence
  chemically synthesized
atttttgtgttttcagtagaga

SEQ ID NO: 946185 - DNA, 22 bp, Artificial Sequence
  chemically synthesized
gctaatttttgtgttttcagta

SEQ ID NO: 946186 - DNA, 22 bp, Artificial Sequence
  chemically synthesized
tctctactgaaaacacaaaaat

SEQ ID NO: 946187 - DNA, 22 bp, Artificial Sequence
  chemically synthesized
tactgaaaacacaaaaattagc

SEQ ID NO: 946188 - DNA, 22 bp, Artificial Sequence
  chemically synthesized
ctgaaaacacaaaaattagcca

SEQ ID NO: 946189 - DNA, 22 bp, Artificial Sequence
  chemically synthesized
aaaacacaaaaattagccaggc

SEQ ID NO: 946190 - DNA, 22 bp, Artificial Sequence
  chemically synthesized
ggataataggtgcccaccacca

SEQ ID NO: 946191 - DNA, 22 bp, Artificial Sequence
  chemically synthesized
gccaggcatggtggtgggcacc

SEQ ID NO: 946192 - DNA, 22 bp, Artificial Sequence
  chemically synthesized
cgaagtacctgggataataggt

SEQ ID NO: 946193 - DNA, 22 bp, Artificial Sequence
  chemically synthesized
agcctccgaagtacctgggata

SEQ ID NO: 946194 - DNA, 22 bp, Artificial Sequence
  chemically synthesized
cctcagcctccgaagtacctgg

SEQ ID NO: 946195 - DNA, 22 bp, Artificial Sequence
  chemically synthesized
ccctgcctcagcctccgaagta

SEQ ID NO: 946196 - DNA, 22 bp, Artificial Sequence
  chemically synthesized
ttatcccaggtacttcggaggc

SEQ ID NO: 946197 - DNA, 22 bp, Artificial Sequence
  chemically synthesized
tcccaggtacttcggaggctga

SEQ ID NO: 946198 - DNA, 22 bp, Artificial Sequence
  chemically synthesized
gagtgattcccctgcctcagcc

SEQ ID NO: 946199 - DNA, 22 bp, Artificial Sequence
  chemically synthesized
cggaggctgaggcaggggaatc

SEQ ID NO: 946200 - DNA, 22 bp, Artificial Sequence
  chemically synthesized
ggaggctgaggcaggggaatca

SEQ ID NO: 946201 - DNA, 22 bp, Artificial Sequence
  chemically synthesized
cccccaccaggttcgagtgatt

SEQ ID NO: 946202 - DNA, 22 bp, Artificial Sequence
  chemically synthesized
tgcccccaccaggttcgagtga

SEQ ID NO: 946203 - DNA, 22 bp, Artificial Sequence
  chemically synthesized
aggcaggggaatcactcgaacc

SEQ ID NO: 946204 - DNA, 22 bp, Artificial Sequence
  chemically synthesized
taacctctgcccccaccaggtt

SEQ ID NO: 946205 - DNA, 22 bp, Artificial Sequence
  chemically synthesized
actgtaacctctgcccccacca

SEQ ID NO: 946206 - DNA, 22 bp, Artificial Sequence
  chemically synthesized
agctgactgtaacctctgcccc

SEQ ID NO: 946207 - DNA, 22 bp, Artificial Sequence
  chemically synthesized
gaacctggtgggggcagaggtt

SEQ ID NO: 946208 - DNA, 22 bp, Artificial Sequence
  chemically synthesized
gtgggggcagaggttacagtca

SEQ ID NO: 946209 - DNA, 22 bp, Artificial Sequence
  chemically synthesized
gagtgaggtggcgcaatctcag

SEQ ID NO: 946210 - DNA, 22 bp, Artificial Sequence
  chemically synthesized
cagtcagctgagattgcgccac

SEQ ID NO: 946211 - DNA, 22 bp, Artificial Sequence
  chemically synthesized
gcccaggctggagtgaggtggc

SEQ ID NO: 946212 - DNA, 22 bp, Artificial Sequence
  chemically synthesized
cgcccaggctggagtgaggtgg

SEQ ID NO: 946213 - DNA, 22 bp, Artificial Sequence
  chemically synthesized
tcgcccaggctggagtgaggtg

SEQ ID NO: 946214 - DNA, 22 bp, Artificial Sequence
  chemically synthesized
tttcgcccaggctggagtgagg

SEQ ID NO: 946215 - DNA, 22 bp, Artificial Sequence
  chemically synthesized
agattgcgccacctcactccag

SEQ ID NO: 946216 - DNA, 22 bp, Artificial Sequence
  chemically synthesized
gctctttcgcccaggctggagt

SEQ ID NO: 946217 - DNA, 22 bp, Artificial Sequence
  chemically synthesized
cgctctttcgcccaggctggag

SEQ ID NO: 946218 - DNA, 22 bp, Artificial Sequence
  chemically synthesized
cgccacctcactccagcctggg

SEQ ID NO: 946219 - DNA, 22 bp, Artificial Sequence
  chemically synthesized
actccagcctgggcgaaagagc

SEQ ID NO: 946220 - DNA, 22 bp, Artificial Sequence
  chemically synthesized
agagggagtttcgctctttcgc

SEQ ID NO: 946221 - DNA, 22 bp, Artificial Sequence
  chemically synthesized
gagagggagtttcgctctttcg

SEQ ID NO: 946222 - DNA, 22 bp, Artificial Sequence
  chemically synthesized
tgagagggagtttcgctctttc

SEQ ID NO: 946223 - DNA, 22 bp, Artificial Sequence
  chemically synthesized
ttgagagggagtttcgctcttt

SEQ ID NO: 946224 - DNA, 22 bp, Artificial Sequence
  chemically synthesized
cagcctgggcgaaagagcgaaa

SEQ ID NO: 946225 - DNA, 22 bp, Artificial Sequence
  chemically synthesized
tttgagagggagtttcgctctt

SEQ ID NO: 946226 - DNA, 22 bp, Artificial Sequence
  chemically synthesized
ttttgagagggagtttcgctct

SEQ ID NO: 946227 - DNA, 22 bp, Artificial Sequence
  chemically synthesized
tttttgagagggagtttcgctc

SEQ ID NO: 946228 - DNA, 22 bp, Artificial Sequence
  chemically synthesized
ttttttgagagggagtttcgct

SEQ ID NO: 946229 - DNA, 22 bp, Artificial Sequence
  chemically synthesized
tttttttgagagggagtttcgc

SEQ ID NO: 946230 - DNA, 22 bp, Artificial Sequence
  chemically synthesized
ttttttttgagagggagtttcg

SEQ ID NO: 946231 - DNA, 22 bp, Artificial Sequence
  chemically synthesized
tttttttttgagagggagtttc

SEQ ID NO: 946232 - DNA, 22 bp, Artificial Sequence
  chemically synthesized
ggcgaaagagcgaaactccctc

SEQ ID NO: 946233 - DNA, 22 bp, Artificial Sequence
  chemically synthesized
ttttttttttgagagggagttt

SEQ ID NO: 946234 - DNA, 22 bp, Artificial Sequence
  chemically synthesized
tttttttttttgagagggagtt

SEQ ID NO: 946235 - DNA, 22 bp, Artificial Sequence
  chemically synthesized
ttttttttttttgagagggagt

SEQ ID NO: 946236 - DNA, 22 bp, Artificial Sequence
  chemically synthesized
tttttttttttttgagagggag

SEQ ID NO: 946237 - DNA, 22 bp, Artificial Sequence
  chemically synthesized
ttttttttttttttgagaggga

SEQ ID NO: 946238 - DNA, 22 bp, Artificial Sequence
  chemically synthesized
tttttttttttttttgagaggg

SEQ ID NO: 946239 - DNA, 22 bp, Artificial Sequence
  chemically synthesized
ttttttttttttttttgagagg

SEQ ID NO: 946240 - DNA, 22 bp, Artificial Sequence
  chemically synthesized
tttttttttttttttttgagag

SEQ ID NO: 946241 - DNA, 22 bp, Artificial Sequence
  chemically synthesized
ttttttttttttttttttgaga

SEQ ID NO: 946242 - DNA, 22 bp, Artificial Sequence
  chemically synthesized
tttttttttttttttttttgag

SEQ ID NO: 946243 - DNA, 22 bp, Artificial Sequence
  chemically synthesized
ttttttttttttttttttttga

SEQ ID NO: 946244 - DNA, 22 bp, Artificial Sequence
  chemically synthesized
atactttttttttttttttttt

SEQ ID NO: 946245 - DNA, 22 bp, Artificial Sequence
  chemically synthesized
catacttttttttttttttttt

SEQ ID NO: 946246 - DNA, 22 bp, Artificial Sequence
  chemically synthesized
cctctcaaaaaaaaaaaaaaaa

SEQ ID NO: 946247 - DNA, 22 bp, Artificial Sequence
  chemically synthesized
tttcatactttttttttttttt

SEQ ID NO: 946248 - DNA, 22 bp, Artificial Sequence
  chemically synthesized
gtttcatacttttttttttttt

SEQ ID NO: 946249 - DNA, 22 bp, Artificial Sequence
  chemically synthesized
tcaaaaaaaaaaaaaaaaaaaa

SEQ ID NO: 946250 - DNA, 22 bp, Artificial Sequence
  chemically synthesized
aaaaaaaaaaaaaaaaaaaaaa

SEQ ID NO: 946251 - DNA, 22 bp, Artificial Sequence
  chemically synthesized
tttgtttcatactttttttttt

SEQ ID NO: 946252 - DNA, 22 bp, Artificial Sequence
  chemically synthesized
gtttgtttcatacttttttttt

SEQ ID NO: 946253 - DNA, 22 bp, Artificial Sequence
  chemically synthesized
tgtttgtttcatactttttttt

SEQ ID NO: 946254 - DNA, 22 bp, Artificial Sequence
  chemically synthesized
tttgtttgtttcatactttttt

SEQ ID NO: 946255 - DNA, 22 bp, Artificial Sequence
  chemically synthesized
aaatagtaaaataatatattct

SEQ ID NO: 946256 - DNA, 22 bp, Artificial Sequence
  chemically synthesized
taaaatagtaaaataatatatt

SEQ ID NO: 946257 - DNA, 22 bp, Artificial Sequence
  chemically synthesized
ctaaaatagtaaaataatatat

SEQ ID NO: 946258 - DNA, 22 bp, Artificial Sequence
  chemically synthesized
ttctaaaatagtaaaataatat

SEQ ID NO: 946259 - DNA, 22 bp, Artificial Sequence
  chemically synthesized
tcttctaaaatagtaaaataat

SEQ ID NO: 946260 - DNA, 22 bp, Artificial Sequence
  chemically synthesized
ctcttctaaaatagtaaaataa

SEQ ID NO: 946261 - DNA, 22 bp, Artificial Sequence
  chemically synthesized
tctcttctaaaatagtaaaata

SEQ ID NO: 946262 - DNA, 22 bp, Artificial Sequence
  chemically synthesized
ttctcttctaaaatagtaaaat

SEQ ID NO: 946263 - DNA, 22 bp, Artificial Sequence
  chemically synthesized
gagcttttctcttctaaaatag

SEQ ID NO: 946264 - DNA, 22 bp, Artificial Sequence
  chemically synthesized
tcctagagcttttctcttctaa

SEQ ID NO: 946265 - DNA, 22 bp, Artificial Sequence
  chemically synthesized
ttttactattttagaagagaaa

SEQ ID NO: 946266 - DNA, 22 bp, Artificial Sequence
  chemically synthesized
cctatcctagagcttttctctt

SEQ ID NO: 946267 - DNA, 22 bp, Artificial Sequence
  chemically synthesized
tactattttagaagagaaaagc

SEQ ID NO: 946268 - DNA, 22 bp, Artificial Sequence
  chemically synthesized
actattttagaagagaaaagct

SEQ ID NO: 946269 - DNA, 22 bp, Artificial Sequence
  chemically synthesized
ctattttagaagagaaaagctc

SEQ ID NO: 946270 - DNA, 22 bp, Artificial Sequence
  chemically synthesized
tgctgcctatcctagagctttt

SEQ ID NO: 946271 - DNA, 22 bp, Artificial Sequence
  chemically synthesized
ttttagaagagaaaagctctag

SEQ ID NO: 946272 - DNA, 22 bp, Artificial Sequence
  chemically synthesized
tagaagagaaaagctctaggat

SEQ ID NO: 946273 - DNA, 22 bp, Artificial Sequence
  chemically synthesized
agaagagaaaagctctaggata

SEQ ID NO: 946274 - DNA, 22 bp, Artificial Sequence
  chemically synthesized
gaagagaaaagctctaggatag

SEQ ID NO: 946275 - DNA, 22 bp, Artificial Sequence
  chemically synthesized
accatatgttatgctgcctatc

SEQ ID NO: 946276 - DNA, 22 bp, Artificial Sequence
  chemically synthesized
tgaccatatgttatgctgccta

SEQ ID NO: 946277 - DNA, 22 bp, Artificial Sequence
  chemically synthesized
ctgaccatatgttatgctgcct

SEQ ID NO: 946278 - DNA, 22 bp, Artificial Sequence
  chemically synthesized
cttctgaccatatgttatgctg

SEQ ID NO: 946279 - DNA, 22 bp, Artificial Sequence
  chemically synthesized
taggataggcagcataacatat

SEQ ID NO: 946280 - DNA, 22 bp, Artificial Sequence
  chemically synthesized
ggataggcagcataacatatgg

SEQ ID NO: 946281 - DNA, 22 bp, Artificial Sequence
  chemically synthesized
gtgtccctgcttctgaccatat

SEQ ID NO: 946282 - DNA, 22 bp, Artificial Sequence
  chemically synthesized
tagtgtccctgcttctgaccat

SEQ ID NO: 946283 - DNA, 22 bp, Artificial Sequence
  chemically synthesized
ccaagacagtggctctagtgtc

SEQ ID NO: 946284 - DNA, 22 bp, Artificial Sequence
  chemically synthesized
cccaaggtcatactgccaagac

SEQ ID NO: 946285 - DNA, 22 bp, Artificial Sequence
  chemically synthesized
gcccaaggtcatactgccaaga

SEQ ID NO: 946286 - DNA, 22 bp, Artificial Sequence
  chemically synthesized
gagccactgtcttggcagtatg

SEQ ID NO: 946287 - DNA, 22 bp, Artificial Sequence
  chemically synthesized
cttgcccaaggtcatactgcca

SEQ ID NO: 946288 - DNA, 22 bp, Artificial Sequence
  chemically synthesized
agttacttgcccaaggtcatac

SEQ ID NO: 946289 - DNA, 22 bp, Artificial Sequence
  chemically synthesized
tcttggcagtatgaccttgggc

SEQ ID NO: 946290 - DNA, 22 bp, Artificial Sequence
  chemically synthesized
ggttaagttacttgcccaaggt

SEQ ID NO: 946291 - DNA, 22 bp, Artificial Sequence
  chemically synthesized
ggcagtatgaccttgggcaagt

SEQ ID NO: 946292 - DNA, 22 bp, Artificial Sequence
  chemically synthesized
gcagtatgaccttgggcaagta

SEQ ID NO: 946293 - DNA, 22 bp, Artificial Sequence
  chemically synthesized
gcaaatgatataactaggttaa

SEQ ID NO: 946294 - DNA, 22 bp, Artificial Sequence
  chemically synthesized
gggcaagtaacttaacctagtt

SEQ ID NO: 946295 - DNA, 22 bp, Artificial Sequence
  chemically synthesized
ggcaagtaacttaacctagtta

SEQ ID NO: 946296 - DNA, 22 bp, Artificial Sequence
  chemically synthesized
gctagcaaatgatataactagg

SEQ ID NO: 946297 - DNA, 22 bp, Artificial Sequence
  chemically synthesized
agctagcaaatgatataactag

SEQ ID NO: 946298 - DNA, 22 bp, Artificial Sequence
  chemically synthesized
tttagctagcaaatgatataac

SEQ ID NO: 946299 - DNA, 22 bp, Artificial Sequence
  chemically synthesized
atttagctagcaaatgatataa

SEQ ID NO: 946300 - DNA, 22 bp, Artificial Sequence
  chemically synthesized
aacctagttatatcatttgcta

SEQ ID NO: 946301 - DNA, 22 bp, Artificial Sequence
  chemically synthesized
tacttatttagctagcaaatga

SEQ ID NO: 946302 - DNA, 22 bp, Artificial Sequence
  chemically synthesized
acctagttatatcatttgctag

SEQ ID NO: 946303 - DNA, 22 bp, Artificial Sequence
  chemically synthesized
ttatacttatttagctagcaaa

SEQ ID NO: 946304 - DNA, 22 bp, Artificial Sequence
  chemically synthesized
gttatatcatttgctagctaaa

SEQ ID NO: 946305 - DNA, 22 bp, Artificial Sequence
  chemically synthesized
ttattatacttatttagctagc

SEQ ID NO: 946306 - DNA, 22 bp, Artificial Sequence
  chemically synthesized
attattatacttatttagctag

SEQ ID NO: 946307 - DNA, 22 bp, Artificial Sequence
  chemically synthesized
tattattatacttatttagcta

SEQ ID NO: 946308 - DNA, 22 bp, Artificial Sequence
  chemically synthesized
tatcatttgctagctaaataag

SEQ ID NO: 946309 - DNA, 22 bp, Artificial Sequence
  chemically synthesized
gctagctaaataagtataataa

SEQ ID NO: 946310 - DNA, 22 bp, Artificial Sequence
  chemically synthesized
ctagctaaataagtataataat

SEQ ID NO: 946311 - DNA, 22 bp, Artificial Sequence
  chemically synthesized
gctaaataagtataataataaa

SEQ ID NO: 946312 - DNA, 22 bp, Artificial Sequence
  chemically synthesized
aataagtataataataaaacct

SEQ ID NO: 946313 - DNA, 22 bp, Artificial Sequence
  chemically synthesized
aggcaatcatcacaacaatccc

SEQ ID NO: 946314 - DNA, 22 bp, Artificial Sequence
  chemically synthesized
attcaggcaatcatcacaacaa

SEQ ID NO: 946315 - DNA, 22 bp, Artificial Sequence
  chemically synthesized
tcctgtgggattgttgtgatga

SEQ ID NO: 946316 - DNA, 22 bp, Artificial Sequence
  chemically synthesized
cattaattcaggcaatcatcac

SEQ ID NO: 946317 - DNA, 22 bp, Artificial Sequence
  chemically synthesized
tgggattgttgtgatgattgcc

SEQ ID NO: 946318 - DNA, 22 bp, Artificial Sequence
  chemically synthesized
tacattaattcaggcaatcatc

SEQ ID NO: 946319 - DNA, 22 bp, Artificial Sequence
  chemically synthesized
tctacattaattcaggcaatca

SEQ ID NO: 946320 - DNA, 22 bp, Artificial Sequence
  chemically synthesized
ctctacattaattcaggcaatc

SEQ ID NO: 946321 - DNA, 22 bp, Artificial Sequence
  chemically synthesized
tctctacattaattcaggcaat

SEQ ID NO: 946322 - DNA, 22 bp, Artificial Sequence
  chemically synthesized
ctttctctacattaattcaggc

SEQ ID NO: 946323 - DNA, 22 bp, Artificial Sequence
  chemically synthesized
ttgtgatgattgcctgaattaa

SEQ ID NO: 946324 - DNA, 22 bp, Artificial Sequence
  chemically synthesized
tgatgattgcctgaattaatgt

SEQ ID NO: 946325 - DNA, 22 bp, Artificial Sequence
  chemically synthesized
gtcaaattactttctctacatt

SEQ ID NO: 946326 - DNA, 22 bp, Artificial Sequence
  chemically synthesized
cctgaattaatgtagagaaagt

SEQ ID NO: 946327 - DNA, 22 bp, Artificial Sequence
  chemically synthesized
aattaatgtagagaaagtaatt

SEQ ID NO: 946328 - DNA, 22 bp, Artificial Sequence
  chemically synthesized
agccagacgttagtcaaattac

SEQ ID NO: 946329 - DNA, 22 bp, Artificial Sequence
  chemically synthesized
atgtagagaaagtaatttgact

SEQ ID NO: 946330 - DNA, 22 bp, Artificial Sequence
  chemically synthesized
tgagccagacgttagtcaaatt

SEQ ID NO: 946331 - DNA, 22 bp, Artificial Sequence
  chemically synthesized
ctgagccagacgttagtcaaat

SEQ ID NO: 946332 - DNA, 22 bp, Artificial Sequence
  chemically synthesized
ttctgagccagacgttagtcaa

SEQ ID NO: 946333 - DNA, 22 bp, Artificial Sequence
  chemically synthesized
cttctgagccagacgttagtca

SEQ ID NO: 946334 - DNA, 22 bp, Artificial Sequence
  chemically synthesized
tagtaatgcttcttctgagcca

SEQ ID NO: 946335 - DNA, 22 bp, Artificial Sequence
  chemically synthesized
gactaacgtctggctcagaaga

SEQ ID NO: 946336 - DNA, 22 bp, Artificial Sequence
  chemically synthesized
actaacgtctggctcagaagaa

SEQ ID NO: 946337 - DNA, 22 bp, Artificial Sequence
  chemically synthesized
acgtctggctcagaagaagcat

SEQ ID NO: 946338 - DNA, 22 bp, Artificial Sequence
  chemically synthesized
agtgttgtagtaatgcttcttc

SEQ ID NO: 946339 - DNA, 22 bp, Artificial Sequence
  chemically synthesized
gctcagaagaagcattactaca

SEQ ID NO: 946340 - DNA, 22 bp, Artificial Sequence
  chemically synthesized
agaagaagcattactacaacac

SEQ ID NO: 946341 - DNA, 22 bp, Artificial Sequence
  chemically synthesized
ctacaacacttaggcatcatca

SEQ ID NO: 946342 - DNA, 22 bp, Artificial Sequence
  chemically synthesized
caacacttaggcatcatcatga

SEQ ID NO: 946343 - DNA, 22 bp, Artificial Sequence
  chemically synthesized
aggcatcatcatgattattatc

SEQ ID NO: 946344 - DNA, 22 bp, Artificial Sequence
  chemically synthesized
ggcatcatcatgattattatca

SEQ ID NO: 946345 - DNA, 22 bp, Artificial Sequence
  chemically synthesized
ttatcatcatcgccatcatcat

SEQ ID NO: 946346 - DNA, 22 bp, Artificial Sequence
  chemically synthesized
agcaatagtaataatgatgatg

SEQ ID NO: 946347 - DNA, 22 bp, Artificial Sequence
  chemically synthesized
cagcaatagtaataatgatgat

SEQ ID NO: 946348 - DNA, 22 bp, Artificial Sequence
  chemically synthesized
tcatcatcgccatcatcattat

SEQ ID NO: 946349 - DNA, 22 bp, Artificial Sequence
  chemically synthesized
atttcagcaatagtaataatga

SEQ ID NO: 946350 - DNA, 22 bp, Artificial Sequence
  chemically synthesized
atattcatttcagcaatagtaa

SEQ ID NO: 946351 - DNA, 22 bp, Artificial Sequence
  chemically synthesized
ttcatattcatttcagcaatag

SEQ ID NO: 946352 - DNA, 22 bp, Artificial Sequence
  chemically synthesized
tgttcatattcatttcagcaat

SEQ ID NO: 946353 - DNA, 22 bp, Artificial Sequence
  chemically synthesized
ctgttcatattcatttcagcaa

SEQ ID NO: 946354 - DNA, 22 bp, Artificial Sequence
  chemically synthesized
atttctgttcatattcatttca

SEQ ID NO: 946355 - DNA, 22 bp, Artificial Sequence
  chemically synthesized
aatttctgttcatattcatttc

SEQ ID NO: 946356 - DNA, 22 bp, Artificial Sequence
  chemically synthesized
ttactattgctgaaatgaatat

SEQ ID NO: 946357 - DNA, 22 bp, Artificial Sequence
  chemically synthesized
ctattgctgaaatgaatatgaa

SEQ ID NO: 946358 - DNA, 22 bp, Artificial Sequence
  chemically synthesized
ttgctgaaatgaatatgaacag

SEQ ID NO: 946359 - DNA, 22 bp, Artificial Sequence
  chemically synthesized
agagacttaatttctgttcata

SEQ ID NO: 946360 - DNA, 22 bp, Artificial Sequence
  chemically synthesized
cagagacttaatttctgttcat

SEQ ID NO: 946361 - DNA, 22 bp, Artificial Sequence
  chemically synthesized
ctgaaatgaatatgaacagaaa

SEQ ID NO: 946362 - DNA, 22 bp, Artificial Sequence
  chemically synthesized
tcagagacttaatttctgttca

SEQ ID NO: 946363 - DNA, 22 bp, Artificial Sequence
  chemically synthesized
ttcagagacttaatttctgttc

SEQ ID NO: 946364 - DNA, 22 bp, Artificial Sequence
  chemically synthesized
aaatgaatatgaacagaaatta

SEQ ID NO: 946365 - DNA, 22 bp, Artificial Sequence
  chemically synthesized
cttttcagagacttaatttctg

SEQ ID NO: 946366 - DNA, 22 bp, Artificial Sequence
  chemically synthesized
ctgcttttcagagacttaattt

SEQ ID NO: 946367 - DNA, 22 bp, Artificial Sequence
  chemically synthesized
cctgcttttcagagacttaatt

SEQ ID NO: 946368 - DNA, 22 bp, Artificial Sequence
  chemically synthesized
ataaagtggggcttcctgcttt

SEQ ID NO: 946369 - DNA, 22 bp, Artificial Sequence
  chemically synthesized
agtctctgaaaagcaggaagcc

SEQ ID NO: 946370 - DNA, 22 bp, Artificial Sequence
  chemically synthesized
tgaaaagcaggaagccccactt

SEQ ID NO: 946371 - DNA, 22 bp, Artificial Sequence
  chemically synthesized
aaaagcaggaagccccacttta

SEQ ID NO: 946372 - DNA, 22 bp, Artificial Sequence
  chemically synthesized
gacacatgatccctcataaagt

SEQ ID NO: 946373 - DNA, 22 bp, Artificial Sequence
  chemically synthesized
ggacacatgatccctcataaag

SEQ ID NO: 946374 - DNA, 22 bp, Artificial Sequence
  chemically synthesized
ttggacacatgatccctcataa

SEQ ID NO: 946375 - DNA, 22 bp, Artificial Sequence
  chemically synthesized
cttggacacatgatccctcata

SEQ ID NO: 946376 - DNA, 22 bp, Artificial Sequence
  chemically synthesized
ttcttggacacatgatccctca

SEQ ID NO: 946377 - DNA, 22 bp, Artificial Sequence
  chemically synthesized
ttcttcttggacacatgatccc

SEQ ID NO: 946378 - DNA, 22 bp, Artificial Sequence
  chemically synthesized
tatgagggatcatgtgtccaag

SEQ ID NO: 946379 - DNA, 22 bp, Artificial Sequence
  chemically synthesized
atgagggatcatgtgtccaaga

SEQ ID NO: 946380 - DNA, 22 bp, Artificial Sequence
  chemically synthesized
tgagggatcatgtgtccaagaa

SEQ ID NO: 946381 - DNA, 22 bp, Artificial Sequence
  chemically synthesized
aaagcaactgttcttcttggac

SEQ ID NO: 946382 - DNA, 22 bp, Artificial Sequence
  chemically synthesized
gaaagcaactgttcttcttgga

SEQ ID NO: 946383 - DNA, 22 bp, Artificial Sequence
  chemically synthesized
caaccaaaaagatatttgaaag

SEQ ID NO: 946384 - DNA, 22 bp, Artificial Sequence
  chemically synthesized
gcaaccaaaaagatatttgaaa

SEQ ID NO: 946385 - DNA, 22 bp, Artificial Sequence
  chemically synthesized
tgcaaccaaaaagatatttgaa

SEQ ID NO: 946386 - DNA, 22 bp, Artificial Sequence
  chemically synthesized
ctttcaaatatctttttggttg

SEQ ID NO: 946387 - DNA, 22 bp, Artificial Sequence
  chemically synthesized
tcaaatatctttttggttgcaa

SEQ ID NO: 946388 - DNA, 22 bp, Artificial Sequence
  chemically synthesized
caaatatctttttggttgcaaa

SEQ ID NO: 946389 - DNA, 22 bp, Artificial Sequence
  chemically synthesized
aaatatctttttggttgcaaag

SEQ ID NO: 946390 - DNA, 22 bp, Artificial Sequence
  chemically synthesized
aagaagaaaaaaactttgcaac

SEQ ID NO: 946391 - DNA, 22 bp, Artificial Sequence
  chemically synthesized
ttgaagaagaaaaaaactttgc

SEQ ID NO: 946392 - DNA, 22 bp, Artificial Sequence
  chemically synthesized
attgaagaagaaaaaaactttg

SEQ ID NO: 946393 - DNA, 22 bp, Artificial Sequence
  chemically synthesized
tttggttgcaaagtttttttct

SEQ ID NO: 946394 - DNA, 22 bp, Artificial Sequence
  chemically synthesized
ttggttgcaaagtttttttctt

SEQ ID NO: 946395 - DNA, 22 bp, Artificial Sequence
  chemically synthesized
catttattgaagaagaaaaaaa

SEQ ID NO: 946396 - DNA, 22 bp, Artificial Sequence
  chemically synthesized
tggttgcaaagtttttttcttc

SEQ ID NO: 946397 - DNA, 22 bp, Artificial Sequence
  chemically synthesized
ggttgcaaagtttttttcttct

SEQ ID NO: 946398 - DNA, 22 bp, Artificial Sequence
  chemically synthesized
gttgcaaagtttttttcttctt

SEQ ID NO: 946399 - DNA, 22 bp, Artificial Sequence
  chemically synthesized
ttgcatttattgaagaagaaaa

SEQ ID NO: 946400 - DNA, 22 bp, Artificial Sequence
  chemically synthesized
caaagtttttttcttcttcaat

SEQ ID NO: 946401 - DNA, 22 bp, Artificial Sequence
  chemically synthesized
ggatcccctgttgcatttattg

SEQ ID NO: 946402 - DNA, 22 bp, Artificial Sequence
  chemically synthesized
ttttcttcttcaataaatgcaa

SEQ ID NO: 946403 - DNA, 22 bp, Artificial Sequence
  chemically synthesized
tttcttcttcaataaatgcaac

SEQ ID NO: 946404 - DNA, 22 bp, Artificial Sequence
  chemically synthesized
ttcttcttcaataaatgcaaca

SEQ ID NO: 946405 - DNA, 22 bp, Artificial Sequence
  chemically synthesized
tcttcttcaataaatgcaacag

SEQ ID NO: 946406 - DNA, 22 bp, Artificial Sequence
  chemically synthesized
cttcttcaataaatgcaacagg

SEQ ID NO: 946407 - DNA, 22 bp, Artificial Sequence
  chemically synthesized
ttcttcaataaatgcaacaggg

SEQ ID NO: 946408 - DNA, 22 bp, Artificial Sequence
  chemically synthesized
tagtattgggatcccctgttgc

SEQ ID NO: 946409 - DNA, 22 bp, Artificial Sequence
  chemically synthesized
cttcaataaatgcaacagggga

SEQ ID NO: 946410 - DNA, 22 bp, Artificial Sequence
  chemically synthesized
ttcaataaatgcaacaggggat

SEQ ID NO: 946411 - DNA, 22 bp, Artificial Sequence
  chemically synthesized
caataaatgcaacaggggatcc

SEQ ID NO: 946412 - DNA, 22 bp, Artificial Sequence
  chemically synthesized
attgtagtattgggatcccctg

SEQ ID NO: 946413 - DNA, 22 bp, Artificial Sequence
  chemically synthesized
aataaatgcaacaggggatccc

SEQ ID NO: 946414 - DNA, 22 bp, Artificial Sequence
  chemically synthesized
aattgtagtattgggatcccct

SEQ ID NO: 946415 - DNA, 22 bp, Artificial Sequence
  chemically synthesized
atttaattgtagtattgggatc

SEQ ID NO: 946416 - DNA, 22 bp, Artificial Sequence
  chemically synthesized
tgatttaattgtagtattggga

SEQ ID NO: 946417 - DNA, 22 bp, Artificial Sequence
  chemically synthesized
aatgcactctgatttaattgta

SEQ ID NO: 946418 - DNA, 22 bp, Artificial Sequence
  chemically synthesized
aactaaatgcactctgatttaa

SEQ ID NO: 946419 - DNA, 22 bp, Artificial Sequence
  chemically synthesized
caattaaatcagagtgcattta

SEQ ID NO: 946420 - DNA, 22 bp, Artificial Sequence
  chemically synthesized
ccaaccaggttcaactaaatgc

SEQ ID NO: 946421 - DNA, 22 bp, Artificial Sequence
  chemically synthesized
aatcagagtgcatttagttgaa

SEQ ID NO: 946422 - DNA, 22 bp, Artificial Sequence
  chemically synthesized
aggctaccaaccaggttcaact

SEQ ID NO: 946423 - DNA, 22 bp, Artificial Sequence
  chemically synthesized
gaggctaccaaccaggttcaac

SEQ ID NO: 946424 - DNA, 22 bp, Artificial Sequence
  chemically synthesized
agttgaacctggttggtagcct

SEQ ID NO: 946425 - DNA, 22 bp, Artificial Sequence
  chemically synthesized
gttgaacctggttggtagcctc

SEQ ID NO: 946426 - DNA, 22 bp, Artificial Sequence
  chemically synthesized
aacctggttggtagcctcaagt

SEQ ID NO: 946427 - DNA, 22 bp, Artificial Sequence
  chemically synthesized
gttggtagcctcaagtcctcat

SEQ ID NO: 946428 - DNA, 22 bp, Artificial Sequence
  chemically synthesized
gtagcctcaagtcctcatgtgt

SEQ ID NO: 946429 - DNA, 22 bp, Artificial Sequence
  chemically synthesized
aagtcctcatgtgtgtgtttct

SEQ ID NO: 946430 - DNA, 22 bp, Artificial Sequence
  chemically synthesized
atgtgtgtgtttctttccacta

SEQ ID NO: 946431 - DNA, 22 bp, Artificial Sequence
  chemically synthesized
agagaacaccaagtatagtgga

SEQ ID NO: 946432 - DNA, 22 bp, Artificial Sequence
  chemically synthesized
cagagaacaccaagtatagtgg

SEQ ID NO: 946433 - DNA, 22 bp, Artificial Sequence
  chemically synthesized
cttcagagaacaccaagtatag

SEQ ID NO: 946434 - DNA, 22 bp, Artificial Sequence
  chemically synthesized
gcttcagagaacaccaagtata

SEQ ID NO: 946435 - DNA, 22 bp, Artificial Sequence
  chemically synthesized
ctttccactatacttggtgttc

SEQ ID NO: 946436 - DNA, 22 bp, Artificial Sequence
  chemically synthesized
acttgcttcagagaacaccaag

SEQ ID NO: 946437 - DNA, 22 bp, Artificial Sequence
  chemically synthesized
tttccactatacttggtgttct

SEQ ID NO: 946438 - DNA, 22 bp, Artificial Sequence
  chemically synthesized
tccactatacttggtgttctct

SEQ ID NO: 946439 - DNA, 22 bp, Artificial Sequence
  chemically synthesized
ccactatacttggtgttctctg

SEQ ID NO: 946440 - DNA, 22 bp, Artificial Sequence
  chemically synthesized
cactatacttggtgttctctga

SEQ ID NO: 946441 - DNA, 22 bp, Artificial Sequence
  chemically synthesized
atattgacttgcttcagagaac

SEQ ID NO: 946442 - DNA, 22 bp, Artificial Sequence
  chemically synthesized
gatattgacttgcttcagagaa

SEQ ID NO: 946443 - DNA, 22 bp, Artificial Sequence
  chemically synthesized
tacttggtgttctctgaagcaa

SEQ ID NO: 946444 - DNA, 22 bp, Artificial Sequence
  chemically synthesized
cttgatattgacttgcttcaga

SEQ ID NO: 946445 - DNA, 22 bp, Artificial Sequence
  chemically synthesized
tacttgatattgacttgcttca

SEQ ID NO: 946446 - DNA, 22 bp, Artificial Sequence
  chemically synthesized
ggtgttctctgaagcaagtcaa

SEQ ID NO: 946447 - DNA, 22 bp, Artificial Sequence
  chemically synthesized
ttctacttgatattgacttgct

SEQ ID NO: 946448 - DNA, 22 bp, Artificial Sequence
  chemically synthesized
gtgttctctgaagcaagtcaat

SEQ ID NO: 946449 - DNA, 22 bp, Artificial Sequence
  chemically synthesized
tgttctacttgatattgacttg

SEQ ID NO: 946450 - DNA, 22 bp, Artificial Sequence
  chemically synthesized
tctgaagcaagtcaatatcaag

SEQ ID NO: 946451 - DNA, 22 bp, Artificial Sequence
  chemically synthesized
tgaagcaagtcaatatcaagta

SEQ ID NO: 946452 - DNA, 22 bp, Artificial Sequence
  chemically synthesized
aatgcctctgttctacttgata

SEQ ID NO: 946453 - DNA, 22 bp, Artificial Sequence
  chemically synthesized
aagcaagtcaatatcaagtaga

SEQ ID NO: 946454 - DNA, 22 bp, Artificial Sequence
  chemically synthesized
acattaaatgcctctgttctac

SEQ ID NO: 946455 - DNA, 22 bp, Artificial Sequence
  chemically synthesized
aacattaaatgcctctgttcta

SEQ ID NO: 946456 - DNA, 22 bp, Artificial Sequence
  chemically synthesized
taacattaaatgcctctgttct

SEQ ID NO: 946457 - DNA, 22 bp, Artificial Sequence
  chemically synthesized
ttttaacattaaatgcctctgt

SEQ ID NO: 946458 - DNA, 22 bp, Artificial Sequence
  chemically synthesized
attttaacattaaatgcctctg

SEQ ID NO: 946459 - DNA, 22 bp, Artificial Sequence
  chemically synthesized
tattttaacattaaatgcctct

SEQ ID NO: 946460 - DNA, 22 bp, Artificial Sequence
  chemically synthesized
gttttattttaacattaaatgc

SEQ ID NO: 946461 - DNA, 22 bp, Artificial Sequence
  chemically synthesized
tagttttattttaacattaaat

SEQ ID NO: 946462 - DNA, 22 bp, Artificial Sequence
  chemically synthesized
ttctagttttattttaacatta

SEQ ID NO: 946463 - DNA, 22 bp, Artificial Sequence
  chemically synthesized
attctagttttattttaacatt

SEQ ID NO: 946464 - DNA, 22 bp, Artificial Sequence
  chemically synthesized
ccttattctagttttattttaa

SEQ ID NO: 946465 - DNA, 22 bp, Artificial Sequence
  chemically synthesized
ttgccttattctagttttattt

SEQ ID NO: 946466 - DNA, 22 bp, Artificial Sequence
  chemically synthesized
gttgccttattctagttttatt

SEQ ID NO: 946467 - DNA, 22 bp, Artificial Sequence
  chemically synthesized
tgttgccttattctagttttat

SEQ ID NO: 946468 - DNA, 22 bp, Artificial Sequence
  chemically synthesized
tttgttgccttattctagtttt

SEQ ID NO: 946469 - DNA, 22 bp, Artificial Sequence
  chemically synthesized
aatgttaaaataaaactagaat

SEQ ID NO: 946470 - DNA, 22 bp, Artificial Sequence
  chemically synthesized
atgttaaaataaaactagaata

SEQ ID NO: 946471 - DNA, 22 bp, Artificial Sequence
  chemically synthesized
aaataaaactagaataaggcaa

SEQ ID NO: 946472 - DNA, 22 bp, Artificial Sequence
  chemically synthesized
tacatgttctttgttgccttat

SEQ ID NO: 946473 - DNA, 22 bp, Artificial Sequence
  chemically synthesized
atacatgttctttgttgcctta

SEQ ID NO: 946474 - DNA, 22 bp, Artificial Sequence
  chemically synthesized
gaataaggcaacaaagaacatg

SEQ ID NO: 946475 - DNA, 22 bp, Artificial Sequence
  chemically synthesized
atgcatccttatacatgttctt

SEQ ID NO: 946476 - DNA, 22 bp, Artificial Sequence
  chemically synthesized
catgcatccttatacatgttct

SEQ ID NO: 946477 - DNA, 22 bp, Artificial Sequence
  chemically synthesized
aacccagagacaatcttcatgc

SEQ ID NO: 946478 - DNA, 22 bp, Artificial Sequence
  chemically synthesized
tcaacccagagacaatcttcat

SEQ ID NO: 946479 - DNA, 22 bp, Artificial Sequence
  chemically synthesized
atagtactctcaacccagagac

SEQ ID NO: 946480 - DNA, 22 bp, Artificial Sequence
  chemically synthesized
aatagtactctcaacccagaga

SEQ ID NO: 946481 - DNA, 22 bp, Artificial Sequence
  chemically synthesized
taatagtactctcaacccagag

SEQ ID NO: 946482 - DNA, 22 bp, Artificial Sequence
  chemically synthesized
ttttaatagtactctcaaccca

SEQ ID NO: 946483 - DNA, 22 bp, Artificial Sequence
  chemically synthesized
tgttttaatagtactctcaacc

SEQ ID NO: 946484 - DNA, 22 bp, Artificial Sequence
  chemically synthesized
ctgttttaatagtactctcaac

SEQ ID NO: 946485 - DNA, 22 bp, Artificial Sequence
  chemically synthesized
tctctgggttgagagtactatt

SEQ ID NO: 946486 - DNA, 22 bp, Artificial Sequence
  chemically synthesized
tgggttgagagtactattaaaa

SEQ ID NO: 946487 - DNA, 22 bp, Artificial Sequence
  chemically synthesized
ggttgagagtactattaaaaca

SEQ ID NO: 946488 - DNA, 22 bp, Artificial Sequence
  chemically synthesized
agagtactattaaaacagaaat

SEQ ID NO: 946489 - DNA, 22 bp, Artificial Sequence
  chemically synthesized
ttaaaacagaaatcttgcattt

SEQ ID NO: 946490 - DNA, 22 bp, Artificial Sequence
  chemically synthesized
agtgatacgaagtcaaatgcaa

SEQ ID NO: 946491 - DNA, 22 bp, Artificial Sequence
  chemically synthesized
aaacagaaatcttgcatttgac

SEQ ID NO: 946492 - DNA, 22 bp, Artificial Sequence
  chemically synthesized
aagtgatacgaagtcaaatgca

SEQ ID NO: 946493 - DNA, 22 bp, Artificial Sequence
  chemically synthesized
taagtgatacgaagtcaaatgc

SEQ ID NO: 946494 - DNA, 22 bp, Artificial Sequence
  chemically synthesized
ttaagtgatacgaagtcaaatg

SEQ ID NO: 946495 - DNA, 22 bp, Artificial Sequence
  chemically synthesized
agtgcttttaagtgatacgaag

SEQ ID NO: 946496 - DNA, 22 bp, Artificial Sequence
  chemically synthesized
taagtgcttttaagtgatacga

SEQ ID NO: 946497 - DNA, 22 bp, Artificial Sequence
  chemically synthesized
gcatttgacttcgtatcactta

SEQ ID NO: 946498 - DNA, 22 bp, Artificial Sequence
  chemically synthesized
catttgacttcgtatcacttaa

SEQ ID NO: 946499 - DNA, 22 bp, Artificial Sequence
  chemically synthesized
gacttcgtatcacttaaaagca

SEQ ID NO: 946500 - DNA, 22 bp, Artificial Sequence
  chemically synthesized
acttcgtatcacttaaaagcac

SEQ ID NO: 946501 - DNA, 22 bp, Artificial Sequence
  chemically synthesized
aaatagttctaagtgcttttaa

SEQ ID NO: 946502 - DNA, 22 bp, Artificial Sequence
  chemically synthesized
cgtatcacttaaaagcacttag

SEQ ID NO: 946503 - DNA, 22 bp, Artificial Sequence
  chemically synthesized
gtatcacttaaaagcacttaga

SEQ ID NO: 946504 - DNA, 22 bp, Artificial Sequence
  chemically synthesized
aattaaaatagttctaagtgct

SEQ ID NO: 946505 - DNA, 22 bp, Artificial Sequence
  chemically synthesized
aaattaaaatagttctaagtgc

SEQ ID NO: 946506 - DNA, 22 bp, Artificial Sequence
  chemically synthesized
taaattaaaatagttctaagtg

SEQ ID NO: 946507 - DNA, 22 bp, Artificial Sequence
  chemically synthesized
ttaaattaaaatagttctaagt

SEQ ID NO: 946508 - DNA, 22 bp, Artificial Sequence
  chemically synthesized
aaaagcacttagaactatttta

SEQ ID NO: 946509 - DNA, 22 bp, Artificial Sequence
  chemically synthesized
aaagcacttagaactattttaa

SEQ ID NO: 946510 - DNA, 22 bp, Artificial Sequence
  chemically synthesized
atagtaggatttttaaattaaa

SEQ ID NO: 946511 - DNA, 22 bp, Artificial Sequence
  chemically synthesized
aatagtaggatttttaaattaa

SEQ ID NO: 946512 - DNA, 22 bp, Artificial Sequence
  chemically synthesized
taatagtaggatttttaaatta

SEQ ID NO: 946513 - DNA, 22 bp, Artificial Sequence
  chemically synthesized
ttaatagtaggatttttaaatt

SEQ ID NO: 946514 - DNA, 22 bp, Artificial Sequence
  chemically synthesized
agaactattttaatttaaaaat

SEQ ID NO: 946515 - DNA, 22 bp, Artificial Sequence
  chemically synthesized
gaactattttaatttaaaaatc

SEQ ID NO: 946516 - DNA, 22 bp, Artificial Sequence
  chemically synthesized
tttttaatagtaggatttttaa

SEQ ID NO: 946517 - DNA, 22 bp, Artificial Sequence
  chemically synthesized
ttttaatttaaaaatcctacta

SEQ ID NO: 946518 - DNA, 22 bp, Artificial Sequence
  chemically synthesized
aacctatttttaatagtaggat

SEQ ID NO: 946519 - DNA, 22 bp, Artificial Sequence
  chemically synthesized
taatttaaaaatcctactatta

SEQ ID NO: 946520 - DNA, 22 bp, Artificial Sequence
  chemically synthesized
aatttaaaaatcctactattaa

SEQ ID NO: 946521 - DNA, 22 bp, Artificial Sequence
  chemically synthesized
atttaaaaatcctactattaaa

SEQ ID NO: 946522 - DNA, 22 bp, Artificial Sequence
  chemically synthesized
aatactaaacctatttttaata

SEQ ID NO: 946523 - DNA, 22 bp, Artificial Sequence
  chemically synthesized
aaaaatcctactattaaaaata

SEQ ID NO: 946524 - DNA, 22 bp, Artificial Sequence
  chemically synthesized
aaatactaaacctatttttaat

SEQ ID NO: 946525 - DNA, 22 bp, Artificial Sequence
  chemically synthesized
aaaatcctactattaaaaatag

SEQ ID NO: 946526 - DNA, 22 bp, Artificial Sequence
  chemically synthesized
taaatactaaacctatttttaa

SEQ ID NO: 946527 - DNA, 22 bp, Artificial Sequence
  chemically synthesized
tttaaatactaaacctattttt

SEQ ID NO: 946528 - DNA, 22 bp, Artificial Sequence
  chemically synthesized
cctctttaaatactaaacctat

SEQ ID NO: 946529 - DNA, 22 bp, Artificial Sequence
  chemically synthesized
acctctttaaatactaaaccta

SEQ ID NO: 946530 - DNA, 22 bp, Artificial Sequence
  chemically synthesized
ctattaaaaataggtttagtat

SEQ ID NO: 946531 - DNA, 22 bp, Artificial Sequence
  chemically synthesized
ttaaaaataggtttagtattta

SEQ ID NO: 946532 - DNA, 22 bp, Artificial Sequence
  chemically synthesized
gaatttacctctttaaatacta

SEQ ID NO: 946533 - DNA, 22 bp, Artificial Sequence
  chemically synthesized
aaaataggtttagtatttaaag

SEQ ID NO: 946534 - DNA, 22 bp, Artificial Sequence
  chemically synthesized
tagaaaattagaatttacctct

SEQ ID NO: 946535 - DNA, 22 bp, Artificial Sequence
  chemically synthesized
agtatttaaagaggtaaattct

SEQ ID NO: 946536 - DNA, 22 bp, Artificial Sequence
  chemically synthesized
gtatttaaagaggtaaattcta

SEQ ID NO: 946537 - DNA, 22 bp, Artificial Sequence
  chemically synthesized
cagttatagaaaattagaattt

SEQ ID NO: 946538 - DNA, 22 bp, Artificial Sequence
  chemically synthesized
aaagaggtaaattctaattttc

SEQ ID NO: 946539 - DNA, 22 bp, Artificial Sequence
  chemically synthesized
aagaggtaaattctaattttct

SEQ ID NO: 946540 - DNA, 22 bp, Artificial Sequence
  chemically synthesized
tcatcagatactgcagttatag

SEQ ID NO: 946541 - DNA, 22 bp, Artificial Sequence
  chemically synthesized
taattttctataactgcagtat

SEQ ID NO: 946542 - DNA, 22 bp, Artificial Sequence
  chemically synthesized
attttctataactgcagtatct

SEQ ID NO: 946543 - DNA, 22 bp, Artificial Sequence
  chemically synthesized
gtggttgtcatcagatactgca

SEQ ID NO: 946544 - DNA, 22 bp, Artificial Sequence
  chemically synthesized
tctataactgcagtatctgatg

SEQ ID NO: 946545 - DNA, 22 bp, Artificial Sequence
  chemically synthesized
ctataactgcagtatctgatga

SEQ ID NO: 946546 - DNA, 22 bp, Artificial Sequence
  chemically synthesized
tataactgcagtatctgatgac

SEQ ID NO: 946547 - DNA, 22 bp, Artificial Sequence
  chemically synthesized
taactgcagtatctgatgacaa

SEQ ID NO: 946548 - DNA, 22 bp, Artificial Sequence
  chemically synthesized
cagtatctgatgacaaccacta

SEQ ID NO: 946549 - DNA, 22 bp, Artificial Sequence
  chemically synthesized
aaaagccgcatgcggctagtgg

SEQ ID NO: 946550 - DNA, 22 bp, Artificial Sequence
  chemically synthesized
caaaagccgcatgcggctagtg

SEQ ID NO: 946551 - DNA, 22 bp, Artificial Sequence
  chemically synthesized
atgacaaccactagccgcatgc

SEQ ID NO: 946552 - DNA, 22 bp, Artificial Sequence
  chemically synthesized
aatttcaaaagccgcatgcggc

SEQ ID NO: 946553 - DNA, 22 bp, Artificial Sequence
  chemically synthesized
aaatttcaaaagccgcatgcgg

SEQ ID NO: 946554 - DNA, 22 bp, Artificial Sequence
  chemically synthesized
aataacgtttaaatttcaaaag

SEQ ID NO: 946555 - DNA, 22 bp, Artificial Sequence
  chemically synthesized
gccgcatgcggcttttgaaatt

SEQ ID NO: 946556 - DNA, 22 bp, Artificial Sequence
  chemically synthesized
atattaaataacgtttaaattt

SEQ ID NO: 946557 - DNA, 22 bp, Artificial Sequence
  chemically synthesized
aatattaaataacgtttaaatt

SEQ ID NO: 946558 - DNA, 22 bp, Artificial Sequence
  chemically synthesized
tttaatattaaataacgtttaa

SEQ ID NO: 946559 - DNA, 22 bp, Artificial Sequence
  chemically synthesized
atttaatattaaataacgttta

SEQ ID NO: 946560 - DNA, 22 bp, Artificial Sequence
  chemically synthesized
tatttaatattaaataacgttt

SEQ ID NO: 946561 - DNA, 22 bp, Artificial Sequence
  chemically synthesized
ttatttaatattaaataacgtt

SEQ ID NO: 946562 - DNA, 22 bp, Artificial Sequence
  chemically synthesized
ttgaaatttaaacgttatttaa

SEQ ID NO: 946563 - DNA, 22 bp, Artificial Sequence
  chemically synthesized
tgaaatttaaacgttatttaat

SEQ ID NO: 946564 - DNA, 22 bp, Artificial Sequence
  chemically synthesized
gaaatttaaacgttatttaata

SEQ ID NO: 946565 - DNA, 22 bp, Artificial Sequence
  chemically synthesized
aaatttaaacgttatttaatat

SEQ ID NO: 946566 - DNA, 22 bp, Artificial Sequence
  chemically synthesized
aatttttatttaatattaaata

SEQ ID NO: 946567 - DNA, 22 bp, Artificial Sequence
  chemically synthesized
aaacgttatttaatattaaata

SEQ ID NO: 946568 - DNA, 22 bp, Artificial Sequence
  chemically synthesized
aacgttatttaatattaaataa

SEQ ID NO: 946569 - DNA, 22 bp, Artificial Sequence
  chemically synthesized
aggaactaaatttttatttaat

SEQ ID NO: 946570 - DNA, 22 bp, Artificial Sequence
  chemically synthesized
tttaatattaaataaaaattta

SEQ ID NO: 946571 - DNA, 22 bp, Artificial Sequence
  chemically synthesized
aatattaaataaaaatttagtt

SEQ ID NO: 946572 - DNA, 22 bp, Artificial Sequence
  chemically synthesized
atattaaataaaaatttagttc

SEQ ID NO: 946573 - DNA, 22 bp, Artificial Sequence
  chemically synthesized
aataaaaatttagttccttagt

SEQ ID NO: 946574 - DNA, 22 bp, Artificial Sequence
  chemically synthesized
agttccttagtgtccctggcca

SEQ ID NO: 946575 - DNA, 22 bp, Artificial Sequence
  chemically synthesized
gttccttagtgtccctggccat

SEQ ID NO: 946576 - DNA, 22 bp, Artificial Sequence
  chemically synthesized
agcaatggtaatatggccaggg

SEQ ID NO: 946577 - DNA, 22 bp, Artificial Sequence
  chemically synthesized
ctgagcaatggtaatatggcca

SEQ ID NO: 946578 - DNA, 22 bp, Artificial Sequence
  chemically synthesized
cttagtgtccctggccatatta

SEQ ID NO: 946579 - DNA, 22 bp, Artificial Sequence
  chemically synthesized
agtgtccctggccatattacca

SEQ ID NO: 946580 - DNA, 22 bp, Artificial Sequence
  chemically synthesized
gtgtccctggccatattaccat

SEQ ID NO: 946581 - DNA, 22 bp, Artificial Sequence
  chemically synthesized
gccatattaccattgctcagta

SEQ ID NO: 946582 - DNA, 22 bp, Artificial Sequence
  chemically synthesized
gatacacatgactactgagcaa

SEQ ID NO: 946583 - DNA, 22 bp, Artificial Sequence
  chemically synthesized
ccattgctcagtagtcatgtgt

SEQ ID NO: 946584 - DNA, 22 bp, Artificial Sequence
  chemically synthesized
ctcagtagtcatgtgtatctag

SEQ ID NO: 946585 - DNA, 22 bp, Artificial Sequence
  chemically synthesized
agtagtcatgtgtatctagtgg

SEQ ID NO: 946586 - DNA, 22 bp, Artificial Sequence
  chemically synthesized
tccaatacaacagccactagat

SEQ ID NO: 946587 - DNA, 22 bp, Artificial Sequence
  chemically synthesized
tgctgtccaatacaacagccac

SEQ ID NO: 946588 - DNA, 22 bp, Artificial Sequence
  chemically synthesized
tgtgctgtccaatacaacagcc

SEQ ID NO: 946589 - DNA, 22 bp, Artificial Sequence
  chemically synthesized
tctctgtgctgtccaatacaac

SEQ ID NO: 946590 - DNA, 22 bp, Artificial Sequence
  chemically synthesized
tgtctctgtgctgtccaataca

SEQ ID NO: 946591 - DNA, 22 bp, Artificial Sequence
  chemically synthesized
gtggctgttgtattggacagca

SEQ ID NO: 946592 - DNA, 22 bp, Artificial Sequence
  chemically synthesized
ttgtattggacagcacagagac

SEQ ID NO: 946593 - DNA, 22 bp, Artificial Sequence
  chemically synthesized
tattggacagcacagagacaga

SEQ ID NO: 946594 - DNA, 22 bp, Artificial Sequence
  chemically synthesized
gacagcacagagacagaacatt

SEQ ID NO: 946595 - DNA, 22 bp, Artificial Sequence
  chemically synthesized
tgtgatgataaaaatgttctgt

SEQ ID NO: 946596 - DNA, 22 bp, Artificial Sequence
  chemically synthesized
gtgtgatgataaaaatgttctg

SEQ ID NO: 946597 - DNA, 22 bp, Artificial Sequence
  chemically synthesized
tgtgtgatgataaaaatgttct

SEQ ID NO: 946598 - DNA, 22 bp, Artificial Sequence
  chemically synthesized
ttatcatcacacaaagttatat

SEQ ID NO: 946599 - DNA, 22 bp, Artificial Sequence
  chemically synthesized
tatcatcacacaaagttatatt

SEQ ID NO: 946600 - DNA, 22 bp, Artificial Sequence
  chemically synthesized
atcatcacacaaagttatattg

SEQ ID NO: 946601 - DNA, 22 bp, Artificial Sequence
  chemically synthesized
tcatcacacaaagttatattgg

SEQ ID NO: 946602 - DNA, 22 bp, Artificial Sequence
  chemically synthesized
aatcagcaatgtccaatataac

SEQ ID NO: 946603 - DNA, 22 bp, Artificial Sequence
  chemically synthesized
tattggacattgctgatttagg

SEQ ID NO: 946604 - DNA, 22 bp, Artificial Sequence
  chemically synthesized
catgtaacaaaatgtcctaaat

SEQ ID NO: 946605 - DNA, 22 bp, Artificial Sequence
  chemically synthesized
ccatgtaacaaaatgtcctaaa

SEQ ID NO: 946606 - DNA, 22 bp, Artificial Sequence
  chemically synthesized
gacattgctgatttaggacatt

SEQ ID NO: 946607 - DNA, 22 bp, Artificial Sequence
  chemically synthesized
tccatgtaacaaaatgtcctaa

SEQ ID NO: 946608 - DNA, 22 bp, Artificial Sequence
  chemically synthesized
ctgatttaggacattttgttac

SEQ ID NO: 946609 - DNA, 22 bp, Artificial Sequence
  chemically synthesized
atttaggacattttgttacatg

SEQ ID NO: 946610 - DNA, 22 bp, Artificial Sequence
  chemically synthesized
tcagcataattttccatgtaac

SEQ ID NO: 946611 - DNA, 22 bp, Artificial Sequence
  chemically synthesized
aggacattttgttacatggaaa

SEQ ID NO: 946612 - DNA, 22 bp, Artificial Sequence
  chemically synthesized
ggacattttgttacatggaaaa

SEQ ID NO: 946613 - DNA, 22 bp, Artificial Sequence
  chemically synthesized
atattgtcagcataattttcca

SEQ ID NO: 946614 - DNA, 22 bp, Artificial Sequence
  chemically synthesized
tgttacatggaaaattatgctg

SEQ ID NO: 946615 - DNA, 22 bp, Artificial Sequence
  chemically synthesized
gttacatggaaaattatgctga

SEQ ID NO: 946616 - DNA, 22 bp, Artificial Sequence
  chemically synthesized
ttacatggaaaattatgctgac

SEQ ID NO: 946617 - DNA, 22 bp, Artificial Sequence
  chemically synthesized
cacacctaatattgtcagcata

SEQ ID NO: 946618 - DNA, 22 bp, Artificial Sequence
  chemically synthesized
catggaaaattatgctgacaat

SEQ ID NO: 946619 - DNA, 22 bp, Artificial Sequence
  chemically synthesized
tgcacacctaatattgtcagca

SEQ ID NO: 946620 - DNA, 22 bp, Artificial Sequence
  chemically synthesized
tggtaatattctgcacacctaa

SEQ ID NO: 946621 - DNA, 22 bp, Artificial Sequence
  chemically synthesized
tgctgacaatattaggtgtgca

SEQ ID NO: 946622 - DNA, 22 bp, Artificial Sequence
  chemically synthesized
atggtaatattctgcacaccta

SEQ ID NO: 946623 - DNA, 22 bp, Artificial Sequence
  chemically synthesized
cttatggtaatattctgcacac

SEQ ID NO: 946624 - DNA, 22 bp, Artificial Sequence
  chemically synthesized
acaatattaggtgtgcagaata

SEQ ID NO: 946625 - DNA, 22 bp, Artificial Sequence
  chemically synthesized
ttgcttatggtaatattctgca

SEQ ID NO: 946626 - DNA, 22 bp, Artificial Sequence
  chemically synthesized
ctattgcttatggtaatattct

SEQ ID NO: 946627 - DNA, 22 bp, Artificial Sequence
  chemically synthesized
gctattgcttatggtaatattc

SEQ ID NO: 946628 - DNA, 22 bp, Artificial Sequence
  chemically synthesized
tgctattgcttatggtaatatt

SEQ ID NO: 946629 - DNA, 22 bp, Artificial Sequence
  chemically synthesized
ggtgtgcagaatattaccataa

SEQ ID NO: 946630 - DNA, 22 bp, Artificial Sequence
  chemically synthesized
ccataagcaatagcaaaatact

SEQ ID NO: 946631 - DNA, 22 bp, Artificial Sequence
  chemically synthesized
ccaaacccatgtagtattttgc

SEQ ID NO: 946632 - DNA, 22 bp, Artificial Sequence
  chemically synthesized
catgggtttgggaacacttttc

SEQ ID NO: 946633 - DNA, 22 bp, Artificial Sequence
  chemically synthesized
cagtgcataaagaaaggaaaag

SEQ ID NO: 946634 - DNA, 22 bp, Artificial Sequence
  chemically synthesized
actgcagtgcataaagaaagga

SEQ ID NO: 946635 - DNA, 22 bp, Artificial Sequence
  chemically synthesized
gggaacacttttcctttcttta

SEQ ID NO: 946636 - DNA, 22 bp, Artificial Sequence
  chemically synthesized
ggaacacttttcctttctttat

SEQ ID NO: 946637 - DNA, 22 bp, Artificial Sequence
  chemically synthesized
attaactgcagtgcataaagaa

SEQ ID NO: 946638 - DNA, 22 bp, Artificial Sequence
  chemically synthesized
cattaactgcagtgcataaaga

SEQ ID NO: 946639 - DNA, 22 bp, Artificial Sequence
  chemically synthesized
tttcattaactgcagtgcataa

SEQ ID NO: 946640 - DNA, 22 bp, Artificial Sequence
  chemically synthesized
ttcctttctttatgcactgcag

SEQ ID NO: 946641 - DNA, 22 bp, Artificial Sequence
  chemically synthesized
tcctttctttatgcactgcagt

SEQ ID NO: 946642 - DNA, 22 bp, Artificial Sequence
  chemically synthesized
cctttctttatgcactgcagtt

SEQ ID NO: 946643 - DNA, 22 bp, Artificial Sequence
  chemically synthesized
agttgtttcattaactgcagtg

SEQ ID NO: 946644 - DNA, 22 bp, Artificial Sequence
  chemically synthesized
ctttctttatgcactgcagtta

SEQ ID NO: 946645 - DNA, 22 bp, Artificial Sequence
  chemically synthesized
aagttgtttcattaactgcagt

SEQ ID NO: 946646 - DNA, 22 bp, Artificial Sequence
  chemically synthesized
tctttatgcactgcagttaatg

SEQ ID NO: 946647 - DNA, 22 bp, Artificial Sequence
  chemically synthesized
ctttatgcactgcagttaatga

SEQ ID NO: 946648 - DNA, 22 bp, Artificial Sequence
  chemically synthesized
tttatgcactgcagttaatgaa

SEQ ID NO: 946649 - DNA, 22 bp, Artificial Sequence
  chemically synthesized
catttaagttgtttcattaact

SEQ ID NO: 946650 - DNA, 22 bp, Artificial Sequence
  chemically synthesized
tatgcactgcagttaatgaaac

SEQ ID NO: 946651 - DNA, 22 bp, Artificial Sequence
  chemically synthesized
atgcactgcagttaatgaaaca

SEQ ID NO: 946652 - DNA, 22 bp, Artificial Sequence
  chemically synthesized
tgcactgcagttaatgaaacaa

SEQ ID NO: 946653 - DNA, 22 bp, Artificial Sequence
  chemically synthesized
cagagaattacatttaagttgt

SEQ ID NO: 946654 - DNA, 22 bp, Artificial Sequence
  chemically synthesized
cagttaatgaaacaacttaaat

SEQ ID NO: 946655 - DNA, 22 bp, Artificial Sequence
  chemically synthesized
ctccagagaattacatttaagt

SEQ ID NO: 946656 - DNA, 22 bp, Artificial Sequence
  chemically synthesized
atgaaacaacttaaatgtaatt

SEQ ID NO: 946657 - DNA, 22 bp, Artificial Sequence
  chemically synthesized
agaaaataaattcctccagaga

SEQ ID NO: 946658 - DNA, 22 bp, Artificial Sequence
  chemically synthesized
aagaaaataaattcctccagag

SEQ ID NO: 946659 - DNA, 22 bp, Artificial Sequence
  chemically synthesized
aaatgtaattctctggaggaat

SEQ ID NO: 946660 - DNA, 22 bp, Artificial Sequence
  chemically synthesized
aatgtaattctctggaggaatt

SEQ ID NO: 946661 - DNA, 22 bp, Artificial Sequence
  chemically synthesized
agagaagtacttaagaaaataa

SEQ ID NO: 946662 - DNA, 22 bp, Artificial Sequence
  chemically synthesized
tctggaggaatttattttctta

SEQ ID NO: 946663 - DNA, 22 bp, Artificial Sequence
  chemically synthesized
aagagaagtacttaagaaaata

SEQ ID NO: 946664 - DNA, 22 bp, Artificial Sequence
  chemically synthesized
taagagaagtacttaagaaaat

SEQ ID NO: 946665 - DNA, 22 bp, Artificial Sequence
  chemically synthesized
tggaggaatttattttcttaag

SEQ ID NO: 946666 - DNA, 22 bp, Artificial Sequence
  chemically synthesized
gaggaatttattttcttaagta

SEQ ID NO: 946667 - DNA, 22 bp, Artificial Sequence
  chemically synthesized
cagacactttaagagaagtact

SEQ ID NO: 946668 - DNA, 22 bp, Artificial Sequence
  chemically synthesized
attttcttaagtacttctctta

SEQ ID NO: 946669 - DNA, 22 bp, Artificial Sequence
  chemically synthesized
ttttcttaagtacttctcttaa

SEQ ID NO: 946670 - DNA, 22 bp, Artificial Sequence
  chemically synthesized
tcttaagtacttctcttaaagt

SEQ ID NO: 946671 - DNA, 22 bp, Artificial Sequence
  chemically synthesized
cttaagtacttctcttaaagtg

SEQ ID NO: 946672 - DNA, 22 bp, Artificial Sequence
  chemically synthesized
ttaagtacttctcttaaagtgt

SEQ ID NO: 946673 - DNA, 22 bp, Artificial Sequence
  chemically synthesized
aagtacttctcttaaagtgtct

SEQ ID NO: 946674 - DNA, 22 bp, Artificial Sequence
  chemically synthesized
agtacttctcttaaagtgtctg

SEQ ID NO: 946675 - DNA, 22 bp, Artificial Sequence
  chemically synthesized
aggtaaaaatcatattgcagac

SEQ ID NO: 946676 - DNA, 22 bp, Artificial Sequence
  chemically synthesized
ctcttaaagtgtctgcaatatg

SEQ ID NO: 946677 - DNA, 22 bp, Artificial Sequence
  chemically synthesized
tcaggtaaaaatcatattgcag

SEQ ID NO: 946678 - DNA, 22 bp, Artificial Sequence
  chemically synthesized
tcttaaagtgtctgcaatatga

SEQ ID NO: 946679 - DNA, 22 bp, Artificial Sequence
  chemically synthesized
ctcaggtaaaaatcatattgca

SEQ ID NO: 946680 - DNA, 22 bp, Artificial Sequence
  chemically synthesized
ttaaagtgtctgcaatatgatt

SEQ ID NO: 946681 - DNA, 22 bp, Artificial Sequence
  chemically synthesized
aaagtgtctgcaatatgatttt

SEQ ID NO: 946682 - DNA, 22 bp, Artificial Sequence
  chemically synthesized
aagtgtctgcaatatgattttt

SEQ ID NO: 946683 - DNA, 22 bp, Artificial Sequence
  chemically synthesized
tgccacacttctcaggtaaaaa

SEQ ID NO: 946684 - DNA, 22 bp, Artificial Sequence
  chemically synthesized
ctgtgccacacttctcaggtaa

SEQ ID NO: 946685 - DNA, 22 bp, Artificial Sequence
  chemically synthesized
caatatgatttttacctgagaa

SEQ ID NO: 946686 - DNA, 22 bp, Artificial Sequence
  chemically synthesized
ctactgtgccacacttctcagg

SEQ ID NO: 946687 - DNA, 22 bp, Artificial Sequence
  chemically synthesized
ttcctactgtgccacacttctc

SEQ ID NO: 946688 - DNA, 22 bp, Artificial Sequence
  chemically synthesized
attcctactgtgccacacttct

SEQ ID NO: 946689 - DNA, 22 bp, Artificial Sequence
  chemically synthesized
tattcctactgtgccacacttc

SEQ ID NO: 946690 - DNA, 22 bp, Artificial Sequence
  chemically synthesized
ttattcctactgtgccacactt

SEQ ID NO: 946691 - DNA, 22 bp, Artificial Sequence
  chemically synthesized
ttacctgagaagtgtggcacag

SEQ ID NO: 946692 - DNA, 22 bp, Artificial Sequence
  chemically synthesized
tacctgagaagtgtggcacagt

SEQ ID NO: 946693 - DNA, 22 bp, Artificial Sequence
  chemically synthesized
acctgagaagtgtggcacagta

SEQ ID NO: 946694 - DNA, 22 bp, Artificial Sequence
  chemically synthesized
cctgagaagtgtggcacagtag

SEQ ID NO: 946695 - DNA, 22 bp, Artificial Sequence
  chemically synthesized
accgtgtttttattcctactgt

SEQ ID NO: 946696 - DNA, 22 bp, Artificial Sequence
  chemically synthesized
agaagtgtggcacagtaggaat

SEQ ID NO: 946697 - DNA, 22 bp, Artificial Sequence
  chemically synthesized
tgaccgtgtttttattcctact

SEQ ID NO: 946698 - DNA, 22 bp, Artificial Sequence
  chemically synthesized
actctgaccgtgtttttattcc

SEQ ID NO: 946699 - DNA, 22 bp, Artificial Sequence
  chemically synthesized
aaggtcatgaaggtgctaactc

SEQ ID NO: 946700 - DNA, 22 bp, Artificial Sequence
  chemically synthesized
tcaaggtcatgaaggtgctaac

SEQ ID NO: 946701 - DNA, 22 bp, Artificial Sequence
  chemically synthesized
ctcaaggtcatgaaggtgctaa

SEQ ID NO: 946702 - DNA, 22 bp, Artificial Sequence
  chemically synthesized
acttctcaaggtcatgaaggtg

SEQ ID NO: 946703 - DNA, 22 bp, Artificial Sequence
  chemically synthesized
gacttctcaaggtcatgaaggt

SEQ ID NO: 946704 - DNA, 22 bp, Artificial Sequence
  chemically synthesized
ttgacttctcaaggtcatgaag

SEQ ID NO: 946705 - DNA, 22 bp, Artificial Sequence
  chemically synthesized
cttgacttctcaaggtcatgaa

SEQ ID NO: 946706 - DNA, 22 bp, Artificial Sequence
  chemically synthesized
gcaccttcatgaccttgagaag

SEQ ID NO: 946707 - DNA, 22 bp, Artificial Sequence
  chemically synthesized
gggagacttcttgacttctcaa

SEQ ID NO: 946708 - DNA, 22 bp, Artificial Sequence
  chemically synthesized
agggagacttcttgacttctca

SEQ ID NO: 946709 - DNA, 22 bp, Artificial Sequence
  chemically synthesized
catgaccttgagaagtcaagaa

SEQ ID NO: 946710 - DNA, 22 bp, Artificial Sequence
  chemically synthesized
atgaccttgagaagtcaagaag

SEQ ID NO: 946711 - DNA, 22 bp, Artificial Sequence
  chemically synthesized
ggtcttagggagacttcttgac

SEQ ID NO: 946712 - DNA, 22 bp, Artificial Sequence
  chemically synthesized
gagaagtcaagaagtctcccta

SEQ ID NO: 946713 - DNA, 22 bp, Artificial Sequence
  chemically synthesized
agaagtcaagaagtctccctaa

SEQ ID NO: 946714 - DNA, 22 bp, Artificial Sequence
  chemically synthesized
gagcccctgggtcttagggaga

SEQ ID NO: 946715 - DNA, 22 bp, Artificial Sequence
  chemically synthesized
cctggagcccctgggtcttagg

SEQ ID NO: 946716 - DNA, 22 bp, Artificial Sequence
  chemically synthesized
ttacctggagcccctgggtctt

SEQ ID NO: 946717 - DNA, 22 bp, Artificial Sequence
  chemically synthesized
tccctgttacctggagcccctg

SEQ ID NO: 946718 - DNA, 22 bp, Artificial Sequence
  chemically synthesized
cctaagacccaggggctccagg

SEQ ID NO: 946719 - DNA, 22 bp, Artificial Sequence
  chemically synthesized
tcattatccctgttacctggag

SEQ ID NO: 946720 - DNA, 22 bp, Artificial Sequence
  chemically synthesized
agacccaggggctccaggtaac

SEQ ID NO: 946721 - DNA, 22 bp, Artificial Sequence
  chemically synthesized
gtggacaactgtcattatccct

SEQ ID NO: 946722 - DNA, 22 bp, Artificial Sequence
  chemically synthesized
ggtggacaactgtcattatccc

SEQ ID NO: 946723 - DNA, 22 bp, Artificial Sequence
  chemically synthesized
caggtaacagggataatgacag

SEQ ID NO: 946724 - DNA, 22 bp, Artificial Sequence
  chemically synthesized
gtttggtggacaactgtcatta

SEQ ID NO: 946725 - DNA, 22 bp, Artificial Sequence
  chemically synthesized
atgtaaactggtttggtggaca

SEQ ID NO: 946726 - DNA, 22 bp, Artificial Sequence
  chemically synthesized
catgtaaactggtttggtggac

SEQ ID NO: 946727 - DNA, 22 bp, Artificial Sequence
  chemically synthesized
ttcatgtaaactggtttggtgg

SEQ ID NO: 946728 - DNA, 22 bp, Artificial Sequence
  chemically synthesized
ttcttcatgtaaactggtttgg

SEQ ID NO: 946729 - DNA, 22 bp, Artificial Sequence
  chemically synthesized
gttcttcatgtaaactggtttg

SEQ ID NO: 946730 - DNA, 22 bp, Artificial Sequence
  chemically synthesized
acttgttcttcatgtaaactgg

SEQ ID NO: 946731 - DNA, 22 bp, Artificial Sequence
  chemically synthesized
tcacttgttcttcatgtaaact

SEQ ID NO: 946732 - DNA, 22 bp, Artificial Sequence
  chemically synthesized
tccaccaaaccagtttacatga

SEQ ID NO: 946733 - DNA, 22 bp, Artificial Sequence
  chemically synthesized
ctcacttgttcttcatgtaaac

SEQ ID NO: 946734 - DNA, 22 bp, Artificial Sequence
  chemically synthesized
tctcacttgttcttcatgtaaa

SEQ ID NO: 946735 - DNA, 22 bp, Artificial Sequence
  chemically synthesized
actttctcacttgttcttcatg

SEQ ID NO: 946736 - DNA, 22 bp, Artificial Sequence
  chemically synthesized
ttcactttctcacttgttcttc

SEQ ID NO: 946737 - DNA, 22 bp, Artificial Sequence
  chemically synthesized
tattcactttctcacttgttct

SEQ ID NO: 946738 - DNA, 22 bp, Artificial Sequence
  chemically synthesized
ctattcactttctcacttgttc

SEQ ID NO: 946739 - DNA, 22 bp, Artificial Sequence
  chemically synthesized
tctattcactttctcacttgtt

SEQ ID NO: 946740 - DNA, 22 bp, Artificial Sequence
  chemically synthesized
ttctattcactttctcacttgt

SEQ ID NO: 946741 - DNA, 22 bp, Artificial Sequence
  chemically synthesized
acatgaagaacaagtgagaaag

SEQ ID NO: 946742 - DNA, 22 bp, Artificial Sequence
  chemically synthesized
catgaagaacaagtgagaaagt

SEQ ID NO: 946743 - DNA, 22 bp, Artificial Sequence
  chemically synthesized
cgaagggtttttctattcactt

SEQ ID NO: 946744 - DNA, 22 bp, Artificial Sequence
  chemically synthesized
acgaagggtttttctattcact

SEQ ID NO: 946745 - DNA, 22 bp, Artificial Sequence
  chemically synthesized
agagtttacgaagggtttttct

SEQ ID NO: 946746 - DNA, 22 bp, Artificial Sequence
  chemically synthesized
cagagtttacgaagggtttttc

SEQ ID NO: 946747 - DNA, 22 bp, Artificial Sequence
  chemically synthesized
ggatttcagagtttacgaaggg

SEQ ID NO: 946748 - DNA, 22 bp, Artificial Sequence
  chemically synthesized
aggatttcagagtttacgaagg

SEQ ID NO: 946749 - DNA, 22 bp, Artificial Sequence
  chemically synthesized
tttaggatttcagagtttacga

SEQ ID NO: 946750 - DNA, 22 bp, Artificial Sequence
  chemically synthesized
gtttaggatttcagagtttacg

SEQ ID NO: 946751 - DNA, 22 bp, Artificial Sequence
  chemically synthesized
cgtaaactctgaaatcctaaac

SEQ ID NO: 946752 - DNA, 22 bp, Artificial Sequence
  chemically synthesized
gtaaactctgaaatcctaaaca

SEQ ID NO: 946753 - DNA, 22 bp, Artificial Sequence
  chemically synthesized
tgaaatcctaaacaaatgttac

SEQ ID NO: 946754 - DNA, 22 bp, Artificial Sequence
  chemically synthesized
aaatcctaaacaaatgttactt

SEQ ID NO: 946755 - DNA, 22 bp, Artificial Sequence
  chemically synthesized
aacaaatgttacttattatgat

SEQ ID NO: 946756 - DNA, 22 bp, Artificial Sequence
  chemically synthesized
cttattatgatcatttctacat

SEQ ID NO: 946757 - DNA, 22 bp, Artificial Sequence
  chemically synthesized
attatgatcatttctacatgta

SEQ ID NO: 946758 - DNA, 22 bp, Artificial Sequence
  chemically synthesized
ttatgatcatttctacatgtat

SEQ ID NO: 946759 - DNA, 22 bp, Artificial Sequence
  chemically synthesized
tgatcatttctacatgtatttt

SEQ ID NO: 946760 - DNA, 22 bp, Artificial Sequence
  chemically synthesized
atccagatgaaaaaaatacatg

SEQ ID NO: 946761 - DNA, 22 bp, Artificial Sequence
  chemically synthesized
acattcatccagatgaaaaaaa

SEQ ID NO: 946762 - DNA, 22 bp, Artificial Sequence
  chemically synthesized
ctacatgtatttttttcatctg

SEQ ID NO: 946763 - DNA, 22 bp, Artificial Sequence
  chemically synthesized
tacatgtatttttttcatctgg

SEQ ID NO: 946764 - DNA, 22 bp, Artificial Sequence
  chemically synthesized
attcacattcatccagatgaaa

SEQ ID NO: 946765 - DNA, 22 bp, Artificial Sequence
  chemically synthesized
cattcacattcatccagatgaa

SEQ ID NO: 946766 - DNA, 22 bp, Artificial Sequence
  chemically synthesized
catgtatttttttcatctggat

SEQ ID NO: 946767 - DNA, 22 bp, Artificial Sequence
  chemically synthesized
tacacttcattcacattcatcc

SEQ ID NO: 946768 - DNA, 22 bp, Artificial Sequence
  chemically synthesized
ttttcatctggatgaatgtgaa

SEQ ID NO: 946769 - DNA, 22 bp, Artificial Sequence
  chemically synthesized
tttcatctggatgaatgtgaat

SEQ ID NO: 946770 - DNA, 22 bp, Artificial Sequence
  chemically synthesized
ttcatctggatgaatgtgaatg

SEQ ID NO: 946771 - DNA, 22 bp, Artificial Sequence
  chemically synthesized
tcatctggatgaatgtgaatga

SEQ ID NO: 946772 - DNA, 22 bp, Artificial Sequence
  chemically synthesized
catctggatgaatgtgaatgaa

SEQ ID NO: 946773 - DNA, 22 bp, Artificial Sequence
  chemically synthesized
atctggatgaatgtgaatgaag

SEQ ID NO: 946774 - DNA, 22 bp, Artificial Sequence
  chemically synthesized
cagaaattatacacttcattca

SEQ ID NO: 946775 - DNA, 22 bp, Artificial Sequence
  chemically synthesized
tacagaaattatacacttcatt

SEQ ID NO: 946776 - DNA, 22 bp, Artificial Sequence
  chemically synthesized
ctacagaaattatacacttcat

SEQ ID NO: 946777 - DNA, 22 bp, Artificial Sequence
  chemically synthesized
gatgaatgtgaatgaagtgtat

SEQ ID NO: 946778 - DNA, 22 bp, Artificial Sequence
  chemically synthesized
cttctacagaaattatacactt

SEQ ID NO: 946779 - DNA, 22 bp, Artificial Sequence
  chemically synthesized
gactacttctacagaaattata

SEQ ID NO: 946780 - DNA, 22 bp, Artificial Sequence
  chemically synthesized
gctcgactacttctacagaaat

SEQ ID NO: 946781 - DNA, 22 bp, Artificial Sequence
  chemically synthesized
gactagctcgactacttctaca

SEQ ID NO: 946782 - DNA, 22 bp, Artificial Sequence
  chemically synthesized
agactagctcgactacttctac

SEQ ID NO: 946783 - DNA, 22 bp, Artificial Sequence
  chemically synthesized
tagactagctcgactacttcta

SEQ ID NO: 946784 - DNA, 22 bp, Artificial Sequence
  chemically synthesized
ctttagactagctcgactactt

SEQ ID NO: 946785 - DNA, 22 bp, Artificial Sequence
  chemically synthesized
gctttagactagctcgactact

SEQ ID NO: 946786 - DNA, 22 bp, Artificial Sequence
  chemically synthesized
tgctttagactagctcgactac

SEQ ID NO: 946787 - DNA, 22 bp, Artificial Sequence
  chemically synthesized
ctgtagaagtagtcgagctagt

SEQ ID NO: 946788 - DNA, 22 bp, Artificial Sequence
  chemically synthesized
tgtagaagtagtcgagctagtc

SEQ ID NO: 946789 - DNA, 22 bp, Artificial Sequence
  chemically synthesized
tagaagtagtcgagctagtcta

SEQ ID NO: 946790 - DNA, 22 bp, Artificial Sequence
  chemically synthesized
tgacattttgctttagactagc

SEQ ID NO: 946791 - DNA, 22 bp, Artificial Sequence
  chemically synthesized
actgtgacattttgctttagac

SEQ ID NO: 946792 - DNA, 22 bp, Artificial Sequence
  chemically synthesized
aactgtgacattttgctttaga

SEQ ID NO: 946793 - DNA, 22 bp, Artificial Sequence
  chemically synthesized
taactgtgacattttgctttag

SEQ ID NO: 946794 - DNA, 22 bp, Artificial Sequence
  chemically synthesized
aaatgctttaactgtgacattt

SEQ ID NO: 946795 - DNA, 22 bp, Artificial Sequence
  chemically synthesized
gtctaaagcaaaatgtcacagt

SEQ ID NO: 946796 - DNA, 22 bp, Artificial Sequence
  chemically synthesized
tctcaaatgctttaactgtgac

SEQ ID NO: 946797 - DNA, 22 bp, Artificial Sequence
  chemically synthesized
atctcaaatgctttaactgtga

SEQ ID NO: 946798 - DNA, 22 bp, Artificial Sequence
  chemically synthesized
aagcaaaatgtcacagttaaag

SEQ ID NO: 946799 - DNA, 22 bp, Artificial Sequence
  chemically synthesized
gaccacaaatgtgccttatctc

SEQ ID NO: 946800 - DNA, 22 bp, Artificial Sequence
  chemically synthesized
ggaccacaaatgtgccttatct

SEQ ID NO: 946801 - DNA, 22 bp, Artificial Sequence
  chemically synthesized
tggaccacaaatgtgccttatc

SEQ ID NO: 946802 - DNA, 22 bp, Artificial Sequence
  chemically synthesized
aagcatttgagataaggcacat

SEQ ID NO: 946803 - DNA, 22 bp, Artificial Sequence
  chemically synthesized
gagtctttggaccacaaatgtg

SEQ ID NO: 946804 - DNA, 22 bp, Artificial Sequence
  chemically synthesized
gagataaggcacatttgtggtc

SEQ ID NO: 946805 - DNA, 22 bp, Artificial Sequence
  chemically synthesized
agataaggcacatttgtggtcc

SEQ ID NO: 946806 - DNA, 22 bp, Artificial Sequence
  chemically synthesized
atcagtagccctggagtctttg

SEQ ID NO: 946807 - DNA, 22 bp, Artificial Sequence
  chemically synthesized
taatcagtagccctggagtctt

SEQ ID NO: 946808 - DNA, 22 bp, Artificial Sequence
  chemically synthesized
tctaatcagtagccctggagtc

SEQ ID NO: 946809 - DNA, 22 bp, Artificial Sequence
  chemically synthesized
ctctaatcagtagccctggagt

SEQ ID NO: 946810 - DNA, 22 bp, Artificial Sequence
  chemically synthesized
gtggtccaaagactccagggct

SEQ ID NO: 946811 - DNA, 22 bp, Artificial Sequence
  chemically synthesized
tctctaatcagtagccctggag

SEQ ID NO: 946812 - DNA, 22 bp, Artificial Sequence
  chemically synthesized
tggtccaaagactccagggcta

SEQ ID NO: 946813 - DNA, 22 bp, Artificial Sequence
  chemically synthesized
ttctctaatcagtagccctgga

SEQ ID NO: 946814 - DNA, 22 bp, Artificial Sequence
  chemically synthesized
cagggctactgattagagaaaa

SEQ ID NO: 946815 - DNA, 22 bp, Artificial Sequence
  chemically synthesized
accagacatgcatttttctcta

SEQ ID NO: 946816 - DNA, 22 bp, Artificial Sequence
  chemically synthesized
aaccagacatgcatttttctct

SEQ ID NO: 946817 - DNA, 22 bp, Artificial Sequence
  chemically synthesized
ctgattagagaaaaatgcatgt

SEQ ID NO: 946818 - DNA, 22 bp, Artificial Sequence
  chemically synthesized
attagagaaaaatgcatgtctg

SEQ ID NO: 946819 - DNA, 22 bp, Artificial Sequence
  chemically synthesized
gagaaaaatgcatgtctggtta

SEQ ID NO: 946820 - DNA, 22 bp, Artificial Sequence
  chemically synthesized
tcatataaatgtatttaaccag

SEQ ID NO: 946821 - DNA, 22 bp, Artificial Sequence
  chemically synthesized
gtaattatcatataaatgtatt

SEQ ID NO: 946822 - DNA, 22 bp, Artificial Sequence
  chemically synthesized
tctagtaattatcatataaatg

SEQ ID NO: 946823 - DNA, 22 bp, Artificial Sequence
  chemically synthesized
gttaaatacatttatatgataa

SEQ ID NO: 946824 - DNA, 22 bp, Artificial Sequence
  chemically synthesized
aatacatttatatgataattac

SEQ ID NO: 946825 - DNA, 22 bp, Artificial Sequence
  chemically synthesized
taaagtccagattatctagtaa

SEQ ID NO: 946826 - DNA, 22 bp, Artificial Sequence
  chemically synthesized
atatgataattactagataatc

SEQ ID NO: 946827 - DNA, 22 bp, Artificial Sequence
  chemically synthesized
tatgataattactagataatct

SEQ ID NO: 946828 - DNA, 22 bp, Artificial Sequence
  chemically synthesized
aattataaagtccagattatct

SEQ ID NO: 946829 - DNA, 22 bp, Artificial Sequence
  chemically synthesized
tatctgaattataaagtccaga

SEQ ID NO: 946830 - DNA, 22 bp, Artificial Sequence
  chemically synthesized
atatctgaattataaagtccag

SEQ ID NO: 946831 - DNA, 22 bp, Artificial Sequence
  chemically synthesized
tatatctgaattataaagtcca

SEQ ID NO: 946832 - DNA, 22 bp, Artificial Sequence
  chemically synthesized
ctagataatctggactttataa

SEQ ID NO: 946833 - DNA, 22 bp, Artificial Sequence
  chemically synthesized
gataatctggactttataattc

SEQ ID NO: 946834 - DNA, 22 bp, Artificial Sequence
  chemically synthesized
acaaaatattttatatctgaat

SEQ ID NO: 946835 - DNA, 22 bp, Artificial Sequence
  chemically synthesized
aacaaaatattttatatctgaa

SEQ ID NO: 946836 - DNA, 22 bp, Artificial Sequence
  chemically synthesized
gactttataattcagatataaa

SEQ ID NO: 946837 - DNA, 22 bp, Artificial Sequence
  chemically synthesized
tataattcagatataaaatatt

SEQ ID NO: 946838 - DNA, 22 bp, Artificial Sequence
  chemically synthesized
ataattcagatataaaatattt

SEQ ID NO: 946839 - DNA, 22 bp, Artificial Sequence
  chemically synthesized
tcaaatttaacaaaatatttta

SEQ ID NO: 946840 - DNA, 22 bp, Artificial Sequence
  chemically synthesized
taattcagatataaaatatttt

SEQ ID NO: 946841 - DNA, 22 bp, Artificial Sequence
  chemically synthesized
atcaaatttaacaaaatatttt

SEQ ID NO: 946842 - DNA, 22 bp, Artificial Sequence
  chemically synthesized
tatcaaatttaacaaaatattt

SEQ ID NO: 946843 - DNA, 22 bp, Artificial Sequence
  chemically synthesized
agatataaaatattttgttaaa

SEQ ID NO: 946844 - DNA, 22 bp, Artificial Sequence
  chemically synthesized
tgttaaatttgataaaatgttg

SEQ ID NO: 946845 - DNA, 22 bp, Artificial Sequence
  chemically synthesized
gttaaatttgataaaatgttgc

SEQ ID NO: 946846 - DNA, 22 bp, Artificial Sequence
  chemically synthesized
ttaaatttgataaaatgttgcc

SEQ ID NO: 946847 - DNA, 22 bp, Artificial Sequence
  chemically synthesized
aatttgataaaatgttgcctca

SEQ ID NO: 946848 - DNA, 22 bp, Artificial Sequence
  chemically synthesized
atgaaatggagatgaggcaaca

SEQ ID NO: 946849 - DNA, 22 bp, Artificial Sequence
  chemically synthesized
gataaaatgttgcctcatctcc

SEQ ID NO: 946850 - DNA, 22 bp, Artificial Sequence
  chemically synthesized
agttgatgaaatggagatgagg

SEQ ID NO: 946851 - DNA, 22 bp, Artificial Sequence
  chemically synthesized
ataaaatgttgcctcatctcca

SEQ ID NO: 946852 - DNA, 22 bp, Artificial Sequence
  chemically synthesized
cctcatctccatttcatcaact

SEQ ID NO: 946853 - DNA, 22 bp, Artificial Sequence
  chemically synthesized
atctccatttcatcaactgaga

SEQ ID NO: 946854 - DNA, 22 bp, Artificial Sequence
  chemically synthesized
aagtcaaaataaatgtctcagt

SEQ ID NO: 946855 - DNA, 22 bp, Artificial Sequence
  chemically synthesized
catttcatcaactgagacattt

SEQ ID NO: 946856 - DNA, 22 bp, Artificial Sequence
  chemically synthesized
aagctaaagtcaaaataaatgt

SEQ ID NO: 946857 - DNA, 22 bp, Artificial Sequence
  chemically synthesized
catcaactgagacatttatttt

SEQ ID NO: 946858 - DNA, 22 bp, Artificial Sequence
  chemically synthesized
atcaactgagacatttattttg

SEQ ID NO: 946859 - DNA, 22 bp, Artificial Sequence
  chemically synthesized
taaagctaaagtcaaaataaat

SEQ ID NO: 946860 - DNA, 22 bp, Artificial Sequence
  chemically synthesized
tctctaaagctaaagtcaaaat

SEQ ID NO: 946861 - DNA, 22 bp, Artificial Sequence
  chemically synthesized
ttatctctaaagctaaagtcaa

SEQ ID NO: 946862 - DNA, 22 bp, Artificial Sequence
  chemically synthesized
agacatttattttgactttagc

SEQ ID NO: 946863 - DNA, 22 bp, Artificial Sequence
  chemically synthesized
attatctctaaagctaaagtca

SEQ ID NO: 946864 - DNA, 22 bp, Artificial Sequence
  chemically synthesized
gcttattatctctaaagctaaa

SEQ ID NO: 946865 - DNA, 22 bp, Artificial Sequence
  chemically synthesized
agcttattatctctaaagctaa

SEQ ID NO: 946866 - DNA, 22 bp, Artificial Sequence
  chemically synthesized
ttagcttattatctctaaagct

SEQ ID NO: 946867 - DNA, 22 bp, Artificial Sequence
  chemically synthesized
attttgactttagctttagaga

SEQ ID NO: 946868 - DNA, 22 bp, Artificial Sequence
  chemically synthesized
ttttgactttagctttagagat

SEQ ID NO: 946869 - DNA, 22 bp, Artificial Sequence
  chemically synthesized
tgactttagctttagagataat

SEQ ID NO: 946870 - DNA, 22 bp, Artificial Sequence
  chemically synthesized
gactttagctttagagataata

SEQ ID NO: 946871 - DNA, 22 bp, Artificial Sequence
  chemically synthesized
actttagctttagagataataa

SEQ ID NO: 946872 - DNA, 22 bp, Artificial Sequence
  chemically synthesized
tagctttagagataataagcta

SEQ ID NO: 946873 - DNA, 22 bp, Artificial Sequence
  chemically synthesized
agtggcagctcttagcttatta

SEQ ID NO: 946874 - DNA, 22 bp, Artificial Sequence
  chemically synthesized
agctttagagataataagctaa

SEQ ID NO: 946875 - DNA, 22 bp, Artificial Sequence
  chemically synthesized
gctttagagataataagctaag

SEQ ID NO: 946876 - DNA, 22 bp, Artificial Sequence
  chemically synthesized
taagtggcagctcttagcttat

SEQ ID NO: 946877 - DNA, 22 bp, Artificial Sequence
  chemically synthesized
ctaagtggcagctcttagctta

SEQ ID NO: 946878 - DNA, 22 bp, Artificial Sequence
  chemically synthesized
tagagataataagctaagagct

SEQ ID NO: 946879 - DNA, 22 bp, Artificial Sequence
  chemically synthesized
agagataataagctaagagctg

SEQ ID NO: 946880 - DNA, 22 bp, Artificial Sequence
  chemically synthesized
gagataataagctaagagctgc

SEQ ID NO: 946881 - DNA, 22 bp, Artificial Sequence
  chemically synthesized
atatgcttctaagtggcagctc

SEQ ID NO: 946882 - DNA, 22 bp, Artificial Sequence
  chemically synthesized
aatatgcttctaagtggcagct

SEQ ID NO: 946883 - DNA, 22 bp, Artificial Sequence
  chemically synthesized
taatatgcttctaagtggcagc

SEQ ID NO: 946884 - DNA, 22 bp, Artificial Sequence
  chemically synthesized
agagctgccacttagaagcata

SEQ ID NO: 946885 - DNA, 22 bp, Artificial Sequence
  chemically synthesized
gtgaagttttaatatgcttcta

SEQ ID NO: 946886 - DNA, 22 bp, Artificial Sequence
  chemically synthesized
cgtgaagttttaatatgcttct

SEQ ID NO: 946887 - DNA, 22 bp, Artificial Sequence
  chemically synthesized
ccacttagaagcatattaaaac

SEQ ID NO: 946888 - DNA, 22 bp, Artificial Sequence
  chemically synthesized
taaaacttcgtgaagttttaat

SEQ ID NO: 946889 - DNA, 22 bp, Artificial Sequence
  chemically synthesized
agaagcatattaaaacttcacg

SEQ ID NO: 946890 - DNA, 22 bp, Artificial Sequence
  chemically synthesized
gaagcatattaaaacttcacga

SEQ ID NO: 946891 - DNA, 22 bp, Artificial Sequence
  chemically synthesized
gcatgttgtaaaacttcgtgaa

SEQ ID NO: 946892 - DNA, 22 bp, Artificial Sequence
  chemically synthesized
aattagcatgttgtaaaacttc

SEQ ID NO: 946893 - DNA, 22 bp, Artificial Sequence
  chemically synthesized
aaacttcacgaagttttacaac

SEQ ID NO: 946894 - DNA, 22 bp, Artificial Sequence
  chemically synthesized
cacgaagttttacaacatgcta

SEQ ID NO: 946895 - DNA, 22 bp, Artificial Sequence
  chemically synthesized
acgaagttttacaacatgctaa

SEQ ID NO: 946896 - DNA, 22 bp, Artificial Sequence
  chemically synthesized
ataaagcattaaattagcatgt

SEQ ID NO: 946897 - DNA, 22 bp, Artificial Sequence
  chemically synthesized
tacaacatgctaatttaatgct

SEQ ID NO: 946898 - DNA, 22 bp, Artificial Sequence
  chemically synthesized
acaacatgctaatttaatgctt

SEQ ID NO: 946899 - DNA, 22 bp, Artificial Sequence
  chemically synthesized
caacatgctaatttaatgcttt

SEQ ID NO: 946900 - DNA, 22 bp, Artificial Sequence
  chemically synthesized
aatgaaataagctaataaagca

SEQ ID NO: 946901 - DNA, 22 bp, Artificial Sequence
  chemically synthesized
aaatgaaataagctaataaagc

SEQ ID NO: 946902 - DNA, 22 bp, Artificial Sequence
  chemically synthesized
atttaatgctttattagcttat

SEQ ID NO: 946903 - DNA, 22 bp, Artificial Sequence
  chemically synthesized
taatcttaaatgaaataagcta

SEQ ID NO: 946904 - DNA, 22 bp, Artificial Sequence
  chemically synthesized
gtaatcttaaatgaaataagct

SEQ ID NO: 946905 - DNA, 22 bp, Artificial Sequence
  chemically synthesized
aatgctttattagcttatttca

SEQ ID NO: 946906 - DNA, 22 bp, Artificial Sequence
  chemically synthesized
tgtaatcttaaatgaaataagc

SEQ ID NO: 946907 - DNA, 22 bp, Artificial Sequence
  chemically synthesized
atgctttattagcttatttcat

SEQ ID NO: 946908 - DNA, 22 bp, Artificial Sequence
  chemically synthesized
tttgtaatcttaaatgaaataa

SEQ ID NO: 946909 - DNA, 22 bp, Artificial Sequence
  chemically synthesized
gttctttgtaatcttaaatgaa

SEQ ID NO: 946910 - DNA, 22 bp, Artificial Sequence
  chemically synthesized
tattagcttatttcatttaaga

SEQ ID NO: 946911 - DNA, 22 bp, Artificial Sequence
  chemically synthesized
agttctttgtaatcttaaatga

SEQ ID NO: 946912 - DNA, 22 bp, Artificial Sequence
  chemically synthesized
attagcttatttcatttaagat

SEQ ID NO: 946913 - DNA, 22 bp, Artificial Sequence
  chemically synthesized
tagttctttgtaatcttaaatg

SEQ ID NO: 946914 - DNA, 22 bp, Artificial Sequence
  chemically synthesized
ttagcttatttcatttaagatt

SEQ ID NO: 946915 - DNA, 22 bp, Artificial Sequence
  chemically synthesized
gcttatttcatttaagattaca

SEQ ID NO: 946916 - DNA, 22 bp, Artificial Sequence
  chemically synthesized
atttcatttaagattacaaaga

SEQ ID NO: 946917 - DNA, 22 bp, Artificial Sequence
  chemically synthesized
tttcatttaagattacaaagaa

SEQ ID NO: 946918 - DNA, 22 bp, Artificial Sequence
  chemically synthesized
catttaagattacaaagaacta

SEQ ID NO: 946919 - DNA, 22 bp, Artificial Sequence
  chemically synthesized
atttaagattacaaagaactaa

SEQ ID NO: 946920 - DNA, 22 bp, Artificial Sequence
  chemically synthesized
accaagatcattttagttcttt

SEQ ID NO: 946921 - DNA, 22 bp, Artificial Sequence
  chemically synthesized
caccaagatcattttagttctt

SEQ ID NO: 946922 - DNA, 22 bp, Artificial Sequence
  chemically synthesized
aagattacaaagaactaaaatg

SEQ ID NO: 946923 - DNA, 22 bp, Artificial Sequence
  chemically synthesized
agattacaaagaactaaaatga

SEQ ID NO: 946924 - DNA, 22 bp, Artificial Sequence
  chemically synthesized
caaagaactaaaatgatcttgg

SEQ ID NO: 946925 - DNA, 22 bp, Artificial Sequence
  chemically synthesized
gatcaacacttcaccaagatca

SEQ ID NO: 946926 - DNA, 22 bp, Artificial Sequence
  chemically synthesized
aaatgatcttggtgaagtgttg

SEQ ID NO: 946927 - DNA, 22 bp, Artificial Sequence
  chemically synthesized
tggaatgagattggatcaacac

SEQ ID NO: 946928 - DNA, 22 bp, Artificial Sequence
  chemically synthesized
ggtgaagtgttgatccaatctc

SEQ ID NO: 946929 - DNA, 22 bp, Artificial Sequence
  chemically synthesized
gtgaagtgttgatccaatctca

SEQ ID NO: 946930 - DNA, 22 bp, Artificial Sequence
  chemically synthesized
agtcccattgtggaatgagatt

SEQ ID NO: 946931 - DNA, 22 bp, Artificial Sequence
  chemically synthesized
atccaatctcattccacaatgg

SEQ ID NO: 946932 - DNA, 22 bp, Artificial Sequence
  chemically synthesized
ggcagaaattaagtcccattgt

SEQ ID NO: 946933 - DNA, 22 bp, Artificial Sequence
  chemically synthesized
taggcagaaattaagtcccatt

SEQ ID NO: 946934 - DNA, 22 bp, Artificial Sequence
  chemically synthesized
ctaggcagaaattaagtcccat

SEQ ID NO: 946935 - DNA, 22 bp, Artificial Sequence
  chemically synthesized
attccacaatgggacttaattt

SEQ ID NO: 946936 - DNA, 22 bp, Artificial Sequence
  chemically synthesized
ccttctaggcagaaattaagtc

SEQ ID NO: 946937 - DNA, 22 bp, Artificial Sequence
  chemically synthesized
gccttctaggcagaaattaagt

SEQ ID NO: 946938 - DNA, 22 bp, Artificial Sequence
  chemically synthesized
cacaatgggacttaatttctgc

SEQ ID NO: 946939 - DNA, 22 bp, Artificial Sequence
  chemically synthesized
agtttgccttctaggcagaaat

SEQ ID NO: 946940 - DNA, 22 bp, Artificial Sequence
  chemically synthesized
aatgtctaagtttgccttctag

SEQ ID NO: 946941 - DNA, 22 bp, Artificial Sequence
  chemically synthesized
aaatgtctaagtttgccttcta

SEQ ID NO: 946942 - DNA, 22 bp, Artificial Sequence
  chemically synthesized
aatttctgcctagaaggcaaac

SEQ ID NO: 946943 - DNA, 22 bp, Artificial Sequence
  chemically synthesized
atttctgcctagaaggcaaact

SEQ ID NO: 946944 - DNA, 22 bp, Artificial Sequence
  chemically synthesized
ctgcctagaaggcaaacttaga

SEQ ID NO: 946945 - DNA, 22 bp, Artificial Sequence
  chemically synthesized
caaatttaaatgtctaagtttg

SEQ ID NO: 946946 - DNA, 22 bp, Artificial Sequence
  chemically synthesized
tgcctagaaggcaaacttagac

SEQ ID NO: 946947 - DNA, 22 bp, Artificial Sequence
  chemically synthesized
ccaaatttaaatgtctaagttt

SEQ ID NO: 946948 - DNA, 22 bp, Artificial Sequence
  chemically synthesized
cctagaaggcaaacttagacat

SEQ ID NO: 946949 - DNA, 22 bp, Artificial Sequence
  chemically synthesized
atttccaaatttaaatgtctaa

SEQ ID NO: 946950 - DNA, 22 bp, Artificial Sequence
  chemically synthesized
aatttccaaatttaaatgtcta

SEQ ID NO: 946951 - DNA, 22 bp, Artificial Sequence
  chemically synthesized
gaaggcaaacttagacatttaa

SEQ ID NO: 946952 - DNA, 22 bp, Artificial Sequence
  chemically synthesized
taatttccaaatttaaatgtct

SEQ ID NO: 946953 - DNA, 22 bp, Artificial Sequence
  chemically synthesized
ttaatttccaaatttaaatgtc

SEQ ID NO: 946954 - DNA, 22 bp, Artificial Sequence
  chemically synthesized
ttttaatttccaaatttaaatg

SEQ ID NO: 946955 - DNA, 22 bp, Artificial Sequence
  chemically synthesized
cttttaatttccaaatttaaat

SEQ ID NO: 946956 - DNA, 22 bp, Artificial Sequence
  chemically synthesized
tcttttaatttccaaatttaaa

SEQ ID NO: 946957 - DNA, 22 bp, Artificial Sequence
  chemically synthesized
tttcttttaatttccaaattta

SEQ ID NO: 946958 - DNA, 22 bp, Artificial Sequence
  chemically synthesized
ctttcttttaatttccaaattt

SEQ ID NO: 946959 - DNA, 22 bp, Artificial Sequence
  chemically synthesized
agacatttaaatttggaaatta

SEQ ID NO: 946960 - DNA, 22 bp, Artificial Sequence
  chemically synthesized
gacatttaaatttggaaattaa

SEQ ID NO: 946961 - DNA, 22 bp, Artificial Sequence
  chemically synthesized
aaatttggaaattaaaagaaag

SEQ ID NO: 946962 - DNA, 22 bp, Artificial Sequence
  chemically synthesized
aatttggaaattaaaagaaaga

SEQ ID NO: 946963 - DNA, 22 bp, Artificial Sequence
  chemically synthesized
atatataacagtttctttcttt

SEQ ID NO: 946964 - DNA, 22 bp, Artificial Sequence
  chemically synthesized
ggaaattaaaagaaagaaactg

SEQ ID NO: 946965 - DNA, 22 bp, Artificial Sequence
  chemically synthesized
gaaattaaaagaaagaaactgt

SEQ ID NO: 946966 - DNA, 22 bp, Artificial Sequence
  chemically synthesized
gtaacactgatatataacagtt

SEQ ID NO: 946967 - DNA, 22 bp, Artificial Sequence
  chemically synthesized
agtaacactgatatataacagt

SEQ ID NO: 946968 - DNA, 22 bp, Artificial Sequence
  chemically synthesized
aaagaaagaaactgttatatat

SEQ ID NO: 946969 - DNA, 22 bp, Artificial Sequence
  chemically synthesized
agggtttagtaacactgatata

SEQ ID NO: 946970 - DNA, 22 bp, Artificial Sequence
  chemically synthesized
cagggtttagtaacactgatat

SEQ ID NO: 946971 - DNA, 22 bp, Artificial Sequence
  chemically synthesized
tcttcagggtttagtaacactg

SEQ ID NO: 946972 - DNA, 22 bp, Artificial Sequence
  chemically synthesized
gtcttcagggtttagtaacact

SEQ ID NO: 946973 - DNA, 22 bp, Artificial Sequence
  chemically synthesized
tgtcttcagggtttagtaacac

SEQ ID NO: 946974 - DNA, 22 bp, Artificial Sequence
  chemically synthesized
ttgtcttcagggtttagtaaca

SEQ ID NO: 946975 - DNA, 22 bp, Artificial Sequence
  chemically synthesized
ttatatatcagtgttactaaac

SEQ ID NO: 946976 - DNA, 22 bp, Artificial Sequence
  chemically synthesized
tatatcagtgttactaaaccct

SEQ ID NO: 946977 - DNA, 22 bp, Artificial Sequence
  chemically synthesized
tatatgtttttgtcttcagggt

SEQ ID NO: 946978 - DNA, 22 bp, Artificial Sequence
  chemically synthesized
tatatatgtttttgtcttcagg

SEQ ID NO: 946979 - DNA, 22 bp, Artificial Sequence
  chemically synthesized
tctatatatgtttttgtcttca

SEQ ID NO: 946980 - DNA, 22 bp, Artificial Sequence
  chemically synthesized
ctaaaccctgaagacaaaaaca

SEQ ID NO: 946981 - DNA, 22 bp, Artificial Sequence
  chemically synthesized
aattctctatatatgtttttgt

SEQ ID NO: 946982 - DNA, 22 bp, Artificial Sequence
  chemically synthesized
caattctctatatatgtttttg

SEQ ID NO: 946983 - DNA, 22 bp, Artificial Sequence
  chemically synthesized
aaccctgaagacaaaaacatat

SEQ ID NO: 946984 - DNA, 22 bp, Artificial Sequence
  chemically synthesized
tcaattctctatatatgttttt

SEQ ID NO: 946985 - DNA, 22 bp, Artificial Sequence
  chemically synthesized
attttcaattctctatatatgt

SEQ ID NO: 946986 - DNA, 22 bp, Artificial Sequence
  chemically synthesized
aagacaaaaacatatatagaga

SEQ ID NO: 946987 - DNA, 22 bp, Artificial Sequence
  chemically synthesized
cattaattttcaattctctata

SEQ ID NO: 946988 - DNA, 22 bp, Artificial Sequence
  chemically synthesized
aactacattaattttcaattct

SEQ ID NO: 946989 - DNA, 22 bp, Artificial Sequence
  chemically synthesized
aggcagctgaactacattaatt

SEQ ID NO: 946990 - DNA, 22 bp, Artificial Sequence
  chemically synthesized
aatctcaggcagctgaactaca

SEQ ID NO: 946991 - DNA, 22 bp, Artificial Sequence
  chemically synthesized
aaaattaatgtagttcagctgc

SEQ ID NO: 946992 - DNA, 22 bp, Artificial Sequence
  chemically synthesized
atgtagttcagctgcctgagat

SEQ ID NO: 946993 - DNA, 22 bp, Artificial Sequence
  chemically synthesized
gcagcatattaaatctcaggca

SEQ ID NO: 946994 - DNA, 22 bp, Artificial Sequence
  chemically synthesized
ggcagcatattaaatctcaggc

SEQ ID NO: 946995 - DNA, 22 bp, Artificial Sequence
  chemically synthesized
tggcagcatattaaatctcagg

SEQ ID NO: 946996 - DNA, 22 bp, Artificial Sequence
  chemically synthesized
ttttggcagcatattaaatctc

SEQ ID NO: 946997 - DNA, 22 bp, Artificial Sequence
  chemically synthesized
gttttggcagcatattaaatct

SEQ ID NO: 946998 - DNA, 22 bp, Artificial Sequence
  chemically synthesized
tgttttggcagcatattaaatc

SEQ ID NO: 946999 - DNA, 22 bp, Artificial Sequence
  chemically synthesized
agctgcctgagatttaatatgc

SEQ ID NO: 947000 - DNA, 22 bp, Artificial Sequence
  chemically synthesized
cctgagatttaatatgctgcca

SEQ ID NO: 947001 - DNA, 22 bp, Artificial Sequence
  chemically synthesized
agatttaatatgctgccaaaac

SEQ ID NO: 947002 - DNA, 22 bp, Artificial Sequence
  chemically synthesized
tgaataatattttgttttggca

SEQ ID NO: 947003 - DNA, 22 bp, Artificial Sequence
  chemically synthesized
atgaataatattttgttttggc

SEQ ID NO: 947004 - DNA, 22 bp, Artificial Sequence
  chemically synthesized
tatgaataatattttgttttgg

SEQ ID NO: 947005 - DNA, 22 bp, Artificial Sequence
  chemically synthesized
aatatgctgccaaaacaaaata

SEQ ID NO: 947006 - DNA, 22 bp, Artificial Sequence
  chemically synthesized
atatgctgccaaaacaaaatat

SEQ ID NO: 947007 - DNA, 22 bp, Artificial Sequence
  chemically synthesized
aaaagtgttttatgaataatat

SEQ ID NO: 947008 - DNA, 22 bp, Artificial Sequence
  chemically synthesized
ccaaaacaaaatattattcata

SEQ ID NO: 947009 - DNA, 22 bp, Artificial Sequence
  chemically synthesized
caattgaaaagtgttttatgaa

SEQ ID NO: 947010 - DNA, 22 bp, Artificial Sequence
  chemically synthesized
tacaattgaaaagtgttttatg

SEQ ID NO: 947011 - DNA, 22 bp, Artificial Sequence
  chemically synthesized
gtctctacaattgaaaagtgtt

SEQ ID NO: 947012 - DNA, 22 bp, Artificial Sequence
  chemically synthesized
agtctctacaattgaaaagtgt

SEQ ID NO: 947013 - DNA, 22 bp, Artificial Sequence
  chemically synthesized
ttcataaaacacttttcaattg

SEQ ID NO: 947014 - DNA, 22 bp, Artificial Sequence
  chemically synthesized
ataaaacacttttcaattgtag

SEQ ID NO: 947015 - DNA, 22 bp, Artificial Sequence
  chemically synthesized
ggaggaaaataatttagtctct

SEQ ID NO: 947016 - DNA, 22 bp, Artificial Sequence
  chemically synthesized
aggaggaaaataatttagtctc

SEQ ID NO: 947017 - DNA, 22 bp, Artificial Sequence
  chemically synthesized
ttcaattgtagagactaaatta

SEQ ID NO: 947018 - DNA, 22 bp, Artificial Sequence
  chemically synthesized
tcaattgtagagactaaattat

SEQ ID NO: 947019 - DNA, 22 bp, Artificial Sequence
  chemically synthesized
caattgtagagactaaattatt

SEQ ID NO: 947020 - DNA, 22 bp, Artificial Sequence
  chemically synthesized
aattgtagagactaaattattt

SEQ ID NO: 947021 - DNA, 22 bp, Artificial Sequence
  chemically synthesized
tagagactaaattattttcctc

SEQ ID NO: 947022 - DNA, 22 bp, Artificial Sequence
  chemically synthesized
aattattttcctcctaaatatg

SEQ ID NO: 947023 - DNA, 22 bp, Artificial Sequence
  chemically synthesized
aaaggggagaaagaaacatatt

SEQ ID NO: 947024 - DNA, 22 bp, Artificial Sequence
  chemically synthesized
ttttcctcctaaatatgtttct

SEQ ID NO: 947025 - DNA, 22 bp, Artificial Sequence
  chemically synthesized
tcctcctaaatatgtttctttc

SEQ ID NO: 947026 - DNA, 22 bp, Artificial Sequence
  chemically synthesized
cctcctaaatatgtttctttct

SEQ ID NO: 947027 - DNA, 22 bp, Artificial Sequence
  chemically synthesized
ctcctaaatatgtttctttctc

SEQ ID NO: 947028 - DNA, 22 bp, Artificial Sequence
  chemically synthesized
atcgttgaaaggggagaaagaa

SEQ ID NO: 947029 - DNA, 22 bp, Artificial Sequence
  chemically synthesized
aatcgttgaaaggggagaaaga

SEQ ID NO: 947030 - DNA, 22 bp, Artificial Sequence
  chemically synthesized
ctaaatatgtttctttctcccc

SEQ ID NO: 947031 - DNA, 22 bp, Artificial Sequence
  chemically synthesized
taatcgttgaaaggggagaaag

SEQ ID NO: 947032 - DNA, 22 bp, Artificial Sequence
  chemically synthesized
ttaatcgttgaaaggggagaaa

SEQ ID NO: 947033 - DNA, 22 bp, Artificial Sequence
  chemically synthesized
tttaatcgttgaaaggggagaa

SEQ ID NO: 947034 - DNA, 22 bp, Artificial Sequence
  chemically synthesized
aatatgtttctttctccccttt

SEQ ID NO: 947035 - DNA, 22 bp, Artificial Sequence
  chemically synthesized
ctttctcccctttcaacgatta

SEQ ID NO: 947036 - DNA, 22 bp, Artificial Sequence
  chemically synthesized
tttctcccctttcaacgattaa

SEQ ID NO: 947037 - DNA, 22 bp, Artificial Sequence
  chemically synthesized
tctcccctttcaacgattaaaa

SEQ ID NO: 947038 - DNA, 22 bp, Artificial Sequence
  chemically synthesized
ctcccctttcaacgattaaaaa

SEQ ID NO: 947039 - DNA, 22 bp, Artificial Sequence
  chemically synthesized
tcccctttcaacgattaaaaaa

SEQ ID NO: 947040 - DNA, 22 bp, Artificial Sequence
  chemically synthesized
ccctttcaacgattaaaaaatg

SEQ ID NO: 947041 - DNA, 22 bp, Artificial Sequence
  chemically synthesized
caaagaggaatagatacatttt

SEQ ID NO: 947042 - DNA, 22 bp, Artificial Sequence
  chemically synthesized
tcaacgattaaaaaatgtatct

SEQ ID NO: 947043 - DNA, 22 bp, Artificial Sequence
  chemically synthesized
caacgattaaaaaatgtatcta

SEQ ID NO: 947044 - DNA, 22 bp, Artificial Sequence
  chemically synthesized
aacgattaaaaaatgtatctat

SEQ ID NO: 947045 - DNA, 22 bp, Artificial Sequence
  chemically synthesized
tgtgctacaaagaggaatagat

SEQ ID NO: 947046 - DNA, 22 bp, Artificial Sequence
  chemically synthesized
aaaaatgtatctattcctcttt

SEQ ID NO: 947047 - DNA, 22 bp, Artificial Sequence
  chemically synthesized
cgtatacatacagctatgtgct

SEQ ID NO: 947048 - DNA, 22 bp, Artificial Sequence
  chemically synthesized
ttcctctttgtagcacatagct

SEQ ID NO: 947049 - DNA, 22 bp, Artificial Sequence
  chemically synthesized
acgtatacatacagctatgtgc

SEQ ID NO: 947050 - DNA, 22 bp, Artificial Sequence
  chemically synthesized
ttacgtatacatacagctatgt

SEQ ID NO: 947051 - DNA, 22 bp, Artificial Sequence
  chemically synthesized
ctctttgtagcacatagctgta

SEQ ID NO: 947052 - DNA, 22 bp, Artificial Sequence
  chemically synthesized
tttgtagcacatagctgtatgt

SEQ ID NO: 947053 - DNA, 22 bp, Artificial Sequence
  chemically synthesized
acctcttacgtatacatacagc

SEQ ID NO: 947054 - DNA, 22 bp, Artificial Sequence
  chemically synthesized
tgtagcacatagctgtatgtat

SEQ ID NO: 947055 - DNA, 22 bp, Artificial Sequence
  chemically synthesized
gtagcacatagctgtatgtata

SEQ ID NO: 947056 - DNA, 22 bp, Artificial Sequence
  chemically synthesized
tagcacatagctgtatgtatac

SEQ ID NO: 947057 - DNA, 22 bp, Artificial Sequence
  chemically synthesized
gcattaacctcttacgtataca

SEQ ID NO: 947058 - DNA, 22 bp, Artificial Sequence
  chemically synthesized
ctggcattaacctcttacgtat

SEQ ID NO: 947059 - DNA, 22 bp, Artificial Sequence
  chemically synthesized
tagctactggcattaacctctt

SEQ ID NO: 947060 - DNA, 22 bp, Artificial Sequence
  chemically synthesized
tatgtatacgtaagaggttaat

SEQ ID NO: 947061 - DNA, 22 bp, Artificial Sequence
  chemically synthesized
ttatagctactggcattaacct

SEQ ID NO: 947062 - DNA, 22 bp, Artificial Sequence
  chemically synthesized
gttatagctactggcattaacc

SEQ ID NO: 947063 - DNA, 22 bp, Artificial Sequence
  chemically synthesized
tgttatagctactggcattaac

SEQ ID NO: 947064 - DNA, 22 bp, Artificial Sequence
  chemically synthesized
tttgttatagctactggcatta

SEQ ID NO: 947065 - DNA, 22 bp, Artificial Sequence
  chemically synthesized
tgggatctctttgttatagcta

SEQ ID NO: 947066 - DNA, 22 bp, Artificial Sequence
  chemically synthesized
atgccagtagctataacaaaga

SEQ ID NO: 947067 - DNA, 22 bp, Artificial Sequence
  chemically synthesized
aaattgtgggatctctttgtta

SEQ ID NO: 947068 - DNA, 22 bp, Artificial Sequence
  chemically synthesized
agccactaaaattgtgggatct

SEQ ID NO: 947069 - DNA, 22 bp, Artificial Sequence
  chemically synthesized
aagccactaaaattgtgggatc

SEQ ID NO: 947070 - DNA, 22 bp, Artificial Sequence
  chemically synthesized
ttaagccactaaaattgtggga

SEQ ID NO: 947071 - DNA, 22 bp, Artificial Sequence
  chemically synthesized
taacaaagagatcccacaattt

SEQ ID NO: 947072 - DNA, 22 bp, Artificial Sequence
  chemically synthesized
cttaagccactaaaattgtggg

SEQ ID NO: 947073 - DNA, 22 bp, Artificial Sequence
  chemically synthesized
tcttaagccactaaaattgtgg

SEQ ID NO: 947074 - DNA, 22 bp, Artificial Sequence
  chemically synthesized
ttcttaagccactaaaattgtg

SEQ ID NO: 947075 - DNA, 22 bp, Artificial Sequence
  chemically synthesized
ttttcttaagccactaaaattg

SEQ ID NO: 947076 - DNA, 22 bp, Artificial Sequence
  chemically synthesized
cttttcttaagccactaaaatt

SEQ ID NO: 947077 - DNA, 22 bp, Artificial Sequence
  chemically synthesized
tcttttcttaagccactaaaat

SEQ ID NO: 947078 - DNA, 22 bp, Artificial Sequence
  chemically synthesized
tttcttttcttaagccactaaa

SEQ ID NO: 947079 - DNA, 22 bp, Artificial Sequence
  chemically synthesized
tagtattctttcttttcttaag

SEQ ID NO: 947080 - DNA, 22 bp, Artificial Sequence
  chemically synthesized
gtagtattctttcttttcttaa

SEQ ID NO: 947081 - DNA, 22 bp, Artificial Sequence
  chemically synthesized
tgtagtattctttcttttctta

SEQ ID NO: 947082 - DNA, 22 bp, Artificial Sequence
  chemically synthesized
tagtggcttaagaaaagaaaga

SEQ ID NO: 947083 - DNA, 22 bp, Artificial Sequence
  chemically synthesized
agtggcttaagaaaagaaagaa

SEQ ID NO: 947084 - DNA, 22 bp, Artificial Sequence
  chemically synthesized
gtggcttaagaaaagaaagaat

SEQ ID NO: 947085 - DNA, 22 bp, Artificial Sequence
  chemically synthesized
aagaaaagaaagaatactacaa

SEQ ID NO: 947086 - DNA, 22 bp, Artificial Sequence
  chemically synthesized
agaaaagaaagaatactacaaa

SEQ ID NO: 947087 - DNA, 22 bp, Artificial Sequence
  chemically synthesized
cagatgggaatgcccattttgt

SEQ ID NO: 947088 - DNA, 22 bp, Artificial Sequence
  chemically synthesized
gcagatgggaatgcccattttg

SEQ ID NO: 947089 - DNA, 22 bp, Artificial Sequence
  chemically synthesized
tttgcagatgggaatgcccatt

SEQ ID NO: 947090 - DNA, 22 bp, Artificial Sequence
  chemically synthesized
caaaatgggcattcccatctgc

SEQ ID NO: 947091 - DNA, 22 bp, Artificial Sequence
  chemically synthesized
ggtagagaaaagctgtttgcag

SEQ ID NO: 947092 - DNA, 22 bp, Artificial Sequence
  chemically synthesized
ctgggtagagaaaagctgtttg

SEQ ID NO: 947093 - DNA, 22 bp, Artificial Sequence
  chemically synthesized
ccatctgcaaacagcttttctc

SEQ ID NO: 947094 - DNA, 22 bp, Artificial Sequence
  chemically synthesized
aattactgggtagagaaaagct

SEQ ID NO: 947095 - DNA, 22 bp, Artificial Sequence
  chemically synthesized
caaacagcttttctctacccag

SEQ ID NO: 947096 - DNA, 22 bp, Artificial Sequence
  chemically synthesized
agagtccctgaattactgggta

SEQ ID NO: 947097 - DNA, 22 bp, Artificial Sequence
  chemically synthesized
ttctctacccagtaattcaggg

SEQ ID NO: 947098 - DNA, 22 bp, Artificial Sequence
  chemically synthesized
tctctacccagtaattcaggga

SEQ ID NO: 947099 - DNA, 22 bp, Artificial Sequence
  chemically synthesized
ctctacccagtaattcagggac

SEQ ID NO: 947100 - DNA, 22 bp, Artificial Sequence
  chemically synthesized
tctacccagtaattcagggact

SEQ ID NO: 947101 - DNA, 22 bp, Artificial Sequence
  chemically synthesized
tacccagtaattcagggactct

SEQ ID NO: 947102 - DNA, 22 bp, Artificial Sequence
  chemically synthesized
cccagtaattcagggactctga

SEQ ID NO: 947103 - DNA, 22 bp, Artificial Sequence
  chemically synthesized
aaatggaaggactcagagtccc

SEQ ID NO: 947104 - DNA, 22 bp, Artificial Sequence
  chemically synthesized
agggactctgagtccttccatt

SEQ ID NO: 947105 - DNA, 22 bp, Artificial Sequence
  chemically synthesized
ggagatgaaaaagcctaaaatg

SEQ ID NO: 947106 - DNA, 22 bp, Artificial Sequence
  chemically synthesized
tgagtccttccattttaggctt

SEQ ID NO: 947107 - DNA, 22 bp, Artificial Sequence
  chemically synthesized
agtccttccattttaggctttt

SEQ ID NO: 947108 - DNA, 22 bp, Artificial Sequence
  chemically synthesized
ccattttaggctttttcatctc

SEQ ID NO: 947109 - DNA, 22 bp, Artificial Sequence
  chemically synthesized
cattttaggctttttcatctcc

SEQ ID NO: 947110 - DNA, 22 bp, Artificial Sequence
  chemically synthesized
taggctttttcatctcctaggt

SEQ ID NO: 947111 - DNA, 22 bp, Artificial Sequence
  chemically synthesized
aggctttttcatctcctaggtc

SEQ ID NO: 947112 - DNA, 22 bp, Artificial Sequence
  chemically synthesized
ggctttttcatctcctaggtct

SEQ ID NO: 947113 - DNA, 22 bp, Artificial Sequence
  chemically synthesized
tggaaaagagtcccaaagacct

SEQ ID NO: 947114 - DNA, 22 bp, Artificial Sequence
  chemically synthesized
tttcatctcctaggtctttggg

SEQ ID NO: 947115 - DNA, 22 bp, Artificial Sequence
  chemically synthesized
atggaaaagagtcccaaagacc

SEQ ID NO: 947116 - DNA, 22 bp, Artificial Sequence
  chemically synthesized
ttcatctcctaggtctttggga

SEQ ID NO: 947117 - DNA, 22 bp, Artificial Sequence
  chemically synthesized
tcatctcctaggtctttgggac

SEQ ID NO: 947118 - DNA, 22 bp, Artificial Sequence
  chemically synthesized
catctcctaggtctttgggact

SEQ ID NO: 947119 - DNA, 22 bp, Artificial Sequence
  chemically synthesized
atctcctaggtctttgggactc

SEQ ID NO: 947120 - DNA, 22 bp, Artificial Sequence
  chemically synthesized
accttatggaaaagagtcccaa

SEQ ID NO: 947121 - DNA, 22 bp, Artificial Sequence
  chemically synthesized
ctaaccttatggaaaagagtcc

SEQ ID NO: 947122 - DNA, 22 bp, Artificial Sequence
  chemically synthesized
ctaggtctttgggactcttttc

SEQ ID NO: 947123 - DNA, 22 bp, Artificial Sequence
  chemically synthesized
gctaaccttatggaaaagagtc

SEQ ID NO: 947124 - DNA, 22 bp, Artificial Sequence
  chemically synthesized
ggtctttgggactcttttccat

SEQ ID NO: 947125 - DNA, 22 bp, Artificial Sequence
  chemically synthesized
ccatttgctaaccttatggaaa

SEQ ID NO: 947126 - DNA, 22 bp, Artificial Sequence
  chemically synthesized
cccatttgctaaccttatggaa

SEQ ID NO: 947127 - DNA, 22 bp, Artificial Sequence
  chemically synthesized
tgggactcttttccataaggtt

SEQ ID NO: 947128 - DNA, 22 bp, Artificial Sequence
  chemically synthesized
gggactcttttccataaggtta

SEQ ID NO: 947129 - DNA, 22 bp, Artificial Sequence
  chemically synthesized
cttcccatttgctaaccttatg

SEQ ID NO: 947130 - DNA, 22 bp, Artificial Sequence
  chemically synthesized
ggactcttttccataaggttag

SEQ ID NO: 947131 - DNA, 22 bp, Artificial Sequence
  chemically synthesized
acttcccatttgctaaccttat

SEQ ID NO: 947132 - DNA, 22 bp, Artificial Sequence
  chemically synthesized
ttacttcccatttgctaacctt

SEQ ID NO: 947133 - DNA, 22 bp, Artificial Sequence
  chemically synthesized
cttacttcccatttgctaacct

SEQ ID NO: 947134 - DNA, 22 bp, Artificial Sequence
  chemically synthesized
ttttccataaggttagcaaatg

SEQ ID NO: 947135 - DNA, 22 bp, Artificial Sequence
  chemically synthesized
ttccataaggttagcaaatggg

SEQ ID NO: 947136 - DNA, 22 bp, Artificial Sequence
  chemically synthesized
tccataaggttagcaaatggga

SEQ ID NO: 947137 - DNA, 22 bp, Artificial Sequence
  chemically synthesized
catcttcttacttcccatttgc

SEQ ID NO: 947138 - DNA, 22 bp, Artificial Sequence
  chemically synthesized
ccataaggttagcaaatgggaa

SEQ ID NO: 947139 - DNA, 22 bp, Artificial Sequence
  chemically synthesized
ccatcttcttacttcccatttg

SEQ ID NO: 947140 - DNA, 22 bp, Artificial Sequence
  chemically synthesized
cataaggttagcaaatgggaag

SEQ ID NO: 947141 - DNA, 22 bp, Artificial Sequence
  chemically synthesized
tccatcttcttacttcccattt

SEQ ID NO: 947142 - DNA, 22 bp, Artificial Sequence
  chemically synthesized
ttccatcttcttacttcccatt

SEQ ID NO: 947143 - DNA, 22 bp, Artificial Sequence
  chemically synthesized
gcaaatgggaagtaagaagatg

SEQ ID NO: 947144 - DNA, 22 bp, Artificial Sequence
  chemically synthesized
caggcataccttttccatcttc

SEQ ID NO: 947145 - DNA, 22 bp, Artificial Sequence
  chemically synthesized
tgttgcaggcataccttttcca

SEQ ID NO: 947146 - DNA, 22 bp, Artificial Sequence
  chemically synthesized
aatgtgagtgggagttatgttg

SEQ ID NO: 947147 - DNA, 22 bp, Artificial Sequence
  chemically synthesized
tgaccaattgaatgtgagtggg

SEQ ID NO: 947148 - DNA, 22 bp, Artificial Sequence
  chemically synthesized
caacataactcccactcacatt

SEQ ID NO: 947149 - DNA, 22 bp, Artificial Sequence
  chemically synthesized
gttgtgaccaattgaatgtgag

SEQ ID NO: 947150 - DNA, 22 bp, Artificial Sequence
  chemically synthesized
ccactcacattcaattggtcac

SEQ ID NO: 947151 - DNA, 22 bp, Artificial Sequence
  chemically synthesized
gagccatgtgactagttgtgac

SEQ ID NO: 947152 - DNA, 22 bp, Artificial Sequence
  chemically synthesized
acattcaattggtcacaactag

SEQ ID NO: 947153 - DNA, 22 bp, Artificial Sequence
  chemically synthesized
gttagagccatgtgactagttg

SEQ ID NO: 947154 - DNA, 22 bp, Artificial Sequence
  chemically synthesized
aattggtcacaactagtcacat

SEQ ID NO: 947155 - DNA, 22 bp, Artificial Sequence
  chemically synthesized
gcatctagttagagccatgtga

SEQ ID NO: 947156 - DNA, 22 bp, Artificial Sequence
  chemically synthesized
gtcacaactagtcacatggctc

SEQ ID NO: 947157 - DNA, 22 bp, Artificial Sequence
  chemically synthesized
gtcacatggctctaactagatg

SEQ ID NO: 947158 - DNA, 22 bp, Artificial Sequence
  chemically synthesized
ccagccccactggcatctagtt

SEQ ID NO: 947159 - DNA, 22 bp, Artificial Sequence
  chemically synthesized
cccagccccactggcatctagt

SEQ ID NO: 947160 - DNA, 22 bp, Artificial Sequence
  chemically synthesized
catttcccagccccactggcat

SEQ ID NO: 947161 - DNA, 22 bp, Artificial Sequence
  chemically synthesized
taactagatgccagtggggctg

SEQ ID NO: 947162 - DNA, 22 bp, Artificial Sequence
  chemically synthesized
actagatgccagtggggctggg

SEQ ID NO: 947163 - DNA, 22 bp, Artificial Sequence
  chemically synthesized
gatgccagtggggctgggaaat

SEQ ID NO: 947164 - DNA, 22 bp, Artificial Sequence
  chemically synthesized
caagccagcaactacatttccc

SEQ ID NO: 947165 - DNA, 22 bp, Artificial Sequence
  chemically synthesized
ggatccagctgcaagccagcaa

SEQ ID NO: 947166 - DNA, 22 bp, Artificial Sequence
  chemically synthesized
ggaaatgtagttgctggcttgc

SEQ ID NO: 947167 - DNA, 22 bp, Artificial Sequence
  chemically synthesized
ctaggatccagctgcaagccag

SEQ ID NO: 947168 - DNA, 22 bp, Artificial Sequence
  chemically synthesized
gctaggatccagctgcaagcca

SEQ ID NO: 947169 - DNA, 22 bp, Artificial Sequence
  chemically synthesized
ttgctaggatccagctgcaagc

SEQ ID NO: 947170 - DNA, 22 bp, Artificial Sequence
  chemically synthesized
ctggcttgcagctggatcctag

SEQ ID NO: 947171 - DNA, 22 bp, Artificial Sequence
  chemically synthesized
gcttgcagctggatcctagcaa

SEQ ID NO: 947172 - DNA, 22 bp, Artificial Sequence
  chemically synthesized
atagtatagagttcttgctagg

SEQ ID NO: 947173 - DNA, 22 bp, Artificial Sequence
  chemically synthesized
catagtatagagttcttgctag

SEQ ID NO: 947174 - DNA, 22 bp, Artificial Sequence
  chemically synthesized
gcagctggatcctagcaagaac

SEQ ID NO: 947175 - DNA, 22 bp, Artificial Sequence
  chemically synthesized
tcatagtatagagttcttgcta

SEQ ID NO: 947176 - DNA, 22 bp, Artificial Sequence
  chemically synthesized
cagctggatcctagcaagaact

SEQ ID NO: 947177 - DNA, 22 bp, Artificial Sequence
  chemically synthesized
tttcatagtatagagttcttgc

SEQ ID NO: 947178 - DNA, 22 bp, Artificial Sequence
  chemically synthesized
gatcctagcaagaactctatac

SEQ ID NO: 947179 - DNA, 22 bp, Artificial Sequence
  chemically synthesized
gtggtccctctttcatagtata

SEQ ID NO: 947180 - DNA, 22 bp, Artificial Sequence
  chemically synthesized
gcaagaactctatactatgaaa

SEQ ID NO: 947181 - DNA, 22 bp, Artificial Sequence
  chemically synthesized
tatactatgaaagagggaccac

SEQ ID NO: 947182 - DNA, 22 bp, Artificial Sequence
  chemically synthesized
tactatgaaagagggaccacga

SEQ ID NO: 947183 - DNA, 22 bp, Artificial Sequence
  chemically synthesized
tgaaagagggaccacgaatttt

SEQ ID NO: 947184 - DNA, 22 bp, Artificial Sequence
  chemically synthesized
tggcagagacaagtgtacatca

SEQ ID NO: 947185 - DNA, 22 bp, Artificial Sequence
  chemically synthesized
tgatgtacacttgtctctgcca

SEQ ID NO: 947186 - DNA, 22 bp, Artificial Sequence
  chemically synthesized
aagcatatgttgtggcagagac

SEQ ID NO: 947187 - DNA, 22 bp, Artificial Sequence
  chemically synthesized
gatgtacacttgtctctgccac

SEQ ID NO: 947188 - DNA, 22 bp, Artificial Sequence
  chemically synthesized
caagcatatgttgtggcagaga

SEQ ID NO: 947189 - DNA, 22 bp, Artificial Sequence
  chemically synthesized
atgtacacttgtctctgccaca

SEQ ID NO: 947190 - DNA, 22 bp, Artificial Sequence
  chemically synthesized
tcaagcatatgttgtggcagag

SEQ ID NO: 947191 - DNA, 22 bp, Artificial Sequence
  chemically synthesized
tttcaagcatatgttgtggcag

SEQ ID NO: 947192 - DNA, 22 bp, Artificial Sequence
  chemically synthesized
ctttcaagcatatgttgtggca

SEQ ID NO: 947193 - DNA, 22 bp, Artificial Sequence
  chemically synthesized
tctttcaagcatatgttgtggc

SEQ ID NO: 947194 - DNA, 22 bp, Artificial Sequence
  chemically synthesized
ttctttcaagcatatgttgtgg

SEQ ID NO: 947195 - DNA, 22 bp, Artificial Sequence
  chemically synthesized
ttttctttcaagcatatgttgt

SEQ ID NO: 947196 - DNA, 22 bp, Artificial Sequence
  chemically synthesized
cttttctttcaagcatatgttg

SEQ ID NO: 947197 - DNA, 22 bp, Artificial Sequence
  chemically synthesized
tcttttctttcaagcatatgtt

SEQ ID NO: 947198 - DNA, 22 bp, Artificial Sequence
  chemically synthesized
gtctctgccacaacatatgctt

SEQ ID NO: 947199 - DNA, 22 bp, Artificial Sequence
  chemically synthesized
tctctgccacaacatatgcttg

SEQ ID NO: 947200 - DNA, 22 bp, Artificial Sequence
  chemically synthesized
tgccacaacatatgcttgaaag

SEQ ID NO: 947201 - DNA, 22 bp, Artificial Sequence
  chemically synthesized
aacctttcttttctttcaagca

SEQ ID NO: 947202 - DNA, 22 bp, Artificial Sequence
  chemically synthesized
ccacaacatatgcttgaaagaa

SEQ ID NO: 947203 - DNA, 22 bp, Artificial Sequence
  chemically synthesized
gaaagaaaagaaaggttgagta

SEQ ID NO: 947204 - DNA, 22 bp, Artificial Sequence
  chemically synthesized
aaagaaaagaaaggttgagtat

SEQ ID NO: 947205 - DNA, 22 bp, Artificial Sequence
  chemically synthesized
agtattatgacacacacacaca

SEQ ID NO: 947206 - DNA, 22 bp, Artificial Sequence
  chemically synthesized
tgacacacacacacacgcacgt

SEQ ID NO: 947207 - DNA, 22 bp, Artificial Sequence
  chemically synthesized
tgtgtgtgtgtgtgtgtgcacg

SEQ ID NO: 947208 - DNA, 22 bp, Artificial Sequence
  chemically synthesized
tgtgtgtgtgtgtgtgtgtgca

SEQ ID NO: 947209 - DNA, 22 bp, Artificial Sequence
  chemically synthesized
tctgtgtgtgtgtgtgtgtgtg

SEQ ID NO: 947210 - DNA, 22 bp, Artificial Sequence
  chemically synthesized
tctctgtgtgtgtgtgtgtgtg

SEQ ID NO: 947211 - DNA, 22 bp, Artificial Sequence
  chemically synthesized
tctctctgtgtgtgtgtgtgtg

SEQ ID NO: 947212 - DNA, 22 bp, Artificial Sequence
  chemically synthesized
tctctctctgtgtgtgtgtgtg

SEQ ID NO: 947213 - DNA, 22 bp, Artificial Sequence
  chemically synthesized
tctctctctctgtgtgtgtgtg

SEQ ID NO: 947214 - DNA, 22 bp, Artificial Sequence
  chemically synthesized
tctctctctctctgtgtgtgtg

SEQ ID NO: 947215 - DNA, 22 bp, Artificial Sequence
  chemically synthesized
tctctctctctctctgtgtgtg

SEQ ID NO: 947216 - DNA, 22 bp, Artificial Sequence
  chemically synthesized
tctctctctctctctctgtgtg

SEQ ID NO: 947217 - DNA, 22 bp, Artificial Sequence
  chemically synthesized
tctctctctctctctctctgtg

SEQ ID NO: 947218 - DNA, 22 bp, Artificial Sequence
  chemically synthesized
tctctctctctctctctctctg

SEQ ID NO: 947219 - DNA, 22 bp, Artificial Sequence
  chemically synthesized
ctctctctctctctctctctct

SEQ ID NO: 947220 - DNA, 22 bp, Artificial Sequence
  chemically synthesized
ccccgcttctctctctctctct

SEQ ID NO: 947221 - DNA, 22 bp, Artificial Sequence
  chemically synthesized
cccccgcttctctctctctctc

SEQ ID NO: 947222 - DNA, 22 bp, Artificial Sequence
  chemically synthesized
cccagccttcccccgcttctct

SEQ ID NO: 947223 - DNA, 22 bp, Artificial Sequence
  chemically synthesized
tccccagccttcccccgcttct

SEQ ID NO: 947224 - DNA, 22 bp, Artificial Sequence
  chemically synthesized
tctccccagccttcccccgctt

SEQ ID NO: 947225 - DNA, 22 bp, Artificial Sequence
  chemically synthesized
tctctccccagccttcccccgc

SEQ ID NO: 947226 - DNA, 22 bp, Artificial Sequence
  chemically synthesized
tctctctccccagccttccccc

SEQ ID NO: 947227 - DNA, 22 bp, Artificial Sequence
  chemically synthesized
tctctctctccccagccttccc

SEQ ID NO: 947228 - DNA, 22 bp, Artificial Sequence
  chemically synthesized
tctctctctctccccagccttc

SEQ ID NO: 947229 - DNA, 22 bp, Artificial Sequence
  chemically synthesized
tctctctctctctccccagcct

SEQ ID NO: 947230 - DNA, 22 bp, Artificial Sequence
  chemically synthesized
gggagagagagagagagagact

SEQ ID NO: 947231 - DNA, 22 bp, Artificial Sequence
  chemically synthesized
gagaacaggatgaaaggtatga

SEQ ID NO: 947232 - DNA, 22 bp, Artificial Sequence
  chemically synthesized
tcatatttttcatacctttcat

SEQ ID NO: 947233 - DNA, 22 bp, Artificial Sequence
  chemically synthesized
catatttttcatacctttcatc

SEQ ID NO: 947234 - DNA, 22 bp, Artificial Sequence
  chemically synthesized
atatttttcatacctttcatcc

SEQ ID NO: 947235 - DNA, 22 bp, Artificial Sequence
  chemically synthesized
gatgctagagaacaggatgaaa

SEQ ID NO: 947236 - DNA, 22 bp, Artificial Sequence
  chemically synthesized
agatgctagagaacaggatgaa

SEQ ID NO: 947237 - DNA, 22 bp, Artificial Sequence
  chemically synthesized
ttcatacctttcatcctgttct

SEQ ID NO: 947238 - DNA, 22 bp, Artificial Sequence
  chemically synthesized
cttagatgctagagaacaggat

SEQ ID NO: 947239 - DNA, 22 bp, Artificial Sequence
  chemically synthesized
tcatacctttcatcctgttctc

SEQ ID NO: 947240 - DNA, 22 bp, Artificial Sequence
  chemically synthesized
acttagatgctagagaacagga

SEQ ID NO: 947241 - DNA, 22 bp, Artificial Sequence
  chemically synthesized
catacctttcatcctgttctct

SEQ ID NO: 947242 - DNA, 22 bp, Artificial Sequence
  chemically synthesized
atacctttcatcctgttctcta

SEQ ID NO: 947243 - DNA, 22 bp, Artificial Sequence
  chemically synthesized
tttacttagatgctagagaaca

SEQ ID NO: 947244 - DNA, 22 bp, Artificial Sequence
  chemically synthesized
tatttacttagatgctagagaa

SEQ ID NO: 947245 - DNA, 22 bp, Artificial Sequence
  chemically synthesized
ctatttacttagatgctagaga

SEQ ID NO: 947246 - DNA, 22 bp, Artificial Sequence
  chemically synthesized
tcatcctgttctctagcatcta

SEQ ID NO: 947247 - DNA, 22 bp, Artificial Sequence
  chemically synthesized
catcctgttctctagcatctaa

SEQ ID NO: 947248 - DNA, 22 bp, Artificial Sequence
  chemically synthesized
atcctgttctctagcatctaag

SEQ ID NO: 947249 - DNA, 22 bp, Artificial Sequence
  chemically synthesized
ttctctagcatctaagtaaata

SEQ ID NO: 947250 - DNA, 22 bp, Artificial Sequence
  chemically synthesized
tctagcatctaagtaaatagaa

SEQ ID NO: 947251 - DNA, 22 bp, Artificial Sequence
  chemically synthesized
tagcatctaagtaaatagaaat

SEQ ID NO: 947252 - DNA, 22 bp, Artificial Sequence
  chemically synthesized
gcatctaagtaaatagaaatgc

SEQ ID NO: 947253 - DNA, 22 bp, Artificial Sequence
  chemically synthesized
acagaaggggaggtacagcatt

SEQ ID NO: 947254 - DNA, 22 bp, Artificial Sequence
  chemically synthesized
agtaaatagaaatgctgtacct

SEQ ID NO: 947255 - DNA, 22 bp, Artificial Sequence
  chemically synthesized
agggagaaaaatgagttaacag

SEQ ID NO: 947256 - DNA, 22 bp, Artificial Sequence
  chemically synthesized
tacctccccttctgttaactca

SEQ ID NO: 947257 - DNA, 22 bp, Artificial Sequence
  chemically synthesized
aagggagaaaaatgagttaaca

SEQ ID NO: 947258 - DNA, 22 bp, Artificial Sequence
  chemically synthesized
cccttctgttaactcatttttc

SEQ ID NO: 947259 - DNA, 22 bp, Artificial Sequence
  chemically synthesized
catgtttaagggagaaaaatga

SEQ ID NO: 947260 - DNA, 22 bp, Artificial Sequence
  chemically synthesized
tacatgtttaagggagaaaaat

SEQ ID NO: 947261 - DNA, 22 bp, Artificial Sequence
  chemically synthesized
ctacatgtttaagggagaaaaa

SEQ ID NO: 947262 - DNA, 22 bp, Artificial Sequence
  chemically synthesized
ctgttaactcatttttctccct

SEQ ID NO: 947263 - DNA, 22 bp, Artificial Sequence
  chemically synthesized
tgttaactcatttttctccctt

SEQ ID NO: 947264 - DNA, 22 bp, Artificial Sequence
  chemically synthesized
ttaactcatttttctcccttaa

SEQ ID NO: 947265 - DNA, 22 bp, Artificial Sequence
  chemically synthesized
tcttctacatgtttaagggaga

SEQ ID NO: 947266 - DNA, 22 bp, Artificial Sequence
  chemically synthesized
gtcttctacatgtttaagggag

SEQ ID NO: 947267 - DNA, 22 bp, Artificial Sequence
  chemically synthesized
tgtcttctacatgtttaaggga

SEQ ID NO: 947268 - DNA, 22 bp, Artificial Sequence
  chemically synthesized
actcatttttctcccttaaaca

SEQ ID NO: 947269 - DNA, 22 bp, Artificial Sequence
  chemically synthesized
ctttgtcttctacatgtttaag

SEQ ID NO: 947270 - DNA, 22 bp, Artificial Sequence
  chemically synthesized
actttgtcttctacatgtttaa

SEQ ID NO: 947271 - DNA, 22 bp, Artificial Sequence
  chemically synthesized
atttttctcccttaaacatgta

SEQ ID NO: 947272 - DNA, 22 bp, Artificial Sequence
  chemically synthesized
ttctcccttaaacatgtagaag

SEQ ID NO: 947273 - DNA, 22 bp, Artificial Sequence
  chemically synthesized
tctcccttaaacatgtagaaga

SEQ ID NO: 947274 - DNA, 22 bp, Artificial Sequence
  chemically synthesized
ctcccttaaacatgtagaagac

SEQ ID NO: 947275 - DNA, 22 bp, Artificial Sequence
  chemically synthesized
tcccttaaacatgtagaagaca

SEQ ID NO: 947276 - DNA, 22 bp, Artificial Sequence
  chemically synthesized
ccaggacttactttgtcttcta

SEQ ID NO: 947277 - DNA, 22 bp, Artificial Sequence
  chemically synthesized
ccttaaacatgtagaagacaaa

SEQ ID NO: 947278 - DNA, 22 bp, Artificial Sequence
  chemically synthesized
tgccaggacttactttgtcttc

SEQ ID NO: 947279 - DNA, 22 bp, Artificial Sequence
  chemically synthesized
tctgccaggacttactttgtct

SEQ ID NO: 947280 - DNA, 22 bp, Artificial Sequence
  chemically synthesized
aaacatgtagaagacaaagtaa

SEQ ID NO: 947281 - DNA, 22 bp, Artificial Sequence
  chemically synthesized
ctctgccaggacttactttgtc

SEQ ID NO: 947282 - DNA, 22 bp, Artificial Sequence
  chemically synthesized
aacatgtagaagacaaagtaag

SEQ ID NO: 947283 - DNA, 22 bp, Artificial Sequence
  chemically synthesized
tctctgccaggacttactttgt

SEQ ID NO: 947284 - DNA, 22 bp, Artificial Sequence
  chemically synthesized
ttctctgccaggacttactttg

SEQ ID NO: 947285 - DNA, 22 bp, Artificial Sequence
  chemically synthesized
tttctctgccaggacttacttt

SEQ ID NO: 947286 - DNA, 22 bp, Artificial Sequence
  chemically synthesized
ttttctctgccaggacttactt

SEQ ID NO: 947287 - DNA, 22 bp, Artificial Sequence
  chemically synthesized
tttttctctgccaggacttact

SEQ ID NO: 947288 - DNA, 22 bp, Artificial Sequence
  chemically synthesized
caccaagctttttttctctgcc

SEQ ID NO: 947289 - DNA, 22 bp, Artificial Sequence
  chemically synthesized
acaccaagctttttttctctgc

SEQ ID NO: 947290 - DNA, 22 bp, Artificial Sequence
  chemically synthesized
tacaccaagctttttttctctg

SEQ ID NO: 947291 - DNA, 22 bp, Artificial Sequence
  chemically synthesized
tttacaccaagctttttttctc

SEQ ID NO: 947292 - DNA, 22 bp, Artificial Sequence
  chemically synthesized
ctttacaccaagctttttttct

SEQ ID NO: 947293 - DNA, 22 bp, Artificial Sequence
  chemically synthesized
ttctttacaccaagcttttttt

SEQ ID NO: 947294 - DNA, 22 bp, Artificial Sequence
  chemically synthesized
cttctttacaccaagctttttt

SEQ ID NO: 947295 - DNA, 22 bp, Artificial Sequence
  chemically synthesized
tcttctttacaccaagcttttt

SEQ ID NO: 947296 - DNA, 22 bp, Artificial Sequence
  chemically synthesized
ctttcttctttacaccaagctt

SEQ ID NO: 947297 - DNA, 22 bp, Artificial Sequence
  chemically synthesized
gcagagaaaaaaagcttggtgt

SEQ ID NO: 947298 - DNA, 22 bp, Artificial Sequence
  chemically synthesized
aagaattcctttcttctttaca

SEQ ID NO: 947299 - DNA, 22 bp, Artificial Sequence
  chemically synthesized
caagaattcctttcttctttac

SEQ ID NO: 947300 - DNA, 22 bp, Artificial Sequence
  chemically synthesized
ggtgtaaagaagaaaggaattc

SEQ ID NO: 947301 - DNA, 22 bp, Artificial Sequence
  chemically synthesized
gtgtaaagaagaaaggaattct

SEQ ID NO: 947302 - DNA, 22 bp, Artificial Sequence
  chemically synthesized
gtgtccccaacttcaagaattc

SEQ ID NO: 947303 - DNA, 22 bp, Artificial Sequence
  chemically synthesized
tagtgtccccaacttcaagaat

SEQ ID NO: 947304 - DNA, 22 bp, Artificial Sequence
  chemically synthesized
ataatctctagtgtccccaact

SEQ ID NO: 947305 - DNA, 22 bp, Artificial Sequence
  chemically synthesized
ttgaagttggggacactagaga

SEQ ID NO: 947306 - DNA, 22 bp, Artificial Sequence
  chemically synthesized
gaagttggggacactagagatt

SEQ ID NO: 947307 - DNA, 22 bp, Artificial Sequence
  chemically synthesized
aagttggggacactagagatta

SEQ ID NO: 947308 - DNA, 22 bp, Artificial Sequence
  chemically synthesized
gggacactagagattatcagtt

SEQ ID NO: 947309 - DNA, 22 bp, Artificial Sequence
  chemically synthesized
atgcagggaaaaataaaaacaa

SEQ ID NO: 947310 - DNA, 22 bp, Artificial Sequence
  chemically synthesized
gagattatcagttgtttttatt

SEQ ID NO: 947311 - DNA, 22 bp, Artificial Sequence
  chemically synthesized
gatgcagggaaaaataaaaaca

SEQ ID NO: 947312 - DNA, 22 bp, Artificial Sequence
  chemically synthesized
tcagttgtttttatttttccct

SEQ ID NO: 947313 - DNA, 22 bp, Artificial Sequence
  chemically synthesized
tttttatttttccctgcatcaa

SEQ ID NO: 947314 - DNA, 22 bp, Artificial Sequence
  chemically synthesized
ttatttttccctgcatcaaacc

SEQ ID NO: 947315 - DNA, 22 bp, Artificial Sequence
  chemically synthesized
ggaaagaatccaggtttgatgc

SEQ ID NO: 947316 - DNA, 22 bp, Artificial Sequence
  chemically synthesized
tatttttccctgcatcaaacct

SEQ ID NO: 947317 - DNA, 22 bp, Artificial Sequence
  chemically synthesized
atttttccctgcatcaaacctg

SEQ ID NO: 947318 - DNA, 22 bp, Artificial Sequence
  chemically synthesized
tttttccctgcatcaaacctgg

SEQ ID NO: 947319 - DNA, 22 bp, Artificial Sequence
  chemically synthesized
ttccctgcatcaaacctggatt

SEQ ID NO: 947320 - DNA, 22 bp, Artificial Sequence
  chemically synthesized
tccctgcatcaaacctggattc

SEQ ID NO: 947321 - DNA, 22 bp, Artificial Sequence
  chemically synthesized
ccctgcatcaaacctggattct

SEQ ID NO: 947322 - DNA, 22 bp, Artificial Sequence
  chemically synthesized
cctgcatcaaacctggattctt

SEQ ID NO: 947323 - DNA, 22 bp, Artificial Sequence
  chemically synthesized
catcaaacctggattctttcct

SEQ ID NO: 947324 - DNA, 22 bp, Artificial Sequence
  chemically synthesized
caaaccaaggggtattaggaaa

SEQ ID NO: 947325 - DNA, 22 bp, Artificial Sequence
  chemically synthesized
gattctttcctaataccccttg

SEQ ID NO: 947326 - DNA, 22 bp, Artificial Sequence
  chemically synthesized
tttcctaataccccttggtttg

SEQ ID NO: 947327 - DNA, 22 bp, Artificial Sequence
  chemically synthesized
ataatgagaactacaaaccaag

SEQ ID NO: 947328 - DNA, 22 bp, Artificial Sequence
  chemically synthesized
tcctaataccccttggtttgta

SEQ ID NO: 947329 - DNA, 22 bp, Artificial Sequence
  chemically synthesized
cctaataccccttggtttgtag

SEQ ID NO: 947330 - DNA, 22 bp, Artificial Sequence
  chemically synthesized
ctaataccccttggtttgtagt

SEQ ID NO: 947331 - DNA, 22 bp, Artificial Sequence
  chemically synthesized
ataccccttggtttgtagttct

SEQ ID NO: 947332 - DNA, 22 bp, Artificial Sequence
  chemically synthesized
atgctgataatgagaactacaa

SEQ ID NO: 947333 - DNA, 22 bp, Artificial Sequence
  chemically synthesized
catgctgataatgagaactaca

SEQ ID NO: 947334 - DNA, 22 bp, Artificial Sequence
  chemically synthesized
atttcatgctgataatgagaac

SEQ ID NO: 947335 - DNA, 22 bp, Artificial Sequence
  chemically synthesized
catttcatgctgataatgagaa

SEQ ID NO: 947336 - DNA, 22 bp, Artificial Sequence
  chemically synthesized
tcatttcatgctgataatgaga

SEQ ID NO: 947337 - DNA, 22 bp, Artificial Sequence
  chemically synthesized
ggtttgtagttctcattatcag

SEQ ID NO: 947338 - DNA, 22 bp, Artificial Sequence
  chemically synthesized
tttcatttcatgctgataatga

SEQ ID NO: 947339 - DNA, 22 bp, Artificial Sequence
  chemically synthesized
gtttgtagttctcattatcagc

SEQ ID NO: 947340 - DNA, 22 bp, Artificial Sequence
  chemically synthesized
gtagttctcattatcagcatga

SEQ ID NO: 947341 - DNA, 22 bp, Artificial Sequence
  chemically synthesized
tagttctcattatcagcatgaa

SEQ ID NO: 947342 - DNA, 22 bp, Artificial Sequence
  chemically synthesized
catcctctttcatttcatgctg

SEQ ID NO: 947343 - DNA, 22 bp, Artificial Sequence
  chemically synthesized
tcattatcagcatgaaatgaaa

SEQ ID NO: 947344 - DNA, 22 bp, Artificial Sequence
  chemically synthesized
aattacatcctctttcatttca

SEQ ID NO: 947345 - DNA, 22 bp, Artificial Sequence
  chemically synthesized
attatcagcatgaaatgaaaga

SEQ ID NO: 947346 - DNA, 22 bp, Artificial Sequence
  chemically synthesized
tcagcatgaaatgaaagaggat

SEQ ID NO: 947347 - DNA, 22 bp, Artificial Sequence
  chemically synthesized
taaccctgaattacatcctctt

SEQ ID NO: 947348 - DNA, 22 bp, Artificial Sequence
  chemically synthesized
tggtggggctataaccctgaat

SEQ ID NO: 947349 - DNA, 22 bp, Artificial Sequence
  chemically synthesized
ctatggtggggctataaccctg

SEQ ID NO: 947350 - DNA, 22 bp, Artificial Sequence
  chemically synthesized
agggttcctatggtggggctat

SEQ ID NO: 947351 - DNA, 22 bp, Artificial Sequence
  chemically synthesized
agggttatagccccaccatagg

SEQ ID NO: 947352 - DNA, 22 bp, Artificial Sequence
  chemically synthesized
tagttcagggttcctatggtgg

SEQ ID NO: 947353 - DNA, 22 bp, Artificial Sequence
  chemically synthesized
agactgtagttcagggttccta

SEQ ID NO: 947354 - DNA, 22 bp, Artificial Sequence
  chemically synthesized
tagccccaccataggaaccctg

SEQ ID NO: 947355 - DNA, 22 bp, Artificial Sequence
  chemically synthesized
aagactgtagttcagggttcct

SEQ ID NO: 947356 - DNA, 22 bp, Artificial Sequence
  chemically synthesized
ttaagactgtagttcagggttc

SEQ ID NO: 947357 - DNA, 22 bp, Artificial Sequence
  chemically synthesized
cttaagactgtagttcagggtt

SEQ ID NO: 947358 - DNA, 22 bp, Artificial Sequence
  chemically synthesized
tcttaagactgtagttcagggt

SEQ ID NO: 947359 - DNA, 22 bp, Artificial Sequence
  chemically synthesized
aactttcttaagactgtagttc

SEQ ID NO: 947360 - DNA, 22 bp, Artificial Sequence
  chemically synthesized
aaactttcttaagactgtagtt

SEQ ID NO: 947361 - DNA, 22 bp, Artificial Sequence
  chemically synthesized
agtcttaaactttcttaagact

SEQ ID NO: 947362 - DNA, 22 bp, Artificial Sequence
  chemically synthesized
aactacagtcttaagaaagttt

SEQ ID NO: 947363 - DNA, 22 bp, Artificial Sequence
  chemically synthesized
aagggttcagtcttaaactttc

SEQ ID NO: 947364 - DNA, 22 bp, Artificial Sequence
  chemically synthesized
cagtcttaagaaagtttaagac

SEQ ID NO: 947365 - DNA, 22 bp, Artificial Sequence
  chemically synthesized
aagaaagtttaagactgaaccc

SEQ ID NO: 947366 - DNA, 22 bp, Artificial Sequence
  chemically synthesized
agaaagtttaagactgaaccct

SEQ ID NO: 947367 - DNA, 22 bp, Artificial Sequence
  chemically synthesized
tgtaaggtaacaggctaaaggg

SEQ ID NO: 947368 - DNA, 22 bp, Artificial Sequence
  chemically synthesized
gtgtaaggtaacaggctaaagg

SEQ ID NO: 947369 - DNA, 22 bp, Artificial Sequence
  chemically synthesized
tgtgtaaggtaacaggctaaag

SEQ ID NO: 947370 - DNA, 22 bp, Artificial Sequence
  chemically synthesized
aagactgaaccctttagcctgt

SEQ ID NO: 947371 - DNA, 22 bp, Artificial Sequence
  chemically synthesized
agactgaaccctttagcctgtt

SEQ ID NO: 947372 - DNA, 22 bp, Artificial Sequence
  chemically synthesized
aaccctttagcctgttacctta

SEQ ID NO: 947373 - DNA, 22 bp, Artificial Sequence
  chemically synthesized
cacagtgctttgtgtaaggtaa

SEQ ID NO: 947374 - DNA, 22 bp, Artificial Sequence
  chemically synthesized
tagcctgttaccttacacaaag

SEQ ID NO: 947375 - DNA, 22 bp, Artificial Sequence
  chemically synthesized
agcctgttaccttacacaaagc

SEQ ID NO: 947376 - DNA, 22 bp, Artificial Sequence
  chemically synthesized
gcctgttaccttacacaaagca

SEQ ID NO: 947377 - DNA, 22 bp, Artificial Sequence
  chemically synthesized
aagggactccacagtgctttgt

SEQ ID NO: 947378 - DNA, 22 bp, Artificial Sequence
  chemically synthesized
ttaccttacacaaagcactgtg

SEQ ID NO: 947379 - DNA, 22 bp, Artificial Sequence
  chemically synthesized
ccttacacaaagcactgtggag

SEQ ID NO: 947380 - DNA, 22 bp, Artificial Sequence
  chemically synthesized
aagttcaagggactccacagtg

SEQ ID NO: 947381 - DNA, 22 bp, Artificial Sequence
  chemically synthesized
tcaagttcaagggactccacag

SEQ ID NO: 947382 - DNA, 22 bp, Artificial Sequence
  chemically synthesized
acacaaagcactgtggagtccc

SEQ ID NO: 947383 - DNA, 22 bp, Artificial Sequence
  chemically synthesized
cacaaagcactgtggagtccct

SEQ ID NO: 947384 - DNA, 22 bp, Artificial Sequence
  chemically synthesized
agggatctctcaagttcaaggg

SEQ ID NO: 947385 - DNA, 22 bp, Artificial Sequence
  chemically synthesized
tggagtcccttgaacttgagag

SEQ ID NO: 947386 - DNA, 22 bp, Artificial Sequence
  chemically synthesized
ccacggtaatctgagggatctc

SEQ ID NO: 947387 - DNA, 22 bp, Artificial Sequence
  chemically synthesized
gaacttgagagatccctcagat

SEQ ID NO: 947388 - DNA, 22 bp, Artificial Sequence
  chemically synthesized
aacttgagagatccctcagatt

SEQ ID NO: 947389 - DNA, 22 bp, Artificial Sequence
  chemically synthesized
gagagatccctcagattaccgt

SEQ ID NO: 947390 - DNA, 22 bp, Artificial Sequence
  chemically synthesized
agagatccctcagattaccgtg

SEQ ID NO: 947391 - DNA, 22 bp, Artificial Sequence
  chemically synthesized
tgaaataagaggctgccacggt

SEQ ID NO: 947392 - DNA, 22 bp, Artificial Sequence
  chemically synthesized
gtgaaataagaggctgccacgg

SEQ ID NO: 947393 - DNA, 22 bp, Artificial Sequence
  chemically synthesized
tgtgaaataagaggctgccacg

SEQ ID NO: 947394 - DNA, 22 bp, Artificial Sequence
  chemically synthesized
ttgtgaaataagaggctgccac

SEQ ID NO: 947395 - DNA, 22 bp, Artificial Sequence
  chemically synthesized
agattaccgtggcagcctctta

SEQ ID NO: 947396 - DNA, 22 bp, Artificial Sequence
  chemically synthesized
ccgtggcagcctcttatttcac

SEQ ID NO: 947397 - DNA, 22 bp, Artificial Sequence
  chemically synthesized
aaatgacataacttttgtgaaa

SEQ ID NO: 947398 - DNA, 22 bp, Artificial Sequence
  chemically synthesized
caaatgacataacttttgtgaa

SEQ ID NO: 947399 - DNA, 22 bp, Artificial Sequence
  chemically synthesized
tatttcaaatgacataactttt

SEQ ID NO: 947400 - DNA, 22 bp, Artificial Sequence
  chemically synthesized
tgtatttcaaatgacataactt

SEQ ID NO: 947401 - DNA, 22 bp, Artificial Sequence
  chemically synthesized
ttatttcacaaaagttatgtca

SEQ ID NO: 947402 - DNA, 22 bp, Artificial Sequence
  chemically synthesized
atttcacaaaagttatgtcatt

SEQ ID NO: 947403 - DNA, 22 bp, Artificial Sequence
  chemically synthesized
tttcacaaaagttatgtcattt

SEQ ID NO: 947404 - DNA, 22 bp, Artificial Sequence
  chemically synthesized
attctgtatttcaaatgacata

SEQ ID NO: 947405 - DNA, 22 bp, Artificial Sequence
  chemically synthesized
cacaaaagttatgtcatttgaa

SEQ ID NO: 947406 - DNA, 22 bp, Artificial Sequence
  chemically synthesized
acaaaagttatgtcatttgaaa

SEQ ID NO: 947407 - DNA, 22 bp, Artificial Sequence
  chemically synthesized
tgtcatttgaaatacagaatca

SEQ ID NO: 947408 - DNA, 22 bp, Artificial Sequence
  chemically synthesized
aagagaagatggatgtattgat

SEQ ID NO: 947409 - DNA, 22 bp, Artificial Sequence
  chemically synthesized
gaaatacagaatcaatacatcc

SEQ ID NO: 947410 - DNA, 22 bp, Artificial Sequence
  chemically synthesized
aaatacagaatcaatacatcca

SEQ ID NO: 947411 - DNA, 22 bp, Artificial Sequence
  chemically synthesized
ctcaagagaagatggatgtatt

SEQ ID NO: 947412 - DNA, 22 bp, Artificial Sequence
  chemically synthesized
ttcctcaagagaagatggatgt

SEQ ID NO: 947413 - DNA, 22 bp, Artificial Sequence
  chemically synthesized
gcattattcctcaagagaagat

SEQ ID NO: 947414 - DNA, 22 bp, Artificial Sequence
  chemically synthesized
acagcactcgcattattcctca

SEQ ID NO: 947415 - DNA, 22 bp, Artificial Sequence
  chemically synthesized
gacagcactcgcattattcctc

SEQ ID NO: 947416 - DNA, 22 bp, Artificial Sequence
  chemically synthesized
ctcttgaggaataatgcgagtg

SEQ ID NO: 947417 - DNA, 22 bp, Artificial Sequence
  chemically synthesized
tcttgaggaataatgcgagtgc

SEQ ID NO: 947418 - DNA, 22 bp, Artificial Sequence
  chemically synthesized
ttgaggaataatgcgagtgctg

SEQ ID NO: 947419 - DNA, 22 bp, Artificial Sequence
  chemically synthesized
gtaggcatttgacagcactcgc

SEQ ID NO: 947420 - DNA, 22 bp, Artificial Sequence
  chemically synthesized
agtaggcatttgacagcactcg

SEQ ID NO: 947421 - DNA, 22 bp, Artificial Sequence
  chemically synthesized
gaggaataatgcgagtgctgtc

SEQ ID NO: 947422 - DNA, 22 bp, Artificial Sequence
  chemically synthesized
tagtaggcatttgacagcactc

SEQ ID NO: 947423 - DNA, 22 bp, Artificial Sequence
  chemically synthesized
aggaataatgcgagtgctgtca

SEQ ID NO: 947424 - DNA, 22 bp, Artificial Sequence
  chemically synthesized
catcagtcctttagtaggcatt

SEQ ID NO: 947425 - DNA, 22 bp, Artificial Sequence
  chemically synthesized
tcaaatgcctactaaaggactg

SEQ ID NO: 947426 - DNA, 22 bp, Artificial Sequence
  chemically synthesized
cagtcaggatagctacatcagt

SEQ ID NO: 947427 - DNA, 22 bp, Artificial Sequence
  chemically synthesized
gcagtcaggatagctacatcag

SEQ ID NO: 947428 - DNA, 22 bp, Artificial Sequence
  chemically synthesized
tgcagtcaggatagctacatca

SEQ ID NO: 947429 - DNA, 22 bp, Artificial Sequence
  chemically synthesized
ctaaaggactgatgtagctatc

SEQ ID NO: 947430 - DNA, 22 bp, Artificial Sequence
  chemically synthesized
aaggactgatgtagctatcctg

SEQ ID NO: 947431 - DNA, 22 bp, Artificial Sequence
  chemically synthesized
atgtagctatcctgactgcaaa

SEQ ID NO: 947432 - DNA, 22 bp, Artificial Sequence
  chemically synthesized
tgtcaagaaggacattttgcag

SEQ ID NO: 947433 - DNA, 22 bp, Artificial Sequence
  chemically synthesized
ttgtgtcaagaaggacattttg

SEQ ID NO: 947434 - DNA, 22 bp, Artificial Sequence
  chemically synthesized
gttgtgtcaagaaggacatttt

SEQ ID NO: 947435 - DNA, 22 bp, Artificial Sequence
  chemically synthesized
tgttgtgtcaagaaggacattt

SEQ ID NO: 947436 - DNA, 22 bp, Artificial Sequence
  chemically synthesized
tcctgactgcaaaatgtccttc

SEQ ID NO: 947437 - DNA, 22 bp, Artificial Sequence
  chemically synthesized
tttgttgtgtcaagaaggacat

SEQ ID NO: 947438 - DNA, 22 bp, Artificial Sequence
  chemically synthesized
actgcaaaatgtccttcttgac

SEQ ID NO: 947439 - DNA, 22 bp, Artificial Sequence
  chemically synthesized
caaaatgtccttcttgacacaa

SEQ ID NO: 947440 - DNA, 22 bp, Artificial Sequence
  chemically synthesized
atgtgctctttgttgtgtcaag

SEQ ID NO: 947441 - DNA, 22 bp, Artificial Sequence
  chemically synthesized
aatggtctgatgtgctctttgt

SEQ ID NO: 947442 - DNA, 22 bp, Artificial Sequence
  chemically synthesized
cttgacacaacaaagagcacat

SEQ ID NO: 947443 - DNA, 22 bp, Artificial Sequence
  chemically synthesized
ttgacacaacaaagagcacatc

SEQ ID NO: 947444 - DNA, 22 bp, Artificial Sequence
  chemically synthesized
gacacaacaaagagcacatcag

SEQ ID NO: 947445 - DNA, 22 bp, Artificial Sequence
  chemically synthesized
acacaacaaagagcacatcaga

SEQ ID NO: 947446 - DNA, 22 bp, Artificial Sequence
  chemically synthesized
tataaatactgaatggtctgat

SEQ ID NO: 947447 - DNA, 22 bp, Artificial Sequence
  chemically synthesized
tggtagatgaaagaacaagttg

SEQ ID NO: 947448 - DNA, 22 bp, Artificial Sequence
  chemically synthesized
agtatttatacaacttgttctt

SEQ ID NO: 947449 - DNA, 22 bp, Artificial Sequence
  chemically synthesized
atacaacttgttctttcatcta

SEQ ID NO: 947450 - DNA, 22 bp, Artificial Sequence
  chemically synthesized
tacaacttgttctttcatctac

SEQ ID NO: 947451 - DNA, 22 bp, Artificial Sequence
  chemically synthesized
agtaaatctgtggtagatgaaa

SEQ ID NO: 947452 - DNA, 22 bp, Artificial Sequence
  chemically synthesized
gttctttcatctaccacagatt

SEQ ID NO: 947453 - DNA, 22 bp, Artificial Sequence
  chemically synthesized
ttctttcatctaccacagattt

SEQ ID NO: 947454 - DNA, 22 bp, Artificial Sequence
  chemically synthesized
tttcatctaccacagatttact

SEQ ID NO: 947455 - DNA, 22 bp, Artificial Sequence
  chemically synthesized
tcatctaccacagatttactga

SEQ ID NO: 947456 - DNA, 22 bp, Artificial Sequence
  chemically synthesized
catctaccacagatttactgag

SEQ ID NO: 947457 - DNA, 22 bp, Artificial Sequence
  chemically synthesized
atctaccacagatttactgagc

SEQ ID NO: 947458 - DNA, 22 bp, Artificial Sequence
  chemically synthesized
acgcatagcaggtgctcagtaa

SEQ ID NO: 947459 - DNA, 22 bp, Artificial Sequence
  chemically synthesized
aacgcatagcaggtgctcagta

SEQ ID NO: 947460 - DNA, 22 bp, Artificial Sequence
  chemically synthesized
ccacagatttactgagcacctg

SEQ ID NO: 947461 - DNA, 22 bp, Artificial Sequence
  chemically synthesized
gggcttaacgcatagcaggtgc

SEQ ID NO: 947462 - DNA, 22 bp, Artificial Sequence
  chemically synthesized
actgagcacctgctatgcgtta

SEQ ID NO: 947463 - DNA, 22 bp, Artificial Sequence
  chemically synthesized
cggcctagggcttaacgcatag

SEQ ID NO: 947464 - DNA, 22 bp, Artificial Sequence
  chemically synthesized
ctgagcacctgctatgcgttaa

SEQ ID NO: 947465 - DNA, 22 bp, Artificial Sequence
  chemically synthesized
ccggcctagggcttaacgcata

SEQ ID NO: 947466 - DNA, 22 bp, Artificial Sequence
  chemically synthesized
agcacctgctatgcgttaagcc

SEQ ID NO: 947467 - DNA, 22 bp, Artificial Sequence
  chemically synthesized
ctatgcgttaagccctaggccg

SEQ ID NO: 947468 - DNA, 22 bp, Artificial Sequence
  chemically synthesized
tatccataacttccggcctagg

SEQ ID NO: 947469 - DNA, 22 bp, Artificial Sequence
  chemically synthesized
gtatccataacttccggcctag

SEQ ID NO: 947470 - DNA, 22 bp, Artificial Sequence
  chemically synthesized
tgcgttaagccctaggccggaa

SEQ ID NO: 947471 - DNA, 22 bp, Artificial Sequence
  chemically synthesized
tgtatccataacttccggccta

SEQ ID NO: 947472 - DNA, 22 bp, Artificial Sequence
  chemically synthesized
tctttgtatccataacttccgg

SEQ ID NO: 947473 - DNA, 22 bp, Artificial Sequence
  chemically synthesized
gtctttgtatccataacttccg

SEQ ID NO: 947474 - DNA, 22 bp, Artificial Sequence
  chemically synthesized
agccctaggccggaagttatgg

SEQ ID NO: 947475 - DNA, 22 bp, Artificial Sequence
  chemically synthesized
atgtttgtctttgtatccataa

SEQ ID NO: 947476 - DNA, 22 bp, Artificial Sequence
  chemically synthesized
ggccggaagttatggatacaaa

SEQ ID NO: 947477 - DNA, 22 bp, Artificial Sequence
  chemically synthesized
aagacccactcatgtttgtctt

SEQ ID NO: 947478 - DNA, 22 bp, Artificial Sequence
  chemically synthesized
aaagacccactcatgtttgtct

SEQ ID NO: 947479 - DNA, 22 bp, Artificial Sequence
  chemically synthesized
tggatacaaagacaaacatgag

SEQ ID NO: 947480 - DNA, 22 bp, Artificial Sequence
  chemically synthesized
cttaaagacccactcatgtttg

SEQ ID NO: 947481 - DNA, 22 bp, Artificial Sequence
  chemically synthesized
gcttaaagacccactcatgttt

SEQ ID NO: 947482 - DNA, 22 bp, Artificial Sequence
  chemically synthesized
ccttgcttaaagacccactcat

SEQ ID NO: 947483 - DNA, 22 bp, Artificial Sequence
  chemically synthesized
taactcccttgcttaaagaccc

SEQ ID NO: 947484 - DNA, 22 bp, Artificial Sequence
  chemically synthesized
ataactcccttgcttaaagacc

SEQ ID NO: 947485 - DNA, 22 bp, Artificial Sequence
  chemically synthesized
atgcaaatatgaccttataact

SEQ ID NO: 947486 - DNA, 22 bp, Artificial Sequence
  chemically synthesized
taagcaagggagttataaggtc

SEQ ID NO: 947487 - DNA, 22 bp, Artificial Sequence
  chemically synthesized
aagcaagggagttataaggtca

SEQ ID NO: 947488 - DNA, 22 bp, Artificial Sequence
  chemically synthesized
ttaatgcaaatatgaccttata

SEQ ID NO: 947489 - DNA, 22 bp, Artificial Sequence
  chemically synthesized
agcaagggagttataaggtcat

SEQ ID NO: 947490 - DNA, 22 bp, Artificial Sequence
  chemically synthesized
attaatgcaaatatgaccttat

SEQ ID NO: 947491 - DNA, 22 bp, Artificial Sequence
  chemically synthesized
tattaatgcaaatatgacctta

SEQ ID NO: 947492 - DNA, 22 bp, Artificial Sequence
  chemically synthesized
ttattaatgcaaatatgacctt

SEQ ID NO: 947493 - DNA, 22 bp, Artificial Sequence
  chemically synthesized
atagtgacttttattaatgcaa

SEQ ID NO: 947494 - DNA, 22 bp, Artificial Sequence
  chemically synthesized
taaggtcatatttgcattaata

SEQ ID NO: 947495 - DNA, 22 bp, Artificial Sequence
  chemically synthesized
catagtgacttttattaatgca

SEQ ID NO: 947496 - DNA, 22 bp, Artificial Sequence
  chemically synthesized
ttcatagtgacttttattaatg

SEQ ID NO: 947497 - DNA, 22 bp, Artificial Sequence
  chemically synthesized
ctcttcatagtgacttttatta

SEQ ID NO: 947498 - DNA, 22 bp, Artificial Sequence
  chemically synthesized
tactcttcatagtgacttttat

SEQ ID NO: 947499 - DNA, 22 bp, Artificial Sequence
  chemically synthesized
tctactcttcatagtgactttt

SEQ ID NO: 947500 - DNA, 22 bp, Artificial Sequence
  chemically synthesized
ttctctactcttcatagtgact

SEQ ID NO: 947501 - DNA, 22 bp, Artificial Sequence
  chemically synthesized
gcattaataaaagtcactatga

SEQ ID NO: 947502 - DNA, 22 bp, Artificial Sequence
  chemically synthesized
attctctactcttcatagtgac

SEQ ID NO: 947503 - DNA, 22 bp, Artificial Sequence
  chemically synthesized
cattaataaaagtcactatgaa

SEQ ID NO: 947504 - DNA, 22 bp, Artificial Sequence
  chemically synthesized
aatttattctctactcttcata

SEQ ID NO: 947505 - DNA, 22 bp, Artificial Sequence
  chemically synthesized
ataaaagtcactatgaagagta

SEQ ID NO: 947506 - DNA, 22 bp, Artificial Sequence
  chemically synthesized
caatttattctctactcttcat

SEQ ID NO: 947507 - DNA, 22 bp, Artificial Sequence
  chemically synthesized
cttcaatttattctctactctt

SEQ ID NO: 947508 - DNA, 22 bp, Artificial Sequence
  chemically synthesized
ctccttcaatttattctctact

SEQ ID NO: 947509 - DNA, 22 bp, Artificial Sequence
  chemically synthesized
gctccttcaatttattctctac

SEQ ID NO: 947510 - DNA, 22 bp, Artificial Sequence
  chemically synthesized
ttgctccttcaatttattctct

SEQ ID NO: 947511 - DNA, 22 bp, Artificial Sequence
  chemically synthesized
cttgctccttcaatttattctc

SEQ ID NO: 947512 - DNA, 22 bp, Artificial Sequence
  chemically synthesized
ttcttgctccttcaatttattc

SEQ ID NO: 947513 - DNA, 22 bp, Artificial Sequence
  chemically synthesized
tgaagagtagagaataaattga

SEQ ID NO: 947514 - DNA, 22 bp, Artificial Sequence
  chemically synthesized
tcttcttgctccttcaatttat

SEQ ID NO: 947515 - DNA, 22 bp, Artificial Sequence
  chemically synthesized
cctctcttcttgctccttcaat

SEQ ID NO: 947516 - DNA, 22 bp, Artificial Sequence
  chemically synthesized
ctgcctctcttcttgctccttc

SEQ ID NO: 947517 - DNA, 22 bp, Artificial Sequence
  chemically synthesized
tcctgcctctcttcttgctcct

SEQ ID NO: 947518 - DNA, 22 bp, Artificial Sequence
  chemically synthesized
cctctcctgcctctcttcttgc

SEQ ID NO: 947519 - DNA, 22 bp, Artificial Sequence
  chemically synthesized
cctccctctcctgcctctcttc

SEQ ID NO: 947520 - DNA, 22 bp, Artificial Sequence
  chemically synthesized
tccctccctctcctgcctctct

SEQ ID NO: 947521 - DNA, 22 bp, Artificial Sequence
  chemically synthesized
aaggagcaagaagagaggcagg

SEQ ID NO: 947522 - DNA, 22 bp, Artificial Sequence
  chemically synthesized
gctctccctccctctcctgcct

SEQ ID NO: 947523 - DNA, 22 bp, Artificial Sequence
  chemically synthesized
accactggctctccctccctct

SEQ ID NO: 947524 - DNA, 22 bp, Artificial Sequence
  chemically synthesized
caccactggctctccctccctc

SEQ ID NO: 947525 - DNA, 22 bp, Artificial Sequence
  chemically synthesized
ttcaccactggctctccctccc

SEQ ID NO: 947526 - DNA, 22 bp, Artificial Sequence
  chemically synthesized
agcagtctcttcaccactggct

SEQ ID NO: 947527 - DNA, 22 bp, Artificial Sequence
  chemically synthesized
attcagcagtctcttcaccact

SEQ ID NO: 947528 - DNA, 22 bp, Artificial Sequence
  chemically synthesized
cattgattcagcagtctcttca

SEQ ID NO: 947529 - DNA, 22 bp, Artificial Sequence
  chemically synthesized
cctgcattgattcagcagtctc

SEQ ID NO: 947530 - DNA, 22 bp, Artificial Sequence
  chemically synthesized
tacctgcattgattcagcagtc

SEQ ID NO: 947531 - DNA, 22 bp, Artificial Sequence
  chemically synthesized
ctacctgcattgattcagcagt

SEQ ID NO: 947532 - DNA, 22 bp, Artificial Sequence
  chemically synthesized
caccttctacctgcattgattc

SEQ ID NO: 947533 - DNA, 22 bp, Artificial Sequence
  chemically synthesized
ggtagcctgcaccttctacctg

SEQ ID NO: 947534 - DNA, 22 bp, Artificial Sequence
  chemically synthesized
ctgaatcaatgcaggtagaagg

SEQ ID NO: 947535 - DNA, 22 bp, Artificial Sequence
  chemically synthesized
aatcaatgcaggtagaaggtgc

SEQ ID NO: 947536 - DNA, 22 bp, Artificial Sequence
  chemically synthesized
cctgggtagcctgcaccttcta

SEQ ID NO: 947537 - DNA, 22 bp, Artificial Sequence
  chemically synthesized
acctgggtagcctgcaccttct

SEQ ID NO: 947538 - DNA, 22 bp, Artificial Sequence
  chemically synthesized
tacctgggtagcctgcaccttc

SEQ ID NO: 947539 - DNA, 22 bp, Artificial Sequence
  chemically synthesized
tttacctgggtagcctgcacct

SEQ ID NO: 947540 - DNA, 22 bp, Artificial Sequence
  chemically synthesized
ctttacctgggtagcctgcacc

SEQ ID NO: 947541 - DNA, 22 bp, Artificial Sequence
  chemically synthesized
aacagtcatttctttacctggg

SEQ ID NO: 947542 - DNA, 22 bp, Artificial Sequence
  chemically synthesized
gaacagtcatttctttacctgg

SEQ ID NO: 947543 - DNA, 22 bp, Artificial Sequence
  chemically synthesized
atttgaacagtcatttctttac

SEQ ID NO: 947544 - DNA, 22 bp, Artificial Sequence
  chemically synthesized
catttgaacagtcatttcttta

SEQ ID NO: 947545 - DNA, 22 bp, Artificial Sequence
  chemically synthesized
tcatttgaacagtcatttcttt

SEQ ID NO: 947546 - DNA, 22 bp, Artificial Sequence
  chemically synthesized
ttttcatttgaacagtcatttc

SEQ ID NO: 947547 - DNA, 22 bp, Artificial Sequence
  chemically synthesized
gttttcatttgaacagtcattt

SEQ ID NO: 947548 - DNA, 22 bp, Artificial Sequence
  chemically synthesized
cccaggtaaagaaatgactgtt

SEQ ID NO: 947549 - DNA, 22 bp, Artificial Sequence
  chemically synthesized
tccacttgttttcatttgaaca

SEQ ID NO: 947550 - DNA, 22 bp, Artificial Sequence
  chemically synthesized
atccacttgttttcatttgaac

SEQ ID NO: 947551 - DNA, 22 bp, Artificial Sequence
  chemically synthesized
aatttatccacttgttttcatt

SEQ ID NO: 947552 - DNA, 22 bp, Artificial Sequence
  chemically synthesized
gaatttatccacttgttttcat

SEQ ID NO: 947553 - DNA, 22 bp, Artificial Sequence
  chemically synthesized
ttgaatttatccacttgttttc

SEQ ID NO: 947554 - DNA, 22 bp, Artificial Sequence
  chemically synthesized
tcttgaatttatccacttgttt

SEQ ID NO: 947555 - DNA, 22 bp, Artificial Sequence
  chemically synthesized
ttcaaatgaaaacaagtggata

SEQ ID NO: 947556 - DNA, 22 bp, Artificial Sequence
  chemically synthesized
aaatgaaaacaagtggataaat

SEQ ID NO: 947557 - DNA, 22 bp, Artificial Sequence
  chemically synthesized
caataaactctcttgaatttat

SEQ ID NO: 947558 - DNA, 22 bp, Artificial Sequence
  chemically synthesized
ccaaatctacaataaactctct

SEQ ID NO: 947559 - DNA, 22 bp, Artificial Sequence
  chemically synthesized
tcaggtcctaccaaatctacaa

SEQ ID NO: 947560 - DNA, 22 bp, Artificial Sequence
  chemically synthesized
aagagagtttattgtagatttg

SEQ ID NO: 947561 - DNA, 22 bp, Artificial Sequence
  chemically synthesized
atcaggtcctaccaaatctaca

SEQ ID NO: 947562 - DNA, 22 bp, Artificial Sequence
  chemically synthesized
atttatcaggtcctaccaaatc

SEQ ID NO: 947563 - DNA, 22 bp, Artificial Sequence
  chemically synthesized
attgtagatttggtaggacctg

SEQ ID NO: 947564 - DNA, 22 bp, Artificial Sequence
  chemically synthesized
ttgtagatttggtaggacctga

SEQ ID NO: 947565 - DNA, 22 bp, Artificial Sequence
  chemically synthesized
tagatttggtaggacctgataa

SEQ ID NO: 947566 - DNA, 22 bp, Artificial Sequence
  chemically synthesized
gagtaaggcacgttcatttatc

SEQ ID NO: 947567 - DNA, 22 bp, Artificial Sequence
  chemically synthesized
ggtaggacctgataaatgaacg

SEQ ID NO: 947568 - DNA, 22 bp, Artificial Sequence
  chemically synthesized
gtaggacctgataaatgaacgt

SEQ ID NO: 947569 - DNA, 22 bp, Artificial Sequence
  chemically synthesized
ataaatgaacgtgccttactcg

SEQ ID NO: 947570 - DNA, 22 bp, Artificial Sequence
  chemically synthesized
agacaatggcaccaccatactc

SEQ ID NO: 947571 - DNA, 22 bp, Artificial Sequence
  chemically synthesized
cagacaatggcaccaccatact

SEQ ID NO: 947572 - DNA, 22 bp, Artificial Sequence
  chemically synthesized
tttcagacaatggcaccaccat

SEQ ID NO: 947573 - DNA, 22 bp, Artificial Sequence
  chemically synthesized
gtttcagacaatggcaccacca

SEQ ID NO: 947574 - DNA, 22 bp, Artificial Sequence
  chemically synthesized
tgtttcagacaatggcaccacc

SEQ ID NO: 947575 - DNA, 22 bp, Artificial Sequence
  chemically synthesized
actcgagtatggtggtgccatt

SEQ ID NO: 947576 - DNA, 22 bp, Artificial Sequence
  chemically synthesized
tttgtttcagacaatggcacca

SEQ ID NO: 947577 - DNA, 22 bp, Artificial Sequence
  chemically synthesized
ctcgagtatggtggtgccattg

SEQ ID NO: 947578 - DNA, 22 bp, Artificial Sequence
  chemically synthesized
ctttgtttcagacaatggcacc

SEQ ID NO: 947579 - DNA, 22 bp, Artificial Sequence
  chemically synthesized
gagtatggtggtgccattgtct

SEQ ID NO: 947580 - DNA, 22 bp, Artificial Sequence
  chemically synthesized
cttctttgtttcagacaatggc

SEQ ID NO: 947581 - DNA, 22 bp, Artificial Sequence
  chemically synthesized
gcttctttgtttcagacaatgg

SEQ ID NO: 947582 - DNA, 22 bp, Artificial Sequence
  chemically synthesized
tgcttctttgtttcagacaatg

SEQ ID NO: 947583 - DNA, 22 bp, Artificial Sequence
  chemically synthesized
ttgcttctttgtttcagacaat

SEQ ID NO: 947584 - DNA, 22 bp, Artificial Sequence
  chemically synthesized
ttttgcttctttgtttcagaca

SEQ ID NO: 947585 - DNA, 22 bp, Artificial Sequence
  chemically synthesized
cttttgcttctttgtttcagac

SEQ ID NO: 947586 - DNA, 22 bp, Artificial Sequence
  chemically synthesized
ttcttttgcttctttgtttcag

SEQ ID NO: 947587 - DNA, 22 bp, Artificial Sequence
  chemically synthesized
tctgaaacaaagaagcaaaaga

SEQ ID NO: 947588 - DNA, 22 bp, Artificial Sequence
  chemically synthesized
aaacaaagaagcaaaagaagaa

SEQ ID NO: 947589 - DNA, 22 bp, Artificial Sequence
  chemically synthesized
ccatcgagcggggttcttcttt

SEQ ID NO: 947590 - DNA, 22 bp, Artificial Sequence
  chemically synthesized
ccctaccatcgagcggggttct

SEQ ID NO: 947591 - DNA, 22 bp, Artificial Sequence
  chemically synthesized
cccctaccatcgagcggggttc

SEQ ID NO: 947592 - DNA, 22 bp, Artificial Sequence
  chemically synthesized
tcccctaccatcgagcggggtt

SEQ ID NO: 947593 - DNA, 22 bp, Artificial Sequence
  chemically synthesized
acaagctttcccctaccatcga

SEQ ID NO: 947594 - DNA, 22 bp, Artificial Sequence
  chemically synthesized
agctcacaagctttcccctacc

SEQ ID NO: 947595 - DNA, 22 bp, Artificial Sequence
  chemically synthesized
gatggtaggggaaagcttgtga

SEQ ID NO: 947596 - DNA, 22 bp, Artificial Sequence
  chemically synthesized
taagatcaaaaactcagctcac

SEQ ID NO: 947597 - DNA, 22 bp, Artificial Sequence
  chemically synthesized
tataagatcaaaaactcagctc

SEQ ID NO: 947598 - DNA, 22 bp, Artificial Sequence
  chemically synthesized
ctataagatcaaaaactcagct

SEQ ID NO: 947599 - DNA, 22 bp, Artificial Sequence
  chemically synthesized
atttctataagatcaaaaactc

SEQ ID NO: 947600 - DNA, 22 bp, Artificial Sequence
  chemically synthesized
aatttctataagatcaaaaact

SEQ ID NO: 947601 - DNA, 22 bp, Artificial Sequence
  chemically synthesized
taatttctataagatcaaaaac

SEQ ID NO: 947602 - DNA, 22 bp, Artificial Sequence
  chemically synthesized
ttaatttctataagatcaaaaa

SEQ ID NO: 947603 - DNA, 22 bp, Artificial Sequence
  chemically synthesized
gtgagctgagtttttgatctta

SEQ ID NO: 947604 - DNA, 22 bp, Artificial Sequence
  chemically synthesized
tgagctgagtttttgatcttat

SEQ ID NO: 947605 - DNA, 22 bp, Artificial Sequence
  chemically synthesized
accaaccttttaatttctataa

SEQ ID NO: 947606 - DNA, 22 bp, Artificial Sequence
  chemically synthesized
agtttttgatcttatagaaatt

SEQ ID NO: 947607 - DNA, 22 bp, Artificial Sequence
  chemically synthesized
gaccaaccttttaatttctata

SEQ ID NO: 947608 - DNA, 22 bp, Artificial Sequence
  chemically synthesized
ttgatcttatagaaattaaaag

SEQ ID NO: 947609 - DNA, 22 bp, Artificial Sequence
  chemically synthesized
tgatcttatagaaattaaaagg

SEQ ID NO: 947610 - DNA, 22 bp, Artificial Sequence
  chemically synthesized
gatcttatagaaattaaaaggt

SEQ ID NO: 947611 - DNA, 22 bp, Artificial Sequence
  chemically synthesized
atcttatagaaattaaaaggtt

SEQ ID NO: 947612 - DNA, 22 bp, Artificial Sequence
  chemically synthesized
atacacttgaccaaccttttaa

SEQ ID NO: 947613 - DNA, 22 bp, Artificial Sequence
  chemically synthesized
atagaaattaaaaggttggtca

SEQ ID NO: 947614 - DNA, 22 bp, Artificial Sequence
  chemically synthesized
cattcatacacttgaccaacct

SEQ ID NO: 947615 - DNA, 22 bp, Artificial Sequence
  chemically synthesized
tagaaattaaaaggttggtcaa

SEQ ID NO: 947616 - DNA, 22 bp, Artificial Sequence
  chemically synthesized
ccattcatacacttgaccaacc

SEQ ID NO: 947617 - DNA, 22 bp, Artificial Sequence
  chemically synthesized
cttccattcatacacttgacca

SEQ ID NO: 947618 - DNA, 22 bp, Artificial Sequence
  chemically synthesized
aaaggttggtcaagtgtatgaa

SEQ ID NO: 947619 - DNA, 22 bp, Artificial Sequence
  chemically synthesized
tatatgcaactgcttccattca

SEQ ID NO: 947620 - DNA, 22 bp, Artificial Sequence
  chemically synthesized
gtatatgcaactgcttccattc

SEQ ID NO: 947621 - DNA, 22 bp, Artificial Sequence
  chemically synthesized
gtcaagtgtatgaatggaagca

SEQ ID NO: 947622 - DNA, 22 bp, Artificial Sequence
  chemically synthesized
cagacttgtatatgcaactgct

SEQ ID NO: 947623 - DNA, 22 bp, Artificial Sequence
  chemically synthesized
ccagacttgtatatgcaactgc

SEQ ID NO: 947624 - DNA, 22 bp, Artificial Sequence
  chemically synthesized
ttccagacttgtatatgcaact

SEQ ID NO: 947625 - DNA, 22 bp, Artificial Sequence
  chemically synthesized
cttccagacttgtatatgcaac

SEQ ID NO: 947626 - DNA, 22 bp, Artificial Sequence
  chemically synthesized
tcttccagacttgtatatgcaa

SEQ ID NO: 947627 - DNA, 22 bp, Artificial Sequence
  chemically synthesized
tttcttccagacttgtatatgc

SEQ ID NO: 947628 - DNA, 22 bp, Artificial Sequence
  chemically synthesized
ctttcttccagacttgtatatg

SEQ ID NO: 947629 - DNA, 22 bp, Artificial Sequence
  chemically synthesized
gcatcttctttcttccagactt

SEQ ID NO: 947630 - DNA, 22 bp, Artificial Sequence
  chemically synthesized
catatacaagtctggaagaaag

SEQ ID NO: 947631 - DNA, 22 bp, Artificial Sequence
  chemically synthesized
catcctggcatcttctttcttc

SEQ ID NO: 947632 - DNA, 22 bp, Artificial Sequence
  chemically synthesized
cctccatcctggcatcttcttt

SEQ ID NO: 947633 - DNA, 22 bp, Artificial Sequence
  chemically synthesized
ccctccatcctggcatcttctt

SEQ ID NO: 947634 - DNA, 22 bp, Artificial Sequence
  chemically synthesized
tccctccatcctggcatcttct

SEQ ID NO: 947635 - DNA, 22 bp, Artificial Sequence
  chemically synthesized
cattttccctccatcctggcat

SEQ ID NO: 947636 - DNA, 22 bp, Artificial Sequence
  chemically synthesized
gaagaaagaagatgccaggatg

SEQ ID NO: 947637 - DNA, 22 bp, Artificial Sequence
  chemically synthesized
caactacattttccctccatcc

SEQ ID NO: 947638 - DNA, 22 bp, Artificial Sequence
  chemically synthesized
cgtgattccaactacattttcc

SEQ ID NO: 947639 - DNA, 22 bp, Artificial Sequence
  chemically synthesized
atccattccgtgattccaacta

SEQ ID NO: 947640 - DNA, 22 bp, Artificial Sequence
  chemically synthesized
gtcatcctcatccattccgtga

SEQ ID NO: 947641 - DNA, 22 bp, Artificial Sequence
  chemically synthesized
ggtcatcctcatccattccgtg

SEQ ID NO: 947642 - DNA, 22 bp, Artificial Sequence
  chemically synthesized
tggtcatcctcatccattccgt

SEQ ID NO: 947643 - DNA, 22 bp, Artificial Sequence
  chemically synthesized
ctttggtcatcctcatccattc

SEQ ID NO: 947644 - DNA, 22 bp, Artificial Sequence
  chemically synthesized
cctttggtcatcctcatccatt

SEQ ID NO: 947645 - DNA, 22 bp, Artificial Sequence
  chemically synthesized
tcctttggtcatcctcatccat

SEQ ID NO: 947646 - DNA, 22 bp, Artificial Sequence
  chemically synthesized
gaatcacggaatggatgaggat

SEQ ID NO: 947647 - DNA, 22 bp, Artificial Sequence
  chemically synthesized
cagactttcctttggtcatcct

SEQ ID NO: 947648 - DNA, 22 bp, Artificial Sequence
  chemically synthesized
atattacagactttcctttggt

SEQ ID NO: 947649 - DNA, 22 bp, Artificial Sequence
  chemically synthesized
catattacagactttcctttgg

SEQ ID NO: 947650 - DNA, 22 bp, Artificial Sequence
  chemically synthesized
tcatattacagactttcctttg

SEQ ID NO: 947651 - DNA, 22 bp, Artificial Sequence
  chemically synthesized
ttcatattacagactttccttt

SEQ ID NO: 947652 - DNA, 22 bp, Artificial Sequence
  chemically synthesized
gacttttcatattacagacttt

SEQ ID NO: 947653 - DNA, 22 bp, Artificial Sequence
  chemically synthesized
ctggacttttcatattacagac

SEQ ID NO: 947654 - DNA, 22 bp, Artificial Sequence
  chemically synthesized
cctggacttttcatattacaga

SEQ ID NO: 947655 - DNA, 22 bp, Artificial Sequence
  chemically synthesized
tcctggacttttcatattacag

SEQ ID NO: 947656 - DNA, 22 bp, Artificial Sequence
  chemically synthesized
ttcctggacttttcatattaca

SEQ ID NO: 947657 - DNA, 22 bp, Artificial Sequence
  chemically synthesized
gatttttcctggacttttcata

SEQ ID NO: 947658 - DNA, 22 bp, Artificial Sequence
  chemically synthesized
taatatgaaaagtccaggaaaa

SEQ ID NO: 947659 - DNA, 22 bp, Artificial Sequence
  chemically synthesized
aaaaagttggatttttcctgga

SEQ ID NO: 947660 - DNA, 22 bp, Artificial Sequence
  chemically synthesized
ctcaaaaagttggatttttcct

SEQ ID NO: 947661 - DNA, 22 bp, Artificial Sequence
  chemically synthesized
atattcctcaaaaagttggatt

SEQ ID NO: 947662 - DNA, 22 bp, Artificial Sequence
  chemically synthesized
aatattcctcaaaaagttggat

SEQ ID NO: 947663 - DNA, 22 bp, Artificial Sequence
  chemically synthesized
taatattcctcaaaaagttgga

SEQ ID NO: 947664 - DNA, 22 bp, Artificial Sequence
  chemically synthesized
cctttaatattcctcaaaaagt

SEQ ID NO: 947665 - DNA, 22 bp, Artificial Sequence
  chemically synthesized
tccctttaatattcctcaaaaa

SEQ ID NO: 947666 - DNA, 22 bp, Artificial Sequence
  chemically synthesized
gcatctctccctttaatattcc

SEQ ID NO: 947667 - DNA, 22 bp, Artificial Sequence
  chemically synthesized
tggcatctctccctttaatatt

SEQ ID NO: 947668 - DNA, 22 bp, Artificial Sequence
  chemically synthesized
ctggcatctctccctttaatat

SEQ ID NO: 947669 - DNA, 22 bp, Artificial Sequence
  chemically synthesized
tctggcatctctccctttaata

SEQ ID NO: 947670 - DNA, 22 bp, Artificial Sequence
  chemically synthesized
tttgaggaatattaaagggaga

SEQ ID NO: 947671 - DNA, 22 bp, Artificial Sequence
  chemically synthesized
ttgaggaatattaaagggagag

SEQ ID NO: 947672 - DNA, 22 bp, Artificial Sequence
  chemically synthesized
tgaggaatattaaagggagaga

SEQ ID NO: 947673 - DNA, 22 bp, Artificial Sequence
  chemically synthesized
gaggaatattaaagggagagat

SEQ ID NO: 947674 - DNA, 22 bp, Artificial Sequence
  chemically synthesized
aggaatattaaagggagagatg

SEQ ID NO: 947675 - DNA, 22 bp, Artificial Sequence
  chemically synthesized
agcccattttctggcatctctc

SEQ ID NO: 947676 - DNA, 22 bp, Artificial Sequence
  chemically synthesized
gagcccattttctggcatctct

SEQ ID NO: 947677 - DNA, 22 bp, Artificial Sequence
  chemically synthesized
tgagcccattttctggcatctc

SEQ ID NO: 947678 - DNA, 22 bp, Artificial Sequence
  chemically synthesized
ttgagcccattttctggcatct

SEQ ID NO: 947679 - DNA, 22 bp, Artificial Sequence
  chemically synthesized
tttgagcccattttctggcatc

SEQ ID NO: 947680 - DNA, 22 bp, Artificial Sequence
  chemically synthesized
ctttttgagcccattttctggc

SEQ ID NO: 947681 - DNA, 22 bp, Artificial Sequence
  chemically synthesized
aagggagagatgccagaaaatg

SEQ ID NO: 947682 - DNA, 22 bp, Artificial Sequence
  chemically synthesized
gtaatccctcctttttgagccc

SEQ ID NO: 947683 - DNA, 22 bp, Artificial Sequence
  chemically synthesized
agtaatccctcctttttgagcc

SEQ ID NO: 947684 - DNA, 22 bp, Artificial Sequence
  chemically synthesized
agtcttagtaatccctcctttt

SEQ ID NO: 947685 - DNA, 22 bp, Artificial Sequence
  chemically synthesized
cctaagtcttagtaatccctcc

SEQ ID NO: 947686 - DNA, 22 bp, Artificial Sequence
  chemically synthesized
aaaaaggagggattactaagac

SEQ ID NO: 947687 - DNA, 22 bp, Artificial Sequence
  chemically synthesized
aatgaacatgtactgcctaagt

SEQ ID NO: 947688 - DNA, 22 bp, Artificial Sequence
  chemically synthesized
ttgaatgaacatgtactgccta

SEQ ID NO: 947689 - DNA, 22 bp, Artificial Sequence
  chemically synthesized
gttgaatgaacatgtactgcct

SEQ ID NO: 947690 - DNA, 22 bp, Artificial Sequence
  chemically synthesized
ctaagacttaggcagtacatgt

SEQ ID NO: 947691 - DNA, 22 bp, Artificial Sequence
  chemically synthesized
cttgttgaatgaacatgtactg

SEQ ID NO: 947692 - DNA, 22 bp, Artificial Sequence
  chemically synthesized
agacttaggcagtacatgttca

SEQ ID NO: 947693 - DNA, 22 bp, Artificial Sequence
  chemically synthesized
aggcagtacatgttcattcaac

SEQ ID NO: 947694 - DNA, 22 bp, Artificial Sequence
  chemically synthesized
ggcagtacatgttcattcaaca

SEQ ID NO: 947695 - DNA, 22 bp, Artificial Sequence
  chemically synthesized
tagtaccagaatctccttgttg

SEQ ID NO: 947696 - DNA, 22 bp, Artificial Sequence
  chemically synthesized
tgtagtaccagaatctccttgt

SEQ ID NO: 947697 - DNA, 22 bp, Artificial Sequence
  chemically synthesized
ctgtagtaccagaatctccttg

SEQ ID NO: 947698 - DNA, 22 bp, Artificial Sequence
  chemically synthesized
gcttctgtagtaccagaatctc

SEQ ID NO: 947699 - DNA, 22 bp, Artificial Sequence
  chemically synthesized
agcttctgtagtaccagaatct

SEQ ID NO: 947700 - DNA, 22 bp, Artificial Sequence
  chemically synthesized
attcaacaaggagattctggta

SEQ ID NO: 947701 - DNA, 22 bp, Artificial Sequence
  chemically synthesized
aacaaggagattctggtactac

SEQ ID NO: 947702 - DNA, 22 bp, Artificial Sequence
  chemically synthesized
agggaatttagcttctgtagta

SEQ ID NO: 947703 - DNA, 22 bp, Artificial Sequence
  chemically synthesized
aagggaatttagcttctgtagt

SEQ ID NO: 947704 - DNA, 22 bp, Artificial Sequence
  chemically synthesized
ttaagggaatttagcttctgta

SEQ ID NO: 947705 - DNA, 22 bp, Artificial Sequence
  chemically synthesized
cttaagggaatttagcttctgt

SEQ ID NO: 947706 - DNA, 22 bp, Artificial Sequence
  chemically synthesized
cttcttaagggaatttagcttc

SEQ ID NO: 947707 - DNA, 22 bp, Artificial Sequence
  chemically synthesized
ccttcttaagggaatttagctt

SEQ ID NO: 947708 - DNA, 22 bp, Artificial Sequence
  chemically synthesized
tggtactacagaagctaaattc

SEQ ID NO: 947709 - DNA, 22 bp, Artificial Sequence
  chemically synthesized
gtactacagaagctaaattccc

SEQ ID NO: 947710 - DNA, 22 bp, Artificial Sequence
  chemically synthesized
cagaagctaaattcccttaaga

SEQ ID NO: 947711 - DNA, 22 bp, Artificial Sequence
  chemically synthesized
tgggtgaaaatgccttccttct

SEQ ID NO: 947712 - DNA, 22 bp, Artificial Sequence
  chemically synthesized
aattcccttaagaaggaaggca

SEQ ID NO: 947713 - DNA, 22 bp, Artificial Sequence
  chemically synthesized
ccttaagaaggaaggcattttc

SEQ ID NO: 947714 - DNA, 22 bp, Artificial Sequence
  chemically synthesized
aagaaggaaggcattttcaccc

SEQ ID NO: 947715 - DNA, 22 bp, Artificial Sequence
  chemically synthesized
agaaggaaggcattttcaccca

SEQ ID NO: 947716 - DNA, 22 bp, Artificial Sequence
  chemically synthesized
tagcaaaatgctgtgggtgaaa

SEQ ID NO: 947717 - DNA, 22 bp, Artificial Sequence
  chemically synthesized
tgtagcaaaatgctgtgggtga

SEQ ID NO: 947718 - DNA, 22 bp, Artificial Sequence
  chemically synthesized
gagcattctgtagcaaaatgct

SEQ ID NO: 947719 - DNA, 22 bp, Artificial Sequence
  chemically synthesized
tcacccacagcattttgctaca

SEQ ID NO: 947720 - DNA, 22 bp, Artificial Sequence
  chemically synthesized
cacccacagcattttgctacag

SEQ ID NO: 947721 - DNA, 22 bp, Artificial Sequence
  chemically synthesized
tactcgagcattctgtagcaaa

SEQ ID NO: 947722 - DNA, 22 bp, Artificial Sequence
  chemically synthesized
acccacagcattttgctacaga

SEQ ID NO: 947723 - DNA, 22 bp, Artificial Sequence
  chemically synthesized
attatactcgagcattctgtag

SEQ ID NO: 947724 - DNA, 22 bp, Artificial Sequence
  chemically synthesized
gtgctgattatactcgagcatt

SEQ ID NO: 947725 - DNA, 22 bp, Artificial Sequence
  chemically synthesized
agtgctgattatactcgagcat

SEQ ID NO: 947726 - DNA, 22 bp, Artificial Sequence
  chemically synthesized
tagtgctgattatactcgagca

SEQ ID NO: 947727 - DNA, 22 bp, Artificial Sequence
  chemically synthesized
ttagtgctgattatactcgagc

SEQ ID NO: 947728 - DNA, 22 bp, Artificial Sequence
  chemically synthesized
tgctacagaatgctcgagtata

SEQ ID NO: 947729 - DNA, 22 bp, Artificial Sequence
  chemically synthesized
tttagtgctgattatactcgag

SEQ ID NO: 947730 - DNA, 22 bp, Artificial Sequence
  chemically synthesized
gctacagaatgctcgagtataa

SEQ ID NO: 947731 - DNA, 22 bp, Artificial Sequence
  chemically synthesized
ctacagaatgctcgagtataat

SEQ ID NO: 947732 - DNA, 22 bp, Artificial Sequence
  chemically synthesized
cagaatgctcgagtataatcag

SEQ ID NO: 947733 - DNA, 22 bp, Artificial Sequence
  chemically synthesized
acaaatgttttttagtgctgat

SEQ ID NO: 947734 - DNA, 22 bp, Artificial Sequence
  chemically synthesized
gagtataatcagcactaaaaaa

SEQ ID NO: 947735 - DNA, 22 bp, Artificial Sequence
  chemically synthesized
ccaaacctgacaaatgtttttt

SEQ ID NO: 947736 - DNA, 22 bp, Artificial Sequence
  chemically synthesized
ttgccaaacctgacaaatgttt

SEQ ID NO: 947737 - DNA, 22 bp, Artificial Sequence
  chemically synthesized
gttgccaaacctgacaaatgtt

SEQ ID NO: 947738 - DNA, 22 bp, Artificial Sequence
  chemically synthesized
ttgttgccaaacctgacaaatg

SEQ ID NO: 947739 - DNA, 22 bp, Artificial Sequence
  chemically synthesized
cttgttgccaaacctgacaaat

SEQ ID NO: 947740 - DNA, 22 bp, Artificial Sequence
  chemically synthesized
tcttgttgccaaacctgacaaa

SEQ ID NO: 947741 - DNA, 22 bp, Artificial Sequence
  chemically synthesized
aaaaacatttgtcaggtttggc

SEQ ID NO: 947742 - DNA, 22 bp, Artificial Sequence
  chemically synthesized
gtcaggtttggcaacaagaaag

SEQ ID NO: 947743 - DNA, 22 bp, Artificial Sequence
  chemically synthesized
tcaggtttggcaacaagaaagt

SEQ ID NO: 947744 - DNA, 22 bp, Artificial Sequence
  chemically synthesized
aagaaggacggcagcaactttc

SEQ ID NO: 947745 - DNA, 22 bp, Artificial Sequence
  chemically synthesized
caagaaggacggcagcaacttt

SEQ ID NO: 947746 - DNA, 22 bp, Artificial Sequence
  chemically synthesized
ggcaacaagaaagttgctgccg

SEQ ID NO: 947747 - DNA, 22 bp, Artificial Sequence
  chemically synthesized
gcaacaagaaagttgctgccgt

SEQ ID NO: 947748 - DNA, 22 bp, Artificial Sequence
  chemically synthesized
acttcaagaaggacggcagcaa

SEQ ID NO: 947749 - DNA, 22 bp, Artificial Sequence
  chemically synthesized
agttcacttcaagaaggacggc

SEQ ID NO: 947750 - DNA, 22 bp, Artificial Sequence
  chemically synthesized
cagttcacttcaagaaggacgg

SEQ ID NO: 947751 - DNA, 22 bp, Artificial Sequence
  chemically synthesized
cttcagttcacttcaagaagga

SEQ ID NO: 947752 - DNA, 22 bp, Artificial Sequence
  chemically synthesized
ccttcagttcacttcaagaagg

SEQ ID NO: 947753 - DNA, 22 bp, Artificial Sequence
  chemically synthesized
tccttcagttcacttcaagaag

SEQ ID NO: 947754 - DNA, 22 bp, Artificial Sequence
  chemically synthesized
ctttccttcagttcacttcaag

SEQ ID NO: 947755 - DNA, 22 bp, Artificial Sequence
  chemically synthesized
ctgccgtccttcttgaagtgaa

SEQ ID NO: 947756 - DNA, 22 bp, Artificial Sequence
  chemically synthesized
ctcctttccttcagttcacttc

SEQ ID NO: 947757 - DNA, 22 bp, Artificial Sequence
  chemically synthesized
ccgtccttcttgaagtgaactg

SEQ ID NO: 947758 - DNA, 22 bp, Artificial Sequence
  chemically synthesized
cctcctttccttcagttcactt

SEQ ID NO: 947759 - DNA, 22 bp, Artificial Sequence
  chemically synthesized
aatttcctcctttccttcagtt

SEQ ID NO: 947760 - DNA, 22 bp, Artificial Sequence
  chemically synthesized
caatttcctcctttccttcagt

SEQ ID NO: 947761 - DNA, 22 bp, Artificial Sequence
  chemically synthesized
cttgaagtgaactgaaggaaag

SEQ ID NO: 947762 - DNA, 22 bp, Artificial Sequence
  chemically synthesized
ttgaagtgaactgaaggaaagg

SEQ ID NO: 947763 - DNA, 22 bp, Artificial Sequence
  chemically synthesized
gaagtgaactgaaggaaaggag

SEQ ID NO: 947764 - DNA, 22 bp, Artificial Sequence
  chemically synthesized
aagtgaactgaaggaaaggagg

SEQ ID NO: 947765 - DNA, 22 bp, Artificial Sequence
  chemically synthesized
aataaatttcaatttcctcctt

SEQ ID NO: 947766 - DNA, 22 bp, Artificial Sequence
  chemically synthesized
tgttcaataaatttcaatttcc

SEQ ID NO: 947767 - DNA, 22 bp, Artificial Sequence
  chemically synthesized
gtgttcaataaatttcaatttc

SEQ ID NO: 947768 - DNA, 22 bp, Artificial Sequence
  chemically synthesized
aaggaaaggaggaaattgaaat

SEQ ID NO: 947769 - DNA, 22 bp, Artificial Sequence
  chemically synthesized
tgtgttcaataaatttcaattt

SEQ ID NO: 947770 - DNA, 22 bp, Artificial Sequence
  chemically synthesized
ctttgtgttcaataaatttcaa

SEQ ID NO: 947771 - DNA, 22 bp, Artificial Sequence
  chemically synthesized
cctttgtgttcaataaatttca

SEQ ID NO: 947772 - DNA, 22 bp, Artificial Sequence
  chemically synthesized
agacacttcctttgtgttcaat

SEQ ID NO: 947773 - DNA, 22 bp, Artificial Sequence
  chemically synthesized
ctcagacacttcctttgtgttc

SEQ ID NO: 947774 - DNA, 22 bp, Artificial Sequence
  chemically synthesized
cctcagacacttcctttgtgtt

SEQ ID NO: 947775 - DNA, 22 bp, Artificial Sequence
  chemically synthesized
aaatttattgaacacaaaggaa

SEQ ID NO: 947776 - DNA, 22 bp, Artificial Sequence
  chemically synthesized
attgaacacaaaggaagtgtct

SEQ ID NO: 947777 - DNA, 22 bp, Artificial Sequence
  chemically synthesized
ttgaacacaaaggaagtgtctg

SEQ ID NO: 947778 - DNA, 22 bp, Artificial Sequence
  chemically synthesized
ataagacacttcctcagacact

SEQ ID NO: 947779 - DNA, 22 bp, Artificial Sequence
  chemically synthesized
aacacaaaggaagtgtctgagg

SEQ ID NO: 947780 - DNA, 22 bp, Artificial Sequence
  chemically synthesized
attaataagacacttcctcaga

SEQ ID NO: 947781 - DNA, 22 bp, Artificial Sequence
  chemically synthesized
ggatctcattaataagacactt

SEQ ID NO: 947782 - DNA, 22 bp, Artificial Sequence
  chemically synthesized
aggaagtgtcttattaatgaga

SEQ ID NO: 947783 - DNA, 22 bp, Artificial Sequence
  chemically synthesized
tgatgccgcattgggatctcat

SEQ ID NO: 947784 - DNA, 22 bp, Artificial Sequence
  chemically synthesized
atgatgccgcattgggatctca

SEQ ID NO: 947785 - DNA, 22 bp, Artificial Sequence
  chemically synthesized
cttatgatgccgcattgggatc

SEQ ID NO: 947786 - DNA, 22 bp, Artificial Sequence
  chemically synthesized
gcttatgatgccgcattgggat

SEQ ID NO: 947787 - DNA, 22 bp, Artificial Sequence
  chemically synthesized
attaatgagatcccaatgcggc

SEQ ID NO: 947788 - DNA, 22 bp, Artificial Sequence
  chemically synthesized
ttaatgagatcccaatgcggca

SEQ ID NO: 947789 - DNA, 22 bp, Artificial Sequence
  chemically synthesized
atgagatcccaatgcggcatca

SEQ ID NO: 947790 - DNA, 22 bp, Artificial Sequence
  chemically synthesized
catcacttgcttatgatgccgc

SEQ ID NO: 947791 - DNA, 22 bp, Artificial Sequence
  chemically synthesized
ccatcacttgcttatgatgccg

SEQ ID NO: 947792 - DNA, 22 bp, Artificial Sequence
  chemically synthesized
cacaaaaaaaaaatggtatatg

SEQ ID NO: 947793 - DNA, 22 bp, Artificial Sequence
  chemically synthesized
taacactgcacaaaaaaaaaat

SEQ ID NO: 947794 - DNA, 22 bp, Artificial Sequence
  chemically synthesized
tgcatataccattttttttttg

SEQ ID NO: 947795 - DNA, 22 bp, Artificial Sequence
  chemically synthesized
catataccattttttttttgtg

SEQ ID NO: 947796 - DNA, 22 bp, Artificial Sequence
  chemically synthesized
ataatatagcattataacactg

SEQ ID NO: 947797 - DNA, 22 bp, Artificial Sequence
  chemically synthesized
gataatatagcattataacact

SEQ ID NO: 947798 - DNA, 22 bp, Artificial Sequence
  chemically synthesized
tttttttgtgcagtgttataat

SEQ ID NO: 947799 - DNA, 22 bp, Artificial Sequence
  chemically synthesized
ttttttgtgcagtgttataatg

SEQ ID NO: 947800 - DNA, 22 bp, Artificial Sequence
  chemically synthesized
tttttgtgcagtgttataatgc

SEQ ID NO: 947801 - DNA, 22 bp, Artificial Sequence
  chemically synthesized
tttgataatatagcattataac

SEQ ID NO: 947802 - DNA, 22 bp, Artificial Sequence
  chemically synthesized
ttttgtgcagtgttataatgct

SEQ ID NO: 947803 - DNA, 22 bp, Artificial Sequence
  chemically synthesized
gtttgataatatagcattataa

SEQ ID NO: 947804 - DNA, 22 bp, Artificial Sequence
  chemically synthesized
tttgtgcagtgttataatgcta

SEQ ID NO: 947805 - DNA, 22 bp, Artificial Sequence
  chemically synthesized
tgtttgataatatagcattata

SEQ ID NO: 947806 - DNA, 22 bp, Artificial Sequence
  chemically synthesized
ttgtgcagtgttataatgctat

SEQ ID NO: 947807 - DNA, 22 bp, Artificial Sequence
  chemically synthesized
tgtgcagtgttataatgctata

SEQ ID NO: 947808 - DNA, 22 bp, Artificial Sequence
  chemically synthesized
gtgcagtgttataatgctatat

SEQ ID NO: 947809 - DNA, 22 bp, Artificial Sequence
  chemically synthesized
tgcagtgttataatgctatatt

SEQ ID NO: 947810 - DNA, 22 bp, Artificial Sequence
  chemically synthesized
taatgctatattatcaaacaaa

SEQ ID NO: 947811 - DNA, 22 bp, Artificial Sequence
  chemically synthesized
tattatcaaacaaaacactttc

SEQ ID NO: 947812 - DNA, 22 bp, Artificial Sequence
  chemically synthesized
tcaaacaaaacactttcttttt

SEQ ID NO: 947813 - DNA, 22 bp, Artificial Sequence
  chemically synthesized
tctttttcttcatcctcacata

SEQ ID NO: 947814 - DNA, 22 bp, Artificial Sequence
  chemically synthesized
ctttttcttcatcctcacatac

SEQ ID NO: 947815 - DNA, 22 bp, Artificial Sequence
  chemically synthesized
aaatgaaaatgtgtatgtgagg

SEQ ID NO: 947816 - DNA, 22 bp, Artificial Sequence
  chemically synthesized
tttttcttcatcctcacataca

SEQ ID NO: 947817 - DNA, 22 bp, Artificial Sequence
  chemically synthesized
taaaatgaaaatgtgtatgtga

SEQ ID NO: 947818 - DNA, 22 bp, Artificial Sequence
  chemically synthesized
tttcttcatcctcacatacaca

SEQ ID NO: 947819 - DNA, 22 bp, Artificial Sequence
  chemically synthesized
ctaaaatgaaaatgtgtatgtg

SEQ ID NO: 947820 - DNA, 22 bp, Artificial Sequence
  chemically synthesized
ttcttcatcctcacatacacat

SEQ ID NO: 947821 - DNA, 22 bp, Artificial Sequence
  chemically synthesized
tctaaaatgaaaatgtgtatgt

SEQ ID NO: 947822 - DNA, 22 bp, Artificial Sequence
  chemically synthesized
tcttcatcctcacatacacatt

SEQ ID NO: 947823 - DNA, 22 bp, Artificial Sequence
  chemically synthesized
cttcatcctcacatacacattt

SEQ ID NO: 947824 - DNA, 22 bp, Artificial Sequence
  chemically synthesized
ttcatcctcacatacacatttt

SEQ ID NO: 947825 - DNA, 22 bp, Artificial Sequence
  chemically synthesized
actttctaaaatgaaaatgtgt

SEQ ID NO: 947826 - DNA, 22 bp, Artificial Sequence
  chemically synthesized
catcctcacatacacattttca

SEQ ID NO: 947827 - DNA, 22 bp, Artificial Sequence
  chemically synthesized
atcctcacatacacattttcat

SEQ ID NO: 947828 - DNA, 22 bp, Artificial Sequence
  chemically synthesized
acatacacattttcattttaga

SEQ ID NO: 947829 - DNA, 22 bp, Artificial Sequence
  chemically synthesized
agtaaaagcacgttgactttct

SEQ ID NO: 947830 - DNA, 22 bp, Artificial Sequence
  chemically synthesized
tcattttagaaagtcaacgtgc

SEQ ID NO: 947831 - DNA, 22 bp, Artificial Sequence
  chemically synthesized
cattttagaaagtcaacgtgct

SEQ ID NO: 947832 - DNA, 22 bp, Artificial Sequence
  chemically synthesized
gtactaagtaaaagcacgttga

SEQ ID NO: 947833 - DNA, 22 bp, Artificial Sequence
  chemically synthesized
attttagaaagtcaacgtgctt

SEQ ID NO: 947834 - DNA, 22 bp, Artificial Sequence
  chemically synthesized
ctagtactaagtaaaagcacgt

SEQ ID NO: 947835 - DNA, 22 bp, Artificial Sequence
  chemically synthesized
actagtactaagtaaaagcacg

SEQ ID NO: 947836 - DNA, 22 bp, Artificial Sequence
  chemically synthesized
tagaaagtcaacgtgcttttac

SEQ ID NO: 947837 - DNA, 22 bp, Artificial Sequence
  chemically synthesized
agaaagtcaacgtgcttttact

SEQ ID NO: 947838 - DNA, 22 bp, Artificial Sequence
  chemically synthesized
gaaagtcaacgtgcttttactt

SEQ ID NO: 947839 - DNA, 22 bp, Artificial Sequence
  chemically synthesized
gcaagacatatttactagtact

SEQ ID NO: 947840 - DNA, 22 bp, Artificial Sequence
  chemically synthesized
ggcaagacatatttactagtac

SEQ ID NO: 947841 - DNA, 22 bp, Artificial Sequence
  chemically synthesized
tggcaagacatatttactagta

SEQ ID NO: 947842 - DNA, 22 bp, Artificial Sequence
  chemically synthesized
ttggcaagacatatttactagt

SEQ ID NO: 947843 - DNA, 22 bp, Artificial Sequence
  chemically synthesized
tttggcaagacatatttactag

SEQ ID NO: 947844 - DNA, 22 bp, Artificial Sequence
  chemically synthesized
ttacttagtactagtaaatatg

SEQ ID NO: 947845 - DNA, 22 bp, Artificial Sequence
  chemically synthesized
tacttagtactagtaaatatgt

SEQ ID NO: 947846 - DNA, 22 bp, Artificial Sequence
  chemically synthesized
acttagtactagtaaatatgtc

SEQ ID NO: 947847 - DNA, 22 bp, Artificial Sequence
  chemically synthesized
gctttttggcaagacatattta

SEQ ID NO: 947848 - DNA, 22 bp, Artificial Sequence
  chemically synthesized
cttagtactagtaaatatgtct

SEQ ID NO: 947849 - DNA, 22 bp, Artificial Sequence
  chemically synthesized
agctttttggcaagacatattt

SEQ ID NO: 947850 - DNA, 22 bp, Artificial Sequence
  chemically synthesized
tagctttttggcaagacatatt

SEQ ID NO: 947851 - DNA, 22 bp, Artificial Sequence
  chemically synthesized
agtactagtaaatatgtcttgc

SEQ ID NO: 947852 - DNA, 22 bp, Artificial Sequence
  chemically synthesized
gtactagtaaatatgtcttgcc

SEQ ID NO: 947853 - DNA, 22 bp, Artificial Sequence
  chemically synthesized
cacaattttagctttttggcaa

SEQ ID NO: 947854 - DNA, 22 bp, Artificial Sequence
  chemically synthesized
gtaaatatgtcttgccaaaaag

SEQ ID NO: 947855 - DNA, 22 bp, Artificial Sequence
  chemically synthesized
acacaattttagctttttggca

SEQ ID NO: 947856 - DNA, 22 bp, Artificial Sequence
  chemically synthesized
atgatttacacaattttagctt

SEQ ID NO: 947857 - DNA, 22 bp, Artificial Sequence
  chemically synthesized
gatgatttacacaattttagct

SEQ ID NO: 947858 - DNA, 22 bp, Artificial Sequence
  chemically synthesized
tgatgatttacacaattttagc

SEQ ID NO: 947859 - DNA, 22 bp, Artificial Sequence
  chemically synthesized
ttgatgatttacacaattttag

SEQ ID NO: 947860 - DNA, 22 bp, Artificial Sequence
  chemically synthesized
gccaaaaagctaaaattgtgta

SEQ ID NO: 947861 - DNA, 22 bp, Artificial Sequence
  chemically synthesized
ccaaaaagctaaaattgtgtaa

SEQ ID NO: 947862 - DNA, 22 bp, Artificial Sequence
  chemically synthesized
tagacttttgatgatttacaca

SEQ ID NO: 947863 - DNA, 22 bp, Artificial Sequence
  chemically synthesized
ttatagacttttgatgatttac

SEQ ID NO: 947864 - DNA, 22 bp, Artificial Sequence
  chemically synthesized
aaattgtgtaaatcatcaaaag

SEQ ID NO: 947865 - DNA, 22 bp, Artificial Sequence
  chemically synthesized
atattattatagacttttgatg

SEQ ID NO: 947866 - DNA, 22 bp, Artificial Sequence
  chemically synthesized
tgtaaatcatcaaaagtctata

SEQ ID NO: 947867 - DNA, 22 bp, Artificial Sequence
  chemically synthesized
aaaacagagcattaatattatt

SEQ ID NO: 947868 - DNA, 22 bp, Artificial Sequence
  chemically synthesized
agtatgttcaaaacagagcatt

SEQ ID NO: 947869 - DNA, 22 bp, Artificial Sequence
  chemically synthesized
cagtatgttcaaaacagagcat

SEQ ID NO: 947870 - DNA, 22 bp, Artificial Sequence
  chemically synthesized
taataatattaatgctctgttt

SEQ ID NO: 947871 - DNA, 22 bp, Artificial Sequence
  chemically synthesized
ggcttcagtatgttcaaaacag

SEQ ID NO: 947872 - DNA, 22 bp, Artificial Sequence
  chemically synthesized
ctgggcttcagtatgttcaaaa

SEQ ID NO: 947873 - DNA, 22 bp, Artificial Sequence
  chemically synthesized
atgctctgttttgaacatactg

SEQ ID NO: 947874 - DNA, 22 bp, Artificial Sequence
  chemically synthesized
tgttttgaacatactgaagccc

SEQ ID NO: 947875 - DNA, 22 bp, Artificial Sequence
  chemically synthesized
ttttgaacatactgaagcccag

SEQ ID NO: 947876 - DNA, 22 bp, Artificial Sequence
  chemically synthesized
tgaacatactgaagcccaggaa

SEQ ID NO: 947877 - DNA, 22 bp, Artificial Sequence
  chemically synthesized
gaacatactgaagcccaggaat

SEQ ID NO: 947878 - DNA, 22 bp, Artificial Sequence
  chemically synthesized
aacatactgaagcccaggaatt

SEQ ID NO: 947879 - DNA, 22 bp, Artificial Sequence
  chemically synthesized
ggggaaataaggcaattcctgg

SEQ ID NO: 947880 - DNA, 22 bp, Artificial Sequence
  chemically synthesized
ttgggggaaataaggcaattcc

SEQ ID NO: 947881 - DNA, 22 bp, Artificial Sequence
  chemically synthesized
aagcccaggaattgccttattt

SEQ ID NO: 947882 - DNA, 22 bp, Artificial Sequence
  chemically synthesized
cagggttgttgggggaaataag

SEQ ID NO: 947883 - DNA, 22 bp, Artificial Sequence
  chemically synthesized
agaaaagctgcagggttgttgg

SEQ ID NO: 947884 - DNA, 22 bp, Artificial Sequence
  chemically synthesized
ccttatttcccccaacaaccct

SEQ ID NO: 947885 - DNA, 22 bp, Artificial Sequence
  chemically synthesized
cagaaaagctgcagggttgttg

SEQ ID NO: 947886 - DNA, 22 bp, Artificial Sequence
  chemically synthesized
ttcagaaaagctgcagggttgt

SEQ ID NO: 947887 - DNA, 22 bp, Artificial Sequence
  chemically synthesized
atttcccccaacaaccctgcag

SEQ ID NO: 947888 - DNA, 22 bp, Artificial Sequence
  chemically synthesized
tcttcagaaaagctgcagggtt

SEQ ID NO: 947889 - DNA, 22 bp, Artificial Sequence
  chemically synthesized
tttcccccaacaaccctgcagc

SEQ ID NO: 947890 - DNA, 22 bp, Artificial Sequence
  chemically synthesized
ctcttcagaaaagctgcagggt

SEQ ID NO: 947891 - DNA, 22 bp, Artificial Sequence
  chemically synthesized
cccccaacaaccctgcagcttt

SEQ ID NO: 947892 - DNA, 22 bp, Artificial Sequence
  chemically synthesized
ccccaacaaccctgcagctttt

SEQ ID NO: 947893 - DNA, 22 bp, Artificial Sequence
  chemically synthesized
aggtttctcttcagaaaagctg

SEQ ID NO: 947894 - DNA, 22 bp, Artificial Sequence
  chemically synthesized
cagcttttctgaagagaaacct

SEQ ID NO: 947895 - DNA, 22 bp, Artificial Sequence
  chemically synthesized
tccgtgaacctcaggtttctct

SEQ ID NO: 947896 - DNA, 22 bp, Artificial Sequence
  chemically synthesized
ctatccgtgaacctcaggtttc

SEQ ID NO: 947897 - DNA, 22 bp, Artificial Sequence
  chemically synthesized
actatccgtgaacctcaggttt

SEQ ID NO: 947898 - DNA, 22 bp, Artificial Sequence
  chemically synthesized
ttctgaagagaaacctgaggtt

SEQ ID NO: 947899 - DNA, 22 bp, Artificial Sequence
  chemically synthesized
tctgaagagaaacctgaggttc

SEQ ID NO: 947900 - DNA, 22 bp, Artificial Sequence
  chemically synthesized
ctgaagagaaacctgaggttca

SEQ ID NO: 947901 - DNA, 22 bp, Artificial Sequence
  chemically synthesized
tgaagagaaacctgaggttcac

SEQ ID NO: 947902 - DNA, 22 bp, Artificial Sequence
  chemically synthesized
aagagaaacctgaggttcacgg

SEQ ID NO: 947903 - DNA, 22 bp, Artificial Sequence
  chemically synthesized
gcatataatttactatccgtga

SEQ ID NO: 947904 - DNA, 22 bp, Artificial Sequence
  chemically synthesized
tggcatataatttactatccgt

SEQ ID NO: 947905 - DNA, 22 bp, Artificial Sequence
  chemically synthesized
atctctggcatataatttacta

SEQ ID NO: 947906 - DNA, 22 bp, Artificial Sequence
  chemically synthesized
aggttcacggatagtaaattat

SEQ ID NO: 947907 - DNA, 22 bp, Artificial Sequence
  chemically synthesized
gatctctggcatataatttact

SEQ ID NO: 947908 - DNA, 22 bp, Artificial Sequence
  chemically synthesized
cttgatctctggcatataattt

SEQ ID NO: 947909 - DNA, 22 bp, Artificial Sequence
  chemically synthesized
acggatagtaaattatatgcca

SEQ ID NO: 947910 - DNA, 22 bp, Artificial Sequence
  chemically synthesized
ccacctgcttgatctctggcat

SEQ ID NO: 947911 - DNA, 22 bp, Artificial Sequence
  chemically synthesized
cccacctgcttgatctctggca

SEQ ID NO: 947912 - DNA, 22 bp, Artificial Sequence
  chemically synthesized
tcatcttcccacctgcttgatc

SEQ ID NO: 947913 - DNA, 22 bp, Artificial Sequence
  chemically synthesized
tatcatcttcccacctgcttga

SEQ ID NO: 947914 - DNA, 22 bp, Artificial Sequence
  chemically synthesized
tatgccagagatcaagcaggtg

SEQ ID NO: 947915 - DNA, 22 bp, Artificial Sequence
  chemically synthesized
atctctatcatcttcccacctg

SEQ ID NO: 947916 - DNA, 22 bp, Artificial Sequence
  chemically synthesized
ggataaaattcatctctatcat

SEQ ID NO: 947917 - DNA, 22 bp, Artificial Sequence
  chemically synthesized
aatgaggaggaaagaaccagca

SEQ ID NO: 947918 - DNA, 22 bp, Artificial Sequence
  chemically synthesized
tatcccagctctgctggttctt

SEQ ID NO: 947919 - DNA, 22 bp, Artificial Sequence
  chemically synthesized
atcccagctctgctggttcttt

SEQ ID NO: 947920 - DNA, 22 bp, Artificial Sequence
  chemically synthesized
tcccagctctgctggttctttc

SEQ ID NO: 947921 - DNA, 22 bp, Artificial Sequence
  chemically synthesized
tgctggttctttcctcctcatt

SEQ ID NO: 947922 - DNA, 22 bp, Artificial Sequence
  chemically synthesized
ctggttctttcctcctcattta

SEQ ID NO: 947923 - DNA, 22 bp, Artificial Sequence
  chemically synthesized
gttctttcctcctcatttaacg

SEQ ID NO: 947924 - DNA, 22 bp, Artificial Sequence
  chemically synthesized
tttcctcctcatttaacgttcc

SEQ ID NO: 947925 - DNA, 22 bp, Artificial Sequence
  chemically synthesized
tcctcctcatttaacgttccac

SEQ ID NO: 947926 - DNA, 22 bp, Artificial Sequence
  chemically synthesized
cctcctcatttaacgttccacc

SEQ ID NO: 947927 - DNA, 22 bp, Artificial Sequence
  chemically synthesized
aaggaataaggtggtggaacgt

SEQ ID NO: 947928 - DNA, 22 bp, Artificial Sequence
  chemically synthesized
ctcctcatttaacgttccacca

SEQ ID NO: 947929 - DNA, 22 bp, Artificial Sequence
  chemically synthesized
aaaggaataaggtggtggaacg

SEQ ID NO: 947930 - DNA, 22 bp, Artificial Sequence
  chemically synthesized
ctcatttaacgttccaccacct

SEQ ID NO: 947931 - DNA, 22 bp, Artificial Sequence
  chemically synthesized
atttaacgttccaccaccttat

SEQ ID NO: 947932 - DNA, 22 bp, Artificial Sequence
  chemically synthesized
gagcttaaaggaataaggtggt

SEQ ID NO: 947933 - DNA, 22 bp, Artificial Sequence
  chemically synthesized
ggagcttaaaggaataaggtgg

SEQ ID NO: 947934 - DNA, 22 bp, Artificial Sequence
  chemically synthesized
aacgttccaccaccttattcct

SEQ ID NO: 947935 - DNA, 22 bp, Artificial Sequence
  chemically synthesized
acgttccaccaccttattcctt

SEQ ID NO: 947936 - DNA, 22 bp, Artificial Sequence
  chemically synthesized
gtacttggagcttaaaggaata

SEQ ID NO: 947937 - DNA, 22 bp, Artificial Sequence
  chemically synthesized
caccaccttattcctttaagct

SEQ ID NO: 947938 - DNA, 22 bp, Artificial Sequence
  chemically synthesized
gattggtacttggagcttaaag

SEQ ID NO: 947939 - DNA, 22 bp, Artificial Sequence
  chemically synthesized
tagattggtacttggagcttaa

SEQ ID NO: 947940 - DNA, 22 bp, Artificial Sequence
  chemically synthesized
attcctttaagctccaagtacc

SEQ ID NO: 947941 - DNA, 22 bp, Artificial Sequence
  chemically synthesized
ttcctttaagctccaagtacca

SEQ ID NO: 947942 - DNA, 22 bp, Artificial Sequence
  chemically synthesized
ctttaagctccaagtaccaatc

SEQ ID NO: 947943 - DNA, 22 bp, Artificial Sequence
  chemically synthesized
taaaaatctctagattggtact

SEQ ID NO: 947944 - DNA, 22 bp, Artificial Sequence
  chemically synthesized
taagctccaagtaccaatctag

SEQ ID NO: 947945 - DNA, 22 bp, Artificial Sequence
  chemically synthesized
aagctccaagtaccaatctaga

SEQ ID NO: 947946 - DNA, 22 bp, Artificial Sequence
  chemically synthesized
attataaaaatctctagattgg

SEQ ID NO: 947947 - DNA, 22 bp, Artificial Sequence
  chemically synthesized
agctccaagtaccaatctagag

SEQ ID NO: 947948 - DNA, 22 bp, Artificial Sequence
  chemically synthesized
caagtaccaatctagagatttt

SEQ ID NO: 947949 - DNA, 22 bp, Artificial Sequence
  chemically synthesized
ggaattaattataaaaatctct

SEQ ID NO: 947950 - DNA, 22 bp, Artificial Sequence
  chemically synthesized
atcagacattaggaattaatta

SEQ ID NO: 947951 - DNA, 22 bp, Artificial Sequence
  chemically synthesized
catcagacattaggaattaatt

SEQ ID NO: 947952 - DNA, 22 bp, Artificial Sequence
  chemically synthesized
gagatttttataattaattcct

SEQ ID NO: 947953 - DNA, 22 bp, Artificial Sequence
  chemically synthesized
ttataattaattcctaatgtct

SEQ ID NO: 947954 - DNA, 22 bp, Artificial Sequence
  chemically synthesized
tataattaattcctaatgtctg

SEQ ID NO: 947955 - DNA, 22 bp, Artificial Sequence
  chemically synthesized
ataattaattcctaatgtctga

SEQ ID NO: 947956 - DNA, 22 bp, Artificial Sequence
  chemically synthesized
taattaattcctaatgtctgat

SEQ ID NO: 947957 - DNA, 22 bp, Artificial Sequence
  chemically synthesized
attcctaatgtctgatgaaacc

SEQ ID NO: 947958 - DNA, 22 bp, Artificial Sequence
  chemically synthesized
catgaggtcggtcaggtttcat

SEQ ID NO: 947959 - DNA, 22 bp, Artificial Sequence
  chemically synthesized
gcatgaggtcggtcaggtttca

SEQ ID NO: 947960 - DNA, 22 bp, Artificial Sequence
  chemically synthesized
ctaatgtctgatgaaacctgac

SEQ ID NO: 947961 - DNA, 22 bp, Artificial Sequence
  chemically synthesized
tgcatgaggtcggtcaggtttc

SEQ ID NO: 947962 - DNA, 22 bp, Artificial Sequence
  chemically synthesized
ttgcatgaggtcggtcaggttt

SEQ ID NO: 947963 - DNA, 22 bp, Artificial Sequence
  chemically synthesized
atgtctgatgaaacctgaccga

SEQ ID NO: 947964 - DNA, 22 bp, Artificial Sequence
  chemically synthesized
atatttttgcatgaggtcggtc

SEQ ID NO: 947965 - DNA, 22 bp, Artificial Sequence
  chemically synthesized
aatatttttgcatgaggtcggt

SEQ ID NO: 947966 - DNA, 22 bp, Artificial Sequence
  chemically synthesized
taatatttttgcatgaggtcgg

SEQ ID NO: 947967 - DNA, 22 bp, Artificial Sequence
  chemically synthesized
atgaaacctgaccgacctcatg

SEQ ID NO: 947968 - DNA, 22 bp, Artificial Sequence
  chemically synthesized
tttaatatttttgcatgaggtc

SEQ ID NO: 947969 - DNA, 22 bp, Artificial Sequence
  chemically synthesized
accgacctcatgcaaaaatatt

SEQ ID NO: 947970 - DNA, 22 bp, Artificial Sequence
  chemically synthesized
aataagtattctttaatatttt

SEQ ID NO: 947971 - DNA, 22 bp, Artificial Sequence
  chemically synthesized
ttcaataagtattctttaatat

SEQ ID NO: 947972 - DNA, 22 bp, Artificial Sequence
  chemically synthesized
attcaataagtattctttaata

SEQ ID NO: 947973 - DNA, 22 bp, Artificial Sequence
  chemically synthesized
atgcaaaaatattaaagaatac

SEQ ID NO: 947974 - DNA, 22 bp, Artificial Sequence
  chemically synthesized
atttattcaataagtattcttt

SEQ ID NO: 947975 - DNA, 22 bp, Artificial Sequence
  chemically synthesized
gattgatttattcaataagtat

SEQ ID NO: 947976 - DNA, 22 bp, Artificial Sequence
  chemically synthesized
ggattgatttattcaataagta

SEQ ID NO: 947977 - DNA, 22 bp, Artificial Sequence
  chemically synthesized
tatcttggattgatttattcaa

SEQ ID NO: 947978 - DNA, 22 bp, Artificial Sequence
  chemically synthesized
aagaatacttattgaataaatc

SEQ ID NO: 947979 - DNA, 22 bp, Artificial Sequence
  chemically synthesized
aattgtatcttggattgattta

SEQ ID NO: 947980 - DNA, 22 bp, Artificial Sequence
  chemically synthesized
caattgtatcttggattgattt

SEQ ID NO: 947981 - DNA, 22 bp, Artificial Sequence
  chemically synthesized
tcaattgtatcttggattgatt

SEQ ID NO: 947982 - DNA, 22 bp, Artificial Sequence
  chemically synthesized
attgaataaatcaatccaagat

SEQ ID NO: 947983 - DNA, 22 bp, Artificial Sequence
  chemically synthesized
ttgaataaatcaatccaagata

SEQ ID NO: 947984 - DNA, 22 bp, Artificial Sequence
  chemically synthesized
cattttcaattgtatcttggat

SEQ ID NO: 947985 - DNA, 22 bp, Artificial Sequence
  chemically synthesized
aataaatcaatccaagatacaa

SEQ ID NO: 947986 - DNA, 22 bp, Artificial Sequence
  chemically synthesized
aattacattttcaattgtatct

SEQ ID NO: 947987 - DNA, 22 bp, Artificial Sequence
  chemically synthesized
attaaattacattttcaattgt

SEQ ID NO: 947988 - DNA, 22 bp, Artificial Sequence
  chemically synthesized
cctaattaaattacattttcaa

SEQ ID NO: 947989 - DNA, 22 bp, Artificial Sequence
  chemically synthesized
tacctaattaaattacattttc

SEQ ID NO: 947990 - DNA, 22 bp, Artificial Sequence
  chemically synthesized
acctctacctaattaaattaca

SEQ ID NO: 947991 - DNA, 22 bp, Artificial Sequence
  chemically synthesized
gacctctacctaattaaattac

SEQ ID NO: 947992 - DNA, 22 bp, Artificial Sequence
  chemically synthesized
aaaatgtaatttaattaggtag

SEQ ID NO: 947993 - DNA, 22 bp, Artificial Sequence
  chemically synthesized
tgaagtttgacctctacctaat

SEQ ID NO: 947994 - DNA, 22 bp, Artificial Sequence
  chemically synthesized
gtgaagtttgacctctacctaa

SEQ ID NO: 947995 - DNA, 22 bp, Artificial Sequence
  chemically synthesized
tgtgaagtttgacctctaccta

SEQ ID NO: 947996 - DNA, 22 bp, Artificial Sequence
  chemically synthesized
ttttgtgaagtttgacctctac

SEQ ID NO: 947997 - DNA, 22 bp, Artificial Sequence
  chemically synthesized
tgttttgtgaagtttgacctct

SEQ ID NO: 947998 - DNA, 22 bp, Artificial Sequence
  chemically synthesized
aattaggtagaggtcaaacttc

SEQ ID NO: 947999 - DNA, 22 bp, Artificial Sequence
  chemically synthesized
attaggtagaggtcaaacttca

SEQ ID NO: 948000 - DNA, 22 bp, Artificial Sequence
  chemically synthesized
tattctgttttgtgaagtttga

SEQ ID NO: 948001 - DNA, 22 bp, Artificial Sequence
  chemically synthesized
ggtagaggtcaaacttcacaaa

SEQ ID NO: 948002 - DNA, 22 bp, Artificial Sequence
  chemically synthesized
tgttatattctgttttgtgaag

SEQ ID NO: 948003 - DNA, 22 bp, Artificial Sequence
  chemically synthesized
atgttatattctgttttgtgaa

SEQ ID NO: 948004 - DNA, 22 bp, Artificial Sequence
  chemically synthesized
tttatgttatattctgttttgt

SEQ ID NO: 948005 - DNA, 22 bp, Artificial Sequence
  chemically synthesized
attatttatgttatattctgtt

SEQ ID NO: 948006 - DNA, 22 bp, Artificial Sequence
  chemically synthesized
cacaaaacagaatataacataa

SEQ ID NO: 948007 - DNA, 22 bp, Artificial Sequence
  chemically synthesized
acaaaacagaatataacataaa

SEQ ID NO: 948008 - DNA, 22 bp, Artificial Sequence
  chemically synthesized
tggtgttgattatttatgttat

SEQ ID NO: 948009 - DNA, 22 bp, Artificial Sequence
  chemically synthesized
cctatggtgttgattatttatg

SEQ ID NO: 948010 - DNA, 22 bp, Artificial Sequence
  chemically synthesized
ttgcctatggtgttgattattt

SEQ ID NO: 948011 - DNA, 22 bp, Artificial Sequence
  chemically synthesized
attgcctatggtgttgattatt

SEQ ID NO: 948012 - DNA, 22 bp, Artificial Sequence
  chemically synthesized
tcttattgcctatggtgttgat

SEQ ID NO: 948013 - DNA, 22 bp, Artificial Sequence
  chemically synthesized
aggcaataagatgtctatctta

SEQ ID NO: 948014 - DNA, 22 bp, Artificial Sequence
  chemically synthesized
cagaaattgaggcaataagatg

SEQ ID NO: 948015 - DNA, 22 bp, Artificial Sequence
  chemically synthesized
tcccctgcagaaattgaggcaa

SEQ ID NO: 948016 - DNA, 22 bp, Artificial Sequence
  chemically synthesized
atcccctgcagaaattgaggca

SEQ ID NO: 948017 - DNA, 22 bp, Artificial Sequence
  chemically synthesized
ccaatttatcccctgcagaaat

SEQ ID NO: 948018 - DNA, 22 bp, Artificial Sequence
  chemically synthesized
cccaatttatcccctgcagaaa

SEQ ID NO: 948019 - DNA, 22 bp, Artificial Sequence
  chemically synthesized
attgcctcaatttctgcagggg

SEQ ID NO: 948020 - DNA, 22 bp, Artificial Sequence
  chemically synthesized
ttgcctcaatttctgcagggga

SEQ ID NO: 948021 - DNA, 22 bp, Artificial Sequence
  chemically synthesized
tttcccaatttatcccctgcag

SEQ ID NO: 948022 - DNA, 22 bp, Artificial Sequence
  chemically synthesized
atttcccaatttatcccctgca

SEQ ID NO: 948023 - DNA, 22 bp, Artificial Sequence
  chemically synthesized
cctcaatttctgcaggggataa

SEQ ID NO: 948024 - DNA, 22 bp, Artificial Sequence
  chemically synthesized
cttatttcccaatttatcccct

SEQ ID NO: 948025 - DNA, 22 bp, Artificial Sequence
  chemically synthesized
aatttctgcaggggataaattg

SEQ ID NO: 948026 - DNA, 22 bp, Artificial Sequence
  chemically synthesized
ggtgttccttatttcccaattt

SEQ ID NO: 948027 - DNA, 22 bp, Artificial Sequence
  chemically synthesized
ctgcaggggataaattgggaaa

SEQ ID NO: 948028 - DNA, 22 bp, Artificial Sequence
  chemically synthesized
aggtgttccttatttcccaatt

SEQ ID NO: 948029 - DNA, 22 bp, Artificial Sequence
  chemically synthesized
tgcaggggataaattgggaaat

SEQ ID NO: 948030 - DNA, 22 bp, Artificial Sequence
  chemically synthesized
ttaggtgttccttatttcccaa

SEQ ID NO: 948031 - DNA, 22 bp, Artificial Sequence
  chemically synthesized
caggggataaattgggaaataa

SEQ ID NO: 948032 - DNA, 22 bp, Artificial Sequence
  chemically synthesized
attcttaggtgttccttatttc

SEQ ID NO: 948033 - DNA, 22 bp, Artificial Sequence
  chemically synthesized
tgattcttaggtgttccttatt

SEQ ID NO: 948034 - DNA, 22 bp, Artificial Sequence
  chemically synthesized
ctgattcttaggtgttccttat

SEQ ID NO: 948035 - DNA, 22 bp, Artificial Sequence
  chemically synthesized
atttctgattcttaggtgttcc

SEQ ID NO: 948036 - DNA, 22 bp, Artificial Sequence
  chemically synthesized
ggaaataaggaacacctaagaa

SEQ ID NO: 948037 - DNA, 22 bp, Artificial Sequence
  chemically synthesized
cctcatttctgattcttaggtg

SEQ ID NO: 948038 - DNA, 22 bp, Artificial Sequence
  chemically synthesized
tacctcatttctgattcttagg

SEQ ID NO: 948039 - DNA, 22 bp, Artificial Sequence
  chemically synthesized
ctacctcatttctgattcttag

SEQ ID NO: 948040 - DNA, 22 bp, Artificial Sequence
  chemically synthesized
aatatttctacctcatttctga

SEQ ID NO: 948041 - DNA, 22 bp, Artificial Sequence
  chemically synthesized
caatatttctacctcatttctg

SEQ ID NO: 948042 - DNA, 22 bp, Artificial Sequence
  chemically synthesized
tttcaatatttctacctcattt

SEQ ID NO: 948043 - DNA, 22 bp, Artificial Sequence
  chemically synthesized
atttcaatatttctacctcatt

SEQ ID NO: 948044 - DNA, 22 bp, Artificial Sequence
  chemically synthesized
tatttcaatatttctacctcat

SEQ ID NO: 948045 - DNA, 22 bp, Artificial Sequence
  chemically synthesized
ttatttcaatatttctacctca

SEQ ID NO: 948046 - DNA, 22 bp, Artificial Sequence
  chemically synthesized
agaatcagaaatgaggtagaaa

SEQ ID NO: 948047 - DNA, 22 bp, Artificial Sequence
  chemically synthesized
gatcaagtttttatttcaatat

SEQ ID NO: 948048 - DNA, 22 bp, Artificial Sequence
  chemically synthesized
tagatcaagtttttatttcaat

SEQ ID NO: 948049 - DNA, 22 bp, Artificial Sequence
  chemically synthesized
ctagatcaagtttttatttcaa

SEQ ID NO: 948050 - DNA, 22 bp, Artificial Sequence
  chemically synthesized
tgatcttctagatcaagttttt

SEQ ID NO: 948051 - DNA, 22 bp, Artificial Sequence
  chemically synthesized
ctgtgatcttctagatcaagtt

SEQ ID NO: 948052 - DNA, 22 bp, Artificial Sequence
  chemically synthesized
actgtgatcttctagatcaagt

SEQ ID NO: 948053 - DNA, 22 bp, Artificial Sequence
  chemically synthesized
aaataaaaacttgatctagaag

SEQ ID NO: 948054 - DNA, 22 bp, Artificial Sequence
  chemically synthesized
agaacttactgtgatcttctag

SEQ ID NO: 948055 - DNA, 22 bp, Artificial Sequence
  chemically synthesized
aagaacttactgtgatcttcta

SEQ ID NO: 948056 - DNA, 22 bp, Artificial Sequence
  chemically synthesized
taagaacttactgtgatcttct

SEQ ID NO: 948057 - DNA, 22 bp, Artificial Sequence
  chemically synthesized
gatctagaagatcacagtaagt

SEQ ID NO: 948058 - DNA, 22 bp, Artificial Sequence
  chemically synthesized
atctagaagatcacagtaagtt

SEQ ID NO: 948059 - DNA, 22 bp, Artificial Sequence
  chemically synthesized
gaagatcacagtaagttcttaa

SEQ ID NO: 948060 - DNA, 22 bp, Artificial Sequence
  chemically synthesized
ggaggaccgcgttttaagaact

SEQ ID NO: 948061 - DNA, 22 bp, Artificial Sequence
  chemically synthesized
ggtcctaggaggaccgcgtttt

SEQ ID NO: 948062 - DNA, 22 bp, Artificial Sequence
  chemically synthesized
tgctgggtcctaggaggaccgc

SEQ ID NO: 948063 - DNA, 22 bp, Artificial Sequence
  chemically synthesized
ttaaaacgcggtcctcctagga

SEQ ID NO: 948064 - DNA, 22 bp, Artificial Sequence
  chemically synthesized
aaaacgcggtcctcctaggacc

SEQ ID NO: 948065 - DNA, 22 bp, Artificial Sequence
  chemically synthesized
cgtgttgtgctgggtcctagga

SEQ ID NO: 948066 - DNA, 22 bp, Artificial Sequence
  chemically synthesized
aaacgcggtcctcctaggaccc

SEQ ID NO: 948067 - DNA, 22 bp, Artificial Sequence
  chemically synthesized
ttacgtgttgtgctgggtccta

SEQ ID NO: 948068 - DNA, 22 bp, Artificial Sequence
  chemically synthesized
attacgtgttgtgctgggtcct

SEQ ID NO: 948069 - DNA, 22 bp, Artificial Sequence
  chemically synthesized
ctaggacccagcacaacacgta

SEQ ID NO: 948070 - DNA, 22 bp, Artificial Sequence
  chemically synthesized
ggacccagcacaacacgtaata

SEQ ID NO: 948071 - DNA, 22 bp, Artificial Sequence
  chemically synthesized
aaaccaggcagcatttattacg

SEQ ID NO: 948072 - DNA, 22 bp, Artificial Sequence
  chemically synthesized
aattcaaaccaggcagcattta

SEQ ID NO: 948073 - DNA, 22 bp, Artificial Sequence
  chemically synthesized
agttcaattcaaaccaggcagc

SEQ ID NO: 948074 - DNA, 22 bp, Artificial Sequence
  chemically synthesized
aagttcaattcaaaccaggcag

SEQ ID NO: 948075 - DNA, 22 bp, Artificial Sequence
  chemically synthesized
ccttaagttcaattcaaaccag

SEQ ID NO: 948076 - DNA, 22 bp, Artificial Sequence
  chemically synthesized
atgctaccttaagttcaattca

SEQ ID NO: 948077 - DNA, 22 bp, Artificial Sequence
  chemically synthesized
ttaatgctaccttaagttcaat

SEQ ID NO: 948078 - DNA, 22 bp, Artificial Sequence
  chemically synthesized
gttaatgctaccttaagttcaa

SEQ ID NO: 948079 - DNA, 22 bp, Artificial Sequence
  chemically synthesized
cctggtttgaattgaacttaag

SEQ ID NO: 948080 - DNA, 22 bp, Artificial Sequence
  chemically synthesized
ttgttaatgctaccttaagttc

SEQ ID NO: 948081 - DNA, 22 bp, Artificial Sequence
  chemically synthesized
gtttgaattgaacttaaggtag

SEQ ID NO: 948082 - DNA, 22 bp, Artificial Sequence
  chemically synthesized
gaattgaacttaaggtagcatt

SEQ ID NO: 948083 - DNA, 22 bp, Artificial Sequence
  chemically synthesized
aattgaacttaaggtagcatta

SEQ ID NO: 948084 - DNA, 22 bp, Artificial Sequence
  chemically synthesized
ccaagttcttgttaatgctacc

SEQ ID NO: 948085 - DNA, 22 bp, Artificial Sequence
  chemically synthesized
cccaagttcttgttaatgctac

SEQ ID NO: 948086 - DNA, 22 bp, Artificial Sequence
  chemically synthesized
aacttaaggtagcattaacaag

SEQ ID NO: 948087 - DNA, 22 bp, Artificial Sequence
  chemically synthesized
aaggtagcattaacaagaactt

SEQ ID NO: 948088 - DNA, 22 bp, Artificial Sequence
  chemically synthesized
aggtagcattaacaagaacttg

SEQ ID NO: 948089 - DNA, 22 bp, Artificial Sequence
  chemically synthesized
tgtcagcacttcccaagttctt

SEQ ID NO: 948090 - DNA, 22 bp, Artificial Sequence
  chemically synthesized
gtgtcagcacttcccaagttct

SEQ ID NO: 948091 - DNA, 22 bp, Artificial Sequence
  chemically synthesized
tgtgtcagcacttcccaagttc

SEQ ID NO: 948092 - DNA, 22 bp, Artificial Sequence
  chemically synthesized
acaagaacttgggaagtgctga

SEQ ID NO: 948093 - DNA, 22 bp, Artificial Sequence
  chemically synthesized
gggaagtgctgacacaaaatgg

SEQ ID NO: 948094 - DNA, 22 bp, Artificial Sequence
  chemically synthesized
gaataagagaatccattttgtg

SEQ ID NO: 948095 - DNA, 22 bp, Artificial Sequence
  chemically synthesized
ggaagtgctgacacaaaatgga

SEQ ID NO: 948096 - DNA, 22 bp, Artificial Sequence
  chemically synthesized
tctagaataagagaatccattt

SEQ ID NO: 948097 - DNA, 22 bp, Artificial Sequence
  chemically synthesized
acacaaaatggattctcttatt

SEQ ID NO: 948098 - DNA, 22 bp, Artificial Sequence
  chemically synthesized
agtacaagaattgtctagaata

SEQ ID NO: 948099 - DNA, 22 bp, Artificial Sequence
  chemically synthesized
attcagtacaagaattgtctag

SEQ ID NO: 948100 - DNA, 22 bp, Artificial Sequence
  chemically synthesized
tcttattctagacaattcttgt

SEQ ID NO: 948101 - DNA, 22 bp, Artificial Sequence
  chemically synthesized
agttcattcagtacaagaattg

SEQ ID NO: 948102 - DNA, 22 bp, Artificial Sequence
  chemically synthesized
ttattctagacaattcttgtac

SEQ ID NO: 948103 - DNA, 22 bp, Artificial Sequence
  chemically synthesized
attctagacaattcttgtactg

SEQ ID NO: 948104 - DNA, 22 bp, Artificial Sequence
  chemically synthesized
ttctagacaattcttgtactga

SEQ ID NO: 948105 - DNA, 22 bp, Artificial Sequence
  chemically synthesized
tagacaattcttgtactgaatg

SEQ ID NO: 948106 - DNA, 22 bp, Artificial Sequence
  chemically synthesized
gacaattcttgtactgaatgaa

SEQ ID NO: 948107 - DNA, 22 bp, Artificial Sequence
  chemically synthesized
aaagaaattaagttcattcagt

SEQ ID NO: 948108 - DNA, 22 bp, Artificial Sequence
  chemically synthesized
ttgtactgaatgaacttaattt

SEQ ID NO: 948109 - DNA, 22 bp, Artificial Sequence
  chemically synthesized
gtactgaatgaacttaatttct

SEQ ID NO: 948110 - DNA, 22 bp, Artificial Sequence
  chemically synthesized
tactgaatgaacttaatttctt

SEQ ID NO: 948111 - DNA, 22 bp, Artificial Sequence
  chemically synthesized
tgccagaactgaaagaaattaa

SEQ ID NO: 948112 - DNA, 22 bp, Artificial Sequence
  chemically synthesized
aatgaacttaatttctttcagt

SEQ ID NO: 948113 - DNA, 22 bp, Artificial Sequence
  chemically synthesized
atccaaactatgccagaactga

SEQ ID NO: 948114 - DNA, 22 bp, Artificial Sequence
  chemically synthesized
aatttctttcagttctggcata

SEQ ID NO: 948115 - DNA, 22 bp, Artificial Sequence
  chemically synthesized
atttctttcagttctggcatag

SEQ ID NO: 948116 - DNA, 22 bp, Artificial Sequence
  chemically synthesized
ctttcagttctggcatagtttg

SEQ ID NO: 948117 - DNA, 22 bp, Artificial Sequence
  chemically synthesized
tttcagttctggcatagtttgg

SEQ ID NO: 948118 - DNA, 22 bp, Artificial Sequence
  chemically synthesized
tcagttctggcatagtttggat

SEQ ID NO: 948119 - DNA, 22 bp, Artificial Sequence
  chemically synthesized
tgaggaagattcatccaaacta

SEQ ID NO: 948120 - DNA, 22 bp, Artificial Sequence
  chemically synthesized
cagttctggcatagtttggatg

SEQ ID NO: 948121 - DNA, 22 bp, Artificial Sequence
  chemically synthesized
agttctggcatagtttggatga

SEQ ID NO: 948122 - DNA, 22 bp, Artificial Sequence
  chemically synthesized
tggcatagtttggatgaatctt

SEQ ID NO: 948123 - DNA, 22 bp, Artificial Sequence
  chemically synthesized
gcatagtttggatgaatcttcc

SEQ ID NO: 948124 - DNA, 22 bp, Artificial Sequence
  chemically synthesized
ggatgaatcttcctcataacca

SEQ ID NO: 948125 - DNA, 22 bp, Artificial Sequence
  chemically synthesized
gatgaatcttcctcataaccat

SEQ ID NO: 948126 - DNA, 22 bp, Artificial Sequence
  chemically synthesized
aaggaagacaaccagatggtta

SEQ ID NO: 948127 - DNA, 22 bp, Artificial Sequence
  chemically synthesized
cctcataaccatctggttgtct

SEQ ID NO: 948128 - DNA, 22 bp, Artificial Sequence
  chemically synthesized
ctcataaccatctggttgtctt

SEQ ID NO: 948129 - DNA, 22 bp, Artificial Sequence
  chemically synthesized
ataaccatctggttgtcttcct

SEQ ID NO: 948130 - DNA, 22 bp, Artificial Sequence
  chemically synthesized
gcagcacagaattgaaggaaga

SEQ ID NO: 948131 - DNA, 22 bp, Artificial Sequence
  chemically synthesized
agcagcacagaattgaaggaag

SEQ ID NO: 948132 - DNA, 22 bp, Artificial Sequence
  chemically synthesized
tttagcagcacagaattgaagg

SEQ ID NO: 948133 - DNA, 22 bp, Artificial Sequence
  chemically synthesized
gtttagcagcacagaattgaag

SEQ ID NO: 948134 - DNA, 22 bp, Artificial Sequence
  chemically synthesized
gttgtcttccttcaattctgtg

SEQ ID NO: 948135 - DNA, 22 bp, Artificial Sequence
  chemically synthesized
tcttccttcaattctgtgctgc

SEQ ID NO: 948136 - DNA, 22 bp, Artificial Sequence
  chemically synthesized
ccttcaattctgtgctgctaaa

SEQ ID NO: 948137 - DNA, 22 bp, Artificial Sequence
  chemically synthesized
cttcaattctgtgctgctaaac

SEQ ID NO: 948138 - DNA, 22 bp, Artificial Sequence
  chemically synthesized
aaaacagaagtttgtttagcag

SEQ ID NO: 948139 - DNA, 22 bp, Artificial Sequence
  chemically synthesized
caattctgtgctgctaaacaaa

SEQ ID NO: 948140 - DNA, 22 bp, Artificial Sequence
  chemically synthesized
aattctgtgctgctaaacaaac

SEQ ID NO: 948141 - DNA, 22 bp, Artificial Sequence
  chemically synthesized
tgtgctgctaaacaaacttctg

SEQ ID NO: 948142 - DNA, 22 bp, Artificial Sequence
  chemically synthesized
tgctgctaaacaaacttctgtt

SEQ ID NO: 948143 - DNA, 22 bp, Artificial Sequence
  chemically synthesized
gcaaaacaaattaaaaacagaa

SEQ ID NO: 948144 - DNA, 22 bp, Artificial Sequence
  chemically synthesized
agcaaaacaaattaaaaacaga

SEQ ID NO: 948145 - DNA, 22 bp, Artificial Sequence
  chemically synthesized
ctaaacaaacttctgtttttaa

SEQ ID NO: 948146 - DNA, 22 bp, Artificial Sequence
  chemically synthesized
cttagcaaaacaaattaaaaac

SEQ ID NO: 948147 - DNA, 22 bp, Artificial Sequence
  chemically synthesized
aacaaacttctgtttttaattt

SEQ ID NO: 948148 - DNA, 22 bp, Artificial Sequence
  chemically synthesized
acttagcaaaacaaattaaaaa

SEQ ID NO: 948149 - DNA, 22 bp, Artificial Sequence
  chemically synthesized
agtttacttagcaaaacaaatt

SEQ ID NO: 948150 - DNA, 22 bp, Artificial Sequence
  chemically synthesized
ctgtttttaatttgttttgcta

SEQ ID NO: 948151 - DNA, 22 bp, Artificial Sequence
  chemically synthesized
tgtttttaatttgttttgctaa

SEQ ID NO: 948152 - DNA, 22 bp, Artificial Sequence
  chemically synthesized
tttttaatttgttttgctaagt

SEQ ID NO: 948153 - DNA, 22 bp, Artificial Sequence
  chemically synthesized
atgactaagtttacttagcaaa

SEQ ID NO: 948154 - DNA, 22 bp, Artificial Sequence
  chemically synthesized
ttaatttgttttgctaagtaaa

SEQ ID NO: 948155 - DNA, 22 bp, Artificial Sequence
  chemically synthesized
ctcatgactaagtttacttagc

SEQ ID NO: 948156 - DNA, 22 bp, Artificial Sequence
  chemically synthesized
taatttgttttgctaagtaaac

SEQ ID NO: 948157 - DNA, 22 bp, Artificial Sequence
  chemically synthesized
cctcatgactaagtttacttag

SEQ ID NO: 948158 - DNA, 22 bp, Artificial Sequence
  chemically synthesized
aatttgttttgctaagtaaact

SEQ ID NO: 948159 - DNA, 22 bp, Artificial Sequence
  chemically synthesized
tcctcatgactaagtttactta

SEQ ID NO: 948160 - DNA, 22 bp, Artificial Sequence
  chemically synthesized
atttgttttgctaagtaaactt

SEQ ID NO: 948161 - DNA, 22 bp, Artificial Sequence
  chemically synthesized
gttttgctaagtaaacttagtc

SEQ ID NO: 948162 - DNA, 22 bp, Artificial Sequence
  chemically synthesized
ttttgctaagtaaacttagtca

SEQ ID NO: 948163 - DNA, 22 bp, Artificial Sequence
  chemically synthesized
acattttcctcatgactaagtt

SEQ ID NO: 948164 - DNA, 22 bp, Artificial Sequence
  chemically synthesized
tgctaagtaaacttagtcatga

SEQ ID NO: 948165 - DNA, 22 bp, Artificial Sequence
  chemically synthesized
gctaagtaaacttagtcatgag

SEQ ID NO: 948166 - DNA, 22 bp, Artificial Sequence
  chemically synthesized
ctaagtaaacttagtcatgagg

SEQ ID NO: 948167 - DNA, 22 bp, Artificial Sequence
  chemically synthesized
agtaaacttagtcatgaggaaa

SEQ ID NO: 948168 - DNA, 22 bp, Artificial Sequence
  chemically synthesized
agtcatgaggaaaatgttagtc

SEQ ID NO: 948169 - DNA, 22 bp, Artificial Sequence
  chemically synthesized
gtcatgaggaaaatgttagtct

SEQ ID NO: 948170 - DNA, 22 bp, Artificial Sequence
  chemically synthesized
cacgaccatccacatagactaa

SEQ ID NO: 948171 - DNA, 22 bp, Artificial Sequence
  chemically synthesized
ccggagaatattacacgaccat

SEQ ID NO: 948172 - DNA, 22 bp, Artificial Sequence
  chemically synthesized
gtctatgtggatggtcgtgtaa

SEQ ID NO: 948173 - DNA, 22 bp, Artificial Sequence
  chemically synthesized
tgtggatggtcgtgtaatattc

SEQ ID NO: 948174 - DNA, 22 bp, Artificial Sequence
  chemically synthesized
taatgggggaaaggttaccgga

SEQ ID NO: 948175 - DNA, 22 bp, Artificial Sequence
  chemically synthesized
gtaatgggggaaaggttaccgg

SEQ ID NO: 948176 - DNA, 22 bp, Artificial Sequence
  chemically synthesized
tttgtaatgggggaaaggttac

SEQ ID NO: 948177 - DNA, 22 bp, Artificial Sequence
  chemically synthesized
tccggtaacctttcccccatta

SEQ ID NO: 948178 - DNA, 22 bp, Artificial Sequence
  chemically synthesized
cggtaacctttcccccattaca

SEQ ID NO: 948179 - DNA, 22 bp, Artificial Sequence
  chemically synthesized
tcccccattacaaataatcaca

SEQ ID NO: 948180 - DNA, 22 bp, Artificial Sequence
  chemically synthesized
cccccattacaaataatcacat

SEQ ID NO: 948181 - DNA, 22 bp, Artificial Sequence
  chemically synthesized
ccccattacaaataatcacatt

SEQ ID NO: 948182 - DNA, 22 bp, Artificial Sequence
  chemically synthesized
caaataatcacattgacattgt

SEQ ID NO: 948183 - DNA, 22 bp, Artificial Sequence
  chemically synthesized
gtggataatgagcacaatgtca

SEQ ID NO: 948184 - DNA, 22 bp, Artificial Sequence
  chemically synthesized
aaactagtggataatgagcaca

SEQ ID NO: 948185 - DNA, 22 bp, Artificial Sequence
  chemically synthesized
acattgtgctcattatccacta

SEQ ID NO: 948186 - DNA, 22 bp, Artificial Sequence
  chemically synthesized
tgctcattatccactagtttga

SEQ ID NO: 948187 - DNA, 22 bp, Artificial Sequence
  chemically synthesized
aaccccataggttcaaactagt

SEQ ID NO: 948188 - DNA, 22 bp, Artificial Sequence
  chemically synthesized
attgaaccccataggttcaaac

SEQ ID NO: 948189 - DNA, 22 bp, Artificial Sequence
  chemically synthesized
attatccactagtttgaaccta

SEQ ID NO: 948190 - DNA, 22 bp, Artificial Sequence
  chemically synthesized
cattgaaccccataggttcaaa

SEQ ID NO: 948191 - DNA, 22 bp, Artificial Sequence
  chemically synthesized
ttcattgaaccccataggttca

SEQ ID NO: 948192 - DNA, 22 bp, Artificial Sequence
  chemically synthesized
cttcattgaaccccataggttc

SEQ ID NO: 948193 - DNA, 22 bp, Artificial Sequence
  chemically synthesized
tccactagtttgaacctatggg

SEQ ID NO: 948194 - DNA, 22 bp, Artificial Sequence
  chemically synthesized
gtttgaacctatggggttcaat

SEQ ID NO: 948195 - DNA, 22 bp, Artificial Sequence
  chemically synthesized
gaacctatggggttcaatgaag

SEQ ID NO: 948196 - DNA, 22 bp, Artificial Sequence
  chemically synthesized
aacctatggggttcaatgaaga

SEQ ID NO: 948197 - DNA, 22 bp, Artificial Sequence
  chemically synthesized
tggggttcaatgaagaaatgca

SEQ ID NO: 948198 - DNA, 22 bp, Artificial Sequence
  chemically synthesized
agcatgtagacatagaaatgca

SEQ ID NO: 948199 - DNA, 22 bp, Artificial Sequence
  chemically synthesized
aatgaagaaatgcatttctatg

SEQ ID NO: 948200 - DNA, 22 bp, Artificial Sequence
  chemically synthesized
ctaagcatgtagacatagaaat

SEQ ID NO: 948201 - DNA, 22 bp, Artificial Sequence
  chemically synthesized
gttgctaagcatgtagacatag

SEQ ID NO: 948202 - DNA, 22 bp, Artificial Sequence
  chemically synthesized
ctatgtctacatgcttagcaac

SEQ ID NO: 948203 - DNA, 22 bp, Artificial Sequence
  chemically synthesized
tatgtctacatgcttagcaacc

SEQ ID NO: 948204 - DNA, 22 bp, Artificial Sequence
  chemically synthesized
agaccaggatctggttgctaag

SEQ ID NO: 948205 - DNA, 22 bp, Artificial Sequence
  chemically synthesized
tgtctacatgcttagcaaccag

SEQ ID NO: 948206 - DNA, 22 bp, Artificial Sequence
  chemically synthesized
tgagaccaggatctggttgcta

SEQ ID NO: 948207 - DNA, 22 bp, Artificial Sequence
  chemically synthesized
tctctgagaccaggatctggtt

SEQ ID NO: 948208 - DNA, 22 bp, Artificial Sequence
  chemically synthesized
atctctgagaccaggatctggt

SEQ ID NO: 948209 - DNA, 22 bp, Artificial Sequence
  chemically synthesized
catgcttagcaaccagatcctg

SEQ ID NO: 948210 - DNA, 22 bp, Artificial Sequence
  chemically synthesized
tatctctgagaccaggatctgg

SEQ ID NO: 948211 - DNA, 22 bp, Artificial Sequence
  chemically synthesized
gcattttatctctgagaccagg

SEQ ID NO: 948212 - DNA, 22 bp, Artificial Sequence
  chemically synthesized
agcaaccagatcctggtctcag

SEQ ID NO: 948213 - DNA, 22 bp, Artificial Sequence
  chemically synthesized
gcaaccagatcctggtctcaga

SEQ ID NO: 948214 - DNA, 22 bp, Artificial Sequence
  chemically synthesized
ctggcattttatctctgagacc

SEQ ID NO: 948215 - DNA, 22 bp, Artificial Sequence
  chemically synthesized
cctggcattttatctctgagac

SEQ ID NO: 948216 - DNA, 22 bp, Artificial Sequence
  chemically synthesized
ttcctggcattttatctctgag

SEQ ID NO: 948217 - DNA, 22 bp, Artificial Sequence
  chemically synthesized
cttcctggcattttatctctga

SEQ ID NO: 948218 - DNA, 22 bp, Artificial Sequence
  chemically synthesized
gtctcagagataaaatgccagg

SEQ ID NO: 948219 - DNA, 22 bp, Artificial Sequence
  chemically synthesized
agagataaaatgccaggaagaa

SEQ ID NO: 948220 - DNA, 22 bp, Artificial Sequence
  chemically synthesized
tcgtcgagtgatttcttcctgg

SEQ ID NO: 948221 - DNA, 22 bp, Artificial Sequence
  chemically synthesized
atcgtcgagtgatttcttcctg

SEQ ID NO: 948222 - DNA, 22 bp, Artificial Sequence
  chemically synthesized
agacgtggatttatcgtcgagt

SEQ ID NO: 948223 - DNA, 22 bp, Artificial Sequence
  chemically synthesized
tgagacgtggatttatcgtcga

SEQ ID NO: 948224 - DNA, 22 bp, Artificial Sequence
  chemically synthesized
gagcaaattctgagacgtggat

SEQ ID NO: 948225 - DNA, 22 bp, Artificial Sequence
  chemically synthesized
agagcaaattctgagacgtgga

SEQ ID NO: 948226 - DNA, 22 bp, Artificial Sequence
  chemically synthesized
gacgataaatccacgtctcaga

SEQ ID NO: 948227 - DNA, 22 bp, Artificial Sequence
  chemically synthesized
aggcttagagcaaattctgaga

SEQ ID NO: 948228 - DNA, 22 bp, Artificial Sequence
  chemically synthesized
tcaggcttagagcaaattctga

SEQ ID NO: 948229 - DNA, 22 bp, Artificial Sequence
  chemically synthesized
ctctcaggcttagagcaaattc

SEQ ID NO: 948230 - DNA, 22 bp, Artificial Sequence
  chemically synthesized
cgtcatctcctctcaggcttag

SEQ ID NO: 948231 - DNA, 22 bp, Artificial Sequence
  chemically synthesized
agaatttgctctaagcctgaga

SEQ ID NO: 948232 - DNA, 22 bp, Artificial Sequence
  chemically synthesized
ataactccgtcatctcctctca

SEQ ID NO: 948233 - DNA, 22 bp, Artificial Sequence
  chemically synthesized
cataactccgtcatctcctctc

SEQ ID NO: 948234 - DNA, 22 bp, Artificial Sequence
  chemically synthesized
gctctaagcctgagaggagatg

SEQ ID NO: 948235 - DNA, 22 bp, Artificial Sequence
  chemically synthesized
ctctaagcctgagaggagatga

SEQ ID NO: 948236 - DNA, 22 bp, Artificial Sequence
  chemically synthesized
taagcctgagaggagatgacgg

SEQ ID NO: 948237 - DNA, 22 bp, Artificial Sequence
  chemically synthesized
gcacttcataactccgtcatct

SEQ ID NO: 948238 - DNA, 22 bp, Artificial Sequence
  chemically synthesized
agcctgagaggagatgacggag

SEQ ID NO: 948239 - DNA, 22 bp, Artificial Sequence
  chemically synthesized
agaggagatgacggagttatga

SEQ ID NO: 948240 - DNA, 22 bp, Artificial Sequence
  chemically synthesized
aacatctagcacttcataactc

SEQ ID NO: 948241 - DNA, 22 bp, Artificial Sequence
  chemically synthesized
caacatctagcacttcataact

SEQ ID NO: 948242 - DNA, 22 bp, Artificial Sequence
  chemically synthesized
cacataagagtttcaacatcta

SEQ ID NO: 948243 - DNA, 22 bp, Artificial Sequence
  chemically synthesized
tgaagtgctagatgttgaaact

SEQ ID NO: 948244 - DNA, 22 bp, Artificial Sequence
  chemically synthesized
aagaagtctgcacataagagtt

SEQ ID NO: 948245 - DNA, 22 bp, Artificial Sequence
  chemically synthesized
tcaagaagtctgcacataagag

SEQ ID NO: 948246 - DNA, 22 bp, Artificial Sequence
  chemically synthesized
gatgttgaaactcttatgtgca

SEQ ID NO: 948247 - DNA, 22 bp, Artificial Sequence
  chemically synthesized
cattctcaagaagtctgcacat

SEQ ID NO: 948248 - DNA, 22 bp, Artificial Sequence
  chemically synthesized
aaactcttatgtgcagacttct

SEQ ID NO: 948249 - DNA, 22 bp, Artificial Sequence
  chemically synthesized
actccattctcaagaagtctgc

SEQ ID NO: 948250 - DNA, 22 bp, Artificial Sequence
  chemically synthesized
aactccattctcaagaagtctg

SEQ ID NO: 948251 - DNA, 22 bp, Artificial Sequence
  chemically synthesized
taactccattctcaagaagtct

SEQ ID NO: 948252 - DNA, 22 bp, Artificial Sequence
  chemically synthesized
ttaactccattctcaagaagtc

SEQ ID NO: 948253 - DNA, 22 bp, Artificial Sequence
  chemically synthesized
tttaactccattctcaagaagt

SEQ ID NO: 948254 - DNA, 22 bp, Artificial Sequence
  chemically synthesized
ttatgtgcagacttcttgagaa

SEQ ID NO: 948255 - DNA, 22 bp, Artificial Sequence
  chemically synthesized
ttttttaactccattctcaaga

SEQ ID NO: 948256 - DNA, 22 bp, Artificial Sequence
  chemically synthesized
atgtgcagacttcttgagaatg

SEQ ID NO: 948257 - DNA, 22 bp, Artificial Sequence
  chemically synthesized
attttttaactccattctcaag

SEQ ID NO: 948258 - DNA, 22 bp, Artificial Sequence
  chemically synthesized
tgtgcagacttcttgagaatgg

SEQ ID NO: 948259 - DNA, 22 bp, Artificial Sequence
  chemically synthesized
tattttttaactccattctcaa

SEQ ID NO: 948260 - DNA, 22 bp, Artificial Sequence
  chemically synthesized
ttattttttaactccattctca

SEQ ID NO: 948261 - DNA, 22 bp, Artificial Sequence
  chemically synthesized
tttttattttttaactccattc

SEQ ID NO: 948262 - DNA, 22 bp, Artificial Sequence
  chemically synthesized
tgtttttattttttaactccat

SEQ ID NO: 948263 - DNA, 22 bp, Artificial Sequence
  chemically synthesized
tctgtttttattttttaactcc

SEQ ID NO: 948264 - DNA, 22 bp, Artificial Sequence
  chemically synthesized
ctctgtttttattttttaactc

SEQ ID NO: 948265 - DNA, 22 bp, Artificial Sequence
  chemically synthesized
tctctgtttttattttttaact

SEQ ID NO: 948266 - DNA, 22 bp, Artificial Sequence
  chemically synthesized
cttgagaatggagttaaaaaat

SEQ ID NO: 948267 - DNA, 22 bp, Artificial Sequence
  chemically synthesized
ttgagaatggagttaaaaaata

SEQ ID NO: 948268 - DNA, 22 bp, Artificial Sequence
  chemically synthesized
gagaatggagttaaaaaataaa

SEQ ID NO: 948269 - DNA, 22 bp, Artificial Sequence
  chemically synthesized
attttctctgtttttatttttt

SEQ ID NO: 948270 - DNA, 22 bp, Artificial Sequence
  chemically synthesized
agaatggagttaaaaaataaaa

SEQ ID NO: 948271 - DNA, 22 bp, Artificial Sequence
  chemically synthesized
gattttctctgtttttattttt

SEQ ID NO: 948272 - DNA, 22 bp, Artificial Sequence
  chemically synthesized
tgattttctctgtttttatttt

SEQ ID NO: 948273 - DNA, 22 bp, Artificial Sequence
  chemically synthesized
actttgattttctctgttttta

SEQ ID NO: 948274 - DNA, 22 bp, Artificial Sequence
  chemically synthesized
gactttgattttctctgttttt

SEQ ID NO: 948275 - DNA, 22 bp, Artificial Sequence
  chemically synthesized
tgactttgattttctctgtttt

SEQ ID NO: 948276 - DNA, 22 bp, Artificial Sequence
  chemically synthesized
aaaaataaaaacagagaaaatc

SEQ ID NO: 948277 - DNA, 22 bp, Artificial Sequence
  chemically synthesized
tatctttgactttgattttctc

SEQ ID NO: 948278 - DNA, 22 bp, Artificial Sequence
  chemically synthesized
atatctttgactttgattttct

SEQ ID NO: 948279 - DNA, 22 bp, Artificial Sequence
  chemically synthesized
tatatctttgactttgattttc

SEQ ID NO: 948280 - DNA, 22 bp, Artificial Sequence
  chemically synthesized
aacattttatatctttgacttt

SEQ ID NO: 948281 - DNA, 22 bp, Artificial Sequence
  chemically synthesized
tcaacattttatatctttgact

SEQ ID NO: 948282 - DNA, 22 bp, Artificial Sequence
  chemically synthesized
ctcaacattttatatctttgac

SEQ ID NO: 948283 - DNA, 22 bp, Artificial Sequence
  chemically synthesized
atttctcaacattttatatctt

SEQ ID NO: 948284 - DNA, 22 bp, Artificial Sequence
  chemically synthesized
gatttctcaacattttatatct

SEQ ID NO: 948285 - DNA, 22 bp, Artificial Sequence
  chemically synthesized
atgtcaggtgtttgatttctca

SEQ ID NO: 948286 - DNA, 22 bp, Artificial Sequence
  chemically synthesized
atagctaatgtcaggtgtttga

SEQ ID NO: 948287 - DNA, 22 bp, Artificial Sequence
  chemically synthesized
tcatagctaatgtcaggtgttt

SEQ ID NO: 948288 - DNA, 22 bp, Artificial Sequence
  chemically synthesized
ctcatagctaatgtcaggtgtt

SEQ ID NO: 948289 - DNA, 22 bp, Artificial Sequence
  chemically synthesized
agaaatcaaacacctgacatta

SEQ ID NO: 948290 - DNA, 22 bp, Artificial Sequence
  chemically synthesized
ccataaacatttctcatagcta

SEQ ID NO: 948291 - DNA, 22 bp, Artificial Sequence
  chemically synthesized
gccataaacatttctcatagct

SEQ ID NO: 948292 - DNA, 22 bp, Artificial Sequence
  chemically synthesized
acattagctatgagaaatgttt

SEQ ID NO: 948293 - DNA, 22 bp, Artificial Sequence
  chemically synthesized
gctatgagaaatgtttatggca

SEQ ID NO: 948294 - DNA, 22 bp, Artificial Sequence
  chemically synthesized
tgagaaatgtttatggcaaaca

SEQ ID NO: 948295 - DNA, 22 bp, Artificial Sequence
  chemically synthesized
ggagaaagcgaggatcagtgtt

SEQ ID NO: 948296 - DNA, 22 bp, Artificial Sequence
  chemically synthesized
ttgggagaaagcgaggatcagt

SEQ ID NO: 948297 - DNA, 22 bp, Artificial Sequence
  chemically synthesized
gttgggagaaagcgaggatcag

SEQ ID NO: 948298 - DNA, 22 bp, Artificial Sequence
  chemically synthesized
atggcaaacactgatcctcgct

SEQ ID NO: 948299 - DNA, 22 bp, Artificial Sequence
  chemically synthesized
tggcaaacactgatcctcgctt

SEQ ID NO: 948300 - DNA, 22 bp, Artificial Sequence
  chemically synthesized
gataacagcttgttgggagaaa

SEQ ID NO: 948301 - DNA, 22 bp, Artificial Sequence
  chemically synthesized
atcctcgctttctcccaacaag

SEQ ID NO: 948302 - DNA, 22 bp, Artificial Sequence
  chemically synthesized
gctttctcccaacaagctgtta

SEQ ID NO: 948303 - DNA, 22 bp, Artificial Sequence
  chemically synthesized
tctcccaacaagctgttatcta

SEQ ID NO: 948304 - DNA, 22 bp, Artificial Sequence
  chemically synthesized
ctcccaacaagctgttatctaa

SEQ ID NO: 948305 - DNA, 22 bp, Artificial Sequence
  chemically synthesized
tcccaacaagctgttatctaat

SEQ ID NO: 948306 - DNA, 22 bp, Artificial Sequence
  chemically synthesized
ccaacaagctgttatctaattg

SEQ ID NO: 948307 - DNA, 22 bp, Artificial Sequence
  chemically synthesized
ttatctaattgttatttgttgt

SEQ ID NO: 948308 - DNA, 22 bp, Artificial Sequence
  chemically synthesized
tctaattgttatttgttgtgtg

SEQ ID NO: 948309 - DNA, 22 bp, Artificial Sequence
  chemically synthesized
attgttatttgttgtgtgatct

SEQ ID NO: 948310 - DNA, 22 bp, Artificial Sequence
  chemically synthesized
aaatggtggatatagatcacac

SEQ ID NO: 948311 - DNA, 22 bp, Artificial Sequence
  chemically synthesized
ttatttgttgtgtgatctatat

SEQ ID NO: 948312 - DNA, 22 bp, Artificial Sequence
  chemically synthesized
attgaaatggtggatatagatc

SEQ ID NO: 948313 - DNA, 22 bp, Artificial Sequence
  chemically synthesized
gattgaaatggtggatatagat

SEQ ID NO: 948314 - DNA, 22 bp, Artificial Sequence
  chemically synthesized
tttgttgtgtgatctatatcca

SEQ ID NO: 948315 - DNA, 22 bp, Artificial Sequence
  chemically synthesized
tgattgaaatggtggatataga

SEQ ID NO: 948316 - DNA, 22 bp, Artificial Sequence
  chemically synthesized
gttgtgtgatctatatccacca

SEQ ID NO: 948317 - DNA, 22 bp, Artificial Sequence
  chemically synthesized
ttgtgtgatctatatccaccat

SEQ ID NO: 948318 - DNA, 22 bp, Artificial Sequence
  chemically synthesized
atgctttgattgaaatggtgga

SEQ ID NO: 948319 - DNA, 22 bp, Artificial Sequence
  chemically synthesized
tgtgatctatatccaccatttc

SEQ ID NO: 948320 - DNA, 22 bp, Artificial Sequence
  chemically synthesized
ctcatgctttgattgaaatggt

SEQ ID NO: 948321 - DNA, 22 bp, Artificial Sequence
  chemically synthesized
gctcatgctttgattgaaatgg

SEQ ID NO: 948322 - DNA, 22 bp, Artificial Sequence
  chemically synthesized
tatccaccatttcaatcaaagc

SEQ ID NO: 948323 - DNA, 22 bp, Artificial Sequence
  chemically synthesized
aaataagtcttgctcatgcttt

SEQ ID NO: 948324 - DNA, 22 bp, Artificial Sequence
  chemically synthesized
ttgaaataagtcttgctcatgc

SEQ ID NO: 948325 - DNA, 22 bp, Artificial Sequence
  chemically synthesized
caatcaaagcatgagcaagact

SEQ ID NO: 948326 - DNA, 22 bp, Artificial Sequence
  chemically synthesized
aatcaaagcatgagcaagactt

SEQ ID NO: 948327 - DNA, 22 bp, Artificial Sequence
  chemically synthesized
tggctattgaaataagtcttgc

SEQ ID NO: 948328 - DNA, 22 bp, Artificial Sequence
  chemically synthesized
ggagcaatgctatggctattga

SEQ ID NO: 948329 - DNA, 22 bp, Artificial Sequence
  chemically synthesized
tctgggagcaatgctatggcta

SEQ ID NO: 948330 - DNA, 22 bp, Artificial Sequence
  chemically synthesized
gtctgggagcaatgctatggct

SEQ ID NO: 948331 - DNA, 22 bp, Artificial Sequence
  chemically synthesized
atttcaatagccatagcattgc

SEQ ID NO: 948332 - DNA, 22 bp, Artificial Sequence
  chemically synthesized
tttcaatagccatagcattgct

SEQ ID NO: 948333 - DNA, 22 bp, Artificial Sequence
  chemically synthesized
caatagccatagcattgctccc

SEQ ID NO: 948334 - DNA, 22 bp, Artificial Sequence
  chemically synthesized
aatagccatagcattgctccca

SEQ ID NO: 948335 - DNA, 22 bp, Artificial Sequence
  chemically synthesized
ctcccagacaaacttattcatt

SEQ ID NO: 948336 - DNA, 22 bp, Artificial Sequence
  chemically synthesized
ccagacaaacttattcattcct

SEQ ID NO: 948337 - DNA, 22 bp, Artificial Sequence
  chemically synthesized
aatataatgaatggaggaggaa

SEQ ID NO: 948338 - DNA, 22 bp, Artificial Sequence
  chemically synthesized
attcattcctcctccattcatt

SEQ ID NO: 948339 - DNA, 22 bp, Artificial Sequence
  chemically synthesized
ttcattcctcctccattcatta

SEQ ID NO: 948340 - DNA, 22 bp, Artificial Sequence
  chemically synthesized
attcctcctccattcattatat

SEQ ID NO: 948341 - DNA, 22 bp, Artificial Sequence
  chemically synthesized
taacagagctaaatataatgaa

SEQ ID NO: 948342 - DNA, 22 bp, Artificial Sequence
  chemically synthesized
ctcctccattcattatatttag

SEQ ID NO: 948343 - DNA, 22 bp, Artificial Sequence
  chemically synthesized
atgctgtaacagagctaaatat

SEQ ID NO: 948344 - DNA, 22 bp, Artificial Sequence
  chemically synthesized
ctccattcattatatttagctc

SEQ ID NO: 948345 - DNA, 22 bp, Artificial Sequence
  chemically synthesized
cattcattatatttagctctgt

SEQ ID NO: 948346 - DNA, 22 bp, Artificial Sequence
  chemically synthesized
cacagttgatgctgtaacagag

SEQ ID NO: 948347 - DNA, 22 bp, Artificial Sequence
  chemically synthesized
attatatttagctctgttacag

SEQ ID NO: 948348 - DNA, 22 bp, Artificial Sequence
  chemically synthesized
tatttagctctgttacagcatc

SEQ ID NO: 948349 - DNA, 22 bp, Artificial Sequence
  chemically synthesized
aggattccacagttgatgctgt

SEQ ID NO: 948350 - DNA, 22 bp, Artificial Sequence
  chemically synthesized
caggattccacagttgatgctg

SEQ ID NO: 948351 - DNA, 22 bp, Artificial Sequence
  chemically synthesized
agctctgttacagcatcaactg

SEQ ID NO: 948352 - DNA, 22 bp, Artificial Sequence
  chemically synthesized
gctctgttacagcatcaactgt

SEQ ID NO: 948353 - DNA, 22 bp, Artificial Sequence
  chemically synthesized
tttcaggattccacagttgatg

SEQ ID NO: 948354 - DNA, 22 bp, Artificial Sequence
  chemically synthesized
tgttacagcatcaactgtggaa

SEQ ID NO: 948355 - DNA, 22 bp, Artificial Sequence
  chemically synthesized
ttacagcatcaactgtggaatc

SEQ ID NO: 948356 - DNA, 22 bp, Artificial Sequence
  chemically synthesized
cagcatcaactgtggaatcctg

SEQ ID NO: 948357 - DNA, 22 bp, Artificial Sequence
  chemically synthesized
tggaatcctgaaataattctct

SEQ ID NO: 948358 - DNA, 22 bp, Artificial Sequence
  chemically synthesized
gtgaaggaggcagacatgtaag

SEQ ID NO: 948359 - DNA, 22 bp, Artificial Sequence
  chemically synthesized
aaataattctcttacatgtctg

SEQ ID NO: 948360 - DNA, 22 bp, Artificial Sequence
  chemically synthesized
cacaatctggtgaaggaggcag

SEQ ID NO: 948361 - DNA, 22 bp, Artificial Sequence
  chemically synthesized
tcttacatgtctgcctccttca

SEQ ID NO: 948362 - DNA, 22 bp, Artificial Sequence
  chemically synthesized
ttacatgtctgcctccttcacc

SEQ ID NO: 948363 - DNA, 22 bp, Artificial Sequence
  chemically synthesized
acatgtctgcctccttcaccag

SEQ ID NO: 948364 - DNA, 22 bp, Artificial Sequence
  chemically synthesized
catgtctgcctccttcaccaga

SEQ ID NO: 948365 - DNA, 22 bp, Artificial Sequence
  chemically synthesized
acagactccacaatctggtgaa

SEQ ID NO: 948366 - DNA, 22 bp, Artificial Sequence
  chemically synthesized
cacagactccacaatctggtga

SEQ ID NO: 948367 - DNA, 22 bp, Artificial Sequence
  chemically synthesized
cttcacagactccacaatctgg

SEQ ID NO: 948368 - DNA, 22 bp, Artificial Sequence
  chemically synthesized
ccttcacagactccacaatctg

SEQ ID NO: 948369 - DNA, 22 bp, Artificial Sequence
  chemically synthesized
cctccttcaccagattgtggag

SEQ ID NO: 948370 - DNA, 22 bp, Artificial Sequence
  chemically synthesized
cttcaccagattgtggagtctg

SEQ ID NO: 948371 - DNA, 22 bp, Artificial Sequence
  chemically synthesized
caccagattgtggagtctgtga

SEQ ID NO: 948372 - DNA, 22 bp, Artificial Sequence
  chemically synthesized
accagattgtggagtctgtgaa

SEQ ID NO: 948373 - DNA, 22 bp, Artificial Sequence
  chemically synthesized
tagagtacataatttccttcac

SEQ ID NO: 948374 - DNA, 22 bp, Artificial Sequence
  chemically synthesized
gtagagtacataatttccttca

SEQ ID NO: 948375 - DNA, 22 bp, Artificial Sequence
  chemically synthesized
tggagtctgtgaaggaaattat

SEQ ID NO: 948376 - DNA, 22 bp, Artificial Sequence
  chemically synthesized
aataaatatttgtagagtacat

SEQ ID NO: 948377 - DNA, 22 bp, Artificial Sequence
  chemically synthesized
tgaaggaaattatgtactctac

SEQ ID NO: 948378 - DNA, 22 bp, Artificial Sequence
  chemically synthesized
ggtgttcaataaatatttgtag

SEQ ID NO: 948379 - DNA, 22 bp, Artificial Sequence
  chemically synthesized
tgtactctacaaatatttattg

SEQ ID NO: 948380 - DNA, 22 bp, Artificial Sequence
  chemically synthesized
gtccatattaggtgttcaataa

SEQ ID NO: 948381 - DNA, 22 bp, Artificial Sequence
  chemically synthesized
tggtccatattaggtgttcaat

SEQ ID NO: 948382 - DNA, 22 bp, Artificial Sequence
  chemically synthesized
tacaaatatttattgaacacct

SEQ ID NO: 948383 - DNA, 22 bp, Artificial Sequence
  chemically synthesized
caaatatttattgaacacctaa

SEQ ID NO: 948384 - DNA, 22 bp, Artificial Sequence
  chemically synthesized
aaacagtctctggtccatatta

SEQ ID NO: 948385 - DNA, 22 bp, Artificial Sequence
  chemically synthesized
attgaacacctaatatggacca

SEQ ID NO: 948386 - DNA, 22 bp, Artificial Sequence
  chemically synthesized
ttgaacacctaatatggaccag

SEQ ID NO: 948387 - DNA, 22 bp, Artificial Sequence
  chemically synthesized
aacacctaatatggaccagaga

SEQ ID NO: 948388 - DNA, 22 bp, Artificial Sequence
  chemically synthesized
tcatctaaaacagtctctggtc

SEQ ID NO: 948389 - DNA, 22 bp, Artificial Sequence
  chemically synthesized
atcatctaaaacagtctctggt

SEQ ID NO: 948390 - DNA, 22 bp, Artificial Sequence
  chemically synthesized
cttatcatctaaaacagtctct

SEQ ID NO: 948391 - DNA, 22 bp, Artificial Sequence
  chemically synthesized
atatggaccagagactgtttta

SEQ ID NO: 948392 - DNA, 22 bp, Artificial Sequence
  chemically synthesized
tctccttatcatctaaaacagt

SEQ ID NO: 948393 - DNA, 22 bp, Artificial Sequence
  chemically synthesized
ctatctccttatcatctaaaac

SEQ ID NO: 948394 - DNA, 22 bp, Artificial Sequence
  chemically synthesized
atcactgctatctccttatcat

SEQ ID NO: 948395 - DNA, 22 bp, Artificial Sequence
  chemically synthesized
gatcactgctatctccttatca

SEQ ID NO: 948396 - DNA, 22 bp, Artificial Sequence
  chemically synthesized
tttgatcactgctatctcctta

SEQ ID NO: 948397 - DNA, 22 bp, Artificial Sequence
  chemically synthesized
ttttagatgataaggagatagc

SEQ ID NO: 948398 - DNA, 22 bp, Artificial Sequence
  chemically synthesized
actgtttgatcactgctatctc

SEQ ID NO: 948399 - DNA, 22 bp, Artificial Sequence
  chemically synthesized
tagatgataaggagatagcagt

SEQ ID NO: 948400 - DNA, 22 bp, Artificial Sequence
  chemically synthesized
gactgtttgatcactgctatct

SEQ ID NO: 948401 - DNA, 22 bp, Artificial Sequence
  chemically synthesized
agatgataaggagatagcagtg

SEQ ID NO: 948402 - DNA, 22 bp, Artificial Sequence
  chemically synthesized
tgactgtttgatcactgctatc

SEQ ID NO: 948403 - DNA, 22 bp, Artificial Sequence
  chemically synthesized
gatgataaggagatagcagtga

SEQ ID NO: 948404 - DNA, 22 bp, Artificial Sequence
  chemically synthesized
ttgactgtttgatcactgctat

SEQ ID NO: 948405 - DNA, 22 bp, Artificial Sequence
  chemically synthesized
acatggacagaaatttttgact

SEQ ID NO: 948406 - DNA, 22 bp, Artificial Sequence
  chemically synthesized
aagtgtaagattcacatggaca

SEQ ID NO: 948407 - DNA, 22 bp, Artificial Sequence
  chemically synthesized
gaagtgtaagattcacatggac

SEQ ID NO: 948408 - DNA, 22 bp, Artificial Sequence
  chemically synthesized
cttgaagtgtaagattcacatg

SEQ ID NO: 948409 - DNA, 22 bp, Artificial Sequence
  chemically synthesized
ctgtccatgtgaatcttacact

SEQ ID NO: 948410 - DNA, 22 bp, Artificial Sequence
  chemically synthesized
tgtccatgtgaatcttacactt

SEQ ID NO: 948411 - DNA, 22 bp, Artificial Sequence
  chemically synthesized
tccatgtgaatcttacacttca

SEQ ID NO: 948412 - DNA, 22 bp, Artificial Sequence
  chemically synthesized
catcatcccccattacttgaag

SEQ ID NO: 948413 - DNA, 22 bp, Artificial Sequence
  chemically synthesized
acatcatcccccattacttgaa

SEQ ID NO: 948414 - DNA, 22 bp, Artificial Sequence
  chemically synthesized
acacttcaagtaatgggggatg

SEQ ID NO: 948415 - DNA, 22 bp, Artificial Sequence
  chemically synthesized
cacttcaagtaatgggggatga

SEQ ID NO: 948416 - DNA, 22 bp, Artificial Sequence
  chemically synthesized
aatgccaaatttacatcatccc

SEQ ID NO: 948417 - DNA, 22 bp, Artificial Sequence
  chemically synthesized
caatgccaaatttacatcatcc

SEQ ID NO: 948418 - DNA, 22 bp, Artificial Sequence
  chemically synthesized
caagtaatgggggatgatgtaa

SEQ ID NO: 948419 - DNA, 22 bp, Artificial Sequence
  chemically synthesized
aagtaatgggggatgatgtaaa

SEQ ID NO: 948420 - DNA, 22 bp, Artificial Sequence
  chemically synthesized
ttcaatgccaaatttacatcat

SEQ ID NO: 948421 - DNA, 22 bp, Artificial Sequence
  chemically synthesized
caagccaaacctcttcaatgcc

SEQ ID NO: 948422 - DNA, 22 bp, Artificial Sequence
  chemically synthesized
caagttacaagccaaacctctt

SEQ ID NO: 948423 - DNA, 22 bp, Artificial Sequence
  chemically synthesized
ggcattgaagaggtttggcttg

SEQ ID NO: 948424 - DNA, 22 bp, Artificial Sequence
  chemically synthesized
gcattgaagaggtttggcttgt

SEQ ID NO: 948425 - DNA, 22 bp, Artificial Sequence
  chemically synthesized
aagaggtttggcttgtaacttg

SEQ ID NO: 948426 - DNA, 22 bp, Artificial Sequence
  chemically synthesized
gaaaataatgattccaagttac

SEQ ID NO: 948427 - DNA, 22 bp, Artificial Sequence
  chemically synthesized
ggcttgtaacttggaatcatta

SEQ ID NO: 948428 - DNA, 22 bp, Artificial Sequence
  chemically synthesized
gcttgtaacttggaatcattat

SEQ ID NO: 948429 - DNA, 22 bp, Artificial Sequence
  chemically synthesized
gtaacttggaatcattattttc

SEQ ID NO: 948430 - DNA, 22 bp, Artificial Sequence
  chemically synthesized
taacttggaatcattattttct

SEQ ID NO: 948431 - DNA, 22 bp, Artificial Sequence
  chemically synthesized
ccaaggtcatagagctagaaaa

SEQ ID NO: 948432 - DNA, 22 bp, Artificial Sequence
  chemically synthesized
accaaggtcatagagctagaaa

SEQ ID NO: 948433 - DNA, 22 bp, Artificial Sequence
  chemically synthesized
ggaatcattattttctagctct

SEQ ID NO: 948434 - DNA, 22 bp, Artificial Sequence
  chemically synthesized
taccaaggtcatagagctagaa

SEQ ID NO: 948435 - DNA, 22 bp, Artificial Sequence
  chemically synthesized
gaatcattattttctagctcta

SEQ ID NO: 948436 - DNA, 22 bp, Artificial Sequence
  chemically synthesized
ttttctagctctatgaccttgg

SEQ ID NO: 948437 - DNA, 22 bp, Artificial Sequence
  chemically synthesized
gtcaagtgactttaccaaggtc

SEQ ID NO: 948438 - DNA, 22 bp, Artificial Sequence
  chemically synthesized
tctagctctatgaccttggtaa

SEQ ID NO: 948439 - DNA, 22 bp, Artificial Sequence
  chemically synthesized
ggtcaagtgactttaccaaggt

SEQ ID NO: 948440 - DNA, 22 bp, Artificial Sequence
  chemically synthesized
ctagctctatgaccttggtaaa

SEQ ID NO: 948441 - DNA, 22 bp, Artificial Sequence
  chemically synthesized
tggtcaagtgactttaccaagg

SEQ ID NO: 948442 - DNA, 22 bp, Artificial Sequence
  chemically synthesized
tagctctatgaccttggtaaag

SEQ ID NO: 948443 - DNA, 22 bp, Artificial Sequence
  chemically synthesized
gctctatgaccttggtaaagtc

SEQ ID NO: 948444 - DNA, 22 bp, Artificial Sequence
  chemically synthesized
aagttttggtcaagtgacttta

SEQ ID NO: 948445 - DNA, 22 bp, Artificial Sequence
  chemically synthesized
tatgaccttggtaaagtcactt

SEQ ID NO: 948446 - DNA, 22 bp, Artificial Sequence
  chemically synthesized
tgaccttggtaaagtcacttga

SEQ ID NO: 948447 - DNA, 22 bp, Artificial Sequence
  chemically synthesized
ggtaaagtcacttgaccaaaac

SEQ ID NO: 948448 - DNA, 22 bp, Artificial Sequence
  chemically synthesized
gtaaagtcacttgaccaaaact

SEQ ID NO: 948449 - DNA, 22 bp, Artificial Sequence
  chemically synthesized
taaataagacagctcaagtttt

SEQ ID NO: 948450 - DNA, 22 bp, Artificial Sequence
  chemically synthesized
ataaataagacagctcaagttt

SEQ ID NO: 948451 - DNA, 22 bp, Artificial Sequence
  chemically synthesized
aatttataaataagacagctca

SEQ ID NO: 948452 - DNA, 22 bp, Artificial Sequence
  chemically synthesized
gaccaaaacttgagctgtctta

SEQ ID NO: 948453 - DNA, 22 bp, Artificial Sequence
  chemically synthesized
accaaaacttgagctgtcttat

SEQ ID NO: 948454 - DNA, 22 bp, Artificial Sequence
  chemically synthesized
tgatcctcaatttataaataag

SEQ ID NO: 948455 - DNA, 22 bp, Artificial Sequence
  chemically synthesized
gagctgtcttatttataaattg

SEQ ID NO: 948456 - DNA, 22 bp, Artificial Sequence
  chemically synthesized
agctgtcttatttataaattga

SEQ ID NO: 948457 - DNA, 22 bp, Artificial Sequence
  chemically synthesized
taaggtattatgatcctcaatt

SEQ ID NO: 948458 - DNA, 22 bp, Artificial Sequence
  chemically synthesized
tcttatttataaattgaggatc

SEQ ID NO: 948459 - DNA, 22 bp, Artificial Sequence
  chemically synthesized
atttataaattgaggatcataa

SEQ ID NO: 948460 - DNA, 22 bp, Artificial Sequence
  chemically synthesized
tttataaattgaggatcataat

SEQ ID NO: 948461 - DNA, 22 bp, Artificial Sequence
  chemically synthesized
ataaattgaggatcataatacc

SEQ ID NO: 948462 - DNA, 22 bp, Artificial Sequence
  chemically synthesized
taaattgaggatcataatacct

SEQ ID NO: 948463 - DNA, 22 bp, Artificial Sequence
  chemically synthesized
tagccatgctataaggtattat

SEQ ID NO: 948464 - DNA, 22 bp, Artificial Sequence
  chemically synthesized
atagccatgctataaggtatta

SEQ ID NO: 948465 - DNA, 22 bp, Artificial Sequence
  chemically synthesized
aggatcataataccttatagca

SEQ ID NO: 948466 - DNA, 22 bp, Artificial Sequence
  chemically synthesized
aaatcttatagccatgctataa

SEQ ID NO: 948467 - DNA, 22 bp, Artificial Sequence
  chemically synthesized
attaaaatcttatagccatgct

SEQ ID NO: 948468 - DNA, 22 bp, Artificial Sequence
  chemically synthesized
cattaaaatcttatagccatgc

SEQ ID NO: 948469 - DNA, 22 bp, Artificial Sequence
  chemically synthesized
atagcatggctataagatttta

SEQ ID NO: 948470 - DNA, 22 bp, Artificial Sequence
  chemically synthesized
tagcatggctataagattttaa

SEQ ID NO: 948471 - DNA, 22 bp, Artificial Sequence
  chemically synthesized
ggccatatgatatcatttcatt

SEQ ID NO: 948472 - DNA, 22 bp, Artificial Sequence
  chemically synthesized
taagattttaatgaaatgatat

SEQ ID NO: 948473 - DNA, 22 bp, Artificial Sequence
  chemically synthesized
ttaggccatatgatatcatttc

SEQ ID NO: 948474 - DNA, 22 bp, Artificial Sequence
  chemically synthesized
attaggccatatgatatcattt

SEQ ID NO: 948475 - DNA, 22 bp, Artificial Sequence
  chemically synthesized
tattaggccatatgatatcatt

SEQ ID NO: 948476 - DNA, 22 bp, Artificial Sequence
  chemically synthesized
ttattaggccatatgatatcat

SEQ ID NO: 948477 - DNA, 22 bp, Artificial Sequence
  chemically synthesized
tttattaggccatatgatatca

SEQ ID NO: 948478 - DNA, 22 bp, Artificial Sequence
  chemically synthesized
ttttattaggccatatgatatc

SEQ ID NO: 948479 - DNA, 22 bp, Artificial Sequence
  chemically synthesized
taatgaaatgatatcatatggc

SEQ ID NO: 948480 - DNA, 22 bp, Artificial Sequence
  chemically synthesized
cttttttattaggccatatgat

SEQ ID NO: 948481 - DNA, 22 bp, Artificial Sequence
  chemically synthesized
aatgaaatgatatcatatggcc

SEQ ID NO: 948482 - DNA, 22 bp, Artificial Sequence
  chemically synthesized
atgaaatgatatcatatggcct

SEQ ID NO: 948483 - DNA, 22 bp, Artificial Sequence
  chemically synthesized
gctacttttttattaggccata

SEQ ID NO: 948484 - DNA, 22 bp, Artificial Sequence
  chemically synthesized
agctacttttttattaggccat

SEQ ID NO: 948485 - DNA, 22 bp, Artificial Sequence
  chemically synthesized
ataaaaaagtagctaagcttta

SEQ ID NO: 948486 - DNA, 22 bp, Artificial Sequence
  chemically synthesized
taaaacaggtatacagtaaagc

SEQ ID NO: 948487 - DNA, 22 bp, Artificial Sequence
  chemically synthesized
ctataaaacaggtatacagtaa

SEQ ID NO: 948488 - DNA, 22 bp, Artificial Sequence
  chemically synthesized
agctttactgtatacctgtttt

SEQ ID NO: 948489 - DNA, 22 bp, Artificial Sequence
  chemically synthesized
tactgtatacctgttttatagt

SEQ ID NO: 948490 - DNA, 22 bp, Artificial Sequence
  chemically synthesized
actgtatacctgttttatagta

SEQ ID NO: 948491 - DNA, 22 bp, Artificial Sequence
  chemically synthesized
ctgtatacctgttttatagtag

SEQ ID NO: 948492 - DNA, 22 bp, Artificial Sequence
  chemically synthesized
aagcacaacagtgctactataa

SEQ ID NO: 948493 - DNA, 22 bp, Artificial Sequence
  chemically synthesized
aaagcacaacagtgctactata

SEQ ID NO: 948494 - DNA, 22 bp, Artificial Sequence
  chemically synthesized
tatacctgttttatagtagcac

SEQ ID NO: 948495 - DNA, 22 bp, Artificial Sequence
  chemically synthesized
taagatttaaagcacaacagtg

SEQ ID NO: 948496 - DNA, 22 bp, Artificial Sequence
  chemically synthesized
ttttatagtagcactgttgtgc

SEQ ID NO: 948497 - DNA, 22 bp, Artificial Sequence
  chemically synthesized
ttgtaagatttaaagcacaaca

SEQ ID NO: 948498 - DNA, 22 bp, Artificial Sequence
  chemically synthesized
tatagtagcactgttgtgcttt

SEQ ID NO: 948499 - DNA, 22 bp, Artificial Sequence
  chemically synthesized
gttgtaagatttaaagcacaac

SEQ ID NO: 948500 - DNA, 22 bp, Artificial Sequence
  chemically synthesized
atagtagcactgttgtgcttta

SEQ ID NO: 948501 - DNA, 22 bp, Artificial Sequence
  chemically synthesized
tagtagcactgttgtgctttaa

SEQ ID NO: 948502 - DNA, 22 bp, Artificial Sequence
  chemically synthesized
aagacttgttgtaagatttaaa

SEQ ID NO: 948503 - DNA, 22 bp, Artificial Sequence
  chemically synthesized
gaagacttgttgtaagatttaa

SEQ ID NO: 948504 - DNA, 22 bp, Artificial Sequence
  chemically synthesized
tcttgaagacttgttgtaagat

SEQ ID NO: 948505 - DNA, 22 bp, Artificial Sequence
  chemically synthesized
ttgtgctttaaatcttacaaca

SEQ ID NO: 948506 - DNA, 22 bp, Artificial Sequence
  chemically synthesized
tgctttaaatcttacaacaagt

SEQ ID NO: 948507 - DNA, 22 bp, Artificial Sequence
  chemically synthesized
taaatcttacaacaagtcttca

SEQ ID NO: 948508 - DNA, 22 bp, Artificial Sequence
  chemically synthesized
aaatcttacaacaagtcttcaa

SEQ ID NO: 948509 - DNA, 22 bp, Artificial Sequence
  chemically synthesized
aatcttacaacaagtcttcaag

SEQ ID NO: 948510 - DNA, 22 bp, Artificial Sequence
  chemically synthesized
taatcatacctatcttgaagac

SEQ ID NO: 948511 - DNA, 22 bp, Artificial Sequence
  chemically synthesized
ctataatcatacctatcttgaa

SEQ ID NO: 948512 - DNA, 22 bp, Artificial Sequence
  chemically synthesized
cctataatcatacctatcttga

SEQ ID NO: 948513 - DNA, 22 bp, Artificial Sequence
  chemically synthesized
acaacaagtcttcaagataggt

SEQ ID NO: 948514 - DNA, 22 bp, Artificial Sequence
  chemically synthesized
caacaagtcttcaagataggta

SEQ ID NO: 948515 - DNA, 22 bp, Artificial Sequence
  chemically synthesized
accttcctataatcatacctat

SEQ ID NO: 948516 - DNA, 22 bp, Artificial Sequence
  chemically synthesized
aaccttcctataatcataccta

SEQ ID NO: 948517 - DNA, 22 bp, Artificial Sequence
  chemically synthesized
caagataggtatgattatagga

SEQ ID NO: 948518 - DNA, 22 bp, Artificial Sequence
  chemically synthesized
aagataggtatgattataggaa

SEQ ID NO: 948519 - DNA, 22 bp, Artificial Sequence
  chemically synthesized
agtaatttaaccttcctataat

SEQ ID NO: 948520 - DNA, 22 bp, Artificial Sequence
  chemically synthesized
tctaagtaatttaaccttccta

SEQ ID NO: 948521 - DNA, 22 bp, Artificial Sequence
  chemically synthesized
tgactatctaagtaatttaacc

SEQ ID NO: 948522 - DNA, 22 bp, Artificial Sequence
  chemically synthesized
gtgactatctaagtaatttaac

SEQ ID NO: 948523 - DNA, 22 bp, Artificial Sequence
  chemically synthesized
acttgtgactatctaagtaatt

SEQ ID NO: 948524 - DNA, 22 bp, Artificial Sequence
  chemically synthesized
taggaaggttaaattacttaga

SEQ ID NO: 948525 - DNA, 22 bp, Artificial Sequence
  chemically synthesized
gctaacttgtgactatctaagt

SEQ ID NO: 948526 - DNA, 22 bp, Artificial Sequence
  chemically synthesized
cactagctaacttgtgactatc

SEQ ID NO: 948527 - DNA, 22 bp, Artificial Sequence
  chemically synthesized
ccactagctaacttgtgactat

SEQ ID NO: 948528 - DNA, 22 bp, Artificial Sequence
  chemically synthesized
aattacttagatagtcacaagt

SEQ ID NO: 948529 - DNA, 22 bp, Artificial Sequence
  chemically synthesized
ttccactagctaacttgtgact

SEQ ID NO: 948530 - DNA, 22 bp, Artificial Sequence
  chemically synthesized
gctcttccactagctaacttgt

SEQ ID NO: 948531 - DNA, 22 bp, Artificial Sequence
  chemically synthesized
cttagatagtcacaagttagct

SEQ ID NO: 948532 - DNA, 22 bp, Artificial Sequence
  chemically synthesized
tagctcttccactagctaactt

SEQ ID NO: 948533 - DNA, 22 bp, Artificial Sequence
  chemically synthesized
agatagtcacaagttagctagt

SEQ ID NO: 948534 - DNA, 22 bp, Artificial Sequence
  chemically synthesized
gatagtcacaagttagctagtg

SEQ ID NO: 948535 - DNA, 22 bp, Artificial Sequence
  chemically synthesized
aattctagctcttccactagct

SEQ ID NO: 948536 - DNA, 22 bp, Artificial Sequence
  chemically synthesized
aaattctagctcttccactagc

SEQ ID NO: 948537 - DNA, 22 bp, Artificial Sequence
  chemically synthesized
tttaaattctagctcttccact

SEQ ID NO: 948538 - DNA, 22 bp, Artificial Sequence
  chemically synthesized
cctgtttaaattctagctcttc

SEQ ID NO: 948539 - DNA, 22 bp, Artificial Sequence
  chemically synthesized
gctagtggaagagctagaattt

SEQ ID NO: 948540 - DNA, 22 bp, Artificial Sequence
  chemically synthesized
aactgcctgtttaaattctagc

SEQ ID NO: 948541 - DNA, 22 bp, Artificial Sequence
  chemically synthesized
gtggaagagctagaatttaaac

SEQ ID NO: 948542 - DNA, 22 bp, Artificial Sequence
  chemically synthesized
caattaaactgcctgtttaaat

SEQ ID NO: 948543 - DNA, 22 bp, Artificial Sequence
  chemically synthesized
gaatttaaacaggcagtttaat

SEQ ID NO: 948544 - DNA, 22 bp, Artificial Sequence
  chemically synthesized
aaacaggcagtttaattgcaac

SEQ ID NO: 948545 - DNA, 22 bp, Artificial Sequence
  chemically synthesized
aacaggcagtttaattgcaaca

SEQ ID NO: 948546 - DNA, 22 bp, Artificial Sequence
  chemically synthesized
aattgcaacatctgccctgtta

SEQ ID NO: 948547 - DNA, 22 bp, Artificial Sequence
  chemically synthesized
attgcaacatctgccctgttat

SEQ ID NO: 948548 - DNA, 22 bp, Artificial Sequence
  chemically synthesized
caacatctgccctgttattcac

SEQ ID NO: 948549 - DNA, 22 bp, Artificial Sequence
  chemically synthesized
ccctgttattcactgggctcta

SEQ ID NO: 948550 - DNA, 22 bp, Artificial Sequence
  chemically synthesized
ttattcactgggctctactctg

SEQ ID NO: 948551 - DNA, 22 bp, Artificial Sequence
  chemically synthesized
aagaaagcagtatacagagtag

SEQ ID NO: 948552 - DNA, 22 bp, Artificial Sequence
  chemically synthesized
ttcactgggctctactctgtat

SEQ ID NO: 948553 - DNA, 22 bp, Artificial Sequence
  chemically synthesized
actgggctctactctgtatact

SEQ ID NO: 948554 - DNA, 22 bp, Artificial Sequence
  chemically synthesized
ggctctactctgtatactgctt

SEQ ID NO: 948555 - DNA, 22 bp, Artificial Sequence
  chemically synthesized
tgatactaaagaaagcagtata

SEQ ID NO: 948556 - DNA, 22 bp, Artificial Sequence
  chemically synthesized
gtgatactaaagaaagcagtat

SEQ ID NO: 948557 - DNA, 22 bp, Artificial Sequence
  chemically synthesized
tgtgatactaaagaaagcagta

SEQ ID NO: 948558 - DNA, 22 bp, Artificial Sequence
  chemically synthesized
tactctgtatactgctttcttt

SEQ ID NO: 948559 - DNA, 22 bp, Artificial Sequence
  chemically synthesized
ctctgtatactgctttctttag

SEQ ID NO: 948560 - DNA, 22 bp, Artificial Sequence
  chemically synthesized
tgtatactgctttctttagtat

SEQ ID NO: 948561 - DNA, 22 bp, Artificial Sequence
  chemically synthesized
tatactgctttctttagtatca

SEQ ID NO: 948562 - DNA, 22 bp, Artificial Sequence
  chemically synthesized
tacggcaggcactttgtgatac

SEQ ID NO: 948563 - DNA, 22 bp, Artificial Sequence
  chemically synthesized
tatacggcaggcactttgtgat

SEQ ID NO: 948564 - DNA, 22 bp, Artificial Sequence
  chemically synthesized
ctttctttagtatcacaaagtg

SEQ ID NO: 948565 - DNA, 22 bp, Artificial Sequence
  chemically synthesized
tctttagtatcacaaagtgcct

SEQ ID NO: 948566 - DNA, 22 bp, Artificial Sequence
  chemically synthesized
ctttagtatcacaaagtgcctg

SEQ ID NO: 948567 - DNA, 22 bp, Artificial Sequence
  chemically synthesized
ccctctatacggcaggcacttt

SEQ ID NO: 948568 - DNA, 22 bp, Artificial Sequence
  chemically synthesized
tttagtatcacaaagtgcctgc

SEQ ID NO: 948569 - DNA, 22 bp, Artificial Sequence
  chemically synthesized
tagtatcacaaagtgcctgccg

SEQ ID NO: 948570 - DNA, 22 bp, Artificial Sequence
  chemically synthesized
agtatcacaaagtgcctgccgt

SEQ ID NO: 948571 - DNA, 22 bp, Artificial Sequence
  chemically synthesized
gtatcacaaagtgcctgccgta

SEQ ID NO: 948572 - DNA, 22 bp, Artificial Sequence
  chemically synthesized
tcacaactgccctctatacggc

SEQ ID NO: 948573 - DNA, 22 bp, Artificial Sequence
  chemically synthesized
actgtcacaactgccctctata

SEQ ID NO: 948574 - DNA, 22 bp, Artificial Sequence
  chemically synthesized
ccgtatagagggcagttgtgac

SEQ ID NO: 948575 - DNA, 22 bp, Artificial Sequence
  chemically synthesized
atagcatcctcactgtcacaac

SEQ ID NO: 948576 - DNA, 22 bp, Artificial Sequence
  chemically synthesized
tgagcaactaatagcatcctca

SEQ ID NO: 948577 - DNA, 22 bp, Artificial Sequence
  chemically synthesized
tgttatgagcaactaatagcat

SEQ ID NO: 948578 - DNA, 22 bp, Artificial Sequence
  chemically synthesized
tgacagtgaggatgctattagt

SEQ ID NO: 948579 - DNA, 22 bp, Artificial Sequence
  chemically synthesized
atgttatgagcaactaatagca

SEQ ID NO: 948580 - DNA, 22 bp, Artificial Sequence
  chemically synthesized
tatgttatgagcaactaatagc

SEQ ID NO: 948581 - DNA, 22 bp, Artificial Sequence
  chemically synthesized
agtgcagctttatgttatgagc

SEQ ID NO: 948582 - DNA, 22 bp, Artificial Sequence
  chemically synthesized
gagtgcagctttatgttatgag

SEQ ID NO: 948583 - DNA, 22 bp, Artificial Sequence
  chemically synthesized
atttgagtgcagctttatgtta

SEQ ID NO: 948584 - DNA, 22 bp, Artificial Sequence
  chemically synthesized
ttagttgctcataacataaagc

SEQ ID NO: 948585 - DNA, 22 bp, Artificial Sequence
  chemically synthesized
gttgctcataacataaagctgc

SEQ ID NO: 948586 - DNA, 22 bp, Artificial Sequence
  chemically synthesized
attaatttgagtgcagctttat

SEQ ID NO: 948587 - DNA, 22 bp, Artificial Sequence
  chemically synthesized
gattaatttgagtgcagcttta

SEQ ID NO: 948588 - DNA, 22 bp, Artificial Sequence
  chemically synthesized
tgattaatttgagtgcagcttt

SEQ ID NO: 948589 - DNA, 22 bp, Artificial Sequence
  chemically synthesized
ttgattaatttgagtgcagctt

SEQ ID NO: 948590 - DNA, 22 bp, Artificial Sequence
  chemically synthesized
ctcataacataaagctgcactc

SEQ ID NO: 948591 - DNA, 22 bp, Artificial Sequence
  chemically synthesized
tttttgattaatttgagtgcag

SEQ ID NO: 948592 - DNA, 22 bp, Artificial Sequence
  chemically synthesized
ataacataaagctgcactcaaa

SEQ ID NO: 948593 - DNA, 22 bp, Artificial Sequence
  chemically synthesized
ctgtttttgattaatttgagtg

SEQ ID NO: 948594 - DNA, 22 bp, Artificial Sequence
  chemically synthesized
actgtttttgattaatttgagt

SEQ ID NO: 948595 - DNA, 22 bp, Artificial Sequence
  chemically synthesized
tttactgtttttgattaatttg

SEQ ID NO: 948596 - DNA, 22 bp, Artificial Sequence
  chemically synthesized
gtttactgtttttgattaattt

SEQ ID NO: 948597 - DNA, 22 bp, Artificial Sequence
  chemically synthesized
tgtttactgtttttgattaatt

SEQ ID NO: 948598 - DNA, 22 bp, Artificial Sequence
  chemically synthesized
cactcaaattaatcaaaaacag

SEQ ID NO: 948599 - DNA, 22 bp, Artificial Sequence
  chemically synthesized
aaattaatcaaaaacagtaaac

SEQ ID NO: 948600 - DNA, 22 bp, Artificial Sequence
  chemically synthesized
atcaaaaacagtaaacaaaggg

SEQ ID NO: 948601 - DNA, 22 bp, Artificial Sequence
  chemically synthesized
aatgacgtgaaccagtagaatc

SEQ ID NO: 948602 - DNA, 22 bp, Artificial Sequence
  chemically synthesized
caatgacgtgaaccagtagaat

SEQ ID NO: 948603 - DNA, 22 bp, Artificial Sequence
  chemically synthesized
tcaatgacgtgaaccagtagaa

SEQ ID NO: 948604 - DNA, 22 bp, Artificial Sequence
  chemically synthesized
cagttttcaatgacgtgaacca

SEQ ID NO: 948605 - DNA, 22 bp, Artificial Sequence
  chemically synthesized
tgcagttttcaatgacgtgaac

SEQ ID NO: 948606 - DNA, 22 bp, Artificial Sequence
  chemically synthesized
ctgcagttttcaatgacgtgaa

SEQ ID NO: 948607 - DNA, 22 bp, Artificial Sequence
  chemically synthesized
tactggttcacgtcattgaaaa

SEQ ID NO: 948608 - DNA, 22 bp, Artificial Sequence
  chemically synthesized
ctggttcacgtcattgaaaact

SEQ ID NO: 948609 - DNA, 22 bp, Artificial Sequence
  chemically synthesized
cagcccccttctgcagttttca

SEQ ID NO: 948610 - DNA, 22 bp, Artificial Sequence
  chemically synthesized
gttcacgtcattgaaaactgca

SEQ ID NO: 948611 - DNA, 22 bp, Artificial Sequence
  chemically synthesized
gcagcccccttctgcagttttc

SEQ ID NO: 948612 - DNA, 22 bp, Artificial Sequence
  chemically synthesized
acgtcattgaaaactgcagaag

SEQ ID NO: 948613 - DNA, 22 bp, Artificial Sequence
  chemically synthesized
acttgcagcccccttctgcagt

SEQ ID NO: 948614 - DNA, 22 bp, Artificial Sequence
  chemically synthesized
cacttgcagcccccttctgcag

SEQ ID NO: 948615 - DNA, 22 bp, Artificial Sequence
  chemically synthesized
aacttcacttgcagcccccttc

SEQ ID NO: 948616 - DNA, 22 bp, Artificial Sequence
  chemically synthesized
aaaactgcagaagggggctgca

SEQ ID NO: 948617 - DNA, 22 bp, Artificial Sequence
  chemically synthesized
attgaacttcacttgcagcccc

SEQ ID NO: 948618 - DNA, 22 bp, Artificial Sequence
  chemically synthesized
cagaagggggctgcaagtgaag

SEQ ID NO: 948619 - DNA, 22 bp, Artificial Sequence
  chemically synthesized
caagtgaagttcaatcaggggg

SEQ ID NO: 948620 - DNA, 22 bp, Artificial Sequence
  chemically synthesized
agagatatggagcaggaccccc

SEQ ID NO: 948621 - DNA, 22 bp, Artificial Sequence
  chemically synthesized
aatcagggggtcctgctccata

SEQ ID NO: 948622 - DNA, 22 bp, Artificial Sequence
  chemically synthesized
agagtactgagagatatggagc

SEQ ID NO: 948623 - DNA, 22 bp, Artificial Sequence
  chemically synthesized
ctccatatctctcagtactctt

SEQ ID NO: 948624 - DNA, 22 bp, Artificial Sequence
  chemically synthesized
catatctctcagtactcttagg

SEQ ID NO: 948625 - DNA, 22 bp, Artificial Sequence
  chemically synthesized
acagacacaagagggagaccta

SEQ ID NO: 948626 - DNA, 22 bp, Artificial Sequence
  chemically synthesized
tcagtactcttaggtctccctc

SEQ ID NO: 948627 - DNA, 22 bp, Artificial Sequence
  chemically synthesized
agtactcttaggtctccctctt

SEQ ID NO: 948628 - DNA, 22 bp, Artificial Sequence
  chemically synthesized
ttaggtctccctcttgtgtctg

SEQ ID NO: 948629 - DNA, 22 bp, Artificial Sequence
  chemically synthesized
aaataaggctgacagacacaag

SEQ ID NO: 948630 - DNA, 22 bp, Artificial Sequence
  chemically synthesized
aggtctccctcttgtgtctgtc

SEQ ID NO: 948631 - DNA, 22 bp, Artificial Sequence
  chemically synthesized
ggtctccctcttgtgtctgtca

SEQ ID NO: 948632 - DNA, 22 bp, Artificial Sequence
  chemically synthesized
cctcttgtgtctgtcagcctta

SEQ ID NO: 948633 - DNA, 22 bp, Artificial Sequence
  chemically synthesized
ttgtgtctgtcagccttatttc

SEQ ID NO: 948634 - DNA, 22 bp, Artificial Sequence
  chemically synthesized
gtgtctgtcagccttatttcag

SEQ ID NO: 948635 - DNA, 22 bp, Artificial Sequence
  chemically synthesized
tgtctgtcagccttatttcagg

SEQ ID NO: 948636 - DNA, 22 bp, Artificial Sequence
  chemically synthesized
tcagccttatttcaggttatct

SEQ ID NO: 948637 - DNA, 22 bp, Artificial Sequence
  chemically synthesized
taataccatgacagaagataac

SEQ ID NO: 948638 - DNA, 22 bp, Artificial Sequence
  chemically synthesized
gtaataccatgacagaagataa

SEQ ID NO: 948639 - DNA, 22 bp, Artificial Sequence
  chemically synthesized
tgtaataccatgacagaagata

SEQ ID NO: 948640 - DNA, 22 bp, Artificial Sequence
  chemically synthesized
atttcaggttatcttctgtcat

SEQ ID NO: 948641 - DNA, 22 bp, Artificial Sequence
  chemically synthesized
tttcaggttatcttctgtcatg

SEQ ID NO: 948642 - DNA, 22 bp, Artificial Sequence
  chemically synthesized
caggttatcttctgtcatggta

SEQ ID NO: 948643 - DNA, 22 bp, Artificial Sequence
  chemically synthesized
cagcctttgtaataccatgaca

SEQ ID NO: 948644 - DNA, 22 bp, Artificial Sequence
  chemically synthesized
aggttatcttctgtcatggtat

SEQ ID NO: 948645 - DNA, 22 bp, Artificial Sequence
  chemically synthesized
gagctgcagcctttgtaatacc

SEQ ID NO: 948646 - DNA, 22 bp, Artificial Sequence
  chemically synthesized
tcttctgtcatggtattacaaa

SEQ ID NO: 948647 - DNA, 22 bp, Artificial Sequence
  chemically synthesized
ctgtcatggtattacaaaggct

SEQ ID NO: 948648 - DNA, 22 bp, Artificial Sequence
  chemically synthesized
tgtcatggtattacaaaggctg

SEQ ID NO: 948649 - DNA, 22 bp, Artificial Sequence
  chemically synthesized
tcatggtattacaaaggctgca

SEQ ID NO: 948650 - DNA, 22 bp, Artificial Sequence
  chemically synthesized
caaaggctgcagctctaactat

SEQ ID NO: 948651 - DNA, 22 bp, Artificial Sequence
  chemically synthesized
agtaatatacatatgtgatagt

SEQ ID NO: 948652 - DNA, 22 bp, Artificial Sequence
  chemically synthesized
cagctctaactatcacatatgt

SEQ ID NO: 948653 - DNA, 22 bp, Artificial Sequence
  chemically synthesized
aactaagtaatatacatatgtg

SEQ ID NO: 948654 - DNA, 22 bp, Artificial Sequence
  chemically synthesized
taactatcacatatgtatatta

SEQ ID NO: 948655 - DNA, 22 bp, Artificial Sequence
  chemically synthesized
cgttgaactaagtaatatacat

SEQ ID NO: 948656 - DNA, 22 bp, Artificial Sequence
  chemically synthesized
gcgttgaactaagtaatataca

SEQ ID NO: 948657 - DNA, 22 bp, Artificial Sequence
  chemically synthesized
actatcacatatgtatattact

SEQ ID NO: 948658 - DNA, 22 bp, Artificial Sequence
  chemically synthesized
ttgcgttgaactaagtaatata

SEQ ID NO: 948659 - DNA, 22 bp, Artificial Sequence
  chemically synthesized
tcttgcgttgaactaagtaata

SEQ ID NO: 948660 - DNA, 22 bp, Artificial Sequence
  chemically synthesized
tcacatatgtatattacttagt

SEQ ID NO: 948661 - DNA, 22 bp, Artificial Sequence
  chemically synthesized
ctcttgcgttgaactaagtaat

SEQ ID NO: 948662 - DNA, 22 bp, Artificial Sequence
  chemically synthesized
tctcttgcgttgaactaagtaa

SEQ ID NO: 948663 - DNA, 22 bp, Artificial Sequence
  chemically synthesized
ttctcttgcgttgaactaagta

SEQ ID NO: 948664 - DNA, 22 bp, Artificial Sequence
  chemically synthesized
tttctcttgcgttgaactaagt

SEQ ID NO: 948665 - DNA, 22 bp, Artificial Sequence
  chemically synthesized
tttttctcttgcgttgaactaa

SEQ ID NO: 948666 - DNA, 22 bp, Artificial Sequence
  chemically synthesized
ggaaattctttttctcttgcgt

SEQ ID NO: 948667 - DNA, 22 bp, Artificial Sequence
  chemically synthesized
tgggaaattctttttctcttgc

SEQ ID NO: 948668 - DNA, 22 bp, Artificial Sequence
  chemically synthesized
cttagttcaacgcaagagaaaa

SEQ ID NO: 948669 - DNA, 22 bp, Artificial Sequence
  chemically synthesized
ctgggaaattctttttctcttg

SEQ ID NO: 948670 - DNA, 22 bp, Artificial Sequence
  chemically synthesized
agttcaacgcaagagaaaaaga

SEQ ID NO: 948671 - DNA, 22 bp, Artificial Sequence
  chemically synthesized
gttcaacgcaagagaaaaagaa

SEQ ID NO: 948672 - DNA, 22 bp, Artificial Sequence
  chemically synthesized
aacgcaagagaaaaagaatttc

SEQ ID NO: 948673 - DNA, 22 bp, Artificial Sequence
  chemically synthesized
caaaggtttctgggaaattctt

SEQ ID NO: 948674 - DNA, 22 bp, Artificial Sequence
  chemically synthesized
ctgcaaaggtttctgggaaatt

SEQ ID NO: 948675 - DNA, 22 bp, Artificial Sequence
  chemically synthesized
cccagaaacctttgcagtaggt

SEQ ID NO: 948676 - DNA, 22 bp, Artificial Sequence
  chemically synthesized
ccagaaacctttgcagtaggtc

SEQ ID NO: 948677 - DNA, 22 bp, Artificial Sequence
  chemically synthesized
ataaaaatcaaggagacctact

SEQ ID NO: 948678 - DNA, 22 bp, Artificial Sequence
  chemically synthesized
tggactaataaaaatcaaggag

SEQ ID NO: 948679 - DNA, 22 bp, Artificial Sequence
  chemically synthesized
tgcagtaggtctccttgatttt

SEQ ID NO: 948680 - DNA, 22 bp, Artificial Sequence
  chemically synthesized
gcagtaggtctccttgattttt

SEQ ID NO: 948681 - DNA, 22 bp, Artificial Sequence
  chemically synthesized
ctgtggactaataaaaatcaag

SEQ ID NO: 948682 - DNA, 22 bp, Artificial Sequence
  chemically synthesized
cagtaggtctccttgattttta

SEQ ID NO: 948683 - DNA, 22 bp, Artificial Sequence
  chemically synthesized
atgacctactgtggactaataa

SEQ ID NO: 948684 - DNA, 22 bp, Artificial Sequence
  chemically synthesized
cttgatttttattagtccacag

SEQ ID NO: 948685 - DNA, 22 bp, Artificial Sequence
  chemically synthesized
gatttttattagtccacagtag

SEQ ID NO: 948686 - DNA, 22 bp, Artificial Sequence
  chemically synthesized
atttttattagtccacagtagg

SEQ ID NO: 948687 - DNA, 22 bp, Artificial Sequence
  chemically synthesized
ttattagtccacagtaggtcat

SEQ ID NO: 948688 - DNA, 22 bp, Artificial Sequence
  chemically synthesized
aaagatgacctcatgacctact

SEQ ID NO: 948689 - DNA, 22 bp, Artificial Sequence
  chemically synthesized
tattagtccacagtaggtcatg

SEQ ID NO: 948690 - DNA, 22 bp, Artificial Sequence
  chemically synthesized
attagtccacagtaggtcatga

SEQ ID NO: 948691 - DNA, 22 bp, Artificial Sequence
  chemically synthesized
ttagtccacagtaggtcatgag

SEQ ID NO: 948692 - DNA, 22 bp, Artificial Sequence
  chemically synthesized
gtccacagtaggtcatgaggtc

SEQ ID NO: 948693 - DNA, 22 bp, Artificial Sequence
  chemically synthesized
cagtaacaggttcaaagatgac

SEQ ID NO: 948694 - DNA, 22 bp, Artificial Sequence
  chemically synthesized
tgaacctgttactgtagattgc

SEQ ID NO: 948695 - DNA, 22 bp, Artificial Sequence
  chemically synthesized
gaacctgttactgtagattgca

SEQ ID NO: 948696 - DNA, 22 bp, Artificial Sequence
  chemically synthesized
aacctgttactgtagattgcac

SEQ ID NO: 948697 - DNA, 22 bp, Artificial Sequence
  chemically synthesized
aggcccagatgaaccagtgcaa

SEQ ID NO: 948698 - DNA, 22 bp, Artificial Sequence
  chemically synthesized
ttactgtagattgcactggttc

SEQ ID NO: 948699 - DNA, 22 bp, Artificial Sequence
  chemically synthesized
ctgtagattgcactggttcatc

SEQ ID NO: 948700 - DNA, 22 bp, Artificial Sequence
  chemically synthesized
tagattgcactggttcatctgg

SEQ ID NO: 948701 - DNA, 22 bp, Artificial Sequence
  chemically synthesized
cactggttcatctgggcctgag

SEQ ID NO: 948702 - DNA, 22 bp, Artificial Sequence
  chemically synthesized
ggaataaagcatatacctcagg

SEQ ID NO: 948703 - DNA, 22 bp, Artificial Sequence
  chemically synthesized
gttcatctgggcctgaggtata

SEQ ID NO: 948704 - DNA, 22 bp, Artificial Sequence
  chemically synthesized
taggaataaagcatatacctca

SEQ ID NO: 948705 - DNA, 22 bp, Artificial Sequence
  chemically synthesized
atctgggcctgaggtatatgct

SEQ ID NO: 948706 - DNA, 22 bp, Artificial Sequence
  chemically synthesized
ctctaggaataaagcatatacc

SEQ ID NO: 948707 - DNA, 22 bp, Artificial Sequence
  chemically synthesized
ggcctgaggtatatgctttatt

SEQ ID NO: 948708 - DNA, 22 bp, Artificial Sequence
  chemically synthesized
aggtatatgctttattcctaga

SEQ ID NO: 948709 - DNA, 22 bp, Artificial Sequence
  chemically synthesized
gagcgcaaatggtattgctcta

SEQ ID NO: 948710 - DNA, 22 bp, Artificial Sequence
  chemically synthesized
tggagcgcaaatggtattgctc

SEQ ID NO: 948711 - DNA, 22 bp, Artificial Sequence
  chemically synthesized
ctctggagcgcaaatggtattg

SEQ ID NO: 948712 - DNA, 22 bp, Artificial Sequence
  chemically synthesized
tattcctagagcaataccattt

SEQ ID NO: 948713 - DNA, 22 bp, Artificial Sequence
  chemically synthesized
attcctagagcaataccatttg

SEQ ID NO: 948714 - DNA, 22 bp, Artificial Sequence
  chemically synthesized
tcctctggagcgcaaatggtat

SEQ ID NO: 948715 - DNA, 22 bp, Artificial Sequence
  chemically synthesized
ttcctagagcaataccatttgc

SEQ ID NO: 948716 - DNA, 22 bp, Artificial Sequence
  chemically synthesized
ctagagcaataccatttgcgct

SEQ ID NO: 948717 - DNA, 22 bp, Artificial Sequence
  chemically synthesized
gagcaataccatttgcgctcca

SEQ ID NO: 948718 - DNA, 22 bp, Artificial Sequence
  chemically synthesized
cggtggtaagaactctcctctg

SEQ ID NO: 948719 - DNA, 22 bp, Artificial Sequence
  chemically synthesized
gcggtggtaagaactctcctct

SEQ ID NO: 948720 - DNA, 22 bp, Artificial Sequence
  chemically synthesized
tgcggtggtaagaactctcctc

SEQ ID NO: 948721 - DNA, 22 bp, Artificial Sequence
  chemically synthesized
ttgcggtggtaagaactctcct

SEQ ID NO: 948722 - DNA, 22 bp, Artificial Sequence
  chemically synthesized
gcgctccagaggagagttctta

SEQ ID NO: 948723 - DNA, 22 bp, Artificial Sequence
  chemically synthesized
cgctccagaggagagttcttac

SEQ ID NO: 948724 - DNA, 22 bp, Artificial Sequence
  chemically synthesized
cagaggagagttcttaccaccg

SEQ ID NO: 948725 - DNA, 22 bp, Artificial Sequence
  chemically synthesized
gtgaatatgtggatttttgcgg

SEQ ID NO: 948726 - DNA, 22 bp, Artificial Sequence
  chemically synthesized
ggtgaatatgtggatttttgcg

SEQ ID NO: 948727 - DNA, 22 bp, Artificial Sequence
  chemically synthesized
ccttggtgaatatgtggatttt

SEQ ID NO: 948728 - DNA, 22 bp, Artificial Sequence
  chemically synthesized
ttaccaccgcaaaaatccacat

SEQ ID NO: 948729 - DNA, 22 bp, Artificial Sequence
  chemically synthesized
accaccgcaaaaatccacatat

SEQ ID NO: 948730 - DNA, 22 bp, Artificial Sequence
  chemically synthesized
ccaccgcaaaaatccacatatt

SEQ ID NO: 948731 - DNA, 22 bp, Artificial Sequence
  chemically synthesized
tgtgagagagattcccttggtg

SEQ ID NO: 948732 - DNA, 22 bp, Artificial Sequence
  chemically synthesized
actgtgtgagagagattccctt

SEQ ID NO: 948733 - DNA, 22 bp, Artificial Sequence
  chemically synthesized
tattgactgtgtgagagagatt

SEQ ID NO: 948734 - DNA, 22 bp, Artificial Sequence
  chemically synthesized
accaagggaatctctctcacac

SEQ ID NO: 948735 - DNA, 22 bp, Artificial Sequence
  chemically synthesized
aactatattgactgtgtgagag

SEQ ID NO: 948736 - DNA, 22 bp, Artificial Sequence
  chemically synthesized
aactaaactatattgactgtgt

SEQ ID NO: 948737 - DNA, 22 bp, Artificial Sequence
  chemically synthesized
attcaactaaactatattgact

SEQ ID NO: 948738 - DNA, 22 bp, Artificial Sequence
  chemically synthesized
tctcacacagtcaatatagttt

SEQ ID NO: 948739 - DNA, 22 bp, Artificial Sequence
  chemically synthesized
attaattcaactaaactatatt

SEQ ID NO: 948740 - DNA, 22 bp, Artificial Sequence
  chemically synthesized
tcacacagtcaatatagtttag

SEQ ID NO: 948741 - DNA, 22 bp, Artificial Sequence
  chemically synthesized
acacagtcaatatagtttagtt

SEQ ID NO: 948742 - DNA, 22 bp, Artificial Sequence
  chemically synthesized
agacattaattaattcaactaa

SEQ ID NO: 948743 - DNA, 22 bp, Artificial Sequence
  chemically synthesized
gagacattaattaattcaacta

SEQ ID NO: 948744 - DNA, 22 bp, Artificial Sequence
  chemically synthesized
tgagacattaattaattcaact

SEQ ID NO: 948745 - DNA, 22 bp, Artificial Sequence
  chemically synthesized
ttgagacattaattaattcaac

SEQ ID NO: 948746 - DNA, 22 bp, Artificial Sequence
  chemically synthesized
tttttgagacattaattaattc

SEQ ID NO: 948747 - DNA, 22 bp, Artificial Sequence
  chemically synthesized
atttttgagacattaattaatt

SEQ ID NO: 948748 - DNA, 22 bp, Artificial Sequence
  chemically synthesized
atttatttttgagacattaatt

SEQ ID NO: 948749 - DNA, 22 bp, Artificial Sequence
  chemically synthesized
aatttatttttgagacattaat

SEQ ID NO: 948750 - DNA, 22 bp, Artificial Sequence
  chemically synthesized
agttgaattaattaatgtctca

SEQ ID NO: 948751 - DNA, 22 bp, Artificial Sequence
  chemically synthesized
gttgaattaattaatgtctcaa

SEQ ID NO: 948752 - DNA, 22 bp, Artificial Sequence
  chemically synthesized
cttaatttatttttgagacatt

SEQ ID NO: 948753 - DNA, 22 bp, Artificial Sequence
  chemically synthesized
aattaattaatgtctcaaaaat

SEQ ID NO: 948754 - DNA, 22 bp, Artificial Sequence
  chemically synthesized
attaatgtctcaaaaataaatt

SEQ ID NO: 948755 - DNA, 22 bp, Artificial Sequence
  chemically synthesized
atgtctcaaaaataaattaagc

SEQ ID NO: 948756 - DNA, 22 bp, Artificial Sequence
  chemically synthesized
caaatatgtgagaactgcttaa

SEQ ID NO: 948757 - DNA, 22 bp, Artificial Sequence
  chemically synthesized
aaaaataaattaagcagttctc

SEQ ID NO: 948758 - DNA, 22 bp, Artificial Sequence
  chemically synthesized
tctacaaatatgtgagaactgc

SEQ ID NO: 948759 - DNA, 22 bp, Artificial Sequence
  chemically synthesized
gaaaatactgtctacaaatatg

SEQ ID NO: 948760 - DNA, 22 bp, Artificial Sequence
  chemically synthesized
agcagttctcacatatttgtag

SEQ ID NO: 948761 - DNA, 22 bp, Artificial Sequence
  chemically synthesized
gtagttagaaaatactgtctac

SEQ ID NO: 948762 - DNA, 22 bp, Artificial Sequence
  chemically synthesized
agtagttagaaaatactgtcta

SEQ ID NO: 948763 - DNA, 22 bp, Artificial Sequence
  chemically synthesized
tcacatatttgtagacagtatt

SEQ ID NO: 948764 - DNA, 22 bp, Artificial Sequence
  chemically synthesized
acatatttgtagacagtatttt

SEQ ID NO: 948765 - DNA, 22 bp, Artificial Sequence
  chemically synthesized
atttagtagttagaaaatactg

SEQ ID NO: 948766 - DNA, 22 bp, Artificial Sequence
  chemically synthesized
catttagtagttagaaaatact

SEQ ID NO: 948767 - DNA, 22 bp, Artificial Sequence
  chemically synthesized
tttcatttagtagttagaaaat

SEQ ID NO: 948768 - DNA, 22 bp, Artificial Sequence
  chemically synthesized
gtagacagtattttctaactac

SEQ ID NO: 948769 - DNA, 22 bp, Artificial Sequence
  chemically synthesized
tagacagtattttctaactact

SEQ ID NO: 948770 - DNA, 22 bp, Artificial Sequence
  chemically synthesized
gttatttcatttagtagttaga

SEQ ID NO: 948771 - DNA, 22 bp, Artificial Sequence
  chemically synthesized
cgttatttcatttagtagttag

SEQ ID NO: 948772 - DNA, 22 bp, Artificial Sequence
  chemically synthesized
tcgttatttcatttagtagtta

SEQ ID NO: 948773 - DNA, 22 bp, Artificial Sequence
  chemically synthesized
ctttcgttatttcatttagtag

SEQ ID NO: 948774 - DNA, 22 bp, Artificial Sequence
  chemically synthesized
actttcgttatttcatttagta

SEQ ID NO: 948775 - DNA, 22 bp, Artificial Sequence
  chemically synthesized
tactttcgttatttcatttagt

SEQ ID NO: 948776 - DNA, 22 bp, Artificial Sequence
  chemically synthesized
ttactttcgttatttcatttag

SEQ ID NO: 948777 - DNA, 22 bp, Artificial Sequence
  chemically synthesized
tttactttcgttatttcattta

SEQ ID NO: 948778 - DNA, 22 bp, Artificial Sequence
  chemically synthesized
tttttactttcgttatttcatt

SEQ ID NO: 948779 - DNA, 22 bp, Artificial Sequence
  chemically synthesized
tctaactactaaatgaaataac

SEQ ID NO: 948780 - DNA, 22 bp, Artificial Sequence
  chemically synthesized
ctttttactttcgttatttcat

SEQ ID NO: 948781 - DNA, 22 bp, Artificial Sequence
  chemically synthesized
ctaactactaaatgaaataacg

SEQ ID NO: 948782 - DNA, 22 bp, Artificial Sequence
  chemically synthesized
taactactaaatgaaataacga

SEQ ID NO: 948783 - DNA, 22 bp, Artificial Sequence
  chemically synthesized
actactaaatgaaataacgaaa

SEQ ID NO: 948784 - DNA, 22 bp, Artificial Sequence
  chemically synthesized
ccttctttttactttcgttatt

SEQ ID NO: 948785 - DNA, 22 bp, Artificial Sequence
  chemically synthesized
gccttctttttactttcgttat

SEQ ID NO: 948786 - DNA, 22 bp, Artificial Sequence
  chemically synthesized
tgccttctttttactttcgtta

SEQ ID NO: 948787 - DNA, 22 bp, Artificial Sequence
  chemically synthesized
ttgccttctttttactttcgtt

SEQ ID NO: 948788 - DNA, 22 bp, Artificial Sequence
  chemically synthesized
ctaaatgaaataacgaaagtaa

SEQ ID NO: 948789 - DNA, 22 bp, Artificial Sequence
  chemically synthesized
ttttgccttctttttactttcg

SEQ ID NO: 948790 - DNA, 22 bp, Artificial Sequence
  chemically synthesized
cttttgccttctttttactttc

SEQ ID NO: 948791 - DNA, 22 bp, Artificial Sequence
  chemically synthesized
aatgaaataacgaaagtaaaaa

SEQ ID NO: 948792 - DNA, 22 bp, Artificial Sequence
  chemically synthesized
ttcttttgccttctttttactt

SEQ ID NO: 948793 - DNA, 22 bp, Artificial Sequence
  chemically synthesized
cttcttttgccttctttttact

SEQ ID NO: 948794 - DNA, 22 bp, Artificial Sequence
  chemically synthesized
aagagtatttcttcttttgcct

SEQ ID NO: 948795 - DNA, 22 bp, Artificial Sequence
  chemically synthesized
aaagagtatttcttcttttgcc

SEQ ID NO: 948796 - DNA, 22 bp, Artificial Sequence
  chemically synthesized
cttaaagagtatttcttctttt

SEQ ID NO: 948797 - DNA, 22 bp, Artificial Sequence
  chemically synthesized
catgagattgcttaaagagtat

SEQ ID NO: 948798 - DNA, 22 bp, Artificial Sequence
  chemically synthesized
ctacatgagattgcttaaagag

SEQ ID NO: 948799 - DNA, 22 bp, Artificial Sequence
  chemically synthesized
tttaagcaatctcatgtagtaa

SEQ ID NO: 948800 - DNA, 22 bp, Artificial Sequence
  chemically synthesized
cgtgaatgaatattactacatg

SEQ ID NO: 948801 - DNA, 22 bp, Artificial Sequence
  chemically synthesized
taagcaatctcatgtagtaata

SEQ ID NO: 948802 - DNA, 22 bp, Artificial Sequence
  chemically synthesized
aagcaatctcatgtagtaatat

SEQ ID NO: 948803 - DNA, 22 bp, Artificial Sequence
  chemically synthesized
agcaatctcatgtagtaatatt

SEQ ID NO: 948804 - DNA, 22 bp, Artificial Sequence
  chemically synthesized
atgtagtaatattcattcacgt

SEQ ID NO: 948805 - DNA, 22 bp, Artificial Sequence
  chemically synthesized
aaacagaaatatgccaggaatg

SEQ ID NO: 948806 - DNA, 22 bp, Artificial Sequence
  chemically synthesized
attcacgtaatcattcctggca

SEQ ID NO: 948807 - DNA, 22 bp, Artificial Sequence
  chemically synthesized
caaacagaaatatgccaggaat

SEQ ID NO: 948808 - DNA, 22 bp, Artificial Sequence
  chemically synthesized
acgtaatcattcctggcatatt

SEQ ID NO: 948809 - DNA, 22 bp, Artificial Sequence
  chemically synthesized
aatttcaaacagaaatatgcca

SEQ ID NO: 948810 - DNA, 22 bp, Artificial Sequence
  chemically synthesized
ctggcatatttctgtttgaaat

SEQ ID NO: 948811 - DNA, 22 bp, Artificial Sequence
  chemically synthesized
gcatatttctgtttgaaattca

SEQ ID NO: 948812 - DNA, 22 bp, Artificial Sequence
  chemically synthesized
catgtagatgactgaatttcaa

SEQ ID NO: 948813 - DNA, 22 bp, Artificial Sequence
  chemically synthesized
ccatgtagatgactgaatttca

SEQ ID NO: 948814 - DNA, 22 bp, Artificial Sequence
  chemically synthesized
tttccatgtagatgactgaatt

SEQ ID NO: 948815 - DNA, 22 bp, Artificial Sequence
  chemically synthesized
ctgtttgaaattcagtcatcta

SEQ ID NO: 948816 - DNA, 22 bp, Artificial Sequence
  chemically synthesized
tgtttgaaattcagtcatctac

SEQ ID NO: 948817 - DNA, 22 bp, Artificial Sequence
  chemically synthesized
cgctgtttccatgtagatgact

SEQ ID NO: 948818 - DNA, 22 bp, Artificial Sequence
  chemically synthesized
ccgctgtttccatgtagatgac

SEQ ID NO: 948819 - DNA, 22 bp, Artificial Sequence
  chemically synthesized
tttgaaattcagtcatctacat

SEQ ID NO: 948820 - DNA, 22 bp, Artificial Sequence
  chemically synthesized
gaaattcagtcatctacatgga

SEQ ID NO: 948821 - DNA, 22 bp, Artificial Sequence
  chemically synthesized
aaattcagtcatctacatggaa

SEQ ID NO: 948822 - DNA, 22 bp, Artificial Sequence
  chemically synthesized
cccttccgctgtttccatgtag

SEQ ID NO: 948823 - DNA, 22 bp, Artificial Sequence
  chemically synthesized
agctccccttccgctgtttcca

SEQ ID NO: 948824 - DNA, 22 bp, Artificial Sequence
  chemically synthesized
agtcatctacatggaaacagcg

SEQ ID NO: 948825 - DNA, 22 bp, Artificial Sequence
  chemically synthesized
tcctgagctccccttccgctgt

SEQ ID NO: 948826 - DNA, 22 bp, Artificial Sequence
  chemically synthesized
catggaaacagcggaaggggag

SEQ ID NO: 948827 - DNA, 22 bp, Artificial Sequence
  chemically synthesized
atggcatattgtcctgagctcc

SEQ ID NO: 948828 - DNA, 22 bp, Artificial Sequence
  chemically synthesized
tgtatgaaatattaatggcata

SEQ ID NO: 948829 - DNA, 22 bp, Artificial Sequence
  chemically synthesized
aggacaatatgccattaatatt

SEQ ID NO: 948830 - DNA, 22 bp, Artificial Sequence
  chemically synthesized
aacagattgtgtatgaaatatt

SEQ ID NO: 948831 - DNA, 22 bp, Artificial Sequence
  chemically synthesized
gtgttaaacagattgtgtatga

SEQ ID NO: 948832 - DNA, 22 bp, Artificial Sequence
  chemically synthesized
agtgttaaacagattgtgtatg

SEQ ID NO: 948833 - DNA, 22 bp, Artificial Sequence
  chemically synthesized
tttagtgttaaacagattgtgt

SEQ ID NO: 948834 - DNA, 22 bp, Artificial Sequence
  chemically synthesized
atatttcatacacaatctgttt

SEQ ID NO: 948835 - DNA, 22 bp, Artificial Sequence
  chemically synthesized
catacacaatctgtttaacact

SEQ ID NO: 948836 - DNA, 22 bp, Artificial Sequence
  chemically synthesized
atacacaatctgtttaacacta

SEQ ID NO: 948837 - DNA, 22 bp, Artificial Sequence
  chemically synthesized
taaaaatgaattgtttagtgtt

SEQ ID NO: 948838 - DNA, 22 bp, Artificial Sequence
  chemically synthesized
ctataaaaatgaattgtttagt

SEQ ID NO: 948839 - DNA, 22 bp, Artificial Sequence
  chemically synthesized
tttaacactaaacaattcattt

SEQ ID NO: 948840 - DNA, 22 bp, Artificial Sequence
  chemically synthesized
aacactaaacaattcattttta

SEQ ID NO: 948841 - DNA, 22 bp, Artificial Sequence
  chemically synthesized
acactaaacaattcatttttat

SEQ ID NO: 948842 - DNA, 22 bp, Artificial Sequence
  chemically synthesized
aacaattcatttttataggagt

SEQ ID NO: 948843 - DNA, 22 bp, Artificial Sequence
  chemically synthesized
tgggagatgagtaaaactccta

SEQ ID NO: 948844 - DNA, 22 bp, Artificial Sequence
  chemically synthesized
gtgggagatgagtaaaactcct

SEQ ID NO: 948845 - DNA, 22 bp, Artificial Sequence
  chemically synthesized
atttttataggagttttactca

SEQ ID NO: 948846 - DNA, 22 bp, Artificial Sequence
  chemically synthesized
aatttgtgggagatgagtaaaa

SEQ ID NO: 948847 - DNA, 22 bp, Artificial Sequence
  chemically synthesized
gaatttgtgggagatgagtaaa

SEQ ID NO: 948848 - DNA, 22 bp, Artificial Sequence
  chemically synthesized
ttataggagttttactcatctc

SEQ ID NO: 948849 - DNA, 22 bp, Artificial Sequence
  chemically synthesized
tataggagttttactcatctcc

SEQ ID NO: 948850 - DNA, 22 bp, Artificial Sequence
  chemically synthesized
ataggagttttactcatctccc

SEQ ID NO: 948851 - DNA, 22 bp, Artificial Sequence
  chemically synthesized
taggagttttactcatctccca

SEQ ID NO: 948852 - DNA, 22 bp, Artificial Sequence
  chemically synthesized
tactcatctcccacaaattcaa

SEQ ID NO: 948853 - DNA, 22 bp, Artificial Sequence
  chemically synthesized
actcatctcccacaaattcaaa

SEQ ID NO: 948854 - DNA, 22 bp, Artificial Sequence
  chemically synthesized
gcaagacaaacatttgaatttg

SEQ ID NO: 948855 - DNA, 22 bp, Artificial Sequence
  chemically synthesized
ctcatctcccacaaattcaaat

SEQ ID NO: 948856 - DNA, 22 bp, Artificial Sequence
  chemically synthesized
atctcccacaaattcaaatgtt

SEQ ID NO: 948857 - DNA, 22 bp, Artificial Sequence
  chemically synthesized
ccacaaattcaaatgtttgtct

SEQ ID NO: 948858 - DNA, 22 bp, Artificial Sequence
  chemically synthesized
aatatgaaaaattagcaagaca

SEQ ID NO: 948859 - DNA, 22 bp, Artificial Sequence
  chemically synthesized
aaatatgaaaaattagcaagac

SEQ ID NO: 948860 - DNA, 22 bp, Artificial Sequence
  chemically synthesized
taaatatgaaaaattagcaaga

SEQ ID NO: 948861 - DNA, 22 bp, Artificial Sequence
  chemically synthesized
aaatgtttgtcttgctaatttt

SEQ ID NO: 948862 - DNA, 22 bp, Artificial Sequence
  chemically synthesized
gtcttgctaatttttcatattt

SEQ ID NO: 948863 - DNA, 22 bp, Artificial Sequence
  chemically synthesized
tcttgctaatttttcatattta

SEQ ID NO: 948864 - DNA, 22 bp, Artificial Sequence
  chemically synthesized
aaaagcaaattttaaatatgaa

SEQ ID NO: 948865 - DNA, 22 bp, Artificial Sequence
  chemically synthesized
gctaatttttcatatttaaaat

SEQ ID NO: 948866 - DNA, 22 bp, Artificial Sequence
  chemically synthesized
gctgaaaagcaaattttaaata

SEQ ID NO: 948867 - DNA, 22 bp, Artificial Sequence
  chemically synthesized
ctaatttttcatatttaaaatt

SEQ ID NO: 948868 - DNA, 22 bp, Artificial Sequence
  chemically synthesized
atttttcatatttaaaatttgc

SEQ ID NO: 948869 - DNA, 22 bp, Artificial Sequence
  chemically synthesized
ttcatatttaaaatttgctttt

SEQ ID NO: 948870 - DNA, 22 bp, Artificial Sequence
  chemically synthesized
tcatatttaaaatttgcttttc

SEQ ID NO: 948871 - DNA, 22 bp, Artificial Sequence
  chemically synthesized
catatttaaaatttgcttttca

SEQ ID NO: 948872 - DNA, 22 bp, Artificial Sequence
  chemically synthesized
atatttaaaatttgcttttcag

SEQ ID NO: 948873 - DNA, 22 bp, Artificial Sequence
  chemically synthesized
gtgaatgaatgctagctgaaaa

SEQ ID NO: 948874 - DNA, 22 bp, Artificial Sequence
  chemically synthesized
agtgaatgaatgctagctgaaa

SEQ ID NO: 948875 - DNA, 22 bp, Artificial Sequence
  chemically synthesized
tagtgaatgaatgctagctgaa

SEQ ID NO: 948876 - DNA, 22 bp, Artificial Sequence
  chemically synthesized
aaaatttgcttttcagctagca

SEQ ID NO: 948877 - DNA, 22 bp, Artificial Sequence
  chemically synthesized
ttagtgaatgaatgctagctga

SEQ ID NO: 948878 - DNA, 22 bp, Artificial Sequence
  chemically synthesized
aaatttgcttttcagctagcat

SEQ ID NO: 948879 - DNA, 22 bp, Artificial Sequence
  chemically synthesized
gcttttcagctagcattcattc

SEQ ID NO: 948880 - DNA, 22 bp, Artificial Sequence
  chemically synthesized
cttttcagctagcattcattca

SEQ ID NO: 948881 - DNA, 22 bp, Artificial Sequence
  chemically synthesized
ttcagctagcattcattcacta

SEQ ID NO: 948882 - DNA, 22 bp, Artificial Sequence
  chemically synthesized
tcagctagcattcattcactaa

SEQ ID NO: 948883 - DNA, 22 bp, Artificial Sequence
  chemically synthesized
cagctagcattcattcactaaa

SEQ ID NO: 948884 - DNA, 22 bp, Artificial Sequence
  chemically synthesized
agctagcattcattcactaaaa

SEQ ID NO: 948885 - DNA, 22 bp, Artificial Sequence
  chemically synthesized
ggtgtacaaagaccttttagtg

SEQ ID NO: 948886 - DNA, 22 bp, Artificial Sequence
  chemically synthesized
gcattcattcactaaaaggtct

SEQ ID NO: 948887 - DNA, 22 bp, Artificial Sequence
  chemically synthesized
attcactaaaaggtctttgtac

SEQ ID NO: 948888 - DNA, 22 bp, Artificial Sequence
  chemically synthesized
gaagtattaggtgtacaaagac

SEQ ID NO: 948889 - DNA, 22 bp, Artificial Sequence
  chemically synthesized
actaaaaggtctttgtacacct

SEQ ID NO: 948890 - DNA, 22 bp, Artificial Sequence
  chemically synthesized
aactcgaagtattaggtgtaca

SEQ ID NO: 948891 - DNA, 22 bp, Artificial Sequence
  chemically synthesized
gaactcgaagtattaggtgtac

SEQ ID NO: 948892 - DNA, 22 bp, Artificial Sequence
  chemically synthesized
aaaggtctttgtacacctaata

SEQ ID NO: 948893 - DNA, 22 bp, Artificial Sequence
  chemically synthesized
catgagcttgaactcgaagtat

SEQ ID NO: 948894 - DNA, 22 bp, Artificial Sequence
  chemically synthesized
tgtacacctaatacttcgagtt

SEQ ID NO: 948895 - DNA, 22 bp, Artificial Sequence
  chemically synthesized
tgcatgagcttgaactcgaagt

SEQ ID NO: 948896 - DNA, 22 bp, Artificial Sequence
  chemically synthesized
gtacacctaatacttcgagttc

SEQ ID NO: 948897 - DNA, 22 bp, Artificial Sequence
  chemically synthesized
tacacctaatacttcgagttca

SEQ ID NO: 948898 - DNA, 22 bp, Artificial Sequence
  chemically synthesized
atacttcgagttcaagctcatg

SEQ ID NO: 948899 - DNA, 22 bp, Artificial Sequence
  chemically synthesized
cgagttcaagctcatgcagaac

SEQ ID NO: 948900 - DNA, 22 bp, Artificial Sequence
  chemically synthesized
gagttcaagctcatgcagaact

SEQ ID NO: 948901 - DNA, 22 bp, Artificial Sequence
  chemically synthesized
gaaaataataaaatagttctgc

SEQ ID NO: 948902 - DNA, 22 bp, Artificial Sequence
  chemically synthesized
ctagaaaataataaaatagttc

SEQ ID NO: 948903 - DNA, 22 bp, Artificial Sequence
  chemically synthesized
aagctcatgcagaactatttta

SEQ ID NO: 948904 - DNA, 22 bp, Artificial Sequence
  chemically synthesized
ctactagaaaataataaaatag

SEQ ID NO: 948905 - DNA, 22 bp, Artificial Sequence
  chemically synthesized
cctactagaaaataataaaata

SEQ ID NO: 948906 - DNA, 22 bp, Artificial Sequence
  chemically synthesized
ttcctactagaaaataataaaa

SEQ ID NO: 948907 - DNA, 22 bp, Artificial Sequence
  chemically synthesized
atgcagaactattttattattt

SEQ ID NO: 948908 - DNA, 22 bp, Artificial Sequence
  chemically synthesized
ttcttcctactagaaaataata

SEQ ID NO: 948909 - DNA, 22 bp, Artificial Sequence
  chemically synthesized
tctgttcttcctactagaaaat

SEQ ID NO: 948910 - DNA, 22 bp, Artificial Sequence
  chemically synthesized
atctgttcttcctactagaaaa

SEQ ID NO: 948911 - DNA, 22 bp, Artificial Sequence
  chemically synthesized
ttttattattttctagtaggaa

SEQ ID NO: 948912 - DNA, 22 bp, Artificial Sequence
  chemically synthesized
tattattttctagtaggaagaa

SEQ ID NO: 948913 - DNA, 22 bp, Artificial Sequence
  chemically synthesized
attattttctagtaggaagaac

SEQ ID NO: 948914 - DNA, 22 bp, Artificial Sequence
  chemically synthesized
ttattttctagtaggaagaaca

SEQ ID NO: 948915 - DNA, 22 bp, Artificial Sequence
  chemically synthesized
ttttctagtaggaagaacagat

SEQ ID NO: 948916 - DNA, 22 bp, Artificial Sequence
  chemically synthesized
caacgaaatgtttatctgttct

SEQ ID NO: 948917 - DNA, 22 bp, Artificial Sequence
  chemically synthesized
gcaacgaaatgtttatctgttc

SEQ ID NO: 948918 - DNA, 22 bp, Artificial Sequence
  chemically synthesized
tctagtaggaagaacagataaa

SEQ ID NO: 948919 - DNA, 22 bp, Artificial Sequence
  chemically synthesized
ctagtaggaagaacagataaac

SEQ ID NO: 948920 - DNA, 22 bp, Artificial Sequence
  chemically synthesized
tagtaggaagaacagataaaca

SEQ ID NO: 948921 - DNA, 22 bp, Artificial Sequence
  chemically synthesized
gtaggaagaacagataaacatt

SEQ ID NO: 948922 - DNA, 22 bp, Artificial Sequence
  chemically synthesized
ccacatttgcaacgaaatgttt

SEQ ID NO: 948923 - DNA, 22 bp, Artificial Sequence
  chemically synthesized
taccacatttgcaacgaaatgt

SEQ ID NO: 948924 - DNA, 22 bp, Artificial Sequence
  chemically synthesized
aaaacagaactctaccacattt

SEQ ID NO: 948925 - DNA, 22 bp, Artificial Sequence
  chemically synthesized
cgttgcaaatgtggtagagttc

SEQ ID NO: 948926 - DNA, 22 bp, Artificial Sequence
  chemically synthesized
gcgttaaaaacagaactctacc

SEQ ID NO: 948927 - DNA, 22 bp, Artificial Sequence
  chemically synthesized
gttgcaaatgtggtagagttct

SEQ ID NO: 948928 - DNA, 22 bp, Artificial Sequence
  chemically synthesized
caaatgtggtagagttctgttt

SEQ ID NO: 948929 - DNA, 22 bp, Artificial Sequence
  chemically synthesized
aacacagataatattggcgtta

SEQ ID NO: 948930 - DNA, 22 bp, Artificial Sequence
  chemically synthesized
tgtttttaacgccaatattatc

SEQ ID NO: 948931 - DNA, 22 bp, Artificial Sequence
  chemically synthesized
tttttaacgccaatattatctg

SEQ ID NO: 948932 - DNA, 22 bp, Artificial Sequence
  chemically synthesized
ttaacgccaatattatctgtgt

SEQ ID NO: 948933 - DNA, 22 bp, Artificial Sequence
  chemically synthesized
taacgccaatattatctgtgtt

SEQ ID NO: 948934 - DNA, 22 bp, Artificial Sequence
  chemically synthesized
aacgccaatattatctgtgttc

SEQ ID NO: 948935 - DNA, 22 bp, Artificial Sequence
  chemically synthesized
acgccaatattatctgtgttca

SEQ ID NO: 948936 - DNA, 22 bp, Artificial Sequence
  chemically synthesized
ataagagataatgcattgaaca

SEQ ID NO: 948937 - DNA, 22 bp, Artificial Sequence
  chemically synthesized
tctgtgttcaatgcattatctc

SEQ ID NO: 948938 - DNA, 22 bp, Artificial Sequence
  chemically synthesized
tgttcaatgcattatctcttat

SEQ ID NO: 948939 - DNA, 22 bp, Artificial Sequence
  chemically synthesized
aatgcattatctcttatgagct

SEQ ID NO: 948940 - DNA, 22 bp, Artificial Sequence
  chemically synthesized
tctcttatgagctacatatttt

SEQ ID NO: 948941 - DNA, 22 bp, Artificial Sequence
  chemically synthesized
ttatgagctacatatttttggg

SEQ ID NO: 948942 - DNA, 22 bp, Artificial Sequence
  chemically synthesized
atgagctacatatttttggggg

SEQ ID NO: 948943 - DNA, 22 bp, Artificial Sequence
  chemically synthesized
tgagctacatatttttgggggg

SEQ ID NO: 948944 - DNA, 22 bp, Artificial Sequence
  chemically synthesized
aaaaatataatcccccccaaaa

SEQ ID NO: 948945 - DNA, 22 bp, Artificial Sequence
  chemically synthesized
catatttttgggggggattata

SEQ ID NO: 948946 - DNA, 22 bp, Artificial Sequence
  chemically synthesized
ttgggggggattatatttttta

SEQ ID NO: 948947 - DNA, 22 bp, Artificial Sequence
  chemically synthesized
aataggtacatctaaaaaatat

SEQ ID NO: 948948 - DNA, 22 bp, Artificial Sequence
  chemically synthesized
tgggggggattatattttttag

SEQ ID NO: 948949 - DNA, 22 bp, Artificial Sequence
  chemically synthesized
gggggggattatattttttaga

SEQ ID NO: 948950 - DNA, 22 bp, Artificial Sequence
  chemically synthesized
ggggggattatattttttagat

SEQ ID NO: 948951 - DNA, 22 bp, Artificial Sequence
  chemically synthesized
gaacactaaataggtacatcta

SEQ ID NO: 948952 - DNA, 22 bp, Artificial Sequence
  chemically synthesized
attggaacactaaataggtaca

SEQ ID NO: 948953 - DNA, 22 bp, Artificial Sequence
  chemically synthesized
tattttttagatgtacctattt

SEQ ID NO: 948954 - DNA, 22 bp, Artificial Sequence
  chemically synthesized
acctaattggaacactaaatag

SEQ ID NO: 948955 - DNA, 22 bp, Artificial Sequence
  chemically synthesized
tttagatgtacctatttagtgt

SEQ ID NO: 948956 - DNA, 22 bp, Artificial Sequence
  chemically synthesized
ttagatgtacctatttagtgtt

SEQ ID NO: 948957 - DNA, 22 bp, Artificial Sequence
  chemically synthesized
tagatgtacctatttagtgttc

SEQ ID NO: 948958 - DNA, 22 bp, Artificial Sequence
  chemically synthesized
agatgtacctatttagtgttcc

SEQ ID NO: 948959 - DNA, 22 bp, Artificial Sequence
  chemically synthesized
gatgtacctatttagtgttcca

SEQ ID NO: 948960 - DNA, 22 bp, Artificial Sequence
  chemically synthesized
ggtcagcattaacctaattgga

SEQ ID NO: 948961 - DNA, 22 bp, Artificial Sequence
  chemically synthesized
cggtcagcattaacctaattgg

SEQ ID NO: 948962 - DNA, 22 bp, Artificial Sequence
  chemically synthesized
tcggtcagcattaacctaattg

SEQ ID NO: 948963 - DNA, 22 bp, Artificial Sequence
  chemically synthesized
tttagtgttccaattaggttaa

SEQ ID NO: 948964 - DNA, 22 bp, Artificial Sequence
  chemically synthesized
agtgttccaattaggttaatgc

SEQ ID NO: 948965 - DNA, 22 bp, Artificial Sequence
  chemically synthesized
gtgttccaattaggttaatgct

SEQ ID NO: 948966 - DNA, 22 bp, Artificial Sequence
  chemically synthesized
tataaaatctttcggtcagcat

SEQ ID NO: 948967 - DNA, 22 bp, Artificial Sequence
  chemically synthesized
caattaggttaatgctgaccga

SEQ ID NO: 948968 - DNA, 22 bp, Artificial Sequence
  chemically synthesized
gttgtataaaatctttcggtca

SEQ ID NO: 948969 - DNA, 22 bp, Artificial Sequence
  chemically synthesized
agttgtataaaatctttcggtc

SEQ ID NO: 948970 - DNA, 22 bp, Artificial Sequence
  chemically synthesized
tagttgtataaaatctttcggt

SEQ ID NO: 948971 - DNA, 22 bp, Artificial Sequence
  chemically synthesized
ggttaatgctgaccgaaagatt

SEQ ID NO: 948972 - DNA, 22 bp, Artificial Sequence
  chemically synthesized
ttttagttgtataaaatctttc

SEQ ID NO: 948973 - DNA, 22 bp, Artificial Sequence
  chemically synthesized
attttagttgtataaaatcttt

SEQ ID NO: 948974 - DNA, 22 bp, Artificial Sequence
  chemically synthesized
tattttagttgtataaaatctt

SEQ ID NO: 948975 - DNA, 22 bp, Artificial Sequence
  chemically synthesized
atgctgaccgaaagattttata

SEQ ID NO: 948976 - DNA, 22 bp, Artificial Sequence
  chemically synthesized
attttattttagttgtataaaa

SEQ ID NO: 948977 - DNA, 22 bp, Artificial Sequence
  chemically synthesized
aattttattttagttgtataaa

SEQ ID NO: 948978 - DNA, 22 bp, Artificial Sequence
  chemically synthesized
accgaaagattttatacaacta

SEQ ID NO: 948979 - DNA, 22 bp, Artificial Sequence
  chemically synthesized
aatcaatttaattttattttag

SEQ ID NO: 948980 - DNA, 22 bp, Artificial Sequence
  chemically synthesized
caatcaatttaattttatttta

SEQ ID NO: 948981 - DNA, 22 bp, Artificial Sequence
  chemically synthesized
tatacaactaaaataaaattaa

SEQ ID NO: 948982 - DNA, 22 bp, Artificial Sequence
  chemically synthesized
atacaactaaaataaaattaaa

SEQ ID NO: 948983 - DNA, 22 bp, Artificial Sequence
  chemically synthesized
tacaactaaaataaaattaaat

SEQ ID NO: 948984 - DNA, 22 bp, Artificial Sequence
  chemically synthesized
aaataaaattaaattgattgaa

SEQ ID NO: 948985 - DNA, 22 bp, Artificial Sequence
  chemically synthesized
aaataaacaataaaatatatct

SEQ ID NO: 948986 - DNA, 22 bp, Artificial Sequence
  chemically synthesized
caaataaacaataaaatatatc

SEQ ID NO: 948987 - DNA, 22 bp, Artificial Sequence
  chemically synthesized
aattgattgaagatatatttta

SEQ ID NO: 948988 - DNA, 22 bp, Artificial Sequence
  chemically synthesized
tttcaaataaacaataaaatat

SEQ ID NO: 948989 - DNA, 22 bp, Artificial Sequence
  chemically synthesized
attgaagatatattttattgtt

SEQ ID NO: 948990 - DNA, 22 bp, Artificial Sequence
  chemically synthesized
aagatatattttattgtttatt

SEQ ID NO: 948991 - DNA, 22 bp, Artificial Sequence
  chemically synthesized
tgaagtattgtttcaaataaac

SEQ ID NO: 948992 - DNA, 22 bp, Artificial Sequence
  chemically synthesized
atgaagtattgtttcaaataaa

SEQ ID NO: 948993 - DNA, 22 bp, Artificial Sequence
  chemically synthesized
tattgtttatttgaaacaatac

SEQ ID NO: 948994 - DNA, 22 bp, Artificial Sequence
  chemically synthesized
attgtttatttgaaacaatact

SEQ ID NO: 948995 - DNA, 22 bp, Artificial Sequence
  chemically synthesized
ttgtttatttgaaacaatactt

SEQ ID NO: 948996 - DNA, 22 bp, Artificial Sequence
  chemically synthesized
tttatttgaaacaatacttcat

SEQ ID NO: 948997 - DNA, 22 bp, Artificial Sequence
  chemically synthesized
aaatcatatcacttatgaagta

SEQ ID NO: 948998 - DNA, 22 bp, Artificial Sequence
  chemically synthesized
atttgaaacaatacttcataag

SEQ ID NO: 948999 - DNA, 22 bp, Artificial Sequence
  chemically synthesized
tttgaaacaatacttcataagt

SEQ ID NO: 949000 - DNA, 22 bp, Artificial Sequence
  chemically synthesized
gaaacaatacttcataagtgat

SEQ ID NO: 949001 - DNA, 22 bp, Artificial Sequence
  chemically synthesized
aaacaatacttcataagtgata

SEQ ID NO: 949002 - DNA, 22 bp, Artificial Sequence
  chemically synthesized
cataagtgatatgattttagat

SEQ ID NO: 949003 - DNA, 22 bp, Artificial Sequence
  chemically synthesized
ataagtgatatgattttagatt

SEQ ID NO: 949004 - DNA, 22 bp, Artificial Sequence
  chemically synthesized
tagatttatactgtctccattt

SEQ ID NO: 949005 - DNA, 22 bp, Artificial Sequence
  chemically synthesized
agatttatactgtctccatttc

SEQ ID NO: 949006 - DNA, 22 bp, Artificial Sequence
  chemically synthesized
gatttatactgtctccatttca

SEQ ID NO: 949007 - DNA, 22 bp, Artificial Sequence
  chemically synthesized
aaaatgaaaatgtgaaatggag

SEQ ID NO: 949008 - DNA, 22 bp, Artificial Sequence
  chemically synthesized
taaaaatgaaaatgtgaaatgg

SEQ ID NO: 949009 - DNA, 22 bp, Artificial Sequence
  chemically synthesized
atactgtctccatttcacattt

SEQ ID NO: 949010 - DNA, 22 bp, Artificial Sequence
  chemically synthesized
tactgtctccatttcacatttt

SEQ ID NO: 949011 - DNA, 22 bp, Artificial Sequence
  chemically synthesized
tctccatttcacattttcattt

SEQ ID NO: 949012 - DNA, 22 bp, Artificial Sequence
  chemically synthesized
catttcacattttcatttttag

SEQ ID NO: 949013 - DNA, 22 bp, Artificial Sequence
  chemically synthesized
cacattttcatttttagagtac

SEQ ID NO: 949014 - DNA, 22 bp, Artificial Sequence
  chemically synthesized
aataacaataaagtactctaaa

SEQ ID NO: 949015 - DNA, 22 bp, Artificial Sequence
  chemically synthesized
acattttcatttttagagtact

SEQ ID NO: 949016 - DNA, 22 bp, Artificial Sequence
  chemically synthesized
tcatttttagagtactttattg

SEQ ID NO: 949017 - DNA, 22 bp, Artificial Sequence
  chemically synthesized
catttttagagtactttattgt

SEQ ID NO: 949018 - DNA, 22 bp, Artificial Sequence
  chemically synthesized
agtgactaaataacaataaagt

SEQ ID NO: 949019 - DNA, 22 bp, Artificial Sequence
  chemically synthesized
atttttagagtactttattgtt

SEQ ID NO: 949020 - DNA, 22 bp, Artificial Sequence
  chemically synthesized
ttagagtactttattgttattt

SEQ ID NO: 949021 - DNA, 22 bp, Artificial Sequence
  chemically synthesized
tagagtactttattgttattta

SEQ ID NO: 949022 - DNA, 22 bp, Artificial Sequence
  chemically synthesized
agagtactttattgttatttag

SEQ ID NO: 949023 - DNA, 22 bp, Artificial Sequence
  chemically synthesized
gagtactttattgttatttagt

SEQ ID NO: 949024 - DNA, 22 bp, Artificial Sequence
  chemically synthesized
tattgttatttagtcactgaat

SEQ ID NO: 949025 - DNA, 22 bp, Artificial Sequence
  chemically synthesized
attgttatttagtcactgaatc

SEQ ID NO: 949026 - DNA, 22 bp, Artificial Sequence
  chemically synthesized
ttgttatttagtcactgaatct

SEQ ID NO: 949027 - DNA, 22 bp, Artificial Sequence
  chemically synthesized
ttatttagtcactgaatctttt

SEQ ID NO: 949028 - DNA, 22 bp, Artificial Sequence
  chemically synthesized
cgagggatgtggaaaagattca

SEQ ID NO: 949029 - DNA, 22 bp, Artificial Sequence
  chemically synthesized
acgagggatgtggaaaagattc

SEQ ID NO: 949030 - DNA, 22 bp, Artificial Sequence
  chemically synthesized
tttagtcactgaatcttttcca

SEQ ID NO: 949031 - DNA, 22 bp, Artificial Sequence
  chemically synthesized
agtcactgaatcttttccacat

SEQ ID NO: 949032 - DNA, 22 bp, Artificial Sequence
  chemically synthesized
aacttacgagggatgtggaaaa

SEQ ID NO: 949033 - DNA, 22 bp, Artificial Sequence
  chemically synthesized
gtcactgaatcttttccacatc

SEQ ID NO: 949034 - DNA, 22 bp, Artificial Sequence
  chemically synthesized
cagattgaacttacgagggatg

SEQ ID NO: 949035 - DNA, 22 bp, Artificial Sequence
  chemically synthesized
aatcttttccacatccctcgta

SEQ ID NO: 949036 - DNA, 22 bp, Artificial Sequence
  chemically synthesized
ttccacatccctcgtaagttca

SEQ ID NO: 949037 - DNA, 22 bp, Artificial Sequence
  chemically synthesized
tccacatccctcgtaagttcaa

SEQ ID NO: 949038 - DNA, 22 bp, Artificial Sequence
  chemically synthesized
ccacatccctcgtaagttcaat

SEQ ID NO: 949039 - DNA, 22 bp, Artificial Sequence
  chemically synthesized
cacatccctcgtaagttcaatc

SEQ ID NO: 949040 - DNA, 22 bp, Artificial Sequence
  chemically synthesized
gcatatacattccagattgaac

SEQ ID NO: 949041 - DNA, 22 bp, Artificial Sequence
  chemically synthesized
gtaagttcaatctggaatgtat

SEQ ID NO: 949042 - DNA, 22 bp, Artificial Sequence
  chemically synthesized
acaaatcactagcatatacatt

SEQ ID NO: 949043 - DNA, 22 bp, Artificial Sequence
  chemically synthesized
aacaaatcactagcatatacat

SEQ ID NO: 949044 - DNA, 22 bp, Artificial Sequence
  chemically synthesized
aatctggaatgtatatgctagt

SEQ ID NO: 949045 - DNA, 22 bp, Artificial Sequence
  chemically synthesized
catgtttaacaaatcactagca

SEQ ID NO: 949046 - DNA, 22 bp, Artificial Sequence
  chemically synthesized
acatgtttaacaaatcactagc

SEQ ID NO: 949047 - DNA, 22 bp, Artificial Sequence
  chemically synthesized
tacatgtttaacaaatcactag

SEQ ID NO: 949048 - DNA, 22 bp, Artificial Sequence
  chemically synthesized
gaatgtatatgctagtgatttg

SEQ ID NO: 949049 - DNA, 22 bp, Artificial Sequence
  chemically synthesized
attttacatgtttaacaaatca

SEQ ID NO: 949050 - DNA, 22 bp, Artificial Sequence
  chemically synthesized
aattttacatgtttaacaaatc

SEQ ID NO: 949051 - DNA, 22 bp, Artificial Sequence
  chemically synthesized
taattttacatgtttaacaaat

SEQ ID NO: 949052 - DNA, 22 bp, Artificial Sequence
  chemically synthesized
gtgatttgttaaacatgtaaaa

SEQ ID NO: 949053 - DNA, 22 bp, Artificial Sequence
  chemically synthesized
aaaatcaatactttaattttac

SEQ ID NO: 949054 - DNA, 22 bp, Artificial Sequence
  chemically synthesized
aaaaatcaatactttaatttta

SEQ ID NO: 949055 - DNA, 22 bp, Artificial Sequence
  chemically synthesized
gttaaacatgtaaaattaaagt

SEQ ID NO: 949056 - DNA, 22 bp, Artificial Sequence
  chemically synthesized
ttaaacatgtaaaattaaagta

SEQ ID NO: 949057 - DNA, 22 bp, Artificial Sequence
  chemically synthesized
tatttaaaaatcaatactttaa

SEQ ID NO: 949058 - DNA, 22 bp, Artificial Sequence
  chemically synthesized
aacatgtaaaattaaagtattg

SEQ ID NO: 949059 - DNA, 22 bp, Artificial Sequence
  chemically synthesized
aagtattgatttttaaatataa

SEQ ID NO: 949060 - DNA, 22 bp, Artificial Sequence
  chemically synthesized
taaataaatatatacacattat

SEQ ID NO: 949061 - DNA, 22 bp, Artificial Sequence
  chemically synthesized
atttttaaatataatgtgtata

SEQ ID NO: 949062 - DNA, 22 bp, Artificial Sequence
  chemically synthesized
ttaaatataatgtgtatatatt

SEQ ID NO: 949063 - DNA, 22 bp, Artificial Sequence
  chemically synthesized
taaatataatgtgtatatattt

SEQ ID NO: 949064 - DNA, 22 bp, Artificial Sequence
  chemically synthesized
aaatataatgtgtatatattta

SEQ ID NO: 949065 - DNA, 22 bp, Artificial Sequence
  chemically synthesized
aatataatgtgtatatatttat

SEQ ID NO: 949066 - DNA, 22 bp, Artificial Sequence
  chemically synthesized
tatatcactataaataaatata

SEQ ID NO: 949067 - DNA, 22 bp, Artificial Sequence
  chemically synthesized
ttatatatcactataaataaat

SEQ ID NO: 949068 - DNA, 22 bp, Artificial Sequence
  chemically synthesized
atttatagtgatatataacagt

SEQ ID NO: 949069 - DNA, 22 bp, Artificial Sequence
  chemically synthesized
tttatagtgatatataacagtt

SEQ ID NO: 949070 - DNA, 22 bp, Artificial Sequence
  chemically synthesized
atagtgatatataacagttgta

SEQ ID NO: 949071 - DNA, 22 bp, Artificial Sequence
  chemically synthesized
tagtgatatataacagttgtat

SEQ ID NO: 949072 - DNA, 22 bp, Artificial Sequence
  chemically synthesized
tatgtatatgggggctacatgt

SEQ ID NO: 949073 - DNA, 22 bp, Artificial Sequence
  chemically synthesized
aaaagtatcaaaatatcacatg

SEQ ID NO: 949074 - DNA, 22 bp, Artificial Sequence
  chemically synthesized
agcaatctaaaaagtatcaaaa

SEQ ID NO: 949075 - DNA, 22 bp, Artificial Sequence
  chemically synthesized
catgtgatattttgatactttt

SEQ ID NO: 949076 - DNA, 22 bp, Artificial Sequence
  chemically synthesized
atcattgagcaatctaaaaagt

SEQ ID NO: 949077 - DNA, 22 bp, Artificial Sequence
  chemically synthesized
gatcattgagcaatctaaaaag

SEQ ID NO: 949078 - DNA, 22 bp, Artificial Sequence
  chemically synthesized
atttgatcattgagcaatctaa

SEQ ID NO: 949079 - DNA, 22 bp, Artificial Sequence
  chemically synthesized
tgatactttttagattgctcaa

SEQ ID NO: 949080 - DNA, 22 bp, Artificial Sequence
  chemically synthesized
gatactttttagattgctcaat

SEQ ID NO: 949081 - DNA, 22 bp, Artificial Sequence
  chemically synthesized
atactttttagattgctcaatg

SEQ ID NO: 949082 - DNA, 22 bp, Artificial Sequence
  chemically synthesized
ccctgatttgatcattgagcaa

SEQ ID NO: 949083 - DNA, 22 bp, Artificial Sequence
  chemically synthesized
aattaccctgatttgatcattg

SEQ ID NO: 949084 - DNA, 22 bp, Artificial Sequence
  chemically synthesized
tttagattgctcaatgatcaaa

SEQ ID NO: 949085 - DNA, 22 bp, Artificial Sequence
  chemically synthesized
ttagattgctcaatgatcaaat

SEQ ID NO: 949086 - DNA, 22 bp, Artificial Sequence
  chemically synthesized
tagattgctcaatgatcaaatc

SEQ ID NO: 949087 - DNA, 22 bp, Artificial Sequence
  chemically synthesized
agattgctcaatgatcaaatca

SEQ ID NO: 949088 - DNA, 22 bp, Artificial Sequence
  chemically synthesized
gattgctcaatgatcaaatcag

SEQ ID NO: 949089 - DNA, 22 bp, Artificial Sequence
  chemically synthesized
ctcaatgatcaaatcagggtaa

SEQ ID NO: 949090 - DNA, 22 bp, Artificial Sequence
  chemically synthesized
aatgatcaaatcagggtaattg

SEQ ID NO: 949091 - DNA, 22 bp, Artificial Sequence
  chemically synthesized
caaaataaaaaatcagcatctc

SEQ ID NO: 949092 - DNA, 22 bp, Artificial Sequence
  chemically synthesized
acaaaataaaaaatcagcatct

SEQ ID NO: 949093 - DNA, 22 bp, Artificial Sequence
  chemically synthesized
ttacaaaataaaaaatcagcat

SEQ ID NO: 949094 - DNA, 22 bp, Artificial Sequence
  chemically synthesized
cttacaaaataaaaaatcagca

SEQ ID NO: 949095 - DNA, 22 bp, Artificial Sequence
  chemically synthesized
cttcttacaaaataaaaaatca

SEQ ID NO: 949096 - DNA, 22 bp, Artificial Sequence
  chemically synthesized
ttacttcttacaaaataaaaaa

SEQ ID NO: 949097 - DNA, 22 bp, Artificial Sequence
  chemically synthesized
tgttacttcttacaaaataaaa

SEQ ID NO: 949098 - DNA, 22 bp, Artificial Sequence
  chemically synthesized
agatgctgattttttattttgt

SEQ ID NO: 949099 - DNA, 22 bp, Artificial Sequence
  chemically synthesized
ctgttacttcttacaaaataaa

SEQ ID NO: 949100 - DNA, 22 bp, Artificial Sequence
  chemically synthesized
ccatttctgttacttcttacaa

SEQ ID NO: 949101 - DNA, 22 bp, Artificial Sequence
  chemically synthesized
cccatttctgttacttcttaca

SEQ ID NO: 949102 - DNA, 22 bp, Artificial Sequence
  chemically synthesized
attttttattttgtaagaagta

SEQ ID NO: 949103 - DNA, 22 bp, Artificial Sequence
  chemically synthesized
tcccatttctgttacttcttac

SEQ ID NO: 949104 - DNA, 22 bp, Artificial Sequence
  chemically synthesized
ttcccatttctgttacttctta

SEQ ID NO: 949105 - DNA, 22 bp, Artificial Sequence
  chemically synthesized
ttttcccatttctgttacttct

SEQ ID NO: 949106 - DNA, 22 bp, Artificial Sequence
  chemically synthesized
tttattttgtaagaagtaacag

SEQ ID NO: 949107 - DNA, 22 bp, Artificial Sequence
  chemically synthesized
cttttcccatttctgttacttc

SEQ ID NO: 949108 - DNA, 22 bp, Artificial Sequence
  chemically synthesized
ttattttgtaagaagtaacaga

SEQ ID NO: 949109 - DNA, 22 bp, Artificial Sequence
  chemically synthesized
tattttgtaagaagtaacagaa

SEQ ID NO: 949110 - DNA, 22 bp, Artificial Sequence
  chemically synthesized
attttgtaagaagtaacagaaa

SEQ ID NO: 949111 - DNA, 22 bp, Artificial Sequence
  chemically synthesized
ttttgtaagaagtaacagaaat

SEQ ID NO: 949112 - DNA, 22 bp, Artificial Sequence
  chemically synthesized
tgtaagaagtaacagaaatggg

SEQ ID NO: 949113 - DNA, 22 bp, Artificial Sequence
  chemically synthesized
gtaagaagtaacagaaatggga

SEQ ID NO: 949114 - DNA, 22 bp, Artificial Sequence
  chemically synthesized
taagaagtaacagaaatgggaa

SEQ ID NO: 949115 - DNA, 22 bp, Artificial Sequence
  chemically synthesized
catgtgcttcttttcccatttc

SEQ ID NO: 949116 - DNA, 22 bp, Artificial Sequence
  chemically synthesized
ccatgtgcttcttttcccattt

SEQ ID NO: 949117 - DNA, 22 bp, Artificial Sequence
  chemically synthesized
tccatgtgcttcttttcccatt

SEQ ID NO: 949118 - DNA, 22 bp, Artificial Sequence
  chemically synthesized
agcgctttccatgtgcttcttt

SEQ ID NO: 949119 - DNA, 22 bp, Artificial Sequence
  chemically synthesized
catctaagcgctttccatgtgc

SEQ ID NO: 949120 - DNA, 22 bp, Artificial Sequence
  chemically synthesized
acatctaagcgctttccatgtg

SEQ ID NO: 949121 - DNA, 22 bp, Artificial Sequence
  chemically synthesized
aagtagtttacatctaagcgct

SEQ ID NO: 949122 - DNA, 22 bp, Artificial Sequence
  chemically synthesized
agatgtaaactacttgagtgtc

SEQ ID NO: 949123 - DNA, 22 bp, Artificial Sequence
  chemically synthesized
gatgtaaactacttgagtgtca

SEQ ID NO: 949124 - DNA, 22 bp, Artificial Sequence
  chemically synthesized
acccagaggcagtgacactcaa

SEQ ID NO: 949125 - DNA, 22 bp, Artificial Sequence
  chemically synthesized
ggctaacccagaggcagtgaca

SEQ ID NO: 949126 - DNA, 22 bp, Artificial Sequence
  chemically synthesized
aattgggctaacccagaggcag

SEQ ID NO: 949127 - DNA, 22 bp, Artificial Sequence
  chemically synthesized
cttgagtgtcactgcctctggg

SEQ ID NO: 949128 - DNA, 22 bp, Artificial Sequence
  chemically synthesized
gagtgtcactgcctctgggtta

SEQ ID NO: 949129 - DNA, 22 bp, Artificial Sequence
  chemically synthesized
agtgtcactgcctctgggttag

SEQ ID NO: 949130 - DNA, 22 bp, Artificial Sequence
  chemically synthesized
cctctgggttagcccaatttag

SEQ ID NO: 949131 - DNA, 22 bp, Artificial Sequence
  chemically synthesized
tgtgtagatggcctaaattggg

SEQ ID NO: 949132 - DNA, 22 bp, Artificial Sequence
  chemically synthesized
atgtgtagatggcctaaattgg

SEQ ID NO: 949133 - DNA, 22 bp, Artificial Sequence
  chemically synthesized
tatgtgtagatggcctaaattg

SEQ ID NO: 949134 - DNA, 22 bp, Artificial Sequence
  chemically synthesized
ttatgtgtagatggcctaaatt

SEQ ID NO: 949135 - DNA, 22 bp, Artificial Sequence
  chemically synthesized
tgggttagcccaatttaggcca

SEQ ID NO: 949136 - DNA, 22 bp, Artificial Sequence
  chemically synthesized
ggttagcccaatttaggccatc

SEQ ID NO: 949137 - DNA, 22 bp, Artificial Sequence
  chemically synthesized
gcccaatttaggccatctacac

SEQ ID NO: 949138 - DNA, 22 bp, Artificial Sequence
  chemically synthesized
aggccatctacacataaaagct

SEQ ID NO: 949139 - DNA, 22 bp, Artificial Sequence
  chemically synthesized
ggccatctacacataaaagctc

SEQ ID NO: 949140 - DNA, 22 bp, Artificial Sequence
  chemically synthesized
aaataaccacatcgagctttta

SEQ ID NO: 949141 - DNA, 22 bp, Artificial Sequence
  chemically synthesized
tgaaataaccacatcgagcttt

SEQ ID NO: 949142 - DNA, 22 bp, Artificial Sequence
  chemically synthesized
ctgaaataaccacatcgagctt

SEQ ID NO: 949143 - DNA, 22 bp, Artificial Sequence
  chemically synthesized
tctgaaataaccacatcgagct

SEQ ID NO: 949144 - DNA, 22 bp, Artificial Sequence
  chemically synthesized
ttctgaaataaccacatcgagc

SEQ ID NO: 949145 - DNA, 22 bp, Artificial Sequence
  chemically synthesized
tttctgaaataaccacatcgag

SEQ ID NO: 949146 - DNA, 22 bp, Artificial Sequence
  chemically synthesized
ttttctgaaataaccacatcga

SEQ ID NO: 949147 - DNA, 22 bp, Artificial Sequence
  chemically synthesized
cacataaaagctcgatgtggtt

SEQ ID NO: 949148 - DNA, 22 bp, Artificial Sequence
  chemically synthesized
tttttctgaaataaccacatcg

SEQ ID NO: 949149 - DNA, 22 bp, Artificial Sequence
  chemically synthesized
aattttttttctgaaataacca

SEQ ID NO: 949150 - DNA, 22 bp, Artificial Sequence
  chemically synthesized
aggtctaaattttttttctgaa

SEQ ID NO: 949151 - DNA, 22 bp, Artificial Sequence
  chemically synthesized
gatgtggttatttcagaaaaaa

SEQ ID NO: 949152 - DNA, 22 bp, Artificial Sequence
  chemically synthesized
ttaaggtctaaattttttttct

SEQ ID NO: 949153 - DNA, 22 bp, Artificial Sequence
  chemically synthesized
gttaaggtctaaattttttttc

SEQ ID NO: 949154 - DNA, 22 bp, Artificial Sequence
  chemically synthesized
cttgttaaggtctaaatttttt

SEQ ID NO: 949155 - DNA, 22 bp, Artificial Sequence
  chemically synthesized
tttcagaaaaaaaatttagacc

SEQ ID NO: 949156 - DNA, 22 bp, Artificial Sequence
  chemically synthesized
cagaaaaaaaatttagacctta

SEQ ID NO: 949157 - DNA, 22 bp, Artificial Sequence
  chemically synthesized
agaaaaaaaatttagaccttaa

SEQ ID NO: 949158 - DNA, 22 bp, Artificial Sequence
  chemically synthesized
agaccttaacaagtagggtcct

SEQ ID NO: 949159 - DNA, 22 bp, Artificial Sequence
  chemically synthesized
gaccttaacaagtagggtcctt

SEQ ID NO: 949160 - DNA, 22 bp, Artificial Sequence
  chemically synthesized
aacaagtagggtccttgccctt

SEQ ID NO: 949161 - DNA, 22 bp, Artificial Sequence
  chemically synthesized
acaagtagggtccttgcccttg

SEQ ID NO: 949162 - DNA, 22 bp, Artificial Sequence
  chemically synthesized
aaagcatggggcccaagggcaa

SEQ ID NO: 949163 - DNA, 22 bp, Artificial Sequence
  chemically synthesized
gaaagcatggggcccaagggca

SEQ ID NO: 949164 - DNA, 22 bp, Artificial Sequence
  chemically synthesized
tgaaagcatggggcccaagggc

SEQ ID NO: 949165 - DNA, 22 bp, Artificial Sequence
  chemically synthesized
cctttgaaagcatggggcccaa

SEQ ID NO: 949166 - DNA, 22 bp, Artificial Sequence
  chemically synthesized
gcctttgaaagcatggggccca

SEQ ID NO: 949167 - DNA, 22 bp, Artificial Sequence
  chemically synthesized
tgcctttgaaagcatggggccc

SEQ ID NO: 949168 - DNA, 22 bp, Artificial Sequence
  chemically synthesized
gcccttgggccccatgctttca

SEQ ID NO: 949169 - DNA, 22 bp, Artificial Sequence
  chemically synthesized
cccttgggccccatgctttcaa

SEQ ID NO: 949170 - DNA, 22 bp, Artificial Sequence
  chemically synthesized
atcagagctttgcctttgaaag

SEQ ID NO: 949171 - DNA, 22 bp, Artificial Sequence
  chemically synthesized
gggccccatgctttcaaaggca

SEQ ID NO: 949172 - DNA, 22 bp, Artificial Sequence
  chemically synthesized
ggccccatgctttcaaaggcaa

SEQ ID NO: 949173 - DNA, 22 bp, Artificial Sequence
  chemically synthesized
ctaatcagagctttgcctttga

SEQ ID NO: 949174 - DNA, 22 bp, Artificial Sequence
  chemically synthesized
cagactcctaatcagagctttg

SEQ ID NO: 949175 - DNA, 22 bp, Artificial Sequence
  chemically synthesized
tcaaaggcaaagctctgattag

SEQ ID NO: 949176 - DNA, 22 bp, Artificial Sequence
  chemically synthesized
caaaggcaaagctctgattagg

SEQ ID NO: 949177 - DNA, 22 bp, Artificial Sequence
  chemically synthesized
gtcctacagactcctaatcaga

SEQ ID NO: 949178 - DNA, 22 bp, Artificial Sequence
  chemically synthesized
aaaggcaaagctctgattagga

SEQ ID NO: 949179 - DNA, 22 bp, Artificial Sequence
  chemically synthesized
ggtcctacagactcctaatcag

SEQ ID NO: 949180 - DNA, 22 bp, Artificial Sequence
  chemically synthesized
gcttggtcctacagactcctaa

SEQ ID NO: 949181 - DNA, 22 bp, Artificial Sequence
  chemically synthesized
tgattaggagtctgtaggacca

SEQ ID NO: 949182 - DNA, 22 bp, Artificial Sequence
  chemically synthesized
attaggagtctgtaggaccaag

SEQ ID NO: 949183 - DNA, 22 bp, Artificial Sequence
  chemically synthesized
gtgagcatgttggcttggtcct

SEQ ID NO: 949184 - DNA, 22 bp, Artificial Sequence
  chemically synthesized
tagtgagcatgttggcttggtc

SEQ ID NO: 949185 - DNA, 22 bp, Artificial Sequence
  chemically synthesized
ggagtctgtaggaccaagccaa

SEQ ID NO: 949186 - DNA, 22 bp, Artificial Sequence
  chemically synthesized
ctagtgagcatgttggcttggt

SEQ ID NO: 949187 - DNA, 22 bp, Artificial Sequence
  chemically synthesized
taggaccaagccaacatgctca

SEQ ID NO: 949188 - DNA, 22 bp, Artificial Sequence
  chemically synthesized
aatgccagatcatgggagcggg

SEQ ID NO: 949189 - DNA, 22 bp, Artificial Sequence
  chemically synthesized
tgaatgccagatcatgggagcg

SEQ ID NO: 949190 - DNA, 22 bp, Artificial Sequence
  chemically synthesized
actagaagccccgctcccatga

SEQ ID NO: 949191 - DNA, 22 bp, Artificial Sequence
  chemically synthesized
gaagccccgctcccatgatctg

SEQ ID NO: 949192 - DNA, 22 bp, Artificial Sequence
  chemically synthesized
agggattctgaatgccagatca

SEQ ID NO: 949193 - DNA, 22 bp, Artificial Sequence
  chemically synthesized
ccatgatctggcattcagaatc

SEQ ID NO: 949194 - DNA, 22 bp, Artificial Sequence
  chemically synthesized
cccagggagttgagggattctg

SEQ ID NO: 949195 - DNA, 22 bp, Artificial Sequence
  chemically synthesized
gcccagggagttgagggattct

SEQ ID NO: 949196 - DNA, 22 bp, Artificial Sequence
  chemically synthesized
gcattcagaatccctcaactcc

SEQ ID NO: 949197 - DNA, 22 bp, Artificial Sequence
  chemically synthesized
aaacatttgcccagggagttga

SEQ ID NO: 949198 - DNA, 22 bp, Artificial Sequence
  chemically synthesized
gaaacatttgcccagggagttg

SEQ ID NO: 949199 - DNA, 22 bp, Artificial Sequence
  chemically synthesized
tgaaacatttgcccagggagtt

SEQ ID NO: 949200 - DNA, 22 bp, Artificial Sequence
  chemically synthesized
agaatccctcaactccctgggc

SEQ ID NO: 949201 - DNA, 22 bp, Artificial Sequence
  chemically synthesized
actttgaaacatttgcccaggg

SEQ ID NO: 949202 - DNA, 22 bp, Artificial Sequence
  chemically synthesized
aactccctgggcaaatgtttca

SEQ ID NO: 949203 - DNA, 22 bp, Artificial Sequence
  chemically synthesized
cctgggcaaatgtttcaaagtc

SEQ ID NO: 949204 - DNA, 22 bp, Artificial Sequence
  chemically synthesized
ggcaaatgtttcaaagtcagtt

SEQ ID NO: 949205 - DNA, 22 bp, Artificial Sequence
  chemically synthesized
gccatacccagtaactgacttt

SEQ ID NO: 949206 - DNA, 22 bp, Artificial Sequence
  chemically synthesized
agccatacccagtaactgactt

SEQ ID NO: 949207 - DNA, 22 bp, Artificial Sequence
  chemically synthesized
ccccttagccatacccagtaac

SEQ ID NO: 949208 - DNA, 22 bp, Artificial Sequence
  chemically synthesized
accccttagccatacccagtaa

SEQ ID NO: 949209 - DNA, 22 bp, Artificial Sequence
  chemically synthesized
caaagtcagttactgggtatgg

SEQ ID NO: 949210 - DNA, 22 bp, Artificial Sequence
  chemically synthesized
aaagtcagttactgggtatggc

SEQ ID NO: 949211 - DNA, 22 bp, Artificial Sequence
  chemically synthesized
atgcaaagatttaccccttagc

SEQ ID NO: 949212 - DNA, 22 bp, Artificial Sequence
  chemically synthesized
ctgggtatggctaaggggtaaa

SEQ ID NO: 949213 - DNA, 22 bp, Artificial Sequence
  chemically synthesized
acctcatgcaaagatttacccc

SEQ ID NO: 949214 - DNA, 22 bp, Artificial Sequence
  chemically synthesized
ggtatggctaaggggtaaatct

SEQ ID NO: 949215 - DNA, 22 bp, Artificial Sequence
  chemically synthesized
ccactcacctcatgcaaagatt

SEQ ID NO: 949216 - DNA, 22 bp, Artificial Sequence
  chemically synthesized
cccactcacctcatgcaaagat

SEQ ID NO: 949217 - DNA, 22 bp, Artificial Sequence
  chemically synthesized
tcccactcacctcatgcaaaga

SEQ ID NO: 949218 - DNA, 22 bp, Artificial Sequence
  chemically synthesized
ttcccactcacctcatgcaaag

SEQ ID NO: 949219 - DNA, 22 bp, Artificial Sequence
  chemically synthesized
aggggtaaatctttgcatgagg

SEQ ID NO: 949220 - DNA, 22 bp, Artificial Sequence
  chemically synthesized
aagtttttcccactcacctcat

SEQ ID NO: 949221 - DNA, 22 bp, Artificial Sequence
  chemically synthesized
tgcatgaggtgagtgggaaaaa

SEQ ID NO: 949222 - DNA, 22 bp, Artificial Sequence
  chemically synthesized
gcatgaggtgagtgggaaaaac

SEQ ID NO: 949223 - DNA, 22 bp, Artificial Sequence
  chemically synthesized
catgaggtgagtgggaaaaact

SEQ ID NO: 949224 - DNA, 22 bp, Artificial Sequence
  chemically synthesized
ccacccacatgttcaagttttt

SEQ ID NO: 949225 - DNA, 22 bp, Artificial Sequence
  chemically synthesized
cccacccacatgttcaagtttt

SEQ ID NO: 949226 - DNA, 22 bp, Artificial Sequence
  chemically synthesized
gtcgccccatttcccacccaca

SEQ ID NO: 949227 - DNA, 22 bp, Artificial Sequence
  chemically synthesized
gaacatgtgggtgggaaatggg

SEQ ID NO: 949228 - DNA, 22 bp, Artificial Sequence
  chemically synthesized
aacatgtgggtgggaaatgggg

SEQ ID NO: 949229 - DNA, 22 bp, Artificial Sequence
  chemically synthesized
tgcacatagatctggtcgcccc

SEQ ID NO: 949230 - DNA, 22 bp, Artificial Sequence
  chemically synthesized
tgtgcacatagatctggtcgcc

SEQ ID NO: 949231 - DNA, 22 bp, Artificial Sequence
  chemically synthesized
tgaggaactctgtgcacataga

SEQ ID NO: 949232 - DNA, 22 bp, Artificial Sequence
  chemically synthesized
cactgtgaggaactctgtgcac

SEQ ID NO: 949233 - DNA, 22 bp, Artificial Sequence
  chemically synthesized
catcctgcactgtgaggaactc

SEQ ID NO: 949234 - DNA, 22 bp, Artificial Sequence
  chemically synthesized
ctccatcctgcactgtgaggaa

SEQ ID NO: 949235 - DNA, 22 bp, Artificial Sequence
  chemically synthesized
tgtgcacagagttcctcacagt

SEQ ID NO: 949236 - DNA, 22 bp, Artificial Sequence
  chemically synthesized
actccatcctgcactgtgagga

SEQ ID NO: 949237 - DNA, 22 bp, Artificial Sequence
  chemically synthesized
tactccatcctgcactgtgagg

SEQ ID NO: 949238 - DNA, 22 bp, Artificial Sequence
  chemically synthesized
ctttactccatcctgcactgtg

SEQ ID NO: 949239 - DNA, 22 bp, Artificial Sequence
  chemically synthesized
cctcctttactccatcctgcac

SEQ ID NO: 949240 - DNA, 22 bp, Artificial Sequence
  chemically synthesized
cctacctcctttactccatcct

SEQ ID NO: 949241 - DNA, 22 bp, Artificial Sequence
  chemically synthesized
ccctacctcctttactccatcc

SEQ ID NO: 949242 - DNA, 22 bp, Artificial Sequence
  chemically synthesized
ctcacagtgcaggatggagtaa

SEQ ID NO: 949243 - DNA, 22 bp, Artificial Sequence
  chemically synthesized
tccctacctcctttactccatc

SEQ ID NO: 949244 - DNA, 22 bp, Artificial Sequence
  chemically synthesized
ttccctacctcctttactccat

SEQ ID NO: 949245 - DNA, 22 bp, Artificial Sequence
  chemically synthesized
tttccctacctcctttactcca

SEQ ID NO: 949246 - DNA, 22 bp, Artificial Sequence
  chemically synthesized
acagtgcaggatggagtaaagg

SEQ ID NO: 949247 - DNA, 22 bp, Artificial Sequence
  chemically synthesized
ttttccctacctcctttactcc

SEQ ID NO: 949248 - DNA, 22 bp, Artificial Sequence
  chemically synthesized
ccttttttccctacctccttta

SEQ ID NO: 949249 - DNA, 22 bp, Artificial Sequence
  chemically synthesized
ttgccttttttccctacctcct

SEQ ID NO: 949250 - DNA, 22 bp, Artificial Sequence
  chemically synthesized
tgaatctgttgccttttttccc

SEQ ID NO: 949251 - DNA, 22 bp, Artificial Sequence
  chemically synthesized
ttgtgaatctgttgcctttttt

SEQ ID NO: 949252 - DNA, 22 bp, Artificial Sequence
  chemically synthesized
gctattgtgaatctgttgcctt

SEQ ID NO: 949253 - DNA, 22 bp, Artificial Sequence
  chemically synthesized
agctattgtgaatctgttgcct

SEQ ID NO: 949254 - DNA, 22 bp, Artificial Sequence
  chemically synthesized
catcttagctattgtgaatctg

SEQ ID NO: 949255 - DNA, 22 bp, Artificial Sequence
  chemically synthesized
tgcatcttagctattgtgaatc

SEQ ID NO: 949256 - DNA, 22 bp, Artificial Sequence
  chemically synthesized
ctgcatcttagctattgtgaat

SEQ ID NO: 949257 - DNA, 22 bp, Artificial Sequence
  chemically synthesized
tttctgcatcttagctattgtg

SEQ ID NO: 949258 - DNA, 22 bp, Artificial Sequence
  chemically synthesized
ggttgtttctgcatcttagcta

SEQ ID NO: 949259 - DNA, 22 bp, Artificial Sequence
  chemically synthesized
aggttgtttctgcatcttagct

SEQ ID NO: 949260 - DNA, 22 bp, Artificial Sequence
  chemically synthesized
acaatagctaagatgcagaaac

SEQ ID NO: 949261 - DNA, 22 bp, Artificial Sequence
  chemically synthesized
ccaatgggcatttaggttgttt

SEQ ID NO: 949262 - DNA, 22 bp, Artificial Sequence
  chemically synthesized
agatgcagaaacaacctaaatg

SEQ ID NO: 949263 - DNA, 22 bp, Artificial Sequence
  chemically synthesized
atctgccaatgggcatttaggt

SEQ ID NO: 949264 - DNA, 22 bp, Artificial Sequence
  chemically synthesized
ttcatctgccaatgggcattta

SEQ ID NO: 949265 - DNA, 22 bp, Artificial Sequence
  chemically synthesized
tctattcatctgccaatgggca

SEQ ID NO: 949266 - DNA, 22 bp, Artificial Sequence
  chemically synthesized
atctattcatctgccaatgggc

SEQ ID NO: 949267 - DNA, 22 bp, Artificial Sequence
  chemically synthesized
aatgcccattggcagatgaata

SEQ ID NO: 949268 - DNA, 22 bp, Artificial Sequence
  chemically synthesized
tgtatatataccacatttatct

SEQ ID NO: 949269 - DNA, 22 bp, Artificial Sequence
  chemically synthesized
gcagatgaatagataaatgtgg

SEQ ID NO: 949270 - DNA, 22 bp, Artificial Sequence
  chemically synthesized
cattgtgtatatataccacatt

SEQ ID NO: 949271 - DNA, 22 bp, Artificial Sequence
  chemically synthesized
aatagtattccattgtgtatat

SEQ ID NO: 949272 - DNA, 22 bp, Artificial Sequence
  chemically synthesized
taaaggctgaatagtattccat

SEQ ID NO: 949273 - DNA, 22 bp, Artificial Sequence
  chemically synthesized
ataaaggctgaatagtattcca

SEQ ID NO: 949274 - DNA, 22 bp, Artificial Sequence
  chemically synthesized
tataaaggctgaatagtattcc

SEQ ID NO: 949275 - DNA, 22 bp, Artificial Sequence
  chemically synthesized
ttataaaggctgaatagtattc

SEQ ID NO: 949276 - DNA, 22 bp, Artificial Sequence
  chemically synthesized
cttttataaaggctgaatagta

SEQ ID NO: 949277 - DNA, 22 bp, Artificial Sequence
  chemically synthesized
ccttttataaaggctgaatagt

SEQ ID NO: 949278 - DNA, 22 bp, Artificial Sequence
  chemically synthesized
cagaatttccttttataaaggc

SEQ ID NO: 949279 - DNA, 22 bp, Artificial Sequence
  chemically synthesized
atattgcagaatttccttttat

SEQ ID NO: 949280 - DNA, 22 bp, Artificial Sequence
  chemically synthesized
catattgcagaatttcctttta

SEQ ID NO: 949281 - DNA, 22 bp, Artificial Sequence
  chemically synthesized
ttcagcctttataaaaggaaat

SEQ ID NO: 949282 - DNA, 22 bp, Artificial Sequence
  chemically synthesized
tttcatattgcagaatttcctt

SEQ ID NO: 949283 - DNA, 22 bp, Artificial Sequence
  chemically synthesized
agcctttataaaaggaaattct

SEQ ID NO: 949284 - DNA, 22 bp, Artificial Sequence
  chemically synthesized
tataaaaggaaattctgcaata

SEQ ID NO: 949285 - DNA, 22 bp, Artificial Sequence
  chemically synthesized
ataaaaggaaattctgcaatat

SEQ ID NO: 949286 - DNA, 22 bp, Artificial Sequence
  chemically synthesized
taaaaggaaattctgcaatatg

SEQ ID NO: 949287 - DNA, 22 bp, Artificial Sequence
  chemically synthesized
aggtccatccatattgtttcat

SEQ ID NO: 949288 - DNA, 22 bp, Artificial Sequence
  chemically synthesized
aaggtccatccatattgtttca

SEQ ID NO: 949289 - DNA, 22 bp, Artificial Sequence
  chemically synthesized
tgcaatatgaaacaatatggat

SEQ ID NO: 949290 - DNA, 22 bp, Artificial Sequence
  chemically synthesized
caatatgaaacaatatggatgg

SEQ ID NO: 949291 - DNA, 22 bp, Artificial Sequence
  chemically synthesized
gcgtaatcttaaggtccatcca

SEQ ID NO: 949292 - DNA, 22 bp, Artificial Sequence
  chemically synthesized
agcgtaatcttaaggtccatcc

SEQ ID NO: 949293 - DNA, 22 bp, Artificial Sequence
  chemically synthesized
acttagcgtaatcttaaggtcc

SEQ ID NO: 949294 - DNA, 22 bp, Artificial Sequence
  chemically synthesized
cacttagcgtaatcttaaggtc

SEQ ID NO: 949295 - DNA, 22 bp, Artificial Sequence
  chemically synthesized
tttcacttagcgtaatcttaag

SEQ ID NO: 949296 - DNA, 22 bp, Artificial Sequence
  chemically synthesized
gtttcacttagcgtaatcttaa

SEQ ID NO: 949297 - DNA, 22 bp, Artificial Sequence
  chemically synthesized
tcttgtttcacttagcgtaatc

SEQ ID NO: 949298 - DNA, 22 bp, Artificial Sequence
  chemically synthesized
tgtctgtcttgtttcacttagc

SEQ ID NO: 949299 - DNA, 22 bp, Artificial Sequence
  chemically synthesized
aagattacgctaagtgaaacaa

SEQ ID NO: 949300 - DNA, 22 bp, Artificial Sequence
  chemically synthesized
tctgtgtctgtcttgtttcact

SEQ ID NO: 949301 - DNA, 22 bp, Artificial Sequence
  chemically synthesized
agattacgctaagtgaaacaag

SEQ ID NO: 949302 - DNA, 22 bp, Artificial Sequence
  chemically synthesized
gtctgtgtctgtcttgtttcac

SEQ ID NO: 949303 - DNA, 22 bp, Artificial Sequence
  chemically synthesized
cgctaagtgaaacaagacagac

SEQ ID NO: 949304 - DNA, 22 bp, Artificial Sequence
  chemically synthesized
agtgaaacaagacagacacaga

SEQ ID NO: 949305 - DNA, 22 bp, Artificial Sequence
  chemically synthesized
aagtaagtggaatcatgcagta

SEQ ID NO: 949306 - DNA, 22 bp, Artificial Sequence
  chemically synthesized
caagtaagtggaatcatgcagt

SEQ ID NO: 949307 - DNA, 22 bp, Artificial Sequence
  chemically synthesized
tttcaagtaagtggaatcatgc

SEQ ID NO: 949308 - DNA, 22 bp, Artificial Sequence
  chemically synthesized
atttcaagtaagtggaatcatg

SEQ ID NO: 949309 - DNA, 22 bp, Artificial Sequence
  chemically synthesized
gataccttatttcaagtaagtg

SEQ ID NO: 949310 - DNA, 22 bp, Artificial Sequence
  chemically synthesized
agataccttatttcaagtaagt

SEQ ID NO: 949311 - DNA, 22 bp, Artificial Sequence
  chemically synthesized
tagataccttatttcaagtaag

SEQ ID NO: 949312 - DNA, 22 bp, Artificial Sequence
  chemically synthesized
catgattccacttacttgaaat

SEQ ID NO: 949313 - DNA, 22 bp, Artificial Sequence
  chemically synthesized
ttttagataccttatttcaagt

SEQ ID NO: 949314 - DNA, 22 bp, Artificial Sequence
  chemically synthesized
actgttttagataccttatttc

SEQ ID NO: 949315 - DNA, 22 bp, Artificial Sequence
  chemically synthesized
gactgttttagataccttattt

SEQ ID NO: 949316 - DNA, 22 bp, Artificial Sequence
  chemically synthesized
cacttacttgaaataaggtatc

SEQ ID NO: 949317 - DNA, 22 bp, Artificial Sequence
  chemically synthesized
acttgaaataaggtatctaaaa

SEQ ID NO: 949318 - DNA, 22 bp, Artificial Sequence
  chemically synthesized
tgagtttgactgttttagatac

SEQ ID NO: 949319 - DNA, 22 bp, Artificial Sequence
  chemically synthesized
cttgaaataaggtatctaaaac

SEQ ID NO: 949320 - DNA, 22 bp, Artificial Sequence
  chemically synthesized
atgagtttgactgttttagata

SEQ ID NO: 949321 - DNA, 22 bp, Artificial Sequence
  chemically synthesized
tatgagtttgactgttttagat

SEQ ID NO: 949322 - DNA, 22 bp, Artificial Sequence
  chemically synthesized
gaaataaggtatctaaaacagt

SEQ ID NO: 949323 - DNA, 22 bp, Artificial Sequence
  chemically synthesized
aaataaggtatctaaaacagtc

SEQ ID NO: 949324 - DNA, 22 bp, Artificial Sequence
  chemically synthesized
attttatgagtttgactgtttt

SEQ ID NO: 949325 - DNA, 22 bp, Artificial Sequence
  chemically synthesized
gattttatgagtttgactgttt

SEQ ID NO: 949326 - DNA, 22 bp, Artificial Sequence
  chemically synthesized
tgattttatgagtttgactgtt

SEQ ID NO: 949327 - DNA, 22 bp, Artificial Sequence
  chemically synthesized
aaacagtcaaactcataaaatc

SEQ ID NO: 949328 - DNA, 22 bp, Artificial Sequence
  chemically synthesized
gcaaccaccagtccagtctttg

SEQ ID NO: 949329 - DNA, 22 bp, Artificial Sequence
  chemically synthesized
ataaaatcaaagactggactgg

SEQ ID NO: 949330 - DNA, 22 bp, Artificial Sequence
  chemically synthesized
tccccagcccctggcaaccacc

SEQ ID NO: 949331 - DNA, 22 bp, Artificial Sequence
  chemically synthesized
gccctatccccagcccctggca

SEQ ID NO: 949332 - DNA, 22 bp, Artificial Sequence
  chemically synthesized
cgccctatccccagcccctggc

SEQ ID NO: 949333 - DNA, 22 bp, Artificial Sequence
  chemically synthesized
gactggtggttgccaggggctg

SEQ ID NO: 949334 - DNA, 22 bp, Artificial Sequence
  chemically synthesized
tttcgccctatccccagcccct

SEQ ID NO: 949335 - DNA, 22 bp, Artificial Sequence
  chemically synthesized
gtggttgccaggggctggggat

SEQ ID NO: 949336 - DNA, 22 bp, Artificial Sequence
  chemically synthesized
ctatttcgccctatccccagcc

SEQ ID NO: 949337 - DNA, 22 bp, Artificial Sequence
  chemically synthesized
cctatttcgccctatccccagc

SEQ ID NO: 949338 - DNA, 22 bp, Artificial Sequence
  chemically synthesized
ccaggggctggggatagggcga

SEQ ID NO: 949339 - DNA, 22 bp, Artificial Sequence
  chemically synthesized
gtaacttcctatttcgccctat

SEQ ID NO: 949340 - DNA, 22 bp, Artificial Sequence
  chemically synthesized
attagtaacttcctatttcgcc

SEQ ID NO: 949341 - DNA, 22 bp, Artificial Sequence
  chemically synthesized
ttgattagtaacttcctatttc

SEQ ID NO: 949342 - DNA, 22 bp, Artificial Sequence
  chemically synthesized
gggatagggcgaaataggaagt

SEQ ID NO: 949343 - DNA, 22 bp, Artificial Sequence
  chemically synthesized
aaatgtaatgtctgttgattag

SEQ ID NO: 949344 - DNA, 22 bp, Artificial Sequence
  chemically synthesized
actgaaatgtaatgtctgttga

SEQ ID NO: 949345 - DNA, 22 bp, Artificial Sequence
  chemically synthesized
aactgaaatgtaatgtctgttg

SEQ ID NO: 949346 - DNA, 22 bp, Artificial Sequence
  chemically synthesized
cttaactgaaatgtaatgtctg

SEQ ID NO: 949347 - DNA, 22 bp, Artificial Sequence
  chemically synthesized
ctaatcaacagacattacattt

SEQ ID NO: 949348 - DNA, 22 bp, Artificial Sequence
  chemically synthesized
atcctacttaactgaaatgtaa

SEQ ID NO: 949349 - DNA, 22 bp, Artificial Sequence
  chemically synthesized
atcaacagacattacatttcag

SEQ ID NO: 949350 - DNA, 22 bp, Artificial Sequence
  chemically synthesized
attcatcctacttaactgaaat

SEQ ID NO: 949351 - DNA, 22 bp, Artificial Sequence
  chemically synthesized
gagctaattcatcctacttaac

SEQ ID NO: 949352 - DNA, 22 bp, Artificial Sequence
  chemically synthesized
tagagctaattcatcctactta

SEQ ID NO: 949353 - DNA, 22 bp, Artificial Sequence
  chemically synthesized
catttcagttaagtaggatgaa

SEQ ID NO: 949354 - DNA, 22 bp, Artificial Sequence
  chemically synthesized
cagttaagtaggatgaattagc

SEQ ID NO: 949355 - DNA, 22 bp, Artificial Sequence
  chemically synthesized
agttaagtaggatgaattagct

SEQ ID NO: 949356 - DNA, 22 bp, Artificial Sequence
  chemically synthesized
gacagcagatctctagagctaa

SEQ ID NO: 949357 - DNA, 22 bp, Artificial Sequence
  chemically synthesized
agtaggatgaattagctctaga

SEQ ID NO: 949358 - DNA, 22 bp, Artificial Sequence
  chemically synthesized
ggtagaatgttggacagcagat

SEQ ID NO: 949359 - DNA, 22 bp, Artificial Sequence
  chemically synthesized
taggtagaatgttggacagcag

SEQ ID NO: 949360 - DNA, 22 bp, Artificial Sequence
  chemically synthesized
gctctagagatctgctgtccaa

SEQ ID NO: 949361 - DNA, 22 bp, Artificial Sequence
  chemically synthesized
actctaggtagaatgttggaca

SEQ ID NO: 949362 - DNA, 22 bp, Artificial Sequence
  chemically synthesized
tagagatctgctgtccaacatt

SEQ ID NO: 949363 - DNA, 22 bp, Artificial Sequence
  chemically synthesized
gagatctgctgtccaacattct

SEQ ID NO: 949364 - DNA, 22 bp, Artificial Sequence
  chemically synthesized
ttgactctaggtagaatgttgg

SEQ ID NO: 949365 - DNA, 22 bp, Artificial Sequence
  chemically synthesized
ttattgactctaggtagaatgt

SEQ ID NO: 949366 - DNA, 22 bp, Artificial Sequence
  chemically synthesized
ctgtccaacattctacctagag

SEQ ID NO: 949367 - DNA, 22 bp, Artificial Sequence
  chemically synthesized
tccaacattctacctagagtca

SEQ ID NO: 949368 - DNA, 22 bp, Artificial Sequence
  chemically synthesized
catgcacaatacattattattg

SEQ ID NO: 949369 - DNA, 22 bp, Artificial Sequence
  chemically synthesized
tacctagagtcaataataatgt

SEQ ID NO: 949370 - DNA, 22 bp, Artificial Sequence
  chemically synthesized
cctagagtcaataataatgtat

SEQ ID NO: 949371 - DNA, 22 bp, Artificial Sequence
  chemically synthesized
gagtcaataataatgtattgtg

SEQ ID NO: 949372 - DNA, 22 bp, Artificial Sequence
  chemically synthesized
ataaatactacatgcacaatac

SEQ ID NO: 949373 - DNA, 22 bp, Artificial Sequence
  chemically synthesized
aataaatactacatgcacaata

SEQ ID NO: 949374 - DNA, 22 bp, Artificial Sequence
  chemically synthesized
tcatcttaataaatactacatg

SEQ ID NO: 949375 - DNA, 22 bp, Artificial Sequence
  chemically synthesized
tgcatgtagtatttattaagat

SEQ ID NO: 949376 - DNA, 22 bp, Artificial Sequence
  chemically synthesized
acatgagatctatcatcttaat

SEQ ID NO: 949377 - DNA, 22 bp, Artificial Sequence
  chemically synthesized
aacatgagatctatcatcttaa

SEQ ID NO: 949378 - DNA, 22 bp, Artificial Sequence
  chemically synthesized
atgacatttaacatgagatcta

SEQ ID NO: 949379 - DNA, 22 bp, Artificial Sequence
  chemically synthesized
attaagatgatagatctcatgt

SEQ ID NO: 949380 - DNA, 22 bp, Artificial Sequence
  chemically synthesized
ttaagatgatagatctcatgtt

SEQ ID NO: 949381 - DNA, 22 bp, Artificial Sequence
  chemically synthesized
tgttaatgacatttaacatgag

SEQ ID NO: 949382 - DNA, 22 bp, Artificial Sequence
  chemically synthesized
agatgatagatctcatgttaaa

SEQ ID NO: 949383 - DNA, 22 bp, Artificial Sequence
  chemically synthesized
ctgtgttaatgacatttaacat

SEQ ID NO: 949384 - DNA, 22 bp, Artificial Sequence
  chemically synthesized
actgtgttaatgacatttaaca

SEQ ID NO: 949385 - DNA, 22 bp, Artificial Sequence
  chemically synthesized
tactgtgttaatgacatttaac

SEQ ID NO: 949386 - DNA, 22 bp, Artificial Sequence
  chemically synthesized
atgttaaatgtcattaacacag

SEQ ID NO: 949387 - DNA, 22 bp, Artificial Sequence
  chemically synthesized
aaaaaaattttactgtgttaat

SEQ ID NO: 949388 - DNA, 22 bp, Artificial Sequence
  chemically synthesized
aaaaaaaattttactgtgttaa

SEQ ID NO: 949389 - DNA, 22 bp, Artificial Sequence
  chemically synthesized
aatgtcattaacacagtaaaat

SEQ ID NO: 949390 - DNA, 22 bp, Artificial Sequence
  chemically synthesized
agcttaaaaaaaattttactgt

SEQ ID NO: 949391 - DNA, 22 bp, Artificial Sequence
  chemically synthesized
aagcttaaaaaaaattttactg

SEQ ID NO: 949392 - DNA, 22 bp, Artificial Sequence
  chemically synthesized
ttaagcttaaaaaaaattttac

SEQ ID NO: 949393 - DNA, 22 bp, Artificial Sequence
  chemically synthesized
cttaagcttaaaaaaaatttta

SEQ ID NO: 949394 - DNA, 22 bp, Artificial Sequence
  chemically synthesized
tcttaagcttaaaaaaaatttt

SEQ ID NO: 949395 - DNA, 22 bp, Artificial Sequence
  chemically synthesized
ttcttaagcttaaaaaaaattt

SEQ ID NO: 949396 - DNA, 22 bp, Artificial Sequence
  chemically synthesized
acacagtaaaattttttttaag

SEQ ID NO: 949397 - DNA, 22 bp, Artificial Sequence
  chemically synthesized
gcttttcttaagcttaaaaaaa

SEQ ID NO: 949398 - DNA, 22 bp, Artificial Sequence
  chemically synthesized
ggatacattggcttttcttaag

SEQ ID NO: 949399 - DNA, 22 bp, Artificial Sequence
  chemically synthesized
aggatacattggcttttcttaa

SEQ ID NO: 949400 - DNA, 22 bp, Artificial Sequence
  chemically synthesized
tttttaagcttaagaaaagcca

SEQ ID NO: 949401 - DNA, 22 bp, Artificial Sequence
  chemically synthesized
tttaggatacattggcttttct

SEQ ID NO: 949402 - DNA, 22 bp, Artificial Sequence
  chemically synthesized
ttttaagcttaagaaaagccaa

SEQ ID NO: 949403 - DNA, 22 bp, Artificial Sequence
  chemically synthesized
tttaagcttaagaaaagccaat

SEQ ID NO: 949404 - DNA, 22 bp, Artificial Sequence
  chemically synthesized
ttaagcttaagaaaagccaatg

SEQ ID NO: 949405 - DNA, 22 bp, Artificial Sequence
  chemically synthesized
ttatttaggatacattggcttt

SEQ ID NO: 949406 - DNA, 22 bp, Artificial Sequence
  chemically synthesized
taagcttaagaaaagccaatgt

SEQ ID NO: 949407 - DNA, 22 bp, Artificial Sequence
  chemically synthesized
aagcttaagaaaagccaatgta

SEQ ID NO: 949408 - DNA, 22 bp, Artificial Sequence
  chemically synthesized
agcttaagaaaagccaatgtat

SEQ ID NO: 949409 - DNA, 22 bp, Artificial Sequence
  chemically synthesized
agcctgttatttaggatacatt

SEQ ID NO: 949410 - DNA, 22 bp, Artificial Sequence
  chemically synthesized
aagaaaagccaatgtatcctaa

SEQ ID NO: 949411 - DNA, 22 bp, Artificial Sequence
  chemically synthesized
agaaaagccaatgtatcctaaa

SEQ ID NO: 949412 - DNA, 22 bp, Artificial Sequence
  chemically synthesized
accctaagcctgttatttagga

SEQ ID NO: 949413 - DNA, 22 bp, Artificial Sequence
  chemically synthesized
gagctaaccctaagcctgttat

SEQ ID NO: 949414 - DNA, 22 bp, Artificial Sequence
  chemically synthesized
gttagagctaaccctaagcctg

SEQ ID NO: 949415 - DNA, 22 bp, Artificial Sequence
  chemically synthesized
ggttagagctaaccctaagcct

SEQ ID NO: 949416 - DNA, 22 bp, Artificial Sequence
  chemically synthesized
aataacaggcttagggttagct

SEQ ID NO: 949417 - DNA, 22 bp, Artificial Sequence
  chemically synthesized
gaatgaggcagcttggttagag

SEQ ID NO: 949418 - DNA, 22 bp, Artificial Sequence
  chemically synthesized
agggttagctctaaccaagctg

SEQ ID NO: 949419 - DNA, 22 bp, Artificial Sequence
  chemically synthesized
gggttagctctaaccaagctgc

SEQ ID NO: 949420 - DNA, 22 bp, Artificial Sequence
  chemically synthesized
tactggaatgaggcagcttggt

SEQ ID NO: 949421 - DNA, 22 bp, Artificial Sequence
  chemically synthesized
gtactggaatgaggcagcttgg

SEQ ID NO: 949422 - DNA, 22 bp, Artificial Sequence
  chemically synthesized
tgtactggaatgaggcagcttg

SEQ ID NO: 949423 - DNA, 22 bp, Artificial Sequence
  chemically synthesized
gctctaaccaagctgcctcatt

SEQ ID NO: 949424 - DNA, 22 bp, Artificial Sequence
  chemically synthesized
gagttttgtactggaatgaggc

SEQ ID NO: 949425 - DNA, 22 bp, Artificial Sequence
  chemically synthesized
agagttttgtactggaatgagg

SEQ ID NO: 949426 - DNA, 22 bp, Artificial Sequence
  chemically synthesized
taaccaagctgcctcattccag

SEQ ID NO: 949427 - DNA, 22 bp, Artificial Sequence
  chemically synthesized
accaagctgcctcattccagta

SEQ ID NO: 949428 - DNA, 22 bp, Artificial Sequence
  chemically synthesized
cttagagttttgtactggaatg

SEQ ID NO: 949429 - DNA, 22 bp, Artificial Sequence
  chemically synthesized
cctcattccagtacaaaactct

SEQ ID NO: 949430 - DNA, 22 bp, Artificial Sequence
  chemically synthesized
attccagtacaaaactctaagg

SEQ ID NO: 949431 - DNA, 22 bp, Artificial Sequence
  chemically synthesized
cagtacaaaactctaaggaatt

SEQ ID NO: 949432 - DNA, 22 bp, Artificial Sequence
  chemically synthesized
atacaataaaataaattcctta

SEQ ID NO: 949433 - DNA, 22 bp, Artificial Sequence
  chemically synthesized
gatacaataaaataaattcctt

SEQ ID NO: 949434 - DNA, 22 bp, Artificial Sequence
  chemically synthesized
taaggaatttattttattgtat

SEQ ID NO: 949435 - DNA, 22 bp, Artificial Sequence
  chemically synthesized
aggaatttattttattgtatca

SEQ ID NO: 949436 - DNA, 22 bp, Artificial Sequence
  chemically synthesized
aaatagcaaaccacttgataca

SEQ ID NO: 949437 - DNA, 22 bp, Artificial Sequence
  chemically synthesized
attttattgtatcaagtggttt

SEQ ID NO: 949438 - DNA, 22 bp, Artificial Sequence
  chemically synthesized
ttttattgtatcaagtggtttg

SEQ ID NO: 949439 - DNA, 22 bp, Artificial Sequence
  chemically synthesized
tattgtatcaagtggtttgcta

SEQ ID NO: 949440 - DNA, 22 bp, Artificial Sequence
  chemically synthesized
attgtatcaagtggtttgctat

SEQ ID NO: 949441 - DNA, 22 bp, Artificial Sequence
  chemically synthesized
gaaaaaactcaaatagcaaacc

SEQ ID NO: 949442 - DNA, 22 bp, Artificial Sequence
  chemically synthesized
ttgtatcaagtggtttgctatt

SEQ ID NO: 949443 - DNA, 22 bp, Artificial Sequence
  chemically synthesized
ggaaaaaactcaaatagcaaac

SEQ ID NO: 949444 - DNA, 22 bp, Artificial Sequence
  chemically synthesized
tatcaagtggtttgctatttga

SEQ ID NO: 949445 - DNA, 22 bp, Artificial Sequence
  chemically synthesized
gcaaggaatttggaaaaaactc

SEQ ID NO: 949446 - DNA, 22 bp, Artificial Sequence
  chemically synthesized
cctggcaaggaatttggaaaaa

SEQ ID NO: 949447 - DNA, 22 bp, Artificial Sequence
  chemically synthesized
gctatttgagttttttccaaat

SEQ ID NO: 949448 - DNA, 22 bp, Artificial Sequence
  chemically synthesized
ctatttgagttttttccaaatt

SEQ ID NO: 949449 - DNA, 22 bp, Artificial Sequence
  chemically synthesized
ttccctggcaaggaatttggaa

SEQ ID NO: 949450 - DNA, 22 bp, Artificial Sequence
  chemically synthesized
attccctggcaaggaatttgga

SEQ ID NO: 949451 - DNA, 22 bp, Artificial Sequence
  chemically synthesized
tttgagttttttccaaattcct

SEQ ID NO: 949452 - DNA, 22 bp, Artificial Sequence
  chemically synthesized
gagttttttccaaattccttgc

SEQ ID NO: 949453 - DNA, 22 bp, Artificial Sequence
  chemically synthesized
agttttttccaaattccttgcc

SEQ ID NO: 949454 - DNA, 22 bp, Artificial Sequence
  chemically synthesized
tttccaaattccttgccaggga

SEQ ID NO: 949455 - DNA, 22 bp, Artificial Sequence
  chemically synthesized
ttccaaattccttgccagggaa

SEQ ID NO: 949456 - DNA, 22 bp, Artificial Sequence
  chemically synthesized
tccaaattccttgccagggaat

SEQ ID NO: 949457 - DNA, 22 bp, Artificial Sequence
  chemically synthesized
ccaaattccttgccagggaata

SEQ ID NO: 949458 - DNA, 22 bp, Artificial Sequence
  chemically synthesized
caaattccttgccagggaataa

SEQ ID NO: 949459 - DNA, 22 bp, Artificial Sequence
  chemically synthesized
aatagtgcaagcagtttattcc

SEQ ID NO: 949460 - DNA, 22 bp, Artificial Sequence
  chemically synthesized
aaatagtgcaagcagtttattc

SEQ ID NO: 949461 - DNA, 22 bp, Artificial Sequence
  chemically synthesized
taaatagtgcaagcagtttatt

SEQ ID NO: 949462 - DNA, 22 bp, Artificial Sequence
  chemically synthesized
ttaaatagtgcaagcagtttat

SEQ ID NO: 949463 - DNA, 22 bp, Artificial Sequence
  chemically synthesized
cttgccagggaataaactgctt

SEQ ID NO: 949464 - DNA, 22 bp, Artificial Sequence
  chemically synthesized
tttaaatagtgcaagcagttta

SEQ ID NO: 949465 - DNA, 22 bp, Artificial Sequence
  chemically synthesized
ttttaaatagtgcaagcagttt

SEQ ID NO: 949466 - DNA, 22 bp, Artificial Sequence
  chemically synthesized
gccagggaataaactgcttgca

SEQ ID NO: 949467 - DNA, 22 bp, Artificial Sequence
  chemically synthesized
ccagggaataaactgcttgcac

SEQ ID NO: 949468 - DNA, 22 bp, Artificial Sequence
  chemically synthesized
tttttttaaatagtgcaagcag

SEQ ID NO: 949469 - DNA, 22 bp, Artificial Sequence
  chemically synthesized
gtttttttaaatagtgcaagca

SEQ ID NO: 949470 - DNA, 22 bp, Artificial Sequence
  chemically synthesized
tcttgtttttttaaatagtgca

SEQ ID NO: 949471 - DNA, 22 bp, Artificial Sequence
  chemically synthesized
tctgtcttgtttttttaaatag

SEQ ID NO: 949472 - DNA, 22 bp, Artificial Sequence
  chemically synthesized
tctgtctgtcttgtttttttaa

SEQ ID NO: 949473 - DNA, 22 bp, Artificial Sequence
  chemically synthesized
cttgcactatttaaaaaaacaa

SEQ ID NO: 949474 - DNA, 22 bp, Artificial Sequence
  chemically synthesized
tctgtctgtctgtcttgttttt

SEQ ID NO: 949475 - DNA, 22 bp, Artificial Sequence
  chemically synthesized
gcactatttaaaaaaacaagac

SEQ ID NO: 949476 - DNA, 22 bp, Artificial Sequence
  chemically synthesized
cactatttaaaaaaacaagaca

SEQ ID NO: 949477 - DNA, 22 bp, Artificial Sequence
  chemically synthesized
tgtctgtctgtctgtcttgttt

SEQ ID NO: 949478 - DNA, 22 bp, Artificial Sequence
  chemically synthesized
ctgtctgtctgtctgtcttgtt

SEQ ID NO: 949479 - DNA, 22 bp, Artificial Sequence
  chemically synthesized
tctgtctgtctgtctgtcttgt

SEQ ID NO: 949480 - DNA, 22 bp, Artificial Sequence
  chemically synthesized
tttctgtctgtctgtctgtctt

SEQ ID NO: 949481 - DNA, 22 bp, Artificial Sequence
  chemically synthesized
tttaaaaaaacaagacagacag

SEQ ID NO: 949482 - DNA, 22 bp, Artificial Sequence
  chemically synthesized
ctttctgtctgtctgtctgtct

SEQ ID NO: 949483 - DNA, 22 bp, Artificial Sequence
  chemically synthesized
tctttctgtctgtctgtctgtc

SEQ ID NO: 949484 - DNA, 22 bp, Artificial Sequence
  chemically synthesized
aaaaaaacaagacagacagaca

SEQ ID NO: 949485 - DNA, 22 bp, Artificial Sequence
  chemically synthesized
tttctttctgtctgtctgtctg

SEQ ID NO: 949486 - DNA, 22 bp, Artificial Sequence
  chemically synthesized
aaaaaacaagacagacagacag

SEQ ID NO: 949487 - DNA, 22 bp, Artificial Sequence
  chemically synthesized
ctttctttctgtctgtctgtct

SEQ ID NO: 949488 - DNA, 22 bp, Artificial Sequence
  chemically synthesized
tctttctttctgtctgtctgtc

SEQ ID NO: 949489 - DNA, 22 bp, Artificial Sequence
  chemically synthesized
tttctttctttctgtctgtctg

SEQ ID NO: 949490 - DNA, 22 bp, Artificial Sequence
  chemically synthesized
ctttctttctttctgtctgtct

SEQ ID NO: 949491 - DNA, 22 bp, Artificial Sequence
  chemically synthesized
tctttctttctttctgtctgtc

SEQ ID NO: 949492 - DNA, 22 bp, Artificial Sequence
  chemically synthesized
tttctttctttctttctgtctg

SEQ ID NO: 949493 - DNA, 22 bp, Artificial Sequence
  chemically synthesized
ctttctttctttctttctgtct

SEQ ID NO: 949494 - DNA, 22 bp, Artificial Sequence
  chemically synthesized
tctttctttctttctttctgtc

SEQ ID NO: 949495 - DNA, 22 bp, Artificial Sequence
  chemically synthesized
tttctttctttctttctttctg

SEQ ID NO: 949496 - DNA, 22 bp, Artificial Sequence
  chemically synthesized
ctttctttctttctttctttct

SEQ ID NO: 949497 - DNA, 22 bp, Artificial Sequence
  chemically synthesized
tctttctttctttctttctttc

SEQ ID NO: 949498 - DNA, 22 bp, Artificial Sequence
  chemically synthesized
tttctttctttctttctttctt

SEQ ID NO: 949499 - DNA, 22 bp, Artificial Sequence
  chemically synthesized
ctttctttctttctttctttct

SEQ ID NO: 949500 - DNA, 22 bp, Artificial Sequence
  chemically synthesized
tctttctttctttctttctttc

SEQ ID NO: 949501 - DNA, 22 bp, Artificial Sequence
  chemically synthesized
tttctttctttctttctttctt

SEQ ID NO: 949502 - DNA, 22 bp, Artificial Sequence
  chemically synthesized
ctttctttctttctttctttct

SEQ ID NO: 949503 - DNA, 22 bp, Artificial Sequence
  chemically synthesized
tctttctttctttctttctttc

SEQ ID NO: 949504 - DNA, 22 bp, Artificial Sequence
  chemically synthesized
tttctttctttctttctttctt

SEQ ID NO: 949505 - DNA, 22 bp, Artificial Sequence
  chemically synthesized
ctttctttctttctttctttct

SEQ ID NO: 949506 - DNA, 22 bp, Artificial Sequence
  chemically synthesized
tctttctttctttctttctttc

SEQ ID NO: 949507 - DNA, 22 bp, Artificial Sequence
  chemically synthesized
tttctttctttctttctttctt

SEQ ID NO: 949508 - DNA, 22 bp, Artificial Sequence
  chemically synthesized
ctttctttctttctttctttct

SEQ ID NO: 949509 - DNA, 22 bp, Artificial Sequence
  chemically synthesized
tctttctttctttctttctttc

SEQ ID NO: 949510 - DNA, 22 bp, Artificial Sequence
  chemically synthesized
tttctttctttctttctttctt

SEQ ID NO: 949511 - DNA, 22 bp, Artificial Sequence
  chemically synthesized
ctttctttctttctttctttct

SEQ ID NO: 949512 - DNA, 22 bp, Artificial Sequence
  chemically synthesized
tctttctttctttctttctttc

SEQ ID NO: 949513 - DNA, 22 bp, Artificial Sequence
  chemically synthesized
tttctttctttctttctttctt

SEQ ID NO: 949514 - DNA, 22 bp, Artificial Sequence
  chemically synthesized
ctttctttctttctttctttct

SEQ ID NO: 949515 - DNA, 22 bp, Artificial Sequence
  chemically synthesized
tctttctttctttctttctttc

SEQ ID NO: 949516 - DNA, 22 bp, Artificial Sequence
  chemically synthesized
tttctttctttctttctttctt

SEQ ID NO: 949517 - DNA, 22 bp, Artificial Sequence
  chemically synthesized
ctttctttctttctttctttct

SEQ ID NO: 949518 - DNA, 22 bp, Artificial Sequence
  chemically synthesized
ttctttctttctttctttcttt

SEQ ID NO: 949519 - DNA, 22 bp, Artificial Sequence
  chemically synthesized
cttctttctttctttctttctt

SEQ ID NO: 949520 - DNA, 22 bp, Artificial Sequence
  chemically synthesized
tcttctttctttctttctttct

SEQ ID NO: 949521 - DNA, 22 bp, Artificial Sequence
  chemically synthesized
tttcttctttctttctttcttt

SEQ ID NO: 949522 - DNA, 22 bp, Artificial Sequence
  chemically synthesized
ctttcttctttctttctttctt

SEQ ID NO: 949523 - DNA, 22 bp, Artificial Sequence
  chemically synthesized
tctttcttctttctttctttct

SEQ ID NO: 949524 - DNA, 22 bp, Artificial Sequence
  chemically synthesized
tttctttcttctttctttcttt

SEQ ID NO: 949525 - DNA, 22 bp, Artificial Sequence
  chemically synthesized
ctttctttcttctttctttctt

SEQ ID NO: 949526 - DNA, 22 bp, Artificial Sequence
  chemically synthesized
tctttctttcttctttctttct

SEQ ID NO: 949527 - DNA, 22 bp, Artificial Sequence
  chemically synthesized
tttctttctttcttctttcttt

SEQ ID NO: 949528 - DNA, 22 bp, Artificial Sequence
  chemically synthesized
ctttctttctttcttctttctt

SEQ ID NO: 949529 - DNA, 22 bp, Artificial Sequence
  chemically synthesized
tctttctttctttcttctttct

SEQ ID NO: 949530 - DNA, 22 bp, Artificial Sequence
  chemically synthesized
ctttctttctttctttcttctt

SEQ ID NO: 949531 - DNA, 22 bp, Artificial Sequence
  chemically synthesized
cctttctttctttctttcttct

SEQ ID NO: 949532 - DNA, 22 bp, Artificial Sequence
  chemically synthesized
cttcctttctttctttctttct

SEQ ID NO: 949533 - DNA, 22 bp, Artificial Sequence
  chemically synthesized
ccttcctttctttctttctttc

SEQ ID NO: 949534 - DNA, 22 bp, Artificial Sequence
  chemically synthesized
tccttcctttctttctttcttt

SEQ ID NO: 949535 - DNA, 22 bp, Artificial Sequence
  chemically synthesized
tttccttcctttctttctttct

SEQ ID NO: 949536 - DNA, 22 bp, Artificial Sequence
  chemically synthesized
ctttccttcctttctttctttc

SEQ ID NO: 949537 - DNA, 22 bp, Artificial Sequence
  chemically synthesized
tctttccttcctttctttcttt

SEQ ID NO: 949538 - DNA, 22 bp, Artificial Sequence
  chemically synthesized
tttctttccttcctttctttct

SEQ ID NO: 949539 - DNA, 22 bp, Artificial Sequence
  chemically synthesized
ctttctttccttcctttctttc

SEQ ID NO: 949540 - DNA, 22 bp, Artificial Sequence
  chemically synthesized
tctttctttccttcctttcttt

SEQ ID NO: 949541 - DNA, 22 bp, Artificial Sequence
  chemically synthesized
tttctttctttccttcctttct

SEQ ID NO: 949542 - DNA, 22 bp, Artificial Sequence
  chemically synthesized
tctttctttctttccttccttt

SEQ ID NO: 949543 - DNA, 22 bp, Artificial Sequence
  chemically synthesized
ctctttctttctttccttcctt

SEQ ID NO: 949544 - DNA, 22 bp, Artificial Sequence
  chemically synthesized
tctctttctttctttccttcct

SEQ ID NO: 949545 - DNA, 22 bp, Artificial Sequence
  chemically synthesized
tttctctttctttctttccttc

SEQ ID NO: 949546 - DNA, 22 bp, Artificial Sequence
  chemically synthesized
ctttctctttctttctttcctt

SEQ ID NO: 949547 - DNA, 22 bp, Artificial Sequence
  chemically synthesized
tctttctctttctttctttcct

SEQ ID NO: 949548 - DNA, 22 bp, Artificial Sequence
  chemically synthesized
tttctttctctttctttctttc

SEQ ID NO: 949549 - DNA, 22 bp, Artificial Sequence
  chemically synthesized
ctttctttctctttctttcttt

SEQ ID NO: 949550 - DNA, 22 bp, Artificial Sequence
  chemically synthesized
tctttctttctctttctttctt

SEQ ID NO: 949551 - DNA, 22 bp, Artificial Sequence
  chemically synthesized
tttctttctttctctttctttc

SEQ ID NO: 949552 - DNA, 22 bp, Artificial Sequence
  chemically synthesized
ctttctttctttctctttcttt

SEQ ID NO: 949553 - DNA, 22 bp, Artificial Sequence
  chemically synthesized
ttctttctttctttctctttct

SEQ ID NO: 949554 - DNA, 22 bp, Artificial Sequence
  chemically synthesized
cttctttctttctttctctttc

SEQ ID NO: 949555 - DNA, 22 bp, Artificial Sequence
  chemically synthesized
tcttctttctttctttctcttt

SEQ ID NO: 949556 - DNA, 22 bp, Artificial Sequence
  chemically synthesized
ttcttctttctttctttctctt

SEQ ID NO: 949557 - DNA, 22 bp, Artificial Sequence
  chemically synthesized
tttcttctttctttctttctct

SEQ ID NO: 949558 - DNA, 22 bp, Artificial Sequence
  chemically synthesized
tttttcttctttctttctttct

SEQ ID NO: 949559 - DNA, 22 bp, Artificial Sequence
  chemically synthesized
ctttttcttctttctttctttc

SEQ ID NO: 949560 - DNA, 22 bp, Artificial Sequence
  chemically synthesized
tctttttcttctttctttcttt

SEQ ID NO: 949561 - DNA, 22 bp, Artificial Sequence
  chemically synthesized
attttctttttcttctttcttt

SEQ ID NO: 949562 - DNA, 22 bp, Artificial Sequence
  chemically synthesized
tcattttctttttcttctttct

SEQ ID NO: 949563 - DNA, 22 bp, Artificial Sequence
  chemically synthesized
tctcattttctttttcttcttt

SEQ ID NO: 949564 - DNA, 22 bp, Artificial Sequence
  chemically synthesized
tctctcattttctttttcttct

SEQ ID NO: 949565 - DNA, 22 bp, Artificial Sequence
  chemically synthesized
tctctctcattttctttttctt

SEQ ID NO: 949566 - DNA, 22 bp, Artificial Sequence
  chemically synthesized
tctctctctcattttctttttc

SEQ ID NO: 949567 - DNA, 22 bp, Artificial Sequence
  chemically synthesized
gaattctctctctctcattttc

SEQ ID NO: 949568 - DNA, 22 bp, Artificial Sequence
  chemically synthesized
agaattctctctctctcatttt

SEQ ID NO: 949569 - DNA, 22 bp, Artificial Sequence
  chemically synthesized
gatttagaattctctctctctc

SEQ ID NO: 949570 - DNA, 22 bp, Artificial Sequence
  chemically synthesized
gattcgatttagaattctctct

SEQ ID NO: 949571 - DNA, 22 bp, Artificial Sequence
  chemically synthesized
taaatcgaatctagatgtccat

SEQ ID NO: 949572 - DNA, 22 bp, Artificial Sequence
  chemically synthesized
aatcgaatctagatgtccatat

SEQ ID NO: 949573 - DNA, 22 bp, Artificial Sequence
  chemically synthesized
tacaatcataatgatatggaca

SEQ ID NO: 949574 - DNA, 22 bp, Artificial Sequence
  chemically synthesized
acaattatacaatcataatgat

SEQ ID NO: 949575 - DNA, 22 bp, Artificial Sequence
  chemically synthesized
gacaattatacaatcataatga

SEQ ID NO: 949576 - DNA, 22 bp, Artificial Sequence
  chemically synthesized
gatgtccatatcattatgattg

SEQ ID NO: 949577 - DNA, 22 bp, Artificial Sequence
  chemically synthesized
cttgacaattatacaatcataa

SEQ ID NO: 949578 - DNA, 22 bp, Artificial Sequence
  chemically synthesized
ccttgacaattatacaatcata

SEQ ID NO: 949579 - DNA, 22 bp, Artificial Sequence
  chemically synthesized
tccttgacaattatacaatcat

SEQ ID NO: 949580 - DNA, 22 bp, Artificial Sequence
  chemically synthesized
ctttccttgacaattatacaat

SEQ ID NO: 949581 - DNA, 22 bp, Artificial Sequence
  chemically synthesized
tctgctttccttgacaattata

SEQ ID NO: 949582 - DNA, 22 bp, Artificial Sequence
  chemically synthesized
tgattgtataattgtcaaggaa

SEQ ID NO: 949583 - DNA, 22 bp, Artificial Sequence
  chemically synthesized
aatatatcctatctgctttcct

SEQ ID NO: 949584 - DNA, 22 bp, Artificial Sequence
  chemically synthesized
tataattgtcaaggaaagcaga

SEQ ID NO: 949585 - DNA, 22 bp, Artificial Sequence
  chemically synthesized
ttaaatatatcctatctgcttt

SEQ ID NO: 949586 - DNA, 22 bp, Artificial Sequence
  chemically synthesized
tcaaggaaagcagataggatat

SEQ ID NO: 949587 - DNA, 22 bp, Artificial Sequence
  chemically synthesized
taaggtataaagtcaacagact

SEQ ID NO: 949588 - DNA, 22 bp, Artificial Sequence
  chemically synthesized
ataaggtataaagtcaacagac

SEQ ID NO: 949589 - DNA, 22 bp, Artificial Sequence
  chemically synthesized
atatttataaggtataaagtca

SEQ ID NO: 949590 - DNA, 22 bp, Artificial Sequence
  chemically synthesized
aatatttataaggtataaagtc

SEQ ID NO: 949591 - DNA, 22 bp, Artificial Sequence
  chemically synthesized
aatagtctgttgactttatacc

SEQ ID NO: 949592 - DNA, 22 bp, Artificial Sequence
  chemically synthesized
atagtctgttgactttatacct

SEQ ID NO: 949593 - DNA, 22 bp, Artificial Sequence
  chemically synthesized
ttgactttataccttataaata

SEQ ID NO: 949594 - DNA, 22 bp, Artificial Sequence
  chemically synthesized
actttataccttataaatatta

SEQ ID NO: 949595 - DNA, 22 bp, Artificial Sequence
  chemically synthesized
catgccacatatttaatattta

SEQ ID NO: 949596 - DNA, 22 bp, Artificial Sequence
  chemically synthesized
tataccttataaatattaaata

SEQ ID NO: 949597 - DNA, 22 bp, Artificial Sequence
  chemically synthesized
ataccttataaatattaaatat

SEQ ID NO: 949598 - DNA, 22 bp, Artificial Sequence
  chemically synthesized
cctgcatgccacatatttaata

SEQ ID NO: 949599 - DNA, 22 bp, Artificial Sequence
  chemically synthesized
taccttataaatattaaatatg

SEQ ID NO: 949600 - DNA, 22 bp, Artificial Sequence
  chemically synthesized
ataaatattaaatatgtggcat

SEQ ID NO: 949601 - DNA, 22 bp, Artificial Sequence
  chemically synthesized
taaatattaaatatgtggcatg

SEQ ID NO: 949602 - DNA, 22 bp, Artificial Sequence
  chemically synthesized
aatatgtggcatgcaggcaacc

SEQ ID NO: 949603 - DNA, 22 bp, Artificial Sequence
  chemically synthesized
tagtaagtgtgcaaatggttgc

SEQ ID NO: 949604 - DNA, 22 bp, Artificial Sequence
  chemically synthesized
cagggcctatagtaagtgtgca

SEQ ID NO: 949605 - DNA, 22 bp, Artificial Sequence
  chemically synthesized
gcagggcctatagtaagtgtgc

SEQ ID NO: 949606 - DNA, 22 bp, Artificial Sequence
  chemically synthesized
tgcagggcctatagtaagtgtg

SEQ ID NO: 949607 - DNA, 22 bp, Artificial Sequence
  chemically synthesized
ttgcagggcctatagtaagtgt

SEQ ID NO: 949608 - DNA, 22 bp, Artificial Sequence
  chemically synthesized
gcacacttactataggccctgc

SEQ ID NO: 949609 - DNA, 22 bp, Artificial Sequence
  chemically synthesized
cacacttactataggccctgca

SEQ ID NO: 949610 - DNA, 22 bp, Artificial Sequence
  chemically synthesized
ccccataacttttgcagggcct

SEQ ID NO: 949611 - DNA, 22 bp, Artificial Sequence
  chemically synthesized
gaactgccccataacttttgca

SEQ ID NO: 949612 - DNA, 22 bp, Artificial Sequence
  chemically synthesized
actataggccctgcaaaagtta

SEQ ID NO: 949613 - DNA, 22 bp, Artificial Sequence
  chemically synthesized
ctataggccctgcaaaagttat

SEQ ID NO: 949614 - DNA, 22 bp, Artificial Sequence
  chemically synthesized
taggccctgcaaaagttatggg

SEQ ID NO: 949615 - DNA, 22 bp, Artificial Sequence
  chemically synthesized
caaaagttatggggcagttcta

SEQ ID NO: 949616 - DNA, 22 bp, Artificial Sequence
  chemically synthesized
catagtcatatgaggttagaac

SEQ ID NO: 949617 - DNA, 22 bp, Artificial Sequence
  chemically synthesized
tgcatagtcatatgaggttaga

SEQ ID NO: 949618 - DNA, 22 bp, Artificial Sequence
  chemically synthesized
ctgcatagtcatatgaggttag

SEQ ID NO: 949619 - DNA, 22 bp, Artificial Sequence
  chemically synthesized
tggggcagttctaacctcatat

SEQ ID NO: 949620 - DNA, 22 bp, Artificial Sequence
  chemically synthesized
taacctcatatgactatgcaga

SEQ ID NO: 949621 - DNA, 22 bp, Artificial Sequence
  chemically synthesized
tatcacatagtcttctgcatag

SEQ ID NO: 949622 - DNA, 22 bp, Artificial Sequence
  chemically synthesized
acctcatatgactatgcagaag

SEQ ID NO: 949623 - DNA, 22 bp, Artificial Sequence
  chemically synthesized
atatgactatgcagaagactat

SEQ ID NO: 949624 - DNA, 22 bp, Artificial Sequence
  chemically synthesized
ataatctgtatcacatagtctt

SEQ ID NO: 949625 - DNA, 22 bp, Artificial Sequence
  chemically synthesized
gataatctgtatcacatagtct

SEQ ID NO: 949626 - DNA, 22 bp, Artificial Sequence
  chemically synthesized
tgataatctgtatcacatagtc

SEQ ID NO: 949627 - DNA, 22 bp, Artificial Sequence
  chemically synthesized
ttgataatctgtatcacatagt

SEQ ID NO: 949628 - DNA, 22 bp, Artificial Sequence
  chemically synthesized
tgcagaagactatgtgatacag

SEQ ID NO: 949629 - DNA, 22 bp, Artificial Sequence
  chemically synthesized
tcatcttttgataatctgtatc

SEQ ID NO: 949630 - DNA, 22 bp, Artificial Sequence
  chemically synthesized
aaaaattgtcatcttttgataa

SEQ ID NO: 949631 - DNA, 22 bp, Artificial Sequence
  chemically synthesized
tgtgatacagattatcaaaaga

SEQ ID NO: 949632 - DNA, 22 bp, Artificial Sequence
  chemically synthesized
aaaaaattgtcatcttttgata

SEQ ID NO: 949633 - DNA, 22 bp, Artificial Sequence
  chemically synthesized
ggaatttaaaaaattgtcatct

SEQ ID NO: 949634 - DNA, 22 bp, Artificial Sequence
  chemically synthesized
gtctgggaatttaaaaaattgt

SEQ ID NO: 949635 - DNA, 22 bp, Artificial Sequence
  chemically synthesized
tcaaaagatgacaattttttaa

SEQ ID NO: 949636 - DNA, 22 bp, Artificial Sequence
  chemically synthesized
ataccatcctggtctgggaatt

SEQ ID NO: 949637 - DNA, 22 bp, Artificial Sequence
  chemically synthesized
ctcataccatcctggtctggga

SEQ ID NO: 949638 - DNA, 22 bp, Artificial Sequence
  chemically synthesized
actcctcataccatcctggtct

SEQ ID NO: 949639 - DNA, 22 bp, Artificial Sequence
  chemically synthesized
tttaaattcccagaccaggatg

SEQ ID NO: 949640 - DNA, 22 bp, Artificial Sequence
  chemically synthesized
ttaaattcccagaccaggatgg

SEQ ID NO: 949641 - DNA, 22 bp, Artificial Sequence
  chemically synthesized
tcactcctcataccatcctggt

SEQ ID NO: 949642 - DNA, 22 bp, Artificial Sequence
  chemically synthesized
taaattcccagaccaggatggt

SEQ ID NO: 949643 - DNA, 22 bp, Artificial Sequence
  chemically synthesized
ctcactcctcataccatcctgg

SEQ ID NO: 949644 - DNA, 22 bp, Artificial Sequence
  chemically synthesized
aaattcccagaccaggatggta

SEQ ID NO: 949645 - DNA, 22 bp, Artificial Sequence
  chemically synthesized
aattcccagaccaggatggtat

SEQ ID NO: 949646 - DNA, 22 bp, Artificial Sequence
  chemically synthesized
ccagaccaggatggtatgagga

SEQ ID NO: 949647 - DNA, 22 bp, Artificial Sequence
  chemically synthesized
aaaaagcttctcactcctcata

SEQ ID NO: 949648 - DNA, 22 bp, Artificial Sequence
  chemically synthesized
gtgtctaaaaaagcttctcact

SEQ ID NO: 949649 - DNA, 22 bp, Artificial Sequence
  chemically synthesized
tgcattggtgtctaaaaaagct

SEQ ID NO: 949650 - DNA, 22 bp, Artificial Sequence
  chemically synthesized
taagagctatgcattggtgtct

SEQ ID NO: 949651 - DNA, 22 bp, Artificial Sequence
  chemically synthesized
ttttagacaccaatgcatagct

SEQ ID NO: 949652 - DNA, 22 bp, Artificial Sequence
  chemically synthesized
tttagacaccaatgcatagctc

SEQ ID NO: 949653 - DNA, 22 bp, Artificial Sequence
  chemically synthesized
ttagacaccaatgcatagctct

SEQ ID NO: 949654 - DNA, 22 bp, Artificial Sequence
  chemically synthesized
tagacaccaatgcatagctctt

SEQ ID NO: 949655 - DNA, 22 bp, Artificial Sequence
  chemically synthesized
agacaccaatgcatagctctta

SEQ ID NO: 949656 - DNA, 22 bp, Artificial Sequence
  chemically synthesized
gacaccaatgcatagctcttac

SEQ ID NO: 949657 - DNA, 22 bp, Artificial Sequence
  chemically synthesized
ggagagcatcccagctgtaaga

SEQ ID NO: 949658 - DNA, 22 bp, Artificial Sequence
  chemically synthesized
cggagagcatcccagctgtaag

SEQ ID NO: 949659 - DNA, 22 bp, Artificial Sequence
  chemically synthesized
ttacagctgggatgctctccga

SEQ ID NO: 949660 - DNA, 22 bp, Artificial Sequence
  chemically synthesized
acagctgggatgctctccgaag

SEQ ID NO: 949661 - DNA, 22 bp, Artificial Sequence
  chemically synthesized
cagctgggatgctctccgaagg

SEQ ID NO: 949662 - DNA, 22 bp, Artificial Sequence
  chemically synthesized
ggatgctctccgaaggcattat

SEQ ID NO: 949663 - DNA, 22 bp, Artificial Sequence
  chemically synthesized
agaaaaaggaataataatgcct

SEQ ID NO: 949664 - DNA, 22 bp, Artificial Sequence
  chemically synthesized
aagaaaaaggaataataatgcc

SEQ ID NO: 949665 - DNA, 22 bp, Artificial Sequence
  chemically synthesized
ccttaagaaaaaggaataataa

SEQ ID NO: 949666 - DNA, 22 bp, Artificial Sequence
  chemically synthesized
tccgaaggcattattattcctt

SEQ ID NO: 949667 - DNA, 22 bp, Artificial Sequence
  chemically synthesized
cgaaggcattattattcctttt

SEQ ID NO: 949668 - DNA, 22 bp, Artificial Sequence
  chemically synthesized
attcccttaagaaaaaggaata

SEQ ID NO: 949669 - DNA, 22 bp, Artificial Sequence
  chemically synthesized
cattcccttaagaaaaaggaat

SEQ ID NO: 949670 - DNA, 22 bp, Artificial Sequence
  chemically synthesized
gcttcattcccttaagaaaaag

SEQ ID NO: 949671 - DNA, 22 bp, Artificial Sequence
  chemically synthesized
ttattcctttttcttaagggaa

SEQ ID NO: 949672 - DNA, 22 bp, Artificial Sequence
  chemically synthesized
tgtctggcttcattcccttaag

SEQ ID NO: 949673 - DNA, 22 bp, Artificial Sequence
  chemically synthesized
ttcctttttcttaagggaatga

SEQ ID NO: 949674 - DNA, 22 bp, Artificial Sequence
  chemically synthesized
tgttatgtctggcttcattccc

SEQ ID NO: 949675 - DNA, 22 bp, Artificial Sequence
  chemically synthesized
ctttttcttaagggaatgaagc

SEQ ID NO: 949676 - DNA, 22 bp, Artificial Sequence
  chemically synthesized
gtgttatgtctggcttcattcc

SEQ ID NO: 949677 - DNA, 22 bp, Artificial Sequence
  chemically synthesized
tttcttaagggaatgaagccag

SEQ ID NO: 949678 - DNA, 22 bp, Artificial Sequence
  chemically synthesized
ttcttaagggaatgaagccaga

SEQ ID NO: 949679 - DNA, 22 bp, Artificial Sequence
  chemically synthesized
tcttaagggaatgaagccagac

SEQ ID NO: 949680 - DNA, 22 bp, Artificial Sequence
  chemically synthesized
cttaagggaatgaagccagaca

SEQ ID NO: 949681 - DNA, 22 bp, Artificial Sequence
  chemically synthesized
taacttgtgttatgtctggctt

SEQ ID NO: 949682 - DNA, 22 bp, Artificial Sequence
  chemically synthesized
ttaagggaatgaagccagacat

SEQ ID NO: 949683 - DNA, 22 bp, Artificial Sequence
  chemically synthesized
ataacttgtgttatgtctggct

SEQ ID NO: 949684 - DNA, 22 bp, Artificial Sequence
  chemically synthesized
aagggaatgaagccagacataa

SEQ ID NO: 949685 - DNA, 22 bp, Artificial Sequence
  chemically synthesized
agggaatgaagccagacataac

SEQ ID NO: 949686 - DNA, 22 bp, Artificial Sequence
  chemically synthesized
gtaacttataacttgtgttatg

SEQ ID NO: 949687 - DNA, 22 bp, Artificial Sequence
  chemically synthesized
actcgtaacttataacttgtgt

SEQ ID NO: 949688 - DNA, 22 bp, Artificial Sequence
  chemically synthesized
taactcgtaacttataacttgt

SEQ ID NO: 949689 - DNA, 22 bp, Artificial Sequence
  chemically synthesized
ctaactcgtaacttataacttg

SEQ ID NO: 949690 - DNA, 22 bp, Artificial Sequence
  chemically synthesized
aagtcatggcttctaactcgta

SEQ ID NO: 949691 - DNA, 22 bp, Artificial Sequence
  chemically synthesized
taagttacgagttagaagccat

SEQ ID NO: 949692 - DNA, 22 bp, Artificial Sequence
  chemically synthesized
aatgtgttcaagtcatggcttc

SEQ ID NO: 949693 - DNA, 22 bp, Artificial Sequence
  chemically synthesized
gaatgtgttcaagtcatggctt

SEQ ID NO: 949694 - DNA, 22 bp, Artificial Sequence
  chemically synthesized
tgaatgtgttcaagtcatggct

SEQ ID NO: 949695 - DNA, 22 bp, Artificial Sequence
  chemically synthesized
ttgaatgtgttcaagtcatggc

SEQ ID NO: 949696 - DNA, 22 bp, Artificial Sequence
  chemically synthesized
cgagttagaagccatgacttga

SEQ ID NO: 949697 - DNA, 22 bp, Artificial Sequence
  chemically synthesized
gaagccatgacttgaacacatt

SEQ ID NO: 949698 - DNA, 22 bp, Artificial Sequence
  chemically synthesized
gaacacattcaaaagcatttcc

SEQ ID NO: 949699 - DNA, 22 bp, Artificial Sequence
  chemically synthesized
aacacattcaaaagcatttccc

SEQ ID NO: 949700 - DNA, 22 bp, Artificial Sequence
  chemically synthesized
gaaatgtatgccagggaaatgc

SEQ ID NO: 949701 - DNA, 22 bp, Artificial Sequence
  chemically synthesized
aaaagcatttccctggcataca

SEQ ID NO: 949702 - DNA, 22 bp, Artificial Sequence
  chemically synthesized
acacattagaaatgtatgccag

SEQ ID NO: 949703 - DNA, 22 bp, Artificial Sequence
  chemically synthesized
ccctggcatacatttctaatgt

SEQ ID NO: 949704 - DNA, 22 bp, Artificial Sequence
  chemically synthesized
cctggcatacatttctaatgtg

SEQ ID NO: 949705 - DNA, 22 bp, Artificial Sequence
  chemically synthesized
gcatacatttctaatgtgtgaa

SEQ ID NO: 949706 - DNA, 22 bp, Artificial Sequence
  chemically synthesized
ctaatgtgtgaatcttttggga

SEQ ID NO: 949707 - DNA, 22 bp, Artificial Sequence
  chemically synthesized
taatgtgtgaatcttttgggat

SEQ ID NO: 949708 - DNA, 22 bp, Artificial Sequence
  chemically synthesized
atgtgtgaatcttttgggatcc

SEQ ID NO: 949709 - DNA, 22 bp, Artificial Sequence
  chemically synthesized
ccagaaataaagaaacaaatgg

SEQ ID NO: 949710 - DNA, 22 bp, Artificial Sequence
  chemically synthesized
ttgggatccatttgtttcttta

SEQ ID NO: 949711 - DNA, 22 bp, Artificial Sequence
  chemically synthesized
tattgccagaaataaagaaaca

SEQ ID NO: 949712 - DNA, 22 bp, Artificial Sequence
  chemically synthesized
tgggatccatttgtttctttat

SEQ ID NO: 949713 - DNA, 22 bp, Artificial Sequence
  chemically synthesized
gggatccatttgtttctttatt

SEQ ID NO: 949714 - DNA, 22 bp, Artificial Sequence
  chemically synthesized
ggatccatttgtttctttattt

SEQ ID NO: 949715 - DNA, 22 bp, Artificial Sequence
  chemically synthesized
attatattgccagaaataaaga

SEQ ID NO: 949716 - DNA, 22 bp, Artificial Sequence
  chemically synthesized
aattatattgccagaaataaag

SEQ ID NO: 949717 - DNA, 22 bp, Artificial Sequence
  chemically synthesized
gaaacttaattatattgccaga

SEQ ID NO: 949718 - DNA, 22 bp, Artificial Sequence
  chemically synthesized
gtttctttatttctggcaatat

SEQ ID NO: 949719 - DNA, 22 bp, Artificial Sequence
  chemically synthesized
tttctttatttctggcaatata

SEQ ID NO: 949720 - DNA, 22 bp, Artificial Sequence
  chemically synthesized
ctttatttctggcaatataatt

SEQ ID NO: 949721 - DNA, 22 bp, Artificial Sequence
  chemically synthesized
tttatttctggcaatataatta

SEQ ID NO: 949722 - DNA, 22 bp, Artificial Sequence
  chemically synthesized
gagttagaaacttaattatatt

SEQ ID NO: 949723 - DNA, 22 bp, Artificial Sequence
  chemically synthesized
agagttagaaacttaattatat

SEQ ID NO: 949724 - DNA, 22 bp, Artificial Sequence
  chemically synthesized
tatttctggcaatataattaag

SEQ ID NO: 949725 - DNA, 22 bp, Artificial Sequence
  chemically synthesized
atttctggcaatataattaagt

SEQ ID NO: 949726 - DNA, 22 bp, Artificial Sequence
  chemically synthesized
tttctggcaatataattaagtt

SEQ ID NO: 949727 - DNA, 22 bp, Artificial Sequence
  chemically synthesized
agcttagagttagaaacttaat

SEQ ID NO: 949728 - DNA, 22 bp, Artificial Sequence
  chemically synthesized
ctggcaatataattaagtttct

SEQ ID NO: 949729 - DNA, 22 bp, Artificial Sequence
  chemically synthesized
tggcaatataattaagtttcta

SEQ ID NO: 949730 - DNA, 22 bp, Artificial Sequence
  chemically synthesized
ttgagcttagagttagaaactt

SEQ ID NO: 949731 - DNA, 22 bp, Artificial Sequence
  chemically synthesized
gcaatataattaagtttctaac

SEQ ID NO: 949732 - DNA, 22 bp, Artificial Sequence
  chemically synthesized
attgttgagcttagagttagaa

SEQ ID NO: 949733 - DNA, 22 bp, Artificial Sequence
  chemically synthesized
aattgttgagcttagagttaga

SEQ ID NO: 949734 - DNA, 22 bp, Artificial Sequence
  chemically synthesized
tcaatttaattgttgagcttag

SEQ ID NO: 949735 - DNA, 22 bp, Artificial Sequence
  chemically synthesized
agtttctaactctaagctcaac

SEQ ID NO: 949736 - DNA, 22 bp, Artificial Sequence
  chemically synthesized
ctaactctaagctcaacaatta

SEQ ID NO: 949737 - DNA, 22 bp, Artificial Sequence
  chemically synthesized
taactctaagctcaacaattaa

SEQ ID NO: 949738 - DNA, 22 bp, Artificial Sequence
  chemically synthesized
atgaactatcaatttaattgtt

SEQ ID NO: 949739 - DNA, 22 bp, Artificial Sequence
  chemically synthesized
actctaagctcaacaattaaat

SEQ ID NO: 949740 - DNA, 22 bp, Artificial Sequence
  chemically synthesized
taagctcaacaattaaattgat

SEQ ID NO: 949741 - DNA, 22 bp, Artificial Sequence
  chemically synthesized
agctcaacaattaaattgatag

SEQ ID NO: 949742 - DNA, 22 bp, Artificial Sequence
  chemically synthesized
aaatgctaatgaactatcaatt

SEQ ID NO: 949743 - DNA, 22 bp, Artificial Sequence
  chemically synthesized
taaaatgctaatgaactatcaa

SEQ ID NO: 949744 - DNA, 22 bp, Artificial Sequence
  chemically synthesized
ctaaaatgctaatgaactatca

SEQ ID NO: 949745 - DNA, 22 bp, Artificial Sequence
  chemically synthesized
aacaattaaattgatagttcat

SEQ ID NO: 949746 - DNA, 22 bp, Artificial Sequence
  chemically synthesized
ttctaaaatgctaatgaactat

SEQ ID NO: 949747 - DNA, 22 bp, Artificial Sequence
  chemically synthesized
cttctaaaatgctaatgaacta

SEQ ID NO: 949748 - DNA, 22 bp, Artificial Sequence
  chemically synthesized
aattgatagttcattagcattt

SEQ ID NO: 949749 - DNA, 22 bp, Artificial Sequence
  chemically synthesized
aagtgtttcttctaaaatgcta

SEQ ID NO: 949750 - DNA, 22 bp, Artificial Sequence
  chemically synthesized
gaagtgtttcttctaaaatgct

SEQ ID NO: 949751 - DNA, 22 bp, Artificial Sequence
  chemically synthesized
atagttcattagcattttagaa

SEQ ID NO: 949752 - DNA, 22 bp, Artificial Sequence
  chemically synthesized
tttgaagtgtttcttctaaaat

SEQ ID NO: 949753 - DNA, 22 bp, Artificial Sequence
  chemically synthesized
ttgtttgaagtgtttcttctaa

SEQ ID NO: 949754 - DNA, 22 bp, Artificial Sequence
  chemically synthesized
gttgtttgaagtgtttcttcta

SEQ ID NO: 949755 - DNA, 22 bp, Artificial Sequence
  chemically synthesized
attagcattttagaagaaacac

SEQ ID NO: 949756 - DNA, 22 bp, Artificial Sequence
  chemically synthesized
aatttgttgtttgaagtgtttc

SEQ ID NO: 949757 - DNA, 22 bp, Artificial Sequence
  chemically synthesized
gcattttagaagaaacacttca

SEQ ID NO: 949758 - DNA, 22 bp, Artificial Sequence
  chemically synthesized
aagctaaatttgttgtttgaag

SEQ ID NO: 949759 - DNA, 22 bp, Artificial Sequence
  chemically synthesized
tagaagaaacacttcaaacaac

SEQ ID NO: 949760 - DNA, 22 bp, Artificial Sequence
  chemically synthesized
agaagaaacacttcaaacaaca

SEQ ID NO: 949761 - DNA, 22 bp, Artificial Sequence
  chemically synthesized
taaagctaaatttgttgtttga

SEQ ID NO: 949762 - DNA, 22 bp, Artificial Sequence
  chemically synthesized
gaagaaacacttcaaacaacaa

SEQ ID NO: 949763 - DNA, 22 bp, Artificial Sequence
  chemically synthesized
ctaaagctaaatttgttgtttg

SEQ ID NO: 949764 - DNA, 22 bp, Artificial Sequence
  chemically synthesized
tctaaagctaaatttgttgttt

SEQ ID NO: 949765 - DNA, 22 bp, Artificial Sequence
  chemically synthesized
ttctaaagctaaatttgttgtt

SEQ ID NO: 949766 - DNA, 22 bp, Artificial Sequence
  chemically synthesized
ttttctaaagctaaatttgttg

SEQ ID NO: 949767 - DNA, 22 bp, Artificial Sequence
  chemically synthesized
ttcttttctaaagctaaatttg

SEQ ID NO: 949768 - DNA, 22 bp, Artificial Sequence
  chemically synthesized
cctgttcttttctaaagctaaa

SEQ ID NO: 949769 - DNA, 22 bp, Artificial Sequence
  chemically synthesized
caaacaacaaatttagctttag

SEQ ID NO: 949770 - DNA, 22 bp, Artificial Sequence
  chemically synthesized
acctgttcttttctaaagctaa

SEQ ID NO: 949771 - DNA, 22 bp, Artificial Sequence
  chemically synthesized
aaacaacaaatttagctttaga

SEQ ID NO: 949772 - DNA, 22 bp, Artificial Sequence
  chemically synthesized
tacctgttcttttctaaagcta

SEQ ID NO: 949773 - DNA, 22 bp, Artificial Sequence
  chemically synthesized
agctttagaaaagaacaggtaa

SEQ ID NO: 949774 - DNA, 22 bp, Artificial Sequence
  chemically synthesized
gctttagaaaagaacaggtaaa

SEQ ID NO: 949775 - DNA, 22 bp, Artificial Sequence
  chemically synthesized
tagaaaagaacaggtaaaattt

SEQ ID NO: 949776 - DNA, 22 bp, Artificial Sequence
  chemically synthesized
agaaaagaacaggtaaaatttg

SEQ ID NO: 949777 - DNA, 22 bp, Artificial Sequence
  chemically synthesized
gaaaagaacaggtaaaatttgt

SEQ ID NO: 949778 - DNA, 22 bp, Artificial Sequence
  chemically synthesized
gaaaatgtgatcaatgtaacaa

SEQ ID NO: 949779 - DNA, 22 bp, Artificial Sequence
  chemically synthesized
agaaaatgtgatcaatgtaaca

SEQ ID NO: 949780 - DNA, 22 bp, Artificial Sequence
  chemically synthesized
atttagaaaatgtgatcaatgt

SEQ ID NO: 949781 - DNA, 22 bp, Artificial Sequence
  chemically synthesized
gttacattgatcacattttcta

SEQ ID NO: 949782 - DNA, 22 bp, Artificial Sequence
  chemically synthesized
aaataattaatttagaaaatgt

SEQ ID NO: 949783 - DNA, 22 bp, Artificial Sequence
  chemically synthesized
ttacattgatcacattttctaa

SEQ ID NO: 949784 - DNA, 22 bp, Artificial Sequence
  chemically synthesized
aaaataattaatttagaaaatg

SEQ ID NO: 949785 - DNA, 22 bp, Artificial Sequence
  chemically synthesized
cattgatcacattttctaaatt

SEQ ID NO: 949786 - DNA, 22 bp, Artificial Sequence
  chemically synthesized
catttaaaataattaatttaga

SEQ ID NO: 949787 - DNA, 22 bp, Artificial Sequence
  chemically synthesized
atcacattttctaaattaatta

SEQ ID NO: 949788 - DNA, 22 bp, Artificial Sequence
  chemically synthesized
aattacatttaaaataattaat

SEQ ID NO: 949789 - DNA, 22 bp, Artificial Sequence
  chemically synthesized
ttcaattacatttaaaataatt

SEQ ID NO: 949790 - DNA, 22 bp, Artificial Sequence
  chemically synthesized
tctaaattaattattttaaatg

SEQ ID NO: 949791 - DNA, 22 bp, Artificial Sequence
  chemically synthesized
ctaaattaattattttaaatgt

SEQ ID NO: 949792 - DNA, 22 bp, Artificial Sequence
  chemically synthesized
taaattaattattttaaatgta

SEQ ID NO: 949793 - DNA, 22 bp, Artificial Sequence
  chemically synthesized
aattaattattttaaatgtaat

SEQ ID NO: 949794 - DNA, 22 bp, Artificial Sequence
  chemically synthesized
attattttaaatgtaattgaat

SEQ ID NO: 949795 - DNA, 22 bp, Artificial Sequence
  chemically synthesized
taggacataggttattcaatta

SEQ ID NO: 949796 - DNA, 22 bp, Artificial Sequence
  chemically synthesized
ataggacataggttattcaatt

SEQ ID NO: 949797 - DNA, 22 bp, Artificial Sequence
  chemically synthesized
ttttaaatgtaattgaataacc

SEQ ID NO: 949798 - DNA, 22 bp, Artificial Sequence
  chemically synthesized
taaatgtaattgaataacctat

SEQ ID NO: 949799 - DNA, 22 bp, Artificial Sequence
  chemically synthesized
tgtttataggacataggttatt

SEQ ID NO: 949800 - DNA, 22 bp, Artificial Sequence
  chemically synthesized
aaatgtaattgaataacctatg

SEQ ID NO: 949801 - DNA, 22 bp, Artificial Sequence
  chemically synthesized
atgtttataggacataggttat

SEQ ID NO: 949802 - DNA, 22 bp, Artificial Sequence
  chemically synthesized
aatgtaattgaataacctatgt

SEQ ID NO: 949803 - DNA, 22 bp, Artificial Sequence
  chemically synthesized
aataacctatgtcctataaaca

SEQ ID NO: 949804 - DNA, 22 bp, Artificial Sequence
  chemically synthesized
tagtcaagtttatgtttatagg

SEQ ID NO: 949805 - DNA, 22 bp, Artificial Sequence
  chemically synthesized
tatagtcaagtttatgtttata

SEQ ID NO: 949806 - DNA, 22 bp, Artificial Sequence
  chemically synthesized
tgactctatagtcaagtttatg

SEQ ID NO: 949807 - DNA, 22 bp, Artificial Sequence
  chemically synthesized
tgtcctataaacataaacttga

SEQ ID NO: 949808 - DNA, 22 bp, Artificial Sequence
  chemically synthesized
aaaattatgactctatagtcaa

SEQ ID NO: 949809 - DNA, 22 bp, Artificial Sequence
  chemically synthesized
taaacataaacttgactataga

SEQ ID NO: 949810 - DNA, 22 bp, Artificial Sequence
  chemically synthesized
aaaaattatgactctatagtca

SEQ ID NO: 949811 - DNA, 22 bp, Artificial Sequence
  chemically synthesized
agtgtttaaaaattatgactct

SEQ ID NO: 949812 - DNA, 22 bp, Artificial Sequence
  chemically synthesized
gactatagagtcataattttta

SEQ ID NO: 949813 - DNA, 22 bp, Artificial Sequence
  chemically synthesized
actatagagtcataatttttaa

SEQ ID NO: 949814 - DNA, 22 bp, Artificial Sequence
  chemically synthesized
tagagtcataatttttaaacac

SEQ ID NO: 949815 - DNA, 22 bp, Artificial Sequence
  chemically synthesized
tgaagagactcagtgtttaaaa

SEQ ID NO: 949816 - DNA, 22 bp, Artificial Sequence
  chemically synthesized
atgaagagactcagtgtttaaa

SEQ ID NO: 949817 - DNA, 22 bp, Artificial Sequence
  chemically synthesized
ttaaacactgagtctcttcata

SEQ ID NO: 949818 - DNA, 22 bp, Artificial Sequence
  chemically synthesized
taaacactgagtctcttcataa

SEQ ID NO: 949819 - DNA, 22 bp, Artificial Sequence
  chemically synthesized
aaacactgagtctcttcataaa

SEQ ID NO: 949820 - DNA, 22 bp, Artificial Sequence
  chemically synthesized
aacactgagtctcttcataaat

SEQ ID NO: 949821 - DNA, 22 bp, Artificial Sequence
  chemically synthesized
agtctcttcataaattaccaca

SEQ ID NO: 949822 - DNA, 22 bp, Artificial Sequence
  chemically synthesized
agtgaaaaatatagtgtggtaa

SEQ ID NO: 949823 - DNA, 22 bp, Artificial Sequence
  chemically synthesized
tcagtgaaaaatatagtgtggt

SEQ ID NO: 949824 - DNA, 22 bp, Artificial Sequence
  chemically synthesized
ctcagtgaaaaatatagtgtgg

SEQ ID NO: 949825 - DNA, 22 bp, Artificial Sequence
  chemically synthesized
ttcataaattaccacactatat

SEQ ID NO: 949826 - DNA, 22 bp, Artificial Sequence
  chemically synthesized
cataaattaccacactatattt

SEQ ID NO: 949827 - DNA, 22 bp, Artificial Sequence
  chemically synthesized
ataaattaccacactatatttt

SEQ ID NO: 949828 - DNA, 22 bp, Artificial Sequence
  chemically synthesized
atttctcagtgaaaaatatagt

SEQ ID NO: 949829 - DNA, 22 bp, Artificial Sequence
  chemically synthesized
aatttctcagtgaaaaatatag

SEQ ID NO: 949830 - DNA, 22 bp, Artificial Sequence
  chemically synthesized
taatttctcagtgaaaaatata

SEQ ID NO: 949831 - DNA, 22 bp, Artificial Sequence
  chemically synthesized
ccacactatatttttcactgag

SEQ ID NO: 949832 - DNA, 22 bp, Artificial Sequence
  chemically synthesized
tatttttcactgagaaattaaa

SEQ ID NO: 949833 - DNA, 22 bp, Artificial Sequence
  chemically synthesized
aaatatcatagttttaatttct

SEQ ID NO: 949834 - DNA, 22 bp, Artificial Sequence
  chemically synthesized
gctaaaatatcatagttttaat

SEQ ID NO: 949835 - DNA, 22 bp, Artificial Sequence
  chemically synthesized
ttcactgagaaattaaaactat

SEQ ID NO: 949836 - DNA, 22 bp, Artificial Sequence
  chemically synthesized
agctaaaatatcatagttttaa

SEQ ID NO: 949837 - DNA, 22 bp, Artificial Sequence
  chemically synthesized
tcactgagaaattaaaactatg

SEQ ID NO: 949838 - DNA, 22 bp, Artificial Sequence
  chemically synthesized
tagctaaaatatcatagtttta

SEQ ID NO: 949839 - DNA, 22 bp, Artificial Sequence
  chemically synthesized
cactgagaaattaaaactatga

SEQ ID NO: 949840 - DNA, 22 bp, Artificial Sequence
  chemically synthesized
actgagaaattaaaactatgat

SEQ ID NO: 949841 - DNA, 22 bp, Artificial Sequence
  chemically synthesized
agaaattaaaactatgatattt

SEQ ID NO: 949842 - DNA, 22 bp, Artificial Sequence
  chemically synthesized
aaactatgatattttagctaaa

SEQ ID NO: 949843 - DNA, 22 bp, Artificial Sequence
  chemically synthesized
aaaatgatacattttagctaaa

SEQ ID NO: 949844 - DNA, 22 bp, Artificial Sequence
  chemically synthesized
caaaatgatacattttagctaa

SEQ ID NO: 949845 - DNA, 22 bp, Artificial Sequence
  chemically synthesized
tgatattttagctaaaatgtat

SEQ ID NO: 949846 - DNA, 22 bp, Artificial Sequence
  chemically synthesized
ggtttcaaaatgatacatttta

SEQ ID NO: 949847 - DNA, 22 bp, Artificial Sequence
  chemically synthesized
gggtttcaaaatgatacatttt

SEQ ID NO: 949848 - DNA, 22 bp, Artificial Sequence
  chemically synthesized
tgggtttcaaaatgatacattt

SEQ ID NO: 949849 - DNA, 22 bp, Artificial Sequence
  chemically synthesized
tattttgggtttcaaaatgata

SEQ ID NO: 949850 - DNA, 22 bp, Artificial Sequence
  chemically synthesized
tagctaaaatgtatcattttga

SEQ ID NO: 949851 - DNA, 22 bp, Artificial Sequence
  chemically synthesized
agctaaaatgtatcattttgaa

SEQ ID NO: 949852 - DNA, 22 bp, Artificial Sequence
  chemically synthesized
gctaaaatgtatcattttgaaa

SEQ ID NO: 949853 - DNA, 22 bp, Artificial Sequence
  chemically synthesized
aaatgtatcattttgaaaccca

SEQ ID NO: 949854 - DNA, 22 bp, Artificial Sequence
  chemically synthesized
tgaaacccaaaatatagatttc

SEQ ID NO: 949855 - DNA, 22 bp, Artificial Sequence
  chemically synthesized
gaaacccaaaatatagatttca

SEQ ID NO: 949856 - DNA, 22 bp, Artificial Sequence
  chemically synthesized
aaacccaaaatatagatttcac

SEQ ID NO: 949857 - DNA, 22 bp, Artificial Sequence
  chemically synthesized
aagaacatgaaaagtgaaatct

SEQ ID NO: 949858 - DNA, 22 bp, Artificial Sequence
  chemically synthesized
caggaaaaataatctcaagaac

SEQ ID NO: 949859 - DNA, 22 bp, Artificial Sequence
  chemically synthesized
cacttttcatgttcttgagatt

SEQ ID NO: 949860 - DNA, 22 bp, Artificial Sequence
  chemically synthesized
tacaggaaaaataatctcaaga

SEQ ID NO: 949861 - DNA, 22 bp, Artificial Sequence
  chemically synthesized
acttttcatgttcttgagatta

SEQ ID NO: 949862 - DNA, 22 bp, Artificial Sequence
  chemically synthesized
ctacaggaaaaataatctcaag

SEQ ID NO: 949863 - DNA, 22 bp, Artificial Sequence
  chemically synthesized
tctacaggaaaaataatctcaa

SEQ ID NO: 949864 - DNA, 22 bp, Artificial Sequence
  chemically synthesized
ttcatgttcttgagattatttt

SEQ ID NO: 949865 - DNA, 22 bp, Artificial Sequence
  chemically synthesized
tcatgttcttgagattattttt

SEQ ID NO: 949866 - DNA, 22 bp, Artificial Sequence
  chemically synthesized
catgttcttgagattatttttc

SEQ ID NO: 949867 - DNA, 22 bp, Artificial Sequence
  chemically synthesized
atgttcttgagattatttttcc

SEQ ID NO: 949868 - DNA, 22 bp, Artificial Sequence
  chemically synthesized
ttgagattatttttcctgtaga

SEQ ID NO: 949869 - DNA, 22 bp, Artificial Sequence
  chemically synthesized
agcatatacgttttctacagga

SEQ ID NO: 949870 - DNA, 22 bp, Artificial Sequence
  chemically synthesized
gagattatttttcctgtagaaa

SEQ ID NO: 949871 - DNA, 22 bp, Artificial Sequence
  chemically synthesized
cagcatatacgttttctacagg

SEQ ID NO: 949872 - DNA, 22 bp, Artificial Sequence
  chemically synthesized
agattatttttcctgtagaaaa

SEQ ID NO: 949873 - DNA, 22 bp, Artificial Sequence
  chemically synthesized
tcagcatatacgttttctacag

SEQ ID NO: 949874 - DNA, 22 bp, Artificial Sequence
  chemically synthesized
tttttcctgtagaaaacgtata

SEQ ID NO: 949875 - DNA, 22 bp, Artificial Sequence
  chemically synthesized
ttcctgtagaaaacgtatatgc

SEQ ID NO: 949876 - DNA, 22 bp, Artificial Sequence
  chemically synthesized
tcctgtagaaaacgtatatgct

SEQ ID NO: 949877 - DNA, 22 bp, Artificial Sequence
  chemically synthesized
atgaccactttcagcatatacg

SEQ ID NO: 949878 - DNA, 22 bp, Artificial Sequence
  chemically synthesized
cctgtagaaaacgtatatgctg

SEQ ID NO: 949879 - DNA, 22 bp, Artificial Sequence
  chemically synthesized
aatgaccactttcagcatatac

SEQ ID NO: 949880 - DNA, 22 bp, Artificial Sequence
  chemically synthesized
ctgtagaaaacgtatatgctga

SEQ ID NO: 949881 - DNA, 22 bp, Artificial Sequence
  chemically synthesized
taatgaccactttcagcatata

SEQ ID NO: 949882 - DNA, 22 bp, Artificial Sequence
  chemically synthesized
tagaaaacgtatatgctgaaag

SEQ ID NO: 949883 - DNA, 22 bp, Artificial Sequence
  chemically synthesized
ttttaatgaccactttcagcat

SEQ ID NO: 949884 - DNA, 22 bp, Artificial Sequence
  chemically synthesized
gagccataattattttaatgac

SEQ ID NO: 949885 - DNA, 22 bp, Artificial Sequence
  chemically synthesized
agagccataattattttaatga

SEQ ID NO: 949886 - DNA, 22 bp, Artificial Sequence
  chemically synthesized
tagagccataattattttaatg

SEQ ID NO: 949887 - DNA, 22 bp, Artificial Sequence
  chemically synthesized
aaagtggtcattaaaataatta

SEQ ID NO: 949888 - DNA, 22 bp, Artificial Sequence
  chemically synthesized
cagttttagagccataattatt

SEQ ID NO: 949889 - DNA, 22 bp, Artificial Sequence
  chemically synthesized
gcagttttagagccataattat

SEQ ID NO: 949890 - DNA, 22 bp, Artificial Sequence
  chemically synthesized
tgcagttttagagccataatta

SEQ ID NO: 949891 - DNA, 22 bp, Artificial Sequence
  chemically synthesized
aaataattatggctctaaaact

SEQ ID NO: 949892 - DNA, 22 bp, Artificial Sequence
  chemically synthesized
gcaatgttttgcagttttagag

SEQ ID NO: 949893 - DNA, 22 bp, Artificial Sequence
  chemically synthesized
gtatgttagcaatgttttgcag

SEQ ID NO: 949894 - DNA, 22 bp, Artificial Sequence
  chemically synthesized
tggctctaaaactgcaaaacat

SEQ ID NO: 949895 - DNA, 22 bp, Artificial Sequence
  chemically synthesized
agtatgttagcaatgttttgca

SEQ ID NO: 949896 - DNA, 22 bp, Artificial Sequence
  chemically synthesized
taaaactgcaaaacattgctaa

SEQ ID NO: 949897 - DNA, 22 bp, Artificial Sequence
  chemically synthesized
gatcttagtatgttagcaatgt

SEQ ID NO: 949898 - DNA, 22 bp, Artificial Sequence
  chemically synthesized
aaactgcaaaacattgctaaca

SEQ ID NO: 949899 - DNA, 22 bp, Artificial Sequence
  chemically synthesized
tattagatcttagtatgttagc

SEQ ID NO: 949900 - DNA, 22 bp, Artificial Sequence
  chemically synthesized
caaaacattgctaacatactaa

SEQ ID NO: 949901 - DNA, 22 bp, Artificial Sequence
  chemically synthesized
ctaacatactaagatctaatac

SEQ ID NO: 949902 - DNA, 22 bp, Artificial Sequence
  chemically synthesized
acaccatgaaactgtattagat

SEQ ID NO: 949903 - DNA, 22 bp, Artificial Sequence
  chemically synthesized
gacaccatgaaactgtattaga

SEQ ID NO: 949904 - DNA, 22 bp, Artificial Sequence
  chemically synthesized
acatactaagatctaatacagt

SEQ ID NO: 949905 - DNA, 22 bp, Artificial Sequence
  chemically synthesized
tgacaccatgaaactgtattag

SEQ ID NO: 949906 - DNA, 22 bp, Artificial Sequence
  chemically synthesized
ttgacaccatgaaactgtatta

SEQ ID NO: 949907 - DNA, 22 bp, Artificial Sequence
  chemically synthesized
tttttgacaccatgaaactgta

SEQ ID NO: 949908 - DNA, 22 bp, Artificial Sequence
  chemically synthesized
tatttttgacaccatgaaactg

SEQ ID NO: 949909 - DNA, 22 bp, Artificial Sequence
  chemically synthesized
agatctaatacagtttcatggt

SEQ ID NO: 949910 - DNA, 22 bp, Artificial Sequence
  chemically synthesized
aaatactctatttttgacacca

SEQ ID NO: 949911 - DNA, 22 bp, Artificial Sequence
  chemically synthesized
atacagtttcatggtgtcaaaa

SEQ ID NO: 949912 - DNA, 22 bp, Artificial Sequence
  chemically synthesized
gaaatactctatttttgacacc

SEQ ID NO: 949913 - DNA, 22 bp, Artificial Sequence
  chemically synthesized
tgaaatactctatttttgacac

SEQ ID NO: 949914 - DNA, 22 bp, Artificial Sequence
  chemically synthesized
tttgaaatactctatttttgac

SEQ ID NO: 949915 - DNA, 22 bp, Artificial Sequence
  chemically synthesized
ctttgaaatactctatttttga

SEQ ID NO: 949916 - DNA, 22 bp, Artificial Sequence
  chemically synthesized
catggtgtcaaaaatagagtat

SEQ ID NO: 949917 - DNA, 22 bp, Artificial Sequence
  chemically synthesized
atggtgtcaaaaatagagtatt

SEQ ID NO: 949918 - DNA, 22 bp, Artificial Sequence
  chemically synthesized
aatcttctttgaaatactctat

SEQ ID NO: 949919 - DNA, 22 bp, Artificial Sequence
  chemically synthesized
aaatcttctttgaaatactcta

SEQ ID NO: 949920 - DNA, 22 bp, Artificial Sequence
  chemically synthesized
taaatcttctttgaaatactct

SEQ ID NO: 949921 - DNA, 22 bp, Artificial Sequence
  chemically synthesized
cattttaaatcttctttgaaat

SEQ ID NO: 949922 - DNA, 22 bp, Artificial Sequence
  chemically synthesized
ccattttaaatcttctttgaaa

SEQ ID NO: 949923 - DNA, 22 bp, Artificial Sequence
  chemically synthesized
catttccattttaaatcttctt

SEQ ID NO: 949924 - DNA, 22 bp, Artificial Sequence
  chemically synthesized
aatgcattacatttccatttta

SEQ ID NO: 949925 - DNA, 22 bp, Artificial Sequence
  chemically synthesized
caaagaagatttaaaatggaaa

SEQ ID NO: 949926 - DNA, 22 bp, Artificial Sequence
  chemically synthesized
caatgcattacatttccatttt

SEQ ID NO: 949927 - DNA, 22 bp, Artificial Sequence
  chemically synthesized
aaagaagatttaaaatggaaat

SEQ ID NO: 949928 - DNA, 22 bp, Artificial Sequence
  chemically synthesized
atttcaatgcattacatttcca

SEQ ID NO: 949929 - DNA, 22 bp, Artificial Sequence
  chemically synthesized
agttgatttcaatgcattacat

SEQ ID NO: 949930 - DNA, 22 bp, Artificial Sequence
  chemically synthesized
gagttgatttcaatgcattaca

SEQ ID NO: 949931 - DNA, 22 bp, Artificial Sequence
  chemically synthesized
aaaatggaaatgtaatgcattg

SEQ ID NO: 949932 - DNA, 22 bp, Artificial Sequence
  chemically synthesized
aaatggaaatgtaatgcattga

SEQ ID NO: 949933 - DNA, 22 bp, Artificial Sequence
  chemically synthesized
tgtttgagttgatttcaatgca

SEQ ID NO: 949934 - DNA, 22 bp, Artificial Sequence
  chemically synthesized
atgtttgagttgatttcaatgc

SEQ ID NO: 949935 - DNA, 22 bp, Artificial Sequence
  chemically synthesized
aaatcaactcaaacataaattt

SEQ ID NO: 949936 - DNA, 22 bp, Artificial Sequence
  chemically synthesized
aaaaagcaaaatatgtgtgaaa

SEQ ID NO: 949937 - DNA, 22 bp, Artificial Sequence
  chemically synthesized
aaacataaatttcacacatatt

SEQ ID NO: 949938 - DNA, 22 bp, Artificial Sequence
  chemically synthesized
ttaaaaaagcaaaatatgtgtg

SEQ ID NO: 949939 - DNA, 22 bp, Artificial Sequence
  chemically synthesized
gttaaaaaagcaaaatatgtgt

SEQ ID NO: 949940 - DNA, 22 bp, Artificial Sequence
  chemically synthesized
tgttaaaaaagcaaaatatgtg

SEQ ID NO: 949941 - DNA, 22 bp, Artificial Sequence
  chemically synthesized
ttgttaaaaaagcaaaatatgt

SEQ ID NO: 949942 - DNA, 22 bp, Artificial Sequence
  chemically synthesized
gcttttgttaaaaaagcaaaat

SEQ ID NO: 949943 - DNA, 22 bp, Artificial Sequence
  chemically synthesized
cacacatattttgcttttttaa

SEQ ID NO: 949944 - DNA, 22 bp, Artificial Sequence
  chemically synthesized
acacatattttgcttttttaac

SEQ ID NO: 949945 - DNA, 22 bp, Artificial Sequence
  chemically synthesized
ggcagtaacgctggcttttgtt

SEQ ID NO: 949946 - DNA, 22 bp, Artificial Sequence
  chemically synthesized
gggcagtaacgctggcttttgt

SEQ ID NO: 949947 - DNA, 22 bp, Artificial Sequence
  chemically synthesized
tgggcagtaacgctggcttttg

SEQ ID NO: 949948 - DNA, 22 bp, Artificial Sequence
  chemically synthesized
tgcttttttaacaaaagccagc

SEQ ID NO: 949949 - DNA, 22 bp, Artificial Sequence
  chemically synthesized
gcttttttaacaaaagccagcg

SEQ ID NO: 949950 - DNA, 22 bp, Artificial Sequence
  chemically synthesized
cttttttaacaaaagccagcgt

SEQ ID NO: 949951 - DNA, 22 bp, Artificial Sequence
  chemically synthesized
cattttgggcagtaacgctggc

SEQ ID NO: 949952 - DNA, 22 bp, Artificial Sequence
  chemically synthesized
ttttaacaaaagccagcgttac

SEQ ID NO: 949953 - DNA, 22 bp, Artificial Sequence
  chemically synthesized
acattttgggcagtaacgctgg

SEQ ID NO: 949954 - DNA, 22 bp, Artificial Sequence
  chemically synthesized
tttaacaaaagccagcgttact

SEQ ID NO: 949955 - DNA, 22 bp, Artificial Sequence
  chemically synthesized
ttaacaaaagccagcgttactg

SEQ ID NO: 949956 - DNA, 22 bp, Artificial Sequence
  chemically synthesized
taacaaaagccagcgttactgc

SEQ ID NO: 949957 - DNA, 22 bp, Artificial Sequence
  chemically synthesized
aacaaaagccagcgttactgcc

SEQ ID NO: 949958 - DNA, 22 bp, Artificial Sequence
  chemically synthesized
acaaaagccagcgttactgccc

SEQ ID NO: 949959 - DNA, 22 bp, Artificial Sequence
  chemically synthesized
ccagaacatttacattttgggc

SEQ ID NO: 949960 - DNA, 22 bp, Artificial Sequence
  chemically synthesized
accagaacatttacattttggg

SEQ ID NO: 949961 - DNA, 22 bp, Artificial Sequence
  chemically synthesized
taccagaacatttacattttgg

SEQ ID NO: 949962 - DNA, 22 bp, Artificial Sequence
  chemically synthesized
ctttaccagaacatttacattt

SEQ ID NO: 949963 - DNA, 22 bp, Artificial Sequence
  chemically synthesized
cctttaccagaacatttacatt

SEQ ID NO: 949964 - DNA, 22 bp, Artificial Sequence
  chemically synthesized
ctgcccaaaatgtaaatgttct

SEQ ID NO: 949965 - DNA, 22 bp, Artificial Sequence
  chemically synthesized
cccaaaatgtaaatgttctggt

SEQ ID NO: 949966 - DNA, 22 bp, Artificial Sequence
  chemically synthesized
gtgaaaatagcgtacatatctt

SEQ ID NO: 949967 - DNA, 22 bp, Artificial Sequence
  chemically synthesized
tggtaaaggaagatatgtacgc

SEQ ID NO: 949968 - DNA, 22 bp, Artificial Sequence
  chemically synthesized
attggtgaaaatagcgtacata

SEQ ID NO: 949969 - DNA, 22 bp, Artificial Sequence
  chemically synthesized
gtaaaggaagatatgtacgcta

SEQ ID NO: 949970 - DNA, 22 bp, Artificial Sequence
  chemically synthesized
tgaaaattaattggtgaaaata

SEQ ID NO: 949971 - DNA, 22 bp, Artificial Sequence
  chemically synthesized
atgaaaattaattggtgaaaat

SEQ ID NO: 949972 - DNA, 22 bp, Artificial Sequence
  chemically synthesized
tatgaaaattaattggtgaaaa

SEQ ID NO: 949973 - DNA, 22 bp, Artificial Sequence
  chemically synthesized
ttatgaaaattaattggtgaaa

SEQ ID NO: 949974 - DNA, 22 bp, Artificial Sequence
  chemically synthesized
tttatgaaaattaattggtgaa

SEQ ID NO: 949975 - DNA, 22 bp, Artificial Sequence
  chemically synthesized
tttttatgaaaattaattggtg

SEQ ID NO: 949976 - DNA, 22 bp, Artificial Sequence
  chemically synthesized
ctttttatgaaaattaattggt

SEQ ID NO: 949977 - DNA, 22 bp, Artificial Sequence
  chemically synthesized
ggcttctttttatgaaaattaa

SEQ ID NO: 949978 - DNA, 22 bp, Artificial Sequence
  chemically synthesized
ttttcaccaattaattttcata

SEQ ID NO: 949979 - DNA, 22 bp, Artificial Sequence
  chemically synthesized
ctaggcttctttttatgaaaat

SEQ ID NO: 949980 - DNA, 22 bp, Artificial Sequence
  chemically synthesized
actaggcttctttttatgaaaa

SEQ ID NO: 949981 - DNA, 22 bp, Artificial Sequence
  chemically synthesized
tcaccaattaattttcataaaa

SEQ ID NO: 949982 - DNA, 22 bp, Artificial Sequence
  chemically synthesized
caccaattaattttcataaaaa

SEQ ID NO: 949983 - DNA, 22 bp, Artificial Sequence
  chemically synthesized
accaattaattttcataaaaag

SEQ ID NO: 949984 - DNA, 22 bp, Artificial Sequence
  chemically synthesized
tttactaggcttctttttatga

SEQ ID NO: 949985 - DNA, 22 bp, Artificial Sequence
  chemically synthesized
tatttactaggcttctttttat

SEQ ID NO: 949986 - DNA, 22 bp, Artificial Sequence
  chemically synthesized
tgttctatttactaggcttctt

SEQ ID NO: 949987 - DNA, 22 bp, Artificial Sequence
  chemically synthesized
attttcataaaaagaagcctag

SEQ ID NO: 949988 - DNA, 22 bp, Artificial Sequence
  chemically synthesized
atgttctatttactaggcttct

SEQ ID NO: 949989 - DNA, 22 bp, Artificial Sequence
  chemically synthesized
tatgttctatttactaggcttc

SEQ ID NO: 949990 - DNA, 22 bp, Artificial Sequence
  chemically synthesized
tcataaaaagaagcctagtaaa

SEQ ID NO: 949991 - DNA, 22 bp, Artificial Sequence
  chemically synthesized
ttttatgttctatttactaggc

SEQ ID NO: 949992 - DNA, 22 bp, Artificial Sequence
  chemically synthesized
cataaaaagaagcctagtaaat

SEQ ID NO: 949993 - DNA, 22 bp, Artificial Sequence
  chemically synthesized
attttatgttctatttactagg

SEQ ID NO: 949994 - DNA, 22 bp, Artificial Sequence
  chemically synthesized
ataaaaagaagcctagtaaata

SEQ ID NO: 949995 - DNA, 22 bp, Artificial Sequence
  chemically synthesized
aatatttattttatgttctatt

SEQ ID NO: 949996 - DNA, 22 bp, Artificial Sequence
  chemically synthesized
gtaaatagaacataaaataaat

SEQ ID NO: 949997 - DNA, 22 bp, Artificial Sequence
  chemically synthesized
aggatgttaaatatttatttta

SEQ ID NO: 949998 - DNA, 22 bp, Artificial Sequence
  chemically synthesized
aaggatgttaaatatttatttt

SEQ ID NO: 949999 - DNA, 22 bp, Artificial Sequence
  chemically synthesized
gtatttaaggatgttaaatatt

SEQ ID NO: 950000 - DNA, 22 bp, Artificial Sequence
  chemically synthesized
agtatttaaggatgttaaatat

SEQ ID NO: 950001 - DNA, 22 bp, Artificial Sequence
  chemically synthesized
tagtatttaaggatgttaaata

SEQ ID NO: 950002 - DNA, 22 bp, Artificial Sequence
  chemically synthesized
ttagtatttaaggatgttaaat

SEQ ID NO: 950003 - DNA, 22 bp, Artificial Sequence
  chemically synthesized
tttagtatttaaggatgttaaa

SEQ ID NO: 950004 - DNA, 22 bp, Artificial Sequence
  chemically synthesized
attttttagtatttaaggatgt

SEQ ID NO: 950005 - DNA, 22 bp, Artificial Sequence
  chemically synthesized
aacatccttaaatactaaaaaa

SEQ ID NO: 950006 - DNA, 22 bp, Artificial Sequence
  chemically synthesized
acatccttaaatactaaaaaat

SEQ ID NO: 950007 - DNA, 22 bp, Artificial Sequence
  chemically synthesized
ggaagataattaattttttagt

SEQ ID NO: 950008 - DNA, 22 bp, Artificial Sequence
  chemically synthesized
aggaagataattaattttttag

SEQ ID NO: 950009 - DNA, 22 bp, Artificial Sequence
  chemically synthesized
cttaggaagataattaattttt

SEQ ID NO: 950010 - DNA, 22 bp, Artificial Sequence
  chemically synthesized
aaatactaaaaaattaattatc

SEQ ID NO: 950011 - DNA, 22 bp, Artificial Sequence
  chemically synthesized
aatactaaaaaattaattatct

SEQ ID NO: 950012 - DNA, 22 bp, Artificial Sequence
  chemically synthesized
tcacagttccttaggaagataa

SEQ ID NO: 950013 - DNA, 22 bp, Artificial Sequence
  chemically synthesized
gtcacagttccttaggaagata

SEQ ID NO: 950014 - DNA, 22 bp, Artificial Sequence
  chemically synthesized
tgtcacagttccttaggaagat

SEQ ID NO: 950015 - DNA, 22 bp, Artificial Sequence
  chemically synthesized
aaaaattaattatcttcctaag

SEQ ID NO: 950016 - DNA, 22 bp, Artificial Sequence
  chemically synthesized
ttgtcacagttccttaggaaga

SEQ ID NO: 950017 - DNA, 22 bp, Artificial Sequence
  chemically synthesized
tttgtcacagttccttaggaag

SEQ ID NO: 950018 - DNA, 22 bp, Artificial Sequence
  chemically synthesized
tttttgtcacagttccttagga

SEQ ID NO: 950019 - DNA, 22 bp, Artificial Sequence
  chemically synthesized
ctttttgtcacagttccttagg

SEQ ID NO: 950020 - DNA, 22 bp, Artificial Sequence
  chemically synthesized
tctttttgtcacagttccttag

SEQ ID NO: 950021 - DNA, 22 bp, Artificial Sequence
  chemically synthesized
ttctttttgtcacagttcctta

SEQ ID NO: 950022 - DNA, 22 bp, Artificial Sequence
  chemically synthesized
attatcttcctaaggaactgtg

SEQ ID NO: 950023 - DNA, 22 bp, Artificial Sequence
  chemically synthesized
tcttcctaaggaactgtgacaa

SEQ ID NO: 950024 - DNA, 22 bp, Artificial Sequence
  chemically synthesized
cctaaggaactgtgacaaaaag

SEQ ID NO: 950025 - DNA, 22 bp, Artificial Sequence
  chemically synthesized
ctaaggaactgtgacaaaaaga

SEQ ID NO: 950026 - DNA, 22 bp, Artificial Sequence
  chemically synthesized
aggaactgtgacaaaaagaaaa

SEQ ID NO: 950027 - DNA, 22 bp, Artificial Sequence
  chemically synthesized
caaagcaagaaatcacattttt

SEQ ID NO: 950028 - DNA, 22 bp, Artificial Sequence
  chemically synthesized
tgacaaaaagaaaaatgtgatt

SEQ ID NO: 950029 - DNA, 22 bp, Artificial Sequence
  chemically synthesized
acctacaaagcaagaaatcaca

SEQ ID NO: 950030 - DNA, 22 bp, Artificial Sequence
  chemically synthesized
gacctacaaagcaagaaatcac

SEQ ID NO: 950031 - DNA, 22 bp, Artificial Sequence
  chemically synthesized
tgacctacaaagcaagaaatca

SEQ ID NO: 950032 - DNA, 22 bp, Artificial Sequence
  chemically synthesized
cttgctttgtaggtcaaaatac

SEQ ID NO: 950033 - DNA, 22 bp, Artificial Sequence
  chemically synthesized
ttgctttgtaggtcaaaatact

SEQ ID NO: 950034 - DNA, 22 bp, Artificial Sequence
  chemically synthesized
agtagcaaataaagtattttga

SEQ ID NO: 950035 - DNA, 22 bp, Artificial Sequence
  chemically synthesized
aagtagcaaataaagtattttg

SEQ ID NO: 950036 - DNA, 22 bp, Artificial Sequence
  chemically synthesized
gctttgtaggtcaaaatacttt

SEQ ID NO: 950037 - DNA, 22 bp, Artificial Sequence
  chemically synthesized
ctttgtaggtcaaaatacttta

SEQ ID NO: 950038 - DNA, 22 bp, Artificial Sequence
  chemically synthesized
tgtaggtcaaaatactttattt

SEQ ID NO: 950039 - DNA, 22 bp, Artificial Sequence
  chemically synthesized
gtaggtcaaaatactttatttg

SEQ ID NO: 950040 - DNA, 22 bp, Artificial Sequence
  chemically synthesized
taggtcaaaatactttatttgc

SEQ ID NO: 950041 - DNA, 22 bp, Artificial Sequence
  chemically synthesized
aaaatttaagtagcaaataaag

SEQ ID NO: 950042 - DNA, 22 bp, Artificial Sequence
  chemically synthesized
aatggaattgaaaatttaagta

SEQ ID NO: 950043 - DNA, 22 bp, Artificial Sequence
  chemically synthesized
ttgaatggaattgaaaatttaa

SEQ ID NO: 950044 - DNA, 22 bp, Artificial Sequence
  chemically synthesized
tatttgctacttaaattttcaa

SEQ ID NO: 950045 - DNA, 22 bp, Artificial Sequence
  chemically synthesized
atttgctacttaaattttcaat

SEQ ID NO: 950046 - DNA, 22 bp, Artificial Sequence
  chemically synthesized
tttgctacttaaattttcaatt

SEQ ID NO: 950047 - DNA, 22 bp, Artificial Sequence
  chemically synthesized
gctacttaaattttcaattcca

SEQ ID NO: 950048 - DNA, 22 bp, Artificial Sequence
  chemically synthesized
ctacttaaattttcaattccat

SEQ ID NO: 950049 - DNA, 22 bp, Artificial Sequence
  chemically synthesized
cttaaattttcaattccattca

SEQ ID NO: 950050 - DNA, 22 bp, Artificial Sequence
  chemically synthesized
aaattttcaattccattcaaca

SEQ ID NO: 950051 - DNA, 22 bp, Artificial Sequence
  chemically synthesized
aattttcaattccattcaacaa

SEQ ID NO: 950052 - DNA, 22 bp, Artificial Sequence
  chemically synthesized
tcaattccattcaacaactatt

SEQ ID NO: 950053 - DNA, 22 bp, Artificial Sequence
  chemically synthesized
caattccattcaacaactattt

SEQ ID NO: 950054 - DNA, 22 bp, Artificial Sequence
  chemically synthesized
aattccattcaacaactattta

SEQ ID NO: 950055 - DNA, 22 bp, Artificial Sequence
  chemically synthesized
cattcaacaactatttactgac

SEQ ID NO: 950056 - DNA, 22 bp, Artificial Sequence
  chemically synthesized
gcatataagaacaagtcagtaa

SEQ ID NO: 950057 - DNA, 22 bp, Artificial Sequence
  chemically synthesized
aacaactatttactgacttgtt

SEQ ID NO: 950058 - DNA, 22 bp, Artificial Sequence
  chemically synthesized
tttactgacttgttcttatatg

SEQ ID NO: 950059 - DNA, 22 bp, Artificial Sequence
  chemically synthesized
acacagggtctggcatataaga

SEQ ID NO: 950060 - DNA, 22 bp, Artificial Sequence
  chemically synthesized
actgacttgttcttatatgcca

SEQ ID NO: 950061 - DNA, 22 bp, Artificial Sequence
  chemically synthesized
taacacagggtctggcatataa

SEQ ID NO: 950062 - DNA, 22 bp, Artificial Sequence
  chemically synthesized
ctgacttgttcttatatgccag

SEQ ID NO: 950063 - DNA, 22 bp, Artificial Sequence
  chemically synthesized
acttgttcttatatgccagacc

SEQ ID NO: 950064 - DNA, 22 bp, Artificial Sequence
  chemically synthesized
gttcttatatgccagaccctgt

SEQ ID NO: 950065 - DNA, 22 bp, Artificial Sequence
  chemically synthesized
ttcttatatgccagaccctgtg

SEQ ID NO: 950066 - DNA, 22 bp, Artificial Sequence
  chemically synthesized
ttatatgccagaccctgtgtta

SEQ ID NO: 950067 - DNA, 22 bp, Artificial Sequence
  chemically synthesized
tgtacacagttctaacacaggg

SEQ ID NO: 950068 - DNA, 22 bp, Artificial Sequence
  chemically synthesized
gtgtacacagttctaacacagg

SEQ ID NO: 950069 - DNA, 22 bp, Artificial Sequence
  chemically synthesized
atatgccagaccctgtgttaga

SEQ ID NO: 950070 - DNA, 22 bp, Artificial Sequence
  chemically synthesized
tatgccagaccctgtgttagaa

SEQ ID NO: 950071 - DNA, 22 bp, Artificial Sequence
  chemically synthesized
atttgtgtacacagttctaaca

SEQ ID NO: 950072 - DNA, 22 bp, Artificial Sequence
  chemically synthesized
tgttagaactgtgtacacaaat

SEQ ID NO: 950073 - DNA, 22 bp, Artificial Sequence
  chemically synthesized
gaactgtgtacacaaattaatg

SEQ ID NO: 950074 - DNA, 22 bp, Artificial Sequence
  chemically synthesized
tgtacacaaattaatgtgatat

SEQ ID NO: 950075 - DNA, 22 bp, Artificial Sequence
  chemically synthesized
tggatatgaacatggacaatat

SEQ ID NO: 950076 - DNA, 22 bp, Artificial Sequence
  chemically synthesized
gactatggatatgaacatggac

SEQ ID NO: 950077 - DNA, 22 bp, Artificial Sequence
  chemically synthesized
atgtgatattgtccatgttcat

SEQ ID NO: 950078 - DNA, 22 bp, Artificial Sequence
  chemically synthesized
agatgggttggactatggatat

SEQ ID NO: 950079 - DNA, 22 bp, Artificial Sequence
  chemically synthesized
tccatgttcatatccatagtcc

SEQ ID NO: 950080 - DNA, 22 bp, Artificial Sequence
  chemically synthesized
cctaagatgggttggactatgg

SEQ ID NO: 950081 - DNA, 22 bp, Artificial Sequence
  chemically synthesized
aactccctaagatgggttggac

SEQ ID NO: 950082 - DNA, 22 bp, Artificial Sequence
  chemically synthesized
aaactccctaagatgggttgga

SEQ ID NO: 950083 - DNA, 22 bp, Artificial Sequence
  chemically synthesized
atatccatagtccaacccatct

SEQ ID NO: 950084 - DNA, 22 bp, Artificial Sequence
  chemically synthesized
ttaaactccctaagatgggttg

SEQ ID NO: 950085 - DNA, 22 bp, Artificial Sequence
  chemically synthesized
cttaaactccctaagatgggtt

SEQ ID NO: 950086 - DNA, 22 bp, Artificial Sequence
  chemically synthesized
agatgaagtgcttcttaaactc

SEQ ID NO: 950087 - DNA, 22 bp, Artificial Sequence
  chemically synthesized
aagatgaagtgcttcttaaact

SEQ ID NO: 950088 - DNA, 22 bp, Artificial Sequence
  chemically synthesized
gtcttaagatgaagtgcttctt

SEQ ID NO: 950089 - DNA, 22 bp, Artificial Sequence
  chemically synthesized
agtcttaagatgaagtgcttct

SEQ ID NO: 950090 - DNA, 22 bp, Artificial Sequence
  chemically synthesized
tagtcttaagatgaagtgcttc

SEQ ID NO: 950091 - DNA, 22 bp, Artificial Sequence
  chemically synthesized
agggagtttaagaagcacttca

SEQ ID NO: 950092 - DNA, 22 bp, Artificial Sequence
  chemically synthesized
gggagtttaagaagcacttcat

SEQ ID NO: 950093 - DNA, 22 bp, Artificial Sequence
  chemically synthesized
aagaagcacttcatcttaagac

SEQ ID NO: 950094 - DNA, 22 bp, Artificial Sequence
  chemically synthesized
agaagcacttcatcttaagact

SEQ ID NO: 950095 - DNA, 22 bp, Artificial Sequence
  chemically synthesized
aaataatagctttagtcttaag

SEQ ID NO: 950096 - DNA, 22 bp, Artificial Sequence
  chemically synthesized
catcttaagactaaagctatta

SEQ ID NO: 950097 - DNA, 22 bp, Artificial Sequence
  chemically synthesized
atcttaagactaaagctattat

SEQ ID NO: 950098 - DNA, 22 bp, Artificial Sequence
  chemically synthesized
taaacacacctaaaataatagc

SEQ ID NO: 950099 - DNA, 22 bp, Artificial Sequence
  chemically synthesized
aagactaaagctattattttag

SEQ ID NO: 950100 - DNA, 22 bp, Artificial Sequence
  chemically synthesized
agactaaagctattattttagg

SEQ ID NO: 950101 - DNA, 22 bp, Artificial Sequence
  chemically synthesized
gatattataaacacacctaaaa

SEQ ID NO: 950102 - DNA, 22 bp, Artificial Sequence
  chemically synthesized
agatattataaacacacctaaa

SEQ ID NO: 950103 - DNA, 22 bp, Artificial Sequence
  chemically synthesized
aagctattattttaggtgtgtt

SEQ ID NO: 950104 - DNA, 22 bp, Artificial Sequence
  chemically synthesized
atttagatattataaacacacc

SEQ ID NO: 950105 - DNA, 22 bp, Artificial Sequence
  chemically synthesized
gatttagatattataaacacac

SEQ ID NO: 950106 - DNA, 22 bp, Artificial Sequence
  chemically synthesized
tgatttagatattataaacaca

SEQ ID NO: 950107 - DNA, 22 bp, Artificial Sequence
  chemically synthesized
ttattttaggtgtgtttataat

SEQ ID NO: 950108 - DNA, 22 bp, Artificial Sequence
  chemically synthesized
ttttaggtgtgtttataatatc

SEQ ID NO: 950109 - DNA, 22 bp, Artificial Sequence
  chemically synthesized
agaattttgatttagatattat

SEQ ID NO: 950110 - DNA, 22 bp, Artificial Sequence
  chemically synthesized
taggtgtgtttataatatctaa

SEQ ID NO: 950111 - DNA, 22 bp, Artificial Sequence
  chemically synthesized
cagaattttgatttagatatta

SEQ ID NO: 950112 - DNA, 22 bp, Artificial Sequence
  chemically synthesized
aggtgtgtttataatatctaaa

SEQ ID NO: 950113 - DNA, 22 bp, Artificial Sequence
  chemically synthesized
ggtgtgtttataatatctaaat

SEQ ID NO: 950114 - DNA, 22 bp, Artificial Sequence
  chemically synthesized
tatttcagaattttgatttaga

SEQ ID NO: 950115 - DNA, 22 bp, Artificial Sequence
  chemically synthesized
ataatatctaaatcaaaattct

SEQ ID NO: 950116 - DNA, 22 bp, Artificial Sequence
  chemically synthesized
taatatctaaatcaaaattctg

SEQ ID NO: 950117 - DNA, 22 bp, Artificial Sequence
  chemically synthesized
caaaataattgtatttcagaat

SEQ ID NO: 950118 - DNA, 22 bp, Artificial Sequence
  chemically synthesized
gcaaaataattgtatttcagaa

SEQ ID NO: 950119 - DNA, 22 bp, Artificial Sequence
  chemically synthesized
tgcaaaataattgtatttcaga

SEQ ID NO: 950120 - DNA, 22 bp, Artificial Sequence
  chemically synthesized
ttgcaaaataattgtatttcag

SEQ ID NO: 950121 - DNA, 22 bp, Artificial Sequence
  chemically synthesized
aatcaaaattctgaaatacaat

SEQ ID NO: 950122 - DNA, 22 bp, Artificial Sequence
  chemically synthesized
tcgtcttttgcaaaataattgt

SEQ ID NO: 950123 - DNA, 22 bp, Artificial Sequence
  chemically synthesized
gtcgtcttttgcaaaataattg

SEQ ID NO: 950124 - DNA, 22 bp, Artificial Sequence
  chemically synthesized
tgtcgtcttttgcaaaataatt

SEQ ID NO: 950125 - DNA, 22 bp, Artificial Sequence
  chemically synthesized
ttgtcgtcttttgcaaaataat

SEQ ID NO: 950126 - DNA, 22 bp, Artificial Sequence
  chemically synthesized
tgaaatacaattattttgcaaa

SEQ ID NO: 950127 - DNA, 22 bp, Artificial Sequence
  chemically synthesized
aaatacaattattttgcaaaag

SEQ ID NO: 950128 - DNA, 22 bp, Artificial Sequence
  chemically synthesized
agtaaaatgatgcttttgtcgt

SEQ ID NO: 950129 - DNA, 22 bp, Artificial Sequence
  chemically synthesized
ttttgcaaaagacgacaaaagc

SEQ ID NO: 950130 - DNA, 22 bp, Artificial Sequence
  chemically synthesized
tgcaaaagacgacaaaagcatc

SEQ ID NO: 950131 - DNA, 22 bp, Artificial Sequence
  chemically synthesized
gcaaaagacgacaaaagcatca

SEQ ID NO: 950132 - DNA, 22 bp, Artificial Sequence
  chemically synthesized
caaaagacgacaaaagcatcat

SEQ ID NO: 950133 - DNA, 22 bp, Artificial Sequence
  chemically synthesized
aggatcagttgagtaaaatgat

SEQ ID NO: 950134 - DNA, 22 bp, Artificial Sequence
  chemically synthesized
caggatcagttgagtaaaatga

SEQ ID NO: 950135 - DNA, 22 bp, Artificial Sequence
  chemically synthesized
aaacttcaggatcagttgagta

SEQ ID NO: 950136 - DNA, 22 bp, Artificial Sequence
  chemically synthesized
aaaacttcaggatcagttgagt

SEQ ID NO: 950137 - DNA, 22 bp, Artificial Sequence
  chemically synthesized
tactcaactgatcctgaagttt

SEQ ID NO: 950138 - DNA, 22 bp, Artificial Sequence
  chemically synthesized
actcaactgatcctgaagtttt

SEQ ID NO: 950139 - DNA, 22 bp, Artificial Sequence
  chemically synthesized
ctcaactgatcctgaagtttta

SEQ ID NO: 950140 - DNA, 22 bp, Artificial Sequence
  chemically synthesized
aatcaaatatgccttaaaactt

SEQ ID NO: 950141 - DNA, 22 bp, Artificial Sequence
  chemically synthesized
aactgatcctgaagttttaagg

SEQ ID NO: 950142 - DNA, 22 bp, Artificial Sequence
  chemically synthesized
aaatcaaatatgccttaaaact

SEQ ID NO: 950143 - DNA, 22 bp, Artificial Sequence
  chemically synthesized
taaatcaaatatgccttaaaac

SEQ ID NO: 950144 - DNA, 22 bp, Artificial Sequence
  chemically synthesized
ttaaatcaaatatgccttaaaa

SEQ ID NO: 950145 - DNA, 22 bp, Artificial Sequence
  chemically synthesized
tttaaatcaaatatgccttaaa

SEQ ID NO: 950146 - DNA, 22 bp, Artificial Sequence
  chemically synthesized
atcctgaagttttaaggcatat

SEQ ID NO: 950147 - DNA, 22 bp, Artificial Sequence
  chemically synthesized
aattttttaaatcaaatatgcc

SEQ ID NO: 950148 - DNA, 22 bp, Artificial Sequence
  chemically synthesized
aaattttttaaatcaaatatgc

SEQ ID NO: 950149 - DNA, 22 bp, Artificial Sequence
  chemically synthesized
taaattttttaaatcaaatatg

SEQ ID NO: 950150 - DNA, 22 bp, Artificial Sequence
  chemically synthesized
aagttttaaggcatatttgatt

SEQ ID NO: 950151 - DNA, 22 bp, Artificial Sequence
  chemically synthesized
ttaaattttttaaatcaaatat

SEQ ID NO: 950152 - DNA, 22 bp, Artificial Sequence
  chemically synthesized
tttaaattttttaaatcaaata

SEQ ID NO: 950153 - DNA, 22 bp, Artificial Sequence
  chemically synthesized
ttttaaattttttaaatcaaat

SEQ ID NO: 950154 - DNA, 22 bp, Artificial Sequence
  chemically synthesized
ttttttaaattttttaaatcaa

SEQ ID NO: 950155 - DNA, 22 bp, Artificial Sequence
  chemically synthesized
cttttttaaattttttaaatca

SEQ ID NO: 950156 - DNA, 22 bp, Artificial Sequence
  chemically synthesized
taaggcatatttgatttaaaaa

SEQ ID NO: 950157 - DNA, 22 bp, Artificial Sequence
  chemically synthesized
tcttttttaaattttttaaatc

SEQ ID NO: 950158 - DNA, 22 bp, Artificial Sequence
  chemically synthesized
aaggcatatttgatttaaaaaa

SEQ ID NO: 950159 - DNA, 22 bp, Artificial Sequence
  chemically synthesized
aggcatatttgatttaaaaaat

SEQ ID NO: 950160 - DNA, 22 bp, Artificial Sequence
  chemically synthesized
tttcttttttaaattttttaaa

SEQ ID NO: 950161 - DNA, 22 bp, Artificial Sequence
  chemically synthesized
gatttaaaaaatttaaaaaaga

SEQ ID NO: 950162 - DNA, 22 bp, Artificial Sequence
  chemically synthesized
atttaaaaaatttaaaaaagaa

SEQ ID NO: 950163 - DNA, 22 bp, Artificial Sequence
  chemically synthesized
ccaaccccaattctttcttttt

SEQ ID NO: 950164 - DNA, 22 bp, Artificial Sequence
  chemically synthesized
cccaaccccaattctttctttt

SEQ ID NO: 950165 - DNA, 22 bp, Artificial Sequence
  chemically synthesized
aaaaaatttaaaaaagaaagaa

SEQ ID NO: 950166 - DNA, 22 bp, Artificial Sequence
  chemically synthesized
tcccaaccccaattctttcttt

SEQ ID NO: 950167 - DNA, 22 bp, Artificial Sequence
  chemically synthesized
aaaaatttaaaaaagaaagaat

SEQ ID NO: 950168 - DNA, 22 bp, Artificial Sequence
  chemically synthesized
ccctttcccaaccccaattctt

SEQ ID NO: 950169 - DNA, 22 bp, Artificial Sequence
  chemically synthesized
aaaaaagaaagaattggggttg

SEQ ID NO: 950170 - DNA, 22 bp, Artificial Sequence
  chemically synthesized
aaaaagaaagaattggggttgg

SEQ ID NO: 950171 - DNA, 22 bp, Artificial Sequence
  chemically synthesized
tactcccctttcccaaccccaa

SEQ ID NO: 950172 - DNA, 22 bp, Artificial Sequence
  chemically synthesized
atactcccctttcccaacccca

SEQ ID NO: 950173 - DNA, 22 bp, Artificial Sequence
  chemically synthesized
tatcatcagtttatactcccct

SEQ ID NO: 950174 - DNA, 22 bp, Artificial Sequence
  chemically synthesized
atatcatcagtttatactcccc

SEQ ID NO: 950175 - DNA, 22 bp, Artificial Sequence
  chemically synthesized
gggttgggaaaggggagtataa

SEQ ID NO: 950176 - DNA, 22 bp, Artificial Sequence
  chemically synthesized
tatatcatcagtttatactccc

SEQ ID NO: 950177 - DNA, 22 bp, Artificial Sequence
  chemically synthesized
ttatatcatcagtttatactcc

SEQ ID NO: 950178 - DNA, 22 bp, Artificial Sequence
  chemically synthesized
ggaaaggggagtataaactgat

SEQ ID NO: 950179 - DNA, 22 bp, Artificial Sequence
  chemically synthesized
agtgatttttatatcatcagtt

SEQ ID NO: 950180 - DNA, 22 bp, Artificial Sequence
  chemically synthesized
aattgagtgatttttatatcat

SEQ ID NO: 950181 - DNA, 22 bp, Artificial Sequence
  chemically synthesized
gagtctaaattgagtgattttt

SEQ ID NO: 950182 - DNA, 22 bp, Artificial Sequence
  chemically synthesized
ctagagtctaaattgagtgatt

SEQ ID NO: 950183 - DNA, 22 bp, Artificial Sequence
  chemically synthesized
actagagtctaaattgagtgat

SEQ ID NO: 950184 - DNA, 22 bp, Artificial Sequence
  chemically synthesized
atgatataaaaatcactcaatt

SEQ ID NO: 950185 - DNA, 22 bp, Artificial Sequence
  chemically synthesized
tgtccttactagagtctaaatt

SEQ ID NO: 950186 - DNA, 22 bp, Artificial Sequence
  chemically synthesized
gtgtccttactagagtctaaat

SEQ ID NO: 950187 - DNA, 22 bp, Artificial Sequence
  chemically synthesized
ttgtgtccttactagagtctaa

SEQ ID NO: 950188 - DNA, 22 bp, Artificial Sequence
  chemically synthesized
gtaattcttgtgtccttactag

SEQ ID NO: 950189 - DNA, 22 bp, Artificial Sequence
  chemically synthesized
ggtaattcttgtgtccttacta

SEQ ID NO: 950190 - DNA, 22 bp, Artificial Sequence
  chemically synthesized
aatttagactctagtaaggaca

SEQ ID NO: 950191 - DNA, 22 bp, Artificial Sequence
  chemically synthesized
tggtaattcttgtgtccttact

SEQ ID NO: 950192 - DNA, 22 bp, Artificial Sequence
  chemically synthesized
ttttggtaattcttgtgtcctt

SEQ ID NO: 950193 - DNA, 22 bp, Artificial Sequence
  chemically synthesized
agactctagtaaggacacaaga

SEQ ID NO: 950194 - DNA, 22 bp, Artificial Sequence
  chemically synthesized
gactctagtaaggacacaagaa

SEQ ID NO: 950195 - DNA, 22 bp, Artificial Sequence
  chemically synthesized
tagtaaggacacaagaattacc

SEQ ID NO: 950196 - DNA, 22 bp, Artificial Sequence
  chemically synthesized
gtaaggacacaagaattaccaa

SEQ ID NO: 950197 - DNA, 22 bp, Artificial Sequence
  chemically synthesized
aatgagaagtaactgttttggt

SEQ ID NO: 950198 - DNA, 22 bp, Artificial Sequence
  chemically synthesized
ccaaaacagttacttctcattt

SEQ ID NO: 950199 - DNA, 22 bp, Artificial Sequence
  chemically synthesized
aacaaaccaaaatgattaaatg

SEQ ID NO: 950200 - DNA, 22 bp, Artificial Sequence
  chemically synthesized
aaacaaaccaaaatgattaaat

SEQ ID NO: 950201 - DNA, 22 bp, Artificial Sequence
  chemically synthesized
cttctcatttaatcattttggt

SEQ ID NO: 950202 - DNA, 22 bp, Artificial Sequence
  chemically synthesized
aagagtttaaacaaaccaaaat

SEQ ID NO: 950203 - DNA, 22 bp, Artificial Sequence
  chemically synthesized
ctcatttaatcattttggtttg

SEQ ID NO: 950204 - DNA, 22 bp, Artificial Sequence
  chemically synthesized
tcatttaatcattttggtttgt

SEQ ID NO: 950205 - DNA, 22 bp, Artificial Sequence
  chemically synthesized
atttaatcattttggtttgttt

SEQ ID NO: 950206 - DNA, 22 bp, Artificial Sequence
  chemically synthesized
aatcattttggtttgtttaaac

SEQ ID NO: 950207 - DNA, 22 bp, Artificial Sequence
  chemically synthesized
atcattttggtttgtttaaact

SEQ ID NO: 950208 - DNA, 22 bp, Artificial Sequence
  chemically synthesized
ccaaataactaaagagtttaaa

SEQ ID NO: 950209 - DNA, 22 bp, Artificial Sequence
  chemically synthesized
cccaaataactaaagagtttaa

SEQ ID NO: 950210 - DNA, 22 bp, Artificial Sequence
  chemically synthesized
tcccaaataactaaagagttta

SEQ ID NO: 950211 - DNA, 22 bp, Artificial Sequence
  chemically synthesized
tttcccaaataactaaagagtt

SEQ ID NO: 950212 - DNA, 22 bp, Artificial Sequence
  chemically synthesized
tggtttgtttaaactctttagt

SEQ ID NO: 950213 - DNA, 22 bp, Artificial Sequence
  chemically synthesized
ctttcccaaataactaaagagt

SEQ ID NO: 950214 - DNA, 22 bp, Artificial Sequence
  chemically synthesized
ggtttgtttaaactctttagtt

SEQ ID NO: 950215 - DNA, 22 bp, Artificial Sequence
  chemically synthesized
gtttgtttaaactctttagtta

SEQ ID NO: 950216 - DNA, 22 bp, Artificial Sequence
  chemically synthesized
gtttaaactctttagttatttg

SEQ ID NO: 950217 - DNA, 22 bp, Artificial Sequence
  chemically synthesized
tttaaactctttagttatttgg

SEQ ID NO: 950218 - DNA, 22 bp, Artificial Sequence
  chemically synthesized
aatacatttctttcccaaataa

SEQ ID NO: 950219 - DNA, 22 bp, Artificial Sequence
  chemically synthesized
aaactctttagttatttgggaa

SEQ ID NO: 950220 - DNA, 22 bp, Artificial Sequence
  chemically synthesized
aactctttagttatttgggaaa

SEQ ID NO: 950221 - DNA, 22 bp, Artificial Sequence
  chemically synthesized
tttagttatttgggaaagaaat

SEQ ID NO: 950222 - DNA, 22 bp, Artificial Sequence
  chemically synthesized
tagttatttgggaaagaaatgt

SEQ ID NO: 950223 - DNA, 22 bp, Artificial Sequence
  chemically synthesized
agttatttgggaaagaaatgta

SEQ ID NO: 950224 - DNA, 22 bp, Artificial Sequence
  chemically synthesized
gttatttgggaaagaaatgtat

SEQ ID NO: 950225 - DNA, 22 bp, Artificial Sequence
  chemically synthesized
tttgggaaagaaatgtattgag

SEQ ID NO: 950226 - DNA, 22 bp, Artificial Sequence
  chemically synthesized
acacacagcaggtactcaatac

SEQ ID NO: 950227 - DNA, 22 bp, Artificial Sequence
  chemically synthesized
gggaaagaaatgtattgagtac

SEQ ID NO: 950228 - DNA, 22 bp, Artificial Sequence
  chemically synthesized
ggaaagaaatgtattgagtacc

SEQ ID NO: 950229 - DNA, 22 bp, Artificial Sequence
  chemically synthesized
gcaccatatctaacacacagca

SEQ ID NO: 950230 - DNA, 22 bp, Artificial Sequence
  chemically synthesized
agtacctgctgtgtgttagata

SEQ ID NO: 950231 - DNA, 22 bp, Artificial Sequence
  chemically synthesized
ctgtgtgttagatatggtgcta

SEQ ID NO: 950232 - DNA, 22 bp, Artificial Sequence
  chemically synthesized
tgtgttagatatggtgctaggt

SEQ ID NO: 950233 - DNA, 22 bp, Artificial Sequence
  chemically synthesized
gatatggtgctaggtcctatat

SEQ ID NO: 950234 - DNA, 22 bp, Artificial Sequence
  chemically synthesized
gatcagtcatatcacacatcca

SEQ ID NO: 950235 - DNA, 22 bp, Artificial Sequence
  chemically synthesized
ggtcctatatgtggatgtgtga

SEQ ID NO: 950236 - DNA, 22 bp, Artificial Sequence
  chemically synthesized
tatgtggatgtgtgatatgact

SEQ ID NO: 950237 - DNA, 22 bp, Artificial Sequence
  chemically synthesized
cggtaggataagaactggatca

SEQ ID NO: 950238 - DNA, 22 bp, Artificial Sequence
  chemically synthesized
gaatgtaagttacggtaggata

SEQ ID NO: 950239 - DNA, 22 bp, Artificial Sequence
  chemically synthesized
atccagttcttatcctaccgta

SEQ ID NO: 950240 - DNA, 22 bp, Artificial Sequence
  chemically synthesized
ctagaatgtaagttacggtagg

SEQ ID NO: 950241 - DNA, 22 bp, Artificial Sequence
  chemically synthesized
cctactagaatgtaagttacgg

SEQ ID NO: 950242 - DNA, 22 bp, Artificial Sequence
  chemically synthesized
ttatcctaccgtaacttacatt

SEQ ID NO: 950243 - DNA, 22 bp, Artificial Sequence
  chemically synthesized
atcctaccgtaacttacattct

SEQ ID NO: 950244 - DNA, 22 bp, Artificial Sequence
  chemically synthesized
tcctaccgtaacttacattcta

SEQ ID NO: 950245 - DNA, 22 bp, Artificial Sequence
  chemically synthesized
atgcaattgcctactagaatgt

SEQ ID NO: 950246 - DNA, 22 bp, Artificial Sequence
  chemically synthesized
tcatgcaattgcctactagaat

SEQ ID NO: 950247 - DNA, 22 bp, Artificial Sequence
  chemically synthesized
ccgtaacttacattctagtagg

SEQ ID NO: 950248 - DNA, 22 bp, Artificial Sequence
  chemically synthesized
aggaactctcatgcaattgcct

SEQ ID NO: 950249 - DNA, 22 bp, Artificial Sequence
  chemically synthesized
aaggaactctcatgcaattgcc

SEQ ID NO: 950250 - DNA, 22 bp, Artificial Sequence
  chemically synthesized
acattctagtaggcaattgcat

SEQ ID NO: 950251 - DNA, 22 bp, Artificial Sequence
  chemically synthesized
cattctagtaggcaattgcatg

SEQ ID NO: 950252 - DNA, 22 bp, Artificial Sequence
  chemically synthesized
ttaaggaactctcatgcaattg

SEQ ID NO: 950253 - DNA, 22 bp, Artificial Sequence
  chemically synthesized
tagtaggcaattgcatgagagt

SEQ ID NO: 950254 - DNA, 22 bp, Artificial Sequence
  chemically synthesized
tagctcttaaggaactctcatg

SEQ ID NO: 950255 - DNA, 22 bp, Artificial Sequence
  chemically synthesized
gtaggcaattgcatgagagttc

SEQ ID NO: 950256 - DNA, 22 bp, Artificial Sequence
  chemically synthesized
ttatagctcttaaggaactctc

SEQ ID NO: 950257 - DNA, 22 bp, Artificial Sequence
  chemically synthesized
ctattatagctcttaaggaact

SEQ ID NO: 950258 - DNA, 22 bp, Artificial Sequence
  chemically synthesized
tgctattatagctcttaaggaa

SEQ ID NO: 950259 - DNA, 22 bp, Artificial Sequence
  chemically synthesized
ctgctattatagctcttaagga

SEQ ID NO: 950260 - DNA, 22 bp, Artificial Sequence
  chemically synthesized
catgagagttccttaagagcta

SEQ ID NO: 950261 - DNA, 22 bp, Artificial Sequence
  chemically synthesized
tatttctgctattatagctctt

SEQ ID NO: 950262 - DNA, 22 bp, Artificial Sequence
  chemically synthesized
gaagcctgtatttctgctatta

SEQ ID NO: 950263 - DNA, 22 bp, Artificial Sequence
  chemically synthesized
cttaagagctataatagcagaa

SEQ ID NO: 950264 - DNA, 22 bp, Artificial Sequence
  chemically synthesized
agaagcctgtatttctgctatt

SEQ ID NO: 950265 - DNA, 22 bp, Artificial Sequence
  chemically synthesized
tagaagcctgtatttctgctat

SEQ ID NO: 950266 - DNA, 22 bp, Artificial Sequence
  chemically synthesized
ttagaagcctgtatttctgcta

SEQ ID NO: 950267 - DNA, 22 bp, Artificial Sequence
  chemically synthesized
aagagctataatagcagaaata

SEQ ID NO: 950268 - DNA, 22 bp, Artificial Sequence
  chemically synthesized
tttagaagcctgtatttctgct

SEQ ID NO: 950269 - DNA, 22 bp, Artificial Sequence
  chemically synthesized
agagctataatagcagaaatac

SEQ ID NO: 950270 - DNA, 22 bp, Artificial Sequence
  chemically synthesized
ttttttagaagcctgtatttct

SEQ ID NO: 950271 - DNA, 22 bp, Artificial Sequence
  chemically synthesized
tgttttttagaagcctgtattt

SEQ ID NO: 950272 - DNA, 22 bp, Artificial Sequence
  chemically synthesized
ctgttttttagaagcctgtatt

SEQ ID NO: 950273 - DNA, 22 bp, Artificial Sequence
  chemically synthesized
tctgttttttagaagcctgtat

SEQ ID NO: 950274 - DNA, 22 bp, Artificial Sequence
  chemically synthesized
taatagcagaaatacaggcttc

SEQ ID NO: 950275 - DNA, 22 bp, Artificial Sequence
  chemically synthesized
tttctgttttttagaagcctgt

SEQ ID NO: 950276 - DNA, 22 bp, Artificial Sequence
  chemically synthesized
ctttctgttttttagaagcctg

SEQ ID NO: 950277 - DNA, 22 bp, Artificial Sequence
  chemically synthesized
ctaaaaaacagaaagaaataca

SEQ ID NO: 950278 - DNA, 22 bp, Artificial Sequence
  chemically synthesized
taaaaaacagaaagaaatacac

SEQ ID NO: 950279 - DNA, 22 bp, Artificial Sequence
  chemically synthesized
gtagaggagaaggtgtatttct

SEQ ID NO: 950280 - DNA, 22 bp, Artificial Sequence
  chemically synthesized
aaaaacagaaagaaatacacct

SEQ ID NO: 950281 - DNA, 22 bp, Artificial Sequence
  chemically synthesized
tagtagaggagaaggtgtattt

SEQ ID NO: 950282 - DNA, 22 bp, Artificial Sequence
  chemically synthesized
acactctagtagaggagaaggt

SEQ ID NO: 950283 - DNA, 22 bp, Artificial Sequence
  chemically synthesized
taacactctagtagaggagaag

SEQ ID NO: 950284 - DNA, 22 bp, Artificial Sequence
  chemically synthesized
ctaacactctagtagaggagaa

SEQ ID NO: 950285 - DNA, 22 bp, Artificial Sequence
  chemically synthesized
tctaacactctagtagaggaga

SEQ ID NO: 950286 - DNA, 22 bp, Artificial Sequence
  chemically synthesized
ttctaacactctagtagaggag

SEQ ID NO: 950287 - DNA, 22 bp, Artificial Sequence
  chemically synthesized
tatgtgtttttctaacactcta

SEQ ID NO: 950288 - DNA, 22 bp, Artificial Sequence
  chemically synthesized
ctcctctactagagtgttagaa

SEQ ID NO: 950289 - DNA, 22 bp, Artificial Sequence
  chemically synthesized
ctatatgtgtttttctaacact

SEQ ID NO: 950290 - DNA, 22 bp, Artificial Sequence
  chemically synthesized
tcctctactagagtgttagaaa

SEQ ID NO: 950291 - DNA, 22 bp, Artificial Sequence
  chemically synthesized
ctctactagagtgttagaaaaa

SEQ ID NO: 950292 - DNA, 22 bp, Artificial Sequence
  chemically synthesized
tactagagtgttagaaaaacac

SEQ ID NO: 950293 - DNA, 22 bp, Artificial Sequence
  chemically synthesized
atattactatatgtgtttttct

SEQ ID NO: 950294 - DNA, 22 bp, Artificial Sequence
  chemically synthesized
aatattactatatgtgtttttc

SEQ ID NO: 950295 - DNA, 22 bp, Artificial Sequence
  chemically synthesized
ctagagtgttagaaaaacacat

SEQ ID NO: 950296 - DNA, 22 bp, Artificial Sequence
  chemically synthesized
gagtgttagaaaaacacatata

SEQ ID NO: 950297 - DNA, 22 bp, Artificial Sequence
  chemically synthesized
tatatatttaatattactatat

SEQ ID NO: 950298 - DNA, 22 bp, Artificial Sequence
  chemically synthesized
gaaaaacacatatagtaatatt

SEQ ID NO: 950299 - DNA, 22 bp, Artificial Sequence
  chemically synthesized
ggtatctgtatatatttaatat

SEQ ID NO: 950300 - DNA, 22 bp, Artificial Sequence
  chemically synthesized
attaggtatctgtatatattta

SEQ ID NO: 950301 - DNA, 22 bp, Artificial Sequence
  chemically synthesized
aatatatacagatacctaatca

SEQ ID NO: 950302 - DNA, 22 bp, Artificial Sequence
  chemically synthesized
tccaaaccaataagtctgatta

SEQ ID NO: 950303 - DNA, 22 bp, Artificial Sequence
  chemically synthesized
tcccactgtccaaaccaataag

SEQ ID NO: 950304 - DNA, 22 bp, Artificial Sequence
  chemically synthesized
ttatcccactgtccaaaccaat

SEQ ID NO: 950305 - DNA, 22 bp, Artificial Sequence
  chemically synthesized
attatcccactgtccaaaccaa

SEQ ID NO: 950306 - DNA, 22 bp, Artificial Sequence
  chemically synthesized
atcagacttattggtttggaca

SEQ ID NO: 950307 - DNA, 22 bp, Artificial Sequence
  chemically synthesized
gccttattatcccactgtccaa

SEQ ID NO: 950308 - DNA, 22 bp, Artificial Sequence
  chemically synthesized
ctagccttattatcccactgtc

SEQ ID NO: 950309 - DNA, 22 bp, Artificial Sequence
  chemically synthesized
attggtttggacagtgggataa

SEQ ID NO: 950310 - DNA, 22 bp, Artificial Sequence
  chemically synthesized
ttggtttggacagtgggataat

SEQ ID NO: 950311 - DNA, 22 bp, Artificial Sequence
  chemically synthesized
gtttggacagtgggataataag

SEQ ID NO: 950312 - DNA, 22 bp, Artificial Sequence
  chemically synthesized
ggacagtgggataataaggcta

SEQ ID NO: 950313 - DNA, 22 bp, Artificial Sequence
  chemically synthesized
gacagtgggataataaggctag

SEQ ID NO: 950314 - DNA, 22 bp, Artificial Sequence
  chemically synthesized
ccaggaaatcattactagcctt

SEQ ID NO: 950315 - DNA, 22 bp, Artificial Sequence
  chemically synthesized
taccaggaaatcattactagcc

SEQ ID NO: 950316 - DNA, 22 bp, Artificial Sequence
  chemically synthesized
ctaccaggaaatcattactagc

SEQ ID NO: 950317 - DNA, 22 bp, Artificial Sequence
  chemically synthesized
tctaccaggaaatcattactag

SEQ ID NO: 950318 - DNA, 22 bp, Artificial Sequence
  chemically synthesized
ttctaccaggaaatcattacta

SEQ ID NO: 950319 - DNA, 22 bp, Artificial Sequence
  chemically synthesized
tttctaccaggaaatcattact

SEQ ID NO: 950320 - DNA, 22 bp, Artificial Sequence
  chemically synthesized
ttttctaccaggaaatcattac

SEQ ID NO: 950321 - DNA, 22 bp, Artificial Sequence
  chemically synthesized
tttttctaccaggaaatcatta

SEQ ID NO: 950322 - DNA, 22 bp, Artificial Sequence
  chemically synthesized
catattttttttctaccaggaa

SEQ ID NO: 950323 - DNA, 22 bp, Artificial Sequence
  chemically synthesized
acatattttttttctaccagga

SEQ ID NO: 950324 - DNA, 22 bp, Artificial Sequence
  chemically synthesized
gtaatgatttcctggtagaaaa

SEQ ID NO: 950325 - DNA, 22 bp, Artificial Sequence
  chemically synthesized
aagacttacatattttttttct

SEQ ID NO: 950326 - DNA, 22 bp, Artificial Sequence
  chemically synthesized
gaagacttacatattttttttc

SEQ ID NO: 950327 - DNA, 22 bp, Artificial Sequence
  chemically synthesized
ttgaagacttacatattttttt

SEQ ID NO: 950328 - DNA, 22 bp, Artificial Sequence
  chemically synthesized
cctggtagaaaaaaaatatgta

SEQ ID NO: 950329 - DNA, 22 bp, Artificial Sequence
  chemically synthesized
ctggtagaaaaaaaatatgtaa

SEQ ID NO: 950330 - DNA, 22 bp, Artificial Sequence
  chemically synthesized
gtagaaaaaaaatatgtaagtc

SEQ ID NO: 950331 - DNA, 22 bp, Artificial Sequence
  chemically synthesized
tccatactcttgaagacttaca

SEQ ID NO: 950332 - DNA, 22 bp, Artificial Sequence
  chemically synthesized
atccatactcttgaagacttac

SEQ ID NO: 950333 - DNA, 22 bp, Artificial Sequence
  chemically synthesized
agcttatccatactcttgaaga

SEQ ID NO: 950334 - DNA, 22 bp, Artificial Sequence
  chemically synthesized
tctgagcttatccatactcttg

SEQ ID NO: 950335 - DNA, 22 bp, Artificial Sequence
  chemically synthesized
atctgagcttatccatactctt

SEQ ID NO: 950336 - DNA, 22 bp, Artificial Sequence
  chemically synthesized
tatctgagcttatccatactct

SEQ ID NO: 950337 - DNA, 22 bp, Artificial Sequence
  chemically synthesized
ctttatctgagcttatccatac

SEQ ID NO: 950338 - DNA, 22 bp, Artificial Sequence
  chemically synthesized
ctactttatctgagcttatcca

SEQ ID NO: 950339 - DNA, 22 bp, Artificial Sequence
  chemically synthesized
caagagtatggataagctcaga

SEQ ID NO: 950340 - DNA, 22 bp, Artificial Sequence
  chemically synthesized
aagagtatggataagctcagat

SEQ ID NO: 950341 - DNA, 22 bp, Artificial Sequence
  chemically synthesized
ccattcctactttatctgagct

SEQ ID NO: 950342 - DNA, 22 bp, Artificial Sequence
  chemically synthesized
tcccattcctactttatctgag

SEQ ID NO: 950343 - DNA, 22 bp, Artificial Sequence
  chemically synthesized
tctctcccattcctactttatc

SEQ ID NO: 950344 - DNA, 22 bp, Artificial Sequence
  chemically synthesized
cctatctctcccattcctactt

SEQ ID NO: 950345 - DNA, 22 bp, Artificial Sequence
  chemically synthesized
agataaagtaggaatgggagag

SEQ ID NO: 950346 - DNA, 22 bp, Artificial Sequence
  chemically synthesized
aacatcaccacccctgcctatc

SEQ ID NO: 950347 - DNA, 22 bp, Artificial Sequence
  chemically synthesized
taaacatcaccacccctgccta

SEQ ID NO: 950348 - DNA, 22 bp, Artificial Sequence
  chemically synthesized
acagtggctctaaacatcacca

SEQ ID NO: 950349 - DNA, 22 bp, Artificial Sequence
  chemically synthesized
attcacagtggctctaaacatc

SEQ ID NO: 950350 - DNA, 22 bp, Artificial Sequence
  chemically synthesized
ggacatgaattcattcacagtg

SEQ ID NO: 950351 - DNA, 22 bp, Artificial Sequence
  chemically synthesized
gttgggacatgaattcattcac

SEQ ID NO: 950352 - DNA, 22 bp, Artificial Sequence
  chemically synthesized
cgttgggacatgaattcattca

SEQ ID NO: 950353 - DNA, 22 bp, Artificial Sequence
  chemically synthesized
tcgttgggacatgaattcattc

SEQ ID NO: 950354 - DNA, 22 bp, Artificial Sequence
  chemically synthesized
agagccactgtgaatgaattca

SEQ ID NO: 950355 - DNA, 22 bp, Artificial Sequence
  chemically synthesized
ttcgttgggacatgaattcatt

SEQ ID NO: 950356 - DNA, 22 bp, Artificial Sequence
  chemically synthesized
gagccactgtgaatgaattcat

SEQ ID NO: 950357 - DNA, 22 bp, Artificial Sequence
  chemically synthesized
tttcgttgggacatgaattcat

SEQ ID NO: 950358 - DNA, 22 bp, Artificial Sequence
  chemically synthesized
ttttcgttgggacatgaattca

SEQ ID NO: 950359 - DNA, 22 bp, Artificial Sequence
  chemically synthesized
tttttttcgttgggacatgaat

SEQ ID NO: 950360 - DNA, 22 bp, Artificial Sequence
  chemically synthesized
ttgtttttttcgttgggacatg

SEQ ID NO: 950361 - DNA, 22 bp, Artificial Sequence
  chemically synthesized
tgaatgaattcatgtcccaacg

SEQ ID NO: 950362 - DNA, 22 bp, Artificial Sequence
  chemically synthesized
cctgttgtttttttcgttggga

SEQ ID NO: 950363 - DNA, 22 bp, Artificial Sequence
  chemically synthesized
acgttccctgttgtttttttcg

SEQ ID NO: 950364 - DNA, 22 bp, Artificial Sequence
  chemically synthesized
atgtcccaacgaaaaaaacaac

SEQ ID NO: 950365 - DNA, 22 bp, Artificial Sequence
  chemically synthesized
ccggaatcagcgatcctaacgt

SEQ ID NO: 950366 - DNA, 22 bp, Artificial Sequence
  chemically synthesized
tacaattcccggaatcagcgat

SEQ ID NO: 950367 - DNA, 22 bp, Artificial Sequence
  chemically synthesized
ggatcgctgattccgggaattg

SEQ ID NO: 950368 - DNA, 22 bp, Artificial Sequence
  chemically synthesized
cgcaaggaaaaaggtctgtaca

SEQ ID NO: 950369 - DNA, 22 bp, Artificial Sequence
  chemically synthesized
attccgggaattgtacagacct

SEQ ID NO: 950370 - DNA, 22 bp, Artificial Sequence
  chemically synthesized
acgcaaggaaaaaggtctgtac

SEQ ID NO: 950371 - DNA, 22 bp, Artificial Sequence
  chemically synthesized
cgggaattgtacagaccttttt

SEQ ID NO: 950372 - DNA, 22 bp, Artificial Sequence
  chemically synthesized
gcttacgcaaggaaaaaggtct

SEQ ID NO: 950373 - DNA, 22 bp, Artificial Sequence
  chemically synthesized
agcttacgcaaggaaaaaggtc

SEQ ID NO: 950374 - DNA, 22 bp, Artificial Sequence
  chemically synthesized
cttagcttacgcaaggaaaaag

SEQ ID NO: 950375 - DNA, 22 bp, Artificial Sequence
  chemically synthesized
tacagacctttttccttgcgta

SEQ ID NO: 950376 - DNA, 22 bp, Artificial Sequence
  chemically synthesized
aaaactacttagcttacgcaag

SEQ ID NO: 950377 - DNA, 22 bp, Artificial Sequence
  chemically synthesized
taaaaactacttagcttacgca

SEQ ID NO: 950378 - DNA, 22 bp, Artificial Sequence
  chemically synthesized
tttccttgcgtaagctaagtag

SEQ ID NO: 950379 - DNA, 22 bp, Artificial Sequence
  chemically synthesized
taactctaaaaactacttagct

SEQ ID NO: 950380 - DNA, 22 bp, Artificial Sequence
  chemically synthesized
ttccttgcgtaagctaagtagt

SEQ ID NO: 950381 - DNA, 22 bp, Artificial Sequence
  chemically synthesized
gtaactctaaaaactacttagc

SEQ ID NO: 950382 - DNA, 22 bp, Artificial Sequence
  chemically synthesized
tccttgcgtaagctaagtagtt

SEQ ID NO: 950383 - DNA, 22 bp, Artificial Sequence
  chemically synthesized
ccttgcgtaagctaagtagttt

SEQ ID NO: 950384 - DNA, 22 bp, Artificial Sequence
  chemically synthesized
cttgcgtaagctaagtagtttt

SEQ ID NO: 950385 - DNA, 22 bp, Artificial Sequence
  chemically synthesized
cttgtaactctaaaaactactt

SEQ ID NO: 950386 - DNA, 22 bp, Artificial Sequence
  chemically synthesized
ccttgtaactctaaaaactact

SEQ ID NO: 950387 - DNA, 22 bp, Artificial Sequence
  chemically synthesized
tccttgtaactctaaaaactac

SEQ ID NO: 950388 - DNA, 22 bp, Artificial Sequence
  chemically synthesized
gcgtaagctaagtagtttttag

SEQ ID NO: 950389 - DNA, 22 bp, Artificial Sequence
  chemically synthesized
ttccttgtaactctaaaaacta

SEQ ID NO: 950390 - DNA, 22 bp, Artificial Sequence
  chemically synthesized
cgtaagctaagtagtttttaga

SEQ ID NO: 950391 - DNA, 22 bp, Artificial Sequence
  chemically synthesized
ttttccttgtaactctaaaaac

SEQ ID NO: 950392 - DNA, 22 bp, Artificial Sequence
  chemically synthesized
catctcttttccttgtaactct

SEQ ID NO: 950393 - DNA, 22 bp, Artificial Sequence
  chemically synthesized
acatctcttttccttgtaactc

SEQ ID NO: 950394 - DNA, 22 bp, Artificial Sequence
  chemically synthesized
agtagtttttagagttacaagg

SEQ ID NO: 950395 - DNA, 22 bp, Artificial Sequence
  chemically synthesized
ttacatctcttttccttgtaac

SEQ ID NO: 950396 - DNA, 22 bp, Artificial Sequence
  chemically synthesized
ttagagttacaaggaaaagaga

SEQ ID NO: 950397 - DNA, 22 bp, Artificial Sequence
  chemically synthesized
cagtctcttacatctcttttcc

SEQ ID NO: 950398 - DNA, 22 bp, Artificial Sequence
  chemically synthesized
tagagttacaaggaaaagagat

SEQ ID NO: 950399 - DNA, 22 bp, Artificial Sequence
  chemically synthesized
agagttacaaggaaaagagatg

SEQ ID NO: 950400 - DNA, 22 bp, Artificial Sequence
  chemically synthesized
gagttacaaggaaaagagatgt

SEQ ID NO: 950401 - DNA, 22 bp, Artificial Sequence
  chemically synthesized
ctccagtctcttacatctcttt

SEQ ID NO: 950402 - DNA, 22 bp, Artificial Sequence
  chemically synthesized
cctccagtctcttacatctctt

SEQ ID NO: 950403 - DNA, 22 bp, Artificial Sequence
  chemically synthesized
ttcctccagtctcttacatctc

SEQ ID NO: 950404 - DNA, 22 bp, Artificial Sequence
  chemically synthesized
cttcctccagtctcttacatct

SEQ ID NO: 950405 - DNA, 22 bp, Artificial Sequence
  chemically synthesized
caaggaaaagagatgtaagaga

SEQ ID NO: 950406 - DNA, 22 bp, Artificial Sequence
  chemically synthesized
aatgtttcttcctccagtctct

SEQ ID NO: 950407 - DNA, 22 bp, Artificial Sequence
  chemically synthesized
aaatgtttcttcctccagtctc

SEQ ID NO: 950408 - DNA, 22 bp, Artificial Sequence
  chemically synthesized
ttaaatgtttcttcctccagtc

SEQ ID NO: 950409 - DNA, 22 bp, Artificial Sequence
  chemically synthesized
agattcttaaatgtttcttcct

SEQ ID NO: 950410 - DNA, 22 bp, Artificial Sequence
  chemically synthesized
cagattcttaaatgtttcttcc

SEQ ID NO: 950411 - DNA, 22 bp, Artificial Sequence
  chemically synthesized
tcagattcttaaatgtttcttc

SEQ ID NO: 950412 - DNA, 22 bp, Artificial Sequence
  chemically synthesized
agtcctttcagattcttaaatg

SEQ ID NO: 950413 - DNA, 22 bp, Artificial Sequence
  chemically synthesized
aagtcctttcagattcttaaat

SEQ ID NO: 950414 - DNA, 22 bp, Artificial Sequence
  chemically synthesized
gaggaagaaacatttaagaatc

SEQ ID NO: 950415 - DNA, 22 bp, Artificial Sequence
  chemically synthesized
ccagatggacttaagtcctttc

SEQ ID NO: 950416 - DNA, 22 bp, Artificial Sequence
  chemically synthesized
cccagatggacttaagtccttt

SEQ ID NO: 950417 - DNA, 22 bp, Artificial Sequence
  chemically synthesized
aagaatctgaaaggacttaagt

SEQ ID NO: 950418 - DNA, 22 bp, Artificial Sequence
  chemically synthesized
cttcccagatggacttaagtcc

SEQ ID NO: 950419 - DNA, 22 bp, Artificial Sequence
  chemically synthesized
agaatctgaaaggacttaagtc

SEQ ID NO: 950420 - DNA, 22 bp, Artificial Sequence
  chemically synthesized
ccttcccagatggacttaagtc

SEQ ID NO: 950421 - DNA, 22 bp, Artificial Sequence
  chemically synthesized
tccttcccagatggacttaagt

SEQ ID NO: 950422 - DNA, 22 bp, Artificial Sequence
  chemically synthesized
ttccttcccagatggacttaag

SEQ ID NO: 950423 - DNA, 22 bp, Artificial Sequence
  chemically synthesized
ccttttccttcccagatggact

SEQ ID NO: 950424 - DNA, 22 bp, Artificial Sequence
  chemically synthesized
cccttttccttcccagatggac

SEQ ID NO: 950425 - DNA, 22 bp, Artificial Sequence
  chemically synthesized
aaaggacttaagtccatctggg

SEQ ID NO: 950426 - DNA, 22 bp, Artificial Sequence
  chemically synthesized
tcccttttccttcccagatgga

SEQ ID NO: 950427 - DNA, 22 bp, Artificial Sequence
  chemically synthesized
cctttcccttttccttcccaga

SEQ ID NO: 950428 - DNA, 22 bp, Artificial Sequence
  chemically synthesized
ctccctttcccttttccttccc

SEQ ID NO: 950429 - DNA, 22 bp, Artificial Sequence
  chemically synthesized
aagtccatctgggaaggaaaag

SEQ ID NO: 950430 - DNA, 22 bp, Artificial Sequence
  chemically synthesized
agtccatctgggaaggaaaagg

SEQ ID NO: 950431 - DNA, 22 bp, Artificial Sequence
  chemically synthesized
ccattcctccctttcccttttc

SEQ ID NO: 950432 - DNA, 22 bp, Artificial Sequence
  chemically synthesized
gccattcctccctttccctttt

SEQ ID NO: 950433 - DNA, 22 bp, Artificial Sequence
  chemically synthesized
tgccattcctccctttcccttt

SEQ ID NO: 950434 - DNA, 22 bp, Artificial Sequence
  chemically synthesized
ggaaggaaaagggaaagggagg

SEQ ID NO: 950435 - DNA, 22 bp, Artificial Sequence
  chemically synthesized
acctttgccattcctccctttc

SEQ ID NO: 950436 - DNA, 22 bp, Artificial Sequence
  chemically synthesized
gccctaacctttgccattcctc

SEQ ID NO: 950437 - DNA, 22 bp, Artificial Sequence
  chemically synthesized
cgccctaacctttgccattcct

SEQ ID NO: 950438 - DNA, 22 bp, Artificial Sequence
  chemically synthesized
acacacttcgccctaacctttg

SEQ ID NO: 950439 - DNA, 22 bp, Artificial Sequence
  chemically synthesized
cccctaacacacttcgccctaa

SEQ ID NO: 950440 - DNA, 22 bp, Artificial Sequence
  chemically synthesized
ctccccctaacacacttcgccc

SEQ ID NO: 950441 - DNA, 22 bp, Artificial Sequence
  chemically synthesized
tctactccccctaacacacttc

SEQ ID NO: 950442 - DNA, 22 bp, Artificial Sequence
  chemically synthesized
gtctactccccctaacacactt

SEQ ID NO: 950443 - DNA, 22 bp, Artificial Sequence
  chemically synthesized
acttgtctactccccctaacac

SEQ ID NO: 950444 - DNA, 22 bp, Artificial Sequence
  chemically synthesized
tcacttgtctactccccctaac

SEQ ID NO: 950445 - DNA, 22 bp, Artificial Sequence
  chemically synthesized
gggcgaagtgtgttagggggag

SEQ ID NO: 950446 - DNA, 22 bp, Artificial Sequence
  chemically synthesized
tctcacttgtctactcccccta

SEQ ID NO: 950447 - DNA, 22 bp, Artificial Sequence
  chemically synthesized
gggggagtagacaagtgagaga

SEQ ID NO: 950448 - DNA, 22 bp, Artificial Sequence
  chemically synthesized
accacaaaggactctctcactt

SEQ ID NO: 950449 - DNA, 22 bp, Artificial Sequence
  chemically synthesized
aaccacaaaggactctctcact

SEQ ID NO: 950450 - DNA, 22 bp, Artificial Sequence
  chemically synthesized
taaccacaaaggactctctcac

SEQ ID NO: 950451 - DNA, 22 bp, Artificial Sequence
  chemically synthesized
tttaaccacaaaggactctctc

SEQ ID NO: 950452 - DNA, 22 bp, Artificial Sequence
  chemically synthesized
gttctttaaccacaaaggactc

SEQ ID NO: 950453 - DNA, 22 bp, Artificial Sequence
  chemically synthesized
gctagttctttaaccacaaagg

SEQ ID NO: 950454 - DNA, 22 bp, Artificial Sequence
  chemically synthesized
ttagctagttctttaaccacaa

SEQ ID NO: 950455 - DNA, 22 bp, Artificial Sequence
  chemically synthesized
attagctagttctttaaccaca

SEQ ID NO: 950456 - DNA, 22 bp, Artificial Sequence
  chemically synthesized
gtttattagctagttctttaac

SEQ ID NO: 950457 - DNA, 22 bp, Artificial Sequence
  chemically synthesized
agacctagtttattagctagtt

SEQ ID NO: 950458 - DNA, 22 bp, Artificial Sequence
  chemically synthesized
tgtggttaaagaactagctaat

SEQ ID NO: 950459 - DNA, 22 bp, Artificial Sequence
  chemically synthesized
cagacctagtttattagctagt

SEQ ID NO: 950460 - DNA, 22 bp, Artificial Sequence
  chemically synthesized
gtggttaaagaactagctaata

SEQ ID NO: 950461 - DNA, 22 bp, Artificial Sequence
  chemically synthesized
tcagacctagtttattagctag

SEQ ID NO: 950462 - DNA, 22 bp, Artificial Sequence
  chemically synthesized
tggttaaagaactagctaataa

SEQ ID NO: 950463 - DNA, 22 bp, Artificial Sequence
  chemically synthesized
aagaactagctaataaactagg

SEQ ID NO: 950464 - DNA, 22 bp, Artificial Sequence
  chemically synthesized
gctaataaactaggtctgaaag

SEQ ID NO: 950465 - DNA, 22 bp, Artificial Sequence
  chemically synthesized
ataaactaggtctgaaagttgt

SEQ ID NO: 950466 - DNA, 22 bp, Artificial Sequence
  chemically synthesized
cagggatagagtaacaactttc

SEQ ID NO: 950467 - DNA, 22 bp, Artificial Sequence
  chemically synthesized
ccagggatagagtaacaacttt

SEQ ID NO: 950468 - DNA, 22 bp, Artificial Sequence
  chemically synthesized
ttccagggatagagtaacaact

SEQ ID NO: 950469 - DNA, 22 bp, Artificial Sequence
  chemically synthesized
ttcttccagggatagagtaaca

SEQ ID NO: 950470 - DNA, 22 bp, Artificial Sequence
  chemically synthesized
ggtctgaaagttgttactctat

SEQ ID NO: 950471 - DNA, 22 bp, Artificial Sequence
  chemically synthesized
gttcttccagggatagagtaac

SEQ ID NO: 950472 - DNA, 22 bp, Artificial Sequence
  chemically synthesized
tttgttcttccagggatagagt

SEQ ID NO: 950473 - DNA, 22 bp, Artificial Sequence
  chemically synthesized
atttgttcttccagggatagag

SEQ ID NO: 950474 - DNA, 22 bp, Artificial Sequence
  chemically synthesized
aaagttgttactctatccctgg

SEQ ID NO: 950475 - DNA, 22 bp, Artificial Sequence
  chemically synthesized
ttatttgttcttccagggatag

SEQ ID NO: 950476 - DNA, 22 bp, Artificial Sequence
  chemically synthesized
ttactctatccctggaagaaca

SEQ ID NO: 950477 - DNA, 22 bp, Artificial Sequence
  chemically synthesized
agtaattcttatttgttcttcc

SEQ ID NO: 950478 - DNA, 22 bp, Artificial Sequence
  chemically synthesized
cagtaattcttatttgttcttc

SEQ ID NO: 950479 - DNA, 22 bp, Artificial Sequence
  chemically synthesized
ctctatccctggaagaacaaat

SEQ ID NO: 950480 - DNA, 22 bp, Artificial Sequence
  chemically synthesized
tatccctggaagaacaaataag

SEQ ID NO: 950481 - DNA, 22 bp, Artificial Sequence
  chemically synthesized
tccctggaagaacaaataagaa

SEQ ID NO: 950482 - DNA, 22 bp, Artificial Sequence
  chemically synthesized
aaagccttcagtaattcttatt

SEQ ID NO: 950483 - DNA, 22 bp, Artificial Sequence
  chemically synthesized
gaagaacaaataagaattactg

SEQ ID NO: 950484 - DNA, 22 bp, Artificial Sequence
  chemically synthesized
cctaaaagccttcagtaattct

SEQ ID NO: 950485 - DNA, 22 bp, Artificial Sequence
  chemically synthesized
tgcctaaaagccttcagtaatt

SEQ ID NO: 950486 - DNA, 22 bp, Artificial Sequence
  chemically synthesized
ctgcctaaaagccttcagtaat

SEQ ID NO: 950487 - DNA, 22 bp, Artificial Sequence
  chemically synthesized
tctgcctaaaagccttcagtaa

SEQ ID NO: 950488 - DNA, 22 bp, Artificial Sequence
  chemically synthesized
attttctgcctaaaagccttca

SEQ ID NO: 950489 - DNA, 22 bp, Artificial Sequence
  chemically synthesized
aatgtgttcattttctgcctaa

SEQ ID NO: 950490 - DNA, 22 bp, Artificial Sequence
  chemically synthesized
ctgaaggcttttaggcagaaaa

SEQ ID NO: 950491 - DNA, 22 bp, Artificial Sequence
  chemically synthesized
aaggcttttaggcagaaaatga

SEQ ID NO: 950492 - DNA, 22 bp, Artificial Sequence
  chemically synthesized
ttaggcagaaaatgaacacatt

SEQ ID NO: 950493 - DNA, 22 bp, Artificial Sequence
  chemically synthesized
taggcagaaaatgaacacattc

SEQ ID NO: 950494 - DNA, 22 bp, Artificial Sequence
  chemically synthesized
aggcagaaaatgaacacattca

SEQ ID NO: 950495 - DNA, 22 bp, Artificial Sequence
  chemically synthesized
ggcagaaaatgaacacattcag

SEQ ID NO: 950496 - DNA, 22 bp, Artificial Sequence
  chemically synthesized
aaaaacaaaaatctgaatgtgt

SEQ ID NO: 950497 - DNA, 22 bp, Artificial Sequence
  chemically synthesized
aaaaaacaaaaatctgaatgtg

SEQ ID NO: 950498 - DNA, 22 bp, Artificial Sequence
  chemically synthesized
taaaaaacaaaaatctgaatgt

SEQ ID NO: 950499 - DNA, 22 bp, Artificial Sequence
  chemically synthesized
ttaaaaaacaaaaatctgaatg

SEQ ID NO: 950500 - DNA, 22 bp, Artificial Sequence
  chemically synthesized
tttaaaaaacaaaaatctgaat

SEQ ID NO: 950501 - DNA, 22 bp, Artificial Sequence
  chemically synthesized
gagtaattttttaaaaaacaaa

SEQ ID NO: 950502 - DNA, 22 bp, Artificial Sequence
  chemically synthesized
agatttttgttttttaaaaaat

SEQ ID NO: 950503 - DNA, 22 bp, Artificial Sequence
  chemically synthesized
cacaaaagctagagtaattttt

SEQ ID NO: 950504 - DNA, 22 bp, Artificial Sequence
  chemically synthesized
ttgttttttaaaaaattactct

SEQ ID NO: 950505 - DNA, 22 bp, Artificial Sequence
  chemically synthesized
tacacaaaagctagagtaattt

SEQ ID NO: 950506 - DNA, 22 bp, Artificial Sequence
  chemically synthesized
tgttttttaaaaaattactcta

SEQ ID NO: 950507 - DNA, 22 bp, Artificial Sequence
  chemically synthesized
ctacacaaaagctagagtaatt

SEQ ID NO: 950508 - DNA, 22 bp, Artificial Sequence
  chemically synthesized
gttttttaaaaaattactctag

SEQ ID NO: 950509 - DNA, 22 bp, Artificial Sequence
  chemically synthesized
ttttttaaaaaattactctagc

SEQ ID NO: 950510 - DNA, 22 bp, Artificial Sequence
  chemically synthesized
tttctacacaaaagctagagta

SEQ ID NO: 950511 - DNA, 22 bp, Artificial Sequence
  chemically synthesized
tttaaaaaattactctagcttt

SEQ ID NO: 950512 - DNA, 22 bp, Artificial Sequence
  chemically synthesized
ttaaaaaattactctagctttt

SEQ ID NO: 950513 - DNA, 22 bp, Artificial Sequence
  chemically synthesized
taaaaaattactctagcttttg

SEQ ID NO: 950514 - DNA, 22 bp, Artificial Sequence
  chemically synthesized
aaaaaattactctagcttttgt

SEQ ID NO: 950515 - DNA, 22 bp, Artificial Sequence
  chemically synthesized
aaaaattactctagcttttgtg

SEQ ID NO: 950516 - DNA, 22 bp, Artificial Sequence
  chemically synthesized
caatctatttctacacaaaagc

SEQ ID NO: 950517 - DNA, 22 bp, Artificial Sequence
  chemically synthesized
tccaatctatttctacacaaaa

SEQ ID NO: 950518 - DNA, 22 bp, Artificial Sequence
  chemically synthesized
ctctccaatctatttctacaca

SEQ ID NO: 950519 - DNA, 22 bp, Artificial Sequence
  chemically synthesized
ctctagcttttgtgtagaaata

SEQ ID NO: 950520 - DNA, 22 bp, Artificial Sequence
  chemically synthesized
ctcctctccaatctatttctac

SEQ ID NO: 950521 - DNA, 22 bp, Artificial Sequence
  chemically synthesized
gctcctctccaatctatttcta

SEQ ID NO: 950522 - DNA, 22 bp, Artificial Sequence
  chemically synthesized
tagcttttgtgtagaaatagat

SEQ ID NO: 950523 - DNA, 22 bp, Artificial Sequence
  chemically synthesized
gcttttgtgtagaaatagattg

SEQ ID NO: 950524 - DNA, 22 bp, Artificial Sequence
  chemically synthesized
agtcttgctcctctccaatcta

SEQ ID NO: 950525 - DNA, 22 bp, Artificial Sequence
  chemically synthesized
ttgtgtagaaatagattggaga

SEQ ID NO: 950526 - DNA, 22 bp, Artificial Sequence
  chemically synthesized
cagtcttgctcctctccaatct

SEQ ID NO: 950527 - DNA, 22 bp, Artificial Sequence
  chemically synthesized
tgtgtagaaatagattggagag

SEQ ID NO: 950528 - DNA, 22 bp, Artificial Sequence
  chemically synthesized
gtgtagaaatagattggagagg

SEQ ID NO: 950529 - DNA, 22 bp, Artificial Sequence
  chemically synthesized
tgtagaaatagattggagagga

SEQ ID NO: 950530 - DNA, 22 bp, Artificial Sequence
  chemically synthesized
gaatttcagtcttgctcctctc

SEQ ID NO: 950531 - DNA, 22 bp, Artificial Sequence
  chemically synthesized
tggaatttcagtcttgctcctc

SEQ ID NO: 950532 - DNA, 22 bp, Artificial Sequence
  chemically synthesized
gactctggaatttcagtcttgc

SEQ ID NO: 950533 - DNA, 22 bp, Artificial Sequence
  chemically synthesized
gagaggagcaagactgaaattc

SEQ ID NO: 950534 - DNA, 22 bp, Artificial Sequence
  chemically synthesized
caccctagactctggaatttca

SEQ ID NO: 950535 - DNA, 22 bp, Artificial Sequence
  chemically synthesized
tacaccctagactctggaattt

SEQ ID NO: 950536 - DNA, 22 bp, Artificial Sequence
  chemically synthesized
ctacaccctagactctggaatt

SEQ ID NO: 950537 - DNA, 22 bp, Artificial Sequence
  chemically synthesized
tttctacaccctagactctgga

SEQ ID NO: 950538 - DNA, 22 bp, Artificial Sequence
  chemically synthesized
caatctatttctacaccctaga

SEQ ID NO: 950539 - DNA, 22 bp, Artificial Sequence
  chemically synthesized
aaattccagagtctagggtgta

SEQ ID NO: 950540 - DNA, 22 bp, Artificial Sequence
  chemically synthesized
tccaatctatttctacacccta

SEQ ID NO: 950541 - DNA, 22 bp, Artificial Sequence
  chemically synthesized
ctctccaatctatttctacacc

SEQ ID NO: 950542 - DNA, 22 bp, Artificial Sequence
  chemically synthesized
cagagtctagggtgtagaaata

SEQ ID NO: 950543 - DNA, 22 bp, Artificial Sequence
  chemically synthesized
ctcctctccaatctatttctac

SEQ ID NO: 950544 - DNA, 22 bp, Artificial Sequence
  chemically synthesized
gctcctctccaatctatttcta

SEQ ID NO: 950545 - DNA, 22 bp, Artificial Sequence
  chemically synthesized
agtcttgctcctctccaatcta

SEQ ID NO: 950546 - DNA, 22 bp, Artificial Sequence
  chemically synthesized
gggtgtagaaatagattggaga

SEQ ID NO: 950547 - DNA, 22 bp, Artificial Sequence
  chemically synthesized
cagtcttgctcctctccaatct

SEQ ID NO: 950548 - DNA, 22 bp, Artificial Sequence
  chemically synthesized
gaatttcagtcttgctcctctc

SEQ ID NO: 950549 - DNA, 22 bp, Artificial Sequence
  chemically synthesized
tggaatttcagtcttgctcctc

SEQ ID NO: 950550 - DNA, 22 bp, Artificial Sequence
  chemically synthesized
gactctggaatttcagtcttgc

SEQ ID NO: 950551 - DNA, 22 bp, Artificial Sequence
  chemically synthesized
cctagactctggaatttcagtc

SEQ ID NO: 950552 - DNA, 22 bp, Artificial Sequence
  chemically synthesized
gagaggagcaagactgaaattc

SEQ ID NO: 950553 - DNA, 22 bp, Artificial Sequence
  chemically synthesized
gcctagactctggaatttcagt

SEQ ID NO: 950554 - DNA, 22 bp, Artificial Sequence
  chemically synthesized
ttgcctagactctggaatttca

SEQ ID NO: 950555 - DNA, 22 bp, Artificial Sequence
  chemically synthesized
tctcttgcctagactctggaat

SEQ ID NO: 950556 - DNA, 22 bp, Artificial Sequence
  chemically synthesized
aaaacactatctcttgcctaga

SEQ ID NO: 950557 - DNA, 22 bp, Artificial Sequence
  chemically synthesized
aaattccagagtctaggcaaga

SEQ ID NO: 950558 - DNA, 22 bp, Artificial Sequence
  chemically synthesized
caaaacactatctcttgcctag

SEQ ID NO: 950559 - DNA, 22 bp, Artificial Sequence
  chemically synthesized
gatttcaaaacactatctcttg

SEQ ID NO: 950560 - DNA, 22 bp, Artificial Sequence
  chemically synthesized
cagagtctaggcaagagatagt

SEQ ID NO: 950561 - DNA, 22 bp, Artificial Sequence
  chemically synthesized
agatttcaaaacactatctctt

SEQ ID NO: 950562 - DNA, 22 bp, Artificial Sequence
  chemically synthesized
cttagatttcaaaacactatct

SEQ ID NO: 950563 - DNA, 22 bp, Artificial Sequence
  chemically synthesized
ctgcttagatttcaaaacacta

SEQ ID NO: 950564 - DNA, 22 bp, Artificial Sequence
  chemically synthesized
ggcaagagatagtgttttgaaa

SEQ ID NO: 950565 - DNA, 22 bp, Artificial Sequence
  chemically synthesized
atctcctgcttagatttcaaaa

SEQ ID NO: 950566 - DNA, 22 bp, Artificial Sequence
  chemically synthesized
tgaaatctaagcaggagatcag

SEQ ID NO: 950567 - DNA, 22 bp, Artificial Sequence
  chemically synthesized
gaaatctaagcaggagatcagg

SEQ ID NO: 950568 - DNA, 22 bp, Artificial Sequence
  chemically synthesized
aaatctaagcaggagatcaggg

SEQ ID NO: 950569 - DNA, 22 bp, Artificial Sequence
  chemically synthesized
agcaggagatcagggtcatctg

SEQ ID NO: 950570 - DNA, 22 bp, Artificial Sequence
  chemically synthesized
cacccaaaaccaaaagtcagat

SEQ ID NO: 950571 - DNA, 22 bp, Artificial Sequence
  chemically synthesized
acacccaaaaccaaaagtcaga

SEQ ID NO: 950572 - DNA, 22 bp, Artificial Sequence
  chemically synthesized
tacacccaaaaccaaaagtcag

SEQ ID NO: 950573 - DNA, 22 bp, Artificial Sequence
  chemically synthesized
cccatctttacacccaaaacca

SEQ ID NO: 950574 - DNA, 22 bp, Artificial Sequence
  chemically synthesized
ccccatctttacacccaaaacc

SEQ ID NO: 950575 - DNA, 22 bp, Artificial Sequence
  chemically synthesized
tccccatctttacacccaaaac

SEQ ID NO: 950576 - DNA, 22 bp, Artificial Sequence
  chemically synthesized
ttttccccatctttacacccaa

SEQ ID NO: 950577 - DNA, 22 bp, Artificial Sequence
  chemically synthesized
attttccccatctttacaccca

SEQ ID NO: 950578 - DNA, 22 bp, Artificial Sequence
  chemically synthesized
acttttggttttgggtgtaaag

SEQ ID NO: 950579 - DNA, 22 bp, Artificial Sequence
  chemically synthesized
ttggttttgggtgtaaagatgg

SEQ ID NO: 950580 - DNA, 22 bp, Artificial Sequence
  chemically synthesized
tggttttgggtgtaaagatggg

SEQ ID NO: 950581 - DNA, 22 bp, Artificial Sequence
  chemically synthesized
ggttttgggtgtaaagatgggg

SEQ ID NO: 950582 - DNA, 22 bp, Artificial Sequence
  chemically synthesized
gttttgggtgtaaagatgggga

SEQ ID NO: 950583 - DNA, 22 bp, Artificial Sequence
  chemically synthesized
gaatgtcttattttccccatct

SEQ ID NO: 950584 - DNA, 22 bp, Artificial Sequence
  chemically synthesized
tagaatgtcttattttccccat

SEQ ID NO: 950585 - DNA, 22 bp, Artificial Sequence
  chemically synthesized
tgggtgtaaagatggggaaaat

SEQ ID NO: 950586 - DNA, 22 bp, Artificial Sequence
  chemically synthesized
gggtgtaaagatggggaaaata

SEQ ID NO: 950587 - DNA, 22 bp, Artificial Sequence
  chemically synthesized
tctagaatgtcttattttcccc

SEQ ID NO: 950588 - DNA, 22 bp, Artificial Sequence
  chemically synthesized
ggtgtaaagatggggaaaataa

SEQ ID NO: 950589 - DNA, 22 bp, Artificial Sequence
  chemically synthesized
tctctagaatgtcttattttcc

SEQ ID NO: 950590 - DNA, 22 bp, Artificial Sequence
  chemically synthesized
ctctctagaatgtcttattttc

SEQ ID NO: 950591 - DNA, 22 bp, Artificial Sequence
  chemically synthesized
tctctctagaatgtcttatttt

SEQ ID NO: 950592 - DNA, 22 bp, Artificial Sequence
  chemically synthesized
cattttctctctagaatgtctt

SEQ ID NO: 950593 - DNA, 22 bp, Artificial Sequence
  chemically synthesized
acattttctctctagaatgtct

SEQ ID NO: 950594 - DNA, 22 bp, Artificial Sequence
  chemically synthesized
ttacattttctctctagaatgt

SEQ ID NO: 950595 - DNA, 22 bp, Artificial Sequence
  chemically synthesized
aatacgttcttacattttctct

SEQ ID NO: 950596 - DNA, 22 bp, Artificial Sequence
  chemically synthesized
ttaaatacgttcttacattttc

SEQ ID NO: 950597 - DNA, 22 bp, Artificial Sequence
  chemically synthesized
ttgttaaatacgttcttacatt

SEQ ID NO: 950598 - DNA, 22 bp, Artificial Sequence
  chemically synthesized
gttgttaaatacgttcttacat

SEQ ID NO: 950599 - DNA, 22 bp, Artificial Sequence
  chemically synthesized
tgttgttaaatacgttcttaca

SEQ ID NO: 950600 - DNA, 22 bp, Artificial Sequence
  chemically synthesized
tagagagaaaatgtaagaacgt

SEQ ID NO: 950601 - DNA, 22 bp, Artificial Sequence
  chemically synthesized
gagagaaaatgtaagaacgtat

SEQ ID NO: 950602 - DNA, 22 bp, Artificial Sequence
  chemically synthesized
agttttgttgttaaatacgttc

SEQ ID NO: 950603 - DNA, 22 bp, Artificial Sequence
  chemically synthesized
atcactaagttttgttgttaaa

SEQ ID NO: 950604 - DNA, 22 bp, Artificial Sequence
  chemically synthesized
caattaatcactaagttttgtt

SEQ ID NO: 950605 - DNA, 22 bp, Artificial Sequence
  chemically synthesized
tacctccaattaatcactaagt

SEQ ID NO: 950606 - DNA, 22 bp, Artificial Sequence
  chemically synthesized
aacaacaaaacttagtgattaa

SEQ ID NO: 950607 - DNA, 22 bp, Artificial Sequence
  chemically synthesized
acaacaaaacttagtgattaat

SEQ ID NO: 950608 - DNA, 22 bp, Artificial Sequence
  chemically synthesized
gacaccatctatacctccaatt

SEQ ID NO: 950609 - DNA, 22 bp, Artificial Sequence
  chemically synthesized
agtgattaattggaggtataga

SEQ ID NO: 950610 - DNA, 22 bp, Artificial Sequence
  chemically synthesized
gtgattaattggaggtatagat

SEQ ID NO: 950611 - DNA, 22 bp, Artificial Sequence
  chemically synthesized
attggaggtatagatggtgtcc

SEQ ID NO: 950612 - DNA, 22 bp, Artificial Sequence
  chemically synthesized
gaggtatagatggtgtccaggc

SEQ ID NO: 950613 - DNA, 22 bp, Artificial Sequence
  chemically synthesized
aataaagcagaagcctggacac

SEQ ID NO: 950614 - DNA, 22 bp, Artificial Sequence
  chemically synthesized
gttgaataaagcagaagcctgg

SEQ ID NO: 950615 - DNA, 22 bp, Artificial Sequence
  chemically synthesized
agttgaataaagcagaagcctg

SEQ ID NO: 950616 - DNA, 22 bp, Artificial Sequence
  chemically synthesized
ctgctttattcaactaagtgga

SEQ ID NO: 950617 - DNA, 22 bp, Artificial Sequence
  chemically synthesized
atatgaccaccatccacttagt

SEQ ID NO: 950618 - DNA, 22 bp, Artificial Sequence
  chemically synthesized
tgctttattcaactaagtggat

SEQ ID NO: 950619 - DNA, 22 bp, Artificial Sequence
  chemically synthesized
aatatgaccaccatccacttag

SEQ ID NO: 950620 - DNA, 22 bp, Artificial Sequence
  chemically synthesized
ctttattcaactaagtggatgg

SEQ ID NO: 950621 - DNA, 22 bp, Artificial Sequence
  chemically synthesized
tttaatatgaccaccatccact

SEQ ID NO: 950622 - DNA, 22 bp, Artificial Sequence
  chemically synthesized
atttaatatgaccaccatccac

SEQ ID NO: 950623 - DNA, 22 bp, Artificial Sequence
  chemically synthesized
tattcaactaagtggatggtgg

SEQ ID NO: 950624 - DNA, 22 bp, Artificial Sequence
  chemically synthesized
attcaactaagtggatggtggt

SEQ ID NO: 950625 - DNA, 22 bp, Artificial Sequence
  chemically synthesized
ttcaactaagtggatggtggtc

SEQ ID NO: 950626 - DNA, 22 bp, Artificial Sequence
  chemically synthesized
atttatttaatatgaccaccat

SEQ ID NO: 950627 - DNA, 22 bp, Artificial Sequence
  chemically synthesized
aactaagtggatggtggtcata

SEQ ID NO: 950628 - DNA, 22 bp, Artificial Sequence
  chemically synthesized
cctgatttatttaatatgacca

SEQ ID NO: 950629 - DNA, 22 bp, Artificial Sequence
  chemically synthesized
agtggatggtggtcatattaaa

SEQ ID NO: 950630 - DNA, 22 bp, Artificial Sequence
  chemically synthesized
gctccctgatttatttaatatg

SEQ ID NO: 950631 - DNA, 22 bp, Artificial Sequence
  chemically synthesized
cctggctccctgatttatttaa

SEQ ID NO: 950632 - DNA, 22 bp, Artificial Sequence
  chemically synthesized
ctccctggctccctgatttatt

SEQ ID NO: 950633 - DNA, 22 bp, Artificial Sequence
  chemically synthesized
tcctccctggctccctgattta

SEQ ID NO: 950634 - DNA, 22 bp, Artificial Sequence
  chemically synthesized
ctcctccctggctccctgattt

SEQ ID NO: 950635 - DNA, 22 bp, Artificial Sequence
  chemically synthesized
cttctcctccctggctccctga

SEQ ID NO: 950636 - DNA, 22 bp, Artificial Sequence
  chemically synthesized
tgcttctcctccctggctccct

SEQ ID NO: 950637 - DNA, 22 bp, Artificial Sequence
  chemically synthesized
aataaatcagggagccagggag

SEQ ID NO: 950638 - DNA, 22 bp, Artificial Sequence
  chemically synthesized
taaattctgcttctcctccctg

SEQ ID NO: 950639 - DNA, 22 bp, Artificial Sequence
  chemically synthesized
atctataaattctgcttctcct

SEQ ID NO: 950640 - DNA, 22 bp, Artificial Sequence
  chemically synthesized
atcacctcatctataaattctg

SEQ ID NO: 950641 - DNA, 22 bp, Artificial Sequence
  chemically synthesized
agctcatcacctcatctataaa

SEQ ID NO: 950642 - DNA, 22 bp, Artificial Sequence
  chemically synthesized
acctgagctcatcacctcatct

SEQ ID NO: 950643 - DNA, 22 bp, Artificial Sequence
  chemically synthesized
aaatactcacctgagctcatca

SEQ ID NO: 950644 - DNA, 22 bp, Artificial Sequence
  chemically synthesized
aaaatactcacctgagctcatc

SEQ ID NO: 950645 - DNA, 22 bp, Artificial Sequence
  chemically synthesized
atagatgaggtgatgagctcag

SEQ ID NO: 950646 - DNA, 22 bp, Artificial Sequence
  chemically synthesized
tagatgaggtgatgagctcagg

SEQ ID NO: 950647 - DNA, 22 bp, Artificial Sequence
  chemically synthesized
aagcttaaaatactcacctgag

SEQ ID NO: 950648 - DNA, 22 bp, Artificial Sequence
  chemically synthesized
caagcttaaaatactcacctga

SEQ ID NO: 950649 - DNA, 22 bp, Artificial Sequence
  chemically synthesized
aggtgcttcaagcttaaaatac

SEQ ID NO: 950650 - DNA, 22 bp, Artificial Sequence
  chemically synthesized
aggtgagtattttaagcttgaa

SEQ ID NO: 950651 - DNA, 22 bp, Artificial Sequence
  chemically synthesized
gatgtccctcaggtgcttcaag

SEQ ID NO: 950652 - DNA, 22 bp, Artificial Sequence
  chemically synthesized
agatgtccctcaggtgcttcaa

SEQ ID NO: 950653 - DNA, 22 bp, Artificial Sequence
  chemically synthesized
tttagatgtccctcaggtgctt

SEQ ID NO: 950654 - DNA, 22 bp, Artificial Sequence
  chemically synthesized
tatttagatgtccctcaggtgc

SEQ ID NO: 950655 - DNA, 22 bp, Artificial Sequence
  chemically synthesized
taagcttgaagcacctgaggga

SEQ ID NO: 950656 - DNA, 22 bp, Artificial Sequence
  chemically synthesized
aagcttgaagcacctgagggac

SEQ ID NO: 950657 - DNA, 22 bp, Artificial Sequence
  chemically synthesized
agcttgaagcacctgagggaca

SEQ ID NO: 950658 - DNA, 22 bp, Artificial Sequence
  chemically synthesized
gaagcacctgagggacatctaa

SEQ ID NO: 950659 - DNA, 22 bp, Artificial Sequence
  chemically synthesized
atagatctctatttagatgtcc

SEQ ID NO: 950660 - DNA, 22 bp, Artificial Sequence
  chemically synthesized
aagcacctgagggacatctaaa

SEQ ID NO: 950661 - DNA, 22 bp, Artificial Sequence
  chemically synthesized
agggacatctaaatagagatct

SEQ ID NO: 950662 - DNA, 22 bp, Artificial Sequence
  chemically synthesized
caagaatacacaaatgtctaat

SEQ ID NO: 950663 - DNA, 22 bp, Artificial Sequence
  chemically synthesized
aatagagatctattagacattt

SEQ ID NO: 950664 - DNA, 22 bp, Artificial Sequence
  chemically synthesized
aggaagctacaagaatacacaa

SEQ ID NO: 950665 - DNA, 22 bp, Artificial Sequence
  chemically synthesized
tgaggaagctacaagaatacac

SEQ ID NO: 950666 - DNA, 22 bp, Artificial Sequence
  chemically synthesized
ctgaggaagctacaagaataca

SEQ ID NO: 950667 - DNA, 22 bp, Artificial Sequence
  chemically synthesized
ttagacatttgtgtattcttgt

SEQ ID NO: 950668 - DNA, 22 bp, Artificial Sequence
  chemically synthesized
tctgaggaagctacaagaatac

SEQ ID NO: 950669 - DNA, 22 bp, Artificial Sequence
  chemically synthesized
ttctgaggaagctacaagaata

SEQ ID NO: 950670 - DNA, 22 bp, Artificial Sequence
  chemically synthesized
gacatttgtgtattcttgtagc

SEQ ID NO: 950671 - DNA, 22 bp, Artificial Sequence
  chemically synthesized
gtgtattcttgtagcttcctca

SEQ ID NO: 950672 - DNA, 22 bp, Artificial Sequence
  chemically synthesized
tgtattcttgtagcttcctcag

SEQ ID NO: 950673 - DNA, 22 bp, Artificial Sequence
  chemically synthesized
cagcccaaatcatttttctgag

SEQ ID NO: 950674 - DNA, 22 bp, Artificial Sequence
  chemically synthesized
ttgtagcttcctcagaaaaatg

SEQ ID NO: 950675 - DNA, 22 bp, Artificial Sequence
  chemically synthesized
gtagcttcctcagaaaaatgat

SEQ ID NO: 950676 - DNA, 22 bp, Artificial Sequence
  chemically synthesized
tagcttcctcagaaaaatgatt

SEQ ID NO: 950677 - DNA, 22 bp, Artificial Sequence
  chemically synthesized
taattccagcccaaatcatttt

SEQ ID NO: 950678 - DNA, 22 bp, Artificial Sequence
  chemically synthesized
cctcagaaaaatgatttgggct

SEQ ID NO: 950679 - DNA, 22 bp, Artificial Sequence
  chemically synthesized
agctataattccagcccaaatc

SEQ ID NO: 950680 - DNA, 22 bp, Artificial Sequence
  chemically synthesized
ctcagaaaaatgatttgggctg

SEQ ID NO: 950681 - DNA, 22 bp, Artificial Sequence
  chemically synthesized
aagctataattccagcccaaat

SEQ ID NO: 950682 - DNA, 22 bp, Artificial Sequence
  chemically synthesized
agaaaaatgatttgggctggaa

SEQ ID NO: 950683 - DNA, 22 bp, Artificial Sequence
  chemically synthesized
atgacccttaagctataattcc

SEQ ID NO: 950684 - DNA, 22 bp, Artificial Sequence
  chemically synthesized
tgttgatgacccttaagctata

SEQ ID NO: 950685 - DNA, 22 bp, Artificial Sequence
  chemically synthesized
atgttgatgacccttaagctat

SEQ ID NO: 950686 - DNA, 22 bp, Artificial Sequence
  chemically synthesized
gggctggaattatagcttaagg

SEQ ID NO: 950687 - DNA, 22 bp, Artificial Sequence
  chemically synthesized
ggctggaattatagcttaaggg

SEQ ID NO: 950688 - DNA, 22 bp, Artificial Sequence
  chemically synthesized
ttatgttgatgacccttaagct

SEQ ID NO: 950689 - DNA, 22 bp, Artificial Sequence
  chemically synthesized
gaattatagcttaagggtcatc

SEQ ID NO: 950690 - DNA, 22 bp, Artificial Sequence
  chemically synthesized
ccattcttatgttgatgaccct

SEQ ID NO: 950691 - DNA, 22 bp, Artificial Sequence
  chemically synthesized
tagcttaagggtcatcaacata

SEQ ID NO: 950692 - DNA, 22 bp, Artificial Sequence
  chemically synthesized
aacgcaattaccattcttatgt

SEQ ID NO: 950693 - DNA, 22 bp, Artificial Sequence
  chemically synthesized
aagggtcatcaacataagaatg

SEQ ID NO: 950694 - DNA, 22 bp, Artificial Sequence
  chemically synthesized
gaacgcaattaccattcttatg

SEQ ID NO: 950695 - DNA, 22 bp, Artificial Sequence
  chemically synthesized
agggtcatcaacataagaatgg

SEQ ID NO: 950696 - DNA, 22 bp, Artificial Sequence
  chemically synthesized
tgaacgcaattaccattcttat

SEQ ID NO: 950697 - DNA, 22 bp, Artificial Sequence
  chemically synthesized
tctttgaacgcaattaccattc

SEQ ID NO: 950698 - DNA, 22 bp, Artificial Sequence
  chemically synthesized
gtctttgaacgcaattaccatt

SEQ ID NO: 950699 - DNA, 22 bp, Artificial Sequence
  chemically synthesized
tgtgggtaatcttgtctttgaa

SEQ ID NO: 950700 - DNA, 22 bp, Artificial Sequence
  chemically synthesized
acattatgtgggtaatcttgtc

SEQ ID NO: 950701 - DNA, 22 bp, Artificial Sequence
  chemically synthesized
gacattatgtgggtaatcttgt

SEQ ID NO: 950702 - DNA, 22 bp, Artificial Sequence
  chemically synthesized
cgttcaaagacaagattaccca

SEQ ID NO: 950703 - DNA, 22 bp, Artificial Sequence
  chemically synthesized
cttgacattatgtgggtaatct

SEQ ID NO: 950704 - DNA, 22 bp, Artificial Sequence
  chemically synthesized
acttgacattatgtgggtaatc

SEQ ID NO: 950705 - DNA, 22 bp, Artificial Sequence
  chemically synthesized
ttacttgacattatgtgggtaa

SEQ ID NO: 950706 - DNA, 22 bp, Artificial Sequence
  chemically synthesized
aaagacaagattacccacataa

SEQ ID NO: 950707 - DNA, 22 bp, Artificial Sequence
  chemically synthesized
ctcttacttgacattatgtggg

SEQ ID NO: 950708 - DNA, 22 bp, Artificial Sequence
  chemically synthesized
cctcttacttgacattatgtgg

SEQ ID NO: 950709 - DNA, 22 bp, Artificial Sequence
  chemically synthesized
tcctcttacttgacattatgtg

SEQ ID NO: 950710 - DNA, 22 bp, Artificial Sequence
  chemically synthesized
ttcctcttacttgacattatgt

SEQ ID NO: 950711 - DNA, 22 bp, Artificial Sequence
  chemically synthesized
ttttcctcttacttgacattat

SEQ ID NO: 950712 - DNA, 22 bp, Artificial Sequence
  chemically synthesized
cccacataatgtcaagtaagag

SEQ ID NO: 950713 - DNA, 22 bp, Artificial Sequence
  chemically synthesized
ggacctcttttcctcttacttg

SEQ ID NO: 950714 - DNA, 22 bp, Artificial Sequence
  chemically synthesized
atctaggacctcttttcctctt

SEQ ID NO: 950715 - DNA, 22 bp, Artificial Sequence
  chemically synthesized
gatctaggacctcttttcctct

SEQ ID NO: 950716 - DNA, 22 bp, Artificial Sequence
  chemically synthesized
tgatctaggacctcttttcctc

SEQ ID NO: 950717 - DNA, 22 bp, Artificial Sequence
  chemically synthesized
atagttttgatctaggacctct

SEQ ID NO: 950718 - DNA, 22 bp, Artificial Sequence
  chemically synthesized
catagttttgatctaggacctc

SEQ ID NO: 950719 - DNA, 22 bp, Artificial Sequence
  chemically synthesized
acgacatccttcatagttttga

SEQ ID NO: 950720 - DNA, 22 bp, Artificial Sequence
  chemically synthesized
agtattgacgacatccttcata

SEQ ID NO: 950721 - DNA, 22 bp, Artificial Sequence
  chemically synthesized
gatcaaaactatgaaggatgtc

SEQ ID NO: 950722 - DNA, 22 bp, Artificial Sequence
  chemically synthesized
cattaagtattgacgacatcct

SEQ ID NO: 950723 - DNA, 22 bp, Artificial Sequence
  chemically synthesized
ccattaagtattgacgacatcc

SEQ ID NO: 950724 - DNA, 22 bp, Artificial Sequence
  chemically synthesized
cccttccattaagtattgacga

SEQ ID NO: 950725 - DNA, 22 bp, Artificial Sequence
  chemically synthesized
tgaaggatgtcgtcaatactta

SEQ ID NO: 950726 - DNA, 22 bp, Artificial Sequence
  chemically synthesized
atctgcccttccattaagtatt

SEQ ID NO: 950727 - DNA, 22 bp, Artificial Sequence
  chemically synthesized
ctcatctgcccttccattaagt

SEQ ID NO: 950728 - DNA, 22 bp, Artificial Sequence
  chemically synthesized
tgaattcctcatctgcccttcc

SEQ ID NO: 950729 - DNA, 22 bp, Artificial Sequence
  chemically synthesized
gtgaattcctcatctgcccttc

SEQ ID NO: 950730 - DNA, 22 bp, Artificial Sequence
  chemically synthesized
tgtgaattcctcatctgccctt

SEQ ID NO: 950731 - DNA, 22 bp, Artificial Sequence
  chemically synthesized
ctttgtgaattcctcatctgcc

SEQ ID NO: 950732 - DNA, 22 bp, Artificial Sequence
  chemically synthesized
aatggaagggcagatgaggaat

SEQ ID NO: 950733 - DNA, 22 bp, Artificial Sequence
  chemically synthesized
actcctttgtgaattcctcatc

SEQ ID NO: 950734 - DNA, 22 bp, Artificial Sequence
  chemically synthesized
atggaagggcagatgaggaatt

SEQ ID NO: 950735 - DNA, 22 bp, Artificial Sequence
  chemically synthesized
aactcctttgtgaattcctcat

SEQ ID NO: 950736 - DNA, 22 bp, Artificial Sequence
  chemically synthesized
ttaactcctttgtgaattcctc

SEQ ID NO: 950737 - DNA, 22 bp, Artificial Sequence
  chemically synthesized
cactcttaactcctttgtgaat

SEQ ID NO: 950738 - DNA, 22 bp, Artificial Sequence
  chemically synthesized
tacactcttaactcctttgtga

SEQ ID NO: 950739 - DNA, 22 bp, Artificial Sequence
  chemically synthesized
tatgactctacactcttaactc

SEQ ID NO: 950740 - DNA, 22 bp, Artificial Sequence
  chemically synthesized
atatgactctacactcttaact

SEQ ID NO: 950741 - DNA, 22 bp, Artificial Sequence
  chemically synthesized
cttatatgactctacactctta

SEQ ID NO: 950742 - DNA, 22 bp, Artificial Sequence
  chemically synthesized
gcttatatgactctacactctt

SEQ ID NO: 950743 - DNA, 22 bp, Artificial Sequence
  chemically synthesized
acaaaggagttaagagtgtaga

SEQ ID NO: 950744 - DNA, 22 bp, Artificial Sequence
  chemically synthesized
cttgcttatatgactctacact

SEQ ID NO: 950745 - DNA, 22 bp, Artificial Sequence
  chemically synthesized
ttccttgcttatatgactctac

SEQ ID NO: 950746 - DNA, 22 bp, Artificial Sequence
  chemically synthesized
tgttccttgcttatatgactct

SEQ ID NO: 950747 - DNA, 22 bp, Artificial Sequence
  chemically synthesized
agagtgtagagtcatataagca

SEQ ID NO: 950748 - DNA, 22 bp, Artificial Sequence
  chemically synthesized
aaacactctgttccttgcttat

SEQ ID NO: 950749 - DNA, 22 bp, Artificial Sequence
  chemically synthesized
aaaacactctgttccttgctta

SEQ ID NO: 950750 - DNA, 22 bp, Artificial Sequence
  chemically synthesized
cttaaaacactctgttccttgc

SEQ ID NO: 950751 - DNA, 22 bp, Artificial Sequence
  chemically synthesized
tgcttaaaacactctgttcctt

SEQ ID NO: 950752 - DNA, 22 bp, Artificial Sequence
  chemically synthesized
ttctgcttaaaacactctgttc

SEQ ID NO: 950753 - DNA, 22 bp, Artificial Sequence
  chemically synthesized
tgttctgcttaaaacactctgt

SEQ ID NO: 950754 - DNA, 22 bp, Artificial Sequence
  chemically synthesized
tcaactctgttctgcttaaaac

SEQ ID NO: 950755 - DNA, 22 bp, Artificial Sequence
  chemically synthesized
tggaccactgtcaactctgttc

SEQ ID NO: 950756 - DNA, 22 bp, Artificial Sequence
  chemically synthesized
ttatggaccactgtcaactctg

SEQ ID NO: 950757 - DNA, 22 bp, Artificial Sequence
  chemically synthesized
attatggaccactgtcaactct

SEQ ID NO: 950758 - DNA, 22 bp, Artificial Sequence
  chemically synthesized
taagcagaacagagttgacagt

SEQ ID NO: 950759 - DNA, 22 bp, Artificial Sequence
  chemically synthesized
aagcagaacagagttgacagtg

SEQ ID NO: 950760 - DNA, 22 bp, Artificial Sequence
  chemically synthesized
agcagaacagagttgacagtgg

SEQ ID NO: 950761 - DNA, 22 bp, Artificial Sequence
  chemically synthesized
accttattatggaccactgtca

SEQ ID NO: 950762 - DNA, 22 bp, Artificial Sequence
  chemically synthesized
gttcaccttattatggaccact

SEQ ID NO: 950763 - DNA, 22 bp, Artificial Sequence
  chemically synthesized
tcctagttcaccttattatgga

SEQ ID NO: 950764 - DNA, 22 bp, Artificial Sequence
  chemically synthesized
atcctagttcaccttattatgg

SEQ ID NO: 950765 - DNA, 22 bp, Artificial Sequence
  chemically synthesized
tatcctagttcaccttattatg

SEQ ID NO: 950766 - DNA, 22 bp, Artificial Sequence
  chemically synthesized
acagtggtccataataaggtga

SEQ ID NO: 950767 - DNA, 22 bp, Artificial Sequence
  chemically synthesized
cagtctttatcctagttcacct

SEQ ID NO: 950768 - DNA, 22 bp, Artificial Sequence
  chemically synthesized
tacagtctttatcctagttcac

SEQ ID NO: 950769 - DNA, 22 bp, Artificial Sequence
  chemically synthesized
gtgggtcctctacagtctttat

SEQ ID NO: 950770 - DNA, 22 bp, Artificial Sequence
  chemically synthesized
ggtgggtcctctacagtcttta

SEQ ID NO: 950771 - DNA, 22 bp, Artificial Sequence
  chemically synthesized
aatttggtgggtcctctacagt

SEQ ID NO: 950772 - DNA, 22 bp, Artificial Sequence
  chemically synthesized
ctaaatttggtgggtcctctac

SEQ ID NO: 950773 - DNA, 22 bp, Artificial Sequence
  chemically synthesized
ggataaagactgtagaggaccc

SEQ ID NO: 950774 - DNA, 22 bp, Artificial Sequence
  chemically synthesized
atgttgctaaatttggtgggtc

SEQ ID NO: 950775 - DNA, 22 bp, Artificial Sequence
  chemically synthesized
tagaggacccaccaaatttagc

SEQ ID NO: 950776 - DNA, 22 bp, Artificial Sequence
  chemically synthesized
atggtcctcatgttgctaaatt

SEQ ID NO: 950777 - DNA, 22 bp, Artificial Sequence
  chemically synthesized
atcaaggacactgatggtcctc

SEQ ID NO: 950778 - DNA, 22 bp, Artificial Sequence
  chemically synthesized
tcatcaaggacactgatggtcc

SEQ ID NO: 950779 - DNA, 22 bp, Artificial Sequence
  chemically synthesized
agcaacatgaggaccatcagtg

SEQ ID NO: 950780 - DNA, 22 bp, Artificial Sequence
  chemically synthesized
gcaacatgaggaccatcagtgt

SEQ ID NO: 950781 - DNA, 22 bp, Artificial Sequence
  chemically synthesized
atgggaggtactctcatcaagg

SEQ ID NO: 950782 - DNA, 22 bp, Artificial Sequence
  chemically synthesized
gcagcaaaggctcatgggaggt

SEQ ID NO: 950783 - DNA, 22 bp, Artificial Sequence
  chemically synthesized
tagcagcaaaggctcatgggag

SEQ ID NO: 950784 - DNA, 22 bp, Artificial Sequence
  chemically synthesized
gatgagagtacctcccatgagc

SEQ ID NO: 950785 - DNA, 22 bp, Artificial Sequence
  chemically synthesized
ctagcagcaaaggctcatggga

SEQ ID NO: 950786 - DNA, 22 bp, Artificial Sequence
  chemically synthesized
atgagagtacctcccatgagcc

SEQ ID NO: 950787 - DNA, 22 bp, Artificial Sequence
  chemically synthesized
acttctagcagcaaaggctcat

SEQ ID NO: 950788 - DNA, 22 bp, Artificial Sequence
  chemically synthesized
cacattgacttctagcagcaaa

SEQ ID NO: 950789 - DNA, 22 bp, Artificial Sequence
  chemically synthesized
ccatgagcctttgctgctagaa

SEQ ID NO: 950790 - DNA, 22 bp, Artificial Sequence
  chemically synthesized
acacactgcacattgacttcta

SEQ ID NO: 950791 - DNA, 22 bp, Artificial Sequence
  chemically synthesized
aacacactgcacattgacttct

SEQ ID NO: 950792 - DNA, 22 bp, Artificial Sequence
  chemically synthesized
taacacactgcacattgacttc

SEQ ID NO: 950793 - DNA, 22 bp, Artificial Sequence
  chemically synthesized
ctttaacacactgcacattgac

SEQ ID NO: 950794 - DNA, 22 bp, Artificial Sequence
  chemically synthesized
tgctgctagaagtcaatgtgca

SEQ ID NO: 950795 - DNA, 22 bp, Artificial Sequence
  chemically synthesized
gctgctagaagtcaatgtgcag

SEQ ID NO: 950796 - DNA, 22 bp, Artificial Sequence
  chemically synthesized
ctgctagaagtcaatgtgcagt

SEQ ID NO: 950797 - DNA, 22 bp, Artificial Sequence
  chemically synthesized
ctagaagtcaatgtgcagtgtg

SEQ ID NO: 950798 - DNA, 22 bp, Artificial Sequence
  chemically synthesized
gaagtcaatgtgcagtgtgtta

SEQ ID NO: 950799 - DNA, 22 bp, Artificial Sequence
  chemically synthesized
ccagccctgctttaacacactg

SEQ ID NO: 950800 - DNA, 22 bp, Artificial Sequence
  chemically synthesized
cacatcatgttgccagccctgc

SEQ ID NO: 950801 - DNA, 22 bp, Artificial Sequence
  chemically synthesized
tctccacatcatgttgccagcc

SEQ ID NO: 950802 - DNA, 22 bp, Artificial Sequence
  chemically synthesized
ttgtctccacatcatgttgcca

SEQ ID NO: 950803 - DNA, 22 bp, Artificial Sequence
  chemically synthesized
gttgtctccacatcatgttgcc

SEQ ID NO: 950804 - DNA, 22 bp, Artificial Sequence
  chemically synthesized
aagcagggctggcaacatgatg

SEQ ID NO: 950805 - DNA, 22 bp, Artificial Sequence
  chemically synthesized
tatttgttgtctccacatcatg

SEQ ID NO: 950806 - DNA, 22 bp, Artificial Sequence
  chemically synthesized
tctatatttgttgtctccacat

SEQ ID NO: 950807 - DNA, 22 bp, Artificial Sequence
  chemically synthesized
gcaacatgatgtggagacaaca

SEQ ID NO: 950808 - DNA, 22 bp, Artificial Sequence
  chemically synthesized
tcataaacaacctatctatatt

SEQ ID NO: 950809 - DNA, 22 bp, Artificial Sequence
  chemically synthesized
tatcataaacaacctatctata

SEQ ID NO: 950810 - DNA, 22 bp, Artificial Sequence
  chemically synthesized
cagataaccctctatcataaac

SEQ ID NO: 950811 - DNA, 22 bp, Artificial Sequence
  chemically synthesized
acagataaccctctatcataaa

SEQ ID NO: 950812 - DNA, 22 bp, Artificial Sequence
  chemically synthesized
tacagataaccctctatcataa

SEQ ID NO: 950813 - DNA, 22 bp, Artificial Sequence
  chemically synthesized
ctttacagataaccctctatca

SEQ ID NO: 950814 - DNA, 22 bp, Artificial Sequence
  chemically synthesized
cctttacagataaccctctatc

SEQ ID NO: 950815 - DNA, 22 bp, Artificial Sequence
  chemically synthesized
tcctttacagataaccctctat

SEQ ID NO: 950816 - DNA, 22 bp, Artificial Sequence
  chemically synthesized
actttcctttacagataaccct

SEQ ID NO: 950817 - DNA, 22 bp, Artificial Sequence
  chemically synthesized
gactttcctttacagataaccc

SEQ ID NO: 950818 - DNA, 22 bp, Artificial Sequence
  chemically synthesized
tttatgatagagggttatctgt

SEQ ID NO: 950819 - DNA, 22 bp, Artificial Sequence
  chemically synthesized
ttgactttcctttacagataac

SEQ ID NO: 950820 - DNA, 22 bp, Artificial Sequence
  chemically synthesized
atgatagagggttatctgtaaa

SEQ ID NO: 950821 - DNA, 22 bp, Artificial Sequence
  chemically synthesized
tgatagagggttatctgtaaag

SEQ ID NO: 950822 - DNA, 22 bp, Artificial Sequence
  chemically synthesized
cctcttgactttcctttacaga

SEQ ID NO: 950823 - DNA, 22 bp, Artificial Sequence
  chemically synthesized
ccctcttgactttcctttacag

SEQ ID NO: 950824 - DNA, 22 bp, Artificial Sequence
  chemically synthesized
tttccctcttgactttccttta

SEQ ID NO: 950825 - DNA, 22 bp, Artificial Sequence
  chemically synthesized
gttatttccctcttgactttcc

SEQ ID NO: 950826 - DNA, 22 bp, Artificial Sequence
  chemically synthesized
tctgtaaaggaaagtcaagagg

SEQ ID NO: 950827 - DNA, 22 bp, Artificial Sequence
  chemically synthesized
cactggttatttccctcttgac

SEQ ID NO: 950828 - DNA, 22 bp, Artificial Sequence
  chemically synthesized
taaaggaaagtcaagagggaaa

SEQ ID NO: 950829 - DNA, 22 bp, Artificial Sequence
  chemically synthesized
tgtgctacactggttatttccc

SEQ ID NO: 950830 - DNA, 22 bp, Artificial Sequence
  chemically synthesized
aagtctatgtgctacactggtt

SEQ ID NO: 950831 - DNA, 22 bp, Artificial Sequence
  chemically synthesized
gaagtctatgtgctacactggt

SEQ ID NO: 950832 - DNA, 22 bp, Artificial Sequence
  chemically synthesized
aaacaacccttgaagtctatgt

SEQ ID NO: 950833 - DNA, 22 bp, Artificial Sequence
  chemically synthesized
atcattaaaacaacccttgaag

SEQ ID NO: 950834 - DNA, 22 bp, Artificial Sequence
  chemically synthesized
aatcattaaaacaacccttgaa

SEQ ID NO: 950835 - DNA, 22 bp, Artificial Sequence
  chemically synthesized
tttaatcattaaaacaaccctt

SEQ ID NO: 950836 - DNA, 22 bp, Artificial Sequence
  chemically synthesized
gtttaatcattaaaacaaccct

SEQ ID NO: 950837 - DNA, 22 bp, Artificial Sequence
  chemically synthesized
tgtttaatcattaaaacaaccc

SEQ ID NO: 950838 - DNA, 22 bp, Artificial Sequence
  chemically synthesized
ttgtttaatcattaaaacaacc

SEQ ID NO: 950839 - DNA, 22 bp, Artificial Sequence
  chemically synthesized
gtatttttgtttaatcattaaa

SEQ ID NO: 950840 - DNA, 22 bp, Artificial Sequence
  chemically synthesized
caagggttgttttaatgattaa

SEQ ID NO: 950841 - DNA, 22 bp, Artificial Sequence
  chemically synthesized
tagtatttttgtttaatcatta

SEQ ID NO: 950842 - DNA, 22 bp, Artificial Sequence
  chemically synthesized
aagggttgttttaatgattaaa

SEQ ID NO: 950843 - DNA, 22 bp, Artificial Sequence
  chemically synthesized
tctagtatttttgtttaatcat

SEQ ID NO: 950844 - DNA, 22 bp, Artificial Sequence
  chemically synthesized
ttttaatgattaaacaaaaata

SEQ ID NO: 950845 - DNA, 22 bp, Artificial Sequence
  chemically synthesized
aacattctctagtatttttgtt

SEQ ID NO: 950846 - DNA, 22 bp, Artificial Sequence
  chemically synthesized
gaacattctctagtatttttgt

SEQ ID NO: 950847 - DNA, 22 bp, Artificial Sequence
  chemically synthesized
taatgattaaacaaaaatacta

SEQ ID NO: 950848 - DNA, 22 bp, Artificial Sequence
  chemically synthesized
aatgattaaacaaaaatactag

SEQ ID NO: 950849 - DNA, 22 bp, Artificial Sequence
  chemically synthesized
atgattaaacaaaaatactaga

SEQ ID NO: 950850 - DNA, 22 bp, Artificial Sequence
  chemically synthesized
tgagcatttgaacattctctag

SEQ ID NO: 950851 - DNA, 22 bp, Artificial Sequence
  chemically synthesized
aacaaaaatactagagaatgtt

SEQ ID NO: 950852 - DNA, 22 bp, Artificial Sequence
  chemically synthesized
tatgagcatttgaacattctct

SEQ ID NO: 950853 - DNA, 22 bp, Artificial Sequence
  chemically synthesized
atcccatattctatgagcattt

SEQ ID NO: 950854 - DNA, 22 bp, Artificial Sequence
  chemically synthesized
gagaatgttcaaatgctcatag

SEQ ID NO: 950855 - DNA, 22 bp, Artificial Sequence
  chemically synthesized
aaatgctcatagaatatgggat

SEQ ID NO: 950856 - DNA, 22 bp, Artificial Sequence
  chemically synthesized
agaaagagattgatcccatatt

SEQ ID NO: 950857 - DNA, 22 bp, Artificial Sequence
  chemically synthesized
gagaaagagattgatcccatat

SEQ ID NO: 950858 - DNA, 22 bp, Artificial Sequence
  chemically synthesized
tgagaaagagattgatcccata

SEQ ID NO: 950859 - DNA, 22 bp, Artificial Sequence
  chemically synthesized
atagaatatgggatcaatctct

SEQ ID NO: 950860 - DNA, 22 bp, Artificial Sequence
  chemically synthesized
tcagtattttgagaaagagatt

SEQ ID NO: 950861 - DNA, 22 bp, Artificial Sequence
  chemically synthesized
acatcatcctatcagtattttg

SEQ ID NO: 950862 - DNA, 22 bp, Artificial Sequence
  chemically synthesized
cacatcatcctatcagtatttt

SEQ ID NO: 950863 - DNA, 22 bp, Artificial Sequence
  chemically synthesized
tcacatcatcctatcagtattt

SEQ ID NO: 950864 - DNA, 22 bp, Artificial Sequence
  chemically synthesized
ttcacatcatcctatcagtatt

SEQ ID NO: 950865 - DNA, 22 bp, Artificial Sequence
  chemically synthesized
tttctcaaaatactgataggat

SEQ ID NO: 950866 - DNA, 22 bp, Artificial Sequence
  chemically synthesized
tctcaaaatactgataggatga

SEQ ID NO: 950867 - DNA, 22 bp, Artificial Sequence
  chemically synthesized
ctcaaaatactgataggatgat

SEQ ID NO: 950868 - DNA, 22 bp, Artificial Sequence
  chemically synthesized
tcaaaatactgataggatgatg

SEQ ID NO: 950869 - DNA, 22 bp, Artificial Sequence
  chemically synthesized
aaaatactgataggatgatgtg

SEQ ID NO: 950870 - DNA, 22 bp, Artificial Sequence
  chemically synthesized
atgaagacatgatttttcacat

SEQ ID NO: 950871 - DNA, 22 bp, Artificial Sequence
  chemically synthesized
ctcatgaagacatgatttttca

SEQ ID NO: 950872 - DNA, 22 bp, Artificial Sequence
  chemically synthesized
ataggatgatgtgaaaaatcat

SEQ ID NO: 950873 - DNA, 22 bp, Artificial Sequence
  chemically synthesized
gctcatgaagacatgatttttc

SEQ ID NO: 950874 - DNA, 22 bp, Artificial Sequence
  chemically synthesized
cttgctcatgaagacatgattt

SEQ ID NO: 950875 - DNA, 22 bp, Artificial Sequence
  chemically synthesized
cacattgcttgctcatgaagac

SEQ ID NO: 950876 - DNA, 22 bp, Artificial Sequence
  chemically synthesized
cctccacattgcttgctcatga

SEQ ID NO: 950877 - DNA, 22 bp, Artificial Sequence
  chemically synthesized
catgagcaagcaatgtggaggc

SEQ ID NO: 950878 - DNA, 22 bp, Artificial Sequence
  chemically synthesized
tgggaatatactgcctccacat

SEQ ID NO: 950879 - DNA, 22 bp, Artificial Sequence
  chemically synthesized
atgagcaagcaatgtggaggca

SEQ ID NO: 950880 - DNA, 22 bp, Artificial Sequence
  chemically synthesized
tgtgggaatatactgcctccac

SEQ ID NO: 950881 - DNA, 22 bp, Artificial Sequence
  chemically synthesized
catgaatatgttctgtgggaat

SEQ ID NO: 950882 - DNA, 22 bp, Artificial Sequence
  chemically synthesized
ccatgaatatgttctgtgggaa

SEQ ID NO: 950883 - DNA, 22 bp, Artificial Sequence
  chemically synthesized
acacttccatgaatatgttctg

SEQ ID NO: 950884 - DNA, 22 bp, Artificial Sequence
  chemically synthesized
tgttaacacttccatgaatatg

SEQ ID NO: 950885 - DNA, 22 bp, Artificial Sequence
  chemically synthesized
gtgttaacacttccatgaatat

SEQ ID NO: 950886 - DNA, 22 bp, Artificial Sequence
  chemically synthesized
tgtgttaacacttccatgaata

SEQ ID NO: 950887 - DNA, 22 bp, Artificial Sequence
  chemically synthesized
ccacagaacatattcatggaag

SEQ ID NO: 950888 - DNA, 22 bp, Artificial Sequence
  chemically synthesized
gtaaaatattttgtgttaacac

SEQ ID NO: 950889 - DNA, 22 bp, Artificial Sequence
  chemically synthesized
ggtaaaatattttgtgttaaca

SEQ ID NO: 950890 - DNA, 22 bp, Artificial Sequence
  chemically synthesized
cttggtaaaatattttgtgtta

SEQ ID NO: 950891 - DNA, 22 bp, Artificial Sequence
  chemically synthesized
atggaagtgttaacacaaaata

SEQ ID NO: 950892 - DNA, 22 bp, Artificial Sequence
  chemically synthesized
gagatggtcattacttggtaaa

SEQ ID NO: 950893 - DNA, 22 bp, Artificial Sequence
  chemically synthesized
acacaaaatattttaccaagta

SEQ ID NO: 950894 - DNA, 22 bp, Artificial Sequence
  chemically synthesized
agagatggtcattacttggtaa

SEQ ID NO: 950895 - DNA, 22 bp, Artificial Sequence
  chemically synthesized
tagagatggtcattacttggta

SEQ ID NO: 950896 - DNA, 22 bp, Artificial Sequence
  chemically synthesized
taccaagtaatgaccatctcta

SEQ ID NO: 950897 - DNA, 22 bp, Artificial Sequence
  chemically synthesized
caaatgtgattttagagatggt

SEQ ID NO: 950898 - DNA, 22 bp, Artificial Sequence
  chemically synthesized
accaagtaatgaccatctctaa

SEQ ID NO: 950899 - DNA, 22 bp, Artificial Sequence
  chemically synthesized
acaaatgtgattttagagatgg

SEQ ID NO: 950900 - DNA, 22 bp, Artificial Sequence
  chemically synthesized
ccaagtaatgaccatctctaaa

SEQ ID NO: 950901 - DNA, 22 bp, Artificial Sequence
  chemically synthesized
tacaaatgtgattttagagatg

SEQ ID NO: 950902 - DNA, 22 bp, Artificial Sequence
  chemically synthesized
ttacaaatgtgattttagagat

SEQ ID NO: 950903 - DNA, 22 bp, Artificial Sequence
  chemically synthesized
gtttttacaaatgtgattttag

SEQ ID NO: 950904 - DNA, 22 bp, Artificial Sequence
  chemically synthesized
taaaatcacatttgtaaaaact

SEQ ID NO: 950905 - DNA, 22 bp, Artificial Sequence
  chemically synthesized
ataaagcacgctagtttttaca

SEQ ID NO: 950906 - DNA, 22 bp, Artificial Sequence
  chemically synthesized
aataaagcacgctagtttttac

SEQ ID NO: 950907 - DNA, 22 bp, Artificial Sequence
  chemically synthesized
aaatcacatttgtaaaaactag

SEQ ID NO: 950908 - DNA, 22 bp, Artificial Sequence
  chemically synthesized
gtaaaaactagcgtgctttatt

SEQ ID NO: 950909 - DNA, 22 bp, Artificial Sequence
  chemically synthesized
taaaaactagcgtgctttatta

SEQ ID NO: 950910 - DNA, 22 bp, Artificial Sequence
  chemically synthesized
cccatgaagatttaataaagca

SEQ ID NO: 950911 - DNA, 22 bp, Artificial Sequence
  chemically synthesized
gcccatgaagatttaataaagc

SEQ ID NO: 950912 - DNA, 22 bp, Artificial Sequence
  chemically synthesized
atcttgcccatgaagatttaat

SEQ ID NO: 950913 - DNA, 22 bp, Artificial Sequence
  chemically synthesized
gcgtgctttattaaatcttcat

SEQ ID NO: 950914 - DNA, 22 bp, Artificial Sequence
  chemically synthesized
tcagttaatcttgcccatgaag

SEQ ID NO: 950915 - DNA, 22 bp, Artificial Sequence
  chemically synthesized
tattaaatcttcatgggcaaga

SEQ ID NO: 950916 - DNA, 22 bp, Artificial Sequence
  chemically synthesized
attaaatcttcatgggcaagat

SEQ ID NO: 950917 - DNA, 22 bp, Artificial Sequence
  chemically synthesized
ttaaatcttcatgggcaagatt

SEQ ID NO: 950918 - DNA, 22 bp, Artificial Sequence
  chemically synthesized
tgtctatcagttaatcttgccc

SEQ ID NO: 950919 - DNA, 22 bp, Artificial Sequence
  chemically synthesized
tgtgtctatcagttaatcttgc

SEQ ID NO: 950920 - DNA, 22 bp, Artificial Sequence
  chemically synthesized
aatcttcatgggcaagattaac

SEQ ID NO: 950921 - DNA, 22 bp, Artificial Sequence
  chemically synthesized
catgggcaagattaactgatag

SEQ ID NO: 950922 - DNA, 22 bp, Artificial Sequence
  chemically synthesized
atgggcaagattaactgataga

SEQ ID NO: 950923 - DNA, 22 bp, Artificial Sequence
  chemically synthesized
aacaaataaatgctctgtgtct

SEQ ID NO: 950924 - DNA, 22 bp, Artificial Sequence
  chemically synthesized
gaacaaataaatgctctgtgtc

SEQ ID NO: 950925 - DNA, 22 bp, Artificial Sequence
  chemically synthesized
actgatagacacagagcattta

SEQ ID NO: 950926 - DNA, 22 bp, Artificial Sequence
  chemically synthesized
aacatttgaacaaataaatgct

SEQ ID NO: 950927 - DNA, 22 bp, Artificial Sequence
  chemically synthesized
atagacacagagcatttatttg

SEQ ID NO: 950928 - DNA, 22 bp, Artificial Sequence
  chemically synthesized
tcaacatttgaacaaataaatg

SEQ ID NO: 950929 - DNA, 22 bp, Artificial Sequence
  chemically synthesized
taattctcaacatttgaacaaa

SEQ ID NO: 950930 - DNA, 22 bp, Artificial Sequence
  chemically synthesized
gtaattctcaacatttgaacaa

SEQ ID NO: 950931 - DNA, 22 bp, Artificial Sequence
  chemically synthesized
aatttgtaattctcaacatttg

SEQ ID NO: 950932 - DNA, 22 bp, Artificial Sequence
  chemically synthesized
ctcaatttgtaattctcaacat

SEQ ID NO: 950933 - DNA, 22 bp, Artificial Sequence
  chemically synthesized
atttgttcaaatgttgagaatt

SEQ ID NO: 950934 - DNA, 22 bp, Artificial Sequence
  chemically synthesized
tttgttcaaatgttgagaatta

SEQ ID NO: 950935 - DNA, 22 bp, Artificial Sequence
  chemically synthesized
ttcctcaatttgtaattctcaa

SEQ ID NO: 950936 - DNA, 22 bp, Artificial Sequence
  chemically synthesized
gttcaaatgttgagaattacaa

SEQ ID NO: 950937 - DNA, 22 bp, Artificial Sequence
  chemically synthesized
ttcaaatgttgagaattacaaa

SEQ ID NO: 950938 - DNA, 22 bp, Artificial Sequence
  chemically synthesized
aaatgttgagaattacaaattg

SEQ ID NO: 950939 - DNA, 22 bp, Artificial Sequence
  chemically synthesized
gaaataattattcctcaatttg

SEQ ID NO: 950940 - DNA, 22 bp, Artificial Sequence
  chemically synthesized
agaattacaaattgaggaataa

SEQ ID NO: 950941 - DNA, 22 bp, Artificial Sequence
  chemically synthesized
tcattagaaataattattcctc

SEQ ID NO: 950942 - DNA, 22 bp, Artificial Sequence
  chemically synthesized
caaattgaggaataattatttc

SEQ ID NO: 950943 - DNA, 22 bp, Artificial Sequence
  chemically synthesized
agaatctatcattagaaataat

SEQ ID NO: 950944 - DNA, 22 bp, Artificial Sequence
  chemically synthesized
aagaatctatcattagaaataa

SEQ ID NO: 950945 - DNA, 22 bp, Artificial Sequence
  chemically synthesized
taagaatctatcattagaaata

SEQ ID NO: 950946 - DNA, 22 bp, Artificial Sequence
  chemically synthesized
aggaataattatttctaatgat

SEQ ID NO: 950947 - DNA, 22 bp, Artificial Sequence
  chemically synthesized
ataataagagttttaagaatct

SEQ ID NO: 950948 - DNA, 22 bp, Artificial Sequence
  chemically synthesized
tttctaatgatagattcttaaa

SEQ ID NO: 950949 - DNA, 22 bp, Artificial Sequence
  chemically synthesized
aataataagagttttaagaatc

SEQ ID NO: 950950 - DNA, 22 bp, Artificial Sequence
  chemically synthesized
taataataagagttttaagaat

SEQ ID NO: 950951 - DNA, 22 bp, Artificial Sequence
  chemically synthesized
ctaatgatagattcttaaaact

SEQ ID NO: 950952 - DNA, 22 bp, Artificial Sequence
  chemically synthesized
taatgatagattcttaaaactc

SEQ ID NO: 950953 - DNA, 22 bp, Artificial Sequence
  chemically synthesized
atgatagattcttaaaactctt

SEQ ID NO: 950954 - DNA, 22 bp, Artificial Sequence
  chemically synthesized
tatctttaataataagagtttt

SEQ ID NO: 950955 - DNA, 22 bp, Artificial Sequence
  chemically synthesized
gtgtattatatctttaataata

SEQ ID NO: 950956 - DNA, 22 bp, Artificial Sequence
  chemically synthesized
agtgtattatatctttaataat

SEQ ID NO: 950957 - DNA, 22 bp, Artificial Sequence
  chemically synthesized
ttaaaactcttattattaaaga

SEQ ID NO: 950958 - DNA, 22 bp, Artificial Sequence
  chemically synthesized
tagtgtattatatctttaataa

SEQ ID NO: 950959 - DNA, 22 bp, Artificial Sequence
  chemically synthesized
aaaactcttattattaaagata

SEQ ID NO: 950960 - DNA, 22 bp, Artificial Sequence
  chemically synthesized
aaactcttattattaaagatat

SEQ ID NO: 950961 - DNA, 22 bp, Artificial Sequence
  chemically synthesized
ttttagtgtattatatctttaa

SEQ ID NO: 950962 - DNA, 22 bp, Artificial Sequence
  chemically synthesized
ttgttttagtgtattatatctt

SEQ ID NO: 950963 - DNA, 22 bp, Artificial Sequence
  chemically synthesized
ttattattaaagatataataca

SEQ ID NO: 950964 - DNA, 22 bp, Artificial Sequence
  chemically synthesized
attattaaagatataatacact

SEQ ID NO: 950965 - DNA, 22 bp, Artificial Sequence
  chemically synthesized
ttattaaagatataatacacta

SEQ ID NO: 950966 - DNA, 22 bp, Artificial Sequence
  chemically synthesized
aaaattattgttttagtgtatt

SEQ ID NO: 950967 - DNA, 22 bp, Artificial Sequence
  chemically synthesized
ttaaagatataatacactaaaa

SEQ ID NO: 950968 - DNA, 22 bp, Artificial Sequence
  chemically synthesized
aagatataatacactaaaacaa

SEQ ID NO: 950969 - DNA, 22 bp, Artificial Sequence
  chemically synthesized
taactgaaaattattgttttag

SEQ ID NO: 950970 - DNA, 22 bp, Artificial Sequence
  chemically synthesized
aaacaataattttcagttatag

SEQ ID NO: 950971 - DNA, 22 bp, Artificial Sequence
  chemically synthesized
aatcaatggaaggaggctataa

SEQ ID NO: 950972 - DNA, 22 bp, Artificial Sequence
  chemically synthesized
gaatcaatggaaggaggctata

SEQ ID NO: 950973 - DNA, 22 bp, Artificial Sequence
  chemically synthesized
gtttgaatcaatggaaggaggc

SEQ ID NO: 950974 - DNA, 22 bp, Artificial Sequence
  chemically synthesized
cgtttgaatcaatggaaggagg

SEQ ID NO: 950975 - DNA, 22 bp, Artificial Sequence
  chemically synthesized
tcgtttgaatcaatggaaggag

SEQ ID NO: 950976 - DNA, 22 bp, Artificial Sequence
  chemically synthesized
tcagttatagcctccttccatt

SEQ ID NO: 950977 - DNA, 22 bp, Artificial Sequence
  chemically synthesized
cagttatagcctccttccattg

SEQ ID NO: 950978 - DNA, 22 bp, Artificial Sequence
  chemically synthesized
agttatagcctccttccattga

SEQ ID NO: 950979 - DNA, 22 bp, Artificial Sequence
  chemically synthesized
tagcctccttccattgattcaa

SEQ ID NO: 950980 - DNA, 22 bp, Artificial Sequence
  chemically synthesized
tgtgtctttcgtttgaatcaat

SEQ ID NO: 950981 - DNA, 22 bp, Artificial Sequence
  chemically synthesized
gtgtgtctttcgtttgaatcaa

SEQ ID NO: 950982 - DNA, 22 bp, Artificial Sequence
  chemically synthesized
tgtgtgtctttcgtttgaatca

SEQ ID NO: 950983 - DNA, 22 bp, Artificial Sequence
  chemically synthesized
cttccattgattcaaacgaaag

SEQ ID NO: 950984 - DNA, 22 bp, Artificial Sequence
  chemically synthesized
cactttgtgtgtctttcgtttg

SEQ ID NO: 950985 - DNA, 22 bp, Artificial Sequence
  chemically synthesized
ccattgattcaaacgaaagaca

SEQ ID NO: 950986 - DNA, 22 bp, Artificial Sequence
  chemically synthesized
cattgattcaaacgaaagacac

SEQ ID NO: 950987 - DNA, 22 bp, Artificial Sequence
  chemically synthesized
attcaaacgaaagacacacaaa

SEQ ID NO: 950988 - DNA, 22 bp, Artificial Sequence
  chemically synthesized
tgcacggttacactttgtgtgt

SEQ ID NO: 950989 - DNA, 22 bp, Artificial Sequence
  chemically synthesized
atgcacggttacactttgtgtg

SEQ ID NO: 950990 - DNA, 22 bp, Artificial Sequence
  chemically synthesized
aaacgaaagacacacaaagtgt

SEQ ID NO: 950991 - DNA, 22 bp, Artificial Sequence
  chemically synthesized
acagtatttatgcacggttaca

SEQ ID NO: 950992 - DNA, 22 bp, Artificial Sequence
  chemically synthesized
gacagtatttatgcacggttac

SEQ ID NO: 950993 - DNA, 22 bp, Artificial Sequence
  chemically synthesized
aaagcttgacagtatttatgca

SEQ ID NO: 950994 - DNA, 22 bp, Artificial Sequence
  chemically synthesized
ctcaaagcttgacagtatttat

SEQ ID NO: 950995 - DNA, 22 bp, Artificial Sequence
  chemically synthesized
cagaaatcgatattcctcaaag

SEQ ID NO: 950996 - DNA, 22 bp, Artificial Sequence
  chemically synthesized
ccagaaatcgatattcctcaaa

SEQ ID NO: 950997 - DNA, 22 bp, Artificial Sequence
  chemically synthesized
tcaagctttgaggaatatcgat

SEQ ID NO: 950998 - DNA, 22 bp, Artificial Sequence
  chemically synthesized
tgaggaatatcgatttctggaa

SEQ ID NO: 950999 - DNA, 22 bp, Artificial Sequence
  chemically synthesized
gaggaatatcgatttctggaaa

SEQ ID NO: 951000 - DNA, 22 bp, Artificial Sequence
  chemically synthesized
aggaatatcgatttctggaaat

SEQ ID NO: 951001 - DNA, 22 bp, Artificial Sequence
  chemically synthesized
ggtaccaataaaacggaggatt

SEQ ID NO: 951002 - DNA, 22 bp, Artificial Sequence
  chemically synthesized
ctggaaatcctccgttttattg

SEQ ID NO: 951003 - DNA, 22 bp, Artificial Sequence
  chemically synthesized
tggaaatcctccgttttattgg

SEQ ID NO: 951004 - DNA, 22 bp, Artificial Sequence
  chemically synthesized
gaaatcctccgttttattggta

SEQ ID NO: 951005 - DNA, 22 bp, Artificial Sequence
  chemically synthesized
tggaaaatctcggtaccaataa

SEQ ID NO: 951006 - DNA, 22 bp, Artificial Sequence
  chemically synthesized
tgtggaaaatctcggtaccaat

SEQ ID NO: 951007 - DNA, 22 bp, Artificial Sequence
  chemically synthesized
ctgtggaaaatctcggtaccaa

SEQ ID NO: 951008 - DNA, 22 bp, Artificial Sequence
  chemically synthesized
cgttttattggtaccgagattt

SEQ ID NO: 951009 - DNA, 22 bp, Artificial Sequence
  chemically synthesized
gtgagtttctgtggaaaatctc

SEQ ID NO: 951010 - DNA, 22 bp, Artificial Sequence
  chemically synthesized
agtgagtttctgtggaaaatct

SEQ ID NO: 951011 - DNA, 22 bp, Artificial Sequence
  chemically synthesized
tattggtaccgagattttccac

SEQ ID NO: 951012 - DNA, 22 bp, Artificial Sequence
  chemically synthesized
attggtaccgagattttccaca

SEQ ID NO: 951013 - DNA, 22 bp, Artificial Sequence
  chemically synthesized
ttggtaccgagattttccacag

SEQ ID NO: 951014 - DNA, 22 bp, Artificial Sequence
  chemically synthesized
gtaccgagattttccacagaaa

SEQ ID NO: 951015 - DNA, 22 bp, Artificial Sequence
  chemically synthesized
caaaaagtggtgcttagtgagt

SEQ ID NO: 951016 - DNA, 22 bp, Artificial Sequence
  chemically synthesized
tccacagaaactcactaagcac

SEQ ID NO: 951017 - DNA, 22 bp, Artificial Sequence
  chemically synthesized
ccacagaaactcactaagcacc

SEQ ID NO: 951018 - DNA, 22 bp, Artificial Sequence
  chemically synthesized
cacagaaactcactaagcacca

SEQ ID NO: 951019 - DNA, 22 bp, Artificial Sequence
  chemically synthesized
actaagcaccactttttgtaac

SEQ ID NO: 951020 - DNA, 22 bp, Artificial Sequence
  chemically synthesized
agcaccactttttgtaactatc

SEQ ID NO: 951021 - DNA, 22 bp, Artificial Sequence
  chemically synthesized
tttgtaactatcccatgatact

SEQ ID NO: 951022 - DNA, 22 bp, Artificial Sequence
  chemically synthesized
ttgtaactatcccatgatactc

SEQ ID NO: 951023 - DNA, 22 bp, Artificial Sequence
  chemically synthesized
tgtaactatcccatgatactca

SEQ ID NO: 951024 - DNA, 22 bp, Artificial Sequence
  chemically synthesized
gtaactatcccatgatactcat

SEQ ID NO: 951025 - DNA, 22 bp, Artificial Sequence
  chemically synthesized
taactatcccatgatactcatt

SEQ ID NO: 951026 - DNA, 22 bp, Artificial Sequence
  chemically synthesized
tcccatgatactcattatacgt

SEQ ID NO: 951027 - DNA, 22 bp, Artificial Sequence
  chemically synthesized
accgtgtgcatggcacgtataa

SEQ ID NO: 951028 - DNA, 22 bp, Artificial Sequence
  chemically synthesized
gaaattgaccgtgtgcatggca

SEQ ID NO: 951029 - DNA, 22 bp, Artificial Sequence
  chemically synthesized
ctagaaattgaccgtgtgcatg

SEQ ID NO: 951030 - DNA, 22 bp, Artificial Sequence
  chemically synthesized
attatacgtgccatgcacacgg

SEQ ID NO: 951031 - DNA, 22 bp, Artificial Sequence
  chemically synthesized
actagaaattgaccgtgtgcat

SEQ ID NO: 951032 - DNA, 22 bp, Artificial Sequence
  chemically synthesized
tacgtgccatgcacacggtcaa

SEQ ID NO: 951033 - DNA, 22 bp, Artificial Sequence
  chemically synthesized
atttactagaaattgaccgtgt

SEQ ID NO: 951034 - DNA, 22 bp, Artificial Sequence
  chemically synthesized
taatttactagaaattgaccgt

SEQ ID NO: 951035 - DNA, 22 bp, Artificial Sequence
  chemically synthesized
ctaatttactagaaattgaccg

SEQ ID NO: 951036 - DNA, 22 bp, Artificial Sequence
  chemically synthesized
tctaatttactagaaattgacc

SEQ ID NO: 951037 - DNA, 22 bp, Artificial Sequence
  chemically synthesized
ctttctaatttactagaaattg

SEQ ID NO: 951038 - DNA, 22 bp, Artificial Sequence
  chemically synthesized
gttactttctaatttactagaa

SEQ ID NO: 951039 - DNA, 22 bp, Artificial Sequence
  chemically synthesized
tgctagttactttctaatttac

SEQ ID NO: 951040 - DNA, 22 bp, Artificial Sequence
  chemically synthesized
ctagtaaattagaaagtaacta

SEQ ID NO: 951041 - DNA, 22 bp, Artificial Sequence
  chemically synthesized
tagtaaattagaaagtaactag

SEQ ID NO: 951042 - DNA, 22 bp, Artificial Sequence
  chemically synthesized
gtaaattagaaagtaactagca

SEQ ID NO: 951043 - DNA, 22 bp, Artificial Sequence
  chemically synthesized
aataaataataggattatgcta

SEQ ID NO: 951044 - DNA, 22 bp, Artificial Sequence
  chemically synthesized
gaaagtaactagcataatccta

SEQ ID NO: 951045 - DNA, 22 bp, Artificial Sequence
  chemically synthesized
aaattaaataaataataggatt

SEQ ID NO: 951046 - DNA, 22 bp, Artificial Sequence
  chemically synthesized
gcataatcctattatttattta

SEQ ID NO: 951047 - DNA, 22 bp, Artificial Sequence
  chemically synthesized
aatgataacatcattgaaatta

SEQ ID NO: 951048 - DNA, 22 bp, Artificial Sequence
  chemically synthesized
ttatttatttaatttcaatgat

SEQ ID NO: 951049 - DNA, 22 bp, Artificial Sequence
  chemically synthesized
tttatttaatttcaatgatgtt

SEQ ID NO: 951050 - DNA, 22 bp, Artificial Sequence
  chemically synthesized
gagattcaatgataacatcatt

SEQ ID NO: 951051 - DNA, 22 bp, Artificial Sequence
  chemically synthesized
atttaatttcaatgatgttatc

SEQ ID NO: 951052 - DNA, 22 bp, Artificial Sequence
  chemically synthesized
tttaatttcaatgatgttatca

SEQ ID NO: 951053 - DNA, 22 bp, Artificial Sequence
  chemically synthesized
aatttcaatgatgttatcattg

SEQ ID NO: 951054 - DNA, 22 bp, Artificial Sequence
  chemically synthesized
atttcaatgatgttatcattga

SEQ ID NO: 951055 - DNA, 22 bp, Artificial Sequence
  chemically synthesized
gaatactggagattcaatgata

SEQ ID NO: 951056 - DNA, 22 bp, Artificial Sequence
  chemically synthesized
tagaatactggagattcaatga

SEQ ID NO: 951057 - DNA, 22 bp, Artificial Sequence
  chemically synthesized
caatgatgttatcattgaatct

SEQ ID NO: 951058 - DNA, 22 bp, Artificial Sequence
  chemically synthesized
ctagaatactggagattcaatg

SEQ ID NO: 951059 - DNA, 22 bp, Artificial Sequence
  chemically synthesized
aatgatgttatcattgaatctc

SEQ ID NO: 951060 - DNA, 22 bp, Artificial Sequence
  chemically synthesized
tcattgaatctccagtattcta

SEQ ID NO: 951061 - DNA, 22 bp, Artificial Sequence
  chemically synthesized
gaaacaaagaatttctagaata

SEQ ID NO: 951062 - DNA, 22 bp, Artificial Sequence
  chemically synthesized
aatctccagtattctagaaatt

SEQ ID NO: 951063 - DNA, 22 bp, Artificial Sequence
  chemically synthesized
cagtattctagaaattctttgt

SEQ ID NO: 951064 - DNA, 22 bp, Artificial Sequence
  chemically synthesized
tagaaattctttgtttccagtg

SEQ ID NO: 951065 - DNA, 22 bp, Artificial Sequence
  chemically synthesized
gaaattctttgtttccagtgta

SEQ ID NO: 951066 - DNA, 22 bp, Artificial Sequence
  chemically synthesized
catatatgaatatacactggaa

SEQ ID NO: 951067 - DNA, 22 bp, Artificial Sequence
  chemically synthesized
ttccatatatgaatatacactg

SEQ ID NO: 951068 - DNA, 22 bp, Artificial Sequence
  chemically synthesized
attccatatatgaatatacact

SEQ ID NO: 951069 - DNA, 22 bp, Artificial Sequence
  chemically synthesized
tttgtttccagtgtatattcat

SEQ ID NO: 951070 - DNA, 22 bp, Artificial Sequence
  chemically synthesized
tgtttccagtgtatattcatat

SEQ ID NO: 951071 - DNA, 22 bp, Artificial Sequence
  chemically synthesized
gtttccagtgtatattcatata

SEQ ID NO: 951072 - DNA, 22 bp, Artificial Sequence
  chemically synthesized
tttccagtgtatattcatatat

SEQ ID NO: 951073 - DNA, 22 bp, Artificial Sequence
  chemically synthesized
ccagtgtatattcatatatgga

SEQ ID NO: 951074 - DNA, 22 bp, Artificial Sequence
  chemically synthesized
cagtgtatattcatatatggaa

SEQ ID NO: 951075 - DNA, 22 bp, Artificial Sequence
  chemically synthesized
aaataaatagtggtttattcca

SEQ ID NO: 951076 - DNA, 22 bp, Artificial Sequence
  chemically synthesized
aaaataaatagtggtttattcc

SEQ ID NO: 951077 - DNA, 22 bp, Artificial Sequence
  chemically synthesized
atatatggaataaaccactatt

SEQ ID NO: 951078 - DNA, 22 bp, Artificial Sequence
  chemically synthesized
taatttaaaataaatagtggtt

SEQ ID NO: 951079 - DNA, 22 bp, Artificial Sequence
  chemically synthesized
ctataatttaaaataaatagtg

SEQ ID NO: 951080 - DNA, 22 bp, Artificial Sequence
  chemically synthesized
aaattgctataatttaaaataa

SEQ ID NO: 951081 - DNA, 22 bp, Artificial Sequence
  chemically synthesized
taaaattgctataatttaaaat

SEQ ID NO: 951082 - DNA, 22 bp, Artificial Sequence
  chemically synthesized
ctaaaattgctataatttaaaa

SEQ ID NO: 951083 - DNA, 22 bp, Artificial Sequence
  chemically synthesized
tttctaaaattgctataattta

SEQ ID NO: 951084 - DNA, 22 bp, Artificial Sequence
  chemically synthesized
tttattttaaattatagcaatt

SEQ ID NO: 951085 - DNA, 22 bp, Artificial Sequence
  chemically synthesized
attttaaattatagcaatttta

SEQ ID NO: 951086 - DNA, 22 bp, Artificial Sequence
  chemically synthesized
ttttaaattatagcaattttag

SEQ ID NO: 951087 - DNA, 22 bp, Artificial Sequence
  chemically synthesized
taaattatagcaattttagaaa

SEQ ID NO: 951088 - DNA, 22 bp, Artificial Sequence
  chemically synthesized
aaattatagcaattttagaaat

SEQ ID NO: 951089 - DNA, 22 bp, Artificial Sequence
  chemically synthesized
aattatagcaattttagaaata

SEQ ID NO: 951090 - DNA, 22 bp, Artificial Sequence
  chemically synthesized
gaataatgaggttatttctaaa

SEQ ID NO: 951091 - DNA, 22 bp, Artificial Sequence
  chemically synthesized
tagcaattttagaaataacctc

SEQ ID NO: 951092 - DNA, 22 bp, Artificial Sequence
  chemically synthesized
tagaaataacctcattattcca

SEQ ID NO: 951093 - DNA, 22 bp, Artificial Sequence
  chemically synthesized
agaaataacctcattattccaa

SEQ ID NO: 951094 - DNA, 22 bp, Artificial Sequence
  chemically synthesized
gaaataacctcattattccaat

SEQ ID NO: 951095 - DNA, 22 bp, Artificial Sequence
  chemically synthesized
cagaacatgaaaaattggaata

SEQ ID NO: 951096 - DNA, 22 bp, Artificial Sequence
  chemically synthesized
attattccaatttttcatgttc

SEQ ID NO: 951097 - DNA, 22 bp, Artificial Sequence
  chemically synthesized
tgagatgtctgcagaacatgaa

SEQ ID NO: 951098 - DNA, 22 bp, Artificial Sequence
  chemically synthesized
ttccaatttttcatgttctgca

SEQ ID NO: 951099 - DNA, 22 bp, Artificial Sequence
  chemically synthesized
agttgtgagatgtctgcagaac

SEQ ID NO: 951100 - DNA, 22 bp, Artificial Sequence
  chemically synthesized
caatttttcatgttctgcagac

SEQ ID NO: 951101 - DNA, 22 bp, Artificial Sequence
  chemically synthesized
ttcatgttctgcagacatctca

SEQ ID NO: 951102 - DNA, 22 bp, Artificial Sequence
  chemically synthesized
tcatgttctgcagacatctcac

SEQ ID NO: 951103 - DNA, 22 bp, Artificial Sequence
  chemically synthesized
ggaagttcagttgtgagatgtc

SEQ ID NO: 951104 - DNA, 22 bp, Artificial Sequence
  chemically synthesized
catgttctgcagacatctcaca

SEQ ID NO: 951105 - DNA, 22 bp, Artificial Sequence
  chemically synthesized
atgttctgcagacatctcacaa

SEQ ID NO: 951106 - DNA, 22 bp, Artificial Sequence
  chemically synthesized
tagcctgggaagttcagttgtg

SEQ ID NO: 951107 - DNA, 22 bp, Artificial Sequence
  chemically synthesized
tgcagacatctcacaactgaac

SEQ ID NO: 951108 - DNA, 22 bp, Artificial Sequence
  chemically synthesized
cagacatctcacaactgaactt

SEQ ID NO: 951109 - DNA, 22 bp, Artificial Sequence
  chemically synthesized
aagttgtagcctgggaagttca

SEQ ID NO: 951110 - DNA, 22 bp, Artificial Sequence
  chemically synthesized
acaactgaacttcccaggctac

SEQ ID NO: 951111 - DNA, 22 bp, Artificial Sequence
  chemically synthesized
ccacattaaagttgtagcctgg

SEQ ID NO: 951112 - DNA, 22 bp, Artificial Sequence
  chemically synthesized
gccacattaaagttgtagcctg

SEQ ID NO: 951113 - DNA, 22 bp, Artificial Sequence
  chemically synthesized
aacttcccaggctacaacttta

SEQ ID NO: 951114 - DNA, 22 bp, Artificial Sequence
  chemically synthesized
tgtgtttgccacattaaagttg

SEQ ID NO: 951115 - DNA, 22 bp, Artificial Sequence
  chemically synthesized
cccaggctacaactttaatgtg

SEQ ID NO: 951116 - DNA, 22 bp, Artificial Sequence
  chemically synthesized
ccaggctacaactttaatgtgg

SEQ ID NO: 951117 - DNA, 22 bp, Artificial Sequence
  chemically synthesized
gttatgtgtttgccacattaaa

SEQ ID NO: 951118 - DNA, 22 bp, Artificial Sequence
  chemically synthesized
ggttatgtgtttgccacattaa

SEQ ID NO: 951119 - DNA, 22 bp, Artificial Sequence
  chemically synthesized
gtttggttatgtgtttgccaca

SEQ ID NO: 951120 - DNA, 22 bp, Artificial Sequence
  chemically synthesized
ggtttggttatgtgtttgccac

SEQ ID NO: 951121 - DNA, 22 bp, Artificial Sequence
  chemically synthesized
tggtttggttatgtgtttgcca

SEQ ID NO: 951122 - DNA, 22 bp, Artificial Sequence
  chemically synthesized
caactttaatgtggcaaacaca

SEQ ID NO: 951123 - DNA, 22 bp, Artificial Sequence
  chemically synthesized
ctttggtttggttatgtgtttg

SEQ ID NO: 951124 - DNA, 22 bp, Artificial Sequence
  chemically synthesized
tactttggtttggttatgtgtt

SEQ ID NO: 951125 - DNA, 22 bp, Artificial Sequence
  chemically synthesized
taatgtggcaaacacataacca

SEQ ID NO: 951126 - DNA, 22 bp, Artificial Sequence
  chemically synthesized
aatgtggcaaacacataaccaa

SEQ ID NO: 951127 - DNA, 22 bp, Artificial Sequence
  chemically synthesized
atgtggcaaacacataaccaaa

SEQ ID NO: 951128 - DNA, 22 bp, Artificial Sequence
  chemically synthesized
ccacagtccggtcagttctact

SEQ ID NO: 951129 - DNA, 22 bp, Artificial Sequence
  chemically synthesized
tgccacagtccggtcagttcta

SEQ ID NO: 951130 - DNA, 22 bp, Artificial Sequence
  chemically synthesized
aacaaatgaccatgtgctctgc

SEQ ID NO: 951131 - DNA, 22 bp, Artificial Sequence
  chemically synthesized
accggactgtggcagagcacat

SEQ ID NO: 951132 - DNA, 22 bp, Artificial Sequence
  chemically synthesized
tggcagagcacatggtcatttg

SEQ ID NO: 951133 - DNA, 22 bp, Artificial Sequence
  chemically synthesized
aatgaccaagtgattgaacaaa

SEQ ID NO: 951134 - DNA, 22 bp, Artificial Sequence
  chemically synthesized
ttgaatgaccaagtgattgaac

SEQ ID NO: 951135 - DNA, 22 bp, Artificial Sequence
  chemically synthesized
gttgaatgaccaagtgattgaa

SEQ ID NO: 951136 - DNA, 22 bp, Artificial Sequence
  chemically synthesized
gaagacgtttgttgaatgacca

SEQ ID NO: 951137 - DNA, 22 bp, Artificial Sequence
  chemically synthesized
gttcaatcacttggtcattcaa

SEQ ID NO: 951138 - DNA, 22 bp, Artificial Sequence
  chemically synthesized
ttcaatcacttggtcattcaac

SEQ ID NO: 951139 - DNA, 22 bp, Artificial Sequence
  chemically synthesized
attagaagacgtttgttgaatg

SEQ ID NO: 951140 - DNA, 22 bp, Artificial Sequence
  chemically synthesized
aatcacttggtcattcaacaaa

SEQ ID NO: 951141 - DNA, 22 bp, Artificial Sequence
  chemically synthesized
gctgattagaagacgtttgttg

SEQ ID NO: 951142 - DNA, 22 bp, Artificial Sequence
  chemically synthesized
tagctgattagaagacgtttgt

SEQ ID NO: 951143 - DNA, 22 bp, Artificial Sequence
  chemically synthesized
ggtcattcaacaaacgtcttct

SEQ ID NO: 951144 - DNA, 22 bp, Artificial Sequence
  chemically synthesized
gtcattcaacaaacgtcttcta

SEQ ID NO: 951145 - DNA, 22 bp, Artificial Sequence
  chemically synthesized
gcacatattctagctgattaga

SEQ ID NO: 951146 - DNA, 22 bp, Artificial Sequence
  chemically synthesized
aacaaacgtcttctaatcagct

SEQ ID NO: 951147 - DNA, 22 bp, Artificial Sequence
  chemically synthesized
ggcacatattctagctgattag

SEQ ID NO: 951148 - DNA, 22 bp, Artificial Sequence
  chemically synthesized
ctaatcagctagaatatgtgcc

SEQ ID NO: 951149 - DNA, 22 bp, Artificial Sequence
  chemically synthesized
aggccagaccttggcacatatt

SEQ ID NO: 951150 - DNA, 22 bp, Artificial Sequence
  chemically synthesized
taatcagctagaatatgtgcca

SEQ ID NO: 951151 - DNA, 22 bp, Artificial Sequence
  chemically synthesized
atcagctagaatatgtgccaag

SEQ ID NO: 951152 - DNA, 22 bp, Artificial Sequence
  chemically synthesized
tgttaaggccagaccttggcac

SEQ ID NO: 951153 - DNA, 22 bp, Artificial Sequence
  chemically synthesized
atgttaaggccagaccttggca

SEQ ID NO: 951154 - DNA, 22 bp, Artificial Sequence
  chemically synthesized
ttatgttaaggccagaccttgg

SEQ ID NO: 951155 - DNA, 22 bp, Artificial Sequence
  chemically synthesized
gaatatgtgccaaggtctggcc

SEQ ID NO: 951156 - DNA, 22 bp, Artificial Sequence
  chemically synthesized
tatctcttatgttaaggccaga

SEQ ID NO: 951157 - DNA, 22 bp, Artificial Sequence
  chemically synthesized
gtatctcttatgttaaggccag

SEQ ID NO: 951158 - DNA, 22 bp, Artificial Sequence
  chemically synthesized
tgtatctcttatgttaaggcca

SEQ ID NO: 951159 - DNA, 22 bp, Artificial Sequence
  chemically synthesized
tttgtatctcttatgttaaggc

SEQ ID NO: 951160 - DNA, 22 bp, Artificial Sequence
  chemically synthesized
ctctttgtatctcttatgttaa

SEQ ID NO: 951161 - DNA, 22 bp, Artificial Sequence
  chemically synthesized
ttcctctttgtatctcttatgt

SEQ ID NO: 951162 - DNA, 22 bp, Artificial Sequence
  chemically synthesized
attcctctttgtatctcttatg

SEQ ID NO: 951163 - DNA, 22 bp, Artificial Sequence
  chemically synthesized
gccttaacataagagatacaaa

SEQ ID NO: 951164 - DNA, 22 bp, Artificial Sequence
  chemically synthesized
cagtttattcctctttgtatct

SEQ ID NO: 951165 - DNA, 22 bp, Artificial Sequence
  chemically synthesized
acagtttattcctctttgtatc

SEQ ID NO: 951166 - DNA, 22 bp, Artificial Sequence
  chemically synthesized
aacataagagatacaaagagga

SEQ ID NO: 951167 - DNA, 22 bp, Artificial Sequence
  chemically synthesized
tttacagtttattcctctttgt

SEQ ID NO: 951168 - DNA, 22 bp, Artificial Sequence
  chemically synthesized
acataagagatacaaagaggaa

SEQ ID NO: 951169 - DNA, 22 bp, Artificial Sequence
  chemically synthesized
gagagcaatgactatttacagt

SEQ ID NO: 951170 - DNA, 22 bp, Artificial Sequence
  chemically synthesized
ccctagagagcaatgactattt

SEQ ID NO: 951171 - DNA, 22 bp, Artificial Sequence
  chemically synthesized
gccctagagagcaatgactatt

SEQ ID NO: 951172 - DNA, 22 bp, Artificial Sequence
  chemically synthesized
gatttgccctagagagcaatga

SEQ ID NO: 951173 - DNA, 22 bp, Artificial Sequence
  chemically synthesized
cctagatttgccctagagagca

SEQ ID NO: 951174 - DNA, 22 bp, Artificial Sequence
  chemically synthesized
taaatagtcattgctctctagg

SEQ ID NO: 951175 - DNA, 22 bp, Artificial Sequence
  chemically synthesized
ctccctagatttgccctagaga

SEQ ID NO: 951176 - DNA, 22 bp, Artificial Sequence
  chemically synthesized
aattcctccctagatttgccct

SEQ ID NO: 951177 - DNA, 22 bp, Artificial Sequence
  chemically synthesized
tctgaattcctccctagatttg

SEQ ID NO: 951178 - DNA, 22 bp, Artificial Sequence
  chemically synthesized
gtctgaattcctccctagattt

SEQ ID NO: 951179 - DNA, 22 bp, Artificial Sequence
  chemically synthesized
ctctctagggcaaatctaggga

SEQ ID NO: 951180 - DNA, 22 bp, Artificial Sequence
  chemically synthesized
tgtctgaattcctccctagatt

SEQ ID NO: 951181 - DNA, 22 bp, Artificial Sequence
  chemically synthesized
ttgtctgaattcctccctagat

SEQ ID NO: 951182 - DNA, 22 bp, Artificial Sequence
  chemically synthesized
tctagggcaaatctagggagga

SEQ ID NO: 951183 - DNA, 22 bp, Artificial Sequence
  chemically synthesized
tttttgtctgaattcctcccta

SEQ ID NO: 951184 - DNA, 22 bp, Artificial Sequence
  chemically synthesized
tagggcaaatctagggaggaat

SEQ ID NO: 951185 - DNA, 22 bp, Artificial Sequence
  chemically synthesized
atttttgtctgaattcctccct

SEQ ID NO: 951186 - DNA, 22 bp, Artificial Sequence
  chemically synthesized
gggcaaatctagggaggaattc

SEQ ID NO: 951187 - DNA, 22 bp, Artificial Sequence
  chemically synthesized
tatgaggatttatttttgtctg

SEQ ID NO: 951188 - DNA, 22 bp, Artificial Sequence
  chemically synthesized
gggaggaattcagacaaaaata

SEQ ID NO: 951189 - DNA, 22 bp, Artificial Sequence
  chemically synthesized
ttatatgaggatttatttttgt

SEQ ID NO: 951190 - DNA, 22 bp, Artificial Sequence
  chemically synthesized
ttattatatgaggatttatttt

SEQ ID NO: 951191 - DNA, 22 bp, Artificial Sequence
  chemically synthesized
ctattattatatgaggatttat

SEQ ID NO: 951192 - DNA, 22 bp, Artificial Sequence
  chemically synthesized
tactattattatatgaggattt

SEQ ID NO: 951193 - DNA, 22 bp, Artificial Sequence
  chemically synthesized
ctactattattatatgaggatt

SEQ ID NO: 951194 - DNA, 22 bp, Artificial Sequence
  chemically synthesized
agacaaaaataaatcctcatat

SEQ ID NO: 951195 - DNA, 22 bp, Artificial Sequence
  chemically synthesized
tctactattattatatgaggat

SEQ ID NO: 951196 - DNA, 22 bp, Artificial Sequence
  chemically synthesized
agttttctactattattatatg

SEQ ID NO: 951197 - DNA, 22 bp, Artificial Sequence
  chemically synthesized
gagttttctactattattatat

SEQ ID NO: 951198 - DNA, 22 bp, Artificial Sequence
  chemically synthesized
tgagttttctactattattata

SEQ ID NO: 951199 - DNA, 22 bp, Artificial Sequence
  chemically synthesized
ttgagttttctactattattat

SEQ ID NO: 951200 - DNA, 22 bp, Artificial Sequence
  chemically synthesized
atgtcccttttgagttttctac

SEQ ID NO: 951201 - DNA, 22 bp, Artificial Sequence
  chemically synthesized
atataataatagtagaaaactc

SEQ ID NO: 951202 - DNA, 22 bp, Artificial Sequence
  chemically synthesized
aatgtcccttttgagttttcta

SEQ ID NO: 951203 - DNA, 22 bp, Artificial Sequence
  chemically synthesized
aaaagggacattaagacggatc

SEQ ID NO: 951204 - DNA, 22 bp, Artificial Sequence
  chemically synthesized
aggcagtcgatagatccgtctt

SEQ ID NO: 951205 - DNA, 22 bp, Artificial Sequence
  chemically synthesized
aaggcagtcgatagatccgtct

SEQ ID NO: 951206 - DNA, 22 bp, Artificial Sequence
  chemically synthesized
agacggatctatcgactgcctt

SEQ ID NO: 951207 - DNA, 22 bp, Artificial Sequence
  chemically synthesized
gtccaacatcatggcttaaggc

SEQ ID NO: 951208 - DNA, 22 bp, Artificial Sequence
  chemically synthesized
cctagtccaacatcatggctta

SEQ ID NO: 951209 - DNA, 22 bp, Artificial Sequence
  chemically synthesized
tcgactgccttaagccatgatg

SEQ ID NO: 951210 - DNA, 22 bp, Artificial Sequence
  chemically synthesized
ccttaagccatgatgttggact

SEQ ID NO: 951211 - DNA, 22 bp, Artificial Sequence
  chemically synthesized
gtgtataatctccctagtccaa

SEQ ID NO: 951212 - DNA, 22 bp, Artificial Sequence
  chemically synthesized
aagccatgatgttggactaggg

SEQ ID NO: 951213 - DNA, 22 bp, Artificial Sequence
  chemically synthesized
agccatgatgttggactaggga

SEQ ID NO: 951214 - DNA, 22 bp, Artificial Sequence
  chemically synthesized
ccagacgaacctagtgtataat

SEQ ID NO: 951215 - DNA, 22 bp, Artificial Sequence
  chemically synthesized
cccagacgaacctagtgtataa

SEQ ID NO: 951216 - DNA, 22 bp, Artificial Sequence
  chemically synthesized
gactagggagattatacactag

SEQ ID NO: 951217 - DNA, 22 bp, Artificial Sequence
  chemically synthesized
tcccagacgaacctagtgtata

SEQ ID NO: 951218 - DNA, 22 bp, Artificial Sequence
  chemically synthesized
gggagattatacactaggttcg

SEQ ID NO: 951219 - DNA, 22 bp, Artificial Sequence
  chemically synthesized
tacaccagacctttcccagacg

SEQ ID NO: 951220 - DNA, 22 bp, Artificial Sequence
  chemically synthesized
tacactaggttcgtctgggaaa

SEQ ID NO: 951221 - DNA, 22 bp, Artificial Sequence
  chemically synthesized
ggttcgtctgggaaaggtctgg

SEQ ID NO: 951222 - DNA, 22 bp, Artificial Sequence
  chemically synthesized
gtctgggaaaggtctggtgtac

SEQ ID NO: 951223 - DNA, 22 bp, Artificial Sequence
  chemically synthesized
ggaaaggtctggtgtacagctt

SEQ ID NO: 951224 - DNA, 22 bp, Artificial Sequence
  chemically synthesized
gtgtacagctttgtcccgtgac

SEQ ID NO: 951225 - DNA, 22 bp, Artificial Sequence
  chemically synthesized
agaataaaaagtgtaggaaagg

SEQ ID NO: 951226 - DNA, 22 bp, Artificial Sequence
  chemically synthesized
gagaataaaaagtgtaggaaag

SEQ ID NO: 951227 - DNA, 22 bp, Artificial Sequence
  chemically synthesized
tgtcccgtgacctttcctacac

SEQ ID NO: 951228 - DNA, 22 bp, Artificial Sequence
  chemically synthesized
tgagaataaaaagtgtaggaaa

SEQ ID NO: 951229 - DNA, 22 bp, Artificial Sequence
  chemically synthesized
gtcccgtgacctttcctacact

SEQ ID NO: 951230 - DNA, 22 bp, Artificial Sequence
  chemically synthesized
tcccgtgacctttcctacactt

SEQ ID NO: 951231 - DNA, 22 bp, Artificial Sequence
  chemically synthesized
ttttgagaataaaaagtgtagg

SEQ ID NO: 951232 - DNA, 22 bp, Artificial Sequence
  chemically synthesized
attttgagaataaaaagtgtag

SEQ ID NO: 951233 - DNA, 22 bp, Artificial Sequence
  chemically synthesized
atgtatttattttgagaataaa

SEQ ID NO: 951234 - DNA, 22 bp, Artificial Sequence
  chemically synthesized
tcctacactttttattctcaaa

SEQ ID NO: 951235 - DNA, 22 bp, Artificial Sequence
  chemically synthesized
cctacactttttattctcaaaa

SEQ ID NO: 951236 - DNA, 22 bp, Artificial Sequence
  chemically synthesized
ctaatgtatttattttgagaat

SEQ ID NO: 951237 - DNA, 22 bp, Artificial Sequence
  chemically synthesized
ctacactttttattctcaaaat

SEQ ID NO: 951238 - DNA, 22 bp, Artificial Sequence
  chemically synthesized
cactttttattctcaaaataaa

SEQ ID NO: 951239 - DNA, 22 bp, Artificial Sequence
  chemically synthesized
tttattctcaaaataaatacat

SEQ ID NO: 951240 - DNA, 22 bp, Artificial Sequence
  chemically synthesized
ttattctcaaaataaatacatt

SEQ ID NO: 951241 - DNA, 22 bp, Artificial Sequence
  chemically synthesized
tattctcaaaataaatacatta

SEQ ID NO: 951242 - DNA, 22 bp, Artificial Sequence
  chemically synthesized
caagatcattgctaatgtattt

SEQ ID NO: 951243 - DNA, 22 bp, Artificial Sequence
  chemically synthesized
attctcaaaataaatacattag

SEQ ID NO: 951244 - DNA, 22 bp, Artificial Sequence
  chemically synthesized
acaagatcattgctaatgtatt

SEQ ID NO: 951245 - DNA, 22 bp, Artificial Sequence
  chemically synthesized
ttctcaaaataaatacattagc

SEQ ID NO: 951246 - DNA, 22 bp, Artificial Sequence
  chemically synthesized
tcaaaataaatacattagcaat

SEQ ID NO: 951247 - DNA, 22 bp, Artificial Sequence
  chemically synthesized
accttacaagatcattgctaat

SEQ ID NO: 951248 - DNA, 22 bp, Artificial Sequence
  chemically synthesized
aaaataaatacattagcaatga

SEQ ID NO: 951249 - DNA, 22 bp, Artificial Sequence
  chemically synthesized
caccttacaagatcattgctaa

SEQ ID NO: 951250 - DNA, 22 bp, Artificial Sequence
  chemically synthesized
tttcaccttacaagatcattgc

SEQ ID NO: 951251 - DNA, 22 bp, Artificial Sequence
  chemically synthesized
gtttcaccttacaagatcattg

SEQ ID NO: 951252 - DNA, 22 bp, Artificial Sequence
  chemically synthesized
tgtttcaccttacaagatcatt

SEQ ID NO: 951253 - DNA, 22 bp, Artificial Sequence
  chemically synthesized
ttgtttcaccttacaagatcat

SEQ ID NO: 951254 - DNA, 22 bp, Artificial Sequence
  chemically synthesized
atggacttttgtttcaccttac

SEQ ID NO: 951255 - DNA, 22 bp, Artificial Sequence
  chemically synthesized
gcaatgatcttgtaaggtgaaa

SEQ ID NO: 951256 - DNA, 22 bp, Artificial Sequence
  chemically synthesized
ctgatggacttttgtttcacct

SEQ ID NO: 951257 - DNA, 22 bp, Artificial Sequence
  chemically synthesized
cctgatggacttttgtttcacc

SEQ ID NO: 951258 - DNA, 22 bp, Artificial Sequence
  chemically synthesized
tcctgatggacttttgtttcac

SEQ ID NO: 951259 - DNA, 22 bp, Artificial Sequence
  chemically synthesized
ttttcctgatggacttttgttt

SEQ ID NO: 951260 - DNA, 22 bp, Artificial Sequence
  chemically synthesized
ctgttttcctgatggacttttg

SEQ ID NO: 951261 - DNA, 22 bp, Artificial Sequence
  chemically synthesized
gtaaggtgaaacaaaagtccat

SEQ ID NO: 951262 - DNA, 22 bp, Artificial Sequence
  chemically synthesized
taaggtgaaacaaaagtccatc

SEQ ID NO: 951263 - DNA, 22 bp, Artificial Sequence
  chemically synthesized
ccacccgccaactcctgttttc

SEQ ID NO: 951264 - DNA, 22 bp, Artificial Sequence
  chemically synthesized
cccacccgccaactcctgtttt

SEQ ID NO: 951265 - DNA, 22 bp, Artificial Sequence
  chemically synthesized
ataaggtaccatttcccacccg

SEQ ID NO: 951266 - DNA, 22 bp, Artificial Sequence
  chemically synthesized
cataaggtaccatttcccaccc

SEQ ID NO: 951267 - DNA, 22 bp, Artificial Sequence
  chemically synthesized
ttcataaggtaccatttcccac

SEQ ID NO: 951268 - DNA, 22 bp, Artificial Sequence
  chemically synthesized
tcttcataaggtaccatttccc

SEQ ID NO: 951269 - DNA, 22 bp, Artificial Sequence
  chemically synthesized
ttctcttcataaggtaccattt

SEQ ID NO: 951270 - DNA, 22 bp, Artificial Sequence
  chemically synthesized
gttctcttcataaggtaccatt

SEQ ID NO: 951271 - DNA, 22 bp, Artificial Sequence
  chemically synthesized
tgttctcttcataaggtaccat

SEQ ID NO: 951272 - DNA, 22 bp, Artificial Sequence
  chemically synthesized
gcgggtgggaaatggtacctta

SEQ ID NO: 951273 - DNA, 22 bp, Artificial Sequence
  chemically synthesized
ctttgttctcttcataaggtac

SEQ ID NO: 951274 - DNA, 22 bp, Artificial Sequence
  chemically synthesized
cctttgttctcttcataaggta

SEQ ID NO: 951275 - DNA, 22 bp, Artificial Sequence
  chemically synthesized
tttcctttgttctcttcataag

SEQ ID NO: 951276 - DNA, 22 bp, Artificial Sequence
  chemically synthesized
ttgtttcctttgttctcttcat

SEQ ID NO: 951277 - DNA, 22 bp, Artificial Sequence
  chemically synthesized
atgaagagaacaaaggaaacaa

SEQ ID NO: 951278 - DNA, 22 bp, Artificial Sequence
  chemically synthesized
tgaagagaacaaaggaaacaat

SEQ ID NO: 951279 - DNA, 22 bp, Artificial Sequence
  chemically synthesized
atatcccatgctattgtttcct

SEQ ID NO: 951280 - DNA, 22 bp, Artificial Sequence
  chemically synthesized
tgatatcccatgctattgtttc

SEQ ID NO: 951281 - DNA, 22 bp, Artificial Sequence
  chemically synthesized
tctgatatcccatgctattgtt

SEQ ID NO: 951282 - DNA, 22 bp, Artificial Sequence
  chemically synthesized
ctctgatatcccatgctattgt

SEQ ID NO: 951283 - DNA, 22 bp, Artificial Sequence
  chemically synthesized
gagtttctctgatatcccatgc

SEQ ID NO: 951284 - DNA, 22 bp, Artificial Sequence
  chemically synthesized
ctagagtttctctgatatccca

SEQ ID NO: 951285 - DNA, 22 bp, Artificial Sequence
  chemically synthesized
tgttgctagagtttctctgata

SEQ ID NO: 951286 - DNA, 22 bp, Artificial Sequence
  chemically synthesized
tactgtgttgctagagtttctc

SEQ ID NO: 951287 - DNA, 22 bp, Artificial Sequence
  chemically synthesized
accccagctatactgtgttgct

SEQ ID NO: 951288 - DNA, 22 bp, Artificial Sequence
  chemically synthesized
caccccagctatactgtgttgc

SEQ ID NO: 951289 - DNA, 22 bp, Artificial Sequence
  chemically synthesized
ttcaccccagctatactgtgtt

SEQ ID NO: 951290 - DNA, 22 bp, Artificial Sequence
  chemically synthesized
tagcaacacagtatagctgggg

SEQ ID NO: 951291 - DNA, 22 bp, Artificial Sequence
  chemically synthesized
gcaacacagtatagctggggtg

SEQ ID NO: 951292 - DNA, 22 bp, Artificial Sequence
  chemically synthesized
gcccagagatactcttcacccc

SEQ ID NO: 951293 - DNA, 22 bp, Artificial Sequence
  chemically synthesized
atgacctcgcccagagatactc

SEQ ID NO: 951294 - DNA, 22 bp, Artificial Sequence
  chemically synthesized
gggtgaagagtatctctgggcg

SEQ ID NO: 951295 - DNA, 22 bp, Artificial Sequence
  chemically synthesized
tccctgatgacctcgcccagag

SEQ ID NO: 951296 - DNA, 22 bp, Artificial Sequence
  chemically synthesized
gtccctgatgacctcgcccaga

SEQ ID NO: 951297 - DNA, 22 bp, Artificial Sequence
  chemically synthesized
tgtccctgatgacctcgcccag

SEQ ID NO: 951298 - DNA, 22 bp, Artificial Sequence
  chemically synthesized
actttgtccctgatgacctcgc

SEQ ID NO: 951299 - DNA, 22 bp, Artificial Sequence
  chemically synthesized
attgactttgtccctgatgacc

SEQ ID NO: 951300 - DNA, 22 bp, Artificial Sequence
  chemically synthesized
taattgactttgtccctgatga

SEQ ID NO: 951301 - DNA, 22 bp, Artificial Sequence
  chemically synthesized
tgggcgaggtcatcagggacaa

SEQ ID NO: 951302 - DNA, 22 bp, Artificial Sequence
  chemically synthesized
ggcgaggtcatcagggacaaag

SEQ ID NO: 951303 - DNA, 22 bp, Artificial Sequence
  chemically synthesized
tccctctaattgactttgtccc

SEQ ID NO: 951304 - DNA, 22 bp, Artificial Sequence
  chemically synthesized
tctatccctctaattgactttg

SEQ ID NO: 951305 - DNA, 22 bp, Artificial Sequence
  chemically synthesized
tgtctatccctctaattgactt

SEQ ID NO: 951306 - DNA, 22 bp, Artificial Sequence
  chemically synthesized
gaactctgtctatccctctaat

SEQ ID NO: 951307 - DNA, 22 bp, Artificial Sequence
  chemically synthesized
ggaactctgtctatccctctaa

SEQ ID NO: 951308 - DNA, 22 bp, Artificial Sequence
  chemically synthesized
acacttggaactctgtctatcc

SEQ ID NO: 951309 - DNA, 22 bp, Artificial Sequence
  chemically synthesized
gagggatagacagagttccaag

SEQ ID NO: 951310 - DNA, 22 bp, Artificial Sequence
  chemically synthesized
accaacaaggtccctgacactt

SEQ ID NO: 951311 - DNA, 22 bp, Artificial Sequence
  chemically synthesized
gtctgaccaacaaggtccctga

SEQ ID NO: 951312 - DNA, 22 bp, Artificial Sequence
  chemically synthesized
agtctgaccaacaaggtccctg

SEQ ID NO: 951313 - DNA, 22 bp, Artificial Sequence
  chemically synthesized
cttagtctgaccaacaaggtcc

SEQ ID NO: 951314 - DNA, 22 bp, Artificial Sequence
  chemically synthesized
caagtgtcagggaccttgttgg

SEQ ID NO: 951315 - DNA, 22 bp, Artificial Sequence
  chemically synthesized
agattgcttagtctgaccaaca

SEQ ID NO: 951316 - DNA, 22 bp, Artificial Sequence
  chemically synthesized
caaatagttcagattgcttagt

SEQ ID NO: 951317 - DNA, 22 bp, Artificial Sequence
  chemically synthesized
ccaaatagttcagattgcttag

SEQ ID NO: 951318 - DNA, 22 bp, Artificial Sequence
  chemically synthesized
tccaaatagttcagattgctta

SEQ ID NO: 951319 - DNA, 22 bp, Artificial Sequence
  chemically synthesized
gttggtcagactaagcaatctg

SEQ ID NO: 951320 - DNA, 22 bp, Artificial Sequence
  chemically synthesized
ttggtcagactaagcaatctga

SEQ ID NO: 951321 - DNA, 22 bp, Artificial Sequence
  chemically synthesized
ctttccaaatagttcagattgc

SEQ ID NO: 951322 - DNA, 22 bp, Artificial Sequence
  chemically synthesized
gctttccaaatagttcagattg

SEQ ID NO: 951323 - DNA, 22 bp, Artificial Sequence
  chemically synthesized
gtcagactaagcaatctgaact

SEQ ID NO: 951324 - DNA, 22 bp, Artificial Sequence
  chemically synthesized
tttgctttccaaatagttcaga

SEQ ID NO: 951325 - DNA, 22 bp, Artificial Sequence
  chemically synthesized
gtttgctttccaaatagttcag

SEQ ID NO: 951326 - DNA, 22 bp, Artificial Sequence
  chemically synthesized
ccttgtttgctttccaaatagt

SEQ ID NO: 951327 - DNA, 22 bp, Artificial Sequence
  chemically synthesized
agcaatctgaactatttggaaa

SEQ ID NO: 951328 - DNA, 22 bp, Artificial Sequence
  chemically synthesized
cagggttaccttgtttgctttc

SEQ ID NO: 951329 - DNA, 22 bp, Artificial Sequence
  chemically synthesized
aactatttggaaagcaaacaag

SEQ ID NO: 951330 - DNA, 22 bp, Artificial Sequence
  chemically synthesized
tttggaaagcaaacaaggtaac

SEQ ID NO: 951331 - DNA, 22 bp, Artificial Sequence
  chemically synthesized
aggaatcctccagggttacctt

SEQ ID NO: 951332 - DNA, 22 bp, Artificial Sequence
  chemically synthesized
ggaaagcaaacaaggtaaccct

SEQ ID NO: 951333 - DNA, 22 bp, Artificial Sequence
  chemically synthesized
gaaagcaaacaaggtaaccctg

SEQ ID NO: 951334 - DNA, 22 bp, Artificial Sequence
  chemically synthesized
aaattcaggaatcctccagggt

SEQ ID NO: 951335 - DNA, 22 bp, Artificial Sequence
  chemically synthesized
gattgaaattcaggaatcctcc

SEQ ID NO: 951336 - DNA, 22 bp, Artificial Sequence
  chemically synthesized
tagattgaaattcaggaatcct

SEQ ID NO: 951337 - DNA, 22 bp, Artificial Sequence
  chemically synthesized
gaggattcctgaatttcaatct

SEQ ID NO: 951338 - DNA, 22 bp, Artificial Sequence
  chemically synthesized
ctgaatttcaatctagaatcac

SEQ ID NO: 951339 - DNA, 22 bp, Artificial Sequence
  chemically synthesized
aatttcaatctagaatcacaca

SEQ ID NO: 951340 - DNA, 22 bp, Artificial Sequence
  chemically synthesized
caatctagaatcacacactata

SEQ ID NO: 951341 - DNA, 22 bp, Artificial Sequence
  chemically synthesized
aatctagaatcacacactatac

SEQ ID NO: 951342 - DNA, 22 bp, Artificial Sequence
  chemically synthesized
aaaaaaaaaaaagtatagtgtg

SEQ ID NO: 951343 - DNA, 22 bp, Artificial Sequence
  chemically synthesized
gaatcacacactatactttttt

SEQ ID NO: 951344 - DNA, 22 bp, Artificial Sequence
  chemically synthesized
tacttttttttttttcaatttt

SEQ ID NO: 951345 - DNA, 22 bp, Artificial Sequence
  chemically synthesized
aagtcgtcatgcaaaattgaaa

SEQ ID NO: 951346 - DNA, 22 bp, Artificial Sequence
  chemically synthesized
cctgaagtcgtcatgcaaaatt

SEQ ID NO: 951347 - DNA, 22 bp, Artificial Sequence
  chemically synthesized
ttttttttttcaattttgcatg

SEQ ID NO: 951348 - DNA, 22 bp, Artificial Sequence
  chemically synthesized
ccctgaagtcgtcatgcaaaat

SEQ ID NO: 951349 - DNA, 22 bp, Artificial Sequence
  chemically synthesized
tttttttttcaattttgcatga

SEQ ID NO: 951350 - DNA, 22 bp, Artificial Sequence
  chemically synthesized
ttttttttcaattttgcatgac

SEQ ID NO: 951351 - DNA, 22 bp, Artificial Sequence
  chemically synthesized
tttttttcaattttgcatgacg

SEQ ID NO: 951352 - DNA, 22 bp, Artificial Sequence
  chemically synthesized
ttttttcaattttgcatgacga

SEQ ID NO: 951353 - DNA, 22 bp, Artificial Sequence
  chemically synthesized
tttttcaattttgcatgacgac

SEQ ID NO: 951354 - DNA, 22 bp, Artificial Sequence
  chemically synthesized
ttttcaattttgcatgacgact

SEQ ID NO: 951355 - DNA, 22 bp, Artificial Sequence
  chemically synthesized
tttcaattttgcatgacgactt

SEQ ID NO: 951356 - DNA, 22 bp, Artificial Sequence
  chemically synthesized
ttcaattttgcatgacgacttc

SEQ ID NO: 951357 - DNA, 22 bp, Artificial Sequence
  chemically synthesized
gcatgtttccctgaagtcgtca

SEQ ID NO: 951358 - DNA, 22 bp, Artificial Sequence
  chemically synthesized
tcaattttgcatgacgacttca

SEQ ID NO: 951359 - DNA, 22 bp, Artificial Sequence
  chemically synthesized
caattttgcatgacgacttcag

SEQ ID NO: 951360 - DNA, 22 bp, Artificial Sequence
  chemically synthesized
aattttgcatgacgacttcagg

SEQ ID NO: 951361 - DNA, 22 bp, Artificial Sequence
  chemically synthesized
attggcatgtttccctgaagtc

SEQ ID NO: 951362 - DNA, 22 bp, Artificial Sequence
  chemically synthesized
cattggcatgtttccctgaagt

SEQ ID NO: 951363 - DNA, 22 bp, Artificial Sequence
  chemically synthesized
tcattggcatgtttccctgaag

SEQ ID NO: 951364 - DNA, 22 bp, Artificial Sequence
  chemically synthesized
ttcattggcatgtttccctgaa

SEQ ID NO: 951365 - DNA, 22 bp, Artificial Sequence
  chemically synthesized
tgcatgacgacttcagggaaac

SEQ ID NO: 951366 - DNA, 22 bp, Artificial Sequence
  chemically synthesized
tttcattggcatgtttccctga

SEQ ID NO: 951367 - DNA, 22 bp, Artificial Sequence
  chemically synthesized
gcatgacgacttcagggaaaca

SEQ ID NO: 951368 - DNA, 22 bp, Artificial Sequence
  chemically synthesized
catgacgacttcagggaaacat

SEQ ID NO: 951369 - DNA, 22 bp, Artificial Sequence
  chemically synthesized
attttttcattggcatgtttcc

SEQ ID NO: 951370 - DNA, 22 bp, Artificial Sequence
  chemically synthesized
gattttttcattggcatgtttc

SEQ ID NO: 951371 - DNA, 22 bp, Artificial Sequence
  chemically synthesized
acttgattttttcattggcatg

SEQ ID NO: 951372 - DNA, 22 bp, Artificial Sequence
  chemically synthesized
aacttgattttttcattggcat

SEQ ID NO: 951373 - DNA, 22 bp, Artificial Sequence
  chemically synthesized
cagggaaacatgccaatgaaaa

SEQ ID NO: 951374 - DNA, 22 bp, Artificial Sequence
  chemically synthesized
agggaaacatgccaatgaaaaa

SEQ ID NO: 951375 - DNA, 22 bp, Artificial Sequence
  chemically synthesized
atgtaatgatttaacttgattt

SEQ ID NO: 951376 - DNA, 22 bp, Artificial Sequence
  chemically synthesized
ttaatgtaatgatttaacttga

SEQ ID NO: 951377 - DNA, 22 bp, Artificial Sequence
  chemically synthesized
attaatgtaatgatttaacttg

SEQ ID NO: 951378 - DNA, 22 bp, Artificial Sequence
  chemically synthesized
agtaaatttattaatgtaatga

SEQ ID NO: 951379 - DNA, 22 bp, Artificial Sequence
  chemically synthesized
gactaagtaaatttattaatgt

SEQ ID NO: 951380 - DNA, 22 bp, Artificial Sequence
  chemically synthesized
aatcattacattaataaattta

SEQ ID NO: 951381 - DNA, 22 bp, Artificial Sequence
  chemically synthesized
caaatcctagactaagtaaatt

SEQ ID NO: 951382 - DNA, 22 bp, Artificial Sequence
  chemically synthesized
cattaataaatttacttagtct

SEQ ID NO: 951383 - DNA, 22 bp, Artificial Sequence
  chemically synthesized
ataaatttacttagtctaggat

SEQ ID NO: 951384 - DNA, 22 bp, Artificial Sequence
  chemically synthesized
caataaatattccaaatcctag

SEQ ID NO: 951385 - DNA, 22 bp, Artificial Sequence
  chemically synthesized
gcaataaatattccaaatccta

SEQ ID NO: 951386 - DNA, 22 bp, Artificial Sequence
  chemically synthesized
acttagtctaggatttggaata

SEQ ID NO: 951387 - DNA, 22 bp, Artificial Sequence
  chemically synthesized
acttgcaataaatattccaaat

SEQ ID NO: 951388 - DNA, 22 bp, Artificial Sequence
  chemically synthesized
cttagtctaggatttggaatat

SEQ ID NO: 951389 - DNA, 22 bp, Artificial Sequence
  chemically synthesized
gacttgcaataaatattccaaa

SEQ ID NO: 951390 - DNA, 22 bp, Artificial Sequence
  chemically synthesized
agtctaggatttggaatattta

SEQ ID NO: 951391 - DNA, 22 bp, Artificial Sequence
  chemically synthesized
gtctaggatttggaatatttat

SEQ ID NO: 951392 - DNA, 22 bp, Artificial Sequence
  chemically synthesized
gtttgacttgcaataaatattc

SEQ ID NO: 951393 - DNA, 22 bp, Artificial Sequence
  chemically synthesized
ggatttggaatatttattgcaa

SEQ ID NO: 951394 - DNA, 22 bp, Artificial Sequence
  chemically synthesized
acaggttagtttgacttgcaat

SEQ ID NO: 951395 - DNA, 22 bp, Artificial Sequence
  chemically synthesized
ggaatatttattgcaagtcaaa

SEQ ID NO: 951396 - DNA, 22 bp, Artificial Sequence
  chemically synthesized
gaatatttattgcaagtcaaac

SEQ ID NO: 951397 - DNA, 22 bp, Artificial Sequence
  chemically synthesized
attgcaagtcaaactaacctgt

SEQ ID NO: 951398 - DNA, 22 bp, Artificial Sequence
  chemically synthesized
ttgcaagtcaaactaacctgtt

SEQ ID NO: 951399 - DNA, 22 bp, Artificial Sequence
  chemically synthesized
tatgcaatgactaacaggttag

SEQ ID NO: 951400 - DNA, 22 bp, Artificial Sequence
  chemically synthesized
atatgcaatgactaacaggtta

SEQ ID NO: 951401 - DNA, 22 bp, Artificial Sequence
  chemically synthesized
caagtcaaactaacctgttagt

SEQ ID NO: 951402 - DNA, 22 bp, Artificial Sequence
  chemically synthesized
tttatatgcaatgactaacagg

SEQ ID NO: 951403 - DNA, 22 bp, Artificial Sequence
  chemically synthesized
gccaacctgtttatatgcaatg

SEQ ID NO: 951404 - DNA, 22 bp, Artificial Sequence
  chemically synthesized
agccaacctgtttatatgcaat

SEQ ID NO: 951405 - DNA, 22 bp, Artificial Sequence
  chemically synthesized
acctgttagtcattgcatataa

SEQ ID NO: 951406 - DNA, 22 bp, Artificial Sequence
  chemically synthesized
tagccaacctgtttatatgcaa

SEQ ID NO: 951407 - DNA, 22 bp, Artificial Sequence
  chemically synthesized
attttagccaacctgtttatat

SEQ ID NO: 951408 - DNA, 22 bp, Artificial Sequence
  chemically synthesized
ttagtcattgcatataaacagg

SEQ ID NO: 951409 - DNA, 22 bp, Artificial Sequence
  chemically synthesized
gattttagccaacctgtttata

SEQ ID NO: 951410 - DNA, 22 bp, Artificial Sequence
  chemically synthesized
gtcattgcatataaacaggttg

SEQ ID NO: 951411 - DNA, 22 bp, Artificial Sequence
  chemically synthesized
aaatttgattttagccaacctg

SEQ ID NO: 951412 - DNA, 22 bp, Artificial Sequence
  chemically synthesized
aaaatttgattttagccaacct

SEQ ID NO: 951413 - DNA, 22 bp, Artificial Sequence
  chemically synthesized
taaaatttgattttagccaacc

SEQ ID NO: 951414 - DNA, 22 bp, Artificial Sequence
  chemically synthesized
catataaacaggttggctaaaa

SEQ ID NO: 951415 - DNA, 22 bp, Artificial Sequence
  chemically synthesized
cattttaaaatttgattttagc

SEQ ID NO: 951416 - DNA, 22 bp, Artificial Sequence
  chemically synthesized
atatctacattttaaaatttga

SEQ ID NO: 951417 - DNA, 22 bp, Artificial Sequence
  chemically synthesized
ttgatatctacattttaaaatt

SEQ ID NO: 951418 - DNA, 22 bp, Artificial Sequence
  chemically synthesized
gctaaaatcaaattttaaaatg

SEQ ID NO: 951419 - DNA, 22 bp, Artificial Sequence
  chemically synthesized
cctattgatatctacattttaa

SEQ ID NO: 951420 - DNA, 22 bp, Artificial Sequence
  chemically synthesized
aaatcaaattttaaaatgtaga

SEQ ID NO: 951421 - DNA, 22 bp, Artificial Sequence
  chemically synthesized
taaaatgtagatatcaataggt

SEQ ID NO: 951422 - DNA, 22 bp, Artificial Sequence
  chemically synthesized
agagcagagactacctattgat

SEQ ID NO: 951423 - DNA, 22 bp, Artificial Sequence
  chemically synthesized
aaaatgtagatatcaataggta

SEQ ID NO: 951424 - DNA, 22 bp, Artificial Sequence
  chemically synthesized
gagagcagagactacctattga

SEQ ID NO: 951425 - DNA, 22 bp, Artificial Sequence
  chemically synthesized
aaatgtagatatcaataggtag

SEQ ID NO: 951426 - DNA, 22 bp, Artificial Sequence
  chemically synthesized
tgagagcagagactacctattg

SEQ ID NO: 951427 - DNA, 22 bp, Artificial Sequence
  chemically synthesized
taagccctttgagagcagagac

SEQ ID NO: 951428 - DNA, 22 bp, Artificial Sequence
  chemically synthesized
cagggaaattgtaagccctttg

SEQ ID NO: 951429 - DNA, 22 bp, Artificial Sequence
  chemically synthesized
tgctctcaaagggcttacaatt

SEQ ID NO: 951430 - DNA, 22 bp, Artificial Sequence
  chemically synthesized
ctctcaaagggcttacaatttc

SEQ ID NO: 951431 - DNA, 22 bp, Artificial Sequence
  chemically synthesized
tcaaagggcttacaatttccct

SEQ ID NO: 951432 - DNA, 22 bp, Artificial Sequence
  chemically synthesized
aaagggcttacaatttccctgt

SEQ ID NO: 951433 - DNA, 22 bp, Artificial Sequence
  chemically synthesized
atccaagtgacacgattacagg

SEQ ID NO: 951434 - DNA, 22 bp, Artificial Sequence
  chemically synthesized
acaatttccctgtaatcgtgtc

SEQ ID NO: 951435 - DNA, 22 bp, Artificial Sequence
  chemically synthesized
caatttccctgtaatcgtgtca

SEQ ID NO: 951436 - DNA, 22 bp, Artificial Sequence
  chemically synthesized
tgtaagctgatccaagtgacac

SEQ ID NO: 951437 - DNA, 22 bp, Artificial Sequence
  chemically synthesized
ccctgtaatcgtgtcacttgga

SEQ ID NO: 951438 - DNA, 22 bp, Artificial Sequence
  chemically synthesized
cctgtaatcgtgtcacttggat

SEQ ID NO: 951439 - DNA, 22 bp, Artificial Sequence
  chemically synthesized
taatcgtgtcacttggatcagc

SEQ ID NO: 951440 - DNA, 22 bp, Artificial Sequence
  chemically synthesized
taatctgtgtaagctgatccaa

SEQ ID NO: 951441 - DNA, 22 bp, Artificial Sequence
  chemically synthesized
attataatctgtgtaagctgat

SEQ ID NO: 951442 - DNA, 22 bp, Artificial Sequence
  chemically synthesized
tgattataatctgtgtaagctg

SEQ ID NO: 951443 - DNA, 22 bp, Artificial Sequence
  chemically synthesized
ctgattataatctgtgtaagct

SEQ ID NO: 951444 - DNA, 22 bp, Artificial Sequence
  chemically synthesized
cttctgattataatctgtgtaa

SEQ ID NO: 951445 - DNA, 22 bp, Artificial Sequence
  chemically synthesized
tgcttctgattataatctgtgt

SEQ ID NO: 951446 - DNA, 22 bp, Artificial Sequence
  chemically synthesized
ggatcagcttacacagattata

SEQ ID NO: 951447 - DNA, 22 bp, Artificial Sequence
  chemically synthesized
gatcagcttacacagattataa

SEQ ID NO: 951448 - DNA, 22 bp, Artificial Sequence
  chemically synthesized
tctctgcttctgattataatct

SEQ ID NO: 951449 - DNA, 22 bp, Artificial Sequence
  chemically synthesized
ctgtctctgcttctgattataa

SEQ ID NO: 951450 - DNA, 22 bp, Artificial Sequence
  chemically synthesized
tgctgtctctgcttctgattat

SEQ ID NO: 951451 - DNA, 22 bp, Artificial Sequence
  chemically synthesized
acacagattataatcagaagca

SEQ ID NO: 951452 - DNA, 22 bp, Artificial Sequence
  chemically synthesized
cacagattataatcagaagcag

SEQ ID NO: 951453 - DNA, 22 bp, Artificial Sequence
  chemically synthesized
tctctgctgtctctgcttctga

SEQ ID NO: 951454 - DNA, 22 bp, Artificial Sequence
  chemically synthesized
aggagttatctctgctgtctct

SEQ ID NO: 951455 - DNA, 22 bp, Artificial Sequence
  chemically synthesized
taatcagaagcagagacagcag

SEQ ID NO: 951456 - DNA, 22 bp, Artificial Sequence
  chemically synthesized
ttcaggagttatctctgctgtc

SEQ ID NO: 951457 - DNA, 22 bp, Artificial Sequence
  chemically synthesized
tattcaggagttatctctgctg

SEQ ID NO: 951458 - DNA, 22 bp, Artificial Sequence
  chemically synthesized
tctattcaggagttatctctgc

SEQ ID NO: 951459 - DNA, 22 bp, Artificial Sequence
  chemically synthesized
ctctattcaggagttatctctg

SEQ ID NO: 951460 - DNA, 22 bp, Artificial Sequence
  chemically synthesized
gtttctctattcaggagttatc

SEQ ID NO: 951461 - DNA, 22 bp, Artificial Sequence
  chemically synthesized
acctagtttctctattcaggag

SEQ ID NO: 951462 - DNA, 22 bp, Artificial Sequence
  chemically synthesized
aacctagtttctctattcagga

SEQ ID NO: 951463 - DNA, 22 bp, Artificial Sequence
  chemically synthesized
ttaacctagtttctctattcag

SEQ ID NO: 951464 - DNA, 22 bp, Artificial Sequence
  chemically synthesized
ttcttaacctagtttctctatt

SEQ ID NO: 951465 - DNA, 22 bp, Artificial Sequence
  chemically synthesized
ctgaatagagaaactaggttaa

SEQ ID NO: 951466 - DNA, 22 bp, Artificial Sequence
  chemically synthesized
tgcccattattcttaacctagt

SEQ ID NO: 951467 - DNA, 22 bp, Artificial Sequence
  chemically synthesized
aatagagaaactaggttaagaa

SEQ ID NO: 951468 - DNA, 22 bp, Artificial Sequence
  chemically synthesized
ggttaagaataatgggcataga

SEQ ID NO: 951469 - DNA, 22 bp, Artificial Sequence
  chemically synthesized
agaataatgggcatagatatgt

SEQ ID NO: 951470 - DNA, 22 bp, Artificial Sequence
  chemically synthesized
aaacacacacatacacacacag

SEQ ID NO: 951471 - DNA, 22 bp, Artificial Sequence
  chemically synthesized
tctaaaacacacacatacacac

SEQ ID NO: 951472 - DNA, 22 bp, Artificial Sequence
  chemically synthesized
atctaaaacacacacatacaca

SEQ ID NO: 951473 - DNA, 22 bp, Artificial Sequence
  chemically synthesized
tgtgtgtatgtgtgtgttttag

SEQ ID NO: 951474 - DNA, 22 bp, Artificial Sequence
  chemically synthesized
agagaagatcagtaacttatct

SEQ ID NO: 951475 - DNA, 22 bp, Artificial Sequence
  chemically synthesized
ggctcagagaagatcagtaact

SEQ ID NO: 951476 - DNA, 22 bp, Artificial Sequence
  chemically synthesized
aggctcagagaagatcagtaac

SEQ ID NO: 951477 - DNA, 22 bp, Artificial Sequence
  chemically synthesized
tagataagttactgatcttctc

SEQ ID NO: 951478 - DNA, 22 bp, Artificial Sequence
  chemically synthesized
agataagttactgatcttctct

SEQ ID NO: 951479 - DNA, 22 bp, Artificial Sequence
  chemically synthesized
gataagttactgatcttctctg

SEQ ID NO: 951480 - DNA, 22 bp, Artificial Sequence
  chemically synthesized
agaaaacttaggctcagagaag

SEQ ID NO: 951481 - DNA, 22 bp, Artificial Sequence
  chemically synthesized
atctgagaaaacttaggctcag

SEQ ID NO: 951482 - DNA, 22 bp, Artificial Sequence
  chemically synthesized
catctgagaaaacttaggctca

SEQ ID NO: 951483 - DNA, 22 bp, Artificial Sequence
  chemically synthesized
ctgatcttctctgagcctaagt

SEQ ID NO: 951484 - DNA, 22 bp, Artificial Sequence
  chemically synthesized
tcatctgagaaaacttaggctc

SEQ ID NO: 951485 - DNA, 22 bp, Artificial Sequence
  chemically synthesized
atcttctctgagcctaagtttt

SEQ ID NO: 951486 - DNA, 22 bp, Artificial Sequence
  chemically synthesized
attttcatctgagaaaacttag

SEQ ID NO: 951487 - DNA, 22 bp, Artificial Sequence
  chemically synthesized
tcattttcatctgagaaaactt

SEQ ID NO: 951488 - DNA, 22 bp, Artificial Sequence
  chemically synthesized
ctctgagcctaagttttctcag

SEQ ID NO: 951489 - DNA, 22 bp, Artificial Sequence
  chemically synthesized
tctgagcctaagttttctcaga

SEQ ID NO: 951490 - DNA, 22 bp, Artificial Sequence
  chemically synthesized
tgagcctaagttttctcagatg

SEQ ID NO: 951491 - DNA, 22 bp, Artificial Sequence
  chemically synthesized
agcctaagttttctcagatgaa

SEQ ID NO: 951492 - DNA, 22 bp, Artificial Sequence
  chemically synthesized
atggttctcattttcatctgag

SEQ ID NO: 951493 - DNA, 22 bp, Artificial Sequence
  chemically synthesized
catggttctcattttcatctga

SEQ ID NO: 951494 - DNA, 22 bp, Artificial Sequence
  chemically synthesized
agttttctcagatgaaaatgag

SEQ ID NO: 951495 - DNA, 22 bp, Artificial Sequence
  chemically synthesized
tctcagatgaaaatgagaacca

SEQ ID NO: 951496 - DNA, 22 bp, Artificial Sequence
  chemically synthesized
ctcagatgaaaatgagaaccat

SEQ ID NO: 951497 - DNA, 22 bp, Artificial Sequence
  chemically synthesized
tcagatgaaaatgagaaccatg

SEQ ID NO: 951498 - DNA, 22 bp, Artificial Sequence
  chemically synthesized
taaggaaggcttcatggttctc

SEQ ID NO: 951499 - DNA, 22 bp, Artificial Sequence
  chemically synthesized
agatgaaaatgagaaccatgaa

SEQ ID NO: 951500 - DNA, 22 bp, Artificial Sequence
  chemically synthesized
accctgtaaggaaggcttcatg

SEQ ID NO: 951501 - DNA, 22 bp, Artificial Sequence
  chemically synthesized
ttcaccctgtaaggaaggcttc

SEQ ID NO: 951502 - DNA, 22 bp, Artificial Sequence
  chemically synthesized
ccattattcaccctgtaaggaa

SEQ ID NO: 951503 - DNA, 22 bp, Artificial Sequence
  chemically synthesized
gattgccattattcaccctgta

SEQ ID NO: 951504 - DNA, 22 bp, Artificial Sequence
  chemically synthesized
cattggattgccattattcacc

SEQ ID NO: 951505 - DNA, 22 bp, Artificial Sequence
  chemically synthesized
acattggattgccattattcac

SEQ ID NO: 951506 - DNA, 22 bp, Artificial Sequence
  chemically synthesized
tacattggattgccattattca

SEQ ID NO: 951507 - DNA, 22 bp, Artificial Sequence
  chemically synthesized
ccttacagggtgaataatggca

SEQ ID NO: 951508 - DNA, 22 bp, Artificial Sequence
  chemically synthesized
cttacagggtgaataatggcaa

SEQ ID NO: 951509 - DNA, 22 bp, Artificial Sequence
  chemically synthesized
ctttacattggattgccattat

SEQ ID NO: 951510 - DNA, 22 bp, Artificial Sequence
  chemically synthesized
acagggtgaataatggcaatcc

SEQ ID NO: 951511 - DNA, 22 bp, Artificial Sequence
  chemically synthesized
cagggtgaataatggcaatcca

SEQ ID NO: 951512 - DNA, 22 bp, Artificial Sequence
  chemically synthesized
gaataaatatccccccctcctt

SEQ ID NO: 951513 - DNA, 22 bp, Artificial Sequence
  chemically synthesized
ctggaataaatatccccccctc

SEQ ID NO: 951514 - DNA, 22 bp, Artificial Sequence
  chemically synthesized
cctggaataaatatccccccct

SEQ ID NO: 951515 - DNA, 22 bp, Artificial Sequence
  chemically synthesized
tcctggaataaatatccccccc

SEQ ID NO: 951516 - DNA, 22 bp, Artificial Sequence
  chemically synthesized
ttcctggaataaatatcccccc

SEQ ID NO: 951517 - DNA, 22 bp, Artificial Sequence
  chemically synthesized
gtttttcctggaataaatatcc

SEQ ID NO: 951518 - DNA, 22 bp, Artificial Sequence
  chemically synthesized
ttcgtttttcctggaataaata

SEQ ID NO: 951519 - DNA, 22 bp, Artificial Sequence
  chemically synthesized
gttcgtttttcctggaataaat

SEQ ID NO: 951520 - DNA, 22 bp, Artificial Sequence
  chemically synthesized
ttgttcgtttttcctggaataa

SEQ ID NO: 951521 - DNA, 22 bp, Artificial Sequence
  chemically synthesized
tcttgttcgtttttcctggaat

SEQ ID NO: 951522 - DNA, 22 bp, Artificial Sequence
  chemically synthesized
ctcttgttcgtttttcctggaa

SEQ ID NO: 951523 - DNA, 22 bp, Artificial Sequence
  chemically synthesized
cttctcttgttcgtttttcctg

SEQ ID NO: 951524 - DNA, 22 bp, Artificial Sequence
  chemically synthesized
tacttctcttgttcgtttttcc

SEQ ID NO: 951525 - DNA, 22 bp, Artificial Sequence
  chemically synthesized
ctacttctcttgttcgtttttc

SEQ ID NO: 951526 - DNA, 22 bp, Artificial Sequence
  chemically synthesized
tttctacttctcttgttcgttt

SEQ ID NO: 951527 - DNA, 22 bp, Artificial Sequence
  chemically synthesized
attccaggaaaaacgaacaaga

SEQ ID NO: 951528 - DNA, 22 bp, Artificial Sequence
  chemically synthesized
ttccaggaaaaacgaacaagag

SEQ ID NO: 951529 - DNA, 22 bp, Artificial Sequence
  chemically synthesized
caggaaaaacgaacaagagaag

SEQ ID NO: 951530 - DNA, 22 bp, Artificial Sequence
  chemically synthesized
tatgtgttgtttctacttctct

SEQ ID NO: 951531 - DNA, 22 bp, Artificial Sequence
  chemically synthesized
caagcactgtatgtgttgtttc

SEQ ID NO: 951532 - DNA, 22 bp, Artificial Sequence
  chemically synthesized
gcaagcactgtatgtgttgttt

SEQ ID NO: 951533 - DNA, 22 bp, Artificial Sequence
  chemically synthesized
tgcaagcactgtatgtgttgtt

SEQ ID NO: 951534 - DNA, 22 bp, Artificial Sequence
  chemically synthesized
tacactttgcaagcactgtatg

SEQ ID NO: 951535 - DNA, 22 bp, Artificial Sequence
  chemically synthesized
ttatacactttgcaagcactgt

SEQ ID NO: 951536 - DNA, 22 bp, Artificial Sequence
  chemically synthesized
aaggcctattatacactttgca

SEQ ID NO: 951537 - DNA, 22 bp, Artificial Sequence
  chemically synthesized
gaaggcctattatacactttgc

SEQ ID NO: 951538 - DNA, 22 bp, Artificial Sequence
  chemically synthesized
ttgaaggcctattatacacttt

SEQ ID NO: 951539 - DNA, 22 bp, Artificial Sequence
  chemically synthesized
cttgaaggcctattatacactt

SEQ ID NO: 951540 - DNA, 22 bp, Artificial Sequence
  chemically synthesized
atttcttgaaggcctattatac

SEQ ID NO: 951541 - DNA, 22 bp, Artificial Sequence
  chemically synthesized
tcatttcttgaaggcctattat

SEQ ID NO: 951542 - DNA, 22 bp, Artificial Sequence
  chemically synthesized
gcaaagtgtataataggccttc

SEQ ID NO: 951543 - DNA, 22 bp, Artificial Sequence
  chemically synthesized
caaagtgtataataggccttca

SEQ ID NO: 951544 - DNA, 22 bp, Artificial Sequence
  chemically synthesized
tgacatagcataataattctca

SEQ ID NO: 951545 - DNA, 22 bp, Artificial Sequence
  chemically synthesized
caagaaatgagaattattatgc

SEQ ID NO: 951546 - DNA, 22 bp, Artificial Sequence
  chemically synthesized
aagaaatgagaattattatgct

SEQ ID NO: 951547 - DNA, 22 bp, Artificial Sequence
  chemically synthesized
atgagatcagactgtgacatag

SEQ ID NO: 951548 - DNA, 22 bp, Artificial Sequence
  chemically synthesized
ttatgctatgtcacagtctgat

SEQ ID NO: 951549 - DNA, 22 bp, Artificial Sequence
  chemically synthesized
tgctatgtcacagtctgatctc

SEQ ID NO: 951550 - DNA, 22 bp, Artificial Sequence
  chemically synthesized
agagtatctaatgagatcagac

SEQ ID NO: 951551 - DNA, 22 bp, Artificial Sequence
  chemically synthesized
tgtcacagtctgatctcattag

SEQ ID NO: 951552 - DNA, 22 bp, Artificial Sequence
  chemically synthesized
atgaggccattgagagtatcta

SEQ ID NO: 951553 - DNA, 22 bp, Artificial Sequence
  chemically synthesized
tcatgaggccattgagagtatc

SEQ ID NO: 951554 - DNA, 22 bp, Artificial Sequence
  chemically synthesized
ctcatgaggccattgagagtat

SEQ ID NO: 951555 - DNA, 22 bp, Artificial Sequence
  chemically synthesized
atctcattagatactctcaatg

SEQ ID NO: 951556 - DNA, 22 bp, Artificial Sequence
  chemically synthesized
atccttctcatgaggccattga

SEQ ID NO: 951557 - DNA, 22 bp, Artificial Sequence
  chemically synthesized
attagatactctcaatggcctc

SEQ ID NO: 951558 - DNA, 22 bp, Artificial Sequence
  chemically synthesized
tcatccttctcatgaggccatt

SEQ ID NO: 951559 - DNA, 22 bp, Artificial Sequence
  chemically synthesized
ctcatccttctcatgaggccat

SEQ ID NO: 951560 - DNA, 22 bp, Artificial Sequence
  chemically synthesized
tctcatccttctcatgaggcca

SEQ ID NO: 951561 - DNA, 22 bp, Artificial Sequence
  chemically synthesized
gatactctcaatggcctcatga

SEQ ID NO: 951562 - DNA, 22 bp, Artificial Sequence
  chemically synthesized
ctttctcatccttctcatgagg

SEQ ID NO: 951563 - DNA, 22 bp, Artificial Sequence
  chemically synthesized
tcaatggcctcatgagaaggat

SEQ ID NO: 951564 - DNA, 22 bp, Artificial Sequence
  chemically synthesized
aatggcctcatgagaaggatga

SEQ ID NO: 951565 - DNA, 22 bp, Artificial Sequence
  chemically synthesized
atgagaaggatgagaaaggaat

SEQ ID NO: 951566 - DNA, 22 bp, Artificial Sequence
  chemically synthesized
taaaatgggagaaatgtattcc

SEQ ID NO: 951567 - DNA, 22 bp, Artificial Sequence
  chemically synthesized
gcctgtaaaatgggagaaatgt

SEQ ID NO: 951568 - DNA, 22 bp, Artificial Sequence
  chemically synthesized
tgccctcgcctgtaaaatggga

SEQ ID NO: 951569 - DNA, 22 bp, Artificial Sequence
  chemically synthesized
gtgccctcgcctgtaaaatggg

SEQ ID NO: 951570 - DNA, 22 bp, Artificial Sequence
  chemically synthesized
tgtgccctcgcctgtaaaatgg

SEQ ID NO: 951571 - DNA, 22 bp, Artificial Sequence
  chemically synthesized
tttgtgccctcgcctgtaaaat

SEQ ID NO: 951572 - DNA, 22 bp, Artificial Sequence
  chemically synthesized
tctttgtgccctcgcctgtaaa

SEQ ID NO: 951573 - DNA, 22 bp, Artificial Sequence
  chemically synthesized
ttctctttgtgccctcgcctgt

SEQ ID NO: 951574 - DNA, 22 bp, Artificial Sequence
  chemically synthesized
gttctctttgtgccctcgcctg

SEQ ID NO: 951575 - DNA, 22 bp, Artificial Sequence
  chemically synthesized
ctcccattttacaggcgagggc

SEQ ID NO: 951576 - DNA, 22 bp, Artificial Sequence
  chemically synthesized
tgttctctttgtgccctcgcct

SEQ ID NO: 951577 - DNA, 22 bp, Artificial Sequence
  chemically synthesized
tcccattttacaggcgagggca

SEQ ID NO: 951578 - DNA, 22 bp, Artificial Sequence
  chemically synthesized
ttgttctctttgtgccctcgcc

SEQ ID NO: 951579 - DNA, 22 bp, Artificial Sequence
  chemically synthesized
tttgttctctttgtgccctcgc

SEQ ID NO: 951580 - DNA, 22 bp, Artificial Sequence
  chemically synthesized
ccattttacaggcgagggcaca

SEQ ID NO: 951581 - DNA, 22 bp, Artificial Sequence
  chemically synthesized
attttttgttctctttgtgccc

SEQ ID NO: 951582 - DNA, 22 bp, Artificial Sequence
  chemically synthesized
tacaggcgagggcacaaagaga

SEQ ID NO: 951583 - DNA, 22 bp, Artificial Sequence
  chemically synthesized
acaggcgagggcacaaagagaa

SEQ ID NO: 951584 - DNA, 22 bp, Artificial Sequence
  chemically synthesized
caggcgagggcacaaagagaac

SEQ ID NO: 951585 - DNA, 22 bp, Artificial Sequence
  chemically synthesized
aagcaaataattgattttttgt

SEQ ID NO: 951586 - DNA, 22 bp, Artificial Sequence
  chemically synthesized
gaagcaaataattgattttttg

SEQ ID NO: 951587 - DNA, 22 bp, Artificial Sequence
  chemically synthesized
tataatttgaagcaaataattg

SEQ ID NO: 951588 - DNA, 22 bp, Artificial Sequence
  chemically synthesized
caataaatagctgtataatttg

SEQ ID NO: 951589 - DNA, 22 bp, Artificial Sequence
  chemically synthesized
ccaataaatagctgtataattt

SEQ ID NO: 951590 - DNA, 22 bp, Artificial Sequence
  chemically synthesized
tttgcttcaaattatacagcta

SEQ ID NO: 951591 - DNA, 22 bp, Artificial Sequence
  chemically synthesized
gcttcaaattatacagctattt

SEQ ID NO: 951592 - DNA, 22 bp, Artificial Sequence
  chemically synthesized
cttcaaattatacagctattta

SEQ ID NO: 951593 - DNA, 22 bp, Artificial Sequence
  chemically synthesized
caaattatacagctatttattg

SEQ ID NO: 951594 - DNA, 22 bp, Artificial Sequence
  chemically synthesized
aaattatacagctatttattgg

SEQ ID NO: 951595 - DNA, 22 bp, Artificial Sequence
  chemically synthesized
agcccaagtgtttccaataaat

SEQ ID NO: 951596 - DNA, 22 bp, Artificial Sequence
  chemically synthesized
gagcccaagtgtttccaataaa

SEQ ID NO: 951597 - DNA, 22 bp, Artificial Sequence
  chemically synthesized
tgagcccaagtgtttccaataa

SEQ ID NO: 951598 - DNA, 22 bp, Artificial Sequence
  chemically synthesized
ttgagcccaagtgtttccaata

SEQ ID NO: 951599 - DNA, 22 bp, Artificial Sequence
  chemically synthesized
tacagctatttattggaaacac

SEQ ID NO: 951600 - DNA, 22 bp, Artificial Sequence
  chemically synthesized
tttattggaaacacttgggctc

SEQ ID NO: 951601 - DNA, 22 bp, Artificial Sequence
  chemically synthesized
attggaaacacttgggctcaaa

SEQ ID NO: 951602 - DNA, 22 bp, Artificial Sequence
  chemically synthesized
ttggaaacacttgggctcaaaa

SEQ ID NO: 951603 - DNA, 22 bp, Artificial Sequence
  chemically synthesized
gaaacgggatatttttgagccc

SEQ ID NO: 951604 - DNA, 22 bp, Artificial Sequence
  chemically synthesized
ggaaacgggatatttttgagcc

SEQ ID NO: 951605 - DNA, 22 bp, Artificial Sequence
  chemically synthesized
gaaacacttgggctcaaaaata

SEQ ID NO: 951606 - DNA, 22 bp, Artificial Sequence
  chemically synthesized
gggctcaaaaatatcccgtttc

SEQ ID NO: 951607 - DNA, 22 bp, Artificial Sequence
  chemically synthesized
ggctcaaaaatatcccgtttcc

SEQ ID NO: 951608 - DNA, 22 bp, Artificial Sequence
  chemically synthesized
gaaagggtaaagacttggaaac

SEQ ID NO: 951609 - DNA, 22 bp, Artificial Sequence
  chemically synthesized
aaaaatatcccgtttccaagtc

SEQ ID NO: 951610 - DNA, 22 bp, Artificial Sequence
  chemically synthesized
agaaagggtaaagacttggaaa

SEQ ID NO: 951611 - DNA, 22 bp, Artificial Sequence
  chemically synthesized
tagaaagggtaaagacttggaa

SEQ ID NO: 951612 - DNA, 22 bp, Artificial Sequence
  chemically synthesized
ccaagtctttaccctttctaaa

SEQ ID NO: 951613 - DNA, 22 bp, Artificial Sequence
  chemically synthesized
caagtctttaccctttctaaaa

SEQ ID NO: 951614 - DNA, 22 bp, Artificial Sequence
  chemically synthesized
acggacagtgtgcattttagaa

SEQ ID NO: 951615 - DNA, 22 bp, Artificial Sequence
  chemically synthesized
cacggacagtgtgcattttaga

SEQ ID NO: 951616 - DNA, 22 bp, Artificial Sequence
  chemically synthesized
taccctttctaaaatgcacact

SEQ ID NO: 951617 - DNA, 22 bp, Artificial Sequence
  chemically synthesized
accctttctaaaatgcacactg

SEQ ID NO: 951618 - DNA, 22 bp, Artificial Sequence
  chemically synthesized
ccctttctaaaatgcacactgt

SEQ ID NO: 951619 - DNA, 22 bp, Artificial Sequence
  chemically synthesized
gcatgtttcacggacagtgtgc

SEQ ID NO: 951620 - DNA, 22 bp, Artificial Sequence
  chemically synthesized
ggcatgtttcacggacagtgtg

SEQ ID NO: 951621 - DNA, 22 bp, Artificial Sequence
  chemically synthesized
tctaaaatgcacactgtccgtg

SEQ ID NO: 951622 - DNA, 22 bp, Artificial Sequence
  chemically synthesized
ctaaaatgcacactgtccgtga

SEQ ID NO: 951623 - DNA, 22 bp, Artificial Sequence
  chemically synthesized
taaaatgcacactgtccgtgaa

SEQ ID NO: 951624 - DNA, 22 bp, Artificial Sequence
  chemically synthesized
aaatgcacactgtccgtgaaac

SEQ ID NO: 951625 - DNA, 22 bp, Artificial Sequence
  chemically synthesized
tccgtgaaacatgccaaattga

SEQ ID NO: 951626 - DNA, 22 bp, Artificial Sequence
  chemically synthesized
gtgatgataaaatcaatttggc

SEQ ID NO: 951627 - DNA, 22 bp, Artificial Sequence
  chemically synthesized
agtgatgataaaatcaatttgg

SEQ ID NO: 951628 - DNA, 22 bp, Artificial Sequence
  chemically synthesized
atcttagtgatgataaaatcaa

SEQ ID NO: 951629 - DNA, 22 bp, Artificial Sequence
  chemically synthesized
tggataagttcatcttagtgat

SEQ ID NO: 951630 - DNA, 22 bp, Artificial Sequence
  chemically synthesized
attttatcatcactaagatgaa

SEQ ID NO: 951631 - DNA, 22 bp, Artificial Sequence
  chemically synthesized
tatcatcactaagatgaactta

SEQ ID NO: 951632 - DNA, 22 bp, Artificial Sequence
  chemically synthesized
atcatcactaagatgaacttat

SEQ ID NO: 951633 - DNA, 22 bp, Artificial Sequence
  chemically synthesized
tcatcactaagatgaacttatc

SEQ ID NO: 951634 - DNA, 22 bp, Artificial Sequence
  chemically synthesized
ggggcacaaggatctatggata

SEQ ID NO: 951635 - DNA, 22 bp, Artificial Sequence
  chemically synthesized
gggggcacaaggatctatggat

SEQ ID NO: 951636 - DNA, 22 bp, Artificial Sequence
  chemically synthesized
agatgaacttatccatagatcc

SEQ ID NO: 951637 - DNA, 22 bp, Artificial Sequence
  chemically synthesized
atccatagatccttgtgccccc

SEQ ID NO: 951638 - DNA, 22 bp, Artificial Sequence
  chemically synthesized
tccatagatccttgtgccccca

SEQ ID NO: 951639 - DNA, 22 bp, Artificial Sequence
  chemically synthesized
agacagtgagatttgggggcac

SEQ ID NO: 951640 - DNA, 22 bp, Artificial Sequence
  chemically synthesized
gtgcccccaaatctcactgtct

SEQ ID NO: 951641 - DNA, 22 bp, Artificial Sequence
  chemically synthesized
tgcccccaaatctcactgtctc

SEQ ID NO: 951642 - DNA, 22 bp, Artificial Sequence
  chemically synthesized
aggcacccaagaactgagacag

SEQ ID NO: 951643 - DNA, 22 bp, Artificial Sequence
  chemically synthesized
gaggcacccaagaactgagaca

SEQ ID NO: 951644 - DNA, 22 bp, Artificial Sequence
  chemically synthesized
gacttgaggcacccaagaactg

SEQ ID NO: 951645 - DNA, 22 bp, Artificial Sequence
  chemically synthesized
ggacttgaggcacccaagaact

SEQ ID NO: 951646 - DNA, 22 bp, Artificial Sequence
  chemically synthesized
actgtctcagttcttgggtgcc

SEQ ID NO: 951647 - DNA, 22 bp, Artificial Sequence
  chemically synthesized
ggaacttggacttgaggcaccc

SEQ ID NO: 951648 - DNA, 22 bp, Artificial Sequence
  chemically synthesized
tctcagttcttgggtgcctcaa

SEQ ID NO: 951649 - DNA, 22 bp, Artificial Sequence
  chemically synthesized
agttcttgggtgcctcaagtcc

SEQ ID NO: 951650 - DNA, 22 bp, Artificial Sequence
  chemically synthesized
ttgggtgcctcaagtccaagtt

SEQ ID NO: 951651 - DNA, 22 bp, Artificial Sequence
  chemically synthesized
gggtgcctcaagtccaagttcc

SEQ ID NO: 951652 - DNA, 22 bp, Artificial Sequence
  chemically synthesized
ggtgcctcaagtccaagttccc

SEQ ID NO: 951653 - DNA, 22 bp, Artificial Sequence
  chemically synthesized
atagacagatgccctgggaact

SEQ ID NO: 951654 - DNA, 22 bp, Artificial Sequence
  chemically synthesized
ctcatagacagatgccctggga

SEQ ID NO: 951655 - DNA, 22 bp, Artificial Sequence
  chemically synthesized
aagtccaagttcccagggcatc

SEQ ID NO: 951656 - DNA, 22 bp, Artificial Sequence
  chemically synthesized
tgaatatcctactcatagacag

SEQ ID NO: 951657 - DNA, 22 bp, Artificial Sequence
  chemically synthesized
ccagggcatctgtctatgagta

SEQ ID NO: 951658 - DNA, 22 bp, Artificial Sequence
  chemically synthesized
actgtgaatatcctactcatag

SEQ ID NO: 951659 - DNA, 22 bp, Artificial Sequence
  chemically synthesized
ctcactgtgaatatcctactca

SEQ ID NO: 951660 - DNA, 22 bp, Artificial Sequence
  chemically synthesized
actcactgtgaatatcctactc

SEQ ID NO: 951661 - DNA, 22 bp, Artificial Sequence
  chemically synthesized
tactcactgtgaatatcctact

SEQ ID NO: 951662 - DNA, 22 bp, Artificial Sequence
  chemically synthesized
ttactcactgtgaatatcctac

SEQ ID NO: 951663 - DNA, 22 bp, Artificial Sequence
  chemically synthesized
tttactcactgtgaatatccta

SEQ ID NO: 951664 - DNA, 22 bp, Artificial Sequence
  chemically synthesized
tctatgagtaggatattcacag

SEQ ID NO: 951665 - DNA, 22 bp, Artificial Sequence
  chemically synthesized
cctttttactcactgtgaatat

SEQ ID NO: 951666 - DNA, 22 bp, Artificial Sequence
  chemically synthesized
tgagtaggatattcacagtgag

SEQ ID NO: 951667 - DNA, 22 bp, Artificial Sequence
  chemically synthesized
tggcattacctttttactcact

SEQ ID NO: 951668 - DNA, 22 bp, Artificial Sequence
  chemically synthesized
atggcattacctttttactcac

SEQ ID NO: 951669 - DNA, 22 bp, Artificial Sequence
  chemically synthesized
tatggcattacctttttactca

SEQ ID NO: 951670 - DNA, 22 bp, Artificial Sequence
  chemically synthesized
ttatggcattacctttttactc

SEQ ID NO: 951671 - DNA, 22 bp, Artificial Sequence
  chemically synthesized
gatttttatggcattacctttt

SEQ ID NO: 951672 - DNA, 22 bp, Artificial Sequence
  chemically synthesized
acagtgagtaaaaaggtaatgc

SEQ ID NO: 951673 - DNA, 22 bp, Artificial Sequence
  chemically synthesized
acccacacctagatttttatgg

SEQ ID NO: 951674 - DNA, 22 bp, Artificial Sequence
  chemically synthesized
ctaacccacacctagattttta

SEQ ID NO: 951675 - DNA, 22 bp, Artificial Sequence
  chemically synthesized
tactaacccacacctagatttt

SEQ ID NO: 951676 - DNA, 22 bp, Artificial Sequence
  chemically synthesized
gattctactaacccacacctag

SEQ ID NO: 951677 - DNA, 22 bp, Artificial Sequence
  chemically synthesized
ggattctactaacccacaccta

SEQ ID NO: 951678 - DNA, 22 bp, Artificial Sequence
  chemically synthesized
tttggattctactaacccacac

SEQ ID NO: 951679 - DNA, 22 bp, Artificial Sequence
  chemically synthesized
atttggattctactaacccaca

SEQ ID NO: 951680 - DNA, 22 bp, Artificial Sequence
  chemically synthesized
tatcgtttatttggattctact

SEQ ID NO: 951681 - DNA, 22 bp, Artificial Sequence
  chemically synthesized
ggtgtgggttagtagaatccaa

SEQ ID NO: 951682 - DNA, 22 bp, Artificial Sequence
  chemically synthesized
tatatcgtttatttggattcta

SEQ ID NO: 951683 - DNA, 22 bp, Artificial Sequence
  chemically synthesized
tgatgttctatatcgtttattt

SEQ ID NO: 951684 - DNA, 22 bp, Artificial Sequence
  chemically synthesized
gtagaatccaaataaacgatat

SEQ ID NO: 951685 - DNA, 22 bp, Artificial Sequence
  chemically synthesized
aatatgagttgtgatgttctat

SEQ ID NO: 951686 - DNA, 22 bp, Artificial Sequence
  chemically synthesized
gaatatgagttgtgatgttcta

SEQ ID NO: 951687 - DNA, 22 bp, Artificial Sequence
  chemically synthesized
acatatttgaatatgagttgtg

SEQ ID NO: 951688 - DNA, 22 bp, Artificial Sequence
  chemically synthesized
gttaacatatttgaatatgagt

SEQ ID NO: 951689 - DNA, 22 bp, Artificial Sequence
  chemically synthesized
agttaacatatttgaatatgag

SEQ ID NO: 951690 - DNA, 22 bp, Artificial Sequence
  chemically synthesized
tagttaacatatttgaatatga

SEQ ID NO: 951691 - DNA, 22 bp, Artificial Sequence
  chemically synthesized
ctttagttaacatatttgaata

SEQ ID NO: 951692 - DNA, 22 bp, Artificial Sequence
  chemically synthesized
atattcaaatatgttaactaaa

SEQ ID NO: 951693 - DNA, 22 bp, Artificial Sequence
  chemically synthesized
aaatatgttaactaaagtaatg

SEQ ID NO: 951694 - DNA, 22 bp, Artificial Sequence
  chemically synthesized
agtaataggaaatcattacttt

SEQ ID NO: 951695 - DNA, 22 bp, Artificial Sequence
  chemically synthesized
taagtaataggaaatcattact

SEQ ID NO: 951696 - DNA, 22 bp, Artificial Sequence
  chemically synthesized
actctaagtaataggaaatcat

SEQ ID NO: 951697 - DNA, 22 bp, Artificial Sequence
  chemically synthesized
actaaagtaatgatttcctatt

SEQ ID NO: 951698 - DNA, 22 bp, Artificial Sequence
  chemically synthesized
aagtaatgatttcctattactt

SEQ ID NO: 951699 - DNA, 22 bp, Artificial Sequence
  chemically synthesized
agaccctcactctaagtaatag

SEQ ID NO: 951700 - DNA, 22 bp, Artificial Sequence
  chemically synthesized
gagaccctcactctaagtaata

SEQ ID NO: 951701 - DNA, 22 bp, Artificial Sequence
  chemically synthesized
tgagaccctcactctaagtaat

SEQ ID NO: 951702 - DNA, 22 bp, Artificial Sequence
  chemically synthesized
cctattacttagagtgagggtc

SEQ ID NO: 951703 - DNA, 22 bp, Artificial Sequence
  chemically synthesized
ctattacttagagtgagggtct

SEQ ID NO: 951704 - DNA, 22 bp, Artificial Sequence
  chemically synthesized
aggaacattttgagaccctcac

SEQ ID NO: 951705 - DNA, 22 bp, Artificial Sequence
  chemically synthesized
caggaacattttgagaccctca

SEQ ID NO: 951706 - DNA, 22 bp, Artificial Sequence
  chemically synthesized
ttacttagagtgagggtctcaa

SEQ ID NO: 951707 - DNA, 22 bp, Artificial Sequence
  chemically synthesized
tttcaggaacattttgagaccc

SEQ ID NO: 951708 - DNA, 22 bp, Artificial Sequence
  chemically synthesized
cttagagtgagggtctcaaaat

SEQ ID NO: 951709 - DNA, 22 bp, Artificial Sequence
  chemically synthesized
agagtgagggtctcaaaatgtt

SEQ ID NO: 951710 - DNA, 22 bp, Artificial Sequence
  chemically synthesized
gagtgagggtctcaaaatgttc

SEQ ID NO: 951711 - DNA, 22 bp, Artificial Sequence
  chemically synthesized
agatctatttcaggaacatttt

SEQ ID NO: 951712 - DNA, 22 bp, Artificial Sequence
  chemically synthesized
gagatctatttcaggaacattt

SEQ ID NO: 951713 - DNA, 22 bp, Artificial Sequence
  chemically synthesized
tgagatctatttcaggaacatt

SEQ ID NO: 951714 - DNA, 22 bp, Artificial Sequence
  chemically synthesized
aaaatgttcctgaaatagatct

SEQ ID NO: 951715 - DNA, 22 bp, Artificial Sequence
  chemically synthesized
gacagagggaatacattttgag

SEQ ID NO: 951716 - DNA, 22 bp, Artificial Sequence
  chemically synthesized
ctgaaatagatctcaaaatgta

SEQ ID NO: 951717 - DNA, 22 bp, Artificial Sequence
  chemically synthesized
aaatagatctcaaaatgtattc

SEQ ID NO: 951718 - DNA, 22 bp, Artificial Sequence
  chemically synthesized
aactagacagagggaatacatt

SEQ ID NO: 951719 - DNA, 22 bp, Artificial Sequence
  chemically synthesized
caactagacagagggaatacat

SEQ ID NO: 951720 - DNA, 22 bp, Artificial Sequence
  chemically synthesized
caaagtttcaactagacagagg

SEQ ID NO: 951721 - DNA, 22 bp, Artificial Sequence
  chemically synthesized
aaaatgtattccctctgtctag

SEQ ID NO: 951722 - DNA, 22 bp, Artificial Sequence
  chemically synthesized
aaagattacaaagtttcaacta

SEQ ID NO: 951723 - DNA, 22 bp, Artificial Sequence
  chemically synthesized
ttcaaagattacaaagtttcaa

SEQ ID NO: 951724 - DNA, 22 bp, Artificial Sequence
  chemically synthesized
cctctgtctagttgaaactttg

SEQ ID NO: 951725 - DNA, 22 bp, Artificial Sequence
  chemically synthesized
ctgttcaaagattacaaagttt

SEQ ID NO: 951726 - DNA, 22 bp, Artificial Sequence
  chemically synthesized
tgtctagttgaaactttgtaat

SEQ ID NO: 951727 - DNA, 22 bp, Artificial Sequence
  chemically synthesized
tctagttgaaactttgtaatct

SEQ ID NO: 951728 - DNA, 22 bp, Artificial Sequence
  chemically synthesized
gttgaaactttgtaatctttga

SEQ ID NO: 951729 - DNA, 22 bp, Artificial Sequence
  chemically synthesized
aaactttgtaatctttgaacag

SEQ ID NO: 951730 - DNA, 22 bp, Artificial Sequence
  chemically synthesized
tgtaatctttgaacagtaactc

SEQ ID NO: 951731 - DNA, 22 bp, Artificial Sequence
  chemically synthesized
gtaatctttgaacagtaactct

SEQ ID NO: 951732 - DNA, 22 bp, Artificial Sequence
  chemically synthesized
taatctttgaacagtaactctc

SEQ ID NO: 951733 - DNA, 22 bp, Artificial Sequence
  chemically synthesized
tgaacagtaactctctattccc

SEQ ID NO: 951734 - DNA, 22 bp, Artificial Sequence
  chemically synthesized
gaacagtaactctctattccct

SEQ ID NO: 951735 - DNA, 22 bp, Artificial Sequence
  chemically synthesized
ggaggtggagtgagggaataga

SEQ ID NO: 951736 - DNA, 22 bp, Artificial Sequence
  chemically synthesized
aacagtaactctctattccctc

SEQ ID NO: 951737 - DNA, 22 bp, Artificial Sequence
  chemically synthesized
gggaggtggagtgagggaatag

SEQ ID NO: 951738 - DNA, 22 bp, Artificial Sequence
  chemically synthesized
acagaggcttgggaggtggagt

SEQ ID NO: 951739 - DNA, 22 bp, Artificial Sequence
  chemically synthesized
tctattccctcactccacctcc

SEQ ID NO: 951740 - DNA, 22 bp, Artificial Sequence
  chemically synthesized
tattccctcactccacctccca

SEQ ID NO: 951741 - DNA, 22 bp, Artificial Sequence
  chemically synthesized
ttccctcactccacctcccaag

SEQ ID NO: 951742 - DNA, 22 bp, Artificial Sequence
  chemically synthesized
cctcactccacctcccaagcct

SEQ ID NO: 951743 - DNA, 22 bp, Artificial Sequence
  chemically synthesized
actccacctcccaagcctctgt

SEQ ID NO: 951744 - DNA, 22 bp, Artificial Sequence
  chemically synthesized
cacctcccaagcctctgttaac

SEQ ID NO: 951745 - DNA, 22 bp, Artificial Sequence
  chemically synthesized
ccaagcctctgttaaccatgat

SEQ ID NO: 951746 - DNA, 22 bp, Artificial Sequence
  chemically synthesized
atagagatgtagagtagaatca

SEQ ID NO: 951747 - DNA, 22 bp, Artificial Sequence
  chemically synthesized
tgttaaccatgattctactcta

SEQ ID NO: 951748 - DNA, 22 bp, Artificial Sequence
  chemically synthesized
ttaaccatgattctactctaca

SEQ ID NO: 951749 - DNA, 22 bp, Artificial Sequence
  chemically synthesized
aattcatagagatgtagagtag

SEQ ID NO: 951750 - DNA, 22 bp, Artificial Sequence
  chemically synthesized
accatgattctactctacatct

SEQ ID NO: 951751 - DNA, 22 bp, Artificial Sequence
  chemically synthesized
tactctacatctctatgaattc

SEQ ID NO: 951752 - DNA, 22 bp, Artificial Sequence
  chemically synthesized
ctctacatctctatgaattcaa

SEQ ID NO: 951753 - DNA, 22 bp, Artificial Sequence
  chemically synthesized
tacatctctatgaattcaactt

SEQ ID NO: 951754 - DNA, 22 bp, Artificial Sequence
  chemically synthesized
catctctatgaattcaactttt

SEQ ID NO: 951755 - DNA, 22 bp, Artificial Sequence
  chemically synthesized
aatgtgcaatgtaagaaaagtt

SEQ ID NO: 951756 - DNA, 22 bp, Artificial Sequence
  chemically synthesized
aaatgtgcaatgtaagaaaagt

SEQ ID NO: 951757 - DNA, 22 bp, Artificial Sequence
  chemically synthesized
tatgaattcaacttttcttaca

SEQ ID NO: 951758 - DNA, 22 bp, Artificial Sequence
  chemically synthesized
tgaattcaacttttcttacatt

SEQ ID NO: 951759 - DNA, 22 bp, Artificial Sequence
  chemically synthesized
aacttttcttacattgcacatt

SEQ ID NO: 951760 - DNA, 22 bp, Artificial Sequence
  chemically synthesized
ttcttacattgcacatttaagt

SEQ ID NO: 951761 - DNA, 22 bp, Artificial Sequence
  chemically synthesized
tcttacattgcacatttaagtg

SEQ ID NO: 951762 - DNA, 22 bp, Artificial Sequence
  chemically synthesized
cttacattgcacatttaagtga

SEQ ID NO: 951763 - DNA, 22 bp, Artificial Sequence
  chemically synthesized
ttacattgcacatttaagtgac

SEQ ID NO: 951764 - DNA, 22 bp, Artificial Sequence
  chemically synthesized
acattgcacatttaagtgacat

SEQ ID NO: 951765 - DNA, 22 bp, Artificial Sequence
  chemically synthesized
cattgcacatttaagtgacatc

SEQ ID NO: 951766 - DNA, 22 bp, Artificial Sequence
  chemically synthesized
cacatttaagtgacatcatgtg

SEQ ID NO: 951767 - DNA, 22 bp, Artificial Sequence
  chemically synthesized
aagtgacatcatgtggtatttg

SEQ ID NO: 951768 - DNA, 22 bp, Artificial Sequence
  chemically synthesized
agtgacatcatgtggtatttgt

SEQ ID NO: 951769 - DNA, 22 bp, Artificial Sequence
  chemically synthesized
ccccaggcacagaaagacaaat

SEQ ID NO: 951770 - DNA, 22 bp, Artificial Sequence
  chemically synthesized
cccccaggcacagaaagacaaa

SEQ ID NO: 951771 - DNA, 22 bp, Artificial Sequence
  chemically synthesized
tcccccaggcacagaaagacaa

SEQ ID NO: 951772 - DNA, 22 bp, Artificial Sequence
  chemically synthesized
ttcccccaggcacagaaagaca

SEQ ID NO: 951773 - DNA, 22 bp, Artificial Sequence
  chemically synthesized
gtctttctgtgcctgggggaaa

SEQ ID NO: 951774 - DNA, 22 bp, Artificial Sequence
  chemically synthesized
tctttctgtgcctgggggaaaa

SEQ ID NO: 951775 - DNA, 22 bp, Artificial Sequence
  chemically synthesized
aggtacatgaacatttttcccc

SEQ ID NO: 951776 - DNA, 22 bp, Artificial Sequence
  chemically synthesized
tctgtgcctgggggaaaaatgt

SEQ ID NO: 951777 - DNA, 22 bp, Artificial Sequence
  chemically synthesized
tgaggtacatgaacatttttcc

SEQ ID NO: 951778 - DNA, 22 bp, Artificial Sequence
  chemically synthesized
ctgtgcctgggggaaaaatgtt

SEQ ID NO: 951779 - DNA, 22 bp, Artificial Sequence
  chemically synthesized
ctgaggtacatgaacatttttc

SEQ ID NO: 951780 - DNA, 22 bp, Artificial Sequence
  chemically synthesized
tgtgcctgggggaaaaatgttc

SEQ ID NO: 951781 - DNA, 22 bp, Artificial Sequence
  chemically synthesized
tgcctgggggaaaaatgttcat

SEQ ID NO: 951782 - DNA, 22 bp, Artificial Sequence
  chemically synthesized
cttctgaggtacatgaacattt

SEQ ID NO: 951783 - DNA, 22 bp, Artificial Sequence
  chemically synthesized
acttctgaggtacatgaacatt

SEQ ID NO: 951784 - DNA, 22 bp, Artificial Sequence
  chemically synthesized
ggggaaaaatgttcatgtacct

SEQ ID NO: 951785 - DNA, 22 bp, Artificial Sequence
  chemically synthesized
aaatgtgtttacttctgaggta

SEQ ID NO: 951786 - DNA, 22 bp, Artificial Sequence
  chemically synthesized
aaaatgtgtttacttctgaggt

SEQ ID NO: 951787 - DNA, 22 bp, Artificial Sequence
  chemically synthesized
atgtacctcagaagtaaacaca

SEQ ID NO: 951788 - DNA, 22 bp, Artificial Sequence
  chemically synthesized
tatagggtacatgcttaaaatg

SEQ ID NO: 951789 - DNA, 22 bp, Artificial Sequence
  chemically synthesized
agaagtaaacacattttaagca

SEQ ID NO: 951790 - DNA, 22 bp, Artificial Sequence
  chemically synthesized
atatagggtacatgcttaaaat

SEQ ID NO: 951791 - DNA, 22 bp, Artificial Sequence
  chemically synthesized
tgaatatatatttatatagggt

SEQ ID NO: 951792 - DNA, 22 bp, Artificial Sequence
  chemically synthesized
taagcatgtaccctatataaat

SEQ ID NO: 951793 - DNA, 22 bp, Artificial Sequence
  chemically synthesized
aagcatgtaccctatataaata

SEQ ID NO: 951794 - DNA, 22 bp, Artificial Sequence
  chemically synthesized
agcatgtaccctatataaatat

SEQ ID NO: 951795 - DNA, 22 bp, Artificial Sequence
  chemically synthesized
catatgtctgtgaatatatatt

SEQ ID NO: 951796 - DNA, 22 bp, Artificial Sequence
  chemically synthesized
aaattacatatgtctgtgaata

SEQ ID NO: 951797 - DNA, 22 bp, Artificial Sequence
  chemically synthesized
aaaattacatatgtctgtgaat

SEQ ID NO: 951798 - DNA, 22 bp, Artificial Sequence
  chemically synthesized
tataaatatatattcacagaca

SEQ ID NO: 951799 - DNA, 22 bp, Artificial Sequence
  chemically synthesized
gtgtcaatgtaatttaaaatta

SEQ ID NO: 951800 - DNA, 22 bp, Artificial Sequence
  chemically synthesized
acagacatatgtaattttaaat

SEQ ID NO: 951801 - DNA, 22 bp, Artificial Sequence
  chemically synthesized
caaaactagtgtcaatgtaatt

SEQ ID NO: 951802 - DNA, 22 bp, Artificial Sequence
  chemically synthesized
tgtctacaaaactagtgtcaat

SEQ ID NO: 951803 - DNA, 22 bp, Artificial Sequence
  chemically synthesized
taaattacattgacactagttt

SEQ ID NO: 951804 - DNA, 22 bp, Artificial Sequence
  chemically synthesized
aaattacattgacactagtttt

SEQ ID NO: 951805 - DNA, 22 bp, Artificial Sequence
  chemically synthesized
aattacattgacactagttttg

SEQ ID NO: 951806 - DNA, 22 bp, Artificial Sequence
  chemically synthesized
cattgacactagttttgtagac

SEQ ID NO: 951807 - DNA, 22 bp, Artificial Sequence
  chemically synthesized
acactagttttgtagacacaac

SEQ ID NO: 951808 - DNA, 22 bp, Artificial Sequence
  chemically synthesized
gttttgtagacacaacttacac

SEQ ID NO: 951809 - DNA, 22 bp, Artificial Sequence
  chemically synthesized
tagtgtatgtgatgtgtaagtt

SEQ ID NO: 951810 - DNA, 22 bp, Artificial Sequence
  chemically synthesized
atagtgtatgtgatgtgtaagt

SEQ ID NO: 951811 - DNA, 22 bp, Artificial Sequence
  chemically synthesized
tatagtgtatgtgatgtgtaag

SEQ ID NO: 951812 - DNA, 22 bp, Artificial Sequence
  chemically synthesized
tgtagacacaacttacacatca

SEQ ID NO: 951813 - DNA, 22 bp, Artificial Sequence
  chemically synthesized
gtagacacaacttacacatcac

SEQ ID NO: 951814 - DNA, 22 bp, Artificial Sequence
  chemically synthesized
tagacacaacttacacatcaca

SEQ ID NO: 951815 - DNA, 22 bp, Artificial Sequence
  chemically synthesized
tatattttatagtgtatgtgat

SEQ ID NO: 951816 - DNA, 22 bp, Artificial Sequence
  chemically synthesized
attgtatattttatagtgtatg

SEQ ID NO: 951817 - DNA, 22 bp, Artificial Sequence
  chemically synthesized
gattgtatattttatagtgtat

SEQ ID NO: 951818 - DNA, 22 bp, Artificial Sequence
  chemically synthesized
tgattgtatattttatagtgta

SEQ ID NO: 951819 - DNA, 22 bp, Artificial Sequence
  chemically synthesized
acacatcacatacactataaaa

SEQ ID NO: 951820 - DNA, 22 bp, Artificial Sequence
  chemically synthesized
cacatcacatacactataaaat

SEQ ID NO: 951821 - DNA, 22 bp, Artificial Sequence
  chemically synthesized
atattttgattgtatattttat

SEQ ID NO: 951822 - DNA, 22 bp, Artificial Sequence
  chemically synthesized
gaaattaatattttgattgtat

SEQ ID NO: 951823 - DNA, 22 bp, Artificial Sequence
  chemically synthesized
tagaaattaatattttgattgt

SEQ ID NO: 951824 - DNA, 22 bp, Artificial Sequence
  chemically synthesized
tctagaaattaatattttgatt

SEQ ID NO: 951825 - DNA, 22 bp, Artificial Sequence
  chemically synthesized
taaaatatacaatcaaaatatt

SEQ ID NO: 951826 - DNA, 22 bp, Artificial Sequence
  chemically synthesized
ttctctagaaattaatattttg

SEQ ID NO: 951827 - DNA, 22 bp, Artificial Sequence
  chemically synthesized
gttctctagaaattaatatttt

SEQ ID NO: 951828 - DNA, 22 bp, Artificial Sequence
  chemically synthesized
tcttgttctctagaaattaata

SEQ ID NO: 951829 - DNA, 22 bp, Artificial Sequence
  chemically synthesized
atcttgttctctagaaattaat

SEQ ID NO: 951830 - DNA, 22 bp, Artificial Sequence
  chemically synthesized
tttatcttgttctctagaaatt

SEQ ID NO: 951831 - DNA, 22 bp, Artificial Sequence
  chemically synthesized
atttatcttgttctctagaaat

SEQ ID NO: 951832 - DNA, 22 bp, Artificial Sequence
  chemically synthesized
tatttatcttgttctctagaaa

SEQ ID NO: 951833 - DNA, 22 bp, Artificial Sequence
  chemically synthesized
ttatttatcttgttctctagaa

SEQ ID NO: 951834 - DNA, 22 bp, Artificial Sequence
  chemically synthesized
tttatttatcttgttctctaga

SEQ ID NO: 951835 - DNA, 22 bp, Artificial Sequence
  chemically synthesized
atttctagagaacaagataaat

SEQ ID NO: 951836 - DNA, 22 bp, Artificial Sequence
  chemically synthesized
ctagagaacaagataaataaaa

SEQ ID NO: 951837 - DNA, 22 bp, Artificial Sequence
  chemically synthesized
tagagaacaagataaataaaaa

SEQ ID NO: 951838 - DNA, 22 bp, Artificial Sequence
  chemically synthesized
gagaacaagataaataaaaagt

SEQ ID NO: 951839 - DNA, 22 bp, Artificial Sequence
  chemically synthesized
gggtagtgagaaaaaatacttt

SEQ ID NO: 951840 - DNA, 22 bp, Artificial Sequence
  chemically synthesized
aacagttggggtagtgagaaaa

SEQ ID NO: 951841 - DNA, 22 bp, Artificial Sequence
  chemically synthesized
tttctcactaccccaactgttt

SEQ ID NO: 951842 - DNA, 22 bp, Artificial Sequence
  chemically synthesized
ttctcactaccccaactgttta

SEQ ID NO: 951843 - DNA, 22 bp, Artificial Sequence
  chemically synthesized
tctcactaccccaactgtttag

SEQ ID NO: 951844 - DNA, 22 bp, Artificial Sequence
  chemically synthesized
ctcactaccccaactgtttagc

SEQ ID NO: 951845 - DNA, 22 bp, Artificial Sequence
  chemically synthesized
tcactaccccaactgtttagca

SEQ ID NO: 951846 - DNA, 22 bp, Artificial Sequence
  chemically synthesized
actaccccaactgtttagcacg

SEQ ID NO: 951847 - DNA, 22 bp, Artificial Sequence
  chemically synthesized
ccccaactgtttagcacgcata

SEQ ID NO: 951848 - DNA, 22 bp, Artificial Sequence
  chemically synthesized
tttagcacgcatattattgggc

SEQ ID NO: 951849 - DNA, 22 bp, Artificial Sequence
  chemically synthesized
agcacgcatattattgggcatg

SEQ ID NO: 951850 - DNA, 22 bp, Artificial Sequence
  chemically synthesized
gcacgcatattattgggcatgt

SEQ ID NO: 951851 - DNA, 22 bp, Artificial Sequence
  chemically synthesized
ccaaagtggaatgtacatgccc

SEQ ID NO: 951852 - DNA, 22 bp, Artificial Sequence
  chemically synthesized
ttaccaaagtggaatgtacatg

SEQ ID NO: 951853 - DNA, 22 bp, Artificial Sequence
  chemically synthesized
ttgggcatgtacattccacttt

SEQ ID NO: 951854 - DNA, 22 bp, Artificial Sequence
  chemically synthesized
ggtcagttgttaccaaagtgga

SEQ ID NO: 951855 - DNA, 22 bp, Artificial Sequence
  chemically synthesized
ggcatgtacattccactttggt

SEQ ID NO: 951856 - DNA, 22 bp, Artificial Sequence
  chemically synthesized
tctaggtcagttgttaccaaag

SEQ ID NO: 951857 - DNA, 22 bp, Artificial Sequence
  chemically synthesized
attatctaggtcagttgttacc

SEQ ID NO: 951858 - DNA, 22 bp, Artificial Sequence
  chemically synthesized
gattatctaggtcagttgttac

SEQ ID NO: 951859 - DNA, 22 bp, Artificial Sequence
  chemically synthesized
cactttggtaacaactgaccta

SEQ ID NO: 951860 - DNA, 22 bp, Artificial Sequence
  chemically synthesized
aatttgattatctaggtcagtt

SEQ ID NO: 951861 - DNA, 22 bp, Artificial Sequence
  chemically synthesized
gaatttgattatctaggtcagt

SEQ ID NO: 951862 - DNA, 22 bp, Artificial Sequence
  chemically synthesized
tggtaacaactgacctagataa

SEQ ID NO: 951863 - DNA, 22 bp, Artificial Sequence
  chemically synthesized
ggtaacaactgacctagataat

SEQ ID NO: 951864 - DNA, 22 bp, Artificial Sequence
  chemically synthesized
gtaacaactgacctagataatc

SEQ ID NO: 951865 - DNA, 22 bp, Artificial Sequence
  chemically synthesized
caacgaccttgaatttgattat

SEQ ID NO: 951866 - DNA, 22 bp, Artificial Sequence
  chemically synthesized
acctagataatcaaattcaagg

SEQ ID NO: 951867 - DNA, 22 bp, Artificial Sequence
  chemically synthesized
tcactccaacgaccttgaattt

SEQ ID NO: 951868 - DNA, 22 bp, Artificial Sequence
  chemically synthesized
gtcactccaacgaccttgaatt

SEQ ID NO: 951869 - DNA, 22 bp, Artificial Sequence
  chemically synthesized
tgtcactccaacgaccttgaat

SEQ ID NO: 951870 - DNA, 22 bp, Artificial Sequence
  chemically synthesized
gataatcaaattcaaggtcgtt

SEQ ID NO: 951871 - DNA, 22 bp, Artificial Sequence
  chemically synthesized
tgaaggattttgtcactccaac

SEQ ID NO: 951872 - DNA, 22 bp, Artificial Sequence
  chemically synthesized
aaggtcgttggagtgacaaaat

SEQ ID NO: 951873 - DNA, 22 bp, Artificial Sequence
  chemically synthesized
gagtgacaaaatccttcataac

SEQ ID NO: 951874 - DNA, 22 bp, Artificial Sequence
  chemically synthesized
cacacacacaccagtgaagtta

SEQ ID NO: 951875 - DNA, 22 bp, Artificial Sequence
  chemically synthesized
acacacacacaccagtgaagtt

SEQ ID NO: 951876 - DNA, 22 bp, Artificial Sequence
  chemically synthesized
cataacttcactggtgtgtgtg

SEQ ID NO: 951877 - DNA, 22 bp, Artificial Sequence
  chemically synthesized
ataacttcactggtgtgtgtgt

SEQ ID NO: 951878 - DNA, 22 bp, Artificial Sequence
  chemically synthesized
cactggtgtgtgtgtgtaagcg

SEQ ID NO: 951879 - DNA, 22 bp, Artificial Sequence
  chemically synthesized
actggtgtgtgtgtgtaagcgt

SEQ ID NO: 951880 - DNA, 22 bp, Artificial Sequence
  chemically synthesized
gtgtgtgtgtgtaagcgtgtgt

SEQ ID NO: 951881 - DNA, 22 bp, Artificial Sequence
  chemically synthesized
taagcacacacacatatacaca

SEQ ID NO: 951882 - DNA, 22 bp, Artificial Sequence
  chemically synthesized
gtggggattgtaagcacacaca

SEQ ID NO: 951883 - DNA, 22 bp, Artificial Sequence
  chemically synthesized
aaatctagtggggattgtaagc

SEQ ID NO: 951884 - DNA, 22 bp, Artificial Sequence
  chemically synthesized
aaaatctagtggggattgtaag

SEQ ID NO: 951885 - DNA, 22 bp, Artificial Sequence
  chemically synthesized
agtttaaaatctagtggggatt

SEQ ID NO: 951886 - DNA, 22 bp, Artificial Sequence
  chemically synthesized
gagtttaaaatctagtggggat

SEQ ID NO: 951887 - DNA, 22 bp, Artificial Sequence
  chemically synthesized
tgagtttaaaatctagtgggga

SEQ ID NO: 951888 - DNA, 22 bp, Artificial Sequence
  chemically synthesized
ttgagtttaaaatctagtgggg

SEQ ID NO: 951889 - DNA, 22 bp, Artificial Sequence
  chemically synthesized
ttttgagtttaaaatctagtgg

SEQ ID NO: 951890 - DNA, 22 bp, Artificial Sequence
  chemically synthesized
tcttttgagtttaaaatctagt

SEQ ID NO: 951891 - DNA, 22 bp, Artificial Sequence
  chemically synthesized
acaatccccactagattttaaa

SEQ ID NO: 951892 - DNA, 22 bp, Artificial Sequence
  chemically synthesized
caatccccactagattttaaac

SEQ ID NO: 951893 - DNA, 22 bp, Artificial Sequence
  chemically synthesized
gttctcttttgagtttaaaatc

SEQ ID NO: 951894 - DNA, 22 bp, Artificial Sequence
  chemically synthesized
ttggttctcttttgagtttaaa

SEQ ID NO: 951895 - DNA, 22 bp, Artificial Sequence
  chemically synthesized
gattttaaactcaaaagagaac

SEQ ID NO: 951896 - DNA, 22 bp, Artificial Sequence
  chemically synthesized
taaactcaaaagagaaccaaca

SEQ ID NO: 951897 - DNA, 22 bp, Artificial Sequence
  chemically synthesized
aaactcaaaagagaaccaacaa

SEQ ID NO: 951898 - DNA, 22 bp, Artificial Sequence
  chemically synthesized
aactcaaaagagaaccaacaat

SEQ ID NO: 951899 - DNA, 22 bp, Artificial Sequence
  chemically synthesized
aaaagagaaccaacaatgcctt

SEQ ID NO: 951900 - DNA, 22 bp, Artificial Sequence
  chemically synthesized
aagagagagaagaaaaaatatg

SEQ ID NO: 951901 - DNA, 22 bp, Artificial Sequence
  chemically synthesized
catattttttcttctctctctt

SEQ ID NO: 951902 - DNA, 22 bp, Artificial Sequence
  chemically synthesized
atattttttcttctctctcttc

SEQ ID NO: 951903 - DNA, 22 bp, Artificial Sequence
  chemically synthesized
agggaacacagattgaagagag

SEQ ID NO: 951904 - DNA, 22 bp, Artificial Sequence
  chemically synthesized
tttcttctctctcttcaatctg

SEQ ID NO: 951905 - DNA, 22 bp, Artificial Sequence
  chemically synthesized
ttcttctctctcttcaatctgt

SEQ ID NO: 951906 - DNA, 22 bp, Artificial Sequence
  chemically synthesized
tcttctctctcttcaatctgtg

SEQ ID NO: 951907 - DNA, 22 bp, Artificial Sequence
  chemically synthesized
cttctctctcttcaatctgtgt

SEQ ID NO: 951908 - DNA, 22 bp, Artificial Sequence
  chemically synthesized
ttctctctcttcaatctgtgtt

SEQ ID NO: 951909 - DNA, 22 bp, Artificial Sequence
  chemically synthesized
ctctctcttcaatctgtgttcc

SEQ ID NO: 951910 - DNA, 22 bp, Artificial Sequence
  chemically synthesized
tctctcttcaatctgtgttccc

SEQ ID NO: 951911 - DNA, 22 bp, Artificial Sequence
  chemically synthesized
tctcttcaatctgtgttccctg

SEQ ID NO: 951912 - DNA, 22 bp, Artificial Sequence
  chemically synthesized
tcttcaatctgtgttccctgag

SEQ ID NO: 951913 - DNA, 22 bp, Artificial Sequence
  chemically synthesized
ttcaatctgtgttccctgagat

SEQ ID NO: 951914 - DNA, 22 bp, Artificial Sequence
  chemically synthesized
caatctgtgttccctgagatcc

SEQ ID NO: 951915 - DNA, 22 bp, Artificial Sequence
  chemically synthesized
aatctgtgttccctgagatcct

SEQ ID NO: 951916 - DNA, 22 bp, Artificial Sequence
  chemically synthesized
tgttccctgagatccttttcta

SEQ ID NO: 951917 - DNA, 22 bp, Artificial Sequence
  chemically synthesized
cctgagatccttttctatttgg

SEQ ID NO: 951918 - DNA, 22 bp, Artificial Sequence
  chemically synthesized
aagggccagtgaaccaaataga

SEQ ID NO: 951919 - DNA, 22 bp, Artificial Sequence
  chemically synthesized
agatccttttctatttggttca

SEQ ID NO: 951920 - DNA, 22 bp, Artificial Sequence
  chemically synthesized
gggttaaagggccagtgaacca

SEQ ID NO: 951921 - DNA, 22 bp, Artificial Sequence
  chemically synthesized
ggggttaaagggccagtgaacc

SEQ ID NO: 951922 - DNA, 22 bp, Artificial Sequence
  chemically synthesized
tggggttaaagggccagtgaac

SEQ ID NO: 951923 - DNA, 22 bp, Artificial Sequence
  chemically synthesized
ttctatttggttcactggccct

SEQ ID NO: 951924 - DNA, 22 bp, Artificial Sequence
  chemically synthesized
ctttggggttaaagggccagtg

SEQ ID NO: 951925 - DNA, 22 bp, Artificial Sequence
  chemically synthesized
tctatttggttcactggccctt

SEQ ID NO: 951926 - DNA, 22 bp, Artificial Sequence
  chemically synthesized
ctatttggttcactggcccttt

SEQ ID NO: 951927 - DNA, 22 bp, Artificial Sequence
  chemically synthesized
tatttggttcactggcccttta

SEQ ID NO: 951928 - DNA, 22 bp, Artificial Sequence
  chemically synthesized
tttggttcactggccctttaac

SEQ ID NO: 951929 - DNA, 22 bp, Artificial Sequence
  chemically synthesized
ggttcactggccctttaacccc

SEQ ID NO: 951930 - DNA, 22 bp, Artificial Sequence
  chemically synthesized
gttcactggccctttaacccca

SEQ ID NO: 951931 - DNA, 22 bp, Artificial Sequence
  chemically synthesized
actggccctttaaccccaaagc

SEQ ID NO: 951932 - DNA, 22 bp, Artificial Sequence
  chemically synthesized
cacagagtggaaactgctttgg

SEQ ID NO: 951933 - DNA, 22 bp, Artificial Sequence
  chemically synthesized
gccctttaaccccaaagcagtt

SEQ ID NO: 951934 - DNA, 22 bp, Artificial Sequence
  chemically synthesized
ccacagagtggaaactgctttg

SEQ ID NO: 951935 - DNA, 22 bp, Artificial Sequence
  chemically synthesized
ttccacagagtggaaactgctt

SEQ ID NO: 951936 - DNA, 22 bp, Artificial Sequence
  chemically synthesized
cttccacagagtggaaactgct

SEQ ID NO: 951937 - DNA, 22 bp, Artificial Sequence
  chemically synthesized
taaccccaaagcagtttccact

SEQ ID NO: 951938 - DNA, 22 bp, Artificial Sequence
  chemically synthesized
cttcttccacagagtggaaact

SEQ ID NO: 951939 - DNA, 22 bp, Artificial Sequence
  chemically synthesized
aaccccaaagcagtttccactc

SEQ ID NO: 951940 - DNA, 22 bp, Artificial Sequence
  chemically synthesized
ccttcttccacagagtggaaac

SEQ ID NO: 951941 - DNA, 22 bp, Artificial Sequence
  chemically synthesized
accccaaagcagtttccactct

SEQ ID NO: 951942 - DNA, 22 bp, Artificial Sequence
  chemically synthesized
tttccttcttccacagagtgga

SEQ ID NO: 951943 - DNA, 22 bp, Artificial Sequence
  chemically synthesized
ccactctgtggaagaaggaaat

SEQ ID NO: 951944 - DNA, 22 bp, Artificial Sequence
  chemically synthesized
cactctgtggaagaaggaaata

SEQ ID NO: 951945 - DNA, 22 bp, Artificial Sequence
  chemically synthesized
tgtggaagaaggaaatagtttc

SEQ ID NO: 951946 - DNA, 22 bp, Artificial Sequence
  chemically synthesized
tggaagaaggaaatagtttcat

SEQ ID NO: 951947 - DNA, 22 bp, Artificial Sequence
  chemically synthesized
aatgaagaaacaacccagagcc

SEQ ID NO: 951948 - DNA, 22 bp, Artificial Sequence
  chemically synthesized
cattatattttggctctgggtt

SEQ ID NO: 951949 - DNA, 22 bp, Artificial Sequence
  chemically synthesized
aaatgaagaaacaacccagagc

SEQ ID NO: 951950 - DNA, 22 bp, Artificial Sequence
  chemically synthesized
attatattttggctctgggttg

SEQ ID NO: 951951 - DNA, 22 bp, Artificial Sequence
  chemically synthesized
taaatgaagaaacaacccagag

SEQ ID NO: 951952 - DNA, 22 bp, Artificial Sequence
  chemically synthesized
tattttggctctgggttgtttc

SEQ ID NO: 951953 - DNA, 22 bp, Artificial Sequence
  chemically synthesized
cggttttaaatgaagaaacaac

SEQ ID NO: 951954 - DNA, 22 bp, Artificial Sequence
  chemically synthesized
tggctctgggttgtttcttcat

SEQ ID NO: 951955 - DNA, 22 bp, Artificial Sequence
  chemically synthesized
ggctctgggttgtttcttcatt

SEQ ID NO: 951956 - DNA, 22 bp, Artificial Sequence
  chemically synthesized
gctacggttttaaatgaagaaa

SEQ ID NO: 951957 - DNA, 22 bp, Artificial Sequence
  chemically synthesized
gctctgggttgtttcttcattt

SEQ ID NO: 951958 - DNA, 22 bp, Artificial Sequence
  chemically synthesized
agctacggttttaaatgaagaa

SEQ ID NO: 951959 - DNA, 22 bp, Artificial Sequence
  chemically synthesized
tagctacggttttaaatgaaga

SEQ ID NO: 951960 - DNA, 22 bp, Artificial Sequence
  chemically synthesized
tgggttgtttcttcatttaaaa

SEQ ID NO: 951961 - DNA, 22 bp, Artificial Sequence
  chemically synthesized
ggttgtttcttcatttaaaacc

SEQ ID NO: 951962 - DNA, 22 bp, Artificial Sequence
  chemically synthesized
gactttagctacggttttaaat

SEQ ID NO: 951963 - DNA, 22 bp, Artificial Sequence
  chemically synthesized
tttcttcatttaaaaccgtagc

SEQ ID NO: 951964 - DNA, 22 bp, Artificial Sequence
  chemically synthesized
gtctggactttagctacggttt

SEQ ID NO: 951965 - DNA, 22 bp, Artificial Sequence
  chemically synthesized
tggtctggactttagctacggt

SEQ ID NO: 951966 - DNA, 22 bp, Artificial Sequence
  chemically synthesized
cttcatttaaaaccgtagctaa

SEQ ID NO: 951967 - DNA, 22 bp, Artificial Sequence
  chemically synthesized
ttcatttaaaaccgtagctaaa

SEQ ID NO: 951968 - DNA, 22 bp, Artificial Sequence
  chemically synthesized
tctggtctggactttagctacg

SEQ ID NO: 951969 - DNA, 22 bp, Artificial Sequence
  chemically synthesized
catttaaaaccgtagctaaagt

SEQ ID NO: 951970 - DNA, 22 bp, Artificial Sequence
  chemically synthesized
atttaaaaccgtagctaaagtc

SEQ ID NO: 951971 - DNA, 22 bp, Artificial Sequence
  chemically synthesized
aaaaccgtagctaaagtccaga

SEQ ID NO: 951972 - DNA, 22 bp, Artificial Sequence
  chemically synthesized
aaaccgtagctaaagtccagac

SEQ ID NO: 951973 - DNA, 22 bp, Artificial Sequence
  chemically synthesized
aaatcattctctggtctggact

SEQ ID NO: 951974 - DNA, 22 bp, Artificial Sequence
  chemically synthesized
caaatcattctctggtctggac

SEQ ID NO: 951975 - DNA, 22 bp, Artificial Sequence
  chemically synthesized
tcaaatcattctctggtctgga

SEQ ID NO: 951976 - DNA, 22 bp, Artificial Sequence
  chemically synthesized
aagtccagaccagagaatgatt

SEQ ID NO: 951977 - DNA, 22 bp, Artificial Sequence
  chemically synthesized
aggtatggttttcaaatcattc

SEQ ID NO: 951978 - DNA, 22 bp, Artificial Sequence
  chemically synthesized
aaggtatggttttcaaatcatt

SEQ ID NO: 951979 - DNA, 22 bp, Artificial Sequence
  chemically synthesized
ttaaggtatggttttcaaatca

SEQ ID NO: 951980 - DNA, 22 bp, Artificial Sequence
  chemically synthesized
attcttaaggtatggttttcaa

SEQ ID NO: 951981 - DNA, 22 bp, Artificial Sequence
  chemically synthesized
ggaaaaactcattcttaaggta

SEQ ID NO: 951982 - DNA, 22 bp, Artificial Sequence
  chemically synthesized
gaaaaccataccttaagaatga

SEQ ID NO: 951983 - DNA, 22 bp, Artificial Sequence
  chemically synthesized
aaaaccataccttaagaatgag

SEQ ID NO: 951984 - DNA, 22 bp, Artificial Sequence
  chemically synthesized
tactaggaaaaactcattctta

SEQ ID NO: 951985 - DNA, 22 bp, Artificial Sequence
  chemically synthesized
ctgtactaggaaaaactcattc

SEQ ID NO: 951986 - DNA, 22 bp, Artificial Sequence
  chemically synthesized
tgtctactgtactaggaaaaac

SEQ ID NO: 951987 - DNA, 22 bp, Artificial Sequence
  chemically synthesized
atgtctactgtactaggaaaaa

SEQ ID NO: 951988 - DNA, 22 bp, Artificial Sequence
  chemically synthesized
ttatgtctactgtactaggaaa

SEQ ID NO: 951989 - DNA, 22 bp, Artificial Sequence
  chemically synthesized
aagaatgagtttttcctagtac

SEQ ID NO: 951990 - DNA, 22 bp, Artificial Sequence
  chemically synthesized
agaatgagtttttcctagtaca

SEQ ID NO: 951991 - DNA, 22 bp, Artificial Sequence
  chemically synthesized
ttcctagtacagtagacataag

SEQ ID NO: 951992 - DNA, 22 bp, Artificial Sequence
  chemically synthesized
tcctagtacagtagacataaga

SEQ ID NO: 951993 - DNA, 22 bp, Artificial Sequence
  chemically synthesized
cctagtacagtagacataagaa

SEQ ID NO: 951994 - DNA, 22 bp, Artificial Sequence
  chemically synthesized
ctagtacagtagacataagaac

SEQ ID NO: 951995 - DNA, 22 bp, Artificial Sequence
  chemically synthesized
gtacagtagacataagaactct

SEQ ID NO: 951996 - DNA, 22 bp, Artificial Sequence
  chemically synthesized
ccccccatccagagagttctta

SEQ ID NO: 951997 - DNA, 22 bp, Artificial Sequence
  chemically synthesized
actcccccccatccagagagtt

SEQ ID NO: 951998 - DNA, 22 bp, Artificial Sequence
  chemically synthesized
gactcccccccatccagagagt

SEQ ID NO: 951999 - DNA, 22 bp, Artificial Sequence
  chemically synthesized
tgactcccccccatccagagag

SEQ ID NO: 952000 - DNA, 22 bp, Artificial Sequence
  chemically synthesized
ttgactcccccccatccagaga

SEQ ID NO: 952001 - DNA, 22 bp, Artificial Sequence
  chemically synthesized
tttgactcccccccatccagag

SEQ ID NO: 952002 - DNA, 22 bp, Artificial Sequence
  chemically synthesized
tttttgactcccccccatccag

SEQ ID NO: 952003 - DNA, 22 bp, Artificial Sequence
  chemically synthesized
ctttttgactcccccccatcca

SEQ ID NO: 952004 - DNA, 22 bp, Artificial Sequence
  chemically synthesized
tctttttgactcccccccatcc

SEQ ID NO: 952005 - DNA, 22 bp, Artificial Sequence
  chemically synthesized
cccaactttctttttgactccc

SEQ ID NO: 952006 - DNA, 22 bp, Artificial Sequence
  chemically synthesized
tctggatgggggggagtcaaaa

SEQ ID NO: 952007 - DNA, 22 bp, Artificial Sequence
  chemically synthesized
tggatgggggggagtcaaaaag

SEQ ID NO: 952008 - DNA, 22 bp, Artificial Sequence
  chemically synthesized
ctccccaactttctttttgact

SEQ ID NO: 952009 - DNA, 22 bp, Artificial Sequence
  chemically synthesized
cctccccaactttctttttgac

SEQ ID NO: 952010 - DNA, 22 bp, Artificial Sequence
  chemically synthesized
gatgggggggagtcaaaaagaa

SEQ ID NO: 952011 - DNA, 22 bp, Artificial Sequence
  chemically synthesized
cttcctccccaactttcttttt

SEQ ID NO: 952012 - DNA, 22 bp, Artificial Sequence
  chemically synthesized
gcttcctccccaactttctttt

SEQ ID NO: 952013 - DNA, 22 bp, Artificial Sequence
  chemically synthesized
ttgcttcctccccaactttctt

SEQ ID NO: 952014 - DNA, 22 bp, Artificial Sequence
  chemically synthesized
cttgcttcctccccaactttct

SEQ ID NO: 952015 - DNA, 22 bp, Artificial Sequence
  chemically synthesized
tcttgcttcctccccaactttc

SEQ ID NO: 952016 - DNA, 22 bp, Artificial Sequence
  chemically synthesized
attttcttgcttcctccccaac

SEQ ID NO: 952017 - DNA, 22 bp, Artificial Sequence
  chemically synthesized
caagcatctaattttcttgctt

SEQ ID NO: 952018 - DNA, 22 bp, Artificial Sequence
  chemically synthesized
gggaggaagcaagaaaattaga

SEQ ID NO: 952019 - DNA, 22 bp, Artificial Sequence
  chemically synthesized
ggaaacctacaagcatctaatt

SEQ ID NO: 952020 - DNA, 22 bp, Artificial Sequence
  chemically synthesized
cggaaacctacaagcatctaat

SEQ ID NO: 952021 - DNA, 22 bp, Artificial Sequence
  chemically synthesized
ttcggaaacctacaagcatcta

SEQ ID NO: 952022 - DNA, 22 bp, Artificial Sequence
  chemically synthesized
gatgcttgtaggtttccgaaga

SEQ ID NO: 952023 - DNA, 22 bp, Artificial Sequence
  chemically synthesized
ccacatcaggccccctcttcgg

SEQ ID NO: 952024 - DNA, 22 bp, Artificial Sequence
  chemically synthesized
gtaggtttccgaagagggggcc

SEQ ID NO: 952025 - DNA, 22 bp, Artificial Sequence
  chemically synthesized
taggtttccgaagagggggcct

SEQ ID NO: 952026 - DNA, 22 bp, Artificial Sequence
  chemically synthesized
atgaaatactgccacatcaggc

SEQ ID NO: 952027 - DNA, 22 bp, Artificial Sequence
  chemically synthesized
ccgaagagggggcctgatgtgg

SEQ ID NO: 952028 - DNA, 22 bp, Artificial Sequence
  chemically synthesized
cgaagagggggcctgatgtggc

SEQ ID NO: 952029 - DNA, 22 bp, Artificial Sequence
  chemically synthesized
ctgatgaaatactgccacatca

SEQ ID NO: 952030 - DNA, 22 bp, Artificial Sequence
  chemically synthesized
gctgatgaaatactgccacatc

SEQ ID NO: 952031 - DNA, 22 bp, Artificial Sequence
  chemically synthesized
ttgctgatgaaatactgccaca

SEQ ID NO: 952032 - DNA, 22 bp, Artificial Sequence
  chemically synthesized
cttgctgatgaaatactgccac

SEQ ID NO: 952033 - DNA, 22 bp, Artificial Sequence
  chemically synthesized
cccttcttgctgatgaaatact

SEQ ID NO: 952034 - DNA, 22 bp, Artificial Sequence
  chemically synthesized
gcccttcttgctgatgaaatac

SEQ ID NO: 952035 - DNA, 22 bp, Artificial Sequence
  chemically synthesized
tgcccttcttgctgatgaaata

SEQ ID NO: 952036 - DNA, 22 bp, Artificial Sequence
  chemically synthesized
atgtggcagtatttcatcagca

SEQ ID NO: 952037 - DNA, 22 bp, Artificial Sequence
  chemically synthesized
cctttgcccttcttgctgatga

SEQ ID NO: 952038 - DNA, 22 bp, Artificial Sequence
  chemically synthesized
gtgaatctgcctttgcccttct

SEQ ID NO: 952039 - DNA, 22 bp, Artificial Sequence
  chemically synthesized
agtgaatctgcctttgcccttc

SEQ ID NO: 952040 - DNA, 22 bp, Artificial Sequence
  chemically synthesized
catcagcaagaagggcaaaggc

SEQ ID NO: 952041 - DNA, 22 bp, Artificial Sequence
  chemically synthesized
atcagcaagaagggcaaaggca

SEQ ID NO: 952042 - DNA, 22 bp, Artificial Sequence
  chemically synthesized
aagaaatttagtgaatctgcct

SEQ ID NO: 952043 - DNA, 22 bp, Artificial Sequence
  chemically synthesized
aggcctcaagaaatttagtgaa

SEQ ID NO: 952044 - DNA, 22 bp, Artificial Sequence
  chemically synthesized
tgaggcctcaagaaatttagtg

SEQ ID NO: 952045 - DNA, 22 bp, Artificial Sequence
  chemically synthesized
cactctgaggcctcaagaaatt

SEQ ID NO: 952046 - DNA, 22 bp, Artificial Sequence
  chemically synthesized
gctgcactctgaggcctcaaga

SEQ ID NO: 952047 - DNA, 22 bp, Artificial Sequence
  chemically synthesized
ctggctgcactctgaggcctca

SEQ ID NO: 952048 - DNA, 22 bp, Artificial Sequence
  chemically synthesized
actaaatttcttgaggcctcag

SEQ ID NO: 952049 - DNA, 22 bp, Artificial Sequence
  chemically synthesized
gctggctgcactctgaggcctc

SEQ ID NO: 952050 - DNA, 22 bp, Artificial Sequence
  chemically synthesized
aatttcttgaggcctcagagtg

SEQ ID NO: 952051 - DNA, 22 bp, Artificial Sequence
  chemically synthesized
cttgaggcctcagagtgcagcc

SEQ ID NO: 952052 - DNA, 22 bp, Artificial Sequence
  chemically synthesized
ttgaggcctcagagtgcagcca

SEQ ID NO: 952053 - DNA, 22 bp, Artificial Sequence
  chemically synthesized
gaggcctcagagtgcagccagc

SEQ ID NO: 952054 - DNA, 22 bp, Artificial Sequence
  chemically synthesized
aggcctcagagtgcagccagca

SEQ ID NO: 952055 - DNA, 22 bp, Artificial Sequence
  chemically synthesized
agagtgcagccagcaagtggct

SEQ ID NO: 952056 - DNA, 22 bp, Artificial Sequence
  chemically synthesized
agggacaggaaaaatgtagcca

SEQ ID NO: 952057 - DNA, 22 bp, Artificial Sequence
  chemically synthesized
cagggacaggaaaaatgtagcc

SEQ ID NO: 952058 - DNA, 22 bp, Artificial Sequence
  chemically synthesized
tcagggacaggaaaaatgtagc

SEQ ID NO: 952059 - DNA, 22 bp, Artificial Sequence
  chemically synthesized
ttcagggacaggaaaaatgtag

SEQ ID NO: 952060 - DNA, 22 bp, Artificial Sequence
  chemically synthesized
ttttcagggacaggaaaaatgt

SEQ ID NO: 952061 - DNA, 22 bp, Artificial Sequence
  chemically synthesized
ccacactcttttcagggacagg

SEQ ID NO: 952062 - DNA, 22 bp, Artificial Sequence
  chemically synthesized
catttttcctgtccctgaaaag

SEQ ID NO: 952063 - DNA, 22 bp, Artificial Sequence
  chemically synthesized
agtcaactcccacactcttttc

SEQ ID NO: 952064 - DNA, 22 bp, Artificial Sequence
  chemically synthesized
ttcctgtccctgaaaagagtgt

SEQ ID NO: 952065 - DNA, 22 bp, Artificial Sequence
  chemically synthesized
tcctgtccctgaaaagagtgtg

SEQ ID NO: 952066 - DNA, 22 bp, Artificial Sequence
  chemically synthesized
cctgtccctgaaaagagtgtgg

SEQ ID NO: 952067 - DNA, 22 bp, Artificial Sequence
  chemically synthesized
ctcagtcaactcccacactctt

SEQ ID NO: 952068 - DNA, 22 bp, Artificial Sequence
  chemically synthesized
ctgtccctgaaaagagtgtggg

SEQ ID NO: 952069 - DNA, 22 bp, Artificial Sequence
  chemically synthesized
cctcagtcaactcccacactct

SEQ ID NO: 952070 - DNA, 22 bp, Artificial Sequence
  chemically synthesized
tcctcagtcaactcccacactc

SEQ ID NO: 952071 - DNA, 22 bp, Artificial Sequence
  chemically synthesized
ttcctcagtcaactcccacact

SEQ ID NO: 952072 - DNA, 22 bp, Artificial Sequence
  chemically synthesized
tccctgaaaagagtgtgggagt

SEQ ID NO: 952073 - DNA, 22 bp, Artificial Sequence
  chemically synthesized
ttttcctcagtcaactcccaca

SEQ ID NO: 952074 - DNA, 22 bp, Artificial Sequence
  chemically synthesized
aaaagagtgtgggagttgactg

SEQ ID NO: 952075 - DNA, 22 bp, Artificial Sequence
  chemically synthesized
tgaccaactcttttcctcagtc

SEQ ID NO: 952076 - DNA, 22 bp, Artificial Sequence
  chemically synthesized
ctatgaccaactcttttcctca

SEQ ID NO: 952077 - DNA, 22 bp, Artificial Sequence
  chemically synthesized
gctatgaccaactcttttcctc

SEQ ID NO: 952078 - DNA, 22 bp, Artificial Sequence
  chemically synthesized
ttgctatgaccaactcttttcc

SEQ ID NO: 952079 - DNA, 22 bp, Artificial Sequence
  chemically synthesized
actgaggaaaagagttggtcat

SEQ ID NO: 952080 - DNA, 22 bp, Artificial Sequence
  chemically synthesized
agcatctcttgctatgaccaac

SEQ ID NO: 952081 - DNA, 22 bp, Artificial Sequence
  chemically synthesized
aggaaaagagttggtcatagca

SEQ ID NO: 952082 - DNA, 22 bp, Artificial Sequence
  chemically synthesized
agttaagcatctcttgctatga

SEQ ID NO: 952083 - DNA, 22 bp, Artificial Sequence
  chemically synthesized
cagttaagcatctcttgctatg

SEQ ID NO: 952084 - DNA, 22 bp, Artificial Sequence
  chemically synthesized
tcagttaagcatctcttgctat

SEQ ID NO: 952085 - DNA, 22 bp, Artificial Sequence
  chemically synthesized
ttcagttaagcatctcttgcta

SEQ ID NO: 952086 - DNA, 22 bp, Artificial Sequence
  chemically synthesized
gtcatagcaagagatgcttaac

SEQ ID NO: 952087 - DNA, 22 bp, Artificial Sequence
  chemically synthesized
catggcccatgcagcttttcag

SEQ ID NO: 952088 - DNA, 22 bp, Artificial Sequence
  chemically synthesized
acactgcatggcccatgcagct

SEQ ID NO: 952089 - DNA, 22 bp, Artificial Sequence
  chemically synthesized
aacactgcatggcccatgcagc

SEQ ID NO: 952090 - DNA, 22 bp, Artificial Sequence
  chemically synthesized
aactgaaaagctgcatgggcca

SEQ ID NO: 952091 - DNA, 22 bp, Artificial Sequence
  chemically synthesized
actgaaaagctgcatgggccat

SEQ ID NO: 952092 - DNA, 22 bp, Artificial Sequence
  chemically synthesized
agtttaacactgcatggcccat

SEQ ID NO: 952093 - DNA, 22 bp, Artificial Sequence
  chemically synthesized
gagtttaacactgcatggccca

SEQ ID NO: 952094 - DNA, 22 bp, Artificial Sequence
  chemically synthesized
aaaagctgcatgggccatgcag

SEQ ID NO: 952095 - DNA, 22 bp, Artificial Sequence
  chemically synthesized
ttgagtttaacactgcatggcc

SEQ ID NO: 952096 - DNA, 22 bp, Artificial Sequence
  chemically synthesized
cttgagtttaacactgcatggc

SEQ ID NO: 952097 - DNA, 22 bp, Artificial Sequence
  chemically synthesized
aatttcttgagtttaacactgc

SEQ ID NO: 952098 - DNA, 22 bp, Artificial Sequence
  chemically synthesized
catgggccatgcagtgttaaac

SEQ ID NO: 952099 - DNA, 22 bp, Artificial Sequence
  chemically synthesized
aaggcctcaatttcttgagttt

SEQ ID NO: 952100 - DNA, 22 bp, Artificial Sequence
  chemically synthesized
tcaaggcctcaatttcttgagt

SEQ ID NO: 952101 - DNA, 22 bp, Artificial Sequence
  chemically synthesized
ctcaaggcctcaatttcttgag

SEQ ID NO: 952102 - DNA, 22 bp, Artificial Sequence
  chemically synthesized
aactcaagaaattgaggccttg

SEQ ID NO: 952103 - DNA, 22 bp, Artificial Sequence
  chemically synthesized
aagaaattgaggccttgagaag

SEQ ID NO: 952104 - DNA, 22 bp, Artificial Sequence
  chemically synthesized
cccatgggtccccttctcaagg

SEQ ID NO: 952105 - DNA, 22 bp, Artificial Sequence
  chemically synthesized
agcatctgcccatgggtcccct

SEQ ID NO: 952106 - DNA, 22 bp, Artificial Sequence
  chemically synthesized
aggccttgagaaggggacccat

SEQ ID NO: 952107 - DNA, 22 bp, Artificial Sequence
  chemically synthesized
gagcatctgcccatgggtcccc

SEQ ID NO: 952108 - DNA, 22 bp, Artificial Sequence
  chemically synthesized
ttgagcatctgcccatgggtcc

SEQ ID NO: 952109 - DNA, 22 bp, Artificial Sequence
  chemically synthesized
ctcttgagcatctgcccatggg

SEQ ID NO: 952110 - DNA, 22 bp, Artificial Sequence
  chemically synthesized
actcttgagcatctgcccatgg

SEQ ID NO: 952111 - DNA, 22 bp, Artificial Sequence
  chemically synthesized
gagaaggggacccatgggcaga

SEQ ID NO: 952112 - DNA, 22 bp, Artificial Sequence
  chemically synthesized
tactcttgagcatctgcccatg

SEQ ID NO: 952113 - DNA, 22 bp, Artificial Sequence
  chemically synthesized
agaaggggacccatgggcagat

SEQ ID NO: 952114 - DNA, 22 bp, Artificial Sequence
  chemically synthesized
aatgtctttactcttgagcatc

SEQ ID NO: 952115 - DNA, 22 bp, Artificial Sequence
  chemically synthesized
tgaatgtctttactcttgagca

SEQ ID NO: 952116 - DNA, 22 bp, Artificial Sequence
  chemically synthesized
gttctgaatgtctttactcttg

SEQ ID NO: 952117 - DNA, 22 bp, Artificial Sequence
  chemically synthesized
ggttctgaatgtctttactctt

SEQ ID NO: 952118 - DNA, 22 bp, Artificial Sequence
  chemically synthesized
caccttggttctgaatgtcttt

SEQ ID NO: 952119 - DNA, 22 bp, Artificial Sequence
  chemically synthesized
tctgcaccttggttctgaatgt

SEQ ID NO: 952120 - DNA, 22 bp, Artificial Sequence
  chemically synthesized
gtctgcaccttggttctgaatg

SEQ ID NO: 952121 - DNA, 22 bp, Artificial Sequence
  chemically synthesized
aagagtaaagacattcagaacc

SEQ ID NO: 952122 - DNA, 22 bp, Artificial Sequence
  chemically synthesized
tgtctgcaccttggttctgaat

SEQ ID NO: 952123 - DNA, 22 bp, Artificial Sequence
  chemically synthesized
tggatgcacggttttgtctgca

SEQ ID NO: 952124 - DNA, 22 bp, Artificial Sequence
  chemically synthesized
atggatgcacggttttgtctgc

SEQ ID NO: 952125 - DNA, 22 bp, Artificial Sequence
  chemically synthesized
agaaccaaggtgcagacaaaac

SEQ ID NO: 952126 - DNA, 22 bp, Artificial Sequence
  chemically synthesized
tcttatggatgcacggttttgt

SEQ ID NO: 952127 - DNA, 22 bp, Artificial Sequence
  chemically synthesized
ttatcttatggatgcacggttt

SEQ ID NO: 952128 - DNA, 22 bp, Artificial Sequence
  chemically synthesized
tatacattgttatcttatggat

SEQ ID NO: 952129 - DNA, 22 bp, Artificial Sequence
  chemically synthesized
aggggatgtgtctgtatacatt

SEQ ID NO: 952130 - DNA, 22 bp, Artificial Sequence
  chemically synthesized
caggggatgtgtctgtatacat

SEQ ID NO: 952131 - DNA, 22 bp, Artificial Sequence
  chemically synthesized
atgaagcacgtatggccttcag

SEQ ID NO: 952132 - DNA, 22 bp, Artificial Sequence
  chemically synthesized
ccaagtgttcatgaagcacgta

SEQ ID NO: 952133 - DNA, 22 bp, Artificial Sequence
  chemically synthesized
aaggccatacgtgcttcatgaa

SEQ ID NO: 952134 - DNA, 22 bp, Artificial Sequence
  chemically synthesized
tgtaggcatcccagttcccaag

SEQ ID NO: 952135 - DNA, 22 bp, Artificial Sequence
  chemically synthesized
tgtgtaggcatcccagttccca

SEQ ID NO: 952136 - DNA, 22 bp, Artificial Sequence
  chemically synthesized
ctgtgtaggcatcccagttccc

SEQ ID NO: 952137 - DNA, 22 bp, Artificial Sequence
  chemically synthesized
catgaacacttgggaactggga

SEQ ID NO: 952138 - DNA, 22 bp, Artificial Sequence
  chemically synthesized
tctgtgtaggcatcccagttcc

SEQ ID NO: 952139 - DNA, 22 bp, Artificial Sequence
  chemically synthesized
atgaacacttgggaactgggat

SEQ ID NO: 952140 - DNA, 22 bp, Artificial Sequence
  chemically synthesized
tttctgtgtaggcatcccagtt

SEQ ID NO: 952141 - DNA, 22 bp, Artificial Sequence
  chemically synthesized
ctttctgtgtaggcatcccagt

SEQ ID NO: 952142 - DNA, 22 bp, Artificial Sequence
  chemically synthesized
gggaactgggatgcctacacag

SEQ ID NO: 952143 - DNA, 22 bp, Artificial Sequence
  chemically synthesized
cccatcttctttctgtgtaggc

SEQ ID NO: 952144 - DNA, 22 bp, Artificial Sequence
  chemically synthesized
ggaactgggatgcctacacaga

SEQ ID NO: 952145 - DNA, 22 bp, Artificial Sequence
  chemically synthesized
ctccccatcttctttctgtgta

SEQ ID NO: 952146 - DNA, 22 bp, Artificial Sequence
  chemically synthesized
ttcctccccatcttctttctgt

SEQ ID NO: 952147 - DNA, 22 bp, Artificial Sequence
  chemically synthesized
ggatgcctacacagaaagaaga

SEQ ID NO: 952148 - DNA, 22 bp, Artificial Sequence
  chemically synthesized
ggattgttcctccccatcttct

SEQ ID NO: 952149 - DNA, 22 bp, Artificial Sequence
  chemically synthesized
aggattgttcctccccatcttc

SEQ ID NO: 952150 - DNA, 22 bp, Artificial Sequence
  chemically synthesized
cacagaaagaagatggggagga

SEQ ID NO: 952151 - DNA, 22 bp, Artificial Sequence
  chemically synthesized
catttaggattgttcctcccca

SEQ ID NO: 952152 - DNA, 22 bp, Artificial Sequence
  chemically synthesized
ccatttaggattgttcctcccc

SEQ ID NO: 952153 - DNA, 22 bp, Artificial Sequence
  chemically synthesized
gtttccatttaggattgttcct

SEQ ID NO: 952154 - DNA, 22 bp, Artificial Sequence
  chemically synthesized
attggtttccatttaggattgt

SEQ ID NO: 952155 - DNA, 22 bp, Artificial Sequence
  chemically synthesized
cattggtttccatttaggattg

SEQ ID NO: 952156 - DNA, 22 bp, Artificial Sequence
  chemically synthesized
ttcattggtttccatttaggat

SEQ ID NO: 952157 - DNA, 22 bp, Artificial Sequence
  chemically synthesized
cttcattggtttccatttagga

SEQ ID NO: 952158 - DNA, 22 bp, Artificial Sequence
  chemically synthesized
tcttcattggtttccatttagg

SEQ ID NO: 952159 - DNA, 22 bp, Artificial Sequence
  chemically synthesized
aggttttcttcattggtttcca

SEQ ID NO: 952160 - DNA, 22 bp, Artificial Sequence
  chemically synthesized
caggttttcttcattggtttcc

SEQ ID NO: 952161 - DNA, 22 bp, Artificial Sequence
  chemically synthesized
atttcaggttttcttcattggt

SEQ ID NO: 952162 - DNA, 22 bp, Artificial Sequence
  chemically synthesized
aatggaaaccaatgaagaaaac

SEQ ID NO: 952163 - DNA, 22 bp, Artificial Sequence
  chemically synthesized
aagacagaaaacataaccatat

SEQ ID NO: 952164 - DNA, 22 bp, Artificial Sequence
  chemically synthesized
gaagacagaaaacataaccata

SEQ ID NO: 952165 - DNA, 22 bp, Artificial Sequence
  chemically synthesized
cttgaagacagaaaacataacc

SEQ ID NO: 952166 - DNA, 22 bp, Artificial Sequence
  chemically synthesized
aaatcaatatggttatgttttc

SEQ ID NO: 952167 - DNA, 22 bp, Artificial Sequence
  chemically synthesized
tacttgaagacagaaaacataa

SEQ ID NO: 952168 - DNA, 22 bp, Artificial Sequence
  chemically synthesized
ctacttgaagacagaaaacata

SEQ ID NO: 952169 - DNA, 22 bp, Artificial Sequence
  chemically synthesized
tctacttgaagacagaaaacat

SEQ ID NO: 952170 - DNA, 22 bp, Artificial Sequence
  chemically synthesized
tgttttctgtcttcaagtagaa

SEQ ID NO: 952171 - DNA, 22 bp, Artificial Sequence
  chemically synthesized
tctgtcttcaagtagaaagggg

SEQ ID NO: 952172 - DNA, 22 bp, Artificial Sequence
  chemically synthesized
ctgtcttcaagtagaaaggggt

SEQ ID NO: 952173 - DNA, 22 bp, Artificial Sequence
  chemically synthesized
tgtcttcaagtagaaaggggtc

SEQ ID NO: 952174 - DNA, 22 bp, Artificial Sequence
  chemically synthesized
aatggatggacatgaccccttt

SEQ ID NO: 952175 - DNA, 22 bp, Artificial Sequence
  chemically synthesized
tcttcaagtagaaaggggtcat

SEQ ID NO: 952176 - DNA, 22 bp, Artificial Sequence
  chemically synthesized
gaatggatggacatgacccctt

SEQ ID NO: 952177 - DNA, 22 bp, Artificial Sequence
  chemically synthesized
tgaatggatggacatgacccct

SEQ ID NO: 952178 - DNA, 22 bp, Artificial Sequence
  chemically synthesized
ttgaatggatggacatgacccc

SEQ ID NO: 952179 - DNA, 22 bp, Artificial Sequence
  chemically synthesized
caagtagaaaggggtcatgtcc

SEQ ID NO: 952180 - DNA, 22 bp, Artificial Sequence
  chemically synthesized
ttttgaatggatggacatgacc

SEQ ID NO: 952181 - DNA, 22 bp, Artificial Sequence
  chemically synthesized
aagtagaaaggggtcatgtcca

SEQ ID NO: 952182 - DNA, 22 bp, Artificial Sequence
  chemically synthesized
gccattcttttgaatggatgga

SEQ ID NO: 952183 - DNA, 22 bp, Artificial Sequence
  chemically synthesized
agccattcttttgaatggatgg

SEQ ID NO: 952184 - DNA, 22 bp, Artificial Sequence
  chemically synthesized
atcttagccattcttttgaatg

SEQ ID NO: 952185 - DNA, 22 bp, Artificial Sequence
  chemically synthesized
atctcatcttagccattctttt

SEQ ID NO: 952186 - DNA, 22 bp, Artificial Sequence
  chemically synthesized
aaaagaatggctaagatgagat

SEQ ID NO: 952187 - DNA, 22 bp, Artificial Sequence
  chemically synthesized
agatgagattaatcttgcattt

SEQ ID NO: 952188 - DNA, 22 bp, Artificial Sequence
  chemically synthesized
gggaaaatgcatccgggaaatg

SEQ ID NO: 952189 - DNA, 22 bp, Artificial Sequence
  chemically synthesized
ggggaaaatgcatccgggaaat

SEQ ID NO: 952190 - DNA, 22 bp, Artificial Sequence
  chemically synthesized
atcttgcatttcccggatgcat

SEQ ID NO: 952191 - DNA, 22 bp, Artificial Sequence
  chemically synthesized
caacttggggaaaatgcatccg

SEQ ID NO: 952192 - DNA, 22 bp, Artificial Sequence
  chemically synthesized
gcatttcccggatgcattttcc

SEQ ID NO: 952193 - DNA, 22 bp, Artificial Sequence
  chemically synthesized
catttcccggatgcattttccc

SEQ ID NO: 952194 - DNA, 22 bp, Artificial Sequence
  chemically synthesized
cactccaacttggggaaaatgc

SEQ ID NO: 952195 - DNA, 22 bp, Artificial Sequence
  chemically synthesized
acactccaacttggggaaaatg

SEQ ID NO: 952196 - DNA, 22 bp, Artificial Sequence
  chemically synthesized
cccggatgcattttccccaagt

SEQ ID NO: 952197 - DNA, 22 bp, Artificial Sequence
  chemically synthesized
gcttacactccaacttggggaa

SEQ ID NO: 952198 - DNA, 22 bp, Artificial Sequence
  chemically synthesized
ccggatgcattttccccaagtt

SEQ ID NO: 952199 - DNA, 22 bp, Artificial Sequence
  chemically synthesized
caaagagctggcttacactcca

SEQ ID NO: 952200 - DNA, 22 bp, Artificial Sequence
  chemically synthesized
tccccaagttggagtgtaagcc

SEQ ID NO: 952201 - DNA, 22 bp, Artificial Sequence
  chemically synthesized
ccccaagttggagtgtaagcca

SEQ ID NO: 952202 - DNA, 22 bp, Artificial Sequence
  chemically synthesized
cccaagttggagtgtaagccag

SEQ ID NO: 952203 - DNA, 22 bp, Artificial Sequence
  chemically synthesized
aagctccaaagagctggcttac

SEQ ID NO: 952204 - DNA, 22 bp, Artificial Sequence
  chemically synthesized
taaagctccaaagagctggctt

SEQ ID NO: 952205 - DNA, 22 bp, Artificial Sequence
  chemically synthesized
gttctaaagctccaaagagctg

SEQ ID NO: 952206 - DNA, 22 bp, Artificial Sequence
  chemically synthesized
agttctaaagctccaaagagct

SEQ ID NO: 952207 - DNA, 22 bp, Artificial Sequence
  chemically synthesized
gagtgtaagccagctctttgga

SEQ ID NO: 952208 - DNA, 22 bp, Artificial Sequence
  chemically synthesized
tttggagctttagaactaagca

SEQ ID NO: 952209 - DNA, 22 bp, Artificial Sequence
  chemically synthesized
tggagctttagaactaagcatc

SEQ ID NO: 952210 - DNA, 22 bp, Artificial Sequence
  chemically synthesized
ggagctttagaactaagcatca

SEQ ID NO: 952211 - DNA, 22 bp, Artificial Sequence
  chemically synthesized
gagctttagaactaagcatcat

SEQ ID NO: 952212 - DNA, 22 bp, Artificial Sequence
  chemically synthesized
tagaactaagcatcatctcttc

SEQ ID NO: 952213 - DNA, 22 bp, Artificial Sequence
  chemically synthesized
agaactaagcatcatctcttct

SEQ ID NO: 952214 - DNA, 22 bp, Artificial Sequence
  chemically synthesized
gaactaagcatcatctcttctt

SEQ ID NO: 952215 - DNA, 22 bp, Artificial Sequence
  chemically synthesized
agcatcatctcttcttccttgc

SEQ ID NO: 952216 - DNA, 22 bp, Artificial Sequence
  chemically synthesized
aatagaacatatgtcagcaagg

SEQ ID NO: 952217 - DNA, 22 bp, Artificial Sequence
  chemically synthesized
ttcttccttgctgacatatgtt

SEQ ID NO: 952218 - DNA, 22 bp, Artificial Sequence
  chemically synthesized
cttccttgctgacatatgttct

SEQ ID NO: 952219 - DNA, 22 bp, Artificial Sequence
  chemically synthesized
ttccttgctgacatatgttcta

SEQ ID NO: 952220 - DNA, 22 bp, Artificial Sequence
  chemically synthesized
ccttgctgacatatgttctatt

SEQ ID NO: 952221 - DNA, 22 bp, Artificial Sequence
  chemically synthesized
cttgctgacatatgttctattg

SEQ ID NO: 952222 - DNA, 22 bp, Artificial Sequence
  chemically synthesized
agaaaagatgttcaatagaaca

SEQ ID NO: 952223 - DNA, 22 bp, Artificial Sequence
  chemically synthesized
gagaaaagatgttcaatagaac

SEQ ID NO: 952224 - DNA, 22 bp, Artificial Sequence
  chemically synthesized
tgagaaaagatgttcaatagaa

SEQ ID NO: 952225 - DNA, 22 bp, Artificial Sequence
  chemically synthesized
gctgacatatgttctattgaac

SEQ ID NO: 952226 - DNA, 22 bp, Artificial Sequence
  chemically synthesized
ctgacatatgttctattgaaca

SEQ ID NO: 952227 - DNA, 22 bp, Artificial Sequence
  chemically synthesized
ttttgagaaaagatgttcaata

SEQ ID NO: 952228 - DNA, 22 bp, Artificial Sequence
  chemically synthesized
acatatgttctattgaacatct

SEQ ID NO: 952229 - DNA, 22 bp, Artificial Sequence
  chemically synthesized
tattgaacatcttttctcaaaa

SEQ ID NO: 952230 - DNA, 22 bp, Artificial Sequence
  chemically synthesized
ttgaacatcttttctcaaaata

SEQ ID NO: 952231 - DNA, 22 bp, Artificial Sequence
  chemically synthesized
aacatcttttctcaaaatagac

SEQ ID NO: 952232 - DNA, 22 bp, Artificial Sequence
  chemically synthesized
aatgtgggcgaaacaggtctat

SEQ ID NO: 952233 - DNA, 22 bp, Artificial Sequence
  chemically synthesized
caatgtgggcgaaacaggtcta

SEQ ID NO: 952234 - DNA, 22 bp, Artificial Sequence
  chemically synthesized
tcaatgtgggcgaaacaggtct

SEQ ID NO: 952235 - DNA, 22 bp, Artificial Sequence
  chemically synthesized
ttctcaaaatagacctgtttcg

SEQ ID NO: 952236 - DNA, 22 bp, Artificial Sequence
  chemically synthesized
tctcaaaatagacctgtttcgc

SEQ ID NO: 952237 - DNA, 22 bp, Artificial Sequence
  chemically synthesized
ctcaaaatagacctgtttcgcc

SEQ ID NO: 952238 - DNA, 22 bp, Artificial Sequence
  chemically synthesized
tcaaaatagacctgtttcgccc

SEQ ID NO: 952239 - DNA, 22 bp, Artificial Sequence
  chemically synthesized
aaaatagacctgtttcgcccac

SEQ ID NO: 952240 - DNA, 22 bp, Artificial Sequence
  chemically synthesized
acagattttcaatgtgggcgaa

SEQ ID NO: 952241 - DNA, 22 bp, Artificial Sequence
  chemically synthesized
gacagattttcaatgtgggcga

SEQ ID NO: 952242 - DNA, 22 bp, Artificial Sequence
  chemically synthesized
ccttgacagattttcaatgtgg

SEQ ID NO: 952243 - DNA, 22 bp, Artificial Sequence
  chemically synthesized
tttcgcccacattgaaaatctg

SEQ ID NO: 952244 - DNA, 22 bp, Artificial Sequence
  chemically synthesized
cgcccacattgaaaatctgtca

SEQ ID NO: 952245 - DNA, 22 bp, Artificial Sequence
  chemically synthesized
gcccacattgaaaatctgtcaa

SEQ ID NO: 952246 - DNA, 22 bp, Artificial Sequence
  chemically synthesized
aaaatctgtcaaggcaggtctc

SEQ ID NO: 952247 - DNA, 22 bp, Artificial Sequence
  chemically synthesized
tcaaggcaggtctctcccccct

SEQ ID NO: 952248 - DNA, 22 bp, Artificial Sequence
  chemically synthesized
tggagatcaccaggaagggggg

SEQ ID NO: 952249 - DNA, 22 bp, Artificial Sequence
  chemically synthesized
gtggagatcaccaggaaggggg

SEQ ID NO: 952250 - DNA, 22 bp, Artificial Sequence
  chemically synthesized
caacacttgtggagatcaccag

SEQ ID NO: 952251 - DNA, 22 bp, Artificial Sequence
  chemically synthesized
ccaacacttgtggagatcacca

SEQ ID NO: 952252 - DNA, 22 bp, Artificial Sequence
  chemically synthesized
tccccccttcctggtgatctcc

SEQ ID NO: 952253 - DNA, 22 bp, Artificial Sequence
  chemically synthesized
cccccttcctggtgatctccac

SEQ ID NO: 952254 - DNA, 22 bp, Artificial Sequence
  chemically synthesized
cctggtgatctccacaagtgtt

SEQ ID NO: 952255 - DNA, 22 bp, Artificial Sequence
  chemically synthesized
ctggtgatctccacaagtgttg

SEQ ID NO: 952256 - DNA, 22 bp, Artificial Sequence
  chemically synthesized
gtgatctccacaagtgttggaa

SEQ ID NO: 952257 - DNA, 22 bp, Artificial Sequence
  chemically synthesized
ccaggacatcccttccaacact

SEQ ID NO: 952258 - DNA, 22 bp, Artificial Sequence
  chemically synthesized
cacaagtgttggaagggatgtc

SEQ ID NO: 952259 - DNA, 22 bp, Artificial Sequence
  chemically synthesized
gaagggatgtcctggcagtcgt

SEQ ID NO: 952260 - DNA, 22 bp, Artificial Sequence
  chemically synthesized
gcagtaagtgggcaggtccacg

SEQ ID NO: 952261 - DNA, 22 bp, Artificial Sequence
  chemically synthesized
gcagtcgtggacctgcccactt

SEQ ID NO: 952262 - DNA, 22 bp, Artificial Sequence
  chemically synthesized
aatcggcaccacctggcagtaa

SEQ ID NO: 952263 - DNA, 22 bp, Artificial Sequence
  chemically synthesized
cccacttactgccaggtggtgc

SEQ ID NO: 952264 - DNA, 22 bp, Artificial Sequence
  chemically synthesized
cgcccagttgaatcggcaccac

SEQ ID NO: 952265 - DNA, 22 bp, Artificial Sequence
  chemically synthesized
tgcgcccagttgaatcggcacc

SEQ ID NO: 952266 - DNA, 22 bp, Artificial Sequence
  chemically synthesized
actgccaggtggtgccgattca

SEQ ID NO: 952267 - DNA, 22 bp, Artificial Sequence
  chemically synthesized
ctgccaggtggtgccgattcaa

SEQ ID NO: 952268 - DNA, 22 bp, Artificial Sequence
  chemically synthesized
ccaggtggtgccgattcaactg

SEQ ID NO: 952269 - DNA, 22 bp, Artificial Sequence
  chemically synthesized
aactgggcgcagagcccatatg

SEQ ID NO: 952270 - DNA, 22 bp, Artificial Sequence
  chemically synthesized
aagccacagatgccatatgggc

SEQ ID NO: 952271 - DNA, 22 bp, Artificial Sequence
  chemically synthesized
ggcgcagagcccatatggcatc

SEQ ID NO: 952272 - DNA, 22 bp, Artificial Sequence
  chemically synthesized
tgtctcaagccacagatgccat

SEQ ID NO: 952273 - DNA, 22 bp, Artificial Sequence
  chemically synthesized
atgtctcaagccacagatgcca

SEQ ID NO: 952274 - DNA, 22 bp, Artificial Sequence
  chemically synthesized
atgatacttatgtctcaagcca

SEQ ID NO: 952275 - DNA, 22 bp, Artificial Sequence
  chemically synthesized
tggctgatgatacttatgtctc

SEQ ID NO: 952276 - DNA, 22 bp, Artificial Sequence
  chemically synthesized
tggcttgagacataagtatcat

SEQ ID NO: 952277 - DNA, 22 bp, Artificial Sequence
  chemically synthesized
gggaatactgtggctgatgata

SEQ ID NO: 952278 - DNA, 22 bp, Artificial Sequence
  chemically synthesized
ggggaatactgtggctgatgat

SEQ ID NO: 952279 - DNA, 22 bp, Artificial Sequence
  chemically synthesized
gagacataagtatcatcagcca

SEQ ID NO: 952280 - DNA, 22 bp, Artificial Sequence
  chemically synthesized
agacataagtatcatcagccac

SEQ ID NO: 952281 - DNA, 22 bp, Artificial Sequence
  chemically synthesized
agaatttggggaatactgtggc

SEQ ID NO: 952282 - DNA, 22 bp, Artificial Sequence
  chemically synthesized
aagaatttggggaatactgtgg

SEQ ID NO: 952283 - DNA, 22 bp, Artificial Sequence
  chemically synthesized
taagaatttggggaatactgtg

SEQ ID NO: 952284 - DNA, 22 bp, Artificial Sequence
  chemically synthesized
ttaagaatttggggaatactgt

SEQ ID NO: 952285 - DNA, 22 bp, Artificial Sequence
  chemically synthesized
agaaagcagaaggtttttaaga

SEQ ID NO: 952286 - DNA, 22 bp, Artificial Sequence
  chemically synthesized
actcagaaagcagaaggttttt

SEQ ID NO: 952287 - DNA, 22 bp, Artificial Sequence
  chemically synthesized
cccaaattcttaaaaaccttct

SEQ ID NO: 952288 - DNA, 22 bp, Artificial Sequence
  chemically synthesized
ttaaaaaccttctgctttctga

SEQ ID NO: 952289 - DNA, 22 bp, Artificial Sequence
  chemically synthesized
aaaaaccttctgctttctgagt

SEQ ID NO: 952290 - DNA, 22 bp, Artificial Sequence
  chemically synthesized
aaaaccttctgctttctgagtt

SEQ ID NO: 952291 - DNA, 22 bp, Artificial Sequence
  chemically synthesized
ctgctttctgagttaacattgg

SEQ ID NO: 952292 - DNA, 22 bp, Artificial Sequence
  chemically synthesized
tgctttctgagttaacattggg

SEQ ID NO: 952293 - DNA, 22 bp, Artificial Sequence
  chemically synthesized
gatgacaataagcccaatgtta

SEQ ID NO: 952294 - DNA, 22 bp, Artificial Sequence
  chemically synthesized
ctttctgagttaacattgggct

SEQ ID NO: 952295 - DNA, 22 bp, Artificial Sequence
  chemically synthesized
tctgagttaacattgggcttat

SEQ ID NO: 952296 - DNA, 22 bp, Artificial Sequence
  chemically synthesized
ctgagttaacattgggcttatt

SEQ ID NO: 952297 - DNA, 22 bp, Artificial Sequence
  chemically synthesized
tgagttaacattgggcttattg

SEQ ID NO: 952298 - DNA, 22 bp, Artificial Sequence
  chemically synthesized
agttaacattgggcttattgtc

SEQ ID NO: 952299 - DNA, 22 bp, Artificial Sequence
  chemically synthesized
acattgggcttattgtcatcta

SEQ ID NO: 952300 - DNA, 22 bp, Artificial Sequence
  chemically synthesized
ggcttattgtcatctagtactg

SEQ ID NO: 952301 - DNA, 22 bp, Artificial Sequence
  chemically synthesized
gaataaaagcaacagtactaga

SEQ ID NO: 952302 - DNA, 22 bp, Artificial Sequence
  chemically synthesized
attgtcatctagtactgttgct

SEQ ID NO: 952303 - DNA, 22 bp, Artificial Sequence
  chemically synthesized
ttgtcatctagtactgttgctt

SEQ ID NO: 952304 - DNA, 22 bp, Artificial Sequence
  chemically synthesized
tcatctagtactgttgctttta

SEQ ID NO: 952305 - DNA, 22 bp, Artificial Sequence
  chemically synthesized
gtactgttgcttttattctagc

SEQ ID NO: 952306 - DNA, 22 bp, Artificial Sequence
  chemically synthesized
aaacatatgagtatacagctag

SEQ ID NO: 952307 - DNA, 22 bp, Artificial Sequence
  chemically synthesized
ttgcttttattctagctgtata

SEQ ID NO: 952308 - DNA, 22 bp, Artificial Sequence
  chemically synthesized
cttttattctagctgtatactc

SEQ ID NO: 952309 - DNA, 22 bp, Artificial Sequence
  chemically synthesized
ttattctagctgtatactcata

SEQ ID NO: 952310 - DNA, 22 bp, Artificial Sequence
  chemically synthesized
tattctagctgtatactcatat

SEQ ID NO: 952311 - DNA, 22 bp, Artificial Sequence
  chemically synthesized
attctagctgtatactcatatg

SEQ ID NO: 952312 - DNA, 22 bp, Artificial Sequence
  chemically synthesized
ttctagctgtatactcatatgt

SEQ ID NO: 952313 - DNA, 22 bp, Artificial Sequence
  chemically synthesized
tagctgtatactcatatgtttg

SEQ ID NO: 952314 - DNA, 22 bp, Artificial Sequence
  chemically synthesized
gctgtatactcatatgtttgag

SEQ ID NO: 952315 - DNA, 22 bp, Artificial Sequence
  chemically synthesized
tatactcatatgtttgagtgtt

SEQ ID NO: 952316 - DNA, 22 bp, Artificial Sequence
  chemically synthesized
atatgtttgagtgttttgttta

SEQ ID NO: 952317 - DNA, 22 bp, Artificial Sequence
  chemically synthesized
aggaagtatcagtaaacaaaac

SEQ ID NO: 952318 - DNA, 22 bp, Artificial Sequence
  chemically synthesized
gagtgttttgtttactgatact

SEQ ID NO: 952319 - DNA, 22 bp, Artificial Sequence
  chemically synthesized
agtgttttgtttactgatactt

SEQ ID NO: 952320 - DNA, 22 bp, Artificial Sequence
  chemically synthesized
tgtttactgatacttcctcagt

SEQ ID NO: 952321 - DNA, 22 bp, Artificial Sequence
  chemically synthesized
gtttactgatacttcctcagtt

SEQ ID NO: 952322 - DNA, 22 bp, Artificial Sequence
  chemically synthesized
tttactgatacttcctcagttt

SEQ ID NO: 952323 - DNA, 22 bp, Artificial Sequence
  chemically synthesized
actgatacttcctcagtttttg

SEQ ID NO: 952324 - DNA, 22 bp, Artificial Sequence
  chemically synthesized
ctgatacttcctcagtttttgt

SEQ ID NO: 952325 - DNA, 22 bp, Artificial Sequence
  chemically synthesized
atacttcctcagtttttgtttc

SEQ ID NO: 952326 - DNA, 22 bp, Artificial Sequence
  chemically synthesized
cagtgatgtacaggaaagaaac

SEQ ID NO: 952327 - DNA, 22 bp, Artificial Sequence
  chemically synthesized
cctcagtttttgtttctttcct

SEQ ID NO: 952328 - DNA, 22 bp, Artificial Sequence
  chemically synthesized
ctcagtttttgtttctttcctg

SEQ ID NO: 952329 - DNA, 22 bp, Artificial Sequence
  chemically synthesized
ttacagtgatgtacaggaaaga

SEQ ID NO: 952330 - DNA, 22 bp, Artificial Sequence
  chemically synthesized
agtttttgtttctttcctgtac

SEQ ID NO: 952331 - DNA, 22 bp, Artificial Sequence
  chemically synthesized
ctgttacagtgatgtacaggaa

SEQ ID NO: 952332 - DNA, 22 bp, Artificial Sequence
  chemically synthesized
ttgtttctttcctgtacatcac

SEQ ID NO: 952333 - DNA, 22 bp, Artificial Sequence
  chemically synthesized
tgtttctttcctgtacatcact

SEQ ID NO: 952334 - DNA, 22 bp, Artificial Sequence
  chemically synthesized
gtttctttcctgtacatcactg

SEQ ID NO: 952335 - DNA, 22 bp, Artificial Sequence
  chemically synthesized
tttctttcctgtacatcactgt

SEQ ID NO: 952336 - DNA, 22 bp, Artificial Sequence
  chemically synthesized
ctttcctgtacatcactgtaac

SEQ ID NO: 952337 - DNA, 22 bp, Artificial Sequence
  chemically synthesized
tttcctgtacatcactgtaaca

SEQ ID NO: 952338 - DNA, 22 bp, Artificial Sequence
  chemically synthesized
tcctgtacatcactgtaacagc

SEQ ID NO: 952339 - DNA, 22 bp, Artificial Sequence
  chemically synthesized
cctgtacatcactgtaacagca

SEQ ID NO: 952340 - DNA, 22 bp, Artificial Sequence
  chemically synthesized
ctgtacatcactgtaacagcag

SEQ ID NO: 952341 - DNA, 22 bp, Artificial Sequence
  chemically synthesized
tacatcactgtaacagcagcac

SEQ ID NO: 952342 - DNA, 22 bp, Artificial Sequence
  chemically synthesized
aatgtgtggagaatgtgctgct

SEQ ID NO: 952343 - DNA, 22 bp, Artificial Sequence
  chemically synthesized
caatgtgtggagaatgtgctgc

SEQ ID NO: 952344 - DNA, 22 bp, Artificial Sequence
  chemically synthesized
tcaatgtgtggagaatgtgctg

SEQ ID NO: 952345 - DNA, 22 bp, Artificial Sequence
  chemically synthesized
taacagcagcacattctccaca

SEQ ID NO: 952346 - DNA, 22 bp, Artificial Sequence
  chemically synthesized
aaggacagacaatgagtctttc

SEQ ID NO: 952347 - DNA, 22 bp, Artificial Sequence
  chemically synthesized
tccacacattgaaagactcatt

SEQ ID NO: 952348 - DNA, 22 bp, Artificial Sequence
  chemically synthesized
cacacattgaaagactcattgt

SEQ ID NO: 952349 - DNA, 22 bp, Artificial Sequence
  chemically synthesized
aaagactcattgtctgtccttg

SEQ ID NO: 952350 - DNA, 22 bp, Artificial Sequence
  chemically synthesized
acagtagagatgatgctcaagg

SEQ ID NO: 952351 - DNA, 22 bp, Artificial Sequence
  chemically synthesized
gacagtagagatgatgctcaag

SEQ ID NO: 952352 - DNA, 22 bp, Artificial Sequence
  chemically synthesized
attgtctgtccttgagcatcat

SEQ ID NO: 952353 - DNA, 22 bp, Artificial Sequence
  chemically synthesized
tctgtccttgagcatcatctct

SEQ ID NO: 952354 - DNA, 22 bp, Artificial Sequence
  chemically synthesized
tcatttgacagtagagatgatg

SEQ ID NO: 952355 - DNA, 22 bp, Artificial Sequence
  chemically synthesized
tccttgagcatcatctctactg

SEQ ID NO: 952356 - DNA, 22 bp, Artificial Sequence
  chemically synthesized
gagcatcatctctactgtcaaa

SEQ ID NO: 952357 - DNA, 22 bp, Artificial Sequence
  chemically synthesized
agcatcatctctactgtcaaat

SEQ ID NO: 952358 - DNA, 22 bp, Artificial Sequence
  chemically synthesized
tactgtcaaatgatagccctcg

SEQ ID NO: 952359 - DNA, 22 bp, Artificial Sequence
  chemically synthesized
ctgtcaaatgatagccctcgta

SEQ ID NO: 952360 - DNA, 22 bp, Artificial Sequence
  chemically synthesized
tcaaatgatagccctcgtacat

SEQ ID NO: 952361 - DNA, 22 bp, Artificial Sequence
  chemically synthesized
gtacatgcatccactacattca

SEQ ID NO: 952362 - DNA, 22 bp, Artificial Sequence
  chemically synthesized
caaaacataaatagtgagacaa

SEQ ID NO: 952363 - DNA, 22 bp, Artificial Sequence
  chemically synthesized
cattcatcattgtctcactatt

SEQ ID NO: 952364 - DNA, 22 bp, Artificial Sequence
  chemically synthesized
atcattgtctcactatttatgt

SEQ ID NO: 952365 - DNA, 22 bp, Artificial Sequence
  chemically synthesized
tctcactatttatgttttgtaa

SEQ ID NO: 952366 - DNA, 22 bp, Artificial Sequence
  chemically synthesized
taataataatgagagttacaaa

SEQ ID NO: 952367 - DNA, 22 bp, Artificial Sequence
  chemically synthesized
actatttatgttttgtaactct

SEQ ID NO: 952368 - DNA, 22 bp, Artificial Sequence
  chemically synthesized
tttatgttttgtaactctcatt

SEQ ID NO: 952369 - DNA, 22 bp, Artificial Sequence
  chemically synthesized
atgttttgtaactctcattatt

SEQ ID NO: 952370 - DNA, 22 bp, Artificial Sequence
  chemically synthesized
aagacctataataataatgaga

SEQ ID NO: 952371 - DNA, 22 bp, Artificial Sequence
  chemically synthesized
tgttttgtaactctcattatta

SEQ ID NO: 952372 - DNA, 22 bp, Artificial Sequence
  chemically synthesized
tgtaactctcattattattata

SEQ ID NO: 952373 - DNA, 22 bp, Artificial Sequence
  chemically synthesized
gtaactctcattattattatag

SEQ ID NO: 952374 - DNA, 22 bp, Artificial Sequence
  chemically synthesized
gaaactgaagacctataataat

SEQ ID NO: 952375 - DNA, 22 bp, Artificial Sequence
  chemically synthesized
taactctcattattattatagg

SEQ ID NO: 952376 - DNA, 22 bp, Artificial Sequence
  chemically synthesized
tcattattattataggtcttca

SEQ ID NO: 952377 - DNA, 22 bp, Artificial Sequence
  chemically synthesized
attattattataggtcttcagt

SEQ ID NO: 952378 - DNA, 22 bp, Artificial Sequence
  chemically synthesized
aaagtgttagaaactgaagacc

SEQ ID NO: 952379 - DNA, 22 bp, Artificial Sequence
  chemically synthesized
gaaagtgttagaaactgaagac

SEQ ID NO: 952380 - DNA, 22 bp, Artificial Sequence
  chemically synthesized
ttattataggtcttcagtttct

SEQ ID NO: 952381 - DNA, 22 bp, Artificial Sequence
  chemically synthesized
atttgaaagtgttagaaactga

SEQ ID NO: 952382 - DNA, 22 bp, Artificial Sequence
  chemically synthesized
ttataggtcttcagtttctaac

SEQ ID NO: 952383 - DNA, 22 bp, Artificial Sequence
  chemically synthesized
taggtcttcagtttctaacact

SEQ ID NO: 952384 - DNA, 22 bp, Artificial Sequence
  chemically synthesized
cagtttctaacactttcaaatt

SEQ ID NO: 952385 - DNA, 22 bp, Artificial Sequence
  chemically synthesized
aacgacagtgctaatttgaaag

SEQ ID NO: 952386 - DNA, 22 bp, Artificial Sequence
  chemically synthesized
agtttctaacactttcaaatta

SEQ ID NO: 952387 - DNA, 22 bp, Artificial Sequence
  chemically synthesized
attcaacgacagtgctaatttg

SEQ ID NO: 952388 - DNA, 22 bp, Artificial Sequence
  chemically synthesized
ctaacactttcaaattagcact

SEQ ID NO: 952389 - DNA, 22 bp, Artificial Sequence
  chemically synthesized
taacactttcaaattagcactg

SEQ ID NO: 952390 - DNA, 22 bp, Artificial Sequence
  chemically synthesized
acactttcaaattagcactgtc

SEQ ID NO: 952391 - DNA, 22 bp, Artificial Sequence
  chemically synthesized
tgcctaattcaacgacagtgct

SEQ ID NO: 952392 - DNA, 22 bp, Artificial Sequence
  chemically synthesized
attatgcctaattcaacgacag

SEQ ID NO: 952393 - DNA, 22 bp, Artificial Sequence
  chemically synthesized
tcaaattagcactgtcgttgaa

SEQ ID NO: 952394 - DNA, 22 bp, Artificial Sequence
  chemically synthesized
caaattagcactgtcgttgaat

SEQ ID NO: 952395 - DNA, 22 bp, Artificial Sequence
  chemically synthesized
aaattagcactgtcgttgaatt

SEQ ID NO: 952396 - DNA, 22 bp, Artificial Sequence
  chemically synthesized
aatctaattatgcctaattcaa

SEQ ID NO: 952397 - DNA, 22 bp, Artificial Sequence
  chemically synthesized
aaatctaattatgcctaattca

SEQ ID NO: 952398 - DNA, 22 bp, Artificial Sequence
  chemically synthesized
taaatctaattatgcctaattc

SEQ ID NO: 952399 - DNA, 22 bp, Artificial Sequence
  chemically synthesized
gcactgtcgttgaattaggcat

SEQ ID NO: 952400 - DNA, 22 bp, Artificial Sequence
  chemically synthesized
tcgttgaattaggcataattag

SEQ ID NO: 952401 - DNA, 22 bp, Artificial Sequence
  chemically synthesized
gcaaaattttaaatctaattat

SEQ ID NO: 952402 - DNA, 22 bp, Artificial Sequence
  chemically synthesized
agcaaaattttaaatctaatta

SEQ ID NO: 952403 - DNA, 22 bp, Artificial Sequence
  chemically synthesized
tagcaaaattttaaatctaatt

SEQ ID NO: 952404 - DNA, 22 bp, Artificial Sequence
  chemically synthesized
aattaggcataattagatttaa

SEQ ID NO: 952405 - DNA, 22 bp, Artificial Sequence
  chemically synthesized
ggcataattagatttaaaattt

SEQ ID NO: 952406 - DNA, 22 bp, Artificial Sequence
  chemically synthesized
tggagtactttagcaaaatttt

SEQ ID NO: 952407 - DNA, 22 bp, Artificial Sequence
  chemically synthesized
gttgtggagtactttagcaaaa

SEQ ID NO: 952408 - DNA, 22 bp, Artificial Sequence
  chemically synthesized
agttgtggagtactttagcaaa

SEQ ID NO: 952409 - DNA, 22 bp, Artificial Sequence
  chemically synthesized
gatttaaaattttgctaaagta

SEQ ID NO: 952410 - DNA, 22 bp, Artificial Sequence
  chemically synthesized
cttagttgtggagtactttagc

SEQ ID NO: 952411 - DNA, 22 bp, Artificial Sequence
  chemically synthesized
ccttagttgtggagtactttag

SEQ ID NO: 952412 - DNA, 22 bp, Artificial Sequence
  chemically synthesized
ttccttagttgtggagtacttt

SEQ ID NO: 952413 - DNA, 22 bp, Artificial Sequence
  chemically synthesized
aaaattttgctaaagtactcca

SEQ ID NO: 952414 - DNA, 22 bp, Artificial Sequence
  chemically synthesized
aaattttgctaaagtactccac

SEQ ID NO: 952415 - DNA, 22 bp, Artificial Sequence
  chemically synthesized
ttcttccttagttgtggagtac

SEQ ID NO: 952416 - DNA, 22 bp, Artificial Sequence
  chemically synthesized
tgctaaagtactccacaactaa

SEQ ID NO: 952417 - DNA, 22 bp, Artificial Sequence
  chemically synthesized
gctaaagtactccacaactaag

SEQ ID NO: 952418 - DNA, 22 bp, Artificial Sequence
  chemically synthesized
ctaaagtactccacaactaagg

SEQ ID NO: 952419 - DNA, 22 bp, Artificial Sequence
  chemically synthesized
gagccctgttcttccttagttg

SEQ ID NO: 952420 - DNA, 22 bp, Artificial Sequence
  chemically synthesized
ggagccctgttcttccttagtt

SEQ ID NO: 952421 - DNA, 22 bp, Artificial Sequence
  chemically synthesized
aagtactccacaactaaggaag

SEQ ID NO: 952422 - DNA, 22 bp, Artificial Sequence
  chemically synthesized
accacttggagccctgttcttc

SEQ ID NO: 952423 - DNA, 22 bp, Artificial Sequence
  chemically synthesized
cacaactaaggaagaacagggc

SEQ ID NO: 952424 - DNA, 22 bp, Artificial Sequence
  chemically synthesized
atgttaaccacttggagccctg

SEQ ID NO: 952425 - DNA, 22 bp, Artificial Sequence
  chemically synthesized
aggaagaacagggctccaagtg

SEQ ID NO: 952426 - DNA, 22 bp, Artificial Sequence
  chemically synthesized
caagtggttaacattaactttg

SEQ ID NO: 952427 - DNA, 22 bp, Artificial Sequence
  chemically synthesized
tcatacccccaccaaagttaat

SEQ ID NO: 952428 - DNA, 22 bp, Artificial Sequence
  chemically synthesized
ctatcatacccccaccaaagtt

SEQ ID NO: 952429 - DNA, 22 bp, Artificial Sequence
  chemically synthesized
tcctatcatacccccaccaaag

SEQ ID NO: 952430 - DNA, 22 bp, Artificial Sequence
  chemically synthesized
acattaactttggtgggggtat

SEQ ID NO: 952431 - DNA, 22 bp, Artificial Sequence
  chemically synthesized
gtcaacactctcctatcatacc

SEQ ID NO: 952432 - DNA, 22 bp, Artificial Sequence
  chemically synthesized
actttggtgggggtatgatagg

SEQ ID NO: 952433 - DNA, 22 bp, Artificial Sequence
  chemically synthesized
tggtgggggtatgataggagag

SEQ ID NO: 952434 - DNA, 22 bp, Artificial Sequence
  chemically synthesized
ggtgggggtatgataggagagt

SEQ ID NO: 952435 - DNA, 22 bp, Artificial Sequence
  chemically synthesized
gtgggggtatgataggagagtg

SEQ ID NO: 952436 - DNA, 22 bp, Artificial Sequence
  chemically synthesized
caagtacaggttcgtcaacact

SEQ ID NO: 952437 - DNA, 22 bp, Artificial Sequence
  chemically synthesized
gctccaagtacaggttcgtcaa

SEQ ID NO: 952438 - DNA, 22 bp, Artificial Sequence
  chemically synthesized
acgaacctgtacttggagctag

SEQ ID NO: 952439 - DNA, 22 bp, Artificial Sequence
  chemically synthesized
aatagaaataaaactagctcca

SEQ ID NO: 952440 - DNA, 22 bp, Artificial Sequence
  chemically synthesized
tacttggagctagttttatttc

SEQ ID NO: 952441 - DNA, 22 bp, Artificial Sequence
  chemically synthesized
ggagctagttttatttctattt

SEQ ID NO: 952442 - DNA, 22 bp, Artificial Sequence
  chemically synthesized
gagctagttttatttctattta

SEQ ID NO: 952443 - DNA, 22 bp, Artificial Sequence
  chemically synthesized
gttttatttctatttaggctat

SEQ ID NO: 952444 - DNA, 22 bp, Artificial Sequence
  chemically synthesized
tatttctatttaggctattact

SEQ ID NO: 952445 - DNA, 22 bp, Artificial Sequence
  chemically synthesized
atttctatttaggctattactc

SEQ ID NO: 952446 - DNA, 22 bp, Artificial Sequence
  chemically synthesized
tttctatttaggctattactct

SEQ ID NO: 952447 - DNA, 22 bp, Artificial Sequence
  chemically synthesized
ctatttaggctattactctctc

SEQ ID NO: 952448 - DNA, 22 bp, Artificial Sequence
  chemically synthesized
tatttaggctattactctctct

SEQ ID NO: 952449 - DNA, 22 bp, Artificial Sequence
  chemically synthesized
tttaggctattactctctcttt

SEQ ID NO: 952450 - DNA, 22 bp, Artificial Sequence
  chemically synthesized
aggctattactctctctttctc

SEQ ID NO: 952451 - DNA, 22 bp, Artificial Sequence
  chemically synthesized
ggctattactctctctttctcc

SEQ ID NO: 952452 - DNA, 22 bp, Artificial Sequence
  chemically synthesized
ttactctctctttctccatgct

SEQ ID NO: 952453 - DNA, 22 bp, Artificial Sequence
  chemically synthesized
ctctctctttctccatgcttcc

SEQ ID NO: 952454 - DNA, 22 bp, Artificial Sequence
  chemically synthesized
tctctttctccatgcttccctc

SEQ ID NO: 952455 - DNA, 22 bp, Artificial Sequence
  chemically synthesized
tctttctccatgcttccctccc

SEQ ID NO: 952456 - DNA, 22 bp, Artificial Sequence
  chemically synthesized
tttctccatgcttccctccctc

SEQ ID NO: 952457 - DNA, 22 bp, Artificial Sequence
  chemically synthesized
tctccatgcttccctccctctc

SEQ ID NO: 952458 - DNA, 22 bp, Artificial Sequence
  chemically synthesized
ctccatgcttccctccctctct

SEQ ID NO: 952459 - DNA, 22 bp, Artificial Sequence
  chemically synthesized
tccatgcttccctccctctctc

SEQ ID NO: 952460 - DNA, 22 bp, Artificial Sequence
  chemically synthesized
catgcttccctccctctctccc

SEQ ID NO: 952461 - DNA, 22 bp, Artificial Sequence
  chemically synthesized
ccctccctctctcccttcctcc

SEQ ID NO: 952462 - DNA, 22 bp, Artificial Sequence
  chemically synthesized
cctccctctctcccttcctccc

SEQ ID NO: 952463 - DNA, 22 bp, Artificial Sequence
  chemically synthesized
cctctctcccttcctccctctc

SEQ ID NO: 952464 - DNA, 22 bp, Artificial Sequence
  chemically synthesized
tctcccttcctccctctctctc

SEQ ID NO: 952465 - DNA, 22 bp, Artificial Sequence
  chemically synthesized
tcccttcctccctctctctctc

SEQ ID NO: 952466 - DNA, 22 bp, Artificial Sequence
  chemically synthesized
ccttcctccctctctctctctc

SEQ ID NO: 952467 - DNA, 22 bp, Artificial Sequence
  chemically synthesized
cctccctctctctctctctctc

SEQ ID NO: 952468 - DNA, 22 bp, Artificial Sequence
  chemically synthesized
ctccctctctctctctctctct

SEQ ID NO: 952469 - DNA, 22 bp, Artificial Sequence
  chemically synthesized
cctctctctctctctctctgtt

SEQ ID NO: 952470 - DNA, 22 bp, Artificial Sequence
  chemically synthesized
tctctctctctctctgttcata

SEQ ID NO: 952471 - DNA, 22 bp, Artificial Sequence
  chemically synthesized
tctctctctctctgttcatata

SEQ ID NO: 952472 - DNA, 22 bp, Artificial Sequence
  chemically synthesized
tctctctctctgttcatatata

SEQ ID NO: 952473 - DNA, 22 bp, Artificial Sequence
  chemically synthesized
tctctctctgttcatatatata

SEQ ID NO: 952474 - DNA, 22 bp, Artificial Sequence
  chemically synthesized
tctctctgttcatatatatata

SEQ ID NO: 952475 - DNA, 22 bp, Artificial Sequence
  chemically synthesized
tctctgttcatatatatatata

SEQ ID NO: 952476 - DNA, 22 bp, Artificial Sequence
  chemically synthesized
tctgttcatatatatatatata

SEQ ID NO: 952477 - DNA, 22 bp, Artificial Sequence
  chemically synthesized
tgttcatatatatatatatata

SEQ ID NO: 952478 - DNA, 22 bp, Artificial Sequence
  chemically synthesized
ttcatatatatatatatatata

SEQ ID NO: 952479 - DNA, 22 bp, Artificial Sequence
  chemically synthesized
atatatatatatatatatatat

SEQ ID NO: 952480 - DNA, 22 bp, Artificial Sequence
  chemically synthesized
cacatatatgtgtgtgtatgtg

SEQ ID NO: 952481 - DNA, 22 bp, Artificial Sequence
  chemically synthesized
ttgcacatatatgtgtgtgtat

SEQ ID NO: 952482 - DNA, 22 bp, Artificial Sequence
  chemically synthesized
attgcacatatatgtgtgtgta

SEQ ID NO: 952483 - DNA, 22 bp, Artificial Sequence
  chemically synthesized
tattgcacatatatgtgtgtgt

SEQ ID NO: 952484 - DNA, 22 bp, Artificial Sequence
  chemically synthesized
tttattgcacatatatgtgtgt

SEQ ID NO: 952485 - DNA, 22 bp, Artificial Sequence
  chemically synthesized
aggcagttctttattgcacata

SEQ ID NO: 952486 - DNA, 22 bp, Artificial Sequence
  chemically synthesized
cccagtctcaggcagttcttta

SEQ ID NO: 952487 - DNA, 22 bp, Artificial Sequence
  chemically synthesized
taaattacccagtctcaggcag

SEQ ID NO: 952488 - DNA, 22 bp, Artificial Sequence
  chemically synthesized
ataaattacccagtctcaggca

SEQ ID NO: 952489 - DNA, 22 bp, Artificial Sequence
  chemically synthesized
tataaattacccagtctcaggc

SEQ ID NO: 952490 - DNA, 22 bp, Artificial Sequence
  chemically synthesized
ctttataaattacccagtctca

SEQ ID NO: 952491 - DNA, 22 bp, Artificial Sequence
  chemically synthesized
cctttataaattacccagtctc

SEQ ID NO: 952492 - DNA, 22 bp, Artificial Sequence
  chemically synthesized
tcctttataaattacccagtct

SEQ ID NO: 952493 - DNA, 22 bp, Artificial Sequence
  chemically synthesized
cctgagactgggtaatttataa

SEQ ID NO: 952494 - DNA, 22 bp, Artificial Sequence
  chemically synthesized
aatccctttcctttataaatta

SEQ ID NO: 952495 - DNA, 22 bp, Artificial Sequence
  chemically synthesized
agactgggtaatttataaagga

SEQ ID NO: 952496 - DNA, 22 bp, Artificial Sequence
  chemically synthesized
ggtaatttataaaggaaaggga

SEQ ID NO: 952497 - DNA, 22 bp, Artificial Sequence
  chemically synthesized
tgagtcaattaaatccctttcc

SEQ ID NO: 952498 - DNA, 22 bp, Artificial Sequence
  chemically synthesized
aactatgagtcaattaaatccc

SEQ ID NO: 952499 - DNA, 22 bp, Artificial Sequence
  chemically synthesized
ataaaggaaagggatttaattg

SEQ ID NO: 952500 - DNA, 22 bp, Artificial Sequence
  chemically synthesized
taaaggaaagggatttaattga

SEQ ID NO: 952501 - DNA, 22 bp, Artificial Sequence
  chemically synthesized
cccagccatgctgaactatgag

SEQ ID NO: 952502 - DNA, 22 bp, Artificial Sequence
  chemically synthesized
aattgactcatagttcagcatg

SEQ ID NO: 952503 - DNA, 22 bp, Artificial Sequence
  chemically synthesized
attgactcatagttcagcatgg

SEQ ID NO: 952504 - DNA, 22 bp, Artificial Sequence
  chemically synthesized
aggtctccccagccatgctgaa

SEQ ID NO: 952505 - DNA, 22 bp, Artificial Sequence
  chemically synthesized
ctgaggtctccccagccatgct

SEQ ID NO: 952506 - DNA, 22 bp, Artificial Sequence
  chemically synthesized
actcatagttcagcatggctgg

SEQ ID NO: 952507 - DNA, 22 bp, Artificial Sequence
  chemically synthesized
cctgaggtctccccagccatgc

SEQ ID NO: 952508 - DNA, 22 bp, Artificial Sequence
  chemically synthesized
atagttcagcatggctggggag

SEQ ID NO: 952509 - DNA, 22 bp, Artificial Sequence
  chemically synthesized
taagtttcctgaggtctcccca

SEQ ID NO: 952510 - DNA, 22 bp, Artificial Sequence
  chemically synthesized
agcatggctggggagacctcag

SEQ ID NO: 952511 - DNA, 22 bp, Artificial Sequence
  chemically synthesized
tgattgtaagtttcctgaggtc

SEQ ID NO: 952512 - DNA, 22 bp, Artificial Sequence
  chemically synthesized
ctatgattgtaagtttcctgag

SEQ ID NO: 952513 - DNA, 22 bp, Artificial Sequence
  chemically synthesized
tactatgattgtaagtttcctg

SEQ ID NO: 952514 - DNA, 22 bp, Artificial Sequence
  chemically synthesized
ctactatgattgtaagtttcct

SEQ ID NO: 952515 - DNA, 22 bp, Artificial Sequence
  chemically synthesized
gggagacctcaggaaacttaca

SEQ ID NO: 952516 - DNA, 22 bp, Artificial Sequence
  chemically synthesized
accttctactatgattgtaagt

SEQ ID NO: 952517 - DNA, 22 bp, Artificial Sequence
  chemically synthesized
caccttctactatgattgtaag

SEQ ID NO: 952518 - DNA, 22 bp, Artificial Sequence
  chemically synthesized
aggaaacttacaatcatagtag

SEQ ID NO: 952519 - DNA, 22 bp, Artificial Sequence
  chemically synthesized
tgcccttcaccttctactatga

SEQ ID NO: 952520 - DNA, 22 bp, Artificial Sequence
  chemically synthesized
ctatgcccttcaccttctacta

SEQ ID NO: 952521 - DNA, 22 bp, Artificial Sequence
  chemically synthesized
tactatgcccttcaccttctac

SEQ ID NO: 952522 - DNA, 22 bp, Artificial Sequence
  chemically synthesized
ctactatgcccttcaccttcta

SEQ ID NO: 952523 - DNA, 22 bp, Artificial Sequence
  chemically synthesized
tctactatgcccttcaccttct

SEQ ID NO: 952524 - DNA, 22 bp, Artificial Sequence
  chemically synthesized
acaatcatagtagaaggtgaag

SEQ ID NO: 952525 - DNA, 22 bp, Artificial Sequence
  chemically synthesized
caatcatagtagaaggtgaagg

SEQ ID NO: 952526 - DNA, 22 bp, Artificial Sequence
  chemically synthesized
tgccctttctactatgcccttc

SEQ ID NO: 952527 - DNA, 22 bp, Artificial Sequence
  chemically synthesized
ctatgccctttctactatgccc

SEQ ID NO: 952528 - DNA, 22 bp, Artificial Sequence
  chemically synthesized
tactatgccctttctactatgc

SEQ ID NO: 952529 - DNA, 22 bp, Artificial Sequence
  chemically synthesized
ctactatgccctttctactatg

SEQ ID NO: 952530 - DNA, 22 bp, Artificial Sequence
  chemically synthesized
tctactatgccctttctactat

SEQ ID NO: 952531 - DNA, 22 bp, Artificial Sequence
  chemically synthesized
ctttctactatgccctttctac

SEQ ID NO: 952532 - DNA, 22 bp, Artificial Sequence
  chemically synthesized
gctttctactatgccctttcta

SEQ ID NO: 952533 - DNA, 22 bp, Artificial Sequence
  chemically synthesized
taaaggaggtgccttgctttct

SEQ ID NO: 952534 - DNA, 22 bp, Artificial Sequence
  chemically synthesized
gtaaaggaggtgccttgctttc

SEQ ID NO: 952535 - DNA, 22 bp, Artificial Sequence
  chemically synthesized
ccaccttgtaaaggaggtgcct

SEQ ID NO: 952536 - DNA, 22 bp, Artificial Sequence
  chemically synthesized
gccaccttgtaaaggaggtgcc

SEQ ID NO: 952537 - DNA, 22 bp, Artificial Sequence
  chemically synthesized
ttgccaccttgtaaaggaggtg

SEQ ID NO: 952538 - DNA, 22 bp, Artificial Sequence
  chemically synthesized
cttgccaccttgtaaaggaggt

SEQ ID NO: 952539 - DNA, 22 bp, Artificial Sequence
  chemically synthesized
cttcttgccaccttgtaaagga

SEQ ID NO: 952540 - DNA, 22 bp, Artificial Sequence
  chemically synthesized
tccttcttgccaccttgtaaag

SEQ ID NO: 952541 - DNA, 22 bp, Artificial Sequence
  chemically synthesized
attctccttcttgccaccttgt

SEQ ID NO: 952542 - DNA, 22 bp, Artificial Sequence
  chemically synthesized
actcattctccttcttgccacc

SEQ ID NO: 952543 - DNA, 22 bp, Artificial Sequence
  chemically synthesized
ctcactcattctccttcttgcc

SEQ ID NO: 952544 - DNA, 22 bp, Artificial Sequence
  chemically synthesized
ctttacaaggtggcaagaagga

SEQ ID NO: 952545 - DNA, 22 bp, Artificial Sequence
  chemically synthesized
tacaaggtggcaagaaggagaa

SEQ ID NO: 952546 - DNA, 22 bp, Artificial Sequence
  chemically synthesized
cctcctcactcattctccttct

SEQ ID NO: 952547 - DNA, 22 bp, Artificial Sequence
  chemically synthesized
acaaggtggcaagaaggagaat

SEQ ID NO: 952548 - DNA, 22 bp, Artificial Sequence
  chemically synthesized
ccctcctcactcattctccttc

SEQ ID NO: 952549 - DNA, 22 bp, Artificial Sequence
  chemically synthesized
caaggtggcaagaaggagaatg

SEQ ID NO: 952550 - DNA, 22 bp, Artificial Sequence
  chemically synthesized
ccccttccctcctcactcattc

SEQ ID NO: 952551 - DNA, 22 bp, Artificial Sequence
  chemically synthesized
cccccttccctcctcactcatt

SEQ ID NO: 952552 - DNA, 22 bp, Artificial Sequence
  chemically synthesized
ttcccccttccctcctcactca

SEQ ID NO: 952553 - DNA, 22 bp, Artificial Sequence
  chemically synthesized
taaagggctcttcccccttccc

SEQ ID NO: 952554 - DNA, 22 bp, Artificial Sequence
  chemically synthesized
ataaagggctcttcccccttcc

SEQ ID NO: 952555 - DNA, 22 bp, Artificial Sequence
  chemically synthesized
tataaagggctcttcccccttc

SEQ ID NO: 952556 - DNA, 22 bp, Artificial Sequence
  chemically synthesized
atagtgaatcatgagatcagat

SEQ ID NO: 952557 - DNA, 22 bp, Artificial Sequence
  chemically synthesized
tataaaaccatctgatctcatg

SEQ ID NO: 952558 - DNA, 22 bp, Artificial Sequence
  chemically synthesized
ctgatagtgaatcatgagatca

SEQ ID NO: 952559 - DNA, 22 bp, Artificial Sequence
  chemically synthesized
ataaaaccatctgatctcatga

SEQ ID NO: 952560 - DNA, 22 bp, Artificial Sequence
  chemically synthesized
taaaaccatctgatctcatgat

SEQ ID NO: 952561 - DNA, 22 bp, Artificial Sequence
  chemically synthesized
tcctgatagtgaatcatgagat

SEQ ID NO: 952562 - DNA, 22 bp, Artificial Sequence
  chemically synthesized
ttctcctgatagtgaatcatga

SEQ ID NO: 952563 - DNA, 22 bp, Artificial Sequence
  chemically synthesized
atctcatgattcactatcagga

SEQ ID NO: 952564 - DNA, 22 bp, Artificial Sequence
  chemically synthesized
cccatgctgttctcctgatagt

SEQ ID NO: 952565 - DNA, 22 bp, Artificial Sequence
  chemically synthesized
gcccatgctgttctcctgatag

SEQ ID NO: 952566 - DNA, 22 bp, Artificial Sequence
  chemically synthesized
tgcccatgctgttctcctgata

SEQ ID NO: 952567 - DNA, 22 bp, Artificial Sequence
  chemically synthesized
atgattcactatcaggagaaca

SEQ ID NO: 952568 - DNA, 22 bp, Artificial Sequence
  chemically synthesized
actatcaggagaacagcatggg

SEQ ID NO: 952569 - DNA, 22 bp, Artificial Sequence
  chemically synthesized
agggtggttttgcccatgctgt

SEQ ID NO: 952570 - DNA, 22 bp, Artificial Sequence
  chemically synthesized
gagggtggttttgcccatgctg

SEQ ID NO: 952571 - DNA, 22 bp, Artificial Sequence
  chemically synthesized
tcaggagaacagcatgggcaaa

SEQ ID NO: 952572 - DNA, 22 bp, Artificial Sequence
  chemically synthesized
gatcttgagggtggttttgccc

SEQ ID NO: 952573 - DNA, 22 bp, Artificial Sequence
  chemically synthesized
aagatccaattgcctccacctg

SEQ ID NO: 952574 - DNA, 22 bp, Artificial Sequence
  chemically synthesized
cctccacctggtctctcccttg

SEQ ID NO: 952575 - DNA, 22 bp, Artificial Sequence
  chemically synthesized
taatccccgtgtgtcaagggag

SEQ ID NO: 952576 - DNA, 22 bp, Artificial Sequence
  chemically synthesized
cacctggtctctcccttgacac

SEQ ID NO: 952577 - DNA, 22 bp, Artificial Sequence
  chemically synthesized
aattataatccccgtgtgtcaa

SEQ ID NO: 952578 - DNA, 22 bp, Artificial Sequence
  chemically synthesized
gaattataatccccgtgtgtca

SEQ ID NO: 952579 - DNA, 22 bp, Artificial Sequence
  chemically synthesized
tgaattataatccccgtgtgtc

SEQ ID NO: 952580 - DNA, 22 bp, Artificial Sequence
  chemically synthesized
gtctctcccttgacacacgggg

SEQ ID NO: 952581 - DNA, 22 bp, Artificial Sequence
  chemically synthesized
attttgaattataatccccgtg

SEQ ID NO: 952582 - DNA, 22 bp, Artificial Sequence
  chemically synthesized
tcccttgacacacggggattat

SEQ ID NO: 952583 - DNA, 22 bp, Artificial Sequence
  chemically synthesized
ccttgacacacggggattataa

SEQ ID NO: 952584 - DNA, 22 bp, Artificial Sequence
  chemically synthesized
aaatctcattttgaattataat

SEQ ID NO: 952585 - DNA, 22 bp, Artificial Sequence
  chemically synthesized
gacacacggggattataattca

SEQ ID NO: 952586 - DNA, 22 bp, Artificial Sequence
  chemically synthesized
acacacggggattataattcaa

SEQ ID NO: 952587 - DNA, 22 bp, Artificial Sequence
  chemically synthesized
tccccactcaaatctcattttg

SEQ ID NO: 952588 - DNA, 22 bp, Artificial Sequence
  chemically synthesized
tgtccccactcaaatctcattt

SEQ ID NO: 952589 - DNA, 22 bp, Artificial Sequence
  chemically synthesized
ctgtccccactcaaatctcatt

SEQ ID NO: 952590 - DNA, 22 bp, Artificial Sequence
  chemically synthesized
tctgtccccactcaaatctcat

SEQ ID NO: 952591 - DNA, 22 bp, Artificial Sequence
  chemically synthesized
taattcaaaatgagatttgagt

SEQ ID NO: 952592 - DNA, 22 bp, Artificial Sequence
  chemically synthesized
ggctttctgtccccactcaaat

SEQ ID NO: 952593 - DNA, 22 bp, Artificial Sequence
  chemically synthesized
aaaatgagatttgagtggggac

SEQ ID NO: 952594 - DNA, 22 bp, Artificial Sequence
  chemically synthesized
atatggttaggctttctgtccc

SEQ ID NO: 952595 - DNA, 22 bp, Artificial Sequence
  chemically synthesized
gagtggggacagaaagcctaac

SEQ ID NO: 952596 - DNA, 22 bp, Artificial Sequence
  chemically synthesized
agtggggacagaaagcctaacc

SEQ ID NO: 952597 - DNA, 22 bp, Artificial Sequence
  chemically synthesized
tacacacacattgatatggtta

SEQ ID NO: 952598 - DNA, 22 bp, Artificial Sequence
  chemically synthesized
accatatcaatgtgtgtgtata

SEQ ID NO: 952599 - DNA, 22 bp, Artificial Sequence
  chemically synthesized
ccagaaataaattatacacaca

SEQ ID NO: 952600 - DNA, 22 bp, Artificial Sequence
  chemically synthesized
atctaccagaaataaattatac

SEQ ID NO: 952601 - DNA, 22 bp, Artificial Sequence
  chemically synthesized
atgaacatgttcatctaccaga

SEQ ID NO: 952602 - DNA, 22 bp, Artificial Sequence
  chemically synthesized
gatgaacatgttcatctaccag

SEQ ID NO: 952603 - DNA, 22 bp, Artificial Sequence
  chemically synthesized
tgatgaacatgttcatctacca

SEQ ID NO: 952604 - DNA, 22 bp, Artificial Sequence
  chemically synthesized
attttgatgaacatgttcatct

SEQ ID NO: 952605 - DNA, 22 bp, Artificial Sequence
  chemically synthesized
atttctggtagatgaacatgtt

SEQ ID NO: 952606 - DNA, 22 bp, Artificial Sequence
  chemically synthesized
tttctggtagatgaacatgttc

SEQ ID NO: 952607 - DNA, 22 bp, Artificial Sequence
  chemically synthesized
ctggtagatgaacatgttcatc

SEQ ID NO: 952608 - DNA, 22 bp, Artificial Sequence
  chemically synthesized
tggtagatgaacatgttcatca

SEQ ID NO: 952609 - DNA, 22 bp, Artificial Sequence
  chemically synthesized
tatagttgattttgatgaacat

SEQ ID NO: 952610 - DNA, 22 bp, Artificial Sequence
  chemically synthesized
gtagatgaacatgttcatcaaa

SEQ ID NO: 952611 - DNA, 22 bp, Artificial Sequence
  chemically synthesized
tgattatatagttgattttgat

SEQ ID NO: 952612 - DNA, 22 bp, Artificial Sequence
  chemically synthesized
atattgtgattatatagttgat

SEQ ID NO: 952613 - DNA, 22 bp, Artificial Sequence
  chemically synthesized
agttaatattgtgattatatag

SEQ ID NO: 952614 - DNA, 22 bp, Artificial Sequence
  chemically synthesized
atcaaaatcaactatataatca

SEQ ID NO: 952615 - DNA, 22 bp, Artificial Sequence
  chemically synthesized
cagttaatattgtgattatata

SEQ ID NO: 952616 - DNA, 22 bp, Artificial Sequence
  chemically synthesized
tataatcacaatattaactgaa

SEQ ID NO: 952617 - DNA, 22 bp, Artificial Sequence
  chemically synthesized
aaagtcagatatttcagttaat

SEQ ID NO: 952618 - DNA, 22 bp, Artificial Sequence
  chemically synthesized
aaaagtcagatatttcagttaa

SEQ ID NO: 952619 - DNA, 22 bp, Artificial Sequence
  chemically synthesized
ttaaaagtcagatatttcagtt

SEQ ID NO: 952620 - DNA, 22 bp, Artificial Sequence
  chemically synthesized
aagttcttaaaagtcagatatt

SEQ ID NO: 952621 - DNA, 22 bp, Artificial Sequence
  chemically synthesized
aaagttcttaaaagtcagatat

SEQ ID NO: 952622 - DNA, 22 bp, Artificial Sequence
  chemically synthesized
actgaaatatctgacttttaag

SEQ ID NO: 952623 - DNA, 22 bp, Artificial Sequence
  chemically synthesized
aaatatttaaagttcttaaaag

SEQ ID NO: 952624 - DNA, 22 bp, Artificial Sequence
  chemically synthesized
aaatatctgacttttaagaact

SEQ ID NO: 952625 - DNA, 22 bp, Artificial Sequence
  chemically synthesized
taaaatatttaaagttcttaaa

SEQ ID NO: 952626 - DNA, 22 bp, Artificial Sequence
  chemically synthesized
acttttaagaactttaaatatt

SEQ ID NO: 952627 - DNA, 22 bp, Artificial Sequence
  chemically synthesized
ttaagaactttaaatattttag

SEQ ID NO: 952628 - DNA, 22 bp, Artificial Sequence
  chemically synthesized
taagaactttaaatattttaga

SEQ ID NO: 952629 - DNA, 22 bp, Artificial Sequence
  chemically synthesized
aagaactttaaatattttagag

SEQ ID NO: 952630 - DNA, 22 bp, Artificial Sequence
  chemically synthesized
agaactttaaatattttagagg

SEQ ID NO: 952631 - DNA, 22 bp, Artificial Sequence
  chemically synthesized
tacagccgtaggcaacctctaa

SEQ ID NO: 952632 - DNA, 22 bp, Artificial Sequence
  chemically synthesized
gtacagccgtaggcaacctcta

SEQ ID NO: 952633 - DNA, 22 bp, Artificial Sequence
  chemically synthesized
taaatattttagaggttgccta

SEQ ID NO: 952634 - DNA, 22 bp, Artificial Sequence
  chemically synthesized
cttgtacagccgtaggcaacct

SEQ ID NO: 952635 - DNA, 22 bp, Artificial Sequence
  chemically synthesized
aaatattttagaggttgcctac

SEQ ID NO: 952636 - DNA, 22 bp, Artificial Sequence
  chemically synthesized
acttgtacagccgtaggcaacc

SEQ ID NO: 952637 - DNA, 22 bp, Artificial Sequence
  chemically synthesized
aatattttagaggttgcctacg

SEQ ID NO: 952638 - DNA, 22 bp, Artificial Sequence
  chemically synthesized
tttacttgtacagccgtaggca

SEQ ID NO: 952639 - DNA, 22 bp, Artificial Sequence
  chemically synthesized
atttacttgtacagccgtaggc

SEQ ID NO: 952640 - DNA, 22 bp, Artificial Sequence
  chemically synthesized
tagaggttgcctacggctgtac

SEQ ID NO: 952641 - DNA, 22 bp, Artificial Sequence
  chemically synthesized
agaggttgcctacggctgtaca

SEQ ID NO: 952642 - DNA, 22 bp, Artificial Sequence
  chemically synthesized
gaggttgcctacggctgtacaa

SEQ ID NO: 952643 - DNA, 22 bp, Artificial Sequence
  chemically synthesized
tcaatttatttacttgtacagc

SEQ ID NO: 952644 - DNA, 22 bp, Artificial Sequence
  chemically synthesized
tatcaatttatttacttgtaca

SEQ ID NO: 952645 - DNA, 22 bp, Artificial Sequence
  chemically synthesized
cctacggctgtacaagtaaata

SEQ ID NO: 952646 - DNA, 22 bp, Artificial Sequence
  chemically synthesized
cggctgtacaagtaaataaatt

SEQ ID NO: 952647 - DNA, 22 bp, Artificial Sequence
  chemically synthesized
aaagaatgtgctctatcaattt

SEQ ID NO: 952648 - DNA, 22 bp, Artificial Sequence
  chemically synthesized
tacaagtaaataaattgataga

SEQ ID NO: 952649 - DNA, 22 bp, Artificial Sequence
  chemically synthesized
aaaagaatgtgctctatcaatt

SEQ ID NO: 952650 - DNA, 22 bp, Artificial Sequence
  chemically synthesized
tatttaaaagaatgtgctctat

SEQ ID NO: 952651 - DNA, 22 bp, Artificial Sequence
  chemically synthesized
atatttaaaagaatgtgctcta

SEQ ID NO: 952652 - DNA, 22 bp, Artificial Sequence
  chemically synthesized
tatatttaaaagaatgtgctct

SEQ ID NO: 952653 - DNA, 22 bp, Artificial Sequence
  chemically synthesized
attttatatttaaaagaatgtg

SEQ ID NO: 952654 - DNA, 22 bp, Artificial Sequence
  chemically synthesized
tcattttatatttaaaagaatg

SEQ ID NO: 952655 - DNA, 22 bp, Artificial Sequence
  chemically synthesized
ctctcattttatatttaaaaga

SEQ ID NO: 952656 - DNA, 22 bp, Artificial Sequence
  chemically synthesized
atagagcacattcttttaaata

SEQ ID NO: 952657 - DNA, 22 bp, Artificial Sequence
  chemically synthesized
cctctcattttatatttaaaag

SEQ ID NO: 952658 - DNA, 22 bp, Artificial Sequence
  chemically synthesized
tttcctctcattttatatttaa

SEQ ID NO: 952659 - DNA, 22 bp, Artificial Sequence
  chemically synthesized
agactatttcctctcattttat

SEQ ID NO: 952660 - DNA, 22 bp, Artificial Sequence
  chemically synthesized
ttttaaatataaaatgagagga

SEQ ID NO: 952661 - DNA, 22 bp, Artificial Sequence
  chemically synthesized
attaagactatttcctctcatt

SEQ ID NO: 952662 - DNA, 22 bp, Artificial Sequence
  chemically synthesized
ttaaatataaaatgagaggaaa

SEQ ID NO: 952663 - DNA, 22 bp, Artificial Sequence
  chemically synthesized
taaatataaaatgagaggaaat

SEQ ID NO: 952664 - DNA, 22 bp, Artificial Sequence
  chemically synthesized
aaatataaaatgagaggaaata

SEQ ID NO: 952665 - DNA, 22 bp, Artificial Sequence
  chemically synthesized
aatataaaatgagaggaaatag

SEQ ID NO: 952666 - DNA, 22 bp, Artificial Sequence
  chemically synthesized
aattagattactacattttccc

SEQ ID NO: 952667 - DNA, 22 bp, Artificial Sequence
  chemically synthesized
attagattactacattttcccc

SEQ ID NO: 952668 - DNA, 22 bp, Artificial Sequence
  chemically synthesized
tgacacatccatggggaaaatg

SEQ ID NO: 952669 - DNA, 22 bp, Artificial Sequence
  chemically synthesized
gattactacattttccccatgg

SEQ ID NO: 952670 - DNA, 22 bp, Artificial Sequence
  chemically synthesized
ctacattttccccatggatgtg

SEQ ID NO: 952671 - DNA, 22 bp, Artificial Sequence
  chemically synthesized
gaatgtactatgacacatccat

SEQ ID NO: 952672 - DNA, 22 bp, Artificial Sequence
  chemically synthesized
cattttccccatggatgtgtca

SEQ ID NO: 952673 - DNA, 22 bp, Artificial Sequence
  chemically synthesized
tagaatgtactatgacacatcc

SEQ ID NO: 952674 - DNA, 22 bp, Artificial Sequence
  chemically synthesized
ctctagaatgtactatgacaca

SEQ ID NO: 952675 - DNA, 22 bp, Artificial Sequence
  chemically synthesized
cctctagaatgtactatgacac

SEQ ID NO: 952676 - DNA, 22 bp, Artificial Sequence
  chemically synthesized
tccccatggatgtgtcatagta

SEQ ID NO: 952677 - DNA, 22 bp, Artificial Sequence
  chemically synthesized
tcctctagaatgtactatgaca

SEQ ID NO: 952678 - DNA, 22 bp, Artificial Sequence
  chemically synthesized
ccccatggatgtgtcatagtac

SEQ ID NO: 952679 - DNA, 22 bp, Artificial Sequence
  chemically synthesized
ttcctctagaatgtactatgac

SEQ ID NO: 952680 - DNA, 22 bp, Artificial Sequence
  chemically synthesized
cccatggatgtgtcatagtaca

SEQ ID NO: 952681 - DNA, 22 bp, Artificial Sequence
  chemically synthesized
tttcctctagaatgtactatga

SEQ ID NO: 952682 - DNA, 22 bp, Artificial Sequence
  chemically synthesized
ttttcctctagaatgtactatg

SEQ ID NO: 952683 - DNA, 22 bp, Artificial Sequence
  chemically synthesized
cttttttcctctagaatgtact

SEQ ID NO: 952684 - DNA, 22 bp, Artificial Sequence
  chemically synthesized
atataatcaattacttttttcc

SEQ ID NO: 952685 - DNA, 22 bp, Artificial Sequence
  chemically synthesized
catataatcaattacttttttc

SEQ ID NO: 952686 - DNA, 22 bp, Artificial Sequence
  chemically synthesized
atcttcatataatcaattactt

SEQ ID NO: 952687 - DNA, 22 bp, Artificial Sequence
  chemically synthesized
tagaggaaaaaagtaattgatt

SEQ ID NO: 952688 - DNA, 22 bp, Artificial Sequence
  chemically synthesized
taatcttcatataatcaattac

SEQ ID NO: 952689 - DNA, 22 bp, Artificial Sequence
  chemically synthesized
gaggaaaaaagtaattgattat

SEQ ID NO: 952690 - DNA, 22 bp, Artificial Sequence
  chemically synthesized
ttctaatcttcatataatcaat

SEQ ID NO: 952691 - DNA, 22 bp, Artificial Sequence
  chemically synthesized
aatatacctattctaatcttca

SEQ ID NO: 952692 - DNA, 22 bp, Artificial Sequence
  chemically synthesized
ttaaatatacctattctaatct

SEQ ID NO: 952693 - DNA, 22 bp, Artificial Sequence
  chemically synthesized
gttaaatatacctattctaatc

SEQ ID NO: 952694 - DNA, 22 bp, Artificial Sequence
  chemically synthesized
attatatgaagattagaatagg

SEQ ID NO: 952695 - DNA, 22 bp, Artificial Sequence
  chemically synthesized
cttgttaaatatacctattcta

SEQ ID NO: 952696 - DNA, 22 bp, Artificial Sequence
  chemically synthesized
tatgaagattagaataggtata

SEQ ID NO: 952697 - DNA, 22 bp, Artificial Sequence
  chemically synthesized
cctgcttgttaaatatacctat

SEQ ID NO: 952698 - DNA, 22 bp, Artificial Sequence
  chemically synthesized
gaataggtatatttaacaagca

SEQ ID NO: 952699 - DNA, 22 bp, Artificial Sequence
  chemically synthesized
cacaaacactacctgcttgtta

SEQ ID NO: 952700 - DNA, 22 bp, Artificial Sequence
  chemically synthesized
ccacaaacactacctgcttgtt

SEQ ID NO: 952701 - DNA, 22 bp, Artificial Sequence
  chemically synthesized
gaacatttccacaaacactacc

SEQ ID NO: 952702 - DNA, 22 bp, Artificial Sequence
  chemically synthesized
agaacatttccacaaacactac

SEQ ID NO: 952703 - DNA, 22 bp, Artificial Sequence
  chemically synthesized
aacaagcaggtagtgtttgtgg

SEQ ID NO: 952704 - DNA, 22 bp, Artificial Sequence
  chemically synthesized
acaagcaggtagtgtttgtgga

SEQ ID NO: 952705 - DNA, 22 bp, Artificial Sequence
  chemically synthesized
acatcttagaacatttccacaa

SEQ ID NO: 952706 - DNA, 22 bp, Artificial Sequence
  chemically synthesized
taacatcttagaacatttccac

SEQ ID NO: 952707 - DNA, 22 bp, Artificial Sequence
  chemically synthesized
ctaacatcttagaacatttcca

SEQ ID NO: 952708 - DNA, 22 bp, Artificial Sequence
  chemically synthesized
tctaacatcttagaacatttcc

SEQ ID NO: 952709 - DNA, 22 bp, Artificial Sequence
  chemically synthesized
ttctaacatcttagaacatttc

SEQ ID NO: 952710 - DNA, 22 bp, Artificial Sequence
  chemically synthesized
tttttctaacatcttagaacat

SEQ ID NO: 952711 - DNA, 22 bp, Artificial Sequence
  chemically synthesized
atttttctaacatcttagaaca

SEQ ID NO: 952712 - DNA, 22 bp, Artificial Sequence
  chemically synthesized
ttatttttctaacatcttagaa

SEQ ID NO: 952713 - DNA, 22 bp, Artificial Sequence
  chemically synthesized
gtggaaatgttctaagatgtta

SEQ ID NO: 952714 - DNA, 22 bp, Artificial Sequence
  chemically synthesized
ttcttatttttctaacatctta

SEQ ID NO: 952715 - DNA, 22 bp, Artificial Sequence
  chemically synthesized
tggaaatgttctaagatgttag

SEQ ID NO: 952716 - DNA, 22 bp, Artificial Sequence
  chemically synthesized
attcttatttttctaacatctt

SEQ ID NO: 952717 - DNA, 22 bp, Artificial Sequence
  chemically synthesized
taagatgttagaaaaataagaa

SEQ ID NO: 952718 - DNA, 22 bp, Artificial Sequence
  chemically synthesized
agatgttagaaaaataagaata

SEQ ID NO: 952719 - DNA, 22 bp, Artificial Sequence
  chemically synthesized
tgaaacagtagatcttattctt

SEQ ID NO: 952720 - DNA, 22 bp, Artificial Sequence
  chemically synthesized
gaaaaataagaataagatctac

SEQ ID NO: 952721 - DNA, 22 bp, Artificial Sequence
  chemically synthesized
tgctatgaaacagtagatctta

SEQ ID NO: 952722 - DNA, 22 bp, Artificial Sequence
  chemically synthesized
ttgtgctatgaaacagtagatc

SEQ ID NO: 952723 - DNA, 22 bp, Artificial Sequence
  chemically synthesized
tagcaaccctattgtgctatga

SEQ ID NO: 952724 - DNA, 22 bp, Artificial Sequence
  chemically synthesized
actatagcaaccctattgtgct

SEQ ID NO: 952725 - DNA, 22 bp, Artificial Sequence
  chemically synthesized
ctgtttcatagcacaatagggt

SEQ ID NO: 952726 - DNA, 22 bp, Artificial Sequence
  chemically synthesized
ctgactatagcaaccctattgt

SEQ ID NO: 952727 - DNA, 22 bp, Artificial Sequence
  chemically synthesized
tttcatagcacaatagggttgc

SEQ ID NO: 952728 - DNA, 22 bp, Artificial Sequence
  chemically synthesized
ttactgactatagcaaccctat

SEQ ID NO: 952729 - DNA, 22 bp, Artificial Sequence
  chemically synthesized
catagcacaatagggttgctat

SEQ ID NO: 952730 - DNA, 22 bp, Artificial Sequence
  chemically synthesized
atagcacaatagggttgctata

SEQ ID NO: 952731 - DNA, 22 bp, Artificial Sequence
  chemically synthesized
agttattactgactatagcaac

SEQ ID NO: 952732 - DNA, 22 bp, Artificial Sequence
  chemically synthesized
aaatgtaccattaagttattac

SEQ ID NO: 952733 - DNA, 22 bp, Artificial Sequence
  chemically synthesized
aaaatgtaccattaagttatta

SEQ ID NO: 952734 - DNA, 22 bp, Artificial Sequence
  chemically synthesized
taaaatgtaccattaagttatt

SEQ ID NO: 952735 - DNA, 22 bp, Artificial Sequence
  chemically synthesized
ctatagtcagtaataacttaat

SEQ ID NO: 952736 - DNA, 22 bp, Artificial Sequence
  chemically synthesized
ttttaaaatgtaccattaagtt

SEQ ID NO: 952737 - DNA, 22 bp, Artificial Sequence
  chemically synthesized
tagtcagtaataacttaatggt

SEQ ID NO: 952738 - DNA, 22 bp, Artificial Sequence
  chemically synthesized
gttattttaaaatgtaccatta

SEQ ID NO: 952739 - DNA, 22 bp, Artificial Sequence
  chemically synthesized
ttagttattttaaaatgtacca

SEQ ID NO: 952740 - DNA, 22 bp, Artificial Sequence
  chemically synthesized
tgttagttattttaaaatgtac

SEQ ID NO: 952741 - DNA, 22 bp, Artificial Sequence
  chemically synthesized
tactctgttagttattttaaaa

SEQ ID NO: 952742 - DNA, 22 bp, Artificial Sequence
  chemically synthesized
aatggtacattttaaaataact

SEQ ID NO: 952743 - DNA, 22 bp, Artificial Sequence
  chemically synthesized
atggtacattttaaaataacta

SEQ ID NO: 952744 - DNA, 22 bp, Artificial Sequence
  chemically synthesized
attatactctgttagttatttt

SEQ ID NO: 952745 - DNA, 22 bp, Artificial Sequence
  chemically synthesized
taattatactctgttagttatt

SEQ ID NO: 952746 - DNA, 22 bp, Artificial Sequence
  chemically synthesized
taaaataactaacagagtataa

SEQ ID NO: 952747 - DNA, 22 bp, Artificial Sequence
  chemically synthesized
caaacattctaattatactctg

SEQ ID NO: 952748 - DNA, 22 bp, Artificial Sequence
  chemically synthesized
aaaataactaacagagtataat

SEQ ID NO: 952749 - DNA, 22 bp, Artificial Sequence
  chemically synthesized
aaataactaacagagtataatt

SEQ ID NO: 952750 - DNA, 22 bp, Artificial Sequence
  chemically synthesized
tattacaaacattctaattata

SEQ ID NO: 952751 - DNA, 22 bp, Artificial Sequence
  chemically synthesized
gtattacaaacattctaattat

SEQ ID NO: 952752 - DNA, 22 bp, Artificial Sequence
  chemically synthesized
tgtattacaaacattctaatta

SEQ ID NO: 952753 - DNA, 22 bp, Artificial Sequence
  chemically synthesized
acagagtataattagaatgttt

SEQ ID NO: 952754 - DNA, 22 bp, Artificial Sequence
  chemically synthesized
tgctttgtattacaaacattct

SEQ ID NO: 952755 - DNA, 22 bp, Artificial Sequence
  chemically synthesized
gtgctttgtattacaaacattc

SEQ ID NO: 952756 - DNA, 22 bp, Artificial Sequence
  chemically synthesized
aagcatttgtgctttgtattac

SEQ ID NO: 952757 - DNA, 22 bp, Artificial Sequence
  chemically synthesized
caagcatttgtgctttgtatta

SEQ ID NO: 952758 - DNA, 22 bp, Artificial Sequence
  chemically synthesized
gaatgtttgtaatacaaagcac

SEQ ID NO: 952759 - DNA, 22 bp, Artificial Sequence
  chemically synthesized
tcccttcaagcatttgtgcttt

SEQ ID NO: 952760 - DNA, 22 bp, Artificial Sequence
  chemically synthesized
tctatcccttcaagcatttgtg

SEQ ID NO: 952761 - DNA, 22 bp, Artificial Sequence
  chemically synthesized
gtaatacaaagcacaaatgctt

SEQ ID NO: 952762 - DNA, 22 bp, Artificial Sequence
  chemically synthesized
taatacaaagcacaaatgcttg

SEQ ID NO: 952763 - DNA, 22 bp, Artificial Sequence
  chemically synthesized
gaagggatagataacccattct

SEQ ID NO: 952764 - DNA, 22 bp, Artificial Sequence
  chemically synthesized
aagggatagataacccattctc

SEQ ID NO: 952765 - DNA, 22 bp, Artificial Sequence
  chemically synthesized
aatatgaaatagtcacatcatg

SEQ ID NO: 952766 - DNA, 22 bp, Artificial Sequence
  chemically synthesized
tccatgatgtgactatttcata

SEQ ID NO: 952767 - DNA, 22 bp, Artificial Sequence
  chemically synthesized
catgatgtgactatttcatatt

SEQ ID NO: 952768 - DNA, 22 bp, Artificial Sequence
  chemically synthesized
acacaagcattcaatatgaaat

SEQ ID NO: 952769 - DNA, 22 bp, Artificial Sequence
  chemically synthesized
aacacaagcattcaatatgaaa

SEQ ID NO: 952770 - DNA, 22 bp, Artificial Sequence
  chemically synthesized
taacacaagcattcaatatgaa

SEQ ID NO: 952771 - DNA, 22 bp, Artificial Sequence
  chemically synthesized
tttcatattgaatgcttgtgtt

SEQ ID NO: 952772 - DNA, 22 bp, Artificial Sequence
  chemically synthesized
catattgaatgcttgtgttaaa

SEQ ID NO: 952773 - DNA, 22 bp, Artificial Sequence
  chemically synthesized
atattgaatgcttgtgttaaaa

SEQ ID NO: 952774 - DNA, 22 bp, Artificial Sequence
  chemically synthesized
atggggtacaagagaggtttta

SEQ ID NO: 952775 - DNA, 22 bp, Artificial Sequence
  chemically synthesized
aatgcttgtgttaaaacctctc

SEQ ID NO: 952776 - DNA, 22 bp, Artificial Sequence
  chemically synthesized
gtgttaaaacctctcttgtacc

SEQ ID NO: 952777 - DNA, 22 bp, Artificial Sequence
  chemically synthesized
tgttaaaacctctcttgtaccc

SEQ ID NO: 952778 - DNA, 22 bp, Artificial Sequence
  chemically synthesized
aaacctctcttgtaccccatca

SEQ ID NO: 952779 - DNA, 22 bp, Artificial Sequence
  chemically synthesized
tcttgtaccccatcaatatata

SEQ ID NO: 952780 - DNA, 22 bp, Artificial Sequence
  chemically synthesized
ttgtaccccatcaatatataca

SEQ ID NO: 952781 - DNA, 22 bp, Artificial Sequence
  chemically synthesized
gtaccccatcaatatatacacc

SEQ ID NO: 952782 - DNA, 22 bp, Artificial Sequence
  chemically synthesized
taccccatcaatatatacacct

SEQ ID NO: 952783 - DNA, 22 bp, Artificial Sequence
  chemically synthesized
cctcatgtaccccgttgacata

SEQ ID NO: 952784 - DNA, 22 bp, Artificial Sequence
  chemically synthesized
ctcatgtaccccgttgacatat

SEQ ID NO: 952785 - DNA, 22 bp, Artificial Sequence
  chemically synthesized
atgtaccccgttgacatataca

SEQ ID NO: 952786 - DNA, 22 bp, Artificial Sequence
  chemically synthesized
tgagtacatggtaggtgtatat

SEQ ID NO: 952787 - DNA, 22 bp, Artificial Sequence
  chemically synthesized
gtgagtacatggtaggtgtata

SEQ ID NO: 952788 - DNA, 22 bp, Artificial Sequence
  chemically synthesized
tgtgagtacatggtaggtgtat

SEQ ID NO: 952789 - DNA, 22 bp, Artificial Sequence
  chemically synthesized
tctttgtgagtacatggtaggt

SEQ ID NO: 952790 - DNA, 22 bp, Artificial Sequence
  chemically synthesized
atctttgtgagtacatggtagg

SEQ ID NO: 952791 - DNA, 22 bp, Artificial Sequence
  chemically synthesized
tatctttgtgagtacatggtag

SEQ ID NO: 952792 - DNA, 22 bp, Artificial Sequence
  chemically synthesized
ttatctttgtgagtacatggta

SEQ ID NO: 952793 - DNA, 22 bp, Artificial Sequence
  chemically synthesized
acatatacacctaccatgtact

SEQ ID NO: 952794 - DNA, 22 bp, Artificial Sequence
  chemically synthesized
tttatctttgtgagtacatggt

SEQ ID NO: 952795 - DNA, 22 bp, Artificial Sequence
  chemically synthesized
aatgggttttttatctttgtga

SEQ ID NO: 952796 - DNA, 22 bp, Artificial Sequence
  chemically synthesized
caatgggttttttatctttgtg

SEQ ID NO: 952797 - DNA, 22 bp, Artificial Sequence
  chemically synthesized
tcaatgggttttttatctttgt

SEQ ID NO: 952798 - DNA, 22 bp, Artificial Sequence
  chemically synthesized
ccatgtactcacaaagataaaa

SEQ ID NO: 952799 - DNA, 22 bp, Artificial Sequence
  chemically synthesized
tttcaatgggttttttatcttt

SEQ ID NO: 952800 - DNA, 22 bp, Artificial Sequence
  chemically synthesized
ctttcaatgggttttttatctt

SEQ ID NO: 952801 - DNA, 22 bp, Artificial Sequence
  chemically synthesized
tctttcaatgggttttttatct

SEQ ID NO: 952802 - DNA, 22 bp, Artificial Sequence
  chemically synthesized
ttctttcaatgggttttttatc

SEQ ID NO: 952803 - DNA, 22 bp, Artificial Sequence
  chemically synthesized
tttctttcaatgggttttttat

SEQ ID NO: 952804 - DNA, 22 bp, Artificial Sequence
  chemically synthesized
agttttttctttcaatgggttt

SEQ ID NO: 952805 - DNA, 22 bp, Artificial Sequence
  chemically synthesized
acaaagataaaaaacccattga

SEQ ID NO: 952806 - DNA, 22 bp, Artificial Sequence
  chemically synthesized
aagttttttctttcaatgggtt

SEQ ID NO: 952807 - DNA, 22 bp, Artificial Sequence
  chemically synthesized
taagttttttctttcaatgggt

SEQ ID NO: 952808 - DNA, 22 bp, Artificial Sequence
  chemically synthesized
ttaagttttttctttcaatggg

SEQ ID NO: 952809 - DNA, 22 bp, Artificial Sequence
  chemically synthesized
ttttaagttttttctttcaatg

SEQ ID NO: 952810 - DNA, 22 bp, Artificial Sequence
  chemically synthesized
cttttaagttttttctttcaat

SEQ ID NO: 952811 - DNA, 22 bp, Artificial Sequence
  chemically synthesized
tcttttaagttttttctttcaa

SEQ ID NO: 952812 - DNA, 22 bp, Artificial Sequence
  chemically synthesized
ttcttttaagttttttctttca

SEQ ID NO: 952813 - DNA, 22 bp, Artificial Sequence
  chemically synthesized
catttttcttttaagttttttc

SEQ ID NO: 952814 - DNA, 22 bp, Artificial Sequence
  chemically synthesized
ccatttttcttttaagtttttt

SEQ ID NO: 952815 - DNA, 22 bp, Artificial Sequence
  chemically synthesized
aaagaaaaaacttaaaagaaaa

SEQ ID NO: 952816 - DNA, 22 bp, Artificial Sequence
  chemically synthesized
gagcatttccatttttctttta

SEQ ID NO: 952817 - DNA, 22 bp, Artificial Sequence
  chemically synthesized
agagcatttccatttttctttt

SEQ ID NO: 952818 - DNA, 22 bp, Artificial Sequence
  chemically synthesized
ttagagcatttccatttttctt

SEQ ID NO: 952819 - DNA, 22 bp, Artificial Sequence
  chemically synthesized
aaaagaaaaatggaaatgctct

SEQ ID NO: 952820 - DNA, 22 bp, Artificial Sequence
  chemically synthesized
tcgtcatctcttagagcatttc

SEQ ID NO: 952821 - DNA, 22 bp, Artificial Sequence
  chemically synthesized
aaagaaaaatggaaatgctcta

SEQ ID NO: 952822 - DNA, 22 bp, Artificial Sequence
  chemically synthesized
cctgtcgtcatctcttagagca

SEQ ID NO: 952823 - DNA, 22 bp, Artificial Sequence
  chemically synthesized
agacgtatattacctgtcgtca

SEQ ID NO: 952824 - DNA, 22 bp, Artificial Sequence
  chemically synthesized
taagagatgacgacaggtaata

SEQ ID NO: 952825 - DNA, 22 bp, Artificial Sequence
  chemically synthesized
agagatgacgacaggtaatata

SEQ ID NO: 952826 - DNA, 22 bp, Artificial Sequence
  chemically synthesized
caaaaataaacacatacataaa

SEQ ID NO: 952827 - DNA, 22 bp, Artificial Sequence
  chemically synthesized
gcaaaaataaacacatacataa

SEQ ID NO: 952828 - DNA, 22 bp, Artificial Sequence
  chemically synthesized
ttgcaaaaataaacacatacat

SEQ ID NO: 952829 - DNA, 22 bp, Artificial Sequence
  chemically synthesized
agtgcatttatgtatgtgttta

SEQ ID NO: 952830 - DNA, 22 bp, Artificial Sequence
  chemically synthesized
gtgcatttatgtatgtgtttat

SEQ ID NO: 952831 - DNA, 22 bp, Artificial Sequence
  chemically synthesized
tctcttgcaaaaataaacacat

SEQ ID NO: 952832 - DNA, 22 bp, Artificial Sequence
  chemically synthesized
tgtctatctcttgcaaaaataa

SEQ ID NO: 952833 - DNA, 22 bp, Artificial Sequence
  chemically synthesized
atgtatgtgtttatttttgcaa

SEQ ID NO: 952834 - DNA, 22 bp, Artificial Sequence
  chemically synthesized
tgtatgtgtttatttttgcaag

SEQ ID NO: 952835 - DNA, 22 bp, Artificial Sequence
  chemically synthesized
acagttatgtctatctcttgca

SEQ ID NO: 952836 - DNA, 22 bp, Artificial Sequence
  chemically synthesized
atttttgcaagagatagacata

SEQ ID NO: 952837 - DNA, 22 bp, Artificial Sequence
  chemically synthesized
tttttgcaagagatagacataa

SEQ ID NO: 952838 - DNA, 22 bp, Artificial Sequence
  chemically synthesized
ttgcaagagatagacataactg

SEQ ID NO: 952839 - DNA, 22 bp, Artificial Sequence
  chemically synthesized
tgcaagagatagacataactgt

SEQ ID NO: 952840 - DNA, 22 bp, Artificial Sequence
  chemically synthesized
gcaagagatagacataactgtc

SEQ ID NO: 952841 - DNA, 22 bp, Artificial Sequence
  chemically synthesized
tgtccaggggctgacagttatg

SEQ ID NO: 952842 - DNA, 22 bp, Artificial Sequence
  chemically synthesized
caagagatagacataactgtca

SEQ ID NO: 952843 - DNA, 22 bp, Artificial Sequence
  chemically synthesized
agctgtgtccaggggctgacag

SEQ ID NO: 952844 - DNA, 22 bp, Artificial Sequence
  chemically synthesized
tccactgagctgtgtccagggg

SEQ ID NO: 952845 - DNA, 22 bp, Artificial Sequence
  chemically synthesized
tcagcccctggacacagctcag

SEQ ID NO: 952846 - DNA, 22 bp, Artificial Sequence
  chemically synthesized
gcaaaagtcactatccactgag

SEQ ID NO: 952847 - DNA, 22 bp, Artificial Sequence
  chemically synthesized
gacacagctcagtggatagtga

SEQ ID NO: 952848 - DNA, 22 bp, Artificial Sequence
  chemically synthesized
agtgttagcaaaagtcactatc

SEQ ID NO: 952849 - DNA, 22 bp, Artificial Sequence
  chemically synthesized
agtggatagtgacttttgctaa

SEQ ID NO: 952850 - DNA, 22 bp, Artificial Sequence
  chemically synthesized
aacatatggaatccattaagtg

SEQ ID NO: 952851 - DNA, 22 bp, Artificial Sequence
  chemically synthesized
ttgaacatatggaatccattaa

SEQ ID NO: 952852 - DNA, 22 bp, Artificial Sequence
  chemically synthesized
attgaacatatggaatccatta

SEQ ID NO: 952853 - DNA, 22 bp, Artificial Sequence
  chemically synthesized
ttgctaacacttaatggattcc

SEQ ID NO: 952854 - DNA, 22 bp, Artificial Sequence
  chemically synthesized
tattgaacatatggaatccatt

SEQ ID NO: 952855 - DNA, 22 bp, Artificial Sequence
  chemically synthesized
tgctaacacttaatggattcca

SEQ ID NO: 952856 - DNA, 22 bp, Artificial Sequence
  chemically synthesized
ttattgaacatatggaatccat

SEQ ID NO: 952857 - DNA, 22 bp, Artificial Sequence
  chemically synthesized
gctaacacttaatggattccat

SEQ ID NO: 952858 - DNA, 22 bp, Artificial Sequence
  chemically synthesized
tttattgaacatatggaatcca

SEQ ID NO: 952859 - DNA, 22 bp, Artificial Sequence
  chemically synthesized
ctaacacttaatggattccata

SEQ ID NO: 952860 - DNA, 22 bp, Artificial Sequence
  chemically synthesized
acacttaatggattccatatgt

SEQ ID NO: 952861 - DNA, 22 bp, Artificial Sequence
  chemically synthesized
aatggattccatatgttcaata

SEQ ID NO: 952862 - DNA, 22 bp, Artificial Sequence
  chemically synthesized
ataatgattttttattgaacat

SEQ ID NO: 952863 - DNA, 22 bp, Artificial Sequence
  chemically synthesized
atggattccatatgttcaataa

SEQ ID NO: 952864 - DNA, 22 bp, Artificial Sequence
  chemically synthesized
tcataatgattttttattgaac

SEQ ID NO: 952865 - DNA, 22 bp, Artificial Sequence
  chemically synthesized
ctcataatgattttttattgaa

SEQ ID NO: 952866 - DNA, 22 bp, Artificial Sequence
  chemically synthesized
tctcataatgattttttattga

SEQ ID NO: 952867 - DNA, 22 bp, Artificial Sequence
  chemically synthesized
catatgttcaataaaaaatcat

SEQ ID NO: 952868 - DNA, 22 bp, Artificial Sequence
  chemically synthesized
agtgaactttctcataatgatt

SEQ ID NO: 952869 - DNA, 22 bp, Artificial Sequence
  chemically synthesized
aataaaaaatcattatgagaaa

SEQ ID NO: 952870 - DNA, 22 bp, Artificial Sequence
  chemically synthesized
tataaaaggttcagtgaacttt

SEQ ID NO: 952871 - DNA, 22 bp, Artificial Sequence
  chemically synthesized
gtataaaaggttcagtgaactt

SEQ ID NO: 952872 - DNA, 22 bp, Artificial Sequence
  chemically synthesized
gtttgtataaaaggttcagtga

SEQ ID NO: 952873 - DNA, 22 bp, Artificial Sequence
  chemically synthesized
tgagaaagttcactgaaccttt

SEQ ID NO: 952874 - DNA, 22 bp, Artificial Sequence
  chemically synthesized
catggttagtttgtataaaagg

SEQ ID NO: 952875 - DNA, 22 bp, Artificial Sequence
  chemically synthesized
gcatggttagtttgtataaaag

SEQ ID NO: 952876 - DNA, 22 bp, Artificial Sequence
  chemically synthesized
tgcatggttagtttgtataaaa

SEQ ID NO: 952877 - DNA, 22 bp, Artificial Sequence
  chemically synthesized
actgaaccttttatacaaacta

SEQ ID NO: 952878 - DNA, 22 bp, Artificial Sequence
  chemically synthesized
agctttgcatggttagtttgta

SEQ ID NO: 952879 - DNA, 22 bp, Artificial Sequence
  chemically synthesized
aaccttttatacaaactaacca

SEQ ID NO: 952880 - DNA, 22 bp, Artificial Sequence
  chemically synthesized
aattgagctttgcatggttagt

SEQ ID NO: 952881 - DNA, 22 bp, Artificial Sequence
  chemically synthesized
gaattgagctttgcatggttag

SEQ ID NO: 952882 - DNA, 22 bp, Artificial Sequence
  chemically synthesized
tgaattgagctttgcatggtta

SEQ ID NO: 952883 - DNA, 22 bp, Artificial Sequence
  chemically synthesized
ttgaattgagctttgcatggtt

SEQ ID NO: 952884 - DNA, 22 bp, Artificial Sequence
  chemically synthesized
ttatacaaactaaccatgcaaa

SEQ ID NO: 952885 - DNA, 22 bp, Artificial Sequence
  chemically synthesized
tttgaattgagctttgcatggt

SEQ ID NO: 952886 - DNA, 22 bp, Artificial Sequence
  chemically synthesized
tatacaaactaaccatgcaaag

SEQ ID NO: 952887 - DNA, 22 bp, Artificial Sequence
  chemically synthesized
atacaaactaaccatgcaaagc

SEQ ID NO: 952888 - DNA, 22 bp, Artificial Sequence
  chemically synthesized
tacaaactaaccatgcaaagct

SEQ ID NO: 952889 - DNA, 22 bp, Artificial Sequence
  chemically synthesized
ggtgcctttttgaattgagctt

SEQ ID NO: 952890 - DNA, 22 bp, Artificial Sequence
  chemically synthesized
ctaggtgcctttttgaattgag

SEQ ID NO: 952891 - DNA, 22 bp, Artificial Sequence
  chemically synthesized
accatgcaaagctcaattcaaa

SEQ ID NO: 952892 - DNA, 22 bp, Artificial Sequence
  chemically synthesized
cctaggtgcctttttgaattga

SEQ ID NO: 952893 - DNA, 22 bp, Artificial Sequence
  chemically synthesized
acttcctaggtgcctttttgaa

SEQ ID NO: 952894 - DNA, 22 bp, Artificial Sequence
  chemically synthesized
cattcacttcctaggtgccttt

SEQ ID NO: 952895 - DNA, 22 bp, Artificial Sequence
  chemically synthesized
aattcaaaaaggcacctaggaa

SEQ ID NO: 952896 - DNA, 22 bp, Artificial Sequence
  chemically synthesized
aaaaaggcacctaggaagtgaa

SEQ ID NO: 952897 - DNA, 22 bp, Artificial Sequence
  chemically synthesized
ggaagtgaatgcaatacttgca

SEQ ID NO: 952898 - DNA, 22 bp, Artificial Sequence
  chemically synthesized
atgtcaaaggaaatatgcaagt

SEQ ID NO: 952899 - DNA, 22 bp, Artificial Sequence
  chemically synthesized
ttcatgtcaaaggaaatatgca

SEQ ID NO: 952900 - DNA, 22 bp, Artificial Sequence
  chemically synthesized
attcatgtcaaaggaaatatgc

SEQ ID NO: 952901 - DNA, 22 bp, Artificial Sequence
  chemically synthesized
tatttattcatgtcaaaggaaa

SEQ ID NO: 952902 - DNA, 22 bp, Artificial Sequence
  chemically synthesized
gtatttattcatgtcaaaggaa

SEQ ID NO: 952903 - DNA, 22 bp, Artificial Sequence
  chemically synthesized
tgtatttattcatgtcaaagga

SEQ ID NO: 952904 - DNA, 22 bp, Artificial Sequence
  chemically synthesized
gcatatttcctttgacatgaat

SEQ ID NO: 952905 - DNA, 22 bp, Artificial Sequence
  chemically synthesized
catatttcctttgacatgaata

SEQ ID NO: 952906 - DNA, 22 bp, Artificial Sequence
  chemically synthesized
cctttgacatgaataaatacaa

SEQ ID NO: 952907 - DNA, 22 bp, Artificial Sequence
  chemically synthesized
ctttgacatgaataaatacaaa

SEQ ID NO: 952908 - DNA, 22 bp, Artificial Sequence
  chemically synthesized
aaataaaatgcctttgtattta

SEQ ID NO: 952909 - DNA, 22 bp, Artificial Sequence
  chemically synthesized
tgacatgaataaatacaaaggc

SEQ ID NO: 952910 - DNA, 22 bp, Artificial Sequence
  chemically synthesized
gacatgaataaatacaaaggca

SEQ ID NO: 952911 - DNA, 22 bp, Artificial Sequence
  chemically synthesized
acatgaataaatacaaaggcat

SEQ ID NO: 952912 - DNA, 22 bp, Artificial Sequence
  chemically synthesized
aattaaaataaaatgcctttgt

SEQ ID NO: 952913 - DNA, 22 bp, Artificial Sequence
  chemically synthesized
actcaattaaaataaaatgcct

SEQ ID NO: 952914 - DNA, 22 bp, Artificial Sequence
  chemically synthesized
aactcaattaaaataaaatgcc

SEQ ID NO: 952915 - DNA, 22 bp, Artificial Sequence
  chemically synthesized
taactcaattaaaataaaatgc

SEQ ID NO: 952916 - DNA, 22 bp, Artificial Sequence
  chemically synthesized
tgctttaactcaattaaaataa

SEQ ID NO: 952917 - DNA, 22 bp, Artificial Sequence
  chemically synthesized
ttatgctttaactcaattaaaa

SEQ ID NO: 952918 - DNA, 22 bp, Artificial Sequence
  chemically synthesized
tattttaattgagttaaagcat

SEQ ID NO: 952919 - DNA, 22 bp, Artificial Sequence
  chemically synthesized
attttaattgagttaaagcata

SEQ ID NO: 952920 - DNA, 22 bp, Artificial Sequence
  chemically synthesized
ttttaattgagttaaagcataa

SEQ ID NO: 952921 - DNA, 22 bp, Artificial Sequence
  chemically synthesized
tgcaagagaaactattatgctt

SEQ ID NO: 952922 - DNA, 22 bp, Artificial Sequence
  chemically synthesized
taattgagttaaagcataatag

SEQ ID NO: 952923 - DNA, 22 bp, Artificial Sequence
  chemically synthesized
atgcaagagaaactattatgct

SEQ ID NO: 952924 - DNA, 22 bp, Artificial Sequence
  chemically synthesized
aattgagttaaagcataatagt

SEQ ID NO: 952925 - DNA, 22 bp, Artificial Sequence
  chemically synthesized
attgagttaaagcataatagtt

SEQ ID NO: 952926 - DNA, 22 bp, Artificial Sequence
  chemically synthesized
tttatgcaagagaaactattat

SEQ ID NO: 952927 - DNA, 22 bp, Artificial Sequence
  chemically synthesized
agttaaagcataatagtttctc

SEQ ID NO: 952928 - DNA, 22 bp, Artificial Sequence
  chemically synthesized
attatttatgcaagagaaacta

SEQ ID NO: 952929 - DNA, 22 bp, Artificial Sequence
  chemically synthesized
aattatttatgcaagagaaact

SEQ ID NO: 952930 - DNA, 22 bp, Artificial Sequence
  chemically synthesized
taattatttatgcaagagaaac

SEQ ID NO: 952931 - DNA, 22 bp, Artificial Sequence
  chemically synthesized
aagcataatagtttctcttgca

SEQ ID NO: 952932 - DNA, 22 bp, Artificial Sequence
  chemically synthesized
ttttaattatttatgcaagaga

SEQ ID NO: 952933 - DNA, 22 bp, Artificial Sequence
  chemically synthesized
tattttaattatttatgcaaga

SEQ ID NO: 952934 - DNA, 22 bp, Artificial Sequence
  chemically synthesized
ctattttaattatttatgcaag

SEQ ID NO: 952935 - DNA, 22 bp, Artificial Sequence
  chemically synthesized
tctattttaattatttatgcaa

SEQ ID NO: 952936 - DNA, 22 bp, Artificial Sequence
  chemically synthesized
tttctattttaattatttatgc

SEQ ID NO: 952937 - DNA, 22 bp, Artificial Sequence
  chemically synthesized
ctttctattttaattatttatg

SEQ ID NO: 952938 - DNA, 22 bp, Artificial Sequence
  chemically synthesized
tctttctattttaattatttat

SEQ ID NO: 952939 - DNA, 22 bp, Artificial Sequence
  chemically synthesized
ttctttctattttaattattta

SEQ ID NO: 952940 - DNA, 22 bp, Artificial Sequence
  chemically synthesized
tttttctttctattttaattat

SEQ ID NO: 952941 - DNA, 22 bp, Artificial Sequence
  chemically synthesized
ctcttgcataaataattaaaat

SEQ ID NO: 952942 - DNA, 22 bp, Artificial Sequence
  chemically synthesized
tcttgcataaataattaaaata

SEQ ID NO: 952943 - DNA, 22 bp, Artificial Sequence
  chemically synthesized
ttgcataaataattaaaataga

SEQ ID NO: 952944 - DNA, 22 bp, Artificial Sequence
  chemically synthesized
gcataaataattaaaatagaaa

SEQ ID NO: 952945 - DNA, 22 bp, Artificial Sequence
  chemically synthesized
cataaataattaaaatagaaag

SEQ ID NO: 952946 - DNA, 22 bp, Artificial Sequence
  chemically synthesized
tatgctatttttctttctattt

SEQ ID NO: 952947 - DNA, 22 bp, Artificial Sequence
  chemically synthesized
atatgctatttttctttctatt

SEQ ID NO: 952948 - DNA, 22 bp, Artificial Sequence
  chemically synthesized
cttatatgctatttttctttct

SEQ ID NO: 952949 - DNA, 22 bp, Artificial Sequence
  chemically synthesized
aaatagaaagaaaaatagcata

SEQ ID NO: 952950 - DNA, 22 bp, Artificial Sequence
  chemically synthesized
atatcagtaagtctccttatat

SEQ ID NO: 952951 - DNA, 22 bp, Artificial Sequence
  chemically synthesized
ggacagtgcctgatatcagtaa

SEQ ID NO: 952952 - DNA, 22 bp, Artificial Sequence
  chemically synthesized
aggacagtgcctgatatcagta

SEQ ID NO: 952953 - DNA, 22 bp, Artificial Sequence
  chemically synthesized
actgatatcaggcactgtccta

SEQ ID NO: 952954 - DNA, 22 bp, Artificial Sequence
  chemically synthesized
ctgatatcaggcactgtcctaa

SEQ ID NO: 952955 - DNA, 22 bp, Artificial Sequence
  chemically synthesized
atatcaggcactgtcctaagta

SEQ ID NO: 952956 - DNA, 22 bp, Artificial Sequence
  chemically synthesized
agtgtatataatatacttagga

SEQ ID NO: 952957 - DNA, 22 bp, Artificial Sequence
  chemically synthesized
cagtgtatataatatacttagg

SEQ ID NO: 952958 - DNA, 22 bp, Artificial Sequence
  chemically synthesized
atagatatttcagtgtatataa

SEQ ID NO: 952959 - DNA, 22 bp, Artificial Sequence
  chemically synthesized
tcctaagtatattatatacact

SEQ ID NO: 952960 - DNA, 22 bp, Artificial Sequence
  chemically synthesized
gatagatatttcagtgtatata

SEQ ID NO: 952961 - DNA, 22 bp, Artificial Sequence
  chemically synthesized
tgatagatatttcagtgtatat

SEQ ID NO: 952962 - DNA, 22 bp, Artificial Sequence
  chemically synthesized
ttttgatagatatttcagtgta

SEQ ID NO: 952963 - DNA, 22 bp, Artificial Sequence
  chemically synthesized
agtatattatatacactgaaat

SEQ ID NO: 952964 - DNA, 22 bp, Artificial Sequence
  chemically synthesized
gttttgatagatatttcagtgt

SEQ ID NO: 952965 - DNA, 22 bp, Artificial Sequence
  chemically synthesized
ataggcttgttttgatagatat

SEQ ID NO: 952966 - DNA, 22 bp, Artificial Sequence
  chemically synthesized
tatacactgaaatatctatcaa

SEQ ID NO: 952967 - DNA, 22 bp, Artificial Sequence
  chemically synthesized
tcataggcttgttttgatagat

SEQ ID NO: 952968 - DNA, 22 bp, Artificial Sequence
  chemically synthesized
aaatatctatcaaaacaagcct

SEQ ID NO: 952969 - DNA, 22 bp, Artificial Sequence
  chemically synthesized
ataatcgtctctcataggcttg

SEQ ID NO: 952970 - DNA, 22 bp, Artificial Sequence
  chemically synthesized
atctaataatcgtctctcatag

SEQ ID NO: 952971 - DNA, 22 bp, Artificial Sequence
  chemically synthesized
tcaaaacaagcctatgagagac

SEQ ID NO: 952972 - DNA, 22 bp, Artificial Sequence
  chemically synthesized
aaattgatctaataatcgtctc

SEQ ID NO: 952973 - DNA, 22 bp, Artificial Sequence
  chemically synthesized
tcaaattgatctaataatcgtc

SEQ ID NO: 952974 - DNA, 22 bp, Artificial Sequence
  chemically synthesized
tctcaaattgatctaataatcg

SEQ ID NO: 952975 - DNA, 22 bp, Artificial Sequence
  chemically synthesized
ctctcaaattgatctaataatc

SEQ ID NO: 952976 - DNA, 22 bp, Artificial Sequence
  chemically synthesized
tctctcaaattgatctaataat

SEQ ID NO: 952977 - DNA, 22 bp, Artificial Sequence
  chemically synthesized
ttctctcaaattgatctaataa

SEQ ID NO: 952978 - DNA, 22 bp, Artificial Sequence
  chemically synthesized
tgagagacgattattagatcaa

SEQ ID NO: 952979 - DNA, 22 bp, Artificial Sequence
  chemically synthesized
atttttctctcaaattgatcta

SEQ ID NO: 952980 - DNA, 22 bp, Artificial Sequence
  chemically synthesized
agttaatttttctctcaaattg

SEQ ID NO: 952981 - DNA, 22 bp, Artificial Sequence
  chemically synthesized
ttagatcaatttgagagaaaaa

SEQ ID NO: 952982 - DNA, 22 bp, Artificial Sequence
  chemically synthesized
gatcaatttgagagaaaaatta

SEQ ID NO: 952983 - DNA, 22 bp, Artificial Sequence
  chemically synthesized
cgtaagcctcagttaatttttc

SEQ ID NO: 952984 - DNA, 22 bp, Artificial Sequence
  chemically synthesized
acctacgtaagcctcagttaat

SEQ ID NO: 952985 - DNA, 22 bp, Artificial Sequence
  chemically synthesized
gagagaaaaattaactgaggct

SEQ ID NO: 952986 - DNA, 22 bp, Artificial Sequence
  chemically synthesized
agagaaaaattaactgaggctt

SEQ ID NO: 952987 - DNA, 22 bp, Artificial Sequence
  chemically synthesized
tgggagttaacctacgtaagcc

SEQ ID NO: 952988 - DNA, 22 bp, Artificial Sequence
  chemically synthesized
actgaggcttacgtaggttaac

SEQ ID NO: 952989 - DNA, 22 bp, Artificial Sequence
  chemically synthesized
gtataacctatgggagttaacc

SEQ ID NO: 952990 - DNA, 22 bp, Artificial Sequence
  chemically synthesized
aggcttacgtaggttaactccc

SEQ ID NO: 952991 - DNA, 22 bp, Artificial Sequence
  chemically synthesized
ttagtataacctatgggagtta

SEQ ID NO: 952992 - DNA, 22 bp, Artificial Sequence
  chemically synthesized
acgtaggttaactcccataggt

SEQ ID NO: 952993 - DNA, 22 bp, Artificial Sequence
  chemically synthesized
cgtaggttaactcccataggtt

SEQ ID NO: 952994 - DNA, 22 bp, Artificial Sequence
  chemically synthesized
catcactattagtataacctat

SEQ ID NO: 952995 - DNA, 22 bp, Artificial Sequence
  chemically synthesized
ttgcatcactattagtataacc

SEQ ID NO: 952996 - DNA, 22 bp, Artificial Sequence
  chemically synthesized
attgcatcactattagtataac

SEQ ID NO: 952997 - DNA, 22 bp, Artificial Sequence
  chemically synthesized
actcccataggttatactaata

SEQ ID NO: 952998 - DNA, 22 bp, Artificial Sequence
  chemically synthesized
gtttattgcatcactattagta

SEQ ID NO: 952999 - DNA, 22 bp, Artificial Sequence
  chemically synthesized
ccataggttatactaatagtga

SEQ ID NO: 953000 - DNA, 22 bp, Artificial Sequence
  chemically synthesized
ctggtttattgcatcactatta

SEQ ID NO: 953001 - DNA, 22 bp, Artificial Sequence
  chemically synthesized
tactaatagtgatgcaataaac

SEQ ID NO: 953002 - DNA, 22 bp, Artificial Sequence
  chemically synthesized
ggtgaaactcctggtttattgc

SEQ ID NO: 953003 - DNA, 22 bp, Artificial Sequence
  chemically synthesized
atagtgatgcaataaaccagga

SEQ ID NO: 953004 - DNA, 22 bp, Artificial Sequence
  chemically synthesized
cctaggtgaaactcctggttta

SEQ ID NO: 953005 - DNA, 22 bp, Artificial Sequence
  chemically synthesized
ggcatactgcctaggtgaaact

SEQ ID NO: 953006 - DNA, 22 bp, Artificial Sequence
  chemically synthesized
gggcatactgcctaggtgaaac

SEQ ID NO: 953007 - DNA, 22 bp, Artificial Sequence
  chemically synthesized
tgggcatactgcctaggtgaaa

SEQ ID NO: 953008 - DNA, 22 bp, Artificial Sequence
  chemically synthesized
aaatacatgggctttgggcata

SEQ ID NO: 953009 - DNA, 22 bp, Artificial Sequence
  chemically synthesized
cacctaggcagtatgcccaaag

SEQ ID NO: 953010 - DNA, 22 bp, Artificial Sequence
  chemically synthesized
acctaggcagtatgcccaaagc

SEQ ID NO: 953011 - DNA, 22 bp, Artificial Sequence
  chemically synthesized
ggcagtatgcccaaagcccatg

SEQ ID NO: 953012 - DNA, 22 bp, Artificial Sequence
  chemically synthesized
taatgattaaaatacatgggct

SEQ ID NO: 953013 - DNA, 22 bp, Artificial Sequence
  chemically synthesized
attataatgattaaaatacatg

SEQ ID NO: 953014 - DNA, 22 bp, Artificial Sequence
  chemically synthesized
taatcattataatcagactcct

SEQ ID NO: 953015 - DNA, 22 bp, Artificial Sequence
  chemically synthesized
aatcattataatcagactccta

SEQ ID NO: 953016 - DNA, 22 bp, Artificial Sequence
  chemically synthesized
atcattataatcagactcctac

SEQ ID NO: 953017 - DNA, 22 bp, Artificial Sequence
  chemically synthesized
aaatcagtggtatgtaatgtag

SEQ ID NO: 953018 - DNA, 22 bp, Artificial Sequence
  chemically synthesized
taatcagactcctacattacat

SEQ ID NO: 953019 - DNA, 22 bp, Artificial Sequence
  chemically synthesized
caaattaaaatcagtggtatgt

SEQ ID NO: 953020 - DNA, 22 bp, Artificial Sequence
  chemically synthesized
ccaaattaaaatcagtggtatg

SEQ ID NO: 953021 - DNA, 22 bp, Artificial Sequence
  chemically synthesized
tccaaattaaaatcagtggtat

SEQ ID NO: 953022 - DNA, 22 bp, Artificial Sequence
  chemically synthesized
ctacattacataccactgattt

SEQ ID NO: 953023 - DNA, 22 bp, Artificial Sequence
  chemically synthesized
tctttccaaattaaaatcagtg

SEQ ID NO: 953024 - DNA, 22 bp, Artificial Sequence
  chemically synthesized
cattacataccactgattttaa

SEQ ID NO: 953025 - DNA, 22 bp, Artificial Sequence
  chemically synthesized
cataccactgattttaatttgg

SEQ ID NO: 953026 - DNA, 22 bp, Artificial Sequence
  chemically synthesized
gaaaaaaattatctttccaaat

SEQ ID NO: 953027 - DNA, 22 bp, Artificial Sequence
  chemically synthesized
tagaaaaaaattatctttccaa

SEQ ID NO: 953028 - DNA, 22 bp, Artificial Sequence
  chemically synthesized
ctagaaaaaaattatctttcca

SEQ ID NO: 953029 - DNA, 22 bp, Artificial Sequence
  chemically synthesized
attttaatttggaaagataatt

SEQ ID NO: 953030 - DNA, 22 bp, Artificial Sequence
  chemically synthesized
taatttggaaagataatttttt

SEQ ID NO: 953031 - DNA, 22 bp, Artificial Sequence
  chemically synthesized
aatttggaaagataattttttt

SEQ ID NO: 953032 - DNA, 22 bp, Artificial Sequence
  chemically synthesized
atttggaaagataatttttttc

SEQ ID NO: 953033 - DNA, 22 bp, Artificial Sequence
  chemically synthesized
agaaacatttctagaaaaaaat

SEQ ID NO: 953034 - DNA, 22 bp, Artificial Sequence
  chemically synthesized
ggaaagataatttttttctaga

SEQ ID NO: 953035 - DNA, 22 bp, Artificial Sequence
  chemically synthesized
ttgagaaacatttctagaaaaa

SEQ ID NO: 953036 - DNA, 22 bp, Artificial Sequence
  chemically synthesized
gaaagataatttttttctagaa

SEQ ID NO: 953037 - DNA, 22 bp, Artificial Sequence
  chemically synthesized
ttttctagaaatgtttctcaat

SEQ ID NO: 953038 - DNA, 22 bp, Artificial Sequence
  chemically synthesized
gaacaaaatactattgagaaac

SEQ ID NO: 953039 - DNA, 22 bp, Artificial Sequence
  chemically synthesized
tttctagaaatgtttctcaata

SEQ ID NO: 953040 - DNA, 22 bp, Artificial Sequence
  chemically synthesized
ttctagaaatgtttctcaatag

SEQ ID NO: 953041 - DNA, 22 bp, Artificial Sequence
  chemically synthesized
tctagaaatgtttctcaatagt

SEQ ID NO: 953042 - DNA, 22 bp, Artificial Sequence
  chemically synthesized
ctagaaatgtttctcaatagta

SEQ ID NO: 953043 - DNA, 22 bp, Artificial Sequence
  chemically synthesized
tagaaatgtttctcaatagtat

SEQ ID NO: 953044 - DNA, 22 bp, Artificial Sequence
  chemically synthesized
tattagaacaaaatactattga

SEQ ID NO: 953045 - DNA, 22 bp, Artificial Sequence
  chemically synthesized
gtattagaacaaaatactattg

SEQ ID NO: 953046 - DNA, 22 bp, Artificial Sequence
  chemically synthesized
gaaatgtttctcaatagtattt

SEQ ID NO: 953047 - DNA, 22 bp, Artificial Sequence
  chemically synthesized
acatttgtattagaacaaaata

SEQ ID NO: 953048 - DNA, 22 bp, Artificial Sequence
  chemically synthesized
ctcaatagtattttgttctaat

SEQ ID NO: 953049 - DNA, 22 bp, Artificial Sequence
  chemically synthesized
tcaatagtattttgttctaata

SEQ ID NO: 953050 - DNA, 22 bp, Artificial Sequence
  chemically synthesized
aatagtattttgttctaataca

SEQ ID NO: 953051 - DNA, 22 bp, Artificial Sequence
  chemically synthesized
aaggtgttcacatttgtattag

SEQ ID NO: 953052 - DNA, 22 bp, Artificial Sequence
  chemically synthesized
aaaggtgttcacatttgtatta

SEQ ID NO: 953053 - DNA, 22 bp, Artificial Sequence
  chemically synthesized
taaaggtgttcacatttgtatt

SEQ ID NO: 953054 - DNA, 22 bp, Artificial Sequence
  chemically synthesized
tgttctaatacaaatgtgaaca

SEQ ID NO: 953055 - DNA, 22 bp, Artificial Sequence
  chemically synthesized
ggattttaaaggtgttcacatt

SEQ ID NO: 953056 - DNA, 22 bp, Artificial Sequence
  chemically synthesized
gttctaatacaaatgtgaacac

SEQ ID NO: 953057 - DNA, 22 bp, Artificial Sequence
  chemically synthesized
aggattttaaaggtgttcacat

SEQ ID NO: 953058 - DNA, 22 bp, Artificial Sequence
  chemically synthesized
ttctaatacaaatgtgaacacc

SEQ ID NO: 953059 - DNA, 22 bp, Artificial Sequence
  chemically synthesized
taggattttaaaggtgttcaca

SEQ ID NO: 953060 - DNA, 22 bp, Artificial Sequence
  chemically synthesized
ttaggattttaaaggtgttcac

SEQ ID NO: 953061 - DNA, 22 bp, Artificial Sequence
  chemically synthesized
taatacaaatgtgaacaccttt

SEQ ID NO: 953062 - DNA, 22 bp, Artificial Sequence
  chemically synthesized
atacaaatgtgaacacctttaa

SEQ ID NO: 953063 - DNA, 22 bp, Artificial Sequence
  chemically synthesized
acacttttaggattttaaaggt

SEQ ID NO: 953064 - DNA, 22 bp, Artificial Sequence
  chemically synthesized
aacacttttaggattttaaagg

SEQ ID NO: 953065 - DNA, 22 bp, Artificial Sequence
  chemically synthesized
tttaacacttttaggattttaa

SEQ ID NO: 953066 - DNA, 22 bp, Artificial Sequence
  chemically synthesized
gtttaacacttttaggatttta

SEQ ID NO: 953067 - DNA, 22 bp, Artificial Sequence
  chemically synthesized
ccccccaacttgtttaacactt

SEQ ID NO: 953068 - DNA, 22 bp, Artificial Sequence
  chemically synthesized
taaaatcctaaaagtgttaaac

SEQ ID NO: 953069 - DNA, 22 bp, Artificial Sequence
  chemically synthesized
aaaatcctaaaagtgttaaaca

SEQ ID NO: 953070 - DNA, 22 bp, Artificial Sequence
  chemically synthesized
aaatcctaaaagtgttaaacaa

SEQ ID NO: 953071 - DNA, 22 bp, Artificial Sequence
  chemically synthesized
ttaccccccaacttgtttaaca

SEQ ID NO: 953072 - DNA, 22 bp, Artificial Sequence
  chemically synthesized
aaagtgttaaacaagttggggg

SEQ ID NO: 953073 - DNA, 22 bp, Artificial Sequence
  chemically synthesized
ggagaatgtcagattattaccc

SEQ ID NO: 953074 - DNA, 22 bp, Artificial Sequence
  chemically synthesized
aacaagttggggggtaataatc

SEQ ID NO: 953075 - DNA, 22 bp, Artificial Sequence
  chemically synthesized
cctgggagaatgtcagattatt

SEQ ID NO: 953076 - DNA, 22 bp, Artificial Sequence
  chemically synthesized
acctgggagaatgtcagattat

SEQ ID NO: 953077 - DNA, 22 bp, Artificial Sequence
  chemically synthesized
gggggtaataatctgacattct

SEQ ID NO: 953078 - DNA, 22 bp, Artificial Sequence
  chemically synthesized
gaaatccccttacctgggagaa

SEQ ID NO: 953079 - DNA, 22 bp, Artificial Sequence
  chemically synthesized
ttcgaaatccccttacctggga

SEQ ID NO: 953080 - DNA, 22 bp, Artificial Sequence
  chemically synthesized
attcgaaatccccttacctggg

SEQ ID NO: 953081 - DNA, 22 bp, Artificial Sequence
  chemically synthesized
acattctcccaggtaaggggat

SEQ ID NO: 953082 - DNA, 22 bp, Artificial Sequence
  chemically synthesized
tcccaggtaaggggatttcgaa

SEQ ID NO: 953083 - DNA, 22 bp, Artificial Sequence
  chemically synthesized
ccaggtaaggggatttcgaata

SEQ ID NO: 953084 - DNA, 22 bp, Artificial Sequence
  chemically synthesized
ccatgccataggaagaccttat

SEQ ID NO: 953085 - DNA, 22 bp, Artificial Sequence
  chemically synthesized
atgttgccatgccataggaaga

SEQ ID NO: 953086 - DNA, 22 bp, Artificial Sequence
  chemically synthesized
aatgttgccatgccataggaag

SEQ ID NO: 953087 - DNA, 22 bp, Artificial Sequence
  chemically synthesized
taatgttgccatgccataggaa

SEQ ID NO: 953088 - DNA, 22 bp, Artificial Sequence
  chemically synthesized
cgaataaggtcttcctatggca

SEQ ID NO: 953089 - DNA, 22 bp, Artificial Sequence
  chemically synthesized
gaataaggtcttcctatggcat

SEQ ID NO: 953090 - DNA, 22 bp, Artificial Sequence
  chemically synthesized
gtgaggactttaatgttgccat

SEQ ID NO: 953091 - DNA, 22 bp, Artificial Sequence
  chemically synthesized
agtgaggactttaatgttgcca

SEQ ID NO: 953092 - DNA, 22 bp, Artificial Sequence
  chemically synthesized
cctatggcatggcaacattaaa

SEQ ID NO: 953093 - DNA, 22 bp, Artificial Sequence
  chemically synthesized
cttagtgaggactttaatgttg

SEQ ID NO: 953094 - DNA, 22 bp, Artificial Sequence
  chemically synthesized
ctatggcatggcaacattaaag

SEQ ID NO: 953095 - DNA, 22 bp, Artificial Sequence
  chemically synthesized
tggcatggcaacattaaagtcc

SEQ ID NO: 953096 - DNA, 22 bp, Artificial Sequence
  chemically synthesized
aataacatgttgcttagtgagg

SEQ ID NO: 953097 - DNA, 22 bp, Artificial Sequence
  chemically synthesized
aagtcctcactaagcaacatgt

SEQ ID NO: 953098 - DNA, 22 bp, Artificial Sequence
  chemically synthesized
actaagcaacatgttatttaac

SEQ ID NO: 953099 - DNA, 22 bp, Artificial Sequence
  chemically synthesized
ccagtgtcatgaagttaaataa

SEQ ID NO: 953100 - DNA, 22 bp, Artificial Sequence
  chemically synthesized
cccagtgtcatgaagttaaata

SEQ ID NO: 953101 - DNA, 22 bp, Artificial Sequence
  chemically synthesized
agcaacatgttatttaacttca

SEQ ID NO: 953102 - DNA, 22 bp, Artificial Sequence
  chemically synthesized
ttcccagtgtcatgaagttaaa

SEQ ID NO: 953103 - DNA, 22 bp, Artificial Sequence
  chemically synthesized
tcttcccagtgtcatgaagtta

SEQ ID NO: 953104 - DNA, 22 bp, Artificial Sequence
  chemically synthesized
tttaacttcatgacactgggaa

SEQ ID NO: 953105 - DNA, 22 bp, Artificial Sequence
  chemically synthesized
gcaaatactctcttcccagtgt

SEQ ID NO: 953106 - DNA, 22 bp, Artificial Sequence
  chemically synthesized
aacttcatgacactgggaagag

SEQ ID NO: 953107 - DNA, 22 bp, Artificial Sequence
  chemically synthesized
acttcatgacactgggaagaga

SEQ ID NO: 953108 - DNA, 22 bp, Artificial Sequence
  chemically synthesized
aagctggcaaatactctcttcc

SEQ ID NO: 953109 - DNA, 22 bp, Artificial Sequence
  chemically synthesized
catgacactgggaagagagtat

SEQ ID NO: 953110 - DNA, 22 bp, Artificial Sequence
  chemically synthesized
taaagctggcaaatactctctt

SEQ ID NO: 953111 - DNA, 22 bp, Artificial Sequence
  chemically synthesized
atgacactgggaagagagtatt

SEQ ID NO: 953112 - DNA, 22 bp, Artificial Sequence
  chemically synthesized
ctaaagctggcaaatactctct

SEQ ID NO: 953113 - DNA, 22 bp, Artificial Sequence
  chemically synthesized
tctaaagctggcaaatactctc

SEQ ID NO: 953114 - DNA, 22 bp, Artificial Sequence
  chemically synthesized
ctttctaaagctggcaaatact

SEQ ID NO: 953115 - DNA, 22 bp, Artificial Sequence
  chemically synthesized
gctttctaaagctggcaaatac

SEQ ID NO: 953116 - DNA, 22 bp, Artificial Sequence
  chemically synthesized
ggaagagagtatttgccagctt

SEQ ID NO: 953117 - DNA, 22 bp, Artificial Sequence
  chemically synthesized
acatttgctttctaaagctggc

SEQ ID NO: 953118 - DNA, 22 bp, Artificial Sequence
  chemically synthesized
aacatttgctttctaaagctgg

SEQ ID NO: 953119 - DNA, 22 bp, Artificial Sequence
  chemically synthesized
ttaacatttgctttctaaagct

SEQ ID NO: 953120 - DNA, 22 bp, Artificial Sequence
  chemically synthesized
gattcttaacatttgctttcta

SEQ ID NO: 953121 - DNA, 22 bp, Artificial Sequence
  chemically synthesized
agattcttaacatttgctttct

SEQ ID NO: 953122 - DNA, 22 bp, Artificial Sequence
  chemically synthesized
gccagctttagaaagcaaatgt

SEQ ID NO: 953123 - DNA, 22 bp, Artificial Sequence
  chemically synthesized
ccagctttagaaagcaaatgtt

SEQ ID NO: 953124 - DNA, 22 bp, Artificial Sequence
  chemically synthesized
ataatgtttagattcttaacat

SEQ ID NO: 953125 - DNA, 22 bp, Artificial Sequence
  chemically synthesized
gataatgtttagattcttaaca

SEQ ID NO: 953126 - DNA, 22 bp, Artificial Sequence
  chemically synthesized
tagaaagcaaatgttaagaatc

SEQ ID NO: 953127 - DNA, 22 bp, Artificial Sequence
  chemically synthesized
agaaagcaaatgttaagaatct

SEQ ID NO: 953128 - DNA, 22 bp, Artificial Sequence
  chemically synthesized
gaaagcaaatgttaagaatcta

SEQ ID NO: 953129 - DNA, 22 bp, Artificial Sequence
  chemically synthesized
agaatctaaacattatcaaggg

SEQ ID NO: 953130 - DNA, 22 bp, Artificial Sequence
  chemically synthesized
agcaaaatagtccccttgataa

SEQ ID NO: 953131 - DNA, 22 bp, Artificial Sequence
  chemically synthesized
aaaattaagcaaaatagtcccc

SEQ ID NO: 953132 - DNA, 22 bp, Artificial Sequence
  chemically synthesized
aacattatcaaggggactattt

SEQ ID NO: 953133 - DNA, 22 bp, Artificial Sequence
  chemically synthesized
aaagctcaaaattaagcaaaat

SEQ ID NO: 953134 - DNA, 22 bp, Artificial Sequence
  chemically synthesized
tcaaggggactattttgcttaa

SEQ ID NO: 953135 - DNA, 22 bp, Artificial Sequence
  chemically synthesized
gtgttgaaagctcaaaattaag

SEQ ID NO: 953136 - DNA, 22 bp, Artificial Sequence
  chemically synthesized
agtgttgaaagctcaaaattaa

SEQ ID NO: 953137 - DNA, 22 bp, Artificial Sequence
  chemically synthesized
tagtgttgaaagctcaaaatta

SEQ ID NO: 953138 - DNA, 22 bp, Artificial Sequence
  chemically synthesized
tttagtgttgaaagctcaaaat

SEQ ID NO: 953139 - DNA, 22 bp, Artificial Sequence
  chemically synthesized
ctttagtgttgaaagctcaaaa

SEQ ID NO: 953140 - DNA, 22 bp, Artificial Sequence
  chemically synthesized
ttttgcttaattttgagctttc

SEQ ID NO: 953141 - DNA, 22 bp, Artificial Sequence
  chemically synthesized
tgcttaattttgagctttcaac

SEQ ID NO: 953142 - DNA, 22 bp, Artificial Sequence
  chemically synthesized
gcttaattttgagctttcaaca

SEQ ID NO: 953143 - DNA, 22 bp, Artificial Sequence
  chemically synthesized
cttaattttgagctttcaacac

SEQ ID NO: 953144 - DNA, 22 bp, Artificial Sequence
  chemically synthesized
tatacttctttagtgttgaaag

SEQ ID NO: 953145 - DNA, 22 bp, Artificial Sequence
  chemically synthesized
atatacttctttagtgttgaaa

SEQ ID NO: 953146 - DNA, 22 bp, Artificial Sequence
  chemically synthesized
tatatacttctttagtgttgaa

SEQ ID NO: 953147 - DNA, 22 bp, Artificial Sequence
  chemically synthesized
aattttgagctttcaacactaa

SEQ ID NO: 953148 - DNA, 22 bp, Artificial Sequence
  chemically synthesized
attttgagctttcaacactaaa

SEQ ID NO: 953149 - DNA, 22 bp, Artificial Sequence
  chemically synthesized
ctttatatacttctttagtgtt

SEQ ID NO: 953150 - DNA, 22 bp, Artificial Sequence
  chemically synthesized
tgagctttcaacactaaagaag

SEQ ID NO: 953151 - DNA, 22 bp, Artificial Sequence
  chemically synthesized
gagctttcaacactaaagaagt

SEQ ID NO: 953152 - DNA, 22 bp, Artificial Sequence
  chemically synthesized
agctttcaacactaaagaagta

SEQ ID NO: 953153 - DNA, 22 bp, Artificial Sequence
  chemically synthesized
tcaacactaaagaagtatataa

SEQ ID NO: 953154 - DNA, 22 bp, Artificial Sequence
  chemically synthesized
caacactaaagaagtatataaa

SEQ ID NO: 953155 - DNA, 22 bp, Artificial Sequence
  chemically synthesized
aacactaaagaagtatataaag

SEQ ID NO: 953156 - DNA, 22 bp, Artificial Sequence
  chemically synthesized
aagtatacccatgttcctttat

SEQ ID NO: 953157 - DNA, 22 bp, Artificial Sequence
  chemically synthesized
aagaagtatataaaggaacatg

SEQ ID NO: 953158 - DNA, 22 bp, Artificial Sequence
  chemically synthesized
cataatcattgaagtataccca

SEQ ID NO: 953159 - DNA, 22 bp, Artificial Sequence
  chemically synthesized
acataatcattgaagtataccc

SEQ ID NO: 953160 - DNA, 22 bp, Artificial Sequence
  chemically synthesized
gacccttacataatcattgaag

SEQ ID NO: 953161 - DNA, 22 bp, Artificial Sequence
  chemically synthesized
gcctggacccttacataatcat

SEQ ID NO: 953162 - DNA, 22 bp, Artificial Sequence
  chemically synthesized
attagcctggacccttacataa

SEQ ID NO: 953163 - DNA, 22 bp, Artificial Sequence
  chemically synthesized
gattagcctggacccttacata

SEQ ID NO: 953164 - DNA, 22 bp, Artificial Sequence
  chemically synthesized
caatgattatgtaagggtccag

SEQ ID NO: 953165 - DNA, 22 bp, Artificial Sequence
  chemically synthesized
aatgattatgtaagggtccagg

SEQ ID NO: 953166 - DNA, 22 bp, Artificial Sequence
  chemically synthesized
agtgatgatttgattagcctgg

SEQ ID NO: 953167 - DNA, 22 bp, Artificial Sequence
  chemically synthesized
tgtaagggtccaggctaatcaa

SEQ ID NO: 953168 - DNA, 22 bp, Artificial Sequence
  chemically synthesized
atcaaatcatcactgaggtggc

SEQ ID NO: 953169 - DNA, 22 bp, Artificial Sequence
  chemically synthesized
gtgtgtgtaatagccacctcag

SEQ ID NO: 953170 - DNA, 22 bp, Artificial Sequence
  chemically synthesized
ggtgtgtgtaatagccacctca

SEQ ID NO: 953171 - DNA, 22 bp, Artificial Sequence
  chemically synthesized
tatgtttggtgtgtgtaatagc

SEQ ID NO: 953172 - DNA, 22 bp, Artificial Sequence
  chemically synthesized
attatatgtttggtgtgtgtaa

SEQ ID NO: 953173 - DNA, 22 bp, Artificial Sequence
  chemically synthesized
tgattatatgtttggtgtgtgt

SEQ ID NO: 953174 - DNA, 22 bp, Artificial Sequence
  chemically synthesized
aggtggctattacacacaccaa

SEQ ID NO: 953175 - DNA, 22 bp, Artificial Sequence
  chemically synthesized
ctgattatatgtttggtgtgtg

SEQ ID NO: 953176 - DNA, 22 bp, Artificial Sequence
  chemically synthesized
tctgattatatgtttggtgtgt

SEQ ID NO: 953177 - DNA, 22 bp, Artificial Sequence
  chemically synthesized
ttacacacaccaaacatataat

SEQ ID NO: 953178 - DNA, 22 bp, Artificial Sequence
  chemically synthesized
cacacaccaaacatataatcag

SEQ ID NO: 953179 - DNA, 22 bp, Artificial Sequence
  chemically synthesized
atgagccacaattttctgatta

SEQ ID NO: 953180 - DNA, 22 bp, Artificial Sequence
  chemically synthesized
tcatgagccacaattttctgat

SEQ ID NO: 953181 - DNA, 22 bp, Artificial Sequence
  chemically synthesized
ctcatgagccacaattttctga

SEQ ID NO: 953182 - DNA, 22 bp, Artificial Sequence
  chemically synthesized
aacttctcatgagccacaattt

SEQ ID NO: 953183 - DNA, 22 bp, Artificial Sequence
  chemically synthesized
agttaaacttctcatgagccac

SEQ ID NO: 953184 - DNA, 22 bp, Artificial Sequence
  chemically synthesized
aagttaaacttctcatgagcca

SEQ ID NO: 953185 - DNA, 22 bp, Artificial Sequence
  chemically synthesized
tggctcatgagaagtttaactt

SEQ ID NO: 953186 - DNA, 22 bp, Artificial Sequence
  chemically synthesized
aataggaagggcttaagttaaa

SEQ ID NO: 953187 - DNA, 22 bp, Artificial Sequence
  chemically synthesized
ttgaataggaagggcttaagtt

SEQ ID NO: 953188 - DNA, 22 bp, Artificial Sequence
  chemically synthesized
atgagaagtttaacttaagccc

SEQ ID NO: 953189 - DNA, 22 bp, Artificial Sequence
  chemically synthesized
aacttaagcccttcctattcaa

SEQ ID NO: 953190 - DNA, 22 bp, Artificial Sequence
  chemically synthesized
agacatcccctattgaatagga

SEQ ID NO: 953191 - DNA, 22 bp, Artificial Sequence
  chemically synthesized
acttaagcccttcctattcaat

SEQ ID NO: 953192 - DNA, 22 bp, Artificial Sequence
  chemically synthesized
aagcccttcctattcaataggg

SEQ ID NO: 953193 - DNA, 22 bp, Artificial Sequence
  chemically synthesized
agcccttcctattcaatagggg

SEQ ID NO: 953194 - DNA, 22 bp, Artificial Sequence
  chemically synthesized
gtcctaagacatcccctattga

SEQ ID NO: 953195 - DNA, 22 bp, Artificial Sequence
  chemically synthesized
cctattcaataggggatgtctt

SEQ ID NO: 953196 - DNA, 22 bp, Artificial Sequence
  chemically synthesized
ctattcaataggggatgtctta

SEQ ID NO: 953197 - DNA, 22 bp, Artificial Sequence
  chemically synthesized
ttcaataggggatgtcttagga

SEQ ID NO: 953198 - DNA, 22 bp, Artificial Sequence
  chemically synthesized
aataggggatgtcttaggacca

SEQ ID NO: 953199 - DNA, 22 bp, Artificial Sequence
  chemically synthesized
agggatatcatcaaacatcctg

SEQ ID NO: 953200 - DNA, 22 bp, Artificial Sequence
  chemically synthesized
cagggatatcatcaaacatcct

SEQ ID NO: 953201 - DNA, 22 bp, Artificial Sequence
  chemically synthesized
aggaccaggatgtttgatgata

SEQ ID NO: 953202 - DNA, 22 bp, Artificial Sequence
  chemically synthesized
tgatttcagggatatcatcaaa

SEQ ID NO: 953203 - DNA, 22 bp, Artificial Sequence
  chemically synthesized
ggaccaggatgtttgatgatat

SEQ ID NO: 953204 - DNA, 22 bp, Artificial Sequence
  chemically synthesized
ataggcattgtgatttcaggga

SEQ ID NO: 953205 - DNA, 22 bp, Artificial Sequence
  chemically synthesized
gatgatatccctgaaatcacaa

SEQ ID NO: 953206 - DNA, 22 bp, Artificial Sequence
  chemically synthesized
atgatatccctgaaatcacaat

SEQ ID NO: 953207 - DNA, 22 bp, Artificial Sequence
  chemically synthesized
acattaataggcattgtgattt

SEQ ID NO: 953208 - DNA, 22 bp, Artificial Sequence
  chemically synthesized
ttaacattaataggcattgtga

SEQ ID NO: 953209 - DNA, 22 bp, Artificial Sequence
  chemically synthesized
ataggctgttaacattaatagg

SEQ ID NO: 953210 - DNA, 22 bp, Artificial Sequence
  chemically synthesized
aaatcacaatgcctattaatgt

SEQ ID NO: 953211 - DNA, 22 bp, Artificial Sequence
  chemically synthesized
aataggctgttaacattaatag

SEQ ID NO: 953212 - DNA, 22 bp, Artificial Sequence
  chemically synthesized
taataggctgttaacattaata

SEQ ID NO: 953213 - DNA, 22 bp, Artificial Sequence
  chemically synthesized
ttaataggctgttaacattaat

SEQ ID NO: 953214 - DNA, 22 bp, Artificial Sequence
  chemically synthesized
tttaataggctgttaacattaa

SEQ ID NO: 953215 - DNA, 22 bp, Artificial Sequence
  chemically synthesized
ttttaataggctgttaacatta

SEQ ID NO: 953216 - DNA, 22 bp, Artificial Sequence
  chemically synthesized
tttttaataggctgttaacatt

SEQ ID NO: 953217 - DNA, 22 bp, Artificial Sequence
  chemically synthesized
ttttttaataggctgttaacat

SEQ ID NO: 953218 - DNA, 22 bp, Artificial Sequence
  chemically synthesized
tttttttaataggctgttaaca

SEQ ID NO: 953219 - DNA, 22 bp, Artificial Sequence
  chemically synthesized
ttaatgttaacagcctattaaa

SEQ ID NO: 953220 - DNA, 22 bp, Artificial Sequence
  chemically synthesized
atgttaacagcctattaaaaaa

SEQ ID NO: 953221 - DNA, 22 bp, Artificial Sequence
  chemically synthesized
acagcctattaaaaaaaaaacc

SEQ ID NO: 953222 - DNA, 22 bp, Artificial Sequence
  chemically synthesized
ttaaaaaaaaaacctacacata

SEQ ID NO: 953223 - DNA, 22 bp, Artificial Sequence
  chemically synthesized
aaaaaaaaacctacacatatcc

SEQ ID NO: 953224 - DNA, 22 bp, Artificial Sequence
  chemically synthesized
cacatatccttttatcgttatt

SEQ ID NO: 953225 - DNA, 22 bp, Artificial Sequence
  chemically synthesized
aataaataaataaataaataat

SEQ ID NO: 953226 - DNA, 22 bp, Artificial Sequence
  chemically synthesized
ttatcgttattatttatttatt

SEQ ID NO: 953227 - DNA, 22 bp, Artificial Sequence
  chemically synthesized
tatcgttattatttatttattt

SEQ ID NO: 953228 - DNA, 22 bp, Artificial Sequence
  chemically synthesized
atcgttattatttatttattta

SEQ ID NO: 953229 - DNA, 22 bp, Artificial Sequence
  chemically synthesized
tcgttattatttatttatttat

SEQ ID NO: 953230 - DNA, 22 bp, Artificial Sequence
  chemically synthesized
ttatttatttatttatttattt

SEQ ID NO: 953231 - DNA, 22 bp, Artificial Sequence
  chemically synthesized
aaaaaaaaaattaaataaataa

SEQ ID NO: 953232 - DNA, 22 bp, Artificial Sequence
  chemically synthesized
tttatttatttatttatttaat

SEQ ID NO: 953233 - DNA, 22 bp, Artificial Sequence
  chemically synthesized
atctcaaaaaaaaaattaaata

SEQ ID NO: 953234 - DNA, 22 bp, Artificial Sequence
  chemically synthesized
atttatttatttatttaatttt

SEQ ID NO: 953235 - DNA, 22 bp, Artificial Sequence
  chemically synthesized
catctcaaaaaaaaaattaaat

SEQ ID NO: 953236 - DNA, 22 bp, Artificial Sequence
  chemically synthesized
tttatttatttatttaattttt

SEQ ID NO: 953237 - DNA, 22 bp, Artificial Sequence
  chemically synthesized
atttatttatttaatttttttt

SEQ ID NO: 953238 - DNA, 22 bp, Artificial Sequence
  chemically synthesized
tttatttatttaattttttttt

SEQ ID NO: 953239 - DNA, 22 bp, Artificial Sequence
  chemically synthesized
atttatttaattttttttttga

SEQ ID NO: 953240 - DNA, 22 bp, Artificial Sequence
  chemically synthesized
tttatttaattttttttttgag

SEQ ID NO: 953241 - DNA, 22 bp, Artificial Sequence
  chemically synthesized
atttaattttttttttgagatg

SEQ ID NO: 953242 - DNA, 22 bp, Artificial Sequence
  chemically synthesized
tttaattttttttttgagatga

SEQ ID NO: 953243 - DNA, 22 bp, Artificial Sequence
  chemically synthesized
aattttttttttgagatgaagt

SEQ ID NO: 953244 - DNA, 22 bp, Artificial Sequence
  chemically synthesized
attttttttttgagatgaagtc

SEQ ID NO: 953245 - DNA, 22 bp, Artificial Sequence
  chemically synthesized
ggcgacagagcgagacttcatc

SEQ ID NO: 953246 - DNA, 22 bp, Artificial Sequence
  chemically synthesized
tttttttgagatgaagtctcgc

SEQ ID NO: 953247 - DNA, 22 bp, Artificial Sequence
  chemically synthesized
ttttttgagatgaagtctcgct

SEQ ID NO: 953248 - DNA, 22 bp, Artificial Sequence
  chemically synthesized
tttttgagatgaagtctcgctc

SEQ ID NO: 953249 - DNA, 22 bp, Artificial Sequence
  chemically synthesized
ttttgagatgaagtctcgctct

SEQ ID NO: 953250 - DNA, 22 bp, Artificial Sequence
  chemically synthesized
tttgagatgaagtctcgctctg

SEQ ID NO: 953251 - DNA, 22 bp, Artificial Sequence
  chemically synthesized
caacctgggcgacagagcgaga

SEQ ID NO: 953252 - DNA, 22 bp, Artificial Sequence
  chemically synthesized
ttgagatgaagtctcgctctgt

SEQ ID NO: 953253 - DNA, 22 bp, Artificial Sequence
  chemically synthesized
tgagatgaagtctcgctctgtc

SEQ ID NO: 953254 - DNA, 22 bp, Artificial Sequence
  chemically synthesized
gagatgaagtctcgctctgtcg

SEQ ID NO: 953255 - DNA, 22 bp, Artificial Sequence
  chemically synthesized
agatgaagtctcgctctgtcgc

SEQ ID NO: 953256 - DNA, 22 bp, Artificial Sequence
  chemically synthesized
cactccaacctgggcgacagag

SEQ ID NO: 953257 - DNA, 22 bp, Artificial Sequence
  chemically synthesized
gctctgtcgcccaggttggagt

SEQ ID NO: 953258 - DNA, 22 bp, Artificial Sequence
  chemically synthesized
tgtcgcccaggttggagtgcag

SEQ ID NO: 953259 - DNA, 22 bp, Artificial Sequence
  chemically synthesized
tcgcccaggttggagtgcagtg

SEQ ID NO: 953260 - DNA, 22 bp, Artificial Sequence
  chemically synthesized
cagtgagccgagatcgtgccac

SEQ ID NO: 953261 - DNA, 22 bp, Artificial Sequence
  chemically synthesized
gcagtgagccgagatcgtgcca

SEQ ID NO: 953262 - DNA, 22 bp, Artificial Sequence
  chemically synthesized
gagtgcagtggcacgatctcgg

SEQ ID NO: 953263 - DNA, 22 bp, Artificial Sequence
  chemically synthesized
ggatgcagagcttgcagtgagc

SEQ ID NO: 953264 - DNA, 22 bp, Artificial Sequence
  chemically synthesized
ggctcactgcaagctctgcatc

SEQ ID NO: 953265 - DNA, 22 bp, Artificial Sequence
  chemically synthesized
actgcaagctctgcatcccagg

SEQ ID NO: 953266 - DNA, 22 bp, Artificial Sequence
  chemically synthesized
caagctctgcatcccaggttca

SEQ ID NO: 953267 - DNA, 22 bp, Artificial Sequence
  chemically synthesized
aggcaggagaatggcgtgaacc

SEQ ID NO: 953268 - DNA, 22 bp, Artificial Sequence
  chemically synthesized
tgcatcccaggttcacgccatt

SEQ ID NO: 953269 - DNA, 22 bp, Artificial Sequence
  chemically synthesized
catcccaggttcacgccattct

SEQ ID NO: 953270 - DNA, 22 bp, Artificial Sequence
  chemically synthesized
ggaggctgaggcaggagaatgg

SEQ ID NO: 953271 - DNA, 22 bp, Artificial Sequence
  chemically synthesized
gggaggctgaggcaggagaatg

SEQ ID NO: 953272 - DNA, 22 bp, Artificial Sequence
  chemically synthesized
cttgggaggctgaggcaggaga

SEQ ID NO: 953273 - DNA, 22 bp, Artificial Sequence
  chemically synthesized
acgccattctcctgcctcagcc

SEQ ID NO: 953274 - DNA, 22 bp, Artificial Sequence
  chemically synthesized
agctacttgggaggctgaggca

SEQ ID NO: 953275 - DNA, 22 bp, Artificial Sequence
  chemically synthesized
tagtctcagctacttgggaggc

SEQ ID NO: 953276 - DNA, 22 bp, Artificial Sequence
  chemically synthesized
tcctgcctcagcctcccaagta

SEQ ID NO: 953277 - DNA, 22 bp, Artificial Sequence
  chemically synthesized
ctgcctcagcctcccaagtagc

SEQ ID NO: 953278 - DNA, 22 bp, Artificial Sequence
  chemically synthesized
cctcagcctcccaagtagctga

SEQ ID NO: 953279 - DNA, 22 bp, Artificial Sequence
  chemically synthesized
agcctcccaagtagctgagact

SEQ ID NO: 953280 - DNA, 22 bp, Artificial Sequence
  chemically synthesized
ccaagtagctgagactacaggt

SEQ ID NO: 953281 - DNA, 22 bp, Artificial Sequence
  chemically synthesized
ggcatggtggcaggcacctgta

SEQ ID NO: 953282 - DNA, 22 bp, Artificial Sequence
  chemically synthesized
gctgggcatggtggcaggcacc

SEQ ID NO: 953283 - DNA, 22 bp, Artificial Sequence
  chemically synthesized
agactacaggtgcctgccacca

SEQ ID NO: 953284 - DNA, 22 bp, Artificial Sequence
  chemically synthesized
caggtgcctgccaccatgccca

SEQ ID NO: 953285 - DNA, 22 bp, Artificial Sequence
  chemically synthesized
aaaatacaaaaaaattagctgg

SEQ ID NO: 953286 - DNA, 22 bp, Artificial Sequence
  chemically synthesized
ccaccatgcccagctaattttt

SEQ ID NO: 953287 - DNA, 22 bp, Artificial Sequence
  chemically synthesized
ctaaaaatacaaaaaaattagc

SEQ ID NO: 953288 - DNA, 22 bp, Artificial Sequence
  chemically synthesized
tactaaaaatacaaaaaaatta

SEQ ID NO: 953289 - DNA, 22 bp, Artificial Sequence
  chemically synthesized
atttttttgtatttttagtaga

SEQ ID NO: 953290 - DNA, 22 bp, Artificial Sequence
  chemically synthesized
ttttgtatttttagtagagacg

SEQ ID NO: 953291 - DNA, 22 bp, Artificial Sequence
  chemically synthesized
tttgtatttttagtagagacgg

SEQ ID NO: 953292 - DNA, 22 bp, Artificial Sequence
  chemically synthesized
ttgtatttttagtagagacggg

SEQ ID NO: 953293 - DNA, 22 bp, Artificial Sequence
  chemically synthesized
acacagtgaaaccccgtctcta

SEQ ID NO: 953294 - DNA, 22 bp, Artificial Sequence
  chemically synthesized
tgtatttttagtagagacgggg

SEQ ID NO: 953295 - DNA, 22 bp, Artificial Sequence
  chemically synthesized
gtatttttagtagagacggggt

SEQ ID NO: 953296 - DNA, 22 bp, Artificial Sequence
  chemically synthesized
tatttttagtagagacggggtt

SEQ ID NO: 953297 - DNA, 22 bp, Artificial Sequence
  chemically synthesized
gctaacacagtgaaaccccgtc

SEQ ID NO: 953298 - DNA, 22 bp, Artificial Sequence
  chemically synthesized
ttagtagagacggggtttcact

SEQ ID NO: 953299 - DNA, 22 bp, Artificial Sequence
  chemically synthesized
tagtagagacggggtttcactg

SEQ ID NO: 953300 - DNA, 22 bp, Artificial Sequence
  chemically synthesized
agtagagacggggtttcactgt

SEQ ID NO: 953301 - DNA, 22 bp, Artificial Sequence
  chemically synthesized
gtagagacggggtttcactgtg

SEQ ID NO: 953302 - DNA, 22 bp, Artificial Sequence
  chemically synthesized
cactgtgttagccaggatggtc

SEQ ID NO: 953303 - DNA, 22 bp, Artificial Sequence
  chemically synthesized
actgtgttagccaggatggtct

SEQ ID NO: 953304 - DNA, 22 bp, Artificial Sequence
  chemically synthesized
tgttagccaggatggtctcgat

SEQ ID NO: 953305 - DNA, 22 bp, Artificial Sequence
  chemically synthesized
gccaggatggtctcgatctcct

SEQ ID NO: 953306 - DNA, 22 bp, Artificial Sequence
  chemically synthesized
gatctcctgacatcatgatccg

SEQ ID NO: 953307 - DNA, 22 bp, Artificial Sequence
  chemically synthesized
ggaggccaaggcgggcggatca

SEQ ID NO: 953308 - DNA, 22 bp, Artificial Sequence
  chemically synthesized
gggaggccaaggcgggcggatc

SEQ ID NO: 953309 - DNA, 22 bp, Artificial Sequence
  chemically synthesized
tgggaggccaaggcgggcggat

SEQ ID NO: 953310 - DNA, 22 bp, Artificial Sequence
  chemically synthesized
ctgacatcatgatccgcccgcc

SEQ ID NO: 953311 - DNA, 22 bp, Artificial Sequence
  chemically synthesized
acatcatgatccgcccgccttg

SEQ ID NO: 953312 - DNA, 22 bp, Artificial Sequence
  chemically synthesized
taatcccagcactttgggaggc

SEQ ID NO: 953313 - DNA, 22 bp, Artificial Sequence
  chemically synthesized
acgcctgtaatcccagcacttt

SEQ ID NO: 953314 - DNA, 22 bp, Artificial Sequence
  chemically synthesized
ggcctcccaaagtgctgggatt

SEQ ID NO: 953315 - DNA, 22 bp, Artificial Sequence
  chemically synthesized
gcctcccaaagtgctgggatta

SEQ ID NO: 953316 - DNA, 22 bp, Artificial Sequence
  chemically synthesized
ccaaagtgctgggattacaggc

SEQ ID NO: 953317 - DNA, 22 bp, Artificial Sequence
  chemically synthesized
ggtgcggaggctcacgcctgta

SEQ ID NO: 953318 - DNA, 22 bp, Artificial Sequence
  chemically synthesized
ggattacaggcgtgagcctccg

SEQ ID NO: 953319 - DNA, 22 bp, Artificial Sequence
  chemically synthesized
caggcgtgagcctccgcaccca

SEQ ID NO: 953320 - DNA, 22 bp, Artificial Sequence
  chemically synthesized
cgcacccagcctatatcattgt

SEQ ID NO: 953321 - DNA, 22 bp, Artificial Sequence
  chemically synthesized
tatcattgttattactatcgtt

SEQ ID NO: 953322 - DNA, 22 bp, Artificial Sequence
  chemically synthesized
gaataatagtagtaataacgat

SEQ ID NO: 953323 - DNA, 22 bp, Artificial Sequence
  chemically synthesized
ttattactatcgttattactac

SEQ ID NO: 953324 - DNA, 22 bp, Artificial Sequence
  chemically synthesized
acattggaataatagtagtaat

SEQ ID NO: 953325 - DNA, 22 bp, Artificial Sequence
  chemically synthesized
ttactatcgttattactactat

SEQ ID NO: 953326 - DNA, 22 bp, Artificial Sequence
  chemically synthesized
ctatcgttattactactattat

SEQ ID NO: 953327 - DNA, 22 bp, Artificial Sequence
  chemically synthesized
tcgttattactactattattcc

SEQ ID NO: 953328 - DNA, 22 bp, Artificial Sequence
  chemically synthesized
ttactactattattccaatgtt

SEQ ID NO: 953329 - DNA, 22 bp, Artificial Sequence
  chemically synthesized
ctactattattccaatgttaat

SEQ ID NO: 953330 - DNA, 22 bp, Artificial Sequence
  chemically synthesized
ctattattccaatgttaatatg

SEQ ID NO: 953331 - DNA, 22 bp, Artificial Sequence
  chemically synthesized
aaacagtgggcaccatattaac

SEQ ID NO: 953332 - DNA, 22 bp, Artificial Sequence
  chemically synthesized
aaaacagtgggcaccatattaa

SEQ ID NO: 953333 - DNA, 22 bp, Artificial Sequence
  chemically synthesized
ttattccaatgttaatatggtg

SEQ ID NO: 953334 - DNA, 22 bp, Artificial Sequence
  chemically synthesized
taaaacagtgggcaccatatta

SEQ ID NO: 953335 - DNA, 22 bp, Artificial Sequence
  chemically synthesized
ttccaatgttaatatggtgccc

SEQ ID NO: 953336 - DNA, 22 bp, Artificial Sequence
  chemically synthesized
ctttaaaacagtgggcaccata

SEQ ID NO: 953337 - DNA, 22 bp, Artificial Sequence
  chemically synthesized
tactttaaaacagtgggcacca

SEQ ID NO: 953338 - DNA, 22 bp, Artificial Sequence
  chemically synthesized
caatgttaatatggtgcccact

SEQ ID NO: 953339 - DNA, 22 bp, Artificial Sequence
  chemically synthesized
ctactttaaaacagtgggcacc

SEQ ID NO: 953340 - DNA, 22 bp, Artificial Sequence
  chemically synthesized
atatggtgcccactgttttaaa

SEQ ID NO: 953341 - DNA, 22 bp, Artificial Sequence
  chemically synthesized
aataatagcatttctactttaa

SEQ ID NO: 953342 - DNA, 22 bp, Artificial Sequence
  chemically synthesized
ttttaaagtagaaatgctatta

SEQ ID NO: 953343 - DNA, 22 bp, Artificial Sequence
  chemically synthesized
taaagtagaaatgctattattt

SEQ ID NO: 953344 - DNA, 22 bp, Artificial Sequence
  chemically synthesized
aaagtagaaatgctattattta

SEQ ID NO: 953345 - DNA, 22 bp, Artificial Sequence
  chemically synthesized
aagtagaaatgctattatttaa

SEQ ID NO: 953346 - DNA, 22 bp, Artificial Sequence
  chemically synthesized
aatacgaacacaagaagattaa

SEQ ID NO: 953347 - DNA, 22 bp, Artificial Sequence
  chemically synthesized
ttgaatacgaacacaagaagat

SEQ ID NO: 953348 - DNA, 22 bp, Artificial Sequence
  chemically synthesized
attgaatacgaacacaagaaga

SEQ ID NO: 953349 - DNA, 22 bp, Artificial Sequence
  chemically synthesized
tattgaatacgaacacaagaag

SEQ ID NO: 953350 - DNA, 22 bp, Artificial Sequence
  chemically synthesized
tttattgaatacgaacacaaga

SEQ ID NO: 953351 - DNA, 22 bp, Artificial Sequence
  chemically synthesized
ttatttaatcttcttgtgttcg

SEQ ID NO: 953352 - DNA, 22 bp, Artificial Sequence
  chemically synthesized
ctttattgaatacgaacacaag

SEQ ID NO: 953353 - DNA, 22 bp, Artificial Sequence
  chemically synthesized
tctttattgaatacgaacacaa

SEQ ID NO: 953354 - DNA, 22 bp, Artificial Sequence
  chemically synthesized
ttctttattgaatacgaacaca

SEQ ID NO: 953355 - DNA, 22 bp, Artificial Sequence
  chemically synthesized
tttaatcttcttgtgttcgtat

SEQ ID NO: 953356 - DNA, 22 bp, Artificial Sequence
  chemically synthesized
aatcttcttgtgttcgtattca

SEQ ID NO: 953357 - DNA, 22 bp, Artificial Sequence
  chemically synthesized
atcttcttgtgttcgtattcaa

SEQ ID NO: 953358 - DNA, 22 bp, Artificial Sequence
  chemically synthesized
tatttttctttattgaatacga

SEQ ID NO: 953359 - DNA, 22 bp, Artificial Sequence
  chemically synthesized
atatttttctttattgaatacg

SEQ ID NO: 953360 - DNA, 22 bp, Artificial Sequence
  chemically synthesized
cttgtgttcgtattcaataaag

SEQ ID NO: 953361 - DNA, 22 bp, Artificial Sequence
  chemically synthesized
ttgtgttcgtattcaataaaga

SEQ ID NO: 953362 - DNA, 22 bp, Artificial Sequence
  chemically synthesized
gtgttcgtattcaataaagaaa

SEQ ID NO: 953363 - DNA, 22 bp, Artificial Sequence
  chemically synthesized
tgttcgtattcaataaagaaaa

SEQ ID NO: 953364 - DNA, 22 bp, Artificial Sequence
  chemically synthesized
tcataatacttatatttttctt

SEQ ID NO: 953365 - DNA, 22 bp, Artificial Sequence
  chemically synthesized
gtcataatacttatatttttct

SEQ ID NO: 953366 - DNA, 22 bp, Artificial Sequence
  chemically synthesized
gtattcaataaagaaaaatata

SEQ ID NO: 953367 - DNA, 22 bp, Artificial Sequence
  chemically synthesized
ccttgtcataatacttatattt

SEQ ID NO: 953368 - DNA, 22 bp, Artificial Sequence
  chemically synthesized
aataaagaaaaatataagtatt

SEQ ID NO: 953369 - DNA, 22 bp, Artificial Sequence
  chemically synthesized
tccaaatcactgccttgtcata

SEQ ID NO: 953370 - DNA, 22 bp, Artificial Sequence
  chemically synthesized
gaaacatcctgtccaaatcact

SEQ ID NO: 953371 - DNA, 22 bp, Artificial Sequence
  chemically synthesized
tgacaaggcagtgatttggaca

SEQ ID NO: 953372 - DNA, 22 bp, Artificial Sequence
  chemically synthesized
cattcgaaacatcctgtccaaa

SEQ ID NO: 953373 - DNA, 22 bp, Artificial Sequence
  chemically synthesized
ggacaggatgtttcgaatgcag

SEQ ID NO: 953374 - DNA, 22 bp, Artificial Sequence
  chemically synthesized
gacaggatgtttcgaatgcagg

SEQ ID NO: 953375 - DNA, 22 bp, Artificial Sequence
  chemically synthesized
tatgtcaacatgcctgcattcg

SEQ ID NO: 953376 - DNA, 22 bp, Artificial Sequence
  chemically synthesized
atgtccagttatatgtcaacat

SEQ ID NO: 953377 - DNA, 22 bp, Artificial Sequence
  chemically synthesized
cgaatgcaggcatgttgacata

SEQ ID NO: 953378 - DNA, 22 bp, Artificial Sequence
  chemically synthesized
gaatgcaggcatgttgacatat

SEQ ID NO: 953379 - DNA, 22 bp, Artificial Sequence
  chemically synthesized
tatcagggctcatgtccagtta

SEQ ID NO: 953380 - DNA, 22 bp, Artificial Sequence
  chemically synthesized
acatataactggacatgagccc

SEQ ID NO: 953381 - DNA, 22 bp, Artificial Sequence
  chemically synthesized
gacatgagccctgatatagttt

SEQ ID NO: 953382 - DNA, 22 bp, Artificial Sequence
  chemically synthesized
agtggcggcaaatatccaaact

SEQ ID NO: 953383 - DNA, 22 bp, Artificial Sequence
  chemically synthesized
gagtggcggcaaatatccaaac

SEQ ID NO: 953384 - DNA, 22 bp, Artificial Sequence
  chemically synthesized
agatttgagtggcggcaaatat

SEQ ID NO: 953385 - DNA, 22 bp, Artificial Sequence
  chemically synthesized
atatagtttggatatttgccgc

SEQ ID NO: 953386 - DNA, 22 bp, Artificial Sequence
  chemically synthesized
gagatttgagtggcggcaaata

SEQ ID NO: 953387 - DNA, 22 bp, Artificial Sequence
  chemically synthesized
cacttgagatttgagtggcggc

SEQ ID NO: 953388 - DNA, 22 bp, Artificial Sequence
  chemically synthesized
ccacttgagatttgagtggcgg

SEQ ID NO: 953389 - DNA, 22 bp, Artificial Sequence
  chemically synthesized
ggatatttgccgccactcaaat

SEQ ID NO: 953390 - DNA, 22 bp, Artificial Sequence
  chemically synthesized
gatatttgccgccactcaaatc

SEQ ID NO: 953391 - DNA, 22 bp, Artificial Sequence
  chemically synthesized
tatttccacttgagatttgagt

SEQ ID NO: 953392 - DNA, 22 bp, Artificial Sequence
  chemically synthesized
gccgccactcaaatctcaagtg

SEQ ID NO: 953393 - DNA, 22 bp, Artificial Sequence
  chemically synthesized
ccgccactcaaatctcaagtgg

SEQ ID NO: 953394 - DNA, 22 bp, Artificial Sequence
  chemically synthesized
ggaattatatttccacttgaga

SEQ ID NO: 953395 - DNA, 22 bp, Artificial Sequence
  chemically synthesized
aaatctcaagtggaaatataat

SEQ ID NO: 953396 - DNA, 22 bp, Artificial Sequence
  chemically synthesized
aagtggaaatataattcccaat

SEQ ID NO: 953397 - DNA, 22 bp, Artificial Sequence
  chemically synthesized
ccgccaggccccaccaccaaca

SEQ ID NO: 953398 - DNA, 22 bp, Artificial Sequence
  chemically synthesized
ccaatgttggtggtggggcctg

SEQ ID NO: 953399 - DNA, 22 bp, Artificial Sequence
  chemically synthesized
gtggtggggcctggcgggaggt

SEQ ID NO: 953400 - DNA, 22 bp, Artificial Sequence
  chemically synthesized
tccccatgacccaaaaacctcc

SEQ ID NO: 953401 - DNA, 22 bp, Artificial Sequence
  chemically synthesized
gcgggaggtttttgggtcatgg

SEQ ID NO: 953402 - DNA, 22 bp, Artificial Sequence
  chemically synthesized
ttgggtcatggggacagatccc

SEQ ID NO: 953403 - DNA, 22 bp, Artificial Sequence
  chemically synthesized
tgggtcatggggacagatccct

SEQ ID NO: 953404 - DNA, 22 bp, Artificial Sequence
  chemically synthesized
gggtcatggggacagatccctc

SEQ ID NO: 953405 - DNA, 22 bp, Artificial Sequence
  chemically synthesized
ggtcatggggacagatccctca

SEQ ID NO: 953406 - DNA, 22 bp, Artificial Sequence
  chemically synthesized
aggacaatacaaaaccatgagg

SEQ ID NO: 953407 - DNA, 22 bp, Artificial Sequence
  chemically synthesized
cactgaggacaatacaaaacca

SEQ ID NO: 953408 - DNA, 22 bp, Artificial Sequence
  chemically synthesized
actacactgaggacaatacaaa

SEQ ID NO: 953409 - DNA, 22 bp, Artificial Sequence
  chemically synthesized
actcactacactgaggacaata

SEQ ID NO: 953410 - DNA, 22 bp, Artificial Sequence
  chemically synthesized
atggttttgtattgtcctcagt

SEQ ID NO: 953411 - DNA, 22 bp, Artificial Sequence
  chemically synthesized
tgtattgtcctcagtgtagtga

SEQ ID NO: 953412 - DNA, 22 bp, Artificial Sequence
  chemically synthesized
atgaaaactcactcactacact

SEQ ID NO: 953413 - DNA, 22 bp, Artificial Sequence
  chemically synthesized
gtattgtcctcagtgtagtgag

SEQ ID NO: 953414 - DNA, 22 bp, Artificial Sequence
  chemically synthesized
tattgtcctcagtgtagtgagt

SEQ ID NO: 953415 - DNA, 22 bp, Artificial Sequence
  chemically synthesized
tcctcagtgtagtgagtgagtt

SEQ ID NO: 953416 - DNA, 22 bp, Artificial Sequence
  chemically synthesized
agtgtagtgagtgagttttcat

SEQ ID NO: 953417 - DNA, 22 bp, Artificial Sequence
  chemically synthesized
aaaaaaaaccagatctcatgaa

SEQ ID NO: 953418 - DNA, 22 bp, Artificial Sequence
  chemically synthesized
aaaaaaaaaccagatctcatga

SEQ ID NO: 953419 - DNA, 22 bp, Artificial Sequence
  chemically synthesized
taaaaaaaaaccagatctcatg

SEQ ID NO: 953420 - DNA, 22 bp, Artificial Sequence
  chemically synthesized
tcatgagatctggttttttttt

SEQ ID NO: 953421 - DNA, 22 bp, Artificial Sequence
  chemically synthesized
catgagatctggttttttttta

SEQ ID NO: 953422 - DNA, 22 bp, Artificial Sequence
  chemically synthesized
atgagatctggtttttttttaa

SEQ ID NO: 953423 - DNA, 22 bp, Artificial Sequence
  chemically synthesized
gtttttttttaaagtgtgtggg

SEQ ID NO: 953424 - DNA, 22 bp, Artificial Sequence
  chemically synthesized
ttttttaaagtgtgtgggcatc

SEQ ID NO: 953425 - DNA, 22 bp, Artificial Sequence
  chemically synthesized
atggcagaaggtgatgcccaca

SEQ ID NO: 953426 - DNA, 22 bp, Artificial Sequence
  chemically synthesized
tttttaaagtgtgtgggcatca

SEQ ID NO: 953427 - DNA, 22 bp, Artificial Sequence
  chemically synthesized
ttttaaagtgtgtgggcatcac

SEQ ID NO: 953428 - DNA, 22 bp, Artificial Sequence
  chemically synthesized
tttaaagtgtgtgggcatcacc

SEQ ID NO: 953429 - DNA, 22 bp, Artificial Sequence
  chemically synthesized
ctcatggcagaaggtgatgccc

SEQ ID NO: 953430 - DNA, 22 bp, Artificial Sequence
  chemically synthesized
ttaaagtgtgtgggcatcacct

SEQ ID NO: 953431 - DNA, 22 bp, Artificial Sequence
  chemically synthesized
gctcatggcagaaggtgatgcc

SEQ ID NO: 953432 - DNA, 22 bp, Artificial Sequence
  chemically synthesized
taaagtgtgtgggcatcacctt

SEQ ID NO: 953433 - DNA, 22 bp, Artificial Sequence
  chemically synthesized
tgctcatggcagaaggtgatgc

SEQ ID NO: 953434 - DNA, 22 bp, Artificial Sequence
  chemically synthesized
aaagtgtgtgggcatcaccttc

SEQ ID NO: 953435 - DNA, 22 bp, Artificial Sequence
  chemically synthesized
ttgctcatggcagaaggtgatg

SEQ ID NO: 953436 - DNA, 22 bp, Artificial Sequence
  chemically synthesized
aagtgtgtgggcatcaccttct

SEQ ID NO: 953437 - DNA, 22 bp, Artificial Sequence
  chemically synthesized
agggagtttttgctcatggcag

SEQ ID NO: 953438 - DNA, 22 bp, Artificial Sequence
  chemically synthesized
gggaggcctcagggagtttttg

SEQ ID NO: 953439 - DNA, 22 bp, Artificial Sequence
  chemically synthesized
ctgccatgagcaaaaactccct

SEQ ID NO: 953440 - DNA, 22 bp, Artificial Sequence
  chemically synthesized
tgccatgagcaaaaactccctg

SEQ ID NO: 953441 - DNA, 22 bp, Artificial Sequence
  chemically synthesized
ctggggaggcctcagggagttt

SEQ ID NO: 953442 - DNA, 22 bp, Artificial Sequence
  chemically synthesized
ccatgagcaaaaactccctgag

SEQ ID NO: 953443 - DNA, 22 bp, Artificial Sequence
  chemically synthesized
gctcctggggaggcctcaggga

SEQ ID NO: 953444 - DNA, 22 bp, Artificial Sequence
  chemically synthesized
ggctcctggggaggcctcaggg

SEQ ID NO: 953445 - DNA, 22 bp, Artificial Sequence
  chemically synthesized
cttggctcctggggaggcctca

SEQ ID NO: 953446 - DNA, 22 bp, Artificial Sequence
  chemically synthesized
gcttggctcctggggaggcctc

SEQ ID NO: 953447 - DNA, 22 bp, Artificial Sequence
  chemically synthesized
cctgaggcctccccaggagcca

SEQ ID NO: 953448 - DNA, 22 bp, Artificial Sequence
  chemically synthesized
aggcctccccaggagccaagca

SEQ ID NO: 953449 - DNA, 22 bp, Artificial Sequence
  chemically synthesized
cccaggagccaagcaaatgcct

SEQ ID NO: 953450 - DNA, 22 bp, Artificial Sequence
  chemically synthesized
tacaggaagtgtggcacaggca

SEQ ID NO: 953451 - DNA, 22 bp, Artificial Sequence
  chemically synthesized
caggctgtacaggaagtgtggc

SEQ ID NO: 953452 - DNA, 22 bp, Artificial Sequence
  chemically synthesized
tgcaggctgtacaggaagtgtg

SEQ ID NO: 953453 - DNA, 22 bp, Artificial Sequence
  chemically synthesized
atggttctgcaggctgtacagg

SEQ ID NO: 953454 - DNA, 22 bp, Artificial Sequence
  chemically synthesized
tgccacacttcctgtacagcct

SEQ ID NO: 953455 - DNA, 22 bp, Artificial Sequence
  chemically synthesized
gctgatggttctgcaggctgta

SEQ ID NO: 953456 - DNA, 22 bp, Artificial Sequence
  chemically synthesized
attggctgatggttctgcaggc

SEQ ID NO: 953457 - DNA, 22 bp, Artificial Sequence
  chemically synthesized
aattggctgatggttctgcagg

SEQ ID NO: 953458 - DNA, 22 bp, Artificial Sequence
  chemically synthesized
cctgtacagcctgcagaaccat

SEQ ID NO: 953459 - DNA, 22 bp, Artificial Sequence
  chemically synthesized
ctgtacagcctgcagaaccatc

SEQ ID NO: 953460 - DNA, 22 bp, Artificial Sequence
  chemically synthesized
tacagcctgcagaaccatcagc

SEQ ID NO: 953461 - DNA, 22 bp, Artificial Sequence
  chemically synthesized
cagaaccatcagccaattaaac

SEQ ID NO: 953462 - DNA, 22 bp, Artificial Sequence
  chemically synthesized
aacaagaaaaaaagtttaattg

SEQ ID NO: 953463 - DNA, 22 bp, Artificial Sequence
  chemically synthesized
caacaagaaaaaaagtttaatt

SEQ ID NO: 953464 - DNA, 22 bp, Artificial Sequence
  chemically synthesized
tatttcaacaagaaaaaaagtt

SEQ ID NO: 953465 - DNA, 22 bp, Artificial Sequence
  chemically synthesized
gcattatatttcaacaagaaaa

SEQ ID NO: 953466 - DNA, 22 bp, Artificial Sequence
  chemically synthesized
ggcattatatttcaacaagaaa

SEQ ID NO: 953467 - DNA, 22 bp, Artificial Sequence
  chemically synthesized
aactttttttcttgttgaaata

SEQ ID NO: 953468 - DNA, 22 bp, Artificial Sequence
  chemically synthesized
tttttcttgttgaaatataatg

SEQ ID NO: 953469 - DNA, 22 bp, Artificial Sequence
  chemically synthesized
ttttcttgttgaaatataatgc

SEQ ID NO: 953470 - DNA, 22 bp, Artificial Sequence
  chemically synthesized
tttcttgttgaaatataatgcc

SEQ ID NO: 953471 - DNA, 22 bp, Artificial Sequence
  chemically synthesized
ttcttgttgaaatataatgcca

SEQ ID NO: 953472 - DNA, 22 bp, Artificial Sequence
  chemically synthesized
tcttgttgaaatataatgccaa

SEQ ID NO: 953473 - DNA, 22 bp, Artificial Sequence
  chemically synthesized
cttgttgaaatataatgccaag

SEQ ID NO: 953474 - DNA, 22 bp, Artificial Sequence
  chemically synthesized
ttgttgaaatataatgccaagt

SEQ ID NO: 953475 - DNA, 22 bp, Artificial Sequence
  chemically synthesized
gttgaaatataatgccaagtgt

SEQ ID NO: 953476 - DNA, 22 bp, Artificial Sequence
  chemically synthesized
ttgaaatataatgccaagtgtt

SEQ ID NO: 953477 - DNA, 22 bp, Artificial Sequence
  chemically synthesized
aaatataatgccaagtgttgga

SEQ ID NO: 953478 - DNA, 22 bp, Artificial Sequence
  chemically synthesized
acaccaggccccaagtccaaca

SEQ ID NO: 953479 - DNA, 22 bp, Artificial Sequence
  chemically synthesized
aaacatctcacaccaggcccca

SEQ ID NO: 953480 - DNA, 22 bp, Artificial Sequence
  chemically synthesized
gacttggggcctggtgtgagat

SEQ ID NO: 953481 - DNA, 22 bp, Artificial Sequence
  chemically synthesized
cgtgactcaaacatctcacacc

SEQ ID NO: 953482 - DNA, 22 bp, Artificial Sequence
  chemically synthesized
ggggcctggtgtgagatgtttg

SEQ ID NO: 953483 - DNA, 22 bp, Artificial Sequence
  chemically synthesized
gggcctggtgtgagatgtttga

SEQ ID NO: 953484 - DNA, 22 bp, Artificial Sequence
  chemically synthesized
gtgtgagatgtttgagtcacgg

SEQ ID NO: 953485 - DNA, 22 bp, Artificial Sequence
  chemically synthesized
tgagggatccacctccgtgact

SEQ ID NO: 953486 - DNA, 22 bp, Artificial Sequence
  chemically synthesized
gagtcacggaggtggatccctc

SEQ ID NO: 953487 - DNA, 22 bp, Artificial Sequence
  chemically synthesized
agtcacggaggtggatccctca

SEQ ID NO: 953488 - DNA, 22 bp, Artificial Sequence
  chemically synthesized
tcatgaggacagcatcaagctg

SEQ ID NO: 953489 - DNA, 22 bp, Artificial Sequence
  chemically synthesized
ctatcatgaggacagcatcaag

SEQ ID NO: 953490 - DNA, 22 bp, Artificial Sequence
  chemically synthesized
agctgctatcatgaggacagca

SEQ ID NO: 953491 - DNA, 22 bp, Artificial Sequence
  chemically synthesized
acagcttgatgctgtcctcatg

SEQ ID NO: 953492 - DNA, 22 bp, Artificial Sequence
  chemically synthesized
aagaactcagctgctatcatga

SEQ ID NO: 953493 - DNA, 22 bp, Artificial Sequence
  chemically synthesized
gatgctgtcctcatgatagcag

SEQ ID NO: 953494 - DNA, 22 bp, Artificial Sequence
  chemically synthesized
atgctgtcctcatgatagcagc

SEQ ID NO: 953495 - DNA, 22 bp, Artificial Sequence
  chemically synthesized
tcctcatgatagcagctgagtt

SEQ ID NO: 953496 - DNA, 22 bp, Artificial Sequence
  chemically synthesized
atgatagcagctgagttcttga

SEQ ID NO: 953497 - DNA, 22 bp, Artificial Sequence
  chemically synthesized
agttcttgagcgatctgttttg

SEQ ID NO: 953498 - DNA, 22 bp, Artificial Sequence
  chemically synthesized
aaaaaaaaaaaaacaaaacaga

SEQ ID NO: 953499 - DNA, 22 bp, Artificial Sequence
  chemically synthesized
aaaaaaaaaaaaaacaaaacag

SEQ ID NO: 953500 - DNA, 22 bp, Artificial Sequence
  chemically synthesized
ttgagcgatctgttttgttttt

SEQ ID NO: 953501 - DNA, 22 bp, Artificial Sequence
  chemically synthesized
gagcgatctgttttgttttttt

SEQ ID NO: 953502 - DNA, 22 bp, Artificial Sequence
  chemically synthesized
agcgatctgttttgtttttttt

SEQ ID NO: 953503 - DNA, 22 bp, Artificial Sequence
  chemically synthesized
ccacacatttaaaaaaaaaaaa

SEQ ID NO: 953504 - DNA, 22 bp, Artificial Sequence
  chemically synthesized
ttttgttttttttttttttaaa

SEQ ID NO: 953505 - DNA, 22 bp, Artificial Sequence
  chemically synthesized
tgttttttttttttttaaatgt

SEQ ID NO: 953506 - DNA, 22 bp, Artificial Sequence
  chemically synthesized
gttttttttttttttaaatgtg

SEQ ID NO: 953507 - DNA, 22 bp, Artificial Sequence
  chemically synthesized
ttttttttttttttaaatgtgt

SEQ ID NO: 953508 - DNA, 22 bp, Artificial Sequence
  chemically synthesized
tttttttttttaaatgtgtggc

SEQ ID NO: 953509 - DNA, 22 bp, Artificial Sequence
  chemically synthesized
ttttttttttaaatgtgtggca

SEQ ID NO: 953510 - DNA, 22 bp, Artificial Sequence
  chemically synthesized
tttttttttaaatgtgtggcaa

SEQ ID NO: 953511 - DNA, 22 bp, Artificial Sequence
  chemically synthesized
ttttttttaaatgtgtggcaac

SEQ ID NO: 953512 - DNA, 22 bp, Artificial Sequence
  chemically synthesized
tttttttaaatgtgtggcaacc

SEQ ID NO: 953513 - DNA, 22 bp, Artificial Sequence
  chemically synthesized
ttttttaaatgtgtggcaacct

SEQ ID NO: 953514 - DNA, 22 bp, Artificial Sequence
  chemically synthesized
tttttaaatgtgtggcaacctc

SEQ ID NO: 953515 - DNA, 22 bp, Artificial Sequence
  chemically synthesized
ttttaaatgtgtggcaacctcc

SEQ ID NO: 953516 - DNA, 22 bp, Artificial Sequence
  chemically synthesized
tttaaatgtgtggcaacctccc

SEQ ID NO: 953517 - DNA, 22 bp, Artificial Sequence
  chemically synthesized
ttaaatgtgtggcaacctcccc

SEQ ID NO: 953518 - DNA, 22 bp, Artificial Sequence
  chemically synthesized
taaatgtgtggcaacctccccc

SEQ ID NO: 953519 - DNA, 22 bp, Artificial Sequence
  chemically synthesized
aaatgtgtggcaacctccccct

SEQ ID NO: 953520 - DNA, 22 bp, Artificial Sequence
  chemically synthesized
aatgtgtggcaacctccccctg

SEQ ID NO: 953521 - DNA, 22 bp, Artificial Sequence
  chemically synthesized
cccctggcttctgctctggcca

SEQ ID NO: 953522 - DNA, 22 bp, Artificial Sequence
  chemically synthesized
gcttctgctctggccatgtgac

SEQ ID NO: 953523 - DNA, 22 bp, Artificial Sequence
  chemically synthesized
ctgctctggccatgtgacatgc

SEQ ID NO: 953524 - DNA, 22 bp, Artificial Sequence
  chemically synthesized
tgctctggccatgtgacatgct

SEQ ID NO: 953525 - DNA, 22 bp, Artificial Sequence
  chemically synthesized
ctctggccatgtgacatgctta

SEQ ID NO: 953526 - DNA, 22 bp, Artificial Sequence
  chemically synthesized
tggccatgtgacatgcttactc

SEQ ID NO: 953527 - DNA, 22 bp, Artificial Sequence
  chemically synthesized
gccatgtgacatgcttactcct

SEQ ID NO: 953528 - DNA, 22 bp, Artificial Sequence
  chemically synthesized
atagtggaagatgaaacaggag

SEQ ID NO: 953529 - DNA, 22 bp, Artificial Sequence
  chemically synthesized
ctcatagtggaagatgaaacag

SEQ ID NO: 953530 - DNA, 22 bp, Artificial Sequence
  chemically synthesized
actcatagtggaagatgaaaca

SEQ ID NO: 953531 - DNA, 22 bp, Artificial Sequence
  chemically synthesized
tactcatagtggaagatgaaac

SEQ ID NO: 953532 - DNA, 22 bp, Artificial Sequence
  chemically synthesized
ttactcatagtggaagatgaaa

SEQ ID NO: 953533 - DNA, 22 bp, Artificial Sequence
  chemically synthesized
actcctgtttcatcttccacta

SEQ ID NO: 953534 - DNA, 22 bp, Artificial Sequence
  chemically synthesized
ctcctgtttcatcttccactat

SEQ ID NO: 953535 - DNA, 22 bp, Artificial Sequence
  chemically synthesized
ctgtttcatcttccactatgag

SEQ ID NO: 953536 - DNA, 22 bp, Artificial Sequence
  chemically synthesized
cgggagcttttactcatagtgg

SEQ ID NO: 953537 - DNA, 22 bp, Artificial Sequence
  chemically synthesized
tttcatcttccactatgagtaa

SEQ ID NO: 953538 - DNA, 22 bp, Artificial Sequence
  chemically synthesized
catcttccactatgagtaaaag

SEQ ID NO: 953539 - DNA, 22 bp, Artificial Sequence
  chemically synthesized
atcttccactatgagtaaaagc

SEQ ID NO: 953540 - DNA, 22 bp, Artificial Sequence
  chemically synthesized
gggaggcctccgggagctttta

SEQ ID NO: 953541 - DNA, 22 bp, Artificial Sequence
  chemically synthesized
ccactatgagtaaaagctcccg

SEQ ID NO: 953542 - DNA, 22 bp, Artificial Sequence
  chemically synthesized
tggggaggcctccgggagcttt

SEQ ID NO: 953543 - DNA, 22 bp, Artificial Sequence
  chemically synthesized
cactatgagtaaaagctcccgg

SEQ ID NO: 953544 - DNA, 22 bp, Artificial Sequence
  chemically synthesized
ctggggaggcctccgggagctt

SEQ ID NO: 953545 - DNA, 22 bp, Artificial Sequence
  chemically synthesized
tgagtaaaagctcccggaggcc

SEQ ID NO: 953546 - DNA, 22 bp, Artificial Sequence
  chemically synthesized
agcttctggggaggcctccggg

SEQ ID NO: 953547 - DNA, 22 bp, Artificial Sequence
  chemically synthesized
ctcagcttctggggaggcctcc

SEQ ID NO: 953548 - DNA, 22 bp, Artificial Sequence
  chemically synthesized
ccggaggcctccccagaagctg

SEQ ID NO: 953549 - DNA, 22 bp, Artificial Sequence
  chemically synthesized
cccagaagctgagtagatgctg

SEQ ID NO: 953550 - DNA, 22 bp, Artificial Sequence
  chemically synthesized
tacaggaagcaggacaccagca

SEQ ID NO: 953551 - DNA, 22 bp, Artificial Sequence
  chemically synthesized
agtagatgctggtgtcctgctt

SEQ ID NO: 953552 - DNA, 22 bp, Artificial Sequence
  chemically synthesized
caggttgtacaggaagcaggac

SEQ ID NO: 953553 - DNA, 22 bp, Artificial Sequence
  chemically synthesized
tgcaggttgtacaggaagcagg

SEQ ID NO: 953554 - DNA, 22 bp, Artificial Sequence
  chemically synthesized
atgattctgcaggttgtacagg

SEQ ID NO: 953555 - DNA, 22 bp, Artificial Sequence
  chemically synthesized
gtgtcctgcttcctgtacaacc

SEQ ID NO: 953556 - DNA, 22 bp, Artificial Sequence
  chemically synthesized
atcgattcatgattctgcaggt

SEQ ID NO: 953557 - DNA, 22 bp, Artificial Sequence
  chemically synthesized
cttcctgtacaacctgcagaat

SEQ ID NO: 953558 - DNA, 22 bp, Artificial Sequence
  chemically synthesized
aatcgattcatgattctgcagg

SEQ ID NO: 953559 - DNA, 22 bp, Artificial Sequence
  chemically synthesized
taatcgattcatgattctgcag

SEQ ID NO: 953560 - DNA, 22 bp, Artificial Sequence
  chemically synthesized
cctgtacaacctgcagaatcat

SEQ ID NO: 953561 - DNA, 22 bp, Artificial Sequence
  chemically synthesized
ctgtacaacctgcagaatcatg

SEQ ID NO: 953562 - DNA, 22 bp, Artificial Sequence
  chemically synthesized
tacaacctgcagaatcatgaat

SEQ ID NO: 953563 - DNA, 22 bp, Artificial Sequence
  chemically synthesized
aaaagagctttaatcgattcat

SEQ ID NO: 953564 - DNA, 22 bp, Artificial Sequence
  chemically synthesized
aaaaagagctttaatcgattca

SEQ ID NO: 953565 - DNA, 22 bp, Artificial Sequence
  chemically synthesized
taaaaagagctttaatcgattc

SEQ ID NO: 953566 - DNA, 22 bp, Artificial Sequence
  chemically synthesized
ttaaaaagagctttaatcgatt

SEQ ID NO: 953567 - DNA, 22 bp, Artificial Sequence
  chemically synthesized
cagaatcatgaatcgattaaag

SEQ ID NO: 953568 - DNA, 22 bp, Artificial Sequence
  chemically synthesized
ggtaatgtatttttaaaaagag

SEQ ID NO: 953569 - DNA, 22 bp, Artificial Sequence
  chemically synthesized
aagctctttttaaaaatacatt

SEQ ID NO: 953570 - DNA, 22 bp, Artificial Sequence
  chemically synthesized
tttttaaaaatacattacccag

SEQ ID NO: 953571 - DNA, 22 bp, Artificial Sequence
  chemically synthesized
tttaaaaatacattacccagtc

SEQ ID NO: 953572 - DNA, 22 bp, Artificial Sequence
  chemically synthesized
ttaaaaatacattacccagtct

SEQ ID NO: 953573 - DNA, 22 bp, Artificial Sequence
  chemically synthesized
taaaaatacattacccagtctc

SEQ ID NO: 953574 - DNA, 22 bp, Artificial Sequence
  chemically synthesized
aaaaatacattacccagtctcg

SEQ ID NO: 953575 - DNA, 22 bp, Artificial Sequence
  chemically synthesized
tgaagaaatagccgagactggg

SEQ ID NO: 953576 - DNA, 22 bp, Artificial Sequence
  chemically synthesized
aaaatacattacccagtctcgg

SEQ ID NO: 953577 - DNA, 22 bp, Artificial Sequence
  chemically synthesized
ctatgaagaaatagccgagact

SEQ ID NO: 953578 - DNA, 22 bp, Artificial Sequence
  chemically synthesized
cccagtctcggctatttcttca

SEQ ID NO: 953579 - DNA, 22 bp, Artificial Sequence
  chemically synthesized
gcatgtattgctatgaagaaat

SEQ ID NO: 953580 - DNA, 22 bp, Artificial Sequence
  chemically synthesized
tgttagcatgtattgctatgaa

SEQ ID NO: 953581 - DNA, 22 bp, Artificial Sequence
  chemically synthesized
ggctatttcttcatagcaatac

SEQ ID NO: 953582 - DNA, 22 bp, Artificial Sequence
  chemically synthesized
tttcttcatagcaatacatgct

SEQ ID NO: 953583 - DNA, 22 bp, Artificial Sequence
  chemically synthesized
cttcatagcaatacatgctaac

SEQ ID NO: 953584 - DNA, 22 bp, Artificial Sequence
  chemically synthesized
ttcatagcaatacatgctaaca

SEQ ID NO: 953585 - DNA, 22 bp, Artificial Sequence
  chemically synthesized
catagcaatacatgctaacaca

SEQ ID NO: 953586 - DNA, 22 bp, Artificial Sequence
  chemically synthesized
atagcaatacatgctaacacag

SEQ ID NO: 953587 - DNA, 22 bp, Artificial Sequence
  chemically synthesized
acacagacccaccctccccgtc

SEQ ID NO: 953588 - DNA, 22 bp, Artificial Sequence
  chemically synthesized
cccgtctgtccttgatactctt

SEQ ID NO: 953589 - DNA, 22 bp, Artificial Sequence
  chemically synthesized
tccttgatactcttgtttttct

SEQ ID NO: 953590 - DNA, 22 bp, Artificial Sequence
  chemically synthesized
gatactcttgtttttctgccga

SEQ ID NO: 953591 - DNA, 22 bp, Artificial Sequence
  chemically synthesized
atactcttgtttttctgccgat

SEQ ID NO: 953592 - DNA, 22 bp, Artificial Sequence
  chemically synthesized
ttgtttttctgccgattttatt

SEQ ID NO: 953593 - DNA, 22 bp, Artificial Sequence
  chemically synthesized
gtttttctgccgattttattcc

SEQ ID NO: 953594 - DNA, 22 bp, Artificial Sequence
  chemically synthesized
tttttctgccgattttattcct

SEQ ID NO: 953595 - DNA, 22 bp, Artificial Sequence
  chemically synthesized
ttctgccgattttattcctatt

SEQ ID NO: 953596 - DNA, 22 bp, Artificial Sequence
  chemically synthesized
tctgccgattttattcctattg

SEQ ID NO: 953597 - DNA, 22 bp, Artificial Sequence
  chemically synthesized
ctgccgattttattcctattgt

SEQ ID NO: 953598 - DNA, 22 bp, Artificial Sequence
  chemically synthesized
tgccgattttattcctattgta

SEQ ID NO: 953599 - DNA, 22 bp, Artificial Sequence
  chemically synthesized
ccgattttattcctattgtatc

SEQ ID NO: 953600 - DNA, 22 bp, Artificial Sequence
  chemically synthesized
acatcaaacaaagagtagatac

SEQ ID NO: 953601 - DNA, 22 bp, Artificial Sequence
  chemically synthesized
aacatcaaacaaagagtagata

SEQ ID NO: 953602 - DNA, 22 bp, Artificial Sequence
  chemically synthesized
tattcctattgtatctactctt

SEQ ID NO: 953603 - DNA, 22 bp, Artificial Sequence
  chemically synthesized
attcctattgtatctactcttt

SEQ ID NO: 953604 - DNA, 22 bp, Artificial Sequence
  chemically synthesized
ttaacatcaaacaaagagtaga

SEQ ID NO: 953605 - DNA, 22 bp, Artificial Sequence
  chemically synthesized
ttcctattgtatctactctttg

SEQ ID NO: 953606 - DNA, 22 bp, Artificial Sequence
  chemically synthesized
cttaacatcaaacaaagagtag

SEQ ID NO: 953607 - DNA, 22 bp, Artificial Sequence
  chemically synthesized
tcttaacatcaaacaaagagta

SEQ ID NO: 953608 - DNA, 22 bp, Artificial Sequence
  chemically synthesized
ctattgtatctactctttgttt

SEQ ID NO: 953609 - DNA, 22 bp, Artificial Sequence
  chemically synthesized
ttgtatctactctttgtttgat

SEQ ID NO: 953610 - DNA, 22 bp, Artificial Sequence
  chemically synthesized
tatctactctttgtttgatgtt

SEQ ID NO: 953611 - DNA, 22 bp, Artificial Sequence
  chemically synthesized
ctctttgtttgatgttaagaaa

SEQ ID NO: 953612 - DNA, 22 bp, Artificial Sequence
  chemically synthesized
aagcaaagatcattttcttaac

SEQ ID NO: 953613 - DNA, 22 bp, Artificial Sequence
  chemically synthesized
gaagcaaagatcattttcttaa

SEQ ID NO: 953614 - DNA, 22 bp, Artificial Sequence
  chemically synthesized
tttgtttgatgttaagaaaatg

SEQ ID NO: 953615 - DNA, 22 bp, Artificial Sequence
  chemically synthesized
tgaagcaaagatcattttctta

SEQ ID NO: 953616 - DNA, 22 bp, Artificial Sequence
  chemically synthesized
ttgaagcaaagatcattttctt

SEQ ID NO: 953617 - DNA, 22 bp, Artificial Sequence
  chemically synthesized
tgtttgatgttaagaaaatgat

SEQ ID NO: 953618 - DNA, 22 bp, Artificial Sequence
  chemically synthesized
gtttgatgttaagaaaatgatc

SEQ ID NO: 953619 - DNA, 22 bp, Artificial Sequence
  chemically synthesized
tttgatgttaagaaaatgatct

SEQ ID NO: 953620 - DNA, 22 bp, Artificial Sequence
  chemically synthesized
aatttttgaagcaaagatcatt

SEQ ID NO: 953621 - DNA, 22 bp, Artificial Sequence
  chemically synthesized
gatgttaagaaaatgatctttg

SEQ ID NO: 953622 - DNA, 22 bp, Artificial Sequence
  chemically synthesized
gaatttttgaagcaaagatcat

SEQ ID NO: 953623 - DNA, 22 bp, Artificial Sequence
  chemically synthesized
atgttaagaaaatgatctttgc

SEQ ID NO: 953624 - DNA, 22 bp, Artificial Sequence
  chemically synthesized
taatttgaatttttgaagcaaa

SEQ ID NO: 953625 - DNA, 22 bp, Artificial Sequence
  chemically synthesized
agaaaatgatctttgcttcaaa

SEQ ID NO: 953626 - DNA, 22 bp, Artificial Sequence
  chemically synthesized
caggattataatttgaattttt

SEQ ID NO: 953627 - DNA, 22 bp, Artificial Sequence
  chemically synthesized
gcaggattataatttgaatttt

SEQ ID NO: 953628 - DNA, 22 bp, Artificial Sequence
  chemically synthesized
tgcttcaaaaattcaaattata

SEQ ID NO: 953629 - DNA, 22 bp, Artificial Sequence
  chemically synthesized
gcttcaaaaattcaaattataa

SEQ ID NO: 953630 - DNA, 22 bp, Artificial Sequence
  chemically synthesized
cttcaaaaattcaaattataat

SEQ ID NO: 953631 - DNA, 22 bp, Artificial Sequence
  chemically synthesized
caaaaattcaaattataatcct

SEQ ID NO: 953632 - DNA, 22 bp, Artificial Sequence
  chemically synthesized
aaaaattcaaattataatcctg

SEQ ID NO: 953633 - DNA, 22 bp, Artificial Sequence
  chemically synthesized
tatcaaagagcttgcaggatta

SEQ ID NO: 953634 - DNA, 22 bp, Artificial Sequence
  chemically synthesized
atatcaaagagcttgcaggatt

SEQ ID NO: 953635 - DNA, 22 bp, Artificial Sequence
  chemically synthesized
aaattataatcctgcaagctct

SEQ ID NO: 953636 - DNA, 22 bp, Artificial Sequence
  chemically synthesized
aacacttatatcaaagagcttg

SEQ ID NO: 953637 - DNA, 22 bp, Artificial Sequence
  chemically synthesized
taatcctgcaagctctttgata

SEQ ID NO: 953638 - DNA, 22 bp, Artificial Sequence
  chemically synthesized
aattgaacacttatatcaaaga

SEQ ID NO: 953639 - DNA, 22 bp, Artificial Sequence
  chemically synthesized
aaattgaacacttatatcaaag

SEQ ID NO: 953640 - DNA, 22 bp, Artificial Sequence
  chemically synthesized
atttaaattgaacacttatatc

SEQ ID NO: 953641 - DNA, 22 bp, Artificial Sequence
  chemically synthesized
aatttaaattgaacacttatat

SEQ ID NO: 953642 - DNA, 22 bp, Artificial Sequence
  chemically synthesized
caagctctttgatataagtgtt

SEQ ID NO: 953643 - DNA, 22 bp, Artificial Sequence
  chemically synthesized
taatttaaattgaacacttata

SEQ ID NO: 953644 - DNA, 22 bp, Artificial Sequence
  chemically synthesized
ttaatttaaattgaacacttat

SEQ ID NO: 953645 - DNA, 22 bp, Artificial Sequence
  chemically synthesized
tttaatttaaattgaacactta

SEQ ID NO: 953646 - DNA, 22 bp, Artificial Sequence
  chemically synthesized
cctttttaatttaaattgaaca

SEQ ID NO: 953647 - DNA, 22 bp, Artificial Sequence
  chemically synthesized
tttgatataagtgttcaattta

SEQ ID NO: 953648 - DNA, 22 bp, Artificial Sequence
  chemically synthesized
gcctttttaatttaaattgaac

SEQ ID NO: 953649 - DNA, 22 bp, Artificial Sequence
  chemically synthesized
tgcctttttaatttaaattgaa

SEQ ID NO: 953650 - DNA, 22 bp, Artificial Sequence
  chemically synthesized
tgatataagtgttcaatttaaa

SEQ ID NO: 953651 - DNA, 22 bp, Artificial Sequence
  chemically synthesized
gatataagtgttcaatttaaat

SEQ ID NO: 953652 - DNA, 22 bp, Artificial Sequence
  chemically synthesized
atataagtgttcaatttaaatt

SEQ ID NO: 953653 - DNA, 22 bp, Artificial Sequence
  chemically synthesized
gttttgcctttttaatttaaat

SEQ ID NO: 953654 - DNA, 22 bp, Artificial Sequence
  chemically synthesized
ggttttgcctttttaatttaaa

SEQ ID NO: 953655 - DNA, 22 bp, Artificial Sequence
  chemically synthesized
tggttttgcctttttaatttaa

SEQ ID NO: 953656 - DNA, 22 bp, Artificial Sequence
  chemically synthesized
ttttggttttgcctttttaatt

SEQ ID NO: 953657 - DNA, 22 bp, Artificial Sequence
  chemically synthesized
attttggttttgcctttttaat

SEQ ID NO: 953658 - DNA, 22 bp, Artificial Sequence
  chemically synthesized
aatttaaattaaaaaggcaaaa

SEQ ID NO: 953659 - DNA, 22 bp, Artificial Sequence
  chemically synthesized
gtcttattttggttttgccttt

SEQ ID NO: 953660 - DNA, 22 bp, Artificial Sequence
  chemically synthesized
agtcttattttggttttgcctt

SEQ ID NO: 953661 - DNA, 22 bp, Artificial Sequence
  chemically synthesized
aaattaaaaaggcaaaaccaaa

SEQ ID NO: 953662 - DNA, 22 bp, Artificial Sequence
  chemically synthesized
aattaaaaaggcaaaaccaaaa

SEQ ID NO: 953663 - DNA, 22 bp, Artificial Sequence
  chemically synthesized
tgcttagtcttattttggtttt

SEQ ID NO: 953664 - DNA, 22 bp, Artificial Sequence
  chemically synthesized
atgcttagtcttattttggttt

SEQ ID NO: 953665 - DNA, 22 bp, Artificial Sequence
  chemically synthesized
ttatgcttagtcttattttggt

SEQ ID NO: 953666 - DNA, 22 bp, Artificial Sequence
  chemically synthesized
cttatgcttagtcttattttgg

SEQ ID NO: 953667 - DNA, 22 bp, Artificial Sequence
  chemically synthesized
aaaaggcaaaaccaaaataaga

SEQ ID NO: 953668 - DNA, 22 bp, Artificial Sequence
  chemically synthesized
tcttatgcttagtcttattttg

SEQ ID NO: 953669 - DNA, 22 bp, Artificial Sequence
  chemically synthesized
ttttcttatgcttagtcttatt

SEQ ID NO: 953670 - DNA, 22 bp, Artificial Sequence
  chemically synthesized
agggaaagtgtattattttctt

SEQ ID NO: 953671 - DNA, 22 bp, Artificial Sequence
  chemically synthesized
agcataagaaaataatacactt

SEQ ID NO: 953672 - DNA, 22 bp, Artificial Sequence
  chemically synthesized
gtaactaagggaaagtgtatta

SEQ ID NO: 953673 - DNA, 22 bp, Artificial Sequence
  chemically synthesized
tggtaactaagggaaagtgtat

SEQ ID NO: 953674 - DNA, 22 bp, Artificial Sequence
  chemically synthesized
aaatatatcactctggtaacta

SEQ ID NO: 953675 - DNA, 22 bp, Artificial Sequence
  chemically synthesized
tcccttagttaccagagtgata

SEQ ID NO: 953676 - DNA, 22 bp, Artificial Sequence
  chemically synthesized
cccttagttaccagagtgatat

SEQ ID NO: 953677 - DNA, 22 bp, Artificial Sequence
  chemically synthesized
aaatgttcaaatatatcactct

SEQ ID NO: 953678 - DNA, 22 bp, Artificial Sequence
  chemically synthesized
ccttagttaccagagtgatata

SEQ ID NO: 953679 - DNA, 22 bp, Artificial Sequence
  chemically synthesized
aaaatgttcaaatatatcactc

SEQ ID NO: 953680 - DNA, 22 bp, Artificial Sequence
  chemically synthesized
agttaccagagtgatatatttg

SEQ ID NO: 953681 - DNA, 22 bp, Artificial Sequence
  chemically synthesized
gttaccagagtgatatatttga

SEQ ID NO: 953682 - DNA, 22 bp, Artificial Sequence
  chemically synthesized
ccagagtgatatatttgaacat

SEQ ID NO: 953683 - DNA, 22 bp, Artificial Sequence
  chemically synthesized
aaagcatttaaaatgttcaaat

SEQ ID NO: 953684 - DNA, 22 bp, Artificial Sequence
  chemically synthesized
gaaagcatttaaaatgttcaaa

SEQ ID NO: 953685 - DNA, 22 bp, Artificial Sequence
  chemically synthesized
tgaaagcatttaaaatgttcaa

SEQ ID NO: 953686 - DNA, 22 bp, Artificial Sequence
  chemically synthesized
ttgaaagcatttaaaatgttca

SEQ ID NO: 953687 - DNA, 22 bp, Artificial Sequence
  chemically synthesized
tttgaaagcatttaaaatgttc

SEQ ID NO: 953688 - DNA, 22 bp, Artificial Sequence
  chemically synthesized
attttttgaaagcatttaaaat

SEQ ID NO: 953689 - DNA, 22 bp, Artificial Sequence
  chemically synthesized
gattttttgaaagcatttaaaa

SEQ ID NO: 953690 - DNA, 22 bp, Artificial Sequence
  chemically synthesized
gaacattttaaatgctttcaaa

SEQ ID NO: 953691 - DNA, 22 bp, Artificial Sequence
  chemically synthesized
gaaatttgattttttgaaagca

SEQ ID NO: 953692 - DNA, 22 bp, Artificial Sequence
  chemically synthesized
aacattttaaatgctttcaaaa

SEQ ID NO: 953693 - DNA, 22 bp, Artificial Sequence
  chemically synthesized
agaaatttgattttttgaaagc

SEQ ID NO: 953694 - DNA, 22 bp, Artificial Sequence
  chemically synthesized
taaatgctttcaaaaaatcaaa

SEQ ID NO: 953695 - DNA, 22 bp, Artificial Sequence
  chemically synthesized
aaatgctttcaaaaaatcaaat

SEQ ID NO: 953696 - DNA, 22 bp, Artificial Sequence
  chemically synthesized
aatgctttcaaaaaatcaaatt

SEQ ID NO: 953697 - DNA, 22 bp, Artificial Sequence
  chemically synthesized
tcaaaaaatcaaatttctaaac

SEQ ID NO: 953698 - DNA, 22 bp, Artificial Sequence
  chemically synthesized
caaaaaatcaaatttctaaact

SEQ ID NO: 953699 - DNA, 22 bp, Artificial Sequence
  chemically synthesized
agtagaggtaacagtttagaaa

SEQ ID NO: 953700 - DNA, 22 bp, Artificial Sequence
  chemically synthesized
aaaaaatcaaatttctaaactg

SEQ ID NO: 953701 - DNA, 22 bp, Artificial Sequence
  chemically synthesized
tgggattaagtagaggtaacag

SEQ ID NO: 953702 - DNA, 22 bp, Artificial Sequence
  chemically synthesized
tgtgggattaagtagaggtaac

SEQ ID NO: 953703 - DNA, 22 bp, Artificial Sequence
  chemically synthesized
ctaaactgttacctctacttaa

SEQ ID NO: 953704 - DNA, 22 bp, Artificial Sequence
  chemically synthesized
taaactgttacctctacttaat

SEQ ID NO: 953705 - DNA, 22 bp, Artificial Sequence
  chemically synthesized
tcacctctgtgggattaagtag

SEQ ID NO: 953706 - DNA, 22 bp, Artificial Sequence
  chemically synthesized
aactgttacctctacttaatcc

SEQ ID NO: 953707 - DNA, 22 bp, Artificial Sequence
  chemically synthesized
atcacctctgtgggattaagta

SEQ ID NO: 953708 - DNA, 22 bp, Artificial Sequence
  chemically synthesized
tatcacctctgtgggattaagt

SEQ ID NO: 953709 - DNA, 22 bp, Artificial Sequence
  chemically synthesized
ttacctctacttaatcccacag

SEQ ID NO: 953710 - DNA, 22 bp, Artificial Sequence
  chemically synthesized
cctctacttaatcccacagagg

SEQ ID NO: 953711 - DNA, 22 bp, Artificial Sequence
  chemically synthesized
ccaataattttatcacctctgt

SEQ ID NO: 953712 - DNA, 22 bp, Artificial Sequence
  chemically synthesized
tacttaatcccacagaggtgat

SEQ ID NO: 953713 - DNA, 22 bp, Artificial Sequence
  chemically synthesized
cttaatcccacagaggtgataa

SEQ ID NO: 953714 - DNA, 22 bp, Artificial Sequence
  chemically synthesized
aatcccacagaggtgataaaat

SEQ ID NO: 953715 - DNA, 22 bp, Artificial Sequence
  chemically synthesized
atcccacagaggtgataaaatt

SEQ ID NO: 953716 - DNA, 22 bp, Artificial Sequence
  chemically synthesized
tccacatgatcatcaattgcca

SEQ ID NO: 953717 - DNA, 22 bp, Artificial Sequence
  chemically synthesized
atccacatgatcatcaattgcc

SEQ ID NO: 953718 - DNA, 22 bp, Artificial Sequence
  chemically synthesized
ttggcaattgatgatcatgtgg

SEQ ID NO: 953719 - DNA, 22 bp, Artificial Sequence
  chemically synthesized
tcagtcaatttatccacatgat

SEQ ID NO: 953720 - DNA, 22 bp, Artificial Sequence
  chemically synthesized
gcaattgatgatcatgtggata

SEQ ID NO: 953721 - DNA, 22 bp, Artificial Sequence
  chemically synthesized
atgatcatgtggataaattgac

SEQ ID NO: 953722 - DNA, 22 bp, Artificial Sequence
  chemically synthesized
atgaataaatgaatgaaattgt

SEQ ID NO: 953723 - DNA, 22 bp, Artificial Sequence
  chemically synthesized
ttaatgaataaatgaatgaaat

SEQ ID NO: 953724 - DNA, 22 bp, Artificial Sequence
  chemically synthesized
actgacaatttcattcatttat

SEQ ID NO: 953725 - DNA, 22 bp, Artificial Sequence
  chemically synthesized
acaatttcattcatttattcat

SEQ ID NO: 953726 - DNA, 22 bp, Artificial Sequence
  chemically synthesized
cattcatttattcattaatagc

SEQ ID NO: 953727 - DNA, 22 bp, Artificial Sequence
  chemically synthesized
attcatttattcattaatagct

SEQ ID NO: 953728 - DNA, 22 bp, Artificial Sequence
  chemically synthesized
atttattcattaatagctcctc

SEQ ID NO: 953729 - DNA, 22 bp, Artificial Sequence
  chemically synthesized
attcattaatagctcctcattg

SEQ ID NO: 953730 - DNA, 22 bp, Artificial Sequence
  chemically synthesized
ggatacatacatcaatgaggag

SEQ ID NO: 953731 - DNA, 22 bp, Artificial Sequence
  chemically synthesized
ttcattaatagctcctcattga

SEQ ID NO: 953732 - DNA, 22 bp, Artificial Sequence
  chemically synthesized
gggatacatacatcaatgagga

SEQ ID NO: 953733 - DNA, 22 bp, Artificial Sequence
  chemically synthesized
attaatagctcctcattgatgt

SEQ ID NO: 953734 - DNA, 22 bp, Artificial Sequence
  chemically synthesized
atagctcctcattgatgtatgt

SEQ ID NO: 953735 - DNA, 22 bp, Artificial Sequence
  chemically synthesized
ctcattgatgtatgtatcccaa

SEQ ID NO: 953736 - DNA, 22 bp, Artificial Sequence
  chemically synthesized
attgatgtatgtatcccaaatg

SEQ ID NO: 953737 - DNA, 22 bp, Artificial Sequence
  chemically synthesized
atgtatgtatcccaaatgtctc

SEQ ID NO: 953738 - DNA, 22 bp, Artificial Sequence
  chemically synthesized
agagaaggaaaggagacatttg

SEQ ID NO: 953739 - DNA, 22 bp, Artificial Sequence
  chemically synthesized
gagagaaggaaaggagacattt

SEQ ID NO: 953740 - DNA, 22 bp, Artificial Sequence
  chemically synthesized
tgagagaaggaaaggagacatt

SEQ ID NO: 953741 - DNA, 22 bp, Artificial Sequence
  chemically synthesized
cccctttgagagaaggaaagga

SEQ ID NO: 953742 - DNA, 22 bp, Artificial Sequence
  chemically synthesized
gcccctttgagagaaggaaagg

SEQ ID NO: 953743 - DNA, 22 bp, Artificial Sequence
  chemically synthesized
cttgcccctttgagagaaggaa

SEQ ID NO: 953744 - DNA, 22 bp, Artificial Sequence
  chemically synthesized
gcttgcccctttgagagaagga

SEQ ID NO: 953745 - DNA, 22 bp, Artificial Sequence
  chemically synthesized
tgcttgcccctttgagagaagg

SEQ ID NO: 953746 - DNA, 22 bp, Artificial Sequence
  chemically synthesized
ctttgcttgcccctttgagaga

SEQ ID NO: 953747 - DNA, 22 bp, Artificial Sequence
  chemically synthesized
cctttgcttgcccctttgagag

SEQ ID NO: 953748 - DNA, 22 bp, Artificial Sequence
  chemically synthesized
ctttccttctctcaaaggggca

SEQ ID NO: 953749 - DNA, 22 bp, Artificial Sequence
  chemically synthesized
catttcctttgcttgccccttt

SEQ ID NO: 953750 - DNA, 22 bp, Artificial Sequence
  chemically synthesized
ccatttcctttgcttgcccctt

SEQ ID NO: 953751 - DNA, 22 bp, Artificial Sequence
  chemically synthesized
tccttctctcaaaggggcaagc

SEQ ID NO: 953752 - DNA, 22 bp, Artificial Sequence
  chemically synthesized
ccttctctcaaaggggcaagca

SEQ ID NO: 953753 - DNA, 22 bp, Artificial Sequence
  chemically synthesized
cttctctcaaaggggcaagcaa

SEQ ID NO: 953754 - DNA, 22 bp, Artificial Sequence
  chemically synthesized
ctctcaaaggggcaagcaaagg

SEQ ID NO: 953755 - DNA, 22 bp, Artificial Sequence
  chemically synthesized
cagtttccatttcctttgcttg

SEQ ID NO: 953756 - DNA, 22 bp, Artificial Sequence
  chemically synthesized
tctcaaaggggcaagcaaagga

SEQ ID NO: 953757 - DNA, 22 bp, Artificial Sequence
  chemically synthesized
tcaaaggggcaagcaaaggaaa

SEQ ID NO: 953758 - DNA, 22 bp, Artificial Sequence
  chemically synthesized
ttacagtttccatttcctttgc

SEQ ID NO: 953759 - DNA, 22 bp, Artificial Sequence
  chemically synthesized
aaaggggcaagcaaaggaaatg

SEQ ID NO: 953760 - DNA, 22 bp, Artificial Sequence
  chemically synthesized
ctgttacagtttccatttcctt

SEQ ID NO: 953761 - DNA, 22 bp, Artificial Sequence
  chemically synthesized
actgttacagtttccatttcct

SEQ ID NO: 953762 - DNA, 22 bp, Artificial Sequence
  chemically synthesized
tactgttacagtttccatttcc

SEQ ID NO: 953763 - DNA, 22 bp, Artificial Sequence
  chemically synthesized
ttactgttacagtttccatttc

SEQ ID NO: 953764 - DNA, 22 bp, Artificial Sequence
  chemically synthesized
gagtatatggcttttactgtta

SEQ ID NO: 953765 - DNA, 22 bp, Artificial Sequence
  chemically synthesized
agagtatatggcttttactgtt

SEQ ID NO: 953766 - DNA, 22 bp, Artificial Sequence
  chemically synthesized
taacagtaaaagccatatactc

SEQ ID NO: 953767 - DNA, 22 bp, Artificial Sequence
  chemically synthesized
atgtccaccttagagtatatgg

SEQ ID NO: 953768 - DNA, 22 bp, Artificial Sequence
  chemically synthesized
taatgtccaccttagagtatat

SEQ ID NO: 953769 - DNA, 22 bp, Artificial Sequence
  chemically synthesized
ctaatgtccaccttagagtata

SEQ ID NO: 953770 - DNA, 22 bp, Artificial Sequence
  chemically synthesized
tctaatgtccaccttagagtat

SEQ ID NO: 953771 - DNA, 22 bp, Artificial Sequence
  chemically synthesized
tagaccaagagactttctaatg

SEQ ID NO: 953772 - DNA, 22 bp, Artificial Sequence
  chemically synthesized
taaggtggacattagaaagtct

SEQ ID NO: 953773 - DNA, 22 bp, Artificial Sequence
  chemically synthesized
aggtggacattagaaagtctct

SEQ ID NO: 953774 - DNA, 22 bp, Artificial Sequence
  chemically synthesized
aaaacgacctgtagaccaagag

SEQ ID NO: 953775 - DNA, 22 bp, Artificial Sequence
  chemically synthesized
gaaagtctcttggtctacaggt

SEQ ID NO: 953776 - DNA, 22 bp, Artificial Sequence
  chemically synthesized
ggattaaaaacgacctgtagac

SEQ ID NO: 953777 - DNA, 22 bp, Artificial Sequence
  chemically synthesized
aggattaaaaacgacctgtaga

SEQ ID NO: 953778 - DNA, 22 bp, Artificial Sequence
  chemically synthesized
taggattaaaaacgacctgtag

SEQ ID NO: 953779 - DNA, 22 bp, Artificial Sequence
  chemically synthesized
tctttaggattaaaaacgacct

SEQ ID NO: 953780 - DNA, 22 bp, Artificial Sequence
  chemically synthesized
tgtctttaggattaaaaacgac

SEQ ID NO: 953781 - DNA, 22 bp, Artificial Sequence
  chemically synthesized
ttggtctacaggtcgtttttaa

SEQ ID NO: 953782 - DNA, 22 bp, Artificial Sequence
  chemically synthesized
ggtctacaggtcgtttttaatc

SEQ ID NO: 953783 - DNA, 22 bp, Artificial Sequence
  chemically synthesized
ttctgtctttaggattaaaaac

SEQ ID NO: 953784 - DNA, 22 bp, Artificial Sequence
  chemically synthesized
gtctacaggtcgtttttaatcc

SEQ ID NO: 953785 - DNA, 22 bp, Artificial Sequence
  chemically synthesized
caggtcgtttttaatcctaaag

SEQ ID NO: 953786 - DNA, 22 bp, Artificial Sequence
  chemically synthesized
tataggtagattattctgtctt

SEQ ID NO: 953787 - DNA, 22 bp, Artificial Sequence
  chemically synthesized
tatataggtagattattctgtc

SEQ ID NO: 953788 - DNA, 22 bp, Artificial Sequence
  chemically synthesized
ttaatcctaaagacagaataat

SEQ ID NO: 953789 - DNA, 22 bp, Artificial Sequence
  chemically synthesized
ctatataggtagattattctgt

SEQ ID NO: 953790 - DNA, 22 bp, Artificial Sequence
  chemically synthesized
taatcctaaagacagaataatc

SEQ ID NO: 953791 - DNA, 22 bp, Artificial Sequence
  chemically synthesized
aatcctaaagacagaataatct

SEQ ID NO: 953792 - DNA, 22 bp, Artificial Sequence
  chemically synthesized
atcctaaagacagaataatcta

SEQ ID NO: 953793 - DNA, 22 bp, Artificial Sequence
  chemically synthesized
atgatttctatataggtagatt

SEQ ID NO: 953794 - DNA, 22 bp, Artificial Sequence
  chemically synthesized
aatgatttctatataggtagat

SEQ ID NO: 953795 - DNA, 22 bp, Artificial Sequence
  chemically synthesized
aagacagaataatctacctata

SEQ ID NO: 953796 - DNA, 22 bp, Artificial Sequence
  chemically synthesized
tttaatgatttctatataggta

SEQ ID NO: 953797 - DNA, 22 bp, Artificial Sequence
  chemically synthesized
gtttaatgatttctatataggt

SEQ ID NO: 953798 - DNA, 22 bp, Artificial Sequence
  chemically synthesized
tttgtttaatgatttctatata

SEQ ID NO: 953799 - DNA, 22 bp, Artificial Sequence
  chemically synthesized
tatttgtttaatgatttctata

SEQ ID NO: 953800 - DNA, 22 bp, Artificial Sequence
  chemically synthesized
ctatttgtttaatgatttctat

SEQ ID NO: 953801 - DNA, 22 bp, Artificial Sequence
  chemically synthesized
cctatatagaaatcattaaaca

SEQ ID NO: 953802 - DNA, 22 bp, Artificial Sequence
  chemically synthesized
tatagaaatcattaaacaaata

SEQ ID NO: 953803 - DNA, 22 bp, Artificial Sequence
  chemically synthesized
taaggcaaaatttctatttgtt

SEQ ID NO: 953804 - DNA, 22 bp, Artificial Sequence
  chemically synthesized
ataaggcaaaatttctatttgt

SEQ ID NO: 953805 - DNA, 22 bp, Artificial Sequence
  chemically synthesized
tttataaggcaaaatttctatt

SEQ ID NO: 953806 - DNA, 22 bp, Artificial Sequence
  chemically synthesized
ctatttataaggcaaaatttct

SEQ ID NO: 953807 - DNA, 22 bp, Artificial Sequence
  chemically synthesized
ctactatttataaggcaaaatt

SEQ ID NO: 953808 - DNA, 22 bp, Artificial Sequence
  chemically synthesized
cctactatttataaggcaaaat

SEQ ID NO: 953809 - DNA, 22 bp, Artificial Sequence
  chemically synthesized
aacaaatagaaattttgcctta

SEQ ID NO: 953810 - DNA, 22 bp, Artificial Sequence
  chemically synthesized
tcctactatttataaggcaaaa

SEQ ID NO: 953811 - DNA, 22 bp, Artificial Sequence
  chemically synthesized
tgccttataaatagtaggaaaa

SEQ ID NO: 953812 - DNA, 22 bp, Artificial Sequence
  chemically synthesized
gccttataaatagtaggaaaat

SEQ ID NO: 953813 - DNA, 22 bp, Artificial Sequence
  chemically synthesized
ccttataaatagtaggaaaata

SEQ ID NO: 953814 - DNA, 22 bp, Artificial Sequence
  chemically synthesized
ataaatagtaggaaaatacata

SEQ ID NO: 953815 - DNA, 22 bp, Artificial Sequence
  chemically synthesized
taaatagtaggaaaatacatac

SEQ ID NO: 953816 - DNA, 22 bp, Artificial Sequence
  chemically synthesized
aggccataaatgtaggtatgta

SEQ ID NO: 953817 - DNA, 22 bp, Artificial Sequence
  chemically synthesized
caggccataaatgtaggtatgt

SEQ ID NO: 953818 - DNA, 22 bp, Artificial Sequence
  chemically synthesized
tcaggccataaatgtaggtatg

SEQ ID NO: 953819 - DNA, 22 bp, Artificial Sequence
  chemically synthesized
gttttcaggccataaatgtagg

SEQ ID NO: 953820 - DNA, 22 bp, Artificial Sequence
  chemically synthesized
atgctggttttcaggccataaa

SEQ ID NO: 953821 - DNA, 22 bp, Artificial Sequence
  chemically synthesized
catttatggcctgaaaaccagc

SEQ ID NO: 953822 - DNA, 22 bp, Artificial Sequence
  chemically synthesized
taacatagctgatgctggtttt

SEQ ID NO: 953823 - DNA, 22 bp, Artificial Sequence
  chemically synthesized
atggcctgaaaaccagcatcag

SEQ ID NO: 953824 - DNA, 22 bp, Artificial Sequence
  chemically synthesized
tggcctgaaaaccagcatcagc

SEQ ID NO: 953825 - DNA, 22 bp, Artificial Sequence
  chemically synthesized
aaaaccagcatcagctatgtta

SEQ ID NO: 953826 - DNA, 22 bp, Artificial Sequence
  chemically synthesized
tgtggacaactataacatagct

SEQ ID NO: 953827 - DNA, 22 bp, Artificial Sequence
  chemically synthesized
tatgtggacaactataacatag

SEQ ID NO: 953828 - DNA, 22 bp, Artificial Sequence
  chemically synthesized
gttctatgtggacaactataac

SEQ ID NO: 953829 - DNA, 22 bp, Artificial Sequence
  chemically synthesized
tattagttctatgtggacaact

SEQ ID NO: 953830 - DNA, 22 bp, Artificial Sequence
  chemically synthesized
tgttatagttgtccacatagaa

SEQ ID NO: 953831 - DNA, 22 bp, Artificial Sequence
  chemically synthesized
tagttgtccacatagaactaat

SEQ ID NO: 953832 - DNA, 22 bp, Artificial Sequence
  chemically synthesized
cccagtacattatattagttct

SEQ ID NO: 953833 - DNA, 22 bp, Artificial Sequence
  chemically synthesized
tacccagtacattatattagtt

SEQ ID NO: 953834 - DNA, 22 bp, Artificial Sequence
  chemically synthesized
ctacccagtacattatattagt

SEQ ID NO: 953835 - DNA, 22 bp, Artificial Sequence
  chemically synthesized
tctacccagtacattatattag

SEQ ID NO: 953836 - DNA, 22 bp, Artificial Sequence
  chemically synthesized
tccacatagaactaatataatg

SEQ ID NO: 953837 - DNA, 22 bp, Artificial Sequence
  chemically synthesized
atataatgtactgggtagaaag

SEQ ID NO: 953838 - DNA, 22 bp, Artificial Sequence
  chemically synthesized
ggtagaaagtgaccatttttct

SEQ ID NO: 953839 - DNA, 22 bp, Artificial Sequence
  chemically synthesized
cagtgatgacaagggtcaaaat

SEQ ID NO: 953840 - DNA, 22 bp, Artificial Sequence
  chemically synthesized
ccagtgatgacaagggtcaaaa

SEQ ID NO: 953841 - DNA, 22 bp, Artificial Sequence
  chemically synthesized
ttccagtgatgacaagggtcaa

SEQ ID NO: 953842 - DNA, 22 bp, Artificial Sequence
  chemically synthesized
ttctccattttgacccttgtca

SEQ ID NO: 953843 - DNA, 22 bp, Artificial Sequence
  chemically synthesized
tctccattttgacccttgtcat

SEQ ID NO: 953844 - DNA, 22 bp, Artificial Sequence
  chemically synthesized
ctccattttgacccttgtcatc

SEQ ID NO: 953845 - DNA, 22 bp, Artificial Sequence
  chemically synthesized
tccattttgacccttgtcatca

SEQ ID NO: 953846 - DNA, 22 bp, Artificial Sequence
  chemically synthesized
cattttgacccttgtcatcact

SEQ ID NO: 953847 - DNA, 22 bp, Artificial Sequence
  chemically synthesized
tgacccttgtcatcactggaag

SEQ ID NO: 953848 - DNA, 22 bp, Artificial Sequence
  chemically synthesized
gacccttgtcatcactggaaga

SEQ ID NO: 953849 - DNA, 22 bp, Artificial Sequence
  chemically synthesized
acccttgtcatcactggaagaa

SEQ ID NO: 953850 - DNA, 22 bp, Artificial Sequence
  chemically synthesized
atggaatccatgttcttccagt

SEQ ID NO: 953851 - DNA, 22 bp, Artificial Sequence
  chemically synthesized
aatggaatccatgttcttccag

SEQ ID NO: 953852 - DNA, 22 bp, Artificial Sequence
  chemically synthesized
gtcatcactggaagaacatgga

SEQ ID NO: 953853 - DNA, 22 bp, Artificial Sequence
  chemically synthesized
tcatcactggaagaacatggat

SEQ ID NO: 953854 - DNA, 22 bp, Artificial Sequence
  chemically synthesized
gaagaacatggattccattaag

SEQ ID NO: 953855 - DNA, 22 bp, Artificial Sequence
  chemically synthesized
cattaaggttcccacattcatt

SEQ ID NO: 953856 - DNA, 22 bp, Artificial Sequence
  chemically synthesized
tgtgaggagaagggtaatgaat

SEQ ID NO: 953857 - DNA, 22 bp, Artificial Sequence
  chemically synthesized
aggttcccacattcattaccct

SEQ ID NO: 953858 - DNA, 22 bp, Artificial Sequence
  chemically synthesized
tgtgtgaggagaagggtaatga

SEQ ID NO: 953859 - DNA, 22 bp, Artificial Sequence
  chemically synthesized
ctgtgtgaggagaagggtaatg

SEQ ID NO: 953860 - DNA, 22 bp, Artificial Sequence
  chemically synthesized
ccacattcattacccttctcct

SEQ ID NO: 953861 - DNA, 22 bp, Artificial Sequence
  chemically synthesized
catttctgtgtgaggagaaggg

SEQ ID NO: 953862 - DNA, 22 bp, Artificial Sequence
  chemically synthesized
gcatttctgtgtgaggagaagg

SEQ ID NO: 953863 - DNA, 22 bp, Artificial Sequence
  chemically synthesized
attacccttctcctcacacaga

SEQ ID NO: 953864 - DNA, 22 bp, Artificial Sequence
  chemically synthesized
aatgtttgcatttctgtgtgag

SEQ ID NO: 953865 - DNA, 22 bp, Artificial Sequence
  chemically synthesized
caatgtttgcatttctgtgtga

SEQ ID NO: 953866 - DNA, 22 bp, Artificial Sequence
  chemically synthesized
tcaatgtttgcatttctgtgtg

SEQ ID NO: 953867 - DNA, 22 bp, Artificial Sequence
  chemically synthesized
ttcaatgtttgcatttctgtgt

SEQ ID NO: 953868 - DNA, 22 bp, Artificial Sequence
  chemically synthesized
cccttctcctcacacagaaatg

SEQ ID NO: 953869 - DNA, 22 bp, Artificial Sequence
  chemically synthesized
ctcctcacacagaaatgcaaac

SEQ ID NO: 953870 - DNA, 22 bp, Artificial Sequence
  chemically synthesized
tcctcacacagaaatgcaaaca

SEQ ID NO: 953871 - DNA, 22 bp, Artificial Sequence
  chemically synthesized
ctcacacagaaatgcaaacatt

SEQ ID NO: 953872 - DNA, 22 bp, Artificial Sequence
  chemically synthesized
acacagaaatgcaaacattgaa

SEQ ID NO: 953873 - DNA, 22 bp, Artificial Sequence
  chemically synthesized
cacgaagaaacttttcaatgtt

SEQ ID NO: 953874 - DNA, 22 bp, Artificial Sequence
  chemically synthesized
tccacgaagaaacttttcaatg

SEQ ID NO: 953875 - DNA, 22 bp, Artificial Sequence
  chemically synthesized
aaaagtttcttcgtggagagtt

SEQ ID NO: 953876 - DNA, 22 bp, Artificial Sequence
  chemically synthesized
cttcgtggagagttctattttg

SEQ ID NO: 953877 - DNA, 22 bp, Artificial Sequence
  chemically synthesized
ttcgtggagagttctattttgt

SEQ ID NO: 953878 - DNA, 22 bp, Artificial Sequence
  chemically synthesized
cgtggagagttctattttgttt

SEQ ID NO: 953879 - DNA, 22 bp, Artificial Sequence
  chemically synthesized
gtggagagttctattttgtttt

SEQ ID NO: 953880 - DNA, 22 bp, Artificial Sequence
  chemically synthesized
atgcaaaaagaacaaaacaaaa

SEQ ID NO: 953881 - DNA, 22 bp, Artificial Sequence
  chemically synthesized
aatgcaaaaagaacaaaacaaa

SEQ ID NO: 953882 - DNA, 22 bp, Artificial Sequence
  chemically synthesized
taatgcaaaaagaacaaaacaa

SEQ ID NO: 953883 - DNA, 22 bp, Artificial Sequence
  chemically synthesized
ttaatgcaaaaagaacaaaaca

SEQ ID NO: 953884 - DNA, 22 bp, Artificial Sequence
  chemically synthesized
aacttttaatgcaaaaagaaca

SEQ ID NO: 953885 - DNA, 22 bp, Artificial Sequence
  chemically synthesized
tattttgttttgttctttttgc

SEQ ID NO: 953886 - DNA, 22 bp, Artificial Sequence
  chemically synthesized
ttttgttttgttctttttgcat

SEQ ID NO: 953887 - DNA, 22 bp, Artificial Sequence
  chemically synthesized
tgttttgttctttttgcattaa

SEQ ID NO: 953888 - DNA, 22 bp, Artificial Sequence
  chemically synthesized
gttttgttctttttgcattaaa

SEQ ID NO: 953889 - DNA, 22 bp, Artificial Sequence
  chemically synthesized
ttttgttctttttgcattaaaa

SEQ ID NO: 953890 - DNA, 22 bp, Artificial Sequence
  chemically synthesized
tgttctttttgcattaaaagtt

SEQ ID NO: 953891 - DNA, 22 bp, Artificial Sequence
  chemically synthesized
gttctttttgcattaaaagttc

SEQ ID NO: 953892 - DNA, 22 bp, Artificial Sequence
  chemically synthesized
ttctttttgcattaaaagttca

SEQ ID NO: 953893 - DNA, 22 bp, Artificial Sequence
  chemically synthesized
aataaatagtattgaactttta

SEQ ID NO: 953894 - DNA, 22 bp, Artificial Sequence
  chemically synthesized
gaataaatagtattgaactttt

SEQ ID NO: 953895 - DNA, 22 bp, Artificial Sequence
  chemically synthesized
tttttgcattaaaagttcaata

SEQ ID NO: 953896 - DNA, 22 bp, Artificial Sequence
  chemically synthesized
tttgcattaaaagttcaatact

SEQ ID NO: 953897 - DNA, 22 bp, Artificial Sequence
  chemically synthesized
ttgcattaaaagttcaatacta

SEQ ID NO: 953898 - DNA, 22 bp, Artificial Sequence
  chemically synthesized
tgcattaaaagttcaatactat

SEQ ID NO: 953899 - DNA, 22 bp, Artificial Sequence
  chemically synthesized
gcattaaaagttcaatactatt

SEQ ID NO: 953900 - DNA, 22 bp, Artificial Sequence
  chemically synthesized
cattaaaagttcaatactattt

SEQ ID NO: 953901 - DNA, 22 bp, Artificial Sequence
  chemically synthesized
ataaacttgaataaatagtatt

SEQ ID NO: 953902 - DNA, 22 bp, Artificial Sequence
  chemically synthesized
gataaacttgaataaatagtat

SEQ ID NO: 953903 - DNA, 22 bp, Artificial Sequence
  chemically synthesized
aaagttcaatactatttattca

SEQ ID NO: 953904 - DNA, 22 bp, Artificial Sequence
  chemically synthesized
agcttgataaacttgaataaat

SEQ ID NO: 953905 - DNA, 22 bp, Artificial Sequence
  chemically synthesized
attcagcttgataaacttgaat

SEQ ID NO: 953906 - DNA, 22 bp, Artificial Sequence
  chemically synthesized
aatactatttattcaagtttat

SEQ ID NO: 953907 - DNA, 22 bp, Artificial Sequence
  chemically synthesized
ttcattcagcttgataaacttg

SEQ ID NO: 953908 - DNA, 22 bp, Artificial Sequence
  chemically synthesized
gttcattcagcttgataaactt

SEQ ID NO: 953909 - DNA, 22 bp, Artificial Sequence
  chemically synthesized
tttattcaagtttatcaagctg

SEQ ID NO: 953910 - DNA, 22 bp, Artificial Sequence
  chemically synthesized
attcaagtttatcaagctgaat

SEQ ID NO: 953911 - DNA, 22 bp, Artificial Sequence
  chemically synthesized
ttcaagtttatcaagctgaatg

SEQ ID NO: 953912 - DNA, 22 bp, Artificial Sequence
  chemically synthesized
aagtttatcaagctgaatgaac

SEQ ID NO: 953913 - DNA, 22 bp, Artificial Sequence
  chemically synthesized
taataggccatttgttcattca

SEQ ID NO: 953914 - DNA, 22 bp, Artificial Sequence
  chemically synthesized
atcaagctgaatgaacaaatgg

SEQ ID NO: 953915 - DNA, 22 bp, Artificial Sequence
  chemically synthesized
tcaagctgaatgaacaaatggc

SEQ ID NO: 953916 - DNA, 22 bp, Artificial Sequence
  chemically synthesized
aatgaacaaatggcctattata

SEQ ID NO: 953917 - DNA, 22 bp, Artificial Sequence
  chemically synthesized
agggcccaaaatatgaaatgca

SEQ ID NO: 953918 - DNA, 22 bp, Artificial Sequence
  chemically synthesized
aagggcccaaaatatgaaatgc

SEQ ID NO: 953919 - DNA, 22 bp, Artificial Sequence
  chemically synthesized
ttataattgcatttcatatttt

SEQ ID NO: 953920 - DNA, 22 bp, Artificial Sequence
  chemically synthesized
taattgcatttcatattttggg

SEQ ID NO: 953921 - DNA, 22 bp, Artificial Sequence
  chemically synthesized
gaaatttaagggcccaaaatat

SEQ ID NO: 953922 - DNA, 22 bp, Artificial Sequence
  chemically synthesized
cgaaatttaagggcccaaaata

SEQ ID NO: 953923 - DNA, 22 bp, Artificial Sequence
  chemically synthesized
catttcatattttgggccctta

SEQ ID NO: 953924 - DNA, 22 bp, Artificial Sequence
  chemically synthesized
catattttgggcccttaaattt

SEQ ID NO: 953925 - DNA, 22 bp, Artificial Sequence
  chemically synthesized
atattttgggcccttaaatttc

SEQ ID NO: 953926 - DNA, 22 bp, Artificial Sequence
  chemically synthesized
gaaacgtagatttcgaaattta

SEQ ID NO: 953927 - DNA, 22 bp, Artificial Sequence
  chemically synthesized
ggaaacgtagatttcgaaattt

SEQ ID NO: 953928 - DNA, 22 bp, Artificial Sequence
  chemically synthesized
tggaaacgtagatttcgaaatt

SEQ ID NO: 953929 - DNA, 22 bp, Artificial Sequence
  chemically synthesized
tgggcccttaaatttcgaaatc

SEQ ID NO: 953930 - DNA, 22 bp, Artificial Sequence
  chemically synthesized
tttggaaacgtagatttcgaaa

SEQ ID NO: 953931 - DNA, 22 bp, Artificial Sequence
  chemically synthesized
gggcccttaaatttcgaaatct

SEQ ID NO: 953932 - DNA, 22 bp, Artificial Sequence
  chemically synthesized
ggcccttaaatttcgaaatcta

SEQ ID NO: 953933 - DNA, 22 bp, Artificial Sequence
  chemically synthesized
tctttggaaacgtagatttcga

SEQ ID NO: 953934 - DNA, 22 bp, Artificial Sequence
  chemically synthesized
ctctttggaaacgtagatttcg

SEQ ID NO: 953935 - DNA, 22 bp, Artificial Sequence
  chemically synthesized
tctctttggaaacgtagatttc

SEQ ID NO: 953936 - DNA, 22 bp, Artificial Sequence
  chemically synthesized
actttctctttggaaacgtaga

SEQ ID NO: 953937 - DNA, 22 bp, Artificial Sequence
  chemically synthesized
aaatttcgaaatctacgtttcc

SEQ ID NO: 953938 - DNA, 22 bp, Artificial Sequence
  chemically synthesized
aactttctctttggaaacgtag

SEQ ID NO: 953939 - DNA, 22 bp, Artificial Sequence
  chemically synthesized
aatttcgaaatctacgtttcca

SEQ ID NO: 953940 - DNA, 22 bp, Artificial Sequence
  chemically synthesized
taactttctctttggaaacgta

SEQ ID NO: 953941 - DNA, 22 bp, Artificial Sequence
  chemically synthesized
ttaactttctctttggaaacgt

SEQ ID NO: 953942 - DNA, 22 bp, Artificial Sequence
  chemically synthesized
tttttaactttctctttggaaa

SEQ ID NO: 953943 - DNA, 22 bp, Artificial Sequence
  chemically synthesized
cgaaatctacgtttccaaagag

SEQ ID NO: 953944 - DNA, 22 bp, Artificial Sequence
  chemically synthesized
gaaatctacgtttccaaagaga

SEQ ID NO: 953945 - DNA, 22 bp, Artificial Sequence
  chemically synthesized
ccctgtttttaactttctcttt

SEQ ID NO: 953946 - DNA, 22 bp, Artificial Sequence
  chemically synthesized
cccctgtttttaactttctctt

SEQ ID NO: 953947 - DNA, 22 bp, Artificial Sequence
  chemically synthesized
tcccctgtttttaactttctct

SEQ ID NO: 953948 - DNA, 22 bp, Artificial Sequence
  chemically synthesized
cgtttccaaagagaaagttaaa

SEQ ID NO: 953949 - DNA, 22 bp, Artificial Sequence
  chemically synthesized
ccaaagagaaagttaaaaacag

SEQ ID NO: 953950 - DNA, 22 bp, Artificial Sequence
  chemically synthesized
caaagagaaagttaaaaacagg

SEQ ID NO: 953951 - DNA, 22 bp, Artificial Sequence
  chemically synthesized
gcagcattttcccctgttttta

SEQ ID NO: 953952 - DNA, 22 bp, Artificial Sequence
  chemically synthesized
agcagcattttcccctgttttt

SEQ ID NO: 953953 - DNA, 22 bp, Artificial Sequence
  chemically synthesized
atcaaataatttagcagcattt

SEQ ID NO: 953954 - DNA, 22 bp, Artificial Sequence
  chemically synthesized
aaaacaggggaaaatgctgcta

SEQ ID NO: 953955 - DNA, 22 bp, Artificial Sequence
  chemically synthesized
ctaaattatttgatgagcttca

SEQ ID NO: 953956 - DNA, 22 bp, Artificial Sequence
  chemically synthesized
aattatttgatgagcttcatat

SEQ ID NO: 953957 - DNA, 22 bp, Artificial Sequence
  chemically synthesized
tttgatgagcttcatatttgtg

SEQ ID NO: 953958 - DNA, 22 bp, Artificial Sequence
  chemically synthesized
aaatgagagcatcacaaatatg

SEQ ID NO: 953959 - DNA, 22 bp, Artificial Sequence
  chemically synthesized
gatgagcttcatatttgtgatg

SEQ ID NO: 953960 - DNA, 22 bp, Artificial Sequence
  chemically synthesized
atgagcttcatatttgtgatgc

SEQ ID NO: 953961 - DNA, 22 bp, Artificial Sequence
  chemically synthesized
atgtaactaaaatgagagcatc

SEQ ID NO: 953962 - DNA, 22 bp, Artificial Sequence
  chemically synthesized
aatgtaactaaaatgagagcat

SEQ ID NO: 953963 - DNA, 22 bp, Artificial Sequence
  chemically synthesized
catatttgtgatgctctcattt

SEQ ID NO: 953964 - DNA, 22 bp, Artificial Sequence
  chemically synthesized
atatttgtgatgctctcatttt

SEQ ID NO: 953965 - DNA, 22 bp, Artificial Sequence
  chemically synthesized
ccttaatgtaactaaaatgaga

SEQ ID NO: 953966 - DNA, 22 bp, Artificial Sequence
  chemically synthesized
gccttaatgtaactaaaatgag

SEQ ID NO: 953967 - DNA, 22 bp, Artificial Sequence
  chemically synthesized
tgccttaatgtaactaaaatga

SEQ ID NO: 953968 - DNA, 22 bp, Artificial Sequence
  chemically synthesized
ttgccttaatgtaactaaaatg

SEQ ID NO: 953969 - DNA, 22 bp, Artificial Sequence
  chemically synthesized
tttgccttaatgtaactaaaat

SEQ ID NO: 953970 - DNA, 22 bp, Artificial Sequence
  chemically synthesized
gtgatgctctcattttagttac

SEQ ID NO: 953971 - DNA, 22 bp, Artificial Sequence
  chemically synthesized
tgatgctctcattttagttaca

SEQ ID NO: 953972 - DNA, 22 bp, Artificial Sequence
  chemically synthesized
gctttttgccttaatgtaacta

SEQ ID NO: 953973 - DNA, 22 bp, Artificial Sequence
  chemically synthesized
ggctttttgccttaatgtaact

SEQ ID NO: 953974 - DNA, 22 bp, Artificial Sequence
  chemically synthesized
tggctttttgccttaatgtaac

SEQ ID NO: 953975 - DNA, 22 bp, Artificial Sequence
  chemically synthesized
ttttggctttttgccttaatgt

SEQ ID NO: 953976 - DNA, 22 bp, Artificial Sequence
  chemically synthesized
tcattttagttacattaaggca

SEQ ID NO: 953977 - DNA, 22 bp, Artificial Sequence
  chemically synthesized
attttggctttttgccttaatg

SEQ ID NO: 953978 - DNA, 22 bp, Artificial Sequence
  chemically synthesized
tattttggctttttgccttaat

SEQ ID NO: 953979 - DNA, 22 bp, Artificial Sequence
  chemically synthesized
attttagttacattaaggcaaa

SEQ ID NO: 953980 - DNA, 22 bp, Artificial Sequence
  chemically synthesized
tagttacattaaggcaaaaagc

SEQ ID NO: 953981 - DNA, 22 bp, Artificial Sequence
  chemically synthesized
agttacattaaggcaaaaagcc

SEQ ID NO: 953982 - DNA, 22 bp, Artificial Sequence
  chemically synthesized
ggattttattttggctttttgc

SEQ ID NO: 953983 - DNA, 22 bp, Artificial Sequence
  chemically synthesized
gttacattaaggcaaaaagcca

SEQ ID NO: 953984 - DNA, 22 bp, Artificial Sequence
  chemically synthesized
gggattttattttggctttttg

SEQ ID NO: 953985 - DNA, 22 bp, Artificial Sequence
  chemically synthesized
cattaaggcaaaaagccaaaat

SEQ ID NO: 953986 - DNA, 22 bp, Artificial Sequence
  chemically synthesized
caagccttgggattttattttg

SEQ ID NO: 953987 - DNA, 22 bp, Artificial Sequence
  chemically synthesized
aggcaaaaagccaaaataaaat

SEQ ID NO: 953988 - DNA, 22 bp, Artificial Sequence
  chemically synthesized
aaactccaagccttgggatttt

SEQ ID NO: 953989 - DNA, 22 bp, Artificial Sequence
  chemically synthesized
caaactccaagccttgggattt

SEQ ID NO: 953990 - DNA, 22 bp, Artificial Sequence
  chemically synthesized
tttcaaactccaagccttggga

SEQ ID NO: 953991 - DNA, 22 bp, Artificial Sequence
  chemically synthesized
gtttcaaactccaagccttggg

SEQ ID NO: 953992 - DNA, 22 bp, Artificial Sequence
  chemically synthesized
accacttgtttcaaactccaag

SEQ ID NO: 953993 - DNA, 22 bp, Artificial Sequence
  chemically synthesized
caccacttgtttcaaactccaa

SEQ ID NO: 953994 - DNA, 22 bp, Artificial Sequence
  chemically synthesized
tcaccacttgtttcaaactcca

SEQ ID NO: 953995 - DNA, 22 bp, Artificial Sequence
  chemically synthesized
cctttcaccacttgtttcaaac

SEQ ID NO: 953996 - DNA, 22 bp, Artificial Sequence
  chemically synthesized
ccctttcaccacttgtttcaaa

SEQ ID NO: 953997 - DNA, 22 bp, Artificial Sequence
  chemically synthesized
ccttccctttcaccacttgttt

SEQ ID NO: 953998 - DNA, 22 bp, Artificial Sequence
  chemically synthesized
ggagtttgaaacaagtggtgaa

SEQ ID NO: 953999 - DNA, 22 bp, Artificial Sequence
  chemically synthesized
gagtttgaaacaagtggtgaaa

SEQ ID NO: 954000 - DNA, 22 bp, Artificial Sequence
  chemically synthesized
tcaatgctcccttccctttcac

SEQ ID NO: 954001 - DNA, 22 bp, Artificial Sequence
  chemically synthesized
atcaatgctcccttccctttca

SEQ ID NO: 954002 - DNA, 22 bp, Artificial Sequence
  chemically synthesized
gaaacaagtggtgaaagggaag

SEQ ID NO: 954003 - DNA, 22 bp, Artificial Sequence
  chemically synthesized
aaacaagtggtgaaagggaagg

SEQ ID NO: 954004 - DNA, 22 bp, Artificial Sequence
  chemically synthesized
ttatcaatgctcccttcccttt

SEQ ID NO: 954005 - DNA, 22 bp, Artificial Sequence
  chemically synthesized
tcttatcaatgctcccttccct

SEQ ID NO: 954006 - DNA, 22 bp, Artificial Sequence
  chemically synthesized
cctctcttatcaatgctccctt

SEQ ID NO: 954007 - DNA, 22 bp, Artificial Sequence
  chemically synthesized
ctgcctctcttatcaatgctcc

SEQ ID NO: 954008 - DNA, 22 bp, Artificial Sequence
  chemically synthesized
cctgcctctcttatcaatgctc

SEQ ID NO: 954009 - DNA, 22 bp, Artificial Sequence
  chemically synthesized
tcctgcctctcttatcaatgct

SEQ ID NO: 954010 - DNA, 22 bp, Artificial Sequence
  chemically synthesized
tctttcctgcctctcttatcaa

SEQ ID NO: 954011 - DNA, 22 bp, Artificial Sequence
  chemically synthesized
aatctatctttcctgcctctct

SEQ ID NO: 954012 - DNA, 22 bp, Artificial Sequence
  chemically synthesized
ataagagaggcaggaaagatag

SEQ ID NO: 954013 - DNA, 22 bp, Artificial Sequence
  chemically synthesized
aaacaaaaaaaatgccattaaa

SEQ ID NO: 954014 - DNA, 22 bp, Artificial Sequence
  chemically synthesized
aaaacaaaaaaaatgccattaa

SEQ ID NO: 954015 - DNA, 22 bp, Artificial Sequence
  chemically synthesized
tttaaaacaaaaaaaatgccat

SEQ ID NO: 954016 - DNA, 22 bp, Artificial Sequence
  chemically synthesized
agcattatttaaaacaaaaaaa

SEQ ID NO: 954017 - DNA, 22 bp, Artificial Sequence
  chemically synthesized
aagcattatttaaaacaaaaaa

SEQ ID NO: 954018 - DNA, 22 bp, Artificial Sequence
  chemically synthesized
ttaagcattatttaaaacaaaa

SEQ ID NO: 954019 - DNA, 22 bp, Artificial Sequence
  chemically synthesized
aatggcattttttttgttttaa

SEQ ID NO: 954020 - DNA, 22 bp, Artificial Sequence
  chemically synthesized
cttaagcattatttaaaacaaa

SEQ ID NO: 954021 - DNA, 22 bp, Artificial Sequence
  chemically synthesized
atggcattttttttgttttaaa

SEQ ID NO: 954022 - DNA, 22 bp, Artificial Sequence
  chemically synthesized
ttcttaagcattatttaaaaca

SEQ ID NO: 954023 - DNA, 22 bp, Artificial Sequence
  chemically synthesized
cttcttaagcattatttaaaac

SEQ ID NO: 954024 - DNA, 22 bp, Artificial Sequence
  chemically synthesized
tcttcttaagcattatttaaaa

SEQ ID NO: 954025 - DNA, 22 bp, Artificial Sequence
  chemically synthesized
ttcttcttaagcattatttaaa

SEQ ID NO: 954026 - DNA, 22 bp, Artificial Sequence
  chemically synthesized
tttttgttttaaataatgctta

SEQ ID NO: 954027 - DNA, 22 bp, Artificial Sequence
  chemically synthesized
ttttgttttaaataatgcttaa

SEQ ID NO: 954028 - DNA, 22 bp, Artificial Sequence
  chemically synthesized
tttgttttaaataatgcttaag

SEQ ID NO: 954029 - DNA, 22 bp, Artificial Sequence
  chemically synthesized
ttgttttaaataatgcttaaga

SEQ ID NO: 954030 - DNA, 22 bp, Artificial Sequence
  chemically synthesized
tgttttaaataatgcttaagaa

SEQ ID NO: 954031 - DNA, 22 bp, Artificial Sequence
  chemically synthesized
gttttaaataatgcttaagaag

SEQ ID NO: 954032 - DNA, 22 bp, Artificial Sequence
  chemically synthesized
ttttaaataatgcttaagaaga

SEQ ID NO: 954033 - DNA, 22 bp, Artificial Sequence
  chemically synthesized
taaataatgcttaagaagaaaa

SEQ ID NO: 954034 - DNA, 22 bp, Artificial Sequence
  chemically synthesized
aaataatgcttaagaagaaaaa

SEQ ID NO: 954035 - DNA, 22 bp, Artificial Sequence
  chemically synthesized
aataatgcttaagaagaaaaat

SEQ ID NO: 954036 - DNA, 22 bp, Artificial Sequence
  chemically synthesized
agtgtaataaacataatttttc

SEQ ID NO: 954037 - DNA, 22 bp, Artificial Sequence
  chemically synthesized
aagaagaaaaattatgtttatt

SEQ ID NO: 954038 - DNA, 22 bp, Artificial Sequence
  chemically synthesized
agaagaaaaattatgtttatta

SEQ ID NO: 954039 - DNA, 22 bp, Artificial Sequence
  chemically synthesized
cacagggaaataaactgagtgt

SEQ ID NO: 954040 - DNA, 22 bp, Artificial Sequence
  chemically synthesized
ccacagggaaataaactgagtg

SEQ ID NO: 954041 - DNA, 22 bp, Artificial Sequence
  chemically synthesized
ttccacagggaaataaactgag

SEQ ID NO: 954042 - DNA, 22 bp, Artificial Sequence
  chemically synthesized
tgtttattacactcagtttatt

SEQ ID NO: 954043 - DNA, 22 bp, Artificial Sequence
  chemically synthesized
ttcttccacagggaaataaact

SEQ ID NO: 954044 - DNA, 22 bp, Artificial Sequence
  chemically synthesized
attacactcagtttatttccct

SEQ ID NO: 954045 - DNA, 22 bp, Artificial Sequence
  chemically synthesized
ttacactcagtttatttccctg

SEQ ID NO: 954046 - DNA, 22 bp, Artificial Sequence
  chemically synthesized
cactcagtttatttccctgtgg

SEQ ID NO: 954047 - DNA, 22 bp, Artificial Sequence
  chemically synthesized
agtttatttccctgtggaagaa

SEQ ID NO: 954048 - DNA, 22 bp, Artificial Sequence
  chemically synthesized
atttccctgtggaagaacaacc

SEQ ID NO: 954049 - DNA, 22 bp, Artificial Sequence
  chemically synthesized
aggagaggaaaaggttgttctt

SEQ ID NO: 954050 - DNA, 22 bp, Artificial Sequence
  chemically synthesized
tttccctgtggaagaacaacct

SEQ ID NO: 954051 - DNA, 22 bp, Artificial Sequence
  chemically synthesized
ccctgtggaagaacaacctttt

SEQ ID NO: 954052 - DNA, 22 bp, Artificial Sequence
  chemically synthesized
cctgtggaagaacaaccttttc

SEQ ID NO: 954053 - DNA, 22 bp, Artificial Sequence
  chemically synthesized
cagactgaggagaggaaaaggt

SEQ ID NO: 954054 - DNA, 22 bp, Artificial Sequence
  chemically synthesized
tggaagaacaaccttttcctct

SEQ ID NO: 954055 - DNA, 22 bp, Artificial Sequence
  chemically synthesized
ttcctctcctcagtctggaact

SEQ ID NO: 954056 - DNA, 22 bp, Artificial Sequence
  chemically synthesized
tcctctcctcagtctggaactc

SEQ ID NO: 954057 - DNA, 22 bp, Artificial Sequence
  chemically synthesized
cctctcctcagtctggaactca

SEQ ID NO: 954058 - DNA, 22 bp, Artificial Sequence
  chemically synthesized
ctctcctcagtctggaactcat

SEQ ID NO: 954059 - DNA, 22 bp, Artificial Sequence
  chemically synthesized
tcctcagtctggaactcatact

SEQ ID NO: 954060 - DNA, 22 bp, Artificial Sequence
  chemically synthesized
ctcagtctggaactcatactct

SEQ ID NO: 954061 - DNA, 22 bp, Artificial Sequence
  chemically synthesized
agtctggaactcatactctttg

SEQ ID NO: 954062 - DNA, 22 bp, Artificial Sequence
  chemically synthesized
ccacaggtcatgtggcaaagag

SEQ ID NO: 954063 - DNA, 22 bp, Artificial Sequence
  chemically synthesized
cccacaggtcatgtggcaaaga

SEQ ID NO: 954064 - DNA, 22 bp, Artificial Sequence
  chemically synthesized
gaactcatactctttgccacat

SEQ ID NO: 954065 - DNA, 22 bp, Artificial Sequence
  chemically synthesized
atactctttgccacatgacctg

SEQ ID NO: 954066 - DNA, 22 bp, Artificial Sequence
  chemically synthesized
aagtcaatttcccacaggtcat

SEQ ID NO: 954067 - DNA, 22 bp, Artificial Sequence
  chemically synthesized
ttcaagtcaatttcccacaggt

SEQ ID NO: 954068 - DNA, 22 bp, Artificial Sequence
  chemically synthesized
tttgccacatgacctgtgggaa

SEQ ID NO: 954069 - DNA, 22 bp, Artificial Sequence
  chemically synthesized
tgccacatgacctgtgggaaat

SEQ ID NO: 954070 - DNA, 22 bp, Artificial Sequence
  chemically synthesized
gccacatgacctgtgggaaatt

SEQ ID NO: 954071 - DNA, 22 bp, Artificial Sequence
  chemically synthesized
ccacatgacctgtgggaaattg

SEQ ID NO: 954072 - DNA, 22 bp, Artificial Sequence
  chemically synthesized
tgggaaattgacttgaacagat

SEQ ID NO: 954073 - DNA, 22 bp, Artificial Sequence
  chemically synthesized
atgtgaaaccaaaacatctgtt

SEQ ID NO: 954074 - DNA, 22 bp, Artificial Sequence
  chemically synthesized
aatgtgaaaccaaaacatctgt

SEQ ID NO: 954075 - DNA, 22 bp, Artificial Sequence
  chemically synthesized
acttgaacagatgttttggttt

SEQ ID NO: 954076 - DNA, 22 bp, Artificial Sequence
  chemically synthesized
tagatttaatgtgaaaccaaaa

SEQ ID NO: 954077 - DNA, 22 bp, Artificial Sequence
  chemically synthesized
gtagatttaatgtgaaaccaaa

SEQ ID NO: 954078 - DNA, 22 bp, Artificial Sequence
  chemically synthesized
gaacagatgttttggtttcaca

SEQ ID NO: 954079 - DNA, 22 bp, Artificial Sequence
  chemically synthesized
aacagatgttttggtttcacat

SEQ ID NO: 954080 - DNA, 22 bp, Artificial Sequence
  chemically synthesized
cgcaaaataatttgtagattta

SEQ ID NO: 954081 - DNA, 22 bp, Artificial Sequence
  chemically synthesized
tggtttcacattaaatctacaa

SEQ ID NO: 954082 - DNA, 22 bp, Artificial Sequence
  chemically synthesized
ggtttcacattaaatctacaaa

SEQ ID NO: 954083 - DNA, 22 bp, Artificial Sequence
  chemically synthesized
gtttcacattaaatctacaaat

SEQ ID NO: 954084 - DNA, 22 bp, Artificial Sequence
  chemically synthesized
cacattaaatctacaaattatt

SEQ ID NO: 954085 - DNA, 22 bp, Artificial Sequence
  chemically synthesized
acattaaatctacaaattattt

SEQ ID NO: 954086 - DNA, 22 bp, Artificial Sequence
  chemically synthesized
gggaattacgcaaaataatttg

SEQ ID NO: 954087 - DNA, 22 bp, Artificial Sequence
  chemically synthesized
aatctacaaattattttgcgta

SEQ ID NO: 954088 - DNA, 22 bp, Artificial Sequence
  chemically synthesized
caaattattttgcgtaattccc

SEQ ID NO: 954089 - DNA, 22 bp, Artificial Sequence
  chemically synthesized
tagtagatgggcactagggaat

SEQ ID NO: 954090 - DNA, 22 bp, Artificial Sequence
  chemically synthesized
ttttgcgtaattccctagtgcc

SEQ ID NO: 954091 - DNA, 22 bp, Artificial Sequence
  chemically synthesized
tgcgtaattccctagtgcccat

SEQ ID NO: 954092 - DNA, 22 bp, Artificial Sequence
  chemically synthesized
gcgtaattccctagtgcccatc

SEQ ID NO: 954093 - DNA, 22 bp, Artificial Sequence
  chemically synthesized
cgtaattccctagtgcccatct

SEQ ID NO: 954094 - DNA, 22 bp, Artificial Sequence
  chemically synthesized
cctagtgcccatctactataat

SEQ ID NO: 954095 - DNA, 22 bp, Artificial Sequence
  chemically synthesized
gtgcccatctactataattttt

SEQ ID NO: 954096 - DNA, 22 bp, Artificial Sequence
  chemically synthesized
ctataatttttatgatgtctct

SEQ ID NO: 954097 - DNA, 22 bp, Artificial Sequence
  chemically synthesized
taatttttatgatgtctctact

SEQ ID NO: 954098 - DNA, 22 bp, Artificial Sequence
  chemically synthesized
ttatgatgtctctactctttgt

SEQ ID NO: 954099 - DNA, 22 bp, Artificial Sequence
  chemically synthesized
tatgatgtctctactctttgtt

SEQ ID NO: 954100 - DNA, 22 bp, Artificial Sequence
  chemically synthesized
atgatgtctctactctttgttt

SEQ ID NO: 954101 - DNA, 22 bp, Artificial Sequence
  chemically synthesized
tgatgtctctactctttgtttt

SEQ ID NO: 954102 - DNA, 22 bp, Artificial Sequence
  chemically synthesized
tcatagtatgtaaaaaacaaag

SEQ ID NO: 954103 - DNA, 22 bp, Artificial Sequence
  chemically synthesized
gtcatagtatgtaaaaaacaaa

SEQ ID NO: 954104 - DNA, 22 bp, Artificial Sequence
  chemically synthesized
tgtcatagtatgtaaaaaacaa

SEQ ID NO: 954105 - DNA, 22 bp, Artificial Sequence
  chemically synthesized
ttgtcatagtatgtaaaaaaca

SEQ ID NO: 954106 - DNA, 22 bp, Artificial Sequence
  chemically synthesized
ttttgtcatagtatgtaaaaaa

SEQ ID NO: 954107 - DNA, 22 bp, Artificial Sequence
  chemically synthesized
tactctttgttttttacatact

SEQ ID NO: 954108 - DNA, 22 bp, Artificial Sequence
  chemically synthesized
ctctttgttttttacatactat

SEQ ID NO: 954109 - DNA, 22 bp, Artificial Sequence
  chemically synthesized
tgactcttttgtcatagtatgt

SEQ ID NO: 954110 - DNA, 22 bp, Artificial Sequence
  chemically synthesized
atgactcttttgtcatagtatg

SEQ ID NO: 954111 - DNA, 22 bp, Artificial Sequence
  chemically synthesized
tttgttttttacatactatgac

SEQ ID NO: 954112 - DNA, 22 bp, Artificial Sequence
  chemically synthesized
tgttttttacatactatgacaa

SEQ ID NO: 954113 - DNA, 22 bp, Artificial Sequence
  chemically synthesized
gttttttacatactatgacaaa

SEQ ID NO: 954114 - DNA, 22 bp, Artificial Sequence
  chemically synthesized
ttttttacatactatgacaaaa

SEQ ID NO: 954115 - DNA, 22 bp, Artificial Sequence
  chemically synthesized
tgtcttatgactcttttgtcat

SEQ ID NO: 954116 - DNA, 22 bp, Artificial Sequence
  chemically synthesized
tttacatactatgacaaaagag

SEQ ID NO: 954117 - DNA, 22 bp, Artificial Sequence
  chemically synthesized
ttacatactatgacaaaagagt

SEQ ID NO: 954118 - DNA, 22 bp, Artificial Sequence
  chemically synthesized
tacatactatgacaaaagagtc

SEQ ID NO: 954119 - DNA, 22 bp, Artificial Sequence
  chemically synthesized
acatactatgacaaaagagtca

SEQ ID NO: 954120 - DNA, 22 bp, Artificial Sequence
  chemically synthesized
catactatgacaaaagagtcat

SEQ ID NO: 954121 - DNA, 22 bp, Artificial Sequence
  chemically synthesized
ggcactatgtcttatgactctt

SEQ ID NO: 954122 - DNA, 22 bp, Artificial Sequence
  chemically synthesized
actaggcactatgtcttatgac

SEQ ID NO: 954123 - DNA, 22 bp, Artificial Sequence
  chemically synthesized
tgacaaaagagtcataagacat

SEQ ID NO: 954124 - DNA, 22 bp, Artificial Sequence
  chemically synthesized
ctgactaggcactatgtcttat

SEQ ID NO: 954125 - DNA, 22 bp, Artificial Sequence
  chemically synthesized
agtgagccaattactgactagg

SEQ ID NO: 954126 - DNA, 22 bp, Artificial Sequence
  chemically synthesized
cagtgagccaattactgactag

SEQ ID NO: 954127 - DNA, 22 bp, Artificial Sequence
  chemically synthesized
agcatttcagtgagccaattac

SEQ ID NO: 954128 - DNA, 22 bp, Artificial Sequence
  chemically synthesized
taagcatttcagtgagccaatt

SEQ ID NO: 954129 - DNA, 22 bp, Artificial Sequence
  chemically synthesized
gtcagtaattggctcactgaaa

SEQ ID NO: 954130 - DNA, 22 bp, Artificial Sequence
  chemically synthesized
caaatatataaactctaagcat

SEQ ID NO: 954131 - DNA, 22 bp, Artificial Sequence
  chemically synthesized
acaaatatataaactctaagca

SEQ ID NO: 954132 - DNA, 22 bp, Artificial Sequence
  chemically synthesized
gctcactgaaatgcttagagtt

SEQ ID NO: 954133 - DNA, 22 bp, Artificial Sequence
  chemically synthesized
actgaaatgcttagagtttata

SEQ ID NO: 954134 - DNA, 22 bp, Artificial Sequence
  chemically synthesized
aaatgcttagagtttatatatt

SEQ ID NO: 954135 - DNA, 22 bp, Artificial Sequence
  chemically synthesized
tgtggtcttacaaatatataaa

SEQ ID NO: 954136 - DNA, 22 bp, Artificial Sequence
  chemically synthesized
gtgtggtcttacaaatatataa

SEQ ID NO: 954137 - DNA, 22 bp, Artificial Sequence
  chemically synthesized
tgtgtggtcttacaaatatata

SEQ ID NO: 954138 - DNA, 22 bp, Artificial Sequence
  chemically synthesized
agagtttatatatttgtaagac

SEQ ID NO: 954139 - DNA, 22 bp, Artificial Sequence
  chemically synthesized
aaattttgtgtggtcttacaaa

SEQ ID NO: 954140 - DNA, 22 bp, Artificial Sequence
  chemically synthesized
gagtttatatatttgtaagacc

SEQ ID NO: 954141 - DNA, 22 bp, Artificial Sequence
  chemically synthesized
gaaattttgtgtggtcttacaa

SEQ ID NO: 954142 - DNA, 22 bp, Artificial Sequence
  chemically synthesized
cttgaaattttgtgtggtctta

SEQ ID NO: 954143 - DNA, 22 bp, Artificial Sequence
  chemically synthesized
atatatttgtaagaccacacaa

SEQ ID NO: 954144 - DNA, 22 bp, Artificial Sequence
  chemically synthesized
ctgcttgaaattttgtgtggtc

SEQ ID NO: 954145 - DNA, 22 bp, Artificial Sequence
  chemically synthesized
tatatttgtaagaccacacaaa

SEQ ID NO: 954146 - DNA, 22 bp, Artificial Sequence
  chemically synthesized
gtaagaccacacaaaatttcaa

SEQ ID NO: 954147 - DNA, 22 bp, Artificial Sequence
  chemically synthesized
aaaggttcctgcttgaaatttt

SEQ ID NO: 954148 - DNA, 22 bp, Artificial Sequence
  chemically synthesized
taagaccacacaaaatttcaag

SEQ ID NO: 954149 - DNA, 22 bp, Artificial Sequence
  chemically synthesized
tgataactgaaaggttcctgct

SEQ ID NO: 954150 - DNA, 22 bp, Artificial Sequence
  chemically synthesized
caagcaggaacctttcagttat

SEQ ID NO: 954151 - DNA, 22 bp, Artificial Sequence
  chemically synthesized
ataaagattgtgataactgaaa

SEQ ID NO: 954152 - DNA, 22 bp, Artificial Sequence
  chemically synthesized
aagcaggaacctttcagttatc

SEQ ID NO: 954153 - DNA, 22 bp, Artificial Sequence
  chemically synthesized
aagagagtattaataaagattg

SEQ ID NO: 954154 - DNA, 22 bp, Artificial Sequence
  chemically synthesized
caagagagtattaataaagatt

SEQ ID NO: 954155 - DNA, 22 bp, Artificial Sequence
  chemically synthesized
tcagttatcacaatctttatta

SEQ ID NO: 954156 - DNA, 22 bp, Artificial Sequence
  chemically synthesized
cagttatcacaatctttattaa

SEQ ID NO: 954157 - DNA, 22 bp, Artificial Sequence
  chemically synthesized
agttatcacaatctttattaat

SEQ ID NO: 954158 - DNA, 22 bp, Artificial Sequence
  chemically synthesized
tcacaatctttattaatactct

SEQ ID NO: 954159 - DNA, 22 bp, Artificial Sequence
  chemically synthesized
aaaagtgtcaatttcaagagag

SEQ ID NO: 954160 - DNA, 22 bp, Artificial Sequence
  chemically synthesized
tattaatactctcttgaaattg

SEQ ID NO: 954161 - DNA, 22 bp, Artificial Sequence
  chemically synthesized
attaatactctcttgaaattga

SEQ ID NO: 954162 - DNA, 22 bp, Artificial Sequence
  chemically synthesized
ttaatactctcttgaaattgac

SEQ ID NO: 954163 - DNA, 22 bp, Artificial Sequence
  chemically synthesized
atactctcttgaaattgacact

SEQ ID NO: 954164 - DNA, 22 bp, Artificial Sequence
  chemically synthesized
gcatatgaagcctaaaaagtgt

SEQ ID NO: 954165 - DNA, 22 bp, Artificial Sequence
  chemically synthesized
tcttgaaattgacactttttag

SEQ ID NO: 954166 - DNA, 22 bp, Artificial Sequence
  chemically synthesized
ggcatatgaagcctaaaaagtg

SEQ ID NO: 954167 - DNA, 22 bp, Artificial Sequence
  chemically synthesized
tggcatatgaagcctaaaaagt

SEQ ID NO: 954168 - DNA, 22 bp, Artificial Sequence
  chemically synthesized
ttgaaattgacactttttaggc

SEQ ID NO: 954169 - DNA, 22 bp, Artificial Sequence
  chemically synthesized
ttggcatatgaagcctaaaaag

SEQ ID NO: 954170 - DNA, 22 bp, Artificial Sequence
  chemically synthesized
tttggcatatgaagcctaaaaa

SEQ ID NO: 954171 - DNA, 22 bp, Artificial Sequence
  chemically synthesized
gaaattgacactttttaggctt

SEQ ID NO: 954172 - DNA, 22 bp, Artificial Sequence
  chemically synthesized
aaattgacactttttaggcttc

SEQ ID NO: 954173 - DNA, 22 bp, Artificial Sequence
  chemically synthesized
atgttttttggcatatgaagcc

SEQ ID NO: 954174 - DNA, 22 bp, Artificial Sequence
  chemically synthesized
acactttttaggcttcatatgc

SEQ ID NO: 954175 - DNA, 22 bp, Artificial Sequence
  chemically synthesized
tcatgttttttggcatatgaag

SEQ ID NO: 954176 - DNA, 22 bp, Artificial Sequence
  chemically synthesized
ctctcatgttttttggcatatg

SEQ ID NO: 954177 - DNA, 22 bp, Artificial Sequence
  chemically synthesized
tttaggcttcatatgccaaaaa

SEQ ID NO: 954178 - DNA, 22 bp, Artificial Sequence
  chemically synthesized
ttactctcatgttttttggcat

SEQ ID NO: 954179 - DNA, 22 bp, Artificial Sequence
  chemically synthesized
ttaggcttcatatgccaaaaaa

SEQ ID NO: 954180 - DNA, 22 bp, Artificial Sequence
  chemically synthesized
taggcttcatatgccaaaaaac

SEQ ID NO: 954181 - DNA, 22 bp, Artificial Sequence
  chemically synthesized
aggcttcatatgccaaaaaaca

SEQ ID NO: 954182 - DNA, 22 bp, Artificial Sequence
  chemically synthesized
ggcttcatatgccaaaaaacat

SEQ ID NO: 954183 - DNA, 22 bp, Artificial Sequence
  chemically synthesized
catatgccaaaaaacatgagag

SEQ ID NO: 954184 - DNA, 22 bp, Artificial Sequence
  chemically synthesized
atatgccaaaaaacatgagagt

SEQ ID NO: 954185 - DNA, 22 bp, Artificial Sequence
  chemically synthesized
aagcataaggtcaattattact

SEQ ID NO: 954186 - DNA, 22 bp, Artificial Sequence
  chemically synthesized
agaagaaacatgtcctaaagca

SEQ ID NO: 954187 - DNA, 22 bp, Artificial Sequence
  chemically synthesized
aagaagaaacatgtcctaaagc

SEQ ID NO: 954188 - DNA, 22 bp, Artificial Sequence
  chemically synthesized
accttatgctttaggacatgtt

SEQ ID NO: 954189 - DNA, 22 bp, Artificial Sequence
  chemically synthesized
atgctttaggacatgtttcttc

SEQ ID NO: 954190 - DNA, 22 bp, Artificial Sequence
  chemically synthesized
tgctttaggacatgtttcttct

SEQ ID NO: 954191 - DNA, 22 bp, Artificial Sequence
  chemically synthesized
aaataagaagtatttaagaaga

SEQ ID NO: 954192 - DNA, 22 bp, Artificial Sequence
  chemically synthesized
taggacatgtttcttcttaaat

SEQ ID NO: 954193 - DNA, 22 bp, Artificial Sequence
  chemically synthesized
aggacatgtttcttcttaaata

SEQ ID NO: 954194 - DNA, 22 bp, Artificial Sequence
  chemically synthesized
ggacatgtttcttcttaaatac

SEQ ID NO: 954195 - DNA, 22 bp, Artificial Sequence
  chemically synthesized
atattaaaataagaagtattta

SEQ ID NO: 954196 - DNA, 22 bp, Artificial Sequence
  chemically synthesized
ctaatattaaaataagaagtat

SEQ ID NO: 954197 - DNA, 22 bp, Artificial Sequence
  chemically synthesized
ttactaatattaaaataagaag

SEQ ID NO: 954198 - DNA, 22 bp, Artificial Sequence
  chemically synthesized
cttcttaaatacttcttatttt

SEQ ID NO: 954199 - DNA, 22 bp, Artificial Sequence
  chemically synthesized
ttcttaaatacttcttatttta

SEQ ID NO: 954200 - DNA, 22 bp, Artificial Sequence
  chemically synthesized
cttaaatacttcttattttaat

SEQ ID NO: 954201 - DNA, 22 bp, Artificial Sequence
  chemically synthesized
ttaaatacttcttattttaata

SEQ ID NO: 954202 - DNA, 22 bp, Artificial Sequence
  chemically synthesized
aaatacttcttattttaatatt

SEQ ID NO: 954203 - DNA, 22 bp, Artificial Sequence
  chemically synthesized
aatacttcttattttaatatta

SEQ ID NO: 954204 - DNA, 22 bp, Artificial Sequence
  chemically synthesized
gtagtagaattgttactaatat

SEQ ID NO: 954205 - DNA, 22 bp, Artificial Sequence
  chemically synthesized
cttattttaatattagtaacaa

SEQ ID NO: 954206 - DNA, 22 bp, Artificial Sequence
  chemically synthesized
ttagtagtagaattgttactaa

SEQ ID NO: 954207 - DNA, 22 bp, Artificial Sequence
  chemically synthesized
ttattttaatattagtaacaat

SEQ ID NO: 954208 - DNA, 22 bp, Artificial Sequence
  chemically synthesized
attttaatattagtaacaattc

SEQ ID NO: 954209 - DNA, 22 bp, Artificial Sequence
  chemically synthesized
ttttaatattagtaacaattct

SEQ ID NO: 954210 - DNA, 22 bp, Artificial Sequence
  chemically synthesized
taatattagtaacaattctact

SEQ ID NO: 954211 - DNA, 22 bp, Artificial Sequence
  chemically synthesized
aatattagtaacaattctacta

SEQ ID NO: 954212 - DNA, 22 bp, Artificial Sequence
  chemically synthesized
atattagtaacaattctactac

SEQ ID NO: 954213 - DNA, 22 bp, Artificial Sequence
  chemically synthesized
gtaacaattctactactaataa

SEQ ID NO: 954214 - DNA, 22 bp, Artificial Sequence
  chemically synthesized
aatgaaccatagatattattag

SEQ ID NO: 954215 - DNA, 22 bp, Artificial Sequence
  chemically synthesized
gcattcaatgaaccatagatat

SEQ ID NO: 954216 - DNA, 22 bp, Artificial Sequence
  chemically synthesized
tactactaataatatctatggt

SEQ ID NO: 954217 - DNA, 22 bp, Artificial Sequence
  chemically synthesized
ctactaataatatctatggttc

SEQ ID NO: 954218 - DNA, 22 bp, Artificial Sequence
  chemically synthesized
ctaataatatctatggttcatt

SEQ ID NO: 954219 - DNA, 22 bp, Artificial Sequence
  chemically synthesized
ataatatctatggttcattgaa

SEQ ID NO: 954220 - DNA, 22 bp, Artificial Sequence
  chemically synthesized
tgtagactagcattcaatgaac

SEQ ID NO: 954221 - DNA, 22 bp, Artificial Sequence
  chemically synthesized
tgcacctatgtagactagcatt

SEQ ID NO: 954222 - DNA, 22 bp, Artificial Sequence
  chemically synthesized
tggttcattgaatgctagtcta

SEQ ID NO: 954223 - DNA, 22 bp, Artificial Sequence
  chemically synthesized
attgaatgctagtctacatagg

SEQ ID NO: 954224 - DNA, 22 bp, Artificial Sequence
  chemically synthesized
aatgctagtctacataggtgca

SEQ ID NO: 954225 - DNA, 22 bp, Artificial Sequence
  chemically synthesized
tatccaggtatctatgcaccta

SEQ ID NO: 954226 - DNA, 22 bp, Artificial Sequence
  chemically synthesized
gtctacataggtgcatagatac

SEQ ID NO: 954227 - DNA, 22 bp, Artificial Sequence
  chemically synthesized
tcatctatatccaggtatctat

SEQ ID NO: 954228 - DNA, 22 bp, Artificial Sequence
  chemically synthesized
atcatctatatccaggtatcta

SEQ ID NO: 954229 - DNA, 22 bp, Artificial Sequence
  chemically synthesized
cataggtgcatagatacctgga

SEQ ID NO: 954230 - DNA, 22 bp, Artificial Sequence
  chemically synthesized
tttatcatctatatccaggtat

SEQ ID NO: 954231 - DNA, 22 bp, Artificial Sequence
  chemically synthesized
tcatctatttatcatctatatc

SEQ ID NO: 954232 - DNA, 22 bp, Artificial Sequence
  chemically synthesized
tgtcatctatttatcatctata

SEQ ID NO: 954233 - DNA, 22 bp, Artificial Sequence
  chemically synthesized
tctgtcatctatttatcatcta

SEQ ID NO: 954234 - DNA, 22 bp, Artificial Sequence
  chemically synthesized
ctctgtcatctatttatcatct

SEQ ID NO: 954235 - DNA, 22 bp, Artificial Sequence
  chemically synthesized
tctctgtcatctatttatcatc

SEQ ID NO: 954236 - DNA, 22 bp, Artificial Sequence
  chemically synthesized
tttctctgtcatctatttatca

SEQ ID NO: 954237 - DNA, 22 bp, Artificial Sequence
  chemically synthesized
tctttctctgtcatctatttat

SEQ ID NO: 954238 - DNA, 22 bp, Artificial Sequence
  chemically synthesized
ctctttctctgtcatctattta

SEQ ID NO: 954239 - DNA, 22 bp, Artificial Sequence
  chemically synthesized
gatatagatgataaatagatga

SEQ ID NO: 954240 - DNA, 22 bp, Artificial Sequence
  chemically synthesized
tctctttctctgtcatctattt

SEQ ID NO: 954241 - DNA, 22 bp, Artificial Sequence
  chemically synthesized
tctttctctttctctgtcatct

SEQ ID NO: 954242 - DNA, 22 bp, Artificial Sequence
  chemically synthesized
tatctttctctttctctgtcat

SEQ ID NO: 954243 - DNA, 22 bp, Artificial Sequence
  chemically synthesized
ctatctttctctttctctgtca

SEQ ID NO: 954244 - DNA, 22 bp, Artificial Sequence
  chemically synthesized
tttctatctttctctttctctg

SEQ ID NO: 954245 - DNA, 22 bp, Artificial Sequence
  chemically synthesized
tgtttctatctttctctttctc

SEQ ID NO: 954246 - DNA, 22 bp, Artificial Sequence
  chemically synthesized
tctgtttctatctttctctttc

SEQ ID NO: 954247 - DNA, 22 bp, Artificial Sequence
  chemically synthesized
ctctgtttctatctttctcttt

SEQ ID NO: 954248 - DNA, 22 bp, Artificial Sequence
  chemically synthesized
aaagtaaaaatatttctctgtt

SEQ ID NO: 954249 - DNA, 22 bp, Artificial Sequence
  chemically synthesized
attcaaagtaaaaatatttctc

SEQ ID NO: 954250 - DNA, 22 bp, Artificial Sequence
  chemically synthesized
cattcaaagtaaaaatatttct

SEQ ID NO: 954251 - DNA, 22 bp, Artificial Sequence
  chemically synthesized
ttactttgaatgaaatacatta

SEQ ID NO: 954252 - DNA, 22 bp, Artificial Sequence
  chemically synthesized
ggatgggagagataatgtattt

SEQ ID NO: 954253 - DNA, 22 bp, Artificial Sequence
  chemically synthesized
tactttgaatgaaatacattat

SEQ ID NO: 954254 - DNA, 22 bp, Artificial Sequence
  chemically synthesized
actttgaatgaaatacattatc

SEQ ID NO: 954255 - DNA, 22 bp, Artificial Sequence
  chemically synthesized
ctttgaatgaaatacattatct

SEQ ID NO: 954256 - DNA, 22 bp, Artificial Sequence
  chemically synthesized
ttaggatgggagagataatgta

SEQ ID NO: 954257 - DNA, 22 bp, Artificial Sequence
  chemically synthesized
tgaatgaaatacattatctctc

SEQ ID NO: 954258 - DNA, 22 bp, Artificial Sequence
  chemically synthesized
gaatgaaatacattatctctcc

SEQ ID NO: 954259 - DNA, 22 bp, Artificial Sequence
  chemically synthesized
aatgaaatacattatctctccc

SEQ ID NO: 954260 - DNA, 22 bp, Artificial Sequence
  chemically synthesized
gaaggtggttattaggatggga

SEQ ID NO: 954261 - DNA, 22 bp, Artificial Sequence
  chemically synthesized
ggaaggtggttattaggatggg

SEQ ID NO: 954262 - DNA, 22 bp, Artificial Sequence
  chemically synthesized
tcttggaaggtggttattagga

SEQ ID NO: 954263 - DNA, 22 bp, Artificial Sequence
  chemically synthesized
atcttggaaggtggttattagg

SEQ ID NO: 954264 - DNA, 22 bp, Artificial Sequence
  chemically synthesized
tctctcccatcctaataaccac

SEQ ID NO: 954265 - DNA, 22 bp, Artificial Sequence
  chemically synthesized
tcccatcctaataaccaccttc

SEQ ID NO: 954266 - DNA, 22 bp, Artificial Sequence
  chemically synthesized
ccatcctaataaccaccttcca

SEQ ID NO: 954267 - DNA, 22 bp, Artificial Sequence
  chemically synthesized
ataaccaccttccaagataagt

SEQ ID NO: 954268 - DNA, 22 bp, Artificial Sequence
  chemically synthesized
ataataagatgtgaacttatct

SEQ ID NO: 954269 - DNA, 22 bp, Artificial Sequence
  chemically synthesized
taataataagatgtgaacttat

SEQ ID NO: 954270 - DNA, 22 bp, Artificial Sequence
  chemically synthesized
atctctaataataagatgtgaa

SEQ ID NO: 954271 - DNA, 22 bp, Artificial Sequence
  chemically synthesized
ccaagataagttcacatcttat

SEQ ID NO: 954272 - DNA, 22 bp, Artificial Sequence
  chemically synthesized
tcatctctaataataagatgtg

SEQ ID NO: 954273 - DNA, 22 bp, Artificial Sequence
  chemically synthesized
caagataagttcacatcttatt

SEQ ID NO: 954274 - DNA, 22 bp, Artificial Sequence
  chemically synthesized
ctcatctctaataataagatgt

SEQ ID NO: 954275 - DNA, 22 bp, Artificial Sequence
  chemically synthesized
aatcttctcatctctaataata

SEQ ID NO: 954276 - DNA, 22 bp, Artificial Sequence
  chemically synthesized
acatcttattattagagatgag

SEQ ID NO: 954277 - DNA, 22 bp, Artificial Sequence
  chemically synthesized
aaactaaatcttctcatctcta

SEQ ID NO: 954278 - DNA, 22 bp, Artificial Sequence
  chemically synthesized
ttaaaactaaatcttctcatct

SEQ ID NO: 954279 - DNA, 22 bp, Artificial Sequence
  chemically synthesized
ttgttaaaactaaatcttctca

SEQ ID NO: 954280 - DNA, 22 bp, Artificial Sequence
  chemically synthesized
attattagagatgagaagattt

SEQ ID NO: 954281 - DNA, 22 bp, Artificial Sequence
  chemically synthesized
ttattagagatgagaagattta

SEQ ID NO: 954282 - DNA, 22 bp, Artificial Sequence
  chemically synthesized
ttagagatgagaagatttagtt

SEQ ID NO: 954283 - DNA, 22 bp, Artificial Sequence
  chemically synthesized
gagatgagaagatttagtttta

SEQ ID NO: 954284 - DNA, 22 bp, Artificial Sequence
  chemically synthesized
agtcaaacactattgttaaaac

SEQ ID NO: 954285 - DNA, 22 bp, Artificial Sequence
  chemically synthesized
aagttcagtcaaacactattgt

SEQ ID NO: 954286 - DNA, 22 bp, Artificial Sequence
  chemically synthesized
caagttcagtcaaacactattg

SEQ ID NO: 954287 - DNA, 22 bp, Artificial Sequence
  chemically synthesized
agttttaacaatagtgtttgac

SEQ ID NO: 954288 - DNA, 22 bp, Artificial Sequence
  chemically synthesized
gttttaacaatagtgtttgact

SEQ ID NO: 954289 - DNA, 22 bp, Artificial Sequence
  chemically synthesized
tgtatttcaagttcagtcaaac

SEQ ID NO: 954290 - DNA, 22 bp, Artificial Sequence
  chemically synthesized
taacaatagtgtttgactgaac

SEQ ID NO: 954291 - DNA, 22 bp, Artificial Sequence
  chemically synthesized
aacaatagtgtttgactgaact

SEQ ID NO: 954292 - DNA, 22 bp, Artificial Sequence
  chemically synthesized
acaatagtgtttgactgaactt

SEQ ID NO: 954293 - DNA, 22 bp, Artificial Sequence
  chemically synthesized
cacacctgtgtatttcaagttc

SEQ ID NO: 954294 - DNA, 22 bp, Artificial Sequence
  chemically synthesized
acacacctgtgtatttcaagtt

SEQ ID NO: 954295 - DNA, 22 bp, Artificial Sequence
  chemically synthesized
atatttacacacctgtgtattt

SEQ ID NO: 954296 - DNA, 22 bp, Artificial Sequence
  chemically synthesized
gactgaacttgaaatacacagg

SEQ ID NO: 954297 - DNA, 22 bp, Artificial Sequence
  chemically synthesized
aatatttacacacctgtgtatt

SEQ ID NO: 954298 - DNA, 22 bp, Artificial Sequence
  chemically synthesized
actgaacttgaaatacacaggt

SEQ ID NO: 954299 - DNA, 22 bp, Artificial Sequence
  chemically synthesized
taatatttacacacctgtgtat

SEQ ID NO: 954300 - DNA, 22 bp, Artificial Sequence
  chemically synthesized
aacttgaaatacacaggtgtgt

SEQ ID NO: 954301 - DNA, 22 bp, Artificial Sequence
  chemically synthesized
atgttttaatatttacacacct

SEQ ID NO: 954302 - DNA, 22 bp, Artificial Sequence
  chemically synthesized
aatgttttaatatttacacacc

SEQ ID NO: 954303 - DNA, 22 bp, Artificial Sequence
  chemically synthesized
taatgttttaatatttacacac

SEQ ID NO: 954304 - DNA, 22 bp, Artificial Sequence
  chemically synthesized
gaaatacacaggtgtgtaaata

SEQ ID NO: 954305 - DNA, 22 bp, Artificial Sequence
  chemically synthesized
aaatacacaggtgtgtaaatat

SEQ ID NO: 954306 - DNA, 22 bp, Artificial Sequence
  chemically synthesized
ggaatgttttaatgttttaata

SEQ ID NO: 954307 - DNA, 22 bp, Artificial Sequence
  chemically synthesized
aggaatgttttaatgttttaat

SEQ ID NO: 954308 - DNA, 22 bp, Artificial Sequence
  chemically synthesized
taggaatgttttaatgttttaa

SEQ ID NO: 954309 - DNA, 22 bp, Artificial Sequence
  chemically synthesized
caaagattttaggaatgtttta

SEQ ID NO: 954310 - DNA, 22 bp, Artificial Sequence
  chemically synthesized
tctgcaaagattttaggaatgt

SEQ ID NO: 954311 - DNA, 22 bp, Artificial Sequence
  chemically synthesized
aaacattaaaacattcctaaaa

SEQ ID NO: 954312 - DNA, 22 bp, Artificial Sequence
  chemically synthesized
attatctgcaaagattttagga

SEQ ID NO: 954313 - DNA, 22 bp, Artificial Sequence
  chemically synthesized
taattatctgcaaagattttag

SEQ ID NO: 954314 - DNA, 22 bp, Artificial Sequence
  chemically synthesized
ctaattatctgcaaagatttta

SEQ ID NO: 954315 - DNA, 22 bp, Artificial Sequence
  chemically synthesized
tctaattatctgcaaagatttt

SEQ ID NO: 954316 - DNA, 22 bp, Artificial Sequence
  chemically synthesized
aaacattcctaaaatctttgca

SEQ ID NO: 954317 - DNA, 22 bp, Artificial Sequence
  chemically synthesized
tttctaattatctgcaaagatt

SEQ ID NO: 954318 - DNA, 22 bp, Artificial Sequence
  chemically synthesized
gactctttctaattatctgcaa

SEQ ID NO: 954319 - DNA, 22 bp, Artificial Sequence
  chemically synthesized
ctaaaatctttgcagataatta

SEQ ID NO: 954320 - DNA, 22 bp, Artificial Sequence
  chemically synthesized
ctagactctttctaattatctg

SEQ ID NO: 954321 - DNA, 22 bp, Artificial Sequence
  chemically synthesized
gctagactctttctaattatct

SEQ ID NO: 954322 - DNA, 22 bp, Artificial Sequence
  chemically synthesized
aaatctttgcagataattagaa

SEQ ID NO: 954323 - DNA, 22 bp, Artificial Sequence
  chemically synthesized
tgcagataattagaaagagtct

SEQ ID NO: 954324 - DNA, 22 bp, Artificial Sequence
  chemically synthesized
gcagataattagaaagagtcta

SEQ ID NO: 954325 - DNA, 22 bp, Artificial Sequence
  chemically synthesized
cagataattagaaagagtctag

SEQ ID NO: 954326 - DNA, 22 bp, Artificial Sequence
  chemically synthesized
cagataatgtttgctagactct

SEQ ID NO: 954327 - DNA, 22 bp, Artificial Sequence
  chemically synthesized
ttacagataatgtttgctagac

SEQ ID NO: 954328 - DNA, 22 bp, Artificial Sequence
  chemically synthesized
attacagataatgtttgctaga

SEQ ID NO: 954329 - DNA, 22 bp, Artificial Sequence
  chemically synthesized
tattacagataatgtttgctag

SEQ ID NO: 954330 - DNA, 22 bp, Artificial Sequence
  chemically synthesized
ttattacagataatgtttgcta

SEQ ID NO: 954331 - DNA, 22 bp, Artificial Sequence
  chemically synthesized
gaaagagtctagcaaacattat

SEQ ID NO: 954332 - DNA, 22 bp, Artificial Sequence
  chemically synthesized
aatatatatgtttttattacag

SEQ ID NO: 954333 - DNA, 22 bp, Artificial Sequence
  chemically synthesized
gcaaacattatctgtaataaaa

SEQ ID NO: 954334 - DNA, 22 bp, Artificial Sequence
  chemically synthesized
caaattaaatatatatgttttt

SEQ ID NO: 954335 - DNA, 22 bp, Artificial Sequence
  chemically synthesized
tctgtaataaaaacatatatat

SEQ ID NO: 954336 - DNA, 22 bp, Artificial Sequence
  chemically synthesized
taataaaaacatatatatttaa

SEQ ID NO: 954337 - DNA, 22 bp, Artificial Sequence
  chemically synthesized
aagcacattccaaattaaatat

SEQ ID NO: 954338 - DNA, 22 bp, Artificial Sequence
  chemically synthesized
aatttggaatgtgctttaattt

SEQ ID NO: 954339 - DNA, 22 bp, Artificial Sequence
  chemically synthesized
atttggaatgtgctttaatttt

SEQ ID NO: 954340 - DNA, 22 bp, Artificial Sequence
  chemically synthesized
ggaatgtgctttaattttgtgg

SEQ ID NO: 954341 - DNA, 22 bp, Artificial Sequence
  chemically synthesized
gaatgtgctttaattttgtggt

SEQ ID NO: 954342 - DNA, 22 bp, Artificial Sequence
  chemically synthesized
taattttgtggtattttgtgac

SEQ ID NO: 954343 - DNA, 22 bp, Artificial Sequence
  chemically synthesized
aattttgtggtattttgtgacc

SEQ ID NO: 954344 - DNA, 22 bp, Artificial Sequence
  chemically synthesized
attttgtggtattttgtgacca

SEQ ID NO: 954345 - DNA, 22 bp, Artificial Sequence
  chemically synthesized
tgtggtattttgtgaccactct

SEQ ID NO: 954346 - DNA, 22 bp, Artificial Sequence
  chemically synthesized
gtggtattttgtgaccactctg

SEQ ID NO: 954347 - DNA, 22 bp, Artificial Sequence
  chemically synthesized
tggtattttgtgaccactctgt

SEQ ID NO: 954348 - DNA, 22 bp, Artificial Sequence
  chemically synthesized
tgtgaccactctgttccttgtc

SEQ ID NO: 954349 - DNA, 22 bp, Artificial Sequence
  chemically synthesized
gtgaccactctgttccttgtcc

SEQ ID NO: 954350 - DNA, 22 bp, Artificial Sequence
  chemically synthesized
atcacaggcaagggacaaggaa

SEQ ID NO: 954351 - DNA, 22 bp, Artificial Sequence
  chemically synthesized
tgaccactctgttccttgtccc

SEQ ID NO: 954352 - DNA, 22 bp, Artificial Sequence
  chemically synthesized
actaatcacaggcaagggacaa

SEQ ID NO: 954353 - DNA, 22 bp, Artificial Sequence
  chemically synthesized
tattcactaatcacaggcaagg

SEQ ID NO: 954354 - DNA, 22 bp, Artificial Sequence
  chemically synthesized
tgttccttgtcccttgcctgtg

SEQ ID NO: 954355 - DNA, 22 bp, Artificial Sequence
  chemically synthesized
tatattcactaatcacaggcaa

SEQ ID NO: 954356 - DNA, 22 bp, Artificial Sequence
  chemically synthesized
ttccttgtcccttgcctgtgat

SEQ ID NO: 954357 - DNA, 22 bp, Artificial Sequence
  chemically synthesized
cttgtcccttgcctgtgattag

SEQ ID NO: 954358 - DNA, 22 bp, Artificial Sequence
  chemically synthesized
gtcccttgcctgtgattagtga

SEQ ID NO: 954359 - DNA, 22 bp, Artificial Sequence
  chemically synthesized
tcccttgcctgtgattagtgaa

SEQ ID NO: 954360 - DNA, 22 bp, Artificial Sequence
  chemically synthesized
gcctgtgattagtgaatataga

SEQ ID NO: 954361 - DNA, 22 bp, Artificial Sequence
  chemically synthesized
cctgtgattagtgaatatagag

SEQ ID NO: 954362 - DNA, 22 bp, Artificial Sequence
  chemically synthesized
tgattagtgaatatagagtgtt

SEQ ID NO: 954363 - DNA, 22 bp, Artificial Sequence
  chemically synthesized
gtgaatatagagtgttcattta

SEQ ID NO: 954364 - DNA, 22 bp, Artificial Sequence
  chemically synthesized
cagagatagtggataaaagtgt

SEQ ID NO: 954365 - DNA, 22 bp, Artificial Sequence
  chemically synthesized
atttattgacacttttatccac

SEQ ID NO: 954366 - DNA, 22 bp, Artificial Sequence
  chemically synthesized
tcctccagagatagtggataaa

SEQ ID NO: 954367 - DNA, 22 bp, Artificial Sequence
  chemically synthesized
gtcctccagagatagtggataa

SEQ ID NO: 954368 - DNA, 22 bp, Artificial Sequence
  chemically synthesized
attgacacttttatccactatc

SEQ ID NO: 954369 - DNA, 22 bp, Artificial Sequence
  chemically synthesized
ttgacacttttatccactatct

SEQ ID NO: 954370 - DNA, 22 bp, Artificial Sequence
  chemically synthesized
acacttttatccactatctctg

SEQ ID NO: 954371 - DNA, 22 bp, Artificial Sequence
  chemically synthesized
acatttgtcctccagagatagt

SEQ ID NO: 954372 - DNA, 22 bp, Artificial Sequence
  chemically synthesized
cacatttgtcctccagagatag

SEQ ID NO: 954373 - DNA, 22 bp, Artificial Sequence
  chemically synthesized
cttcacatttgtcctccagaga

SEQ ID NO: 954374 - DNA, 22 bp, Artificial Sequence
  chemically synthesized
ttatccactatctctggaggac

SEQ ID NO: 954375 - DNA, 22 bp, Artificial Sequence
  chemically synthesized
tatccactatctctggaggaca

SEQ ID NO: 954376 - DNA, 22 bp, Artificial Sequence
  chemically synthesized
atccactatctctggaggacaa

SEQ ID NO: 954377 - DNA, 22 bp, Artificial Sequence
  chemically synthesized
tccactatctctggaggacaaa

SEQ ID NO: 954378 - DNA, 22 bp, Artificial Sequence
  chemically synthesized
gcaactacttcacatttgtcct

SEQ ID NO: 954379 - DNA, 22 bp, Artificial Sequence
  chemically synthesized
ggcaactacttcacatttgtcc

SEQ ID NO: 954380 - DNA, 22 bp, Artificial Sequence
  chemically synthesized
tctctggaggacaaatgtgaag

SEQ ID NO: 954381 - DNA, 22 bp, Artificial Sequence
  chemically synthesized
tggaggacaaatgtgaagtagt

SEQ ID NO: 954382 - DNA, 22 bp, Artificial Sequence
  chemically synthesized
gaggacaaatgtgaagtagttg

SEQ ID NO: 954383 - DNA, 22 bp, Artificial Sequence
  chemically synthesized
aagtagagtcttggcaactact

SEQ ID NO: 954384 - DNA, 22 bp, Artificial Sequence
  chemically synthesized
cctaaagtagagtcttggcaac

SEQ ID NO: 954385 - DNA, 22 bp, Artificial Sequence
  chemically synthesized
ccaagactctactttaggcagt

SEQ ID NO: 954386 - DNA, 22 bp, Artificial Sequence
  chemically synthesized
atgatatgtgaaactgcctaaa

SEQ ID NO: 954387 - DNA, 22 bp, Artificial Sequence
  chemically synthesized
aatgatatgtgaaactgcctaa

SEQ ID NO: 954388 - DNA, 22 bp, Artificial Sequence
  chemically synthesized
taatgatatgtgaaactgccta

SEQ ID NO: 954389 - DNA, 22 bp, Artificial Sequence
  chemically synthesized
ttttaatgatatgtgaaactgc

SEQ ID NO: 954390 - DNA, 22 bp, Artificial Sequence
  chemically synthesized
gttttaatgatatgtgaaactg

SEQ ID NO: 954391 - DNA, 22 bp, Artificial Sequence
  chemically synthesized
tgttttaatgatatgtgaaact

SEQ ID NO: 954392 - DNA, 22 bp, Artificial Sequence
  chemically synthesized
ttgttttaatgatatgtgaaac

SEQ ID NO: 954393 - DNA, 22 bp, Artificial Sequence
  chemically synthesized
tactttaggcagtttcacatat

SEQ ID NO: 954394 - DNA, 22 bp, Artificial Sequence
  chemically synthesized
ctttaggcagtttcacatatca

SEQ ID NO: 954395 - DNA, 22 bp, Artificial Sequence
  chemically synthesized
taggcagtttcacatatcatta

SEQ ID NO: 954396 - DNA, 22 bp, Artificial Sequence
  chemically synthesized
aggcagtttcacatatcattaa

SEQ ID NO: 954397 - DNA, 22 bp, Artificial Sequence
  chemically synthesized
taaatttttgttttaatgatat

SEQ ID NO: 954398 - DNA, 22 bp, Artificial Sequence
  chemically synthesized
ggcagtttcacatatcattaaa

SEQ ID NO: 954399 - DNA, 22 bp, Artificial Sequence
  chemically synthesized
cacatatcattaaaacaaaaat

SEQ ID NO: 954400 - DNA, 22 bp, Artificial Sequence
  chemically synthesized
acatatcattaaaacaaaaatt

SEQ ID NO: 954401 - DNA, 22 bp, Artificial Sequence
  chemically synthesized
atggaaatacataatctgtaaa

SEQ ID NO: 954402 - DNA, 22 bp, Artificial Sequence
  chemically synthesized
catggaaatacataatctgtaa

SEQ ID NO: 954403 - DNA, 22 bp, Artificial Sequence
  chemically synthesized
aaacaaaaatttacagattatg

SEQ ID NO: 954404 - DNA, 22 bp, Artificial Sequence
  chemically synthesized
tcatatttcatggaaatacata

SEQ ID NO: 954405 - DNA, 22 bp, Artificial Sequence
  chemically synthesized
ttgtcatatttcatggaaatac

SEQ ID NO: 954406 - DNA, 22 bp, Artificial Sequence
  chemically synthesized
acagattatgtatttccatgaa

SEQ ID NO: 954407 - DNA, 22 bp, Artificial Sequence
  chemically synthesized
ttattgtcatatttcatggaaa

SEQ ID NO: 954408 - DNA, 22 bp, Artificial Sequence
  chemically synthesized
cagattatgtatttccatgaaa

SEQ ID NO: 954409 - DNA, 22 bp, Artificial Sequence
  chemically synthesized
gttattgtcatatttcatggaa

SEQ ID NO: 954410 - DNA, 22 bp, Artificial Sequence
  chemically synthesized
caatttgttattgtcatatttc

SEQ ID NO: 954411 - DNA, 22 bp, Artificial Sequence
  chemically synthesized
tgtatttccatgaaatatgaca

SEQ ID NO: 954412 - DNA, 22 bp, Artificial Sequence
  chemically synthesized
ccaatttgttattgtcatattt

SEQ ID NO: 954413 - DNA, 22 bp, Artificial Sequence
  chemically synthesized
agccttccaatttgttattgtc

SEQ ID NO: 954414 - DNA, 22 bp, Artificial Sequence
  chemically synthesized
ccatgaaatatgacaataacaa

SEQ ID NO: 954415 - DNA, 22 bp, Artificial Sequence
  chemically synthesized
catgaaatatgacaataacaaa

SEQ ID NO: 954416 - DNA, 22 bp, Artificial Sequence
  chemically synthesized
gccctcagccttccaatttgtt

SEQ ID NO: 954417 - DNA, 22 bp, Artificial Sequence
  chemically synthesized
tgtgtaaaattagccctcagcc

SEQ ID NO: 954418 - DNA, 22 bp, Artificial Sequence
  chemically synthesized
caaaattatgtgtaaaattagc

SEQ ID NO: 954419 - DNA, 22 bp, Artificial Sequence
  chemically synthesized
gaaggctgagggctaattttac

SEQ ID NO: 954420 - DNA, 22 bp, Artificial Sequence
  chemically synthesized
gcaaaattatgtgtaaaattag

SEQ ID NO: 954421 - DNA, 22 bp, Artificial Sequence
  chemically synthesized
agggctaattttacacataatt

SEQ ID NO: 954422 - DNA, 22 bp, Artificial Sequence
  chemically synthesized
acaaacagatttgcaaaattat

SEQ ID NO: 954423 - DNA, 22 bp, Artificial Sequence
  chemically synthesized
aacaaacagatttgcaaaatta

SEQ ID NO: 954424 - DNA, 22 bp, Artificial Sequence
  chemically synthesized
attttacacataattttgcaaa

SEQ ID NO: 954425 - DNA, 22 bp, Artificial Sequence
  chemically synthesized
ttaacaaacagatttgcaaaat

SEQ ID NO: 954426 - DNA, 22 bp, Artificial Sequence
  chemically synthesized
tacacataattttgcaaatctg

SEQ ID NO: 954427 - DNA, 22 bp, Artificial Sequence
  chemically synthesized
attcttaacaaacagatttgca

SEQ ID NO: 954428 - DNA, 22 bp, Artificial Sequence
  chemically synthesized
acacataattttgcaaatctgt

SEQ ID NO: 954429 - DNA, 22 bp, Artificial Sequence
  chemically synthesized
cacataattttgcaaatctgtt

SEQ ID NO: 954430 - DNA, 22 bp, Artificial Sequence
  chemically synthesized
catactcattcttaacaaacag

SEQ ID NO: 954431 - DNA, 22 bp, Artificial Sequence
  chemically synthesized
tgcaaatctgtttgttaagaat

SEQ ID NO: 954432 - DNA, 22 bp, Artificial Sequence
  chemically synthesized
gcaaatctgtttgttaagaatg

SEQ ID NO: 954433 - DNA, 22 bp, Artificial Sequence
  chemically synthesized
caaatctgtttgttaagaatga

SEQ ID NO: 954434 - DNA, 22 bp, Artificial Sequence
  chemically synthesized
tttgttaagaatgagtatgcaa

SEQ ID NO: 954435 - DNA, 22 bp, Artificial Sequence
  chemically synthesized
gttaagaatgagtatgcaattc

SEQ ID NO: 954436 - DNA, 22 bp, Artificial Sequence
  chemically synthesized
ttaagaatgagtatgcaattca

SEQ ID NO: 954437 - DNA, 22 bp, Artificial Sequence
  chemically synthesized
agaatgagtatgcaattcatac

SEQ ID NO: 954438 - DNA, 22 bp, Artificial Sequence
  chemically synthesized
ccagaatgtcaatgtatgaatt

SEQ ID NO: 954439 - DNA, 22 bp, Artificial Sequence
  chemically synthesized
atgaactaccagaatgtcaatg

SEQ ID NO: 954440 - DNA, 22 bp, Artificial Sequence
  chemically synthesized
taaactgatgaactaccagaat

SEQ ID NO: 954441 - DNA, 22 bp, Artificial Sequence
  chemically synthesized
ataaactgatgaactaccagaa

SEQ ID NO: 954442 - DNA, 22 bp, Artificial Sequence
  chemically synthesized
atacattgacattctggtagtt

SEQ ID NO: 954443 - DNA, 22 bp, Artificial Sequence
  chemically synthesized
tataaactgatgaactaccaga

SEQ ID NO: 954444 - DNA, 22 bp, Artificial Sequence
  chemically synthesized
gttttataaactgatgaactac

SEQ ID NO: 954445 - DNA, 22 bp, Artificial Sequence
  chemically synthesized
acattctggtagttcatcagtt

SEQ ID NO: 954446 - DNA, 22 bp, Artificial Sequence
  chemically synthesized
actagttttataaactgatgaa

SEQ ID NO: 954447 - DNA, 22 bp, Artificial Sequence
  chemically synthesized
cactagttttataaactgatga

SEQ ID NO: 954448 - DNA, 22 bp, Artificial Sequence
  chemically synthesized
tggtagttcatcagtttataaa

SEQ ID NO: 954449 - DNA, 22 bp, Artificial Sequence
  chemically synthesized
catttcactagttttataaact

SEQ ID NO: 954450 - DNA, 22 bp, Artificial Sequence
  chemically synthesized
ccatttcactagttttataaac

SEQ ID NO: 954451 - DNA, 22 bp, Artificial Sequence
  chemically synthesized
gtagttcatcagtttataaaac

SEQ ID NO: 954452 - DNA, 22 bp, Artificial Sequence
  chemically synthesized
ttccatttcactagttttataa

SEQ ID NO: 954453 - DNA, 22 bp, Artificial Sequence
  chemically synthesized
atcagtttataaaactagtgaa

SEQ ID NO: 954454 - DNA, 22 bp, Artificial Sequence
  chemically synthesized
aatgcattcttccatttcacta

SEQ ID NO: 954455 - DNA, 22 bp, Artificial Sequence
  chemically synthesized
caatgcattcttccatttcact

SEQ ID NO: 954456 - DNA, 22 bp, Artificial Sequence
  chemically synthesized
ataaaactagtgaaatggaaga

SEQ ID NO: 954457 - DNA, 22 bp, Artificial Sequence
  chemically synthesized
taaaactagtgaaatggaagaa

SEQ ID NO: 954458 - DNA, 22 bp, Artificial Sequence
  chemically synthesized
aatttcaatgcattcttccatt

SEQ ID NO: 954459 - DNA, 22 bp, Artificial Sequence
  chemically synthesized
gtgaaatggaagaatgcattga

SEQ ID NO: 954460 - DNA, 22 bp, Artificial Sequence
  chemically synthesized
aaatttaattgttggtatcttc

SEQ ID NO: 954461 - DNA, 22 bp, Artificial Sequence
  chemically synthesized
aattgttggtatcttcacactt

SEQ ID NO: 954462 - DNA, 22 bp, Artificial Sequence
  chemically synthesized
attgttggtatcttcacacttt

SEQ ID NO: 954463 - DNA, 22 bp, Artificial Sequence
  chemically synthesized
atatagtcagcaaaagtgtgaa

SEQ ID NO: 954464 - DNA, 22 bp, Artificial Sequence
  chemically synthesized
aatatagtcagcaaaagtgtga

SEQ ID NO: 954465 - DNA, 22 bp, Artificial Sequence
  chemically synthesized
taatatagtcagcaaaagtgtg

SEQ ID NO: 954466 - DNA, 22 bp, Artificial Sequence
  chemically synthesized
ttggtatcttcacacttttgct

SEQ ID NO: 954467 - DNA, 22 bp, Artificial Sequence
  chemically synthesized
ttttaatatagtcagcaaaagt

SEQ ID NO: 954468 - DNA, 22 bp, Artificial Sequence
  chemically synthesized
gtatcttcacacttttgctgac

SEQ ID NO: 954469 - DNA, 22 bp, Artificial Sequence
  chemically synthesized
cacacttttgctgactatatta

SEQ ID NO: 954470 - DNA, 22 bp, Artificial Sequence
  chemically synthesized
acacttttgctgactatattaa

SEQ ID NO: 954471 - DNA, 22 bp, Artificial Sequence
  chemically synthesized
aatgtatctgttttaatatagt

SEQ ID NO: 954472 - DNA, 22 bp, Artificial Sequence
  chemically synthesized
agttcaatgtatctgttttaat

SEQ ID NO: 954473 - DNA, 22 bp, Artificial Sequence
  chemically synthesized
ttgctgactatattaaaacaga

SEQ ID NO: 954474 - DNA, 22 bp, Artificial Sequence
  chemically synthesized
tgctgactatattaaaacagat

SEQ ID NO: 954475 - DNA, 22 bp, Artificial Sequence
  chemically synthesized
gctgactatattaaaacagata

SEQ ID NO: 954476 - DNA, 22 bp, Artificial Sequence
  chemically synthesized
ctgactatattaaaacagatac

SEQ ID NO: 954477 - DNA, 22 bp, Artificial Sequence
  chemically synthesized
actatattaaaacagatacatt

SEQ ID NO: 954478 - DNA, 22 bp, Artificial Sequence
  chemically synthesized
tattaaaacagatacattgaac

SEQ ID NO: 954479 - DNA, 22 bp, Artificial Sequence
  chemically synthesized
aaacagatacattgaactgagt

SEQ ID NO: 954480 - DNA, 22 bp, Artificial Sequence
  chemically synthesized
ggaggcgggaccactcagttca

SEQ ID NO: 954481 - DNA, 22 bp, Artificial Sequence
  chemically synthesized
ttaggaggcgggaccactcagt

SEQ ID NO: 954482 - DNA, 22 bp, Artificial Sequence
  chemically synthesized
taaattattaggaggcgggacc

SEQ ID NO: 954483 - DNA, 22 bp, Artificial Sequence
  chemically synthesized
aactgagtggtcccgcctccta

SEQ ID NO: 954484 - DNA, 22 bp, Artificial Sequence
  chemically synthesized
agtggtcccgcctcctaataat

SEQ ID NO: 954485 - DNA, 22 bp, Artificial Sequence
  chemically synthesized
aagatgttataaattattagga

SEQ ID NO: 954486 - DNA, 22 bp, Artificial Sequence
  chemically synthesized
gtggcagaaactgaagatgtta

SEQ ID NO: 954487 - DNA, 22 bp, Artificial Sequence
  chemically synthesized
ctaataatttataacatcttca

SEQ ID NO: 954488 - DNA, 22 bp, Artificial Sequence
  chemically synthesized
ataatttataacatcttcagtt

SEQ ID NO: 954489 - DNA, 22 bp, Artificial Sequence
  chemically synthesized
ataacatcttcagtttctgcca

SEQ ID NO: 954490 - DNA, 22 bp, Artificial Sequence
  chemically synthesized
taacatcttcagtttctgccac

SEQ ID NO: 954491 - DNA, 22 bp, Artificial Sequence
  chemically synthesized
cagtttctgccactaatattta

SEQ ID NO: 954492 - DNA, 22 bp, Artificial Sequence
  chemically synthesized
ataagataatgataaatattag

SEQ ID NO: 954493 - DNA, 22 bp, Artificial Sequence
  chemically synthesized
agtttctgccactaatatttat

SEQ ID NO: 954494 - DNA, 22 bp, Artificial Sequence
  chemically synthesized
ttcataagataatgataaatat

SEQ ID NO: 954495 - DNA, 22 bp, Artificial Sequence
  chemically synthesized
ctgccactaatatttatcatta

SEQ ID NO: 954496 - DNA, 22 bp, Artificial Sequence
  chemically synthesized
tgccactaatatttatcattat

SEQ ID NO: 954497 - DNA, 22 bp, Artificial Sequence
  chemically synthesized
ccactaatatttatcattatct

SEQ ID NO: 954498 - DNA, 22 bp, Artificial Sequence
  chemically synthesized
atatttatcattatcttatgaa

SEQ ID NO: 954499 - DNA, 22 bp, Artificial Sequence
  chemically synthesized
aatgcacagacctgttcataag

SEQ ID NO: 954500 - DNA, 22 bp, Artificial Sequence
  chemically synthesized
caatgcacagacctgttcataa

SEQ ID NO: 954501 - DNA, 22 bp, Artificial Sequence
  chemically synthesized
atcattatcttatgaacaggtc

SEQ ID NO: 954502 - DNA, 22 bp, Artificial Sequence
  chemically synthesized
tttcaatgcacagacctgttca

SEQ ID NO: 954503 - DNA, 22 bp, Artificial Sequence
  chemically synthesized
tcattatcttatgaacaggtct

SEQ ID NO: 954504 - DNA, 22 bp, Artificial Sequence
  chemically synthesized
ttatttcaatgcacagacctgt

SEQ ID NO: 954505 - DNA, 22 bp, Artificial Sequence
  chemically synthesized
ttattatttcaatgcacagacc

SEQ ID NO: 954506 - DNA, 22 bp, Artificial Sequence
  chemically synthesized
tcttatgaacaggtctgtgcat

SEQ ID NO: 954507 - DNA, 22 bp, Artificial Sequence
  chemically synthesized
attattatttcaatgcacagac

SEQ ID NO: 954508 - DNA, 22 bp, Artificial Sequence
  chemically synthesized
tattattatttcaatgcacaga

SEQ ID NO: 954509 - DNA, 22 bp, Artificial Sequence
  chemically synthesized
ttattattatttcaatgcacag

SEQ ID NO: 954510 - DNA, 22 bp, Artificial Sequence
  chemically synthesized
atgaacaggtctgtgcattgaa

SEQ ID NO: 954511 - DNA, 22 bp, Artificial Sequence
  chemically synthesized
tgaacaggtctgtgcattgaaa

SEQ ID NO: 954512 - DNA, 22 bp, Artificial Sequence
  chemically synthesized
tcgtttttattattatttcaat

SEQ ID NO: 954513 - DNA, 22 bp, Artificial Sequence
  chemically synthesized
atcgtttttattattatttcaa

SEQ ID NO: 954514 - DNA, 22 bp, Artificial Sequence
  chemically synthesized
cttatcgtttttattattattt

SEQ ID NO: 954515 - DNA, 22 bp, Artificial Sequence
  chemically synthesized
ccttatcgtttttattattatt

SEQ ID NO: 954516 - DNA, 22 bp, Artificial Sequence
  chemically synthesized
tttccttatcgtttttattatt

SEQ ID NO: 954517 - DNA, 22 bp, Artificial Sequence
  chemically synthesized
tgcattgaaataataataaaaa

SEQ ID NO: 954518 - DNA, 22 bp, Artificial Sequence
  chemically synthesized
atttccttatcgtttttattat

SEQ ID NO: 954519 - DNA, 22 bp, Artificial Sequence
  chemically synthesized
tttatttccttatcgtttttat

SEQ ID NO: 954520 - DNA, 22 bp, Artificial Sequence
  chemically synthesized
aaataataataaaaacgataag

SEQ ID NO: 954521 - DNA, 22 bp, Artificial Sequence
  chemically synthesized
tgtctatttatttccttatcgt

SEQ ID NO: 954522 - DNA, 22 bp, Artificial Sequence
  chemically synthesized
aataaataatagttatgtctat

SEQ ID NO: 954523 - DNA, 22 bp, Artificial Sequence
  chemically synthesized
ataatacactgaataaataata

SEQ ID NO: 954524 - DNA, 22 bp, Artificial Sequence
  chemically synthesized
aataatacactgaataaataat

SEQ ID NO: 954525 - DNA, 22 bp, Artificial Sequence
  chemically synthesized
tatcatacacttaataatacac

SEQ ID NO: 954526 - DNA, 22 bp, Artificial Sequence
  chemically synthesized
ttatttattcagtgtattatta

SEQ ID NO: 954527 - DNA, 22 bp, Artificial Sequence
  chemically synthesized
tttattcagtgtattattaagt

SEQ ID NO: 954528 - DNA, 22 bp, Artificial Sequence
  chemically synthesized
gcattatatcatacacttaata

SEQ ID NO: 954529 - DNA, 22 bp, Artificial Sequence
  chemically synthesized
attcagtgtattattaagtgta

SEQ ID NO: 954530 - DNA, 22 bp, Artificial Sequence
  chemically synthesized
ttcagtgtattattaagtgtat

SEQ ID NO: 954531 - DNA, 22 bp, Artificial Sequence
  chemically synthesized
agtgtattattaagtgtatgat

SEQ ID NO: 954532 - DNA, 22 bp, Artificial Sequence
  chemically synthesized
ggatgcctggcattatatcata

SEQ ID NO: 954533 - DNA, 22 bp, Artificial Sequence
  chemically synthesized
ttaagtgtatgatataatgcca

SEQ ID NO: 954534 - DNA, 22 bp, Artificial Sequence
  chemically synthesized
agtgtatgatataatgccaggc

SEQ ID NO: 954535 - DNA, 22 bp, Artificial Sequence
  chemically synthesized
tgaggagtaaatgagatgatat

SEQ ID NO: 954536 - DNA, 22 bp, Artificial Sequence
  chemically synthesized
attgtgaggagtaaatgagatg

SEQ ID NO: 954537 - DNA, 22 bp, Artificial Sequence
  chemically synthesized
gatatatcatctcatttactcc

SEQ ID NO: 954538 - DNA, 22 bp, Artificial Sequence
  chemically synthesized
ataggttcattgtgaggagtaa

SEQ ID NO: 954539 - DNA, 22 bp, Artificial Sequence
  chemically synthesized
aataggttcattgtgaggagta

SEQ ID NO: 954540 - DNA, 22 bp, Artificial Sequence
  chemically synthesized
cttaataggttcattgtgagga

SEQ ID NO: 954541 - DNA, 22 bp, Artificial Sequence
  chemically synthesized
atttactcctcacaatgaacct

SEQ ID NO: 954542 - DNA, 22 bp, Artificial Sequence
  chemically synthesized
actcctcacaatgaacctatta

SEQ ID NO: 954543 - DNA, 22 bp, Artificial Sequence
  chemically synthesized
ctcctcacaatgaacctattaa

SEQ ID NO: 954544 - DNA, 22 bp, Artificial Sequence
  chemically synthesized
ctcacaatgaacctattaagta

SEQ ID NO: 954545 - DNA, 22 bp, Artificial Sequence
  chemically synthesized
acaatgaacctattaagtagat

SEQ ID NO: 954546 - DNA, 22 bp, Artificial Sequence
  chemically synthesized
aaataggcacaaggacatctac

SEQ ID NO: 954547 - DNA, 22 bp, Artificial Sequence
  chemically synthesized
aaaataggcacaaggacatcta

SEQ ID NO: 954548 - DNA, 22 bp, Artificial Sequence
  chemically synthesized
taaaataggcacaaggacatct

SEQ ID NO: 954549 - DNA, 22 bp, Artificial Sequence
  chemically synthesized
ttaaaataggcacaaggacatc

SEQ ID NO: 954550 - DNA, 22 bp, Artificial Sequence
  chemically synthesized
atttttaaaataggcacaagga

SEQ ID NO: 954551 - DNA, 22 bp, Artificial Sequence
  chemically synthesized
ttaagtagatgtccttgtgcct

SEQ ID NO: 954552 - DNA, 22 bp, Artificial Sequence
  chemically synthesized
ctcatttttaaaataggcacaa

SEQ ID NO: 954553 - DNA, 22 bp, Artificial Sequence
  chemically synthesized
agtagatgtccttgtgcctatt

SEQ ID NO: 954554 - DNA, 22 bp, Artificial Sequence
  chemically synthesized
cctcatttttaaaataggcaca

SEQ ID NO: 954555 - DNA, 22 bp, Artificial Sequence
  chemically synthesized
tcttcctcatttttaaaatagg

SEQ ID NO: 954556 - DNA, 22 bp, Artificial Sequence
  chemically synthesized
atcttcctcatttttaaaatag

SEQ ID NO: 954557 - DNA, 22 bp, Artificial Sequence
  chemically synthesized
tatcttcctcatttttaaaata

SEQ ID NO: 954558 - DNA, 22 bp, Artificial Sequence
  chemically synthesized
gtgcctattttaaaaatgagga

SEQ ID NO: 954559 - DNA, 22 bp, Artificial Sequence
  chemically synthesized
tacgttttatcttcctcatttt

SEQ ID NO: 954560 - DNA, 22 bp, Artificial Sequence
  chemically synthesized
tgcctattttaaaaatgaggaa

SEQ ID NO: 954561 - DNA, 22 bp, Artificial Sequence
  chemically synthesized
tgtacgttttatcttcctcatt

SEQ ID NO: 954562 - DNA, 22 bp, Artificial Sequence
  chemically synthesized
ctgtacgttttatcttcctcat

SEQ ID NO: 954563 - DNA, 22 bp, Artificial Sequence
  chemically synthesized
ttttaaaaatgaggaagataaa

SEQ ID NO: 954564 - DNA, 22 bp, Artificial Sequence
  chemically synthesized
aatttctgtacgttttatcttc

SEQ ID NO: 954565 - DNA, 22 bp, Artificial Sequence
  chemically synthesized
taaaaatgaggaagataaaacg

SEQ ID NO: 954566 - DNA, 22 bp, Artificial Sequence
  chemically synthesized
aaaaatgaggaagataaaacgt

SEQ ID NO: 954567 - DNA, 22 bp, Artificial Sequence
  chemically synthesized
aaaatgaggaagataaaacgta

SEQ ID NO: 954568 - DNA, 22 bp, Artificial Sequence
  chemically synthesized
ggcaaaatgttaaatttctgta

SEQ ID NO: 954569 - DNA, 22 bp, Artificial Sequence
  chemically synthesized
gggcaaaatgttaaatttctgt

SEQ ID NO: 954570 - DNA, 22 bp, Artificial Sequence
  chemically synthesized
caatcttgggcaaaatgttaaa

SEQ ID NO: 954571 - DNA, 22 bp, Artificial Sequence
  chemically synthesized
gcaatcttgggcaaaatgttaa

SEQ ID NO: 954572 - DNA, 22 bp, Artificial Sequence
  chemically synthesized
tgcaatcttgggcaaaatgtta

SEQ ID NO: 954573 - DNA, 22 bp, Artificial Sequence
  chemically synthesized
ctttgcaatcttgggcaaaatg

SEQ ID NO: 954574 - DNA, 22 bp, Artificial Sequence
  chemically synthesized
gctttgcaatcttgggcaaaat

SEQ ID NO: 954575 - DNA, 22 bp, Artificial Sequence
  chemically synthesized
gtttgctttgcaatcttgggca

SEQ ID NO: 954576 - DNA, 22 bp, Artificial Sequence
  chemically synthesized
agtttgctttgcaatcttgggc

SEQ ID NO: 954577 - DNA, 22 bp, Artificial Sequence
  chemically synthesized
aacattttgcccaagattgcaa

SEQ ID NO: 954578 - DNA, 22 bp, Artificial Sequence
  chemically synthesized
acattttgcccaagattgcaaa

SEQ ID NO: 954579 - DNA, 22 bp, Artificial Sequence
  chemically synthesized
atgcatttagtttgctttgcaa

SEQ ID NO: 954580 - DNA, 22 bp, Artificial Sequence
  chemically synthesized
tgcccaagattgcaaagcaaac

SEQ ID NO: 954581 - DNA, 22 bp, Artificial Sequence
  chemically synthesized
ttcatgcatttagtttgctttg

SEQ ID NO: 954582 - DNA, 22 bp, Artificial Sequence
  chemically synthesized
gcccaagattgcaaagcaaact

SEQ ID NO: 954583 - DNA, 22 bp, Artificial Sequence
  chemically synthesized
gttcatgcatttagtttgcttt

SEQ ID NO: 954584 - DNA, 22 bp, Artificial Sequence
  chemically synthesized
cccaagattgcaaagcaaacta

SEQ ID NO: 954585 - DNA, 22 bp, Artificial Sequence
  chemically synthesized
aaatccttgttcatgcatttag

SEQ ID NO: 954586 - DNA, 22 bp, Artificial Sequence
  chemically synthesized
caaagcaaactaaatgcatgaa

SEQ ID NO: 954587 - DNA, 22 bp, Artificial Sequence
  chemically synthesized
aatgcatgaacaaggatttgaa

SEQ ID NO: 954588 - DNA, 22 bp, Artificial Sequence
  chemically synthesized
cagatgaaaaaaaaaaacacag

SEQ ID NO: 954589 - DNA, 22 bp, Artificial Sequence
  chemically synthesized
gaactgtgtttttttttttcat

SEQ ID NO: 954590 - DNA, 22 bp, Artificial Sequence
  chemically synthesized
aactgtgtttttttttttcatc

SEQ ID NO: 954591 - DNA, 22 bp, Artificial Sequence
  chemically synthesized
ggaacggaggcctccagatgaa

SEQ ID NO: 954592 - DNA, 22 bp, Artificial Sequence
  chemically synthesized
tgtttttttttttcatctggag

SEQ ID NO: 954593 - DNA, 22 bp, Artificial Sequence
  chemically synthesized
gggaacggaggcctccagatga

SEQ ID NO: 954594 - DNA, 22 bp, Artificial Sequence
  chemically synthesized
ttttttttcatctggaggcctc

SEQ ID NO: 954595 - DNA, 22 bp, Artificial Sequence
  chemically synthesized
tttttttcatctggaggcctcc

SEQ ID NO: 954596 - DNA, 22 bp, Artificial Sequence
  chemically synthesized
ttttttcatctggaggcctccg

SEQ ID NO: 954597 - DNA, 22 bp, Artificial Sequence
  chemically synthesized
tttttcatctggaggcctccgt

SEQ ID NO: 954598 - DNA, 22 bp, Artificial Sequence
  chemically synthesized
ttttcatctggaggcctccgtt

SEQ ID NO: 954599 - DNA, 22 bp, Artificial Sequence
  chemically synthesized
tttcatctggaggcctccgttc

SEQ ID NO: 954600 - DNA, 22 bp, Artificial Sequence
  chemically synthesized
ttcatctggaggcctccgttcc

SEQ ID NO: 954601 - DNA, 22 bp, Artificial Sequence
  chemically synthesized
aaagcatgcttgggaacggagg

SEQ ID NO: 954602 - DNA, 22 bp, Artificial Sequence
  chemically synthesized
tcatctggaggcctccgttccc

SEQ ID NO: 954603 - DNA, 22 bp, Artificial Sequence
  chemically synthesized
aaaagcatgcttgggaacggag

SEQ ID NO: 954604 - DNA, 22 bp, Artificial Sequence
  chemically synthesized
catctggaggcctccgttccca

SEQ ID NO: 954605 - DNA, 22 bp, Artificial Sequence
  chemically synthesized
atctggaggcctccgttcccaa

SEQ ID NO: 954606 - DNA, 22 bp, Artificial Sequence
  chemically synthesized
gaggcctccgttcccaagcatg

SEQ ID NO: 954607 - DNA, 22 bp, Artificial Sequence
  chemically synthesized
cgttcccaagcatgcttttaaa

SEQ ID NO: 954608 - DNA, 22 bp, Artificial Sequence
  chemically synthesized
ccaagcatgcttttaaattttt

SEQ ID NO: 954609 - DNA, 22 bp, Artificial Sequence
  chemically synthesized
tgatatgtgtcaagagaaaaaa

SEQ ID NO: 954610 - DNA, 22 bp, Artificial Sequence
  chemically synthesized
atgatatgtgtcaagagaaaaa

SEQ ID NO: 954611 - DNA, 22 bp, Artificial Sequence
  chemically synthesized
ttaaattttttttttctcttga

SEQ ID NO: 954612 - DNA, 22 bp, Artificial Sequence
  chemically synthesized
taaattttttttttctcttgac

SEQ ID NO: 954613 - DNA, 22 bp, Artificial Sequence
  chemically synthesized
aaattttttttttctcttgaca

SEQ ID NO: 954614 - DNA, 22 bp, Artificial Sequence
  chemically synthesized
aattttttttttctcttgacac

SEQ ID NO: 954615 - DNA, 22 bp, Artificial Sequence
  chemically synthesized
tttttttctcttgacacatatc

SEQ ID NO: 954616 - DNA, 22 bp, Artificial Sequence
  chemically synthesized
ttttttctcttgacacatatca

SEQ ID NO: 954617 - DNA, 22 bp, Artificial Sequence
  chemically synthesized
tttttctcttgacacatatcat

SEQ ID NO: 954618 - DNA, 22 bp, Artificial Sequence
  chemically synthesized
ttttctcttgacacatatcata

SEQ ID NO: 954619 - DNA, 22 bp, Artificial Sequence
  chemically synthesized
tttctcttgacacatatcataa

SEQ ID NO: 954620 - DNA, 22 bp, Artificial Sequence
  chemically synthesized
ttctcttgacacatatcataag

SEQ ID NO: 954621 - DNA, 22 bp, Artificial Sequence
  chemically synthesized
tctcttgacacatatcataagg

SEQ ID NO: 954622 - DNA, 22 bp, Artificial Sequence
  chemically synthesized
ctcttgacacatatcataaggt

SEQ ID NO: 954623 - DNA, 22 bp, Artificial Sequence
  chemically synthesized
tcttgacacatatcataaggtt

SEQ ID NO: 954624 - DNA, 22 bp, Artificial Sequence
  chemically synthesized
ttgacacatatcataaggtttc

SEQ ID NO: 954625 - DNA, 22 bp, Artificial Sequence
  chemically synthesized
gacacatatcataaggtttctt

SEQ ID NO: 954626 - DNA, 22 bp, Artificial Sequence
  chemically synthesized
acacatatcataaggtttcttc

SEQ ID NO: 954627 - DNA, 22 bp, Artificial Sequence
  chemically synthesized
atatgatgtgaaaaatgagaag

SEQ ID NO: 954628 - DNA, 22 bp, Artificial Sequence
  chemically synthesized
gttgatatgatgtgaaaaatga

SEQ ID NO: 954629 - DNA, 22 bp, Artificial Sequence
  chemically synthesized
cttctcatttttcacatcatat

SEQ ID NO: 954630 - DNA, 22 bp, Artificial Sequence
  chemically synthesized
ttctcatttttcacatcatatc

SEQ ID NO: 954631 - DNA, 22 bp, Artificial Sequence
  chemically synthesized
ctcatttttcacatcatatcaa

SEQ ID NO: 954632 - DNA, 22 bp, Artificial Sequence
  chemically synthesized
tcatttttcacatcatatcaac

SEQ ID NO: 954633 - DNA, 22 bp, Artificial Sequence
  chemically synthesized
atttttcacatcatatcaacca

SEQ ID NO: 954634 - DNA, 22 bp, Artificial Sequence
  chemically synthesized
ttcacatcatatcaaccagtct

SEQ ID NO: 954635 - DNA, 22 bp, Artificial Sequence
  chemically synthesized
tcacatcatatcaaccagtctc

SEQ ID NO: 954636 - DNA, 22 bp, Artificial Sequence
  chemically synthesized
cacatcatatcaaccagtctct

SEQ ID NO: 954637 - DNA, 22 bp, Artificial Sequence
  chemically synthesized
caggaacagcaaagagactggt

SEQ ID NO: 954638 - DNA, 22 bp, Artificial Sequence
  chemically synthesized
acatcatatcaaccagtctctt

SEQ ID NO: 954639 - DNA, 22 bp, Artificial Sequence
  chemically synthesized
ttccaggaacagcaaagagact

SEQ ID NO: 954640 - DNA, 22 bp, Artificial Sequence
  chemically synthesized
tttgctgttcctggaacagcat

SEQ ID NO: 954641 - DNA, 22 bp, Artificial Sequence
  chemically synthesized
tgctgttcctggaacagcatat

SEQ ID NO: 954642 - DNA, 22 bp, Artificial Sequence
  chemically synthesized
gctgttcctggaacagcatatt

SEQ ID NO: 954643 - DNA, 22 bp, Artificial Sequence
  chemically synthesized
ctgttcctggaacagcatattc

SEQ ID NO: 954644 - DNA, 22 bp, Artificial Sequence
  chemically synthesized
ttcctggaacagcatattcaca

SEQ ID NO: 954645 - DNA, 22 bp, Artificial Sequence
  chemically synthesized
ctggaacagcatattcacatct

SEQ ID NO: 954646 - DNA, 22 bp, Artificial Sequence
  chemically synthesized
gaacagcatattcacatctctg

SEQ ID NO: 954647 - DNA, 22 bp, Artificial Sequence
  chemically synthesized
gtaagagccgaggcccagagat

SEQ ID NO: 954648 - DNA, 22 bp, Artificial Sequence
  chemically synthesized
acatctctgggcctcggctctt

SEQ ID NO: 954649 - DNA, 22 bp, Artificial Sequence
  chemically synthesized
tgggcctcggctcttactagtt

SEQ ID NO: 954650 - DNA, 22 bp, Artificial Sequence
  chemically synthesized
ggcctcggctcttactagttcc

SEQ ID NO: 954651 - DNA, 22 bp, Artificial Sequence
  chemically synthesized
ggctcttactagttccttatcc

SEQ ID NO: 954652 - DNA, 22 bp, Artificial Sequence
  chemically synthesized
aagaaatgagtcaggataagga

SEQ ID NO: 954653 - DNA, 22 bp, Artificial Sequence
  chemically synthesized
ttactagttccttatcctgact

SEQ ID NO: 954654 - DNA, 22 bp, Artificial Sequence
  chemically synthesized
tctaaagaaatgagtcaggata

SEQ ID NO: 954655 - DNA, 22 bp, Artificial Sequence
  chemically synthesized
actagttccttatcctgactca

SEQ ID NO: 954656 - DNA, 22 bp, Artificial Sequence
  chemically synthesized
ctagttccttatcctgactcat

SEQ ID NO: 954657 - DNA, 22 bp, Artificial Sequence
  chemically synthesized
ctatctaaagaaatgagtcagg

SEQ ID NO: 954658 - DNA, 22 bp, Artificial Sequence
  chemically synthesized
gttccttatcctgactcatttc

SEQ ID NO: 954659 - DNA, 22 bp, Artificial Sequence
  chemically synthesized
cttatcctgactcatttcttta

SEQ ID NO: 954660 - DNA, 22 bp, Artificial Sequence
  chemically synthesized
atcctgactcatttctttagat

SEQ ID NO: 954661 - DNA, 22 bp, Artificial Sequence
  chemically synthesized
tcctgactcatttctttagata

SEQ ID NO: 954662 - DNA, 22 bp, Artificial Sequence
  chemically synthesized
actcatttctttagatagtagc

SEQ ID NO: 954663 - DNA, 22 bp, Artificial Sequence
  chemically synthesized
atttctttagatagtagcatgt

SEQ ID NO: 954664 - DNA, 22 bp, Artificial Sequence
  chemically synthesized
ctttagatagtagcatgtttca

SEQ ID NO: 954665 - DNA, 22 bp, Artificial Sequence
  chemically synthesized
tttagatagtagcatgtttcat

SEQ ID NO: 954666 - DNA, 22 bp, Artificial Sequence
  chemically synthesized
tagatagtagcatgtttcattc

SEQ ID NO: 954667 - DNA, 22 bp, Artificial Sequence
  chemically synthesized
aatcaagtcaaggaatgaaaca

SEQ ID NO: 954668 - DNA, 22 bp, Artificial Sequence
  chemically synthesized
agatagtagcatgtttcattcc

SEQ ID NO: 954669 - DNA, 22 bp, Artificial Sequence
  chemically synthesized
gatagtagcatgtttcattcct

SEQ ID NO: 954670 - DNA, 22 bp, Artificial Sequence
  chemically synthesized
agcagagacctaaatcaagtca

SEQ ID NO: 954671 - DNA, 22 bp, Artificial Sequence
  chemically synthesized
cattccttgacttgatttaggt

SEQ ID NO: 954672 - DNA, 22 bp, Artificial Sequence
  chemically synthesized
attccttgacttgatttaggtc

SEQ ID NO: 954673 - DNA, 22 bp, Artificial Sequence
  chemically synthesized
cttgacttgatttaggtctctg

SEQ ID NO: 954674 - DNA, 22 bp, Artificial Sequence
  chemically synthesized
gacttgatttaggtctctgctc

SEQ ID NO: 954675 - DNA, 22 bp, Artificial Sequence
  chemically synthesized
acttgatttaggtctctgctca

SEQ ID NO: 954676 - DNA, 22 bp, Artificial Sequence
  chemically synthesized
agagtgtgacatctgagcagag

SEQ ID NO: 954677 - DNA, 22 bp, Artificial Sequence
  chemically synthesized
gatttaggtctctgctcagatg

SEQ ID NO: 954678 - DNA, 22 bp, Artificial Sequence
  chemically synthesized
atttaggtctctgctcagatgt

SEQ ID NO: 954679 - DNA, 22 bp, Artificial Sequence
  chemically synthesized
aggtctctgctcagatgtcaca

SEQ ID NO: 954680 - DNA, 22 bp, Artificial Sequence
  chemically synthesized
ggtctctgctcagatgtcacac

SEQ ID NO: 954681 - DNA, 22 bp, Artificial Sequence
  chemically synthesized
tgctcagatgtcacactctcag

SEQ ID NO: 954682 - DNA, 22 bp, Artificial Sequence
  chemically synthesized
ctcagatgtcacactctcagcc

SEQ ID NO: 954683 - DNA, 22 bp, Artificial Sequence
  chemically synthesized
agatgtcacactctcagcctcc

SEQ ID NO: 954684 - DNA, 22 bp, Artificial Sequence
  chemically synthesized
gcaagagtggtgaagagaggag

SEQ ID NO: 954685 - DNA, 22 bp, Artificial Sequence
  chemically synthesized
agcaagagtggtgaagagagga

SEQ ID NO: 954686 - DNA, 22 bp, Artificial Sequence
  chemically synthesized
tagcaagagtggtgaagagagg

SEQ ID NO: 954687 - DNA, 22 bp, Artificial Sequence
  chemically synthesized
tcagcctcctctcttcaccact

SEQ ID NO: 954688 - DNA, 22 bp, Artificial Sequence
  chemically synthesized
agcctcctctcttcaccactct

SEQ ID NO: 954689 - DNA, 22 bp, Artificial Sequence
  chemically synthesized
ctctcttcaccactcttgctaa

SEQ ID NO: 954690 - DNA, 22 bp, Artificial Sequence
  chemically synthesized
tcttcaccactcttgctaaaat

SEQ ID NO: 954691 - DNA, 22 bp, Artificial Sequence
  chemically synthesized
ttcaccactcttgctaaaatac

SEQ ID NO: 954692 - DNA, 22 bp, Artificial Sequence
  chemically synthesized
caccactcttgctaaaatactg

SEQ ID NO: 954693 - DNA, 22 bp, Artificial Sequence
  chemically synthesized
accactcttgctaaaatactgc

SEQ ID NO: 954694 - DNA, 22 bp, Artificial Sequence
  chemically synthesized
ttgctaaaatactgcttccctt

SEQ ID NO: 954695 - DNA, 22 bp, Artificial Sequence
  chemically synthesized
gctaaaatactgcttccctttt

SEQ ID NO: 954696 - DNA, 22 bp, Artificial Sequence
  chemically synthesized
ctaaaatactgcttcccttttt

SEQ ID NO: 954697 - DNA, 22 bp, Artificial Sequence
  chemically synthesized
aaatactgcttccctttttcct

SEQ ID NO: 954698 - DNA, 22 bp, Artificial Sequence
  chemically synthesized
cttccctttttcctttaccctg

SEQ ID NO: 954699 - DNA, 22 bp, Artificial Sequence
  chemically synthesized
ccctttttcctttaccctgatg

SEQ ID NO: 954700 - DNA, 22 bp, Artificial Sequence
  chemically synthesized
cctttttcctttaccctgatga

SEQ ID NO: 954701 - DNA, 22 bp, Artificial Sequence
  chemically synthesized
tttcctttaccctgatgatttt

SEQ ID NO: 954702 - DNA, 22 bp, Artificial Sequence
  chemically synthesized
ttcctttaccctgatgattttt

SEQ ID NO: 954703 - DNA, 22 bp, Artificial Sequence
  chemically synthesized
tcctttaccctgatgatttttt

SEQ ID NO: 954704 - DNA, 22 bp, Artificial Sequence
  chemically synthesized
aaagtacgatgaaaaaaatcat

SEQ ID NO: 954705 - DNA, 22 bp, Artificial Sequence
  chemically synthesized
cctttaccctgatgattttttt

SEQ ID NO: 954706 - DNA, 22 bp, Artificial Sequence
  chemically synthesized
ctttaccctgatgatttttttc

SEQ ID NO: 954707 - DNA, 22 bp, Artificial Sequence
  chemically synthesized
taccctgatgatttttttcatc

SEQ ID NO: 954708 - DNA, 22 bp, Artificial Sequence
  chemically synthesized
accctgatgatttttttcatcg

SEQ ID NO: 954709 - DNA, 22 bp, Artificial Sequence
  chemically synthesized
ccctgatgatttttttcatcgt

SEQ ID NO: 954710 - DNA, 22 bp, Artificial Sequence
  chemically synthesized
atgatttttttcatcgtacttt

SEQ ID NO: 954711 - DNA, 22 bp, Artificial Sequence
  chemically synthesized
ttttcatcgtacttttaatctg

SEQ ID NO: 954712 - DNA, 22 bp, Artificial Sequence
  chemically synthesized
tttcatcgtacttttaatctga

SEQ ID NO: 954713 - DNA, 22 bp, Artificial Sequence
  chemically synthesized
ttcatcgtacttttaatctgat

SEQ ID NO: 954714 - DNA, 22 bp, Artificial Sequence
  chemically synthesized
tcatcgtacttttaatctgata

SEQ ID NO: 954715 - DNA, 22 bp, Artificial Sequence
  chemically synthesized
catcgtacttttaatctgatat

SEQ ID NO: 954716 - DNA, 22 bp, Artificial Sequence
  chemically synthesized
atcgtacttttaatctgatatt

SEQ ID NO: 954717 - DNA, 22 bp, Artificial Sequence
  chemically synthesized
ttaatctgatattttatcatat

SEQ ID NO: 954718 - DNA, 22 bp, Artificial Sequence
  chemically synthesized
taatctgatattttatcatatt

SEQ ID NO: 954719 - DNA, 22 bp, Artificial Sequence
  chemically synthesized
aatctgatattttatcatattt

SEQ ID NO: 954720 - DNA, 22 bp, Artificial Sequence
  chemically synthesized
atctgatattttatcatattta

SEQ ID NO: 954721 - DNA, 22 bp, Artificial Sequence
  chemically synthesized
atattttatcatatttattggg

SEQ ID NO: 954722 - DNA, 22 bp, Artificial Sequence
  chemically synthesized
gcaggggaggcaaagaacccaa

SEQ ID NO: 954723 - DNA, 22 bp, Artificial Sequence
  chemically synthesized
tatcatatttattgggttcttt

SEQ ID NO: 954724 - DNA, 22 bp, Artificial Sequence
  chemically synthesized
agcaggggaggcaaagaaccca

SEQ ID NO: 954725 - DNA, 22 bp, Artificial Sequence
  chemically synthesized
atcatatttattgggttctttg

SEQ ID NO: 954726 - DNA, 22 bp, Artificial Sequence
  chemically synthesized
tagcaggggaggcaaagaaccc

SEQ ID NO: 954727 - DNA, 22 bp, Artificial Sequence
  chemically synthesized
tcatatttattgggttctttgc

SEQ ID NO: 954728 - DNA, 22 bp, Artificial Sequence
  chemically synthesized
cattttagcaggggaggcaaag

SEQ ID NO: 954729 - DNA, 22 bp, Artificial Sequence
  chemically synthesized
acattttagcaggggaggcaaa

SEQ ID NO: 954730 - DNA, 22 bp, Artificial Sequence
  chemically synthesized
attgggttctttgcctcccctg

SEQ ID NO: 954731 - DNA, 22 bp, Artificial Sequence
  chemically synthesized
ttgggttctttgcctcccctgc

SEQ ID NO: 954732 - DNA, 22 bp, Artificial Sequence
  chemically synthesized
ggttctttgcctcccctgctaa

SEQ ID NO: 954733 - DNA, 22 bp, Artificial Sequence
  chemically synthesized
tggaatttacattttagcaggg

SEQ ID NO: 954734 - DNA, 22 bp, Artificial Sequence
  chemically synthesized
ttgtggaatttacattttagca

SEQ ID NO: 954735 - DNA, 22 bp, Artificial Sequence
  chemically synthesized
tttgcctcccctgctaaaatgt

SEQ ID NO: 954736 - DNA, 22 bp, Artificial Sequence
  chemically synthesized
gttgtggaatttacattttagc

SEQ ID NO: 954737 - DNA, 22 bp, Artificial Sequence
  chemically synthesized
tgttgtggaatttacattttag

SEQ ID NO: 954738 - DNA, 22 bp, Artificial Sequence
  chemically synthesized
tgcctcccctgctaaaatgtaa

SEQ ID NO: 954739 - DNA, 22 bp, Artificial Sequence
  chemically synthesized
gcctcccctgctaaaatgtaaa

SEQ ID NO: 954740 - DNA, 22 bp, Artificial Sequence
  chemically synthesized
cctcccctgctaaaatgtaaat

SEQ ID NO: 954741 - DNA, 22 bp, Artificial Sequence
  chemically synthesized
ccctgctaaaatgtaaattcca

SEQ ID NO: 954742 - DNA, 22 bp, Artificial Sequence
  chemically synthesized
ctaaaatgtaaattccacaaca

SEQ ID NO: 954743 - DNA, 22 bp, Artificial Sequence
  chemically synthesized
aaatgtaaattccacaacaaag

SEQ ID NO: 954744 - DNA, 22 bp, Artificial Sequence
  chemically synthesized
cacaacaaagggacgttgtttt

SEQ ID NO: 954745 - DNA, 22 bp, Artificial Sequence
  chemically synthesized
caggtaccaggtatccatccat

SEQ ID NO: 954746 - DNA, 22 bp, Artificial Sequence
  chemically synthesized
ttgcaggtaccaggtatccatc

SEQ ID NO: 954747 - DNA, 22 bp, Artificial Sequence
  chemically synthesized
ttttctttatggatggatacct

SEQ ID NO: 954748 - DNA, 22 bp, Artificial Sequence
  chemically synthesized
gttgcaggtaccaggtatccat

SEQ ID NO: 954749 - DNA, 22 bp, Artificial Sequence
  chemically synthesized
tgttgcaggtaccaggtatcca

SEQ ID NO: 954750 - DNA, 22 bp, Artificial Sequence
  chemically synthesized
tctttatggatggatacctggt

SEQ ID NO: 954751 - DNA, 22 bp, Artificial Sequence
  chemically synthesized
ctttatggatggatacctggta

SEQ ID NO: 954752 - DNA, 22 bp, Artificial Sequence
  chemically synthesized
tttatggatggatacctggtac

SEQ ID NO: 954753 - DNA, 22 bp, Artificial Sequence
  chemically synthesized
tatggatggatacctggtacct

SEQ ID NO: 954754 - DNA, 22 bp, Artificial Sequence
  chemically synthesized
atggatggatacctggtacctg

SEQ ID NO: 954755 - DNA, 22 bp, Artificial Sequence
  chemically synthesized
tggatggatacctggtacctgc

SEQ ID NO: 954756 - DNA, 22 bp, Artificial Sequence
  chemically synthesized
tgccaggttttgttgcaggtac

SEQ ID NO: 954757 - DNA, 22 bp, Artificial Sequence
  chemically synthesized
gtacctgcaacaaaacctggca

SEQ ID NO: 954758 - DNA, 22 bp, Artificial Sequence
  chemically synthesized
gtcaatcagcctgtgccaggtt

SEQ ID NO: 954759 - DNA, 22 bp, Artificial Sequence
  chemically synthesized
caacaaaacctggcacaggctg

SEQ ID NO: 954760 - DNA, 22 bp, Artificial Sequence
  chemically synthesized
aaccaatactagtcaatcagcc

SEQ ID NO: 954761 - DNA, 22 bp, Artificial Sequence
  chemically synthesized
ttcaaccaatactagtcaatca

SEQ ID NO: 954762 - DNA, 22 bp, Artificial Sequence
  chemically synthesized
attcaaccaatactagtcaatc

SEQ ID NO: 954763 - DNA, 22 bp, Artificial Sequence
  chemically synthesized
ttattcaaccaatactagtcaa

SEQ ID NO: 954764 - DNA, 22 bp, Artificial Sequence
  chemically synthesized
gcacaggctgattgactagtat

SEQ ID NO: 954765 - DNA, 22 bp, Artificial Sequence
  chemically synthesized
ctcttattcaaccaatactagt

SEQ ID NO: 954766 - DNA, 22 bp, Artificial Sequence
  chemically synthesized
gctcttattcaaccaatactag

SEQ ID NO: 954767 - DNA, 22 bp, Artificial Sequence
  chemically synthesized
tgctcttattcaaccaatacta

SEQ ID NO: 954768 - DNA, 22 bp, Artificial Sequence
  chemically synthesized
ttgctcttattcaaccaatact

SEQ ID NO: 954769 - DNA, 22 bp, Artificial Sequence
  chemically synthesized
atttttgctcttattcaaccaa

SEQ ID NO: 954770 - DNA, 22 bp, Artificial Sequence
  chemically synthesized
attgactagtattggttgaata

SEQ ID NO: 954771 - DNA, 22 bp, Artificial Sequence
  chemically synthesized
actagtattggttgaataagag

SEQ ID NO: 954772 - DNA, 22 bp, Artificial Sequence
  chemically synthesized
gtattggttgaataagagcaaa

SEQ ID NO: 954773 - DNA, 22 bp, Artificial Sequence
  chemically synthesized
agtagtcattcatttttgctct

SEQ ID NO: 954774 - DNA, 22 bp, Artificial Sequence
  chemically synthesized
gttgaataagagcaaaaatgaa

SEQ ID NO: 954775 - DNA, 22 bp, Artificial Sequence
  chemically synthesized
aataagagcaaaaatgaatgac

SEQ ID NO: 954776 - DNA, 22 bp, Artificial Sequence
  chemically synthesized
gggtaaatctcagtagtcattc

SEQ ID NO: 954777 - DNA, 22 bp, Artificial Sequence
  chemically synthesized
agggtaaatctcagtagtcatt

SEQ ID NO: 954778 - DNA, 22 bp, Artificial Sequence
  chemically synthesized
tagggtaaatctcagtagtcat

SEQ ID NO: 954779 - DNA, 22 bp, Artificial Sequence
  chemically synthesized
aaaattttagggtaaatctcag

SEQ ID NO: 954780 - DNA, 22 bp, Artificial Sequence
  chemically synthesized
gaaaattttagggtaaatctca

SEQ ID NO: 954781 - DNA, 22 bp, Artificial Sequence
  chemically synthesized
ctgagatttaccctaaaatttt

SEQ ID NO: 954782 - DNA, 22 bp, Artificial Sequence
  chemically synthesized
agatttaccctaaaattttcaa

SEQ ID NO: 954783 - DNA, 22 bp, Artificial Sequence
  chemically synthesized
tacatcaaaatatttgaaaatt

SEQ ID NO: 954784 - DNA, 22 bp, Artificial Sequence
  chemically synthesized
atacatcaaaatatttgaaaat

SEQ ID NO: 954785 - DNA, 22 bp, Artificial Sequence
  chemically synthesized
tatacatcaaaatatttgaaaa

SEQ ID NO: 954786 - DNA, 22 bp, Artificial Sequence
  chemically synthesized
ttatacatcaaaatatttgaaa

SEQ ID NO: 954787 - DNA, 22 bp, Artificial Sequence
  chemically synthesized
accctaaaattttcaaatattt

SEQ ID NO: 954788 - DNA, 22 bp, Artificial Sequence
  chemically synthesized
ccctaaaattttcaaatatttt

SEQ ID NO: 954789 - DNA, 22 bp, Artificial Sequence
  chemically synthesized
tttttatacatcaaaatatttg

SEQ ID NO: 954790 - DNA, 22 bp, Artificial Sequence
  chemically synthesized
aaattttcaaatattttgatgt

SEQ ID NO: 954791 - DNA, 22 bp, Artificial Sequence
  chemically synthesized
atagactatttttatacatcaa

SEQ ID NO: 954792 - DNA, 22 bp, Artificial Sequence
  chemically synthesized
tcaaatattttgatgtataaaa

SEQ ID NO: 954793 - DNA, 22 bp, Artificial Sequence
  chemically synthesized
caaatattttgatgtataaaaa

SEQ ID NO: 954794 - DNA, 22 bp, Artificial Sequence
  chemically synthesized
aaatattttgatgtataaaaat

SEQ ID NO: 954795 - DNA, 22 bp, Artificial Sequence
  chemically synthesized
cattcatagactatttttatac

SEQ ID NO: 954796 - DNA, 22 bp, Artificial Sequence
  chemically synthesized
gttacattcatagactattttt

SEQ ID NO: 954797 - DNA, 22 bp, Artificial Sequence
  chemically synthesized
ggttacattcatagactatttt

SEQ ID NO: 954798 - DNA, 22 bp, Artificial Sequence
  chemically synthesized
tgatgtataaaaatagtctatg

SEQ ID NO: 954799 - DNA, 22 bp, Artificial Sequence
  chemically synthesized
gatgtataaaaatagtctatga

SEQ ID NO: 954800 - DNA, 22 bp, Artificial Sequence
  chemically synthesized
atgtataaaaatagtctatgaa

SEQ ID NO: 954801 - DNA, 22 bp, Artificial Sequence
  chemically synthesized
tccacacagtttggttacattc

SEQ ID NO: 954802 - DNA, 22 bp, Artificial Sequence
  chemically synthesized
tgtccacacagtttggttacat

SEQ ID NO: 954803 - DNA, 22 bp, Artificial Sequence
  chemically synthesized
tgaatgtaaccaaactgtgtgg

SEQ ID NO: 954804 - DNA, 22 bp, Artificial Sequence
  chemically synthesized
agaccccatcagcctctgtcca

SEQ ID NO: 954805 - DNA, 22 bp, Artificial Sequence
  chemically synthesized
gagaccccatcagcctctgtcc

SEQ ID NO: 954806 - DNA, 22 bp, Artificial Sequence
  chemically synthesized
tgtggacagaggctgatggggt

SEQ ID NO: 954807 - DNA, 22 bp, Artificial Sequence
  chemically synthesized
acatacacacaccacttgagac

SEQ ID NO: 954808 - DNA, 22 bp, Artificial Sequence
  chemically synthesized
cacatacacacaccacttgaga

SEQ ID NO: 954809 - DNA, 22 bp, Artificial Sequence
  chemically synthesized
cccttcacatacacacaccact

SEQ ID NO: 954810 - DNA, 22 bp, Artificial Sequence
  chemically synthesized
atggggtctcaagtggtgtgtg

SEQ ID NO: 954811 - DNA, 22 bp, Artificial Sequence
  chemically synthesized
acccttcacatacacacaccac

SEQ ID NO: 954812 - DNA, 22 bp, Artificial Sequence
  chemically synthesized
aaatgtcttacccttcacatac

SEQ ID NO: 954813 - DNA, 22 bp, Artificial Sequence
  chemically synthesized
aagtggtgtgtgtatgtgaagg

SEQ ID NO: 954814 - DNA, 22 bp, Artificial Sequence
  chemically synthesized
taaaatgtcttacccttcacat

SEQ ID NO: 954815 - DNA, 22 bp, Artificial Sequence
  chemically synthesized
ctaaaatgtcttacccttcaca

SEQ ID NO: 954816 - DNA, 22 bp, Artificial Sequence
  chemically synthesized
ttctaaaatgtcttacccttca

SEQ ID NO: 954817 - DNA, 22 bp, Artificial Sequence
  chemically synthesized
cttctaaaatgtcttacccttc

SEQ ID NO: 954818 - DNA, 22 bp, Artificial Sequence
  chemically synthesized
aaaatccagcataggtacttct

SEQ ID NO: 954819 - DNA, 22 bp, Artificial Sequence
  chemically synthesized
caaaatccagcataggtacttc

SEQ ID NO: 954820 - DNA, 22 bp, Artificial Sequence
  chemically synthesized
tagaagaagtacctatgctgga

SEQ ID NO: 954821 - DNA, 22 bp, Artificial Sequence
  chemically synthesized
agagtttcaaaatccagcatag

SEQ ID NO: 954822 - DNA, 22 bp, Artificial Sequence
  chemically synthesized
agaagaagtacctatgctggat

SEQ ID NO: 954823 - DNA, 22 bp, Artificial Sequence
  chemically synthesized
cagagtttcaaaatccagcata

SEQ ID NO: 954824 - DNA, 22 bp, Artificial Sequence
  chemically synthesized
gaagaagtacctatgctggatt

SEQ ID NO: 954825 - DNA, 22 bp, Artificial Sequence
  chemically synthesized
tcagagtttcaaaatccagcat

SEQ ID NO: 954826 - DNA, 22 bp, Artificial Sequence
  chemically synthesized
tcctttcagagtttcaaaatcc

SEQ ID NO: 954827 - DNA, 22 bp, Artificial Sequence
  chemically synthesized
gtcctttcagagtttcaaaatc

SEQ ID NO: 954828 - DNA, 22 bp, Artificial Sequence
  chemically synthesized
gtttgtcctttcagagtttcaa

SEQ ID NO: 954829 - DNA, 22 bp, Artificial Sequence
  chemically synthesized
tgctggattttgaaactctgaa

SEQ ID NO: 954830 - DNA, 22 bp, Artificial Sequence
  chemically synthesized
cattcgtttgtcctttcagagt

SEQ ID NO: 954831 - DNA, 22 bp, Artificial Sequence
  chemically synthesized
gattttgaaactctgaaaggac

SEQ ID NO: 954832 - DNA, 22 bp, Artificial Sequence
  chemically synthesized
cctccattcgtttgtcctttca

SEQ ID NO: 954833 - DNA, 22 bp, Artificial Sequence
  chemically synthesized
ccctccattcgtttgtcctttc

SEQ ID NO: 954834 - DNA, 22 bp, Artificial Sequence
  chemically synthesized
ttccctccattcgtttgtcctt

SEQ ID NO: 954835 - DNA, 22 bp, Artificial Sequence
  chemically synthesized
tgaaactctgaaaggacaaacg

SEQ ID NO: 954836 - DNA, 22 bp, Artificial Sequence
  chemically synthesized
cttccctccattcgtttgtcct

SEQ ID NO: 954837 - DNA, 22 bp, Artificial Sequence
  chemically synthesized
gaaactctgaaaggacaaacga

SEQ ID NO: 954838 - DNA, 22 bp, Artificial Sequence
  chemically synthesized
aaactctgaaaggacaaacgaa

SEQ ID NO: 954839 - DNA, 22 bp, Artificial Sequence
  chemically synthesized
tttcttccctccattcgtttgt

SEQ ID NO: 954840 - DNA, 22 bp, Artificial Sequence
  chemically synthesized
ctgtttcttccctccattcgtt

SEQ ID NO: 954841 - DNA, 22 bp, Artificial Sequence
  chemically synthesized
tgaaaggacaaacgaatggagg

SEQ ID NO: 954842 - DNA, 22 bp, Artificial Sequence
  chemically synthesized
aaaggacaaacgaatggaggga

SEQ ID NO: 954843 - DNA, 22 bp, Artificial Sequence
  chemically synthesized
aagtatcccgcagtctactgtt

SEQ ID NO: 954844 - DNA, 22 bp, Artificial Sequence
  chemically synthesized
tcaagtatcccgcagtctactg

SEQ ID NO: 954845 - DNA, 22 bp, Artificial Sequence
  chemically synthesized
gttctcaagtatcccgcagtct

SEQ ID NO: 954846 - DNA, 22 bp, Artificial Sequence
  chemically synthesized
tcgttctcaagtatcccgcagt

SEQ ID NO: 954847 - DNA, 22 bp, Artificial Sequence
  chemically synthesized
ctcgttctcaagtatcccgcag

SEQ ID NO: 954848 - DNA, 22 bp, Artificial Sequence
  chemically synthesized
ttctcgttctcaagtatcccgc

SEQ ID NO: 954849 - DNA, 22 bp, Artificial Sequence
  chemically synthesized
cttctcgttctcaagtatcccg

SEQ ID NO: 954850 - DNA, 22 bp, Artificial Sequence
  chemically synthesized
tttcttctcgttctcaagtatc

SEQ ID NO: 954851 - DNA, 22 bp, Artificial Sequence
  chemically synthesized
gtttcttctcgttctcaagtat

SEQ ID NO: 954852 - DNA, 22 bp, Artificial Sequence
  chemically synthesized
tttgtttcttctcgttctcaag

SEQ ID NO: 954853 - DNA, 22 bp, Artificial Sequence
  chemically synthesized
gtttgtttcttctcgttctcaa

SEQ ID NO: 954854 - DNA, 22 bp, Artificial Sequence
  chemically synthesized
tttgtttgtttcttctcgttct

SEQ ID NO: 954855 - DNA, 22 bp, Artificial Sequence
  chemically synthesized
cgggatacttgagaacgagaag

SEQ ID NO: 954856 - DNA, 22 bp, Artificial Sequence
  chemically synthesized
gtttgtttgtttcttctcgttc

SEQ ID NO: 954857 - DNA, 22 bp, Artificial Sequence
  chemically synthesized
tttgtttgtttgtttcttctcg

SEQ ID NO: 954858 - DNA, 22 bp, Artificial Sequence
  chemically synthesized
gtttgtttgtttgtttcttctc

SEQ ID NO: 954859 - DNA, 22 bp, Artificial Sequence
  chemically synthesized
tgtttgtttgtttgtttcttct

SEQ ID NO: 954860 - DNA, 22 bp, Artificial Sequence
  chemically synthesized
attttgtttgtttgtttgtttc

SEQ ID NO: 954861 - DNA, 22 bp, Artificial Sequence
  chemically synthesized
gagaacgagaagaaacaaacaa

SEQ ID NO: 954862 - DNA, 22 bp, Artificial Sequence
  chemically synthesized
agaacgagaagaaacaaacaaa

SEQ ID NO: 954863 - DNA, 22 bp, Artificial Sequence
  chemically synthesized
attcattttgtttgtttgtttg

SEQ ID NO: 954864 - DNA, 22 bp, Artificial Sequence
  chemically synthesized
cattcattttgtttgtttgttt

SEQ ID NO: 954865 - DNA, 22 bp, Artificial Sequence
  chemically synthesized
tcattcattttgtttgtttgtt

SEQ ID NO: 954866 - DNA, 22 bp, Artificial Sequence
  chemically synthesized
acagtggctttcattcattttg

SEQ ID NO: 954867 - DNA, 22 bp, Artificial Sequence
  chemically synthesized
caagaactgacagtggctttca

SEQ ID NO: 954868 - DNA, 22 bp, Artificial Sequence
  chemically synthesized
tgttccaagaactgacagtggc

SEQ ID NO: 954869 - DNA, 22 bp, Artificial Sequence
  chemically synthesized
tgtgttccaagaactgacagtg

SEQ ID NO: 954870 - DNA, 22 bp, Artificial Sequence
  chemically synthesized
ccaactctgtgttccaagaact

SEQ ID NO: 954871 - DNA, 22 bp, Artificial Sequence
  chemically synthesized
cccaactctgtgttccaagaac

SEQ ID NO: 954872 - DNA, 22 bp, Artificial Sequence
  chemically synthesized
tcccaactctgtgttccaagaa

SEQ ID NO: 954873 - DNA, 22 bp, Artificial Sequence
  chemically synthesized
tcagttcttggaacacagagtt

SEQ ID NO: 954874 - DNA, 22 bp, Artificial Sequence
  chemically synthesized
ttggaacacagagttgggaaaa

SEQ ID NO: 954875 - DNA, 22 bp, Artificial Sequence
  chemically synthesized
ggaacacagagttgggaaaatg

SEQ ID NO: 954876 - DNA, 22 bp, Artificial Sequence
  chemically synthesized
gaacacagagttgggaaaatgt

SEQ ID NO: 954877 - DNA, 22 bp, Artificial Sequence
  chemically synthesized
cagatatagataatacattttc

SEQ ID NO: 954878 - DNA, 22 bp, Artificial Sequence
  chemically synthesized
tccagatatagataatacattt

SEQ ID NO: 954879 - DNA, 22 bp, Artificial Sequence
  chemically synthesized
ctccagatatagataatacatt

SEQ ID NO: 954880 - DNA, 22 bp, Artificial Sequence
  chemically synthesized
agtatttctccagatatagata

SEQ ID NO: 954881 - DNA, 22 bp, Artificial Sequence
  chemically synthesized
ggaaaatgtattatctatatct

SEQ ID NO: 954882 - DNA, 22 bp, Artificial Sequence
  chemically synthesized
gagtatttctccagatatagat

SEQ ID NO: 954883 - DNA, 22 bp, Artificial Sequence
  chemically synthesized
acttgagtatttctccagatat

SEQ ID NO: 954884 - DNA, 22 bp, Artificial Sequence
  chemically synthesized
ccctgacttgagtatttctcca

SEQ ID NO: 954885 - DNA, 22 bp, Artificial Sequence
  chemically synthesized
cccctgacttgagtatttctcc

SEQ ID NO: 954886 - DNA, 22 bp, Artificial Sequence
  chemically synthesized
tctatatctggagaaatactca

SEQ ID NO: 954887 - DNA, 22 bp, Artificial Sequence
  chemically synthesized
cttcccctgacttgagtatttc

SEQ ID NO: 954888 - DNA, 22 bp, Artificial Sequence
  chemically synthesized
tccttcccctgacttgagtatt

SEQ ID NO: 954889 - DNA, 22 bp, Artificial Sequence
  chemically synthesized
tatctggagaaatactcaagtc

SEQ ID NO: 954890 - DNA, 22 bp, Artificial Sequence
  chemically synthesized
ttctccttcccctgacttgagt

SEQ ID NO: 954891 - DNA, 22 bp, Artificial Sequence
  chemically synthesized
gagaaatactcaagtcagggga

SEQ ID NO: 954892 - DNA, 22 bp, Artificial Sequence
  chemically synthesized
ccagtcatctgttctccttccc

SEQ ID NO: 954893 - DNA, 22 bp, Artificial Sequence
  chemically synthesized
attgccagtcatctgttctcct

SEQ ID NO: 954894 - DNA, 22 bp, Artificial Sequence
  chemically synthesized
aagtcaggggaaggagaacaga

SEQ ID NO: 954895 - DNA, 22 bp, Artificial Sequence
  chemically synthesized
cattgccagtcatctgttctcc

SEQ ID NO: 954896 - DNA, 22 bp, Artificial Sequence
  chemically synthesized
aggtcccttcattgccagtcat

SEQ ID NO: 954897 - DNA, 22 bp, Artificial Sequence
  chemically synthesized
gaggtcccttcattgccagtca

SEQ ID NO: 954898 - DNA, 22 bp, Artificial Sequence
  chemically synthesized
tgaggtcccttcattgccagtc

SEQ ID NO: 954899 - DNA, 22 bp, Artificial Sequence
  chemically synthesized
ctttgaggtcccttcattgcca

SEQ ID NO: 954900 - DNA, 22 bp, Artificial Sequence
  chemically synthesized
gctttgaggtcccttcattgcc

SEQ ID NO: 954901 - DNA, 22 bp, Artificial Sequence
  chemically synthesized
gaccttgctttgaggtcccttc

SEQ ID NO: 954902 - DNA, 22 bp, Artificial Sequence
  chemically synthesized
aattagaccttgctttgaggtc

SEQ ID NO: 954903 - DNA, 22 bp, Artificial Sequence
  chemically synthesized
gcaatgaagggacctcaaagca

SEQ ID NO: 954904 - DNA, 22 bp, Artificial Sequence
  chemically synthesized
aaatctcaattagaccttgctt

SEQ ID NO: 954905 - DNA, 22 bp, Artificial Sequence
  chemically synthesized
tctcaaatctcaattagacctt

SEQ ID NO: 954906 - DNA, 22 bp, Artificial Sequence
  chemically synthesized
ttgtctcaaatctcaattagac

SEQ ID NO: 954907 - DNA, 22 bp, Artificial Sequence
  chemically synthesized
aaagcaaggtctaattgagatt

SEQ ID NO: 954908 - DNA, 22 bp, Artificial Sequence
  chemically synthesized
attgagatttgagacaacagca

SEQ ID NO: 954909 - DNA, 22 bp, Artificial Sequence
  chemically synthesized
caagtggatgcatgctgttgtc

SEQ ID NO: 954910 - DNA, 22 bp, Artificial Sequence
  chemically synthesized
agatttgagacaacagcatgca

SEQ ID NO: 954911 - DNA, 22 bp, Artificial Sequence
  chemically synthesized
taagaactccaagtggatgcat

SEQ ID NO: 954912 - DNA, 22 bp, Artificial Sequence
  chemically synthesized
gagacaacagcatgcatccact

SEQ ID NO: 954913 - DNA, 22 bp, Artificial Sequence
  chemically synthesized
gtaagaactccaagtggatgca

SEQ ID NO: 954914 - DNA, 22 bp, Artificial Sequence
  chemically synthesized
agacaacagcatgcatccactt

SEQ ID NO: 954915 - DNA, 22 bp, Artificial Sequence
  chemically synthesized
tgtaagaactccaagtggatgc

SEQ ID NO: 954916 - DNA, 22 bp, Artificial Sequence
  chemically synthesized
tttgtaagaactccaagtggat

SEQ ID NO: 954917 - DNA, 22 bp, Artificial Sequence
  chemically synthesized
ctctttgtaagaactccaagtg

SEQ ID NO: 954918 - DNA, 22 bp, Artificial Sequence
  chemically synthesized
aacatagtattcctctttgtaa

SEQ ID NO: 954919 - DNA, 22 bp, Artificial Sequence
  chemically synthesized
ggagttcttacaaagaggaata

SEQ ID NO: 954920 - DNA, 22 bp, Artificial Sequence
  chemically synthesized
gagttcttacaaagaggaatac

SEQ ID NO: 954921 - DNA, 22 bp, Artificial Sequence
  chemically synthesized
ttacaaagaggaatactatgtt

SEQ ID NO: 954922 - DNA, 22 bp, Artificial Sequence
  chemically synthesized
acaaagaggaatactatgttca

SEQ ID NO: 954923 - DNA, 22 bp, Artificial Sequence
  chemically synthesized
caaagaggaatactatgttcaa

SEQ ID NO: 954924 - DNA, 22 bp, Artificial Sequence
  chemically synthesized
caaatgtacgagtcagttgaac

SEQ ID NO: 954925 - DNA, 22 bp, Artificial Sequence
  chemically synthesized
tgttcaactgactcgtacattt

SEQ ID NO: 954926 - DNA, 22 bp, Artificial Sequence
  chemically synthesized
acggacgtattacaaatgtacg

SEQ ID NO: 954927 - DNA, 22 bp, Artificial Sequence
  chemically synthesized
aacggacgtattacaaatgtac

SEQ ID NO: 954928 - DNA, 22 bp, Artificial Sequence
  chemically synthesized
taacggacgtattacaaatgta

SEQ ID NO: 954929 - DNA, 22 bp, Artificial Sequence
  chemically synthesized
ttaacggacgtattacaaatgt

SEQ ID NO: 954930 - DNA, 22 bp, Artificial Sequence
  chemically synthesized
aactgactcgtacatttgtaat

SEQ ID NO: 954931 - DNA, 22 bp, Artificial Sequence
  chemically synthesized
tttaacggacgtattacaaatg

SEQ ID NO: 954932 - DNA, 22 bp, Artificial Sequence
  chemically synthesized
ttttaacggacgtattacaaat

SEQ ID NO: 954933 - DNA, 22 bp, Artificial Sequence
  chemically synthesized
actcgtacatttgtaatacgtc

SEQ ID NO: 954934 - DNA, 22 bp, Artificial Sequence
  chemically synthesized
gtacatttgtaatacgtccgtt

SEQ ID NO: 954935 - DNA, 22 bp, Artificial Sequence
  chemically synthesized
gtaatacgtccgttaaaaaaac

SEQ ID NO: 954936 - DNA, 22 bp, Artificial Sequence
  chemically synthesized
taatacgtccgttaaaaaaacc

SEQ ID NO: 954937 - DNA, 22 bp, Artificial Sequence
  chemically synthesized
caatagcaatagggttttttta

SEQ ID NO: 954938 - DNA, 22 bp, Artificial Sequence
  chemically synthesized
ccaatagcaatagggttttttt

SEQ ID NO: 954939 - DNA, 22 bp, Artificial Sequence
  chemically synthesized
atttccaatagcaatagggttt

SEQ ID NO: 954940 - DNA, 22 bp, Artificial Sequence
  chemically synthesized
catactcatttccaatagcaat

SEQ ID NO: 954941 - DNA, 22 bp, Artificial Sequence
  chemically synthesized
ccatactcatttccaatagcaa

SEQ ID NO: 954942 - DNA, 22 bp, Artificial Sequence
  chemically synthesized
aaaaaaccctattgctattgga

SEQ ID NO: 954943 - DNA, 22 bp, Artificial Sequence
  chemically synthesized
tccatactcatttccaatagca

SEQ ID NO: 954944 - DNA, 22 bp, Artificial Sequence
  chemically synthesized
aaagctttccatactcatttcc

SEQ ID NO: 954945 - DNA, 22 bp, Artificial Sequence
  chemically synthesized
tgaaagctttccatactcattt

SEQ ID NO: 954946 - DNA, 22 bp, Artificial Sequence
  chemically synthesized
ttgctattggaaatgagtatgg

SEQ ID NO: 954947 - DNA, 22 bp, Artificial Sequence
  chemically synthesized
ctattggaaatgagtatggaaa

SEQ ID NO: 954948 - DNA, 22 bp, Artificial Sequence
  chemically synthesized
cattctgaaagctttccatact

SEQ ID NO: 954949 - DNA, 22 bp, Artificial Sequence
  chemically synthesized
ccattctgaaagctttccatac

SEQ ID NO: 954950 - DNA, 22 bp, Artificial Sequence
  chemically synthesized
ttggaaatgagtatggaaagct

SEQ ID NO: 954951 - DNA, 22 bp, Artificial Sequence
  chemically synthesized
gaaatgagtatggaaagctttc

SEQ ID NO: 954952 - DNA, 22 bp, Artificial Sequence
  chemically synthesized
ccaacaatggaataaaacttcc

SEQ ID NO: 954953 - DNA, 22 bp, Artificial Sequence
  chemically synthesized
accaacaatggaataaaacttc

SEQ ID NO: 954954 - DNA, 22 bp, Artificial Sequence
  chemically synthesized
tcagaatggaagttttattcca

SEQ ID NO: 954955 - DNA, 22 bp, Artificial Sequence
  chemically synthesized
cagaatggaagttttattccat

SEQ ID NO: 954956 - DNA, 22 bp, Artificial Sequence
  chemically synthesized
agaatggaagttttattccatt

SEQ ID NO: 954957 - DNA, 22 bp, Artificial Sequence
  chemically synthesized
caccccttaccaacaatggaat

SEQ ID NO: 954958 - DNA, 22 bp, Artificial Sequence
  chemically synthesized
ttgcaccccttaccaacaatgg

SEQ ID NO: 954959 - DNA, 22 bp, Artificial Sequence
  chemically synthesized
attgcaccccttaccaacaatg

SEQ ID NO: 954960 - DNA, 22 bp, Artificial Sequence
  chemically synthesized
tattccattgttggtaaggggt

SEQ ID NO: 954961 - DNA, 22 bp, Artificial Sequence
  chemically synthesized
attccattgttggtaaggggtg

SEQ ID NO: 954962 - DNA, 22 bp, Artificial Sequence
  chemically synthesized
ttccattgttggtaaggggtgc

SEQ ID NO: 954963 - DNA, 22 bp, Artificial Sequence
  chemically synthesized
cattgttggtaaggggtgcaat

SEQ ID NO: 954964 - DNA, 22 bp, Artificial Sequence
  chemically synthesized
tgcatgaataatttattgcacc

SEQ ID NO: 954965 - DNA, 22 bp, Artificial Sequence
  chemically synthesized
ttggtaaggggtgcaataaatt

SEQ ID NO: 954966 - DNA, 22 bp, Artificial Sequence
  chemically synthesized
gtaaggggtgcaataaattatt

SEQ ID NO: 954967 - DNA, 22 bp, Artificial Sequence
  chemically synthesized
cggttatgcatgaataatttat

SEQ ID NO: 954968 - DNA, 22 bp, Artificial Sequence
  chemically synthesized
tagttgcggttatgcatgaata

SEQ ID NO: 954969 - DNA, 22 bp, Artificial Sequence
  chemically synthesized
gtagttgcggttatgcatgaat

SEQ ID NO: 954970 - DNA, 22 bp, Artificial Sequence
  chemically synthesized
cttgtagttgcggttatgcatg

SEQ ID NO: 954971 - DNA, 22 bp, Artificial Sequence
  chemically synthesized
ccttgtagttgcggttatgcat

SEQ ID NO: 954972 - DNA, 22 bp, Artificial Sequence
  chemically synthesized
ttcatgcataaccgcaactaca

SEQ ID NO: 954973 - DNA, 22 bp, Artificial Sequence
  chemically synthesized
tgcccatttccttgtagttgcg

SEQ ID NO: 954974 - DNA, 22 bp, Artificial Sequence
  chemically synthesized
atgcccatttccttgtagttgc

SEQ ID NO: 954975 - DNA, 22 bp, Artificial Sequence
  chemically synthesized
tatgcccatttccttgtagttg

SEQ ID NO: 954976 - DNA, 22 bp, Artificial Sequence
  chemically synthesized
atgcataaccgcaactacaagg

SEQ ID NO: 954977 - DNA, 22 bp, Artificial Sequence
  chemically synthesized
tttatgcccatttccttgtagt

SEQ ID NO: 954978 - DNA, 22 bp, Artificial Sequence
  chemically synthesized
acctctttatgcccatttcctt

SEQ ID NO: 954979 - DNA, 22 bp, Artificial Sequence
  chemically synthesized
cctcacctctttatgcccattt

SEQ ID NO: 954980 - DNA, 22 bp, Artificial Sequence
  chemically synthesized
acctcacctctttatgcccatt

SEQ ID NO: 954981 - DNA, 22 bp, Artificial Sequence
  chemically synthesized
cttacctcacctctttatgccc

SEQ ID NO: 954982 - DNA, 22 bp, Artificial Sequence
  chemically synthesized
caaggaaatgggcataaagagg

SEQ ID NO: 954983 - DNA, 22 bp, Artificial Sequence
  chemically synthesized
ctacttacctcacctctttatg

SEQ ID NO: 954984 - DNA, 22 bp, Artificial Sequence
  chemically synthesized
ttcctacttacctcacctcttt

SEQ ID NO: 954985 - DNA, 22 bp, Artificial Sequence
  chemically synthesized
attcctacttacctcacctctt

SEQ ID NO: 954986 - DNA, 22 bp, Artificial Sequence
  chemically synthesized
gcacttattcctacttacctca

SEQ ID NO: 954987 - DNA, 22 bp, Artificial Sequence
  chemically synthesized
tatatgcactagcacttattcc

SEQ ID NO: 954988 - DNA, 22 bp, Artificial Sequence
  chemically synthesized
gtaattatatatgcactagcac

SEQ ID NO: 954989 - DNA, 22 bp, Artificial Sequence
  chemically synthesized
agtaattatatatgcactagca

SEQ ID NO: 954990 - DNA, 22 bp, Artificial Sequence
  chemically synthesized
catttagtaattatatatgcac

SEQ ID NO: 954991 - DNA, 22 bp, Artificial Sequence
  chemically synthesized
ccatttagtaattatatatgca

SEQ ID NO: 954992 - DNA, 22 bp, Artificial Sequence
  chemically synthesized
gtgcatatataattactaaatg

SEQ ID NO: 954993 - DNA, 22 bp, Artificial Sequence
  chemically synthesized
tcaaaccatttccatttagtaa

SEQ ID NO: 954994 - DNA, 22 bp, Artificial Sequence
  chemically synthesized
gtcaaaccatttccatttagta

SEQ ID NO: 954995 - DNA, 22 bp, Artificial Sequence
  chemically synthesized
tatcagacttgtcaaaccattt

SEQ ID NO: 954996 - DNA, 22 bp, Artificial Sequence
  chemically synthesized
gtatcagacttgtcaaaccatt

SEQ ID NO: 954997 - DNA, 22 bp, Artificial Sequence
  chemically synthesized
tgtatcagacttgtcaaaccat

SEQ ID NO: 954998 - DNA, 22 bp, Artificial Sequence
  chemically synthesized
ttgtatcagacttgtcaaacca

SEQ ID NO: 954999 - DNA, 22 bp, Artificial Sequence
  chemically synthesized
ctaaatggaaatggtttgacaa

SEQ ID NO: 955000 - DNA, 22 bp, Artificial Sequence
  chemically synthesized
tttgtatcagacttgtcaaacc

SEQ ID NO: 955001 - DNA, 22 bp, Artificial Sequence
  chemically synthesized
aatggaaatggtttgacaagtc

SEQ ID NO: 955002 - DNA, 22 bp, Artificial Sequence
  chemically synthesized
gggtccagagagcctttttgta

SEQ ID NO: 955003 - DNA, 22 bp, Artificial Sequence
  chemically synthesized
gacaagtctgatacaaaaaggc

SEQ ID NO: 955004 - DNA, 22 bp, Artificial Sequence
  chemically synthesized
acaagtctgatacaaaaaggct

SEQ ID NO: 955005 - DNA, 22 bp, Artificial Sequence
  chemically synthesized
aaattggggtccagagagcctt

SEQ ID NO: 955006 - DNA, 22 bp, Artificial Sequence
  chemically synthesized
gaaattggggtccagagagcct

SEQ ID NO: 955007 - DNA, 22 bp, Artificial Sequence
  chemically synthesized
tttgaaattggggtccagagag

SEQ ID NO: 955008 - DNA, 22 bp, Artificial Sequence
  chemically synthesized
atacaaaaaggctctctggacc

SEQ ID NO: 955009 - DNA, 22 bp, Artificial Sequence
  chemically synthesized
atttgaaattggggtccagaga

SEQ ID NO: 955010 - DNA, 22 bp, Artificial Sequence
  chemically synthesized
tatttgaaattggggtccagag

SEQ ID NO: 955011 - DNA, 22 bp, Artificial Sequence
  chemically synthesized
ttatttgaaattggggtccaga

SEQ ID NO: 955012 - DNA, 22 bp, Artificial Sequence
  chemically synthesized
aggtcttttatttgaaattggg

SEQ ID NO: 955013 - DNA, 22 bp, Artificial Sequence
  chemically synthesized
caggtcttttatttgaaattgg

SEQ ID NO: 955014 - DNA, 22 bp, Artificial Sequence
  chemically synthesized
tctggaccccaatttcaaataa

SEQ ID NO: 955015 - DNA, 22 bp, Artificial Sequence
  chemically synthesized
tggaccccaatttcaaataaaa

SEQ ID NO: 955016 - DNA, 22 bp, Artificial Sequence
  chemically synthesized
gaccccaatttcaaataaaaga

SEQ ID NO: 955017 - DNA, 22 bp, Artificial Sequence
  chemically synthesized
caaataaaagacctgaagtgat

SEQ ID NO: 955018 - DNA, 22 bp, Artificial Sequence
  chemically synthesized
aaataaaagacctgaagtgata

SEQ ID NO: 955019 - DNA, 22 bp, Artificial Sequence
  chemically synthesized
aagggataaggaataaatgtat

SEQ ID NO: 955020 - DNA, 22 bp, Artificial Sequence
  chemically synthesized
tgaagggataaggaataaatgt

SEQ ID NO: 955021 - DNA, 22 bp, Artificial Sequence
  chemically synthesized
aagtgatacatttattccttat

SEQ ID NO: 955022 - DNA, 22 bp, Artificial Sequence
  chemically synthesized
tagaaaatggagactctgaagg

SEQ ID NO: 955023 - DNA, 22 bp, Artificial Sequence
  chemically synthesized
atagaaaatggagactctgaag

SEQ ID NO: 955024 - DNA, 22 bp, Artificial Sequence
  chemically synthesized
attccttatcccttcagagtct

SEQ ID NO: 955025 - DNA, 22 bp, Artificial Sequence
  chemically synthesized
ttccttatcccttcagagtctc

SEQ ID NO: 955026 - DNA, 22 bp, Artificial Sequence
  chemically synthesized
gcttatagaaaatggagactct

SEQ ID NO: 955027 - DNA, 22 bp, Artificial Sequence
  chemically synthesized
cttatcccttcagagtctccat

SEQ ID NO: 955028 - DNA, 22 bp, Artificial Sequence
  chemically synthesized
atcccttcagagtctccatttt

SEQ ID NO: 955029 - DNA, 22 bp, Artificial Sequence
  chemically synthesized
tcccttcagagtctccattttc

SEQ ID NO: 955030 - DNA, 22 bp, Artificial Sequence
  chemically synthesized
cagagtctccattttctataag

SEQ ID NO: 955031 - DNA, 22 bp, Artificial Sequence
  chemically synthesized
agagtctccattttctataagc

SEQ ID NO: 955032 - DNA, 22 bp, Artificial Sequence
  chemically synthesized
tggagggggctcgcttatagaa

SEQ ID NO: 955033 - DNA, 22 bp, Artificial Sequence
  chemically synthesized
gtggagggggctcgcttataga

SEQ ID NO: 955034 - DNA, 22 bp, Artificial Sequence
  chemically synthesized
cattttctataagcgagccccc

SEQ ID NO: 955035 - DNA, 22 bp, Artificial Sequence
  chemically synthesized
atggtgcgtttgtggagggggc

SEQ ID NO: 955036 - DNA, 22 bp, Artificial Sequence
  chemically synthesized
tctataagcgagccccctccac

SEQ ID NO: 955037 - DNA, 22 bp, Artificial Sequence
  chemically synthesized
aatggtgcgtttgtggaggggg

SEQ ID NO: 955038 - DNA, 22 bp, Artificial Sequence
  chemically synthesized
ctataagcgagccccctccaca

SEQ ID NO: 955039 - DNA, 22 bp, Artificial Sequence
  chemically synthesized
tataagcgagccccctccacaa

SEQ ID NO: 955040 - DNA, 22 bp, Artificial Sequence
  chemically synthesized
taagcgagccccctccacaaac

SEQ ID NO: 955041 - DNA, 22 bp, Artificial Sequence
  chemically synthesized
tacaggtttaatggtgcgtttg

SEQ ID NO: 955042 - DNA, 22 bp, Artificial Sequence
  chemically synthesized
cacaaacgcaccattaaacctg

SEQ ID NO: 955043 - DNA, 22 bp, Artificial Sequence
  chemically synthesized
tcatagattgtacaggtttaat

SEQ ID NO: 955044 - DNA, 22 bp, Artificial Sequence
  chemically synthesized
ttgtcatagattgtacaggttt

SEQ ID NO: 955045 - DNA, 22 bp, Artificial Sequence
  chemically synthesized
ccattgttgtcatagattgtac

SEQ ID NO: 955046 - DNA, 22 bp, Artificial Sequence
  chemically synthesized
aacctgtacaatctatgacaac

SEQ ID NO: 955047 - DNA, 22 bp, Artificial Sequence
  chemically synthesized
gataaattcccattgttgtcat

SEQ ID NO: 955048 - DNA, 22 bp, Artificial Sequence
  chemically synthesized
ggataaattcccattgttgtca

SEQ ID NO: 955049 - DNA, 22 bp, Artificial Sequence
  chemically synthesized
tacaatctatgacaacaatggg

SEQ ID NO: 955050 - DNA, 22 bp, Artificial Sequence
  chemically synthesized
catcttggataaattcccattg

SEQ ID NO: 955051 - DNA, 22 bp, Artificial Sequence
  chemically synthesized
tgacaacaatgggaatttatcc

SEQ ID NO: 955052 - DNA, 22 bp, Artificial Sequence
  chemically synthesized
cgtctacatcttggataaattc

SEQ ID NO: 955053 - DNA, 22 bp, Artificial Sequence
  chemically synthesized
tacgtctacatcttggataaat

SEQ ID NO: 955054 - DNA, 22 bp, Artificial Sequence
  chemically synthesized
ctacgtctacatcttggataaa

SEQ ID NO: 955055 - DNA, 22 bp, Artificial Sequence
  chemically synthesized
acccatcacttctacgtctaca

SEQ ID NO: 955056 - DNA, 22 bp, Artificial Sequence
  chemically synthesized
gacccatcacttctacgtctac

SEQ ID NO: 955057 - DNA, 22 bp, Artificial Sequence
  chemically synthesized
tgacccatcacttctacgtcta

SEQ ID NO: 955058 - DNA, 22 bp, Artificial Sequence
  chemically synthesized
atccaagatgtagacgtagaag

SEQ ID NO: 955059 - DNA, 22 bp, Artificial Sequence
  chemically synthesized
tccaagatgtagacgtagaagt

SEQ ID NO: 955060 - DNA, 22 bp, Artificial Sequence
  chemically synthesized
tggatcactttgacccatcact

SEQ ID NO: 955061 - DNA, 22 bp, Artificial Sequence
  chemically synthesized
atgtgaactgtggatcactttg

SEQ ID NO: 955062 - DNA, 22 bp, Artificial Sequence
  chemically synthesized
atggtatctgatgtgaactgtg

SEQ ID NO: 955063 - DNA, 22 bp, Artificial Sequence
  chemically synthesized
aatggtatctgatgtgaactgt

SEQ ID NO: 955064 - DNA, 22 bp, Artificial Sequence
  chemically synthesized
taaaaacacttaatggtatctg

SEQ ID NO: 955065 - DNA, 22 bp, Artificial Sequence
  chemically synthesized
acatcagataccattaagtgtt

SEQ ID NO: 955066 - DNA, 22 bp, Artificial Sequence
  chemically synthesized
gaggaggtaaagagctataaaa

SEQ ID NO: 955067 - DNA, 22 bp, Artificial Sequence
  chemically synthesized
tactagaggaggtaaagagcta

SEQ ID NO: 955068 - DNA, 22 bp, Artificial Sequence
  chemically synthesized
atactagaggaggtaaagagct

SEQ ID NO: 955069 - DNA, 22 bp, Artificial Sequence
  chemically synthesized
agtgtttttatagctctttacc

SEQ ID NO: 955070 - DNA, 22 bp, Artificial Sequence
  chemically synthesized
agtccttatactagaggaggta

SEQ ID NO: 955071 - DNA, 22 bp, Artificial Sequence
  chemically synthesized
ttatagctctttacctcctcta

SEQ ID NO: 955072 - DNA, 22 bp, Artificial Sequence
  chemically synthesized
gagtccttatactagaggaggt

SEQ ID NO: 955073 - DNA, 22 bp, Artificial Sequence
  chemically synthesized
tatagctctttacctcctctag

SEQ ID NO: 955074 - DNA, 22 bp, Artificial Sequence
  chemically synthesized
tgagtccttatactagaggagg

SEQ ID NO: 955075 - DNA, 22 bp, Artificial Sequence
  chemically synthesized
atagctctttacctcctctagt

SEQ ID NO: 955076 - DNA, 22 bp, Artificial Sequence
  chemically synthesized
ttgagtccttatactagaggag

SEQ ID NO: 955077 - DNA, 22 bp, Artificial Sequence
  chemically synthesized
tagctctttacctcctctagta

SEQ ID NO: 955078 - DNA, 22 bp, Artificial Sequence
  chemically synthesized
tatttttgagtccttatactag

SEQ ID NO: 955079 - DNA, 22 bp, Artificial Sequence
  chemically synthesized
tttacctcctctagtataagga

SEQ ID NO: 955080 - DNA, 22 bp, Artificial Sequence
  chemically synthesized
tacctcctctagtataaggact

SEQ ID NO: 955081 - DNA, 22 bp, Artificial Sequence
  chemically synthesized
acctcctctagtataaggactc

SEQ ID NO: 955082 - DNA, 22 bp, Artificial Sequence
  chemically synthesized
cctcctctagtataaggactca

SEQ ID NO: 955083 - DNA, 22 bp, Artificial Sequence
  chemically synthesized
aagctgtatttttgagtcctta

SEQ ID NO: 955084 - DNA, 22 bp, Artificial Sequence
  chemically synthesized
ctctagtataaggactcaaaaa

SEQ ID NO: 955085 - DNA, 22 bp, Artificial Sequence
  chemically synthesized
tagtataaggactcaaaaatac

SEQ ID NO: 955086 - DNA, 22 bp, Artificial Sequence
  chemically synthesized
gatcattcaagctgtatttttg

SEQ ID NO: 955087 - DNA, 22 bp, Artificial Sequence
  chemically synthesized
gtataaggactcaaaaatacag

SEQ ID NO: 955088 - DNA, 22 bp, Artificial Sequence
  chemically synthesized
tggatcattcaagctgtatttt

SEQ ID NO: 955089 - DNA, 22 bp, Artificial Sequence
  chemically synthesized
ctggatcattcaagctgtattt

SEQ ID NO: 955090 - DNA, 22 bp, Artificial Sequence
  chemically synthesized
tctggatcattcaagctgtatt

SEQ ID NO: 955091 - DNA, 22 bp, Artificial Sequence
  chemically synthesized
aattttctggatcattcaagct

SEQ ID NO: 955092 - DNA, 22 bp, Artificial Sequence
  chemically synthesized
caattttctggatcattcaagc

SEQ ID NO: 955093 - DNA, 22 bp, Artificial Sequence
  chemically synthesized
aaaaatacagcttgaatgatcc

SEQ ID NO: 955094 - DNA, 22 bp, Artificial Sequence
  chemically synthesized
ataccttcaattttctggatca

SEQ ID NO: 955095 - DNA, 22 bp, Artificial Sequence
  chemically synthesized
aagcctgataccttcaattttc

SEQ ID NO: 955096 - DNA, 22 bp, Artificial Sequence
  chemically synthesized
gaatgatccagaaaattgaagg

SEQ ID NO: 955097 - DNA, 22 bp, Artificial Sequence
  chemically synthesized
aatgatccagaaaattgaaggt

SEQ ID NO: 955098 - DNA, 22 bp, Artificial Sequence
  chemically synthesized
ggtatcactaaagcctgatacc

SEQ ID NO: 955099 - DNA, 22 bp, Artificial Sequence
  chemically synthesized
ttaggtatcactaaagcctgat

SEQ ID NO: 955100 - DNA, 22 bp, Artificial Sequence
  chemically synthesized
attgttaggtatcactaaagcc

SEQ ID NO: 955101 - DNA, 22 bp, Artificial Sequence
  chemically synthesized
aaggtatcaggctttagtgata

SEQ ID NO: 955102 - DNA, 22 bp, Artificial Sequence
  chemically synthesized
atccaactaattgttaggtatc

SEQ ID NO: 955103 - DNA, 22 bp, Artificial Sequence
  chemically synthesized
tagtgatacctaacaattagtt

SEQ ID NO: 955104 - DNA, 22 bp, Artificial Sequence
  chemically synthesized
agtgatacctaacaattagttg

SEQ ID NO: 955105 - DNA, 22 bp, Artificial Sequence
  chemically synthesized
gtgatacctaacaattagttgg

SEQ ID NO: 955106 - DNA, 22 bp, Artificial Sequence
  chemically synthesized
aagtgcagaacctcatccaact

SEQ ID NO: 955107 - DNA, 22 bp, Artificial Sequence
  chemically synthesized
caagtgcagaacctcatccaac

SEQ ID NO: 955108 - DNA, 22 bp, Artificial Sequence
  chemically synthesized
acaattagttggatgaggttct

SEQ ID NO: 955109 - DNA, 22 bp, Artificial Sequence
  chemically synthesized
gttggatgaggttctgcacttg

SEQ ID NO: 955110 - DNA, 22 bp, Artificial Sequence
  chemically synthesized
gatgaggttctgcacttgaagg

SEQ ID NO: 955111 - DNA, 22 bp, Artificial Sequence
  chemically synthesized
aaaaaccaagtgcccttcaagt

SEQ ID NO: 955112 - DNA, 22 bp, Artificial Sequence
  chemically synthesized
ctgaaaaaccaagtgcccttca

SEQ ID NO: 955113 - DNA, 22 bp, Artificial Sequence
  chemically synthesized
cctgaaaaaccaagtgcccttc

SEQ ID NO: 955114 - DNA, 22 bp, Artificial Sequence
  chemically synthesized
cttcctgaaaaaccaagtgccc

SEQ ID NO: 955115 - DNA, 22 bp, Artificial Sequence
  chemically synthesized
ccttcctgaaaaaccaagtgcc

SEQ ID NO: 955116 - DNA, 22 bp, Artificial Sequence
  chemically synthesized
tgcacttgaagggcacttggtt

SEQ ID NO: 955117 - DNA, 22 bp, Artificial Sequence
  chemically synthesized
cacttgaagggcacttggtttt

SEQ ID NO: 955118 - DNA, 22 bp, Artificial Sequence
  chemically synthesized
gaagggcacttggtttttcagg

SEQ ID NO: 955119 - DNA, 22 bp, Artificial Sequence
  chemically synthesized
aagggcacttggtttttcagga

SEQ ID NO: 955120 - DNA, 22 bp, Artificial Sequence
  chemically synthesized
aaaaaaaatcttccttcctgaa

SEQ ID NO: 955121 - DNA, 22 bp, Artificial Sequence
  chemically synthesized
ctgaaaaaaaatcttccttcct

SEQ ID NO: 955122 - DNA, 22 bp, Artificial Sequence
  chemically synthesized
ggtttttcaggaaggaagattt

SEQ ID NO: 955123 - DNA, 22 bp, Artificial Sequence
  chemically synthesized
gtttttcaggaaggaagatttt

SEQ ID NO: 955124 - DNA, 22 bp, Artificial Sequence
  chemically synthesized
ttcaggaaggaagatttttttt

SEQ ID NO: 955125 - DNA, 22 bp, Artificial Sequence
  chemically synthesized
tcaggaaggaagattttttttc

SEQ ID NO: 955126 - DNA, 22 bp, Artificial Sequence
  chemically synthesized
caggaaggaagattttttttca

SEQ ID NO: 955127 - DNA, 22 bp, Artificial Sequence
  chemically synthesized
aggaaggaagattttttttcag

SEQ ID NO: 955128 - DNA, 22 bp, Artificial Sequence
  chemically synthesized
tttttcagtaatttttgtattc

SEQ ID NO: 955129 - DNA, 22 bp, Artificial Sequence
  chemically synthesized
ttttcagtaatttttgtattct

SEQ ID NO: 955130 - DNA, 22 bp, Artificial Sequence
  chemically synthesized
tttcagtaatttttgtattctt

SEQ ID NO: 955131 - DNA, 22 bp, Artificial Sequence
  chemically synthesized
ttcagtaatttttgtattctta

SEQ ID NO: 955132 - DNA, 22 bp, Artificial Sequence
  chemically synthesized
tcagtaatttttgtattcttac

SEQ ID NO: 955133 - DNA, 22 bp, Artificial Sequence
  chemically synthesized
cagtaatttttgtattcttact

SEQ ID NO: 955134 - DNA, 22 bp, Artificial Sequence
  chemically synthesized
agtaatttttgtattcttactg

SEQ ID NO: 955135 - DNA, 22 bp, Artificial Sequence
  chemically synthesized
ttgtattcttactggggtgttc

SEQ ID NO: 955136 - DNA, 22 bp, Artificial Sequence
  chemically synthesized
tgtattcttactggggtgttcc

SEQ ID NO: 955137 - DNA, 22 bp, Artificial Sequence
  chemically synthesized
gtattcttactggggtgttcct

SEQ ID NO: 955138 - DNA, 22 bp, Artificial Sequence
  chemically synthesized
tattcttactggggtgttcctt

SEQ ID NO: 955139 - DNA, 22 bp, Artificial Sequence
  chemically synthesized
ttactggggtgttccttacact

SEQ ID NO: 955140 - DNA, 22 bp, Artificial Sequence
  chemically synthesized
gggatggaatacagtgtaagga

SEQ ID NO: 955141 - DNA, 22 bp, Artificial Sequence
  chemically synthesized
agggatggaatacagtgtaagg

SEQ ID NO: 955142 - DNA, 22 bp, Artificial Sequence
  chemically synthesized
actggggtgttccttacactgt

SEQ ID NO: 955143 - DNA, 22 bp, Artificial Sequence
  chemically synthesized
ctggggtgttccttacactgta

SEQ ID NO: 955144 - DNA, 22 bp, Artificial Sequence
  chemically synthesized
ttagggatggaatacagtgtaa

SEQ ID NO: 955145 - DNA, 22 bp, Artificial Sequence
  chemically synthesized
cttagggatggaatacagtgta

SEQ ID NO: 955146 - DNA, 22 bp, Artificial Sequence
  chemically synthesized
tcttagggatggaatacagtgt

SEQ ID NO: 955147 - DNA, 22 bp, Artificial Sequence
  chemically synthesized
gggtgttccttacactgtattc

SEQ ID NO: 955148 - DNA, 22 bp, Artificial Sequence
  chemically synthesized
cttacactgtattccatcccta

SEQ ID NO: 955149 - DNA, 22 bp, Artificial Sequence
  chemically synthesized
acactgtattccatccctaaga

SEQ ID NO: 955150 - DNA, 22 bp, Artificial Sequence
  chemically synthesized
cactgtattccatccctaagaa

SEQ ID NO: 955151 - DNA, 22 bp, Artificial Sequence
  chemically synthesized
tattccatccctaagaaaatgc

SEQ ID NO: 955152 - DNA, 22 bp, Artificial Sequence
  chemically synthesized
ataatgaaaaagtagcattttc

SEQ ID NO: 955153 - DNA, 22 bp, Artificial Sequence
  chemically synthesized
catccctaagaaaatgctactt

SEQ ID NO: 955154 - DNA, 22 bp, Artificial Sequence
  chemically synthesized
agaaaatgctactttttcatta

SEQ ID NO: 955155 - DNA, 22 bp, Artificial Sequence
  chemically synthesized
ctttttcattatcagttgtatt

SEQ ID NO: 955156 - DNA, 22 bp, Artificial Sequence
  chemically synthesized
gatgtcaagatacaatacaact

SEQ ID NO: 955157 - DNA, 22 bp, Artificial Sequence
  chemically synthesized
tttcattatcagttgtattgta

SEQ ID NO: 955158 - DNA, 22 bp, Artificial Sequence
  chemically synthesized
ttcattatcagttgtattgtat

SEQ ID NO: 955159 - DNA, 22 bp, Artificial Sequence
  chemically synthesized
tcattatcagttgtattgtatc

SEQ ID NO: 955160 - DNA, 22 bp, Artificial Sequence
  chemically synthesized
cattatcagttgtattgtatct

SEQ ID NO: 955161 - DNA, 22 bp, Artificial Sequence
  chemically synthesized
attatcagttgtattgtatctt

SEQ ID NO: 955162 - DNA, 22 bp, Artificial Sequence
  chemically synthesized
ccaattagatgtcaagatacaa

SEQ ID NO: 955163 - DNA, 22 bp, Artificial Sequence
  chemically synthesized
tcagttgtattgtatcttgaca

SEQ ID NO: 955164 - DNA, 22 bp, Artificial Sequence
  chemically synthesized
tattgtatcttgacatctaatt

SEQ ID NO: 955165 - DNA, 22 bp, Artificial Sequence
  chemically synthesized
tatcttgacatctaattggcaa

SEQ ID NO: 955166 - DNA, 22 bp, Artificial Sequence
  chemically synthesized
tagagaaatgtggtgtattgcc

SEQ ID NO: 955167 - DNA, 22 bp, Artificial Sequence
  chemically synthesized
gacatctaattggcaatacacc

SEQ ID NO: 955168 - DNA, 22 bp, Artificial Sequence
  chemically synthesized
atagagaaatgtggtgtattgc

SEQ ID NO: 955169 - DNA, 22 bp, Artificial Sequence
  chemically synthesized
acatctaattggcaatacacca

SEQ ID NO: 955170 - DNA, 22 bp, Artificial Sequence
  chemically synthesized
attggcaatacaccacatttct

SEQ ID NO: 955171 - DNA, 22 bp, Artificial Sequence
  chemically synthesized
gcaatacaccacatttctctat

SEQ ID NO: 955172 - DNA, 22 bp, Artificial Sequence
  chemically synthesized
aacgagataatttatagagaaa

SEQ ID NO: 955173 - DNA, 22 bp, Artificial Sequence
  chemically synthesized
aaacgagataatttatagagaa

SEQ ID NO: 955174 - DNA, 22 bp, Artificial Sequence
  chemically synthesized
tttaaacgagataatttataga

SEQ ID NO: 955175 - DNA, 22 bp, Artificial Sequence
  chemically synthesized
ctctataaattatctcgtttaa

SEQ ID NO: 955176 - DNA, 22 bp, Artificial Sequence
  chemically synthesized
tctataaattatctcgtttaaa

SEQ ID NO: 955177 - DNA, 22 bp, Artificial Sequence
  chemically synthesized
ggaaagtaactgtttaaacgag

SEQ ID NO: 955178 - DNA, 22 bp, Artificial Sequence
  chemically synthesized
tataaattatctcgtttaaaca

SEQ ID NO: 955179 - DNA, 22 bp, Artificial Sequence
  chemically synthesized
taaattatctcgtttaaacagt

SEQ ID NO: 955180 - DNA, 22 bp, Artificial Sequence
  chemically synthesized
actaggaaagtaactgtttaaa

SEQ ID NO: 955181 - DNA, 22 bp, Artificial Sequence
  chemically synthesized
aactaggaaagtaactgtttaa

SEQ ID NO: 955182 - DNA, 22 bp, Artificial Sequence
  chemically synthesized
tctcgtttaaacagttactttc

SEQ ID NO: 955183 - DNA, 22 bp, Artificial Sequence
  chemically synthesized
aatatacttaactaggaaagta

SEQ ID NO: 955184 - DNA, 22 bp, Artificial Sequence
  chemically synthesized
gtttaaacagttactttcctag

SEQ ID NO: 955185 - DNA, 22 bp, Artificial Sequence
  chemically synthesized
ttaaatatacttaactaggaaa

SEQ ID NO: 955186 - DNA, 22 bp, Artificial Sequence
  chemically synthesized
aaacagttactttcctagttaa

SEQ ID NO: 955187 - DNA, 22 bp, Artificial Sequence
  chemically synthesized
aacagttactttcctagttaag

SEQ ID NO: 955188 - DNA, 22 bp, Artificial Sequence
  chemically synthesized
agttgttaaatatacttaacta

SEQ ID NO: 955189 - DNA, 22 bp, Artificial Sequence
  chemically synthesized
ctttcctagttaagtatattta

SEQ ID NO: 955190 - DNA, 22 bp, Artificial Sequence
  chemically synthesized
tcctagttaagtatatttaaca

SEQ ID NO: 955191 - DNA, 22 bp, Artificial Sequence
  chemically synthesized
cctagttaagtatatttaacaa

SEQ ID NO: 955192 - DNA, 22 bp, Artificial Sequence
  chemically synthesized
tcagaatctaagttgttaaata

SEQ ID NO: 955193 - DNA, 22 bp, Artificial Sequence
  chemically synthesized
ctagttaagtatatttaacaac

SEQ ID NO: 955194 - DNA, 22 bp, Artificial Sequence
  chemically synthesized
gttaagtatatttaacaactta

SEQ ID NO: 955195 - DNA, 22 bp, Artificial Sequence
  chemically synthesized
agtatatttaacaacttagatt

SEQ ID NO: 955196 - DNA, 22 bp, Artificial Sequence
  chemically synthesized
aaaaactgtcagaatctaagtt

SEQ ID NO: 955197 - DNA, 22 bp, Artificial Sequence
  chemically synthesized
ttaaaaaactgtcagaatctaa

SEQ ID NO: 955198 - DNA, 22 bp, Artificial Sequence
  chemically synthesized
attaaaaaactgtcagaatcta

SEQ ID NO: 955199 - DNA, 22 bp, Artificial Sequence
  chemically synthesized
aacaacttagattctgacagtt

SEQ ID NO: 955200 - DNA, 22 bp, Artificial Sequence
  chemically synthesized
acaacttagattctgacagttt

SEQ ID NO: 955201 - DNA, 22 bp, Artificial Sequence
  chemically synthesized
agattctgacagttttttaata

SEQ ID NO: 955202 - DNA, 22 bp, Artificial Sequence
  chemically synthesized
gattctgacagttttttaataa

SEQ ID NO: 955203 - DNA, 22 bp, Artificial Sequence
  chemically synthesized
tgacagttttttaataaacgta

SEQ ID NO: 955204 - DNA, 22 bp, Artificial Sequence
  chemically synthesized
aaaataccaaaatacgtttatt

SEQ ID NO: 955205 - DNA, 22 bp, Artificial Sequence
  chemically synthesized
acagttttttaataaacgtatt

SEQ ID NO: 955206 - DNA, 22 bp, Artificial Sequence
  chemically synthesized
attaaaaataccaaaatacgtt

SEQ ID NO: 955207 - DNA, 22 bp, Artificial Sequence
  chemically synthesized
aattaaaaataccaaaatacgt

SEQ ID NO: 955208 - DNA, 22 bp, Artificial Sequence
  chemically synthesized
taattaaaaataccaaaatacg

SEQ ID NO: 955209 - DNA, 22 bp, Artificial Sequence
  chemically synthesized
tttaataaacgtattttggtat

SEQ ID NO: 955210 - DNA, 22 bp, Artificial Sequence
  chemically synthesized
ttaataaacgtattttggtatt

SEQ ID NO: 955211 - DNA, 22 bp, Artificial Sequence
  chemically synthesized
attttaattaaaaataccaaaa

SEQ ID NO: 955212 - DNA, 22 bp, Artificial Sequence
  chemically synthesized
taataaacgtattttggtattt

SEQ ID NO: 955213 - DNA, 22 bp, Artificial Sequence
  chemically synthesized
aataaacgtattttggtatttt

SEQ ID NO: 955214 - DNA, 22 bp, Artificial Sequence
  chemically synthesized
ataaacgtattttggtattttt

SEQ ID NO: 955215 - DNA, 22 bp, Artificial Sequence
  chemically synthesized
ctgattttaattaaaaatacca

SEQ ID NO: 955216 - DNA, 22 bp, Artificial Sequence
  chemically synthesized
tactgattttaattaaaaatac

SEQ ID NO: 955217 - DNA, 22 bp, Artificial Sequence
  chemically synthesized
tactctactgattttaattaaa

SEQ ID NO: 955218 - DNA, 22 bp, Artificial Sequence
  chemically synthesized
atactctactgattttaattaa

SEQ ID NO: 955219 - DNA, 22 bp, Artificial Sequence
  chemically synthesized
tttatactctactgattttaat

SEQ ID NO: 955220 - DNA, 22 bp, Artificial Sequence
  chemically synthesized
tggtatttttaattaaaatcag

SEQ ID NO: 955221 - DNA, 22 bp, Artificial Sequence
  chemically synthesized
gtttatactctactgattttaa

SEQ ID NO: 955222 - DNA, 22 bp, Artificial Sequence
  chemically synthesized
ggtatttttaattaaaatcagt

SEQ ID NO: 955223 - DNA, 22 bp, Artificial Sequence
  chemically synthesized
gtatttttaattaaaatcagta

SEQ ID NO: 955224 - DNA, 22 bp, Artificial Sequence
  chemically synthesized
tttgtttatactctactgattt

SEQ ID NO: 955225 - DNA, 22 bp, Artificial Sequence
  chemically synthesized
tatttgtttatactctactgat

SEQ ID NO: 955226 - DNA, 22 bp, Artificial Sequence
  chemically synthesized
ctatttgtttatactctactga

SEQ ID NO: 955227 - DNA, 22 bp, Artificial Sequence
  chemically synthesized
ttaattaaaatcagtagagtat

SEQ ID NO: 955228 - DNA, 22 bp, Artificial Sequence
  chemically synthesized
taattaaaatcagtagagtata

SEQ ID NO: 955229 - DNA, 22 bp, Artificial Sequence
  chemically synthesized
aattaaaatcagtagagtataa

SEQ ID NO: 955230 - DNA, 22 bp, Artificial Sequence
  chemically synthesized
attaaaatcagtagagtataaa

SEQ ID NO: 955231 - DNA, 22 bp, Artificial Sequence
  chemically synthesized
gtgtgtttctatttgtttatac

SEQ ID NO: 955232 - DNA, 22 bp, Artificial Sequence
  chemically synthesized
aaatcagtagagtataaacaaa

SEQ ID NO: 955233 - DNA, 22 bp, Artificial Sequence
  chemically synthesized
agtgtgtttctatttgtttata

SEQ ID NO: 955234 - DNA, 22 bp, Artificial Sequence
  chemically synthesized
tagtgtgtttctatttgtttat

SEQ ID NO: 955235 - DNA, 22 bp, Artificial Sequence
  chemically synthesized
tctttagtgtgtttctatttgt

SEQ ID NO: 955236 - DNA, 22 bp, Artificial Sequence
  chemically synthesized
aaatgcataattgtctttagtg

SEQ ID NO: 955237 - DNA, 22 bp, Artificial Sequence
  chemically synthesized
ttaaaatgcataattgtcttta

SEQ ID NO: 955238 - DNA, 22 bp, Artificial Sequence
  chemically synthesized
attaaaatgcataattgtcttt

SEQ ID NO: 955239 - DNA, 22 bp, Artificial Sequence
  chemically synthesized
tattaaaatgcataattgtctt

SEQ ID NO: 955240 - DNA, 22 bp, Artificial Sequence
  chemically synthesized
ttttattaaaatgcataattgt

SEQ ID NO: 955241 - DNA, 22 bp, Artificial Sequence
  chemically synthesized
gttttattaaaatgcataattg

SEQ ID NO: 955242 - DNA, 22 bp, Artificial Sequence
  chemically synthesized
cacatttgttttattaaaatgc

SEQ ID NO: 955243 - DNA, 22 bp, Artificial Sequence
  chemically synthesized
aagacaattatgcattttaata

SEQ ID NO: 955244 - DNA, 22 bp, Artificial Sequence
  chemically synthesized
cggacctgcacatttgttttat

SEQ ID NO: 955245 - DNA, 22 bp, Artificial Sequence
  chemically synthesized
ccggacctgcacatttgtttta

SEQ ID NO: 955246 - DNA, 22 bp, Artificial Sequence
  chemically synthesized
tgcattttaataaaacaaatgt

SEQ ID NO: 955247 - DNA, 22 bp, Artificial Sequence
  chemically synthesized
taataaaacaaatgtgcaggtc

SEQ ID NO: 955248 - DNA, 22 bp, Artificial Sequence
  chemically synthesized
tgaacatttccggacctgcaca

SEQ ID NO: 955249 - DNA, 22 bp, Artificial Sequence
  chemically synthesized
aataaaacaaatgtgcaggtcc

SEQ ID NO: 955250 - DNA, 22 bp, Artificial Sequence
  chemically synthesized
ataaaacaaatgtgcaggtccg

SEQ ID NO: 955251 - DNA, 22 bp, Artificial Sequence
  chemically synthesized
aaggtaaataaaatcaagagtc

SEQ ID NO: 955252 - DNA, 22 bp, Artificial Sequence
  chemically synthesized
atagactcttgattttatttac

SEQ ID NO: 955253 - DNA, 22 bp, Artificial Sequence
  chemically synthesized
gtataatactaaaggtaaataa

SEQ ID NO: 955254 - DNA, 22 bp, Artificial Sequence
  chemically synthesized
ggtataatactaaaggtaaata

SEQ ID NO: 955255 - DNA, 22 bp, Artificial Sequence
  chemically synthesized
ttgattttatttacctttagta

SEQ ID NO: 955256 - DNA, 22 bp, Artificial Sequence
  chemically synthesized
gattttatttacctttagtatt

SEQ ID NO: 955257 - DNA, 22 bp, Artificial Sequence
  chemically synthesized
attttatttacctttagtatta

SEQ ID NO: 955258 - DNA, 22 bp, Artificial Sequence
  chemically synthesized
gtcacatttggtataatactaa

SEQ ID NO: 955259 - DNA, 22 bp, Artificial Sequence
  chemically synthesized
tatttacctttagtattatacc

SEQ ID NO: 955260 - DNA, 22 bp, Artificial Sequence
  chemically synthesized
atttacctttagtattatacca

SEQ ID NO: 955261 - DNA, 22 bp, Artificial Sequence
  chemically synthesized
tttacctttagtattataccaa

SEQ ID NO: 955262 - DNA, 22 bp, Artificial Sequence
  chemically synthesized
acctttagtattataccaaatg

SEQ ID NO: 955263 - DNA, 22 bp, Artificial Sequence
  chemically synthesized
cctttagtattataccaaatgt

SEQ ID NO: 955264 - DNA, 22 bp, Artificial Sequence
  chemically synthesized
aaaaatgactggtcacatttgg

SEQ ID NO: 955265 - DNA, 22 bp, Artificial Sequence
  chemically synthesized
gaaaaatgactggtcacatttg

SEQ ID NO: 955266 - DNA, 22 bp, Artificial Sequence
  chemically synthesized
tagtattataccaaatgtgacc

SEQ ID NO: 955267 - DNA, 22 bp, Artificial Sequence
  chemically synthesized
agtattataccaaatgtgacca

SEQ ID NO: 955268 - DNA, 22 bp, Artificial Sequence
  chemically synthesized
gtattataccaaatgtgaccag

SEQ ID NO: 955269 - DNA, 22 bp, Artificial Sequence
  chemically synthesized
aaatttgaaaaatgactggtca

SEQ ID NO: 955270 - DNA, 22 bp, Artificial Sequence
  chemically synthesized
taccaaatgtgaccagtcattt

SEQ ID NO: 955271 - DNA, 22 bp, Artificial Sequence
  chemically synthesized
ttcaaatttgagcatggattat

SEQ ID NO: 955272 - DNA, 22 bp, Artificial Sequence
  chemically synthesized
tcaaatttgagcatggattatg

SEQ ID NO: 955273 - DNA, 22 bp, Artificial Sequence
  chemically synthesized
caaatttgagcatggattatgt

SEQ ID NO: 955274 - DNA, 22 bp, Artificial Sequence
  chemically synthesized
aaatttgagcatggattatgtt

SEQ ID NO: 955275 - DNA, 22 bp, Artificial Sequence
  chemically synthesized
atataggcagaaaaaaaacata

SEQ ID NO: 955276 - DNA, 22 bp, Artificial Sequence
  chemically synthesized
gatataggcagaaaaaaaacat

SEQ ID NO: 955277 - DNA, 22 bp, Artificial Sequence
  chemically synthesized
gagcatggattatgtttttttt

SEQ ID NO: 955278 - DNA, 22 bp, Artificial Sequence
  chemically synthesized
agcatggattatgttttttttc

SEQ ID NO: 955279 - DNA, 22 bp, Artificial Sequence
  chemically synthesized
tttgatataggcagaaaaaaaa

SEQ ID NO: 955280 - DNA, 22 bp, Artificial Sequence
  chemically synthesized
tactatttgatataggcagaaa

SEQ ID NO: 955281 - DNA, 22 bp, Artificial Sequence
  chemically synthesized
tgttttttttctgcctatatca

SEQ ID NO: 955282 - DNA, 22 bp, Artificial Sequence
  chemically synthesized
gacccctatactatttgatata

SEQ ID NO: 955283 - DNA, 22 bp, Artificial Sequence
  chemically synthesized
ggacccctatactatttgatat

SEQ ID NO: 955284 - DNA, 22 bp, Artificial Sequence
  chemically synthesized
tttttctgcctatatcaaatag

SEQ ID NO: 955285 - DNA, 22 bp, Artificial Sequence
  chemically synthesized
tggacccctatactatttgata

SEQ ID NO: 955286 - DNA, 22 bp, Artificial Sequence
  chemically synthesized
ttttctgcctatatcaaatagt

SEQ ID NO: 955287 - DNA, 22 bp, Artificial Sequence
  chemically synthesized
tttctgcctatatcaaatagta

SEQ ID NO: 955288 - DNA, 22 bp, Artificial Sequence
  chemically synthesized
ttctgcctatatcaaatagtat

SEQ ID NO: 955289 - DNA, 22 bp, Artificial Sequence
  chemically synthesized
ttttggacccctatactatttg

SEQ ID NO: 955290 - DNA, 22 bp, Artificial Sequence
  chemically synthesized
tctgcctatatcaaatagtata

SEQ ID NO: 955291 - DNA, 22 bp, Artificial Sequence
  chemically synthesized
ctgcctatatcaaatagtatag

SEQ ID NO: 955292 - DNA, 22 bp, Artificial Sequence
  chemically synthesized
tgcctatatcaaatagtatagg

SEQ ID NO: 955293 - DNA, 22 bp, Artificial Sequence
  chemically synthesized
cctatatcaaatagtatagggg

SEQ ID NO: 955294 - DNA, 22 bp, Artificial Sequence
  chemically synthesized
aaaacctgttttggacccctat

SEQ ID NO: 955295 - DNA, 22 bp, Artificial Sequence
  chemically synthesized
tatcaaatagtataggggtcca

SEQ ID NO: 955296 - DNA, 22 bp, Artificial Sequence
  chemically synthesized
cctaaaaacctgttttggaccc

SEQ ID NO: 955297 - DNA, 22 bp, Artificial Sequence
  chemically synthesized
ataactccctaaaaacctgttt

SEQ ID NO: 955298 - DNA, 22 bp, Artificial Sequence
  chemically synthesized
aataactccctaaaaacctgtt

SEQ ID NO: 955299 - DNA, 22 bp, Artificial Sequence
  chemically synthesized
tagacttaataactccctaaaa

SEQ ID NO: 955300 - DNA, 22 bp, Artificial Sequence
  chemically synthesized
tatagacttaataactccctaa

SEQ ID NO: 955301 - DNA, 22 bp, Artificial Sequence
  chemically synthesized
ctatagacttaataactcccta

SEQ ID NO: 955302 - DNA, 22 bp, Artificial Sequence
  chemically synthesized
tctatagacttaataactccct

SEQ ID NO: 955303 - DNA, 22 bp, Artificial Sequence
  chemically synthesized
ttagggagttattaagtctata

SEQ ID NO: 955304 - DNA, 22 bp, Artificial Sequence
  chemically synthesized
tagggagttattaagtctatag

SEQ ID NO: 955305 - DNA, 22 bp, Artificial Sequence
  chemically synthesized
agggagttattaagtctataga

SEQ ID NO: 955306 - DNA, 22 bp, Artificial Sequence
  chemically synthesized
aaagcataattttctatagact

SEQ ID NO: 955307 - DNA, 22 bp, Artificial Sequence
  chemically synthesized
gggagttattaagtctatagaa

SEQ ID NO: 955308 - DNA, 22 bp, Artificial Sequence
  chemically synthesized
ctaaaagcataattttctatag

SEQ ID NO: 955309 - DNA, 22 bp, Artificial Sequence
  chemically synthesized
cctaaaagcataattttctata

SEQ ID NO: 955310 - DNA, 22 bp, Artificial Sequence
  chemically synthesized
ttaagtctatagaaaattatgc

SEQ ID NO: 955311 - DNA, 22 bp, Artificial Sequence
  chemically synthesized
agtctatagaaaattatgcttt

SEQ ID NO: 955312 - DNA, 22 bp, Artificial Sequence
  chemically synthesized
tagaaaattatgcttttaggaa

SEQ ID NO: 955313 - DNA, 22 bp, Artificial Sequence
  chemically synthesized
gcataagcacaacacttcctaa

SEQ ID NO: 955314 - DNA, 22 bp, Artificial Sequence
  chemically synthesized
ggcataagcacaacacttccta

SEQ ID NO: 955315 - DNA, 22 bp, Artificial Sequence
  chemically synthesized
tgcttttaggaagtgttgtgct

SEQ ID NO: 955316 - DNA, 22 bp, Artificial Sequence
  chemically synthesized
ccacttggcataagcacaacac

SEQ ID NO: 955317 - DNA, 22 bp, Artificial Sequence
  chemically synthesized
tcccacttggcataagcacaac

SEQ ID NO: 955318 - DNA, 22 bp, Artificial Sequence
  chemically synthesized
ctcccacttggcataagcacaa

SEQ ID NO: 955319 - DNA, 22 bp, Artificial Sequence
  chemically synthesized
ttaggaagtgttgtgcttatgc

SEQ ID NO: 955320 - DNA, 22 bp, Artificial Sequence
  chemically synthesized
taggaagtgttgtgcttatgcc

SEQ ID NO: 955321 - DNA, 22 bp, Artificial Sequence
  chemically synthesized
aggaagtgttgtgcttatgcca

SEQ ID NO: 955322 - DNA, 22 bp, Artificial Sequence
  chemically synthesized
ggaagtgttgtgcttatgccaa

SEQ ID NO: 955323 - DNA, 22 bp, Artificial Sequence
  chemically synthesized
tgcttctcccacttggcataag

SEQ ID NO: 955324 - DNA, 22 bp, Artificial Sequence
  chemically synthesized
ttatgcttctcccacttggcat

SEQ ID NO: 955325 - DNA, 22 bp, Artificial Sequence
  chemically synthesized
ttattatgcttctcccacttgg

SEQ ID NO: 955326 - DNA, 22 bp, Artificial Sequence
  chemically synthesized
attattatgcttctcccacttg

SEQ ID NO: 955327 - DNA, 22 bp, Artificial Sequence
  chemically synthesized
tattattatgcttctcccactt

SEQ ID NO: 955328 - DNA, 22 bp, Artificial Sequence
  chemically synthesized
tgcttatgccaagtgggagaag

SEQ ID NO: 955329 - DNA, 22 bp, Artificial Sequence
  chemically synthesized
tattttattattatgcttctcc

SEQ ID NO: 955330 - DNA, 22 bp, Artificial Sequence
  chemically synthesized
gtattttattattatgcttctc

SEQ ID NO: 955331 - DNA, 22 bp, Artificial Sequence
  chemically synthesized
atgccaagtgggagaagcataa

SEQ ID NO: 955332 - DNA, 22 bp, Artificial Sequence
  chemically synthesized
tgtattttattattatgcttct

SEQ ID NO: 955333 - DNA, 22 bp, Artificial Sequence
  chemically synthesized
tgccaagtgggagaagcataat

SEQ ID NO: 955334 - DNA, 22 bp, Artificial Sequence
  chemically synthesized
taaactttgtattttattatta

SEQ ID NO: 955335 - DNA, 22 bp, Artificial Sequence
  chemically synthesized
gtaaactttgtattttattatt

SEQ ID NO: 955336 - DNA, 22 bp, Artificial Sequence
  chemically synthesized
ggcagtataatttgtaaacttt

SEQ ID NO: 955337 - DNA, 22 bp, Artificial Sequence
  chemically synthesized
tataacctaggcagtataattt

SEQ ID NO: 955338 - DNA, 22 bp, Artificial Sequence
  chemically synthesized
acaaattatactgcctaggtta

SEQ ID NO: 955339 - DNA, 22 bp, Artificial Sequence
  chemically synthesized
caaattatactgcctaggttat

SEQ ID NO: 955340 - DNA, 22 bp, Artificial Sequence
  chemically synthesized
tgtagtaattgtataacctagg

SEQ ID NO: 955341 - DNA, 22 bp, Artificial Sequence
  chemically synthesized
aattatgtagtaattgtataac

SEQ ID NO: 955342 - DNA, 22 bp, Artificial Sequence
  chemically synthesized
caattatgtagtaattgtataa

SEQ ID NO: 955343 - DNA, 22 bp, Artificial Sequence
  chemically synthesized
tactgcctaggttatacaatta

SEQ ID NO: 955344 - DNA, 22 bp, Artificial Sequence
  chemically synthesized
tcaattatgtagtaattgtata

SEQ ID NO: 955345 - DNA, 22 bp, Artificial Sequence
  chemically synthesized
ttttcaattatgtagtaattgt

SEQ ID NO: 955346 - DNA, 22 bp, Artificial Sequence
  chemically synthesized
attttcaattatgtagtaattg

SEQ ID NO: 955347 - DNA, 22 bp, Artificial Sequence
  chemically synthesized
cctaggttatacaattactaca

SEQ ID NO: 955348 - DNA, 22 bp, Artificial Sequence
  chemically synthesized
tattttcaattatgtagtaatt

SEQ ID NO: 955349 - DNA, 22 bp, Artificial Sequence
  chemically synthesized
ggttatacaattactacataat

SEQ ID NO: 955350 - DNA, 22 bp, Artificial Sequence
  chemically synthesized
aattttattttcaattatgtag

SEQ ID NO: 955351 - DNA, 22 bp, Artificial Sequence
  chemically synthesized
tacaattactacataattgaaa

SEQ ID NO: 955352 - DNA, 22 bp, Artificial Sequence
  chemically synthesized
ctacataattgaaaataaaatt

SEQ ID NO: 955353 - DNA, 22 bp, Artificial Sequence
  chemically synthesized
cataattgaaaataaaatttaa

SEQ ID NO: 955354 - DNA, 22 bp, Artificial Sequence
  chemically synthesized
aaaataaaatttaactgctgtg

SEQ ID NO: 955355 - DNA, 22 bp, Artificial Sequence
  chemically synthesized
atatagataaatgatgtacaca

SEQ ID NO: 955356 - DNA, 22 bp, Artificial Sequence
  chemically synthesized
gatatagataaatgatgtacac

SEQ ID NO: 955357 - DNA, 22 bp, Artificial Sequence
  chemically synthesized
tgatatagataaatgatgtaca

SEQ ID NO: 955358 - DNA, 22 bp, Artificial Sequence
  chemically synthesized
aactgctgtgtacatcatttat

SEQ ID NO: 955359 - DNA, 22 bp, Artificial Sequence
  chemically synthesized
actgctgtgtacatcatttatc

SEQ ID NO: 955360 - DNA, 22 bp, Artificial Sequence
  chemically synthesized
ctgtgtacatcatttatctata

SEQ ID NO: 955361 - DNA, 22 bp, Artificial Sequence
  chemically synthesized
tgtacatcatttatctatatca

SEQ ID NO: 955362 - DNA, 22 bp, Artificial Sequence
  chemically synthesized
agcataggtaactttgatatag

SEQ ID NO: 955363 - DNA, 22 bp, Artificial Sequence
  chemically synthesized
aaattaagcataggtaactttg

SEQ ID NO: 955364 - DNA, 22 bp, Artificial Sequence
  chemically synthesized
caaattaagcataggtaacttt

SEQ ID NO: 955365 - DNA, 22 bp, Artificial Sequence
  chemically synthesized
atctatatcaaagttacctatg

SEQ ID NO: 955366 - DNA, 22 bp, Artificial Sequence
  chemically synthesized
tctatatcaaagttacctatgc

SEQ ID NO: 955367 - DNA, 22 bp, Artificial Sequence
  chemically synthesized
tatcaaagttacctatgcttaa

SEQ ID NO: 955368 - DNA, 22 bp, Artificial Sequence
  chemically synthesized
cagtgatttcaaattaagcata

SEQ ID NO: 955369 - DNA, 22 bp, Artificial Sequence
  chemically synthesized
ttacagtgatttcaaattaagc

SEQ ID NO: 955370 - DNA, 22 bp, Artificial Sequence
  chemically synthesized
cctatgcttaatttgaaatcac

SEQ ID NO: 955371 - DNA, 22 bp, Artificial Sequence
  chemically synthesized
tcagcattattacagtgatttc

SEQ ID NO: 955372 - DNA, 22 bp, Artificial Sequence
  chemically synthesized
atcagcattattacagtgattt

SEQ ID NO: 955373 - DNA, 22 bp, Artificial Sequence
  chemically synthesized
tgcttaatttgaaatcactgta

SEQ ID NO: 955374 - DNA, 22 bp, Artificial Sequence
  chemically synthesized
atttatcagcattattacagtg

SEQ ID NO: 955375 - DNA, 22 bp, Artificial Sequence
  chemically synthesized
catttatcagcattattacagt

SEQ ID NO: 955376 - DNA, 22 bp, Artificial Sequence
  chemically synthesized
aatttgaaatcactgtaataat

SEQ ID NO: 955377 - DNA, 22 bp, Artificial Sequence
  chemically synthesized
tcatttatcagcattattacag

SEQ ID NO: 955378 - DNA, 22 bp, Artificial Sequence
  chemically synthesized
atttgaaatcactgtaataatg

SEQ ID NO: 955379 - DNA, 22 bp, Artificial Sequence
  chemically synthesized
tttcatttatcagcattattac

SEQ ID NO: 955380 - DNA, 22 bp, Artificial Sequence
  chemically synthesized
gaaatcactgtaataatgctga

SEQ ID NO: 955381 - DNA, 22 bp, Artificial Sequence
  chemically synthesized
aaatcactgtaataatgctgat

SEQ ID NO: 955382 - DNA, 22 bp, Artificial Sequence
  chemically synthesized
aattctttcatttatcagcatt

SEQ ID NO: 955383 - DNA, 22 bp, Artificial Sequence
  chemically synthesized
taataatgctgataaatgaaag

SEQ ID NO: 955384 - DNA, 22 bp, Artificial Sequence
  chemically synthesized
atgtagaaatcaattcaattct

SEQ ID NO: 955385 - DNA, 22 bp, Artificial Sequence
  chemically synthesized
aatgtagaaatcaattcaattc

SEQ ID NO: 955386 - DNA, 22 bp, Artificial Sequence
  chemically synthesized
taatgtagaaatcaattcaatt

SEQ ID NO: 955387 - DNA, 22 bp, Artificial Sequence
  chemically synthesized
ataaatgaaagaattgaattga

SEQ ID NO: 955388 - DNA, 22 bp, Artificial Sequence
  chemically synthesized
tacattttaatgtagaaatcaa

SEQ ID NO: 955389 - DNA, 22 bp, Artificial Sequence
  chemically synthesized
attgtacattttaatgtagaaa

SEQ ID NO: 955390 - DNA, 22 bp, Artificial Sequence
  chemically synthesized
aattgtacattttaatgtagaa

SEQ ID NO: 955391 - DNA, 22 bp, Artificial Sequence
  chemically synthesized
aattgatttctacattaaaatg

SEQ ID NO: 955392 - DNA, 22 bp, Artificial Sequence
  chemically synthesized
gcaggtttaattgtacatttta

SEQ ID NO: 955393 - DNA, 22 bp, Artificial Sequence
  chemically synthesized
agcaggtttaattgtacatttt

SEQ ID NO: 955394 - DNA, 22 bp, Artificial Sequence
  chemically synthesized
atttctacattaaaatgtacaa

SEQ ID NO: 955395 - DNA, 22 bp, Artificial Sequence
  chemically synthesized
ctacattaaaatgtacaattaa

SEQ ID NO: 955396 - DNA, 22 bp, Artificial Sequence
  chemically synthesized
tacattaaaatgtacaattaaa

SEQ ID NO: 955397 - DNA, 22 bp, Artificial Sequence
  chemically synthesized
catatttagcaggtttaattgt

SEQ ID NO: 955398 - DNA, 22 bp, Artificial Sequence
  chemically synthesized
cattaaaatgtacaattaaacc

SEQ ID NO: 955399 - DNA, 22 bp, Artificial Sequence
  chemically synthesized
aaatgtacaattaaacctgcta

SEQ ID NO: 955400 - DNA, 22 bp, Artificial Sequence
  chemically synthesized
aacctgctaaatatgcaactgt

SEQ ID NO: 955401 - DNA, 22 bp, Artificial Sequence
  chemically synthesized
ctaaatatgcaactgtactttt

SEQ ID NO: 955402 - DNA, 22 bp, Artificial Sequence
  chemically synthesized
aatatgcaactgtactttttat

SEQ ID NO: 955403 - DNA, 22 bp, Artificial Sequence
  chemically synthesized
caataaaggcacatataaaaag

SEQ ID NO: 955404 - DNA, 22 bp, Artificial Sequence
  chemically synthesized
ctacaataaaggcacatataaa

SEQ ID NO: 955405 - DNA, 22 bp, Artificial Sequence
  chemically synthesized
actacaataaaggcacatataa

SEQ ID NO: 955406 - DNA, 22 bp, Artificial Sequence
  chemically synthesized
tccttactacaataaaggcaca

SEQ ID NO: 955407 - DNA, 22 bp, Artificial Sequence
  chemically synthesized
tactttttatatgtgcctttat

SEQ ID NO: 955408 - DNA, 22 bp, Artificial Sequence
  chemically synthesized
tatccttactacaataaaggca

SEQ ID NO: 955409 - DNA, 22 bp, Artificial Sequence
  chemically synthesized
ctatccttactacaataaaggc

SEQ ID NO: 955410 - DNA, 22 bp, Artificial Sequence
  chemically synthesized
tttatatgtgcctttattgtag

SEQ ID NO: 955411 - DNA, 22 bp, Artificial Sequence
  chemically synthesized
ttatatgtgcctttattgtagt

SEQ ID NO: 955412 - DNA, 22 bp, Artificial Sequence
  chemically synthesized
tatatgtgcctttattgtagta

SEQ ID NO: 955413 - DNA, 22 bp, Artificial Sequence
  chemically synthesized
atatgtgcctttattgtagtaa

SEQ ID NO: 955414 - DNA, 22 bp, Artificial Sequence
  chemically synthesized
tatgtgcctttattgtagtaag

SEQ ID NO: 955415 - DNA, 22 bp, Artificial Sequence
  chemically synthesized
caatcaacaatttctatcctta

SEQ ID NO: 955416 - DNA, 22 bp, Artificial Sequence
  chemically synthesized
acaatcaacaatttctatcctt

SEQ ID NO: 955417 - DNA, 22 bp, Artificial Sequence
  chemically synthesized
tattgtagtaaggatagaaatt

SEQ ID NO: 955418 - DNA, 22 bp, Artificial Sequence
  chemically synthesized
attgtagtaaggatagaaattg

SEQ ID NO: 955419 - DNA, 22 bp, Artificial Sequence
  chemically synthesized
ttgtagtaaggatagaaattgt

SEQ ID NO: 955420 - DNA, 22 bp, Artificial Sequence
  chemically synthesized
catttacaatcaacaatttcta

SEQ ID NO: 955421 - DNA, 22 bp, Artificial Sequence
  chemically synthesized
acatttacaatcaacaatttct

SEQ ID NO: 955422 - DNA, 22 bp, Artificial Sequence
  chemically synthesized
tagtaaggatagaaattgttga

SEQ ID NO: 955423 - DNA, 22 bp, Artificial Sequence
  chemically synthesized
tagaacataaggtttacattta

SEQ ID NO: 955424 - DNA, 22 bp, Artificial Sequence
  chemically synthesized
atagaacataaggtttacattt

SEQ ID NO: 955425 - DNA, 22 bp, Artificial Sequence
  chemically synthesized
cttatagaacataaggtttaca

SEQ ID NO: 955426 - DNA, 22 bp, Artificial Sequence
  chemically synthesized
ttgattgtaaatgtaaacctta

SEQ ID NO: 955427 - DNA, 22 bp, Artificial Sequence
  chemically synthesized
attgtaaatgtaaaccttatgt

SEQ ID NO: 955428 - DNA, 22 bp, Artificial Sequence
  chemically synthesized
taaatgtaaaccttatgttcta

SEQ ID NO: 955429 - DNA, 22 bp, Artificial Sequence
  chemically synthesized
agaaatcattccttatagaaca

SEQ ID NO: 955430 - DNA, 22 bp, Artificial Sequence
  chemically synthesized
aagaaatcattccttatagaac

SEQ ID NO: 955431 - DNA, 22 bp, Artificial Sequence
  chemically synthesized
taagaaatcattccttatagaa

SEQ ID NO: 955432 - DNA, 22 bp, Artificial Sequence
  chemically synthesized
ttaagaaatcattccttataga

SEQ ID NO: 955433 - DNA, 22 bp, Artificial Sequence
  chemically synthesized
tttaagaaatcattccttatag

SEQ ID NO: 955434 - DNA, 22 bp, Artificial Sequence
  chemically synthesized
cctttttaagaaatcattcctt

SEQ ID NO: 955435 - DNA, 22 bp, Artificial Sequence
  chemically synthesized
atgttctataaggaatgatttc

SEQ ID NO: 955436 - DNA, 22 bp, Artificial Sequence
  chemically synthesized
tgttctataaggaatgatttct

SEQ ID NO: 955437 - DNA, 22 bp, Artificial Sequence
  chemically synthesized
tataaggaatgatttcttaaaa

SEQ ID NO: 955438 - DNA, 22 bp, Artificial Sequence
  chemically synthesized
taatagactccctttttaagaa

SEQ ID NO: 955439 - DNA, 22 bp, Artificial Sequence
  chemically synthesized
taaggaatgatttcttaaaaag

SEQ ID NO: 955440 - DNA, 22 bp, Artificial Sequence
  chemically synthesized
attgtaatagactcccttttta

SEQ ID NO: 955441 - DNA, 22 bp, Artificial Sequence
  chemically synthesized
ctgattgtaatagactcccttt

SEQ ID NO: 955442 - DNA, 22 bp, Artificial Sequence
  chemically synthesized
cttaaaaagggagtctattaca

SEQ ID NO: 955443 - DNA, 22 bp, Artificial Sequence
  chemically synthesized
ttaaaaagggagtctattacaa

SEQ ID NO: 955444 - DNA, 22 bp, Artificial Sequence
  chemically synthesized
tgatattactgattgtaataga

SEQ ID NO: 955445 - DNA, 22 bp, Artificial Sequence
  chemically synthesized
atgatattactgattgtaatag

SEQ ID NO: 955446 - DNA, 22 bp, Artificial Sequence
  chemically synthesized
aaaaagggagtctattacaatc

SEQ ID NO: 955447 - DNA, 22 bp, Artificial Sequence
  chemically synthesized
tatgatattactgattgtaata

SEQ ID NO: 955448 - DNA, 22 bp, Artificial Sequence
  chemically synthesized
aaaagggagtctattacaatca

SEQ ID NO: 955449 - DNA, 22 bp, Artificial Sequence
  chemically synthesized
aaattttatgatattactgatt

SEQ ID NO: 955450 - DNA, 22 bp, Artificial Sequence
  chemically synthesized
aaaattttatgatattactgat

SEQ ID NO: 955451 - DNA, 22 bp, Artificial Sequence
  chemically synthesized
taaaattttatgatattactga

SEQ ID NO: 955452 - DNA, 22 bp, Artificial Sequence
  chemically synthesized
tctttaaaattttatgatatta

SEQ ID NO: 955453 - DNA, 22 bp, Artificial Sequence
  chemically synthesized
ttacaatcagtaatatcataaa

SEQ ID NO: 955454 - DNA, 22 bp, Artificial Sequence
  chemically synthesized
ttatctttaaaattttatgata

SEQ ID NO: 955455 - DNA, 22 bp, Artificial Sequence
  chemically synthesized
caatcagtaatatcataaaatt

SEQ ID NO: 955456 - DNA, 22 bp, Artificial Sequence
  chemically synthesized
gatgaaaaacatctattatctt

SEQ ID NO: 955457 - DNA, 22 bp, Artificial Sequence
  chemically synthesized
aactggatgaaaaacatctatt

SEQ ID NO: 955458 - DNA, 22 bp, Artificial Sequence
  chemically synthesized
gaactggatgaaaaacatctat

SEQ ID NO: 955459 - DNA, 22 bp, Artificial Sequence
  chemically synthesized
tgaactggatgaaaaacatcta

SEQ ID NO: 955460 - DNA, 22 bp, Artificial Sequence
  chemically synthesized
taaagataatagatgtttttca

SEQ ID NO: 955461 - DNA, 22 bp, Artificial Sequence
  chemically synthesized
aaagataatagatgtttttcat

SEQ ID NO: 955462 - DNA, 22 bp, Artificial Sequence
  chemically synthesized
aagataatagatgtttttcatc

SEQ ID NO: 955463 - DNA, 22 bp, Artificial Sequence
  chemically synthesized
ttcatccagttcaaaatgcttc

SEQ ID NO: 955464 - DNA, 22 bp, Artificial Sequence
  chemically synthesized
tcatccagttcaaaatgcttca

SEQ ID NO: 955465 - DNA, 22 bp, Artificial Sequence
  chemically synthesized
catccagttcaaaatgcttcac

SEQ ID NO: 955466 - DNA, 22 bp, Artificial Sequence
  chemically synthesized
atccagttcaaaatgcttcacc

SEQ ID NO: 955467 - DNA, 22 bp, Artificial Sequence
  chemically synthesized
aaaatgcttcaccatgtgggct

SEQ ID NO: 955468 - DNA, 22 bp, Artificial Sequence
  chemically synthesized
aagataggatcaaaaagcccac

SEQ ID NO: 955469 - DNA, 22 bp, Artificial Sequence
  chemically synthesized
aaagataggatcaaaaagccca

SEQ ID NO: 955470 - DNA, 22 bp, Artificial Sequence
  chemically synthesized
taaagataggatcaaaaagccc

SEQ ID NO: 955471 - DNA, 22 bp, Artificial Sequence
  chemically synthesized
ttaaagataggatcaaaaagcc

SEQ ID NO: 955472 - DNA, 22 bp, Artificial Sequence
  chemically synthesized
caccatgtgggctttttgatcc

SEQ ID NO: 955473 - DNA, 22 bp, Artificial Sequence
  chemically synthesized
accatgtgggctttttgatcct

SEQ ID NO: 955474 - DNA, 22 bp, Artificial Sequence
  chemically synthesized
atggacacaaaagtttttaaag

SEQ ID NO: 955475 - DNA, 22 bp, Artificial Sequence
  chemically synthesized
tttgatcctatctttaaaaact

SEQ ID NO: 955476 - DNA, 22 bp, Artificial Sequence
  chemically synthesized
ttgatcctatctttaaaaactt

SEQ ID NO: 955477 - DNA, 22 bp, Artificial Sequence
  chemically synthesized
tcatggacacaaaagtttttaa

SEQ ID NO: 955478 - DNA, 22 bp, Artificial Sequence
  chemically synthesized
tgatcctatctttaaaaacttt

SEQ ID NO: 955479 - DNA, 22 bp, Artificial Sequence
  chemically synthesized
ctcatggacacaaaagttttta

SEQ ID NO: 955480 - DNA, 22 bp, Artificial Sequence
  chemically synthesized
gatcctatctttaaaaactttt

SEQ ID NO: 955481 - DNA, 22 bp, Artificial Sequence
  chemically synthesized
atcctatctttaaaaacttttg

SEQ ID NO: 955482 - DNA, 22 bp, Artificial Sequence
  chemically synthesized
tacttctcatggacacaaaagt

SEQ ID NO: 955483 - DNA, 22 bp, Artificial Sequence
  chemically synthesized
atacttctcatggacacaaaag

SEQ ID NO: 955484 - DNA, 22 bp, Artificial Sequence
  chemically synthesized
tctttaaaaacttttgtgtcca

SEQ ID NO: 955485 - DNA, 22 bp, Artificial Sequence
  chemically synthesized
acttatacttctcatggacaca

SEQ ID NO: 955486 - DNA, 22 bp, Artificial Sequence
  chemically synthesized
taaaaacttttgtgtccatgag

SEQ ID NO: 955487 - DNA, 22 bp, Artificial Sequence
  chemically synthesized
aaaaacttttgtgtccatgaga

SEQ ID NO: 955488 - DNA, 22 bp, Artificial Sequence
  chemically synthesized
aaaacttttgtgtccatgagaa

SEQ ID NO: 955489 - DNA, 22 bp, Artificial Sequence
  chemically synthesized
cctaacttatacttctcatgga

SEQ ID NO: 955490 - DNA, 22 bp, Artificial Sequence
  chemically synthesized
acctaacttatacttctcatgg

SEQ ID NO: 955491 - DNA, 22 bp, Artificial Sequence
  chemically synthesized
ttgtgtccatgagaagtataag

SEQ ID NO: 955492 - DNA, 22 bp, Artificial Sequence
  chemically synthesized
tgtgtccatgagaagtataagt

SEQ ID NO: 955493 - DNA, 22 bp, Artificial Sequence
  chemically synthesized
gtgtccatgagaagtataagtt

SEQ ID NO: 955494 - DNA, 22 bp, Artificial Sequence
  chemically synthesized
gaaaacttacctaacttatact

SEQ ID NO: 955495 - DNA, 22 bp, Artificial Sequence
  chemically synthesized
tgtccatgagaagtataagtta

SEQ ID NO: 955496 - DNA, 22 bp, Artificial Sequence
  chemically synthesized
agaaaacttacctaacttatac

SEQ ID NO: 955497 - DNA, 22 bp, Artificial Sequence
  chemically synthesized
acttagaaaacttacctaactt

SEQ ID NO: 955498 - DNA, 22 bp, Artificial Sequence
  chemically synthesized
agttaacttagaaaacttacct

SEQ ID NO: 955499 - DNA, 22 bp, Artificial Sequence
  chemically synthesized
cagttaacttagaaaacttacc

SEQ ID NO: 955500 - DNA, 22 bp, Artificial Sequence
  chemically synthesized
tttcagttaacttagaaaactt

SEQ ID NO: 955501 - DNA, 22 bp, Artificial Sequence
  chemically synthesized
atttcagttaacttagaaaact

SEQ ID NO: 955502 - DNA, 22 bp, Artificial Sequence
  chemically synthesized
tatttcagttaacttagaaaac

SEQ ID NO: 955503 - DNA, 22 bp, Artificial Sequence
  chemically synthesized
ttatttcagttaacttagaaaa

SEQ ID NO: 955504 - DNA, 22 bp, Artificial Sequence
  chemically synthesized
ggtaagttttctaagttaactg

SEQ ID NO: 955505 - DNA, 22 bp, Artificial Sequence
  chemically synthesized
aatgtgtttttatttcagttaa

SEQ ID NO: 955506 - DNA, 22 bp, Artificial Sequence
  chemically synthesized
tctaagttaactgaaataaaaa

SEQ ID NO: 955507 - DNA, 22 bp, Artificial Sequence
  chemically synthesized
ctaagttaactgaaataaaaac

SEQ ID NO: 955508 - DNA, 22 bp, Artificial Sequence
  chemically synthesized
taagttaactgaaataaaaaca

SEQ ID NO: 955509 - DNA, 22 bp, Artificial Sequence
  chemically synthesized
agaaattcaatgtgtttttatt

SEQ ID NO: 955510 - DNA, 22 bp, Artificial Sequence
  chemically synthesized
aagaaattcaatgtgtttttat

SEQ ID NO: 955511 - DNA, 22 bp, Artificial Sequence
  chemically synthesized
agttaactgaaataaaaacaca

SEQ ID NO: 955512 - DNA, 22 bp, Artificial Sequence
  chemically synthesized
taagaaattcaatgtgttttta

SEQ ID NO: 955513 - DNA, 22 bp, Artificial Sequence
  chemically synthesized
actgaaataaaaacacattgaa

SEQ ID NO: 955514 - DNA, 22 bp, Artificial Sequence
  chemically synthesized
ggattttaagaaattcaatgtg

SEQ ID NO: 955515 - DNA, 22 bp, Artificial Sequence
  chemically synthesized
aaataaaaacacattgaatttc

SEQ ID NO: 955516 - DNA, 22 bp, Artificial Sequence
  chemically synthesized
ctaggattttaagaaattcaat

SEQ ID NO: 955517 - DNA, 22 bp, Artificial Sequence
  chemically synthesized
gctaggattttaagaaattcaa

SEQ ID NO: 955518 - DNA, 22 bp, Artificial Sequence
  chemically synthesized
tgctaggattttaagaaattca

SEQ ID NO: 955519 - DNA, 22 bp, Artificial Sequence
  chemically synthesized
ttttgctaggattttaagaaat

SEQ ID NO: 955520 - DNA, 22 bp, Artificial Sequence
  chemically synthesized
cactattttgctaggattttaa

SEQ ID NO: 955521 - DNA, 22 bp, Artificial Sequence
  chemically synthesized
acactattttgctaggatttta

SEQ ID NO: 955522 - DNA, 22 bp, Artificial Sequence
  chemically synthesized
tacactattttgctaggatttt

SEQ ID NO: 955523 - DNA, 22 bp, Artificial Sequence
  chemically synthesized
ttttacactattttgctaggat

SEQ ID NO: 955524 - DNA, 22 bp, Artificial Sequence
  chemically synthesized
aatttcttaaaatcctagcaaa

SEQ ID NO: 955525 - DNA, 22 bp, Artificial Sequence
  chemically synthesized
cttaaaatcctagcaaaatagt

SEQ ID NO: 955526 - DNA, 22 bp, Artificial Sequence
  chemically synthesized
ttaaaatcctagcaaaatagtg

SEQ ID NO: 955527 - DNA, 22 bp, Artificial Sequence
  chemically synthesized
aaaatcctagcaaaatagtgta

SEQ ID NO: 955528 - DNA, 22 bp, Artificial Sequence
  chemically synthesized
aaatcctagcaaaatagtgtaa

SEQ ID NO: 955529 - DNA, 22 bp, Artificial Sequence
  chemically synthesized
taggtacgttattttacactat

SEQ ID NO: 955530 - DNA, 22 bp, Artificial Sequence
  chemically synthesized
gcaaaatagtgtaaaataacgt

SEQ ID NO: 955531 - DNA, 22 bp, Artificial Sequence
  chemically synthesized
atataaagatgtgccagagaag

SEQ ID NO: 955532 - DNA, 22 bp, Artificial Sequence
  chemically synthesized
ttcatataaagatgtgccagag

SEQ ID NO: 955533 - DNA, 22 bp, Artificial Sequence
  chemically synthesized
tagtcttctctggcacatcttt

SEQ ID NO: 955534 - DNA, 22 bp, Artificial Sequence
  chemically synthesized
acgttattcatataaagatgtg

SEQ ID NO: 955535 - DNA, 22 bp, Artificial Sequence
  chemically synthesized
ctctggcacatctttatatgaa

SEQ ID NO: 955536 - DNA, 22 bp, Artificial Sequence
  chemically synthesized
tctggcacatctttatatgaat

SEQ ID NO: 955537 - DNA, 22 bp, Artificial Sequence
  chemically synthesized
tggcacatctttatatgaataa

SEQ ID NO: 955538 - DNA, 22 bp, Artificial Sequence
  chemically synthesized
tacatgattcacgttattcata

SEQ ID NO: 955539 - DNA, 22 bp, Artificial Sequence
  chemically synthesized
gcacatctttatatgaataacg

SEQ ID NO: 955540 - DNA, 22 bp, Artificial Sequence
  chemically synthesized
atacatgattcacgttattcat

SEQ ID NO: 955541 - DNA, 22 bp, Artificial Sequence
  chemically synthesized
tatatgaataacgtgaatcatg

SEQ ID NO: 955542 - DNA, 22 bp, Artificial Sequence
  chemically synthesized
atatgaataacgtgaatcatgt

SEQ ID NO: 955543 - DNA, 22 bp, Artificial Sequence
  chemically synthesized
aaggatatttatacatgattca

SEQ ID NO: 955544 - DNA, 22 bp, Artificial Sequence
  chemically synthesized
tatgaataacgtgaatcatgta

SEQ ID NO: 955545 - DNA, 22 bp, Artificial Sequence
  chemically synthesized
caaggatatttatacatgattc

SEQ ID NO: 955546 - DNA, 22 bp, Artificial Sequence
  chemically synthesized
aggcaatgtaaatgaaatacat

SEQ ID NO: 955547 - DNA, 22 bp, Artificial Sequence
  chemically synthesized
gcctgaggcaatgtaaatgaaa

SEQ ID NO: 955548 - DNA, 22 bp, Artificial Sequence
  chemically synthesized
gaaatatgtatttcatttacat

SEQ ID NO: 955549 - DNA, 22 bp, Artificial Sequence
  chemically synthesized
aaatatgtatttcatttacatt

SEQ ID NO: 955550 - DNA, 22 bp, Artificial Sequence
  chemically synthesized
catttacattgcctcaggctaa

SEQ ID NO: 955551 - DNA, 22 bp, Artificial Sequence
  chemically synthesized
atttacattgcctcaggctaac

SEQ ID NO: 955552 - DNA, 22 bp, Artificial Sequence
  chemically synthesized
acattgcctcaggctaacttcc

SEQ ID NO: 955553 - DNA, 22 bp, Artificial Sequence
  chemically synthesized
cattgcctcaggctaacttcct

SEQ ID NO: 955554 - DNA, 22 bp, Artificial Sequence
  chemically synthesized
cctcaggctaacttcctctttt

SEQ ID NO: 955555 - DNA, 22 bp, Artificial Sequence
  chemically synthesized
gggggaaaaaaaaaaaaagagg

SEQ ID NO: 955556 - DNA, 22 bp, Artificial Sequence
  chemically synthesized
aggctaacttcctctttttttt

SEQ ID NO: 955557 - DNA, 22 bp, Artificial Sequence
  chemically synthesized
ttagggggaaaaaaaaaaaaag

SEQ ID NO: 955558 - DNA, 22 bp, Artificial Sequence
  chemically synthesized
tattagggggaaaaaaaaaaaa

SEQ ID NO: 955559 - DNA, 22 bp, Artificial Sequence
  chemically synthesized
acttcctctttttttttttttc

SEQ ID NO: 955560 - DNA, 22 bp, Artificial Sequence
  chemically synthesized
tctctattagggggaaaaaaaa

SEQ ID NO: 955561 - DNA, 22 bp, Artificial Sequence
  chemically synthesized
cctctttttttttttttccccc

SEQ ID NO: 955562 - DNA, 22 bp, Artificial Sequence
  chemically synthesized
ctctttttttttttttccccct

SEQ ID NO: 955563 - DNA, 22 bp, Artificial Sequence
  chemically synthesized
tttttttttttttccccctaat

SEQ ID NO: 955564 - DNA, 22 bp, Artificial Sequence
  chemically synthesized
tttttttttttccccctaatag

SEQ ID NO: 955565 - DNA, 22 bp, Artificial Sequence
  chemically synthesized
ttttttttttccccctaataga

SEQ ID NO: 955566 - DNA, 22 bp, Artificial Sequence
  chemically synthesized
tttttttttccccctaatagag

SEQ ID NO: 955567 - DNA, 22 bp, Artificial Sequence
  chemically synthesized
ttttttttccccctaatagaga

SEQ ID NO: 955568 - DNA, 22 bp, Artificial Sequence
  chemically synthesized
tttttttccccctaatagagac

SEQ ID NO: 955569 - DNA, 22 bp, Artificial Sequence
  chemically synthesized
ttttttccccctaatagagaca

SEQ ID NO: 955570 - DNA, 22 bp, Artificial Sequence
  chemically synthesized
tttttccccctaatagagacag

SEQ ID NO: 955571 - DNA, 22 bp, Artificial Sequence
  chemically synthesized
ttttccccctaatagagacagg

SEQ ID NO: 955572 - DNA, 22 bp, Artificial Sequence
  chemically synthesized
tttccccctaatagagacaggc

SEQ ID NO: 955573 - DNA, 22 bp, Artificial Sequence
  chemically synthesized
ttccccctaatagagacaggct

SEQ ID NO: 955574 - DNA, 22 bp, Artificial Sequence
  chemically synthesized
tccccctaatagagacaggctc

SEQ ID NO: 955575 - DNA, 22 bp, Artificial Sequence
  chemically synthesized
ccccctaatagagacaggctct

SEQ ID NO: 955576 - DNA, 22 bp, Artificial Sequence
  chemically synthesized
ggcaacacagtgagagcctgtc

SEQ ID NO: 955577 - DNA, 22 bp, Artificial Sequence
  chemically synthesized
cccctaatagagacaggctctc

SEQ ID NO: 955578 - DNA, 22 bp, Artificial Sequence
  chemically synthesized
atagagacaggctctcactgtg

SEQ ID NO: 955579 - DNA, 22 bp, Artificial Sequence
  chemically synthesized
aaaaccagcctgggcaacacag

SEQ ID NO: 955580 - DNA, 22 bp, Artificial Sequence
  chemically synthesized
tcactgtgttgcccaggctggt

SEQ ID NO: 955581 - DNA, 22 bp, Artificial Sequence
  chemically synthesized
actgtgttgcccaggctggttt

SEQ ID NO: 955582 - DNA, 22 bp, Artificial Sequence
  chemically synthesized
agcccaggagttcaaaaccagc

SEQ ID NO: 955583 - DNA, 22 bp, Artificial Sequence
  chemically synthesized
tgttgcccaggctggttttgaa

SEQ ID NO: 955584 - DNA, 22 bp, Artificial Sequence
  chemically synthesized
cccaggctggttttgaactcct

SEQ ID NO: 955585 - DNA, 22 bp, Artificial Sequence
  chemically synthesized
tcgattgagcccaggagttcaa

SEQ ID NO: 955586 - DNA, 22 bp, Artificial Sequence
  chemically synthesized
gttttgaactcctgggctcaat

SEQ ID NO: 955587 - DNA, 22 bp, Artificial Sequence
  chemically synthesized
tgaactcctgggctcaatcgat

SEQ ID NO: 955588 - DNA, 22 bp, Artificial Sequence
  chemically synthesized
gaactcctgggctcaatcgata

SEQ ID NO: 955589 - DNA, 22 bp, Artificial Sequence
  chemically synthesized
aactcctgggctcaatcgataa

SEQ ID NO: 955590 - DNA, 22 bp, Artificial Sequence
  chemically synthesized
gaggccaaggtgggattatcga

SEQ ID NO: 955591 - DNA, 22 bp, Artificial Sequence
  chemically synthesized
ggaggccaaggtgggattatcg

SEQ ID NO: 955592 - DNA, 22 bp, Artificial Sequence
  chemically synthesized
ctgggctcaatcgataatccca

SEQ ID NO: 955593 - DNA, 22 bp, Artificial Sequence
  chemically synthesized
tggaggccaaggtgggattatc

SEQ ID NO: 955594 - DNA, 22 bp, Artificial Sequence
  chemically synthesized
ttggaggccaaggtgggattat

SEQ ID NO: 955595 - DNA, 22 bp, Artificial Sequence
  chemically synthesized
ggctcaatcgataatcccacct

SEQ ID NO: 955596 - DNA, 22 bp, Artificial Sequence
  chemically synthesized
aatcgataatcccaccttggcc

SEQ ID NO: 955597 - DNA, 22 bp, Artificial Sequence
  chemically synthesized
taatcccagcatttttggaggc

SEQ ID NO: 955598 - DNA, 22 bp, Artificial Sequence
  chemically synthesized
acacctgtaatcccagcatttt

SEQ ID NO: 955599 - DNA, 22 bp, Artificial Sequence
  chemically synthesized
ggcctccaaaaatgctgggatt

SEQ ID NO: 955600 - DNA, 22 bp, Artificial Sequence
  chemically synthesized
gcctccaaaaatgctgggatta

SEQ ID NO: 955601 - DNA, 22 bp, Artificial Sequence
  chemically synthesized
caaaaatgctgggattacaggt

SEQ ID NO: 955602 - DNA, 22 bp, Artificial Sequence
  chemically synthesized
aaagtcgggtgatgtgactcac

SEQ ID NO: 955603 - DNA, 22 bp, Artificial Sequence
  chemically synthesized
ggattacaggtgtgagtcacat

SEQ ID NO: 955604 - DNA, 22 bp, Artificial Sequence
  chemically synthesized
caggtgtgagtcacatcacccg

SEQ ID NO: 955605 - DNA, 22 bp, Artificial Sequence
  chemically synthesized
tgggtgtgatcaagagggcagc

SEQ ID NO: 955606 - DNA, 22 bp, Artificial Sequence
  chemically synthesized
tcaggctgccctcttgatcaca

SEQ ID NO: 955607 - DNA, 22 bp, Artificial Sequence
  chemically synthesized
caggctgccctcttgatcacac

SEQ ID NO: 955608 - DNA, 22 bp, Artificial Sequence
  chemically synthesized
aggctgccctcttgatcacacc

SEQ ID NO: 955609 - DNA, 22 bp, Artificial Sequence
  chemically synthesized
ccctcttgatcacacccacaat

SEQ ID NO: 955610 - DNA, 22 bp, Artificial Sequence
  chemically synthesized
aaaaaaaatcagtaattgtggg

SEQ ID NO: 955611 - DNA, 22 bp, Artificial Sequence
  chemically synthesized
gaaaaaaaatcagtaattgtgg

SEQ ID NO: 955612 - DNA, 22 bp, Artificial Sequence
  chemically synthesized
ttgatcacacccacaattactg

SEQ ID NO: 955613 - DNA, 22 bp, Artificial Sequence
  chemically synthesized
gatcacacccacaattactgat

SEQ ID NO: 955614 - DNA, 22 bp, Artificial Sequence
  chemically synthesized
atcacacccacaattactgatt

SEQ ID NO: 955615 - DNA, 22 bp, Artificial Sequence
  chemically synthesized
catttgaaaaaaaatcagtaat

SEQ ID NO: 955616 - DNA, 22 bp, Artificial Sequence
  chemically synthesized
ccatttgaaaaaaaatcagtaa

SEQ ID NO: 955617 - DNA, 22 bp, Artificial Sequence
  chemically synthesized
gaaaatacatttccatttgaaa

SEQ ID NO: 955618 - DNA, 22 bp, Artificial Sequence
  chemically synthesized
ctgattttttttcaaatggaaa

SEQ ID NO: 955619 - DNA, 22 bp, Artificial Sequence
  chemically synthesized
tgttagaaaatacatttccatt

SEQ ID NO: 955620 - DNA, 22 bp, Artificial Sequence
  chemically synthesized
attttttttcaaatggaaatgt

SEQ ID NO: 955621 - DNA, 22 bp, Artificial Sequence
  chemically synthesized
atgttagaaaatacatttccat

SEQ ID NO: 955622 - DNA, 22 bp, Artificial Sequence
  chemically synthesized
tatgttagaaaatacatttcca

SEQ ID NO: 955623 - DNA, 22 bp, Artificial Sequence
  chemically synthesized
tttttcaaatggaaatgtattt

SEQ ID NO: 955624 - DNA, 22 bp, Artificial Sequence
  chemically synthesized
ttttcaaatggaaatgtatttt

SEQ ID NO: 955625 - DNA, 22 bp, Artificial Sequence
  chemically synthesized
tttcaaatggaaatgtattttc

SEQ ID NO: 955626 - DNA, 22 bp, Artificial Sequence
  chemically synthesized
tactttatgttagaaaatacat

SEQ ID NO: 955627 - DNA, 22 bp, Artificial Sequence
  chemically synthesized
ttcaaatggaaatgtattttct

SEQ ID NO: 955628 - DNA, 22 bp, Artificial Sequence
  chemically synthesized
tcaaatggaaatgtattttcta

SEQ ID NO: 955629 - DNA, 22 bp, Artificial Sequence
  chemically synthesized
caaatggaaatgtattttctaa

SEQ ID NO: 955630 - DNA, 22 bp, Artificial Sequence
  chemically synthesized
aaatggaaatgtattttctaac

SEQ ID NO: 955631 - DNA, 22 bp, Artificial Sequence
  chemically synthesized
acctatactttatgttagaaaa

SEQ ID NO: 955632 - DNA, 22 bp, Artificial Sequence
  chemically synthesized
tctaacctatactttatgttag

SEQ ID NO: 955633 - DNA, 22 bp, Artificial Sequence
  chemically synthesized
gtctaacctatactttatgtta

SEQ ID NO: 955634 - DNA, 22 bp, Artificial Sequence
  chemically synthesized
tctaacataaagtataggttag

SEQ ID NO: 955635 - DNA, 22 bp, Artificial Sequence
  chemically synthesized
gtgtgcatttgtctaacctata

SEQ ID NO: 955636 - DNA, 22 bp, Artificial Sequence
  chemically synthesized
ctaacataaagtataggttaga

SEQ ID NO: 955637 - DNA, 22 bp, Artificial Sequence
  chemically synthesized
ggtgtgcatttgtctaacctat

SEQ ID NO: 955638 - DNA, 22 bp, Artificial Sequence
  chemically synthesized
taacataaagtataggttagac

SEQ ID NO: 955639 - DNA, 22 bp, Artificial Sequence
  chemically synthesized
acataaagtataggttagacaa

SEQ ID NO: 955640 - DNA, 22 bp, Artificial Sequence
  chemically synthesized
acatttggtgtgcatttgtcta

SEQ ID NO: 955641 - DNA, 22 bp, Artificial Sequence
  chemically synthesized
aacatttggtgtgcatttgtct

SEQ ID NO: 955642 - DNA, 22 bp, Artificial Sequence
  chemically synthesized
gacaaatgcacaccaaatgtta

SEQ ID NO: 955643 - DNA, 22 bp, Artificial Sequence
  chemically synthesized
gacacagaagggaatttaacat

SEQ ID NO: 955644 - DNA, 22 bp, Artificial Sequence
  chemically synthesized
cagagatgactagacacagaag

SEQ ID NO: 955645 - DNA, 22 bp, Artificial Sequence
  chemically synthesized
aattcccttctgtgtctagtca

SEQ ID NO: 955646 - DNA, 22 bp, Artificial Sequence
  chemically synthesized
ataattacagagatgactagac

SEQ ID NO: 955647 - DNA, 22 bp, Artificial Sequence
  chemically synthesized
cataattacagagatgactaga

SEQ ID NO: 955648 - DNA, 22 bp, Artificial Sequence
  chemically synthesized
ttcataattacagagatgacta

SEQ ID NO: 955649 - DNA, 22 bp, Artificial Sequence
  chemically synthesized
ccttctgtgtctagtcatctct

SEQ ID NO: 955650 - DNA, 22 bp, Artificial Sequence
  chemically synthesized
tctcttcataattacagagatg

SEQ ID NO: 955651 - DNA, 22 bp, Artificial Sequence
  chemically synthesized
ctgtgtctagtcatctctgtaa

SEQ ID NO: 955652 - DNA, 22 bp, Artificial Sequence
  chemically synthesized
gtctcttcataattacagagat

SEQ ID NO: 955653 - DNA, 22 bp, Artificial Sequence
  chemically synthesized
tgtgtctagtcatctctgtaat

SEQ ID NO: 955654 - DNA, 22 bp, Artificial Sequence
  chemically synthesized
tgtctcttcataattacagaga

SEQ ID NO: 955655 - DNA, 22 bp, Artificial Sequence
  chemically synthesized
tgtctagtcatctctgtaatta

SEQ ID NO: 955656 - DNA, 22 bp, Artificial Sequence
  chemically synthesized
aactttgtctcttcataattac

SEQ ID NO: 955657 - DNA, 22 bp, Artificial Sequence
  chemically synthesized
gtcatctctgtaattatgaaga

SEQ ID NO: 955658 - DNA, 22 bp, Artificial Sequence
  chemically synthesized
ttaaactttgtctcttcataat

SEQ ID NO: 955659 - DNA, 22 bp, Artificial Sequence
  chemically synthesized
atattattaaactttgtctctt

SEQ ID NO: 955660 - DNA, 22 bp, Artificial Sequence
  chemically synthesized
catattattaaactttgtctct

SEQ ID NO: 955661 - DNA, 22 bp, Artificial Sequence
  chemically synthesized
tgtaattatgaagagacaaagt

SEQ ID NO: 955662 - DNA, 22 bp, Artificial Sequence
  chemically synthesized
tcatattattaaactttgtctc

SEQ ID NO: 955663 - DNA, 22 bp, Artificial Sequence
  chemically synthesized
taattatgaagagacaaagttt

SEQ ID NO: 955664 - DNA, 22 bp, Artificial Sequence
  chemically synthesized
tgaagagacaaagtttaataat

SEQ ID NO: 955665 - DNA, 22 bp, Artificial Sequence
  chemically synthesized
atcagctttcatattattaaac

SEQ ID NO: 955666 - DNA, 22 bp, Artificial Sequence
  chemically synthesized
catcagctttcatattattaaa

SEQ ID NO: 955667 - DNA, 22 bp, Artificial Sequence
  chemically synthesized
ttcatcagctttcatattatta

SEQ ID NO: 955668 - DNA, 22 bp, Artificial Sequence
  chemically synthesized
cttcatcagctttcatattatt

SEQ ID NO: 955669 - DNA, 22 bp, Artificial Sequence
  chemically synthesized
tcttcatcagctttcatattat

SEQ ID NO: 955670 - DNA, 22 bp, Artificial Sequence
  chemically synthesized
ttcttcatcagctttcatatta

SEQ ID NO: 955671 - DNA, 22 bp, Artificial Sequence
  chemically synthesized
tttcttcatcagctttcatatt

SEQ ID NO: 955672 - DNA, 22 bp, Artificial Sequence
  chemically synthesized
ttttttcttcatcagctttcat

SEQ ID NO: 955673 - DNA, 22 bp, Artificial Sequence
  chemically synthesized
aataatatgaaagctgatgaag

SEQ ID NO: 955674 - DNA, 22 bp, Artificial Sequence
  chemically synthesized
ataatatgaaagctgatgaaga

SEQ ID NO: 955675 - DNA, 22 bp, Artificial Sequence
  chemically synthesized
tggggttattttttcttcatca

SEQ ID NO: 955676 - DNA, 22 bp, Artificial Sequence
  chemically synthesized
taaattatggggttattttttc

SEQ ID NO: 955677 - DNA, 22 bp, Artificial Sequence
  chemically synthesized
ataaattatggggttatttttt

SEQ ID NO: 955678 - DNA, 22 bp, Artificial Sequence
  chemically synthesized
atgaagaaaaaataaccccata

SEQ ID NO: 955679 - DNA, 22 bp, Artificial Sequence
  chemically synthesized
gggaatgcacatttataaatta

SEQ ID NO: 955680 - DNA, 22 bp, Artificial Sequence
  chemically synthesized
tggggaatgcacatttataaat

SEQ ID NO: 955681 - DNA, 22 bp, Artificial Sequence
  chemically synthesized
actctggggaatgcacatttat

SEQ ID NO: 955682 - DNA, 22 bp, Artificial Sequence
  chemically synthesized
cactctggggaatgcacattta

SEQ ID NO: 955683 - DNA, 22 bp, Artificial Sequence
  chemically synthesized
tcactctggggaatgcacattt

SEQ ID NO: 955684 - DNA, 22 bp, Artificial Sequence
  chemically synthesized
ataaatgtgcattccccagagt

SEQ ID NO: 955685 - DNA, 22 bp, Artificial Sequence
  chemically synthesized
taaatgtgcattccccagagtg

SEQ ID NO: 955686 - DNA, 22 bp, Artificial Sequence
  chemically synthesized
ccaagagccattttcactctgg

SEQ ID NO: 955687 - DNA, 22 bp, Artificial Sequence
  chemically synthesized
cccagagtgaaaatggctcttg

SEQ ID NO: 955688 - DNA, 22 bp, Artificial Sequence
  chemically synthesized
aaaatgaagttaccaagagcca

SEQ ID NO: 955689 - DNA, 22 bp, Artificial Sequence
  chemically synthesized
aaattaaaaatgaagttaccaa

SEQ ID NO: 955690 - DNA, 22 bp, Artificial Sequence
  chemically synthesized
ttggtaacttcatttttaattt

SEQ ID NO: 955691 - DNA, 22 bp, Artificial Sequence
  chemically synthesized
ggtaacttcatttttaatttca

SEQ ID NO: 955692 - DNA, 22 bp, Artificial Sequence
  chemically synthesized
gtaacttcatttttaatttcaa

SEQ ID NO: 955693 - DNA, 22 bp, Artificial Sequence
  chemically synthesized
tataaaatacataattgaaatt

SEQ ID NO: 955694 - DNA, 22 bp, Artificial Sequence
  chemically synthesized
atataaaatacataattgaaat

SEQ ID NO: 955695 - DNA, 22 bp, Artificial Sequence
  chemically synthesized
cttatataaaatacataattga

SEQ ID NO: 955696 - DNA, 22 bp, Artificial Sequence
  chemically synthesized
catttttaatttcaattatgta

SEQ ID NO: 955697 - DNA, 22 bp, Artificial Sequence
  chemically synthesized
ccttatataaaatacataattg

SEQ ID NO: 955698 - DNA, 22 bp, Artificial Sequence
  chemically synthesized
atttttaatttcaattatgtat

SEQ ID NO: 955699 - DNA, 22 bp, Artificial Sequence
  chemically synthesized
tccttatataaaatacataatt

SEQ ID NO: 955700 - DNA, 22 bp, Artificial Sequence
  chemically synthesized
ttccttatataaaatacataat

SEQ ID NO: 955701 - DNA, 22 bp, Artificial Sequence
  chemically synthesized
ttaatttcaattatgtatttta

SEQ ID NO: 955702 - DNA, 22 bp, Artificial Sequence
  chemically synthesized
taatttcaattatgtattttat

SEQ ID NO: 955703 - DNA, 22 bp, Artificial Sequence
  chemically synthesized
aatttcaattatgtattttata

SEQ ID NO: 955704 - DNA, 22 bp, Artificial Sequence
  chemically synthesized
atttcaattatgtattttatat

SEQ ID NO: 955705 - DNA, 22 bp, Artificial Sequence
  chemically synthesized
tgatttttccttatataaaata

SEQ ID NO: 955706 - DNA, 22 bp, Artificial Sequence
  chemically synthesized
gtgatttttccttatataaaat

SEQ ID NO: 955707 - DNA, 22 bp, Artificial Sequence
  chemically synthesized
tgtgatttttccttatataaaa

SEQ ID NO: 955708 - DNA, 22 bp, Artificial Sequence
  chemically synthesized
caattatgtattttatataagg

SEQ ID NO: 955709 - DNA, 22 bp, Artificial Sequence
  chemically synthesized
aattatgtattttatataagga

SEQ ID NO: 955710 - DNA, 22 bp, Artificial Sequence
  chemically synthesized
ttttgtgatttttccttatata

SEQ ID NO: 955711 - DNA, 22 bp, Artificial Sequence
  chemically synthesized
tgtattttatataaggaaaaat

SEQ ID NO: 955712 - DNA, 22 bp, Artificial Sequence
  chemically synthesized
tatataaggaaaaatcacaaaa

SEQ ID NO: 955713 - DNA, 22 bp, Artificial Sequence
  chemically synthesized
atataaggaaaaatcacaaaat

SEQ ID NO: 955714 - DNA, 22 bp, Artificial Sequence
  chemically synthesized
tataaggaaaaatcacaaaata

SEQ ID NO: 955715 - DNA, 22 bp, Artificial Sequence
  chemically synthesized
cagtaagcagcctattttgtga

SEQ ID NO: 955716 - DNA, 22 bp, Artificial Sequence
  chemically synthesized
aacactacagtaagcagcctat

SEQ ID NO: 955717 - DNA, 22 bp, Artificial Sequence
  chemically synthesized
caacactacagtaagcagccta

SEQ ID NO: 955718 - DNA, 22 bp, Artificial Sequence
  chemically synthesized
tatttcaacactacagtaagca

SEQ ID NO: 955719 - DNA, 22 bp, Artificial Sequence
  chemically synthesized
cactatatttcaacactacagt

SEQ ID NO: 955720 - DNA, 22 bp, Artificial Sequence
  chemically synthesized
tcattacactatatttcaacac

SEQ ID NO: 955721 - DNA, 22 bp, Artificial Sequence
  chemically synthesized
tatcattacactatatttcaac

SEQ ID NO: 955722 - DNA, 22 bp, Artificial Sequence
  chemically synthesized
cttactgtagtgttgaaatata

SEQ ID NO: 955723 - DNA, 22 bp, Artificial Sequence
  chemically synthesized
actgtagtgttgaaatatagtg

SEQ ID NO: 955724 - DNA, 22 bp, Artificial Sequence
  chemically synthesized
ctgtagtgttgaaatatagtgt

SEQ ID NO: 955725 - DNA, 22 bp, Artificial Sequence
  chemically synthesized
cattctatcattacactatatt

SEQ ID NO: 955726 - DNA, 22 bp, Artificial Sequence
  chemically synthesized
tagtgttgaaatatagtgtaat

SEQ ID NO: 955727 - DNA, 22 bp, Artificial Sequence
  chemically synthesized
aaattacattctatcattacac

SEQ ID NO: 955728 - DNA, 22 bp, Artificial Sequence
  chemically synthesized
aaaattacattctatcattaca

SEQ ID NO: 955729 - DNA, 22 bp, Artificial Sequence
  chemically synthesized
taaaattacattctatcattac

SEQ ID NO: 955730 - DNA, 22 bp, Artificial Sequence
  chemically synthesized
tttaaaattacattctatcatt

SEQ ID NO: 955731 - DNA, 22 bp, Artificial Sequence
  chemically synthesized
aaatatagtgtaatgatagaat

SEQ ID NO: 955732 - DNA, 22 bp, Artificial Sequence
  chemically synthesized
ctttaaaattacattctatcat

SEQ ID NO: 955733 - DNA, 22 bp, Artificial Sequence
  chemically synthesized
aacatttctttaaaattacatt

SEQ ID NO: 955734 - DNA, 22 bp, Artificial Sequence
  chemically synthesized
aaacatttctttaaaattacat

SEQ ID NO: 955735 - DNA, 22 bp, Artificial Sequence
  chemically synthesized
tttaaacatttctttaaaatta

SEQ ID NO: 955736 - DNA, 22 bp, Artificial Sequence
  chemically synthesized
atttaaacatttctttaaaatt

SEQ ID NO: 955737 - DNA, 22 bp, Artificial Sequence
  chemically synthesized
tttatttaaacatttctttaaa

SEQ ID NO: 955738 - DNA, 22 bp, Artificial Sequence
  chemically synthesized
aattatttatttaaacatttct

SEQ ID NO: 955739 - DNA, 22 bp, Artificial Sequence
  chemically synthesized
taaattatttatttaaacattt

SEQ ID NO: 955740 - DNA, 22 bp, Artificial Sequence
  chemically synthesized
ctaaattatttatttaaacatt

SEQ ID NO: 955741 - DNA, 22 bp, Artificial Sequence
  chemically synthesized
tctaaattatttatttaaacat

SEQ ID NO: 955742 - DNA, 22 bp, Artificial Sequence
  chemically synthesized
gttttctaaattatttatttaa

SEQ ID NO: 955743 - DNA, 22 bp, Artificial Sequence
  chemically synthesized
taaagaaatgtttaaataaata

SEQ ID NO: 955744 - DNA, 22 bp, Artificial Sequence
  chemically synthesized
agttttctaaattatttattta

SEQ ID NO: 955745 - DNA, 22 bp, Artificial Sequence
  chemically synthesized
aaagaaatgtttaaataaataa

SEQ ID NO: 955746 - DNA, 22 bp, Artificial Sequence
  chemically synthesized
tagttttctaaattatttattt

SEQ ID NO: 955747 - DNA, 22 bp, Artificial Sequence
  chemically synthesized
aagaaatgtttaaataaataat

SEQ ID NO: 955748 - DNA, 22 bp, Artificial Sequence
  chemically synthesized
ttagttttctaaattatttatt

SEQ ID NO: 955749 - DNA, 22 bp, Artificial Sequence
  chemically synthesized
aaataaataatttagaaaacta

SEQ ID NO: 955750 - DNA, 22 bp, Artificial Sequence
  chemically synthesized
aataaataatttagaaaactaa

SEQ ID NO: 955751 - DNA, 22 bp, Artificial Sequence
  chemically synthesized
acatcataaaaagtaggccatt

SEQ ID NO: 955752 - DNA, 22 bp, Artificial Sequence
  chemically synthesized
agaaaactaaaaatggcctact

SEQ ID NO: 955753 - DNA, 22 bp, Artificial Sequence
  chemically synthesized
aacatcataaaaagtaggccat

SEQ ID NO: 955754 - DNA, 22 bp, Artificial Sequence
  chemically synthesized
gaaaactaaaaatggcctactt

SEQ ID NO: 955755 - DNA, 22 bp, Artificial Sequence
  chemically synthesized
aaaatggcctactttttatgat

SEQ ID NO: 955756 - DNA, 22 bp, Artificial Sequence
  chemically synthesized
catatacttaacatcataaaaa

SEQ ID NO: 955757 - DNA, 22 bp, Artificial Sequence
  chemically synthesized
agcattccatatacttaacatc

SEQ ID NO: 955758 - DNA, 22 bp, Artificial Sequence
  chemically synthesized
ctttttatgatgttaagtatat

SEQ ID NO: 955759 - DNA, 22 bp, Artificial Sequence
  chemically synthesized
attcagcattccatatacttaa

SEQ ID NO: 955760 - DNA, 22 bp, Artificial Sequence
  chemically synthesized
aattcagcattccatatactta

SEQ ID NO: 955761 - DNA, 22 bp, Artificial Sequence
  chemically synthesized
tttatgatgttaagtatatgga

SEQ ID NO: 955762 - DNA, 22 bp, Artificial Sequence
  chemically synthesized
ttaattcagcattccatatact

SEQ ID NO: 955763 - DNA, 22 bp, Artificial Sequence
  chemically synthesized
ttatgatgttaagtatatggaa

SEQ ID NO: 955764 - DNA, 22 bp, Artificial Sequence
  chemically synthesized
tatgatgttaagtatatggaat

SEQ ID NO: 955765 - DNA, 22 bp, Artificial Sequence
  chemically synthesized
tcttaattcagcattccatata

SEQ ID NO: 955766 - DNA, 22 bp, Artificial Sequence
  chemically synthesized
atgatgttaagtatatggaatg

SEQ ID NO: 955767 - DNA, 22 bp, Artificial Sequence
  chemically synthesized
tgatgttaagtatatggaatgc

SEQ ID NO: 955768 - DNA, 22 bp, Artificial Sequence
  chemically synthesized
ctctcttaattcagcattccat

SEQ ID NO: 955769 - DNA, 22 bp, Artificial Sequence
  chemically synthesized
actctcttaattcagcattcca

SEQ ID NO: 955770 - DNA, 22 bp, Artificial Sequence
  chemically synthesized
agtatatggaatgctgaattaa

SEQ ID NO: 955771 - DNA, 22 bp, Artificial Sequence
  chemically synthesized
ccaagaaaaatttactctctta

SEQ ID NO: 955772 - DNA, 22 bp, Artificial Sequence
  chemically synthesized
gccaagaaaaatttactctctt

SEQ ID NO: 955773 - DNA, 22 bp, Artificial Sequence
  chemically synthesized
tttgccaagaaaaatttactct

SEQ ID NO: 955774 - DNA, 22 bp, Artificial Sequence
  chemically synthesized
ctatttgccaagaaaaatttac

SEQ ID NO: 955775 - DNA, 22 bp, Artificial Sequence
  chemically synthesized
aattaagagagtaaatttttct

SEQ ID NO: 955776 - DNA, 22 bp, Artificial Sequence
  chemically synthesized
agagagtaaatttttcttggca

SEQ ID NO: 955777 - DNA, 22 bp, Artificial Sequence
  chemically synthesized
gtgtgtctactatttgccaaga

SEQ ID NO: 955778 - DNA, 22 bp, Artificial Sequence
  chemically synthesized
tatctagtgtgtctactatttg

SEQ ID NO: 955779 - DNA, 22 bp, Artificial Sequence
  chemically synthesized
ttcttggcaaatagtagacaca

SEQ ID NO: 955780 - DNA, 22 bp, Artificial Sequence
  chemically synthesized
acctatatctagtgtgtctact

SEQ ID NO: 955781 - DNA, 22 bp, Artificial Sequence
  chemically synthesized
tcttggcaaatagtagacacac

SEQ ID NO: 955782 - DNA, 22 bp, Artificial Sequence
  chemically synthesized
cacctatatctagtgtgtctac

SEQ ID NO: 955783 - DNA, 22 bp, Artificial Sequence
  chemically synthesized
cttggcaaatagtagacacact

SEQ ID NO: 955784 - DNA, 22 bp, Artificial Sequence
  chemically synthesized
ttggcaaatagtagacacacta

SEQ ID NO: 955785 - DNA, 22 bp, Artificial Sequence
  chemically synthesized
ggcaaatagtagacacactaga

SEQ ID NO: 955786 - DNA, 22 bp, Artificial Sequence
  chemically synthesized
acttcacctatatctagtgtgt

SEQ ID NO: 955787 - DNA, 22 bp, Artificial Sequence
  chemically synthesized
gcaaatagtagacacactagat

SEQ ID NO: 955788 - DNA, 22 bp, Artificial Sequence
  chemically synthesized
attcacttcacctatatctagt

SEQ ID NO: 955789 - DNA, 22 bp, Artificial Sequence
  chemically synthesized
catattcattcacttcacctat

SEQ ID NO: 955790 - DNA, 22 bp, Artificial Sequence
  chemically synthesized
tacatattcattcacttcacct

SEQ ID NO: 955791 - DNA, 22 bp, Artificial Sequence
  chemically synthesized
ctacatattcattcacttcacc

SEQ ID NO: 955792 - DNA, 22 bp, Artificial Sequence
  chemically synthesized
tctacatattcattcacttcac

SEQ ID NO: 955793 - DNA, 22 bp, Artificial Sequence
  chemically synthesized
attttctacatattcattcact

SEQ ID NO: 955794 - DNA, 22 bp, Artificial Sequence
  chemically synthesized
gatataggtgaagtgaatgaat

SEQ ID NO: 955795 - DNA, 22 bp, Artificial Sequence
  chemically synthesized
aggaactgattttctacatatt

SEQ ID NO: 955796 - DNA, 22 bp, Artificial Sequence
  chemically synthesized
aaggaactgattttctacatat

SEQ ID NO: 955797 - DNA, 22 bp, Artificial Sequence
  chemically synthesized
ttaaggaactgattttctacat

SEQ ID NO: 955798 - DNA, 22 bp, Artificial Sequence
  chemically synthesized
agccgttcttaaggaactgatt

SEQ ID NO: 955799 - DNA, 22 bp, Artificial Sequence
  chemically synthesized
aatatcatcattgagccgttct

SEQ ID NO: 955800 - DNA, 22 bp, Artificial Sequence
  chemically synthesized
taaatatcatcattgagccgtt

SEQ ID NO: 955801 - DNA, 22 bp, Artificial Sequence
  chemically synthesized
gattctaaatatcatcattgag

SEQ ID NO: 955802 - DNA, 22 bp, Artificial Sequence
  chemically synthesized
cttaagaacggctcaatgatga

SEQ ID NO: 955803 - DNA, 22 bp, Artificial Sequence
  chemically synthesized
aagaacggctcaatgatgatat

SEQ ID NO: 955804 - DNA, 22 bp, Artificial Sequence
  chemically synthesized
agaacggctcaatgatgatatt

SEQ ID NO: 955805 - DNA, 22 bp, Artificial Sequence
  chemically synthesized
tcactagattctaaatatcatc

SEQ ID NO: 955806 - DNA, 22 bp, Artificial Sequence
  chemically synthesized
aattatcactagattctaaata

SEQ ID NO: 955807 - DNA, 22 bp, Artificial Sequence
  chemically synthesized
caattatcactagattctaaat

SEQ ID NO: 955808 - DNA, 22 bp, Artificial Sequence
  chemically synthesized
aatgatgatatttagaatctag

SEQ ID NO: 955809 - DNA, 22 bp, Artificial Sequence
  chemically synthesized
agtttcaattatcactagattc

SEQ ID NO: 955810 - DNA, 22 bp, Artificial Sequence
  chemically synthesized
aactaagtttcaattatcacta

SEQ ID NO: 955811 - DNA, 22 bp, Artificial Sequence
  chemically synthesized
aaactaagtttcaattatcact

SEQ ID NO: 955812 - DNA, 22 bp, Artificial Sequence
  chemically synthesized
taaactaagtttcaattatcac

SEQ ID NO: 955813 - DNA, 22 bp, Artificial Sequence
  chemically synthesized
ttaaactaagtttcaattatca

SEQ ID NO: 955814 - DNA, 22 bp, Artificial Sequence
  chemically synthesized
agaatctagtgataattgaaac

SEQ ID NO: 955815 - DNA, 22 bp, Artificial Sequence
  chemically synthesized
gaatctagtgataattgaaact

SEQ ID NO: 955816 - DNA, 22 bp, Artificial Sequence
  chemically synthesized
acttttaaactaagtttcaatt

SEQ ID NO: 955817 - DNA, 22 bp, Artificial Sequence
  chemically synthesized
gttcacttttaaactaagtttc

SEQ ID NO: 955818 - DNA, 22 bp, Artificial Sequence
  chemically synthesized
agttcacttttaaactaagttt

SEQ ID NO: 955819 - DNA, 22 bp, Artificial Sequence
  chemically synthesized
gtgataattgaaacttagttta

SEQ ID NO: 955820 - DNA, 22 bp, Artificial Sequence
  chemically synthesized
tcttagttcacttttaaactaa

SEQ ID NO: 955821 - DNA, 22 bp, Artificial Sequence
  chemically synthesized
gttatcttagttcacttttaaa

SEQ ID NO: 955822 - DNA, 22 bp, Artificial Sequence
  chemically synthesized
agttatcttagttcacttttaa

SEQ ID NO: 955823 - DNA, 22 bp, Artificial Sequence
  chemically synthesized
tagttatcttagttcactttta

SEQ ID NO: 955824 - DNA, 22 bp, Artificial Sequence
  chemically synthesized
aaacttagtttaaaagtgaact

SEQ ID NO: 955825 - DNA, 22 bp, Artificial Sequence
  chemically synthesized
agtttaaaagtgaactaagata

SEQ ID NO: 955826 - DNA, 22 bp, Artificial Sequence
  chemically synthesized
gtttaaaagtgaactaagataa

SEQ ID NO: 955827 - DNA, 22 bp, Artificial Sequence
  chemically synthesized
aaaagtgaactaagataactaa

SEQ ID NO: 955828 - DNA, 22 bp, Artificial Sequence
  chemically synthesized
aaagtgaactaagataactaaa

SEQ ID NO: 955829 - DNA, 22 bp, Artificial Sequence
  chemically synthesized
agataactaaaatattttcatg

SEQ ID NO: 955830 - DNA, 22 bp, Artificial Sequence
  chemically synthesized
tgtgaataagcacatgaaaata

SEQ ID NO: 955831 - DNA, 22 bp, Artificial Sequence
  chemically synthesized
attatgtgaataagcacatgaa

SEQ ID NO: 955832 - DNA, 22 bp, Artificial Sequence
  chemically synthesized
gattatgtgaataagcacatga

SEQ ID NO: 955833 - DNA, 22 bp, Artificial Sequence
  chemically synthesized
aaatattttcatgtgcttattc

SEQ ID NO: 955834 - DNA, 22 bp, Artificial Sequence
  chemically synthesized
tgccttgattatgtgaataagc

SEQ ID NO: 955835 - DNA, 22 bp, Artificial Sequence
  chemically synthesized
ctatgccttgattatgtgaata

SEQ ID NO: 955836 - DNA, 22 bp, Artificial Sequence
  chemically synthesized
tcatgtgcttattcacataatc

SEQ ID NO: 955837 - DNA, 22 bp, Artificial Sequence
  chemically synthesized
catgtgcttattcacataatca

SEQ ID NO: 955838 - DNA, 22 bp, Artificial Sequence
  chemically synthesized
actcctatgccttgattatgtg

SEQ ID NO: 955839 - DNA, 22 bp, Artificial Sequence
  chemically synthesized
atgtgcttattcacataatcaa

SEQ ID NO: 955840 - DNA, 22 bp, Artificial Sequence
  chemically synthesized
aactcctatgccttgattatgt

SEQ ID NO: 955841 - DNA, 22 bp, Artificial Sequence
  chemically synthesized
attcacataatcaaggcatagg

SEQ ID NO: 955842 - DNA, 22 bp, Artificial Sequence
  chemically synthesized
ttcacataatcaaggcatagga

SEQ ID NO: 955843 - DNA, 22 bp, Artificial Sequence
  chemically synthesized
acataatcaaggcataggagtt

SEQ ID NO: 955844 - DNA, 22 bp, Artificial Sequence
  chemically synthesized
tcgatgacaggagacccttaac

SEQ ID NO: 955845 - DNA, 22 bp, Artificial Sequence
  chemically synthesized
gggctgtcgatgacaggagacc

SEQ ID NO: 955846 - DNA, 22 bp, Artificial Sequence
  chemically synthesized
tagggctgtcgatgacaggaga

SEQ ID NO: 955847 - DNA, 22 bp, Artificial Sequence
  chemically synthesized
tctagggctgtcgatgacagga

SEQ ID NO: 955848 - DNA, 22 bp, Artificial Sequence
  chemically synthesized
ctctagggctgtcgatgacagg

SEQ ID NO: 955849 - DNA, 22 bp, Artificial Sequence
  chemically synthesized
agggtctcctgtcatcgacagc

SEQ ID NO: 955850 - DNA, 22 bp, Artificial Sequence
  chemically synthesized
gtaacttctctagggctgtcga

SEQ ID NO: 955851 - DNA, 22 bp, Artificial Sequence
  chemically synthesized
cgtaacttctctagggctgtcg

SEQ ID NO: 955852 - DNA, 22 bp, Artificial Sequence
  chemically synthesized
tcgtaacttctctagggctgtc

SEQ ID NO: 955853 - DNA, 22 bp, Artificial Sequence
  chemically synthesized
ctgtcatcgacagccctagaga

SEQ ID NO: 955854 - DNA, 22 bp, Artificial Sequence
  chemically synthesized
tctttcgtaacttctctagggc

SEQ ID NO: 955855 - DNA, 22 bp, Artificial Sequence
  chemically synthesized
gtctttcgtaacttctctaggg

SEQ ID NO: 955856 - DNA, 22 bp, Artificial Sequence
  chemically synthesized
tcatcgacagccctagagaagt

SEQ ID NO: 955857 - DNA, 22 bp, Artificial Sequence
  chemically synthesized
atatttgtctttcgtaacttct

SEQ ID NO: 955858 - DNA, 22 bp, Artificial Sequence
  chemically synthesized
aaagtctcatatttgtctttcg

SEQ ID NO: 955859 - DNA, 22 bp, Artificial Sequence
  chemically synthesized
gagaagttacgaaagacaaata

SEQ ID NO: 955860 - DNA, 22 bp, Artificial Sequence
  chemically synthesized
atatcattaaaagtctcatatt

SEQ ID NO: 955861 - DNA, 22 bp, Artificial Sequence
  chemically synthesized
cgaaagacaaatatgagacttt

SEQ ID NO: 955862 - DNA, 22 bp, Artificial Sequence
  chemically synthesized
ttaatgatatcagatattttgg

SEQ ID NO: 955863 - DNA, 22 bp, Artificial Sequence
  chemically synthesized
taatgatatcagatattttggg

SEQ ID NO: 955864 - DNA, 22 bp, Artificial Sequence
  chemically synthesized
aatgatatcagatattttgggg

SEQ ID NO: 955865 - DNA, 22 bp, Artificial Sequence
  chemically synthesized
atgatatcagatattttggggc

SEQ ID NO: 955866 - DNA, 22 bp, Artificial Sequence
  chemically synthesized
aaaggatgacagtgcagtgccc

SEQ ID NO: 955867 - DNA, 22 bp, Artificial Sequence
  chemically synthesized
aaaaggatgacagtgcagtgcc

SEQ ID NO: 955868 - DNA, 22 bp, Artificial Sequence
  chemically synthesized
cttaaaaggatgacagtgcagt

SEQ ID NO: 955869 - DNA, 22 bp, Artificial Sequence
  chemically synthesized
gcttaaaaggatgacagtgcag

SEQ ID NO: 955870 - DNA, 22 bp, Artificial Sequence
  chemically synthesized
gtttgcttaaaaggatgacagt

SEQ ID NO: 955871 - DNA, 22 bp, Artificial Sequence
  chemically synthesized
tggggcactgcactgtcatcct

SEQ ID NO: 955872 - DNA, 22 bp, Artificial Sequence
  chemically synthesized
ggggcactgcactgtcatcctt

SEQ ID NO: 955873 - DNA, 22 bp, Artificial Sequence
  chemically synthesized
gggcactgcactgtcatccttt

SEQ ID NO: 955874 - DNA, 22 bp, Artificial Sequence
  chemically synthesized
cactgtcatccttttaagcaaa

SEQ ID NO: 955875 - DNA, 22 bp, Artificial Sequence
  chemically synthesized
tcatccttttaagcaaactaga

SEQ ID NO: 955876 - DNA, 22 bp, Artificial Sequence
  chemically synthesized
tggtggagagagaatctagttt

SEQ ID NO: 955877 - DNA, 22 bp, Artificial Sequence
  chemically synthesized
gtggtggagagagaatctagtt

SEQ ID NO: 955878 - DNA, 22 bp, Artificial Sequence
  chemically synthesized
cttgtggtggagagagaatcta

SEQ ID NO: 955879 - DNA, 22 bp, Artificial Sequence
  chemically synthesized
gcttgtggtggagagagaatct

SEQ ID NO: 955880 - DNA, 22 bp, Artificial Sequence
  chemically synthesized
ttaagcaaactagattctctct

SEQ ID NO: 955881 - DNA, 22 bp, Artificial Sequence
  chemically synthesized
taagcaaactagattctctctc

SEQ ID NO: 955882 - DNA, 22 bp, Artificial Sequence
  chemically synthesized
aagcaaactagattctctctcc

SEQ ID NO: 955883 - DNA, 22 bp, Artificial Sequence
  chemically synthesized
agcaaactagattctctctcca

SEQ ID NO: 955884 - DNA, 22 bp, Artificial Sequence
  chemically synthesized
gggtttgcttgtggtggagaga

SEQ ID NO: 955885 - DNA, 22 bp, Artificial Sequence
  chemically synthesized
agggtttgcttgtggtggagag

SEQ ID NO: 955886 - DNA, 22 bp, Artificial Sequence
  chemically synthesized
gattctctctccaccacaagca

SEQ ID NO: 955887 - DNA, 22 bp, Artificial Sequence
  chemically synthesized
ccacttagggtttgcttgtggt

SEQ ID NO: 955888 - DNA, 22 bp, Artificial Sequence
  chemically synthesized
tctctccaccacaagcaaaccc

SEQ ID NO: 955889 - DNA, 22 bp, Artificial Sequence
  chemically synthesized
catctcccacttagggtttgct

SEQ ID NO: 955890 - DNA, 22 bp, Artificial Sequence
  chemically synthesized
tctccaccacaagcaaacccta

SEQ ID NO: 955891 - DNA, 22 bp, Artificial Sequence
  chemically synthesized
gcatctcccacttagggtttgc

SEQ ID NO: 955892 - DNA, 22 bp, Artificial Sequence
  chemically synthesized
tccaccacaagcaaaccctaag

SEQ ID NO: 955893 - DNA, 22 bp, Artificial Sequence
  chemically synthesized
caccacaagcaaaccctaagtg

SEQ ID NO: 955894 - DNA, 22 bp, Artificial Sequence
  chemically synthesized
aagaacaaggtgtacttgcatc

SEQ ID NO: 955895 - DNA, 22 bp, Artificial Sequence
  chemically synthesized
aaagaacaaggtgtacttgcat

SEQ ID NO: 955896 - DNA, 22 bp, Artificial Sequence
  chemically synthesized
agtgggagatgcaagtacacct

SEQ ID NO: 955897 - DNA, 22 bp, Artificial Sequence
  chemically synthesized
tgaatacaaagatccagagttt

SEQ ID NO: 955898 - DNA, 22 bp, Artificial Sequence
  chemically synthesized
gttctttaaactctggatcttt

SEQ ID NO: 955899 - DNA, 22 bp, Artificial Sequence
  chemically synthesized
tcctgtgaatacaaagatccag

SEQ ID NO: 955900 - DNA, 22 bp, Artificial Sequence
  chemically synthesized
ttctttaaactctggatctttg

SEQ ID NO: 955901 - DNA, 22 bp, Artificial Sequence
  chemically synthesized
tttaaactctggatctttgtat

SEQ ID NO: 955902 - DNA, 22 bp, Artificial Sequence
  chemically synthesized
taaactctggatctttgtattc

SEQ ID NO: 955903 - DNA, 22 bp, Artificial Sequence
  chemically synthesized
aaactctggatctttgtattca

SEQ ID NO: 955904 - DNA, 22 bp, Artificial Sequence
  chemically synthesized
aatgttgtcctgtgaatacaaa

SEQ ID NO: 955905 - DNA, 22 bp, Artificial Sequence
  chemically synthesized
aactctggatctttgtattcac

SEQ ID NO: 955906 - DNA, 22 bp, Artificial Sequence
  chemically synthesized
ttgaatgttgtcctgtgaatac

SEQ ID NO: 955907 - DNA, 22 bp, Artificial Sequence
  chemically synthesized
attgaatgttgtcctgtgaata

SEQ ID NO: 955908 - DNA, 22 bp, Artificial Sequence
  chemically synthesized
tggatctttgtattcacaggac

SEQ ID NO: 955909 - DNA, 22 bp, Artificial Sequence
  chemically synthesized
gatctttgtattcacaggacaa

SEQ ID NO: 955910 - DNA, 22 bp, Artificial Sequence
  chemically synthesized
tgtattcacaggacaacattca

SEQ ID NO: 955911 - DNA, 22 bp, Artificial Sequence
  chemically synthesized
gtattcacaggacaacattcaa

SEQ ID NO: 955912 - DNA, 22 bp, Artificial Sequence
  chemically synthesized
tattcacaggacaacattcaat

SEQ ID NO: 955913 - DNA, 22 bp, Artificial Sequence
  chemically synthesized
acaggacaacattcaataaggc

SEQ ID NO: 955914 - DNA, 22 bp, Artificial Sequence
  chemically synthesized
caatggacaggtggccttattg

SEQ ID NO: 955915 - DNA, 22 bp, Artificial Sequence
  chemically synthesized
cattacaatggacaggtggcct

SEQ ID NO: 955916 - DNA, 22 bp, Artificial Sequence
  chemically synthesized
aataaggccacctgtccattgt

SEQ ID NO: 955917 - DNA, 22 bp, Artificial Sequence
  chemically synthesized
atgatctccattacaatggaca

SEQ ID NO: 955918 - DNA, 22 bp, Artificial Sequence
  chemically synthesized
catgatctccattacaatggac

SEQ ID NO: 955919 - DNA, 22 bp, Artificial Sequence
  chemically synthesized
tttcatgatctccattacaatg

SEQ ID NO: 955920 - DNA, 22 bp, Artificial Sequence
  chemically synthesized
ggttatttcatgatctccatta

SEQ ID NO: 955921 - DNA, 22 bp, Artificial Sequence
  chemically synthesized
aggttatttcatgatctccatt

SEQ ID NO: 955922 - DNA, 22 bp, Artificial Sequence
  chemically synthesized
tccattgtaatggagatcatga

SEQ ID NO: 955923 - DNA, 22 bp, Artificial Sequence
  chemically synthesized
taatggagatcatgaaataacc

SEQ ID NO: 955924 - DNA, 22 bp, Artificial Sequence
  chemically synthesized
aaaaagtaaacttaggttattt

SEQ ID NO: 955925 - DNA, 22 bp, Artificial Sequence
  chemically synthesized
caaaaagtaaacttaggttatt

SEQ ID NO: 955926 - DNA, 22 bp, Artificial Sequence
  chemically synthesized
cttcaaaaagtaaacttaggtt

SEQ ID NO: 955927 - DNA, 22 bp, Artificial Sequence
  chemically synthesized
ccaaattacttcaaaaagtaaa

SEQ ID NO: 955928 - DNA, 22 bp, Artificial Sequence
  chemically synthesized
cccaaattacttcaaaaagtaa

SEQ ID NO: 955929 - DNA, 22 bp, Artificial Sequence
  chemically synthesized
catttcccaaattacttcaaaa

SEQ ID NO: 955930 - DNA, 22 bp, Artificial Sequence
  chemically synthesized
tacatttcccaaattacttcaa

SEQ ID NO: 955931 - DNA, 22 bp, Artificial Sequence
  chemically synthesized
ctacatttcccaaattacttca

SEQ ID NO: 955932 - DNA, 22 bp, Artificial Sequence
  chemically synthesized
agtttactttttgaagtaattt

SEQ ID NO: 955933 - DNA, 22 bp, Artificial Sequence
  chemically synthesized
tctacatttcccaaattacttc

SEQ ID NO: 955934 - DNA, 22 bp, Artificial Sequence
  chemically synthesized
ttctacatttcccaaattactt

SEQ ID NO: 955935 - DNA, 22 bp, Artificial Sequence
  chemically synthesized
actttttgaagtaatttgggaa

SEQ ID NO: 955936 - DNA, 22 bp, Artificial Sequence
  chemically synthesized
ctttttgaagtaatttgggaaa

SEQ ID NO: 955937 - DNA, 22 bp, Artificial Sequence
  chemically synthesized
tttgaagtaatttgggaaatgt

SEQ ID NO: 955938 - DNA, 22 bp, Artificial Sequence
  chemically synthesized
ttgaagtaatttgggaaatgta

SEQ ID NO: 955939 - DNA, 22 bp, Artificial Sequence
  chemically synthesized
tgaagtaatttgggaaatgtag

SEQ ID NO: 955940 - DNA, 22 bp, Artificial Sequence
  chemically synthesized
gaagtaatttgggaaatgtaga

SEQ ID NO: 955941 - DNA, 22 bp, Artificial Sequence
  chemically synthesized
ggaacatatttttctacatttc

SEQ ID NO: 955942 - DNA, 22 bp, Artificial Sequence
  chemically synthesized
aagtaatttgggaaatgtagaa

SEQ ID NO: 955943 - DNA, 22 bp, Artificial Sequence
  chemically synthesized
ctgggaacatatttttctacat

SEQ ID NO: 955944 - DNA, 22 bp, Artificial Sequence
  chemically synthesized
gggaaatgtagaaaaatatgtt

SEQ ID NO: 955945 - DNA, 22 bp, Artificial Sequence
  chemically synthesized
ggaaatgtagaaaaatatgttc

SEQ ID NO: 955946 - DNA, 22 bp, Artificial Sequence
  chemically synthesized
cccaatacgaaaattcctggga

SEQ ID NO: 955947 - DNA, 22 bp, Artificial Sequence
  chemically synthesized
tacccaatacgaaaattcctgg

SEQ ID NO: 955948 - DNA, 22 bp, Artificial Sequence
  chemically synthesized
ctacccaatacgaaaattcctg

SEQ ID NO: 955949 - DNA, 22 bp, Artificial Sequence
  chemically synthesized
ccaggaattttcgtattgggta

SEQ ID NO: 955950 - DNA, 22 bp, Artificial Sequence
  chemically synthesized
cagaaaagcatatatttctacc

SEQ ID NO: 955951 - DNA, 22 bp, Artificial Sequence
  chemically synthesized
gcagaaaagcatatatttctac

SEQ ID NO: 955952 - DNA, 22 bp, Artificial Sequence
  chemically synthesized
tcgtattgggtagaaatatatg

SEQ ID NO: 955953 - DNA, 22 bp, Artificial Sequence
  chemically synthesized
cgtattgggtagaaatatatgc

SEQ ID NO: 955954 - DNA, 22 bp, Artificial Sequence
  chemically synthesized
gtattgggtagaaatatatgct

SEQ ID NO: 955955 - DNA, 22 bp, Artificial Sequence
  chemically synthesized
cacttgcagaaaagcatatatt

SEQ ID NO: 955956 - DNA, 22 bp, Artificial Sequence
  chemically synthesized
tactgcacttgcagaaaagcat

SEQ ID NO: 955957 - DNA, 22 bp, Artificial Sequence
  chemically synthesized
ggtagaaatatatgcttttctg

SEQ ID NO: 955958 - DNA, 22 bp, Artificial Sequence
  chemically synthesized
atactgcacttgcagaaaagca

SEQ ID NO: 955959 - DNA, 22 bp, Artificial Sequence
  chemically synthesized
tatactgcacttgcagaaaagc

SEQ ID NO: 955960 - DNA, 22 bp, Artificial Sequence
  chemically synthesized
ttatactgcacttgcagaaaag

SEQ ID NO: 955961 - DNA, 22 bp, Artificial Sequence
  chemically synthesized
atacttttatactgcacttgca

SEQ ID NO: 955962 - DNA, 22 bp, Artificial Sequence
  chemically synthesized
catacttttatactgcacttgc

SEQ ID NO: 955963 - DNA, 22 bp, Artificial Sequence
  chemically synthesized
tcatacttttatactgcacttg

SEQ ID NO: 955964 - DNA, 22 bp, Artificial Sequence
  chemically synthesized
ttcatacttttatactgcactt

SEQ ID NO: 955965 - DNA, 22 bp, Artificial Sequence
  chemically synthesized
tttttcatacttttatactgca

SEQ ID NO: 955966 - DNA, 22 bp, Artificial Sequence
  chemically synthesized
ttctgcaagtgcagtataaaag

SEQ ID NO: 955967 - DNA, 22 bp, Artificial Sequence
  chemically synthesized
tctgcaagtgcagtataaaagt

SEQ ID NO: 955968 - DNA, 22 bp, Artificial Sequence
  chemically synthesized
ctgcaagtgcagtataaaagta

SEQ ID NO: 955969 - DNA, 22 bp, Artificial Sequence
  chemically synthesized
tgcaagtgcagtataaaagtat

SEQ ID NO: 955970 - DNA, 22 bp, Artificial Sequence
  chemically synthesized
catcctatttttcatactttta

SEQ ID NO: 955971 - DNA, 22 bp, Artificial Sequence
  chemically synthesized
caagtgcagtataaaagtatga

SEQ ID NO: 955972 - DNA, 22 bp, Artificial Sequence
  chemically synthesized
ctccatcctatttttcatactt

SEQ ID NO: 955973 - DNA, 22 bp, Artificial Sequence
  chemically synthesized
ttactccatcctatttttcata

SEQ ID NO: 955974 - DNA, 22 bp, Artificial Sequence
  chemically synthesized
ctgttactccatcctatttttc

SEQ ID NO: 955975 - DNA, 22 bp, Artificial Sequence
  chemically synthesized
cctgttactccatcctattttt

SEQ ID NO: 955976 - DNA, 22 bp, Artificial Sequence
  chemically synthesized
tcctgttactccatcctatttt

SEQ ID NO: 955977 - DNA, 22 bp, Artificial Sequence
  chemically synthesized
ttttcctgttactccatcctat

SEQ ID NO: 955978 - DNA, 22 bp, Artificial Sequence
  chemically synthesized
attttcctgttactccatccta

SEQ ID NO: 955979 - DNA, 22 bp, Artificial Sequence
  chemically synthesized
agaaaacttattttcctgttac

SEQ ID NO: 955980 - DNA, 22 bp, Artificial Sequence
  chemically synthesized
cccaactaagaaaacttatttt

SEQ ID NO: 955981 - DNA, 22 bp, Artificial Sequence
  chemically synthesized
gatggtctgcccaactaagaaa

SEQ ID NO: 955982 - DNA, 22 bp, Artificial Sequence
  chemically synthesized
tgcctagatggtctgcccaact

SEQ ID NO: 955983 - DNA, 22 bp, Artificial Sequence
  chemically synthesized
tatgcctagatggtctgcccaa

SEQ ID NO: 955984 - DNA, 22 bp, Artificial Sequence
  chemically synthesized
tcttagttgggcagaccatcta

SEQ ID NO: 955985 - DNA, 22 bp, Artificial Sequence
  chemically synthesized
aggttctatgcctagatggtct

SEQ ID NO: 955986 - DNA, 22 bp, Artificial Sequence
  chemically synthesized
cttagttgggcagaccatctag

SEQ ID NO: 955987 - DNA, 22 bp, Artificial Sequence
  chemically synthesized
ttagttgggcagaccatctagg

SEQ ID NO: 955988 - DNA, 22 bp, Artificial Sequence
  chemically synthesized
ctcaggttctatgcctagatgg

SEQ ID NO: 955989 - DNA, 22 bp, Artificial Sequence
  chemically synthesized
agttgggcagaccatctaggca

SEQ ID NO: 955990 - DNA, 22 bp, Artificial Sequence
  chemically synthesized
actcaggttctatgcctagatg

SEQ ID NO: 955991 - DNA, 22 bp, Artificial Sequence
  chemically synthesized
gttgggcagaccatctaggcat

SEQ ID NO: 955992 - DNA, 22 bp, Artificial Sequence
  chemically synthesized
cttactcaggttctatgcctag

SEQ ID NO: 955993 - DNA, 22 bp, Artificial Sequence
  chemically synthesized
acttactcaggttctatgccta

SEQ ID NO: 955994 - DNA, 22 bp, Artificial Sequence
  chemically synthesized
ggcagaccatctaggcatagaa

SEQ ID NO: 955995 - DNA, 22 bp, Artificial Sequence
  chemically synthesized
ggggaatttacttactcaggtt

SEQ ID NO: 955996 - DNA, 22 bp, Artificial Sequence
  chemically synthesized
ttgggggaatttacttactcag

SEQ ID NO: 955997 - DNA, 22 bp, Artificial Sequence
  chemically synthesized
ggcatagaacctgagtaagtaa

SEQ ID NO: 955998 - DNA, 22 bp, Artificial Sequence
  chemically synthesized
attattgggggaatttacttac

SEQ ID NO: 955999 - DNA, 22 bp, Artificial Sequence
  chemically synthesized
agattaattattgggggaattt

SEQ ID NO: 956000 - DNA, 22 bp, Artificial Sequence
  chemically synthesized
aagattaattattgggggaatt

SEQ ID NO: 956001 - DNA, 22 bp, Artificial Sequence
  chemically synthesized
agtaagtaaattcccccaataa

SEQ ID NO: 956002 - DNA, 22 bp, Artificial Sequence
  chemically synthesized
ccccaataattaatcttaaggt

SEQ ID NO: 956003 - DNA, 22 bp, Artificial Sequence
  chemically synthesized
tgtgaaaagtgaaccttaagat

SEQ ID NO: 956004 - DNA, 22 bp, Artificial Sequence
  chemically synthesized
tatgtgaaaagtgaaccttaag

SEQ ID NO: 956005 - DNA, 22 bp, Artificial Sequence
  chemically synthesized
ctatgtgaaaagtgaaccttaa

SEQ ID NO: 956006 - DNA, 22 bp, Artificial Sequence
  chemically synthesized
acttctatgtgaaaagtgaacc

SEQ ID NO: 956007 - DNA, 22 bp, Artificial Sequence
  chemically synthesized
aacttctatgtgaaaagtgaac

SEQ ID NO: 956008 - DNA, 22 bp, Artificial Sequence
  chemically synthesized
atcttaaggttcacttttcaca

SEQ ID NO: 956009 - DNA, 22 bp, Artificial Sequence
  chemically synthesized
tgtgacttaacttctatgtgaa

SEQ ID NO: 956010 - DNA, 22 bp, Artificial Sequence
  chemically synthesized
aaggttcacttttcacatagaa

SEQ ID NO: 956011 - DNA, 22 bp, Artificial Sequence
  chemically synthesized
atgtgacttaacttctatgtga

SEQ ID NO: 956012 - DNA, 22 bp, Artificial Sequence
  chemically synthesized
aggttcacttttcacatagaag

SEQ ID NO: 956013 - DNA, 22 bp, Artificial Sequence
  chemically synthesized
tatgtgacttaacttctatgtg

SEQ ID NO: 956014 - DNA, 22 bp, Artificial Sequence
  chemically synthesized
acttttcacatagaagttaagt

SEQ ID NO: 956015 - DNA, 22 bp, Artificial Sequence
  chemically synthesized
ttcacatagaagttaagtcaca

SEQ ID NO: 956016 - DNA, 22 bp, Artificial Sequence
  chemically synthesized
tcacatagaagttaagtcacat

SEQ ID NO: 956017 - DNA, 22 bp, Artificial Sequence
  chemically synthesized
cacatagaagttaagtcacata

SEQ ID NO: 956018 - DNA, 22 bp, Artificial Sequence
  chemically synthesized
acatagaagttaagtcacataa

SEQ ID NO: 956019 - DNA, 22 bp, Artificial Sequence
  chemically synthesized
gaggagcaagagtgtatcttta

SEQ ID NO: 956020 - DNA, 22 bp, Artificial Sequence
  chemically synthesized
agtcacataaagatacactctt

SEQ ID NO: 956021 - DNA, 22 bp, Artificial Sequence
  chemically synthesized
atagctagaggagcaagagtgt

SEQ ID NO: 956022 - DNA, 22 bp, Artificial Sequence
  chemically synthesized
aatagctagaggagcaagagtg

SEQ ID NO: 956023 - DNA, 22 bp, Artificial Sequence
  chemically synthesized
gtttaatagctagaggagcaag

SEQ ID NO: 956024 - DNA, 22 bp, Artificial Sequence
  chemically synthesized
ggtttaatagctagaggagcaa

SEQ ID NO: 956025 - DNA, 22 bp, Artificial Sequence
  chemically synthesized
tggaccttggtttaatagctag

SEQ ID NO: 956026 - DNA, 22 bp, Artificial Sequence
  chemically synthesized
ttgctcctctagctattaaacc

SEQ ID NO: 956027 - DNA, 22 bp, Artificial Sequence
  chemically synthesized
gctcctctagctattaaaccaa

SEQ ID NO: 956028 - DNA, 22 bp, Artificial Sequence
  chemically synthesized
ctcctctagctattaaaccaag

SEQ ID NO: 956029 - DNA, 22 bp, Artificial Sequence
  chemically synthesized
ctctagctattaaaccaaggtc

SEQ ID NO: 956030 - DNA, 22 bp, Artificial Sequence
  chemically synthesized
tagctattaaaccaaggtccat

SEQ ID NO: 956031 - DNA, 22 bp, Artificial Sequence
  chemically synthesized
gctattaaaccaaggtccataa

SEQ ID NO: 956032 - DNA, 22 bp, Artificial Sequence
  chemically synthesized
agtaaaaaaaaaaattatggac

SEQ ID NO: 956033 - DNA, 22 bp, Artificial Sequence
  chemically synthesized
ttaaaccaaggtccataatttt

SEQ ID NO: 956034 - DNA, 22 bp, Artificial Sequence
  chemically synthesized
aaccaaggtccataattttttt

SEQ ID NO: 956035 - DNA, 22 bp, Artificial Sequence
  chemically synthesized
ggagtggaaactaagtaaaaaa

SEQ ID NO: 956036 - DNA, 22 bp, Artificial Sequence
  chemically synthesized
atatccctgggagtggaaacta

SEQ ID NO: 956037 - DNA, 22 bp, Artificial Sequence
  chemically synthesized
ttttttttacttagtttccact

SEQ ID NO: 956038 - DNA, 22 bp, Artificial Sequence
  chemically synthesized
catatccctgggagtggaaact

SEQ ID NO: 956039 - DNA, 22 bp, Artificial Sequence
  chemically synthesized
tttttttacttagtttccactc

SEQ ID NO: 956040 - DNA, 22 bp, Artificial Sequence
  chemically synthesized
ttttttacttagtttccactcc

SEQ ID NO: 956041 - DNA, 22 bp, Artificial Sequence
  chemically synthesized
tttttacttagtttccactccc

SEQ ID NO: 956042 - DNA, 22 bp, Artificial Sequence
  chemically synthesized
ttttacttagtttccactccca

SEQ ID NO: 956043 - DNA, 22 bp, Artificial Sequence
  chemically synthesized
tttacttagtttccactcccag

SEQ ID NO: 956044 - DNA, 22 bp, Artificial Sequence
  chemically synthesized
aatttcatatccctgggagtgg

SEQ ID NO: 956045 - DNA, 22 bp, Artificial Sequence
  chemically synthesized
ttacttagtttccactcccagg

SEQ ID NO: 956046 - DNA, 22 bp, Artificial Sequence
  chemically synthesized
tacttagtttccactcccaggg

SEQ ID NO: 956047 - DNA, 22 bp, Artificial Sequence
  chemically synthesized
acttagtttccactcccaggga

SEQ ID NO: 956048 - DNA, 22 bp, Artificial Sequence
  chemically synthesized
cttagtttccactcccagggat

SEQ ID NO: 956049 - DNA, 22 bp, Artificial Sequence
  chemically synthesized
agtttccactcccagggatatg

SEQ ID NO: 956050 - DNA, 22 bp, Artificial Sequence
  chemically synthesized
gtttccactcccagggatatga

SEQ ID NO: 956051 - DNA, 22 bp, Artificial Sequence
  chemically synthesized
ccactcccagggatatgaaatt

SEQ ID NO: 956052 - DNA, 22 bp, Artificial Sequence
  chemically synthesized
cactcccagggatatgaaattt

SEQ ID NO: 956053 - DNA, 22 bp, Artificial Sequence
  chemically synthesized
gggtcaagaatctaaatttcat

SEQ ID NO: 956054 - DNA, 22 bp, Artificial Sequence
  chemically synthesized
ggggtcaagaatctaaatttca

SEQ ID NO: 956055 - DNA, 22 bp, Artificial Sequence
  chemically synthesized
ccagggatatgaaatttagatt

SEQ ID NO: 956056 - DNA, 22 bp, Artificial Sequence
  chemically synthesized
atttggggtcaagaatctaaat

SEQ ID NO: 956057 - DNA, 22 bp, Artificial Sequence
  chemically synthesized
agattcatttggggtcaagaat

SEQ ID NO: 956058 - DNA, 22 bp, Artificial Sequence
  chemically synthesized
agattcttgaccccaaatgaat

SEQ ID NO: 956059 - DNA, 22 bp, Artificial Sequence
  chemically synthesized
gattcttgaccccaaatgaatc

SEQ ID NO: 956060 - DNA, 22 bp, Artificial Sequence
  chemically synthesized
atccatgtgttaagattcattt

SEQ ID NO: 956061 - DNA, 22 bp, Artificial Sequence
  chemically synthesized
catccatgtgttaagattcatt

SEQ ID NO: 956062 - DNA, 22 bp, Artificial Sequence
  chemically synthesized
ttgaccccaaatgaatcttaac

SEQ ID NO: 956063 - DNA, 22 bp, Artificial Sequence
  chemically synthesized
gaccccaaatgaatcttaacac

SEQ ID NO: 956064 - DNA, 22 bp, Artificial Sequence
  chemically synthesized
accccaaatgaatcttaacaca

SEQ ID NO: 956065 - DNA, 22 bp, Artificial Sequence
  chemically synthesized
aagtgtttcatccatgtgttaa

SEQ ID NO: 956066 - DNA, 22 bp, Artificial Sequence
  chemically synthesized
gaagtgtttcatccatgtgtta

SEQ ID NO: 956067 - DNA, 22 bp, Artificial Sequence
  chemically synthesized
tgaagtgtttcatccatgtgtt

SEQ ID NO: 956068 - DNA, 22 bp, Artificial Sequence
  chemically synthesized
ttgaagtgtttcatccatgtgt

SEQ ID NO: 956069 - DNA, 22 bp, Artificial Sequence
  chemically synthesized
tttgaagtgtttcatccatgtg

SEQ ID NO: 956070 - DNA, 22 bp, Artificial Sequence
  chemically synthesized
tactttttgaagtgtttcatcc

SEQ ID NO: 956071 - DNA, 22 bp, Artificial Sequence
  chemically synthesized
aacacatggatgaaacacttca

SEQ ID NO: 956072 - DNA, 22 bp, Artificial Sequence
  chemically synthesized
acacatggatgaaacacttcaa

SEQ ID NO: 956073 - DNA, 22 bp, Artificial Sequence
  chemically synthesized
gtgaaacaggaaagaaactata

SEQ ID NO: 956074 - DNA, 22 bp, Artificial Sequence
  chemically synthesized
caaaaagtatagtttctttcct

SEQ ID NO: 956075 - DNA, 22 bp, Artificial Sequence
  chemically synthesized
aaaaagtatagtttctttcctg

SEQ ID NO: 956076 - DNA, 22 bp, Artificial Sequence
  chemically synthesized
gtcaggtgactggtgaaacagg

SEQ ID NO: 956077 - DNA, 22 bp, Artificial Sequence
  chemically synthesized
ggtcaggtgactggtgaaacag

SEQ ID NO: 956078 - DNA, 22 bp, Artificial Sequence
  chemically synthesized
ctttcctgtttcaccagtcacc

SEQ ID NO: 956079 - DNA, 22 bp, Artificial Sequence
  chemically synthesized
tttcctgtttcaccagtcacct

SEQ ID NO: 956080 - DNA, 22 bp, Artificial Sequence
  chemically synthesized
tcctgtttcaccagtcacctga

SEQ ID NO: 956081 - DNA, 22 bp, Artificial Sequence
  chemically synthesized
cctgtttcaccagtcacctgac

SEQ ID NO: 956082 - DNA, 22 bp, Artificial Sequence
  chemically synthesized
ctgtttcaccagtcacctgacc

SEQ ID NO: 956083 - DNA, 22 bp, Artificial Sequence
  chemically synthesized
tttcaccagtcacctgaccaaa

SEQ ID NO: 956084 - DNA, 22 bp, Artificial Sequence
  chemically synthesized
caccagtcacctgaccaaatca

SEQ ID NO: 956085 - DNA, 22 bp, Artificial Sequence
  chemically synthesized
accagtcacctgaccaaatcac

SEQ ID NO: 956086 - DNA, 22 bp, Artificial Sequence
  chemically synthesized
aggggtgataaggtgatttggt

SEQ ID NO: 956087 - DNA, 22 bp, Artificial Sequence
  chemically synthesized
aattaaggggtgataaggtgat

SEQ ID NO: 956088 - DNA, 22 bp, Artificial Sequence
  chemically synthesized
gaattaaggggtgataaggtga

SEQ ID NO: 956089 - DNA, 22 bp, Artificial Sequence
  chemically synthesized
tgaattaaggggtgataaggtg

SEQ ID NO: 956090 - DNA, 22 bp, Artificial Sequence
  chemically synthesized
accaaatcaccttatcacccct

SEQ ID NO: 956091 - DNA, 22 bp, Artificial Sequence
  chemically synthesized
atcaccccttaattcaaaattg

SEQ ID NO: 956092 - DNA, 22 bp, Artificial Sequence
  chemically synthesized
tcaccccttaattcaaaattga

SEQ ID NO: 956093 - DNA, 22 bp, Artificial Sequence
  chemically synthesized
gaatagagagcacaatcaattt

SEQ ID NO: 956094 - DNA, 22 bp, Artificial Sequence
  chemically synthesized
aattcaaaattgattgtgctct

SEQ ID NO: 956095 - DNA, 22 bp, Artificial Sequence
  chemically synthesized
attcaaaattgattgtgctctc

SEQ ID NO: 956096 - DNA, 22 bp, Artificial Sequence
  chemically synthesized
gaagtctagaatagagagcaca

SEQ ID NO: 956097 - DNA, 22 bp, Artificial Sequence
  chemically synthesized
aaaattgattgtgctctctatt

SEQ ID NO: 956098 - DNA, 22 bp, Artificial Sequence
  chemically synthesized
attgtgctctctattctagact

SEQ ID NO: 956099 - DNA, 22 bp, Artificial Sequence
  chemically synthesized
tgctctctattctagacttcga

SEQ ID NO: 956100 - DNA, 22 bp, Artificial Sequence
  chemically synthesized
tctattctagacttcgagtgac

SEQ ID NO: 956101 - DNA, 22 bp, Artificial Sequence
  chemically synthesized
tattctagacttcgagtgaccc

SEQ ID NO: 956102 - DNA, 22 bp, Artificial Sequence
  chemically synthesized
ttctagacttcgagtgacccat

SEQ ID NO: 956103 - DNA, 22 bp, Artificial Sequence
  chemically synthesized
tagacttcgagtgacccatatt

SEQ ID NO: 956104 - DNA, 22 bp, Artificial Sequence
  chemically synthesized
gacttcgagtgacccatatttt

SEQ ID NO: 956105 - DNA, 22 bp, Artificial Sequence
  chemically synthesized
cgagtgacccatattttttgcc

SEQ ID NO: 956106 - DNA, 22 bp, Artificial Sequence
  chemically synthesized
gagtgacccatattttttgcca

SEQ ID NO: 956107 - DNA, 22 bp, Artificial Sequence
  chemically synthesized
aagaaaaatacaaatggcaaaa

SEQ ID NO: 956108 - DNA, 22 bp, Artificial Sequence
  chemically synthesized
ggaaattaaagaaaaatacaaa

SEQ ID NO: 956109 - DNA, 22 bp, Artificial Sequence
  chemically synthesized
tttgccatttgtatttttcttt

SEQ ID NO: 956110 - DNA, 22 bp, Artificial Sequence
  chemically synthesized
ttgccatttgtatttttcttta

SEQ ID NO: 956111 - DNA, 22 bp, Artificial Sequence
  chemically synthesized
tgccatttgtatttttctttaa

SEQ ID NO: 956112 - DNA, 22 bp, Artificial Sequence
  chemically synthesized
gccatttgtatttttctttaat

SEQ ID NO: 956113 - DNA, 22 bp, Artificial Sequence
  chemically synthesized
ccatttgtatttttctttaatt

SEQ ID NO: 956114 - DNA, 22 bp, Artificial Sequence
  chemically synthesized
gtatttttctttaatttcctag

SEQ ID NO: 956115 - DNA, 22 bp, Artificial Sequence
  chemically synthesized
tatttttctttaatttcctagc

SEQ ID NO: 956116 - DNA, 22 bp, Artificial Sequence
  chemically synthesized
ttctttaatttcctagcccact

SEQ ID NO: 956117 - DNA, 22 bp, Artificial Sequence
  chemically synthesized
tctttaatttcctagcccactt

SEQ ID NO: 956118 - DNA, 22 bp, Artificial Sequence
  chemically synthesized
ctttaatttcctagcccacttt

SEQ ID NO: 956119 - DNA, 22 bp, Artificial Sequence
  chemically synthesized
tttaatttcctagcccacttta

SEQ ID NO: 956120 - DNA, 22 bp, Artificial Sequence
  chemically synthesized
taatttcctagcccactttacc

SEQ ID NO: 956121 - DNA, 22 bp, Artificial Sequence
  chemically synthesized
aatttcctagcccactttaccg

SEQ ID NO: 956122 - DNA, 22 bp, Artificial Sequence
  chemically synthesized
atttcctagcccactttaccgg

SEQ ID NO: 956123 - DNA, 22 bp, Artificial Sequence
  chemically synthesized
cctagcccactttaccggtctt

SEQ ID NO: 956124 - DNA, 22 bp, Artificial Sequence
  chemically synthesized
ctagcccactttaccggtcttc

SEQ ID NO: 956125 - DNA, 22 bp, Artificial Sequence
  chemically synthesized
aacatacaatgagaagaccggt

SEQ ID NO: 956126 - DNA, 22 bp, Artificial Sequence
  chemically synthesized
tgaacatacaatgagaagaccg

SEQ ID NO: 956127 - DNA, 22 bp, Artificial Sequence
  chemically synthesized
gcccactttaccggtcttctca

SEQ ID NO: 956128 - DNA, 22 bp, Artificial Sequence
  chemically synthesized
ttctgaacatacaatgagaaga

SEQ ID NO: 956129 - DNA, 22 bp, Artificial Sequence
  chemically synthesized
attctgaacatacaatgagaag

SEQ ID NO: 956130 - DNA, 22 bp, Artificial Sequence
  chemically synthesized
tattctgaacatacaatgagaa

SEQ ID NO: 956131 - DNA, 22 bp, Artificial Sequence
  chemically synthesized
ttattctgaacatacaatgaga

SEQ ID NO: 956132 - DNA, 22 bp, Artificial Sequence
  chemically synthesized
ttttattctgaacatacaatga

SEQ ID NO: 956133 - DNA, 22 bp, Artificial Sequence
  chemically synthesized
taccggtcttctcattgtatgt

SEQ ID NO: 956134 - DNA, 22 bp, Artificial Sequence
  chemically synthesized
cttttattctgaacatacaatg

SEQ ID NO: 956135 - DNA, 22 bp, Artificial Sequence
  chemically synthesized
accggtcttctcattgtatgtt

SEQ ID NO: 956136 - DNA, 22 bp, Artificial Sequence
  chemically synthesized
tcttttattctgaacatacaat

SEQ ID NO: 956137 - DNA, 22 bp, Artificial Sequence
  chemically synthesized
ccggtcttctcattgtatgttc

SEQ ID NO: 956138 - DNA, 22 bp, Artificial Sequence
  chemically synthesized
ttcttttattctgaacatacaa

SEQ ID NO: 956139 - DNA, 22 bp, Artificial Sequence
  chemically synthesized
ctcattgtatgttcagaataaa

SEQ ID NO: 956140 - DNA, 22 bp, Artificial Sequence
  chemically synthesized
tcattgtatgttcagaataaaa

SEQ ID NO: 956141 - DNA, 22 bp, Artificial Sequence
  chemically synthesized
gtggtccttttcttttattctg

SEQ ID NO: 956142 - DNA, 22 bp, Artificial Sequence
  chemically synthesized
attgtatgttcagaataaaaga

SEQ ID NO: 956143 - DNA, 22 bp, Artificial Sequence
  chemically synthesized
tcgtggtccttttcttttattc

SEQ ID NO: 956144 - DNA, 22 bp, Artificial Sequence
  chemically synthesized
ctcgtggtccttttcttttatt

SEQ ID NO: 956145 - DNA, 22 bp, Artificial Sequence
  chemically synthesized
ttctcgtggtccttttctttta

SEQ ID NO: 956146 - DNA, 22 bp, Artificial Sequence
  chemically synthesized
tatgttcagaataaaagaaaag

SEQ ID NO: 956147 - DNA, 22 bp, Artificial Sequence
  chemically synthesized
agaataaaagaaaaggaccacg

SEQ ID NO: 956148 - DNA, 22 bp, Artificial Sequence
  chemically synthesized
atatagtaccataaaggatatt

SEQ ID NO: 956149 - DNA, 22 bp, Artificial Sequence
  chemically synthesized
catatagtaccataaaggatat

SEQ ID NO: 956150 - DNA, 22 bp, Artificial Sequence
  chemically synthesized
tcatatagtaccataaaggata

SEQ ID NO: 956151 - DNA, 22 bp, Artificial Sequence
  chemically synthesized
atgccacgttttcatatagtac

SEQ ID NO: 956152 - DNA, 22 bp, Artificial Sequence
  chemically synthesized
tatggtactatatgaaaacgtg

SEQ ID NO: 956153 - DNA, 22 bp, Artificial Sequence
  chemically synthesized
atggtactatatgaaaacgtgg

SEQ ID NO: 956154 - DNA, 22 bp, Artificial Sequence
  chemically synthesized
tggtactatatgaaaacgtggc

SEQ ID NO: 956155 - DNA, 22 bp, Artificial Sequence
  chemically synthesized
gtcaagtcatattcatgccacg

SEQ ID NO: 956156 - DNA, 22 bp, Artificial Sequence
  chemically synthesized
tatgaaaacgtggcatgaatat

SEQ ID NO: 956157 - DNA, 22 bp, Artificial Sequence
  chemically synthesized
tatgattagtcaagtcatattc

SEQ ID NO: 956158 - DNA, 22 bp, Artificial Sequence
  chemically synthesized
gtatgattagtcaagtcatatt

SEQ ID NO: 956159 - DNA, 22 bp, Artificial Sequence
  chemically synthesized
tgtatgattagtcaagtcatat

SEQ ID NO: 956160 - DNA, 22 bp, Artificial Sequence
  chemically synthesized
ttgtatgattagtcaagtcata

SEQ ID NO: 956161 - DNA, 22 bp, Artificial Sequence
  chemically synthesized
atttttgtatgattagtcaagt

SEQ ID NO: 956162 - DNA, 22 bp, Artificial Sequence
  chemically synthesized
ctgatttttgtatgattagtca

SEQ ID NO: 956163 - DNA, 22 bp, Artificial Sequence
  chemically synthesized
gactaatcatacaaaaatcagt

SEQ ID NO: 956164 - DNA, 22 bp, Artificial Sequence
  chemically synthesized
actaatcatacaaaaatcagta

SEQ ID NO: 956165 - DNA, 22 bp, Artificial Sequence
  chemically synthesized
atcatacaaaaatcagtaacat

SEQ ID NO: 956166 - DNA, 22 bp, Artificial Sequence
  chemically synthesized
tggacagtagtgtgatgttact

SEQ ID NO: 956167 - DNA, 22 bp, Artificial Sequence
  chemically synthesized
acccaatatctgtggacagtag

SEQ ID NO: 956168 - DNA, 22 bp, Artificial Sequence
  chemically synthesized
actaacccaatatctgtggaca

SEQ ID NO: 956169 - DNA, 22 bp, Artificial Sequence
  chemically synthesized
atgaaatctgactaacccaata

SEQ ID NO: 956170 - DNA, 22 bp, Artificial Sequence
  chemically synthesized
ctgtccacagatattgggttag

SEQ ID NO: 956171 - DNA, 22 bp, Artificial Sequence
  chemically synthesized
tccacagatattgggttagtca

SEQ ID NO: 956172 - DNA, 22 bp, Artificial Sequence
  chemically synthesized
aactaatgaaatctgactaacc

SEQ ID NO: 956173 - DNA, 22 bp, Artificial Sequence
  chemically synthesized
actaaactaatgaaatctgact

SEQ ID NO: 956174 - DNA, 22 bp, Artificial Sequence
  chemically synthesized
cctgactaaactaatgaaatct

SEQ ID NO: 956175 - DNA, 22 bp, Artificial Sequence
  chemically synthesized
ggttagtcagatttcattagtt

SEQ ID NO: 956176 - DNA, 22 bp, Artificial Sequence
  chemically synthesized
gattacctgactaaactaatga

SEQ ID NO: 956177 - DNA, 22 bp, Artificial Sequence
  chemically synthesized
tcgattacctgactaaactaat

SEQ ID NO: 956178 - DNA, 22 bp, Artificial Sequence
  chemically synthesized
ctcgattacctgactaaactaa

SEQ ID NO: 956179 - DNA, 22 bp, Artificial Sequence
  chemically synthesized
gtcagatttcattagtttagtc

SEQ ID NO: 956180 - DNA, 22 bp, Artificial Sequence
  chemically synthesized
cattagtttagtcaggtaatcg

SEQ ID NO: 956181 - DNA, 22 bp, Artificial Sequence
  chemically synthesized
aagcaggtttctcgattacctg

SEQ ID NO: 956182 - DNA, 22 bp, Artificial Sequence
  chemically synthesized
attagtttagtcaggtaatcga

SEQ ID NO: 956183 - DNA, 22 bp, Artificial Sequence
  chemically synthesized
caagcaggtttctcgattacct

SEQ ID NO: 956184 - DNA, 22 bp, Artificial Sequence
  chemically synthesized
gtttagtcaggtaatcgagaaa

SEQ ID NO: 956185 - DNA, 22 bp, Artificial Sequence
  chemically synthesized
atttcaagcaggtttctcgatt

SEQ ID NO: 956186 - DNA, 22 bp, Artificial Sequence
  chemically synthesized
aatttcaagcaggtttctcgat

SEQ ID NO: 956187 - DNA, 22 bp, Artificial Sequence
  chemically synthesized
agtcaggtaatcgagaaacctg

SEQ ID NO: 956188 - DNA, 22 bp, Artificial Sequence
  chemically synthesized
gtcaggtaatcgagaaacctgc

SEQ ID NO: 956189 - DNA, 22 bp, Artificial Sequence
  chemically synthesized
ccacttaatttcaagcaggttt

SEQ ID NO: 956190 - DNA, 22 bp, Artificial Sequence
  chemically synthesized
cccacttaatttcaagcaggtt

SEQ ID NO: 956191 - DNA, 22 bp, Artificial Sequence
  chemically synthesized
tgcccaccttcccacttaattt

SEQ ID NO: 956192 - DNA, 22 bp, Artificial Sequence
  chemically synthesized
tcgttgtgcccaccttcccact

SEQ ID NO: 956193 - DNA, 22 bp, Artificial Sequence
  chemically synthesized
cttgaaattaagtgggaaggtg

SEQ ID NO: 956194 - DNA, 22 bp, Artificial Sequence
  chemically synthesized
attatcgttgtgcccaccttcc

SEQ ID NO: 956195 - DNA, 22 bp, Artificial Sequence
  chemically synthesized
gaaattaagtgggaaggtgggc

SEQ ID NO: 956196 - DNA, 22 bp, Artificial Sequence
  chemically synthesized
gattatcgttgtgcccaccttc

SEQ ID NO: 956197 - DNA, 22 bp, Artificial Sequence
  chemically synthesized
aaattaagtgggaaggtgggca

SEQ ID NO: 956198 - DNA, 22 bp, Artificial Sequence
  chemically synthesized
agtgggaaggtgggcacaacga

SEQ ID NO: 956199 - DNA, 22 bp, Artificial Sequence
  chemically synthesized
taaaatttgattatcgttgtgc

SEQ ID NO: 956200 - DNA, 22 bp, Artificial Sequence
  chemically synthesized
tgttataaaatttgattatcgt

SEQ ID NO: 956201 - DNA, 22 bp, Artificial Sequence
  chemically synthesized
agtatgctatgttataaaattt

SEQ ID NO: 956202 - DNA, 22 bp, Artificial Sequence
  chemically synthesized
cagtatgctatgttataaaatt

SEQ ID NO: 956203 - DNA, 22 bp, Artificial Sequence
  chemically synthesized
cttcagtatgctatgttataaa

SEQ ID NO: 956204 - DNA, 22 bp, Artificial Sequence
  chemically synthesized
ccttcagtatgctatgttataa

SEQ ID NO: 956205 - DNA, 22 bp, Artificial Sequence
  chemically synthesized
gatttccttcagtatgctatgt

SEQ ID NO: 956206 - DNA, 22 bp, Artificial Sequence
  chemically synthesized
agatttccttcagtatgctatg

SEQ ID NO: 956207 - DNA, 22 bp, Artificial Sequence
  chemically synthesized
tagatttccttcagtatgctat

SEQ ID NO: 956208 - DNA, 22 bp, Artificial Sequence
  chemically synthesized
tataacatagcatactgaagga

SEQ ID NO: 956209 - DNA, 22 bp, Artificial Sequence
  chemically synthesized
ataacatagcatactgaaggaa

SEQ ID NO: 956210 - DNA, 22 bp, Artificial Sequence
  chemically synthesized
taacatagcatactgaaggaaa

SEQ ID NO: 956211 - DNA, 22 bp, Artificial Sequence
  chemically synthesized
atgtcagctttagatttccttc

SEQ ID NO: 956212 - DNA, 22 bp, Artificial Sequence
  chemically synthesized
caattaatgtcagctttagatt

SEQ ID NO: 956213 - DNA, 22 bp, Artificial Sequence
  chemically synthesized
ccaattaatgtcagctttagat

SEQ ID NO: 956214 - DNA, 22 bp, Artificial Sequence
  chemically synthesized
atttccaattaatgtcagcttt

SEQ ID NO: 956215 - DNA, 22 bp, Artificial Sequence
  chemically synthesized
aaggaaatctaaagctgacatt

SEQ ID NO: 956216 - DNA, 22 bp, Artificial Sequence
  chemically synthesized
attcatttccaattaatgtcag

SEQ ID NO: 956217 - DNA, 22 bp, Artificial Sequence
  chemically synthesized
tcattcatttccaattaatgtc

SEQ ID NO: 956218 - DNA, 22 bp, Artificial Sequence
  chemically synthesized
ctctcattcatttccaattaat

SEQ ID NO: 956219 - DNA, 22 bp, Artificial Sequence
  chemically synthesized
ctactctcattcatttccaatt

SEQ ID NO: 956220 - DNA, 22 bp, Artificial Sequence
  chemically synthesized
aagctgacattaattggaaatg

SEQ ID NO: 956221 - DNA, 22 bp, Artificial Sequence
  chemically synthesized
gatctactactctcattcattt

SEQ ID NO: 956222 - DNA, 22 bp, Artificial Sequence
  chemically synthesized
acattaattggaaatgaatgag

SEQ ID NO: 956223 - DNA, 22 bp, Artificial Sequence
  chemically synthesized
ggatctactactctcattcatt

SEQ ID NO: 956224 - DNA, 22 bp, Artificial Sequence
  chemically synthesized
attggaaatgaatgagagtagt

SEQ ID NO: 956225 - DNA, 22 bp, Artificial Sequence
  chemically synthesized
cagatatttggatctactactc

SEQ ID NO: 956226 - DNA, 22 bp, Artificial Sequence
  chemically synthesized
gaaatgaatgagagtagtagat

SEQ ID NO: 956227 - DNA, 22 bp, Artificial Sequence
  chemically synthesized
aaggtactgcagatatttggat

SEQ ID NO: 956228 - DNA, 22 bp, Artificial Sequence
  chemically synthesized
ctcaaggtactgcagatatttg

SEQ ID NO: 956229 - DNA, 22 bp, Artificial Sequence
  chemically synthesized
ctgctcaaggtactgcagatat

SEQ ID NO: 956230 - DNA, 22 bp, Artificial Sequence
  chemically synthesized
ctgctgctcaaggtactgcaga

SEQ ID NO: 956231 - DNA, 22 bp, Artificial Sequence
  chemically synthesized
atctcctgctgctcaaggtact

SEQ ID NO: 956232 - DNA, 22 bp, Artificial Sequence
  chemically synthesized
cagttcatctcctgctgctcaa

SEQ ID NO: 956233 - DNA, 22 bp, Artificial Sequence
  chemically synthesized
cagtaccttgagcagcaggaga

SEQ ID NO: 956234 - DNA, 22 bp, Artificial Sequence
  chemically synthesized
tgacaattacagttcatctcct

SEQ ID NO: 956235 - DNA, 22 bp, Artificial Sequence
  chemically synthesized
gagcagcaggagatgaactgta

SEQ ID NO: 956236 - DNA, 22 bp, Artificial Sequence
  chemically synthesized
agcagcaggagatgaactgtaa

SEQ ID NO: 956237 - DNA, 22 bp, Artificial Sequence
  chemically synthesized
aagggcctatgacaattacagt

SEQ ID NO: 956238 - DNA, 22 bp, Artificial Sequence
  chemically synthesized
agtgcgtaattaaagggcctat

SEQ ID NO: 956239 - DNA, 22 bp, Artificial Sequence
  chemically synthesized
ctcagtgcgtaattaaagggcc

SEQ ID NO: 956240 - DNA, 22 bp, Artificial Sequence
  chemically synthesized
taattgtcataggccctttaat

SEQ ID NO: 956241 - DNA, 22 bp, Artificial Sequence
  chemically synthesized
ttcctcagtgcgtaattaaagg

SEQ ID NO: 956242 - DNA, 22 bp, Artificial Sequence
  chemically synthesized
tcataggccctttaattacgca

SEQ ID NO: 956243 - DNA, 22 bp, Artificial Sequence
  chemically synthesized
gtggagttgttcctcagtgcgt

SEQ ID NO: 956244 - DNA, 22 bp, Artificial Sequence
  chemically synthesized
ggtggagttgttcctcagtgcg

SEQ ID NO: 956245 - DNA, 22 bp, Artificial Sequence
  chemically synthesized
tggtggagttgttcctcagtgc

SEQ ID NO: 956246 - DNA, 22 bp, Artificial Sequence
  chemically synthesized
taattacgcactgaggaacaac

SEQ ID NO: 956247 - DNA, 22 bp, Artificial Sequence
  chemically synthesized
aattacgcactgaggaacaact

SEQ ID NO: 956248 - DNA, 22 bp, Artificial Sequence
  chemically synthesized
attacgcactgaggaacaactc

SEQ ID NO: 956249 - DNA, 22 bp, Artificial Sequence
  chemically synthesized
cgcactgaggaacaactccacc

SEQ ID NO: 956250 - DNA, 22 bp, Artificial Sequence
  chemically synthesized
gagcagtgatgttttggtggag

SEQ ID NO: 956251 - DNA, 22 bp, Artificial Sequence
  chemically synthesized
tggagcagtgatgttttggtgg

SEQ ID NO: 956252 - DNA, 22 bp, Artificial Sequence
  chemically synthesized
aggaacaactccaccaaaacat

SEQ ID NO: 956253 - DNA, 22 bp, Artificial Sequence
  chemically synthesized
ttctggagcagtgatgttttgg

SEQ ID NO: 956254 - DNA, 22 bp, Artificial Sequence
  chemically synthesized
attctggagcagtgatgttttg

SEQ ID NO: 956255 - DNA, 22 bp, Artificial Sequence
  chemically synthesized
tattctggagcagtgatgtttt

SEQ ID NO: 956256 - DNA, 22 bp, Artificial Sequence
  chemically synthesized
ttattctggagcagtgatgttt

SEQ ID NO: 956257 - DNA, 22 bp, Artificial Sequence
  chemically synthesized
tttttattctggagcagtgatg

SEQ ID NO: 956258 - DNA, 22 bp, Artificial Sequence
  chemically synthesized
gtttttattctggagcagtgat

SEQ ID NO: 956259 - DNA, 22 bp, Artificial Sequence
  chemically synthesized
caccaaaacatcactgctccag

SEQ ID NO: 956260 - DNA, 22 bp, Artificial Sequence
  chemically synthesized
tagtttgtttttattctggagc

SEQ ID NO: 956261 - DNA, 22 bp, Artificial Sequence
  chemically synthesized
atagtttgtttttattctggag

SEQ ID NO: 956262 - DNA, 22 bp, Artificial Sequence
  chemically synthesized
tatagtttgtttttattctgga

SEQ ID NO: 956263 - DNA, 22 bp, Artificial Sequence
  chemically synthesized
ttatagtttgtttttattctgg

SEQ ID NO: 956264 - DNA, 22 bp, Artificial Sequence
  chemically synthesized
cttttatagtttgtttttattc

SEQ ID NO: 956265 - DNA, 22 bp, Artificial Sequence
  chemically synthesized
tccttttatagtttgtttttat

SEQ ID NO: 956266 - DNA, 22 bp, Artificial Sequence
  chemically synthesized
ctccagaataaaaacaaactat

SEQ ID NO: 956267 - DNA, 22 bp, Artificial Sequence
  chemically synthesized
caactctccttttatagtttgt

SEQ ID NO: 956268 - DNA, 22 bp, Artificial Sequence
  chemically synthesized
cagaataaaaacaaactataaa

SEQ ID NO: 956269 - DNA, 22 bp, Artificial Sequence
  chemically synthesized
atcaagaaagaggcattgcaac

SEQ ID NO: 956270 - DNA, 22 bp, Artificial Sequence
  chemically synthesized
catcaagaaagaggcattgcaa

SEQ ID NO: 956271 - DNA, 22 bp, Artificial Sequence
  chemically synthesized
taaaaggagagttgcaatgcct

SEQ ID NO: 956272 - DNA, 22 bp, Artificial Sequence
  chemically synthesized
tcatcaagaaagaggcattgca

SEQ ID NO: 956273 - DNA, 22 bp, Artificial Sequence
  chemically synthesized
ccaaagtctttcatcaagaaag

SEQ ID NO: 956274 - DNA, 22 bp, Artificial Sequence
  chemically synthesized
cccaaagtctttcatcaagaaa

SEQ ID NO: 956275 - DNA, 22 bp, Artificial Sequence
  chemically synthesized
caatgcctctttcttgatgaaa

SEQ ID NO: 956276 - DNA, 22 bp, Artificial Sequence
  chemically synthesized
cccaagtcttcccaaagtcttt

SEQ ID NO: 956277 - DNA, 22 bp, Artificial Sequence
  chemically synthesized
tttcttgatgaaagactttggg

SEQ ID NO: 956278 - DNA, 22 bp, Artificial Sequence
  chemically synthesized
ttgcccaagtcttcccaaagtc

SEQ ID NO: 956279 - DNA, 22 bp, Artificial Sequence
  chemically synthesized
tcttgatgaaagactttgggaa

SEQ ID NO: 956280 - DNA, 22 bp, Artificial Sequence
  chemically synthesized
attgcccaagtcttcccaaagt

SEQ ID NO: 956281 - DNA, 22 bp, Artificial Sequence
  chemically synthesized
cttgatgaaagactttgggaag

SEQ ID NO: 956282 - DNA, 22 bp, Artificial Sequence
  chemically synthesized
tattgcccaagtcttcccaaag

SEQ ID NO: 956283 - DNA, 22 bp, Artificial Sequence
  chemically synthesized
ttgatgaaagactttgggaaga

SEQ ID NO: 956284 - DNA, 22 bp, Artificial Sequence
  chemically synthesized
tttattgcccaagtcttcccaa

SEQ ID NO: 956285 - DNA, 22 bp, Artificial Sequence
  chemically synthesized
gatgaaagactttgggaagact

SEQ ID NO: 956286 - DNA, 22 bp, Artificial Sequence
  chemically synthesized
atgaaagactttgggaagactt

SEQ ID NO: 956287 - DNA, 22 bp, Artificial Sequence
  chemically synthesized
tgagtattctttattgcccaag

SEQ ID NO: 956288 - DNA, 22 bp, Artificial Sequence
  chemically synthesized
atgagtattctttattgcccaa

SEQ ID NO: 956289 - DNA, 22 bp, Artificial Sequence
  chemically synthesized
tgggaagacttgggcaataaag

SEQ ID NO: 956290 - DNA, 22 bp, Artificial Sequence
  chemically synthesized
gggaagacttgggcaataaaga

SEQ ID NO: 956291 - DNA, 22 bp, Artificial Sequence
  chemically synthesized
ggaagacttgggcaataaagaa

SEQ ID NO: 956292 - DNA, 22 bp, Artificial Sequence
  chemically synthesized
acaatttatgagtattctttat

SEQ ID NO: 956293 - DNA, 22 bp, Artificial Sequence
  chemically synthesized
aactcacaatttatgagtattc

SEQ ID NO: 956294 - DNA, 22 bp, Artificial Sequence
  chemically synthesized
gggcaataaagaatactcataa

SEQ ID NO: 956295 - DNA, 22 bp, Artificial Sequence
  chemically synthesized
ggcaataaagaatactcataaa

SEQ ID NO: 956296 - DNA, 22 bp, Artificial Sequence
  chemically synthesized
aggaaactaaactcacaattta

SEQ ID NO: 956297 - DNA, 22 bp, Artificial Sequence
  chemically synthesized
caggaaactaaactcacaattt

SEQ ID NO: 956298 - DNA, 22 bp, Artificial Sequence
  chemically synthesized
ttcaggaaactaaactcacaat

SEQ ID NO: 956299 - DNA, 22 bp, Artificial Sequence
  chemically synthesized
ataaattgtgagtttagtttcc

SEQ ID NO: 956300 - DNA, 22 bp, Artificial Sequence
  chemically synthesized
tgagtttagtttcctgaagagt

SEQ ID NO: 956301 - DNA, 22 bp, Artificial Sequence
  chemically synthesized
agtttcctgaagagtctttccc

SEQ ID NO: 956302 - DNA, 22 bp, Artificial Sequence
  chemically synthesized
gtttcctgaagagtctttcccc

SEQ ID NO: 956303 - DNA, 22 bp, Artificial Sequence
  chemically synthesized
cctgaagagtctttccccttct

SEQ ID NO: 956304 - DNA, 22 bp, Artificial Sequence
  chemically synthesized
ctgaagagtctttccccttctc

SEQ ID NO: 956305 - DNA, 22 bp, Artificial Sequence
  chemically synthesized
aagagtctttccccttctctct

SEQ ID NO: 956306 - DNA, 22 bp, Artificial Sequence
  chemically synthesized
tccccttctctcttgtctattc

SEQ ID NO: 956307 - DNA, 22 bp, Artificial Sequence
  chemically synthesized
gcagtggtgtgggaatagacaa

SEQ ID NO: 956308 - DNA, 22 bp, Artificial Sequence
  chemically synthesized
ccccttctctcttgtctattcc

SEQ ID NO: 956309 - DNA, 22 bp, Artificial Sequence
  chemically synthesized
cccttctctcttgtctattccc

SEQ ID NO: 956310 - DNA, 22 bp, Artificial Sequence
  chemically synthesized
ctctcttgtctattcccacacc

SEQ ID NO: 956311 - DNA, 22 bp, Artificial Sequence
  chemically synthesized
tctcttgtctattcccacacca

SEQ ID NO: 956312 - DNA, 22 bp, Artificial Sequence
  chemically synthesized
tcttgtctattcccacaccact

SEQ ID NO: 956313 - DNA, 22 bp, Artificial Sequence
  chemically synthesized
ttgtctattcccacaccactgc

SEQ ID NO: 956314 - DNA, 22 bp, Artificial Sequence
  chemically synthesized
gtctattcccacaccactgcta

SEQ ID NO: 956315 - DNA, 22 bp, Artificial Sequence
  chemically synthesized
ggaagataaatctagcagtggt

SEQ ID NO: 956316 - DNA, 22 bp, Artificial Sequence
  chemically synthesized
tctattcccacaccactgctag

SEQ ID NO: 956317 - DNA, 22 bp, Artificial Sequence
  chemically synthesized
aggaagataaatctagcagtgg

SEQ ID NO: 956318 - DNA, 22 bp, Artificial Sequence
  chemically synthesized
taggaagataaatctagcagtg

SEQ ID NO: 956319 - DNA, 22 bp, Artificial Sequence
  chemically synthesized
ttcccacaccactgctagattt

SEQ ID NO: 956320 - DNA, 22 bp, Artificial Sequence
  chemically synthesized
ttttaggaagataaatctagca

SEQ ID NO: 956321 - DNA, 22 bp, Artificial Sequence
  chemically synthesized
ccacaccactgctagatttatc

SEQ ID NO: 956322 - DNA, 22 bp, Artificial Sequence
  chemically synthesized
aaactattttaggaagataaat

SEQ ID NO: 956323 - DNA, 22 bp, Artificial Sequence
  chemically synthesized
taaaactattttaggaagataa

SEQ ID NO: 956324 - DNA, 22 bp, Artificial Sequence
  chemically synthesized
ctaaaactattttaggaagata

SEQ ID NO: 956325 - DNA, 22 bp, Artificial Sequence
  chemically synthesized
ctagatttatcttcctaaaata

SEQ ID NO: 956326 - DNA, 22 bp, Artificial Sequence
  chemically synthesized
gatttatcttcctaaaatagtt

SEQ ID NO: 956327 - DNA, 22 bp, Artificial Sequence
  chemically synthesized
tgcaagtttctaaaactatttt

SEQ ID NO: 956328 - DNA, 22 bp, Artificial Sequence
  chemically synthesized
atcttcctaaaatagttttaga

SEQ ID NO: 956329 - DNA, 22 bp, Artificial Sequence
  chemically synthesized
tcttcctaaaatagttttagaa

SEQ ID NO: 956330 - DNA, 22 bp, Artificial Sequence
  chemically synthesized
aattgtgcaagtttctaaaact

SEQ ID NO: 956331 - DNA, 22 bp, Artificial Sequence
  chemically synthesized
caattgtgcaagtttctaaaac

SEQ ID NO: 956332 - DNA, 22 bp, Artificial Sequence
  chemically synthesized
tcaattgtgcaagtttctaaaa

SEQ ID NO: 956333 - DNA, 22 bp, Artificial Sequence
  chemically synthesized
cctaaaatagttttagaaactt

SEQ ID NO: 956334 - DNA, 22 bp, Artificial Sequence
  chemically synthesized
ctaaaatagttttagaaacttg

SEQ ID NO: 956335 - DNA, 22 bp, Artificial Sequence
  chemically synthesized
tattttcaattgtgcaagtttc

SEQ ID NO: 956336 - DNA, 22 bp, Artificial Sequence
  chemically synthesized
aaatagttttagaaacttgcac

SEQ ID NO: 956337 - DNA, 22 bp, Artificial Sequence
  chemically synthesized
gtattttcaattgtgcaagttt

SEQ ID NO: 956338 - DNA, 22 bp, Artificial Sequence
  chemically synthesized
tgtattttcaattgtgcaagtt

SEQ ID NO: 956339 - DNA, 22 bp, Artificial Sequence
  chemically synthesized
tcaattttgtattttcaattgt

SEQ ID NO: 956340 - DNA, 22 bp, Artificial Sequence
  chemically synthesized
tagaaacttgcacaattgaaaa

SEQ ID NO: 956341 - DNA, 22 bp, Artificial Sequence
  chemically synthesized
agaaacttgcacaattgaaaat

SEQ ID NO: 956342 - DNA, 22 bp, Artificial Sequence
  chemically synthesized
gaaacttgcacaattgaaaata

SEQ ID NO: 956343 - DNA, 22 bp, Artificial Sequence
  chemically synthesized
attgtcaattttgtattttcaa

SEQ ID NO: 956344 - DNA, 22 bp, Artificial Sequence
  chemically synthesized
gtctgattgtcaattttgtatt

SEQ ID NO: 956345 - DNA, 22 bp, Artificial Sequence
  chemically synthesized
gcacaattgaaaatacaaaatt

SEQ ID NO: 956346 - DNA, 22 bp, Artificial Sequence
  chemically synthesized
agtctgattgtcaattttgtat

SEQ ID NO: 956347 - DNA, 22 bp, Artificial Sequence
  chemically synthesized
cacaattgaaaatacaaaattg

SEQ ID NO: 956348 - DNA, 22 bp, Artificial Sequence
  chemically synthesized
tagtctgattgtcaattttgta

SEQ ID NO: 956349 - DNA, 22 bp, Artificial Sequence
  chemically synthesized
ttagtctgattgtcaattttgt

SEQ ID NO: 956350 - DNA, 22 bp, Artificial Sequence
  chemically synthesized
ttttagtctgattgtcaatttt

SEQ ID NO: 956351 - DNA, 22 bp, Artificial Sequence
  chemically synthesized
cttttagtctgattgtcaattt

SEQ ID NO: 956352 - DNA, 22 bp, Artificial Sequence
  chemically synthesized
aaaatacaaaattgacaatcag

SEQ ID NO: 956353 - DNA, 22 bp, Artificial Sequence
  chemically synthesized
caccttcttttagtctgattgt

SEQ ID NO: 956354 - DNA, 22 bp, Artificial Sequence
  chemically synthesized
ttacaccttcttttagtctgat

SEQ ID NO: 956355 - DNA, 22 bp, Artificial Sequence
  chemically synthesized
actattacaccttcttttagtc

SEQ ID NO: 956356 - DNA, 22 bp, Artificial Sequence
  chemically synthesized
acaatcagactaaaagaaggtg

SEQ ID NO: 956357 - DNA, 22 bp, Artificial Sequence
  chemically synthesized
aaagaaggtgtaatagttaggt

SEQ ID NO: 956358 - DNA, 22 bp, Artificial Sequence
  chemically synthesized
agatccatgaatgcgtgaccta

SEQ ID NO: 956359 - DNA, 22 bp, Artificial Sequence
  chemically synthesized
taagatccatgaatgcgtgacc

SEQ ID NO: 956360 - DNA, 22 bp, Artificial Sequence
  chemically synthesized
tgtcccattctaagatccatga

SEQ ID NO: 956361 - DNA, 22 bp, Artificial Sequence
  chemically synthesized
ggtcacgcattcatggatctta

SEQ ID NO: 956362 - DNA, 22 bp, Artificial Sequence
  chemically synthesized
accactatgtcccattctaaga

SEQ ID NO: 956363 - DNA, 22 bp, Artificial Sequence
  chemically synthesized
attgaccactatgtcccattct

SEQ ID NO: 956364 - DNA, 22 bp, Artificial Sequence
  chemically synthesized
atggatcttagaatgggacata

SEQ ID NO: 956365 - DNA, 22 bp, Artificial Sequence
  chemically synthesized
gattcattgaccactatgtccc

SEQ ID NO: 956366 - DNA, 22 bp, Artificial Sequence
  chemically synthesized
agattcattgaccactatgtcc

SEQ ID NO: 956367 - DNA, 22 bp, Artificial Sequence
  chemically synthesized
ttagattcattgaccactatgt

SEQ ID NO: 956368 - DNA, 22 bp, Artificial Sequence
  chemically synthesized
cttagattcattgaccactatg

SEQ ID NO: 956369 - DNA, 22 bp, Artificial Sequence
  chemically synthesized
agaatgggacatagtggtcaat

SEQ ID NO: 956370 - DNA, 22 bp, Artificial Sequence
  chemically synthesized
gaatgggacatagtggtcaatg

SEQ ID NO: 956371 - DNA, 22 bp, Artificial Sequence
  chemically synthesized
agagcttcttagattcattgac

SEQ ID NO: 956372 - DNA, 22 bp, Artificial Sequence
  chemically synthesized
gagagcttcttagattcattga

SEQ ID NO: 956373 - DNA, 22 bp, Artificial Sequence
  chemically synthesized
catttgagagcttcttagattc

SEQ ID NO: 956374 - DNA, 22 bp, Artificial Sequence
  chemically synthesized
tacatttgagagcttcttagat

SEQ ID NO: 956375 - DNA, 22 bp, Artificial Sequence
  chemically synthesized
gatgagaattctacatttgaga

SEQ ID NO: 956376 - DNA, 22 bp, Artificial Sequence
  chemically synthesized
agatgagaattctacatttgag

SEQ ID NO: 956377 - DNA, 22 bp, Artificial Sequence
  chemically synthesized
agaagctctcaaatgtagaatt

SEQ ID NO: 956378 - DNA, 22 bp, Artificial Sequence
  chemically synthesized
gggatgcttagatgagaattct

SEQ ID NO: 956379 - DNA, 22 bp, Artificial Sequence
  chemically synthesized
ttagggatgcttagatgagaat

SEQ ID NO: 956380 - DNA, 22 bp, Artificial Sequence
  chemically synthesized
tcaaatgtagaattctcatcta

SEQ ID NO: 956381 - DNA, 22 bp, Artificial Sequence
  chemically synthesized
aaatgtagaattctcatctaag

SEQ ID NO: 956382 - DNA, 22 bp, Artificial Sequence
  chemically synthesized
tcatctgttagggatgcttaga

SEQ ID NO: 956383 - DNA, 22 bp, Artificial Sequence
  chemically synthesized
gtcatctgttagggatgcttag

SEQ ID NO: 956384 - DNA, 22 bp, Artificial Sequence
  chemically synthesized
acttgtcatctgttagggatgc

SEQ ID NO: 956385 - DNA, 22 bp, Artificial Sequence
  chemically synthesized
tcatctaagcatccctaacaga

SEQ ID NO: 956386 - DNA, 22 bp, Artificial Sequence
  chemically synthesized
atctaagcatccctaacagatg

SEQ ID NO: 956387 - DNA, 22 bp, Artificial Sequence
  chemically synthesized
agcatccctaacagatgacaag

SEQ ID NO: 956388 - DNA, 22 bp, Artificial Sequence
  chemically synthesized
agccaaaattgacttgtcatct

SEQ ID NO: 956389 - DNA, 22 bp, Artificial Sequence
  chemically synthesized
tctaagccaaaattgacttgtc

SEQ ID NO: 956390 - DNA, 22 bp, Artificial Sequence
  chemically synthesized
acagatgacaagtcaattttgg

SEQ ID NO: 956391 - DNA, 22 bp, Artificial Sequence
  chemically synthesized
aaactgtctaagccaaaattga

SEQ ID NO: 956392 - DNA, 22 bp, Artificial Sequence
  chemically synthesized
tggcttagacagtttcagctca

SEQ ID NO: 956393 - DNA, 22 bp, Artificial Sequence
  chemically synthesized
ggcttagacagtttcagctcat

SEQ ID NO: 956394 - DNA, 22 bp, Artificial Sequence
  chemically synthesized
gcttagacagtttcagctcatt

SEQ ID NO: 956395 - DNA, 22 bp, Artificial Sequence
  chemically synthesized
agcatcacaaagcaatgagctg

SEQ ID NO: 956396 - DNA, 22 bp, Artificial Sequence
  chemically synthesized
gagcatcacaaagcaatgagct

SEQ ID NO: 956397 - DNA, 22 bp, Artificial Sequence
  chemically synthesized
tgagcatcacaaagcaatgagc

SEQ ID NO: 956398 - DNA, 22 bp, Artificial Sequence
  chemically synthesized
agacagtttcagctcattgctt

SEQ ID NO: 956399 - DNA, 22 bp, Artificial Sequence
  chemically synthesized
gacagtttcagctcattgcttt

SEQ ID NO: 956400 - DNA, 22 bp, Artificial Sequence
  chemically synthesized
cagctcattgctttgtgatgct

SEQ ID NO: 956401 - DNA, 22 bp, Artificial Sequence
  chemically synthesized
catagtattttgagcatcacaa

SEQ ID NO: 956402 - DNA, 22 bp, Artificial Sequence
  chemically synthesized
agctcattgctttgtgatgctc

SEQ ID NO: 956403 - DNA, 22 bp, Artificial Sequence
  chemically synthesized
tccatagtattttgagcatcac

SEQ ID NO: 956404 - DNA, 22 bp, Artificial Sequence
  chemically synthesized
ttctccatagtattttgagcat

SEQ ID NO: 956405 - DNA, 22 bp, Artificial Sequence
  chemically synthesized
attgctttgtgatgctcaaaat

SEQ ID NO: 956406 - DNA, 22 bp, Artificial Sequence
  chemically synthesized
ctttgtgatgctcaaaatacta

SEQ ID NO: 956407 - DNA, 22 bp, Artificial Sequence
  chemically synthesized
tagctattctccatagtatttt

SEQ ID NO: 956408 - DNA, 22 bp, Artificial Sequence
  chemically synthesized
gtagctattctccatagtattt

SEQ ID NO: 956409 - DNA, 22 bp, Artificial Sequence
  chemically synthesized
tgtgatgctcaaaatactatgg

SEQ ID NO: 956410 - DNA, 22 bp, Artificial Sequence
  chemically synthesized
gtgatgctcaaaatactatgga

SEQ ID NO: 956411 - DNA, 22 bp, Artificial Sequence
  chemically synthesized
tgatgctcaaaatactatggag

SEQ ID NO: 956412 - DNA, 22 bp, Artificial Sequence
  chemically synthesized
cttgtagctattctccatagta

SEQ ID NO: 956413 - DNA, 22 bp, Artificial Sequence
  chemically synthesized
ccttgtagctattctccatagt

SEQ ID NO: 956414 - DNA, 22 bp, Artificial Sequence
  chemically synthesized
aaaatactatggagaatagcta

SEQ ID NO: 956415 - DNA, 22 bp, Artificial Sequence
  chemically synthesized
cgagataacttccttgtagcta

SEQ ID NO: 956416 - DNA, 22 bp, Artificial Sequence
  chemically synthesized
acgagataacttccttgtagct

SEQ ID NO: 956417 - DNA, 22 bp, Artificial Sequence
  chemically synthesized
tacgagataacttccttgtagc

SEQ ID NO: 956418 - DNA, 22 bp, Artificial Sequence
  chemically synthesized
tggagaatagctacaaggaagt

SEQ ID NO: 956419 - DNA, 22 bp, Artificial Sequence
  chemically synthesized
agcatactttacgagataactt

SEQ ID NO: 956420 - DNA, 22 bp, Artificial Sequence
  chemically synthesized
cagcatactttacgagataact

SEQ ID NO: 956421 - DNA, 22 bp, Artificial Sequence
  chemically synthesized
caaggaagttatctcgtaaagt

SEQ ID NO: 956422 - DNA, 22 bp, Artificial Sequence
  chemically synthesized
tctcgtaaagtatgctgaaaca

SEQ ID NO: 956423 - DNA, 22 bp, Artificial Sequence
  chemically synthesized
gtaaagtatgctgaaacattct

SEQ ID NO: 956424 - DNA, 22 bp, Artificial Sequence
  chemically synthesized
aaacattctttcctatacttct

SEQ ID NO: 956425 - DNA, 22 bp, Artificial Sequence
  chemically synthesized
caggaccaaatgataaaaagaa

SEQ ID NO: 956426 - DNA, 22 bp, Artificial Sequence
  chemically synthesized
tttcctatacttctttttatca

SEQ ID NO: 956427 - DNA, 22 bp, Artificial Sequence
  chemically synthesized
ctacaggaccaaatgataaaaa

SEQ ID NO: 956428 - DNA, 22 bp, Artificial Sequence
  chemically synthesized
tcctatacttctttttatcatt

SEQ ID NO: 956429 - DNA, 22 bp, Artificial Sequence
  chemically synthesized
cctatacttctttttatcattt

SEQ ID NO: 956430 - DNA, 22 bp, Artificial Sequence
  chemically synthesized
ctatacttctttttatcatttg

SEQ ID NO: 956431 - DNA, 22 bp, Artificial Sequence
  chemically synthesized
tacttctttttatcatttggtc

SEQ ID NO: 956432 - DNA, 22 bp, Artificial Sequence
  chemically synthesized
gtaaactactacaggaccaaat

SEQ ID NO: 956433 - DNA, 22 bp, Artificial Sequence
  chemically synthesized
ctttttatcatttggtcctgta

SEQ ID NO: 956434 - DNA, 22 bp, Artificial Sequence
  chemically synthesized
tttttatcatttggtcctgtag

SEQ ID NO: 956435 - DNA, 22 bp, Artificial Sequence
  chemically synthesized
atctagtaaactactacaggac

SEQ ID NO: 956436 - DNA, 22 bp, Artificial Sequence
  chemically synthesized
tttatcatttggtcctgtagta

SEQ ID NO: 956437 - DNA, 22 bp, Artificial Sequence
  chemically synthesized
ttatcatttggtcctgtagtag

SEQ ID NO: 956438 - DNA, 22 bp, Artificial Sequence
  chemically synthesized
tatcatttggtcctgtagtagt

SEQ ID NO: 956439 - DNA, 22 bp, Artificial Sequence
  chemically synthesized
atcatttggtcctgtagtagtt

SEQ ID NO: 956440 - DNA, 22 bp, Artificial Sequence
  chemically synthesized
tcatttggtcctgtagtagttt

SEQ ID NO: 956441 - DNA, 22 bp, Artificial Sequence
  chemically synthesized
tgttgatctagtaaactactac

SEQ ID NO: 956442 - DNA, 22 bp, Artificial Sequence
  chemically synthesized
tgtgttgatctagtaaactact

SEQ ID NO: 956443 - DNA, 22 bp, Artificial Sequence
  chemically synthesized
ggtcctgtagtagtttactaga

SEQ ID NO: 956444 - DNA, 22 bp, Artificial Sequence
  chemically synthesized
attctgtgttgatctagtaaac

SEQ ID NO: 956445 - DNA, 22 bp, Artificial Sequence
  chemically synthesized
gtcctgtagtagtttactagat

SEQ ID NO: 956446 - DNA, 22 bp, Artificial Sequence
  chemically synthesized
tagtagtttactagatcaacac

SEQ ID NO: 956447 - DNA, 22 bp, Artificial Sequence
  chemically synthesized
agggggaaattcattctgtgtt

SEQ ID NO: 956448 - DNA, 22 bp, Artificial Sequence
  chemically synthesized
gagggggaaattcattctgtgt

SEQ ID NO: 956449 - DNA, 22 bp, Artificial Sequence
  chemically synthesized
ttgagggggaaattcattctgt

SEQ ID NO: 956450 - DNA, 22 bp, Artificial Sequence
  chemically synthesized
actagatcaacacagaatgaat

SEQ ID NO: 956451 - DNA, 22 bp, Artificial Sequence
  chemically synthesized
cttgagggggaaattcattctg

SEQ ID NO: 956452 - DNA, 22 bp, Artificial Sequence
  chemically synthesized
ctagatcaacacagaatgaatt

SEQ ID NO: 956453 - DNA, 22 bp, Artificial Sequence
  chemically synthesized
gatcaacacagaatgaatttcc

SEQ ID NO: 956454 - DNA, 22 bp, Artificial Sequence
  chemically synthesized
atatacttcttgagggggaaat

SEQ ID NO: 956455 - DNA, 22 bp, Artificial Sequence
  chemically synthesized
ttcatatacttcttgaggggga

SEQ ID NO: 956456 - DNA, 22 bp, Artificial Sequence
  chemically synthesized
attcatatacttcttgaggggg

SEQ ID NO: 956457 - DNA, 22 bp, Artificial Sequence
  chemically synthesized
ccttattcatatacttcttgag

SEQ ID NO: 956458 - DNA, 22 bp, Artificial Sequence
  chemically synthesized
ccccctcaagaagtatatgaat

SEQ ID NO: 956459 - DNA, 22 bp, Artificial Sequence
  chemically synthesized
cccctcaagaagtatatgaata

SEQ ID NO: 956460 - DNA, 22 bp, Artificial Sequence
  chemically synthesized
atgtgtatcattcccttattca

SEQ ID NO: 956461 - DNA, 22 bp, Artificial Sequence
  chemically synthesized
aagaagtatatgaataagggaa

SEQ ID NO: 956462 - DNA, 22 bp, Artificial Sequence
  chemically synthesized
tgatgtgtatcattcccttatt

SEQ ID NO: 956463 - DNA, 22 bp, Artificial Sequence
  chemically synthesized
ctgatgtgtatcattcccttat

SEQ ID NO: 956464 - DNA, 22 bp, Artificial Sequence
  chemically synthesized
tctgatgtgtatcattccctta

SEQ ID NO: 956465 - DNA, 22 bp, Artificial Sequence
  chemically synthesized
ttctgatgtgtatcattccctt

SEQ ID NO: 956466 - DNA, 22 bp, Artificial Sequence
  chemically synthesized
acaaagtgaagaaatgtacctt

SEQ ID NO: 956467 - DNA, 22 bp, Artificial Sequence
  chemically synthesized
aaagtagtgaacaagagctaac

SEQ ID NO: 956468 - DNA, 22 bp, Artificial Sequence
  chemically synthesized
cttcactttgttagctcttgtt

SEQ ID NO: 956469 - DNA, 22 bp, Artificial Sequence
  chemically synthesized
ttcactttgttagctcttgttc

SEQ ID NO: 956470 - DNA, 22 bp, Artificial Sequence
  chemically synthesized
tgctaaaagtagtgaacaagag

SEQ ID NO: 956471 - DNA, 22 bp, Artificial Sequence
  chemically synthesized
cactttgttagctcttgttcac

SEQ ID NO: 956472 - DNA, 22 bp, Artificial Sequence
  chemically synthesized
actttgttagctcttgttcact

SEQ ID NO: 956473 - DNA, 22 bp, Artificial Sequence
  chemically synthesized
tgttagctcttgttcactactt

SEQ ID NO: 956474 - DNA, 22 bp, Artificial Sequence
  chemically synthesized
gttagctcttgttcactacttt

SEQ ID NO: 956475 - DNA, 22 bp, Artificial Sequence
  chemically synthesized
ccagctgtgctaaaagtagtga

SEQ ID NO: 956476 - DNA, 22 bp, Artificial Sequence
  chemically synthesized
ttagctcttgttcactactttt

SEQ ID NO: 956477 - DNA, 22 bp, Artificial Sequence
  chemically synthesized
gccagctgtgctaaaagtagtg

SEQ ID NO: 956478 - DNA, 22 bp, Artificial Sequence
  chemically synthesized
tgccagctgtgctaaaagtagt

SEQ ID NO: 956479 - DNA, 22 bp, Artificial Sequence
  chemically synthesized
gctcttgttcactacttttagc

SEQ ID NO: 956480 - DNA, 22 bp, Artificial Sequence
  chemically synthesized
ttgttcactacttttagcacag

SEQ ID NO: 956481 - DNA, 22 bp, Artificial Sequence
  chemically synthesized
agagctttgccagctgtgctaa

SEQ ID NO: 956482 - DNA, 22 bp, Artificial Sequence
  chemically synthesized
gttcactacttttagcacagct

SEQ ID NO: 956483 - DNA, 22 bp, Artificial Sequence
  chemically synthesized
ttcactacttttagcacagctg

SEQ ID NO: 956484 - DNA, 22 bp, Artificial Sequence
  chemically synthesized
actacttttagcacagctggca

SEQ ID NO: 956485 - DNA, 22 bp, Artificial Sequence
  chemically synthesized
cttttagcacagctggcaaagc

SEQ ID NO: 956486 - DNA, 22 bp, Artificial Sequence
  chemically synthesized
ttagcacagctggcaaagctct

SEQ ID NO: 956487 - DNA, 22 bp, Artificial Sequence
  chemically synthesized
tagcacagctggcaaagctctt

SEQ ID NO: 956488 - DNA, 22 bp, Artificial Sequence
  chemically synthesized
agcacagctggcaaagctctta

SEQ ID NO: 956489 - DNA, 22 bp, Artificial Sequence
  chemically synthesized
gcacagctggcaaagctcttaa

SEQ ID NO: 956490 - DNA, 22 bp, Artificial Sequence
  chemically synthesized
gcaaagctcttaatgtcatgcc

SEQ ID NO: 956491 - DNA, 22 bp, Artificial Sequence
  chemically synthesized
taataggaaagtagacagaggc

SEQ ID NO: 956492 - DNA, 22 bp, Artificial Sequence
  chemically synthesized
ttaatgtcatgcctctgtctac

SEQ ID NO: 956493 - DNA, 22 bp, Artificial Sequence
  chemically synthesized
tgtaataggaaagtagacagag

SEQ ID NO: 956494 - DNA, 22 bp, Artificial Sequence
  chemically synthesized
aatgtcatgcctctgtctactt

SEQ ID NO: 956495 - DNA, 22 bp, Artificial Sequence
  chemically synthesized
atgtcatgcctctgtctacttt

SEQ ID NO: 956496 - DNA, 22 bp, Artificial Sequence
  chemically synthesized
tgtctactttcctattacagag

SEQ ID NO: 956497 - DNA, 22 bp, Artificial Sequence
  chemically synthesized
tctactttcctattacagaggc

SEQ ID NO: 956498 - DNA, 22 bp, Artificial Sequence
  chemically synthesized
ctttcctattacagaggcattg

SEQ ID NO: 956499 - DNA, 22 bp, Artificial Sequence
  chemically synthesized
tcctattacagaggcattgttg

SEQ ID NO: 956500 - DNA, 22 bp, Artificial Sequence
  chemically synthesized
cctattacagaggcattgttgt

SEQ ID NO: 956501 - DNA, 22 bp, Artificial Sequence
  chemically synthesized
ctattacagaggcattgttgtt

SEQ ID NO: 956502 - DNA, 22 bp, Artificial Sequence
  chemically synthesized
ttacagaggcattgttgttttt

SEQ ID NO: 956503 - DNA, 22 bp, Artificial Sequence
  chemically synthesized
agagtgggcgagaaaaaacaac

SEQ ID NO: 956504 - DNA, 22 bp, Artificial Sequence
  chemically synthesized
gagagtgggcgagaaaaaacaa

SEQ ID NO: 956505 - DNA, 22 bp, Artificial Sequence
  chemically synthesized
cagaggcattgttgttttttct

SEQ ID NO: 956506 - DNA, 22 bp, Artificial Sequence
  chemically synthesized
ttgttttttctcgcccactctc

SEQ ID NO: 956507 - DNA, 22 bp, Artificial Sequence
  chemically synthesized
ttttttctcgcccactctcaag

SEQ ID NO: 956508 - DNA, 22 bp, Artificial Sequence
  chemically synthesized
tttctcgcccactctcaagcca

SEQ ID NO: 956509 - DNA, 22 bp, Artificial Sequence
  chemically synthesized
ttctcgcccactctcaagccac

SEQ ID NO: 956510 - DNA, 22 bp, Artificial Sequence
  chemically synthesized
tctcgcccactctcaagccaca

SEQ ID NO: 956511 - DNA, 22 bp, Artificial Sequence
  chemically synthesized
gagagtggtatgtgtggcttga

SEQ ID NO: 956512 - DNA, 22 bp, Artificial Sequence
  chemically synthesized
ctcgcccactctcaagccacac

SEQ ID NO: 956513 - DNA, 22 bp, Artificial Sequence
  chemically synthesized
tcgcccactctcaagccacaca

SEQ ID NO: 956514 - DNA, 22 bp, Artificial Sequence
  chemically synthesized
gcccactctcaagccacacata

SEQ ID NO: 956515 - DNA, 22 bp, Artificial Sequence
  chemically synthesized
ggactggagagtggtatgtgtg

SEQ ID NO: 956516 - DNA, 22 bp, Artificial Sequence
  chemically synthesized
aggactggagagtggtatgtgt

SEQ ID NO: 956517 - DNA, 22 bp, Artificial Sequence
  chemically synthesized
tcaagccacacataccactctc

SEQ ID NO: 956518 - DNA, 22 bp, Artificial Sequence
  chemically synthesized
aagccacacataccactctcca

SEQ ID NO: 956519 - DNA, 22 bp, Artificial Sequence
  chemically synthesized
tccagtcctaaatatgcccttg

SEQ ID NO: 956520 - DNA, 22 bp, Artificial Sequence
  chemically synthesized
cagtcctaaatatgcccttgac

SEQ ID NO: 956521 - DNA, 22 bp, Artificial Sequence
  chemically synthesized
aatatgcccttgacttttgtca

SEQ ID NO: 956522 - DNA, 22 bp, Artificial Sequence
  chemically synthesized
acagagggaacaaaggcatagt

SEQ ID NO: 956523 - DNA, 22 bp, Artificial Sequence
  chemically synthesized
gacttttgtcactatgcctttg

SEQ ID NO: 956524 - DNA, 22 bp, Artificial Sequence
  chemically synthesized
tgacagagggaacaaaggcata

SEQ ID NO: 956525 - DNA, 22 bp, Artificial Sequence
  chemically synthesized
acttttgtcactatgcctttgt

SEQ ID NO: 956526 - DNA, 22 bp, Artificial Sequence
  chemically synthesized
ttgtcactatgcctttgttccc

SEQ ID NO: 956527 - DNA, 22 bp, Artificial Sequence
  chemically synthesized
tgtcactatgcctttgttccct

SEQ ID NO: 956528 - DNA, 22 bp, Artificial Sequence
  chemically synthesized
gtcactatgcctttgttccctc

SEQ ID NO: 956529 - DNA, 22 bp, Artificial Sequence
  chemically synthesized
tcactatgcctttgttccctct

SEQ ID NO: 956530 - DNA, 22 bp, Artificial Sequence
  chemically synthesized
tgcctttgttccctctgtcaga

SEQ ID NO: 956531 - DNA, 22 bp, Artificial Sequence
  chemically synthesized
gaacatggaagatctctgacag

SEQ ID NO: 956532 - DNA, 22 bp, Artificial Sequence
  chemically synthesized
agaacatggaagatctctgaca

SEQ ID NO: 956533 - DNA, 22 bp, Artificial Sequence
  chemically synthesized
tgttccctctgtcagagatctt

SEQ ID NO: 956534 - DNA, 22 bp, Artificial Sequence
  chemically synthesized
gttccctctgtcagagatcttc

SEQ ID NO: 956535 - DNA, 22 bp, Artificial Sequence
  chemically synthesized
ttccctctgtcagagatcttcc

SEQ ID NO: 956536 - DNA, 22 bp, Artificial Sequence
  chemically synthesized
cctctgtcagagatcttccatg

SEQ ID NO: 956537 - DNA, 22 bp, Artificial Sequence
  chemically synthesized
aagacatttagaacatggaaga

SEQ ID NO: 956538 - DNA, 22 bp, Artificial Sequence
  chemically synthesized
gaagacatttagaacatggaag

SEQ ID NO: 956539 - DNA, 22 bp, Artificial Sequence
  chemically synthesized
tgaagacatttagaacatggaa

SEQ ID NO: 956540 - DNA, 22 bp, Artificial Sequence
  chemically synthesized
tgtcagagatcttccatgttct

SEQ ID NO: 956541 - DNA, 22 bp, Artificial Sequence
  chemically synthesized
tcagagatcttccatgttctaa

SEQ ID NO: 956542 - DNA, 22 bp, Artificial Sequence
  chemically synthesized
ccatgttctaaatgtcttcaaa

SEQ ID NO: 956543 - DNA, 22 bp, Artificial Sequence
  chemically synthesized
catgttctaaatgtcttcaaag

SEQ ID NO: 956544 - DNA, 22 bp, Artificial Sequence
  chemically synthesized
acgggtgagaagtctttgaaga

SEQ ID NO: 956545 - DNA, 22 bp, Artificial Sequence
  chemically synthesized
aacgggtgagaagtctttgaag

SEQ ID NO: 956546 - DNA, 22 bp, Artificial Sequence
  chemically synthesized
taaatgtcttcaaagacttctc

SEQ ID NO: 956547 - DNA, 22 bp, Artificial Sequence
  chemically synthesized
aatgtcttcaaagacttctcac

SEQ ID NO: 956548 - DNA, 22 bp, Artificial Sequence
  chemically synthesized
gaaccaaccttaacgggtgaga

SEQ ID NO: 956549 - DNA, 22 bp, Artificial Sequence
  chemically synthesized
caaagacttctcacccgttaag

SEQ ID NO: 956550 - DNA, 22 bp, Artificial Sequence
  chemically synthesized
aaagacttctcacccgttaagg

SEQ ID NO: 956551 - DNA, 22 bp, Artificial Sequence
  chemically synthesized
ctcacccgttaaggttggttct

SEQ ID NO: 956552 - DNA, 22 bp, Artificial Sequence
  chemically synthesized
tcacccgttaaggttggttcta

SEQ ID NO: 956553 - DNA, 22 bp, Artificial Sequence
  chemically synthesized
acccgttaaggttggttctaat

SEQ ID NO: 956554 - DNA, 22 bp, Artificial Sequence
  chemically synthesized
cacagggagatgtcattagaac

SEQ ID NO: 956555 - DNA, 22 bp, Artificial Sequence
  chemically synthesized
aggttggttctaatgacatctc

SEQ ID NO: 956556 - DNA, 22 bp, Artificial Sequence
  chemically synthesized
ggagattgcacagggagatgtc

SEQ ID NO: 956557 - DNA, 22 bp, Artificial Sequence
  chemically synthesized
gttctaatgacatctccctgtg

SEQ ID NO: 956558 - DNA, 22 bp, Artificial Sequence
  chemically synthesized
taatgacatctccctgtgcaat

SEQ ID NO: 956559 - DNA, 22 bp, Artificial Sequence
  chemically synthesized
atgacatctccctgtgcaatct

SEQ ID NO: 956560 - DNA, 22 bp, Artificial Sequence
  chemically synthesized
cctgtgcaatctcctaattgca

SEQ ID NO: 956561 - DNA, 22 bp, Artificial Sequence
  chemically synthesized
tgcaatctcctaattgcatctt

SEQ ID NO: 956562 - DNA, 22 bp, Artificial Sequence
  chemically synthesized
ctaattgcatctttgttggcac

SEQ ID NO: 956563 - DNA, 22 bp, Artificial Sequence
  chemically synthesized
tgcgtatgtgtgtgtgccaaca

SEQ ID NO: 956564 - DNA, 22 bp, Artificial Sequence
  chemically synthesized
gtgcgtatgtgtgtgtgccaac

SEQ ID NO: 956565 - DNA, 22 bp, Artificial Sequence
  chemically synthesized
attgcatctttgttggcacaca

SEQ ID NO: 956566 - DNA, 22 bp, Artificial Sequence
  chemically synthesized
tttgtgcgtatgtgtgtgtgcc

SEQ ID NO: 956567 - DNA, 22 bp, Artificial Sequence
  chemically synthesized
catctttgttggcacacacaca

SEQ ID NO: 956568 - DNA, 22 bp, Artificial Sequence
  chemically synthesized
tgttggcacacacacatacgca

SEQ ID NO: 956569 - DNA, 22 bp, Artificial Sequence
  chemically synthesized
gttggcacacacacatacgcac

SEQ ID NO: 956570 - DNA, 22 bp, Artificial Sequence
  chemically synthesized
ttggcacacacacatacgcaca

SEQ ID NO: 956571 - DNA, 22 bp, Artificial Sequence
  chemically synthesized
gcacacacacatacgcacaaat

SEQ ID NO: 956572 - DNA, 22 bp, Artificial Sequence
  chemically synthesized
tgaacaaagcatatattatttg

SEQ ID NO: 956573 - DNA, 22 bp, Artificial Sequence
  chemically synthesized
atgaacaaagcatatattattt

SEQ ID NO: 956574 - DNA, 22 bp, Artificial Sequence
  chemically synthesized
agcagaataaaatgtgatttat

SEQ ID NO: 956575 - DNA, 22 bp, Artificial Sequence
  chemically synthesized
aagcagaataaaatgtgattta

SEQ ID NO: 956576 - DNA, 22 bp, Artificial Sequence
  chemically synthesized
taagcagaataaaatgtgattt

SEQ ID NO: 956577 - DNA, 22 bp, Artificial Sequence
  chemically synthesized
ttttaagcagaataaaatgtga

SEQ ID NO: 956578 - DNA, 22 bp, Artificial Sequence
  chemically synthesized
tgttcataaatcacattttatt

SEQ ID NO: 956579 - DNA, 22 bp, Artificial Sequence
  chemically synthesized
gttcataaatcacattttattc

SEQ ID NO: 956580 - DNA, 22 bp, Artificial Sequence
  chemically synthesized
ttcataaatcacattttattct

SEQ ID NO: 956581 - DNA, 22 bp, Artificial Sequence
  chemically synthesized
ataaatcacattttattctgct

SEQ ID NO: 956582 - DNA, 22 bp, Artificial Sequence
  chemically synthesized
aagaactattttaagcagaata

SEQ ID NO: 956583 - DNA, 22 bp, Artificial Sequence
  chemically synthesized
aaagaactattttaagcagaat

SEQ ID NO: 956584 - DNA, 22 bp, Artificial Sequence
  chemically synthesized
tattctgcttaaaatagttctt

SEQ ID NO: 956585 - DNA, 22 bp, Artificial Sequence
  chemically synthesized
attctgcttaaaatagttcttt

SEQ ID NO: 956586 - DNA, 22 bp, Artificial Sequence
  chemically synthesized
ttctgcttaaaatagttcttta

SEQ ID NO: 956587 - DNA, 22 bp, Artificial Sequence
  chemically synthesized
tgcttaaaatagttctttaaat

SEQ ID NO: 956588 - DNA, 22 bp, Artificial Sequence
  chemically synthesized
cttaaaatagttctttaaatct

SEQ ID NO: 956589 - DNA, 22 bp, Artificial Sequence
  chemically synthesized
aaaatagttctttaaatcttgt

SEQ ID NO: 956590 - DNA, 22 bp, Artificial Sequence
  chemically synthesized
aaatagttctttaaatcttgtc

SEQ ID NO: 956591 - DNA, 22 bp, Artificial Sequence
  chemically synthesized
gggagaggaacatggacaagat

SEQ ID NO: 956592 - DNA, 22 bp, Artificial Sequence
  chemically synthesized
tttaaatcttgtccatgttcct

SEQ ID NO: 956593 - DNA, 22 bp, Artificial Sequence
  chemically synthesized
cagaactagggagaggaacatg

SEQ ID NO: 956594 - DNA, 22 bp, Artificial Sequence
  chemically synthesized
taaatcttgtccatgttcctct

SEQ ID NO: 956595 - DNA, 22 bp, Artificial Sequence
  chemically synthesized
acagaactagggagaggaacat

SEQ ID NO: 956596 - DNA, 22 bp, Artificial Sequence
  chemically synthesized
aaatcttgtccatgttcctctc

SEQ ID NO: 956597 - DNA, 22 bp, Artificial Sequence
  chemically synthesized
aatcttgtccatgttcctctcc

SEQ ID NO: 956598 - DNA, 22 bp, Artificial Sequence
  chemically synthesized
gtccatgttcctctccctagtt

SEQ ID NO: 956599 - DNA, 22 bp, Artificial Sequence
  chemically synthesized
tccatgttcctctccctagttc

SEQ ID NO: 956600 - DNA, 22 bp, Artificial Sequence
  chemically synthesized
aaaaggtttacagaactaggga

SEQ ID NO: 956601 - DNA, 22 bp, Artificial Sequence
  chemically synthesized
caaaaggtttacagaactaggg

SEQ ID NO: 956602 - DNA, 22 bp, Artificial Sequence
  chemically synthesized
tcaaaaggtttacagaactagg

SEQ ID NO: 956603 - DNA, 22 bp, Artificial Sequence
  chemically synthesized
ctttcaaaaggtttacagaact

SEQ ID NO: 956604 - DNA, 22 bp, Artificial Sequence
  chemically synthesized
ctctccctagttctgtaaacct

SEQ ID NO: 956605 - DNA, 22 bp, Artificial Sequence
  chemically synthesized
tccctagttctgtaaacctttt

SEQ ID NO: 956606 - DNA, 22 bp, Artificial Sequence
  chemically synthesized
cctagttctgtaaaccttttga

SEQ ID NO: 956607 - DNA, 22 bp, Artificial Sequence
  chemically synthesized
gttctgtaaaccttttgaaagt

SEQ ID NO: 956608 - DNA, 22 bp, Artificial Sequence
  chemically synthesized
aggtatagatcctactttcaaa

SEQ ID NO: 956609 - DNA, 22 bp, Artificial Sequence
  chemically synthesized
aaggtatagatcctactttcaa

SEQ ID NO: 956610 - DNA, 22 bp, Artificial Sequence
  chemically synthesized
tgtaaaccttttgaaagtagga

SEQ ID NO: 956611 - DNA, 22 bp, Artificial Sequence
  chemically synthesized
taaaccttttgaaagtaggatc

SEQ ID NO: 956612 - DNA, 22 bp, Artificial Sequence
  chemically synthesized
ggtgaccttaaggtatagatcc

SEQ ID NO: 956613 - DNA, 22 bp, Artificial Sequence
  chemically synthesized
ttgaaagtaggatctatacctt

SEQ ID NO: 956614 - DNA, 22 bp, Artificial Sequence
  chemically synthesized
tgaaagtaggatctatacctta

SEQ ID NO: 956615 - DNA, 22 bp, Artificial Sequence
  chemically synthesized
gaaagtaggatctataccttaa

SEQ ID NO: 956616 - DNA, 22 bp, Artificial Sequence
  chemically synthesized
aaagtaggatctataccttaag

SEQ ID NO: 956617 - DNA, 22 bp, Artificial Sequence
  chemically synthesized
taccttaaggtcacctaatttt

SEQ ID NO: 956618 - DNA, 22 bp, Artificial Sequence
  chemically synthesized
aaaaagagaaaaaaaattaggt

SEQ ID NO: 956619 - DNA, 22 bp, Artificial Sequence
  chemically synthesized
aaaaaagagaaaaaaaattagg

SEQ ID NO: 956620 - DNA, 22 bp, Artificial Sequence
  chemically synthesized
taaaaaagagaaaaaaaattag

SEQ ID NO: 956621 - DNA, 22 bp, Artificial Sequence
  chemically synthesized
ttaaaaaagagaaaaaaaatta

SEQ ID NO: 956622 - DNA, 22 bp, Artificial Sequence
  chemically synthesized
tttaaaaaagagaaaaaaaatt

SEQ ID NO: 956623 - DNA, 22 bp, Artificial Sequence
  chemically synthesized
ttttaaaaaagagaaaaaaaat

SEQ ID NO: 956624 - DNA, 22 bp, Artificial Sequence
  chemically synthesized
aaggtcacctaattttttttct

SEQ ID NO: 956625 - DNA, 22 bp, Artificial Sequence
  chemically synthesized
tttttaaaaaagagaaaaaaaa

SEQ ID NO: 956626 - DNA, 22 bp, Artificial Sequence
  chemically synthesized
aggtcacctaattttttttctc

SEQ ID NO: 956627 - DNA, 22 bp, Artificial Sequence
  chemically synthesized
attttttttctcttttttaaaa

SEQ ID NO: 956628 - DNA, 22 bp, Artificial Sequence
  chemically synthesized
ggtatatagtctttttttaaaa

SEQ ID NO: 956629 - DNA, 22 bp, Artificial Sequence
  chemically synthesized
aggtatatagtctttttttaaa

SEQ ID NO: 956630 - DNA, 22 bp, Artificial Sequence
  chemically synthesized
tttttctcttttttaaaaaaag

SEQ ID NO: 956631 - DNA, 22 bp, Artificial Sequence
  chemically synthesized
ttttctcttttttaaaaaaaga

SEQ ID NO: 956632 - DNA, 22 bp, Artificial Sequence
  chemically synthesized
tttctcttttttaaaaaaagac

SEQ ID NO: 956633 - DNA, 22 bp, Artificial Sequence
  chemically synthesized
ttctcttttttaaaaaaagact

SEQ ID NO: 956634 - DNA, 22 bp, Artificial Sequence
  chemically synthesized
atttaggtatatagtctttttt

SEQ ID NO: 956635 - DNA, 22 bp, Artificial Sequence
  chemically synthesized
tctcttttttaaaaaaagacta

SEQ ID NO: 956636 - DNA, 22 bp, Artificial Sequence
  chemically synthesized
gatttaggtatatagtcttttt

SEQ ID NO: 956637 - DNA, 22 bp, Artificial Sequence
  chemically synthesized
ctcttttttaaaaaaagactat

SEQ ID NO: 956638 - DNA, 22 bp, Artificial Sequence
  chemically synthesized
tgatttaggtatatagtctttt

SEQ ID NO: 956639 - DNA, 22 bp, Artificial Sequence
  chemically synthesized
tcttttttaaaaaaagactata

SEQ ID NO: 956640 - DNA, 22 bp, Artificial Sequence
  chemically synthesized
ttttttaaaaaaagactatata

SEQ ID NO: 956641 - DNA, 22 bp, Artificial Sequence
  chemically synthesized
ttttaaaaaaagactatatacc

SEQ ID NO: 956642 - DNA, 22 bp, Artificial Sequence
  chemically synthesized
tttaaaaaaagactatatacct

SEQ ID NO: 956643 - DNA, 22 bp, Artificial Sequence
  chemically synthesized
ttaaaaaaagactatataccta

SEQ ID NO: 956644 - DNA, 22 bp, Artificial Sequence
  chemically synthesized
ccccctttgatttaggtatata

SEQ ID NO: 956645 - DNA, 22 bp, Artificial Sequence
  chemically synthesized
taaaaaaagactatatacctaa

SEQ ID NO: 956646 - DNA, 22 bp, Artificial Sequence
  chemically synthesized
aaaaaaagactatatacctaaa

SEQ ID NO: 956647 - DNA, 22 bp, Artificial Sequence
  chemically synthesized
aaaaaagactatatacctaaat

SEQ ID NO: 956648 - DNA, 22 bp, Artificial Sequence
  chemically synthesized
attcccccctttgatttaggta

SEQ ID NO: 956649 - DNA, 22 bp, Artificial Sequence
  chemically synthesized
aattcccccctttgatttaggt

SEQ ID NO: 956650 - DNA, 22 bp, Artificial Sequence
  chemically synthesized
tatacctaaatcaaagggggga

SEQ ID NO: 956651 - DNA, 22 bp, Artificial Sequence
  chemically synthesized
tgtgcatttaattccccccttt

SEQ ID NO: 956652 - DNA, 22 bp, Artificial Sequence
  chemically synthesized
ctatgtgcatttaattcccccc

SEQ ID NO: 956653 - DNA, 22 bp, Artificial Sequence
  chemically synthesized
cctatgtgcatttaattccccc

SEQ ID NO: 956654 - DNA, 22 bp, Artificial Sequence
  chemically synthesized
tcctatgtgcatttaattcccc

SEQ ID NO: 956655 - DNA, 22 bp, Artificial Sequence
  chemically synthesized
aatcaaaggggggaattaaatg

SEQ ID NO: 956656 - DNA, 22 bp, Artificial Sequence
  chemically synthesized
atggacaaaatcaatattttcc

SEQ ID NO: 956657 - DNA, 22 bp, Artificial Sequence
  chemically synthesized
aatgcacataggaaaatattga

SEQ ID NO: 956658 - DNA, 22 bp, Artificial Sequence
  chemically synthesized
gaagtctaatggacaaaatcaa

SEQ ID NO: 956659 - DNA, 22 bp, Artificial Sequence
  chemically synthesized
agaagtctaatggacaaaatca

SEQ ID NO: 956660 - DNA, 22 bp, Artificial Sequence
  chemically synthesized
tgtatagatttagaagtctaat

SEQ ID NO: 956661 - DNA, 22 bp, Artificial Sequence
  chemically synthesized
gtgtatagatttagaagtctaa

SEQ ID NO: 956662 - DNA, 22 bp, Artificial Sequence
  chemically synthesized
attttgtccattagacttctaa

SEQ ID NO: 956663 - DNA, 22 bp, Artificial Sequence
  chemically synthesized
ttgtgtatagatttagaagtct

SEQ ID NO: 956664 - DNA, 22 bp, Artificial Sequence
  chemically synthesized
cttgtgtatagatttagaagtc

SEQ ID NO: 956665 - DNA, 22 bp, Artificial Sequence
  chemically synthesized
tgtccattagacttctaaatct

SEQ ID NO: 956666 - DNA, 22 bp, Artificial Sequence
  chemically synthesized
gtccattagacttctaaatcta

SEQ ID NO: 956667 - DNA, 22 bp, Artificial Sequence
  chemically synthesized
tccattagacttctaaatctat

SEQ ID NO: 956668 - DNA, 22 bp, Artificial Sequence
  chemically synthesized
gacttctaaatctatacacaag

SEQ ID NO: 956669 - DNA, 22 bp, Artificial Sequence
  chemically synthesized
ctaaatctatacacaagaagct

SEQ ID NO: 956670 - DNA, 22 bp, Artificial Sequence
  chemically synthesized
taaatctatacacaagaagctt

SEQ ID NO: 956671 - DNA, 22 bp, Artificial Sequence
  chemically synthesized
aatctatacacaagaagctttc

SEQ ID NO: 956672 - DNA, 22 bp, Artificial Sequence
  chemically synthesized
tacacaagaagctttcattatt

SEQ ID NO: 956673 - DNA, 22 bp, Artificial Sequence
  chemically synthesized
aggatatatgtgaataatgaaa

SEQ ID NO: 956674 - DNA, 22 bp, Artificial Sequence
  chemically synthesized
tcattattcacatatatcctta

SEQ ID NO: 956675 - DNA, 22 bp, Artificial Sequence
  chemically synthesized
cattattcacatatatccttaa

SEQ ID NO: 956676 - DNA, 22 bp, Artificial Sequence
  chemically synthesized
attattcacatatatccttaat

SEQ ID NO: 956677 - DNA, 22 bp, Artificial Sequence
  chemically synthesized
ttcacatatatccttaatcata

SEQ ID NO: 956678 - DNA, 22 bp, Artificial Sequence
  chemically synthesized
acatatatccttaatcatattg

SEQ ID NO: 956679 - DNA, 22 bp, Artificial Sequence
  chemically synthesized
aatcatattgtatatgtggggt

SEQ ID NO: 956680 - DNA, 22 bp, Artificial Sequence
  chemically synthesized
atcatattgtatatgtggggta

SEQ ID NO: 956681 - DNA, 22 bp, Artificial Sequence
  chemically synthesized
acacacacacacacacataccc

SEQ ID NO: 956682 - DNA, 22 bp, Artificial Sequence
  chemically synthesized
tcacacacacacacacacatac

SEQ ID NO: 956683 - DNA, 22 bp, Artificial Sequence
  chemically synthesized
tatatgtggggtatgtgtgtgt

SEQ ID NO: 956684 - DNA, 22 bp, Artificial Sequence
  chemically synthesized
tctcacacacacacacacacat

SEQ ID NO: 956685 - DNA, 22 bp, Artificial Sequence
  chemically synthesized
tctctcacacacacacacacac

SEQ ID NO: 956686 - DNA, 22 bp, Artificial Sequence
  chemically synthesized
tctctctcacacacacacacac

SEQ ID NO: 956687 - DNA, 22 bp, Artificial Sequence
  chemically synthesized
tctctctctcacacacacacac

SEQ ID NO: 956688 - DNA, 22 bp, Artificial Sequence
  chemically synthesized
tctctctctctcacacacacac

SEQ ID NO: 956689 - DNA, 22 bp, Artificial Sequence
  chemically synthesized
tctctctctctctcacacacac

SEQ ID NO: 956690 - DNA, 22 bp, Artificial Sequence
  chemically synthesized
tctctctctctctctcacacac

SEQ ID NO: 956691 - DNA, 22 bp, Artificial Sequence
  chemically synthesized
tctctctctctctctctcacac

SEQ ID NO: 956692 - DNA, 22 bp, Artificial Sequence
  chemically synthesized
tctctctctctctctctctcac

SEQ ID NO: 956693 - DNA, 22 bp, Artificial Sequence
  chemically synthesized
tctctctctctctctctctctc

SEQ ID NO: 956694 - DNA, 22 bp, Artificial Sequence
  chemically synthesized
tctctctctctctctctctctc

SEQ ID NO: 956695 - DNA, 22 bp, Artificial Sequence
  chemically synthesized
tctctctctctctctctctctc

SEQ ID NO: 956696 - DNA, 22 bp, Artificial Sequence
  chemically synthesized
tctctctctctctctctctctc

SEQ ID NO: 956697 - DNA, 22 bp, Artificial Sequence
  chemically synthesized
tctctctctctctctctctctc

SEQ ID NO: 956698 - DNA, 22 bp, Artificial Sequence
  chemically synthesized
tctctctctctctctctctctc

SEQ ID NO: 956699 - DNA, 22 bp, Artificial Sequence
  chemically synthesized
tctctctctctctctctctctc

SEQ ID NO: 956700 - DNA, 22 bp, Artificial Sequence
  chemically synthesized
tctctctctctctctctctctc

SEQ ID NO: 956701 - DNA, 22 bp, Artificial Sequence
  chemically synthesized
tctctctctctctctctctctc

SEQ ID NO: 956702 - DNA, 22 bp, Artificial Sequence
  chemically synthesized
tctctctctctctctctctctc

SEQ ID NO: 956703 - DNA, 22 bp, Artificial Sequence
  chemically synthesized
tctctctctctctctctctctc

SEQ ID NO: 956704 - DNA, 22 bp, Artificial Sequence
  chemically synthesized
tctctctctctctctctctctc

SEQ ID NO: 956705 - DNA, 22 bp, Artificial Sequence
  chemically synthesized
tctctctctctctctctctctc

SEQ ID NO: 956706 - DNA, 22 bp, Artificial Sequence
  chemically synthesized
ctctctctctctctctctctct

SEQ ID NO: 956707 - DNA, 22 bp, Artificial Sequence
  chemically synthesized
ttctctctctctctctctctct

SEQ ID NO: 956708 - DNA, 22 bp, Artificial Sequence
  chemically synthesized
agtcctcttctctctctctctc

SEQ ID NO: 956709 - DNA, 22 bp, Artificial Sequence
  chemically synthesized
ctcagtcctcttctctctctct

SEQ ID NO: 956710 - DNA, 22 bp, Artificial Sequence
  chemically synthesized
gttcctcagtcctcttctctct

SEQ ID NO: 956711 - DNA, 22 bp, Artificial Sequence
  chemically synthesized
ggttcctcagtcctcttctctc

SEQ ID NO: 956712 - DNA, 22 bp, Artificial Sequence
  chemically synthesized
tggttcctcagtcctcttctct

SEQ ID NO: 956713 - DNA, 22 bp, Artificial Sequence
  chemically synthesized
ttggttcctcagtcctcttctc

SEQ ID NO: 956714 - DNA, 22 bp, Artificial Sequence
  chemically synthesized
tttggttcctcagtcctcttct

SEQ ID NO: 956715 - DNA, 22 bp, Artificial Sequence
  chemically synthesized
tttttggttcctcagtcctctt

SEQ ID NO: 956716 - DNA, 22 bp, Artificial Sequence
  chemically synthesized
ctttttggttcctcagtcctct

SEQ ID NO: 956717 - DNA, 22 bp, Artificial Sequence
  chemically synthesized
tctttttggttcctcagtcctc

SEQ ID NO: 956718 - DNA, 22 bp, Artificial Sequence
  chemically synthesized
ttttctttttggttcctcagtc

SEQ ID NO: 956719 - DNA, 22 bp, Artificial Sequence
  chemically synthesized
attttctttttggttcctcagt

SEQ ID NO: 956720 - DNA, 22 bp, Artificial Sequence
  chemically synthesized
acttattttctttttggttcct

SEQ ID NO: 956721 - DNA, 22 bp, Artificial Sequence
  chemically synthesized
ctgacttattttctttttggtt

SEQ ID NO: 956722 - DNA, 22 bp, Artificial Sequence
  chemically synthesized
tgctcctgacttattttctttt

SEQ ID NO: 956723 - DNA, 22 bp, Artificial Sequence
  chemically synthesized
atgctcctgacttattttcttt

SEQ ID NO: 956724 - DNA, 22 bp, Artificial Sequence
  chemically synthesized
aggaaccaaaaagaaaataagt

SEQ ID NO: 956725 - DNA, 22 bp, Artificial Sequence
  chemically synthesized
cttatgctcctgacttattttc

SEQ ID NO: 956726 - DNA, 22 bp, Artificial Sequence
  chemically synthesized
aagtataataaaaaaaaaaaag

SEQ ID NO: 956727 - DNA, 22 bp, Artificial Sequence
  chemically synthesized
aaagtataataaaaaaaaaaaa

SEQ ID NO: 956728 - DNA, 22 bp, Artificial Sequence
  chemically synthesized
aaacttaaagtataataaaaaa

SEQ ID NO: 956729 - DNA, 22 bp, Artificial Sequence
  chemically synthesized
tcttcttttttttttttattat

SEQ ID NO: 956730 - DNA, 22 bp, Artificial Sequence
  chemically synthesized
cttcttttttttttttattata

SEQ ID NO: 956731 - DNA, 22 bp, Artificial Sequence
  chemically synthesized
ttcttttttttttttattatac

SEQ ID NO: 956732 - DNA, 22 bp, Artificial Sequence
  chemically synthesized
cttttttttttttattatactt

SEQ ID NO: 956733 - DNA, 22 bp, Artificial Sequence
  chemically synthesized
ttttttttttttattatacttt

SEQ ID NO: 956734 - DNA, 22 bp, Artificial Sequence
  chemically synthesized
ttttttttttattatactttaa

SEQ ID NO: 956735 - DNA, 22 bp, Artificial Sequence
  chemically synthesized
tttttttttattatactttaag

SEQ ID NO: 956736 - DNA, 22 bp, Artificial Sequence
  chemically synthesized
ttttttttattatactttaagt

SEQ ID NO: 956737 - DNA, 22 bp, Artificial Sequence
  chemically synthesized
tttttttattatactttaagtt

SEQ ID NO: 956738 - DNA, 22 bp, Artificial Sequence
  chemically synthesized
ttttttattatactttaagttt

SEQ ID NO: 956739 - DNA, 22 bp, Artificial Sequence
  chemically synthesized
tttttattatactttaagtttt

SEQ ID NO: 956740 - DNA, 22 bp, Artificial Sequence
  chemically synthesized
ttttattatactttaagtttta

SEQ ID NO: 956741 - DNA, 22 bp, Artificial Sequence
  chemically synthesized
tttattatactttaagttttag

SEQ ID NO: 956742 - DNA, 22 bp, Artificial Sequence
  chemically synthesized
tgcacatgtaccctaaaactta

SEQ ID NO: 956743 - DNA, 22 bp, Artificial Sequence
  chemically synthesized
ttattatactttaagttttagg

SEQ ID NO: 956744 - DNA, 22 bp, Artificial Sequence
  chemically synthesized
tattatactttaagttttaggg

SEQ ID NO: 956745 - DNA, 22 bp, Artificial Sequence
  chemically synthesized
attatactttaagttttagggt

SEQ ID NO: 956746 - DNA, 22 bp, Artificial Sequence
  chemically synthesized
ttatactttaagttttagggta

SEQ ID NO: 956747 - DNA, 22 bp, Artificial Sequence
  chemically synthesized
tactttaagttttagggtacat

SEQ ID NO: 956748 - DNA, 22 bp, Artificial Sequence
  chemically synthesized
cacgttgtgcacatgtacccta

SEQ ID NO: 956749 - DNA, 22 bp, Artificial Sequence
  chemically synthesized
taagttttagggtacatgtgca

SEQ ID NO: 956750 - DNA, 22 bp, Artificial Sequence
  chemically synthesized
aagttttagggtacatgtgcac

SEQ ID NO: 956751 - DNA, 22 bp, Artificial Sequence
  chemically synthesized
agttttagggtacatgtgcaca

SEQ ID NO: 956752 - DNA, 22 bp, Artificial Sequence
  chemically synthesized
tagggtacatgtgcacaacgtg

SEQ ID NO: 956753 - DNA, 22 bp, Artificial Sequence
  chemically synthesized
agggtacatgtgcacaacgtgc

SEQ ID NO: 956754 - DNA, 22 bp, Artificial Sequence
  chemically synthesized
gggtacatgtgcacaacgtgca

SEQ ID NO: 956755 - DNA, 22 bp, Artificial Sequence
  chemically synthesized
gttacatatgtatacatgtgcc

SEQ ID NO: 956756 - DNA, 22 bp, Artificial Sequence
  chemically synthesized
ttacatatgtatacatgtgcca

SEQ ID NO: 956757 - DNA, 22 bp, Artificial Sequence
  chemically synthesized
catatgtatacatgtgccatgt

SEQ ID NO: 956758 - DNA, 22 bp, Artificial Sequence
  chemically synthesized
atgggtgcaggacaccaacatg

SEQ ID NO: 956759 - DNA, 22 bp, Artificial Sequence
  chemically synthesized
aatgaccagttaatgggtgcag

SEQ ID NO: 956760 - DNA, 22 bp, Artificial Sequence
  chemically synthesized
atgctaaatgaccagttaatgg

SEQ ID NO: 956761 - DNA, 22 bp, Artificial Sequence
  chemically synthesized
gtgtcctgcacccattaactgg

SEQ ID NO: 956762 - DNA, 22 bp, Artificial Sequence
  chemically synthesized
aatgctaaatgaccagttaatg

SEQ ID NO: 956763 - DNA, 22 bp, Artificial Sequence
  chemically synthesized
cacccattaactggtcatttag

SEQ ID NO: 956764 - DNA, 22 bp, Artificial Sequence
  chemically synthesized
ggagatatacttaatgctaaat

SEQ ID NO: 956765 - DNA, 22 bp, Artificial Sequence
  chemically synthesized
actggtcatttagcattaagta

SEQ ID NO: 956766 - DNA, 22 bp, Artificial Sequence
  chemically synthesized
gtcatttagcattaagtatatc

SEQ ID NO: 956767 - DNA, 22 bp, Artificial Sequence
  chemically synthesized
agcattaagtatatctcctaat

SEQ ID NO: 956768 - DNA, 22 bp, Artificial Sequence
  chemically synthesized
gcattaagtatatctcctaatg

SEQ ID NO: 956769 - DNA, 22 bp, Artificial Sequence
  chemically synthesized
agtatatctcctaatgctatcc

SEQ ID NO: 956770 - DNA, 22 bp, Artificial Sequence
  chemically synthesized
tggggtggggggagggtggagg

SEQ ID NO: 956771 - DNA, 22 bp, Artificial Sequence
  chemically synthesized
ctaatgctatccctccaccctc

SEQ ID NO: 956772 - DNA, 22 bp, Artificial Sequence
  chemically synthesized
ttgtggggtggggggagggtgg

SEQ ID NO: 956773 - DNA, 22 bp, Artificial Sequence
  chemically synthesized
atgctatccctccaccctcccc

SEQ ID NO: 956774 - DNA, 22 bp, Artificial Sequence
  chemically synthesized
tccctccaccctccccccaccc

SEQ ID NO: 956775 - DNA, 22 bp, Artificial Sequence
  chemically synthesized
caccctccccccaccccacaac

SEQ ID NO: 956776 - DNA, 22 bp, Artificial Sequence
  chemically synthesized
cccccaccccacaacaggcccc

SEQ ID NO: 956777 - DNA, 22 bp, Artificial Sequence
  chemically synthesized
aacaatgagaacacatggacac

SEQ ID NO: 956778 - DNA, 22 bp, Artificial Sequence
  chemically synthesized
cccttcctgtgtccatgtgttc

SEQ ID NO: 956779 - DNA, 22 bp, Artificial Sequence
  chemically synthesized
cctgtgtccatgtgttctcatt

SEQ ID NO: 956780 - DNA, 22 bp, Artificial Sequence
  chemically synthesized
ctgtgtccatgtgttctcattg

SEQ ID NO: 956781 - DNA, 22 bp, Artificial Sequence
  chemically synthesized
tgtccatgtgttctcattgttc

SEQ ID NO: 956782 - DNA, 22 bp, Artificial Sequence
  chemically synthesized
ataggtgggaattgaacaatga

SEQ ID NO: 956783 - DNA, 22 bp, Artificial Sequence
  chemically synthesized
actcataggtgggaattgaaca

SEQ ID NO: 956784 - DNA, 22 bp, Artificial Sequence
  chemically synthesized
tcactcataggtgggaattgaa

SEQ ID NO: 956785 - DNA, 22 bp, Artificial Sequence
  chemically synthesized
tcattgttcaattcccacctat

SEQ ID NO: 956786 - DNA, 22 bp, Artificial Sequence
  chemically synthesized
attgttcaattcccacctatga

SEQ ID NO: 956787 - DNA, 22 bp, Artificial Sequence
  chemically synthesized
ttcaattcccacctatgagtga

SEQ ID NO: 956788 - DNA, 22 bp, Artificial Sequence
  chemically synthesized
aattcccacctatgagtgagaa

SEQ ID NO: 956789 - DNA, 22 bp, Artificial Sequence
  chemically synthesized
ccacctatgagtgagaacatgc

SEQ ID NO: 956790 - DNA, 22 bp, Artificial Sequence
  chemically synthesized
tgagtgagaacatgcggtgttt

SEQ ID NO: 956791 - DNA, 22 bp, Artificial Sequence
  chemically synthesized
caaggacaaaaaaccaaacacc

SEQ ID NO: 956792 - DNA, 22 bp, Artificial Sequence
  chemically synthesized
ttgcaaggacaaaaaaccaaac

SEQ ID NO: 956793 - DNA, 22 bp, Artificial Sequence
  chemically synthesized
agcaaactattgcaaggacaaa

SEQ ID NO: 956794 - DNA, 22 bp, Artificial Sequence
  chemically synthesized
tcagcaaactattgcaaggaca

SEQ ID NO: 956795 - DNA, 22 bp, Artificial Sequence
  chemically synthesized
ggttttttgtccttgcaatagt

SEQ ID NO: 956796 - DNA, 22 bp, Artificial Sequence
  chemically synthesized
gttttttgtccttgcaatagtt

SEQ ID NO: 956797 - DNA, 22 bp, Artificial Sequence
  chemically synthesized
tttgtccttgcaatagtttgct

SEQ ID NO: 956798 - DNA, 22 bp, Artificial Sequence
  chemically synthesized
ttgtccttgcaatagtttgctg

SEQ ID NO: 956799 - DNA, 22 bp, Artificial Sequence
  chemically synthesized
tgtccttgcaatagtttgctga

SEQ ID NO: 956800 - DNA, 22 bp, Artificial Sequence
  chemically synthesized
gtccttgcaatagtttgctgag

SEQ ID NO: 956801 - DNA, 22 bp, Artificial Sequence
  chemically synthesized
gaaaccatcgttctcagcaaac

SEQ ID NO: 956802 - DNA, 22 bp, Artificial Sequence
  chemically synthesized
tccttgcaatagtttgctgaga

SEQ ID NO: 956803 - DNA, 22 bp, Artificial Sequence
  chemically synthesized
gcaatagtttgctgagaacgat

SEQ ID NO: 956804 - DNA, 22 bp, Artificial Sequence
  chemically synthesized
caatagtttgctgagaacgatg

SEQ ID NO: 956805 - DNA, 22 bp, Artificial Sequence
  chemically synthesized
gctgagaacgatggtttccaga

SEQ ID NO: 956806 - DNA, 22 bp, Artificial Sequence
  chemically synthesized
ctgagaacgatggtttccagat

SEQ ID NO: 956807 - DNA, 22 bp, Artificial Sequence
  chemically synthesized
agaacgatggtttccagattca

SEQ ID NO: 956808 - DNA, 22 bp, Artificial Sequence
  chemically synthesized
tagggacatggatgaatctgga

SEQ ID NO: 956809 - DNA, 22 bp, Artificial Sequence
  chemically synthesized
gtagggacatggatgaatctgg

SEQ ID NO: 956810 - DNA, 22 bp, Artificial Sequence
  chemically synthesized
tgtagggacatggatgaatctg

SEQ ID NO: 956811 - DNA, 22 bp, Artificial Sequence
  chemically synthesized
ccagattcatccatgtccctac

SEQ ID NO: 956812 - DNA, 22 bp, Artificial Sequence
  chemically synthesized
cagattcatccatgtccctaca

SEQ ID NO: 956813 - DNA, 22 bp, Artificial Sequence
  chemically synthesized
tagaaaaggaaaatactttgta

SEQ ID NO: 956814 - DNA, 22 bp, Artificial Sequence
  chemically synthesized
atccatgtccctacaaagtatt

SEQ ID NO: 956815 - DNA, 22 bp, Artificial Sequence
  chemically synthesized
gtagaaaaggaaaatactttgt

SEQ ID NO: 956816 - DNA, 22 bp, Artificial Sequence
  chemically synthesized
tgtagaaaaggaaaatactttg

SEQ ID NO: 956817 - DNA, 22 bp, Artificial Sequence
  chemically synthesized
ttgtagaaaaggaaaatacttt

SEQ ID NO: 956818 - DNA, 22 bp, Artificial Sequence
  chemically synthesized
tttgtagaaaaggaaaatactt

SEQ ID NO: 956819 - DNA, 22 bp, Artificial Sequence
  chemically synthesized
ttttgtagaaaaggaaaatact

SEQ ID NO: 956820 - DNA, 22 bp, Artificial Sequence
  chemically synthesized
gaatttttttgtagaaaaggaa

SEQ ID NO: 956821 - DNA, 22 bp, Artificial Sequence
  chemically synthesized
caaagtattttccttttctaca

SEQ ID NO: 956822 - DNA, 22 bp, Artificial Sequence
  chemically synthesized
tccttttctacaaaaaaattct

SEQ ID NO: 956823 - DNA, 22 bp, Artificial Sequence
  chemically synthesized
ccttttctacaaaaaaattcta

SEQ ID NO: 956824 - DNA, 22 bp, Artificial Sequence
  chemically synthesized
cttttctacaaaaaaattctaa

SEQ ID NO: 956825 - DNA, 22 bp, Artificial Sequence
  chemically synthesized
ttctacaaaaaaattctaattg

SEQ ID NO: 956826 - DNA, 22 bp, Artificial Sequence
  chemically synthesized
tctacaaaaaaattctaattga

SEQ ID NO: 956827 - DNA, 22 bp, Artificial Sequence
  chemically synthesized
ctacaaaaaaattctaattgac

SEQ ID NO: 956828 - DNA, 22 bp, Artificial Sequence
  chemically synthesized
tacaaaaaaattctaattgacc

SEQ ID NO: 956829 - DNA, 22 bp, Artificial Sequence
  chemically synthesized
caaaaaaattctaattgacctg

SEQ ID NO: 956830 - DNA, 22 bp, Artificial Sequence
  chemically synthesized
caaagtgaaaataatgtgcaca

SEQ ID NO: 956831 - DNA, 22 bp, Artificial Sequence
  chemically synthesized
tccaaagtgaaaataatgtgca

SEQ ID NO: 956832 - DNA, 22 bp, Artificial Sequence
  chemically synthesized
taattgacctgtgcacattatt

SEQ ID NO: 956833 - DNA, 22 bp, Artificial Sequence
  chemically synthesized
ctccaaagtgaaaataatgtgc

SEQ ID NO: 956834 - DNA, 22 bp, Artificial Sequence
  chemically synthesized
attgacctgtgcacattatttt

SEQ ID NO: 956835 - DNA, 22 bp, Artificial Sequence
  chemically synthesized
acctgtgcacattattttcact

SEQ ID NO: 956836 - DNA, 22 bp, Artificial Sequence
  chemically synthesized
tgcacattattttcactttgga

SEQ ID NO: 956837 - DNA, 22 bp, Artificial Sequence
  chemically synthesized
aggagaagtcacttctccaaag

SEQ ID NO: 956838 - DNA, 22 bp, Artificial Sequence
  chemically synthesized
gaggagaagtcacttctccaaa

SEQ ID NO: 956839 - DNA, 22 bp, Artificial Sequence
  chemically synthesized
cttgaggagaagtcacttctcc

SEQ ID NO: 956840 - DNA, 22 bp, Artificial Sequence
  chemically synthesized
acttgaggagaagtcacttctc

SEQ ID NO: 956841 - DNA, 22 bp, Artificial Sequence
  chemically synthesized
ttttcactttggagaagtgact

SEQ ID NO: 956842 - DNA, 22 bp, Artificial Sequence
  chemically synthesized
tcactttggagaagtgacttct

SEQ ID NO: 956843 - DNA, 22 bp, Artificial Sequence
  chemically synthesized
cactttggagaagtgacttctc

SEQ ID NO: 956844 - DNA, 22 bp, Artificial Sequence
  chemically synthesized
actttggagaagtgacttctcc

SEQ ID NO: 956845 - DNA, 22 bp, Artificial Sequence
  chemically synthesized
tggcttacttgaggagaagtca

SEQ ID NO: 956846 - DNA, 22 bp, Artificial Sequence
  chemically synthesized
ttatggcttacttgaggagaag

SEQ ID NO: 956847 - DNA, 22 bp, Artificial Sequence
  chemically synthesized
tggagaagtgacttctcctcaa

SEQ ID NO: 956848 - DNA, 22 bp, Artificial Sequence
  chemically synthesized
gttatggcttacttgaggagaa

SEQ ID NO: 956849 - DNA, 22 bp, Artificial Sequence
  chemically synthesized
ggagaagtgacttctcctcaag

SEQ ID NO: 956850 - DNA, 22 bp, Artificial Sequence
  chemically synthesized
gagaagtgacttctcctcaagt

SEQ ID NO: 956851 - DNA, 22 bp, Artificial Sequence
  chemically synthesized
gcaaacacttgttatggcttac

SEQ ID NO: 956852 - DNA, 22 bp, Artificial Sequence
  chemically synthesized
ggcaaacacttgttatggctta

SEQ ID NO: 956853 - DNA, 22 bp, Artificial Sequence
  chemically synthesized
tggcaaacacttgttatggctt

SEQ ID NO: 956854 - DNA, 22 bp, Artificial Sequence
  chemically synthesized
ctcctcaagtaagccataacaa

SEQ ID NO: 956855 - DNA, 22 bp, Artificial Sequence
  chemically synthesized
tcctcaagtaagccataacaag

SEQ ID NO: 956856 - DNA, 22 bp, Artificial Sequence
  chemically synthesized
gctttggcaaacacttgttatg

SEQ ID NO: 956857 - DNA, 22 bp, Artificial Sequence
  chemically synthesized
ctcaagtaagccataacaagtg

SEQ ID NO: 956858 - DNA, 22 bp, Artificial Sequence
  chemically synthesized
tagctttggcaaacacttgtta

SEQ ID NO: 956859 - DNA, 22 bp, Artificial Sequence
  chemically synthesized
aagtaagccataacaagtgttt

SEQ ID NO: 956860 - DNA, 22 bp, Artificial Sequence
  chemically synthesized
attctagctttggcaaacactt

SEQ ID NO: 956861 - DNA, 22 bp, Artificial Sequence
  chemically synthesized
gctaattctagctttggcaaac

SEQ ID NO: 956862 - DNA, 22 bp, Artificial Sequence
  chemically synthesized
gccaaagctagaattagctaac

SEQ ID NO: 956863 - DNA, 22 bp, Artificial Sequence
  chemically synthesized
ccaaagctagaattagctaacc

SEQ ID NO: 956864 - DNA, 22 bp, Artificial Sequence
  chemically synthesized
gaattagctaaccacttgctca

SEQ ID NO: 956865 - DNA, 22 bp, Artificial Sequence
  chemically synthesized
ggggatatgtaagcaaatgagc

SEQ ID NO: 956866 - DNA, 22 bp, Artificial Sequence
  chemically synthesized
gctaaccacttgctcatttgct

SEQ ID NO: 956867 - DNA, 22 bp, Artificial Sequence
  chemically synthesized
accacttgctcatttgcttaca

SEQ ID NO: 956868 - DNA, 22 bp, Artificial Sequence
  chemically synthesized
tatggtgcctcggggatatgta

SEQ ID NO: 956869 - DNA, 22 bp, Artificial Sequence
  chemically synthesized
gctcatttgcttacatatcccc

SEQ ID NO: 956870 - DNA, 22 bp, Artificial Sequence
  chemically synthesized
ctcatttgcttacatatccccg

SEQ ID NO: 956871 - DNA, 22 bp, Artificial Sequence
  chemically synthesized
atttgcttacatatccccgagg

SEQ ID NO: 956872 - DNA, 22 bp, Artificial Sequence
  chemically synthesized
gcttacatatccccgaggcacc

SEQ ID NO: 956873 - DNA, 22 bp, Artificial Sequence
  chemically synthesized
cttacatatccccgaggcacca

SEQ ID NO: 956874 - DNA, 22 bp, Artificial Sequence
  chemically synthesized
acatatccccgaggcaccatac

SEQ ID NO: 956875 - DNA, 22 bp, Artificial Sequence
  chemically synthesized
catatccccgaggcaccataca

SEQ ID NO: 956876 - DNA, 22 bp, Artificial Sequence
  chemically synthesized
catagtatcagcaatgtcctgt

SEQ ID NO: 956877 - DNA, 22 bp, Artificial Sequence
  chemically synthesized
ccatagtatcagcaatgtcctg

SEQ ID NO: 956878 - DNA, 22 bp, Artificial Sequence
  chemically synthesized
taggtcatttccatagtatcag

SEQ ID NO: 956879 - DNA, 22 bp, Artificial Sequence
  chemically synthesized
tgtaggtcatttccatagtatc

SEQ ID NO: 956880 - DNA, 22 bp, Artificial Sequence
  chemically synthesized
ctgtaggtcatttccatagtat

SEQ ID NO: 956881 - DNA, 22 bp, Artificial Sequence
  chemically synthesized
ctgatactatggaaatgaccta

SEQ ID NO: 956882 - DNA, 22 bp, Artificial Sequence
  chemically synthesized
atactatggaaatgacctacag

SEQ ID NO: 956883 - DNA, 22 bp, Artificial Sequence
  chemically synthesized
accaaatgtccaaacttctgta

SEQ ID NO: 956884 - DNA, 22 bp, Artificial Sequence
  chemically synthesized
tggaaatgacctacagaagttt

SEQ ID NO: 956885 - DNA, 22 bp, Artificial Sequence
  chemically synthesized
cagaagtttggacatttggtga

SEQ ID NO: 956886 - DNA, 22 bp, Artificial Sequence
  chemically synthesized
ggacatttggtgaggaccattt

SEQ ID NO: 956887 - DNA, 22 bp, Artificial Sequence
  chemically synthesized
gacatttggtgaggaccatttt

SEQ ID NO: 956888 - DNA, 22 bp, Artificial Sequence
  chemically synthesized
ggtgaggaccatttttcacttt

SEQ ID NO: 956889 - DNA, 22 bp, Artificial Sequence
  chemically synthesized
gtgaggaccatttttcactttt

SEQ ID NO: 956890 - DNA, 22 bp, Artificial Sequence
  chemically synthesized
acatagagaaaggaatgaaaaa

SEQ ID NO: 956891 - DNA, 22 bp, Artificial Sequence
  chemically synthesized
cacatagagaaaggaatgaaaa

SEQ ID NO: 956892 - DNA, 22 bp, Artificial Sequence
  chemically synthesized
cttcacatagagaaaggaatga

SEQ ID NO: 956893 - DNA, 22 bp, Artificial Sequence
  chemically synthesized
ttcactttttttcattcctttc

SEQ ID NO: 956894 - DNA, 22 bp, Artificial Sequence
  chemically synthesized
ccttcacatagagaaaggaatg

SEQ ID NO: 956895 - DNA, 22 bp, Artificial Sequence
  chemically synthesized
tcactttttttcattcctttct

SEQ ID NO: 956896 - DNA, 22 bp, Artificial Sequence
  chemically synthesized
cactttttttcattcctttctc

SEQ ID NO: 956897 - DNA, 22 bp, Artificial Sequence
  chemically synthesized
actttttttcattcctttctct

SEQ ID NO: 956898 - DNA, 22 bp, Artificial Sequence
  chemically synthesized
aatttccttcacatagagaaag

SEQ ID NO: 956899 - DNA, 22 bp, Artificial Sequence
  chemically synthesized
tttttcattcctttctctatgt

SEQ ID NO: 956900 - DNA, 22 bp, Artificial Sequence
  chemically synthesized
ttttcattcctttctctatgtg

SEQ ID NO: 956901 - DNA, 22 bp, Artificial Sequence
  chemically synthesized
ttaaatttccttcacatagaga

SEQ ID NO: 956902 - DNA, 22 bp, Artificial Sequence
  chemically synthesized
tttcattcctttctctatgtga

SEQ ID NO: 956903 - DNA, 22 bp, Artificial Sequence
  chemically synthesized
ttcattcctttctctatgtgaa

SEQ ID NO: 956904 - DNA, 22 bp, Artificial Sequence
  chemically synthesized
tcattcctttctctatgtgaag

SEQ ID NO: 956905 - DNA, 22 bp, Artificial Sequence
  chemically synthesized
cattcctttctctatgtgaagg

SEQ ID NO: 956906 - DNA, 22 bp, Artificial Sequence
  chemically synthesized
attcctttctctatgtgaagga

SEQ ID NO: 956907 - DNA, 22 bp, Artificial Sequence
  chemically synthesized
ctttctctatgtgaaggaaatt

SEQ ID NO: 956908 - DNA, 22 bp, Artificial Sequence
  chemically synthesized
tctctatgtgaaggaaatttaa

SEQ ID NO: 956909 - DNA, 22 bp, Artificial Sequence
  chemically synthesized
ctctatgtgaaggaaatttaat

SEQ ID NO: 956910 - DNA, 22 bp, Artificial Sequence
  chemically synthesized
tctatgtgaaggaaatttaata

SEQ ID NO: 956911 - DNA, 22 bp, Artificial Sequence
  chemically synthesized
tatgtgaaggaaatttaatagt

SEQ ID NO: 956912 - DNA, 22 bp, Artificial Sequence
  chemically synthesized
aagaatacataatactattaaa

SEQ ID NO: 956913 - DNA, 22 bp, Artificial Sequence
  chemically synthesized
tgtgaaggaaatttaatagtat

SEQ ID NO: 956914 - DNA, 22 bp, Artificial Sequence
  chemically synthesized
aggtattaaagaatacataata

SEQ ID NO: 956915 - DNA, 22 bp, Artificial Sequence
  chemically synthesized
aatagtattatgtattctttaa

SEQ ID NO: 956916 - DNA, 22 bp, Artificial Sequence
  chemically synthesized
atagtattatgtattctttaat

SEQ ID NO: 956917 - DNA, 22 bp, Artificial Sequence
  chemically synthesized
gagaaagagttaaggtattaaa

SEQ ID NO: 956918 - DNA, 22 bp, Artificial Sequence
  chemically synthesized
tgtattctttaataccttaact

SEQ ID NO: 956919 - DNA, 22 bp, Artificial Sequence
  chemically synthesized
acacattagagaaagagttaag

SEQ ID NO: 956920 - DNA, 22 bp, Artificial Sequence
  chemically synthesized
tcacacattagagaaagagtta

SEQ ID NO: 956921 - DNA, 22 bp, Artificial Sequence
  chemically synthesized
tttaataccttaactctttctc

SEQ ID NO: 956922 - DNA, 22 bp, Artificial Sequence
  chemically synthesized
tctcacacattagagaaagagt

SEQ ID NO: 956923 - DNA, 22 bp, Artificial Sequence
  chemically synthesized
taataccttaactctttctcta

SEQ ID NO: 956924 - DNA, 22 bp, Artificial Sequence
  chemically synthesized
aataccttaactctttctctaa

SEQ ID NO: 956925 - DNA, 22 bp, Artificial Sequence
  chemically synthesized
ataccttaactctttctctaat

SEQ ID NO: 956926 - DNA, 22 bp, Artificial Sequence
  chemically synthesized
ccctctctcacacattagagaa

SEQ ID NO: 956927 - DNA, 22 bp, Artificial Sequence
  chemically synthesized
cctcccctctctcacacattag

SEQ ID NO: 956928 - DNA, 22 bp, Artificial Sequence
  chemically synthesized
ccctcccctctctcacacatta

SEQ ID NO: 956929 - DNA, 22 bp, Artificial Sequence
  chemically synthesized
aactctttctctaatgtgtgag

SEQ ID NO: 956930 - DNA, 22 bp, Artificial Sequence
  chemically synthesized
actctttctctaatgtgtgaga

SEQ ID NO: 956931 - DNA, 22 bp, Artificial Sequence
  chemically synthesized
ccttccctcccctctctcacac

SEQ ID NO: 956932 - DNA, 22 bp, Artificial Sequence
  chemically synthesized
cccttccctcccctctctcaca

SEQ ID NO: 956933 - DNA, 22 bp, Artificial Sequence
  chemically synthesized
tttctctaatgtgtgagagagg

SEQ ID NO: 956934 - DNA, 22 bp, Artificial Sequence
  chemically synthesized
tctctaatgtgtgagagagggg

SEQ ID NO: 956935 - DNA, 22 bp, Artificial Sequence
  chemically synthesized
ctctaatgtgtgagagagggga

SEQ ID NO: 956936 - DNA, 22 bp, Artificial Sequence
  chemically synthesized
ccttcccttccctcccctctct

SEQ ID NO: 956937 - DNA, 22 bp, Artificial Sequence
  chemically synthesized
tctaatgtgtgagagaggggag

SEQ ID NO: 956938 - DNA, 22 bp, Artificial Sequence
  chemically synthesized
cccttcccttccctcccctctc

SEQ ID NO: 956939 - DNA, 22 bp, Artificial Sequence
  chemically synthesized
taatgtgtgagagaggggaggg

SEQ ID NO: 956940 - DNA, 22 bp, Artificial Sequence
  chemically synthesized
atgtgtgagagaggggagggaa

SEQ ID NO: 956941 - DNA, 22 bp, Artificial Sequence
  chemically synthesized
ccttcccttcccttccctcccc

SEQ ID NO: 956942 - DNA, 22 bp, Artificial Sequence
  chemically synthesized
cccttcccttcccttccctccc

SEQ ID NO: 956943 - DNA, 22 bp, Artificial Sequence
  chemically synthesized
cttcccttcccttcccttccct

SEQ ID NO: 956944 - DNA, 22 bp, Artificial Sequence
  chemically synthesized
tccttcccttcccttcccttcc

SEQ ID NO: 956945 - DNA, 22 bp, Artificial Sequence
  chemically synthesized
ccctctccttcccttcccttcc

SEQ ID NO: 956946 - DNA, 22 bp, Artificial Sequence
  chemically synthesized
cctcccctctccttcccttccc

SEQ ID NO: 956947 - DNA, 22 bp, Artificial Sequence
  chemically synthesized
ccctcccctctccttcccttcc

SEQ ID NO: 956948 - DNA, 22 bp, Artificial Sequence
  chemically synthesized
ccttccctcccctctccttccc

SEQ ID NO: 956949 - DNA, 22 bp, Artificial Sequence
  chemically synthesized
cccttccctcccctctccttcc

SEQ ID NO: 956950 - DNA, 22 bp, Artificial Sequence
  chemically synthesized
cccttcccttccctcccctctc

SEQ ID NO: 956951 - DNA, 22 bp, Artificial Sequence
  chemically synthesized
ccctccccttcccttccctccc

SEQ ID NO: 956952 - DNA, 22 bp, Artificial Sequence
  chemically synthesized
ccctcccctccccttcccttcc

SEQ ID NO: 956953 - DNA, 22 bp, Artificial Sequence
  chemically synthesized
ccctcccctcccctccccttcc

SEQ ID NO: 956954 - DNA, 22 bp, Artificial Sequence
  chemically synthesized
ccctcccctcccctcccctccc

SEQ ID NO: 956955 - DNA, 22 bp, Artificial Sequence
  chemically synthesized
ctcccctcccctcccctcccct

SEQ ID NO: 956956 - DNA, 22 bp, Artificial Sequence
  chemically synthesized
tcctcccctcccctcccctccc

SEQ ID NO: 956957 - DNA, 22 bp, Artificial Sequence
  chemically synthesized
tctcctcccctcccctcccctc

SEQ ID NO: 956958 - DNA, 22 bp, Artificial Sequence
  chemically synthesized
tctctcctcccctcccctcccc

SEQ ID NO: 956959 - DNA, 22 bp, Artificial Sequence
  chemically synthesized
atctctctctcctcccctcccc

SEQ ID NO: 956960 - DNA, 22 bp, Artificial Sequence
  chemically synthesized
gatctctctctcctcccctccc

SEQ ID NO: 956961 - DNA, 22 bp, Artificial Sequence
  chemically synthesized
tgatctctctctcctcccctcc

SEQ ID NO: 956962 - DNA, 22 bp, Artificial Sequence
  chemically synthesized
tcctttgatctctctctcctcc

SEQ ID NO: 956963 - DNA, 22 bp, Artificial Sequence
  chemically synthesized
gtcctttgatctctctctcctc

SEQ ID NO: 956964 - DNA, 22 bp, Artificial Sequence
  chemically synthesized
tgtcctttgatctctctctcct

SEQ ID NO: 956965 - DNA, 22 bp, Artificial Sequence
  chemically synthesized
tttgtcctttgatctctctctc

SEQ ID NO: 956966 - DNA, 22 bp, Artificial Sequence
  chemically synthesized
ctttgtcctttgatctctctct

SEQ ID NO: 956967 - DNA, 22 bp, Artificial Sequence
  chemically synthesized
tctttgtcctttgatctctctc

SEQ ID NO: 956968 - DNA, 22 bp, Artificial Sequence
  chemically synthesized
ttttctttgtcctttgatctct

SEQ ID NO: 956969 - DNA, 22 bp, Artificial Sequence
  chemically synthesized
gttattttctttgtcctttgat

SEQ ID NO: 956970 - DNA, 22 bp, Artificial Sequence
  chemically synthesized
tggttattttctttgtcctttg

SEQ ID NO: 956971 - DNA, 22 bp, Artificial Sequence
  chemically synthesized
tatctctggttattttctttgt

SEQ ID NO: 956972 - DNA, 22 bp, Artificial Sequence
  chemically synthesized
gtatctctggttattttctttg

SEQ ID NO: 956973 - DNA, 22 bp, Artificial Sequence
  chemically synthesized
catccttgtatctctggttatt

SEQ ID NO: 956974 - DNA, 22 bp, Artificial Sequence
  chemically synthesized
gcatccttgtatctctggttat

SEQ ID NO: 956975 - DNA, 22 bp, Artificial Sequence
  chemically synthesized
tgcatccttgtatctctggtta

SEQ ID NO: 956976 - DNA, 22 bp, Artificial Sequence
  chemically synthesized
tttgcatccttgtatctctggt

SEQ ID NO: 956977 - DNA, 22 bp, Artificial Sequence
  chemically synthesized
tctttgcatccttgtatctctg

SEQ ID NO: 956978 - DNA, 22 bp, Artificial Sequence
  chemically synthesized
gaagtagaaaaaggaaattctc

SEQ ID NO: 956979 - DNA, 22 bp, Artificial Sequence
  chemically synthesized
ggaagtagaaaaaggaaattct

SEQ ID NO: 956980 - DNA, 22 bp, Artificial Sequence
  chemically synthesized
tggaagtagaaaaaggaaattc

SEQ ID NO: 956981 - DNA, 22 bp, Artificial Sequence
  chemically synthesized
gattttggaagtagaaaaagga

SEQ ID NO: 956982 - DNA, 22 bp, Artificial Sequence
  chemically synthesized
cctttttctacttccaaaatct

SEQ ID NO: 956983 - DNA, 22 bp, Artificial Sequence
  chemically synthesized
cacagaataactagattttgga

SEQ ID NO: 956984 - DNA, 22 bp, Artificial Sequence
  chemically synthesized
ctttttctacttccaaaatcta

SEQ ID NO: 956985 - DNA, 22 bp, Artificial Sequence
  chemically synthesized
gcacagaataactagattttgg

SEQ ID NO: 956986 - DNA, 22 bp, Artificial Sequence
  chemically synthesized
tgcacagaataactagattttg

SEQ ID NO: 956987 - DNA, 22 bp, Artificial Sequence
  chemically synthesized
ttgcacagaataactagatttt

SEQ ID NO: 956988 - DNA, 22 bp, Artificial Sequence
  chemically synthesized
tttctacttccaaaatctagtt

SEQ ID NO: 956989 - DNA, 22 bp, Artificial Sequence
  chemically synthesized
ttctacttccaaaatctagtta

SEQ ID NO: 956990 - DNA, 22 bp, Artificial Sequence
  chemically synthesized
tctacttccaaaatctagttat

SEQ ID NO: 956991 - DNA, 22 bp, Artificial Sequence
  chemically synthesized
ctacttccaaaatctagttatt

SEQ ID NO: 956992 - DNA, 22 bp, Artificial Sequence
  chemically synthesized
tacttccaaaatctagttattc

SEQ ID NO: 956993 - DNA, 22 bp, Artificial Sequence
  chemically synthesized
acgtttttgcacagaataacta

SEQ ID NO: 956994 - DNA, 22 bp, Artificial Sequence
  chemically synthesized
cttccaaaatctagttattctg

SEQ ID NO: 956995 - DNA, 22 bp, Artificial Sequence
  chemically synthesized
aacgtttttgcacagaataact

SEQ ID NO: 956996 - DNA, 22 bp, Artificial Sequence
  chemically synthesized
ttaacgtttttgcacagaataa

SEQ ID NO: 956997 - DNA, 22 bp, Artificial Sequence
  chemically synthesized
ccaaaatctagttattctgtgc

SEQ ID NO: 956998 - DNA, 22 bp, Artificial Sequence
  chemically synthesized
caaaatctagttattctgtgca

SEQ ID NO: 956999 - DNA, 22 bp, Artificial Sequence
  chemically synthesized
gttcttaacgtttttgcacaga

SEQ ID NO: 957000 - DNA, 22 bp, Artificial Sequence
  chemically synthesized
gttattctgtgcaaaaacgtta

SEQ ID NO: 957001 - DNA, 22 bp, Artificial Sequence
  chemically synthesized
caaagttcgttcttaacgtttt

SEQ ID NO: 957002 - DNA, 22 bp, Artificial Sequence
  chemically synthesized
ccaaagttcgttcttaacgttt

SEQ ID NO: 957003 - DNA, 22 bp, Artificial Sequence
  chemically synthesized
ttctgtgcaaaaacgttaagaa

SEQ ID NO: 957004 - DNA, 22 bp, Artificial Sequence
  chemically synthesized
ttccaaagttcgttcttaacgt

SEQ ID NO: 957005 - DNA, 22 bp, Artificial Sequence
  chemically synthesized
cttccaaagttcgttcttaacg

SEQ ID NO: 957006 - DNA, 22 bp, Artificial Sequence
  chemically synthesized
tcttccaaagttcgttcttaac

SEQ ID NO: 957007 - DNA, 22 bp, Artificial Sequence
  chemically synthesized
tgtgcaaaaacgttaagaacga

SEQ ID NO: 957008 - DNA, 22 bp, Artificial Sequence
  chemically synthesized
tgcaaaaacgttaagaacgaac

SEQ ID NO: 957009 - DNA, 22 bp, Artificial Sequence
  chemically synthesized
accatgcatagttttcttccaa

SEQ ID NO: 957010 - DNA, 22 bp, Artificial Sequence
  chemically synthesized
caccatgcatagttttcttcca

SEQ ID NO: 957011 - DNA, 22 bp, Artificial Sequence
  chemically synthesized
agaacgaactttggaagaaaac

SEQ ID NO: 957012 - DNA, 22 bp, Artificial Sequence
  chemically synthesized
tcaccatgcatagttttcttcc

SEQ ID NO: 957013 - DNA, 22 bp, Artificial Sequence
  chemically synthesized
tggaagaaaactatgcatggtg

SEQ ID NO: 957014 - DNA, 22 bp, Artificial Sequence
  chemically synthesized
ggaagaaaactatgcatggtga

SEQ ID NO: 957015 - DNA, 22 bp, Artificial Sequence
  chemically synthesized
gaagaaaactatgcatggtgaa

SEQ ID NO: 957016 - DNA, 22 bp, Artificial Sequence
  chemically synthesized
aacagcagcattttcaccatgc

SEQ ID NO: 957017 - DNA, 22 bp, Artificial Sequence
  chemically synthesized
aaacagcagcattttcaccatg

SEQ ID NO: 957018 - DNA, 22 bp, Artificial Sequence
  chemically synthesized
taaacagcagcattttcaccat

SEQ ID NO: 957019 - DNA, 22 bp, Artificial Sequence
  chemically synthesized
ttaaacagcagcattttcacca

SEQ ID NO: 957020 - DNA, 22 bp, Artificial Sequence
  chemically synthesized
tagtttttaaacagcagcattt

SEQ ID NO: 957021 - DNA, 22 bp, Artificial Sequence
  chemically synthesized
tgcatggtgaaaatgctgctgt

SEQ ID NO: 957022 - DNA, 22 bp, Artificial Sequence
  chemically synthesized
ttgtagtttttaaacagcagca

SEQ ID NO: 957023 - DNA, 22 bp, Artificial Sequence
  chemically synthesized
gttgtagtttttaaacagcagc

SEQ ID NO: 957024 - DNA, 22 bp, Artificial Sequence
  chemically synthesized
tgttgtagtttttaaacagcag

SEQ ID NO: 957025 - DNA, 22 bp, Artificial Sequence
  chemically synthesized
ttttgttgtagtttttaaacag

SEQ ID NO: 957026 - DNA, 22 bp, Artificial Sequence
  chemically synthesized
tgatgggctgttttgttgtagt

SEQ ID NO: 957027 - DNA, 22 bp, Artificial Sequence
  chemically synthesized
ctgtttaaaaactacaacaaaa

SEQ ID NO: 957028 - DNA, 22 bp, Artificial Sequence
  chemically synthesized
tatgatgggctgttttgttgta

SEQ ID NO: 957029 - DNA, 22 bp, Artificial Sequence
  chemically synthesized
tttaaaaactacaacaaaacag

SEQ ID NO: 957030 - DNA, 22 bp, Artificial Sequence
  chemically synthesized
ctctatgatgggctgttttgtt

SEQ ID NO: 957031 - DNA, 22 bp, Artificial Sequence
  chemically synthesized
tactctatgatgggctgttttg

SEQ ID NO: 957032 - DNA, 22 bp, Artificial Sequence
  chemically synthesized
aaaaactacaacaaaacagccc

SEQ ID NO: 957033 - DNA, 22 bp, Artificial Sequence
  chemically synthesized
ctactctatgatgggctgtttt

SEQ ID NO: 957034 - DNA, 22 bp, Artificial Sequence
  chemically synthesized
aaaactacaacaaaacagccca

SEQ ID NO: 957035 - DNA, 22 bp, Artificial Sequence
  chemically synthesized
ttctactctatgatgggctgtt

SEQ ID NO: 957036 - DNA, 22 bp, Artificial Sequence
  chemically synthesized
cttctactctatgatgggctgt

SEQ ID NO: 957037 - DNA, 22 bp, Artificial Sequence
  chemically synthesized
caacaaaacagcccatcataga

SEQ ID NO: 957038 - DNA, 22 bp, Artificial Sequence
  chemically synthesized
ccaggccggtgtttcttctact

SEQ ID NO: 957039 - DNA, 22 bp, Artificial Sequence
  chemically synthesized
tcctcccaggccggtgtttctt

SEQ ID NO: 957040 - DNA, 22 bp, Artificial Sequence
  chemically synthesized
gtcctcccaggccggtgtttct

SEQ ID NO: 957041 - DNA, 22 bp, Artificial Sequence
  chemically synthesized
tgatagaacacaggcacttgtc

SEQ ID NO: 957042 - DNA, 22 bp, Artificial Sequence
  chemically synthesized
tgtgatagaacacaggcacttg

SEQ ID NO: 957043 - DNA, 22 bp, Artificial Sequence
  chemically synthesized
gctctgtgatagaacacaggca

SEQ ID NO: 957044 - DNA, 22 bp, Artificial Sequence
  chemically synthesized
ggaggacaagtgcctgtgttct

SEQ ID NO: 957045 - DNA, 22 bp, Artificial Sequence
  chemically synthesized
acattagctctgtgatagaaca

SEQ ID NO: 957046 - DNA, 22 bp, Artificial Sequence
  chemically synthesized
ttaacattagctctgtgataga

SEQ ID NO: 957047 - DNA, 22 bp, Artificial Sequence
  chemically synthesized
gttaacattagctctgtgatag

SEQ ID NO: 957048 - DNA, 22 bp, Artificial Sequence
  chemically synthesized
tgttctatcacagagctaatgt

SEQ ID NO: 957049 - DNA, 22 bp, Artificial Sequence
  chemically synthesized
tatcacagagctaatgttaaca

SEQ ID NO: 957050 - DNA, 22 bp, Artificial Sequence
  chemically synthesized
tcacagagctaatgttaacaag

SEQ ID NO: 957051 - DNA, 22 bp, Artificial Sequence
  chemically synthesized
gtcaatgagcagcttgttaaca

SEQ ID NO: 957052 - DNA, 22 bp, Artificial Sequence
  chemically synthesized
cgtcaatgagcagcttgttaac

SEQ ID NO: 957053 - DNA, 22 bp, Artificial Sequence
  chemically synthesized
tcgtcaatgagcagcttgttaa

SEQ ID NO: 957054 - DNA, 22 bp, Artificial Sequence
  chemically synthesized
atgttaacaagctgctcattga

SEQ ID NO: 957055 - DNA, 22 bp, Artificial Sequence
  chemically synthesized
acaagctgctcattgacgaaaa

SEQ ID NO: 957056 - DNA, 22 bp, Artificial Sequence
  chemically synthesized
atataagggacgagattttcgt

SEQ ID NO: 957057 - DNA, 22 bp, Artificial Sequence
  chemically synthesized
ctcattgacgaaaatctcgtcc

SEQ ID NO: 957058 - DNA, 22 bp, Artificial Sequence
  chemically synthesized
agtctgatataagggacgagat

SEQ ID NO: 957059 - DNA, 22 bp, Artificial Sequence
  chemically synthesized
attgacgaaaatctcgtccctt

SEQ ID NO: 957060 - DNA, 22 bp, Artificial Sequence
  chemically synthesized
acgaaaatctcgtcccttatat

SEQ ID NO: 957061 - DNA, 22 bp, Artificial Sequence
  chemically synthesized
tgaatgaggagattgagtctga

SEQ ID NO: 957062 - DNA, 22 bp, Artificial Sequence
  chemically synthesized
atgaatgaggagattgagtctg

SEQ ID NO: 957063 - DNA, 22 bp, Artificial Sequence
  chemically synthesized
gtcccttatatcagactcaatc

SEQ ID NO: 957064 - DNA, 22 bp, Artificial Sequence
  chemically synthesized
atcttatgaatgaggagattga

SEQ ID NO: 957065 - DNA, 22 bp, Artificial Sequence
  chemically synthesized
tcatcttatgaatgaggagatt

SEQ ID NO: 957066 - DNA, 22 bp, Artificial Sequence
  chemically synthesized
atatcagactcaatctcctcat

SEQ ID NO: 957067 - DNA, 22 bp, Artificial Sequence
  chemically synthesized
ctcatcttatgaatgaggagat

SEQ ID NO: 957068 - DNA, 22 bp, Artificial Sequence
  chemically synthesized
tatcagactcaatctcctcatt

SEQ ID NO: 957069 - DNA, 22 bp, Artificial Sequence
  chemically synthesized
gtgcaaatttctcatcttatga

SEQ ID NO: 957070 - DNA, 22 bp, Artificial Sequence
  chemically synthesized
aatctcctcattcataagatga

SEQ ID NO: 957071 - DNA, 22 bp, Artificial Sequence
  chemically synthesized
ctcattcataagatgagaaatt

SEQ ID NO: 957072 - DNA, 22 bp, Artificial Sequence
  chemically synthesized
attcataagatgagaaatttgc

SEQ ID NO: 957073 - DNA, 22 bp, Artificial Sequence
  chemically synthesized
agtgataatctagtgcaaattt

SEQ ID NO: 957074 - DNA, 22 bp, Artificial Sequence
  chemically synthesized
cagtgataatctagtgcaaatt

SEQ ID NO: 957075 - DNA, 22 bp, Artificial Sequence
  chemically synthesized
ataagatgagaaatttgcacta

SEQ ID NO: 957076 - DNA, 22 bp, Artificial Sequence
  chemically synthesized
gaggtggagcaaatttcagtga

SEQ ID NO: 957077 - DNA, 22 bp, Artificial Sequence
  chemically synthesized
gcactagattatcactgaaatt

SEQ ID NO: 957078 - DNA, 22 bp, Artificial Sequence
  chemically synthesized
agaggtggagcaaatttcagtg

SEQ ID NO: 957079 - DNA, 22 bp, Artificial Sequence
  chemically synthesized
cactagattatcactgaaattt

SEQ ID NO: 957080 - DNA, 22 bp, Artificial Sequence
  chemically synthesized
tagaggtggagcaaatttcagt

SEQ ID NO: 957081 - DNA, 22 bp, Artificial Sequence
  chemically synthesized
gattatcactgaaatttgctcc

SEQ ID NO: 957082 - DNA, 22 bp, Artificial Sequence
  chemically synthesized
gtcattttagaggtggagcaaa

SEQ ID NO: 957083 - DNA, 22 bp, Artificial Sequence
  chemically synthesized
tcactgaaatttgctccacctc

SEQ ID NO: 957084 - DNA, 22 bp, Artificial Sequence
  chemically synthesized
aaatttgctccacctctaaaat

SEQ ID NO: 957085 - DNA, 22 bp, Artificial Sequence
  chemically synthesized
gctccacctctaaaatgactag

SEQ ID NO: 957086 - DNA, 22 bp, Artificial Sequence
  chemically synthesized
ctccacctctaaaatgactagg

SEQ ID NO: 957087 - DNA, 22 bp, Artificial Sequence
  chemically synthesized
ccagaatatggaaccctagtca

SEQ ID NO: 957088 - DNA, 22 bp, Artificial Sequence
  chemically synthesized
cacctctaaaatgactagggtt

SEQ ID NO: 957089 - DNA, 22 bp, Artificial Sequence
  chemically synthesized
accagaatatggaaccctagtc

SEQ ID NO: 957090 - DNA, 22 bp, Artificial Sequence
  chemically synthesized
atttaccagaatatggaaccct

SEQ ID NO: 957091 - DNA, 22 bp, Artificial Sequence
  chemically synthesized
aatttaccagaatatggaaccc

SEQ ID NO: 957092 - DNA, 22 bp, Artificial Sequence
  chemically synthesized
taaaatgactagggttccatat

SEQ ID NO: 957093 - DNA, 22 bp, Artificial Sequence
  chemically synthesized
aaatgactagggttccatattc

SEQ ID NO: 957094 - DNA, 22 bp, Artificial Sequence
  chemically synthesized
tttaatttaccagaatatggaa

SEQ ID NO: 957095 - DNA, 22 bp, Artificial Sequence
  chemically synthesized
tgtttaatttaccagaatatgg

SEQ ID NO: 957096 - DNA, 22 bp, Artificial Sequence
  chemically synthesized
ctctgtttaatttaccagaata

SEQ ID NO: 957097 - DNA, 22 bp, Artificial Sequence
  chemically synthesized
gggttccatattctggtaaatt

SEQ ID NO: 957098 - DNA, 22 bp, Artificial Sequence
  chemically synthesized
aaacattactctgtttaattta

SEQ ID NO: 957099 - DNA, 22 bp, Artificial Sequence
  chemically synthesized
aaaacattactctgtttaattt

SEQ ID NO: 957100 - DNA, 22 bp, Artificial Sequence
  chemically synthesized
catattctggtaaattaaacag

SEQ ID NO: 957101 - DNA, 22 bp, Artificial Sequence
  chemically synthesized
atttaaaacattactctgttta

SEQ ID NO: 957102 - DNA, 22 bp, Artificial Sequence
  chemically synthesized
aatttaaaacattactctgttt

SEQ ID NO: 957103 - DNA, 22 bp, Artificial Sequence
  chemically synthesized
taatttaaaacattactctgtt

SEQ ID NO: 957104 - DNA, 22 bp, Artificial Sequence
  chemically synthesized
tggtaaattaaacagagtaatg

SEQ ID NO: 957105 - DNA, 22 bp, Artificial Sequence
  chemically synthesized
gtaaattaaacagagtaatgtt

SEQ ID NO: 957106 - DNA, 22 bp, Artificial Sequence
  chemically synthesized
aacagagtaatgttttaaatta

SEQ ID NO: 957107 - DNA, 22 bp, Artificial Sequence
  chemically synthesized
tgataatatctttaatttaaaa

SEQ ID NO: 957108 - DNA, 22 bp, Artificial Sequence
  chemically synthesized
cacacctgtgataatatcttta

SEQ ID NO: 957109 - DNA, 22 bp, Artificial Sequence
  chemically synthesized
taaattaaagatattatcacag

SEQ ID NO: 957110 - DNA, 22 bp, Artificial Sequence
  chemically synthesized
aaattaaagatattatcacagg

SEQ ID NO: 957111 - DNA, 22 bp, Artificial Sequence
  chemically synthesized
aattaaagatattatcacaggt

SEQ ID NO: 957112 - DNA, 22 bp, Artificial Sequence
  chemically synthesized
aagatattatcacaggtgtgta

SEQ ID NO: 957113 - DNA, 22 bp, Artificial Sequence
  chemically synthesized
aacaggcaagattacacacctg

SEQ ID NO: 957114 - DNA, 22 bp, Artificial Sequence
  chemically synthesized
tgctcaacaggcaagattacac

SEQ ID NO: 957115 - DNA, 22 bp, Artificial Sequence
  chemically synthesized
atgctcaacaggcaagattaca

SEQ ID NO: 957116 - DNA, 22 bp, Artificial Sequence
  chemically synthesized
tcacaggtgtgtaatcttgcct

SEQ ID NO: 957117 - DNA, 22 bp, Artificial Sequence
  chemically synthesized
atttatgctcaacaggcaagat

SEQ ID NO: 957118 - DNA, 22 bp, Artificial Sequence
  chemically synthesized
aatttatgctcaacaggcaaga

SEQ ID NO: 957119 - DNA, 22 bp, Artificial Sequence
  chemically synthesized
ttaatttatgctcaacaggcaa

SEQ ID NO: 957120 - DNA, 22 bp, Artificial Sequence
  chemically synthesized
aaaatattcttaatttatgctc

SEQ ID NO: 957121 - DNA, 22 bp, Artificial Sequence
  chemically synthesized
gaaaatattcttaatttatgct

SEQ ID NO: 957122 - DNA, 22 bp, Artificial Sequence
  chemically synthesized
tgaaaatattcttaatttatgc

SEQ ID NO: 957123 - DNA, 22 bp, Artificial Sequence
  chemically synthesized
gcctgttgagcataaattaaga

SEQ ID NO: 957124 - DNA, 22 bp, Artificial Sequence
  chemically synthesized
cctgttgagcataaattaagaa

SEQ ID NO: 957125 - DNA, 22 bp, Artificial Sequence
  chemically synthesized
ttgagcataaattaagaatatt

SEQ ID NO: 957126 - DNA, 22 bp, Artificial Sequence
  chemically synthesized
agcataaattaagaatattttc

SEQ ID NO: 957127 - DNA, 22 bp, Artificial Sequence
  chemically synthesized
aatgtcacatcgttttgaaaat

SEQ ID NO: 957128 - DNA, 22 bp, Artificial Sequence
  chemically synthesized
agaatattttcaaaacgatgtg

SEQ ID NO: 957129 - DNA, 22 bp, Artificial Sequence
  chemically synthesized
taaattgaatgtcacatcgttt

SEQ ID NO: 957130 - DNA, 22 bp, Artificial Sequence
  chemically synthesized
ctataaattgaatgtcacatcg

SEQ ID NO: 957131 - DNA, 22 bp, Artificial Sequence
  chemically synthesized
ttactataaattgaatgtcaca

SEQ ID NO: 957132 - DNA, 22 bp, Artificial Sequence
  chemically synthesized
tcaaaacgatgtgacattcaat

SEQ ID NO: 957133 - DNA, 22 bp, Artificial Sequence
  chemically synthesized
caaaacgatgtgacattcaatt

SEQ ID NO: 957134 - DNA, 22 bp, Artificial Sequence
  chemically synthesized
aaaacgatgtgacattcaattt

SEQ ID NO: 957135 - DNA, 22 bp, Artificial Sequence
  chemically synthesized
aatctgttactataaattgaat

SEQ ID NO: 957136 - DNA, 22 bp, Artificial Sequence
  chemically synthesized
gaatctgttactataaattgaa

SEQ ID NO: 957137 - DNA, 22 bp, Artificial Sequence
  chemically synthesized
tgaatctgttactataaattga

SEQ ID NO: 957138 - DNA, 22 bp, Artificial Sequence
  chemically synthesized
ttgaatctgttactataaattg

SEQ ID NO: 957139 - DNA, 22 bp, Artificial Sequence
  chemically synthesized
tttgaatctgttactataaatt

SEQ ID NO: 957140 - DNA, 22 bp, Artificial Sequence
  chemically synthesized
aatatgctttttgaatctgtta

SEQ ID NO: 957141 - DNA, 22 bp, Artificial Sequence
  chemically synthesized
aaatatgctttttgaatctgtt

SEQ ID NO: 957142 - DNA, 22 bp, Artificial Sequence
  chemically synthesized
taaatatgctttttgaatctgt

SEQ ID NO: 957143 - DNA, 22 bp, Artificial Sequence
  chemically synthesized
aatttatagtaacagattcaaa

SEQ ID NO: 957144 - DNA, 22 bp, Artificial Sequence
  chemically synthesized
ttaaatatgctttttgaatctg

SEQ ID NO: 957145 - DNA, 22 bp, Artificial Sequence
  chemically synthesized
tttttaaatatgctttttgaat

SEQ ID NO: 957146 - DNA, 22 bp, Artificial Sequence
  chemically synthesized
atttttaaatatgctttttgaa

SEQ ID NO: 957147 - DNA, 22 bp, Artificial Sequence
  chemically synthesized
atagtaacagattcaaaaagca

SEQ ID NO: 957148 - DNA, 22 bp, Artificial Sequence
  chemically synthesized
tagtaacagattcaaaaagcat

SEQ ID NO: 957149 - DNA, 22 bp, Artificial Sequence
  chemically synthesized
taatttatttttaaatatgctt

SEQ ID NO: 957150 - DNA, 22 bp, Artificial Sequence
  chemically synthesized
gctataatttatttttaaatat

SEQ ID NO: 957151 - DNA, 22 bp, Artificial Sequence
  chemically synthesized
tctagctataatttatttttaa

SEQ ID NO: 957152 - DNA, 22 bp, Artificial Sequence
  chemically synthesized
aaaaagcatatttaaaaataaa

SEQ ID NO: 957153 - DNA, 22 bp, Artificial Sequence
  chemically synthesized
ctatctagctataatttatttt

SEQ ID NO: 957154 - DNA, 22 bp, Artificial Sequence
  chemically synthesized
tcctatctagctataatttatt

SEQ ID NO: 957155 - DNA, 22 bp, Artificial Sequence
  chemically synthesized
ctcctatctagctataatttat

SEQ ID NO: 957156 - DNA, 22 bp, Artificial Sequence
  chemically synthesized
tttctcctatctagctataatt

SEQ ID NO: 957157 - DNA, 22 bp, Artificial Sequence
  chemically synthesized
atttctcctatctagctataat

SEQ ID NO: 957158 - DNA, 22 bp, Artificial Sequence
  chemically synthesized
aaaaataaattatagctagata

SEQ ID NO: 957159 - DNA, 22 bp, Artificial Sequence
  chemically synthesized
aaaataaattatagctagatag

SEQ ID NO: 957160 - DNA, 22 bp, Artificial Sequence
  chemically synthesized
gaacttatttctcctatctagc

SEQ ID NO: 957161 - DNA, 22 bp, Artificial Sequence
  chemically synthesized
tagctagataggagaaataagt

SEQ ID NO: 957162 - DNA, 22 bp, Artificial Sequence
  chemically synthesized
gataggagaaataagttctagt

SEQ ID NO: 957163 - DNA, 22 bp, Artificial Sequence
  chemically synthesized
agtcgtatagagcactagaact

SEQ ID NO: 957164 - DNA, 22 bp, Artificial Sequence
  chemically synthesized
tagtcaccattcagtcgtatag

SEQ ID NO: 957165 - DNA, 22 bp, Artificial Sequence
  chemically synthesized
actatagtcaccattcagtcgt

SEQ ID NO: 957166 - DNA, 22 bp, Artificial Sequence
  chemically synthesized
tagtgctctatacgactgaatg

SEQ ID NO: 957167 - DNA, 22 bp, Artificial Sequence
  chemically synthesized
gtgctctatacgactgaatggt

SEQ ID NO: 957168 - DNA, 22 bp, Artificial Sequence
  chemically synthesized
ctaactatagtcaccattcagt

SEQ ID NO: 957169 - DNA, 22 bp, Artificial Sequence
  chemically synthesized
ttgctaactatagtcaccattc

SEQ ID NO: 957170 - DNA, 22 bp, Artificial Sequence
  chemically synthesized
tatacgactgaatggtgactat

SEQ ID NO: 957171 - DNA, 22 bp, Artificial Sequence
  chemically synthesized
tacgactgaatggtgactatag

SEQ ID NO: 957172 - DNA, 22 bp, Artificial Sequence
  chemically synthesized
tattattgctaactatagtcac

SEQ ID NO: 957173 - DNA, 22 bp, Artificial Sequence
  chemically synthesized
tatattattgctaactatagtc

SEQ ID NO: 957174 - DNA, 22 bp, Artificial Sequence
  chemically synthesized
ctatattattgctaactatagt

SEQ ID NO: 957175 - DNA, 22 bp, Artificial Sequence
  chemically synthesized
aatggtgactatagttagcaat

SEQ ID NO: 957176 - DNA, 22 bp, Artificial Sequence
  chemically synthesized
aaacttctatattattgctaac

SEQ ID NO: 957177 - DNA, 22 bp, Artificial Sequence
  chemically synthesized
gaaacttctatattattgctaa

SEQ ID NO: 957178 - DNA, 22 bp, Artificial Sequence
  chemically synthesized
gccatttgaaacttctatatta
